United States Patent 7,795,419 (VIRAL AND VIRAL ASSOCIATED MIRNAS AND USES THEREOF) - sequence listing, part 17

SEQ ID NO: 492615 - RNA, 64 nt, Human
agaacccuaaaagaaccaaaaaucugccacagccugccuccaucagcuucuuauuuaguauuuc

SEQ ID NO: 492616 - RNA, 64 nt, Human
uuuguuuugcucuuucagaacaaacauuaaauggugccuccaaggaaacuuugccaaauauaau

SEQ ID NO: 492617 - RNA, 64 nt, Human
gccuuguaguauaguuugaagucagguagugugaugccuccagcuuuguucuuuuggcuuagga

SEQ ID NO: 492618 - RNA, 64 nt, Human
cagccucuggaguagcugggacuacagacaugcaccaccacaccugguuaauuuuuuauuuuua

SEQ ID NO: 492619 - RNA, 64 nt, Human
gugccgugccguguaauaaagucccagugcucauccaccacagaugccugguccuguugcagga

SEQ ID NO: 492620 - RNA, 64 nt, Human
ggccagggcaucaagaacccagugaacaagggcaccaccacaguggacggcgcuggcuucggca

SEQ ID NO: 492621 - RNA, 64 nt, Human
ugcuuuugcauuaaacugugaauguuccaacaccugccuccacuucuccccucaagaaauuuuc

SEQ ID NO: 492622 - RNA, 64 nt, Human
uacucaagcccuauuuauaaacaaauacuuuuccugccuccaccaaaccccuacagaacaucac

SEQ ID NO: 492623 - RNA, 64 nt, Human
cccagucagaucucaggcuugucccccugucagcugccuccagaagggaagguagccagugccu

SEQ ID NO: 492624 - RNA, 64 nt, Human
acaaagagaauuaaugaugagguuacaugcugcuugccuccaccagauguccacaacaauauga

SEQ ID NO: 492625 - RNA, 64 nt, Human
cugucuuugcagaguuugccuucugccagguggaugccuccaucgcucuggcccuggcccuggc

SEQ ID NO: 492626 - RNA, 54 nt, Human
cagguggagguugcugcuaaaauuugccuccauccuuuucucacagcaaugaau

SEQ ID NO: 492627 - RNA, 64 nt, Human
ugcugccuguauuggucccuucugaccacucuccugccuccagagaaagcucugcuucacccug

SEQ ID NO: 492628 - RNA, 64 nt, Human
ucucagacccaaggcaccucaggucucuuugcugugccuccacuauauugucgugugggugugu

SEQ ID NO: 492629 - RNA, 64 nt, Human
aagacuuguucuauuuauaaguauuuauuucuaaugccuccacauagcccuguaauauucagau

SEQ ID NO: 492630 - RNA, 64 nt, Human
ccaguccaguugccucccuagcuuguguguggccugccuccaccauagcagggacuagggaggg

SEQ ID NO: 492631 - RNA, 64 nt, Human
ggaugggccugauagaagugcauucuccuccuauugccuccauucuccucucucuaucccugaa

SEQ ID NO: 492632 - RNA, 64 nt, Human
ugcgggcucaguggaccacuggugacugggcucaugccuccaagucagaguuucccuggugccc

SEQ ID NO: 492633 - RNA, 64 nt, Human
aacagacuuguauauucuauuuuacaacuacaaaugccuccaaaguauuguacaaauaagugug

SEQ ID NO: 492634 - RNA, 64 nt, Human
gaagaauaaauguuuccugacucagaaacaauuuugccuccauauuucagugcaaauauauuuu

SEQ ID NO: 492635 - RNA, 64 nt, Human
cagccucccaaguagcugggauuacaggcaccugccaccacaucuggcugaauuuuuuuuuuuu

SEQ ID NO: 492636 - RNA, 64 nt, Human
cagccucccaaagugcugggauuacaggcaugagccaccacaaccgucccacuauuuuacuuuu

SEQ ID NO: 492637 - RNA, 64 nt, Human
uggccuccaaaggugcugggguuacagguaugagccaccacacccagcccaacucauuauucuu

SEQ ID NO: 492638 - RNA, 64 nt, Human
gagaagguuagguaaggggagaggauggaaugcuugccuccaaugaacuuuggagcuuguaugu

SEQ ID NO: 492639 - RNA, 64 nt, Human
cucagccuccugaguagcugggauuacaggugugugccuccacacccggcuaauuuuuuguauu

SEQ ID NO: 492640 - RNA, 64 nt, Human
gagacaccauaguggaaacuggggcuuaugcugcugccuccagggugugagguggguggggacc

SEQ ID NO: 492641 - RNA, 64 nt, Human
ugaaacaaaauuagaaauguaauuauguucuaagugccuccaaguucaaaacuuauuggaaugu

SEQ ID NO: 492642 - RNA, 64 nt, Human
gggagcccggcuggccuccgcggccggcguccccugccuccacccugugcccgagggggugucc

SEQ ID NO: 492643 - RNA, 64 nt, Human
agaagcucucgacaauacccguuggcaaggagucugccuccaugcugcaguguucgaguggauu

SEQ ID NO: 492644 - RNA, 64 nt, Human
uggacagaguuaccuuaagugucucuacuaucuuugccuccagauuucaagaggagaaauuuag

SEQ ID NO: 492645 - RNA, 64 nt, Human
gcagcauuauuucuauagugugauuaccugagggugccuccaaauguauaucauuucacucccc

SEQ ID NO: 492646 - RNA, 64 nt, Human
ugacuuucuuccccacuguggaagaggccaguuuugccuccauuugcacauucauuucaguuau

SEQ ID NO: 492647 - RNA, 64 nt, Human
ugcucaccugccaacuucagucuggagcuucucuugccuccagggacuggccaggucucccccc

SEQ ID NO: 492648 - RNA, 64 nt, Human
ucaccacauugugccucugcuuugggggugccccugccuccagcagagcccccaccauucacug

SEQ ID NO: 492649 - RNA, 64 nt, Human
gagacuucugggaacuauuuauugagcaggccugugccuccacaucaucuuguugucucugggg

SEQ ID NO: 492650 - RNA, 64 nt, Human
cuaacgcccagacgcauggaugcacccccuacccugccuccaucuaugggaguucuuucucuca

SEQ ID NO: 492651 - RNA, 64 nt, Human
aggcuuccgaacuguuuuauugagggcuacuaucugccuccacaauuuuauuaaaaccacucca

SEQ ID NO: 492652 - RNA, 64 nt, Human
cagacuuccgaguggcugggauuacaggcgcccgccaccacaccagguugauuuuuguauuuuu

SEQ ID NO: 492653 - RNA, 58 nt, Human
agaaggaaaccuacuacugaccucagccccaccacaucgcccaucucuuccccguccc

SEQ ID NO: 492654 - RNA, 64 nt, Human
gccacagccaggauuugaacaaacuugguauucaccaccacauucuuugccucuauuccaaaaa

SEQ ID NO: 492655 - RNA, 64 nt, Human
cugcaacugugauuucccauguccaaaguggcucugccuccacccccucccuauuccugcugca

SEQ ID NO: 492656 - RNA, 64 nt, Human
acccuuggcacgagggcagggcuggcucucccaaugccuccaucccauccccauggugcuuugg

SEQ ID NO: 492657 - RNA, 64 nt, Human
aucaaaggaagguuuucaccuguagaaagcccccugccuccagccaaauagucccaugcugacu

SEQ ID NO: 492658 - RNA, 64 nt, Human
ucauaccauucccauuuucucagccucuucucacugccuccagagaggugggugccuggguuga

SEQ ID NO: 492659 - RNA, 64 nt, Human
augggaccauaaagaugaguaagacaaggauuuuugccuccaaggacuuguuaucacuguaaac

SEQ ID NO: 492660 - RNA, 64 nt, Human
ccauuaauuucuauuugaccucuaaauuguaaaaugccuccaaaaguuuauuuauagaacaaaa

SEQ ID NO: 492661 - RNA, 64 nt, Human
aguagugucuucucucuccaccaaaaagaggaagugccuccagcuuuucugggggucucauaaa

SEQ ID NO: 492662 - RNA, 64 nt, Human
gaugggacuggaggaccugggaauuucaucuuucugccuccaccccuggguccauggagcuuuc

SEQ ID NO: 492663 - RNA, 64 nt, Human
gagucauccagcucuugcucagugaagaggaaaaugccuccauggcagaagucaacgccucggu

SEQ ID NO: 492664 - RNA, 64 nt, Human
gcacauccgcgugugccugugugcgugcgcaucuugccuccaggugcagagguacccugggugu

SEQ ID NO: 492665 - RNA, 64 nt, Human
ggacagacagacagccagguucuccagugguaucugccuccauuuuccugagaucaaaaagacu

SEQ ID NO: 492666 - RNA, 64 nt, Human
ggaacgcuaagacacaggcuccaguaggggcuguugccuccaauaaagcagcagugagcuuugc

SEQ ID NO: 492667 - RNA, 64 nt, Human
gccggagccuuuggaagucugcgcccuugugcccugccuccaccgagccagcuuggucccuaug

SEQ ID NO: 492668 - RNA, 64 nt, Human
gccaggcuggggugcacccagccaaagacaaagcugccuccacgugcccaaggauucagauggu

SEQ ID NO: 492669 - RNA, 64 nt, Human
agccagccaccugcccagccgggccugggaugggccaccacaccacuggauauuccugggaguc

SEQ ID NO: 492670 - RNA, 64 nt, Human
cggccucccaaaaugcugggauuacagaugugagccaccacacacaccaucugauuaaaaaaaa

SEQ ID NO: 492671 - RNA, 64 nt, Human
cagccuccagaguagcugggauuacaggcaugcaccaccacagcccagcuaauuuuuuguauuu

SEQ ID NO: 492672 - RNA, 64 nt, Human
aggagacacagccuggccuccucagggcugaagaugccuccauucgccuguggaccuugauuuc

SEQ ID NO: 492673 - RNA, 64 nt, Human
gugaauaguacagucguaaguaacugucuggaggugccuccauuauccucaugccuucaggaaa

SEQ ID NO: 492674 - RNA, 64 nt, Human
gccucuucagaacccuuuagaaaguauaaaauauugccuccaacaugcugaaaaagaguaucua

SEQ ID NO: 492675 - RNA, 64 nt, Human
acggcucccaaagcccguucuugcuguguugugcugccuccauauccgucaggaagagccuuuc

SEQ ID NO: 492676 - RNA, 64 nt, Human
cuucuguuuugauguagguauuaacaaucuuuucugccuccaacuacuaugaaguuggcagcaa

SEQ ID NO: 492677 - RNA, 64 nt, Human
uuagaguaaacuccacaucuuugcacuaccuguuugccuccaagagacuaucaguuccuugggg

SEQ ID NO: 492678 - RNA, 64 nt, Human
agccuuugucuccagcccugccuuuauuccuccuugccuccacaccagccuccccuugcuucuc

SEQ ID NO: 492679 - RNA, 64 nt, Human
aguguucucacccucuaggcccugugccuggaggugccuccacagccgaccagcagccaccccg

SEQ ID NO: 492680 - RNA, 64 nt, Human
ccuuuaagucuuacaggaagccucucauagaaauugccuccaguccaguuucccaaaaacccca

SEQ ID NO: 492681 - RNA, 64 nt, Human
uguagaagcucaggaauuaugauuaaucaccaucugccuccaggccuuucaucucaugacaaac

SEQ ID NO: 492682 - RNA, 64 nt, Human
uuuccagccuaucuaauuucuuuaguuuucuauuugccuccagugcaguccauuuccuaaugua

SEQ ID NO: 492683 - RNA, 64 nt, Human
ccagcagcuacuuugggucaugucuuuacuguccugccuccaacccuuuagucucguagacuuu

SEQ ID NO: 492684 - RNA, 64 nt, Human
agagguggagguagaucuuucucucaaccacaucugccuccacacacagcuccuccgcagggaa

SEQ ID NO: 492685 - RNA, 64 nt, Human
uaggcccuaagcugaagaagugaggcagugauucugccuccauccugguuuccccaaagcccca

SEQ ID NO: 492686 - RNA, 64 nt, Human
cagccuccugaguagcuaggauuacaggugccugccaccacacccggcuaauuuucauauuuuu

SEQ ID NO: 492687 - RNA, 64 nt, Human
cagccucuugaguagcugggacuacaggugcccgccaccacaccagcuaauuuuuguauuuuua

SEQ ID NO: 492688 - RNA, 64 nt, Human
ucagccuccagagaguugggaccauaggugcacaccaccacaccuagcuaauuuuuuggggagg

SEQ ID NO: 492689 - RNA, 64 nt, Human
accccaaagaggugaauugcauuuaaauacagucugccuccacugagggcauccugccauucuu

SEQ ID NO: 492690 - RNA, 64 nt, Human
cugauaccucaaccuuggggccagcaucucccacugccuccaaauauuaguaacuaugacugac

SEQ ID NO: 492691 - RNA, 64 nt, Human
ugcacgcacgugugugaaaagccaucccaucuucugccuccaguuggagcuuucagcuguuaaa

SEQ ID NO: 492692 - RNA, 64 nt, Human
gcuagaaucuuucucuggacuguugcauguacagugccuccauccuggaggcaagagaguuggg

SEQ ID NO: 492693 - RNA, 64 nt, Human
gcuguccccucccugaucacacagcuaacgaggcugccuccagcauuuccugauuuccucugug

SEQ ID NO: 492694 - RNA, 64 nt, Human
cacaaaauaugcugcuuacgugcccccagcccacugccuccaagucaggcagaccuuggugaau

SEQ ID NO: 492695 - RNA, 64 nt, Human
cagaaguucuggguggugccagcacccaguccucugccuccauuuaauuuuuaagagaagguga

SEQ ID NO: 492696 - RNA, 64 nt, Human
uuccuuugccuuuuuugcacuuuggugaauuacgugccuccauaaccugaacugugccgacucc

SEQ ID NO: 492697 - RNA, 64 nt, Human
aauuuccucuagcaaauacuucuuucuccuugcuugccuccaccaugauauuugaauaagagau

SEQ ID NO: 492698 - RNA, 64 nt, Human
agaggucacauagucgugugggucgaggauucugugccuccaggaccaggggcccacccucugc

SEQ ID NO: 492699 - RNA, 64 nt, Human
cgaagugcuacccccaguuucugcuguuacuugcugccuccaggccaggggagcaggagaugcu

SEQ ID NO: 492700 - RNA, 64 nt, Human
acugacacauugcugauaugcaaguaagaaauaaugccuccaauuuuuucuuaaaauaguuuag

SEQ ID NO: 492701 - RNA, 64 nt, Human
uauacucaccaggccauuuagaaguuuuaaauaaugccuccacuauuuuuuuucuuagacauag

SEQ ID NO: 492702 - RNA, 64 nt, Human
cuggucuugaacuccugggcucaagccaucugccugccuccaccucccaaaaugcugagauuac

SEQ ID NO: 492703 - RNA, 64 nt, Human
gcguccuccuguagcccaggcaagagagaagcaaccaccacaagcucucgggacuagcugccuu

SEQ ID NO: 492704 - RNA, 64 nt, Human
cugccucccaaagugcugggauuacagacgugagccaccacagcuggcugaagauuauacuuuc

SEQ ID NO: 492705 - RNA, 64 nt, Human
gcaggguggguggguaccaugggugcccaccccuccaccacauggggccccaaagcacugcagg

SEQ ID NO: 492706 - RNA, 64 nt, Human
uuccuccugcuucaugggaaaacagaccugugugugccuccagcauuuaaaaggacugcugauu

SEQ ID NO: 492707 - RNA, 64 nt, Human
uugcuccuacuuguuacuauuauugcugcagaucugccuccaagguugaaaaggagacuaagac

SEQ ID NO: 492708 - RNA, 64 nt, Human
uuauuauuauuguugggacaggugccauuuaaauugccuccaugcuccccauuugcaccuagcu

SEQ ID NO: 492709 - RNA, 64 nt, Human
cagcugagccaaaggggucagaaauucugcccuuugccuccaccacauggcauucugguuuugg

SEQ ID NO: 492710 - RNA, 64 nt, Human
ccuggcuguuuuugugccuguuugaagcuacugcugccuccauuucugggaaagaccuuugaga

SEQ ID NO: 492711 - RNA, 64 nt, Human
ggcaagaaaacugcaggggccgugaccagcccucugccuccagggaggccaacugacucugagc

SEQ ID NO: 492712 - RNA, 64 nt, Human
cuggucucgaacuucugagcucgagcgauccuccugccuccaccucccaaaguguucggauuac

SEQ ID NO: 492713 - RNA, 64 nt, Human
uccaagaagaauuuuuaagaacuaccucuaggugugccuccacgcuggcccuagcuuucccauu

SEQ ID NO: 492714 - RNA, 64 nt, Human
gcaacuuuaggaaaaggucugauaaaaaccaagaugccuccacauuuugucauaauuguaacca

SEQ ID NO: 492715 - RNA, 64 nt, Human
aaaaauaauugauuucaagaccuucuccccauucugccuccauucugaccauuucaggggucgu

SEQ ID NO: 492716 - RNA, 64 nt, Human
ggccccgccggcuguccacagcggacccugcugaugccuccaccaucuaugcaguuguaguuug

SEQ ID NO: 492717 - RNA, 64 nt, Human
ggccugccuggggagcccgugaaggccgcacgggugccuccagccugagacaucaggggagagc

SEQ ID NO: 492718 - RNA, 64 nt, Human
guaagggcagggcugggccugcauccgcuugcccugccuccaucccgcagggcacagagaagcc

SEQ ID NO: 492719 - RNA, 64 nt, Human
cacgggcucugccccuuccagcuggagccgcccgugccuccaggggccaagaggaugaugucgu

SEQ ID NO: 492720 - RNA, 64 nt, Human
cagccucccaaguaccugggacuacaggugugcaccaccacaccaggcuaauuuuuuguguauu

SEQ ID NO: 492721 - RNA, 61 nt, Human
agacgaugaagaacaauuagacuggacccacccaccacagcccaucacccuccauuuccac

SEQ ID NO: 492722 - RNA, 64 nt, Human
cagucuccugacuagcugggacuacaggugcaugccaccacaccuggauaauuuuuuguauuuu

SEQ ID NO: 492723 - RNA, 64 nt, Human
cacuuccaggagcccagagggccaagagagacauugccuccaccucuccuuggaaauacuuuau

SEQ ID NO: 492724 - RNA, 64 nt, Human
cucccacccugcccuggccuggguggaggaacugugccuccauccccagaagaaacagcccccu

SEQ ID NO: 492725 - RNA, 64 nt, Human
gcccucucacuccagccaaagaaaugggccugccugccuccacccguccucccucagccucccc

SEQ ID NO: 492726 - RNA, 64 nt, Human
ugcuccccugcaccucuggggugcagaaaccucuugccuccagauuuggguggagccucugugg

SEQ ID NO: 492727 - RNA, 64 nt, Human
ucccuguucuuggaucugccauggagggaucuggugccuccagacgugugcacauaaauccaua

SEQ ID NO: 492728 - RNA, 64 nt, Human
uaccuaaaacugagguggggauggggagaggcuuugccuccaccauucccaccccacccucccc

SEQ ID NO: 492729 - RNA, 64 nt, Human
cuuuaggaagagguauacauuuuuuaagucgcucugccuccaaaucugaacagucacuguaaau

SEQ ID NO: 492730 - RNA, 64 nt, Human
gcccaggaacaugacaacgugaccacaccacacaugccuccaacacacacccacagucuaaaca

SEQ ID NO: 492731 - RNA, 64 nt, Human
cuuuuaagccagugguucuucagaaucaccuagaugccuccacccuccagagauccugagucca

SEQ ID NO: 492732 - RNA, 64 nt, Human
agagacugcuuggccagcuuuguaaguaaguggcugccuccaaugugaugugaguacauguugg

SEQ ID NO: 492733 - RNA, 64 nt, Human
gucucuugaccuuuucuuaccuugcaacugucagugccuccagccaaaugccuagcacagagcu

SEQ ID NO: 492734 - RNA, 64 nt, Human
cccaggaagggaggcugucuggccagccucucccugccuccacuugcuccacguccagcuccuc

SEQ ID NO: 492735 - RNA, 64 nt, Human
ugugguggagaaccacagcugcagaguaggcagcugccuccaggaugaguuacuugaaauuugc

SEQ ID NO: 492736 - RNA, 64 nt, Human
ccucuguccuucccccagcacaaagcacuggccuugccuccaggaccuugcuuccuucucaucu

SEQ ID NO: 492737 - RNA, 64 nt, Human
ccaccugccaaagugcugagauuacaggcgugagccaccacaccuggccuguuuuuuguuucuu

SEQ ID NO: 492738 - RNA, 64 nt, Human
cggccucccaaagugcugggauuacaggugugagccaccacaccugacccauaggucuucaaua

SEQ ID NO: 492739 - RNA, 64 nt, Human
cauaccucaaagauauuguggauuggguugcagcccaccacaauaaagcaaauauugcuauaaa

SEQ ID NO: 492740 - RNA, 64 nt, Human
ucucagacucugauuagcugccuccccuucucccugccuccagaauguucugggauaacauuug

SEQ ID NO: 492741 - RNA, 64 nt, Human
caggagagggggagcaaacaggaaauuccacagcugccuccagaaacauuaaccaccccucucu

SEQ ID NO: 492742 - RNA, 64 nt, Human
uaagcagaggaggggccgcugccacccaccucccugccuccaggaaccacaccacaucuaagcc

SEQ ID NO: 492743 - RNA, 64 nt, Human
caguccuagaauguuucauuugcacaaguagggcugccuccaagaggaaccucugauuuauuuu

SEQ ID NO: 492744 - RNA, 64 nt, Human
ucagcucucaauuuaguauaauaugcaguuccugugccuccagacuaugcagcucaucacccua

SEQ ID NO: 492745 - RNA, 64 nt, Human
agugaaaagugcuuuaggugagaugacuaaauuaugccuccaagaaaaaaaaauuaaagugcuu

SEQ ID NO: 492746 - RNA, 64 nt, Human
gggcgccgggaggggaugcugaggcugauggagcugccuccagggcuagggccacucaccggag

SEQ ID NO: 492747 - RNA, 64 nt, Human
ugugagccaccucgccugggcccccuucuccauaugccuccaaaaacaugucccuggagaguag

SEQ ID NO: 492748 - RNA, 56 nt, Human
ucaccugcacugaucugugaugccccugccuccagggcuagguagagagggcccag

SEQ ID NO: 492749 - RNA, 64 nt, Human
ugucacuuaacauaaacagaaacauuauuuuauuugccuccagucuggcuaggaaaccagaucu

SEQ ID NO: 492750 - RNA, 64 nt, Human
uccauuuuaacacuuccugguugcaagagggaugugccuccauuauuuccuccacaguuuuggu

SEQ ID NO: 492751 - RNA, 64 nt, Human
gcaguaaacguuuuaauggcccguuuaugucucaugccuccaaacaacacugaauuugaaaccc

SEQ ID NO: 492752 - RNA, 64 nt, Human
auuuccccuucuuccugauagacuuggagcugugugccuccacuccaaggcugccugccugcug

SEQ ID NO: 492753 - RNA, 64 nt, Human
ccugccgcaggccuaacccuccugcccugggcacugccuccaugcagaagcgcuucgagguucu

SEQ ID NO: 492754 - RNA, 64 nt, Human
cagccuccugaguagcugggcugacaggcacccaccaccacacccagcuaauuuuuauguuuuu

SEQ ID NO: 492755 - RNA, 64 nt, Human
cuggguggagccucugugugacuccauacuccucccaccacaacacucaucugucaaacaccaa

SEQ ID NO: 492756 - RNA, 64 nt, Human
aaccugcacggggcauuccugcuucucucucaggccaccacagagggcaggggaugguuaguca

SEQ ID NO: 492757 - RNA, 64 nt, Human
ggggccugcgcaggcgggacuaucaggaguccacugccuccaugaugcaagccagcuuccugug

SEQ ID NO: 492758 - RNA, 64 nt, Human
acggacuaaugauguuuccucuugccuucucuggugccuccauugcccucauggaacagagcau

SEQ ID NO: 492759 - RNA, 64 nt, Human
cacucccuucccgcucagggaaguuuaucaugacugccuccagugacaccacuguccucaucug

SEQ ID NO: 492760 - RNA, 64 nt, Human
cucugacacccagccccaggagccagaccacuccugccuccaccucugacucuucagcagcuga

SEQ ID NO: 492761 - RNA, 64 nt, Human
aaggcacugagaccuccacccacuguggacuccaugccuccaauaaaagguaguucugggccca

SEQ ID NO: 492762 - RNA, 64 nt, Human
auauauuuuuguaaauaaacaggaacugauuuucugccuccaucccacccaugagggcugcagg

SEQ ID NO: 492763 - RNA, 64 nt, Human
ugccccgcagcuaagccagcacugagaugcguggugccuccaggaccgcugcgggugguaacca

SEQ ID NO: 492764 - RNA, 64 nt, Human
cuugagugccuggaggugcuuggccuccaguagcugccuccauucucuuuuaaaaaaagggggu

SEQ ID NO: 492765 - RNA, 64 nt, Human
agaugccgccuacacacgauccuggcccuccaccugccuccaggccacgaaaugggaauuccag

SEQ ID NO: 492766 - RNA, 64 nt, Human
gcacugagcgccugcagaucccgcaggcuucguuugccuccagaaccuucccgucugauuguuc

SEQ ID NO: 492767 - RNA, 64 nt, Human
uacuugggaaaaugcaguccaguguucucaccucugccuccaagguaggagaugucugugggug

SEQ ID NO: 492768 - RNA, 64 nt, Human
cuccucuucgugaacaccagcagauaccuccuugugccuccacugaugcaggagcugccacccc

SEQ ID NO: 492769 - RNA, 64 nt, Human
uggcaagucugcccuagagucauuuacucuccucugccuccauuuguuaauacagaaucaacau

SEQ ID NO: 492770 - RNA, 53 nt, Human
aggacaggagccgcuccugagccugccuccagcuggcuggggccaccgugcgg

SEQ ID NO: 492771 - RNA, 64 nt, Human
uagaaaugucugucuggaaacaggacacaucuugccaccacaaguccacaccuggccuuggcug

SEQ ID NO: 492772 - RNA, 64 nt, Human
cuggaggaaaccagcccuuuagccagcagccccuccaccacaggcacugcuguguggaacgagu

SEQ ID NO: 492773 - RNA, 64 nt, Human
cgacuucccagagugcugggauuacaggcgugagccaccacacccucccgagaucuuuaaaguu

SEQ ID NO: 492774 - RNA, 64 nt, Human
cuccugggaugggccgcuuucagaagcccugcagugccuccagauggaaaggcgggcccggccu

SEQ ID NO: 492775 - RNA, 64 nt, Human
ugugccugcacauccagaacugccuccuugccgcugccuccaggaagcccaccuugagccagag

SEQ ID NO: 492776 - RNA, 64 nt, Human
gccacagcugcccucuggccucuccaugaugaggugccuccacaacuuccugacaggucagugc

SEQ ID NO: 492777 - RNA, 64 nt, Human
caacaucggcuucucagauggcuuccucacuucaugccuccagaaagcauauugcccggugaug

SEQ ID NO: 492778 - RNA, 64 nt, Human
gccccucugggccaaagcccauggguagcuuggcugccuccagaagagaugcagagagcugugg

SEQ ID NO: 492779 - RNA, 64 nt, Human
auguacguuuauauguauuauaauugcauacacaugccuccaugcauauaugugugugauaaua

SEQ ID NO: 492780 - RNA, 64 nt, Human
ugcacccagcccuggucucagcagcgaccaccccugccuccacccucugagcuuugcauguucc

SEQ ID NO: 492781 - RNA, 64 nt, Human
uaauuugagggucaguuccugcagaagugcccuuugccuccacucaaugccucaauuuguuuuc

SEQ ID NO: 492782 - RNA, 64 nt, Human
caaaaaggccaauuucagaugaugacuguccaagugccuccaaaguguacaaagcaucagauuc

SEQ ID NO: 492783 - RNA, 64 nt, Human
uaaauagccugacuucuuguuggguaacuugcccugccuccagagguauuugaacuucauuauc

SEQ ID NO: 492784 - RNA, 64 nt, Human
cauaaaaagccugaaugccaagccaaggaguggaugccuccagucauauuuagaacaaagucaa

SEQ ID NO: 492785 - RNA, 64 nt, Human
ccacccugcccagccagaaacuagauuuucuuuaugccuccaccccuucuuauucauuuacuuu

SEQ ID NO: 492786 - RNA, 64 nt, Human
cuguccacacccacgcgccccgggagcggggccaugccuccagccccccagcucgcccgaccca

SEQ ID NO: 492787 - RNA, 64 nt, Human
gacggcuacugagcacucccagcccggggccugcugccuccagcagccacuucagagcccccgc

SEQ ID NO: 492788 - RNA, 64 nt, Human
uugggcugcccuggcccccacucucccgggccgcccaccacaggcucuuaauggggccggguca

SEQ ID NO: 492789 - RNA, 64 nt, Human
cagccucccgaguagcugggauuacaggugccugccaccacacccagcuaauguuuuguauuuu

SEQ ID NO: 492790 - RNA, 64 nt, Human
caugacuucagcuccaccuggggcacccagcaccccaccacagggcuagaggcccuaagacccu

SEQ ID NO: 492791 - RNA, 64 nt, Human
cucacgcaugagcaaacguguacagacuggcacaugccuccacaugcgaacacccacuuacaca

SEQ ID NO: 492792 - RNA, 64 nt, Human
gaggagcacacuuuggggagauguccugguuuccugccuccauuucucugggaccgaugcagua

SEQ ID NO: 492793 - RNA, 64 nt, Human
agaagagcagggcuaggacuugucccagcaucugugccuccauaccaauccucuuucucacaga

SEQ ID NO: 492794 - RNA, 64 nt, Human
aacacgcaggagcacacccagcccccacauccugugccuccaucagcuaaacaccacgucacuu

SEQ ID NO: 492795 - RNA, 64 nt, Human
accaagauggaggcuguggagcagcauuucccguugccuccauagcaagaagaguuuuuguuug

SEQ ID NO: 492796 - RNA, 64 nt, Human
ccgcgggccuguuuucagguguuccuagcauuucugccuccaggcaggacggcaggggugagca

SEQ ID NO: 492797 - RNA, 64 nt, Human
ucacguaggugcggagcucaauuugcccaccugcugccuccaggaucagcaccuugaagaagug

SEQ ID NO: 492798 - RNA, 64 nt, Human
cccccuccucuccccagaccacagggggccucucugccuccagccccaccuuccccgggagaag

SEQ ID NO: 492799 - RNA, 64 nt, Human
ccugcagguccacacaccuuccaggccuguggccugccuccaaagaugugcaagggcaggcugg

SEQ ID NO: 492800 - RNA, 64 nt, Human
uggaaagugcuggugggguuugcccuugaucaagugccuccauugugcugcaagggcuguagac

SEQ ID NO: 492801 - RNA, 64 nt, Human
aaggagcagugugaccuccugugacccgugaaugugccuccaagcggcccuguguguuugacau

SEQ ID NO: 492802 - RNA, 64 nt, Human
accagauaaucuucugaaaguguaacucagaugaugccuccaacccuguggcugcccuucacac

SEQ ID NO: 492803 - RNA, 64 nt, Human
aaccaucuuucuguuugucgucuuguugauuugcugccuccacacugucagcuccuugggaaca

SEQ ID NO: 492804 - RNA, 64 nt, Human
aacauauuuguagauuuuuaauaucucaugauucugccuccaaggauguuuaaaaucuaguugg

SEQ ID NO: 492805 - RNA, 64 nt, Human
cagccuccugaguaggugggauuacagaugcccgccaccacacccaguuaauuuuuguauuuuu

SEQ ID NO: 492806 - RNA, 64 nt, Human
gugcccauguguucgccuccgccccccacccuugccaccacacucgcccacuugcccaccgggu

SEQ ID NO: 492807 - RNA, 64 nt, Human
gccuuuaggggcagugucugggccgaagcacgucccaccacacagugccagagccagagaaggg

SEQ ID NO: 492808 - RNA, 64 nt, Human
cauggaacaccgucccucugccagccauaggcccugccuccagugucagggaauggaggcuggg

SEQ ID NO: 492809 - RNA, 64 nt, Human
ccugagagugaacucagcugucaucugcagccucugccuccagcccggcagcucuggggaggca

SEQ ID NO: 492810 - RNA, 64 nt, Human
ccugcugcaguucgccguacuuccaucugcugggugccuccaucguugguuggguggggauggg

SEQ ID NO: 492811 - RNA, 64 nt, Human
cauuacgccucaacauauacuugugcucuuccuuugccuccagaagaaguuuuuccuugauugu

SEQ ID NO: 492812 - RNA, 64 nt, Human
uuguaccuucuagaaaaucaguguucacagagacugccuccaccacaggcauccugcaaaugca

SEQ ID NO: 492813 - RNA, 64 nt, Human
gccuccagcagccaugcaugugcgcccgcagcccugccuccacagcucgccacacacucacgcu

SEQ ID NO: 492814 - RNA, 64 nt, Human
cacacucacgcuucgccagagacaggaagugcgcugccuccacggccccuugcccuugcucagg

SEQ ID NO: 492815 - RNA, 64 nt, Human
aacgacaaacuugaguguuucccugccacuucugugccuccacagccugcuccaguuccgcagc

SEQ ID NO: 492816 - RNA, 64 nt, Human
cagccaaagcaugccguucugcacccuacccaguugccuccagggccucuccuuggaaggucuu

SEQ ID NO: 492817 - RNA, 64 nt, Human
ugcggcgcccucgggccgccugcgagccccucucugccuccagaccuugggcagaaggaggccu

SEQ ID NO: 492818 - RNA, 64 nt, Human
auuugguguguuccugugggaaaaagcaggacugugccuccauaauuuggucauuuggcagccc

SEQ ID NO: 492819 - RNA, 64 nt, Human
aaaaaucuauccuguacgugugaagaucuaggccugccuccauguuacucccuuucucuuacua

SEQ ID NO: 492820 - RNA, 64 nt, Human
uaccugcugaauggaccugcaggguaaacuugggugccuccaucugggaaagcugaugaugugu

SEQ ID NO: 492821 - RNA, 64 nt, Human
ggcuguuaccuggaaauagagaagcuuugaacuuugccuccauugucagacuauuucgucugau

SEQ ID NO: 492822 - RNA, 64 nt, Human
caggcuccugaguagcugggauuacaggcgucggccaccacaccuggcuaauuuuuguauuuuu

SEQ ID NO: 492823 - RNA, 64 nt, Human
uccuugaagaaugcagcauugucuuugucuguccccaccacauggaggugggggugggaucaau

SEQ ID NO: 492824 - RNA, 64 nt, Human
agccuuccaaaagugcugggauuacaggcgugagccaccacauccggccagugcacucuuaaua

SEQ ID NO: 492825 - RNA, 64 nt, Human
ccuuugggcucccuggagguuuuuaagcaguacgugccuccaaguuaccuccagaucagcaggc

SEQ ID NO: 492826 - RNA, 64 nt, Human
ugaccucugccuggcucccccuuggugcaacuccugccuccaucccccuugcugggguccccuc

SEQ ID NO: 492827 - RNA, 64 nt, Human
gccacaccaccgagguccaaguaugagccagggcugccuccacccugcaacuccuggcagcuuu

SEQ ID NO: 492828 - RNA, 64 nt, Human
gguggagggaggcaguguccuuccugacagcacuugccuccauggaucuucuguacacagaacu

SEQ ID NO: 492829 - RNA, 64 nt, Human
cuagccccccuuaggaaaggaguuagggucucagugccuccagccacacccccugccuucccca

SEQ ID NO: 492830 - RNA, 64 nt, Human
ucugagacauguccugaccaccccccagggcauuugccuccaucuucaccccagauuguggguu

SEQ ID NO: 492831 - RNA, 64 nt, Human
ccuuugcuccauaguguuaaccuacucucggagcugccuccaugggcacaguaaagguggccca

SEQ ID NO: 492832 - RNA, 64 nt, Human
acccccagggugcccugaggccccaggcagcugcugccuccacuaucgaugccuccugacugca

SEQ ID NO: 492833 - RNA, 64 nt, Human
ugggaaagccugagaagucacuuuggaacuaaauugccuccauuuuauuuuguacgaguaaggg

SEQ ID NO: 492834 - RNA, 64 nt, Human
accauuuugaugaucaugaaacgcugaugaaaaaugccuccaaacauuuuucuguacucauacu

SEQ ID NO: 492835 - RNA, 64 nt, Human
cauggaguggcgcuggacagucacgacaaggacuugccuccagcacuggacacaccuguguuaa

SEQ ID NO: 492836 - RNA, 64 nt, Human
cugcacucucaccuggaggcuccggggaagcaucugccuccaggaccauucaggcuguugacaa

SEQ ID NO: 492837 - RNA, 64 nt, Human
aauggccagcuaugcgccucauccucauugcuucugccuccacguaaaugaaaccaaaggccuc

SEQ ID NO: 492838 - RNA, 64 nt, Human
uuaauaaagacaaaguggcaacuguagaaaguguugccuccaaucuugguccguauuuccaaag

SEQ ID NO: 492839 - RNA, 64 nt, Human
aagauggugcaaaucuaugaccuucacauuuuuuccaccacacccaccaguagcuguuggugau

SEQ ID NO: 492840 - RNA, 64 nt, Human
cagccucccaaguagcugggauuacaggcacgcgccaccacaccuggcugauuuuguauuuuua

SEQ ID NO: 492841 - RNA, 64 nt, Human
gucuaggccgugugguacccagaagugucccagcccaccacaccguuuaccucccucgcccugc

SEQ ID NO: 492842 - RNA, 64 nt, Human
ggagcacccuagugagaguugaaccccuuccuucugccuccagggccugucugccuccacauca

SEQ ID NO: 492843 - RNA, 64 nt, Human
guugaaccccuuccuucugccuccagggccugucugccuccacaucacucugaggacagggaca

SEQ ID NO: 492844 - RNA, 64 nt, Human
ggacugggacacuuuuauguuaaugcucuggacuugccuccagagacugcuccagaguugguga

SEQ ID NO: 492845 - RNA, 64 nt, Human
ccccggccccagauagcagccccagggaggaugcugccuccaagaggugugagcccucugucuc

SEQ ID NO: 492846 - RNA, 64 nt, Human
cugugggggucccaguggagaugagccucccccaugccuccagcagccugacccucgugcccug

SEQ ID NO: 492847 - RNA, 64 nt, Human
ucuaggaugcagcugccagauccacucacucugcugccuccagcaggacccaaggccacuuuca

SEQ ID NO: 492848 - RNA, 64 nt, Human
cuucacagcucacaggggcaggaggcagcuccccugccuccaggacccuguugcuauggugaca

SEQ ID NO: 492849 - RNA, 64 nt, Human
agagccugcccucagacugcaggaccagaaccccugccuccaucuuuccaagcaccggggcgaa

SEQ ID NO: 492850 - RNA, 64 nt, Human
gcccuuauucaggaaaagccucugugucacuggcugccuccacucccacuucccugacacugcg

SEQ ID NO: 492851 - RNA, 64 nt, Human
ugugucuuuuggaaaaggagcugcauggccucagugccuccauaaaaagcuuaaguugaguuca

SEQ ID NO: 492852 - RNA, 64 nt, Human
uucccagcagcuuccuaguuaacaacccccaugcugccuccagucuuugucuguauucuucugu

SEQ ID NO: 492853 - RNA, 64 nt, Human
aagcucacuucucacccagcaagguugacucaucugccuccaugucucuggggcuuugcuguug

SEQ ID NO: 492854 - RNA, 64 nt, Human
ccggugagcugccccccacacgugcagcccgggcugccuccagggucuggcugagugggaucag

SEQ ID NO: 492855 - RNA, 64 nt, Human
cugggggaaaccuggcuccaaccaaccccuccccugccuccaccauauccacuaccaggcaccc

SEQ ID NO: 492856 - RNA, 64 nt, Human
cauggcuggcacugagcaguaccagugugcuugcccaccacagcgauccacggagcugaagcug

SEQ ID NO: 492857 - RNA, 64 nt, Human
uccuaggcccaggccuggguuuguacuuccaccuccaccacaucugccagaccuuaauaaaggc

SEQ ID NO: 492858 - RNA, 64 nt, Human
agggcuggggcuggguuggaacaggugugugcccccaccacagcucuaugacucuguucucccu

SEQ ID NO: 492859 - RNA, 64 nt, Human
gcccucugguguuaccaccucgagacuugucucaugccuccaugcuugccgauggaggacagac

SEQ ID NO: 492860 - RNA, 64 nt, Human
cucagccuggcccccgggaaagaggaaaacccgcugccuccagggagggcuggacggcgagcug

SEQ ID NO: 492861 - RNA, 64 nt, Human
ccugcccugcccucccaggaguccagccaggggcugccuccauguccugcccccaugagagccc

SEQ ID NO: 492862 - RNA, 62 nt, Human
cacagcucaacaacagauagacgggccggcccugccuccacguggcuccggcuccacucucg

SEQ ID NO: 492863 - RNA, 64 nt, Human
ggggcccagcugugauuuuuaucaguaauggccaugccuccacccaccuuaguuaggagcuacu

SEQ ID NO: 492864 - RNA, 64 nt, Human
auguuggcuuaacugaauauuguaugaaaagacaugccuccauaugugccuuucuguuagcuuu

SEQ ID NO: 492865 - RNA, 64 nt, Human
aacguuggcccagaugggggcugaaucauucaacugccuccaucuguggggcagcugcugccuu

SEQ ID NO: 492866 - RNA, 64 nt, Human
cucuguaccuagaauagucucacugucccccguuugccuccacgagccugcuguuuccaggaaa

SEQ ID NO: 492867 - RNA, 64 nt, Human
aggagccccuggacaugccuguccugaaagcggcugccuccauuauccauucccaagaugccug

SEQ ID NO: 492868 - RNA, 64 nt, Human
gcugccagagaagucuggucagagccacagggucugccuccagccaaacgggagcuuuugguga

SEQ ID NO: 492869 - RNA, 64 nt, Human
gcucuauagcagacacuaaagacuggguuacauaugccuccaguaguaguauggcacuugaugu

SEQ ID NO: 492870 - RNA, 64 nt, Human
aggaagcuaaaagcauggcccugcugccccucccugccuccacccacaguggagagggcuacaa

SEQ ID NO: 492871 - RNA, 64 nt, Human
aggcccucuguguauuccauucccuccuccuuaaugccuccaaggguccuugcaucccuagucu

SEQ ID NO: 492872 - RNA, 64 nt, Human
aggaauggacuuggaguucaacaggcugagaggaugccuccaauggaccagagagcugaguguu

SEQ ID NO: 492873 - RNA, 64 nt, Human
uggccucccaaagugcugggauuacaggugugagccaccacacccggccuuaucuccuaacauu

SEQ ID NO: 492874 - RNA, 64 nt, Human
uggguuaugcaccgccauggcccacauuaacgcuccaccacaagcccagccuagucagagcccu

SEQ ID NO: 492875 - RNA, 64 nt, Human
ccucauguagccccgccuucccccugcuggggguccaccacaucgcugcucuuucucacagucu

SEQ ID NO: 492876 - RNA, 64 nt, Human
aguaacaccucauucuggccgagaguagggcagcugccuccagacucuggggagacgggcgcua

SEQ ID NO: 492877 - RNA, 64 nt, Human
cacugugggcgugcaucugguucagcccuggauaugccuccacuguggagggaagcauuggaac

SEQ ID NO: 492878 - RNA, 64 nt, Human
uuucacugaggaugcuguccucugauuuagcugcugccuccagccucuggcuugagaacuuacu

SEQ ID NO: 492879 - RNA, 64 nt, Human
uguauuacagcccucuguggaucuucaacucugcugccuccacugugaugcagcaguccaacug

SEQ ID NO: 492880 - RNA, 64 nt, Human
gagguguauuguguauguagccuuagagcaucucugccuccaacccagcaguucucugccaaag

SEQ ID NO: 492881 - RNA, 64 nt, Human
gaugccagcccccugggaccucccccauccuuuuugccuccaaguuucuaagcaauacauuuug

SEQ ID NO: 492882 - RNA, 64 nt, Human
cucaccccugcccagagcgagggggcaaggacucugccuccagggcaucugggguuuuccccuc

SEQ ID NO: 492883 - RNA, 64 nt, Human
cucagccucccgaguaguugggauuacaggcgccugccuccaugccuggcuaauuuuguauuuu

SEQ ID NO: 492884 - RNA, 53 nt, Human
uccugcacauguuggagugauggugccuccagcaaccgcuggggagugugucc

SEQ ID NO: 492885 - RNA, 64 nt, Human
gggcuuugaacucuccuagcuccugucccagcccugccuccagggcuccugggcugccagggac

SEQ ID NO: 492886 - RNA, 64 nt, Human
ccucgccaagccucuaugcaccccacaaaguuucugccuccaugccguccacagcgccucuucc

SEQ ID NO: 492887 - RNA, 64 nt, Human
augaagcugugugagcaggugggucaaaugccauugccuccacuuuucugcaccccccugcucc

SEQ ID NO: 492888 - RNA, 64 nt, Human
auuugaguacuuauggcccugaaagcggccacggugccuccagauggcagguuugcaauccaag

SEQ ID NO: 492889 - RNA, 64 nt, Human
auuggguuagucaagaugaaggaggaggacuggcugccuccauuuugccuuguuuguuaguuug

SEQ ID NO: 492890 - RNA, 64 nt, Human
auuacauucucaauuagaaaacugcaauuugguuccaccacauccugacuacuaccguauaguu

SEQ ID NO: 492891 - RNA, 64 nt, Human
acuuaugccgugguccugcccugagccccuuuccccaccacaacccaccacggccaggcagaga

SEQ ID NO: 492892 - RNA, 64 nt, Human
accugaaaaggauuuuagaaaacccugggaaaacccaccacaccaccacaaaauggccuuuagu

SEQ ID NO: 492893 - RNA, 64 nt, Human
gacaguugauuggcauaauuucuuguuugaaugcugccuccauuauauagguccuuccaggaac

SEQ ID NO: 492894 - RNA, 64 nt, Human
gucacagacgucgcuuccugggauuccagcacgaugccuccauaguugaaagacuacacaaaaa

SEQ ID NO: 492895 - RNA, 64 nt, Human
aggacccuccucaccaggaaccgcaucccugugcugccuccaccugagaguugcuaggggguuc

SEQ ID NO: 492896 - RNA, 64 nt, Human
aagaagaugggaauuaccuucaucccucucucuuugccuccaagaaguguaaccgccuugaaga

SEQ ID NO: 492897 - RNA, 64 nt, Human
cccauguuauagaaacugcagcagaguugaaaauugccuccaaauuaccggaagaguguaugaa

SEQ ID NO: 492898 - RNA, 64 nt, Human
cuucggagggacguggucuugcccacuguccuuuugccuccaugcugaggucggugcuguauuu

SEQ ID NO: 492899 - RNA, 64 nt, Human
gacuccuccugaggaggggcccuccuccucugacugccuccaacguaaaaauguaaauauaaau

SEQ ID NO: 492900 - RNA, 64 nt, Human
aaaagacaagcaaauuaagaauggagcuuaaccaugccuccauugggaagucuagacuuugagc

SEQ ID NO: 492901 - RNA, 64 nt, Human
guguagcccuaacgucauuuagcuuguugucugaugccuccaguaggacaccuccgauggagcu

SEQ ID NO: 492902 - RNA, 64 nt, Human
uugaccuggccucucccccacaggaacaaaacacugccuccagagucuuuaaauucucaguuau

SEQ ID NO: 492903 - RNA, 50 nt, Human
aaccaccuuccacaccauaaugccuccaaaaugagaccaugauauuaagc

SEQ ID NO: 492904 - RNA, 64 nt, Human
gggcagaggcuggaggcagggccuugcccagagaugccuccaccgcugccuaaguggcugcuga

SEQ ID NO: 492905 - RNA, 64 nt, Human
gaucucuaagagauccccagaccucacuugccucugccuccaucuuggcccugauucaacccua

SEQ ID NO: 492906 - RNA, 64 nt, Human
uccuuccccuuccucccuccaugcccacucccccugccuccagcaggccaggaagaaggcacag

SEQ ID NO: 492907 - RNA, 64 nt, Human
aggauuuuagaaaacccugggaaaacccaccacaccaccacaaaauggccuuuaguguaugaaa

SEQ ID NO: 492908 - RNA, 64 nt, Human
auacagaagcuugacaagcauguccucacccuccccaccacauaaacacauggacacacaccca

SEQ ID NO: 492909 - RNA, 64 nt, Human
uggccucccaaguauguaggacuacagguacucgccaccacaccuggauaauuaaaaaauuauu

SEQ ID NO: 492910 - RNA, 55 nt, Human
ggaagagcuacaagcacuaaagugcugccuccagcucucggucccacaguccuca

SEQ ID NO: 492911 - RNA, 64 nt, Human
cuggagcuucacuguuacuaaauuauuaauuucuugccuccaguguucuaucucugaggcugag

SEQ ID NO: 492912 - RNA, 64 nt, Human
ugaaucaggauuugagagcuggagcccaucuuucugccuccauccaaagaggccuuuuaacuca

SEQ ID NO: 492913 - RNA, 64 nt, Human
gcaagguagggagaagucauuguuaucauuccucugccuccaaguagaaugcccuuaugcccca

SEQ ID NO: 492914 - RNA, 64 nt, Human
ggggaguuuacuaccuggggaccccccuugcccaugccuccagcuacaaaacaauucaauugcu

SEQ ID NO: 492915 - RNA, 64 nt, Human
cugucucauaaguucauggaaugaaauggcuuucugccuccauuuuaaucaugcauaaaaugaa

SEQ ID NO: 492916 - RNA, 64 nt, Human
gguuaagcuuuguguuuaccuacuaaacagaaaaugccuccaaauaaacagugucacaaguaca

SEQ ID NO: 492917 - RNA, 64 nt, Human
aaugaauuucgaagucuaauuuugguuccuaacaugccuccaacagcaucuaucaauccuguua

SEQ ID NO: 492918 - RNA, 64 nt, Human
ugcacggaaaguuaucuuacagcaaacuguaguuugccuccaagacaccauugucucccuuuaa

SEQ ID NO: 492919 - RNA, 64 nt, Human
aacuuuuucccuccucagaugaccuuacuuccacugccuccacaaagaccuucuuaccaugacc

SEQ ID NO: 492920 - RNA, 64 nt, Human
cugaacagacggagaagaugugcuagggagaaucugccuccacagucacccauuucauugcucg

SEQ ID NO: 492921 - RNA, 64 nt, Human
gaugacuucaggcaggcgggccggggcagggacuugccuccacucaccacaagcugagcaggac

SEQ ID NO: 492922 - RNA, 64 nt, Human
agcaguauuucaguaucacaguguuucaguaauuugccuccaugauucuagugcuucugccuua

SEQ ID NO: 492923 - RNA, 64 nt, Human
aggcccccccgcugcagacccucuguccugccucugccuccaggcaugcguuuccccgugaggg

SEQ ID NO: 492924 - RNA, 64 nt, Human
gggaaccuggucccagcuugaguuccugccuuucccaccacaaauuaucaacugguugaugugu

SEQ ID NO: 492925 - RNA, 64 nt, Human
uucucugccauucgcuaaggccuuugucacuuuuccaccacagaaaggcucuggccuuggauac

SEQ ID NO: 492926 - RNA, 64 nt, Human
uuucuguuauagcaguccccacaacaucaaagaaccaccacaagucaauagauuugaguuuaau

SEQ ID NO: 492927 - RNA, 64 nt, Human
guagaguauucagugcuuccaaaguggugggcccugccuccaucaauagccccugccacucccc

SEQ ID NO: 492928 - RNA, 64 nt, Human
guagaguauucagugcuuucuaaguagcagccccugccuccaucaauaguccuaccacuccccu

SEQ ID NO: 492929 - RNA, 64 nt, Human
ugccuguccugacccucgugacuccagugaccaaugccuccaccucuuggaccaggugugcccc

SEQ ID NO: 492930 - RNA, 64 nt, Human
gcugcuguucaauuaucugagguugucugggaccugccuccaccccauccagggaugagaaugg

SEQ ID NO: 492931 - RNA, 64 nt, Human
uucuggugucuuuccacuccucagccccucaucuugccuccacccagcugcuccauuuuugcca

SEQ ID NO: 492932 - RNA, 64 nt, Human
gcugagggguaagagguuguuguaguuguccuggugccuccaucagacucucccuacuuguccc

SEQ ID NO: 492933 - RNA, 64 nt, Human
cuuccuucuccccucccaccuuucccuggcuuuuugccuccauuccaugaggcauacaguaagg

SEQ ID NO: 492934 - RNA, 64 nt, Human
gugcuguuuggccuaggaacuguggcugggaaggugccuccaacaaugggauccagggaagcca

SEQ ID NO: 492935 - RNA, 64 nt, Human
uaaucauagcgggaaauaaagcaccuuccaagcuugccuccaagaguuacgaguuaaggaagag

SEQ ID NO: 492936 - RNA, 64 nt, Human
cauauguaaaaacuaucaucuuugcagauuacucugccuccaaaugcagggccuuucagagaug

SEQ ID NO: 492937 - RNA, 64 nt, Human
gagacccuggaaacacacugagaucuccaauugcugccuccauugaugucucuagaccugcaga

SEQ ID NO: 492938 - RNA, 64 nt, Human
cccagcuuagccucuggcuguaagcuucggucauugccuccaugcccuugcuuggcucaagcac

SEQ ID NO: 492939 - RNA, 64 nt, Human
aaaagcuggggugagugguuaccucaaagacaauugccuccaguuugggggcuccucucagggu

SEQ ID NO: 492940 - RNA, 64 nt, Human
uagaaccaaaccacccaaggccagcccuuaagccugccuccaccuuccuggugcaugacaaaau

SEQ ID NO: 492941 - RNA, 64 nt, Human
cagacuccugcguagcugggaccacagggguaugccaccacaccuggcuaauuuuuuauuuucc

SEQ ID NO: 492942 - RNA, 64 nt, Human
cagccuccugaguagcugggaugacaggcacccgccaccacacccagcuaauuuuuguacuuuu

SEQ ID NO: 492943 - RNA, 64 nt, Human
cagccuccugaguagcugggauuacaggcacccaccaccacaccuggcuaauuuuuuguauuuu

SEQ ID NO: 492944 - RNA, 64 nt, Human
ugaugaucugaugauuuauuuaaagagccguugaugccuccaggaaacuuaaguauuuuauuaa

SEQ ID NO: 492945 - RNA, 64 nt, Human
ucccaccguacaacccccuccaccccccacucagugccuccacaugcugccuggcacagaccag

SEQ ID NO: 492946 - RNA, 64 nt, Human
gcacuugagaggcagcagcuccuugaagguccucugccuccagcuguggcccugcauccagaua

SEQ ID NO: 492947 - RNA, 64 nt, Human
gucuguugggagcagaugugcucacugacguuugugccuccagggcagauuccuaagcagcugg

SEQ ID NO: 492948 - RNA, 64 nt, Human
cuccuguggaagaggguggugggccuuggaacgcugccuccacugaggcgggcacacaaggcgg

SEQ ID NO: 492949 - RNA, 64 nt, Human
caggcauccaugugugcaaaccaucugccccagcugccuccacagacugcugucuccuuguccu

SEQ ID NO: 492950 - RNA, 64 nt, Human
gagugcucgagggaggggagugcuuucugccccaugccuccaacuacuguaugcaggccuggcu

SEQ ID NO: 492951 - RNA, 64 nt, Human
agcugccccugcugcuuaagugcaugcauugagcugccuccagccugguggcccagcuauuacc

SEQ ID NO: 492952 - RNA, 64 nt, Human
uucccugacuguugccucacuuccuuggaacuccugccuccacagccccuccaguggcagggac

SEQ ID NO: 492953 - RNA, 64 nt, Human
auucuacuugcucuggaccugcccccgcauccccugccuccauccuaguaaagacuccuugcua

SEQ ID NO: 492954 - RNA, 64 nt, Human
cuguuuucagaugugauugagggguguucugcccugccuccacugucacagccuuuaauaaaga

SEQ ID NO: 492955 - RNA, 64 nt, Human
cuuucucugccugcccugcccuuggggccaccucugccuccagcaggcuugagcuugccccagg

SEQ ID NO: 492956 - RNA, 64 nt, Human
cucaagaagcaggcuacacugacacugguauuccugccuccauauuuucuuuaaaagacaaauc

SEQ ID NO: 492957 - RNA, 64 nt, Human
cagccaucauaggaagggaccaaggcaaggcaggugccuccaggugugcacguggcauguggcc

SEQ ID NO: 492958 - RNA, 64 nt, Human
aaggggagggauuuugacuaguugaauuauuaagccaccacaauaaagcagauuuuuaaauaag

SEQ ID NO: 492959 - RNA, 64 nt, Human
cuccuauuuucuuuuuaacuuuuuaaagacugugccaccacaaaacagccuuagccuccuuguu

SEQ ID NO: 492960 - RNA, 64 nt, Human
auguucccuuggccucagagcugccccugcucucccaccacagccacccagaggcaccccauga

SEQ ID NO: 492961 - RNA, 64 nt, Human
uggccugugucccaugacccaccccugugcuccgugccuccaccaccacuggccaccaggcugg

SEQ ID NO: 492962 - RNA, 64 nt, Human
agucuccagcagagcaggcagucaggccccagcgugccuccaucccagugccccgaugaccauc

SEQ ID NO: 492963 - RNA, 64 nt, Human
acaauuuguacaaaaaaugugguacguugguuccugccuccacuccaggucaucuguguguuua

SEQ ID NO: 492964 - RNA, 64 nt, Human
agaggcuacugcccuugggaggcacucaugaaggugccuccaucucucccuuccccaauauacc

SEQ ID NO: 492965 - RNA, 64 nt, Human
cuuccacagaagcccucuucgggcagccccccuuugccuccaggucguucucggagcuggaaga

SEQ ID NO: 492966 - RNA, 64 nt, Human
gcauuucucguucuuuacugggucuaaagggcuaugccuccauuucagagagcuucaacuacuu

SEQ ID NO: 492967 - RNA, 64 nt, Human
ucuucgugucaggaucccagcccgauucugcaaaugccuccaugggguuuaaaaacaugaggcu

SEQ ID NO: 492968 - RNA, 64 nt, Human
agcagcacccccaccugcuggcuuggccucaaggugccuccaccccugcccuccccuucauccc

SEQ ID NO: 492969 - RNA, 64 nt, Human
cagaagguuuguugcuguguugugaaugaugagcugccuccauagggaacccacugccaccugg

SEQ ID NO: 492970 - RNA, 64 nt, Human
auaugucuguacgugucgugggccaaccucguucugccuccagcuuuccugguuagcgcaacgc

SEQ ID NO: 492971 - RNA, 64 nt, Human
cugaggguucugccgcgggcuaccggccucugagugccuccagccagagcucccugcgcucgcu

SEQ ID NO: 492972 - RNA, 64 nt, Human
aaguagaucuccuccuccuucaugcagccaggauugccuccagugcuguuagcuuaggcaaaca

SEQ ID NO: 492973 - RNA, 64 nt, Human
cugugacugaggcggagcccagcccuccagcgucugccuccaggagcugcaagaaguccauauu

SEQ ID NO: 492974 - RNA, 64 nt, Human
cuggcccucaccccugcccugggauguccacagaugccuccaccccccagaaccuguccuugca

SEQ ID NO: 492975 - RNA, 64 nt, Human
cagccucucgaguagcugggaccacaguugugugccaccacacuuggcuaacuuuuuaauuuuu

SEQ ID NO: 492976 - RNA, 64 nt, Human
ucagaggaccuaagacccaccuaugacucagggcccaccacaccccacccccccccaacuggcu

SEQ ID NO: 492977 - RNA, 64 nt, Human
cagccucccaaguagcugggauuacaggcacccaccaccacauccagcuaauuguuguauuuuu

SEQ ID NO: 492978 - RNA, 64 nt, Human
gcucuuccucuucuuugccgcggacucccuuuccugccuccaagaccuggugucucccacugug

SEQ ID NO: 492979 - RNA, 64 nt, Human
ugaggcugagagacucuggguuuagggcuagcccugccuccaucucccuuggguaaaaugaagg

SEQ ID NO: 492980 - RNA, 64 nt, Human
cccgcucgguccuggacacacugccccccucucuugccuccaccccucugcggacucugcagcu

SEQ ID NO: 492981 - RNA, 64 nt, Human
ccauaguccauuuuuuuagggcagugggaaccucugccuccacuuccugcuuuagccccuuccc

SEQ ID NO: 492982 - RNA, 64 nt, Human
ccaccucccagccaagaucugucuuccuucauggugccuccagggagccuuccuggucccagga

SEQ ID NO: 492983 - RNA, 64 nt, Human
gccacugugugaaucggcgacggagcacugcaccugccuccagccgccggcugugcaguccugg

SEQ ID NO: 492984 - RNA, 64 nt, Human
aggaagaggcagggccagguuuugggauaggcuuugccuccaggaugggcugcuccugggccug

SEQ ID NO: 492985 - RNA, 64 nt, Human
ccccgagggcugcccugcccuggaagggccccucugccuccacaccaguggagucuucgagacu

SEQ ID NO: 492986 - RNA, 64 nt, Human
cugucggcugacuuagcccccugcucacucuaggugccuccaggaggugagcccugggugcagc

SEQ ID NO: 492987 - RNA, 64 nt, Human
auucgccacucucccaccccccagcccccaccucugccuccaggucucaucuuccaccccaaaa

SEQ ID NO: 492988 - RNA, 64 nt, Human
cuggcuccugaagggccugggaggguccaucagcugccuccagcauccaguggcugcuggcaua

SEQ ID NO: 492989 - RNA, 64 nt, Human
agucagugauucaacuggaaggaaaccucaaugcugccuccagagcuuuuuggaaauacucaga

SEQ ID NO: 492990 - RNA, 64 nt, Human
uccagcuccaagcuuccugcauucaguccuuugaugccuccagcugugauaucucagaugcugc

SEQ ID NO: 492991 - RNA, 64 nt, Human
agugucuccaccucggggaccaaggacgccuccgugccuccagaccccgccuccuccagccccu

SEQ ID NO: 492992 - RNA, 64 nt, Human
guacauuucagugagcucacuuugauuuuuaaucccaccacaagcacauacuaauuuuauuuau

SEQ ID NO: 492993 - RNA, 64 nt, Human
cggccucccaaagugcugggauuacaggcgugagccaccacaaccgacuuuuuuuuuuuuuuuu

SEQ ID NO: 492994 - RNA, 64 nt, Human
cagccuuccaaguagcugggacuacaggugugcaccaccacagcuggcuaauucuauuuuuuua

SEQ ID NO: 492995 - RNA, 64 nt, Human
ggcagagcuggccaacagcuugugguccccgaucugccuccagccccaagaugccuacagcccc

SEQ ID NO: 492996 - RNA, 61 nt, Human
cgcccagcguggggcccuagccggcguccccugccuccagaacgcggugcgugagguuccc

SEQ ID NO: 492997 - RNA, 64 nt, Human
cucagccucccaaguagcugggauuacaggcacaugccuccauaccgggcuaauuuuuguauuu

SEQ ID NO: 492998 - RNA, 64 nt, Human
uaggaccuggcagcuuuucuugccgucccuccccugccuccagaaucacagcccuucuccccaa

SEQ ID NO: 492999 - RNA, 64 nt, Human
ugggacccuccagccuggagaccccauggacugaugccuccacugcugugugccccauguugug

SEQ ID NO: 493000 - RNA, 64 nt, Human
cuggccaaugcggcccacuuuccugagcugucgcugccuccauggcagcagccagggaccccca

SEQ ID NO: 493001 - RNA, 64 nt, Human
ugacccuucuggccuucgaaggccuaaacacagcugccuccaaggaccgcugccuggccugcau

SEQ ID NO: 493002 - RNA, 64 nt, Human
ucguugguauucugagggagcugccuggcuucucugccuccagccuuugggguagccacacuuu

SEQ ID NO: 493003 - RNA, 64 nt, Human
aaacuacuuuucaggcacuguagggucacccauaugccuccagcucaguugacgcuuaaaaaca

SEQ ID NO: 493004 - RNA, 64 nt, Human
aguuaguguccuaggaaaaccagaacucagaacuugccuccaugguugaguaacaagcuguaca

SEQ ID NO: 493005 - RNA, 64 nt, Human
ccccauccucccucccccagccaccacccucaggugccuccaauuggugcuucagcccuggccc

SEQ ID NO: 493006 - RNA, 64 nt, Human
agaagauggcccauuggugggagcaaugucacccugccuccagcuagcuaugggcccagaguuu

SEQ ID NO: 493007 - RNA, 64 nt, Human
cauaaaaggaccucuccugagaggcaaaaccuguugccuccaccacggcuucccucuuggcuca

SEQ ID NO: 493008 - RNA, 62 nt, Human
acauuguaacugaacuucaggauaauaaaguguuugccuccagucacguccuuccuccuucu

SEQ ID NO: 493009 - RNA, 64 nt, Human
cagccucccaaguagcugggauuacuggugcacaccaccacacucagcuaauuuuugcauuuuu

SEQ ID NO: 493010 - RNA, 64 nt, Human
cagcuuccccagcagcugggacuacaggcacgcgccaccacagccggcuaauuuuuuauuuaau

SEQ ID NO: 493011 - RNA, 64 nt, Human
cagccuccugaacagcugggaccacaggugcacgccaccacaccuggcuuuuuuuuguuguuuu

SEQ ID NO: 493012 - RNA, 64 nt, Human
gaagcuccaguccugcucucuacccagcccaucuugccuccauggugccucuggaggccucugg

SEQ ID NO: 493013 - RNA, 64 nt, Human
ggaauccuuuucuucuccuuugguagcagcucccugccuccagggcuuccgccaccagcgucuc

SEQ ID NO: 493014 - RNA, 64 nt, Human
gggaggccucaaaauaccgacugcguccauucucugccuccauggaaacagccccuagaaucug

SEQ ID NO: 493015 - RNA, 64 nt, Human
agagguguccccacuguaccagccucugauaagcugccuccaguuguccuuuaugaacauugca

SEQ ID NO: 493016 - RNA, 64 nt, Human
gagggaggccgguguggaaagccucgcacaguggugccuccagcuguugaaggguagcgcuggc

SEQ ID NO: 493017 - RNA, 64 nt, Human
gcuucucucuccggacucucauuauccaacccgcugccuccauuucucuagaucugugcucucc

SEQ ID NO: 493018 - RNA, 64 nt, Human
gcccugagcacagguacgggccccccucagccccugccuccaucugccugagacgccuauuuuu

SEQ ID NO: 493019 - RNA, 64 nt, Human
cugauuccugcccuggcuuggccuggacucgcccugccuccaucaccugggcccuuggucugga

SEQ ID NO: 493020 - RNA, 64 nt, Human
ucgggccgcgggcccauggacucugaguggcgacugccuccaccucauucccgugacucguggc

SEQ ID NO: 493021 - RNA, 64 nt, Human
uuccauuucugagaacaagucagccccuucuaccugccuccacccaggagacugaugcacaaga

SEQ ID NO: 493022 - RNA, 64 nt, Human
guuccuagagcuuggcugggucuaggcuguucugugccuccaaggacugucuggcaaugacuug

SEQ ID NO: 493023 - RNA, 64 nt, Human
agccuggaccuggcugggcuccaugagaaugaguugccuccaaccugucccaacagcugacagc

SEQ ID NO: 493024 - RNA, 64 nt, Human
cugcuacaugggguggggucguagggaggcuguuugccuccacgucuaggaaggccugugagag

SEQ ID NO: 493025 - RNA, 64 nt, Human
ccucacucagggauucuucauuucuucuuccuacugccuccacuucauguuauuuucuucccuu

SEQ ID NO: 493026 - RNA, 64 nt, Human
cauguuucacacaaguguagaaaaugccagggauccaccacaagauggagauggucagcacaaa

SEQ ID NO: 493027 - RNA, 64 nt, Human
cacuaggcgggcagcccacacccaccccagacggccaccacacugaggccacacguuggccauu

SEQ ID NO: 493028 - RNA, 64 nt, Human
ccuccacagcggaggccugcaggaaugucccuucccaccacaccccacuucccucuccuuccac

SEQ ID NO: 493029 - RNA, 64 nt, Human
acauuuauucaucaugccuaaggaauuugaagauugccuccaucauuuguagggccacagaucu

SEQ ID NO: 493030 - RNA, 64 nt, Human
gcgugcuaccugcaccgccccuucuccaacaaguugccuccaagcuuuggguuggagcuguucc

SEQ ID NO: 493031 - RNA, 64 nt, Human
ccgggggcaggaggcucugguuccucacuccuccugccuccacccccuaccauggacacauggg

SEQ ID NO: 493032 - RNA, 64 nt, Human
gcgcucaggggcuccaugcugggucugaggccccugccuccaagauuuaaccugcaaguugcuc

SEQ ID NO: 493033 - RNA, 64 nt, Human
aaaacaguggccuuuggucauuuuacuucuuuuuugccuccaccaucauguuuuccaucacuuu

SEQ ID NO: 493034 - RNA, 64 nt, Human
ccagaagcagguacucagcuuucugggaaaagcgugccuccagccguggggacaggccauccua

SEQ ID NO: 493035 - RNA, 64 nt, Human
gccaucuuccauauccgggugcucaauaaacuugugccuccaaugugguaccugccuccucuag

SEQ ID NO: 493036 - RNA, 64 nt, Human
gggcucagcagcgacaucucuacucccgccucccugccuccagcccuggcugcaaugucucuac

SEQ ID NO: 493037 - RNA, 64 nt, Human
aguggauucuccuucaauuccucagcuuccccucugccuccaaacaggggacacuucgggaaug

SEQ ID NO: 493038 - RNA, 64 nt, Human
ucggcguugcugggagaaugugccguuccugcccugccuccacccaccucgggagcagaagccc

SEQ ID NO: 493039 - RNA, 64 nt, Human
acacaccgcacauacacaugcaucagugucugccugccuccaccugcccagccuguucuucuuc

SEQ ID NO: 493040 - RNA, 64 nt, Human
ugccauguccuuucccauuucuuuuuggcuuuuuugccuccaccuuuuagcccacaucauuuaa

SEQ ID NO: 493041 - RNA, 64 nt, Human
guucuuucucaguaguuauuauuaugucaaaaugugccuccagagugauaaagcucuguauaug

SEQ ID NO: 493042 - RNA, 64 nt, Human
gccgggugucccaguggcaccacuaggugccugcugccuccacagugggguucacacccagggc

SEQ ID NO: 493043 - RNA, 64 nt, Human
cagccuccugagcagcugggauuacaggugcgugccaccacaccaggcugguuuucuuguauuu

SEQ ID NO: 493044 - RNA, 64 nt, Human
ucuccaggaaggcggccccguccccuacucauacccaccacagagcaccagccagugccaacgc

SEQ ID NO: 493045 - RNA, 52 nt, Human
ugcggagugugaauuacugaccccaccacacaccggaccaccaagagagcca

SEQ ID NO: 493046 - RNA, 64 nt, Human
guuuuguuuuuuaacgauuuuuaaauaacgucugugccuccacugguugaggguggaaccucca

SEQ ID NO: 493047 - RNA, 64 nt, Human
uuccugguccaggguauccuggggccacccucccugccuccaaaacagggaucccuggcaggcu

SEQ ID NO: 493048 - RNA, 64 nt, Human
ugagcagaucggagccccugggagguuuggaagcugccuccaagccuaggacacggaccagugg

SEQ ID NO: 493049 - RNA, 64 nt, Human
caaugagccugggcaaguagcaagggcuucccgcugccuccagacagcaccuggguccucgcca

SEQ ID NO: 493050 - RNA, 64 nt, Human
cccuaugaaccugggucuuauucuguccuucugaugccuccaaguuucccugguguagagcuug

SEQ ID NO: 493051 - RNA, 64 nt, Human
uaccugaugcacacggauugcgaccagagcaugaugccuccaucaagugguaauauguuugcag

SEQ ID NO: 493052 - RNA, 64 nt, Human
guccgcccaccuagugcuuccacuucuaugcaaaugccuccaagccauucacuuccccaaucuu

SEQ ID NO: 493053 - RNA, 64 nt, Human
gugcaguggcaugaucucaggucacugcaaccucugccuccaggguucaagcaauucuccugcc

SEQ ID NO: 493054 - RNA, 64 nt, Human
gugcaguggcaugaucucaggucgcugcaaccucugccuccaggguucaagcaacucuccugcu

SEQ ID NO: 493055 - RNA, 57 nt, Human
aggccaaggacgagcuguagagaggccugccuccagggcuggacugaggccugagcg

SEQ ID NO: 493056 - RNA, 64 nt, Human
aggguggaugugggcaugcaggugacaagggcccugccuccaccccuccagcccauccagcaau

SEQ ID NO: 493057 - RNA, 64 nt, Human
uccccuguaccugugccaagccuagcacuugugaugccuccaugccccgagggcccucucucag

SEQ ID NO: 493058 - RNA, 64 nt, Human
aaggcaacuuggaaguggugggugcccaggacggugccuccagccucaacagugggcauggaca

SEQ ID NO: 493059 - RNA, 64 nt, Human
cccucaccuucugaguacagaguguggacucuggugccuccagaggggcucaggucacauaaaa

SEQ ID NO: 493060 - RNA, 64 nt, Human
ccccccccacccuucucucucccagacccuucccccaccacaucgggagcaauacccccaccac

SEQ ID NO: 493061 - RNA, 64 nt, Human
ucuagaaguccuuggauauuugauauuuaccugaccaccacagacaaagauugggauccuggcu

SEQ ID NO: 493062 - RNA, 64 nt, Human
ucaguggccgggucccugagcucccuagagucggccaccacagauucagacuuggacuaugauu

SEQ ID NO: 493063 - RNA, 64 nt, Human
agagagcuucggggcgucugucuccgugcucuccugccuccaccgccuugguuuugcuuccugc

SEQ ID NO: 493064 - RNA, 64 nt, Human
accucuccccagcuagucuucccucuguucuuccugccuccagccgcccgcgccagauuuugaa

SEQ ID NO: 493065 - RNA, 64 nt, Human
gucagggcccgcagccucgccccauccacuccggugccuccauuuagcuggccaaucagcccag

SEQ ID NO: 493066 - RNA, 64 nt, Human
uguccuugggagcccugagacuucuuucucuccuugccuccacccaccuccaaaggugcugagc

SEQ ID NO: 493067 - RNA, 64 nt, Human
cauggagacucaggaccccagaaggcauggaagcugccuccaguagacaucacugaaccccagc

SEQ ID NO: 493068 - RNA, 64 nt, Human
gaguaacuguccuagagcugggacaggucacgccugccuccacaucucuguuucuucagcggga

SEQ ID NO: 493069 - RNA, 64 nt, Human
aggcucugccaaacugaagacagccuuugugcggugccuccaacuuugccucaaaugggacagu

SEQ ID NO: 493070 - RNA, 64 nt, Human
uugcccuggguggcucccaggcuccuggaacuucugccuccaccucgcuggggagcccccaggg

SEQ ID NO: 493071 - RNA, 64 nt, Human
acccugggaggaccccaggcagggagagcccgccugccuccacccuuuccaacaagccaucuug

SEQ ID NO: 493072 - RNA, 64 nt, Human
cugcagaggggacggcuggggucccgagcaacucugccuccauccacgugggaagcggacccuc

SEQ ID NO: 493073 - RNA, 64 nt, Human
gcuccaaaaucccugcuccugcguccccgugauaugccuccacuucucucccuaaccaagguua

SEQ ID NO: 493074 - RNA, 64 nt, Human
uagaaggcugggucccauucuguccuucuugucaugccuccaauuuccccugguguagagcuug

SEQ ID NO: 493075 - RNA, 64 nt, Human
ugggacccuggagggcuaggccaaggccuucucaugccuccaccuagaagcugaauagugacgc

SEQ ID NO: 493076 - RNA, 64 nt, Human
ccgccaccuccccugggaccccgcccccucauccugccuccaguucccggccacgccccccagg

SEQ ID NO: 493077 - RNA, 64 nt, Human
cagccucccaaagugcugggauuacaggcgugauccaccacaccuggcccuugcaaucuucuac

SEQ ID NO: 493078 - RNA, 64 nt, Human
agcauugacugucucugugccaugaucaaccucgccaccacagagcuggagucugacuucaggu

SEQ ID NO: 493079 - RNA, 64 nt, Human
aaagauauauucauaguuauuaaugacccuauucccaccacaaauuuuaaagugcuccuaagcc

SEQ ID NO: 493080 - RNA, 64 nt, Human
augggccggggcaagcacuucaucggagacuuccugccuccagacgagcuggaaaaguuuaugg

SEQ ID NO: 493081 - RNA, 64 nt, Human
gcugaggcaagcuggggcaaggggccgcucccauugccuccacccacucacccccuacagccug

SEQ ID NO: 493082 - RNA, 64 nt, Human
guauccuaaaucuuuauuuuucuaggacauguuaugccuccauuuucaauuaaaauaaaguuau

SEQ ID NO: 493083 - RNA, 58 nt, Human
agaaagaacgggaccccuaggcuaccacugccuccaggcuacugcccucugccccuuu

SEQ ID NO: 493084 - RNA, 64 nt, Human
ccuggggagagcugagcccucgcuccucauggugugccuccaaccccccuguuccccaccaccu

SEQ ID NO: 493085 - RNA, 64 nt, Human
ggauggucucgaucuucuguccuuaaaauccaccugccuccaccugccaaagugcugagauuac

SEQ ID NO: 493086 - RNA, 64 nt, Human
cucaccuuuucauauuugguaaacuguaugcauuugccuccagcccaagauuauaaauaugaac

SEQ ID NO: 493087 - RNA, 64 nt, Human
cucggggcaggagcccccucugccacacgcuuugugccuccaaagcuccccccgccuuggucag

SEQ ID NO: 493088 - RNA, 64 nt, Human
cuaacgcucacugucagugcccauguuugcuagcugccuccaugugacuagugagcugcuggug

SEQ ID NO: 493089 - RNA, 64 nt, Human
aaaggacagggcccaggucagccucagucugcugugccuccagacugcagagcucucagaaccc

SEQ ID NO: 493090 - RNA, 64 nt, Human
cucucagcuccgggggugaggugugccuggccucugccuccacccuccuccucuucaccaggug

SEQ ID NO: 493091 - RNA, 64 nt, Human
cugagcugucagagcaagcaauuaggggccagccugccuccaccucccacccccuuccaccucc

SEQ ID NO: 493092 - RNA, 64 nt, Human
gccacugugguggguggguggaugcugcuucuguugccuccagaccucggugcccacagccuug

SEQ ID NO: 493093 - RNA, 64 nt, Human
guagcuaaugaaauugagaagggaaaucuuagcaugccuccaaaaauucacauccaaugcauag

SEQ ID NO: 493094 - RNA, 64 nt, Human
ugagcuaccugcacccgagcccuggggcucagccccaccacaggggcggguggacgugcuggcc

SEQ ID NO: 493095 - RNA, 64 nt, Human
acacugaccacccucaacccauugcgcccaguccccaccacagugaccacacccucacuggcuc

SEQ ID NO: 493096 - RNA, 64 nt, Human
ggacaagagcccugguuuucuacgcugcccuuggccaccacacugccugccccacgagcuggga

SEQ ID NO: 493097 - RNA, 64 nt, Human
cuccugccugcccuggccuugcuggggccccuccugccuccacgcccacccagcgucgacccuu

SEQ ID NO: 493098 - RNA, 64 nt, Human
uaccuaaaacugagguggggauggggagagccuuugccuccaccauucccacccacccuccccu

SEQ ID NO: 493099 - RNA, 64 nt, Human
cuguccccaacagaucugccauggagggaucuggugccuccagacaugugcacaugaauccaua

SEQ ID NO: 493100 - RNA, 64 nt, Human
ucgaugacugcccuuuacaacucauauucaguucugccuccaaaaugcauguguccacuuacau

SEQ ID NO: 493101 - RNA, 64 nt, Human
cugggcaguugaggaaaggacagccccugguuggugccuccaaaggaagguggacuuuuuuggu

SEQ ID NO: 493102 - RNA, 64 nt, Human
gaaaccugugaagaguggauucugccuccaucucugccuccauggcuaccuuuaggagacagag

SEQ ID NO: 493103 - RNA, 64 nt, Human
auguucuauguggaaaccugugaagaguggauucugccuccaucucugccuccauggcuaccuu

SEQ ID NO: 493104 - RNA, 64 nt, Human
ugauuagauuuucaguuuucuuucaaacuggaaaugccuccauaaauaugaucuaugauuuugc

SEQ ID NO: 493105 - RNA, 64 nt, Human
gcccuaccucuauugcagaaauugucaguccugcugccuccaguccuacaugaggauaagcauu

SEQ ID NO: 493106 - RNA, 64 nt, Human
gcgagggaaaaggguguucaccaugauaaccuagugccuccauagagggguuuggaaaaauucc

SEQ ID NO: 493107 - RNA, 64 nt, Human
agccuacaccaaauccagcccuugauuucccugcugccuccauaaacagaaagaggucugcugg

SEQ ID NO: 493108 - RNA, 64 nt, Human
gcucucucuauuuaacuaacauuuuguucaguuuugccuccaguggaagcagaaaggguuuuuu

SEQ ID NO: 493109 - RNA, 64 nt, Human
guggguggggugagggccaaaggcuaugguuuccugccuccaggagaauggagagaaagggcuu

SEQ ID NO: 493110 - RNA, 64 nt, Human
gcaugaggucaauggucauccugucuacccacccugccuccaggccagggggcuggggaggcaa

SEQ ID NO: 493111 - RNA, 64 nt, Human
agcaugaguuuuacaagugacccuucccuucccuccaccacaccacucaggggcuggggcuucu

SEQ ID NO: 493112 - RNA, 64 nt, Human
uggccucccaaguagcugggauuacaggugugugccaccacacccggcuaauuuuuauauuuuu

SEQ ID NO: 493113 - RNA, 64 nt, Human
cagccucccgaguagcugggacuacaggugcccgccaccacacccagcuaauuuuuuguauuuu

SEQ ID NO: 493114 - RNA, 64 nt, Human
gauucugcaagcaacucagaaagcuuuauaaaccugccuccaagccauucaugaagcaggcaug

SEQ ID NO: 493115 - RNA, 64 nt, Human
gaagcccugggucacccccacucugccucauuucugccuccaggaugccacugccucugcuucc

SEQ ID NO: 493116 - RNA, 64 nt, Human
ugacucaaaagaguuucuggcugaucuguggcuuugccuccaccaucccuaaccaaccucucau

SEQ ID NO: 493117 - RNA, 64 nt, Human
ccucuuccuccacacaggucgccgugagucaagcugccuccagaaccucagagcuucccuggug

SEQ ID NO: 493118 - RNA, 64 nt, Human
gcuguugugugccuaucggcagauccauccuuccugccuccaaggaggauacacagagaauggc

SEQ ID NO: 493119 - RNA, 64 nt, Human
uccuauauaaaagaguuuaaacugaacuuuaaggugccuccauuuaucaaggguuaugaaacuc

SEQ ID NO: 493120 - RNA, 64 nt, Human
aauguuuugaguucuguaaguugcaugccaacaaugccuccaauuccagcucggagucaauccc

SEQ ID NO: 493121 - RNA, 64 nt, Human
acccugucuuuccuucuaggugaccucauacauuugccuccauaccuuagaauggacuuuuugu

SEQ ID NO: 493122 - RNA, 64 nt, Human
ucaagucgcggcugcaggauccuugccuccaacgugccuccagcacaugcggcuuccgagggca

SEQ ID NO: 493123 - RNA, 64 nt, Human
acccaugcgauucaagucgcggcugcaggauccuugccuccaacgugccuccagcacaugcggc

SEQ ID NO: 493124 - RNA, 64 nt, Human
ggccuuaccugucucuauccaugcugucaacuccugccuccaccuggggucacccagucacauu

SEQ ID NO: 493125 - RNA, 64 nt, Human
cagcaucugcccugugaaguuuguuuucucccacugccuccaggccccacugauacccccaaau

SEQ ID NO: 493126 - RNA, 64 nt, Human
gccaggcuuccccuccuaccuggacucggccagcugccuccagggaccgcccguccauauuuau

SEQ ID NO: 493127 - RNA, 64 nt, Human
cucugucugcacccguggggcugugacuuacuccugccuccaggggcggggcggggccccccug

SEQ ID NO: 493128 - RNA, 64 nt, Human
aaccucaaccacaucuuauccuccaccccacaucccaccacauccaccuccauccccaacccau

SEQ ID NO: 493129 - RNA, 64 nt, Human
cagucucccagguagcugggauuacaggcaugugccaccacaccccguuaauuuuuguauuuuu

SEQ ID NO: 493130 - RNA, 64 nt, Human
ccgccccaaccccuccagcuccaaaucugagccuccaccacauagacugaaacuccccuggccc

SEQ ID NO: 493131 - RNA, 64 nt, Human
aaaaaaaaaaaaaaagcaauuccugguggcugugugccuccaacccuggucccccucugucucc

SEQ ID NO: 493132 - RNA, 64 nt, Human
gcucuuccagacucuuccugcagaggcuccuuucugccuccauggcuauccauccacccccaca

SEQ ID NO: 493133 - RNA, 64 nt, Human
gcucucccaggcucuuccugcagaggccucuuucugccuccauggcuauccauccacccaccaa

SEQ ID NO: 493134 - RNA, 64 nt, Human
aacaucaagcaggaaacagacgacugagccuuccugccuccagccuggcuucuagcuggaagcc

SEQ ID NO: 493135 - RNA, 64 nt, Human
aagccagcccagcguuucucuaccaccaccaccaugccuccaccugacuuuggcuuggagacug

SEQ ID NO: 493136 - RNA, 64 nt, Human
cccaggauucaccuuccuagugguguuuagaaaaugccuccacagcccccuuccaccaugggca

SEQ ID NO: 493137 - RNA, 64 nt, Human
ugucuguccgucugugcuuguggcuaugagcgugugccuccacccaccccacgacccgugacua

SEQ ID NO: 493138 - RNA, 64 nt, Human
ccuggcccaggaggccaggaaggagggcccugucugccuccaccucugggugcacccccugccu

SEQ ID NO: 493139 - RNA, 64 nt, Human
agcagcagggggagcucccaagcugccaagccccugccuccagccuuccugaguuucucucucc

SEQ ID NO: 493140 - RNA, 57 nt, Human
cccauggagccccgaauugacccucacugccuccaaagcccagagccugccugucag

SEQ ID NO: 493141 - RNA, 64 nt, Human
cagugcaguuagccugagcuccccuggccccaggugccuccaucagagcauuuaccccauugug

SEQ ID NO: 493142 - RNA, 64 nt, Human
gcugggagacagcgcagccauagaggaagugaaaugccuccacggcuguguacgccuguugcaa

SEQ ID NO: 493143 - RNA, 64 nt, Human
aucauuucucuucccccuuuuuggcauccuggcuugccuccaguuuuagguccuuuaguuugcu

SEQ ID NO: 493144 - RNA, 64 nt, Human
uucuccccgguccuguguuccugugaucucgcccugccuccacuugccuugugauauucuauua

SEQ ID NO: 493145 - RNA, 64 nt, Human
uagccuccuaaguagcugagacuacagacgugcgccaccacacccaguucauuuuuguauuuuu

SEQ ID NO: 493146 - RNA, 64 nt, Human
cucagccugaaagugcuaggauuacaggcgugagccaccacaccuggccagcucagcauauucu

SEQ ID NO: 493147 - RNA, 64 nt, Human
cagccuccccaguagcugggauuacagacaugcaccaccacaccuggcuaauuuuuguauuuuu

SEQ ID NO: 493148 - RNA, 64 nt, Human
gccccacucuguacagaggcuguuugggcagccuugccuccagagagcagauuccagcuucgga

SEQ ID NO: 493149 - RNA, 64 nt, Human
agcacagcugaaaucuagcagaguuuaacucuucugccuccaugucugucacuuauaauucagg

SEQ ID NO: 493150 - RNA, 64 nt, Human
ggaggggguaguugaaaaaucccagcuuccucugugccuccacucuggcccuaaaugcuccucc

SEQ ID NO: 493151 - RNA, 64 nt, Human
gugaaaaucccaguggaggguggaaggaaccguuugccuccagagauggccccagggagaacac

SEQ ID NO: 493152 - RNA, 64 nt, Human
cccuccugucgagaaugacugccagggccucgccugccuccaccugcccccaccugcuccuacc

SEQ ID NO: 493153 - RNA, 64 nt, Human
aaaauuaaauaaaugguguuuuggguuucaaagcugccuccaugccgaguguuguguggguggg

SEQ ID NO: 493154 - RNA, 64 nt, Human
uucuuacuccuaugucugugucaucccagaugugugccuccagauggcaguauacuacacuauc

SEQ ID NO: 493155 - RNA, 64 nt, Human
uaguguaucuuuaaaaaaaaaucuuguguuaacuugccuccaucuuuuucuugggugaggacac

SEQ ID NO: 493156 - RNA, 64 nt, Human
guaacggguuuguaacugccacagcaaaacaauuugccuccaugccugaaucuucugucuugug

SEQ ID NO: 493157 - RNA, 64 nt, Human
guaaggaauagguugucucuuggauuaagucauaugccuccagccauuauaugagaacugugaa

SEQ ID NO: 493158 - RNA, 64 nt, Human
uauauagauguauaaugauucaaacugcugccuuugccuccagugcauccuuacuuagguauua

SEQ ID NO: 493159 - RNA, 64 nt, Human
gccccccucagagugcacaauacgaguuuguuccugccuccacucucccaccccguucuggccu

SEQ ID NO: 493160 - RNA, 64 nt, Human
uuuggggcauuuguaaaaaguagauuaaaauauuugccuccauguagaacuugaacuaacauaa

SEQ ID NO: 493161 - RNA, 64 nt, Human
agcugccccuuucccuccucuccgcccaugaaaaugccuccaaacugagaugcuuucagcugag

SEQ ID NO: 493162 - RNA, 64 nt, Human
ccuccccuccuacucccuuuucucacucucauccccaccacagaucccuggauugcugggaaug

SEQ ID NO: 493163 - RNA, 64 nt, Human
cagccucccgaguagcugggauuacaggcacgcaccaccacaccuggcuaauuuuuguacuuuu

SEQ ID NO: 493164 - RNA, 64 nt, Human
uuccuuucccucccacaaagccaacacucugugaccaccacacuccaggaggcagccccauccc

SEQ ID NO: 493165 - RNA, 64 nt, Human
cguucacuaucaugagaauagcaugggaaagaccugccuccaugauucaguuaccucccacugg

SEQ ID NO: 493166 - RNA, 64 nt, Human
gaacuccaugguaugcucacaauuuucugcaaguugccuccacuuccaaguggccagugauuug

SEQ ID NO: 493167 - RNA, 64 nt, Human
gaagguuuuuuuaaaaaagaggacuugcaucagcugccuccagaacaauuuuaagaaaauaaca

SEQ ID NO: 493168 - RNA, 64 nt, Human
ucucccucaucccucaauacccuaccacagauccugccuccacccaguuccccacaaagcacca

SEQ ID NO: 493169 - RNA, 64 nt, Human
uacaucagguuucagcacacaacuuacauuucuuugccuccaaauugaggcauuuauuaugaug

SEQ ID NO: 493170 - RNA, 64 nt, Human
guaagagaaaugaggaacuuucgaacugcaaauaugccuccaaacuagcuuuugauaagugugg

SEQ ID NO: 493171 - RNA, 64 nt, Human
aaggaggcaauggcuccaagccuugccauagggcugccuccaaggacacagaaggaugccaguu

SEQ ID NO: 493172 - RNA, 64 nt, Human
ggagcugcugagccaccaacucccaaagccagccugccuccagcuuuacugagcacaggaugcg

SEQ ID NO: 493173 - RNA, 64 nt, Human
ggcucugugggcauaggcaggcagaguggaacccugccuccaugccagcaucugggggcaagga

SEQ ID NO: 493174 - RNA, 64 nt, Human
auauuguucagggaaaucagcaugauagaugcugugccuccagagaguucucuggagauuacua

SEQ ID NO: 493175 - RNA, 64 nt, Human
caacccucuucucacuuuuuaaaaucuuguuccaugccuccagguuuaucuuugucuuaucuac

SEQ ID NO: 493176 - RNA, 64 nt, Human
cuggagguucccugcacucccagugagccagccaccaccacaaccugucucccaguccugcucu

SEQ ID NO: 493177 - RNA, 64 nt, Human
cagccucccgaguagcugggaguacaggcacacaccaccacacccagcuaauuuuuguauuuuu

SEQ ID NO: 493178 - RNA, 64 nt, Human
acauacacagcuuccucuuuugguuccauccuuaccaccacaccacacgcacacuccacaugcc

SEQ ID NO: 493179 - RNA, 64 nt, Human
cagccucccaaggugcugggauuacaggugugagccaccacaccuggccaagaauaccacuuuu

SEQ ID NO: 493180 - RNA, 64 nt, Human
cuguccuucuccuuccacccgcucccaggguuucccaccacagggucuggaagugugugugacg

SEQ ID NO: 493181 - RNA, 64 nt, Human
ugggcagaagccccucuuaaauugugguugccaugguaccgagggacucauuccuggggcucgc

SEQ ID NO: 493182 - RNA, 64 nt, Human
cgguccauccccuuuucaaggucacuuuuuugaugguaccgaagaucccauggacauuaaggga

SEQ ID NO: 493183 - RNA, 64 nt, Human
uccucaguuuccucauuugguaaauggggauaaugguaccgaccucuuaggcuuggugugagga

SEQ ID NO: 493184 - RNA, 64 nt, Human
cucuccgugaggggcagguggacuccaggcacccgguaccgauggggcagggaccgagucuccc

SEQ ID NO: 493185 - RNA, 64 nt, Human
uuucugcuauauauguaacuuuuuauuacuuaaagguaccgaaggaaggccaggugcaguggcu

SEQ ID NO: 493186 - RNA, 64 nt, Human
cuucucuauguaacgauauaagcuaucggagggugguaccgaucaggaacgcuuuuuggcgggg

SEQ ID NO: 493187 - RNA, 64 nt, Human
uuccauucuuuucaccagcacccaucgcccaagggguaccgaggggggcaagggguguccaguc

SEQ ID NO: 493188 - RNA, 64 nt, Human
ugcacaagccucggccugccccugagccaggcucgguaccgaugcgugggcugggcuagguccc

SEQ ID NO: 493189 - RNA, 64 nt, Human
guaaagccaaugacccccaagguggucacucucugguaccgagccccugaacugcuguugggaa

SEQ ID NO: 493190 - RNA, 64 nt, Human
uggauuagaccaacuggagaauugccagacuugugguaccgauuauaucaucucagucuugaau

SEQ ID NO: 493191 - RNA, 64 nt, Human; identical to SEQ ID NO: 493190

SEQ ID NO: 493192 - RNA, 64 nt, Human
aaucacucauagauauugaacaauaaaggagaaugguaccgaugcaggaggaagcaagcguguc

SEQ ID NO: 493193 - RNA, 64 nt, Human
ugauauauuuuaugugacugcauuuuuggggagggguaccgaaaucguuaaauuugucaguuug

SEQ ID NO: 493194 - RNA, 64 nt, Human
gggagccgcaugcccugggcccaggccugacccugguaccgaagcuguggacguucucgccaca

SEQ ID NO: 493195 - RNA, 64 nt, Human
augaauacucagagcauuguucagcugguacagagguaccgaaguggcauccgaggccacauga

SEQ ID NO: 493196 - RNA, 64 nt, Human
cagccucccaaguagcugggacuacaggcacacgccaccacacccaacuaauuuuuguauuuuu

SEQ ID NO: 493197 - RNA, 64 nt, Human
cagccucccaaagugcugggauuacaggcaugagccaccacacccagcgagacgggguuucauu

SEQ ID NO: 493198 - RNA, 64 nt, Human
aaguggggcugggaagcugacuucgugcucuucaccaccacaaaggaugugugugcauccuggg

SEQ ID NO: 493199 - RNA, 64 nt, Human
uuuuccuuugaacgugcuucuuuguaaugaccaagguaccgauuucugcuaaguucucccaaca

SEQ ID NO: 493200 - RNA, 64 nt, Human
gcaggaggggguuuugggugggccacugaaaagggguaccgaauagguugugugaugaaauucu

SEQ ID NO: 493201 - RNA, 64 nt, Human
cuuuucucccuuuagcaaacugacucgggaaagugguaccgacuuccccaucccugcuguccca

SEQ ID NO: 493202 - RNA, 64 nt, Human
acaagagggccugucccuguccccguccccaggagguaccgacagucccugugcugguuagaca

SEQ ID NO: 493203 - RNA, 64 nt, Human
auuacuuuaaaacauaucuaccaucugauuggcugguaccgagagcuguggguaaaauuugaaa

SEQ ID NO: 493204 - RNA, 64 nt, Human
aaguggaauaauacaacguaacuaaaacauggcggguaccgaaaggagggcaauucauggaaga

SEQ ID NO: 493205 - RNA, 64 nt, Human; identical to SEQ ID NO: 162790

SEQ ID NO: 493206 - RNA, 64 nt, Human; identical to SEQ ID NO: 162791

SEQ ID NO: 493207 - RNA, 64 nt, Human; identical to SEQ ID NO: 162792

SEQ ID NO: 493208 - RNA, 64 nt, Human; identical to SEQ ID NO: 162793

SEQ ID NO: 493209 - RNA, 64 nt, Human; identical to SEQ ID NO: 162794

SEQ ID NO: 493210 - RNA, 64 nt, Human; identical to SEQ ID NO: 162795

SEQ ID NO: 493211 - RNA, 64 nt, Human; identical to SEQ ID NO: 162796

SEQ ID NO: 493212 - RNA, 64 nt, Human; identical to SEQ ID NO: 162797

SEQ ID NO: 493213 - RNA, 64 nt, Human; identical to SEQ ID NO: 162798

SEQ ID NO: 493214 - RNA, 64 nt, Human
ccuucucccacacugcuaggugggccagccccucccaccacagcaggugucauauauggggggc

SEQ ID NO: 493215 - RNA, 64 nt, Human
agcuuccagagagcgagcgcccuuuagcggccugccaccacagcacgcggccuccugauccgga

SEQ ID NO: 493216 - RNA, 64 nt, Human
gugaucauugcucuggauuuggggcucccggcugccaccacaugcagcuuugccucaccuuucu

SEQ ID NO: 493217 - RNA, 64 nt, Human; identical to SEQ ID NO: 162799

SEQ ID NO: 493218 - RNA, 64 nt, Human; identical to SEQ ID NO: 162800

SEQ ID NO: 493219 - RNA, 64 nt, Human; identical to SEQ ID NO: 162801

SEQ ID NO: 493220 - RNA, 64 nt, Human; identical to SEQ ID NO: 162802

SEQ ID NO: 493221 - RNA, 64 nt, Human; identical to SEQ ID NO: 162803

SEQ ID NO: 493222 - RNA, 64 nt, Human; identical to SEQ ID NO: 162804

SEQ ID NO: 493223 - RNA, 64 nt, Human; identical to SEQ ID NO: 162805

SEQ ID NO: 493224 - RNA, 64 nt, Human; identical to SEQ ID NO: 162806

SEQ ID NO: 493225 - RNA, 64 nt, Human; identical to SEQ ID NO: 162807

SEQ ID NO: 493226 - RNA, 64 nt, Human; identical to SEQ ID NO: 162808

SEQ ID NO: 493227 - RNA, 64 nt, Human; identical to SEQ ID NO: 162809

SEQ ID NO: 493228 - RNA, 51 nt, Human; identical to SEQ ID NO: 162810

SEQ ID NO: 493229 - RNA, 64 nt, Human; identical to SEQ ID NO: 162811

SEQ ID NO: 493230 - RNA, 64 nt, Human; identical to SEQ ID NO: 162812

SEQ ID NO: 493231 - RNA, 64 nt, Human
uugaaggcuccauggaaugagauaaagcauugacccaccacaggacaucucaugaagccauguu

SEQ ID NO: 493232 - RNA, 64 nt, Human
acaaacacaaaaagaugagucccaccccccacuaccaccacacccaucaaccagccacauucac

SEQ ID NO: 493233 - RNA, 64 nt, Human
aucgagacccucugacgacuugccgacuaacuggccaccacaagcugcagucuguagcacugaa

SEQ ID NO: 493234 - RNA, 64 nt, Human; identical to SEQ ID NO: 162813

SEQ ID NO: 493235 - RNA, 64 nt, Human; identical to SEQ ID NO: 162814

SEQ ID NO: 493236 - RNA, 64 nt, Human; identical to SEQ ID NO: 162815

SEQ ID NO: 493237 - RNA, 64 nt, Human; identical to SEQ ID NO: 162816

SEQ ID NO: 493238 - RNA, 64 nt, Human; identical to SEQ ID NO: 162817

SEQ ID NO: 493239 - RNA, 64 nt, Human; identical to SEQ ID NO: 162818

SEQ ID NO: 493240 - RNA, 64 nt, Human; identical to SEQ ID NO: 162819

SEQ ID NO: 493241 - RNA, 64 nt, Human; identical to SEQ ID NO: 162820

SEQ ID NO: 493242 - RNA, 64 nt, Human; identical to SEQ ID NO: 162821

SEQ ID NO: 493243 - RNA, 64 nt, Human; identical to SEQ ID NO: 162822

SEQ ID NO: 493244 - RNA, 64 nt, Human; identical to SEQ ID NO: 162823

SEQ ID NO: 493245 - RNA, 64 nt, Human; identical to SEQ ID NO: 162824

SEQ ID NO: 493246 - RNA, 64 nt, Human; identical to SEQ ID NO: 162825

SEQ ID NO: 493247 - RNA, 64 nt, Human; identical to SEQ ID NO: 162826

SEQ ID NO: 493248 - RNA, 64 nt, Human
cagccucccaaagugcugggguuacaggcaugagccaccacacccagccuucagcugucaccuu

SEQ ID NO: 493249 - RNA, 64 nt, Human
auauacaaauaaguguauuguuuugauuuuuagaccaccacauggcaugcuugacuauuucuua

SEQ ID NO: 493250 - RNA, 64 nt, Human
uucauguucaaaggagcuuuucaaauuacccaguccaccacagaaucagcuaaugugacagaag

SEQ ID NO: 493251 - RNA, 64 nt, Human; identical to SEQ ID NO: 162827

SEQ ID NO: 493252 - RNA, 64 nt, Human; identical to SEQ ID NO: 162828

SEQ ID NO: 493253 - RNA, 64 nt, Human; identical to SEQ ID NO: 162829

SEQ ID NO: 493254 - RNA, 64 nt, Human; identical to SEQ ID NO: 162830

SEQ ID NO: 493255 - RNA, 64 nt, Human; identical to SEQ ID NO: 162831

SEQ ID NO: 493256 - RNA, 64 nt, Human; identical to SEQ ID NO: 162832

SEQ ID NO: 493257 - RNA, 64 nt, Human; identical to SEQ ID NO: 162833

SEQ ID NO: 493258 - RNA, 64 nt, Human; identical to SEQ ID NO: 162834

SEQ ID NO: 493259 - RNA, 64 nt, Human; identical to SEQ ID NO: 162835

SEQ ID NO: 493260 - RNA, 64 nt, Human; identical to SEQ ID NO: 162836

SEQ ID NO: 493261 - RNA, 64 nt, Human; identical to SEQ ID NO: 162837

SEQ ID NO: 493262 - RNA, 64 nt, Human; identical to SEQ ID NO: 162838

SEQ ID NO: 493263 - RNA, 64 nt, Human; identical to SEQ ID NO: 162839

SEQ ID NO: 493264 - RNA, 64 nt, Human; identical to SEQ ID NO: 162840

SEQ ID NO: 493265 - RNA, 64 nt, Human
cagccuccugaguagcugggacuacaggcaugcaccaccacacccggcuaauuuuuguauuuuu

SEQ ID NO: 493266 - RNA, 64 nt, Human
cagccucccgaguagcugggauuacaggcaugggccaccacacccagcuaauuuuuuguguuuu

SEQ ID NO: 493267 - RNA, 64 nt, Human
cauucuccccaguagcugggauuacaggugcccgccaccacaccagccuaauuuuuguauuuuu

SEQ ID NO: 493268 - RNA, 64 nt, Human; identical to SEQ ID NO: 162841

SEQ ID NO: 493269 - RNA, 64 nt, Human; identical to SEQ ID NO: 162842

SEQ ID NO: 493270 - RNA, 64 nt, Human; identical to SEQ ID NO: 162843

SEQ ID NO: 493271 - RNA, 64 nt, Human; identical to SEQ ID NO: 162844

SEQ ID NO: 493272 - RNA, 64 nt, Human; identical to SEQ ID NO: 162845

SEQ ID NO: 493273 - RNA, 64 nt, Human; identical to SEQ ID NO: 162846

SEQ ID NO: 493274 - RNA, 55 nt, Human; identical to SEQ ID NO: 162847

SEQ ID NO: 493275 - RNA, 64 nt, Human; identical to SEQ ID NO: 162848

SEQ ID NO: 493276 - RNA, 64 nt, Human; identical to SEQ ID NO: 162849

SEQ ID NO: 493277 - RNA, 64 nt, Human; identical to SEQ ID NO: 162850

SEQ ID NO: 493278 - RNA, 64 nt, Human; identical to SEQ ID NO: 162851

SEQ ID NO: 493279 - RNA, 64 nt, Human; identical to SEQ ID NO: 162852

SEQ ID NO: 493280 - RNA, 64 nt, Human; identical to SEQ ID NO: 162853

SEQ ID NO: 493281 - RNA, 64 nt, Human; identical to SEQ ID NO: 162854

SEQ ID NO: 493282 - RNA, 64 nt, Human
ucaaaagcaugauuuuuaauaguuguugaguauuccaccacaggaauguaucacaacuuaaccg

SEQ ID NO: 493283 - RNA, 54 nt, Human
agaguaugaaacccaaauaaacagccaccacauuuucaaaacagauuuguaaaa

SEQ ID NO: 493284 - RNA, 64 nt, Human
cagcuucccgaguagcugggauuauaggcacccaccaccacaccuggcuaauuuuuguauuuuu

SEQ ID NO: 493285 - RNA, 64 nt, Human; identical to SEQ ID NO: 162855

SEQ ID NO: 493286 - RNA, 64 nt, Human; identical to SEQ ID NO: 162856

SEQ ID NO: 493287 - RNA, 64 nt, Human; identical to SEQ ID NO: 162857

SEQ ID NO: 493288 - RNA, 64 nt, Human; identical to SEQ ID NO: 162858

SEQ ID NO: 493289 - RNA, 64 nt, Human; identical to SEQ ID NO: 162859

SEQ ID NO: 493290 - RNA, 64 nt, Human; identical to SEQ ID NO: 162860

SEQ ID NO: 493291 - RNA, 64 nt, Human; identical to SEQ ID NO: 162861

SEQ ID NO: 493292 - RNA, 64 nt, Human; identical to SEQ ID NO: 162862

SEQ ID NO: 493293 - RNA, 64 nt, Human; identical to SEQ ID NO: 162863

SEQ ID NO: 493294 - RNA, 64 nt, Human; identical to SEQ ID NO: 162864

SEQ ID NO: 493295 - RNA, 64 nt, Human; identical to SEQ ID NO: 162865

SEQ ID NO: 493296 - RNA, 64 nt, Human; identical to SEQ ID NO: 162866

SEQ ID NO: 493297 - RNA, 64 nt, Human; identical to SEQ ID NO: 162867

SEQ ID NO: 493298 - RNA, 64 nt, Human; identical to SEQ ID NO: 162868

SEQ ID NO: 493299 - RNA, 64 nt, Human
ucuuuaaucggguacuaccagucuugaaauuuugccaccacagaaagaaagauguuuuuaaaag

SEQ ID NO: 493300 - RNA, 64 nt, Human
uugcacacaggaucacucacauauguacauguacccaccacaaacgugcaagcuccugcacaca

SEQ ID NO: 493301 - RNA, 64 nt, Human
caggaaauugaggcugcagugagccaugauugagccaccacacuccaaccuaggugacagagca

SEQ ID NO: 493302 - RNA, 64 nt, Human; identical to SEQ ID NO: 162869

SEQ ID NO: 493303 - RNA, 64 nt, Human; identical to SEQ ID NO: 162870

SEQ ID NO: 493304 - RNA, 64 nt, Human; identical to SEQ ID NO: 162871

SEQ ID NO: 493305 - RNA, 64 nt, Human; identical to SEQ ID NO: 162872

SEQ ID NO: 493306 - RNA, 64 nt, Human; identical to SEQ ID NO: 162873

SEQ ID NO: 493307 - RNA, 64 nt, Human; identical to SEQ ID NO: 162874

SEQ ID NO: 493308 - RNA, 64 nt, Human; identical to SEQ ID NO: 162875

SEQ ID NO: 493309 - RNA, 64 nt, Human; identical to SEQ ID NO: 162876

SEQ ID NO: 493310 - RNA, 64 nt, Human; identical to SEQ ID NO: 162877

SEQ ID NO: 493311 - RNA, 64 nt, Human; identical to SEQ ID NO: 162878

SEQ ID NO: 493312 - RNA, 64 nt, Human; identical to SEQ ID NO: 162879

SEQ ID NO: 493313 - RNA, 64 nt, Human; identical to SEQ ID NO: 162880

SEQ ID NO: 493314 - RNA, 64 nt, Human; identical to SEQ ID NO: 162881

SEQ ID NO: 493315 - RNA, 64 nt, Human; identical to SEQ ID NO: 162882

SEQ ID NO: 493316 - RNA, 64 nt, Human
aaacaaaaccacacauauugauggagucugcauuccaccacauauccacccuugagaaguaugu

SEQ ID NO: 493317 - RNA, 64 nt, Human
caggaggcugcauuuuuccagguccuuagucuugccaccacacagaugauucugauucauagcc

SEQ ID NO: 493318 - RNA, 64 nt, Human
ugugacacuggcguucuccucuccccuccuucccccaccacaggucucuccugcauaggcagcc

SEQ ID NO: 493319 - RNA, 64 nt, Human; identical to SEQ ID NO: 162883

SEQ ID NO: 493320 - RNA, 64 nt, Human; identical to SEQ ID NO: 162884

SEQ ID NO: 493321 - RNA, 64 nt, Human; identical to SEQ ID NO: 162885

SEQ ID NO: 493322 - RNA, 64 nt, Human; identical to SEQ ID NO: 162886

SEQ ID NO: 493323 - RNA, 64 nt, Human; identical to SEQ ID NO: 162887

SEQ ID NO: 493324 - RNA, 64 nt, Human; identical to SEQ ID NO: 162888

SEQ ID NO: 493325 - RNA, 64 nt, Human; identical to SEQ ID NO: 162889

SEQ ID NO: 493326 - RNA, 64 nt, Human; identical to SEQ ID NO: 162890

SEQ ID NO: 493327 - RNA, 64 nt, Human; identical to SEQ ID NO: 162891

SEQ ID NO: 493328 - RNA, 64 nt, Human; identical to SEQ ID NO: 162892

SEQ ID NO: 493329 - RNA, 64 nt, Human; identical to SEQ ID NO: 162893

SEQ ID NO: 493330 - RNA, 64 nt, Human; identical to SEQ ID NO: 162894

SEQ ID NO: 493331 - RNA, 64 nt, Human; identical to SEQ ID NO: 162895

SEQ ID NO: 493332 - RNA, 64 nt, Human; identical to SEQ ID NO: 162896

SEQ ID NO: 493333 - RNA, 64 nt, Human
cucagcuggcggugacagccggcccagcguggcgccaccacacaccgcagagcuguccaggcac

SEQ ID NO: 493334 - RNA, 64 nt, Human
agggcagugcaagggagaaccugccagcccagccccaccacagggagagugcgucagcagaccu

SEQ ID NO: 493335 - RNA, 64 nt, Human
cagccucccgaguagcugggacuacaggcaccugccaccacacccggcuacuuuuuuauauuuu

SEQ ID NO: 493336 - RNA, 64 nt, Human; identical to SEQ ID NO: 162897

SEQ ID NO: 493337 - RNA, 64 nt, Human; identical to SEQ ID NO: 162898

SEQ ID NO: 493338 - RNA, 64 nt, Human; identical to SEQ ID NO: 162899

SEQ ID NO: 493339 - RNA, 64 nt, Human; identical to SEQ ID NO: 162900

SEQ ID NO: 493340 - RNA, 64 nt, Human; identical to SEQ ID NO: 162901

SEQ ID NO: 493341 - RNA, 64 nt, Human; identical to SEQ ID NO: 162902

SEQ ID NO: 493342 - RNA, 64 nt, Human; identical to SEQ ID NO: 162903

SEQ ID NO: 493343 - RNA, 64 nt, Human; identical to SEQ ID NO: 162904

SEQ ID NO: 493344 - RNA, 64 nt, Human; identical to SEQ ID NO: 162905

SEQ ID NO: 493345 - RNA, 64 nt, Human; identical to SEQ ID NO: 162906

SEQ ID NO: 493346 - RNA, 64 nt, Human; identical to SEQ ID NO: 162907

SEQ ID NO: 493347 - RNA, 64 nt, Human; identical to SEQ ID NO: 162908

SEQ ID NO: 493348 - RNA, 64 nt, Human; identical to SEQ ID NO: 162909

SEQ ID NO: 493349 - RNA, 64 nt, Human; identical to SEQ ID NO: 162910

SEQ ID NO: 493350 - RNA, 64 nt, Human
cagccucccauguggcugggacuauaggugcaugccaccacacccagcuaauuaaaaaaauuuu

SEQ ID NO: 493351 - RNA, 64 nt, Human
cagccuccugaguagcugggauuauaggcacacaccaccacacccagcuaaucuuuuuguauuu

SEQ ID NO: 493352 - RNA, 64 nt, Human
cagccucccaaagugcugggauuacacgcgugagccaccacacccagccuccaucuuuaaacuu

SEQ ID NO: 493353 - RNA, 64 nt, Human; identical to SEQ ID NO: 162911

SEQ ID NO: 493354 - RNA, 64 nt, Human; identical to SEQ ID NO: 162912

SEQ ID NO: 493355 - RNA, 64 nt, Human; identical to SEQ ID NO: 162913

SEQ ID NO: 493356 - RNA, 64 nt, Human; identical to SEQ ID NO: 162914

SEQ ID NO: 493357 - RNA, 64 nt, Human; identical to SEQ ID NO: 162915

SEQ ID NO: 493358 - RNA, 64 nt, Human; identical to SEQ ID NO: 162916

SEQ ID NO: 493359 - RNA, 64 nt, Human; identical to SEQ ID NO: 162917

SEQ ID NO: 493360 - RNA, 64 nt, Human; identical to SEQ ID NO: 162918

SEQ ID NO: 493361 - RNA, 64 nt, Human; identical to SEQ ID NO: 162919

SEQ ID NO: 493362 - RNA, 64 nt, Human; identical to SEQ ID NO: 162920

SEQ ID NO: 493363 - RNA, 64 nt, Human; identical to SEQ ID NO: 162921

SEQ ID NO: 493364 - RNA, 64 nt, Human; identical to SEQ ID NO: 162922

SEQ ID NO: 493365 - RNA, 64 nt, Human; identical to SEQ ID NO: 162923

SEQ ID NO: 493366 - RNA, 64 nt, Human; identical to SEQ ID NO: 162924

SEQ ID NO: 493367 - RNA, 64 nt, Human
ggcuugacggcuucucucuuuuuuuaaaucacccccaccacauaaaucucaaauccuauguugc

SEQ ID NO: 493368 - RNA, 64 nt, Human
gaaguguuuuaaaaauccauucuucgcaguguggccaccacaccgcccugagcccucccacggc

SEQ ID NO: 493369 - RNA, 64 nt, Human
cagccuccugaguagcugggacuacaggugugcaccaccacacccagccaaaacagccauccuc

SEQ ID NO: 493370 - RNA, 64 nt, Human; identical to SEQ ID NO: 162925

SEQ ID NO: 493371 - RNA, 64 nt, Human; identical to SEQ ID NO: 162926

SEQ ID NO: 493372 - RNA, 64 nt, Human; identical to SEQ ID NO: 162927

SEQ ID NO: 493373 - RNA, 64 nt, Human; identical to SEQ ID NO: 162928

SEQ ID NO: 493374 - RNA, 57 nt, Human; identical to SEQ ID NO: 162929

SEQ ID NO: 493375 - RNA, 64 nt, Human; identical to SEQ ID NO: 162930

SEQ ID NO: 493376 - RNA, 64 nt, Human; identical to SEQ ID NO: 162931

SEQ ID NO: 493377 - RNA, 64 nt, Human; identical to SEQ ID NO: 162932

SEQ ID NO: 493378 - RNA, 64 nt, Human; identical to SEQ ID NO: 162933

SEQ ID NO: 493379 - RNA, 64 nt, Human; identical to SEQ ID NO: 162934

SEQ ID NO: 493380 - RNA, 64 nt, Human; identical to SEQ ID NO: 162935

SEQ ID NO: 493381 - RNA, 64 nt, Human; identical to SEQ ID NO: 162936

SEQ ID NO: 493382 - RNA, 64 nt, Human; identical to SEQ ID NO: 162937

SEQ ID NO: 493383 - RNA, 64 nt, Human; identical to SEQ ID NO: 162938

SEQ ID NO: 493384 - RNA, 64 nt, Human
gguuaaugaacuucaggucccugcaacucagcccccaccacaaacacagcccuggaaacauaca

SEQ ID NO: 493385 - RNA, 64 nt, Human
cauaaucacuuugaacuuccaugaaaccugucuuccaccacaacaacccugggagagaaaaaca

SEQ ID NO: 493386 - RNA, 64 nt, Human
aaggugacaugacacaggcagagcagaguggcacccaccacagaauacaguguguguuauuacg

SEQ ID NO: 493387 - RNA, 64 nt, Human; identical to SEQ ID NO: 162939

SEQ ID NO: 493388 - RNA, 64 nt, Human; identical to SEQ ID NO: 162940

SEQ ID NO: 493389 - RNA, 64 nt, Human; identical to SEQ ID NO: 162941

SEQ ID NO: 493390 - RNA, 64 nt, Human; identical to SEQ ID NO: 162942

SEQ ID NO: 493391 - RNA, 64 nt, Human; identical to SEQ ID NO: 162943

SEQ ID NO: 493392 - RNA, 64 nt, Human; identical to SEQ ID NO: 162944

SEQ ID NO: 493393 - RNA, 64 nt, Human; identical to SEQ ID NO: 162945

SEQ ID NO: 493394 - RNA, 64 nt, Human; identical to SEQ ID NO: 162946

SEQ ID NO: 493395 - RNA, 64 nt, Human; identical to SEQ ID NO: 162947

SEQ ID NO: 493396 - RNA, 64 nt, Human; identical to SEQ ID NO: 162948

SEQ ID NO: 493397 - RNA, 64 nt, Human; identical to SEQ ID NO: 162949

SEQ ID NO: 493398 - RNA, 64 nt, Human; identical to SEQ ID NO: 162950

SEQ ID NO: 493399 - RNA, 64 nt, Human; identical to SEQ ID NO: 162951

SEQ ID NO: 493400 - RNA, 64 nt, Human; identical to SEQ ID NO: 162952

SEQ ID NO: 493401 - RNA, 64 nt, Human
uggcuucccaaaguccugggauuacaggugugagccaccacauccagccuaacuuacauucuua

SEQ ID NO: 493402 - RNA, 64 nt, Human
gaucugaccaguauuccccucucuucuccuugucccaccacauggacaugccuuacacuggcgu

SEQ ID NO: 493403 - RNA, 64 nt, Human
aaggagcaccuggccuuaggaauccuggcugccaccaccacaaggcuccccauuuggacauuac

SEQ ID NO: 493404 - RNA, 64 nt, Human; identical to SEQ ID NO: 162953

SEQ ID NO: 493405 - RNA, 64 nt, Human; identical to SEQ ID NO: 162954

SEQ ID NO: 493406 - RNA, 64 nt, Human; identical to SEQ ID NO: 162955

SEQ ID NO: 493407 - RNA, 64 nt, Human; identical to SEQ ID NO: 162956

SEQ ID NO: 493408 - RNA, 64 nt, Human; identical to SEQ ID NO: 162957

SEQ ID NO: 493409 - RNA, 64 nt, Human; identical to SEQ ID NO: 162958

SEQ ID NO: 493410 - RNA, 64 nt, Human; identical to SEQ ID NO: 162959

SEQ ID NO: 493411 - RNA, 64 nt, Human; identical to SEQ ID NO: 162960

SEQ ID NO: 493412 - RNA, 64 nt, Human; identical to SEQ ID NO: 162961

SEQ ID NO: 493413 - RNA, 64 nt, Human; identical to SEQ ID NO: 162962

SEQ ID NO: 493414 - RNA, 64 nt, Human; identical to SEQ ID NO: 162963

SEQ ID NO: 493415 - RNA, 64 nt, Human; identical to SEQ ID NO: 162964

SEQ ID NO: 493416 - RNA, 64 nt, Human; identical to SEQ ID NO: 162965

SEQ ID NO: 493417 - RNA, 64 nt, Human; identical to SEQ ID NO: 162966

SEQ ID NO: 493418 - RNA, 64 nt, Human
uagucucccaaguagcugggacuauaggcacgugccaccacacccggcuaauuuucauauuuuu

SEQ ID NO: 493419 - RNA, 64 nt, Human
ucuuuagaguuaggugccugccuaaagccaggcaccaccacaccuggcuuuagaguucacacaa

SEQ ID NO: 493420 - RNA, 64 nt, Human
cagccuccugaguagcugggauuacaggcacacgccaccacacgcagcuaauuuuuguauuuuu

SEQ ID NO: 493421 - RNA, 64 nt, Human; identical to SEQ ID NO: 162967

SEQ ID NO: 493422 - RNA, 64 nt, Human; identical to SEQ ID NO: 162968

SEQ ID NO: 493423 - RNA, 64 nt, Human; identical to SEQ ID NO: 162969

SEQ ID NO: 493424 - RNA, 64 nt, Human; identical to SEQ ID NO: 162970

SEQ ID NO: 493425 - RNA, 64 nt, Human; identical to SEQ ID NO: 162971

SEQ ID NO: 493426 - RNA, 64 nt, Human; identical to SEQ ID NO: 162972

SEQ ID NO: 493427 - RNA, 64 nt, Human; identical to SEQ ID NO: 162973

SEQ ID NO: 493428 - RNA, 64 nt, Human; identical to SEQ ID NO: 162974

SEQ ID NO: 493429 - RNA, 64 nt, Human; identical to SEQ ID NO: 162975

SEQ ID NO: 493430 - RNA, 64 nt, Human; identical to SEQ ID NO: 162976

SEQ ID NO: 493431 - RNA, 64 nt, Human; identical to SEQ ID NO: 162977

SEQ ID NO: 493432 - RNA, 64 nt, Human; identical to SEQ ID NO: 162978

SEQ ID NO: 493433 - RNA, 64 nt, Human; identical to SEQ ID NO: 162979

SEQ ID NO: 493434 - RNA, 64 nt, Human; identical to SEQ ID NO: 162980

SEQ ID NO: 493435 - RNA, 64 nt, Human
ggacuggggaaggggaggguguucagaggcagcaccaccacacagucaccccucccucccucuu

SEQ ID NO: 493436 - RNA, 64 nt, Human
ugcccaacacauuucugcuaauagggagagggacccaccacacacccacacaugccagaggucc

SEQ ID NO: 493437 - RNA, 64 nt, Human
uaucauagcuuugcucuuaccugaagccuuguccccaccacacaggacagccuuccuccugaag

SEQ ID NO: 493438 - RNA, 64 nt, Human; identical to SEQ ID NO: 162981

SEQ ID NO: 493439 - RNA, 64 nt, Human; identical to SEQ ID NO: 162982

SEQ ID NO: 493440 - RNA, 64 nt, Human; identical to SEQ ID NO: 162983

SEQ ID NO: 493441 - RNA, 64 nt, Human; identical to SEQ ID NO: 162984

SEQ ID NO: 493442 - RNA, 64 nt, Human; identical to SEQ ID NO: 162985

SEQ ID NO: 493443 - RNA, 64 nt, Human; identical to SEQ ID NO: 162986

SEQ ID NO: 493444 - RNA, 64 nt, Human; identical to SEQ ID NO: 162987

SEQ ID NO: 493445 - RNA, 64 nt, Human; identical to SEQ ID NO: 162988

SEQ ID NO: 493446 - RNA, 64 nt, Human; identical to SEQ ID NO: 162989

SEQ ID NO: 493447 - RNA, 64 nt, Human; identical to SEQ ID NO: 162990

SEQ ID NO: 493448 - RNA, 64 nt, Human; identical to SEQ ID NO: 162991

SEQ ID NO: 493449 - RNA, 64 nt, Human; identical to SEQ ID NO: 162992

SEQ ID NO: 493450 - RNA, 64 nt, Human; identical to SEQ ID NO: 162993

SEQ ID NO: 493451 - RNA, 64 nt, Human; identical to SEQ ID NO: 162994

SEQ ID NO: 493452 - RNA, 64 nt, Human
agcaggacugagggaacugcuggcucgccuggcaccaccacacggccacagccagccaucugcu

SEQ ID NO: 493453 - RNA, 64 nt, Human
gcccacccuguguacccagguccagaggguccguccaccacagcagccccagguggagggcugg

SEQ ID NO: 493454 - RNA, 64 nt, Human
ucagcuucccagauagcugggccacaggcgugugccaccacaccuggcuaacuuuuuuuuuuuu

SEQ ID NO: 493455 - RNA, 64 nt, Human; identical to SEQ ID NO: 162995

SEQ ID NO: 493456 - RNA, 64 nt, Human; identical to SEQ ID NO: 162996

SEQ ID NO: 493457 - RNA, 64 nt, Human; identical to SEQ ID NO: 162997

SEQ ID NO: 493458 - RNA, 64 nt, Human; identical to SEQ ID NO: 162998

SEQ ID NO: 493459 - RNA, 64 nt, Human; identical to SEQ ID NO: 162999

SEQ ID NO: 493460 - RNA, 64 nt, Human; identical to SEQ ID NO: 163000

SEQ ID NO: 493461 - RNA, 64 nt, Human; identical to SEQ ID NO: 163001

SEQ ID NO: 493462 - RNA, 64 nt, Human; identical to SEQ ID NO: 163002

SEQ ID NO: 493463 - RNA, 64 nt, Human; identical to SEQ ID NO: 163003

SEQ ID NO: 493464 - RNA, 64 nt, Human; identical to SEQ ID NO: 163004

SEQ ID NO: 493465 - RNA, 64 nt, Human; identical to SEQ ID NO: 163005

SEQ ID NO: 493466 - RNA, 64 nt, Human; identical to SEQ ID NO: 163006

SEQ ID NO: 493467 - RNA, 64 nt, Human; identical to SEQ ID NO: 163007

SEQ ID NO: 493468 - RNA, 64 nt, Human; identical to SEQ ID NO: 163008

SEQ ID NO: 493469 - RNA, 64 nt, Human
gucugcacaugauugaugcuuaaaauccaauauaccaccacauaucaaagguugggauuuucag

SEQ ID NO: 493470 - RNA, 64 nt, Human
gcugggguggauguugcuuccuccugguucugccccaccacaaaguuuucuguggcaagugcug

SEQ ID NO: 493471 - RNA, 64 nt, Human
uacaacugaccaaaguggcccccucuggggguccccaccacacaaguguuuguaaacugggcug

SEQ ID NO: 493472 - RNA, 64 nt, Human; identical to SEQ ID NO: 163009

SEQ ID NO: 493473 - RNA, 64 nt, Human; identical to SEQ ID NO: 163010

SEQ ID NO: 493474 - RNA, 64 nt, Human; identical to SEQ ID NO: 163011

SEQ ID NO: 493475 - RNA, 64 nt, Human; identical to SEQ ID NO: 163012

SEQ ID NO: 493476 - RNA, 64 nt, Human; identical to SEQ ID NO: 163013

SEQ ID NO: 493477 - RNA, 64 nt, Human; identical to SEQ ID NO: 163014

SEQ ID NO: 493478 - RNA, 64 nt, Human; identical to SEQ ID NO: 163015

SEQ ID NO: 493479 - RNA, 64 nt, Human; identical to SEQ ID NO: 163016

SEQ ID NO: 493480 - RNA, 64 nt, Human; identical to SEQ ID NO: 163017

SEQ ID NO: 493481 - RNA, 64 nt, Human; identical to SEQ ID NO: 163018

SEQ ID NO: 493482 - RNA, 64 nt, Human; identical to SEQ ID NO: 163019

SEQ ID NO: 493483 - RNA, 64 nt, Human; identical to SEQ ID NO: 163020

SEQ ID NO: 493484 - RNA, 64 nt, Human; identical to SEQ ID NO: 163021

SEQ ID NO: 493485 - RNA, 64 nt, Human; identical to SEQ ID NO: 163022

SEQ ID NO: 493486 - RNA, 64 nt, Human
cugucucccaaagugcuaggauuacaggugugagccaccacaccuggcccauaguuguauuuuu

SEQ ID NO: 493487 - RNA, 64 nt, Human
cacuuccggauggagggagagguugugcugaccaccaccacacuggcacaggcgggagccuucu

SEQ ID NO: 493488 - RNA, 64 nt, Human
uguccccagaggcugaggagaggggguacugugcccaccacacaugauuaggccucagacccaa

SEQ ID NO: 493489 - RNA, 64 nt, Human; identical to SEQ ID NO: 163023

SEQ ID NO: 493490 - RNA, 64 nt, Human; identical to SEQ ID NO: 163024

SEQ ID NO: 493491 - RNA, 64 nt, Human; identical to SEQ ID NO: 163025

SEQ ID NO: 493492 - RNA, 64 nt, Human; identical to SEQ ID NO: 163026

SEQ ID NO: 493493 - RNA, 64 nt, Human; identical to SEQ ID NO: 163027

SEQ ID NO: 493494 - RNA, 64 nt, Human; identical to SEQ ID NO: 163028

SEQ ID NO: 493495 - RNA, 64 nt, Human; identical to SEQ ID NO: 163029

SEQ ID NO: 493496 - RNA, 64 nt, Human; identical to SEQ ID NO: 163030

SEQ ID NO: 493497 - RNA, 64 nt, Human; identical to SEQ ID NO: 163031

SEQ ID NO: 493498 - RNA, 64 nt, Human; identical to SEQ ID NO: 163032

SEQ ID NO: 493499 - RNA, 64 nt, Human; identical to SEQ ID NO: 163033

SEQ ID NO: 493500 - RNA, 64 nt, Human; identical to SEQ ID NO: 163034

SEQ ID NO: 493501 - RNA, 64 nt, Human; identical to SEQ ID NO: 163035

SEQ ID NO: 493502 - RNA, 64 nt, Human; identical to SEQ ID NO: 163036

SEQ ID NO: 493503 - RNA, 64 nt, Human
auguggacgcccuccguccugcagucuugccagcccaccacagccacuguagaccacaggcagg

SEQ ID NO: 493504 - RNA, 64 nt, Human
cuugcaggucuccauaaauugucuuugggggauuccaccacacccaaugcucuggagccacaag

SEQ ID NO: 493505 - RNA, 64 nt, Human
gggacuccaaaagugcuggguuuacaggcaugagccaccacacccagcuccucccccucaaacu

SEQ ID NO: 493506 - RNA, 64 nt, Human; identical to SEQ ID NO: 163037

SEQ ID NO: 493507 - RNA, 64 nt, Human; identical to SEQ ID NO: 163038

SEQ ID NO: 493508 - RNA, 64 nt, Human; identical to SEQ ID NO: 163039

SEQ ID NO: 493509 - RNA, 64 nt, Human; identical to SEQ ID NO: 163040

SEQ ID NO: 493510 - RNA, 64 nt, Human; identical to SEQ ID NO: 163041

SEQ ID NO: 493511 - RNA, 64 nt, Human; identical to SEQ ID NO: 163042

SEQ ID NO: 493512 - RNA, 64 nt, Human; identical to SEQ ID NO: 163043

SEQ ID NO: 493513 - RNA, 64 nt, Human; identical to SEQ ID NO: 163044

SEQ ID NO: 493514 - RNA, 64 nt, Human; identical to SEQ ID NO: 163045

SEQ ID NO: 493515 - RNA, 64 nt, Human; identical to SEQ ID NO: 163046

SEQ ID NO: 493516 - RNA, 64 nt, Human; identical to SEQ ID NO: 163047

SEQ ID NO: 493517 - RNA, 64 nt, Human; identical to SEQ ID NO: 163048

SEQ ID NO: 493518 - RNA, 64 nt, Human; identical to SEQ ID NO: 163049

SEQ ID NO: 493519 - RNA, 64 nt, Human; identical to SEQ ID NO: 163050

SEQ ID NO: 493520 - RNA, 64 nt, Human
aaaaacaggaaaaaaagaaccauacaaaauuuuuccaccacacauacccucuaagccagcaaga

SEQ ID NO: 493521 - RNA, 64 nt, Human
guggcacaucuggagggcagggguugaggggccaccaccacacaugccuuucuggggugaagcc

SEQ ID NO: 493522 - RNA, 64 nt, Human
cccuggcccacccuggggucugagccugcugggcccaccacauggaaucacuagcuuggguugu

SEQ ID NO: 493523 - RNA, 64 nt, Human; identical to SEQ ID NO: 163051

SEQ ID NO: 493524 - RNA, 64 nt, Human; identical to SEQ ID NO: 163052

SEQ ID NO: 493525 - RNA, 64 nt, Human; identical to SEQ ID NO: 163053

SEQ ID NO: 493526 - RNA, 64 nt, Human; identical to SEQ ID NO: 163054

SEQ ID NO: 493527 - RNA, 64 nt, Human; identical to SEQ ID NO: 163055

SEQ ID NO: 493528 - RNA, 64 nt, Human; identical to SEQ ID NO: 163056

SEQ ID NO: 493529 - RNA, 64 nt, Human; identical to SEQ ID NO: 163057

SEQ ID NO: 493530 - RNA, 64 nt, Human; identical to SEQ ID NO: 163058

SEQ ID NO: 493531 - RNA, 64 nt, Human; identical to SEQ ID NO: 163059

SEQ ID NO: 493532 - RNA, 64 nt, Human; identical to SEQ ID NO: 163060

SEQ ID NO: 493533 - RNA, 64 nt, Human; identical to SEQ ID NO: 163061

SEQ ID NO: 493534 - RNA, 64 nt, Human; identical to SEQ ID NO: 163062

SEQ ID NO: 493535 - RNA, 64 nt, Human; identical to SEQ ID NO: 163063

SEQ ID NO: 493536 - RNA, 64 nt, Human; identical to SEQ ID NO: 163064

SEQ ID NO: 493537 - RNA, 64 nt, Human
uugauuguuuucaauuucuucuuuuauguucacaccaccacauucccauucacuuugauuuucu

SEQ ID NO: 493538 - RNA, 64 nt, Human
cugucuccauuccauaaaucucuuccugugugagccaccacacccagccugggucucucuacuu

SEQ ID NO: 493539 - RNA, 64 nt, Human
cagccucccgaauagcuggaauuacgggcaugcaccaccacaccuggcuaauuuuuguauuuuu

SEQ ID NO: 493540 - RNA, 64 nt, Human; identical to SEQ ID NO: 163065

SEQ ID NO: 493541 - RNA, 64 nt, Human; identical to SEQ ID NO: 163066

SEQ ID NO: 493542 - RNA, 64 nt, Human; identical to SEQ ID NO: 163067

SEQ ID NO: 493543 - RNA, 60 nt, Human; identical to SEQ ID NO: 163068

SEQ ID NO: 493544 - RNA, 64 nt, Human; identical to SEQ ID NO: 163069

SEQ ID NO: 493545 - RNA, 64 nt, Human; identical to SEQ ID NO: 163070

SEQ ID NO: 493546 - RNA, 64 nt, Human; identical to SEQ ID NO: 163071

SEQ ID NO: 493547 - RNA, 64 nt, Human; identical to SEQ ID NO: 163072

SEQ ID NO: 493548 - RNA, 64 nt, Human; identical to SEQ ID NO: 163073

SEQ ID NO: 493549 - RNA, 64 nt, Human; identical to SEQ ID NO: 163074

SEQ ID NO: 493550 - RNA, 64 nt, Human; identical to SEQ ID NO: 163075

SEQ ID NO: 493551 - RNA, 64 nt, Human; identical to SEQ ID NO: 163076

SEQ ID NO: 493552 - RNA, 64 nt, Human; identical to SEQ ID NO: 163077

SEQ ID NO: 493553 - RNA, 64 nt, Human; identical to SEQ ID NO: 163078

SEQ ID NO: 493554 - RNA, 64 nt, Human
cccgcgccgcggccggccgccaggccuccccaugccaccacaaaggcccuuuuaagggccacca

SEQ ID NO: 493555 - RNA, 64 nt, Human
ggugguucuuccuguucugugacuguguauagugccaccacagcuuauggcaucucauugagga

SEQ ID NO: 493556 - RNA, 64 nt, Human
ugucuugacaucacccuacccaggcggugggucuccaccacagccacuuugagucugugguccc

SEQ ID NO: 493557 - RNA, 64 nt, Human; identical to SEQ ID NO: 163079

SEQ ID NO: 493558 - RNA, 64 nt, Human; identical to SEQ ID NO: 163080

SEQ ID NO: 493559 - RNA, 64 nt, Human; identical to SEQ ID NO: 163081

SEQ ID NO: 493560 - RNA, 64 nt, Human; identical to SEQ ID NO: 163082

SEQ ID NO: 493561 - RNA, 64 nt, Human; identical to SEQ ID NO: 163083

SEQ ID NO: 493562 - RNA, 64 nt, Human; identical to SEQ ID NO: 163084

SEQ ID NO: 493563 - RNA, 64 nt, Human; identical to SEQ ID NO: 163085

SEQ ID NO: 493564 - RNA, 64 nt, Human; identical to SEQ ID NO: 163086

SEQ ID NO: 493565 - RNA, 52 nt, Human; identical to SEQ ID NO: 163087

SEQ ID NO: 493566 - RNA, 64 nt, Human; identical to SEQ ID NO: 163088

SEQ ID NO: 493567 - RNA, 64 nt, Human; identical to SEQ ID NO: 163089

SEQ ID NO: 493568 - RNA, 64 nt, Human; identical to SEQ ID NO: 163090

SEQ ID NO: 493569 - RNA, 64 nt, Human; identical to SEQ ID NO: 163091

SEQ ID NO: 493570 - RNA, 64 nt, Human; identical to SEQ ID NO: 163092

SEQ ID NO: 493571 - RNA, 64 nt, Human
cccagucuguucccugcucccucgcuggcaagccccaccacacaggagugaggccaggggcuag

SEQ ID NO: 493572 - RNA, 64 nt, Human
ucacugcuggggagucccugccacacucagucccccaccacacugaaucuccccuccucacagu

SEQ ID NO: 493573 - RNA, 64 nt, Human
uggccuucagaccugaucagacucccaggggcagccaccacauguaugacagagaacagaggau

SEQ ID NO: 493574 - RNA, 64 nt, Human; identical to SEQ ID NO: 163093

SEQ ID NO: 493575 - RNA, 64 nt, Human; identical to SEQ ID NO: 163094

SEQ ID NO: 493576 - RNA, 64 nt, Human; identical to SEQ ID NO: 163095

SEQ ID NO: 493577 - RNA, 64 nt, Human; identical to SEQ ID NO: 163096

SEQ ID NO: 493578 - RNA, 64 nt, Human; identical to SEQ ID NO: 163097

SEQ ID NO: 493579 - RNA, 64 nt, Human; identical to SEQ ID NO: 163098

SEQ ID NO: 493580 - RNA, 54 nt, Human; identical to SEQ ID NO: 163099

SEQ ID NO: 493581 - RNA, 64 nt, Human; identical to SEQ ID NO: 163100

SEQ ID NO: 493582 - RNA, 64 nt, Human; identical to SEQ ID NO: 163101

SEQ ID NO: 493583 - RNA, 64 nt, Human; identical to SEQ ID NO: 163102

SEQ ID NO: 493584 - RNA, 64 nt, Human; identical to SEQ ID NO: 163103

SEQ ID NO: 493585 - RNA, 64 nt, Human; identical to SEQ ID NO: 163104

SEQ ID NO: 493586 - RNA, 64 nt, Human; identical to SEQ ID NO: 163105

SEQ ID NO: 493587 - RNA, 64 nt, Human; identical to SEQ ID NO: 163106

SEQ ID NO: 493588 - RNA, 64 nt, Human
uccucuuuuaacgucugucuuguucucuuuuuacccaccacauauguauaacuaugugaaaaau

SEQ ID NO: 493589 - RNA, 64 nt, Human
gauccugaacugucaagccacuggcagccucaugccaccacauuugccagaaaugcaguugccc

SEQ ID NO: 493590 - RNA, 64 nt, Human
cagcuccccaaguagcugggacuagaggcaugcgccaccacacccggcuaauuuuuguauuuuc

SEQ ID NO: 493591 - RNA, 64 nt, Human; identical to SEQ ID NO: 163107

SEQ ID NO: 493592 - RNA, 64 nt, Human; identical to SEQ ID NO: 163108

SEQ ID NO: 493593 - RNA, 64 nt, Human; identical to SEQ ID NO: 163109

SEQ ID NO: 493594 - RNA, 64 nt, Human; identical to SEQ ID NO: 163110

SEQ ID NO: 493595 - RNA, 64 nt, Human; identical to SEQ ID NO: 163111

SEQ ID NO: 493596 - RNA, 64 nt, Human; identical to SEQ ID NO: 163112

SEQ ID NO: 493597 - RNA, 64 nt, Human; identical to SEQ ID NO: 163113

SEQ ID NO: 493598 - RNA, 64 nt, Human; identical to SEQ ID NO: 163114

SEQ ID NO: 493599 - RNA, 64 nt, Human; identical to SEQ ID NO: 163115

SEQ ID NO: 493600 - RNA, 64 nt, Human; identical to SEQ ID NO: 163116

SEQ ID NO: 493601 - RNA, 64 nt, Human; identical to SEQ ID NO: 163117

SEQ ID NO: 493602 - RNA, 64 nt, Human; identical to SEQ ID NO: 163118

SEQ ID NO: 493603 - RNA, 64 nt, Human; identical to SEQ ID NO: 163119

SEQ ID NO: 493604 - RNA, 64 nt, Human; identical to SEQ ID NO: 163120

SEQ ID NO: 493605 - RNA, 64 nt, Human
cugcuggugguaucuauggaaaugaugaaguuacccaccacauuaaaacaaaagucugagaugg

SEQ ID NO: 493606 - RNA, 64 nt, Human
cagccucccaauuagcuuggccuacagucaucugccaccacaccuggcuaauuuuuuguacuuu

SEQ ID NO: 493607 - RNA, 64 nt, Human
cagccucccaaguagcugagacuacaggcacgagccaccacacccagcuaauuuuuaaguuuuc

SEQ ID NO: 493608 - RNA, 64 nt, Human; identical to SEQ ID NO: 163121

SEQ ID NO: 493609 - RNA, 64 nt, Human; identical to SEQ ID NO: 163122

SEQ ID NO: 493610 - RNA, 64 nt, Human; identical to SEQ ID NO: 163123

SEQ ID NO: 493611 - RNA, 61 nt, Human; identical to SEQ ID NO: 163124

SEQ ID NO: 493612 - RNA, 64 nt, Human; identical to SEQ ID NO: 163125

SEQ ID NO: 493613 - RNA, 64 nt, Human; identical to SEQ ID NO: 163126

SEQ ID NO: 493614 - RNA, 64 nt, Human; identical to SEQ ID NO: 163127

SEQ ID NO: 493615 - RNA, 64 nt, Human; identical to SEQ ID NO: 163128

SEQ ID NO: 493616 - RNA, 64 nt, Human; identical to SEQ ID NO: 163129

SEQ ID NO: 493617 - RNA, 64 nt, Human; identical to SEQ ID NO: 163130

SEQ ID NO: 493618 - RNA, 64 nt, Human; identical to SEQ ID NO: 163131

SEQ ID NO: 493619 - RNA, 64 nt, Human; identical to SEQ ID NO: 163132

SEQ ID NO: 493620 - RNA, 64 nt, Human; identical to SEQ ID NO: 163133

SEQ ID NO: 493621 - RNA, 64 nt, Human; identical to SEQ ID NO: 163134

SEQ ID NO: 493622 - RNA, 64 nt, Human
uugcauccuucuuccugagccaacugcuugggcaccaccacagcgucuucuauagcucggugga

SEQ ID NO: 493623 - RNA, 64 nt, Human
cagguggcaggucgcaguuggguaccuuccauucccaccacacagacucugggccuccccgcaa

SEQ ID NO: 493624 - RNA, 64 nt, Human
ucaaagaacagagaggaggaggagggagaaauggccaccacaucaccccagagaaauuucugga

SEQ ID NO: 493625 - RNA, 64 nt, Human; identical to SEQ ID NO: 163135

SEQ ID NO: 493626 - RNA, 64 nt, Human; identical to SEQ ID NO: 163136

SEQ ID NO: 493627 - RNA, 64 nt, Human; identical to SEQ ID NO: 163137

SEQ ID NO: 493628 - RNA, 64 nt, Human; identical to SEQ ID NO: 163138

SEQ ID NO: 493629 - RNA, 64 nt, Human; identical to SEQ ID NO: 163139

SEQ ID NO: 493630 - RNA, 64 nt, Human; identical to SEQ ID NO: 163140

SEQ ID NO: 493631 - RNA, 64 nt, Human; identical to SEQ ID NO: 163141

SEQ ID NO: 493632 - RNA, 64 nt, Human; identical to SEQ ID NO: 163142

SEQ ID NO: 493633 - RNA, 64 nt, Human; identical to SEQ ID NO: 163143

SEQ ID NO: 493634 - RNA, 64 nt, Human; identical to SEQ ID NO: 163144

SEQ ID NO: 493635 - RNA, 64 nt, Human; identical to SEQ ID NO: 163145

SEQ ID NO: 493636 - RNA, 64 nt, Human; identical to SEQ ID NO: 163146

SEQ ID NO: 493637 - RNA, 64 nt, Human; identical to SEQ ID NO: 163147

SEQ ID NO: 493638 - RNA, 64 nt, Human; identical to SEQ ID NO: 163148

SEQ ID NO: 493639 - RNA, 64 nt, Human
gccccccacccacccugcaccccucgcccuccccccaccacagaaucuaagaccuuucagcuuc

SEQ ID NO: 493640 - RNA, 64 nt, Human
gcagagacuagcagcggggccaccuccacaaccaccaccacaagguaggugcagcguccaccgc

SEQ ID NO: 493641 - RNA, 64 nt, Human
augacuaucaggccaugugcaaacccucgagucaccaccacagugcagcccagccccuggucag

SEQ ID NO: 493642 - RNA, 64 nt, Human; identical to SEQ ID NO: 163149

SEQ ID NO: 493643 - RNA, 64 nt, Human; identical to SEQ ID NO: 163150

SEQ ID NO: 493644 - RNA, 64 nt, Human; identical to SEQ ID NO: 163151

SEQ ID NO: 493645 - RNA, 64 nt, Human; identical to SEQ ID NO: 163152

SEQ ID NO: 493646 - RNA, 64 nt, Human; identical to SEQ ID NO: 163153

SEQ ID NO: 493647 - RNA, 64 nt, Human; identical to SEQ ID NO: 163154

SEQ ID NO: 493648 - RNA, 64 nt, Human; identical to SEQ ID NO: 163155

SEQ ID NO: 493649 - RNA, 64 nt, Human; identical to SEQ ID NO: 163156

SEQ ID NO: 493650 - RNA, 64 nt, Human; identical to SEQ ID NO: 163157

SEQ ID NO: 493651 - RNA, 64 nt, Human; identical to SEQ ID NO: 163158

SEQ ID NO: 493652 - RNA, 64 nt, Human; identical to SEQ ID NO: 163159

SEQ ID NO: 493653 - RNA, 64 nt, Human; identical to SEQ ID NO: 163160

SEQ ID NO: 493654 - RNA, 64 nt, Human; identical to SEQ ID NO: 163161

SEQ ID NO: 493655 - RNA, 64 nt, Human; identical to SEQ ID NO: 163162

SEQ ID NO: 493656 - RNA, 64 nt, Human
ugauucguuuauggguaguaccgggaugaacccaccaccacaaagcaaauuagacaacuuaaug

SEQ ID NO: 493657 - RNA, 64 nt, Human
cagccucccaaguagcugggauuacagucaggcaccaccacacccggcuaauuuuguauuuuuu

SEQ ID NO: 493658 - RNA, 64 nt, Human
uggccucccaaagugcugggauuacagaugugagccaccacaccuggccccaagcuugaauuuu

SEQ ID NO: 493659 - RNA, 64 nt, Human; identical to SEQ ID NO: 163163

SEQ ID NO: 493660 - RNA, 64 nt, Human; identical to SEQ ID NO: 163164

SEQ ID NO: 493661 - RNA, 64 nt, Human; identical to SEQ ID NO: 163165

SEQ ID NO: 493662 - RNA, 64 nt, Human; identical to SEQ ID NO: 163166

SEQ ID NO: 493663 - RNA, 64 nt, Human; identical to SEQ ID NO: 163167

SEQ ID NO: 493664 - RNA, 64 nt, Human; identical to SEQ ID NO: 163168

SEQ ID NO: 493665 - RNA, 64 nt, Human; identical to SEQ ID NO: 163169

SEQ ID NO: 493666 - RNA, 64 nt, Human; identical to SEQ ID NO: 163170

SEQ ID NO: 493667 - RNA, 64 nt, Human; identical to SEQ ID NO: 163171

SEQ ID NO: 493668 - RNA, 64 nt, Human; identical to SEQ ID NO: 163172

SEQ ID NO: 493669 - RNA, 64 nt, Human; identical to SEQ ID NO: 163173

SEQ ID NO: 493670 - RNA, 64 nt, Human; identical to SEQ ID NO: 163174

SEQ ID NO: 493671 - RNA, 55 nt, Human; identical to SEQ ID NO: 163175

SEQ ID NO: 493672 - RNA, 64 nt, Human; identical to SEQ ID NO: 163176

SEQ ID NO: 493673 - RNA, 64 nt, Human
aaaggcaauucagauauccccaaggcugccucucccaccacaagcccagaguggaugggcuggg

SEQ ID NO: 493674 - RNA, 64 nt, Human
cggccucccaaagugcugggauuacaggcaugagccaccacagcuggcccccuucuguuuuaug

SEQ ID NO: 493675 - RNA, 64 nt, Human
cagccuccuaaguaucugggauuacaggcaugugccaccacaccugggugauuuuuguauuuuu

SEQ ID NO: 493676 - RNA, 64 nt, Human; identical to SEQ ID NO: 163177

SEQ ID NO: 493677 - RNA, 64 nt, Human; identical to SEQ ID NO: 163178

SEQ ID NO: 493678 - RNA, 64 nt, Human; identical to SEQ ID NO: 163179

SEQ ID NO: 493679 - RNA, 64 nt, Human; identical to SEQ ID NO: 163180

SEQ ID NO: 493680 - RNA, 64 nt, Human; identical to SEQ ID NO: 163181

SEQ ID NO: 493681 - RNA, 64 nt, Human; identical to SEQ ID NO: 163182

SEQ ID NO: 493682 - RNA, 64 nt, Human; identical to SEQ ID NO: 163183

SEQ ID NO: 493683 - RNA, 64 nt, Human; identical to SEQ ID NO: 163184

SEQ ID NO: 493684 - RNA, 64 nt, Human; identical to SEQ ID NO: 163185

SEQ ID NO: 493685 - RNA, 64 nt, Human; identical to SEQ ID NO: 163186

SEQ ID NO: 493686 - RNA, 64 nt, Human; identical to SEQ ID NO: 163187

SEQ ID NO: 493687 - RNA, 64 nt, Human; identical to SEQ ID NO: 163188

SEQ ID NO: 493688 - RNA, 64 nt, Human; identical to SEQ ID NO: 163189

SEQ ID NO: 493689 - RNA, 64 nt, Human; identical to SEQ ID NO: 163190

SEQ ID NO: 493690 - RNA, 64 nt, Human
aaaaaaagucuguguauaauuuuugugauaucugccaccacagauaagcaaaaaaguccuugca

SEQ ID NO: 493691 - RNA, 64 nt, Human
ucagccucccuaguagcugggacuacagcacccaccaccacacccagcuaauuuuuguauuuuu

SEQ ID NO: 493692 - RNA, 64 nt, Human
gcccucauggaccugaccacucaacaaacaguccccaccacaccuaucuccuuaggcaagacuu

SEQ ID NO: 493693 - RNA, 64 nt, Human; identical to SEQ ID NO: 163191

SEQ ID NO: 493694 - RNA, 64 nt, Human; identical to SEQ ID NO: 163192

SEQ ID NO: 493695 - RNA, 64 nt, Human; identical to SEQ ID NO: 163193

SEQ ID NO: 493696 - RNA, 64 nt, Human; identical to SEQ ID NO: 163194

SEQ ID NO: 493697 - RNA, 64 nt, Human; identical to SEQ ID NO: 163195

SEQ ID NO: 493698 - RNA, 64 nt, Human; identical to SEQ ID NO: 163196

SEQ ID NO: 493699 - RNA, 64 nt, Human; identical to SEQ ID NO: 163197

SEQ ID NO: 493700 - RNA, 64 nt, Human; identical to SEQ ID NO: 163198

SEQ ID NO: 493701 - RNA, 64 nt, Human; identical to SEQ ID NO: 163199

SEQ ID NO: 493702 - RNA, 64 nt, Human; identical to SEQ ID NO: 163200

SEQ ID NO: 493703 - RNA, 64 nt, Human; identical to SEQ ID NO: 163201

SEQ ID NO: 493704 - RNA, 64 nt, Human; identical to SEQ ID NO: 163202

SEQ ID NO: 493705 - RNA, 64 nt, Human; identical to SEQ ID NO: 163203

SEQ ID NO: 493706 - RNA, 64 nt, Human; identical to SEQ ID NO: 163204

SEQ ID NO: 493707 - RNA, 64 nt, Human
cagacuuaagaacguggauaugaagugccuagaaccaccacaaccuggcugugcgucugucccu

SEQ ID NO: 493708 - RNA, 64 nt, Human
caggaggcggagguugcagugagcugagaugccaccaccacaccagccugggugacagagugaa

SEQ ID NO: 493709 - RNA, 64 nt, Human
uccuccagcaagucuguccccaccuugucguccuccaccacacacugaaucuguagcuuccgga

SEQ ID NO: 493710 - RNA, 56 nt, Human; identical to SEQ ID NO: 163205

SEQ ID NO: 493711 - RNA, 64 nt, Human; identical to SEQ ID NO: 163206

SEQ ID NO: 493712 - RNA, 64 nt, Human; identical to SEQ ID NO: 163207

SEQ ID NO: 493713 - RNA, 64 nt, Human; identical to SEQ ID NO: 163208

SEQ ID NO: 493714 - RNA, 64 nt, Human; identical to SEQ ID NO: 163209

SEQ ID NO: 493715 - RNA, 64 nt, Human; identical to SEQ ID NO: 163210

SEQ ID NO: 493716 - RNA, 64 nt, Human; identical to SEQ ID NO: 163211

SEQ ID NO: 493717 - RNA, 64 nt, Human; identical to SEQ ID NO: 163212

SEQ ID NO: 493718 - RNA, 64 nt, Human; identical to SEQ ID NO: 163213

SEQ ID NO: 493719 - RNA, 64 nt, Human; identical to SEQ ID NO: 163214

SEQ ID NO: 493720 - RNA, 64 nt, Human; identical to SEQ ID NO: 163215

SEQ ID NO: 493721 - RNA, 64 nt, Human; identical to SEQ ID NO: 163216

SEQ ID NO: 493722 - RNA, 64 nt, Human; identical to SEQ ID NO: 163217

SEQ ID NO: 493723 - RNA, 64 nt, Human; identical to SEQ ID NO: 163218

SEQ ID NO: 493724 - RNA, 64 nt, Human
gaggagggggcugugaguccucagaggcccugggccaccacauuucuggcagcguuucccagac

SEQ ID NO: 493725 - RNA, 64 nt, Human
gaaacgcugcucgccccacaccccguccugccucccaccacacuuacacacacgggacuguggc

SEQ ID NO: 493726 - RNA, 64 nt, Human
cucagcugaugucacagugcagacauccaccguuccaccacagaaccaguggcugagcggacca

SEQ ID NO: 493727 - RNA, 64 nt, Human; identical to SEQ ID NO: 163219

SEQ ID NO: 493728 - RNA, 64 nt, Human; identical to SEQ ID NO: 163220

SEQ ID NO: 493729 - RNA, 64 nt, Human; identical to SEQ ID NO: 163221

SEQ ID NO: 493730 - RNA, 64 nt, Human; identical to SEQ ID NO: 163222

SEQ ID NO: 493731 - RNA, 64 nt, Human; identical to SEQ ID NO: 163223

SEQ ID NO: 493732 - RNA, 64 nt, Human; identical to SEQ ID NO: 163224

SEQ ID NO: 493733 - RNA, 64 nt, Human; identical to SEQ ID NO: 163225

SEQ ID NO: 493734 - RNA, 64 nt, Human; identical to SEQ ID NO: 163226

SEQ ID NO: 493735 - RNA, 64 nt, Human; identical to SEQ ID NO: 163227

SEQ ID NO: 493736 - RNA, 64 nt, Human; identical to SEQ ID NO: 163228

SEQ ID NO: 493737 - RNA, 64 nt, Human; identical to SEQ ID NO: 163229

SEQ ID NO: 493738 - RNA, 64 nt, Human; identical to SEQ ID NO: 163230

SEQ ID NO: 493739 - RNA, 64 nt, Human; identical to SEQ ID NO: 163231

SEQ ID NO: 493740 - RNA, 64 nt, Human; identical to SEQ ID NO: 163232

SEQ ID NO: 493741 - RNA, 64 nt, Human
ugaguucuuccauuucaaagacucacuucuauaaccaccacaaguugaaucaaaauuuccaaau

SEQ ID NO: 493742 - RNA, 64 nt, Human
ugaguucuuccauuucaaagacucacuucuauaaccaccacaaguugaaucaaaauuuucaaau

SEQ ID NO: 493743 - RNA, 64 nt, Human
caccagcucagccacagcagagccaaucacagacccaccacacagcccagcagcccuucgugaa

SEQ ID NO: 493744 - RNA, 53 nt, Human; identical to SEQ ID NO: 163233

SEQ ID NO: 493745 - RNA, 64 nt, Human; identical to SEQ ID NO: 163234

SEQ ID NO: 493746 - RNA, 64 nt, Human; identical to SEQ ID NO: 163235

SEQ ID NO: 493747 - RNA, 64 nt, Human; identical to SEQ ID NO: 163236

SEQ ID NO: 493748 - RNA, 64 nt, Human; identical to SEQ ID NO: 163237

SEQ ID NO: 493749 - RNA, 64 nt, Human; identical to SEQ ID NO: 163238

SEQ ID NO: 493750 - RNA, 64 nt, Human; identical to SEQ ID NO: 163239

SEQ ID NO: 493751 - RNA, 64 nt, Human; identical to SEQ ID NO: 163240

SEQ ID NO: 493752 - RNA, 64 nt, Human; identical to SEQ ID NO: 163241

SEQ ID NO: 493753 - RNA, 64 nt, Human; identical to SEQ ID NO: 163242

SEQ ID NO: 493754 - RNA, 64 nt, Human; identical to SEQ ID NO: 163243

SEQ ID NO: 493755 - RNA, 64 nt, Human; identical to SEQ ID NO: 163244

SEQ ID NO: 493756 - RNA, 64 nt, Human; identical to SEQ ID NO: 163245

SEQ ID NO: 493757 - RNA, 64 nt, Human; identical to SEQ ID NO: 163246

SEQ ID NO: 493758 - RNA, 64 nt, Human
gcaaagagggaguuccugacugcuagaggugccaccaccacaaacacuuuuuauucaggagaua

SEQ ID NO: 493759 - RNA, 64 nt, Human
cuguuccugagauggaaagcacaaauuuaauacaccaccacaauggaaaacaaguucaaagacu

SEQ ID NO: 493760 - RNA, 64 nt, Human
gcucuaggcaugcagacaaccccacacggccacaccaccacaugcccaaguguacacacacaga

SEQ ID NO: 493761 - RNA, 64 nt, Human; identical to SEQ ID NO: 163247

SEQ ID NO: 493762 - RNA, 64 nt, Human; identical to SEQ ID NO: 163248

SEQ ID NO: 493763 - RNA, 64 nt, Human; identical to SEQ ID NO: 163249

SEQ ID NO: 493764 - RNA, 64 nt, Human; identical to SEQ ID NO: 163250

SEQ ID NO: 493765 - RNA, 64 nt, Human; identical to SEQ ID NO: 163251

SEQ ID NO: 493766 - RNA, 64 nt, Human; identical to SEQ ID NO: 163252

SEQ ID NO: 493767 - RNA, 64 nt, Human; identical to SEQ ID NO: 163253

SEQ ID NO: 493768 - RNA, 64 nt, Human; identical to SEQ ID NO: 163254

SEQ ID NO: 493769 - RNA, 64 nt, Human; identical to SEQ ID NO: 163255

SEQ ID NO: 493770 - RNA, 64 nt, Human; identical to SEQ ID NO: 163256

SEQ ID NO: 493771 - RNA, 64 nt, Human; identical to SEQ ID NO: 163257

SEQ ID NO: 493772 - RNA, 64 nt, Human; identical to SEQ ID NO: 163258

SEQ ID NO: 493773 - RNA, 64 nt, Human; identical to SEQ ID NO: 163259

SEQ ID NO: 493774 - RNA, 64 nt, Human; identical to SEQ ID NO: 163260

SEQ ID NO: 493775 - RNA, 64 nt, Human
gggaaaaagagccuguuuuuaacuuccuugcuauccaccacaaaauaagcaauuauuuucuuua

SEQ ID NO: 493776 - RNA, 64 nt, Human
ccauggaaguuuccucacaaagucagcuccucucccaccacaggcucacacugcccuuacuuua

SEQ ID NO: 493777 - RNA, 64 nt, Human
cagccuccugaguagcugggauuacaggcacacaccaccacaccuggcccagcuaauucuuuuu

SEQ ID NO: 493778 - RNA, 64 nt, Human; identical to SEQ ID NO: 163261

SEQ ID NO: 493779 - RNA, 64 nt, Human; identical to SEQ ID NO: 163262

SEQ ID NO: 493780 - RNA, 64 nt, Human; identical to SEQ ID NO: 163263

SEQ ID NO: 493781 - RNA, 64 nt, Human; identical to SEQ ID NO: 163264

SEQ ID NO: 493782 - RNA, 64 nt, Human; identical to SEQ ID NO: 163265

SEQ ID NO: 493783 - RNA, 64 nt, Human; identical to SEQ ID NO: 163266

SEQ ID NO: 493784 - RNA, 64 nt, Human; identical to SEQ ID NO: 163267

SEQ ID NO: 493785 - RNA, 64 nt, Human; identical to SEQ ID NO: 163268

SEQ ID NO: 493786 - RNA, 64 nt, Human; identical to SEQ ID NO: 163269

SEQ ID NO: 493787 - RNA, 64 nt, Human; identical to SEQ ID NO: 163270

SEQ ID NO: 493788 - RNA, 64 nt, Human; identical to SEQ ID NO: 163271

SEQ ID NO: 493789 - RNA, 64 nt, Human; identical to SEQ ID NO: 163272

SEQ ID NO: 493790 - RNA, 64 nt, Human; identical to SEQ ID NO: 163273

SEQ ID NO: 493791 - RNA, 64 nt, Human; identical to SEQ ID NO: 163274

SEQ ID NO: 493792 - RNA, 64 nt, Human
agaguccagugucgugcccucagccaguucuuggccaccacaaugggagcagcccuggccgagu

SEQ ID NO: 493793 - RNA, 64 nt, Human
aagagggcucacaagacacauuugucccccgggcccaccacaucauccucacguguucgguacu

SEQ ID NO: 493794 - RNA, 64 nt, Human
cagccucccaaguagcugggauuacaggcacccgccaccacacccagcuaauuuuuuguauauu

SEQ ID NO: 493795 - RNA, 64 nt, Human; identical to SEQ ID NO: 163275

SEQ ID NO: 493796 - RNA, 64 nt, Human; identical to SEQ ID NO: 163276

SEQ ID NO: 493797 - RNA, 64 nt, Human; identical to SEQ ID NO: 163277

SEQ ID NO: 493798 - RNA, 64 nt, Human; identical to SEQ ID NO: 163278

SEQ ID NO: 493799 - RNA, 64 nt, Human; identical to SEQ ID NO: 163279

SEQ ID NO: 493800 - RNA, 64 nt, Human; identical to SEQ ID NO: 163280

SEQ ID NO: 493801 - RNA, 64 nt, Human; identical to SEQ ID NO: 163281

SEQ ID NO: 493802 - RNA, 64 nt, Human; identical to SEQ ID NO: 163282

SEQ ID NO: 493803 - RNA, 64 nt, Human; identical to SEQ ID NO: 163283

SEQ ID NO: 493804 - RNA, 56 nt, Human; identical to SEQ ID NO: 163284

SEQ ID NO: 493805 - RNA, 64 nt, Human; identical to SEQ ID NO: 163285

SEQ ID NO: 493806 - RNA, 64 nt, Human; identical to SEQ ID NO: 163286

SEQ ID NO: 493807 - RNA, 56 nt, Human; identical to SEQ ID NO: 163284

SEQ ID NO: 493808 - RNA, 64 nt, Human; identical to SEQ ID NO: 163288

SEQ ID NO: 493809 - RNA, 64 nt, Human
uugguggcagugagaccagcccacccaccaccacccaccacagaaaagcacaaaccucugggaa

SEQ ID NO: 493810 - RNA, 64 nt, Human
aaggcugcuagggauguuagaccucggccaggacccaccacauugcuuccuaauacccacccuu

SEQ ID NO: 493811 - RNA, 64 nt, Human
gcuuuggccuccuaaagugcugggauuacaugagccaccacaugcagccagauguuugaauauu

SEQ ID NO: 493812 - RNA, 64 nt, Human; identical to SEQ ID NO: 163289

SEQ ID NO: 493813 - RNA, 64 nt, Human; identical to SEQ ID NO: 163290

SEQ ID NO: 493814 - RNA, 64 nt, Human; identical to SEQ ID NO: 163291

SEQ ID NO: 493815 - RNA, 64 nt, Human; identical to SEQ ID NO: 163292

SEQ ID NO: 493816 - RNA, 64 nt, Human; identical to SEQ ID NO: 163293

SEQ ID NO: 493817 - RNA, 64 nt, Human; identical to SEQ ID NO: 163294

SEQ ID NO: 493818 - RNA, 64 nt, Human; identical to SEQ ID NO: 163295

SEQ ID NO: 493819 - RNA, 64 nt, Human; identical to SEQ ID NO: 163296

SEQ ID NO: 493820 - RNA, 64 nt, Human; identical to SEQ ID NO: 163297

SEQ ID NO: 493821 - RNA, 53 nt, Human; identical to SEQ ID NO: 163298

SEQ ID NO: 493822 - RNA, 64 nt, Human; identical to SEQ ID NO: 163299

SEQ ID NO: 493823 - RNA, 64 nt, Human; identical to SEQ ID NO: 163300

SEQ ID NO: 493824 - RNA, 64 nt, Human; identical to SEQ ID NO: 163301

SEQ ID NO: 493825 - RNA, 64 nt, Human; identical to SEQ ID NO: 163302

SEQ ID NO: 493826 - RNA, 64 nt, Human
ugucugccagguaugagaagaacacguaagaccgccaccacacucacccucccucaaggcccug

SEQ ID NO: 493827 - RNA, 64 nt, Human
cauacagcugccuaccuaaugaggacuucaagccccaccacauagcaugcuuccuuucucuccu

SEQ ID NO: 493828 - RNA, 64 nt, Human
cagcuacaacagccucacuuggucugccaggcccccaccacacaucccagcccaauccagguac

SEQ ID NO: 493829 - RNA, 64 nt, Human; identical to SEQ ID NO: 163303

SEQ ID NO: 493830 - RNA, 64 nt, Human; identical to SEQ ID NO: 163304

SEQ ID NO: 493831 - RNA, 64 nt, Human; identical to SEQ ID NO: 163305

SEQ ID NO: 493832 - RNA, 64 nt, Human; identical to SEQ ID NO: 163306

SEQ ID NO: 493833 - RNA, 64 nt, Human; identical to SEQ ID NO: 163307

SEQ ID NO: 493834 - RNA, 64 nt, Human; identical to SEQ ID NO: 163308

SEQ ID NO: 493835 - RNA, 64 nt, Human; identical to SEQ ID NO: 163309

SEQ ID NO: 493836 - RNA, 64 nt, Human; identical to SEQ ID NO: 163310

SEQ ID NO: 493837 - RNA, 64 nt, Human; identical to SEQ ID NO: 163311

SEQ ID NO: 493838 - RNA, 64 nt, Human; identical to SEQ ID NO: 163312

SEQ ID NO: 493839 - RNA, 64 nt, Human; identical to SEQ ID NO: 163313

SEQ ID NO: 493840 - RNA, 64 nt, Human; identical to SEQ ID NO: 163314

SEQ ID NO: 493841 - RNA, 64 nt, Human; identical to SEQ ID NO: 163315

SEQ ID NO: 493842 - RNA, 64 nt, Human; identical to SEQ ID NO: 163316

SEQ ID NO: 493843 - RNA, 64 nt, Human
aagacccaguaguuggccccugagccuuauaccuccaccacagggggugccgugagacuucaag

SEQ ID NO: 493844 - RNA, 64 nt, Human
aggacuuaccagagggagcccuacuggccuucccccaccacagcagcccugccugugaagcucu

SEQ ID NO: 493845 - RNA, 64 nt, Human
cagccucugaaauugcugggauuacaggcaugagccaccacacccagcccggacagcuucuuug

SEQ ID NO: 493846 - RNA, 64 nt, Human; identical to SEQ ID NO: 163317

SEQ ID NO: 493847 - RNA, 56 nt, Human; identical to SEQ ID NO: 163318

SEQ ID NO: 493848 - RNA, 64 nt, Human; identical to SEQ ID NO: 163319

SEQ ID NO: 493849 - RNA, 64 nt, Human; identical to SEQ ID NO: 163320

SEQ ID NO: 493850 - RNA, 64 nt, Human; identical to SEQ ID NO: 163321

SEQ ID NO: 493851 - RNA, 64 nt, Human; identical to SEQ ID NO: 163322

SEQ ID NO: 493852 - RNA, 64 nt, Human; identical to SEQ ID NO: 163323

SEQ ID NO: 493853 - RNA, 64 nt, Human; identical to SEQ ID NO: 163324

SEQ ID NO: 493854 - RNA, 64 nt, Human; identical to SEQ ID NO: 163325

SEQ ID NO: 493855 - RNA, 64 nt, Human; identical to SEQ ID NO: 163326

SEQ ID NO: 493856 - RNA, 64 nt, Human; identical to SEQ ID NO: 163327

SEQ ID NO: 493857 - RNA, 64 nt, Human; identical to SEQ ID NO: 163328

SEQ ID NO: 493858 - RNA, 64 nt, Human; identical to SEQ ID NO: 163329

SEQ ID NO: 493859 - RNA, 64 nt, Human; identical to SEQ ID NO: 163330

SEQ ID NO: 493860 - RNA, 64 nt, Human
cagcuucccgaguagcuaggauuacaggugcaugccaccacaccuggcuaauuuuuguauuuua

SEQ ID NO: 493861 - RNA, 64 nt, Human
acuaucugggcucgucucucucugcuucgugaacccaccacaccagggccugucugcugugcua

SEQ ID NO: 493862 - RNA, 64 nt, Human
uagucccaggaguagcugggacuacaggugcccaccaccacacccagcuaauuuuuuuguauuu

SEQ ID NO: 493863 - RNA, 64 nt, Human; identical to SEQ ID NO: 163331

SEQ ID NO: 493864 - RNA, 64 nt, Human; identical to SEQ ID NO: 163332

SEQ ID NO: 493865 - RNA, 64 nt, Human; identical to SEQ ID NO: 163333

SEQ ID NO: 493866 - RNA, 64 nt, Human; identical to SEQ ID NO: 163334

SEQ ID NO: 493867 - RNA, 64 nt, Human; identical to SEQ ID NO: 163335

SEQ ID NO: 493868 - RNA, 64 nt, Human; identical to SEQ ID NO: 163336

SEQ ID NO: 493869 - RNA, 64 nt, Human; identical to SEQ ID NO: 163337

SEQ ID NO: 493870 - RNA, 64 nt, Human; identical to SEQ ID NO: 163338

SEQ ID NO: 493871 - RNA, 64 nt, Human; identical to SEQ ID NO: 163339

SEQ ID NO: 493872 - RNA, 64 nt, Human; identical to SEQ ID NO: 163340

SEQ ID NO: 493873 - RNA, 64 nt, Human; identical to SEQ ID NO: 163341

SEQ ID NO: 493874 - RNA, 64 nt, Human; identical to SEQ ID NO: 163342

SEQ ID NO: 493875 - RNA, 64 nt, Human; identical to SEQ ID NO: 163343

SEQ ID NO: 493876 - RNA, 64 nt, Human; identical to SEQ ID NO: 163344

SEQ ID NO: 493877 - RNA, 64 nt, Human
gccuccugaguagccggggagcuacaagcaugcaccaccacacccagcuaauuuuuuuuuuuuu

SEQ ID NO: 493878 - RNA, 64 nt, Human
cagccucccuaguagcugggauuacaggugcacaccaccacaccuggcuaauuuuuguauuuuu

SEQ ID NO: 493879 - RNA, 64 nt, Human
aggcaaucuggaagcagaaaugcaaacuccagccccaccacacauccaccgaugcauuuguggc

SEQ ID NO: 493880 - RNA, 64 nt, Human; identical to SEQ ID NO: 163345

SEQ ID NO: 493881 - RNA, 64 nt, Human; identical to SEQ ID NO: 163346

SEQ ID NO: 493882 - RNA, 64 nt, Human; identical to SEQ ID NO: 163347

SEQ ID NO: 493883 - RNA, 64 nt, Human; identical to SEQ ID NO: 163348

SEQ ID NO: 493884 - RNA, 64 nt, Human; identical to SEQ ID NO: 163349

SEQ ID NO: 493885 - RNA, 64 nt, Human; identical to SEQ ID NO: 163350

SEQ ID NO: 493886 - RNA, 64 nt, Human; identical to SEQ ID NO: 163351

SEQ ID NO: 493887 - RNA, 64 nt, Human; identical to SEQ ID NO: 163352

SEQ ID NO: 493888 - RNA, 64 nt, Human; identical to SEQ ID NO: 163353

SEQ ID NO: 493889 - RNA, 64 nt, Human; identical to SEQ ID NO: 163354

SEQ ID NO: 493890 - RNA, 64 nt, Human; identical to SEQ ID NO: 163355

SEQ ID NO: 493891 - RNA, 64 nt, Human; identical to SEQ ID NO: 163356

SEQ ID NO: 493892 - RNA, 64 nt, Human; identical to SEQ ID NO: 163357

SEQ ID NO: 493893 - RNA, 64 nt, Human; identical to SEQ ID NO: 163358

SEQ ID NO: 493894 - RNA, 64 nt, Human
cagccucuugaguagcugggauuacaggcgcccaccaccacagccugcuaauuuuuguauuuuu

SEQ ID NO: 493895 - RNA, 64 nt, Human
ggauugaaccgggacagaaacacggugagggcccccaccacaccucccugguugaaucaggaau

SEQ ID NO: 493896 - RNA, 64 nt, Human
ugggagacacaggcugcagugggcccugauugagccaccacacugcagccuaggugacagucag

SEQ ID NO: 493897 - RNA, 64 nt, Human; identical to SEQ ID NO: 163359

SEQ ID NO: 493898 - RNA, 64 nt, Human; identical to SEQ ID NO: 163360

SEQ ID NO: 493899 - RNA, 64 nt, Human; identical to SEQ ID NO: 163361

SEQ ID NO: 493900 - RNA, 64 nt, Human; identical to SEQ ID NO: 163362

SEQ ID NO: 493901 - RNA, 64 nt, Human; identical to SEQ ID NO: 163363

SEQ ID NO: 493902 - RNA, 64 nt, Human; identical to SEQ ID NO: 163364

SEQ ID NO: 493903 - RNA, 64 nt, Human; identical to SEQ ID NO: 163365

SEQ ID NO: 493904 - RNA, 64 nt, Human; identical to SEQ ID NO: 163366

SEQ ID NO: 493905 - RNA, 64 nt, Human; identical to SEQ ID NO: 163367

SEQ ID NO: 493906 - RNA, 64 nt, Human; identical to SEQ ID NO: 163368

SEQ ID NO: 493907 - RNA, 64 nt, Human; identical to SEQ ID NO: 163369

SEQ ID NO: 493908 - RNA, 64 nt, Human; identical to SEQ ID NO: 163370

SEQ ID NO: 493909 - RNA, 64 nt, Human; identical to SEQ ID NO: 163371

SEQ ID NO: 493910 - RNA, 64 nt, Human; identical to SEQ ID NO: 163372

SEQ ID NO: 493911 - RNA, 64 nt, Human
ucuccuggggccacuguugggggugggagugagcccaccacagaggccacaggcaggcccccac

SEQ ID NO: 493912 - RNA, 64 nt, Human
cucauccaaauaacauuguucccauccuccccacccaccacaucaaaacauaacacaucacagc

SEQ ID NO: 493913 - RNA, 64 nt, Human
ccgccucccaaguagcugggauuacaggcaugcaccaccacaccuggcuaguuuuuguauuuuu

SEQ ID NO: 493914 - RNA, 64 nt, Human; identical to SEQ ID NO: 163373

SEQ ID NO: 493915 - RNA, 64 nt, Human; identical to SEQ ID NO: 163374

SEQ ID NO: 493916 - RNA, 64 nt, Human; identical to SEQ ID NO: 163375

SEQ ID NO: 493917 - RNA, 64 nt, Human; identical to SEQ ID NO: 163376

SEQ ID NO: 493918 - RNA, 64 nt, Human; identical to SEQ ID NO: 163377

SEQ ID NO: 493919 - RNA, 64 nt, Human; identical to SEQ ID NO: 163378

SEQ ID NO: 493920 - RNA, 57 nt, Human; identical to SEQ ID NO: 163379

SEQ ID NO: 493921 - RNA, 64 nt, Human; identical to SEQ ID NO: 163380

SEQ ID NO: 493922 - RNA, 64 nt, Human; identical to SEQ ID NO: 163381

SEQ ID NO: 493923 - RNA, 64 nt, Human; identical to SEQ ID NO: 163382

SEQ ID NO: 493924 - RNA, 64 nt, Human; identical to SEQ ID NO: 163383

SEQ ID NO: 493925 - RNA, 64 nt, Human; identical to SEQ ID NO: 163384

SEQ ID NO: 493926 - RNA, 64 nt, Human; identical to SEQ ID NO: 163385

SEQ ID NO: 493927 - RNA, 64 nt, Human; identical to SEQ ID NO: 163386

SEQ ID NO: 493928 - RNA, 64 nt, Human
agcagaagcugggagucggccuuuccucuaguaaccaccacauggcucagcaucugugccaaac

SEQ ID NO: 493929 - RNA, 64 nt, Human
cagccucccaaauagcugggauuacaggugcaugccaccacacccagcuaauuuuuguauuuuu

SEQ ID NO: 493930 - RNA, 64 nt, Human
cacagauauauuucuccaagaaagccaacaaccaccaccacaaugacagaaaugacaacaaggc

SEQ ID NO: 493931 - RNA, 64 nt, Human; identical to SEQ ID NO: 163387

SEQ ID NO: 493932 - RNA, 64 nt, Human; identical to SEQ ID NO: 163388

SEQ ID NO: 493933 - RNA, 64 nt, Human; identical to SEQ ID NO: 163389

SEQ ID NO: 493934 - RNA, 64 nt, Human; identical to SEQ ID NO: 163390

SEQ ID NO: 493935 - RNA, 64 nt, Human; identical to SEQ ID NO: 163391

SEQ ID NO: 493936 - RNA, 64 nt, Human; identical to SEQ ID NO: 163392

SEQ ID NO: 493937 - RNA, 64 nt, Human; identical to SEQ ID NO: 163393

SEQ ID NO: 493938 - RNA, 64 nt, Human; identical to SEQ ID NO: 163394

SEQ ID NO: 493939 - RNA, 64 nt, Human; identical to SEQ ID NO: 163395

SEQ ID NO: 493940 - RNA, 64 nt, Human; identical to SEQ ID NO: 163396

SEQ ID NO: 493941 - RNA, 64 nt, Human; identical to SEQ ID NO: 163397

SEQ ID NO: 493942 - RNA, 64 nt, Human; identical to SEQ ID NO: 163398

SEQ ID NO: 493943 - RNA, 64 nt, Human; identical to SEQ ID NO: 163399

SEQ ID NO: 493944 - RNA, 64 nt, Human; identical to SEQ ID NO: 163400

SEQ ID NO: 493945 - RNA, 64 nt, Human
gguccucaccuggaggggccagcaggcugccgucccaccacacguggccucugcgcccagcacg

SEQ ID NO: 493946 - RNA, 64 nt, Human
cagucaagacggaaguaaaggcucaggaaacagcccaccacagaggcagaugccaaaccaaaga

SEQ ID NO: 493947 - RNA, 64 nt, Human
aauggcuguggaguguggcaguuuggcaaacucuccaccacacguaaugaaacuuggauuugcu

SEQ ID NO: 493948 - RNA, 64 nt, Human; identical to SEQ ID NO: 163401

SEQ ID NO: 493949 - RNA, 64 nt, Human; identical to SEQ ID NO: 163402

SEQ ID NO: 493950 - RNA, 64 nt, Human; identical to SEQ ID NO: 163403

SEQ ID NO: 493951 - RNA, 64 nt, Human; identical to SEQ ID NO: 163404

SEQ ID NO: 493952 - RNA, 64 nt, Human; identical to SEQ ID NO: 163405

SEQ ID NO: 493953 - RNA, 64 nt, Human; identical to SEQ ID NO: 163406

SEQ ID NO: 493954 - RNA, 64 nt, Human; identical to SEQ ID NO: 163388

SEQ ID NO: 493955 - RNA, 64 nt, Human; identical to SEQ ID NO: 163408

SEQ ID NO: 493956 - RNA, 64 nt, Human; identical to SEQ ID NO: 163409

SEQ ID NO: 493957 - RNA, 64 nt, Human; identical to SEQ ID NO: 163410

SEQ ID NO: 493958 - RNA, 64 nt, Human; identical to SEQ ID NO: 163411

SEQ ID NO: 493959 - RNA, 64 nt, Human; identical to SEQ ID NO: 163412

SEQ ID NO: 493960 - RNA, 64 nt, Human; identical to SEQ ID NO: 163413

SEQ ID NO: 493961 - RNA, 56 nt, Human; identical to SEQ ID NO: 163414

SEQ ID NO: 493962 - RNA, 64 nt, Human
guggcaucagugucuuuccacuccuccuagccacccaccacacugauccagcccugaguuccua

SEQ ID NO: 493963 - RNA, 64 nt, Human
auugggccccugccagacccccuggagacuaaccccaccacacccucccucuacugggagccua

SEQ ID NO: 493964 - RNA, 64 nt, Human
ggaauuucugcauggggcgugaaggcacacugucccaccacaacugaaccagaagagagugaag

SEQ ID NO: 493965 - RNA, 64 nt, Human; identical to SEQ ID NO: 163415

SEQ ID NO: 493966 - RNA, 64 nt, Human; identical to SEQ ID NO: 163416

SEQ ID NO: 493967 - RNA, 64 nt, Human; identical to SEQ ID NO: 163417

SEQ ID NO: 493968 - RNA, 64 nt, Human; identical to SEQ ID NO: 163418

SEQ ID NO: 493969 - RNA, 64 nt, Human; identical to SEQ ID NO: 163419

SEQ ID NO: 493970 - RNA, 64 nt, Human; identical to SEQ ID NO: 163420

SEQ ID NO: 493971 - RNA, 64 nt, Human; identical to SEQ ID NO: 163421

SEQ ID NO: 493972 - RNA, 64 nt, Human; identical to SEQ ID NO: 163422

SEQ ID NO: 493973 - RNA, 64 nt, Human; identical to SEQ ID NO: 163423

SEQ ID NO: 493974 - RNA, 64 nt, Human; identical to SEQ ID NO: 163424

SEQ ID NO: 493975 - RNA, 64 nt, Human; identical to SEQ ID NO: 163425

SEQ ID NO: 493976 - RNA, 64 nt, Human; identical to SEQ ID NO: 163426

SEQ ID NO: 493977 - RNA, 64 nt, Human; identical to SEQ ID NO: 163427

SEQ ID NO: 493978 - RNA, 64 nt, Human; identical to SEQ ID NO: 163428

SEQ ID NO: 493979 - RNA, 64 nt, Human
cagccucccgaguagcugggacuacaggcacccgccaccacauccggcuaauuuuuuguauuuu

SEQ ID NO: 493980 - RNA, 64 nt, Human
ucucaaaggcugugcacaagggaaguggguguucccaccacacagcaauaccugcaggcugggg

SEQ ID NO: 493981 - RNA, 64 nt, Human
ccucagccuccuguguaacugggauuacaggcucccaccacaccuggcuaguguuuuguauuuu

SEQ ID NO: 493982 - RNA, 64 nt, Human; identical to SEQ ID NO: 163429

SEQ ID NO: 493983 - RNA, 64 nt, Human; identical to SEQ ID NO: 163430

SEQ ID NO: 493984 - RNA, 64 nt, Human; identical to SEQ ID NO: 163431

SEQ ID NO: 493985 - RNA, 64 nt, Human; identical to SEQ ID NO: 163432

SEQ ID NO: 493986 - RNA, 64 nt, Human; identical to SEQ ID NO: 163433

SEQ ID NO: 493987 - RNA, 64 nt, Human; identical to SEQ ID NO: 163434

SEQ ID NO: 493988 - RNA, 64 nt, Human; identical to SEQ ID NO: 163435

SEQ ID NO: 493989 - RNA, 64 nt, Human; identical to SEQ ID NO: 163436

SEQ ID NO: 493990 - RNA, 64 nt, Human; identical to SEQ ID NO: 163437

SEQ ID NO: 493991 - RNA, 64 nt, Human; identical to SEQ ID NO: 163438

SEQ ID NO: 493992 - RNA, 64 nt, Human; identical to SEQ ID NO: 163439

SEQ ID NO: 493993 - RNA, 64 nt, Human; identical to SEQ ID NO: 163440

SEQ ID NO: 493994 - RNA, 64 nt, Human; identical to SEQ ID NO: 163441

SEQ ID NO: 493995 - RNA, 64 nt, Human; identical to SEQ ID NO: 163442

SEQ ID NO: 493996 - RNA, 64 nt, Human
cagcuggaaccagcaucucugauuuaugccgucuccaccacagagccuccacuuugcaggagug

SEQ ID NO: 493997 - RNA, 64 nt, Human
gaaauucaugaaagagaaguaacuguuacucaagccaccacauuuuguaaugcagaguuuuuuu

SEQ ID NO: 493998 - RNA, 64 nt, Human
auucaaaagaaauuuuaaaaaaauccuacuaacaccaccacaaauaugcaaucagcaauaucca

SEQ ID NO: 493999 - RNA, 64 nt, Human; identical to SEQ ID NO: 163443

SEQ ID NO: 494000 - RNA, 64 nt, Human; identical to SEQ ID NO: 163444

SEQ ID NO: 494001 - RNA, 64 nt, Human
gcucaccuucuuccugguaacggguaacgggggcagcgcccaggaucacccagagcugggccuu

SEQ ID NO: 494002 - RNA, 64 nt, Human
cugggccuuaaaggaugcggacucauccucagccagcgcccauguugugauacagggguguuug

SEQ ID NO: 494003 - RNA, 64 nt, Human
uugcauccuuguguuuugcugugguuuuuaaaggagcgcccacgaaguguaguggcugacgauu

SEQ ID NO: 494004 - RNA, 64 nt, Human
ggaagcccagccgugggcuuaggagagagggaccagcgcccagcguuagggcuggaagacggca

SEQ ID NO: 494005 - RNA, 64 nt, Human
uggcuuccaggccacccaucugucacccuuggacagcgcccacacccuucuagcaccuccugac

SEQ ID NO: 494006 - RNA, 64 nt, Human
cuccucaaggguuggggguccuucucccucgcagccaccacaugucucagggcuaccuucuccg

SEQ ID NO: 494007 - RNA, 64 nt, Human
ugccuucaaaacccacccccaccccuacccuaccccaccacaccccaucccagaggccuugccu

SEQ ID NO: 494008 - RNA, 64 nt, Human
gguuuguagcuccucuccggcugccuugcagacaccaccacaugggcucugcucuaugggaauc

SEQ ID NO: 494009 - RNA, 64 nt, Human
caguguguuggcgcuuugcuuuggucuaucuuugagcgcccacuagacccacuggacucaccuc

SEQ ID NO: 494010 - RNA, 64 nt, Human
guggcccccagccucggccaggccugcucugcucagcgcccaccgcccaccaccccuccugcuu

SEQ ID NO: 494011 - RNA, 64 nt, Human
agguggguaaccaaguucaccagcaauaaaacccagcgcccagguagccuccagcagugcggcu

SEQ ID NO: 494012 - RNA, 64 nt, Human
cucugaaaguccucaugccuggcagucggaggagagcgcccagacucugaacucagcagaaagu

SEQ ID NO: 494013 - RNA, 64 nt, Human
gaaugaaagauacuugaauuauugugcgccugugagcgcccagcuucuguuucauagucuuaac

SEQ ID NO: 494014 - RNA, 64 nt, Human
cuggugccgucuugcaugaaacgcaugagccgugagcgcccaguucagacuggggccagggagg

SEQ ID NO: 494015 - RNA, 54 nt, Human
ucccauuugagcagcugugagcugagcgcccacuagaggggcacccaccaguug

SEQ ID NO: 494016 - RNA, 64 nt, Human
aggagaagacucggaauucccugagucccaccauagcgcccaagcucagcuuagaaguucgaaa

SEQ ID NO: 494017 - RNA, 64 nt, Human
ugaccucacacccucugggcccgccucuggagccagcgcccagggucccucugugcuuuuucgc

SEQ ID NO: 494018 - RNA, 62 nt, Human
ccaagauggacuugcugugaauggugccacacagcgcccacagacugggcccucgcacccuu

SEQ ID NO: 494019 - RNA, 64 nt, Human
guucagauugccccuggggaucuucugugucuucagcgcccagcccugcguguuccuggugaag

SEQ ID NO: 494020 - RNA, 64 nt, Human
ugaaggcaugagacaucuguacaggaagcaucccagcgcccacaugggcaugagacagucugca

SEQ ID NO: 494021 - RNA, 64 nt, Human
uccugccugugagucggccuuacuccguuuccuuagcgcccaugacacgccaagucccguuucg

SEQ ID NO: 494022 - RNA, 64 nt, Human
acccguugaauguuuugaaugcccugacucuaccagcgcccauaaaugaucucuagaaggacug

SEQ ID NO: 494023 - RNA, 64 nt, Human
ccggccccuucccccaggagucacugugccagccccaccacauccuggaagaggagggggcccc

SEQ ID NO: 494024 - RNA, 64 nt, Human
ggggguaccugugggguucuucucuucauuuucaccaccacaaagcuggucuaagcugccauca

SEQ ID NO: 494025 - RNA, 64 nt, Human
ccggggaggagggccucucaugggaaagcccuggccaccacaccggccugugccccuugaagcc

SEQ ID NO: 494026 - RNA, 64 nt, Human
ccgcuaguggcagaugugaacugacaaggagugaagcgcccacccagcggauggacagcaccca

SEQ ID NO: 494027 - RNA, 64 nt, Human
cagaccccaccccgucuaccccuccagucagcccagcgcccauccugcagcucagcugggagca

SEQ ID NO: 494028 - RNA, 64 nt, Human
cccucgggggagaccgcaggcuccucuggccgccagcgcccacuuucgggacaccagugcgcaa

SEQ ID NO: 494029 - RNA, 64 nt, Human
cugcugaaggggucccccauuguuuugcuuccccagcgcccaggaugagcgguuuaccaucgag

SEQ ID NO: 494030 - RNA, 64 nt, Human
cugcugugcuccacacccugcaggcgccucgggaagcgcccaaaggauuccccuucacguuggu

SEQ ID NO: 494031 - RNA, 64 nt, Human
caguguaacuuuuagaccugcgugacaucuacaaagcgcccaauaaagaaagaggaagccacgg

SEQ ID NO: 494032 - RNA, 64 nt, Human
ugaagguacgccacccaccuccgucgcccaccucagcgcccaggagccuugggacuuccuucca

SEQ ID NO: 494033 - RNA, 64 nt, Human
ucgugacagguggcggguguggcugucacugcacagcgcccacggcuacagcugcgccggaucu

SEQ ID NO: 494034 - RNA, 64 nt, Human
cuagucaccgacagcggccuugaagacagagcaaagcgcccacccaggucccccgacugccugu

SEQ ID NO: 494035 - RNA, 64 nt, Human
gacccaacgccaacaccuggugccuucugcagccagcgcccacccauccgugcccggacccuug

SEQ ID NO: 494036 - RNA, 64 nt, Human
agcccgggccaccucgugggggacaagucucgccagcgcccacccccauggcucgggucagucc

SEQ ID NO: 494037 - RNA, 64 nt, Human
ugugaguggaggcagaggagugaggcccacgggcagcgcccaggagcccaccuuccccucuggc

SEQ ID NO: 494038 - RNA, 64 nt, Human
uuuuuacgcauagcuccgucaagcugccuggaugagcgcccaugcagcaaggcuuggaggaagc

SEQ ID NO: 494039 - RNA, 64 nt, Human
ccccaaagcaagcagggggccaguggcggggcccagcgcccagcaggacacccaugcaagaggc

SEQ ID NO: 494040 - RNA, 64 nt, Human
ucaagcuuccugugauggaaagcgaccucuccaaccaccacacuccccgccguacaguucucca

SEQ ID NO: 494041 - RNA, 64 nt, Human
gaacacuuccuggggagcuacaggggcacuuaacccaccacagcacagccucaucaaaaugcag

SEQ ID NO: 494042 - RNA, 64 nt, Human
cagccucccagguagcugggacuacaggcgugcaccaccacacccagcuaauuuuuaaguuuuu

SEQ ID NO: 494043 - RNA, 64 nt, Human
cgcaggggacaccgugccggcuucagacacucccagcgcccacucuuacaggcccaggacugga

SEQ ID NO: 494044 - RNA, 64 nt, Human
gugggcuaaugcugaaggggcagccagucaccagagcgcccaccuggcacaccccccucacccc

SEQ ID NO: 494045 - RNA, 64 nt, Human
uuugcuuuaagaaaaaaggaggcaagguagggagagcgcccacacuguccaugcuccaggcccc

SEQ ID NO: 494046 - RNA, 64 nt, Human
ggccagugcgccugcuccugaccacugcaaucccagcgcccaaggaaggccacuucucaacugg

SEQ ID NO: 494047 - RNA, 64 nt, Human
ccacccccacccgucccaggcccaggccgaagccagcgcccagcuuuccucacuguuccugugg

SEQ ID NO: 494048 - RNA, 64 nt, Human
uaggcaggugggcucugcuucccgauucccugugagcgcccacccucucgaaagaauuuucugc

SEQ ID NO: 494049 - RNA, 64 nt, Human
ugggggcugcaguucgacucugugcuggccagcgagcgcccagcuccugacacugcuggagagg

SEQ ID NO: 494050 - RNA, 64 nt, Human
aaaguuccaaagaggugguuucugaggaagucagagcgcccagggccagagcagucaguaaugg

SEQ ID NO: 494051 - RNA, 64 nt, Human
aaacacacuauggaacucugcugauggggacccaagcgcccacgugcucagccacccucuggcu

SEQ ID NO: 494052 - RNA, 64 nt, Human
agggagugagcuccccagacccccucgccacuccagcgcccaguccuucuccugcccgagagau

SEQ ID NO: 494053 - RNA, 64 nt, Human
agcaacgguguugucagugugcgaacuccagagaagcgcccacaucugaaggaccugcucgcga

SEQ ID NO: 494054 - RNA, 64 nt, Human
cuggcugcugggagagcccaugggaaccuugcuuagcgcccaagguagaugagagacagggcag

SEQ ID NO: 494055 - RNA, 64 nt, Human
gagcaccaugcuggaggucacccagcacuguggcagcgcccaggagggcauagggcagccuacc

SEQ ID NO: 494056 - RNA, 64 nt, Human
augcggcugcuucaugagaugcagaacccccaggagcgcccaggcuugggcagcaaccccugca

SEQ ID NO: 494057 - RNA, 64 nt, Human
caagcaaccucagcaguucccaucaaggccaccuccaccacaaccgaaaguaucaucucaggga

SEQ ID NO: 494058 - RNA, 64 nt, Human
cagccucuugaguggcugggauuacaggcacaugccaccacacccggcuaauuuuuguauuuuu

SEQ ID NO: 494059 - RNA, 64 nt, Human
cggccucucaaauugcuggaauuacaguugugagccaccacaccuggcuugaauguagauuuua

SEQ ID NO: 494060 - RNA, 64 nt, Human
gugaggggaugacgcgcugugggugggaggaggcagcgcccaucucagcagcaccaggacugcc

SEQ ID NO: 494061 - RNA, 64 nt, Human
acggaccgcucuuggcuccugacucccaggguacagcgcccaguaacucauccuucauucagag

SEQ ID NO: 494062 - RNA, 64 nt, Human
gcugacagacacaggcccggcuccaggcuccuuuagcgcccaguuggguggaugccugguggca

SEQ ID NO: 494063 - RNA, 64 nt, Human
gcauaucuggucagaacugcagggccuauaugccagcgcccagggaggagucaguaccccuggu

SEQ ID NO: 494064 - RNA, 64 nt, Human
gagccuccccaaggagcgccgcccccugcuccacagcgcccagucccaucgaccacccaagggc

SEQ ID NO: 494065 - RNA, 64 nt, Human
uccucccuugccccaggccagguagcaagagagcagcgcccaggccugcuggcaucaggucugg

SEQ ID NO: 494066 - RNA, 64 nt, Human
aguaucaguacaugccuagaccugggcuccggccagcgcccaacagcguggaugucgaugacuu

SEQ ID NO: 494067 - RNA, 64 nt, Human
acucacacucguccccagcuuagcacagagcuggagcgcccauuucuggaauuuuccguuuggg

SEQ ID NO: 494068 - RNA, 64 nt, Human
gcuucucagccggcugucccagccagccccgcagagcgcccacggacaguguccacucuggcaa

SEQ ID NO: 494069 - RNA, 64 nt, Human
cucggguuauuucagccccggccugcagaguggaagcgcccagcggccuuuccucgcucaccag

SEQ ID NO: 494070 - RNA, 64 nt, Human
cugcugccucccucuggaguggccacuuggccaaagcgcccauccacaucuggaaagucggagc

SEQ ID NO: 494071 - RNA, 64 nt, Human
agugcagacuucggggucuccaccccaggccagcagcgcccacugggcuacagcaagccaacag

SEQ ID NO: 494072 - RNA, 64 nt, Human
gcuccaggcucccaccaucuacagaggggcuuacagcgcccauucuggucuuggggaacccauc

SEQ ID NO: 494073 - RNA, 64 nt, Human
agccgacgcccuugccccugccccuaccccugccagcgcccacccccagccagggccccucgcc

SEQ ID NO: 494074 - RNA, 64 nt, Human
gauucuagaaaaaggaaucauucuccccucccucccaccacauagaaucaacauaugguaggga

SEQ ID NO: 494075 - RNA, 64 nt, Human
ucuuacuccagccucccaagcagcugggacuacaccaccacagguaugcaccaccauaccuggc

SEQ ID NO: 494076 - RNA, 64 nt, Human
aauggaaggacaaguaagagugaggccacaguucccaccacacgagggcuuuuguauuguucua

SEQ ID NO: 494077 - RNA, 64 nt, Human
uacaggguccaacauagagccggguguccccaacagcgcccaaaggacgcacugagcaacgcua

SEQ ID NO: 494078 - RNA, 64 nt, Human
cugcucugagcugggagcagccagaggcggugcaagcgcccagcuccccagagcuccccaaccu

SEQ ID NO: 494079 - RNA, 64 nt, Human
gcccucccuggccucuccacugucuccacucuccagcgcccauucaagucucugcuuugaguca

SEQ ID NO: 494080 - RNA, 64 nt, Human
gccagcuccugucuguaugggcgagaugacugagagcgcccacgucccuaaggcuguccugacc

SEQ ID NO: 494081 - RNA, 64 nt, Human
cuuauaccaccucucaaccauuacucacacuuccagcgcccagguccaagucugagccugaccu

SEQ ID NO: 494082 - RNA, 64 nt, Human
auuccccuaggagcgcuuggccagcugggaaggcagcgcccagcugcacuuguuguugauacag

SEQ ID NO: 494083 - RNA, 64 nt, Human
ccuggccggugucacuguggcccggccaccccugagcgcccagcucccuaccuccuggacgucu

SEQ ID NO: 494084 - RNA, 64 nt, Human
cauugacaguccugacgggagcucagggcugcccagcgcccagcgugcacgggacggccccacg

SEQ ID NO: 494085 - RNA, 64 nt, Human
auaugucagcaccuggaaguggagugcaggcugcagcgcccagccaugugggccaggugcauuc

SEQ ID NO: 494086 - RNA, 64 nt, Human
ccugauggcacacaaggagccuccuuccuguagcagcgcccaguuuucauguggauggauugua

SEQ ID NO: 494087 - RNA, 64 nt, Human
gggugaugcagaggccacaggugcugcacgcuccagcgcccacucuagacaucagccuccaggu

SEQ ID NO: 494088 - RNA, 64 nt, Human
cucaguuccuaccuccaagggggaggguccuggaagcgcccacccaggcgccgccccugugcuu

SEQ ID NO: 494089 - RNA, 64 nt, Human
uccauucggcccccaggccggcgggcgcgcccgaagcgcccauccucgugguaggcaacaagcg

SEQ ID NO: 494090 - RNA, 60 nt, Human
agaccauccucaagaacugagaccccggccagcgcccaccccagccuucugcccgcccca

SEQ ID NO: 494091 - RNA, 64 nt, Human
cugaguuuuggcaaaugcagucaagucacuaccaccaccacaauuaacagcuauaucacccucc

SEQ ID NO: 494092 - RNA, 64 nt, Human
gauccccaucagcacagccaggcagagaugauacccaccacacaccugggggcccccacaccca

SEQ ID NO: 494093 - RNA, 64 nt, Human
cacugaaagucacggcugcgcacuguguccucuuccaccacagagggcgugugcucggugcuga

SEQ ID NO: 494094 - RNA, 64 nt, Human
gcccagugacccccagacgcggaaaccggguggcagcgcccagccuggccccaagcauggaaac

SEQ ID NO: 494095 - RNA, 64 nt, Human
acccucaugaacacagggauuggggagggaccagagcgcccaauacacacagcuccauuaugca

SEQ ID NO: 494096 - RNA, 64 nt, Human
aagaggguguaaguauuccaccagcccgcugagugugcacgaaauguucgcagugcaacaaaaa

SEQ ID NO: 494097 - RNA, 64 nt, Human
cacgggcagcaagcugguggacuacgcgcgcagcgugcacgaggaguuuugagcgcccggccgc

SEQ ID NO: 494098 - RNA, 64 nt, Human
cuuguguccaggugggacuuucuacaacgcugcugugcacgacguggaugccguaugcauguug

SEQ ID NO: 494099 - RNA, 64 nt, Human
gcagcaaggccaauucucgcagaaacccccacgugugcacgagugggagaggggaaagagaaaa

SEQ ID NO: 494100 - RNA, 64 nt, Human
aaaguuguuugugucuggcccacagugacucucugugcacgacucaacugccaagggcaucacu

SEQ ID NO: 494101 - RNA, 64 nt, Human
uuggacuggguugcguccugacggcgcccccagugugcacgagugggaaggacuuggcgcgccc

SEQ ID NO: 494102 - RNA, 64 nt, Human
gagccgccaaacauuccuccagacguccaccucagugcacgagcuggcccagaggcucucgggc

SEQ ID NO: 494103 - RNA, 64 nt, Human
guuuaaaagugaaucguaagagaaccucagcauugugcacgauaagagaaugugucaguauuuc

SEQ ID NO: 494104 - RNA, 64 nt, Human
uaacucaagaccuacccucuuaacaaaucuuuaagugcacgauauaguauuguuaauuccaggc

SEQ ID NO: 494105 - RNA, 64 nt, Human
gggugaugaaaauguucugaaauuaguggugauugugcacgauuuugagaauguacuaaaaacc

SEQ ID NO: 494106 - RNA, 64 nt, Human
ccucccccugagucagugggacucccagacacugccaccacagcugaaauucucaugcagcauc

SEQ ID NO: 494107 - RNA, 64 nt, Human
aguaaucugagcagucuaacgaggcccaccuccuccaccacagaacguggcuauguuccaagug

SEQ ID NO: 494108 - RNA, 64 nt, Human
aaggcgcagugcuucucuacagacuucuccagacccaccacaccgcagaagcgggacgagaccc

SEQ ID NO: 494109 - RNA, 64 nt, Human
auugucacuuuuuaugcuauuucuguauauaaaggugcacgaagguaaaaaguauuuuuucaag

SEQ ID NO: 494110 - RNA, 64 nt, Human
cacccugcugguaggagccagcggcucuggccaagugcacgagggucucuguguuuccagaagg

SEQ ID NO: 494111 - RNA, 64 nt, Human
aggugaaagacaugagugcccucccaaagucugagugcacgaaaauuucucucuugccuugagg

SEQ ID NO: 494112 - RNA, 64 nt, Human
guuggcucugcagaagcucugggguucccuucaagugcacgagggguuaggcugcugucccuga

SEQ ID NO: 494113 - RNA, 64 nt, Human
accccaacacaugccuucccuccccagccacaccgugcacgaagggggcacaggagaggagagg

SEQ ID NO: 494114 - RNA, 64 nt, Human
uggugguauggaagcauguacucaaaauauagacgugcacgauggugguguggcuuacccagga

SEQ ID NO: 494115 - RNA, 64 nt, Human
caugggucuugagagagaauuuuaauuacuaauugugcacgagauaguugguugucuauauguc

SEQ ID NO: 494116 - RNA, 64 nt, Human
uggaauguucugggagagaacguuucguuugcuugugcacgacucuguucauuuuugcuguuua

SEQ ID NO: 494117 - RNA, 64 nt, Human
caacugcgccgaccccgccacucucacccgacccgugcacgacgcugcccgggagggcuuccug

SEQ ID NO: 494118 - RNA, 64 nt, Human
uucaaaggccucaaaaauacuuuuauaguaacaagugcacgacuuuaguuggguuauucaagau

SEQ ID NO: 494119 - RNA, 64 nt, Human
ccagggcacgccccuggccccuugcuguucccaagugcacgaugcugcugugacugaggagugg

SEQ ID NO: 494120 - RNA, 64 nt, Human
aaguaccuugaaguagcacagcccguccuugcaugugcacgagcuaucauuugaguaaaaguau

SEQ ID NO: 494121 - RNA, 64 nt, Human
gacagaggggccucccagucuccccccaccacccgugcacgacuuccucaccacccccagguuc

SEQ ID NO: 494122 - RNA, 64 nt, Human
ugcaagugcaaggccaguggaguuaaucugcaacgugcacgagggcgugugucaguggcugugu

SEQ ID NO: 494123 - RNA, 64 nt, Human
ggagacuuuccaaauauggaacuaacuggagaaggugcacgaaggagacaccacuuggggaccu

SEQ ID NO: 494124 - RNA, 64 nt, Human
ggcuccacacugccggaagcagccuuccugcucggugcacgaugcugcccugaaacacaggcuc

SEQ ID NO: 494125 - RNA, 64 nt, Human
cagccucccaaagugcugggauuaccggcuugagccaccacacccggcacaucuucauucuuuu

SEQ ID NO: 494126 - RNA, 64 nt, Human
cagccucccaaguagcugggguuacaggcgcccaccaccacacucggcuaauuuuguguuuuua

SEQ ID NO: 494127 - RNA, 64 nt, Human
ucagcccccaaguagcugggauuacaagugugcgccaccacacccagcuaauuuuuuauuuuua

SEQ ID NO: 494128 - RNA, 64 nt, Human
gacauggacuaggaguuuaagcaggacagugugcgugcacgagcuccgagcccagcacagacau

SEQ ID NO: 494129 - RNA, 64 nt, Human
ccugugggucccugacaaagaagagcuacgcucugugcacgaagucaagaaccaaacagcucag

SEQ ID NO: 494130 - RNA, 64 nt, Human
cguuugcacguuaacucuaugccggauagcagcugugcacgagacaaucuugcaacacccgggc

SEQ ID NO: 494131 - RNA, 64 nt, Human
uaaccaagcauuuucagucuuacaaagaaaucuagugcacgacaccuuuaaaaugccuagauuu

SEQ ID NO: 494132 - RNA, 64 nt, Human
cuuggccgguggggacgcagagccccagcagguggugcacgacuguuggcggaaggaacgcgug

SEQ ID NO: 494133 - RNA, 64 nt, Human
cuuuuuuaugauuuuguaaguucccauaaguugugugcacgagguucugagagugcccgcaggc

SEQ ID NO: 494134 - RNA, 64 nt, Human
gcaagagcaguuuucaaaagucuuugaguccagugugcacgagucgacaagcaguaccuggcau

SEQ ID NO: 494135 - RNA, 64 nt, Human
agagaccauauuuuagccccacucacccucuugggugcacgaccuguacagccaaacacagcau

SEQ ID NO: 494136 - RNA, 64 nt, Human
gaagucaaaguucucauggucagaaguucucauggugcacgaguccucagcacucugccggcag

SEQ ID NO: 494137 - RNA, 63 nt, Human
ggccaaggcucccauagaggcgcugugucagugaagauguacgacuaccuguugggaaggaca

SEQ ID NO: 494138 - RNA, 63 nt, Human
ggguaggugcaacccaauggaccacuuaugcaaaagauguaaacucuugcauaauacauugau

SEQ ID NO: 494139 - RNA, 63 nt, Human
accuccugcagcaacugaacgagcagcgcaggcaagauguauuuugugacugcaguauucuag

SEQ ID NO: 494140 - RNA, 63 nt, Human
uuuuuuuuuuuaacuugggaccaccaaguuguaaagauguauguuuuuaccugacaguuauac

SEQ ID NO: 494141 - RNA, 63 nt, Human
aaaggaggacucaauguauauaucuuauaucauaagauguaugcuagagauaaacuuuccaau

SEQ ID NO: 494142 - RNA, 63 nt, Human
uugauaauuguauauaauaguauagucaccaucaagauguagaaaauagaaaauaggcuaggc

SEQ ID NO: 494143 - RNA, 64 nt, Human
ucccaaguagcugagacuacaguacaggcacaugccaccacaccuggcuaauagaaauuuuuuu

SEQ ID NO: 494144 - RNA, 64 nt, Human
ugguagcuggacuuccccagggcccucuuccccuccaccacacccagguggacuugcagcccac

SEQ ID NO: 494145 - RNA, 64 nt, Human
gagccaaaggggucagaaauucugcccuuugccuccaccacauggcauucugguuuugguuucu

SEQ ID NO: 494146 - RNA, 63 nt, Human
uucugaaguguuagagguagagauggucuaguaaagauguaguaguaauguuuuauccauuua

SEQ ID NO: 494147 - RNA, 63 nt, Human
gauuuacuaauuuugguaaaucugaaugaacuaaagauguaucuguaccuucucauuugaugu

SEQ ID NO: 494148 - RNA, 63 nt, Human
gcaaguaaaauuugacagaaauuuuaaaauaugaagauguauagcuuucccaagaugauggua

SEQ ID NO: 494149 - RNA, 63 nt, Human
gagccuacccuccucucacaucuccuccugcccaagauguaaggaagcauuguaaggauuucu

SEQ ID NO: 494150 - RNA, 63 nt, Human
cuaagacuucaguccuggucugcucaggaauugaagauguaaggaauugaagauaggagagau

SEQ ID NO: 494151 - RNA, 63 nt, Human
aaaagaacccaagagaauugucacacaugacacaagauguacauaauaucaugcucacugcag

SEQ ID NO: 494152 - RNA, 63 nt, Human
caugauuccuuuuuccuuuuaaacaauguaugaaagauguauuuuaaaucuaaauaaagagca

SEQ ID NO: 494153 - RNA, 63 nt, Human
ugaacuuuuuuauagccuauuucuuuaauauuaaagauguacuggcauuacuuuuauggacag

SEQ ID NO: 494154 - RNA, 63 nt, Human
guacauggugguaauagacucuaagcaauugccaagauguauucuauuuuuaugaaguguaua

SEQ ID NO: 494155 - RNA, 63 nt, Human
ugaaugacacuuugagaguagucuuucaaucugaagauguaagacuuccugaaacaaguucuc

SEQ ID NO: 494156 - RNA, 63 nt, Human
uucauaaaauaagaauuuguucuguguuaucuaaagauguaucaguauauugucacaguugug

SEQ ID NO: 494157 - RNA, 63 nt, Human
acacaacacagauaauuuuuucuuaagucggccaagauguacuucucugugugcacacccaug

SEQ ID NO: 494158 - RNA, 63 nt, Human
aguugucccaugguguuaauaaaguugccaaagaagauguauuaugaacaauucagcaauaag

SEQ ID NO: 494159 - RNA, 63 nt, Human
uuaaacuuuuuaaagaaaaucuguacuuuuauaaagauguauuuuguauaacuuaaauaauaa

SEQ ID NO: 494160 - RNA, 63 nt, Human
agauagauacuauauuaaacuguacuguuauuuaagauguaauaaagcaguuugacaugaggg

SEQ ID NO: 494161 - RNA, 63 nt, Human
cauguauauuuccacauuuuugugcuuggauauaagauguauuucuuguagugaaguuguuuu

SEQ ID NO: 494162 - RNA, 64 nt, Human
aaggccacgccugugggugggcagccaccuggugccaccacagggcaccagggaugauccugau

SEQ ID NO: 494163 - RNA, 64 nt, Human
gaggugcaaaaauuuuaaugcuagucaguaugcaccaccacaggaaaguuagaucccauuagca

SEQ ID NO: 494164 - RNA, 64 nt, Human
cggccucccaaagcacugggauuacaggcgugagccaccacauccagccagugauccuuaaaag

SEQ ID NO: 494165 - RNA, 64 nt, Human
ccacccaccuuauccucccaccccacucccuccaccaccacagcacaccggugcuggccacacc

SEQ ID NO: 494166 - RNA, 63 nt, Human
agggguacuugugcauuuaaaaaccaacacaaaaagauguaaauacuuaacacucaaauauua

SEQ ID NO: 494167 - RNA, 63 nt, Human
ucucaaagcaggaauugguggcagauuuuacaaaagauguauccuuccaauuuggaaucuucu

SEQ ID NO: 494168 - RNA, 63 nt, Human
gagaugcggccaaagauucuuuauaucugaaccaagauguaaaacaagaaaugcuuugaggcu

SEQ ID NO: 494169 - RNA, 63 nt, Human
aggcugaaacauugcuuccacccaccaucagugaagauguaacuagcauguuacaagagugaa

SEQ ID NO: 494170 - RNA, 63 nt, Human
ugaaggacccuauauuauauuucccuaacucugaagauguauauguaguuuaaagcaguuugu

SEQ ID NO: 494171 - RNA, 63 nt, Human
gagccaggccaccuuagaaugggguuuggaaguaagauguauagaguuggggaaucauggaga

SEQ ID NO: 494172 - RNA, 63 nt, Human
agaagaaagaaacagagauaauauauauauagaaagauguauauagauguauauaugcccaaa

SEQ ID NO: 494173 - RNA, 63 nt, Human
agacuuaccuuauuucuuucaguguguagggacaagauguacugcugugugugugugugugug

SEQ ID NO: 494174 - RNA, 63 nt, Human
uaauuccaagauuaaaaguucauauauaggcuaaagauguaacuaggccauuuguauuuguau

SEQ ID NO: 494175 - RNA, 63 nt, Human
auguguacuaugggguaaaagggguaggguuuaaagauguagacaguuggguuuuuuaagggc

SEQ ID NO: 494176 - RNA, 63 nt, Human
gauguuuuaaauacaugcauugucuucacgaagaagauguaaaaauaaugaacaauaaauugc

SEQ ID NO: 494177 - RNA, 63 nt, Human
cguccuuccccucuucuucuuuccuuccaucaaaagauguauuugaauucauacuagaauuca

SEQ ID NO: 494178 - RNA, 63 nt, Human
ucugcacagcagcagaugcaggguuuuuuuuuaaagauguaguuugauuuaucaaauuaaugu

SEQ ID NO: 494179 - RNA, 63 nt, Human
auaauuguaauaaauuauuuaggaaagcaagcaaagauguaaguuuuuuuaauuuagggggaa

SEQ ID NO: 494180 - RNA, 63 nt, Human
cguccugcuccagccugcccguguguaaccuguaagauguacugugugccuccggaagacacc

SEQ ID NO: 494181 - RNA, 63 nt, Human
uugucuugcguguuauuuuuaauuguaucauugaagauguauuuuaaaccaaaggaauuaaau

SEQ ID NO: 494182 - RNA, 64 nt, Human
uauccuccugagcagcugggacuacaggcacacaccaccacaccuggcuaaguuuuguauuuuu

SEQ ID NO: 494183 - RNA, 64 nt, Human
cagcacuggguuuacagaaugaggcccuggcuccccaccacagccccagcugccucagagcagg

SEQ ID NO: 494184 - RNA, 64 nt, Human
ucagccucccgaguacugggaauauaggugcacgccaccacacccaacaaauuuuuguacuuuu

SEQ ID NO: 494185 - RNA, 63 nt, Human
uucuuucuauaccacugucauuaauauauuaaaaagauguauguguuagacuaucgaaagggc

SEQ ID NO: 494186 - RNA, 63 nt, Human
gagaauuuaacauuuuacucuuguaaaucauagaagauguaucauaacaguucagaauuuuaa

SEQ ID NO: 494187 - RNA, 63 nt, Human
aaggaacaucuugagauaugucucaagaauauaaagauguauuauuuuaagccaaggagcuga

SEQ ID NO: 494188 - RNA, 63 nt, Human
guggugagccaccaucaauacagaaagugaccuaagauguaccagcaagaugccaucccuucu

SEQ ID NO: 494189 - RNA, 63 nt, Human
aagagcaacuuguuagaaaacugacaaugucgcaagauguacucaguuuuguuucugugugac

SEQ ID NO: 494190 - RNA, 63 nt, Human
uuguauuguuuauuucauuuugguuuauuuuaaaagauguaaacauauauuaagcuauauuaa

SEQ ID NO: 494191 - RNA, 63 nt, Human
ugcacugugccuuucaacuccagaaacauucugaagauguacuuggauuuaauuaaaaaguuc

SEQ ID NO: 494192 - RNA, 52 nt, Human
acuucugcauggaacucugagcaagauguaaauaaaauuaaaagguggaugg

SEQ ID NO: 494193 - RNA, 63 nt, Human
agccgugggccugcuggacacacacauacaccaaagauguauuuggaucugggcacccccucc

SEQ ID NO: 494194 - RNA, 63 nt, Human
ugagaugggagugagaucugaucggauccugggaagauguauacccaguuagaacguguaggg

SEQ ID NO: 494195 - RNA, 63 nt, Human
cuguaugccauuguucaugccuuaagaaaugcaaagauguacaauaaaucauuuuuaaaaugu

SEQ ID NO: 494196 - RNA, 63 nt, Human
cuuacaauauuuuugacuuacaauuggcuaaucaagauguaacaccaucauaagacaaggaga

SEQ ID NO: 494197 - RNA, 63 nt, Human
cugugguauauaaacuaauucuuggucuauacuaagauguauuugagaaaauacauuugauuu

SEQ ID NO: 494198 - RNA, 63 nt, Human
cugagcgacagugagacucugucucaguccaugaagauguagaggagaaacuggaacucucga

SEQ ID NO: 494199 - RNA, 63 nt, Human
acuuauacauauaauuuugaaaauaacaacuaaaagauguauaacauagcaaaacugcuuaaa

SEQ ID NO: 494200 - RNA, 63 nt, Human
guuacaauuuaaucuuuacaauuaaaagggcgaaagauguagaauuuuaguuuuuguuguuga

SEQ ID NO: 494201 - RNA, 64 nt, Human
ugcaugguaagagugauaccaucuugaagugaaaccaccacaauggccauuuuuuuuuuagaug

SEQ ID NO: 494202 - RNA, 64 nt, Human
cagacucccgaauagcugggauuacagacaggcaccaccacacccagcuaauuuuuguauuuuu

SEQ ID NO: 494203 - RNA, 64 nt, Human
uggccgccacccccaucuuccaccugugcccucaccaccacacuacacagcacaccagccgcug

SEQ ID NO: 494204 - RNA, 63 nt, Human
aggaggcuaauauugucuucuaaguuccaaaagaagauguaauaaaagucuguuaccuuaagu

SEQ ID NO: 494205 - RNA, 63 nt, Human
uauaucgaacgugagaguggagcugcuuaguggaagauguaagugaggugggugucccaugug

SEQ ID NO: 494206 - RNA, 63 nt, Human
uacuugaaccaagagcacaugaaugaacaggaaaagauguaaaaacauuuuuuucugagauga

SEQ ID NO: 494207 - RNA, 63 nt, Human
uugccaccauaccuuuuguacuuuccccuauacaagauguaucucauucuccucaagcauuua

SEQ ID NO: 494208 - RNA, 63 nt, Human
uagauauuaaaaagcagacagucauuaacaaucaagauguaaaagugauccauguuggacaua

SEQ ID NO: 494209 - RNA, 63 nt, Human
cagaaaucuggaaacagaggaaccggugaagugaagauguaauggagauuuagcuaaugaugu

SEQ ID NO: 494210 - RNA, 63 nt, Human
auuuuuuguagguucauuauguuuauguucuuuaagauguauauaagaaccuaccuaucaugc

SEQ ID NO: 494211 - RNA, 63 nt, Human
uugucccauuuuuguuuuuaaauguauuuuuauaagauguauacauguguauuuguaauagau

SEQ ID NO: 494212 - RNA, 63 nt, Human
uuuaugucauauaucaaaucaucucuuuaaccuaagauguaaguauuaagaauaucuaauuuu

SEQ ID NO: 494213 - RNA, 63 nt, Human
acaugagauugaaucaacaugcuuuaauaggaaaagauguauggucuauauauguaucaaucu

SEQ ID NO: 494214 - RNA, 63 nt, Human
cguuuuugaauugugagaggcaguucauuagcaaagauguacugggcaguaacuaaacacaca

SEQ ID NO: 494215 - RNA, 63 nt, Human
agauuccuccuuaugauguaugcuagguuauggaagauguaaaauauucaacuuuuuccuccu

SEQ ID NO: 494216 - RNA, 63 nt, Human
gagcagaagagccccaagcagacuaugucuuucaagauguacagaagacugacaacaggccag

SEQ ID NO: 494217 - RNA, 63 nt, Human
agacugaauaugcauuaaaguaugcagguagcaaagauguaauaaauuugcuuaaaaaaagaa

SEQ ID NO: 494218 - RNA, 63 nt, Human
aggcuaacuaugagcuugcucauuaauuuugaaaagauguaccugguggauaucuagcuagua

SEQ ID NO: 494219 - RNA, 63 nt, Human
aaaacuuuucaggaacuucuguguuguuuaagcaagauguaucuguacugaugucucagugaa

SEQ ID NO: 494220 - RNA, 64 nt, Human
uggcacccaaaguguugagauuuacaggugugagccaccacaccaggccagagcuauauuucca

SEQ ID NO: 494221 - RNA, 64 nt, Human
acacacuugacuuuuuaaaaauacaaccaaccaaccaccacaacuucuuauacauuugggacau

SEQ ID NO: 494222 - RNA, 64 nt, Human
gguaacacccucaagucucuuugccagugaggccccaccacaucggugugaguuagguuucuca

SEQ ID NO: 494223 - RNA, 63 nt, Human
guaaguaggucucauucauuuugacaguuaucaaagauguacuuuccacaguuaaauuuacau

SEQ ID NO: 494224 - RNA, 63 nt, Human
gaugggguaucuucagcaagagagagggcguuaaagauguaaaaugcuuuguccauggggaag

SEQ ID NO: 494225 - RNA, 63 nt, Human
uuuacaucaaugcaugcuucguugugaucccucaagauguaacacuugguaugcucgguugag

SEQ ID NO: 494226 - RNA, 63 nt, Human
ccagcgaggggguugggggauggaguucacaugaagauguaaggaauuugggugggggcuggg

SEQ ID NO: 494227 - RNA, 63 nt, Human
ucucuuuuuuuuuccuuuuuuggcccaauguugaagauguagaacuuuguuuuuaaauaaugu

SEQ ID NO: 494228 - RNA, 63 nt, Human
uauacauuccugagauucugggaaaggugcucaaagauguacugagaggagggguaaauauau

SEQ ID NO: 494229 - RNA, 63 nt, Human
ggacaaaguauggauguggcagaguccucaugaaagauguauccaaacaagauaacuuauaug

SEQ ID NO: 494230 - RNA, 63 nt, Human
gucuuguccuccuguuacuugcuucugcuguacaagauguagcaccuuuucuccucuuugaac

SEQ ID NO: 494231 - RNA, 63 nt, Human
aaggaaauauucaguuagcaguggauauuguacaagauguaacauggcuuagaggaaagagug

SEQ ID NO: 494232 - RNA, 63 nt, Human
auuucaguacuuagcaauuagaguucuuuuauuaagauguaucugcuggauuaaggguacagg

SEQ ID NO: 494233 - RNA, 63 nt, Human
gcuuggcucucuacacauggcauuucaggguauaagauguagcauuucaauguguaagauaua

SEQ ID NO: 494234 - RNA, 63 nt, Human
ugacugacugacuaaaugacacccaaaaugguuaagauguacuugacuaguuuacuuaugcau

SEQ ID NO: 494235 - RNA, 63 nt, Human
uaaacgguuccuuccuucuucuacugugcaaggaagauguaaggaaaaacucgcacacuaucu

SEQ ID NO: 494236 - RNA, 63 nt, Human
uccuggugcuaacuguggucuucuugacacauuaagauguauuuuguauuuuaagagucucau

SEQ ID NO: 494237 - RNA, 63 nt, Human
guugugaaugugcuaauaugugcaucaacuguaaagauguaucaguuuuauuaaaaucaguug

SEQ ID NO: 494238 - RNA, 63 nt, Human
uauaucuauauauauaauuuauugaguuuuuacaagauguauuuguuguagacuuaacacuuc

SEQ ID NO: 494239 - RNA, 64 nt, Human
ccaucuccugccucccuuaggcaggcaccuccaaccaccacacacucccugcuguuuucccugc

SEQ ID NO: 494240 - RNA, 64 nt, Human
cacaguccuuuugucuccaaagcccuucuucuuuccaccacaaauuaaucacuauguuuauaag

SEQ ID NO: 494241 - RNA, 64 nt, Human
cagucuccugagcagcugggauuacaggcaaacgccaccacacccagcuaaauuuuuuuuuuuu

SEQ ID NO: 494242 - RNA, 64 nt, Human
ccacgccaaccagagacuggguuccaaucucaccccaccacauacagagcccucaucugugaaa

SEQ ID NO: 494243 - RNA, 63 nt, Human
aggccauucguuaccuacuuuucagcagcccacaagauguagcacuauuagugucccccucag

SEQ ID NO: 494244 - RNA, 63 nt, Human
uuuuuguucauguuacgggcguuccguuccuuaaagauguauauauuuucuuacuguacauaa

SEQ ID NO: 494245 - RNA, 63 nt, Human
uccuaugggaagaugcuuuuggucuucuggcugaagauguaggcauaccucucacucauuuca

SEQ ID NO: 494246 - RNA, 63 nt, Human
cuacacucauugaaauguaauuucaguucuaaaaagauguaauaaucauuuuagaauuaaaau

SEQ ID NO: 494247 - RNA, 63 nt, Human
gaacaucuauagagauaaauagaaauuuucaauaagauguaguaacacugugauuuaucuuuc

SEQ ID NO: 494248 - RNA, 63 nt, Human
cagauauguauguaaaacuguuuccugaacaauaagauguaugaacggagcagaaauaaauac

SEQ ID NO: 494249 - RNA, 63 nt, Human
auauuguuaaauuaucuuaaauuaucaagguguaagauguaaugaucccaagaguuuuuauag

SEQ ID NO: 494250 - RNA, 63 nt, Human
cugccagagugaaguuugauuccuaugggugagaagauguagaugacuauuguucucacuaaa

SEQ ID NO: 494251 - RNA, 63 nt, Human
uugucaaaaacucauauugaauuuucaaugccaaagauguagcuauugauguuaucagacaga

SEQ ID NO: 494252 - RNA, 63 nt, Human
aaaccaguaguucuuuaauuuacgggucuucauaagauguacuguacaaugcucaauuguuau

SEQ ID NO: 494253 - RNA, 63 nt, Human
uauucuuucuacuguaaaauggcgccuuuaaaaaagauguaagacuuugguucccaacuuugu

SEQ ID NO: 494254 - RNA, 63 nt, Human
aagauaaagauggucacacaaacaguuuccauaaagauguacauauucauuauacuucugacc

SEQ ID NO: 494255 - RNA, 63 nt, Human
uggugcauagcaucucagcuucuuuuaucauuaaagauguauguauaaaaaaaaaaugagugu

SEQ ID NO: 494256 - RNA, 63 nt, Human
ggugugccauaauaauaccagcuauggagucccaagauguaaacauuuuacauaaugaaagca

SEQ ID NO: 494257 - RNA, 63 nt, Human
uauauggggggagugagcucucucagacccuugaagauguagcuuccaaauuugaauggauua

SEQ ID NO: 494258 - RNA, 63 nt, Human
aucuguaacaaugaaagacugccuuuguuuucuaagauguaaaucacucaaaguauauggugu

SEQ ID NO: 494259 - RNA, 64 nt, Human
ccgaaucuuccaaaaaacagccuacaaucugugaccaccacaagaugugcccugauggcagcug

SEQ ID NO: 494260 - RNA, 64 nt, Human
cagccuccuaaguaccugguacuacaggcgcgugccaccacaccuggcuaauuuuugcauuuuu

SEQ ID NO: 494261 - RNA, 64 nt, Human
uuuucuaacaagguauaucuaguaggggagaaagccaccacaauaaauauauuuguuaauaguu

SEQ ID NO: 494262 - RNA, 63 nt, Human
uuuggguagaaagcaguauguuuugcugacauuaagauguagguuauagauagguuuagccuu

SEQ ID NO: 494263 - RNA, 63 nt, Human
caggucauuuguaggcaguuucucuucucacaaaagauguacuuaagcaggcugaucgcuguu

SEQ ID NO: 494264 - RNA, 63 nt, Human
acauccuuuuguuuucuaauuuuaaaaauuauaaagauguaaauggaauuauaaauacuguga

SEQ ID NO: 494265 - RNA, 63 nt, Human
ggaaucaaauccaaagcuuuuaauucucucaacaagauguaaacaggaaagaaaucuaguuga

SEQ ID NO: 494266 - RNA, 63 nt, Human
uguauauuggauuuuucacuugguuagcuaaagaagauguaaaaauaucuaaaauaauguuca

SEQ ID NO: 494267 - RNA, 63 nt, Human
uuauacaaugacuccaaaggcaaucccaaagaaaagauguaaagaauguuuugagcaauggua

SEQ ID NO: 494268 - RNA, 62 nt, Human
augugaaauuuaugcuauaacauuuuuacaauaagauguacaauuuauuaccuauauggaag

SEQ ID NO: 494269 - RNA, 63 nt, Human
acgugguauggauguuugcuuguuuauuaacuaaagauguacagcaaacugcccguuuagagu

SEQ ID NO: 494270 - RNA, 63 nt, Human
caguauuuggaaaguaauccaguuugaaaugugaagauguauuccggcagaauagugaguaga

SEQ ID NO: 494271 - RNA, 63 nt, Human
uuugaaguguguagaccaucucuucauauuuucaagauguaauuuuacauuucugcauuuuua

SEQ ID NO: 494272 - RNA, 61 nt, Human
uucgguccaggagagaaagagcaguuucuguuaaagauguaacaaauggauuuccaaaguc

SEQ ID NO: 494273 - RNA, 63 nt, Human
ucuacaauauauuugaauuuggggcagcauauuaagauguaauggccuguuaugucuugaaaa

SEQ ID NO: 494274 - RNA, 63 nt, Human
gcacacucuugacuccauaauaugaugcuuuuuaagauguauguucacaccaauaauugccug

SEQ ID NO: 494275 - RNA, 63 nt, Human
ucaccucucccugcauggaggcaacagcauuucaagauguaccuugggaagucaggauagcug

SEQ ID NO: 494276 - RNA, 63 nt, Human
guucuaaauauugcuucaauuucaaacuuuugaaagauguauggauuuccaguuuuucuuuac

SEQ ID NO: 494277 - RNA, 63 nt, Human
gcaaccauauuuuuacuuugucuugacaacugaaagauguauaagguuuuuugccagaaaugu

SEQ ID NO: 494278 - RNA, 64 nt, Human
cagccucccagguagcugggacuauaggcacgugccaccacacccggcuaauuuuuuguauuuu

SEQ ID NO: 494279 - RNA, 64 nt, Human
acugcauucucaauuagaaaacugcaauuugguuccaccacauucugacuacuacaguauaguu

SEQ ID NO: 494280 - RNA, 64 nt, Human
uuuauaguggaacccucuuuucccccuagaagaaccaccacaaggaaaaaugcugucaccauaa

SEQ ID NO: 494281 - RNA, 63 nt, Human
auucuuaauugcaucacacaauagauguaaaugaagauguagucaccucagauaaaauuggua

SEQ ID NO: 494282 - RNA, 63 nt, Human
gggcuuccucccgaaaugugagacuauacuuuaaagauguaugguuagaguccaauugccauu

SEQ ID NO: 494283 - RNA, 63 nt, Human
cacugcaccuggccuacguauuaggcuuuauguaagauguacauaguacuccauacuccuuuc

SEQ ID NO: 494284 - RNA, 63 nt, Human
ucucuuguaacugcacaauagcagaaaauuggcaagauguauuuuuacuuuccaagaugccgu

SEQ ID NO: 494285 - RNA, 63 nt, Human
uuuuggaaaauguauuuugccucuggguaggaaaagauguauguugcuauccugcaggaaaua

SEQ ID NO: 494286 - RNA, 63 nt, Human
uacuuuugcuuucucugagagacugcagauaauaagauguaaacauuaacaccucgugaauac

SEQ ID NO: 494287 - RNA, 63 nt, Human
guauaccuagaaaagugaaauugaaaauaccaaaagauguaucauuuuuauuugaauccauca

SEQ ID NO: 494288 - RNA, 63 nt, Human
cuuuuguuuuuggcugucucugguccuugauucaagauguauuuugauucauccaaggguuuc

SEQ ID NO: 494289 - RNA, 63 nt, Human
aauguaaaaauggaacuuauuuuugucaaaaauaagauguacacuugucaugauuuauauaug

SEQ ID NO: 494290 - RNA, 63 nt, Human
uguagguaugucugugccauuucucagggaaguaagauguaaauugaagaagccucacacgua

SEQ ID NO: 494291 - RNA, 63 nt, Human
cugaaaguuuuuaauugaaaguauuauuaguuaaagauguaaaccuagccaaaauuaccaguu

SEQ ID NO: 494292 - RNA, 63 nt, Human
uugcuaguuaaaaaauaaaaccuuugagaaucuaagauguacauuuuuaccuuuuaggcaauu

SEQ ID NO: 494293 - RNA, 63 nt, Human
aacauucaccucauuaaccuaaaaugucucccaaagauguauguaagacacacacugcccuaa

SEQ ID NO: 494294 - RNA, 63 nt, Human
ccaucuguaauccaugucuauaaucuaccaacaaagauguacucuuaaacucaguaucaccag

SEQ ID NO: 494295 - RNA, 63 nt, Human
uauguguaaauuguguuauuauguauauggguaaagauguacaaauauauguccucuuuguag

SEQ ID NO: 494296 - RNA, 63 nt, Human
caaagcuguuaccuucuacagaauuuaagucugaagauguaaagagagaacaggccuugugua

SEQ ID NO: 494297 - RNA, 64 nt, Human
cagccucccaaagugcugggauuacaggcgugagccaccacaccaggcccgagaaaugcuuuuu

SEQ ID NO: 494298 - RNA, 64 nt, Human
cagccuccggaguagcugggauuacaggcacaugccaccacacccagugaauuuuuguauuuuu

SEQ ID NO: 494299 - RNA, 64 nt, Human
cgaugcaagggcgcuguggcccccgggugaucucccaccacacuuacugucuuccuuuaucucu

SEQ ID NO: 494300 - RNA, 63 nt, Human
aagacauucuuguacauauuaucaauaggcuauaagauguaacaacgaaaugaugacaucugg

SEQ ID NO: 494301 - RNA, 63 nt, Human
ucuuuuggacaauuuaucuuauuucuaucauauaagauguauuuuuuuauuguccuuaaaaga

SEQ ID NO: 494302 - RNA, 63 nt, Human
guuuuccccaccaaccccuuuucacaugcuccaaagauguaguagugucugcuguuuuggauc

SEQ ID NO: 494303 - RNA, 63 nt, Human
cauuuacuuuuucuaaaaaaguuuuagaagaaaaagauguaacuaaacuuuuaaaguagcucc

SEQ ID NO: 494304 - RNA, 63 nt, Human
ucaugggcuuugcugagaguuuaguuaaggacaaagauguaaaaaugccaaauuugggaaagg

SEQ ID NO: 494305 - RNA, 63 nt, Human
ucuauugucuuagaauugauugccagaaauugcaagauguaauauaucaaagucagggaugag

SEQ ID NO: 494306 - RNA, 63 nt, Human
aaaauucaugggaaauggcccuucauuuaaaaaaagauguaccucacuacccacuacaaauuu

SEQ ID NO: 494307 - RNA, 63 nt, Human
cucuugaauuugguaucuuauuaaugaguuuuaaagauguaaaaccuaaccuuuuuuaaagcu

SEQ ID NO: 494308 - RNA, 63 nt, Human
aagcuaauuuuguugaauguuuagaauugagcaaagauguaaauuuuugaagggcaguuuaga

SEQ ID NO: 494309 - RNA, 63 nt, Human
gaauacucaucuuacaggggaauuugugaccagaagauguaguaacuucaaugacugaaaguc

SEQ ID NO: 494310 - RNA, 63 nt, Human
agagaauccgaggcuaugagugggggugggggaaagauguacaggaugcuuugguuucacucc

SEQ ID NO: 494311 - RNA, 63 nt, Human
aaaauguucugcauuguagucaauaaagggcuuaagauguaaaacaaugcauuuucucucuca

SEQ ID NO: 494312 - RNA, 63 nt, Human
auacucuguaaguaggagguacuuugucccaaaaagauguauaagaauguacuaauaguuuua

SEQ ID NO: 494313 - RNA, 63 nt, Human
uugauaaaguugcaauugaaauauuauuaacagaagauguaagaaauuucugcauggucuaaa

SEQ ID NO: 494314 - RNA, 63 nt, Human
uggaagauuaagucaugacaauucaaagaaaagaagauguagccucuuuuccagaauaagagu

SEQ ID NO: 494315 - RNA, 63 nt, Human
uaaaagugcgcuguacuucuuaauguuuauuaaaagauguauuuuuacaaguuucugcuucug

SEQ ID NO: 494316 - RNA, 64 nt, Human
aagugacagccaggaagagaccugaagguuggggccaccacaaugccaaaucguuucuaaagga

SEQ ID NO: 494317 - RNA, 64 nt, Human
aguuguuccuaucucucccccgccccccaccgccccaccacacacauauuuuuaaaguuuuucc

SEQ ID NO: 494318 - RNA, 64 nt, Human
ggacaggggguagccccuggauucaggcacacgaccaccacacgagcacgugccacgcaugccu

SEQ ID NO: 494319 - RNA, 63 nt, Human
uuuguuaccaguuguaauuugucuguauuaugaaagauguaaugguuugucagcugucacugu

SEQ ID NO: 494320 - RNA, 63 nt, Human
uuaucuuuguguuccucaagcucuuuaaagaaaaagauguaaucguuguaaccuuugucucau

SEQ ID NO: 494321 - RNA, 63 nt, Human
gaauccugcuuuacaggaucauguaaaugcucaaagauguaauguaguucuuuguuccugcuu

SEQ ID NO: 494322 - RNA, 63 nt, Human
cuuugggaauaguuuuuccuuuucaaguuuuucaagauguagguauauccaugaaugcaauuu

SEQ ID NO: 494323 - RNA, 63 nt, Human
gugcugucaguauaaaauacauaccagauuuuaaagauguaccaaaaaauguaaacuaucuca

SEQ ID NO: 494324 - RNA, 63 nt, Human
ugcuguuuuccacccauuuuauuauacucuuaaaagauguaauuguugucauuuugaacaguu

SEQ ID NO: 494325 - RNA, 63 nt, Human
ugauuuacagacugaugccagacaaaccuugggaagauguaucaauggagcaugugugcaaaa

SEQ ID NO: 494326 - RNA, 63 nt, Human
caaaagaaugcauguuucacauugugacagauaaagauguaugauuucuaaggcuuuaaaaau

SEQ ID NO: 494327 - RNA, 63 nt, Human
guauaaauuaauacagaguacguuaaaagcaaaaagauguauauuugcauauuuuucuaaaga

SEQ ID NO: 494328 - RNA, 63 nt, Human
aauaugugaagaaaaagaccugcauuuggcaggaagauguaugcuuugaaugcaaaagaaauu

SEQ ID NO: 494329 - RNA, 63 nt, Human
aaaagccaacauaugccgugaccuacguaggaaaagauguauuugugcaucuucuuucugggu

SEQ ID NO: 494330 - RNA, 63 nt, Human
caggcuugauuuggagggugaaugacgccuagcaagauguauuguacuuguguuuuuuuaauu

SEQ ID NO: 494331 - RNA, 63 nt, Human
uuuacauaaagccugugccuuuccuagaaaguuaagauguaaauguauucucacauguaaauu

SEQ ID NO: 494332 - RNA, 63 nt, Human
ccugaaaacuuaagaaaucuggagaauuuucugaagauguaaccagaucuuuccaaauacaaa

SEQ ID NO: 494333 - RNA, 63 nt, Human
accugaaaaagcauucuggagugcugaauuuuuaagauguauauuuuguuaagcauauucucu

SEQ ID NO: 494334 - RNA, 63 nt, Human
gucuucuacacuuucucugaaucauuuagguuuaagauguaagugaacaauucuuucuuucug

SEQ ID NO: 494335 - RNA, 64 nt, Human
uauacaggagauuggaaucuacuuugucauuuauccaccacagugacaaaggaaaaguggugcc

SEQ ID NO: 494336 - RNA, 64 nt, Human
caggccugggugccacacagagguggccacccucccaccacagugucugcagcugcugcccuuc

SEQ ID NO: 494337 - RNA, 64 nt, Human
ucggcccccaaagugcugggauuacaggcaugagccaccacaucuggccuaggaccuuaaauau

SEQ ID NO: 494338 - RNA, 63 nt, Human
cugagaccaugccacuagcuuuuaagggcuaccaagauguacaacagaacaugauagcccauu

SEQ ID NO: 494339 - RNA, 63 nt, Human
ugauuuuauauguauauuuccuauagacucuuuaagauguauuuauaauguuucuaauaugaa

SEQ ID NO: 494340 - RNA, 63 nt, Human
gauuacaugauucaagcgagggauuuuaaaguaaagauguauuuauucugaagaaucuaaaag

SEQ ID NO: 494341 - RNA, 63 nt, Human
cacgucauugccauccaguacugacagggaagaaagauguaguuuuccaguagugaugaauca

SEQ ID NO: 494342 - RNA, 63 nt, Human
gacuggauacuuuuugaaaucugacuuucuuugaagauguauguuaagcaaaaacauguugcu

SEQ ID NO: 494343 - RNA, 63 nt, Human
gaguaccauauugcuaagaaaacugucuuauaaaagauguauaugugugaagacaugaaaguu

SEQ ID NO: 494344 - RNA, 63 nt, Human
uuaugaagauucuacucuugguaagaguauuuuaagauguacuaugcuauuuuacuuuuuuga

SEQ ID NO: 494345 - RNA, 63 nt, Human
agcagaggcaggcugggacggaccagcaucuggaagauguacauaguuauuuuucucuuugug

SEQ ID NO: 494346 - RNA, 63 nt, Human
auagacguaaaaauaaaggcauuuggcugguccaagauguaauuaucaaucagucagcaccug

SEQ ID NO: 494347 - RNA, 63 nt, Human
aaagugucagaugagaauuuuaggggcuggaggaagauguaaaagaugaaaauguuuuccuua

SEQ ID NO: 494348 - RNA, 63 nt, Human
gaauagaaacaagccugccauaauccuuuggaaaagauguauuauaccagugaaaagguguua

SEQ ID NO: 494349 - RNA, 63 nt, Human
guucguugauuaguugcuacaggcuguaccuauaagauguacaggauaauaguuaaauguuga

SEQ ID NO: 494350 - RNA, 63 nt, Human
uuaaaacaggcuagaaucucauguuuuauaugaaagauguacaauucaguguuuaaaaauaaa

SEQ ID NO: 494351 - RNA, 63 nt, Human
acgaaaaguuaauccucuuagaauaccuauaaaaagauguaaacuaauguaccucaguaauua

SEQ ID NO: 494352 - RNA, 63 nt, Human
uuuuuaauaugacugugaccuugacugauaauaaagauguaauaagaauugcaagcuaaaugu

SEQ ID NO: 494353 - RNA, 63 nt, Human
auccacugaaucuaauaagggacuuguaucgguaagauguaaagaacucuuggccaggugugg

SEQ ID NO: 494354 - RNA, 64 nt, Human
cagccuccugaguagcugggacuacaggugccugccaccacacccagcuaauuuuuuuuguauu

SEQ ID NO: 494355 - RNA, 64 nt, Human
cagccuccugaguagcugggauuauaggcaugcaccaccacacccagcuauuuuuuguauuuuu

SEQ ID NO: 494356 - RNA, 64 nt, Human
cucacguggcccuuauggugcccugugcagggugccaccacagccucauuuuacagacagcccc

SEQ ID NO: 494357 - RNA, 63 nt, Human
uuucaguuuacucagaauuuucaauuugcuauaaagauguaucaauuagcauauagaaaaaua

SEQ ID NO: 494358 - RNA, 63 nt, Human
uccacuucaauagcugccccuuuaggaucaagaaagauguacacugucagagcauuguuaaug

SEQ ID NO: 494359 - RNA, 63 nt, Human
cuuguuuuuccauuguaugcaaauugaaagaaaaagauguaccauuucucuguuguauguugg

SEQ ID NO: 494360 - RNA, 63 nt, Human
aucccucuauauuuauauuuuuuaagacuaagaaagauguaagacuaauguucugugcuguau

SEQ ID NO: 494361 - RNA, 63 nt, Human
aguuacagaagcaguuguguuaauauuuagaagaagauguauaucuuccagauuuuguuauau

SEQ ID NO: 494362 - RNA, 63 nt, Human
ugggaaagcaggaggauggacacaccccacugaaagauguaggcaggggcaggucucucaacc

SEQ ID NO: 494363 - RNA, 63 nt, Human
aauucuaagacuuuugaauuuucauuuuuuaaaaagauguacaaaacaguuugaaauaaauuu

SEQ ID NO: 494364 - RNA, 63 nt, Human
gugcaaguuuuuuggugcuguaguauaugaugaaagauguaaagcugaauaaagcauuauuuc

SEQ ID NO: 494365 - RNA, 63 nt, Human
uagggcugguauucuuugcuuagguucauuuacaagauguaucaguguuguaaguccaauaau

SEQ ID NO: 494366 - RNA, 63 nt, Human
augauauuacuguauuuauuuuaagaaagcacuaagauguaauaaagugaugaacuaauuugc

SEQ ID NO: 494367 - RNA, 63 nt, Human
aaacccaaaacauuuagugguccguugccucugaagauguaaacaaacaaauacacuauuucu

SEQ ID NO: 494368 - RNA, 63 nt, Human
uuguauguauaauucaaagcaccaaaauaagaaaagauguagauuuauuucaucauauuauac

SEQ ID NO: 494369 - RNA, 63 nt, Human
gaaaaaagcccgggagggguggggagaauuucgaagauguauuucaucucaagcuugcucuuu

SEQ ID NO: 494370 - RNA, 63 nt, Human
uguguacaugucacgaaaccauuucccuuaucaaagauguaauuuguaaaccucaaauaguug

SEQ ID NO: 494371 - RNA, 63 nt, Human
cuuccaaauauugacuacuaaaggcaguucugcaagauguacuaaauauguauauuagaaauu

SEQ ID NO: 494372 - RNA, 63 nt, Human
uacaguuuauaccaguguaugcucuagacuuggaagauguaguauguuugauguggauuaccu

SEQ ID NO: 494373 - RNA, 64 nt, Human
cagccucccaaguaggugggacuacaggugcccgccaccacacccggcuaauuuuugcauuuuu

SEQ ID NO: 494374 - RNA, 64 nt, Human
cagccucccaaagugcugggauuacaggcaugagccaccacacccagccccuuuccaaccauuu

SEQ ID NO: 494375 - RNA, 64 nt, Human
auuucaacuaguuaucagcaagugacaauacauuccaccacaaauacacucuuguucuucuagc

SEQ ID NO: 494376 - RNA, 63 nt, Human
uucuucaauuuuaguaacugguaaaauacauguaagauguaccaucuuaaccauuuuuaagug

SEQ ID NO: 494377 - RNA, 63 nt, Human
uuugguuuuauuuuauacuugccaucagugaaaaagauguacagaacacauuucucugaucuc

SEQ ID NO: 494378 - RNA, 63 nt, Human
aauuuccuacuacagcagugcaguccagagguuaagauguauuagaauuauacaauaucaguu

SEQ ID NO: 494379 - RNA, 63 nt, Human
uuuuuauacuccaccuccuuucaaaaaagauuuaagauguacgacauuaccgaacaccuaaaa

SEQ ID NO: 494380 - RNA, 63 nt, Human
uuacuggauucuguucaacuguaaucaaugaaaaagauguacguuguagacaaaguugcagaa

SEQ ID NO: 494381 - RNA, 63 nt, Human
ugcaguaacaagcauaaaacucacaucuuaaugaagauguaucuaccagugucauucaauuag

SEQ ID NO: 494382 - RNA, 63 nt, Human
aaaaccgaaaaagcaaaacugcaaaaaaguacuaagauguacgggucuuggggauaucugccu

SEQ ID NO: 494383 - RNA, 63 nt, Human
ccaacacauuguuucugagcuccacaaaugcaaaagauguauuuuccuguggcccaugacauu

SEQ ID NO: 494384 - RNA, 63 nt, Human
ugaucuuucccacuuucuguuuucggauuggagaagauguaccuuuuuugucaacucuuacuu

SEQ ID NO: 494385 - RNA, 63 nt, Human
uguaaaauuauuacuguauuguguacuggcuauaagauguagacaccuuucaguaagccaauc

SEQ ID NO: 494386 - RNA, 63 nt, Human
uaaaaucuaguuucuauuuaucaacguguugugaagauguaccuaaugaaguuuugagaaagc

SEQ ID NO: 494387 - RNA, 63 nt, Human
ucauaaaucauguuguuguguguauauguauuuaagauguacauuuaauaauaucaaagagaa

SEQ ID NO: 494388 - RNA, 63 nt, Human
cuaugucuccgggugcuccaguuucaaaccccaaagauguauacauuagguuaauugacauau

SEQ ID NO: 494389 - RNA, 63 nt, Human
uccaguggagcaguuuuaugaaauauguucuauaagauguacauuuuuucauuguaacauaga

SEQ ID NO: 494390 - RNA, 63 nt, Human
aacccuugcaacauugccugaaguuuauggaauaagauguauucucacucccuugaucucaag

SEQ ID NO: 494391 - RNA, 63 nt, Human
auuuaauuauuuugcaaagcaaccuaagagcuaaagauguaauuuuucuugcaauuguaaauc

SEQ ID NO: 494392 - RNA, 64 nt, Human
uagccucccuaguagcugggacuacagggauguaccaccacacccagcuaaucuucaucuaauc

SEQ ID NO: 494393 - RNA, 64 nt, Human
uacuuacauuccuuuuuugauggcuaaaauacuaccaccacacaaucaucuuuuuuuuccugaa

SEQ ID NO: 494394 - RNA, 64 nt, Human
cagccucccgaguagcugggauuacaggugcucaccaccacacccagcuaauuuuuguauuuuu

SEQ ID NO: 494395 - RNA, 63 nt, Human
gagaagagagagggagauaaaagggggagacaaaagauguacagaaaugauuuccuggcuggc

SEQ ID NO: 494396 - RNA, 63 nt, Human
ugacuuaugggccgaggcuguucugagccugggaagauguaccuaugucaagagaagggauga

SEQ ID NO: 494397 - RNA, 63 nt, Human
gaaguuuauguacaguuguauauacaguaugacaagauguaaaauaauauguuuuucaugcag

SEQ ID NO: 494398 - RNA, 63 nt, Human
ggaaucagagaaagaaaauauaauuuaacuuuaaagauguaaauuauauauauaguauauuau

SEQ ID NO: 494399 - RNA, 63 nt, Human
uucuuauacuaucaagaaaaaauucugugaauuaagauguaauuuauaaaauaacauuucaau

SEQ ID NO: 494400 - RNA, 63 nt, Human
ugauggucuccuaugguauaguucacucuguagaagauguaugcaaagugaaaugccagcccu

SEQ ID NO: 494401 - RNA, 63 nt, Human
aaaaaaaagaaguuacuuccaagacagacuuuuaagauguaaccagcacaaagcaaugucagg

SEQ ID NO: 494402 - RNA, 63 nt, Human
gagcaagugaggcaaucuggcaaaagauuaauaaagauguaaaccccuggaaacccuuuggug

SEQ ID NO: 494403 - RNA, 63 nt, Human
guauucucaggauucaggaucuacccagcaccaaagauguauuuucaggagaacagaccuaga

SEQ ID NO: 494404 - RNA, 63 nt, Human
ggcuuggcagugggcugcaguggaaaucaacucaagauguacacgaagguuuuuuaggggggc

SEQ ID NO: 494405 - RNA, 63 nt, Human
uugaccauagaaaaauacagucauucauuggcaaagauguacaguggugguuuagugcaguga

SEQ ID NO: 494406 - RNA, 63 nt, Human
auaaaauauugucccuugcuacuugauauauuaaagauguagauuuuaaaguguuucauuuuc

SEQ ID NO: 494407 - RNA, 63 nt, Human
aauaagaauuuagaagugguaaaauuauggcccaagauguauuugguucucuauuauguuuug

SEQ ID NO: 494408 - RNA, 63 nt, Human
agagcaagacucccucucaaaagaaaaagaaaaaagauguaaaaaccauucuuaguuuguggg

SEQ ID NO: 494409 - RNA, 63 nt, Human
aagccacugugcccaggcagacccccuucuuuaaagauguaaaacccggccgggcgcgguggc

SEQ ID NO: 494410 - RNA, 63 nt, Human
gaacauacugaguacuuagaaguagaagaacauaagauguauuucugacuaaaacaaauggcu

SEQ ID NO: 494411 - RNA, 64 nt, Human
cagccuccugaguagcugggacuacaggcgcccaccaccacacauggcuaauuuuuguauuuuc

SEQ ID NO: 494412 - RNA, 64 nt, Human
aauuucucuguuuccucaggaagucauuacugcgccaccacaucacaugaccuuaacaugauca

SEQ ID NO: 494413 - RNA, 64 nt, Human
ccccaaauaugaacaacugcagcaggugccaccaccaccacaaaagacaccacuacccuuguaa

SEQ ID NO: 494414 - RNA, 63 nt, Human
acaagauacugugaaucuagauguucugaccuaaagauguagucuacauagccccagcuuggg

SEQ ID NO: 494415 - RNA, 63 nt, Human
aauuagguugaggaaagugcuuuagaaauaauaaagauguacaaauacaaggcuuuggauuuu

SEQ ID NO: 494416 - RNA, 63 nt, Human
guucauaauuaaaaaguauuuuccagcaguccaaagauguaaguuaucuuacacauaaaaugu

SEQ ID NO: 494417 - RNA, 63 nt, Human
gauuaagucuaccaaagaacacacugcauguaaaagauguauuacaaucucaaagccaguaaa

SEQ ID NO: 494418 - RNA, 63 nt, Human
caguuauuugagaugaaagaucucugcuuauugaagauguaccuucuaaaacuuuccuaaaag

SEQ ID NO: 494419 - RNA, 63 nt, Human
uagcagccauuugggaguaggggguagguggggaagauguacuccguaucaaauaauaaugau

SEQ ID NO: 494420 - RNA, 63 nt, Human
uggaggauuaucuucugguguuguguccaucauaagauguaaaaagagaaaucauaguuuuau

SEQ ID NO: 494421 - RNA, 63 nt, Human
caucuuagggucacucacacccucuguaauuuuaagauguaugugguggccggcgggaagacc

SEQ ID NO: 494422 - RNA, 63 nt, Human
aagaauaagaaauacaaguacaaauuggugaugaagauguauucguauuguuugggauuggga

SEQ ID NO: 494423 - RNA, 63 nt, Human
aauuuuggggaaggguuugaauuguuuucuuuaaagauguaaugucccuuucagagacagcug

SEQ ID NO: 494424 - RNA, 63 nt, Human
aaauucauuuuauaauggcuauuuugugacgauaagauguaguucauguuuuucuguagcacu

SEQ ID NO: 494425 - RNA, 63 nt, Human
aagcuguuuauauucugauaugaaacuaccaucaagauguauaaaguaaaaauaacuaaggag

SEQ ID NO: 494426 - RNA, 63 nt, Human
gcuacguguauuggaccucuggccaaauuacaaaagauguacucuuuguucucuaaaaccaca

SEQ ID NO: 494427 - RNA, 63 nt, Human
acauaaaaaauauacaaauuuuuggcugcugugaagauguaauuuuaucuuuuaacauuuaua

SEQ ID NO: 494428 - RNA, 63 nt, Human
ugccagcgggugagauggccgauggagguuucaaagauguagcuagcauuuugaaaccauaug

SEQ ID NO: 494429 - RNA, 63 nt, Human
ccugucccccaggaaccucacagggguaucaaaaagauguaaacagcccagaggcuuaugagc

SEQ ID NO: 494430 - RNA, 64 nt, Human
agcacuaucauuaaucuuucaaucuaauuauucaccaccacaagaccuauuaacaagacaaaau

SEQ ID NO: 494431 - RNA, 64 nt, Human
cagccucccaaagugcugggauuacaggugugagccaccacagccagccaguaugaccuaucuu

SEQ ID NO: 494432 - RNA, 64 nt, Human
aauucaacauugccauaaaugcuuuaaagaaaacccaccacacuuuccuccuacuccggucuuu

SEQ ID NO: 494433 - RNA, 63 nt, Human
uuuaaaaauaaaguauuagaaaaauguguaguaaagauguaaaauuaaaaaauggaauucucc

SEQ ID NO: 494434 - RNA, 63 nt, Human
uugugugugugaaacacuucaaaacugauuuaaaagauguaaauuuaaaauugguuguaucua

SEQ ID NO: 494435 - RNA, 63 nt, Human
ucaccaaacccugacuuuauugaaugcuaguagaagauguagaauuagagacaucugauuugu

SEQ ID NO: 494436 - RNA, 63 nt, Human
aggaagccugaaccaauccuuccacauacuguuaagauguagacuuggaacaaagcuguuggg

SEQ ID NO: 494437 - RNA, 63 nt, Human
cuagagaagaaaagugaagaagucauguugaagaagauguaagaaugugucaagaccauccag

SEQ ID NO: 494438 - RNA, 63 nt, Human
aagaaaaacacuaguguccaauuucauuuuuaaaagauguagaaagaagaaucaagcaucaau

SEQ ID NO: 494439 - RNA, 63 nt, Human
augccacaguccuccauuaggcugaugacuccaaagauguaacucuagccucuugccugagcu

SEQ ID NO: 494440 - RNA, 63 nt, Human
gacuuuuuuccuuuuguauuuguaauguugauuaagauguaaaauaaaaagugugccugauua

SEQ ID NO: 494441 - RNA, 63 nt, Human
uguuaaaugucuguuuuaaaagaaaguaguguuaagauguaucaguaacugaaaugauaugcu

SEQ ID NO: 494442 - RNA, 63 nt, Human
uauuuuaugcacuugggagaaggcuuagaauaaaagauguagcacauuuugcuuucccauuua

SEQ ID NO: 494443 - RNA, 63 nt, Human
ggaacagagacaucagaaggaaagacuggugaaaagauguaucuuuguauauuaauagcugua

SEQ ID NO: 494444 - RNA, 63 nt, Human
uuuuucaucaucuuuaaggacuucuuauaaggaaagauguaucguaucgcagucaucugaguu

SEQ ID NO: 494445 - RNA, 63 nt, Human
ccgucuccagagcccugggcagcauuuuccagcaagauguacacaaucuuuugccuuuauuuc

SEQ ID NO: 494446 - RNA, 63 nt, Human
uuuugaagggaauuugagguugaucugguuuucaagauguaguuaaaggaauaaaucacucaa

SEQ ID NO: 494447 - RNA, 63 nt, Human
uuccuuaagcuauuguaaccauguuuuauugcaaagauguaaaauaugccagaugugugugag

SEQ ID NO: 494448 - RNA, 63 nt, Human
uuaauauggagugaaaacuggaccagagguggaaagauguauuugccccaguucacuucaaag

SEQ ID NO: 494449 - RNA, 64 nt, Human
cagccuccugaguagcugggauuacaggcaugaaccaccacaccuggauaauuuuuguauuuuu

SEQ ID NO: 494450 - RNA, 64 nt, Human
cagccucccaaagugcugggauuacaggcgugagccaccacaccuggccuuucugcaacauuuu

SEQ ID NO: 494451 - RNA, 64 nt, Human
uaaaaggucacacaaaagaagcaaucgggcuccgccaccacaaaaugaaacccaagguacauuu

SEQ ID NO: 494452 - RNA, 64 nt, Human
cagccucccaaagugcugggauuacaggugugagccaccacacuuggccaguauauccucagua

SEQ ID NO: 494453 - RNA, 63 nt, Human
auguuuggaaacauuuuuuaaaacaagccaagaaagauguauauaggugugugagacuacuaa

SEQ ID NO: 494454 - RNA, 63 nt, Human
uauaguuuuguuuguuagaaaaguugcucuuaaaagauguaaauagaugacaaacgauguaaa

SEQ ID NO: 494455 - RNA, 63 nt, Human
caucacuaaaucuuaggauuuaggauugcuguaaagauguaaguuguguauguuuggcagguc

SEQ ID NO: 494456 - RNA, 63 nt, Human
ucaauagaauugccacaaacugcaugcuaaauaaagauguaguucuucuggacagaccacaac

SEQ ID NO: 494457 - RNA, 63 nt, Human
aagagccugccguguguuaaucauuugccuuacaagauguaccagacgguuuccaguacuaac

SEQ ID NO: 494458 - RNA, 63 nt, Human
acauuuguuacagauaguuuuaugccuaagaccaagauguaaaguaccaucugcccuuaaaaa

SEQ ID NO: 494459 - RNA, 63 nt, Human
cuggaaucuuaaaaaaggaguuuuuaauaagucaagauguacaauuuguaguaaauuagcaga

SEQ ID NO: 494460 - RNA, 63 nt, Human
aauagauggugccccccaaauugucuccacaugaagauguacugaugacgccccagaaaugcu

SEQ ID NO: 494461 - RNA, 63 nt, Human
guauuauagagcuauucagauauuuuaaauauaaagauguauuguuuccguaauauagacgua

SEQ ID NO: 494462 - RNA, 63 nt, Human
gaaggucaauuucaguguaugauauacuuuauuaagauguauaaaaauccugaaguuuuuauu

SEQ ID NO: 494463 - RNA, 63 nt, Human
gcagcauguguuuuaagcucuguuaaggggugaaagauguaauuauugacagauuaaauagau

SEQ ID NO: 494464 - RNA, 63 nt, Human
acccagcugaauaguuacugcugcacuuucacuaagauguauuugaacacuuggugaguaggg

SEQ ID NO: 494465 - RNA, 63 nt, Human
aaaguggaaaaggacauuucuguaguagcuguuaagauguaugcaguuguccuaucacaguua

SEQ ID NO: 494466 - RNA, 63 nt, Human
cauacccaguauguauacuuauuaaucuguaugaagauguacauucuaaaauauaaucaacca

SEQ ID NO: 494467 - RNA, 63 nt, Human
caaagucuuaaguguguuugcagcucaaaaauaaagauguauuaaggggggaaaaccuggucu

SEQ ID NO: 494468 - RNA, 63 nt, Human
uuuuacauuuaagcauuuguaaaguuacagcaaaagauguaccuguuaauacacagaaugugu

SEQ ID NO: 494469 - RNA, 64 nt, Human
aaccucggcaggugccgugugaggggcuuaaugaccaccacagggagcucagaccccaacccug

SEQ ID NO: 494470 - RNA, 64 nt, Human
cucuauuucugugacgcgcccccaugcccccaccccaccacaagaggcaggagggcccagucau

SEQ ID NO: 494471 - RNA, 64 nt, Human
cagccuccugaguagcugggauuacaggcaugcaccaccacaccaggcuaauuuuguauuuuua

SEQ ID NO: 494472 - RNA, 63 nt, Human
cauucuauccuagaaagauuuuaaugugagcuuaagauguaaauaaauaauuuugcaaacaug

SEQ ID NO: 494473 - RNA, 63 nt, Human
acagaaaguaaaguaucacauuuauaaauaccaaagauguaacaauuuuaaaauuuucuagau

SEQ ID NO: 494474 - RNA, 63 nt, Human
ccguggcuauaguuuuaucaagacucugaacacaagauguaacaaugcaaauaaauuuaugua

SEQ ID NO: 494475 - RNA, 63 nt, Human
uauuuaaaauucaaaaguaauuaauaguguuggaagauguaggugagaaaauauuccugaaag

SEQ ID NO: 494476 - RNA, 63 nt, Human
uaaacucauaaaacucauaauguugauauaaucaagauguaaccacuauaaauauguagaaga

SEQ ID NO: 494477 - RNA, 63 nt, Human
cauuugcuaacucccagaauuggaucaucuccuaagauguacuuacuuuuuaaaguccaaaua

SEQ ID NO: 494478 - RNA, 63 nt, Human
cucauguaauugaaaauuacuggaaagcacuggaagauguagauuauguacagacauuuaaag

SEQ ID NO: 494479 - RNA, 63 nt, Human
aucuaccaauccaugugcauuggauugcacacuaagauguauuuucuuacgaaauaguucugu

SEQ ID NO: 494480 - RNA, 63 nt, Human
ugaaauauugauguggggagguuuauugagcacaagauguauuucagcccaugcccccuccca

SEQ ID NO: 494481 - RNA, 63 nt, Human
uuucauguuucaaaauuucagauuuuacauguuaagauguacuaacaauauuccuuguaucaa

SEQ ID NO: 494482 - RNA, 63 nt, Human
gacuucuguuugaaauugcucaaugacuaggaaaagauguaguaguuuacuaaaauuguuuuu

SEQ ID NO: 494483 - RNA, 63 nt, Human
ucuccauuacauagggacuguacagagccugugaagauguaugaaugguaucuuuuauaaucc

SEQ ID NO: 494484 - RNA, 63 nt, Human
uagaacuauuugacaauucagacuuucaaaauaaagauguaaaugacuggccaauaauaacca

SEQ ID NO: 494485 - RNA, 63 nt, Human
caggcacagugccaggccccgggaguggggaccaagauguacauaagacaaagcuacugccuu

SEQ ID NO: 494486 - RNA, 63 nt, Human
auuuuuggcuuuacaguuucuuucagugcuuuaaagauguaccucugcuauuuacuugcauug

SEQ ID NO: 494487 - RNA, 63 nt, Human
guuuccuacuggugguuuugauauuguuuguuuaagauguauauuuagaaugacaucaucuaa

SEQ ID NO: 494488 - RNA, 64 nt, Human
cacaaccaccaugugucuucuaggugcuggcccaccaccacacaucacaggcugauuuccacag

SEQ ID NO: 494489 - RNA, 64 nt, Human
cacuaagaugugaggaaauugugauuuguucucuccaccacaaaugaauuacacauuuauuauc

SEQ ID NO: 494490 - RNA, 64 nt, Human
aucuaaaugggugggccauuugauuguagaggguccaccacagaauuaugggaugccuuaagug

SEQ ID NO: 494491 - RNA, 64 nt, Human
ggaaauauauuuuaccauacauuuaaaguuuuggccaccacauguaucacgggucacuugaaau

SEQ ID NO: 494492 - RNA, 63 nt, Human
auugaaagguggaauauuguaaaaauuuugucaaagauguacuguagugcuauuugaaguacc

SEQ ID NO: 494493 - RNA, 63 nt, Human
ggaucccuucuuuuccuuuuuuuguuuuuuuguaagauguagaugcuuauucuuugcuuuaga

SEQ ID NO: 494494 - RNA, 63 nt, Human
uauggccaagaggaaagaagagugacguugucuaagauguaaugagugcucucugagagaauc

SEQ ID NO: 494495 - RNA, 63 nt, Human
gcauuauaucuccaaggcguugguauauggaaaaagauguaggggcuuggagguguucuggac

SEQ ID NO: 494496 - RNA, 63 nt, Human
gaagcuuaaauguguuucuucugaaagcuguuaaagauguauuuauguucuguguuauuuuau

SEQ ID NO: 494497 - RNA, 63 nt, Human
agccugguaaaauagugagaccucaucucuacaaagauguaaaaaaauuagccacaugugcug

SEQ ID NO: 494498 - RNA, 63 nt, Human
acugagcuggaggccccugcaaggguaggggacaagauguaggcuccagcuccccucagaccu

SEQ ID NO: 494499 - RNA, 63 nt, Human
gccguccguccacugggaaccgaguagggucgcaagauguauccuuggaguccucucaggcag

SEQ ID NO: 494500 - RNA, 63 nt, Human
ccguuuugaaaaugcacuuugaauaaucucaaaaagauguacaaguuauaccuguaaaccaca

SEQ ID NO: 494501 - RNA, 63 nt, Human
uuggauguccaauagugcccugcuaagaggaagaagauguagggagguauuuuguuguuguug

SEQ ID NO: 494502 - RNA, 63 nt, Human
uaagcacucuugucaaucauggaauuggaaaaaaagauguacauuuaguuaaacaagauaaca

SEQ ID NO: 494503 - RNA, 63 nt, Human
uaggcuuauuuugaaugcaucuuuaacuuacgaaagauguacuaauugugggggugccugagu

SEQ ID NO: 494504 - RNA, 63 nt, Human
aaauccgacugggcucaagaggccacuuagggaaagauguagaaagaugcuagaaaaauguuc

SEQ ID NO: 494505 - RNA, 63 nt, Human
aauuguaaauaugcacuguacuuaaggauucuuaagauguauuuuuuuguuauuucuccucca

SEQ ID NO: 494506 - RNA, 63 nt, Human
gugggagugaugguggaagauaauguacuacugaagauguaauguagcuuuccacuggagucu

SEQ ID NO: 494507 - RNA, 63 nt, Human
cuuuugaacucacgagccuugcgcaaaacccagaagauguauucagagccacccaggccacug

SEQ ID NO: 494508 - RNA, 64 nt, Human
ggagcggcagcucccuugggggcuuagcccaggugcuucguaacugcaaucggaagugcaggag

SEQ ID NO: 494509 - RNA, 64 nt, Human
gccucauaaaaagagaaugaggucuucugcuagagcuucguauugcuuuggaaguucaucugug

SEQ ID NO: 494510 - RNA, 64 nt, Human
auuauuugaggcuaggaguuccaguucgaaaccagcuucguaaacauagcaagacccagucucu

SEQ ID NO: 494511 - RNA, 63 nt, Human
aguaugcuacaauauacaguucaggcaaaauuuaagauguaauuaucuucaauacuuaagugu

SEQ ID NO: 494512 - RNA, 63 nt, Human
accauucccuggaagcagcuaccuaggggaaacaagauguagugcuauugccgauaacaagua

SEQ ID NO: 494513 - RNA, 63 nt, Human
ccuaaguaugcuacacagcaucauauuagauguaagauguaagacuugcaaaggacagaagga

SEQ ID NO: 494514 - RNA, 63 nt, Human
uaaacaguagcgagaaaauggaaaccacagaggaagauguauuuugcauguuuuuccuuucag

SEQ ID NO: 494515 - RNA, 63 nt, Human
guuccuuuguaagggugggcaggccucguaagaaagauguagcagcauauucacuauccguua

SEQ ID NO: 494516 - RNA, 63 nt, Human
ugaauguagacacaaaacagcaacacuuguaugaagauguaaagugcugaacauauuuuuuuc

SEQ ID NO: 494517 - RNA, 63 nt, Human
ggaguacuacuuaaaaaaaagucugugauuuauaagauguauaugcuuucuaugugaauauaa

SEQ ID NO: 494518 - RNA, 63 nt, Human
ugucucagaucaacuacucuaccacucuacucuaagauguagugagaguagcggagucacuga

SEQ ID NO: 494519 - RNA, 63 nt, Human
gaaagcaguggagguggggguugcuguugauugaagauguauauaauaucuccgguuuauaaa

SEQ ID NO: 494520 - RNA, 63 nt, Human
aucuguauaaugcaacaacauuggaacacaauaaagauguauuuuuguaaauuguuacuacau

SEQ ID NO: 494521 - RNA, 63 nt, Human
cuaauccaugugcugcuguggcaucaggaaaggaagauguaagaagcuaaaaugaaaaauagu

SEQ ID NO: 494522 - RNA, 63 nt, Human
gucaagccuguaguauuaaaaugauuuuuuuaaaagauguaaacugugcuuaguuaauugguu

SEQ ID NO: 494523 - RNA, 63 nt, Human
uaaacauuuuacuuuauguaauugccacaucccaagauguaaaacggcaguaauuuaugacca

SEQ ID NO: 494524 - RNA, 63 nt, Human
gcccuguuuuccuuucuguugcuuucccaguagaagauguagcuaaaaaaaguucaggaucug

SEQ ID NO: 494525 - RNA, 63 nt, Human
cuucaucucaguuuagaaauuuauucaaagcuaaagauguauauauacauauacuuuugugug

SEQ ID NO: 494526 - RNA, 63 nt, Human
uauuuucaucacaguugccuaugcccagggaauaagauguauucuuuauaauugaauugguuu

SEQ ID NO: 494527 - RNA, 64 nt, Human
guaaagagauucuaaaagcaagaucuggaaaagugcuucguagacuccuugacggaguuugccu

SEQ ID NO: 494528 - RNA, 64 nt, Human
guacugcucgggccgcccaggucacagagccugagcuucguagccaaagcagccugaugaccca

SEQ ID NO: 494529 - RNA, 64 nt, Human
ugcaggcuguuccgcuccuccuccagcuggcgcagcuucguagacacguugagcuucugccggg

SEQ ID NO: 494530 - RNA, 63 nt, Human
aucuuuguuuuauuaguaaaugcuuaucaucuaaagauguagcucuggcccagugggaaaaau

SEQ ID NO: 494531 - RNA, 63 nt, Human
uuaggaagauauuaaaaguagaugagaggacacaagauguagucgauccuuaugcgauuauau

SEQ ID NO: 494532 - RNA, 63 nt, Human
acauugugagcuggcucagaagacaaaccaauuaagauguagauagaaauuaauuuaaggucu

SEQ ID NO: 494533 - RNA, 63 nt, Human
uaauuccucuucaaaaauugagcgcuauguugcaagauguaauuuuucuuuuccuuuuuuuug

SEQ ID NO: 494534 - RNA, 63 nt, Human
ggguuacaggugugagccacugcacccggccacaagauguaauuuuuacuuuaucucucacac

SEQ ID NO: 494535 - RNA, 63 nt, Human
gccaccucauuugucuuuauuuuuuucucuuuuaagauguaagaugcuaauuaauaaaagcug

SEQ ID NO: 494536 - RNA, 63 nt, Human
ggguaaaaaaguaguuuuacauuuuauaaaguaaagauguaaaugauucagguuuaaagcucu

SEQ ID NO: 494537 - RNA, 63 nt, Human
auaaucaugaauacuuuuccaggucaguacguaaagauguaacccauucuuuguaagguucag

SEQ ID NO: 494538 - RNA, 63 nt, Human
guuuauaucagaguaccaggugucccgguucucaagauguaacacagcagaaaagucuugucg

SEQ ID NO: 494539 - RNA, 63 nt, Human
aaugguuuccaaacuguaucguagccguccacaaagauguaauccaaaucuauuuuucucacg

SEQ ID NO: 494540 - RNA, 63 nt, Human
uugaaucauggaaguggauuucucaaacugagaaagauguagcgucauccccuuggugcuguc

SEQ ID NO: 494541 - RNA, 63 nt, Human
ugccuuuuguguaccaggaacucuuaaacacugaagauguagcaauaaaccaaaugugcuaaa

SEQ ID NO: 494542 - RNA, 63 nt, Human
cuuggagggggaaauaagggaauaaggccaaggaagauguauagcuuuagcuuuagccuggca

SEQ ID NO: 494543 - RNA, 63 nt, Human
aacaacuauaaauauucuuagcugucuagagaaaagauguauguuauuuugaaaugaauggua

SEQ ID NO: 494544 - RNA, 63 nt, Human
gaggagugcagucugcugguucaggcucuucaaaagauguagaaaaagagauagaaggaacca

SEQ ID NO: 494545 - RNA, 63 nt, Human
agcuuuaaaagcauauaugaaauguauaaaucuaagauguauaauacauuauugacucuauga

SEQ ID NO: 494546 - RNA, 64 nt, Human
cagccucucgaguagcugggauuacaggcaugcaccaccacacccagcuaauuuuguauuuuua

SEQ ID NO: 494547 - RNA, 64 nt, Human
aguaguaaucucacacuucauccuauagagucaaccaccacagauaggaauuccuuauucuuuu

SEQ ID NO: 494548 - RNA, 64 nt, Human
cagccuccugaguagcuggaauuacaggcacccaccaccacacccagcucauuuuuguauuuuu

SEQ ID NO: 494549 - RNA, 63 nt, Human
cugaucugaucucacuguuuauguugcuuuccaaagauguauguugcauaauacaguggaucu

SEQ ID NO: 494550 - RNA, 63 nt, Human
uuguucucaaggaauuugcauucuagaaaguagaagauguaauaaauguacugugggacaugu

SEQ ID NO: 494551 - RNA, 63 nt, Human
ccuucagugguugccucacuugcguuuuccuacaagauguaagacuguuuauaauuaaacuuu

SEQ ID NO: 494552 - RNA, 63 nt, Human
auugcugucuaaugacggggaaagcacgaugaaaagauguacaauccugcauccuugcuuauu

SEQ ID NO: 494553 - RNA, 63 nt, Human
guuuaauuauucuguaaauuauuuaauuuugucaagauguaaguauuuauauucacagccucu

SEQ ID NO: 494554 - RNA, 63 nt, Human
uauaaaguuuucuaaauuuaucaguaccuaaguaagauguagcgcuuugaauaugaaaucaua

SEQ ID NO: 494555 - RNA, 63 nt, Human
uucucuccauuccccuuucuagcuuuaacuaggaagauguaggcagauuggugguuuuuuuuu

SEQ ID NO: 494556 - RNA, 63 nt, Human
uuauucuuaaaacauuuuaaaaaccacuguagaaagauguaaauagggacugugcaguauuuc

SEQ ID NO: 494557 - RNA, 63 nt, Human
gcuuuguccagaacacauugaccaagcuccugaaagauguaaguuuacuacgcauagacuuuu

SEQ ID NO: 494558 - RNA, 63 nt, Human
uacuggaaauuaagaacuugcugcuguuuuaauaagauguaguauauuuucugacuacaggag

SEQ ID NO: 494559 - RNA, 63 nt, Human
caccuaaauuccuauguccacacuuaaccuuuaaagauguacauugagggaauaucaaaaaau

SEQ ID NO: 494560 - RNA, 63 nt, Human
acacuugggugaaaaguauggcagugggagacuaagauguauuaaccuaccugugaaucauau

SEQ ID NO: 494561 - RNA, 63 nt, Human
uguauaguauaaauauauauauuuucuauauauaagauguauaauauaaggcuccacaaauau

SEQ ID NO: 494562 - RNA, 63 nt, Human
ggguuaguaauuuguuuuacuagaaugacaaagaagauguaaaccauuuuauucuguaggcuu

SEQ ID NO: 494563 - RNA, 63 nt, Human
acuuuuuuuuccuugaaggaaaauacugacuuuaagauguauuuuaagacugaaauuuuguuc

SEQ ID NO: 494564 - RNA, 63 nt, Human
cguaagcaucauagaaauuccugucuucauauuaagauguacugcuuuaaaacacaacuccag

SEQ ID NO: 494565 - RNA, 64 nt, Human
cagccucccaagcagcuaggacuacaggcacaugccaccacacuuggguaauuaaaaaauaaau

SEQ ID NO: 494566 - RNA, 64 nt, Human
auuuuacaauuugagccuugagccauacacaaaaccaccacaaaauuagauuuauagacucaaa

SEQ ID NO: 494567 - RNA, 64 nt, Human
caggaggcugagguugcagugagccaggauugcgccaccacacuccagccugggcaacagagac

SEQ ID NO: 494568 - RNA, 63 nt, Human
uccauugccauaacauccugcuccauucccucuaagauguaggaagaauucggauccuuacca

SEQ ID NO: 494569 - RNA, 63 nt, Human
aaaacacagcuagaguaguaguauuguagucucaagauguauggugugucauuugugaaaaua

SEQ ID NO: 494570 - RNA, 63 nt, Human
uaaagcuaaaauaguuacuucaaauuuucagaaaagauguauauagucaaaauuuaagauaca

SEQ ID NO: 494571 - RNA, 63 nt, Human
cuuuuuuuuuuuuuaaggauacgggacaauuuuaagauguaauaccaauacuuuagaaguuug

SEQ ID NO: 494572 - RNA, 63 nt, Human
aauaguaggagccuaaaacuuuguucaaugaguaagauguagauuuggagucaucagcagggg

SEQ ID NO: 494573 - RNA, 63 nt, Human
ucuuucagucaugagcccuacacauuugcaugaaagauguacauuauauauugugaaacgaaa

SEQ ID NO: 494574 - RNA, 63 nt, Human
augcuuuagcuuauuuuuacaguuauagaaagcaagauguacuauaacauagaauugcaaucu

SEQ ID NO: 494575 - RNA, 63 nt, Human
aguuucaugugaguuuuuaccguuaggaugauuaagauguauauaggacaaaauguuaagucu

SEQ ID NO: 494576 - RNA, 63 nt, Human
gagaguuuuagacaaucucuagguagaggagacaagauguagacccagacagaagaaaucugc

SEQ ID NO: 494577 - RNA, 63 nt, Human
cuaacauuuggcaacagcaaauuaaacguuuuuaagauguaaagaaaggguuaccgcuugcua

SEQ ID NO: 494578 - RNA, 63 nt, Human
ucagggaagauaaguuggaaacacuaaauguuaaagauguagcaaacccugucaaacauuagu

SEQ ID NO: 494579 - RNA, 63 nt, Human
auuauaaacagaccuuuauuaaacacaucuugaaagauguagaagucccucuauagucuagua

SEQ ID NO: 494580 - RNA, 63 nt, Human
ccagcacuguccccauggagcugguggcugacaaagauguaguuuccaucagucaauaaaacc

SEQ ID NO: 494581 - RNA, 63 nt, Human
uucugaguaucuacuguguauuggauaauacaaaagauguaaugucauuuaccuuucugggua

SEQ ID NO: 494582 - RNA, 63 nt, Human
caagauccgugcucgcagugggcugauucaaucaagauguauguuugcuauguucuaagucca

SEQ ID NO: 494583 - RNA, 63 nt, Human
accaaaaaacuacaccaguagguugauucaaucaagauguauguagaccuaaaacuacaccaa

SEQ ID NO: 494584 - RNA, 64 nt, Human
aacccugugugcgcugugugugcgcccagugcccgcuucguaggacaccaccucacacucacuu

SEQ ID NO: 494585 - RNA, 64 nt, Human
gaaccuaaggacgaagccuacaggggcaagggccgcuucguauuccuggaagaaggaaggcaua

SEQ ID NO: 494586 - RNA, 64 nt, Human
cagaaauguugccauucuuggaaacugucccauugcuucguauuucugccaacguagcucugcc

SEQ ID NO: 494587 - RNA, 63 nt, Human
uacgucagagcuccucauguucuugcauggcccaagauguauuucccugugacugaaccagga

SEQ ID NO: 494588 - RNA, 63 nt, Human
gcuaacaaguacaacucauguuugcagccuucgaagauguaacaaucucguuggaaacauaag

SEQ ID NO: 494589 - RNA, 63 nt, Human; identical to SEQ ID NO: 494570

SEQ ID NO: 494590 - RNA, 63 nt, Human
aaaaaacagcagcccuauucagaaauugguuugaagauguaauugcucuaguuuggauuaaac

SEQ ID NO: 494591 - RNA, 63 nt, Human
cuaaauuucagcaacagugaaaaacugagaugaaagauguauaauguagagaacugacuucuc

SEQ ID NO: 494592 - RNA, 63 nt, Human
ugagucaucacuugaguaauaaaguagauggagaagauguacuuucucccucacauaaaugca

SEQ ID NO: 494593 - RNA, 64 nt, Human
gauuucuuuuucagugacguucaaguguuucucacggauggaauucuagucagcugcaggcggg

SEQ ID NO: 494594 - RNA, 64 nt, Human
ccgggccaccaagccgcaccugugccugagacuccggauggacgacacagucgucacgucgcuc

SEQ ID NO: 494595 - RNA, 64 nt, Human
uaugaccccgucucucugaagugggacauucggacggauggagcccucagcgugucuuuucagc

SEQ ID NO: 494596 - RNA, 64 nt, Human
cucuagagguuggaaagagaagagaggcugggagcggauggaaagcaugacugcaucuggagcc

SEQ ID NO: 494597 - RNA, 64 nt, Human
uuaagguauuucgaaacugccaagggugcuggugcggauggacacuaaugcagccacgauugga

SEQ ID NO: 494598 - RNA, 64 nt, Human
caagcuuaaggagaggagagcaucugcucugagacggauggaaggagagagguugaggaugcac

SEQ ID NO: 494599 - RNA, 64 nt, Human
uuccugugcuccuccacuugccacggaugggccacggauggagcuugccaugggaagcacuggg

SEQ ID NO: 494600 - RNA, 64 nt, Human
cagccuccugaguagcugggaggacaggcauaugccaccacaucacugagaagaaauuuuugau

SEQ ID NO: 494601 - RNA, 64 nt, Human
cacccuccugaguagcugggacuacaggugugcaccaccacaccuggcuaauucuucuuaaaau

SEQ ID NO: 494602 - RNA, 64 nt, Human
cugcgcggaggcucgggagcuggccggggaggggcggauggaggggccuggguugccagcuccc

SEQ ID NO: 494603 - RNA, 64 nt, Human
gacuccuacccugaccuucguaccuaugauuauacggauggaaaagcucagaacucaggugaaa

SEQ ID NO: 494604 - RNA, 64 nt, Human
cuuuugggagugcuauggcaaguagaaguucugccggauggaaagaggcugccccauuugaggu

SEQ ID NO: 494605 - RNA, 64 nt, Human
cuuauucauacaagacaggaagcacggucuuaggcggauggaggccugacgucccuggaguuga

SEQ ID NO: 494606 - RNA, 64 nt, Human
uuugccuguccccaggguagaaauguccuaccagcggauggagaauccuggcugccaugugguu

SEQ ID NO: 494607 - RNA, 64 nt, Human
auauauaaaacauuccccucuguccccuuggcuucggauggaggccuuucuguugagcugaaau

SEQ ID NO: 494608 - RNA, 64 nt, Human
cuguggauaaaaggaagguuaugauuccuucuagcggauggaccagauuccucuggcuaacgua

SEQ ID NO: 494609 - RNA, 64 nt, Human
uauauaugaaguauucagagccccccaggagagacggauggacagacagacagccagguucucc

SEQ ID NO: 494610 - RNA, 64 nt, Human
uccaguuagucauguguaacugaguauuagauuucggauggagucaucauggccaauuauagga

SEQ ID NO: 494611 - RNA, 64 nt, Human
uccugcaugucggggccccugcguguguucucuccggauggaaucacagccaauaaacaccagu

SEQ ID NO: 494612 - RNA, 64 nt, Human
agaugacauuaaucugucuucacuguuuauaauacggauggauuuuuuuucaaaucagugugug

SEQ ID NO: 494613 - RNA, 64 nt, Human
augugaacugacaaggagugaagcgcccacccagcggauggacagcacccaccuggguuuacuc

SEQ ID NO: 494614 - RNA, 64 nt, Human
aaagcugagaaugauccaacucagcccuacuuugcggauggacauauuaaggccaggaggggag

SEQ ID NO: 494615 - RNA, 64 nt, Human
guucuaagcaucucuucuauacucugugcugaaacggauggaauucauggcuuauggaaaucaa

SEQ ID NO: 494616 - RNA, 64 nt, Human
cgugcagcccuccgcaucuaucagcagguugccccggauggaucucagagaugaggauuggaac

SEQ ID NO: 494617 - RNA, 64 nt, Human
cugcuucccaaagugcugggauuacaggcacgagccaccacaccuggccaaaaaaauuuauauu

SEQ ID NO: 494618 - RNA, 64 nt, Human
auacacuaaaauugugguccuuuuccucuugugaccaccacaugucuagugauuauuuuguuua

SEQ ID NO: 494619 - RNA, 64 nt, Human
auauauucuuguuggcuaacuaaauuguguaugcccaccacaaagaagguacuauuuuuuguuu

SEQ ID NO: 494620 - RNA, 56 nt, Human
accuccagaacaccagguagccguggccaccacagccagacugaacguuugugaaa

SEQ ID NO: 494621 - RNA, 64 nt, Human
ugaauacuauggcucaagguuuucauaugcagcucggauggacauuuuucuucuaagauggaac

SEQ ID NO: 494622 - RNA, 64 nt, Human
ccuccacuucacaggacucuuaauaagaccugcacggauggaaacagaaaauauucacaaugua

SEQ ID NO: 494623 - RNA, 64 nt, Human
ccaccugcccugccuguugcaaacgugaugcucccggauggaguggagaaacuaggagacuggg

SEQ ID NO: 494624 - RNA, 64 nt, Human
acaccuguaaucccagcacuuugggaggcugaggcggauggaucacgaggucaggcagucgaga

SEQ ID NO: 494625 - RNA, 64 nt, Human
ggacggcaaacagguaaggaguuccaugcaacugcggauggagccccucugagaaacacaugcc

SEQ ID NO: 494626 - RNA, 64 nt, Human
cucuuaaaaacauuagauaaaauaaaagauucaccggauggauucugaugaaaacgaaaacaaa

SEQ ID NO: 494627 - RNA, 64 nt, Human
gcguuuccagcaggagaaugaagaauugaaagcucggauggacaagcacauggcaaucucaagg

SEQ ID NO: 494628 - RNA, 64 nt, Human
ugggcacgccugcuggccgacccacugacccacucggauggaccaaccugcucuguccccaaag

SEQ ID NO: 494629 - RNA, 64 nt, Human
uuagcagccucgguacugaagccacaccaguguccggauggaagucugcaucugagguugcuca

SEQ ID NO: 494630 - RNA, 64 nt, Human
gauugcaugguguccugauugcaucuagguggagcggauggaaugugcugggccacuguugggu

SEQ ID NO: 494631 - RNA, 64 nt, Human
cccagcugcugagcaggggugggacaugaaccagcggauggaguccagcaggggagugggaaag

SEQ ID NO: 494632 - RNA, 64 nt, Human
caucacauaucgaauuaccaaccacucacacuuccggauggagggagagguugugcugaccacc

SEQ ID NO: 494633 - RNA, 64 nt, Human
cagacggccccggccguguccuguggcccccugucggauggaugcgugccguuuguagagaaga

SEQ ID NO: 494634 - RNA, 64 nt, Human
cucagcauucuccaucacuuccccuccagaaaaacggauggaaggaagcccucugugacacugc

SEQ ID NO: 494635 - RNA, 64 nt, Human
aacuuuugggggcuucccggucuagccacacccucggauggaaagacuugacugcauaaagaug

SEQ ID NO: 494636 - RNA, 64 nt, Human
agccagacugaacguuugugaaagcugggacaucccaccacacgcugagccagaccugcagagu

SEQ ID NO: 494637 - RNA, 64 nt, Human
uucuccagcguugguuacugaccaccccacccucccaccacacacacacacacacacacacaca

SEQ ID NO: 494638 - RNA, 64 nt, Human
caggaagggagccauugcccagugguccauaucuccaccacauccccugcuugagcccagcgcu

SEQ ID NO: 494639 - RNA, 64 nt, Human
gcugaacauaauuucauuaucccucaaaaaguuaccaccacaucagaaaaaauaaaaaaaaaau

SEQ ID NO: 494640 - RNA, 64 nt, Human
ccggcagaagcagcugcagcagcaguuccgggagcggauggagaagcagcagguucgagucucc

SEQ ID NO: 494641 - RNA, 64 nt, Human
cccacccccacaaggggagaaaaaguaggggaagcggauggagaaaaacccaaagccacuagua

SEQ ID NO: 494642 - RNA, 64 nt, Human
ugagccugaagagccccaaagcaggaagaagcuccggauggaggccagcuaagccacucggggc

SEQ ID NO: 494643 - RNA, 64 nt, Human
gcugacacuugagcccagcauccuggggauccagcggauggacagcuuggcucucccagagagg

SEQ ID NO: 494644 - RNA, 64 nt, Human
uaugacagaggugugaauaaaagcaucaggaaaucggauggagaaccaccauucacccaagggu

SEQ ID NO: 494645 - RNA, 64 nt, Human
acgccuguaaucccagcacugugggaggccgaggcggauggaucaccugaggucgggaauucga

SEQ ID NO: 494646 - RNA, 64 nt, Human
cauuucugguuuccagaccccaaugccucccauucggauggaucucugcguuuuuauacugagu

SEQ ID NO: 494647 - RNA, 64 nt, Human
aacagaauauauaccugaacuguagugguuugaucggauggagacagaaaacccgauuuuuauu

SEQ ID NO: 494648 - RNA, 64 nt, Human
auguuguuggccggaucaccaucugaagagcagacggauggaaaaaggaccugaucauugggga

SEQ ID NO: 494649 - RNA, 64 nt, Human
gagcgcugugcucugagcuuagaaagggagguggcggauggagugggaagugagagacacugau

SEQ ID NO: 494650 - RNA, 64 nt, Human
uauagagaagggcuuggcccccauggggaagacacggauggaagguggagcaaaggaaaauaca

SEQ ID NO: 494651 - RNA, 64 nt, Human
acgccuguaaucccagcacuuuaagaggccaaggcggauggaucacuugagcccaggaguucaa

SEQ ID NO: 494652 - RNA, 64 nt, Human
uguacauagaagccaccggauggcacuuccccaccggauggacaguuauuuuguugauaaguaa

SEQ ID NO: 494653 - RNA, 64 nt, Human
gccugacugcucagaacuugcugcugucuuguugcggauggauggaagguuggauggaugggug

SEQ ID NO: 494654 - RNA, 64 nt, Human
uaagagcaggucuuucaagccacacccccaccugcggauggauggguuucucuguaggccaugc

SEQ ID NO: 494655 - RNA, 64 nt, Human
uugcacugaacccucgaggaccugggcacggggucggauggacacacagccagaccguaaaccc

SEQ ID NO: 494656 - RNA, 64 nt, Human
gcagauacuuaaagcuucaaaaagacugccccuaccaccacaggaggaccagccuaaccauacg

SEQ ID NO: 494657 - RNA, 64 nt, Human
guggcuuacuauuucauugugugcacccacccacccaccacacuggacuuuucuagagauggac

SEQ ID NO: 494658 - RNA, 64 nt, Human
gucagggguccuggaauaccccguagcucuggcaccaccacacuggccucugauggcaagacuu

SEQ ID NO: 494659 - RNA, 64 nt, Human
gggggagagaagcagagggagagagaaggugacacggauggaagagugggaaggagcuggccug

SEQ ID NO: 494660 - RNA, 64 nt, Human
ucagcuuccuuuucuguugguuugguuuucuucgcggauggauugaguuacauguuuuaacagu

SEQ ID NO: 494661 - RNA, 64 nt, Human
ugaugacugaagaauaccaguuaaauaauacauucggauggauuuggaaguuggaauuccucuu

SEQ ID NO: 494662 - RNA, 64 nt, Human
gaacguguauccagauggacugacaggccgagagcggauggacuacaugaaacgcaagagccgc

SEQ ID NO: 494663 - RNA, 64 nt, Human
agaaugaagaaauacaacgcacaguacuuuugaagcuucguauuuuucuugguuucacacucag

SEQ ID NO: 494664 - RNA, 64 nt, Human
cuauaguugaaccaaggauaugcauugauucuuugcuucguauguaaauaaaguuaaaaacagu

SEQ ID NO: 494665 - RNA, 64 nt, Human
uuucuaagaaaaagaaaaugaggcucaagaggcugcuucguagaauuccuuuugaaugaauuga

SEQ ID NO: 494666 - RNA, 64 nt, Human
aaaaaggugugugagugccaccugguugcuuauggcuucguauuuuuauguugagaaauuugaa

SEQ ID NO: 494667 - RNA, 64 nt, Human
aauauaacucuuagagaaauguacauaaaagaaugcuucguaauuuuggaguaggagguucccu

SEQ ID NO: 494668 - RNA, 64 nt, Human
ucacacauacagcaaacaaaaaugcacaaagccugcuucguaacuuuuuuuucuggaauuguuu

SEQ ID NO: 494669 - RNA, 64 nt, Human
uuuguucauauauuaugaauguauuauuuuauuugcuucguaauaaaguuuauaaggaagagca

SEQ ID NO: 494670 - RNA, 64 nt, Human
uuccugaaccuuaaaacaggauaacauaguaccugcuucguagaguuuuugugagaauuaaagg

SEQ ID NO: 494671 - RNA, 64 nt, Human
uucguucugaagaucacaguucacagaagcuuuugcuucguaaagauaauccaaaggaucucag

SEQ ID NO: 494672 - RNA, 64 nt, Human
auuuuugcagauagcuaugacuuguggcaaucaggcuucguagcuuggggagguagaguuacuu

SEQ ID NO: 494673 - RNA, 64 nt, Human
agaaaugaacuacuugauauagcaaaguccuuuggcuucguaaauaacccugagguuuuguacu

SEQ ID NO: 494674 - RNA, 64 nt, Human
uauauacauuugugaagcaagaaacaauaaaaaagcuucguaugccauuaauuuaacaaaauau

SEQ ID NO: 494675 - RNA, 64 nt, Human
gaggagggacggaggagguucccuugcugggcaugcuucguagagggccaggagcagcagguca

SEQ ID NO: 494676 - RNA, 64 nt, Human
cuagugauuuuagucagauccauggaacagagcagcuucguaauacauugucaaguuaccugau

SEQ ID NO: 494677 - RNA, 64 nt, Human
acauacucuuuauuaucuucauuuaucaauuacagcuucguaucucuaauuuauggucuauaua

SEQ ID NO: 494678 - RNA, 55 nt, Human; identical to SEQ ID NO: 371384

SEQ ID NO: 494679 - RNA, 64 nt, Human; identical to SEQ ID NO: 371385

SEQ ID NO: 494680 - RNA, 64 nt, Human; identical to SEQ ID NO: 371386

SEQ ID NO: 494681 - RNA, 64 nt, Human; identical to SEQ ID NO: 371387

SEQ ID NO: 494682 - RNA, 64 nt, Human; identical to SEQ ID NO: 371388

SEQ ID NO: 494683 - RNA, 64 nt, Human; identical to SEQ ID NO: 371389

SEQ ID NO: 494684 - RNA, 64 nt, Human; identical to SEQ ID NO: 371390

SEQ ID NO: 494685 - RNA, 64 nt, Human; identical to SEQ ID NO: 371391

SEQ ID NO: 494686 - RNA, 64 nt, Human; identical to SEQ ID NO: 371392

SEQ ID NO: 494687 - RNA, 64 nt, Human; identical to SEQ ID NO: 371393

SEQ ID NO: 494688 - RNA, 64 nt, Human; identical to SEQ ID NO: 371394

SEQ ID NO: 494689 - RNA, 64 nt, Human; identical to SEQ ID NO: 371395

SEQ ID NO: 494690 - RNA, 63 nt, Human; identical to SEQ ID NO: 371164

SEQ ID NO: 494691 - RNA, 64 nt, Human; identical to SEQ ID NO: 371165

SEQ ID NO: 494692 - RNA, 64 nt, Human; identical to SEQ ID NO: 368722

SEQ ID NO: 494693 - RNA, 64 nt, Human; identical to SEQ ID NO: 368723

SEQ ID NO: 494694 - RNA, 64 nt, Human
aggugaagaucugagcccagaaaugacccuuccuccaccacaccccuccuuugaggacgcccgg

SEQ ID NO: 494695 - RNA, 64 nt, Human
uauuccauuccuaggugucaucagaugaccuugaccaccacaauaccaggcccucuuggaugga

SEQ ID NO: 494696 - RNA, 64 nt, Human
uggccucccaaacuggugagauuacaggcaugagccaccacaacuggccugaaauucuuaaagg

SEQ ID NO: 494697 - RNA, 64 nt, Human; identical to SEQ ID NO: 371166

SEQ ID NO: 494698 - RNA, 64 nt, Human; identical to SEQ ID NO: 371167

SEQ ID NO: 494699 - RNA, 64 nt, Human; identical to SEQ ID NO: 368740

SEQ ID NO: 494700 - RNA, 64 nt, Human; identical to SEQ ID NO: 371274

SEQ ID NO: 494701 - RNA, 64 nt, Human; identical to SEQ ID NO: 371275

SEQ ID NO: 494702 - RNA, 64 nt, Human; identical to SEQ ID NO: 371276

SEQ ID NO: 494703 - RNA, 64 nt, Human; identical to SEQ ID NO: 371277

SEQ ID NO: 494704 - RNA, 64 nt, Human; identical to SEQ ID NO: 371294

SEQ ID NO: 494705 - RNA, 64 nt, Human; identical to SEQ ID NO: 371295

SEQ ID NO: 494706 - RNA, 64 nt, Human; identical to SEQ ID NO: 368741

SEQ ID NO: 494707 - RNA, 64 nt, Human; identical to SEQ ID NO: 371296

SEQ ID NO: 494708 - RNA, 53 nt, Human; identical to SEQ ID NO: 371297

SEQ ID NO: 494709 - RNA, 64 nt, Human; identical to SEQ ID NO: 371184

SEQ ID NO: 494710 - RNA, 64 nt, Human; identical to SEQ ID NO: 371185

SEQ ID NO: 494711 - RNA, 64 nt, Human; identical to SEQ ID NO: 368742

SEQ ID NO: 494712 - RNA, 52 nt, Human; identical to SEQ ID NO: 371314

SEQ ID NO: 494713 - RNA, 64 nt, Human
guguagcucugagacuugcuuccaaagucauuucccaccacaugcagacauguguggagguaag

SEQ ID NO: 494714 - RNA, 64 nt, Human
gaagguacuaagaagacagaaacaagcaaagccgccaccacagagcccgaaacaacccagccgg

SEQ ID NO: 494715 - RNA, 64 nt, Human
ggaaacuuauucuauuccuguuuucucuuucugcccaccacauccaaucucucaaaacggucag

SEQ ID NO: 494716 - RNA, 64 nt, Human; identical to SEQ ID NO: 371315

SEQ ID NO: 494717 - RNA, 64 nt, Human; identical to SEQ ID NO: 371316

SEQ ID NO: 494718 - RNA, 64 nt, Human; identical to SEQ ID NO: 371317

SEQ ID NO: 494719 - RNA, 64 nt, Human; identical to SEQ ID NO: 368869

SEQ ID NO: 494720 - RNA, 64 nt, Human; identical to SEQ ID NO: 368870

SEQ ID NO: 494721 - RNA, 64 nt, Human; identical to SEQ ID NO: 368759

SEQ ID NO: 494722 - RNA, 64 nt, Human; identical to SEQ ID NO: 371354

SEQ ID NO: 494723 - RNA, 62 nt, Human; identical to SEQ ID NO: 371355

SEQ ID NO: 494724 - RNA, 64 nt, Human; identical to SEQ ID NO: 371356

SEQ ID NO: 494725 - RNA, 64 nt, Human; identical to SEQ ID NO: 371357

SEQ ID NO: 494726 - RNA, 64 nt, Human; identical to SEQ ID NO: 368831

SEQ ID NO: 494727 - RNA, 64 nt, Human; identical to SEQ ID NO: 368832

SEQ ID NO: 494728 - RNA, 64 nt, Human; identical to SEQ ID NO: 368760

SEQ ID NO: 494729 - RNA, 64 nt, Human; identical to SEQ ID NO: 371374

SEQ ID NO: 494730 - RNA, 64 nt, Human; identical to SEQ ID NO: 371375

SEQ ID NO: 494731 - RNA, 64 nt, Human; identical to SEQ ID NO: 371376

SEQ ID NO: 494732 - RNA, 64 nt, Human
uggucucccaaagugcugggauuacaugcgugagccaccacacuuggccuacauuuuuucuuua

SEQ ID NO: 494733 - RNA, 64 nt, Human
uugucucuucuguaaaaugugaaaagaugugcucccaccacaugcgcagggucugugauuuuac

SEQ ID NO: 494734 - RNA, 64 nt, Human
aaucccgcauguugucaacauacuacagcauuagccaccacaccuuaagaugcauuucacagcc

SEQ ID NO: 494735 - RNA, 64 nt, Human; identical to SEQ ID NO: 371377

SEQ ID NO: 494736 - RNA, 64 nt, Human; identical to SEQ ID NO: 368814

SEQ ID NO: 494737 - RNA, 64 nt, Human; identical to SEQ ID NO: 368815

SEQ ID NO: 494738 - RNA, 64 nt, Human; identical to SEQ ID NO: 331124

SEQ ID NO: 494739 - RNA, 64 nt, Human; identical to SEQ ID NO: 331125

SEQ ID NO: 494740 - RNA, 64 nt, Human; identical to SEQ ID NO: 331126

SEQ ID NO: 494741 - RNA, 64 nt, Human; identical to SEQ ID NO: 331127

SEQ ID NO: 494742 - RNA, 64 nt, Human; identical to SEQ ID NO: 331128

SEQ ID NO: 494743 - RNA, 64 nt, Human; identical to SEQ ID NO: 331129

SEQ ID NO: 494744 - RNA, 64 nt, Human; identical to SEQ ID NO: 331130

SEQ ID NO: 494745 - RNA, 64 nt, Human; identical to SEQ ID NO: 331131

SEQ ID NO: 494746 - RNA, 64 nt, Human; identical to SEQ ID NO: 331132

SEQ ID NO: 494747 - RNA, 64 nt, Human; identical to SEQ ID NO: 331133

SEQ ID NO: 494748 - RNA, 64 nt, Human
uaccaucuccucauccuaacccaggucuucggcaccaccacaauuaauucccuucccaacacuu

SEQ ID NO: 494749 - RNA, 64 nt, Human
caccugccuucuacccucugguugggagaugcagccaccacaucccuucauaucauacuguuuu

SEQ ID NO: 494750 - RNA, 64 nt, Human
cagcuuccugaguagcuggaacuacaggcgugugccaccacacccggcuaauuuuucguauuuu

SEQ ID NO: 494751 - RNA, 64 nt, Human; identical to SEQ ID NO: 331134

SEQ ID NO: 494752 - RNA, 64 nt, Human; identical to SEQ ID NO: 331135

SEQ ID NO: 494753 - RNA, 64 nt, Human; identical to SEQ ID NO: 331136

SEQ ID NO: 494754 - RNA, 64 nt, Human; identical to SEQ ID NO: 331137

SEQ ID NO: 494755 - RNA, 64 nt, Human; identical to SEQ ID NO: 331138

SEQ ID NO: 494756 - RNA, 64 nt, Human; identical to SEQ ID NO: 331142

SEQ ID NO: 494757 - RNA, 64 nt, Human; identical to SEQ ID NO: 331143

SEQ ID NO: 494758 - RNA, 64 nt, Human; identical to SEQ ID NO: 331144

SEQ ID NO: 494759 - RNA, 64 nt, Human; identical to SEQ ID NO: 331145

SEQ ID NO: 494760 - RNA, 64 nt, Human; identical to SEQ ID NO: 331146

SEQ ID NO: 494761 - RNA, 64 nt, Human; identical to SEQ ID NO: 331147

SEQ ID NO: 494762 - RNA, 64 nt, Human; identical to SEQ ID NO: 331148

SEQ ID NO: 494763 - RNA, 64 nt, Human; identical to SEQ ID NO: 331149

SEQ ID NO: 494764 - RNA, 64 nt, Human; identical to SEQ ID NO: 331150

SEQ ID NO: 494765 - RNA, 64 nt, Human; identical to SEQ ID NO: 331151

SEQ ID NO: 494766 - RNA, 64 nt, Human; identical to SEQ ID NO: 331152

SEQ ID NO: 494767 - RNA, 64 nt, Human
cggccucccaaaguccucggauuacaggcaugagccaccacacccggccaaucaguccaccuuu

SEQ ID NO: 494768 - RNA, 64 nt, Human
cagccuccugaguagcugggaccacaggcgacugccaccacacccagcuaauuuuuuguauuuu

SEQ ID NO: 494769 - RNA, 64 nt, Human
uauuggguucacauucuggaguucucuuuauuuuccaccacaaaaaauaaucugagaauuguau

SEQ ID NO: 494770 - RNA, 64 nt, Human; identical to SEQ ID NO: 331153

SEQ ID NO: 494771 - RNA, 64 nt, Human; identical to SEQ ID NO: 331154

SEQ ID NO: 494772 - RNA, 64 nt, Human; identical to SEQ ID NO: 331155

SEQ ID NO: 494773 - RNA, 64 nt, Human; identical to SEQ ID NO: 331156

SEQ ID NO: 494774 - RNA, 64 nt, Human; identical to SEQ ID NO: 331160

SEQ ID NO: 494775 - RNA, 64 nt, Human; identical to SEQ ID NO: 331161

SEQ ID NO: 494776 - RNA, 64 nt, Human; identical to SEQ ID NO: 331162

SEQ ID NO: 494777 - RNA, 64 nt, Human; identical to SEQ ID NO: 331163

SEQ ID NO: 494778 - RNA, 64 nt, Human; identical to SEQ ID NO: 331164

SEQ ID NO: 494779 - RNA, 64 nt, Human; identical to SEQ ID NO: 331165

SEQ ID NO: 494780 - RNA, 64 nt, Human; identical to SEQ ID NO: 331166

SEQ ID NO: 494781 - RNA, 64 nt, Human; identical to SEQ ID NO: 331167

SEQ ID NO: 494782 - RNA, 64 nt, Human; identical to SEQ ID NO: 331168

SEQ ID NO: 494783 - RNA, 64 nt, Human; identical to SEQ ID NO: 331169

SEQ ID NO: 494784 - RNA, 64 nt, Human; identical to SEQ ID NO: 331170

SEQ ID NO: 494785 - RNA, 64 nt, Human; identical to SEQ ID NO: 331171

SEQ ID NO: 494786 - RNA, 64 nt, Human
caucacuugugcacccacuuugacuaugaguauaccaccacauugcauuucuguuugcaccaug

SEQ ID NO: 494787 - RNA, 64 nt, Human
uaagcccccaaguagcuaggacuacaggagcacaccaccacaccuggcuaauuuuuguauuuuu

SEQ ID NO: 494788 - RNA, 64 nt, Human
cugcuugugggggcaccugggaggucaaaggucuccaccacaucaaccuauuuuguuuuacccu

SEQ ID NO: 494789 - RNA, 64 nt, Human; identical to SEQ ID NO: 331172

SEQ ID NO: 494790 - RNA, 64 nt, Human; identical to SEQ ID NO: 331173

SEQ ID NO: 494791 - RNA, 64 nt, Human; identical to SEQ ID NO: 331174

SEQ ID NO: 494792 - RNA, 64 nt, Human; identical to SEQ ID NO: 331179

SEQ ID NO: 494793 - RNA, 64 nt, Human; identical to SEQ ID NO: 331180

SEQ ID NO: 494794 - RNA, 64 nt, Human; identical to SEQ ID NO: 331181

SEQ ID NO: 494795 - RNA, 64 nt, Human; identical to SEQ ID NO: 331182

SEQ ID NO: 494796 - RNA, 64 nt, Human; identical to SEQ ID NO: 331183

SEQ ID NO: 494797 - RNA, 64 nt, Human; identical to SEQ ID NO: 331184

SEQ ID NO: 494798 - RNA, 64 nt, Human; identical to SEQ ID NO: 331185

SEQ ID NO: 494799 - RNA, 64 nt, Human; identical to SEQ ID NO: 331186

SEQ ID NO: 494800 - RNA, 64 nt, Human; identical to SEQ ID NO: 331187

SEQ ID NO: 494801 - RNA, 64 nt, Human; identical to SEQ ID NO: 331188

SEQ ID NO: 494802 - RNA, 64 nt, Human; identical to SEQ ID NO: 331189

SEQ ID NO: 494803 - RNA, 64 nt, Human; identical to SEQ ID NO: 331190

SEQ ID NO: 494804 - RNA, 64 nt, Human; identical to SEQ ID NO: 331191

SEQ ID NO: 494805 - RNA, 64 nt, Human
cucacagaaaggaucaagaagacuuccuuuucuaccaccacacuacugccccccauuaagguuc

SEQ ID NO: 494806 - RNA, 64 nt, Human
uucauuucaucauuuucuguugcaggaagccacuccaccacagaaugcuaauaugccaguggua

SEQ ID NO: 494807 - RNA, 64 nt, Human
cagccuccugaguagcuaggacuacagaugcucgccaccacaccuggcuaauuuuuuuuuuuug

SEQ ID NO: 494808 - RNA, 64 nt, Human; identical to SEQ ID NO: 331192

SEQ ID NO: 494809 - RNA, 64 nt, Human; identical to SEQ ID NO: 331193

SEQ ID NO: 494810 - RNA, 64 nt, Human; identical to SEQ ID NO: 331198

SEQ ID NO: 494811 - RNA, 64 nt, Human; identical to SEQ ID NO: 331199

SEQ ID NO: 494812 - RNA, 64 nt, Human; identical to SEQ ID NO: 331200

SEQ ID NO: 494813 - RNA, 64 nt, Human; identical to SEQ ID NO: 331201

SEQ ID NO: 494814 - RNA, 64 nt, Human; identical to SEQ ID NO: 331202

SEQ ID NO: 494815 - RNA, 64 nt, Human; identical to SEQ ID NO: 331203

SEQ ID NO: 494816 - RNA, 64 nt, Human; identical to SEQ ID NO: 331204

SEQ ID NO: 494817 - RNA, 64 nt, Human; identical to SEQ ID NO: 331205

SEQ ID NO: 494818 - RNA, 64 nt, Human; identical to SEQ ID NO: 331206

SEQ ID NO: 494819 - RNA, 64 nt, Human; identical to SEQ ID NO: 331207

SEQ ID NO: 494820 - RNA, 64 nt, Human; identical to SEQ ID NO: 331208

SEQ ID NO: 494821 - RNA, 64 nt, Human; identical to SEQ ID NO: 331209

SEQ ID NO: 494822 - RNA, 64 nt, Human; identical to SEQ ID NO: 331210

SEQ ID NO: 494823 - RNA, 64 nt, Human; identical to SEQ ID NO: 331211

SEQ ID NO: 494824 - RNA, 64 nt, Human
uagccucccaaguagcugggacuacagguguacgccaccacacccagcuaauuuuuguauuuuu

SEQ ID NO: 494825 - RNA, 64 nt, Human
uggccucccaaagugcuggaauuacaggcaugagccaccacacccacacaagacuaucauuuuu

SEQ ID NO: 494826 - RNA, 64 nt, Human
gcaguucccacaugggcguguggcuggggcguggccaccacagagcacauggcugugucuaggc

SEQ ID NO: 494827 - RNA, 64 nt, Human; identical to SEQ ID NO: 331212

SEQ ID NO: 494828 - RNA, 64 nt, Human; identical to SEQ ID NO: 331217

SEQ ID NO: 494829 - RNA, 64 nt, Human; identical to SEQ ID NO: 331218

SEQ ID NO: 494830 - RNA, 64 nt, Human; identical to SEQ ID NO: 331219

SEQ ID NO: 494831 - RNA, 64 nt, Human; identical to SEQ ID NO: 331220

SEQ ID NO: 494832 - RNA, 64 nt, Human; identical to SEQ ID NO: 331221

SEQ ID NO: 494833 - RNA, 64 nt, Human; identical to SEQ ID NO: 331222

SEQ ID NO: 494834 - RNA, 64 nt, Human; identical to SEQ ID NO: 331223

SEQ ID NO: 494835 - RNA, 64 nt, Human; identical to SEQ ID NO: 331224

SEQ ID NO: 494836 - RNA, 64 nt, Human; identical to SEQ ID NO: 331225

SEQ ID NO: 494837 - RNA, 64 nt, Human; identical to SEQ ID NO: 331226

SEQ ID NO: 494838 - RNA, 64 nt, Human; identical to SEQ ID NO: 331227

SEQ ID NO: 494839 - RNA, 64 nt, Human; identical to SEQ ID NO: 331228

SEQ ID NO: 494840 - RNA, 64 nt, Human; identical to SEQ ID NO: 331229

SEQ ID NO: 494841 - RNA, 64 nt, Human; identical to SEQ ID NO: 331230

SEQ ID NO: 494842 - RNA, 64 nt, Human; identical to SEQ ID NO: 331231

SEQ ID NO: 494843 - RNA, 64 nt, Human
aauggagagcuaccuuguccugcugcugccccugccaccacagcugcuuaugugugaccgaugg

SEQ ID NO: 494844 - RNA, 64 nt, Human
auaacuacucaacucuguuucugaagcaggaaagccaccacagacaguacauaaaggaauaugu

SEQ ID NO: 494845 - RNA, 64 nt, Human
cagccucccgaguagcugggauuacaggugugugccaccacacccggcuaauuuuuguauuuuu

SEQ ID NO: 494846 - RNA, 64 nt, Human; identical to SEQ ID NO: 331236

SEQ ID NO: 494847 - RNA, 64 nt, Human; identical to SEQ ID NO: 331237

SEQ ID NO: 494848 - RNA, 64 nt, Human; identical to SEQ ID NO: 331238

SEQ ID NO: 494849 - RNA, 64 nt, Human; identical to SEQ ID NO: 331239

SEQ ID NO: 494850 - RNA, 64 nt, Human; identical to SEQ ID NO: 331240

SEQ ID NO: 494851 - RNA, 64 nt, Human; identical to SEQ ID NO: 331241

SEQ ID NO: 494852 - RNA, 64 nt, Human; identical to SEQ ID NO: 331242

SEQ ID NO: 494853 - RNA, 64 nt, Human; identical to SEQ ID NO: 331243

SEQ ID NO: 494854 - RNA, 64 nt, Human; identical to SEQ ID NO: 331244

SEQ ID NO: 494855 - RNA, 64 nt, Human; identical to SEQ ID NO: 331245

SEQ ID NO: 494856 - RNA, 64 nt, Human; identical to SEQ ID NO: 331246

SEQ ID NO: 494857 - RNA, 64 nt, Human; identical to SEQ ID NO: 331247

SEQ ID NO: 494858 - RNA, 64 nt, Human; identical to SEQ ID NO: 331248

SEQ ID NO: 494859 - RNA, 64 nt, Human; identical to SEQ ID NO: 331249

SEQ ID NO: 494860 - RNA, 64 nt, Human; identical to SEQ ID NO: 331250

SEQ ID NO: 494861 - RNA, 64 nt, Human; identical to SEQ ID NO: 331255

SEQ ID NO: 494862 - RNA, 64 nt, Human
aaaauauuguuacaaaaaauguacaguacugacaccaccacaaaucaugguuaauaaaagagag

SEQ ID NO: 494863 - RNA, 64 nt, Human
cggccucccaaaguguugggauuauaggagugagccaccacaccggccaagaugcuuuucaaac

SEQ ID NO: 494864 - RNA, 64 nt, Human
cccuccuccacagguccaggugccgcucccucccccaccacacaucagugucuccucccuccug

SEQ ID NO: 494865 - RNA, 64 nt, Human; identical to SEQ ID NO: 331256

SEQ ID NO: 494866 - RNA, 64 nt, Human; identical to SEQ ID NO: 331257

SEQ ID NO: 494867 - RNA, 64 nt, Human; identical to SEQ ID NO: 331258

SEQ ID NO: 494868 - RNA, 64 nt, Human; identical to SEQ ID NO: 331259

SEQ ID NO: 494869 - RNA, 64 nt, Human; identical to SEQ ID NO: 331260

SEQ ID NO: 494870 - RNA, 64 nt, Human; identical to SEQ ID NO: 331261

SEQ ID NO: 494871 - RNA, 64 nt, Human; identical to SEQ ID NO: 331262

SEQ ID NO: 494872 - RNA, 64 nt, Human; identical to SEQ ID NO: 331263

SEQ ID NO: 494873 - RNA, 64 nt, Human; identical to SEQ ID NO: 331264

SEQ ID NO: 494874 - RNA, 64 nt, Human; identical to SEQ ID NO: 331265

SEQ ID NO: 494875 - RNA, 64 nt, Human; identical to SEQ ID NO: 331266

SEQ ID NO: 494876 - RNA, 64 nt, Human; identical to SEQ ID NO: 331267

SEQ ID NO: 494877 - RNA, 64 nt, Human; identical to SEQ ID NO: 331268

SEQ ID NO: 494878 - RNA, 64 nt, Human; identical to SEQ ID NO: 331269

SEQ ID NO: 494879 - RNA, 64 nt, Human; identical to SEQ ID NO: 331274

SEQ ID NO: 494880 - RNA, 64 nt, Human; identical to SEQ ID NO: 331275

SEQ ID NO: 494881 - RNA, 64 nt, Human
uggccucccaaagugcugggauuacagggacgagccaccacaccccaccuauugucuauauuuc

SEQ ID NO: 494882 - RNA, 64 nt, Human
cagccuucugaguagcugggacuacagaugcacaccaccacaccuggcuaauuuuuguguuuuu

SEQ ID NO: 494883 - RNA, 64 nt, Human
cagccucccaaagugcugggaugauaggcgugagccaccacacccggccaagcacaggcuuuug

SEQ ID NO: 494884 - RNA, 64 nt, Human; identical to SEQ ID NO: 331276

SEQ ID NO: 494885 - RNA, 64 nt, Human; identical to SEQ ID NO: 331277

SEQ ID NO: 494886 - RNA, 64 nt, Human; identical to SEQ ID NO: 331278

SEQ ID NO: 494887 - RNA, 64 nt, Human; identical to SEQ ID NO: 331279

SEQ ID NO: 494888 - RNA, 64 nt, Human; identical to SEQ ID NO: 331280

SEQ ID NO: 494889 - RNA, 64 nt, Human; identical to SEQ ID NO: 331281

SEQ ID NO: 494890 - RNA, 64 nt, Human; identical to SEQ ID NO: 331282

SEQ ID NO: 494891 - RNA, 64 nt, Human; identical to SEQ ID NO: 331283

SEQ ID NO: 494892 - RNA, 64 nt, Human; identical to SEQ ID NO: 331284

SEQ ID NO: 494893 - RNA, 64 nt, Human; identical to SEQ ID NO: 331285

SEQ ID NO: 494894 - RNA, 64 nt, Human; identical to SEQ ID NO: 331286

SEQ ID NO: 494895 - RNA, 64 nt, Human; identical to SEQ ID NO: 331287

SEQ ID NO: 494896 - RNA, 64 nt, Human; identical to SEQ ID NO: 331288

SEQ ID NO: 494897 - RNA, 64 nt, Human; identical to SEQ ID NO: 331293

SEQ ID NO: 494898 - RNA, 64 nt, Human; identical to SEQ ID NO: 331294

SEQ ID NO: 494899 - RNA, 64 nt, Human; identical to SEQ ID NO: 331295

SEQ ID NO: 494900 - RNA, 64 nt, Human
cagccuccugaguagcugagaccacaggcacccgccaccacacccagcuauuuuuuuguauuuu

SEQ ID NO: 494901 - RNA, 64 nt, Human
caguugucagauuuugcacaccacaauaaauguaccaccacacacggaauaugcuaagaaaacu

SEQ ID NO: 494902 - RNA, 63 nt, Human
cccagccagcugcccagugaggcccaccgccucccaccacaccugccaccuguuccuggccuc

SEQ ID NO: 494903 - RNA, 64 nt, Human; identical to SEQ ID NO: 331296

SEQ ID NO: 494904 - RNA, 64 nt, Human; identical to SEQ ID NO: 331297

SEQ ID NO: 494905 - RNA, 64 nt, Human; identical to SEQ ID NO: 331298

SEQ ID NO: 494906 - RNA, 64 nt, Human; identical to SEQ ID NO: 331299

SEQ ID NO: 494907 - RNA, 64 nt, Human; identical to SEQ ID NO: 331300

SEQ ID NO: 494908 - RNA, 64 nt, Human; identical to SEQ ID NO: 331301

SEQ ID NO: 494909 - RNA, 64 nt, Human; identical to SEQ ID NO: 331302

SEQ ID NO: 494910 - RNA, 64 nt, Human; identical to SEQ ID NO: 331303

SEQ ID NO: 494911 - RNA, 64 nt, Human
uauauauauguuuguguauauauauacacauaugcauacauaugauuuuuuuuuuucauuuaag

SEQ ID NO: 494912 - RNA, 64 nt, Human
ugacuuuauuuguuuaaaauguuuaauauauauacauacauauauauauauuugucuguaagaa

SEQ ID NO: 494913 - RNA, 64 nt, Human
uaucagauuaaaacggaagugagguucuuauuuucauacauauugguaugcaccaaacugugaa

SEQ ID NO: 494914 - RNA, 64 nt, Human
cacauauauauacacacacauacguauacacacacauacauauauauaaauauaccugaugcca

SEQ ID NO: 494915 - RNA, 64 nt, Human
uugacuucaucuuaauguacauucacuguuguuacauacauaucuaaguaaaucaaaguuuugg

SEQ ID NO: 494916 - RNA, 64 nt, Human
gaagagauauauaugcacauauaguaucuauauucauacauauuauacucuuguguguagugca

SEQ ID NO: 494917 - RNA, 64 nt, Human
uguguguguguguguauguguauguguauguacacauacauauauauaguugacacuugaaaaa

SEQ ID NO: 494918 - RNA, 64 nt, Human
accaaaaauaccuagauuuuuggagaacuuauuacauacauagaaacaugaauaugguuuacca

SEQ ID NO: 494919 - RNA, 64 nt, Human
caggcuucugaguagcugggauuauaggugcgcaccaccacacccggcuaguuucuguauuuuu

SEQ ID NO: 494920 - RNA, 64 nt, Human
ggacuccaggccaaguccaacagagaccccaaacccaccacacaccagcagccacaaccucacc

SEQ ID NO: 494921 - RNA, 64 nt, Human
cagccucccaaguagcugggauuauaggugugcgccaccacaccagcuaauuuuuguauuuuua

SEQ ID NO: 494922 - RNA, 64 nt, Human
cuucagauaugagauagugggcuuagaccuaagccauacauauuucuuuucccacauucuguuu

SEQ ID NO: 494923 - RNA, 64 nt, Human
auuaguacaagucucaugauauaaucacugccugcauacauaugcacagauccaguuagugagu

SEQ ID NO: 494924 - RNA, 64 nt, Human
acuguaaacacacguuuaucuuuuggcccaaugccauacauaugguaggcauuuaauuacugau

SEQ ID NO: 494925 - RNA, 64 nt, Human
cuccccugccacacccagugcccacgcaugcucacauacauacagcagaccacaacccuguugc

SEQ ID NO: 494926 - RNA, 64 nt, Human
gauucaaccaaauaaauauauauauacacacacacauacauauacaccuauauauguguguaua

SEQ ID NO: 494927 - RNA, 64 nt, Human
aaagaaguccaaauuuacagguucagggaagauacauacauauaugagguacaguuuuugaaug

SEQ ID NO: 494928 - RNA, 64 nt, Human
ugaaaguaaguuaauuuguuucugcauauaugcacauacauacguaaggaucuuaaacccaguc

SEQ ID NO: 494929 - RNA, 64 nt, Human
aauaauaaaauuaucuaugaaucacuuuuauggucauacauauaugauacaaauccagaguuau

SEQ ID NO: 494930 - RNA, 64 nt, Human
aagaaaaaucccauaugaacaaucuggucauuaacauacauaugauacggagucucuuuguugu

SEQ ID NO: 494931 - RNA, 64 nt, Human
accggaagcaccaaaugcuggugcugcuuuuguacauacauauuuuuaaaccauuaaaauucuu

SEQ ID NO: 494932 - RNA, 64 nt, Human
cagaaaauuuaaaaaaucacaauaguaaucaaaacauacauaacauugaaacagaaggaaaugc

SEQ ID NO: 494933 - RNA, 64 nt, Human
cacacacgcucaaaccccuguccacauauacaaccauacauacuugcacauguguguucaugua

SEQ ID NO: 494934 - RNA, 64 nt, Human
gcaaagcauacacacacacuccaauccauccaugcauacauagacacaagacacacacgcucaa

SEQ ID NO: 494935 - RNA, 64 nt, Human
ccuuuuguugcuuaaaaagaaacaaaacaaaucacauacauacauuuaaaaaaaaaacaacaac

SEQ ID NO: 494936 - RNA, 64 nt, Human
accuuuguaaauagaaacauuucugcauaaaagucauacauaugaagcaagggcugaaucauaa

SEQ ID NO: 494937 - RNA, 64 nt, Human
auaaaacaaauuguuuuaaauguuuaguuucacacauacauaguaccaugauuuucuuugaaag

SEQ ID NO: 494938 - RNA, 64 nt, Human
uagaggucagguacgcugcuaaacacugcagcucccaccacauagaauuauccgaccccagaug

SEQ ID NO: 494939 - RNA, 64 nt, Human
cagccucccaaguagcugggauuacaggcacccgccaccacaccuggcuaauuuuuuuguauuu

SEQ ID NO: 494940 - RNA, 64 nt, Human
gccauugaacccacagagcuguguugcuuuaaagccaccacaaggguacagcauuaaauggcag

SEQ ID NO: 494941 - RNA, 64 nt, Human
cagacagaccuaccuauacauacgugcacacacacauacauauucauacacaauucauacacau

SEQ ID NO: 494942 - RNA, 64 nt, Human
uuuuuaucaguaaggaccaugaucaccauuuguacauacauaacuagguuguugagcaaagcau

SEQ ID NO: 494943 - RNA, 64 nt, Human
aaccuaagaaguuaucuuuucuuucuacccaaagcauacauagucacugagcaccugcggucca

SEQ ID NO: 494944 - RNA, 64 nt, Human
uugugacagaagacauguacacacacaccacacacauacauacacacucucucacucugucucu

SEQ ID NO: 494945 - RNA, 64 nt, Human
ucuuuucucuuggacuuaacaaacauacuguucccauacauaguacaaagaguagcauaauaaa

SEQ ID NO: 494946 - RNA, 64 nt, Human
uuauaacuaaaaaucuuacuauaaugaaagaaaucauacauaaaaauguagccugccuuacaua

SEQ ID NO: 494947 - RNA, 64 nt, Human
aaugccuuggauauuucuguguugucuuuccauucauacauaauuuuagguuaucauuauccuu

SEQ ID NO: 494948 - RNA, 64 nt, Human
ccaguucuccuauccaaaaauaaaugcgaacaugcauacauaaauguggcugagggccacuuuu

SEQ ID NO: 494949 - RNA, 64 nt, Human
ucgacaaacuuuucugaagguucuauuuauuuaccauacauaggguuacuuaccaaacuuuuug

SEQ ID NO: 494950 - RNA, 64 nt, Human
auauucaaaugaagggaucacauuaaaaaaaacccauacauaagaaacagccuccaagaacauu

SEQ ID NO: 494951 - RNA, 64 nt, Human
cuucuaauuauaguuugaaaauagauucccuacacauacauacauauguaugcacagauagggu

SEQ ID NO: 494952 - RNA, 64 nt, Human
uaauuauaguuugaaaauagauucccuacacauacauacauauguaugcacagauagggucuug

SEQ ID NO: 494953 - RNA, 64 nt, Human
ugaaagcugccuuucuauuuacuugagucuuguacauacauacuuuuuuaugagcuaugaaaua

SEQ ID NO: 494954 - RNA, 64 nt, Human
aaaugaaacauuuugaguacugauggcauguuaucauacauaaaguaggucauuuaggaaaaaa

SEQ ID NO: 494955 - RNA, 64 nt, Human
uucauuauucugauagauuguauacauauguacacauacauauacacauaugcacagucaaggu

SEQ ID NO: 494956 - RNA, 64 nt, Human
cugacaggcacauaacuuacgggaaagggaauuucauacauacgauuuuuguuuuguggguagg

SEQ ID NO: 494957 - RNA, 64 nt, Human
accaucacacugaaccacaggacagacccuuucuccaccacagccaaggccuggagacuggggg

SEQ ID NO: 494958 - RNA, 64 nt, Human
ucugugggaagggagucccuggcuuauacugcccccaccacagcuccuugcccuggccagaacu

SEQ ID NO: 494959 - RNA, 64 nt, Human
cagccucccgaguagggaggaccacaggugugagccaccacaccuggcuaauuuuuacuuuuuu

SEQ ID NO: 494960 - RNA, 64 nt, Human
uccaauauacuuuaaaaugguauuuguuuuacagcauacauaaaauguagcaaaucgguacugu

SEQ ID NO: 494961 - RNA, 64 nt, Human
uucuuguaagccccuagaggcagaucagguaaagcauacauaguagagggaaaggagagaaugg

SEQ ID NO: 494962 - RNA, 64 nt, Human
guuaccccucuacacguccacaccacucaccacacauacauacacaugcacacacacacacaug

SEQ ID NO: 494963 - RNA, 64 nt, Human
uguauguauacacacauauacauauauauauacacauacauacacauacauacauacauacaua

SEQ ID NO: 494964 - RNA, 64 nt, Human
cacacauauacauauauauauacacauacauacacauacauacauacauacauauauaucugau

SEQ ID NO: 494965 - RNA, 64 nt, Human
cauauacauauauauauacacauacauacacauacauacauacauacauauauaucugauaaaa

SEQ ID NO: 494966 - RNA, 64 nt, Human
uacauauauauauacacauacauacacauacauacauacauacauauauaucugauaaaauugu

SEQ ID NO: 494967 - RNA, 64 nt, Human
uauauauauacacauacauacacauacauacauacauacauauauaucugauaaaauugugaug

SEQ ID NO: 494968 - RNA, 64 nt, Human
uuguauguuugacuuaccuuagauuuuuauuuuccauacauacugcaaaugauugacuuguugc

SEQ ID NO: 494969 - RNA, 64 nt, Human
uuucaaaauggaaguaauuuagauuuguucuccucauacauaaaaugauuuuaguucaguuuua

SEQ ID NO: 494970 - RNA, 64 nt, Human
uuccucugcugcucaauaguuuuauauaucuaugcauacauauauacacacauauguauauaaa

SEQ ID NO: 494971 - RNA, 64 nt, Human
agcuauauuuuccugagagacugauacauacacucauacauauauguguuccccuuuucccugu

SEQ ID NO: 494972 - RNA, 64 nt, Human
uugagagucagacauuauaauuguuaaccuuauucauacauaccuacauucagaauugaaaggu

SEQ ID NO: 494973 - RNA, 64 nt, Human
aaugugaacuguauuuacauaaacgugcaaggcacauacauaaugacuuucuuuuuccuuaagu

SEQ ID NO: 494974 - RNA, 64 nt, Human
uuugucuuuaggggaggagggcugaggaagaaggcauacauaauuacuucaguguaauccuuua

SEQ ID NO: 494975 - RNA, 64 nt, Human
acccacaccauacauacauacauauauauauacacauacauacaaaccugugugccaagugaca

SEQ ID NO: 494976 - RNA, 64 nt, Human
ucagccucccaaaguacugggauuuaggcaugagccaccacaucuggccaauaguuucuuuuga

SEQ ID NO: 494977 - RNA, 64 nt, Human
gaccucccaaagugcugggauuacuagacguaagccaccacaccuggcaauucccugcuuuuuu

SEQ ID NO: 494978 - RNA, 64 nt, Human
ucagcucccaaguagcugggacuacaggugcacgccaccacaacuggcuaauuuuuguauuuuu

SEQ ID NO: 494979 - RNA, 64 nt, Human
uaauuuuuaagacuauguacccacaccauacauacauacauauauauauacacauacauacaaa

SEQ ID NO: 494980 - RNA, 64 nt, Human
uggguaauuuuuaagacuauguacccacaccauacauacauacauauauauauacacauacaua

SEQ ID NO: 494981 - RNA, 64 nt, Human
uuacuggguaauuuuuaagacuauguacccacaccauacauacauacauauauauauacacaua

SEQ ID NO: 494982 - RNA, 64 nt, Human
aaaccuaaaagcauuugaacaugacacccgaacacauacauauauguucacuuauuuguggcag

SEQ ID NO: 494983 - RNA, 64 nt, Human
ccaaggggcaauucugaaccccaucuuuggcaggcauacauauuucacuguuuccaaagcuauc

SEQ ID NO: 494984 - RNA, 64 nt, Human
cugacuuugccaaaaagcauacaagcaaccuggucauacauaggaugacaaaauucuuucuggu

SEQ ID NO: 494985 - RNA, 64 nt, Human
ucucagaaauaaaucacagaugcauauagacacacauacauaaugguacucccaaacugacaau

SEQ ID NO: 494986 - RNA, 64 nt, Human
guuuucaguacauauuuacaaguucuuacuccaucauacauauugggaaugagcuggcauuuuc

SEQ ID NO: 494987 - RNA, 64 nt, Human
aauugacaauaaguauuuuuauuauaacucagcccauacauauauacuauguaugcagugcauc

SEQ ID NO: 494988 - RNA, 64 nt, Human
cauaauaaaaguucuauauauauauaaauauauacauacauaugagaaaaugauguuuauagca

SEQ ID NO: 494989 - RNA, 64 nt, Human
uuuucuuaagguggucuuaguaauauaacauguucauacauaucaagagaguacuugguauacc

SEQ ID NO: 494990 - RNA, 64 nt, Human
uagacuuauucuuuuauaauaaugaaugugcacucauacauauguagaaacauuuagauuuaga

SEQ ID NO: 494991 - RNA, 64 nt, Human
ggagggguguugacagucuguuucacucagccuacauacauaauaaaaucuaagcccuuuaauu

SEQ ID NO: 494992 - RNA, 64 nt, Human
ucagaucucuucuacuguauuacugaauagcauacauacauagacaauguucgccauucacuag

SEQ ID NO: 494993 - RNA, 64 nt, Human
uaucucagaucucuucuacuguauuacugaauagcauacauacauagacaauguucgccauuca

SEQ ID NO: 494994 - RNA, 64 nt, Human
cauauauacauauauauguauauauauacacacacauacauauguguguguauaguauauauau

SEQ ID NO: 494995 - RNA, 64 nt, Human
cagccucccaaguagcugggacuacaggcacacgccaccacacccagcuaauuuuuuguauuuu

SEQ ID NO: 494996 - RNA, 64 nt, Human
cggccucccaaagugcugggguuacaagcaugagccaccacaccuggccuauuaugaccuuuuu

SEQ ID NO: 494997 - RNA, 64 nt, Human
uucuuucagggagacuucauguguucauuuauuuccaccacagcagauuuuaagaaauuauaau

SEQ ID NO: 494998 - RNA, 64 nt, Human
acccaaacucugcaagaaagcacugugacuaaaacauacauaacgccugcauaaauauuccaug

SEQ ID NO: 494999 - RNA, 64 nt, Human
ggaaugugugaggggcugacagcacaguaacgugcauacauaucugcagggcuggaauggaagc

SEQ ID NO: 495000 - RNA, 64 nt, Human
cauagcaaguucauaaguuuccaaaaaggaagcccauacauaacaguggagguguuuugucuaa

SEQ ID NO: 495001 - RNA, 64 nt, Human
aauguguguacauauacauauauacauaucuacacauacauauauacacauauauguguguaug

SEQ ID NO: 495002 - RNA, 64 nt, Human
ugcuucguaauaaaguuuauaaggaagagcaucucauacauaucauuaucguggaacacguuga

SEQ ID NO: 495003 - RNA, 64 nt, Human
auugguucugaucacuccuaacuugcugggugaucauacauacaucaacaugaaggugugacau

SEQ ID NO: 495004 - RNA, 64 nt, Human
ggccagagauuagagauuucacugauauuuuggacauacauaagaaacaucauuauaauuaaua

SEQ ID NO: 495005 - RNA, 56 nt, Human
uucuuagaaucuggaauuaacagugucauacauauuuguucuccauugauauaucu

SEQ ID NO: 495006 - RNA, 64 nt, Human
gcuuuuacuaucuguguuuuaugguuucauguaacauacauauuccugguguagcacuuaacuc

SEQ ID NO: 495007 - RNA, 64 nt, Human
cacacacauaguauugaucagaaaucuuaugaaucauacauacacucaacaaacauuaaaguug

SEQ ID NO: 495008 - RNA, 64 nt, Human
cuuuuggaaguuaaaauuuaaauggcuuuugccacauacauagaucuucaugaugugugagugu

SEQ ID NO: 495009 - RNA, 64 nt, Human
aggagcaaaaaagaacucaguguaagagaaggcacauacauaguuaagaauacuaaaguauuuu

SEQ ID NO: 495010 - RNA, 63 nt, Human
gagcaccauagucuaaaugccaauaaaaauaauucauacauagaaaugucauugguccugaau

SEQ ID NO: 495011 - RNA, 64 nt, Human
ugcaaaggagacuuaauuucaaaucuguaauuaccauacauaaacugucucauuauacguaugc

SEQ ID NO: 495012 - RNA, 64 nt, Human
uaaaaauuguauuguauauaaugugauuuuuacacauacauacacacacaaauacacaaucucu

SEQ ID NO: 495013 - RNA, 64 nt, Human
uuaaccuuaaccuuaaaauugauauuauauuaaacauacauaauacaauguaacuccacuguuc

SEQ ID NO: 495014 - RNA, 64 nt, Human
caagagggcagggccgggguuuguggucccccccccaccacaaacacagcacuucggcuccucu

SEQ ID NO: 495015 - RNA, 64 nt, Human
ucuagagacuuaaggggaaaagcugcuuucaaggccaccacaugucugugcuccccaaccagcu

SEQ ID NO: 495016 - RNA, 64 nt, Human
cacucuuaggggggugguggcaucuggacaaaugccaccacagcaggugggguggcaaagcuac

SEQ ID NO: 495017 - RNA, 64 nt, Human
ccuauucuaaccacuuaaaauuaucuuaaguaugcauacauaaaagcaaccacuaugagaacua

SEQ ID NO: 495018 - RNA, 64 nt, Human
ugcuuuaugaaucugggugcuccuguauuaggugcauacauauuuaggauaguuagcucuucuu

SEQ ID NO: 495019 - RNA, 64 nt, Human
ucaacagaaucacucacacauacaaguacacucacauacauaaacuaauuauuucucuggauau

SEQ ID NO: 495020 - RNA, 64 nt, Human
agcaauauauuuuccuaguagauauauauauacacauacauauauacacauauacaaauguaua

SEQ ID NO: 495021 - RNA, 64 nt, Human
uuuugauagaauuagauugguaaauacauguauucauacauacucugugguaauagagacuuga

SEQ ID NO: 495022 - RNA, 64 nt, Human
guuauauauacauacagguguauacuuaugcaugcauacauaaauccuuaguauagaaaaauug

SEQ ID NO: 495023 - RNA, 64 nt, Human
agugcgauuuuauauauauauauauauauauauacauacauauauauauaucauauagcuuaag

SEQ ID NO: 495024 - RNA, 64 nt, Human
aguuggaaauuaugaaacuucaccauauuaugaucauacauauuuugaagaacagacugaccaa

SEQ ID NO: 495025 - RNA, 64 nt, Human
gcuuaaaguugcucuuuugguuuuuaacuuccuccauacauaagcuucaaggacaauaagaugu

SEQ ID NO: 495026 - RNA, 64 nt, Human
cccucaaagaucuuaaugaguaaaacaacugcuacauacauaugcagaauguguaauaaaacaa

SEQ ID NO: 495027 - RNA, 64 nt, Human
uacuauagugauucuguuuuugaggugcaaaaaacauacauauauaccaguugguaauucuaac

SEQ ID NO: 495028 - RNA, 64 nt, Human
uuuuaaaagaucagagggugacugaugauacaugcauacauauuuguugaauaaaugaaaauuu

SEQ ID NO: 495029 - RNA, 64 nt, Human
uuacacguuauguauauguguuacauaacaguaacauacauaacucacuccuaggaauguauuu

SEQ ID NO: 495030 - RNA, 64 nt, Human
agaucuaugacauuauucugaucacuggcuccaucauacauauucaccacuugagauucauaac

SEQ ID NO: 495031 - RNA, 64 nt, Human
guuuuuuuaaaaauaucuuuuucuccucucagcucauacauaacacaaggcagaaaucuggaua

SEQ ID NO: 495032 - RNA, 64 nt, Human
aauauuuaugcuuuucuuuguguggcaugacugacauacauacucaaauauaggcugucucuag

SEQ ID NO: 495033 - RNA, 64 nt, Human
ucccuggcagccaggaccagcaccuguagucaccccaccacacgcagacucaugcacgcacaca

SEQ ID NO: 495034 - RNA, 64 nt, Human
uggcguguuuaaauccucaugucuuugagggaucccaccacaggugaaggaaguaaagaccacu

SEQ ID NO: 495035 - RNA, 64 nt, Human
gcccccacacccacuccacaccaguaauaaaaagccaccacacacugacuggcauuucugucac

SEQ ID NO: 495036 - RNA, 64 nt, Human
augagcugucccaccagcaacuuauauauguaaacauacauauauacacauaugcaugugugug

SEQ ID NO: 495037 - RNA, 64 nt, Human
uggaaauuuggaaugaaaugcaauucauuuuguacauacauaguauauuaaaacuauauaauag

SEQ ID NO: 495038 - RNA, 64 nt, Human
uuuuguuuuuuauguauguguauguacguaaauacauacauauuaauuuacauuagagugaaaa

SEQ ID NO: 495039 - RNA, 64 nt, Human
uacuguauauguguauguuauacagacauauacacauacauacauugacccacaggacauugua

SEQ ID NO: 495040 - RNA, 64 nt, Human
gcuguggaucaucuccuaggaaaauagaacaaaacauacauauucacauuacacaguuccagag

SEQ ID NO: 495041 - RNA, 64 nt, Human
guauggagagauucaagaaauaauuuuaaaaccgcauacauaauaaaagacauuguugcauggc

SEQ ID NO: 495042 - RNA, 64 nt, Human
acuaguuuuggcaccugcaacuuucuguauagaccauacauaucugacaucagaaaagcaggcc

SEQ ID NO: 495043 - RNA, 64 nt, Human
guauuuuaugaaaaaaaaugauuuuuuuaaccuucauacauagaagcaaaaauacuuuaacugc

SEQ ID NO: 495044 - RNA, 64 nt, Human
aaaaauauauauuuuuguccaagaaaaaaaaaagcauacauaugugauuauggcuaaaucaaag

SEQ ID NO: 495045 - RNA, 64 nt, Human
auaacaaaccuuauacauacuguuuuuuccuaugcauacauaccugugauuaaguuuaugaauu

SEQ ID NO: 495046 - RNA, 64 nt, Human
uaauuuauuaccuuuacaacauuuauuuacauuacauacauacauuuacaacauuuauuaauuu

SEQ ID NO: 495047 - RNA, 64 nt, Human
ucaauguagcagaauugcacuugugccucacgaacauacauaaauuuuaaaaauaaagaauaaa

SEQ ID NO: 495048 - RNA, 64 nt, Human
cacacacacacacacacacacacacacacacacacauacauacacacacacauauauauacaca

SEQ ID NO: 495049 - RNA, 64 nt, Human
gaucugaaguagacgauaggaauguggaagaacacauacauagugcuuaagaaauacauuuaac

SEQ ID NO: 495050 - RNA, 64 nt, Human
uucauuuucuuuccaggcauagcaguucuuuagccauacauaucauugcaugaacuauuucgaa

SEQ ID NO: 495051 - RNA, 64 nt, Human
gagaugacuuuuauaucccauuuugguaauuauucauacauagcacauaugaccaugauguuca

SEQ ID NO: 495052 - RNA, 64 nt, Human
caaccuccugaguagcugggauuacaggugcgugccaccacaccccgcuaauuuuuguauuuuu

SEQ ID NO: 495053 - RNA, 62 nt, Human
ccuugguccacucugagugaggccaccaucacccaccacacccugcccacuccugcgcuuuu

SEQ ID NO: 495054 - RNA, 64 nt, Human
cggccucccaaagcgcugggauuacaggcgugagccaccacacccggccguggaaugguuuucu

SEQ ID NO: 495055 - RNA, 64 nt, Human
ugcccugacugaauucucuugagacuagaugggacauacauauauagagagagagugagagagu

SEQ ID NO: 495056 - RNA, 64 nt, Human
uggcauuaaaaauaagcacacuuacauaagcccccauacauagagugggacucuuggaaucagg

SEQ ID NO: 495057 - RNA, 64 nt, Human
uccccaggaaagaaggaauugcauccaagguauacauacauauucaucgauguuucgugcuucu

SEQ ID NO: 495058 - RNA, 64 nt, Human
uuaugucaucauuguucaaaauuggagauguacacauacauacccuauaccaagagggccgaaa

SEQ ID NO: 495059 - RNA, 64 nt, Human
acuugcuuucuucuucuuaaagagagcugcuuaccauacauagcacccacagugucucccuucu

SEQ ID NO: 495060 - RNA, 64 nt, Human
cuuuuaaacuucuuuucuuguagaacauuucaaacauacauaaaagagaagagcacagugaacc

SEQ ID NO: 495061 - RNA, 64 nt, Human
ugcgucccuucucuuuggggcuccuuuccccucucauacauaaaaucgcuuucaaauuaaaauc

SEQ ID NO: 495062 - RNA, 64 nt, Human
agucauauaaaugcuuacagacugaaaaaugucucauacauauuuugcagcuaucaugauccua

SEQ ID NO: 495063 - RNA, 64 nt, Human
cacuaucuuuucaaugaaaaaagcaauaaugauccauacauacuauaaggcacuuuuaacagau

SEQ ID NO: 495064 - RNA, 64 nt, Human
guuuggaaagguucuaaggggaccuacagacagacauacauagacauuucaaaauuaauagcuu

SEQ ID NO: 495065 - RNA, 64 nt, Human
uauauauauauauauacauauauauacauacacacauacauauaauuuuuuuuuuuuuugagau

SEQ ID NO: 495066 - RNA, 64 nt, Human
cacacacacacacacacacacacacacauacauacauacauauauauauauauauacauauaua

SEQ ID NO: 495067 - RNA, 64 nt, Human
uacacacacacacacacacacacacacacacauacauacauacauauauauauauauauacaua

SEQ ID NO: 495068 - RNA, 64 nt, Human
uauauacacacacacacacacacacacacacacacauacauacauacauauauauauauauaua

SEQ ID NO: 495069 - RNA, 64 nt, Human
uaauaaaagugaacauugcuacuaucugagccuacauacauaacuugugugauuucaaauuaaa

SEQ ID NO: 495070 - RNA, 64 nt, Human
guaagcuuuuaguuuagcugcuuuaacauggagucauacauacuuagagguaagucauuuauua

SEQ ID NO: 495071 - RNA, 64 nt, Human
uauuuuaaaaguuuacugccaugaaauacuccucccaccacacacacaugcuccaaaagaggaa

SEQ ID NO: 495072 - RNA, 64 nt, Human
gagguacaggauggggcuggcaccagaugaugucccaccacagucccucaccuccggccuccac

SEQ ID NO: 495073 - RNA, 64 nt, Human
ucacuugacccuuguaacugaugaggcaaugaugccaccacaguauucuaauuuacaaaaagaa

SEQ ID NO: 495074 - RNA, 64 nt, Human
aagauuuucuaaaagacuauuuugauaaacuauacauacauaauuuggaauuguuuaagucuau

SEQ ID NO: 495075 - RNA, 64 nt, Human
uuccauuagucugcuauucuguuuccuucaacuucauacauagauucauauaugaaguacugca

SEQ ID NO: 495076 - RNA, 64 nt, Human
aagcugugugaugguauuauaacuguuauauacacauacauauaauuuuguuuuccuuuuuaag

SEQ ID NO: 495077 - RNA, 64 nt, Human
auguauauauauauaguaacuacuuuuuauacuccauacauaacuugauauagaaagcuguuua

SEQ ID NO: 495078 - RNA, 64 nt, Human
uuacuguaaaggcaagccagcauguguguccacacauacauaggauggcuggcucugcaccugu

SEQ ID NO: 495079 - RNA, 64 nt, Human
auuauuuuguaaauccaugacuuaaaacaagauacauacauaguauaacacaccucacaguguu

SEQ ID NO: 495080 - RNA, 64 nt, Human
guacauuuugacuuuguuggcauaaugucaguaacauacauauuccagugguuuuauggacagg

SEQ ID NO: 495081 - RNA, 64 nt, Human
aaacuuuugaaucuuucuuuuauugcuauuuacacauacauacacacauacaaaaccuuuaaau

SEQ ID NO: 495082 - RNA, 64 nt, Human
aaaacuaguauaauuuagucuuuucaugaauguacauacauaaaauuauacauaaaaauauuaa

SEQ ID NO: 495083 - RNA, 64 nt, Human
uuuuguguauagacuguugguaacuucacuagagcauacauaacaacuggaacuggaaauuaua

SEQ ID NO: 495084 - RNA, 64 nt, Human
acagaaagucugccuguuuaguaaguggcaauuccauacauauuuuagaguuuuuucuaucuaa

SEQ ID NO: 495085 - RNA, 64 nt, Human
aauuucacaaaacugccuggcacacaagcacacacauacauagacacauuuuaagugauaaucu

SEQ ID NO: 495086 - RNA, 64 nt, Human
auguaaauuaaaaauuaggaaaucaaaagaaaagcauacauauaaaaaacaguuuuuucuaagc

SEQ ID NO: 495087 - RNA, 64 nt, Human
uguagcuuuaucaaagggugaaaauuauuuuguucauacauauuuuuguagcacugacagauuu

SEQ ID NO: 495088 - RNA, 64 nt, Human
agaagauguaaucuaauauugccauccaauuuagcauacauaaaauguugccacucaccuuccc

SEQ ID NO: 495089 - RNA, 64 nt, Human
ggagucucugaacucuuaauaggaugcagccucacauacauaaugucacccauuuuauguugau

SEQ ID NO: 495090 - RNA, 64 nt, Human
ccaccccccgaguggcugguauuacaagcacaugccaccacaccaggcuaauuuuuguauuuuu

SEQ ID NO: 495091 - RNA, 64 nt, Human
cucccgugcauggcugcccccccguucauuuucuccaccacagccgcuugcacguauagauacu

SEQ ID NO: 495092 - RNA, 64 nt, Human
cagcacuccccuugccuuccccugucuucaccugccaccacacacacacacacacacacacaca

SEQ ID NO: 495093 - RNA, 64 nt, Human
aucaugggagggagcugagggguuaauauauauacauacauacacauauauauauuuuuguaaa

SEQ ID NO: 495094 - RNA, 64 nt, Human
ucauucauuuugcuaagguauaagcagacauaagcauacauaauugaauauauuguugcuauua

SEQ ID NO: 495095 - RNA, 64 nt, Human
agauuaaugcagaagauuuagguuuccagagaagcauacauaaccuagcuucuuuuuacucuug

SEQ ID NO: 495096 - RNA, 64 nt, Human
auucgcugaaauccuucgcuuuaccaaaucuagacauacauaaggggcuuucucucccuuuuca

SEQ ID NO: 495097 - RNA, 64 nt, Human
auuguuacuggugaauugguuuucagguuuugagcauacauauacaauguguuucaaaugcugc

SEQ ID NO: 495098 - RNA, 64 nt, Human
acacuugcaggagcagagcuggucaucgucuuagcauacauauccuacacugaguaaaccguaa

SEQ ID NO: 495099 - RNA, 64 nt, Human
gucaucagcaugcuggguugucauggguuugcugcauacauaguucacccuaauuuauacuuac

SEQ ID NO: 495100 - RNA, 64 nt, Human
gaaaaaauggagcgauuuaggugaccaaauauuacauacauaaauagccacaugaaguuuuaga

SEQ ID NO: 495101 - RNA, 64 nt, Human
uauguguguguauauaaauacaugcacacacuugcauacauauauauuuuuggcugggggagug

SEQ ID NO: 495102 - RNA, 64 nt, Human
acccuccauguucauuuccagacuuggucaggcacauacauaguaaauuauaaucaaucauggg

SEQ ID NO: 495103 - RNA, 64 nt, Human
auuuuuuugcugugaaggucaagcugaaauuuaccauacauaucauacuugcucauuuguuucc

SEQ ID NO: 495104 - RNA, 64 nt, Human
caucuugaugucuaugauagauaauaaacaaggucauacauaccuuacuaaacaauuuugguuu

SEQ ID NO: 495105 - RNA, 64 nt, Human
guggaaaggugucauucaaaaaaaaaguaauuggcauacauauuccacaucaucgauccucucu

SEQ ID NO: 495106 - RNA, 64 nt, Human
gccuccuaaguaaaaguaaaaaaggagucaugugcauacauagaaucagugauggaggccaggc

SEQ ID NO: 495107 - RNA, 64 nt, Human
guucaggugaguuucucuaguuccauaaacaaaacauacauagugggaacucccugguaugcca

SEQ ID NO: 495108 - RNA, 64 nt, Human
cugcucuucccacacaaaguuuugggaaucaauucauacauauuugagauuaaccaaaguccau

SEQ ID NO: 495109 - RNA, 64 nt, Human
gagaugggagguggugaggcguccucaccuccccccaccacagcuguggcugguaaggcaacug

SEQ ID NO: 495110 - RNA, 64 nt, Human
cugccucuaaggccaaggccucaggagagcaucaccaccacaccccugccggccuuggccuugg

SEQ ID NO: 495111 - RNA, 64 nt, Human
agccuccagaguagcuaggacuacaggcagugugccaccacauccagcuaauuuuuuaaaguuu

SEQ ID NO: 495112 - RNA, 64 nt, Human
gucagcaccauguaccaggaauagcuuuacuuuccauacauagaaauauaaauuuagugguauc

SEQ ID NO: 495113 - RNA, 64 nt, Human
auaauaaucguuacaacacguggaguuuuacuaacauacauauuaaaucaaaguauauucuuaa

SEQ ID NO: 495114 - RNA, 64 nt, Human
ugugugcauuugcaugugcaacaguacacacaaacauacauaaagagagcaauugauaaggcaa

SEQ ID NO: 495115 - RNA, 64 nt, Human
agaaaugcuguuuucuuuuucuugauccuugauacauacauauuuuguaugucuauacacuuca

SEQ ID NO: 495116 - RNA, 64 nt, Human
cccaucuccaugccacaccuuauccaguuagacacauacauaccaaucauuagaagaacaaguu

SEQ ID NO: 495117 - RNA, 64 nt, Human
uccaauauacuuuaaaaugguauuuguuuuacagcauacauaaaauguagcaaaucaguacugu

SEQ ID NO: 495118 - RNA, 64 nt, Human
uugccguucugcugauuuuaaauauacaauacaucauacauacuuuacaagcaaguuaaaugga

SEQ ID NO: 495119 - RNA, 64 nt, Human
ucaaauugaauuugaauaaauuagaaauacugugcauacauaaccuucuugugcaccaugagua

SEQ ID NO: 495120 - RNA, 64 nt, Human; identical to SEQ ID NO: 495117

SEQ ID NO: 495121 - RNA, 64 nt, Human
acacauaauacaaacauacaugcaugcacacauacauacauauguauacacacacauaauuuga

SEQ ID NO: 495122 - RNA, 64 nt, Human
aaauacacauaauacaaacauacaugcaugcacacauacauacauauguauacacacacauaau

SEQ ID NO: 495123 - RNA, 64 nt, Human
uauauacuguacauauguauauguaacuaauauacauacauacagguauguauauguaaugguu

SEQ ID NO: 495124 - RNA, 64 nt, Human
ggggccacagcuuagguuuggagcucuggauguacauacauaaguaggagcagugggacguguu

SEQ ID NO: 495125 - RNA, 64 nt, Human
gguuuggaagucuauugcugggaagaaauuccaucauacauauucaugcuuauaauaagcuggg

SEQ ID NO: 495126 - RNA, 64 nt, Human
guauguuuuauaucaaaugccuucaugaaucuuucauacauauauauauuuguaacauuguaaa

SEQ ID NO: 495127 - RNA, 64 nt, Human
uuauagagcugcaaaacacacacaugcguauagacauacauacauguacaccauacauagacaa

SEQ ID NO: 495128 - RNA, 64 nt, Human
gccuggaagguccaggcagugagccaagauugugccaccacacuccagccugggcgacagaaug

SEQ ID NO: 495129 - RNA, 64 nt, Human
ugcuugccaugucuuuucuggaacauacuugcauccaccacagcaucaauucccuugauccagc

SEQ ID NO: 495130 - RNA, 64 nt, Human
auaucaauauuuagacuauggcagauagcuaccaccaccacagggugcuaaaagaaacagugau

SEQ ID NO: 495131 - RNA, 64 nt, Human
acacacaugcguauagacauacauacauguacaccauacauagacaagcaucauaaaggcacaa

SEQ ID NO: 495132 - RNA, 64 nt, Human
uuaauuuaggaguauaugugugucuauacacacacauacauaaauauaccacauauacaccuga

SEQ ID NO: 495133 - RNA, 64 nt, Human
uauccguuuguuuuuccaaaauacuuuauucucucauacauaguauuuucauaauguuugacau

SEQ ID NO: 495134 - RNA, 64 nt, Human
aaacuuccagaucuuuuuucuaugcguaaucagacauacauauauacugcaguguaucucacgu

SEQ ID NO: 495135 - RNA, 64 nt, Human
aaguuucacgcauaaauuaauacaugccugugugcauacauauguaugggauauauuuguauau

SEQ ID NO: 495136 - RNA, 64 nt, Human
ccauuccccuaauaguuuuauuuuuaaagaaagccauacauagaaugcuucaagcuaucuugcu

SEQ ID NO: 495137 - RNA, 64 nt, Human
agauaggguuccaacugggccuacaagcucaagccauacauaaaaggaccuugggacauaagaa

SEQ ID NO: 495138 - RNA, 64 nt, Human
caggauggaaagaaaugcagaacuaucauagucacauacauauaagagggaugguguuuugucu

SEQ ID NO: 495139 - RNA, 64 nt, Human
uuuuuuuccaaaacuguuuuuaaagcuguauacgcauacauauauauauuuuuacucugucuua

SEQ ID NO: 495140 - RNA, 64 nt, Human
gugaguccugauuaaaugcuaguaaaagcugccucauacauacugaguaaaauaaauacggaau

SEQ ID NO: 495141 - RNA, 64 nt, Human
gauagagccaguucaaccucccccaauccauacacauacauaccuaggucauccuaucacccaa

SEQ ID NO: 495142 - RNA, 64 nt, Human
agaaacugcauguaacucuaaguuuuacuccuaacauacauauguuuggggaaguauucuauuc

SEQ ID NO: 495143 - RNA, 64 nt, Human
aucucaagcaaacagcuucacaaauucucacacacauacauaccuauauacucacuuucuagau

SEQ ID NO: 495144 - RNA, 64 nt, Human
aacugacauuccuuuaaaaauauaaauauaaauacauacauacauagauauauacccagacuug

SEQ ID NO: 495145 - RNA, 64 nt, Human
gacauuccuuuaaaaauauaaauauaaauacauacauacauagauauauacccagacuugggug

SEQ ID NO: 495146 - RNA, 64 nt, Human
cugccagagauacucuaggcauguaaagcacaaacauacauauaaaaucugcgggcuucaaaaa

SEQ ID NO: 495147 - RNA, 64 nt, Human
ucagccaccugacuagcugggauugcagccugcaccaccacaccuggcuaaauuuuuguuguug

SEQ ID NO: 495148 - RNA, 64 nt, Human
cuuuuuuuuuuuuugcagcaaccauuaauaaaugccaccacauucuaccagcacaaggaaacau

SEQ ID NO: 495149 - RNA, 64 nt, Human
ucucccaaugcuaucccucccccaucccccgaccccaccacaguccccagagugugauauuccc

SEQ ID NO: 495150 - RNA, 64 nt, Human
ucuuugcaaaacaaggaaaucacacauaugcacacauacauauuuaugguuacuaugauuguua

SEQ ID NO: 495151 - RNA, 64 nt, Human
cacauggaguauggaagggggcauguugauuaaccauacauagaaauaaauauucucuuaguua

SEQ ID NO: 495152 - RNA, 64 nt, Human
uacuauuugaauagaaauguguauguauaauauacauacauacauaagcauauaugugugugug

SEQ ID NO: 495153 - RNA, 64 nt, Human
auuugaauagaaauguguauguauaauauacauacauacauaagcauauaugugugugugugug

SEQ ID NO: 495154 - RNA, 64 nt, Human
ggccugcucuuuccauuguggaucacagcacacacauacauacacccuccaccuccccaucccc

SEQ ID NO: 495155 - RNA, 64 nt, Human
cuguauuuaucugcacuuuguguauauauacacacauacauaugccaacauguaaauaaccuca

SEQ ID NO: 495156 - RNA, 64 nt, Human
ggugauccaaucauuuuuuacucccuuuugaugccauacauagaggaaagucuagcuuuuuugg

SEQ ID NO: 495157 - RNA, 64 nt, Human
ccggucuugcccacagggccugugcugcgacgcacauacauacguguugugucugucaauaaag

SEQ ID NO: 495158 - RNA, 64 nt, Human
ggauuuguucaaugugaaaucagauaguuguuuucauacauauauauauauacacacacacaca

SEQ ID NO: 495159 - RNA, 64 nt, Human
uuauucuguuauuuuagucuccauauguucauuacauacauaaucuuauuuaaucuucacacca

SEQ ID NO: 495160 - RNA, 64 nt, Human
ugcagguuaugguaggagagggugagauauaagacauacauacuuuagauuuuaaauuauuaaa

SEQ ID NO: 495161 - RNA, 64 nt, Human
guuauauuuauauacaguuacagcaggccagaaacauacauacacugcauccuguaaggucugu

SEQ ID NO: 495162 - RNA, 64 nt, Human
caccauuuccucucccugggaucuggaggaacaucauacauaguaggugaaucguuuuguagag

SEQ ID NO: 495163 - RNA, 64 nt, Human; identical to SEQ ID NO: 494961

SEQ ID NO: 495164 - RNA, 64 nt, Human
uguacuguuacaguuugagaauuguagauaacaucauacauaagucauuuaguaacagccuuug

SEQ ID NO: 495165 - RNA, 64 nt, Human
acucuuccuuucuccuuugcuuuuucuucucuuucauacauauaugcgugccuaguucuaggag

SEQ ID NO: 495166 - RNA, 64 nt, Human
gagucucugaaagugcugggauuacaggcgugagccaccacacauggccuauugcacaagucuu

SEQ ID NO: 495167 - RNA, 64 nt, Human
cagucuccugaguagcugagacuacagcugugcgccaccacaucuggcuaauuuuauuuuuauu

SEQ ID NO: 495168 - RNA, 64 nt, Human
cagccucccgaguagcugggacuacaggggcccgccaccacaccuggcuaauuuuuuaaaaaua

SEQ ID NO: 495169 - RNA, 64 nt, Human
auaaaauaguaugaaaauggaaauuugggagagccauacauaaaagaaauaaaccaaaggaaaa

SEQ ID NO: 495170 - RNA, 64 nt, Human
uguacaaaaaaaaaaaaaaaaaaaaaaaaaccagcauacauaugcaaaacuauauauauaugua

SEQ ID NO: 495171 - RNA, 64 nt, Human
gagcuucgggugugugugucugucuguguguaugcauacauauguguguauauaugguuuuguc

SEQ ID NO: 495172 - RNA, 64 nt, Human
gggaaacacacacagagauaucuauacauauauacauacauacaaacauaggcuaucuuggcac

SEQ ID NO: 495173 - RNA, 64 nt, Human
aaaacuuuauuauuucuccucaguagaguuuggacauacauaaggagagaagguacagugauga

SEQ ID NO: 495174 - RNA, 64 nt, Human
uuauaauccauaaggauaugccuguuuuaaauaacauacauauuaacaauaucuaucaggaaaa

SEQ ID NO: 495175 - RNA, 64 nt, Human
agcguucauaugcucugcuuuuaguucauauauacauacauaauguuuuuccuuucuuaauuuu

SEQ ID NO: 495176 - RNA, 64 nt, Human
uuaguccuuuaucauccuuaaaacaauucugugacauacauauuaucucauuuuacacaaaggg

SEQ ID NO: 495177 - RNA, 64 nt, Human
uguguauacauauauacacauauauacacacacacauacauauacauguguauauauauaccau

SEQ ID NO: 495178 - RNA, 64 nt, Human
cugucuuaacuugaacauggcguguuuaaauuuucauacauacuuuacuugaauuauugcuguu

SEQ ID NO: 495179 - RNA, 64 nt, Human
ucuccaauuuaggacuuuuccauagugccaaagccauacauauucaguagaacaucaauaaauu

SEQ ID NO: 495180 - RNA, 64 nt, Human
aaaauucccuguaaaucugaaauauauauauguacauacauauauauuuuuggaaaauggagcu

SEQ ID NO: 495181 - RNA, 64 nt, Human
ggaguccuacuauuucgugccuucauuuguguuacauacauagcugcaagcaaaccauuuuucc

SEQ ID NO: 495182 - RNA, 64 nt, Human
agugcaauuucaacauguaccauuaacugaaaaucauacauaacugugauugaaauuugguuuu

SEQ ID NO: 495183 - RNA, 64 nt, Human
ccaggauuaaaauucauauauacugcagggcagacauacauaugauagcuugugcugauuaauu

SEQ ID NO: 495184 - RNA, 64 nt, Human
gagaauuucauauauauauacauauauauauacacauacauauauauauauauauauguaugua

SEQ ID NO: 495185 - RNA, 64 nt, Human
ggggagggcccgaaauaucuauguuuuaccaagcccaccacaugauucugauguacucuaaaua

SEQ ID NO: 495186 - RNA, 64 nt, Human
gccucccaaagugcugggacgugacaggagugagccaccacaccuggccacucgcaagaccuuu

SEQ ID NO: 495187 - RNA, 64 nt, Human
cagagagacagagcagcccugcacuguuuucccuccaccacagccauccugucccucauuggcu

SEQ ID NO: 495188 - RNA, 64 nt, Human
cuuugaacuauauguauguguauaaggguauacacauacauauauggcauauaacaaguguaca

SEQ ID NO: 495189 - RNA, 64 nt, Human
cauauacacauaacaaguguagaaguauauauuacauacauacacucacucugucugguauagg

SEQ ID NO: 495190 - RNA, 64 nt, Human
uauauauauacacacacacacacacauauguacacauacauauauauacauauauauguauaua

SEQ ID NO: 495191 - RNA, 64 nt, Human
ugucucaaaaguauaaaaaacuuuaauacaaguacauacauauuauauauacacauacauauau

SEQ ID NO: 495192 - RNA, 64 nt, Human
acuuuaauacaaguacauacauauuauauauacacauacauauauauacuauauauggaugaaa

SEQ ID NO: 495193 - RNA, 64 nt, Human
uguuuuccaaacagcuaguuuaacaaaacagcaucauacauagugaaugauguucauuggaaaa

SEQ ID NO: 495194 - RNA, 64 nt, Human
aaaaguaaagauguauaggcaucugguguuucagcauacauaacugaagcaugugaaacaguau

SEQ ID NO: 495195 - RNA, 64 nt, Human
cacuuguuauuauuacaagggaaauagauuuauacauacauauauauauucuucauuacaggaa

SEQ ID NO: 495196 - RNA, 64 nt, Human
gauauaaguuuuuuaaaaaaauaguuguauauaacauacauaucugccccaguguuacuucaca

SEQ ID NO: 495197 - RNA, 64 nt, Human
augcauuaugagucugguuaggcauuacuuuaaacauacauaaagagacaguaggacauugugg

SEQ ID NO: 495198 - RNA, 64 nt, Human
acagagugagauucugucucaaaauaaauacauacauacauacaauaaaaccgaaugagcuggu

SEQ ID NO: 495199 - RNA, 64 nt, Human
gacgacagagugagauucugucucaaaauaaauacauacauacauacaauaaaaccgaaugagc

SEQ ID NO: 495200 - RNA, 64 nt, Human
guugaugaaaaagaacauccugcccaggacccaucauacauauuuucaagaucuuauuuaauuu

SEQ ID NO: 495201 - RNA, 64 nt, Human
uuacuugaaaucuuggcaggugcuuaauagggaacauacauacagcuauguaacugugaauaau

SEQ ID NO: 495202 - RNA, 64 nt, Human
cucuuguuaugcagggaguacaguucuuuucauucauacauaaguucaguaguugcuucccuaa

SEQ ID NO: 495203 - RNA, 64 nt, Human
uggagccaagggucuuucacaucaccuaucccuacauacauaccaaauggaaaaguggccaucc

SEQ ID NO: 495204 - RNA, 64 nt, Human
caaccucccaaagugcugagauuacaggcgugagccaccacacccagcucagggaggcguaguu

SEQ ID NO: 495205 - RNA, 64 nt, Human
ccacuuucagagcccccagcccugggaaccacucccaccacaggcauaagcuaucaccuagcag

SEQ ID NO: 495206 - RNA, 64 nt, Human
gcugccucuucuaccccuauguccaaauuuucagccaccacagaccucagcuguguauccuauc

SEQ ID NO: 495207 - RNA, 64 nt, Human
augcuugccaugugccaggcacugugcugagugccauacauacauuucauuuaauuauccaaua

SEQ ID NO: 495208 - RNA, 64 nt, Human
cugaagaaauuauacguacauacacacauacauacauacauacaaauauauguauauauauucu

SEQ ID NO: 495209 - RNA, 64 nt, Human
ugagcugaagaaauuauacguacauacacacauacauacauacauacaaauauauguauauaua

SEQ ID NO: 495210 - RNA, 64 nt, Human
augcugagcugaagaaauuauacguacauacacacauacauacauacauacaaauauauguaua

SEQ ID NO: 495211 - RNA, 64 nt, Human
acagugcugaaccuuauauauauuuuuuccuacacauacauaccuaugauaaaguuuaauuuau

SEQ ID NO: 495212 - RNA, 64 nt, Human
aauaauacuucagccaccagguuuuucugucucacauacauaagcagcauuucauugcagauau

SEQ ID NO: 495213 - RNA, 64 nt, Human
uuguucuguguauuuuguuuggcuaauaguauugcauacauacuuucucuguauacuacuuucu

SEQ ID NO: 495214 - RNA, 64 nt, Human
gcaaagcuaguuuuauuucuuaaaggauaacagucauacauagaauacuaggaaagccaauauu

SEQ ID NO: 495215 - RNA, 64 nt, Human
cuuugaaaauguaucauucaguguaaauuaauuacauacauauuuuucuauauauuuguuucaa

SEQ ID NO: 495216 - RNA, 64 nt, Human
aaauaaggacaugaguuaaauauauuuauauguacauacauauauauaucccuuuacauauaua

SEQ ID NO: 495217 - RNA, 64 nt, Human
gagucagugcccauguguauggaagacaaauacacauacauauauacauuuugcagcuauggac

SEQ ID NO: 495218 - RNA, 64 nt, Human
ccuaacccauaguuuauauguauaugcacacauacauacauauauguuguguauaaauguacac

SEQ ID NO: 495219 - RNA, 64 nt, Human
ccagccuaacccauaguuuauauguauaugcacacauacauacauauauguuguguauaaaugu

SEQ ID NO: 495220 - RNA, 64 nt, Human
cuccacaggacauaggcaagccuugaucauaguucauacauauaaaugguggugaaauaaagaa

SEQ ID NO: 495221 - RNA, 64 nt, Human
gaaaauuacuuuggagacccaaguaaauauuucucauacauauguagaaagaaauauagguaag

SEQ ID NO: 495222 - RNA, 64 nt, Human
auaagccugucuuccuaucuggauuuuuugugugcauacauauucuacugauuaacuacuuuug

SEQ ID NO: 495223 - RNA, 64 nt, Human
ucuugguugggacacuccucuggcagccccagcaccaccacaaccccuugcagugugccccagu

SEQ ID NO: 495224 - RNA, 64 nt, Human
ggcgccgccgugcucaugcugccgugacaacaggccaccacauaccucaaccuggggaacugua

SEQ ID NO: 495225 - RNA, 64 nt, Human
ccccuugcccggucucgcagccaccccgagcguuccaccacacuguccgcccuuggccucggca

SEQ ID NO: 495226 - RNA, 64 nt, Human
acccccaggagggacccuugauacauguacaaagcauacauagcaccccuugcccugugucugu

SEQ ID NO: 495227 - RNA, 64 nt, Human
cuguggugaaauggcuccagaggucuguacaucacauacauaugcacacaggcacacauggcaa

SEQ ID NO: 495228 - RNA, 64 nt, Human
guguuuugccuccuguucuaauuaauuuugucuccauacauaucugaaccccaaguguguaccu

SEQ ID NO: 495229 - RNA, 64 nt, Human
cuccuuaagaguaggguugugccuuauucaacugcauacauagcuccuagcacagugccuuauu

SEQ ID NO: 495230 - RNA, 64 nt, Human
aauauaaauuuuuuuaaagaucuaacugugaaaacauacauaccuguacauauuuagauauaag

SEQ ID NO: 495231 - RNA, 64 nt, Human
acacugaaacuauacuugaacaguuccaacuguacauacauacuguaugaagcuuguccucuga

SEQ ID NO: 495232 - RNA, 64 nt, Human
auauguguuauacucagagauuaacaaucucaaucauacauacugauucuuucagacauuuaau

SEQ ID NO: 495233 - RNA, 64 nt, Human
gagggagggcaguguccagauccccagagccacacauacauacacauacacacccuuaccccca

SEQ ID NO: 495234 - RNA, 64 nt, Human
auguggaguaguaacuuaauauguaaaguuguaacauacauacauuuaaaauggaaaugcagaa

SEQ ID NO: 495235 - RNA, 64 nt, Human
cacauacucacaaacacacacacaagcacuugcacauacauacaaacacaugcaaacauaccua

SEQ ID NO: 495236 - RNA, 64 nt, Human
cuauugaagaugcugccuguauuugagagacugccauacauaauauaugacuuccuagggaucu

SEQ ID NO: 495237 - RNA, 64 nt, Human
uauauaaauauauauauacauauauauauacacacauacauaucuagaauguguauccgcggcg

SEQ ID NO: 495238 - RNA, 64 nt, Human
agaacugccuuuguuaaauaguuauuuaaagacucauacauaucaaaccaugacuuugaaaggu

SEQ ID NO: 495239 - RNA, 64 nt, Human
uuuuaaucuauuuaaauuuacuuugaaauauauacauacauaugaaugaaagguuguuacagag

SEQ ID NO: 495240 - RNA, 64 nt, Human
uugccaaaccaagccagcuggagcgccacagccgcauacauacagguaacggggaaggacgugc

SEQ ID NO: 495241 - RNA, 64 nt, Human
ugucauucugucaguuuuuaaauuuauguauauacauacauauauauguuuugaagcaaugaaa

SEQ ID NO: 495242 - RNA, 64 nt, Human
uuagggcaccagggguuucucgcauaggaccuuuccaccacagccagcaccuggcaucgcacca

SEQ ID NO: 495243 - RNA, 64 nt, Human
gacugcuuuagagcccuugauaauagucuuauucccaccacauacuaggcacuccauaaauauc

SEQ ID NO: 495244 - RNA, 64 nt, Human
cagccaccugaguagcugggauuacacgcacaugccaccacacccagcuaauuuuugcauuuuu

SEQ ID NO: 495245 - RNA, 64 nt, Human
uguuauaaacauuuaaaaucacauuuuccauuuccauacauaucuuuuuguucaucaguaauaa

SEQ ID NO: 495246 - RNA, 64 nt, Human
uagaaugagcaauagaaaugcacagaugccuauacauacauauacaaauaaaaagauacgauuc

SEQ ID NO: 495247 - RNA, 64 nt, Human
augaacauaaggauaaauagaaaaacugaaucaucauacauaaacauauauaaaaugcauugau

SEQ ID NO: 495248 - RNA, 64 nt, Human
uauuugcaggagcgugguucuaccacccccugggcauacauaaaucgacacaugccaaguccuu

SEQ ID NO: 495249 - RNA, 64 nt, Human
uuagucauuagggaaauacaaaucaaacucaagacauacauagcaucucauuaggauuaguagu

SEQ ID NO: 495250 - RNA, 64 nt, Human
aauaccagauauauuauuucauccacagacauuucauacauaucuuuaaagcacaugacaacau

SEQ ID NO: 495251 - RNA, 64 nt, Human
uauuuugauacaacauauuccccccaaaaaaacacauacauaggaacugguuauauuccaccau

SEQ ID NO: 495252 - RNA, 64 nt, Human
cuuugugagacagagaacagggaauuaaaugugucauacauauccacuugagggcgauuugucu

SEQ ID NO: 495253 - RNA, 64 nt, Human
uuuauuuaaauauauguuacauauuauauuuaaacauacauauuuaacauuuuuuacauaucua

SEQ ID NO: 495254 - RNA, 64 nt, Human
guuuuccaugugaaguuuuuauugagccaacuuucauacauaucuugcuagccuaaagucuaaa

SEQ ID NO: 495255 - RNA, 64 nt, Human
ggcgagggguuuaaccgagucacccagcuggucucauacauagacagcacuugugaaggauuga

SEQ ID NO: 495256 - RNA, 64 nt, Human
uaaaaucucacgcugccauuucccugaacagauacauacauagagagagacaguuuuccaaacu

SEQ ID NO: 495257 - RNA, 64 nt, Human
uguccuuggcagugcugcuacuccucaggugcagcauacauaaccaguaagagacuaaaucugc

SEQ ID NO: 495258 - RNA, 64 nt, Human
cucuggcuguagguuuuaaauuuuuauaucuauacauacauauauacauauauauauaauguac

SEQ ID NO: 495259 - RNA, 64 nt, Human
ugcguggcccaugguggcccuuccagugcauauacauacauauauauauauauaugcauauaua

SEQ ID NO: 495260 - RNA, 64 nt, Human
uucuaagcaggcuucucuguugcuccauuugcuucauacauacuugaccucucuuuucuauucc

SEQ ID NO: 495261 - RNA, 64 nt, Human
gaaacguuugcaacaugaucaagguguuaguucuccaccacacaaguuguauucuucuuuugcc

SEQ ID NO: 495262 - RNA, 64 nt, Human
agaugaucauuggaagcaaucaguuuacucuuccccaccacagugguuaaaaggcguuuguauc

SEQ ID NO: 495263 - RNA, 64 nt, Human
aagcuagugcuguugagaaggggguuccccuguaccaccacaucgccgacuugucuggcaacuc

SEQ ID NO: 495264 - RNA, 64 nt, Human
guacagguguauauaccucuauauuauauaucgacauacauauauauuuuugggggggggcgga

SEQ ID NO: 495265 - RNA, 64 nt, Human
caaaugcuugcucuucaucauauauauaguuaugcauacauacacacacacacauacaguauau

SEQ ID NO: 495266 - RNA, 64 nt, Human
ccccccagcccugacauguucuuuuuuuggcaaacauacauaauguuacaucauacuaugauga

SEQ ID NO: 495267 - RNA, 64 nt, Human
uacacacacauauauauguguguauauauauacacauacauauauauacacacacgcauuugca

SEQ ID NO: 495268 - RNA, 64 nt, Human
agaaauuuuauaaauguguauuucuguguauucacauacauauauauauacacacauauauaug

SEQ ID NO: 495269 - RNA, 64 nt, Human
cauauauauauacacacauauauauguacauacacauacauacauauuaccauacugaagggaa

SEQ ID NO: 495270 - RNA, 64 nt, Human
uauauauacacacauauauauguacauacacauacauacauauuaccauacugaagggaaaugg

SEQ ID NO: 495271 - RNA, 64 nt, Human
caguuuuauuaccuuauauacaaaucuucauuuucauacauaguacaauguaaauauauaacuu

SEQ ID NO: 495272 - RNA, 64 nt, Human
caaauaaccaacccuucccugaaaaccucacaugcauacauacacauauauacacacacaaaga

SEQ ID NO: 495273 - RNA, 64 nt, Human
ggacaaagacauaaauauuagaauggagguaauacauacauaguaucaauauuguuucaacuug

SEQ ID NO: 495274 - RNA, 64 nt, Human
cauaaaauuguuaauuuauacacacacauacacucauacauagagagagauuuucgguauguug

SEQ ID NO: 495275 - RNA, 64 nt, Human
aacugugcuaguacuaaaagaaaacagguuggaacauacauauagccuagcauuuauaacagaa

SEQ ID NO: 495276 - RNA, 64 nt, Human
gacugauauauauauauauuuuaauucagaguuacauacauacagcuaccauuuuauaugaaaa

SEQ ID NO: 495277 - RNA, 64 nt, Human
aaaaccacugaagaacaaguguuccuuuuuaccacauacauauuauguuuugaucacugcugcu

SEQ ID NO: 495278 - RNA, 64 nt, Human
uaaacaaggguuugguguuuuuaaaguguguauacauacauacacauacacacaugcacauaug

SEQ ID NO: 495279 - RNA, 64 nt, Human
uuuuaacaacaaaaaagaaagucuggguuccacacauacauagaaaaagauuauuauguucuga

SEQ ID NO: 495280 - RNA, 64 nt, Human
cagccuccagaguagcugggacuacaggugcccgccaccacacccggcuaauuuuuuguguuuu

SEQ ID NO: 495281 - RNA, 64 nt, Human
cuucugcuugucacuugucaggaauguguuuuuaccaccacagggaaacugcguucaaaucaac

SEQ ID NO: 495282 - RNA, 64 nt, Human
cagucuccugaguagcuggaacuacaaggaagggccaccacaccugacuaacuuuuuuguuuuu

SEQ ID NO: 495283 - RNA, 64 nt, Human
acucaaguuaugucauaccuuuggauacgaagaccauacauaauaaccaaacauaacauuauac

SEQ ID NO: 495284 - RNA, 64 nt, Human
caaucuuuugcccuuugcuugaauuccuggaaugcauacauauaagcuaaacagaugucugcag

SEQ ID NO: 495285 - RNA, 64 nt, Human
gcuucagcugcagccugccugugcuggcugcuggggucgauaggcuuuugucguaauaggcaga

SEQ ID NO: 495286 - RNA, 64 nt, Human
cucaaauagucuauaccugaacugcuauaagcaaggucgauagggaaguggauagauugcuuca

SEQ ID NO: 495287 - RNA, 64 nt, Human
caguguuuuuaugacuuuuauacuauuucuuuauggucgauauacaauugauuuuuuaaaauaa

SEQ ID NO: 495288 - RNA, 64 nt, Human
ugugugugugugcuauaccuuaauggggaaggggggucgauaugcauuauaugugccgugugug

SEQ ID NO: 495289 - RNA, 64 nt, Human
aaccuuguggaaucccuuugcuuaggcccaaccuggucgauagcucgagaaagaauuuuuucca

SEQ ID NO: 495290 - RNA, 64 nt, Human
guauuauuuucuccgaaaacuucacucaccgaaaggucgauagauugaggcuacucucaggcaa

SEQ ID NO: 495291 - RNA, 64 nt, Human
ggcuggaggccagaggugucagcaacacugugucccaccacaaccuccagccucccuuuucaga

SEQ ID NO: 495292 - RNA, 64 nt, Human
cagccuccugaguagcugggacuacagguuccuaccaccacacccggccaauuuuuguauuuuu

SEQ ID NO: 495293 - RNA, 64 nt, Human
acccggguuccccucucuuuaauuuggagacacuccaccacaaacuuuucacuuuagagguagc

SEQ ID NO: 495294 - RNA, 64 nt, Human
ccucagccuccaaaguagcugggauuacaggcacccaccacaucuggcuaauuuuuuguauuuu

SEQ ID NO: 495295 - RNA, 64 nt, Human
cugccuuggaggguacaagauccacugaggguggccaccacagccuuggcuccaugguggcggg

SEQ ID NO: 495296 - RNA, 64 nt, Human
caccugggauuugcuauugaaucucuacccucucccaccacacaguacugauugcucacugaaa

SEQ ID NO: 495297 - RNA, 64 nt, Human
cgggagcggggcugcuggagagagcggggaacucccaccacaguggggcauccggcacugaagc

SEQ ID NO: 495298 - RNA, 64 nt, Human
cucagccucucaaguagcugggacuacaggugcaccaccacaccuggcuaauuuuuguauuuuu

SEQ ID NO: 495299 - RNA, 64 nt, Human
cuggugggcgggaaaccaguguccccaccaucagccaccacacaccucugcugcccuggagacu

SEQ ID NO: 495300 - RNA, 64 nt, Human
cggccucccuaguagcugggauuacaggcgcacaccaccacacacagcuaauuuuuuuuuuuuu

SEQ ID NO: 495301 - RNA, 64 nt, Human
cacccagcucagccacacacaacuacccuccaaaccaccacagucucugucacacccccacuac

SEQ ID NO: 495302 - RNA, 64 nt, Human
cccagggccucaaugagccugguccaugaagugcccaccacaucgcagcacuuuuaccacguuu

SEQ ID NO: 495303 - RNA, 64 nt, Human; identical to SEQ ID NO: 486639

SEQ ID NO: 495304 - RNA, 64 nt, Human; identical to SEQ ID NO: 486643

SEQ ID NO: 495305 - RNA, 64 nt, Human; identical to SEQ ID NO: 486644

SEQ ID NO: 495306 - RNA, 64 nt, Human; identical to SEQ ID NO: 486645

SEQ ID NO: 495307 - RNA, 64 nt, Human; identical to SEQ ID NO: 486646

SEQ ID NO: 495308 - RNA, 64 nt, Human; identical to SEQ ID NO: 486647

SEQ ID NO: 495309 - RNA, 64 nt, Human; identical to SEQ ID NO: 486648

SEQ ID NO: 495310 - RNA, 64 nt, Human; identical to SEQ ID NO: 486649

SEQ ID NO: 495311 - RNA, 64 nt, Human; identical to SEQ ID NO: 486650

SEQ ID NO: 495312 - RNA, 64 nt, Human; identical to SEQ ID NO: 486651

SEQ ID NO: 495313 - RNA, 64 nt, Human; identical to SEQ ID NO: 486652

SEQ ID NO: 495314 - RNA, 64 nt, Human; identical to SEQ ID NO: 486653

SEQ ID NO: 495315 - RNA, 64 nt, Human; identical to SEQ ID NO: 486654

SEQ ID NO: 495316 - RNA, 64 nt, Human; identical to SEQ ID NO: 300374

SEQ ID NO: 495317 - RNA, 64 nt, Human; identical to SEQ ID NO: 300383

SEQ ID NO: 495318 - RNA, 64 nt, Human; identical to SEQ ID NO: 300390

SEQ ID NO: 495319 - RNA, 64 nt, Human; identical to SEQ ID NO: 300400

SEQ ID NO: 495320 - RNA, 64 nt, Human; identical to SEQ ID NO: 486655

SEQ ID NO: 495321 - RNA, 64 nt, Human; identical to SEQ ID NO: 486656

SEQ ID NO: 495322 - RNA, 64 nt, Human; identical to SEQ ID NO: 486657

SEQ ID NO: 495323 - RNA, 64 nt, Human; identical to SEQ ID NO: 486661

SEQ ID NO: 495324 - RNA, 64 nt, Human; identical to SEQ ID NO: 486662

SEQ ID NO: 495325 - RNA, 64 nt, Human; identical to SEQ ID NO: 486663

SEQ ID NO: 495326 - RNA, 64 nt, Human; identical to SEQ ID NO: 486664

SEQ ID NO: 495327 - RNA, 64 nt, Human; identical to SEQ ID NO: 486665

SEQ ID NO: 495328 - RNA, 64 nt, Human; identical to SEQ ID NO: 486666

SEQ ID NO: 495329 - RNA, 64 nt, Human; identical to SEQ ID NO: 486667

SEQ ID NO: 495330 - RNA, 64 nt, Human; identical to SEQ ID NO: 486668

SEQ ID NO: 495331 - RNA, 64 nt, Human; identical to SEQ ID NO: 486669

SEQ ID NO: 495332 - RNA, 64 nt, Human; identical to SEQ ID NO: 486670

SEQ ID NO: 495333 - RNA, 64 nt, Human; identical to SEQ ID NO: 300405

SEQ ID NO: 495334 - RNA, 64 nt, Human; identical to SEQ ID NO: 300413

SEQ ID NO: 495335 - RNA, 64 nt, Human; identical to SEQ ID NO: 300421

SEQ ID NO: 495336 - RNA, 64 nt, Human; identical to SEQ ID NO: 300429

SEQ ID NO: 495337 - RNA, 64 nt, Human; identical to SEQ ID NO: 486671

SEQ ID NO: 495338 - RNA, 64 nt, Human; identical to SEQ ID NO: 486672

SEQ ID NO: 495339 - RNA, 64 nt, Human; identical to SEQ ID NO: 486673

SEQ ID NO: 495340 - RNA, 64 nt, Human; identical to SEQ ID NO: 486674

SEQ ID NO: 495341 - RNA, 64 nt, Human; identical to SEQ ID NO: 486675

SEQ ID NO: 495342 - RNA, 64 nt, Human; identical to SEQ ID NO: 486679

SEQ ID NO: 495343 - RNA, 64 nt, Human; identical to SEQ ID NO: 486680

SEQ ID NO: 495344 - RNA, 64 nt, Human; identical to SEQ ID NO: 486681

SEQ ID NO: 495345 - RNA, 64 nt, Human; identical to SEQ ID NO: 486682

SEQ ID NO: 495346 - RNA, 64 nt, Human; identical to SEQ ID NO: 486683

SEQ ID NO: 495347 - RNA, 64 nt, Human; identical to SEQ ID NO: 486684

SEQ ID NO: 495348 - RNA, 64 nt, Human; identical to SEQ ID NO: 486685

SEQ ID NO: 495349 - RNA, 64 nt, Human; identical to SEQ ID NO: 486686

SEQ ID NO: 495350 - RNA, 64 nt, Human; identical to SEQ ID NO: 300440

SEQ ID NO: 495351 - RNA, 64 nt, Human; identical to SEQ ID NO: 300444

SEQ ID NO: 495352 - RNA, 64 nt, Human; identical to SEQ ID NO: 300448

SEQ ID NO: 495353 - RNA, 64 nt, Human; identical to SEQ ID NO: 300456

SEQ ID NO: 495354 - RNA, 64 nt, Human; identical to SEQ ID NO: 486687

SEQ ID NO: 495355 - RNA, 64 nt, Human; identical to SEQ ID NO: 486688

SEQ ID NO: 495356 - RNA, 64 nt, Human; identical to SEQ ID NO: 486689

SEQ ID NO: 495357 - RNA, 64 nt, Human; identical to SEQ ID NO: 486690

SEQ ID NO: 495358 - RNA, 64 nt, Human; identical to SEQ ID NO: 486691

SEQ ID NO: 495359 - RNA, 64 nt, Human; identical to SEQ ID NO: 486692

SEQ ID NO: 495360 - RNA, 64 nt, Human; identical to SEQ ID NO: 486693

SEQ ID NO: 495361 - RNA, 64 nt, Human; identical to SEQ ID NO: 486697

SEQ ID NO: 495362 - RNA, 64 nt, Human; identical to SEQ ID NO: 486698

SEQ ID NO: 495363 - RNA, 64 nt, Human; identical to SEQ ID NO: 486699

SEQ ID NO: 495364 - RNA, 64 nt, Human; identical to SEQ ID NO: 486700

SEQ ID NO: 495365 - RNA, 64 nt, Human; identical to SEQ ID NO: 486701

SEQ ID NO: 495366 - RNA, 64 nt, Human; identical to SEQ ID NO: 486702

SEQ ID NO: 495367 - RNA, 64 nt, Human; identical to SEQ ID NO: 300463

SEQ ID NO: 495368 - RNA, 64 nt, Human; identical to SEQ ID NO: 300474

SEQ ID NO: 495369 - RNA, 64 nt, Human; identical to SEQ ID NO: 300478

SEQ ID NO: 495370 - RNA, 64 nt, Human; identical to SEQ ID NO: 300483

SEQ ID NO: 495371 - RNA, 64 nt, Human; identical to SEQ ID NO: 486703

SEQ ID NO: 495372 - RNA, 64 nt, Human; identical to SEQ ID NO: 486704

SEQ ID NO: 495373 - RNA, 64 nt, Human; identical to SEQ ID NO: 486705

SEQ ID NO: 495374 - RNA, 64 nt, Human; identical to SEQ ID NO: 486706

SEQ ID NO: 495375 - RNA, 64 nt, Human; identical to SEQ ID NO: 486707

SEQ ID NO: 495376 - RNA, 64 nt, Human; identical to SEQ ID NO: 486708

SEQ ID NO: 495377 - RNA, 64 nt, Human; identical to SEQ ID NO: 486709

SEQ ID NO: 495378 - RNA, 64 nt, Human; identical to SEQ ID NO: 486710

SEQ ID NO: 495379 - RNA, 64 nt, Human; identical to SEQ ID NO: 486711

SEQ ID NO: 495380 - RNA, 64 nt, Human; identical to SEQ ID NO: 486715

SEQ ID NO: 495381 - RNA, 64 nt, Human; identical to SEQ ID NO: 486716

SEQ ID NO: 495382 - RNA, 64 nt, Human; identical to SEQ ID NO: 486717

SEQ ID NO: 495383 - RNA, 64 nt, Human; identical to SEQ ID NO: 486718

SEQ ID NO: 495384 - RNA, 64 nt, Human; identical to SEQ ID NO: 300488

SEQ ID NO: 495385 - RNA, 64 nt, Human; identical to SEQ ID NO: 300499

SEQ ID NO: 495386 - RNA, 64 nt, Human; identical to SEQ ID NO: 300504

SEQ ID NO: 495387 - RNA, 64 nt, Human; identical to SEQ ID NO: 300513

SEQ ID NO: 495388 - RNA, 64 nt, Human; identical to SEQ ID NO: 486719

SEQ ID NO: 495389 - RNA, 64 nt, Human; identical to SEQ ID NO: 486720

SEQ ID NO: 495390 - RNA, 64 nt, Human; identical to SEQ ID NO: 486721

SEQ ID NO: 495391 - RNA, 64 nt, Human; identical to SEQ ID NO: 486722

SEQ ID NO: 495392 - RNA, 64 nt, Human; identical to SEQ ID NO: 486723

SEQ ID NO: 495393 - RNA, 64 nt, Human; identical to SEQ ID NO: 486724

SEQ ID NO: 495394 - RNA, 64 nt, Human; identical to SEQ ID NO: 486725

SEQ ID NO: 495395 - RNA, 64 nt, Human; identical to SEQ ID NO: 486726

SEQ ID NO: 495396 - RNA, 64 nt, Human; identical to SEQ ID NO: 486727

SEQ ID NO: 495397 - RNA, 64 nt, Human; identical to SEQ ID NO: 486728

SEQ ID NO: 495398 - RNA, 64 nt, Human; identical to SEQ ID NO: 486729

SEQ ID NO: 495399 - RNA, 64 nt, Human; identical to SEQ ID NO: 486733

SEQ ID NO: 495400 - RNA, 64 nt, Human; identical to SEQ ID NO: 486734

SEQ ID NO: 495401 - RNA, 64 nt, Human; identical to SEQ ID NO: 300521

SEQ ID NO: 495402 - RNA, 64 nt, Human; identical to SEQ ID NO: 300522

SEQ ID NO: 495403 - RNA, 64 nt, Human; identical to SEQ ID NO: 300523

SEQ ID NO: 495404 - RNA, 64 nt, Human; identical to SEQ ID NO: 300524

SEQ ID NO: 495405 - RNA, 64 nt, Human; identical to SEQ ID NO: 486735

SEQ ID NO: 495406 - RNA, 64 nt, Human; identical to SEQ ID NO: 486736

SEQ ID NO: 495407 - RNA, 64 nt, Human; identical to SEQ ID NO: 486737

SEQ ID NO: 495408 - RNA, 64 nt, Human; identical to SEQ ID NO: 486738

SEQ ID NO: 495409 - RNA, 64 nt, Human; identical to SEQ ID NO: 486739

SEQ ID NO: 495410 - RNA, 64 nt, Human; identical to SEQ ID NO: 486740

SEQ ID NO: 495411 - RNA, 64 nt, Human; identical to SEQ ID NO: 486741

SEQ ID NO: 495412 - RNA, 64 nt, Human; identical to SEQ ID NO: 486742

SEQ ID NO: 495413 - RNA, 64 nt, Human; identical to SEQ ID NO: 486743

SEQ ID NO: 495414 - RNA, 64 nt, Human; identical to SEQ ID NO: 486744

SEQ ID NO: 495415 - RNA, 64 nt, Human; identical to SEQ ID NO: 486745

SEQ ID NO: 495416 - RNA, 64 nt, Human; identical to SEQ ID NO: 486746

SEQ ID NO: 495417 - RNA, 64 nt, Human; identical to SEQ ID NO: 486747

SEQ ID NO: 495418 - RNA, 64 nt, Human; identical to SEQ ID NO: 90376

SEQ ID NO: 495419 - RNA, 64 nt, Human; identical to SEQ ID NO: 90377

SEQ ID NO: 495420 - RNA, 64 nt, Human; identical to SEQ ID NO: 90378

SEQ ID NO: 495421 - RNA, 64 nt, Human; identical to SEQ ID NO: 90379

SEQ ID NO: 495422 - RNA, 64 nt, Human; identical to SEQ ID NO: 486751

SEQ ID NO: 495423 - RNA, 64 nt, Human; identical to SEQ ID NO: 486752

SEQ ID NO: 495424 - RNA, 64 nt, Human; identical to SEQ ID NO: 486753

SEQ ID NO: 495425 - RNA, 64 nt, Human; identical to SEQ ID NO: 486754

SEQ ID NO: 495426 - RNA, 64 nt, Human; identical to SEQ ID NO: 486755

SEQ ID NO: 495427 - RNA, 64 nt, Human; identical to SEQ ID NO: 486756

SEQ ID NO: 495428 - RNA, 64 nt, Human; identical to SEQ ID NO: 486757

SEQ ID NO: 495429 - RNA, 64 nt, Human; identical to SEQ ID NO: 486758

SEQ ID NO: 495430 - RNA, 64 nt, Human; identical to SEQ ID NO: 486759

SEQ ID NO: 495431 - RNA, 64 nt, Human; identical to SEQ ID NO: 486760

SEQ ID NO: 495432 - RNA, 64 nt, Human; identical to SEQ ID NO: 486761

SEQ ID NO: 495433 - RNA, 64 nt, Human; identical to SEQ ID NO: 486762

SEQ ID NO: 495434 - RNA, 64 nt, Human; identical to SEQ ID NO: 486763

SEQ ID NO: 495435 - RNA, 64 nt, Human; identical to SEQ ID NO: 90383

SEQ ID NO: 495436 - RNA, 51 nt, Human; identical to SEQ ID NO: 23188

SEQ ID NO: 495437 - RNA, 64 nt, Human; identical to SEQ ID NO: 90399

SEQ ID NO: 495438 - RNA, 64 nt, Human; identical to SEQ ID NO: 90404

SEQ ID NO: 495439 - RNA, 64 nt, Human; identical to SEQ ID NO: 486764

SEQ ID NO: 495440 - RNA, 64 nt, Human; identical to SEQ ID NO: 486765

SEQ ID NO: 495441 - RNA, 64 nt, Human; identical to SEQ ID NO: 486769

SEQ ID NO: 495442 - RNA, 64 nt, Human; identical to SEQ ID NO: 486770

SEQ ID NO: 495443 - RNA, 64 nt, Human; identical to SEQ ID NO: 486771

SEQ ID NO: 495444 - RNA, 64 nt, Human; identical to SEQ ID NO: 486772

SEQ ID NO: 495445 - RNA, 64 nt, Human; identical to SEQ ID NO: 486773

SEQ ID NO: 495446 - RNA, 64 nt, Human; identical to SEQ ID NO: 486774

SEQ ID NO: 495447 - RNA, 64 nt, Human; identical to SEQ ID NO: 486775

SEQ ID NO: 495448 - RNA, 64 nt, Human; identical to SEQ ID NO: 486776

SEQ ID NO: 495449 - RNA, 64 nt, Human; identical to SEQ ID NO: 486777

SEQ ID NO: 495450 - RNA, 64 nt, Human; identical to SEQ ID NO: 486778

SEQ ID NO: 495451 - RNA, 64 nt, Human; identical to SEQ ID NO: 486779

SEQ ID NO: 495452 - RNA, 64 nt, Human; identical to SEQ ID NO: 300533

SEQ ID NO: 495453 - RNA, 64 nt, Human; identical to SEQ ID NO: 300534

SEQ ID NO: 495454 - RNA, 64 nt, Human; identical to SEQ ID NO: 300535

SEQ ID NO: 495455 - RNA, 53 nt, Human; identical to SEQ ID NO: 300536

SEQ ID NO: 495456 - RNA, 64 nt, Human; identical to SEQ ID NO: 486780

SEQ ID NO: 495457 - RNA, 64 nt, Human; identical to SEQ ID NO: 486781

SEQ ID NO: 495458 - RNA, 64 nt, Human; identical to SEQ ID NO: 486782

SEQ ID NO: 495459 - RNA, 64 nt, Human; identical to SEQ ID NO: 486783

SEQ ID NO: 495460 - RNA, 55 nt, Human; identical to SEQ ID NO: 486787

SEQ ID NO: 495461 - RNA, 64 nt, Human; identical to SEQ ID NO: 486788

SEQ ID NO: 495462 - RNA, 64 nt, Human; identical to SEQ ID NO: 486789

SEQ ID NO: 495463 - RNA, 64 nt, Human; identical to SEQ ID NO: 486790

SEQ ID NO: 495464 - RNA, 64 nt, Human; identical to SEQ ID NO: 486791

SEQ ID NO: 495465 - RNA, 64 nt, Human; identical to SEQ ID NO: 486792

SEQ ID NO: 495466 - RNA, 64 nt, Human; identical to SEQ ID NO: 486793

SEQ ID NO: 495467 - RNA, 64 nt, Human; identical to SEQ ID NO: 486794

SEQ ID NO: 495468 - RNA, 64 nt, Human; identical to SEQ ID NO: 486795

SEQ ID NO: 495469 - RNA, 64 nt, Human; identical to SEQ ID NO: 300526

SEQ ID NO: 495470 - RNA, 64 nt, Human; identical to SEQ ID NO: 300527

SEQ ID NO: 495471 - RNA, 64 nt, Human; identical to SEQ ID NO: 300531

SEQ ID NO: 495472 - RNA, 64 nt, Human; identical to SEQ ID NO: 300532

SEQ ID NO: 495473 - RNA, 64 nt, Human; identical to SEQ ID NO: 486796

SEQ ID NO: 495474 - RNA, 64 nt, Human; identical to SEQ ID NO: 486797

SEQ ID NO: 495475 - RNA, 64 nt, Human; identical to SEQ ID NO: 486798

SEQ ID NO: 495476 - RNA, 64 nt, Human; identical to SEQ ID NO: 486799

SEQ ID NO: 495477 - RNA, 64 nt, Human; identical to SEQ ID NO: 486800

SEQ ID NO: 495478 - RNA, 64 nt, Human; identical to SEQ ID NO: 486801

SEQ ID NO: 495479 - RNA, 64 nt, Human; identical to SEQ ID NO: 486805

SEQ ID NO: 495480 - RNA, 64 nt, Human; identical to SEQ ID NO: 486806

SEQ ID NO: 495481 - RNA, 64 nt, Human; identical to SEQ ID NO: 486807

SEQ ID NO: 495482 - RNA, 64 nt, Human; identical to SEQ ID NO: 486808

SEQ ID NO: 495483 - RNA, 64 nt, Human; identical to SEQ ID NO: 486809

SEQ ID NO: 495484 - RNA, 64 nt, Human; identical to SEQ ID NO: 486810

SEQ ID NO: 495485 - RNA, 64 nt, Human; identical to SEQ ID NO: 486811

SEQ ID NO: 495486 - RNA, 64 nt, Human; identical to SEQ ID NO: 300537

SEQ ID NO: 495487 - RNA, 64 nt, Human; identical to SEQ ID NO: 300538

SEQ ID NO: 495488 - RNA, 64 nt, Human; identical to SEQ ID NO: 300539

SEQ ID NO: 495489 - RNA, 64 nt, Human; identical to SEQ ID NO: 300540

SEQ ID NO: 495490 - RNA, 64 nt, Human; identical to SEQ ID NO: 486812

SEQ ID NO: 495491 - RNA, 64 nt, Human; identical to SEQ ID NO: 486813

SEQ ID NO: 495492 - RNA, 64 nt, Human; identical to SEQ ID NO: 486814

SEQ ID NO: 495493 - RNA, 64 nt, Human; identical to SEQ ID NO: 486815

SEQ ID NO: 495494 - RNA, 64 nt, Human; identical to SEQ ID NO: 486816

SEQ ID NO: 495495 - RNA, 64 nt, Human; identical to SEQ ID NO: 486817

SEQ ID NO: 495496 - RNA, 64 nt, Human; identical to SEQ ID NO: 486818

SEQ ID NO: 495497 - RNA, 64 nt, Human; identical to SEQ ID NO: 486819

SEQ ID NO: 495498 - RNA, 64 nt, Human; identical to SEQ ID NO: 486823

SEQ ID NO: 495499 - RNA, 64 nt, Human; identical to SEQ ID NO: 486824

SEQ ID NO: 495500 - RNA, 64 nt, Human; identical to SEQ ID NO: 486825

SEQ ID NO: 495501 - RNA, 64 nt, Human; identical to SEQ ID NO: 486826

SEQ ID NO: 495502 - RNA, 64 nt, Human; identical to SEQ ID NO: 486827

SEQ ID NO: 495503 - RNA, 64 nt, Human; identical to SEQ ID NO: 300485

SEQ ID NO: 495504 - RNA, 64 nt, Human; identical to SEQ ID NO: 300486

SEQ ID NO: 495505 - RNA, 64 nt, Human; identical to SEQ ID NO: 300487

SEQ ID NO: 495506 - RNA, 64 nt, Human; identical to SEQ ID NO: 300508

SEQ ID NO: 495507 - RNA, 64 nt, Human; identical to SEQ ID NO: 486828

SEQ ID NO: 495508 - RNA, 64 nt, Human; identical to SEQ ID NO: 486829

SEQ ID NO: 495509 - RNA, 64 nt, Human; identical to SEQ ID NO: 486830

SEQ ID NO: 495510 - RNA, 64 nt, Human; identical to SEQ ID NO: 486831

SEQ ID NO: 495511 - RNA, 64 nt, Human; identical to SEQ ID NO: 486832

SEQ ID NO: 495512 - RNA, 64 nt, Human; identical to SEQ ID NO: 486833

SEQ ID NO: 495513 - RNA, 64 nt, Human; identical to SEQ ID NO: 486834

SEQ ID NO: 495514 - RNA, 64 nt, Human; identical to SEQ ID NO: 486835

SEQ ID NO: 495515 - RNA, 64 nt, Human; identical to SEQ ID NO: 486836

SEQ ID NO: 495516 - RNA, 64 nt, Human; identical to SEQ ID NO: 486837

SEQ ID NO: 495517 - RNA, 64 nt, Human; identical to SEQ ID NO: 486841

SEQ ID NO: 495518 - RNA, 64 nt, Human; identical to SEQ ID NO: 486842

SEQ ID NO: 495519 - RNA, 64 nt, Human; identical to SEQ ID NO: 486843

SEQ ID NO: 495520 - RNA, 64 nt, Human; identical to SEQ ID NO: 300512

SEQ ID NO: 495521 - RNA, 64 nt, Human; identical to SEQ ID NO: 300541

SEQ ID NO: 495522 - RNA, 64 nt, Human; identical to SEQ ID NO: 300542

SEQ ID NO: 495523 - RNA, 64 nt, Human; identical to SEQ ID NO: 300543

SEQ ID NO: 495524 - RNA, 64 nt, Human; identical to SEQ ID NO: 486844

SEQ ID NO: 495525 - RNA, 64 nt, Human; identical to SEQ ID NO: 486845

SEQ ID NO: 495526 - RNA, 64 nt, Human; identical to SEQ ID NO: 486846

SEQ ID NO: 495527 - RNA, 64 nt, Human; identical to SEQ ID NO: 486847

SEQ ID NO: 495528 - RNA, 64 nt, Human; identical to SEQ ID NO: 486848

SEQ ID NO: 495529 - RNA, 64 nt, Human; identical to SEQ ID NO: 486849

SEQ ID NO: 495530 - RNA, 64 nt, Human; identical to SEQ ID NO: 486850

SEQ ID NO: 495531 - RNA, 64 nt, Human; identical to SEQ ID NO: 486851

SEQ ID NO: 495532 - RNA, 64 nt, Human; identical to SEQ ID NO: 486852

SEQ ID NO: 495533 - RNA, 64 nt, Human; identical to SEQ ID NO: 486853

SEQ ID NO: 495534 - RNA, 64 nt, Human; identical to SEQ ID NO: 486854

SEQ ID NO: 495535 - RNA, 64 nt, Human; identical to SEQ ID NO: 486855

SEQ ID NO: 495536 - RNA, 64 nt, Human; identical to SEQ ID NO: 486859

SEQ ID NO: 495537 - RNA, 64 nt, Human; identical to SEQ ID NO: 300544

SEQ ID NO: 495538 - RNA, 64 nt, Human; identical to SEQ ID NO: 300545

SEQ ID NO: 495539 - RNA, 64 nt, Human; identical to SEQ ID NO: 300546

SEQ ID NO: 495540 - RNA, 64 nt, Human; identical to SEQ ID NO: 300550

SEQ ID NO: 495541 - RNA, 64 nt, Human; identical to SEQ ID NO: 486860

SEQ ID NO: 495542 - RNA, 52 nt, Human; identical to SEQ ID NO: 486861

SEQ ID NO: 495543 - RNA, 64 nt, Human; identical to SEQ ID NO: 486862

SEQ ID NO: 495544 - RNA, 64 nt, Human; identical to SEQ ID NO: 486863

SEQ ID NO: 495545 - RNA, 64 nt, Human; identical to SEQ ID NO: 486864

SEQ ID NO: 495546 - RNA, 64 nt, Human; identical to SEQ ID NO: 486865

SEQ ID NO: 495547 - RNA, 64 nt, Human; identical to SEQ ID NO: 486866

SEQ ID NO: 495548 - RNA, 64 nt, Human; identical to SEQ ID NO: 486867

SEQ ID NO: 495549 - RNA, 64 nt, Human; identical to SEQ ID NO: 486868

SEQ ID NO: 495550 - RNA, 64 nt, Human; identical to SEQ ID NO: 486869

SEQ ID NO: 495551 - RNA, 64 nt, Human; identical to SEQ ID NO: 486870

SEQ ID NO: 495552 - RNA, 64 nt, Human; identical to SEQ ID NO: 486871

SEQ ID NO: 495553 - RNA, 64 nt, Human; identical to SEQ ID NO: 486872

SEQ ID NO: 495554 - RNA, 64 nt, Human; identical to SEQ ID NO: 300551

SEQ ID NO: 495555 - RNA, 64 nt, Human; identical to SEQ ID NO: 300552

SEQ ID NO: 495556 - RNA, 64 nt, Human; identical to SEQ ID NO: 300553

SEQ ID NO: 495557 - RNA, 64 nt, Human; identical to SEQ ID NO: 300554

SEQ ID NO: 495558 - RNA, 64 nt, Human; identical to SEQ ID NO: 486873

SEQ ID NO: 495559 - RNA, 64 nt, Human; identical to SEQ ID NO: 486877

SEQ ID NO: 495560 - RNA, 64 nt, Human; identical to SEQ ID NO: 486878

SEQ ID NO: 495561 - RNA, 64 nt, Human; identical to SEQ ID NO: 486879

SEQ ID NO: 495562 - RNA, 64 nt, Human; identical to SEQ ID NO: 486880

SEQ ID NO: 495563 - RNA, 64 nt, Human; identical to SEQ ID NO: 486881

SEQ ID NO: 495564 - RNA, 64 nt, Human; identical to SEQ ID NO: 486882

SEQ ID NO: 495565 - RNA, 64 nt, Human; identical to SEQ ID NO: 486883

SEQ ID NO: 495566 - RNA, 64 nt, Human; identical to SEQ ID NO: 486884

SEQ ID NO: 495567 - RNA, 64 nt, Human; identical to SEQ ID NO: 486885

SEQ ID NO: 495568 - RNA, 64 nt, Human; identical to SEQ ID NO: 486886

SEQ ID NO: 495569 - RNA, 64 nt, Human; identical to SEQ ID NO: 486887

SEQ ID NO: 495570 - RNA, 64 nt, Human; identical to SEQ ID NO: 486888

SEQ ID NO: 495571 - RNA, 64 nt, Human; identical to SEQ ID NO: 300501

SEQ ID NO: 495572 - RNA, 64 nt, Human; identical to SEQ ID NO: 300502

SEQ ID NO: 495573 - RNA, 62 nt, Human; identical to SEQ ID NO: 300503

SEQ ID NO: 495574 - RNA, 64 nt, Human; identical to SEQ ID NO: 90411

SEQ ID NO: 495575 - RNA, 64 nt, Human; identical to SEQ ID NO: 486889

SEQ ID NO: 495576 - RNA, 64 nt, Human; identical to SEQ ID NO: 486890

SEQ ID NO: 495577 - RNA, 64 nt, Human; identical to SEQ ID NO: 486891

SEQ ID NO: 495578 - RNA, 64 nt, Human; identical to SEQ ID NO: 486895

SEQ ID NO: 495579 - RNA, 64 nt, Human; identical to SEQ ID NO: 486896

SEQ ID NO: 495580 - RNA, 64 nt, Human; identical to SEQ ID NO: 486897

SEQ ID NO: 495581 - RNA, 64 nt, Human; identical to SEQ ID NO: 486898

SEQ ID NO: 495582 - RNA, 64 nt, Human; identical to SEQ ID NO: 486899

SEQ ID NO: 495583 - RNA, 64 nt, Human; identical to SEQ ID NO: 486900

SEQ ID NO: 495584 - RNA, 64 nt, Human; identical to SEQ ID NO: 486901

SEQ ID NO: 495585 - RNA, 62 nt, Human; identical to SEQ ID NO: 486902

SEQ ID NO: 495586 - RNA, 64 nt, Human; identical to SEQ ID NO: 486903

SEQ ID NO: 495587 - RNA, 64 nt, Human; identical to SEQ ID NO: 486904

SEQ ID NO: 495588 - RNA, 64 nt, Human; identical to SEQ ID NO: 90419

SEQ ID NO: 495589 - RNA, 64 nt, Human; identical to SEQ ID NO: 90420

SEQ ID NO: 495590 - RNA, 64 nt, Human; identical to SEQ ID NO: 90421

SEQ ID NO: 495591 - RNA, 64 nt, Human; identical to SEQ ID NO: 90422

SEQ ID NO: 495592 - RNA, 64 nt, Human; identical to SEQ ID NO: 486905

SEQ ID NO: 495593 - RNA, 64 nt, Human; identical to SEQ ID NO: 486906

SEQ ID NO: 495594 - RNA, 64 nt, Human; identical to SEQ ID NO: 486907

SEQ ID NO: 495595 - RNA, 64 nt, Human; identical to SEQ ID NO: 486908

SEQ ID NO: 495596 - RNA, 64 nt, Human; identical to SEQ ID NO: 486909

SEQ ID NO: 495597 - RNA, 64 nt, Human; identical to SEQ ID NO: 486913

SEQ ID NO: 495598 - RNA, 64 nt, Human; identical to SEQ ID NO: 486914

SEQ ID NO: 495599 - RNA, 64 nt, Human; identical to SEQ ID NO: 486915

SEQ ID NO: 495600 - RNA, 64 nt, Human; identical to SEQ ID NO: 486916

SEQ ID NO: 495601 - RNA, 64 nt, Human; identical to SEQ ID NO: 486917

SEQ ID NO: 495602 - RNA, 64 nt, Human; identical to SEQ ID NO: 486918

SEQ ID NO: 495603 - RNA, 64 nt, Human; identical to SEQ ID NO: 486919

SEQ ID NO: 495604 - RNA, 64 nt, Human; identical to SEQ ID NO: 90423

SEQ ID NO: 495605 - RNA, 64 nt, Human; identical to SEQ ID NO: 90424

SEQ ID NO: 495606 - RNA, 64 nt, Human; identical to SEQ ID NO: 90425

SEQ ID NO: 495607 - RNA, 64 nt, Human; identical to SEQ ID NO: 486920

SEQ ID NO: 495608 - RNA, 64 nt, Human; identical to SEQ ID NO: 486921

SEQ ID NO: 495609 - RNA, 59 nt, Human; identical to SEQ ID NO: 486922

SEQ ID NO: 495610 - RNA, 64 nt, Human; identical to SEQ ID NO: 486923

SEQ ID NO: 495611 - RNA, 64 nt, Human; identical to SEQ ID NO: 486924

SEQ ID NO: 495612 - RNA, 58 nt, Human; identical to SEQ ID NO: 486925

SEQ ID NO: 495613 - RNA, 64 nt, Human; identical to SEQ ID NO: 486926

SEQ ID NO: 495614 - RNA, 64 nt, Human; identical to SEQ ID NO: 486930

SEQ ID NO: 495615 - RNA, 64 nt, Human; identical to SEQ ID NO: 486931

SEQ ID NO: 495616 - RNA, 64 nt, Human; identical to SEQ ID NO: 486932

SEQ ID NO: 495617 - RNA, 64 nt, Human; identical to SEQ ID NO: 486933

SEQ ID NO: 495618 - RNA, 64 nt, Human; identical to SEQ ID NO: 486934

SEQ ID NO: 495619 - RNA, 64 nt, Human; identical to SEQ ID NO: 486935

SEQ ID NO: 495620 - RNA, 64 nt, Human; identical to SEQ ID NO: 300457

SEQ ID NO: 495621 - RNA, 64 nt, Human; identical to SEQ ID NO: 300458

SEQ ID NO: 495622 - RNA, 64 nt, Human; identical to SEQ ID NO: 300459

SEQ ID NO: 495623 - RNA, 64 nt, Human; identical to SEQ ID NO: 300460

SEQ ID NO: 495624 - RNA, 64 nt, Human; identical to SEQ ID NO: 486936

SEQ ID NO: 495625 - RNA, 64 nt, Human; identical to SEQ ID NO: 486937

SEQ ID NO: 495626 - RNA, 64 nt, Human; identical to SEQ ID NO: 486938

SEQ ID NO: 495627 - RNA, 64 nt, Human; identical to SEQ ID NO: 486939

SEQ ID NO: 495628 - RNA, 64 nt, Human; identical to SEQ ID NO: 486940

SEQ ID NO: 495629 - RNA, 64 nt, Human; identical to SEQ ID NO: 486941

SEQ ID NO: 495630 - RNA, 64 nt, Human; identical to SEQ ID NO: 486942

SEQ ID NO: 495631 - RNA, 64 nt, Human; identical to SEQ ID NO: 486943

SEQ ID NO: 495632 - RNA, 64 nt, Human; identical to SEQ ID NO: 486944

SEQ ID NO: 495633 - RNA, 64 nt, Human; identical to SEQ ID NO: 486948

SEQ ID NO: 495634 - RNA, 64 nt, Human; identical to SEQ ID NO: 486949

SEQ ID NO: 495635 - RNA, 64 nt, Human; identical to SEQ ID NO: 486950

SEQ ID NO: 495636 - RNA, 64 nt, Human; identical to SEQ ID NO: 486951

SEQ ID NO: 495637 - RNA, 64 nt, Human; identical to SEQ ID NO: 300450

SEQ ID NO: 495638 - RNA, 64 nt, Human; identical to SEQ ID NO: 300451

SEQ ID NO: 495639 - RNA, 64 nt, Human; identical to SEQ ID NO: 300455

SEQ ID NO: 495640 - RNA, 64 nt, Human; identical to SEQ ID NO: 300461

SEQ ID NO: 495641 - RNA, 64 nt, Human; identical to SEQ ID NO: 486952

SEQ ID NO: 495642 - RNA, 64 nt, Human; identical to SEQ ID NO: 486953

SEQ ID NO: 495643 - RNA, 64 nt, Human; identical to SEQ ID NO: 486954

SEQ ID NO: 495644 - RNA, 64 nt, Human; identical to SEQ ID NO: 486955

SEQ ID NO: 495645 - RNA, 64 nt, Human; identical to SEQ ID NO: 486956

SEQ ID NO: 495646 - RNA, 64 nt, Human; identical to SEQ ID NO: 486957

SEQ ID NO: 495647 - RNA, 64 nt, Human; identical to SEQ ID NO: 486958

SEQ ID NO: 495648 - RNA, 64 nt, Human; identical to SEQ ID NO: 486959

SEQ ID NO: 495649 - RNA, 64 nt, Human; identical to SEQ ID NO: 486960

SEQ ID NO: 495650 - RNA, 64 nt, Human; identical to SEQ ID NO: 486961

SEQ ID NO: 495651 - RNA, 64 nt, Human; identical to SEQ ID NO: 486962

SEQ ID NO: 495652 - RNA, 64 nt, Human; identical to SEQ ID NO: 486966

SEQ ID NO: 495653 - RNA, 64 nt, Human; identical to SEQ ID NO: 486967

SEQ ID NO: 495654 - RNA, 62 nt, Human
gcuuugguguuugccgcagcauggaaaacagggcgccuaaggcugggagcuggaagaagggg

SEQ ID NO: 495655 - RNA, 64 nt, Human
guccugaguggccaccuccuccuugggagggaggccgcggcagguacucucccuuugcugcuug

SEQ ID NO: 495656 - RNA, 64 nt, Human
ccuggggcugcggccaaggggcaucagccugggcccgcggcagggccuggccugccucuccugu

SEQ ID NO: 495657 - RNA, 64 nt, Human; identical to SEQ ID NO: 486968

SEQ ID NO: 495658 - RNA, 64 nt, Human; identical to SEQ ID NO: 486969

SEQ ID NO: 495659 - RNA, 64 nt, Human; identical to SEQ ID NO: 486970

SEQ ID NO: 495660 - RNA, 64 nt, Human; identical to SEQ ID NO: 486971

SEQ ID NO: 495661 - RNA, 64 nt, Human; identical to SEQ ID NO: 486972

SEQ ID NO: 495662 - RNA, 64 nt, Human; identical to SEQ ID NO: 486973

SEQ ID NO: 495663 - RNA, 64 nt, Human; identical to SEQ ID NO: 486974

SEQ ID NO: 495664 - RNA, 64 nt, Human; identical to SEQ ID NO: 486975

SEQ ID NO: 495665 - RNA, 64 nt, Human; identical to SEQ ID NO: 486976

SEQ ID NO: 495666 - RNA, 64 nt, Human; identical to SEQ ID NO: 486977

SEQ ID NO: 495667 - RNA, 64 nt, Human; identical to SEQ ID NO: 486978

SEQ ID NO: 495668 - RNA, 64 nt, Human; identical to SEQ ID NO: 486979

SEQ ID NO: 495669 - RNA, 64 nt, Human; identical to SEQ ID NO: 486980

SEQ ID NO: 495670 - RNA, 64 nt, Human; identical to SEQ ID NO: 300464

SEQ ID NO: 495671 - RNA, 64 nt, Human; identical to SEQ ID NO: 300465

SEQ ID NO: 495672 - RNA, 64 nt, Human; identical to SEQ ID NO: 300466

SEQ ID NO: 495673 - RNA, 64 nt, Human; identical to SEQ ID NO: 300467

SEQ ID NO: 495674 - RNA, 64 nt, Human; identical to SEQ ID NO: 486984

SEQ ID NO: 495675 - RNA, 64 nt, Human; identical to SEQ ID NO: 486985

SEQ ID NO: 495676 - RNA, 64 nt, Human; identical to SEQ ID NO: 486986

SEQ ID NO: 495677 - RNA, 57 nt, Human; identical to SEQ ID NO: 486987

SEQ ID NO: 495678 - RNA, 64 nt, Human; identical to SEQ ID NO: 486988

SEQ ID NO: 495679 - RNA, 64 nt, Human; identical to SEQ ID NO: 486989

SEQ ID NO: 495680 - RNA, 64 nt, Human; identical to SEQ ID NO: 486990

SEQ ID NO: 495681 - RNA, 64 nt, Human; identical to SEQ ID NO: 486991

SEQ ID NO: 495682 - RNA, 64 nt, Human; identical to SEQ ID NO: 486992

SEQ ID NO: 495683 - RNA, 64 nt, Human; identical to SEQ ID NO: 486993

SEQ ID NO: 495684 - RNA, 64 nt, Human; identical to SEQ ID NO: 486994

SEQ ID NO: 495685 - RNA, 64 nt, Human; identical to SEQ ID NO: 486995

SEQ ID NO: 495686 - RNA, 64 nt, Human; identical to SEQ ID NO: 486996

SEQ ID NO: 495687 - RNA, 64 nt, Human; identical to SEQ ID NO: 300468

SEQ ID NO: 495688 - RNA, 64 nt, Human; identical to SEQ ID NO: 300469

SEQ ID NO: 495689 - RNA, 64 nt, Human; identical to SEQ ID NO: 300470

SEQ ID NO: 495690 - RNA, 64 nt, Human; identical to SEQ ID NO: 300475

SEQ ID NO: 495691 - RNA, 64 nt, Human; identical to SEQ ID NO: 486997

SEQ ID NO: 495692 - RNA, 64 nt, Human; identical to SEQ ID NO: 486998

SEQ ID NO: 495693 - RNA, 64 nt, Human; identical to SEQ ID NO: 487002

SEQ ID NO: 495694 - RNA, 64 nt, Human; identical to SEQ ID NO: 487003

SEQ ID NO: 495695 - RNA, 64 nt, Human; identical to SEQ ID NO: 487004

SEQ ID NO: 495696 - RNA, 64 nt, Human; identical to SEQ ID NO: 487005

SEQ ID NO: 495697 - RNA, 64 nt, Human; identical to SEQ ID NO: 487006

SEQ ID NO: 495698 - RNA, 64 nt, Human; identical to SEQ ID NO: 487007

SEQ ID NO: 495699 - RNA, 64 nt, Human; identical to SEQ ID NO: 487008

SEQ ID NO: 495700 - RNA, 64 nt, Human; identical to SEQ ID NO: 487009

SEQ ID NO: 495701 - RNA, 64 nt, Human; identical to SEQ ID NO: 487010

SEQ ID NO: 495702 - RNA, 64 nt, Human; identical to SEQ ID NO: 487011

SEQ ID NO: 495703 - RNA, 64 nt, Human; identical to SEQ ID NO: 487012

SEQ ID NO: 495704 - RNA, 64 nt, Human
gcgucugguccagaguaacucccucuguccagguccggaacagugucucaacuggccaggcggu

SEQ ID NO: 495705 - RNA, 64 nt, Human
cccuuccccagucaacuguggcaccuguaaccucccggaacaugaaggacuaugcucugaggcu

SEQ ID NO: 495706 - RNA, 64 nt, Human
aaagcaauguguuuuuccacuggauuaauuuucaccggaacaauugcgaauucucucugccucg

SEQ ID NO: 495707 - RNA, 64 nt, Human
caagaccugcucuuguggagguacauuuccuaagccggaacacucaagcuuuuuucaggguguu

SEQ ID NO: 495708 - RNA, 64 nt, Human; identical to SEQ ID NO: 487013

SEQ ID NO: 495709 - RNA, 64 nt, Human; identical to SEQ ID NO: 487014

SEQ ID NO: 495710 - RNA, 64 nt, Human; identical to SEQ ID NO: 487015

SEQ ID NO: 495711 - RNA, 64 nt, Human; identical to SEQ ID NO: 487016

SEQ ID NO: 495712 - RNA, 64 nt, Human; identical to SEQ ID NO: 487020

SEQ ID NO: 495713 - RNA, 64 nt, Human; identical to SEQ ID NO: 487021

SEQ ID NO: 495714 - RNA, 64 nt, Human; identical to SEQ ID NO: 487022

SEQ ID NO: 495715 - RNA, 52 nt, Human; identical to SEQ ID NO: 487023

SEQ ID NO: 495716 - RNA, 64 nt, Human; identical to SEQ ID NO: 487024

SEQ ID NO: 495717 - RNA, 64 nt, Human; identical to SEQ ID NO: 487025

SEQ ID NO: 495718 - RNA, 64 nt, Human; identical to SEQ ID NO: 487026

SEQ ID NO: 495719 - RNA, 64 nt, Human; identical to SEQ ID NO: 487027

SEQ ID NO: 495720 - RNA, 64 nt, Human; identical to SEQ ID NO: 487028

SEQ ID NO: 495721 - RNA, 64 nt, Human
acacaagagaaaucaacuucgugguuggauggggccggaacacaaccagucuuuuuguauuuau

SEQ ID NO: 495722 - RNA, 64 nt, Human
gggcuggugugucccccauagucugcaugcugugccggaacauucuuuggcagaaggagccucc

SEQ ID NO: 495723 - RNA, 64 nt, Human
ucugacugcuggcuuuucccagacagcccaagggccggaacagcagguggcuucucaguuccuc

SEQ ID NO: 495724 - RNA, 64 nt, Human
gacaaaggagauuggaugacugggaagcgcuggcccggaacagccccugcaacuguggggccug

SEQ ID NO: 495725 - RNA, 64 nt, Human; identical to SEQ ID NO: 487029

SEQ ID NO: 495726 - RNA, 64 nt, Human; identical to SEQ ID NO: 487030

SEQ ID NO: 495727 - RNA, 64 nt, Human; identical to SEQ ID NO: 487031

SEQ ID NO: 495728 - RNA, 64 nt, Human; identical to SEQ ID NO: 487032

SEQ ID NO: 495729 - RNA, 64 nt, Human; identical to SEQ ID NO: 487033

SEQ ID NO: 495730 - RNA, 64 nt, Human; identical to SEQ ID NO: 487034

SEQ ID NO: 495731 - RNA, 64 nt, Human; identical to SEQ ID NO: 487038

SEQ ID NO: 495732 - RNA, 64 nt, Human; identical to SEQ ID NO: 487039

SEQ ID NO: 495733 - RNA, 64 nt, Human; identical to SEQ ID NO: 487040

SEQ ID NO: 495734 - RNA, 64 nt, Human; identical to SEQ ID NO: 487041

SEQ ID NO: 495735 - RNA, 64 nt, Human; identical to SEQ ID NO: 487042

SEQ ID NO: 495736 - RNA, 64 nt, Human; identical to SEQ ID NO: 487043

SEQ ID NO: 495737 - RNA, 64 nt, Human; identical to SEQ ID NO: 487044

SEQ ID NO: 495738 - RNA, 64 nt, Human
ggaagguccuuucuuuccuucccaggggccggggccggaacaugugccucccguuccagcaucu

SEQ ID NO: 495739 - RNA, 64 nt, Human
uggcggcccucacuuuucuccuguguaaagccauccggaacaccagcaccucacugcaucugca

SEQ ID NO: 495740 - RNA, 64 nt, Human
cgugcaugcuuaagcuuuuacccaggcaucaaaaccggaacaucacaggguuuauacuggagag

SEQ ID NO: 495741 - RNA, 64 nt, Human; identical to SEQ ID NO: 300479

SEQ ID NO: 495742 - RNA, 64 nt, Human; identical to SEQ ID NO: 487045

SEQ ID NO: 495743 - RNA, 64 nt, Human; identical to SEQ ID NO: 487046

SEQ ID NO: 495744 - RNA, 64 nt, Human; identical to SEQ ID NO: 487047

SEQ ID NO: 495745 - RNA, 64 nt, Human; identical to SEQ ID NO: 487048

SEQ ID NO: 495746 - RNA, 64 nt, Human; identical to SEQ ID NO: 487049

SEQ ID NO: 495747 - RNA, 64 nt, Human; identical to SEQ ID NO: 487050

SEQ ID NO: 495748 - RNA, 64 nt, Human; identical to SEQ ID NO: 487051

SEQ ID NO: 495749 - RNA, 64 nt, Human; identical to SEQ ID NO: 487052

SEQ ID NO: 495750 - RNA, 64 nt, Human; identical to SEQ ID NO: 487056

SEQ ID NO: 495751 - RNA, 64 nt, Human; identical to SEQ ID NO: 487057

SEQ ID NO: 495752 - RNA, 64 nt, Human; identical to SEQ ID NO: 487058

SEQ ID NO: 495753 - RNA, 64 nt, Human; identical to SEQ ID NO: 487059

SEQ ID NO: 495754 - RNA, 64 nt, Human; identical to SEQ ID NO: 487060

SEQ ID NO: 495755 - RNA, 64 nt, Human
aaaaucaguacaaucacacaaggaggaugaaacgccggaacaaaaaugagguguguagaacagg

SEQ ID NO: 495756 - RNA, 64 nt, Human
caucucgagccccuacagcucuacgggaggccucccggaacaaaagcggaagaggggccagccu

SEQ ID NO: 495757 - RNA, 64 nt, Human
gccaaggggaaguaaggcagggagaaaggaacauccggaacagccaaagaaacucagaagaguc

SEQ ID NO: 495758 - RNA, 64 nt, Human
agccagugccaucauccccaccccgcccaggguuccggaacauucauucccccaccggugagga

SEQ ID NO: 495759 - RNA, 64 nt, Human; identical to SEQ ID NO: 487061

SEQ ID NO: 495760 - RNA, 64 nt, Human; identical to SEQ ID NO: 487062

SEQ ID NO: 495761 - RNA, 64 nt, Human; identical to SEQ ID NO: 487063

SEQ ID NO: 495762 - RNA, 64 nt, Human; identical to SEQ ID NO: 487064

SEQ ID NO: 495763 - RNA, 64 nt, Human; identical to SEQ ID NO: 487065

SEQ ID NO: 495764 - RNA, 64 nt, Human; identical to SEQ ID NO: 487066

SEQ ID NO: 495765 - RNA, 64 nt, Human; identical to SEQ ID NO: 487067

SEQ ID NO: 495766 - RNA, 64 nt, Human; identical to SEQ ID NO: 487068

SEQ ID NO: 495767 - RNA, 64 nt, Human; identical to SEQ ID NO: 487069

SEQ ID NO: 495768 - RNA, 64 nt, Human; identical to SEQ ID NO: 487070

SEQ ID NO: 495769 - RNA, 64 nt, Human; identical to SEQ ID NO: 487074

SEQ ID NO: 495770 - RNA, 64 nt, Human; identical to SEQ ID NO: 487075

SEQ ID NO: 495771 - RNA, 64 nt, Human; identical to SEQ ID NO: 487076

SEQ ID NO: 495772 - RNA, 64 nt, Human; identical to SEQ ID NO: 300480

SEQ ID NO: 495773 - RNA, 64 nt, Human; identical to SEQ ID NO: 300481

SEQ ID NO: 495774 - RNA, 64 nt, Human; identical to SEQ ID NO: 300482

SEQ ID NO: 495775 - RNA, 64 nt, Human; identical to SEQ ID NO: 300484

SEQ ID NO: 495776 - RNA, 64 nt, Human; identical to SEQ ID NO: 487077

SEQ ID NO: 495777 - RNA, 64 nt, Human; identical to SEQ ID NO: 487078

SEQ ID NO: 495778 - RNA, 64 nt, Human; identical to SEQ ID NO: 487079

SEQ ID NO: 495779 - RNA, 64 nt, Human; identical to SEQ ID NO: 487080

SEQ ID NO: 495780 - RNA, 64 nt, Human; identical to SEQ ID NO: 487081

SEQ ID NO: 495781 - RNA, 64 nt, Human; identical to SEQ ID NO: 487082

SEQ ID NO: 495782 - RNA, 64 nt, Human; identical to SEQ ID NO: 487083

SEQ ID NO: 495783 - RNA, 64 nt, Human; identical to SEQ ID NO: 487084

SEQ ID NO: 495784 - RNA, 64 nt, Human; identical to SEQ ID NO: 487085

SEQ ID NO: 495785 - RNA, 64 nt, Human; identical to SEQ ID NO: 487086

SEQ ID NO: 495786 - RNA, 64 nt, Human; identical to SEQ ID NO: 487087

SEQ ID NO: 495787 - RNA, 64 nt, Human; identical to SEQ ID NO: 487088

SEQ ID NO: 495788 - RNA, 64 nt, Human; identical to SEQ ID NO: 487092

SEQ ID NO: 495789 - RNA, 64 nt, Human; identical to SEQ ID NO: 300462

SEQ ID NO: 495790 - RNA, 64 nt, Human
ugggguucuguuccaugucuguguuguggacauuccgcggcaugaccgcgugaacugcacggug

SEQ ID NO: 495791 - RNA, 63 nt, Human
auauuccaguuuuguauuuuguguauuauaaaagcgaaugagacagagaucagaauacauuga

SEQ ID NO: 495792 - RNA, 64 nt, Human; identical to SEQ ID NO: 487093

SEQ ID NO: 495793 - RNA, 64 nt, Human; identical to SEQ ID NO: 487094

SEQ ID NO: 495794 - RNA, 64 nt, Human; identical to SEQ ID NO: 487095

SEQ ID NO: 495795 - RNA, 64 nt, Human; identical to SEQ ID NO: 487096

SEQ ID NO: 495796 - RNA, 64 nt, Human; identical to SEQ ID NO: 487097

SEQ ID NO: 495797 - RNA, 64 nt, Human; identical to SEQ ID NO: 487098

SEQ ID NO: 495798 - RNA, 64 nt, Human; identical to SEQ ID NO: 487099

SEQ ID NO: 495799 - RNA, 64 nt, Human; identical to SEQ ID NO: 487100

SEQ ID NO: 495800 - RNA, 64 nt, Human; identical to SEQ ID NO: 487101

SEQ ID NO: 495801 - RNA, 64 nt, Human; identical to SEQ ID NO: 487102

SEQ ID NO: 495802 - RNA, 64 nt, Human; identical to SEQ ID NO: 487103

SEQ ID NO: 495803 - RNA, 64 nt, Human; identical to SEQ ID NO: 487104

SEQ ID NO: 495804 - RNA, 64 nt, Human; identical to SEQ ID NO: 487105

SEQ ID NO: 495805 - RNA, 64 nt, Human
gucaccagcucgaggcguguggauugguuuccacccggaacaggcucugugauggcugaaugga

SEQ ID NO: 495806 - RNA, 64 nt, Human
aggacagagugugugcgugcgugugggugugugcgcgcgugagcacacacgcguguguuggggg

SEQ ID NO: 495807 - RNA, 64 nt, Human; identical to SEQ ID NO: 300476

SEQ ID NO: 495808 - RNA, 64 nt, Human; identical to SEQ ID NO: 487106

SEQ ID NO: 495809 - RNA, 64 nt, Human; identical to SEQ ID NO: 487110

SEQ ID NO: 495810 - RNA, 64 nt, Human; identical to SEQ ID NO: 487111

SEQ ID NO: 495811 - RNA, 64 nt, Human; identical to SEQ ID NO: 487112

SEQ ID NO: 495812 - RNA, 64 nt, Human; identical to SEQ ID NO: 487113

SEQ ID NO: 495813 - RNA, 64 nt, Human; identical to SEQ ID NO: 487114

SEQ ID NO: 495814 - RNA, 64 nt, Human; identical to SEQ ID NO: 487115

SEQ ID NO: 495815 - RNA, 64 nt, Human; identical to SEQ ID NO: 487116

SEQ ID NO: 495816 - RNA, 64 nt, Human; identical to SEQ ID NO: 487117

SEQ ID NO: 495817 - RNA, 64 nt, Human; identical to SEQ ID NO: 487118

SEQ ID NO: 495818 - RNA, 64 nt, Human; identical to SEQ ID NO: 487119

SEQ ID NO: 495819 - RNA, 64 nt, Human; identical to SEQ ID NO: 487120

SEQ ID NO: 495820 - RNA, 64 nt, Human; identical to SEQ ID NO: 487121

SEQ ID NO: 495821 - RNA, 64 nt, Human; identical to SEQ ID NO: 300489

SEQ ID NO: 495822 - RNA, 64 nt, Human; identical to SEQ ID NO: 300489

SEQ ID NO: 495823 - RNA, 64 nt, Human; identical to SEQ ID NO: 300494

SEQ ID NO: 495824 - RNA, 64 nt, Human; identical to SEQ ID NO: 300495

SEQ ID NO: 495825 - RNA, 64 nt, Human; identical to SEQ ID NO: 487122

SEQ ID NO: 495826 - RNA, 64 nt, Human; identical to SEQ ID NO: 487123

SEQ ID NO: 495827 - RNA, 64 nt, Human; identical to SEQ ID NO: 487124

SEQ ID NO: 495828 - RNA, 64 nt, Human; identical to SEQ ID NO: 487128

SEQ ID NO: 495829 - RNA, 64 nt, Human; identical to SEQ ID NO: 487129

SEQ ID NO: 495830 - RNA, 64 nt, Human; identical to SEQ ID NO: 487130

SEQ ID NO: 495831 - RNA, 64 nt, Human; identical to SEQ ID NO: 487131

SEQ ID NO: 495832 - RNA, 63 nt, Human; identical to SEQ ID NO: 487132

SEQ ID NO: 495833 - RNA, 64 nt, Human; identical to SEQ ID NO: 487133

SEQ ID NO: 495834 - RNA, 64 nt, Human; identical to SEQ ID NO: 487134

SEQ ID NO: 495835 - RNA, 64 nt, Human; identical to SEQ ID NO: 487135

SEQ ID NO: 495836 - RNA, 64 nt, Human; identical to SEQ ID NO: 487136

SEQ ID NO: 495837 - RNA, 64 nt, Human; identical to SEQ ID NO: 487137

SEQ ID NO: 495838 - RNA, 64 nt, Human; identical to SEQ ID NO: 300418

SEQ ID NO: 495839 - RNA, 53 nt, Human; identical to SEQ ID NO: 300419

SEQ ID NO: 495840 - RNA, 64 nt, Human; identical to SEQ ID NO: 300420

SEQ ID NO: 495841 - RNA, 64 nt, Human; identical to SEQ ID NO: 300442

SEQ ID NO: 495842 - RNA, 64 nt, Human; identical to SEQ ID NO: 487138

SEQ ID NO: 495843 - RNA, 64 nt, Human; identical to SEQ ID NO: 487139

SEQ ID NO: 495844 - RNA, 64 nt, Human; identical to SEQ ID NO: 487140

SEQ ID NO: 495845 - RNA, 64 nt, Human; identical to SEQ ID NO: 487141

SEQ ID NO: 495846 - RNA, 64 nt, Human; identical to SEQ ID NO: 487142

SEQ ID NO: 495847 - RNA, 64 nt, Human; identical to SEQ ID NO: 487146

SEQ ID NO: 495848 - RNA, 64 nt, Human; identical to SEQ ID NO: 487147

SEQ ID NO: 495849 - RNA, 64 nt, Human; identical to SEQ ID NO: 487148

SEQ ID NO: 495850 - RNA, 64 nt, Human; identical to SEQ ID NO: 487149

SEQ ID NO: 495851 - RNA, 64 nt, Human; identical to SEQ ID NO: 487150

SEQ ID NO: 495852 - RNA, 64 nt, Human; identical to SEQ ID NO: 487146

SEQ ID NO: 495853 - RNA, 64 nt, Human; identical to SEQ ID NO: 487152

SEQ ID NO: 495854 - RNA, 64 nt, Human; identical to SEQ ID NO: 487153

SEQ ID NO: 495855 - RNA, 64 nt, Human; identical to SEQ ID NO: 300496

SEQ ID NO: 495856 - RNA, 64 nt, Human; identical to SEQ ID NO: 300497

SEQ ID NO: 495857 - RNA, 64 nt, Human; identical to SEQ ID NO: 300498

SEQ ID NO: 495858 - RNA, 64 nt, Human; identical to SEQ ID NO: 300500

SEQ ID NO: 495859 - RNA, 64 nt, Human; identical to SEQ ID NO: 487154

SEQ ID NO: 495860 - RNA, 64 nt, Human; identical to SEQ ID NO: 487155

SEQ ID NO: 495861 - RNA, 64 nt, Human; identical to SEQ ID NO: 487156

SEQ ID NO: 495862 - RNA, 64 nt, Human; identical to SEQ ID NO: 487157

SEQ ID NO: 495863 - RNA, 64 nt, Human; identical to SEQ ID NO: 487158

SEQ ID NO: 495864 - RNA, 64 nt, Human; identical to SEQ ID NO: 487159

SEQ ID NO: 495865 - RNA, 64 nt, Human; identical to SEQ ID NO: 487160

SEQ ID NO: 495866 - RNA, 64 nt, Human; identical to SEQ ID NO: 487164

SEQ ID NO: 495867 - RNA, 64 nt, Human; identical to SEQ ID NO: 487165

SEQ ID NO: 495868 - RNA, 64 nt, Human; identical to SEQ ID NO: 487166

SEQ ID NO: 495869 - RNA, 64 nt, Human; identical to SEQ ID NO: 487167

SEQ ID NO: 495870 - RNA, 64 nt, Human; identical to SEQ ID NO: 487168

SEQ ID NO: 495871 - RNA, 64 nt, Human; identical to SEQ ID NO: 487169

SEQ ID NO: 495872 - RNA, 64 nt, Human; identical to SEQ ID NO: 300443

SEQ ID NO: 495873 - RNA, 64 nt, Human; identical to SEQ ID NO: 300505

SEQ ID NO: 495874 - RNA, 64 nt, Human; identical to SEQ ID NO: 300506

SEQ ID NO: 495875 - RNA, 64 nt, Human; identical to SEQ ID NO: 300507

SEQ ID NO: 495876 - RNA, 64 nt, Human; identical to SEQ ID NO: 487170

SEQ ID NO: 495877 - RNA, 64 nt, Human; identical to SEQ ID NO: 487171

SEQ ID NO: 495878 - RNA, 64 nt, Human; identical to SEQ ID NO: 487172

SEQ ID NO: 495879 - RNA, 64 nt, Human; identical to SEQ ID NO: 487173

SEQ ID NO: 495880 - RNA, 64 nt, Human; identical to SEQ ID NO: 487174

SEQ ID NO: 495881 - RNA, 64 nt, Human; identical to SEQ ID NO: 487175

SEQ ID NO: 495882 - RNA, 64 nt, Human; identical to SEQ ID NO: 487176

SEQ ID NO: 495883 - RNA, 64 nt, Human; identical to SEQ ID NO: 487177

SEQ ID NO: 495884 - RNA, 64 nt, Human; identical to SEQ ID NO: 487178

SEQ ID NO: 495885 - RNA, 64 nt, Human; identical to SEQ ID NO: 487182

SEQ ID NO: 495886 - RNA, 64 nt, Human; identical to SEQ ID NO: 487183

SEQ ID NO: 495887 - RNA, 64 nt, Human; identical to SEQ ID NO: 487184

SEQ ID NO: 495888 - RNA, 64 nt, Human; identical to SEQ ID NO: 487185

SEQ ID NO: 495889 - RNA, 64 nt, Human
acuuuacaccuggaaaaaaagauuuguaaaaucaccggaacaauugugugcuuuauuuuauagg

SEQ ID NO: 495890 - RNA, 64 nt, Human
ggccaggaggcagaaacaccagccucugccaacaccggaacaagccgacgcuuccagacaaggc

SEQ ID NO: 495891 - RNA, 64 nt, Human
acaggucaauacaguacaggcagcacagagacccccggaacaagccuaaaaauuguuucaaaau

SEQ ID NO: 495892 - RNA, 64 nt, Human
cccaggaucuaauuucagaauuuaccacccaaacccggaacagauggguuuagggcugguguua

SEQ ID NO: 495893 - RNA, 64 nt, Human; identical to SEQ ID NO: 487186

SEQ ID NO: 495894 - RNA, 64 nt, Human; identical to SEQ ID NO: 487187

SEQ ID NO: 495895 - RNA, 64 nt, Human; identical to SEQ ID NO: 487188

SEQ ID NO: 495896 - RNA, 64 nt, Human; identical to SEQ ID NO: 487189

SEQ ID NO: 495897 - RNA, 64 nt, Human; identical to SEQ ID NO: 487190

SEQ ID NO: 495898 - RNA, 64 nt, Human; identical to SEQ ID NO: 487191

SEQ ID NO: 495899 - RNA, 64 nt, Human; identical to SEQ ID NO: 487192

SEQ ID NO: 495900 - RNA, 64 nt, Human; identical to SEQ ID NO: 487193

SEQ ID NO: 495901 - RNA, 64 nt, Human; identical to SEQ ID NO: 487194

SEQ ID NO: 495902 - RNA, 64 nt, Human; identical to SEQ ID NO: 487195

SEQ ID NO: 495903 - RNA, 64 nt, Human; identical to SEQ ID NO: 487196

SEQ ID NO: 495904 - RNA, 64 nt, Human; identical to SEQ ID NO: 487200

SEQ ID NO: 495905 - RNA, 64 nt, Human; identical to SEQ ID NO: 487201

SEQ ID NO: 495906 - RNA, 64 nt, Human
acugcuuuaccugugcugccugcaagacgcccauccggaacagggccuucuacauggaggaggg

SEQ ID NO: 495907 - RNA, 64 nt, Human
uccauauucacuuauuggcgauuuggggaaaaggccggaacaagagauuguuacgagaguggca

SEQ ID NO: 495908 - RNA, 64 nt, Human
ccaaagaaaaaucagaggaggagaaauggaaaccccggaacaaugccaauguauaaaaccccaa

SEQ ID NO: 495909 - RNA, 63 nt, Human
aaauuuaauggguggugauguagcccaaugagggcgaaugacauuacagcuugaccucuccag

SEQ ID NO: 495910 - RNA, 64 nt, Human; identical to SEQ ID NO: 487202

SEQ ID NO: 495911 - RNA, 64 nt, Human; identical to SEQ ID NO: 487203

SEQ ID NO: 495912 - RNA, 64 nt, Human; identical to SEQ ID NO: 487204

SEQ ID NO: 495913 - RNA, 64 nt, Human; identical to SEQ ID NO: 487205

SEQ ID NO: 495914 - RNA, 64 nt, Human; identical to SEQ ID NO: 487206

SEQ ID NO: 495915 - RNA, 64 nt, Human; identical to SEQ ID NO: 487207

SEQ ID NO: 495916 - RNA, 64 nt, Human; identical to SEQ ID NO: 487208

SEQ ID NO: 495917 - RNA, 64 nt, Human; identical to SEQ ID NO: 487209

SEQ ID NO: 495918 - RNA, 64 nt, Human; identical to SEQ ID NO: 487210

SEQ ID NO: 495919 - RNA, 64 nt, Human; identical to SEQ ID NO: 487211

SEQ ID NO: 495920 - RNA, 64 nt, Human; identical to SEQ ID NO: 487212

SEQ ID NO: 495921 - RNA, 64 nt, Human; identical to SEQ ID NO: 487213

SEQ ID NO: 495922 - RNA, 64 nt, Human; identical to SEQ ID NO: 487214

SEQ ID NO: 495923 - RNA, 64 nt, Human; identical to SEQ ID NO: 300384

SEQ ID NO: 495924 - RNA, 64 nt, Human; identical to SEQ ID NO: 300385

SEQ ID NO: 495925 - RNA, 64 nt, Human; identical to SEQ ID NO: 300386

SEQ ID NO: 495926 - RNA, 64 nt, Human; identical to SEQ ID NO: 300342

SEQ ID NO: 495927 - RNA, 64 nt, Human; identical to SEQ ID NO: 487218

SEQ ID NO: 495928 - RNA, 64 nt, Human; identical to SEQ ID NO: 487219

SEQ ID NO: 495929 - RNA, 64 nt, Human; identical to SEQ ID NO: 487220

SEQ ID NO: 495930 - RNA, 64 nt, Human; identical to SEQ ID NO: 487221

SEQ ID NO: 495931 - RNA, 64 nt, Human; identical to SEQ ID NO: 487222

SEQ ID NO: 495932 - RNA, 64 nt, Human; identical to SEQ ID NO: 487223

SEQ ID NO: 495933 - RNA, 64 nt, Human; identical to SEQ ID NO: 487224

SEQ ID NO: 495934 - RNA, 64 nt, Human; identical to SEQ ID NO: 36852

SEQ ID NO: 495935 - RNA, 64 nt, Human; identical to SEQ ID NO: 36853

SEQ ID NO: 495936 - RNA, 64 nt, Human; identical to SEQ ID NO: 36854

SEQ ID NO: 495937 - RNA, 64 nt, Human; identical to SEQ ID NO: 36855

SEQ ID NO: 495938 - RNA, 64 nt, Human; identical to SEQ ID NO: 36856

SEQ ID NO: 495939 - RNA, 64 nt, Human; identical to SEQ ID NO: 36857

SEQ ID NO: 495940 - RNA, 64 nt, Human; identical to SEQ ID NO: 36858

SEQ ID NO: 495941 - RNA, 64 nt, Human
ccaugcuucacagagaccauucuguagcaagagaccggaacauugugacuuggaccuuuucagg

SEQ ID NO: 495942 - RNA, 64 nt, Human; identical to SEQ ID NO: 300388

SEQ ID NO: 495943 - RNA, 64 nt, Human; identical to SEQ ID NO: 300389

SEQ ID NO: 495944 - RNA, 64 nt, Human; identical to SEQ ID NO: 36859

SEQ ID NO: 495945 - RNA, 64 nt, Human; identical to SEQ ID NO: 36860

SEQ ID NO: 495946 - RNA, 64 nt, Human; identical to SEQ ID NO: 36861

SEQ ID NO: 495947 - RNA, 64 nt, Human; identical to SEQ ID NO: 36862

SEQ ID NO: 495948 - RNA, 64 nt, Human; identical to SEQ ID NO: 36863

SEQ ID NO: 495949 - RNA, 64 nt, Human; identical to SEQ ID NO: 36864

SEQ ID NO: 495950 - RNA, 64 nt, Human; identical to SEQ ID NO: 36865

SEQ ID NO: 495951 - RNA, 64 nt, Human; identical to SEQ ID NO: 36866

SEQ ID NO: 495952 - RNA, 64 nt, Human; identical to SEQ ID NO: 36867

SEQ ID NO: 495953 - RNA, 64 nt, Human; identical to SEQ ID NO: 36868

SEQ ID NO: 495954 - RNA, 64 nt, Human; identical to SEQ ID NO: 36869

SEQ ID NO: 495955 - RNA, 64 nt, Human; identical to SEQ ID NO: 36870

SEQ ID NO: 495956 - RNA, 52 nt, Human; identical to SEQ ID NO: 36871

SEQ ID NO: 495957 - RNA, 63 nt, Human; identical to SEQ ID NO: 36872

SEQ ID NO: 495958 - RNA, 64 nt, Human; identical to SEQ ID NO: 36873

SEQ ID NO: 495959 - RNA, 64 nt, Human
caccugcucucaccugagcccccggugaaggggcccggaacacuugcucucaccugagccccag

SEQ ID NO: 495960 - RNA, 64 nt, Human
cacuugcucucaccugagccccaggugaaggggcccggaacaccuccucucaccugagccccag

SEQ ID NO: 495961 - RNA, 64 nt, Human
caccuccucucaccugagccccaggugaaggggcccggaacaccuccugucaccugagccccag

SEQ ID NO: 495962 - RNA, 64 nt, Human; identical to SEQ ID NO: 36874

SEQ ID NO: 495963 - RNA, 64 nt, Human; identical to SEQ ID NO: 36875

SEQ ID NO: 495964 - RNA, 64 nt, Human; identical to SEQ ID NO: 36876

SEQ ID NO: 495965 - RNA, 64 nt, Human; identical to SEQ ID NO: 36877

SEQ ID NO: 495966 - RNA, 64 nt, Human; identical to SEQ ID NO: 36878

SEQ ID NO: 495967 - RNA, 64 nt, Human; identical to SEQ ID NO: 36879

SEQ ID NO: 495968 - RNA, 64 nt, Human
ucugugaagugucuagaaguaucuagugcagaugguggcggaggcagaaucgaccaucagcaaa

SEQ ID NO: 495969 - RNA, 64 nt, Human
aacgcuacggauccggacgggcgccgucgcucggguggcggaggcugcgguggcccagcgagac

SEQ ID NO: 495970 - RNA, 64 nt, Human
ggggcagcuucaugaccgaugucuggcugaggcuguggcggacacucucgggguugucugcagg

SEQ ID NO: 495971 - RNA, 64 nt, Human
ucucgguggggggcccaucucugcugaccuggguguggcggagggagaggcgaugcugcaaagu

SEQ ID NO: 495972 - RNA, 64 nt, Human
gcggcuaaacucuuggccaaaaggcgguacucacguggcggaagggaaacugcauuaaaaaaag

SEQ ID NO: 495973 - RNA, 64 nt, Human
ugauaguaauggacuuuauucuaacuugagaucaguggcggaucaaaaccuacaagauucaacu

SEQ ID NO: 495974 - RNA, 58 nt, Human
ccgaaggcuuugcuuacuaaguuucugaguggcggaguggccaaacccuagagcuagc

SEQ ID NO: 495975 - RNA, 53 nt, Human
uugagcucuuuggccccugaugaccggaacacagcugaggacccuuguccuca

SEQ ID NO: 495976 - RNA, 64 nt, Human
gauucaucauuucaaaguuacuuucuauaugcggccggaacagggugguugacaucaguuuucu

SEQ ID NO: 495977 - RNA, 64 nt, Human
cuuucauggugcucucuaccuucuggcccccaucccggaacauuccugagugaauucgcaagcg

SEQ ID NO: 495978 - RNA, 64 nt, Human
cugggcugauucccuucugugcucccacaugcuuccggaacagugacaggugagugaaaaccag

SEQ ID NO: 495979 - RNA, 64 nt, Human
uaaguguaacguuagaacuuaggcauuuuccuguguggcggaauaagaaaggauuaaacaguua

SEQ ID NO: 495980 - RNA, 64 nt, Human
aggagagggccggauguggguguggacagcaguaguggcggaggagagcucggggcugggcugc

SEQ ID NO: 495981 - RNA, 64 nt, Human
guacgcauagacgccccaggauggggggcccacuguggcggaagggggucccuggaaacaacuc

SEQ ID NO: 495982 - RNA, 64 nt, Human
ccaccucacauaggacccggaagcagccugagcuguggcggaggauccaggaagcuacggagag

SEQ ID NO: 495983 - RNA, 64 nt, Human
uguuggucccucaagagggagacuuucuuccucaguggcggagagaagaaagugcauuuauugu

SEQ ID NO: 495984 - RNA, 64 nt, Human
cuggccccagacaagcgccgcugugaggcugcuuguggcggauuccucaccaagcucaacggcu

SEQ ID NO: 495985 - RNA, 64 nt, Human
gggcccuacuacuagugacugcaggugacagggcguggcggagcugccacagacaagccuagcu

SEQ ID NO: 495986 - RNA, 64 nt, Human
gccugggccguguaguggggacgcucugggaaugguggcggacgggcagcgugggugggaccug

SEQ ID NO: 495987 - RNA, 64 nt, Human
ucucuggcaggucaugaugaugggcagcgcccgaguggcggagcugcugcugcuccacggcgcg

SEQ ID NO: 495988 - RNA, 64 nt, Human
ucucuggcaggucaugaugaugggcagcgcccgcguggcggagcugcugcugcuccacggcgcg

SEQ ID NO: 495989 - RNA, 64 nt, Human
cagcugccuaaucccaggguugagccuugugcucguggcggaccccaaaccacugcccuccugg

SEQ ID NO: 495990 - RNA, 64 nt, Human
aaaguggccugggcucuguuggugugcguguuccguggcggagagaagaaaaugggaaagacau

SEQ ID NO: 495991 - RNA, 64 nt, Human
agaaucagguccccacggcuguugcucaauaaaaguggcggaauaaagugcaucccuguguuca

SEQ ID NO: 495992 - RNA, 64 nt, Human
gggauucugguugcaauaaaacaugcugcugcugguggcggagcucccugucccuuugccccag

SEQ ID NO: 495993 - RNA, 64 nt, Human
cuuagcacugccccccucccuagccccuuauuugguggcggaaguggccuccaccccuucccug

SEQ ID NO: 495994 - RNA, 64 nt, Human
ggcagcacccaaggucugggcaaacucagcauuaguggcggaggauggagccacuccauucagg

SEQ ID NO: 495995 - RNA, 64 nt, Human; identical to SEQ ID NO: 300391

SEQ ID NO: 495996 - RNA, 64 nt, Human; identical to SEQ ID NO: 300392

SEQ ID NO: 495997 - RNA, 64 nt, Human; identical to SEQ ID NO: 300393

SEQ ID NO: 495998 - RNA, 64 nt, Human
gggaggcugcggcaggagaaucgcuugaacccagguggcggagguugcggugagcugagaucac

SEQ ID NO: 495999 - RNA, 64 nt, Human
accgaccgacagaccucagugcccaccacgggcuguggcggagcucccgcccccugcgcccuaa

SEQ ID NO: 496000 - RNA, 62 nt, Human
ucagugaccugucccagugaccacacguccugguggcggaugaagcccucuucgagcuagag

SEQ ID NO: 496001 - RNA, 64 nt, Human
gcagccucucccuccgcucagggcuugaaggucgguggcggaggggguggcucucacagggccc

SEQ ID NO: 496002 - RNA, 64 nt, Human
ucuacuaaaaauacaaaaaaauuagucgggcgugguggcggacgccuguauucacagcuacucg

SEQ ID NO: 496003 - RNA, 64 nt, Human
cacagugcagccuggauccugucgaucuuuacuuguggcggagcuaauggucacauugauaguu

SEQ ID NO: 496004 - RNA, 64 nt, Human
guugugauuugugaagaauuuguacuuugauauuguggcggaaagucuagacugaguguguaug

SEQ ID NO: 496005 - RNA, 64 nt, Human
agcuggacgaagucugcuaagagagauggaggcuguggcggacuccuuccaacucacgauuuau

SEQ ID NO: 496006 - RNA, 64 nt, Human
guaggagcgcugugcucugagcuuagaaagggagguggcggauggagugggaagugagagacac

SEQ ID NO: 496007 - RNA, 64 nt, Human
agcucuugauggaauuauaucacugccagugccuguggcggaagccaucuuauugcuaccagcu

SEQ ID NO: 496008 - RNA, 64 nt, Human
acguuugagcucacguggcggccaugcaugguuuguggcggaagacggggcccagcggcucccc

SEQ ID NO: 496009 - RNA, 64 nt, Human
ucucagagaaguggcagguuucacguucagccguguggcggaucguguggcuuccaaagccuuu

SEQ ID NO: 496010 - RNA, 64 nt, Human
augaagaugcugcauuggcccacagaaggcaaaaguggcggaccugcuguacuggaaggacacg

SEQ ID NO: 496011 - RNA, 64 nt, Human
ccaggagcacugcagcccgagacuuccaaccugaguggcggagaagcugggacccugggcugga

SEQ ID NO: 496012 - RNA, 64 nt, Human
cacaggcuggaggagagacggggcugggcgcaagguggcggagggcaguguggguucugugucu

SEQ ID NO: 496013 - RNA, 64 nt, Human
ucucuacuaaaaguacaaaaauuagcugggcgugguggcggacgccuguaaucucagcuacuug

SEQ ID NO: 496014 - RNA, 64 nt, Human
auucccaaaauguggaaagacuuuucuuuuccuuccggaacauguucuucaccaccuuuuggag

SEQ ID NO: 496015 - RNA, 64 nt, Human
agcaauucacgcauucuucaagcagcaaaaguucccggaacaauuagggaagacguauggucug

SEQ ID NO: 496016 - RNA, 64 nt, Human
aggcguccucuucagcguagcucuccaccucuacccggaacacacccucucacagacguaccaa

SEQ ID NO: 496017 - RNA, 64 nt, Human
uuagucuucagggcuuggcaacugaaauagcuauguggcggauacggaaaacagaggacaauuu

SEQ ID NO: 496018 - RNA, 64 nt, Human
cucacacuuugagcugagacuugaaaacgaugcuguggcggaagagcauguggggcuuggugga

SEQ ID NO: 496019 - RNA, 64 nt, Human
ggucucagggugucccagaccccgacaccggccaguggcggaagugaccgcaccucacacuccu

SEQ ID NO: 496020 - RNA, 64 nt, Human
cagagauguugauacagacucaaggacgcagcaaguggcggagcaagaaucacacucaggcagu

SEQ ID NO: 496021 - RNA, 64 nt, Human
acacccuagagcugugaugcugagcaaggugccuguggcggaaggaacugcccaguccucccug

SEQ ID NO: 496022 - RNA, 64 nt, Human
uuacuaaaaauacaaaaaaaauuagcugggcgugguggcggaugccuguagucccagcuacuca

SEQ ID NO: 496023 - RNA, 64 nt, Human
accccgcccuguccgacuguaacagaccaggaggguggcggaggaacuccugccacgccacugu

SEQ ID NO: 496024 - RNA, 64 nt, Human
aguuuccauuuggcauuagcccagcacagagccaccggaacaucaagauccuagaggacgaacc

SEQ ID NO: 496025 - RNA, 64 nt, Human
cgguguccagaucggucccguuggucaccuccguccggaacaccaccuccaccgggcugcaguu

SEQ ID NO: 496026 - RNA, 64 nt, Human
ccuccgugcaccuagcaggagugccaggccacagccggaacagccaggccaugacccaggggag

SEQ ID NO: 496027 - RNA, 64 nt, Human
gggccugggucaagggccagucagcaggaggcugccggaacaacagcggcuuucccagcaaccc

SEQ ID NO: 496028 - RNA, 64 nt, Human
caccugcucucaccugaaccccaggugaaggggcccggaacaccugcucucaccugagccccag

SEQ ID NO: 496029 - RNA, 64 nt, Human
caggcuggaguguaguggcgcgaucucggcucagccucccgaguagcugggauuacaggcaugu

SEQ ID NO: 496030 - RNA, 64 nt, Human
agcugguggaucugggcccagcaaagacuguucuccucccgagggaaccuucuucccaggccuc

SEQ ID NO: 496031 - RNA, 64 nt, Human
acaccacgcauggccagagcuagcgucccuacugccucccgacuccucaguggaggaggagcug

SEQ ID NO: 496032 - RNA, 64 nt, Human
cgccucccagguucaagcaauucuccugccucagccucccgaguagcuggaauuacaagugcgc

SEQ ID NO: 496033 - RNA, 64 nt, Human
caccucccagguucaagcaauucucuugccucagccucccgaguagcugggauuacaggugcau

SEQ ID NO: 496034 - RNA, 64 nt, Human
gucaugcccccaccccugcucuccgcacccgcuuccucccgaccccaggaccaggcuacuucuc

SEQ ID NO: 496035 - RNA, 64 nt, Human
ggagucaggacuuuugacuucaggccagucauuuccucccgauggggaaagggugagauuuaca

SEQ ID NO: 496036 - RNA, 64 nt, Human
ugccucccggauuuaagcgauucuucugccucagccucccgaguagcugggacuacaggugugc

SEQ ID NO: 496037 - RNA, 64 nt, Human
gaacucuugggcucaagugauucucccuccucagccucccgaguagcuggaacgaacuauaguu

SEQ ID NO: 496038 - RNA, 64 nt, Human
acaguggcaugaucucagcucacugcaaacucugccucccgaauucaagugauucuccugccuc

SEQ ID NO: 496039 - RNA, 64 nt, Human
acuugguagggcaggagacgcagcguggagccuaccucccgacauucacgcuucgccccacgcu

SEQ ID NO: 496040 - RNA, 64 nt, Human
cgccucccggguucgagcaauucuccugccucagccucccgaguagcugggauuacaggcgugu

SEQ ID NO: 496041 - RNA, 64 nt, Human
gcaauggcaugaucucgguucauugcaaccuccgccucccgaguucaaucgauucuccugccuc

SEQ ID NO: 496042 - RNA, 64 nt, Human
gcucaugcccccgucuugccagugacacuugaagccucccgacuuccacagagugcuucaggac

SEQ ID NO: 496043 - RNA, 64 nt, Human
uuggcccacaggauaagccucaggcccugggaaaccucccgaccccugcaccuucguuggagcc

SEQ ID NO: 496044 - RNA, 64 nt, Human; identical to SEQ ID NO: 300394

SEQ ID NO: 496045 - RNA, 64 nt, Human; identical to SEQ ID NO: 300398

SEQ ID NO: 496046 - RNA, 64 nt, Human; identical to SEQ ID NO: 300399

SEQ ID NO: 496047 - RNA, 64 nt, Human; identical to SEQ ID NO: 300401

SEQ ID NO: 496048 - RNA, 64 nt, Human
cgccucccagguucaagcgauuuuccugccucagccucccgaguagcugggguuacaggcaugc

SEQ ID NO: 496049 - RNA, 64 nt, Human
cugguggcagccaggauucuggcccagggcgccuccucccgacugagcagagccagacagacau

SEQ ID NO: 496050 - RNA, 64 nt, Human
ugccuccugggugcaagcaauuauccugccucagccucccgaguagcugggacugcaggcacac

SEQ ID NO: 496051 - RNA, 64 nt, Human
cgccucccggguucaagcaauucuccugccucagccucccgaguagcugggagugcaggugcac

SEQ ID NO: 496052 - RNA, 64 nt, Human
ugaacucugggcucaagcaauccucucaccucagccucccgaguagggaggaccacagguguga

SEQ ID NO: 496053 - RNA, 64 nt, Human
cgccucccagguucaagcaauuuuccugccucagccucccgaguaccugggacuauaugugcgc

SEQ ID NO: 496054 - RNA, 64 nt, Human
ccgucucucggguucaagcaauugucugccucagccucccgaguagcugggauuacaggugcgc

SEQ ID NO: 496055 - RNA, 64 nt, Human
cuggugaaggguucugaauaucucccucuucaucccucccgaaaucuggaauacuuauucuauu

SEQ ID NO: 496056 - RNA, 64 nt, Human
ugccucccgaguucaagcgauucuccugccucagccucccgaguagcuggaauuauaggcgugc

SEQ ID NO: 496057 - RNA, 64 nt, Human
gcaguggcaccaucucaguucacugcaacuucugccucccgaguucaagcgauucuccugccuc

SEQ ID NO: 496058 - RNA, 64 nt, Human
cgccaccuggguuccagcaauucuccugccucagccucccgaguagcugagauuauaggcaccu

SEQ ID NO: 496059 - RNA, 64 nt, Human
cgccuccuggguucacgcgauucuccugccucagccucccgaguagcugggauuacaggcacac

SEQ ID NO: 496060 - RNA, 64 nt, Human
ugccucccggguucaagcgauucuccuaccucagccucccgaguagcugggauuacaggcaugu

SEQ ID NO: 496061 - RNA, 64 nt, Human
aagguaaagucagcagaaaucuggcuucucccuuccucccgacaucugcaucccuugauccacu

SEQ ID NO: 496062 - RNA, 64 nt, Human
ugccucccggguucgagcgauucuccugccucagccucccgaguagcugggacuacaggcaccc

SEQ ID NO: 496063 - RNA, 64 nt, Human; identical to SEQ ID NO: 300514

SEQ ID NO: 496064 - RNA, 64 nt, Human; identical to SEQ ID NO: 300515

SEQ ID NO: 496065 - RNA, 64 nt, Human; identical to SEQ ID NO: 300516

SEQ ID NO: 496066 - RNA, 54 nt, Human; identical to SEQ ID NO: 300517

SEQ ID NO: 496067 - RNA, 64 nt, Human
cgccucccggguucaugccauucuccugccucagccucccgaguagcugggacugcaggcaccg

SEQ ID NO: 496068 - RNA, 64 nt, Human
gcucggggcccagcgugccagccccggaguucagccucccgagcugcggcgcccgcagcggagg

SEQ ID NO: 496069 - RNA, 64 nt, Human
gcucagagguccaugccgaggagaccaggcaggaccucccgaggcugcgccccggccggcccau

SEQ ID NO: 496070 - RNA, 64 nt, Human
cgccucccggguucucaccauucuccugccucagccucccgaguagcugggacuacaggcgccc

SEQ ID NO: 496071 - RNA, 64 nt, Human
ugccuccuggguucaagugauucuccagccucagccucccgaguagcugggauuaugggcgccc

SEQ ID NO: 496072 - RNA, 64 nt, Human
cgccucccagguucaagcaauucuccugccucagccucccgaguagcugggauuacaggcaugc

SEQ ID NO: 496073 - RNA, 64 nt, Human
ugccuccugaguucaaaugauucuccugccucagccucccgaguagcugggauuacaggcaccu

SEQ ID NO: 496074 - RNA, 64 nt, Human
caccuccugggcucaagcgauucucaugccucagccucccgaguagcugggacuacaggugugu

SEQ ID NO: 496075 - RNA, 64 nt, Human
ugacucccugguucaaacgauucuccugccucagccucccgaguggcuggcaucaccacgccca

SEQ ID NO: 496076 - RNA, 64 nt, Human
cagcuccuaaccgcgagugauccgccagccucggccucccgaggugccgggauugcagacggag

SEQ ID NO: 496077 - RNA, 64 nt, Human
gcuacaaccuccaccucccagcugccugccuuggccucccgaagugccaagagugcagccucug

SEQ ID NO: 496078 - RNA, 64 nt, Human
cgccucccggguucaggccauucuccugccucagccucccgaguagcugggacuacaggggccc

SEQ ID NO: 496079 - RNA, 64 nt, Human
aauguggauggccuggggacuccuggguuuucucccucccgacucccuaauaaaccccgugaac

SEQ ID NO: 496080 - RNA, 64 nt, Human
ugcuuccuggguucaagugauucucuugccuuagccucccgagcagcugggauuauaggcgucc

SEQ ID NO: 496081 - RNA, 64 nt, Human
ugacuuccuccaaggagcuuuggcuauacucucuccucccgacccccacccuggcauacuacac

SEQ ID NO: 496082 - RNA, 64 nt, Human; identical to SEQ ID NO: 300406

SEQ ID NO: 496083 - RNA, 64 nt, Human; identical to SEQ ID NO: 300407

SEQ ID NO: 496084 - RNA, 64 nt, Human; identical to SEQ ID NO: 300408

SEQ ID NO: 496085 - RNA, 64 nt, Human; identical to SEQ ID NO: 300409

SEQ ID NO: 496086 - RNA, 64 nt, Human
gaccuccugggcucaagcgauccuccugccucaaccucccgacuagcuggcauuacaggcgugc

SEQ ID NO: 496087 - RNA, 64 nt, Human
cgccucccggguucccgccauucuccugccucagccucccgaguagccgggacuacaggcgccc

SEQ ID NO: 496088 - RNA, 64 nt, Human
ccuuuuucauuugaaugucauugcuucuccggugccucccgacccgcaucgccggcccugguuu

SEQ ID NO: 496089 - RNA, 64 nt, Human
gcccaggcagccuccgggcgugugaagaacaccuccucccgaaaaaugugugguucuuuuuuuu

SEQ ID NO: 496090 - RNA, 64 nt, Human
aucugaagucagauaguaaggaugugguaccaauccucccgagugcaaugcuaaacacuuccag

SEQ ID NO: 496091 - RNA, 64 nt, Human
cgccuccgggguucaagcgauucuccugccucagccucccgaguagcugggacuacaggugagc

SEQ ID NO: 496092 - RNA, 64 nt, Human
gguuaccugggcucaagugauccuucugccucagccucccgaguagcugggauuacaggugagc

SEQ ID NO: 496093 - RNA, 64 nt, Human
cgccucuuggguucaagcaauucugcugcaucagccucccgaguaccugggauuacaggcaugu

SEQ ID NO: 496094 - RNA, 64 nt, Human
ccuuuuuauccccauagcuuuuagcuaaaacaucccucccgaguugacccccugggguuucaaa

SEQ ID NO: 496095 - RNA, 64 nt, Human
cgccucccagguucacgccauucuccugccucagccucccgaguagcugggaccacaggggccc

SEQ ID NO: 496096 - RNA, 64 nt, Human
ucgaacuccuggcucaagugaucucccacuucagccucccgaguaucugggauuauaagcaaga

SEQ ID NO: 496097 - RNA, 64 nt, Human
cgccucccggguucaagugauucuccugccucagccucccgaguagcugggauuacaggcaugc

SEQ ID NO: 496098 - RNA, 64 nt, Human
caccuccuggguucaugccauucuccugccucagccucccgaguagcugggacuacaggcgccc

SEQ ID NO: 496099 - RNA, 64 nt, Human
ugccuccuggguucaagcgauucuccugccucagccucccgaguagcugggauuacaggugccu

SEQ ID NO: 496100 - RNA, 64 nt, Human
cgccucccagguucaugccauucuccuaccucagccucccgaguagcugggacuacaggcgccc

SEQ ID NO: 496101 - RNA, 63 nt, Human; identical to SEQ ID NO: 300402

SEQ ID NO: 496102 - RNA, 64 nt, Human; identical to SEQ ID NO: 300403

SEQ ID NO: 496103 - RNA, 64 nt, Human; identical to SEQ ID NO: 300404

SEQ ID NO: 496104 - RNA, 64 nt, Human; identical to SEQ ID NO: 300417

SEQ ID NO: 496105 - RNA, 64 nt, Human
ugccucccagguucaagugauucuccugccucagccucccgaguagcugggauuacaggcaugc

SEQ ID NO: 496106 - RNA, 64 nt, Human
uucagguuuuucuagcuccuccauaaccucacucccucccgaggucucugguucaaagaccacc

SEQ ID NO: 496107 - RNA, 64 nt, Human
cgccucccggguucaagugauucuccugccucagccucccgaguagcugggauuacaggugugu

SEQ ID NO: 496108 - RNA, 64 nt, Human
cuucuccuggguccaagcaauuauugugccucagccucccgaguagcugagacuucaggugcau

SEQ ID NO: 496109 - RNA, 64 nt, Human
ugccucccagguucaagcgauucuucugccucagccucccgaguagcugggaccacaggugccu

SEQ ID NO: 496110 - RNA, 64 nt, Human
ccucaggugcuacacaguauaguucuaggguuucccucccgauaucaaaaagacuguggccugc

SEQ ID NO: 496111 - RNA, 64 nt, Human
agccuugaccucccaggcucaggucccaucugagccucccgaguagcuggggcuacaggugugu

SEQ ID NO: 496112 - RNA, 64 nt, Human
ugccucccagguucacaccauucuccugccucaaccucccgaauggcugggacuacaggcaccc

SEQ ID NO: 496113 - RNA, 64 nt, Human
cuccaucagcaaaggagcacuucucuaaucaugcccucccgaagacuggcugggagaagguuua

SEQ ID NO: 496114 - RNA, 64 nt, Human
gcugggaggggaaggagggccuggcagauggcagccucccgagguagggcuguguucuaaucag

SEQ ID NO: 496115 - RNA, 64 nt, Human
gcaguggugcaaucucggcucacugcaaccucugccucccgaguucaagcaauucuccugccuc

SEQ ID NO: 496116 - RNA, 64 nt, Human
uugaacgccugaccuugugaucugcccgccucggccucccgaagugcugggauuacagguguga

SEQ ID NO: 496117 - RNA, 64 nt, Human
cuccucuuggguucaagcaauucuccugccucagccucccgaguagcugggacuacaggcaccc

SEQ ID NO: 496118 - RNA, 64 nt, Human
ugccacccggauucaagcaauucuccugucucagccucccgaguagcuggaauugcagacaccc

SEQ ID NO: 496119 - RNA, 64 nt, Human
cgccuccuugguuccagcaauucuucugccucagccucccgaguagcugggacuacaagcggcu

SEQ ID NO: 496120 - RNA, 64 nt, Human; identical to SEQ ID NO: 300422

SEQ ID NO: 496121 - RNA, 64 nt, Human; identical to SEQ ID NO: 300423

SEQ ID NO: 496122 - RNA, 64 nt, Human; identical to SEQ ID NO: 300424

SEQ ID NO: 496123 - RNA, 64 nt, Human; identical to SEQ ID NO: 300425

SEQ ID NO: 496124 - RNA, 64 nt, Human
cgccucucuaguucaagcgauuuuccugccucagccucccgaguagcugggauuccaggcgccc

SEQ ID NO: 496125 - RNA, 64 nt, Human
agcaugaagaaggagccaugaggaguucccaugaccucccgagacuugccauaaguguucuagu

SEQ ID NO: 496126 - RNA, 64 nt, Human
uggauuuauaguuccuccaaacaaagaugggaccccucccgagggaaguucaaaaggaccggcu

SEQ ID NO: 496127 - RNA, 64 nt, Human
cgccucccagguucaagugauucuccugccucagccucccgaguagcugggauuacaggcgugc

SEQ ID NO: 496128 - RNA, 64 nt, Human
auuccaaagccucugauuguuguuuccuuuuucuccucccgaaggaacagcugauucaugcucc

SEQ ID NO: 496129 - RNA, 64 nt, Human
ugccucccagguucaagcgauucuccugccucagccucccgaguaccugggacuacaggcaugu

SEQ ID NO: 496130 - RNA, 64 nt, Human
aaacuccugaccucaagugaucuaccugccucugccucccgaagugcuuggauuacagguguga

SEQ ID NO: 496131 - RNA, 64 nt, Human
ccccucccguguucacgccauucuccugccucagccucccgaguagcugggacuacaggcgccu

SEQ ID NO: 496132 - RNA, 64 nt, Human
cgccucucggguucaagcaauucuccugcaucagccucccgaguagcuggcauuacaggcgccc

SEQ ID NO: 496133 - RNA, 64 nt, Human
ggggggcuguuagcuaauggguacaaggacacccccucccgagaagagaagccacagaugagug

SEQ ID NO: 496134 - RNA, 64 nt, Human
aagaaacccugcugauuaaaucucucuugggcuuccucccgaaaugugagacuauacuuuaaag

SEQ ID NO: 496135 - RNA, 64 nt, Human
ccggaagcagaggcugaccaggagcaggggccucccucccgaacugaaagcccauccguccucg

SEQ ID NO: 496136 - RNA, 64 nt, Human
ggccuccuggguucaagcgauucuccugccucagccucccgaguaguugggauuagaggcauag

SEQ ID NO: 496137 - RNA, 64 nt, Human
caccuccuggguucaaacaauucuccugccucagccucccgaguacugggaauauaggugcacg

SEQ ID NO: 496138 - RNA, 64 nt, Human
aaacaagaggacacaauggcaccucugcccuuccccucccgacagcccaucaccucuaauagag

SEQ ID NO: 496139 - RNA, 64 nt, Human; identical to SEQ ID NO: 300430

SEQ ID NO: 496140 - RNA, 64 nt, Human; identical to SEQ ID NO: 300431

SEQ ID NO: 496141 - RNA, 64 nt, Human; identical to SEQ ID NO: 300432

SEQ ID NO: 496142 - RNA, 64 nt, Human; identical to SEQ ID NO: 300436

SEQ ID NO: 496143 - RNA, 64 nt, Human
gaauccaggccccaucucccccaacuccacagccccucccgagccucaaggcaaguccaggacu

SEQ ID NO: 496144 - RNA, 64 nt, Human
agucucccagguucaagugauucuccugccuuagccucccgaguagcugggauuauaggcaccc

SEQ ID NO: 496145 - RNA, 64 nt, Human
cuccgccucccagguucaagcgauucuccugcagccucccgaguagcugggauuacaggcgcac

SEQ ID NO: 496146 - RNA, 64 nt, Human
cgccucccggguucacgccauucuccugccucagccucccgaguagcugggacuacaggcgccc

SEQ ID NO: 496147 - RNA, 64 nt, Human
caccuccuggguucaagugauucuccugccucagccucccgaguagcugggauuagaggcgugu

SEQ ID NO: 496148 - RNA, 64 nt, Human
cccagaggcuggcugagggcccuggggccccuccccucccgaacacugagaaauagugcacucc

SEQ ID NO: 496149 - RNA, 64 nt, Human
ugccucccggguuugagugauucuccugcgucagccucccgaguagcugggauuacaggcaccu

SEQ ID NO: 496150 - RNA, 64 nt, Human
caccuccuggauucacgccacucuccugccucagccucccgaguagcugggacuacaggcaccu

SEQ ID NO: 496151 - RNA, 64 nt, Human
cgccuccuggguucaagugauucuccugccucagccucccgaguagcuggaauuacaggcaccu

SEQ ID NO: 496152 - RNA, 64 nt, Human
gaauuccucaccucaggucauccgccugucucggccucccgaagugcugggauuauagguguga

SEQ ID NO: 496153 - RNA, 64 nt, Human
caccuuccagguucaagugauucuccugccucagccucccgaguagcugggacuacgggcacgc

SEQ ID NO: 496154 - RNA, 64 nt, Human
cgucucuuagguucaagcaauucuccugccucagccucccgaguagcugggauuacaggugcuc

SEQ ID NO: 496155 - RNA, 64 nt, Human
ccuauguaguucucagaugcguaaagcagaacagccucccgaaugaagcguugccauugaacuc

SEQ ID NO: 496156 - RNA, 64 nt, Human
uaccuccuggguucaagugauucucuugccucagccucccgaguugcugggauuacaggcaugu

SEQ ID NO: 496157 - RNA, 64 nt, Human
ugcguccuggguugacgccauucuccugccucagccucccgaguagcugggacuacaggagcuc

SEQ ID NO: 496158 - RNA, 61 nt, Human
ucuuugcccucugggucuugacccauuaagagccccauagaacucuugauuuuuccugucc

SEQ ID NO: 496159 - RNA, 61 nt, Human
ucaucccccguggugucugcacaucacuccagccccauaaagagugucauguuagcugagu

SEQ ID NO: 496160 - RNA, 61 nt, Human
uuggaggucuggacagggagcccagucccgggccccauaguggugcgggcacuggaccccc

SEQ ID NO: 496161 - RNA, 61 nt, Human
agaagcguugcugaguguguucccuguaacugccccauagugggcagcccuggaggaacaa

SEQ ID NO: 496162 - RNA, 64 nt, Human
acuggcuuugcggaggcugcucagauggccugagccucccgaggcuugcugccccguaggagga

SEQ ID NO: 496163 - RNA, 64 nt, Human
gccccucgggauucaagugauucuacugccucagccucccgaguagcugggauuauaggcgagu

SEQ ID NO: 496164 - RNA, 64 nt, Human
uuccuauuuagagggaguccuggcuccaugacccccucccgaguggacuguccaagcagauagg

SEQ ID NO: 496165 - RNA, 64 nt, Human
cagcuccuggguucgaacgauucuccugccucagccucccgagcagcugggacuacaggcaugc

SEQ ID NO: 496166 - RNA, 64 nt, Human
ccuuguguccagugcccagcaacuccugccucagccucccgagcagcugggacuacaggcgccc

SEQ ID NO: 496167 - RNA, 64 nt, Human
ugccucccggguucacgccauucuccugccucagccucccgaguagcugggacuacaggugccc

SEQ ID NO: 496168 - RNA, 64 nt, Human
ccgcugacccgcuggauggagagcaaaggagaccccucccgagccgcucacaguccuguauuug

SEQ ID NO: 496169 - RNA, 64 nt, Human
uagcucacugcaaccuccaccucccaggcucaagccucccgaauagcugggacuacaggcgcac

SEQ ID NO: 496170 - RNA, 64 nt, Human
ggaggcuccauccuucuccccaaggucuguggcuccucccgaaacccaaguuaugcauccccau

SEQ ID NO: 496171 - RNA, 64 nt, Human
gccucugugagagaugccccacaccaaacccaacccucccgauggcugcauucccugguccucc

SEQ ID NO: 496172 - RNA, 64 nt, Human
ugccucccagguucacgccauucuccugccucagccucccgaguagcugggacuacaggcaccc

SEQ ID NO: 496173 - RNA, 64 nt, Human
cagcuccuggguucgaacgauucuccugccucagccucccgagcagcugggacuacaggcgugc

SEQ ID NO: 496174 - RNA, 64 nt, Human
ugccucccagguucaagcaauucucuugccucagccucccgaguagcugggacuaaaggcgugu

SEQ ID NO: 496175 - RNA, 64 nt, Human
ugccucccggguucaagcaauucuccugccucagccucccgaguagcuggaacuacaggcacac

SEQ ID NO: 496176 - RNA, 64 nt, Human
agcccagccccugccuagauccuaggucccuuuuccucccgaguuuggcuggcacgagagcuag

SEQ ID NO: 496177 - RNA, 61 nt, Human
caaauuuugugaguuuaguacucuacagauugccccauaagagcaguagcuuuugaaacuc

SEQ ID NO: 496178 - RNA, 61 nt, Human
gaugcucagcuguggggcgggccucuaagaugccccauacuuugggggucucagaaaugga

SEQ ID NO: 496179 - RNA, 61 nt, Human
gugccaaaucccuggcaggcagauggcuccugccccauauucuugccgugucuuggaaaag

SEQ ID NO: 496180 - RNA, 64 nt, Human
ccaccucccagauucaagcaacucucugccucagccucccgaguagcugggauuacaagcaccc

SEQ ID NO: 496181 - RNA, 64 nt, Human
aggauggugccuggagcagagggacccacaagugccucccgagccuagauccuggcucggacca

SEQ ID NO: 496182 - RNA, 64 nt, Human
ccgccucccagguucaagcgauuucgugccucagccucccgaguagcugggauuacaggcaccc

SEQ ID NO: 496183 - RNA, 64 nt, Human
ugccuccuggguucaagugauucuccugccuuagccucccgaauagcuggaauuacaggcacgc

SEQ ID NO: 496184 - RNA, 64 nt, Human
gagaaagaauuugcaaccaugaggaauguucccaccucccgacgggacgugcauuuggaaaaca

SEQ ID NO: 496185 - RNA, 64 nt, Human
gcggggggggcgccuggagagcgaggaggcgcggccucccgaggaggggcccgguggcggcagg

SEQ ID NO: 496186 - RNA, 62 nt, Human
aagggaaagagacuugcugagagcagcugccgccucccgacaccuucagaaaacacgacacc

SEQ ID NO: 496187 - RNA, 64 nt, Human
cccggcggcaagaggcccauguuccggagagaagccucccgacccugugcccuggcucccggga

SEQ ID NO: 496188 - RNA, 64 nt, Human
uccgcucccgguuugagugauucucaugccucagccucccgaguagcugggauuacaggcauga

SEQ ID NO: 496189 - RNA, 64 nt, Human
gccuggacuccccagccuucccaccccauaccucccucccgaucuugcugcccuucuugacaca

SEQ ID NO: 496190 - RNA, 64 nt, Human
cgccuccuggguucaagcaauucuucugacucagccucccgaguagcugggaguacaggugcac

SEQ ID NO: 496191 - RNA, 64 nt, Human
cagcucuucuccuccaacggcugcaagaccguggccucccgaaucgccuucuuccucugacucu

SEQ ID NO: 496192 - RNA, 64 nt, Human
aggccacccagggaccacgggcgaggacgugaagccucccgaacacgcacagaaggaaggagcc

SEQ ID NO: 496193 - RNA, 64 nt, Human
cacccacuggguucaagcgauucuucugccucagccucccgaguagcugggauuaccggcaccc

SEQ ID NO: 496194 - RNA, 64 nt, Human
uugggcccaugcccagcgcaggccugaagaccacccucccgagaggaaccagcccgguaagagg

SEQ ID NO: 496195 - RNA, 61 nt, Human
gcaugaauugggucccuuauucccagggggugccccauauuccccaauacuguaaagcaga

SEQ ID NO: 496196 - RNA, 61 nt, Human
ucucucuccuugccccccucccgcccuccccgccccauaccuuuucuuccccuggauuuuc

SEQ ID NO: 496197 - RNA, 61 nt, Human
ucauucuuagcccccuacuguggcccccauagccccauaacccagagagggagcuggacuu

SEQ ID NO: 496198 - RNA, 64 nt, Human
acggucucaggaauguuuuccaucccgccacgcgccucccgaagcucccagaccggaggcucag

SEQ ID NO: 496199 - RNA, 64 nt, Human
caccacccagguucaagcaauuauccugccucagccucccgaguaggugggauuauaggagcgu

SEQ ID NO: 496200 - RNA, 64 nt, Human
ugccucucggguuccagcaauucuccugccucagccucccgaguagcugagauuacaggcgccc

SEQ ID NO: 496201 - RNA, 64 nt, Human
cgccuccuggguucaagcgauucuccagccucagccucccgaguagcugggauuacagacaccc

SEQ ID NO: 496202 - RNA, 64 nt, Human
uguuaggaaugcagagucuaggccucacccuauaccucccgacucagacccugcauuuuagcaa

SEQ ID NO: 496203 - RNA, 64 nt, Human
ugucuccuggguucaugccauucuccugcuucagccucccgaguagucccaggaguagcuggga

SEQ ID NO: 496204 - RNA, 64 nt, Human
cacuucccagguucaagcgauucucaugccucagccucccgaguagcugggacuacaggcacaa

SEQ ID NO: 496205 - RNA, 64 nt, Human
aagccaguugugggaaaaacucgaguccuccccuccucccgaccuaccccguguggcugcuuuu

SEQ ID NO: 496206 - RNA, 64 nt, Human
cgucuccuggguucaagugauucuccagccucagccucccgaauagcugggauuacacgugccc

SEQ ID NO: 496207 - RNA, 64 nt, Human
gcuguggugcaaucucggcucacugcaaccucugccucccgaguucaagcaauucuccugccuc

SEQ ID NO: 496208 - RNA, 64 nt, Human
ugccucccgaguucaagcaauucuccugccucagccucccgaguagcugggauuacaggcgacc

SEQ ID NO: 496209 - RNA, 64 nt, Human
aagcacucgccggcccuucggcacccucgcccucccucccgacucaacccggccguugcuucug

SEQ ID NO: 496210 - RNA, 64 nt, Human
cgccucccagguucaagcgauucuccugccucagccucccgagcagcugagacuacaggcgccu

SEQ ID NO: 496211 - RNA, 64 nt, Human
gccucuugcugauggcaccuucccugcauugcugccucccgaugaugugguucuuuucuugugc

SEQ ID NO: 496212 - RNA, 64 nt, Human
cacaucccauguugaaguaauucuucugccucagccucccgaguagcugggacuagaggaacgu

SEQ ID NO: 496213 - RNA, 61 nt, Human
cucauaagacccucauuccagagagggugcugccccauacccggaaggaggaacgcugcac

SEQ ID NO: 496214 - RNA, 61 nt, Human
gcaagggcaggggucccugagcuguucuucugccccauacugaaggaacugaggccugggu

SEQ ID NO: 496215 - RNA, 61 nt, Human
auguuuuuaaggaugguugugaaucccccuggccccauaauaaauuguaauuuuauacugc

SEQ ID NO: 496216 - RNA, 64 nt, Human
ccucaaggcaguucaagcaauucuccugccucagccucccgaguagcuaggacuacaggcgugu

SEQ ID NO: 496217 - RNA, 64 nt, Human
caccucucuaguucaagcgauucuccugucucagccucccgaguagcugggacuacaggcacau

SEQ ID NO: 496218 - RNA, 64 nt, Human
agccuccccgauucacgccauucuccugccucagccucccgaguagcugggacuacaggcgccu

SEQ ID NO: 496219 - RNA, 64 nt, Human
cuuuuuguuuuugaagacaggacuuaggucuccuccucccgaacucuaaaccugcguguguggc

SEQ ID NO: 496220 - RNA, 64 nt, Human
caccuccuggguucaagcaauucuccugccucagccucccgaguagcugggacuacaggugcau

SEQ ID NO: 496221 - RNA, 64 nt, Human
ugggguuucaccauguugcccaggcuggucuugaccucccgaccucaagugaucugccugcccc

SEQ ID NO: 496222 - RNA, 64 nt, Human
ugucucccaaguucaagugauucuccugccugagccucccgaguagcugggauuacaggugcau

SEQ ID NO: 496223 - RNA, 64 nt, Human
ugucuccugggcucaagugauucucgugccucagccucccgaauagcuggaauuacgggcaugc

SEQ ID NO: 496224 - RNA, 64 nt, Human
gccgggacgaagcacuugguaacaggcacaucuuccucccgagugacugccuccuaggaggaca

SEQ ID NO: 496225 - RNA, 64 nt, Human
cgucucccggguucacgccauucuccugccucagccucccgagcagcugggacuacaggcgccc

SEQ ID NO: 496226 - RNA, 64 nt, Human
ggguccagagcagauauggaccccucugcacaggccucccgaaguccugaagcugggcggcagu

SEQ ID NO: 496227 - RNA, 64 nt, Human
gggccguaucuccggcucccagccucagcgcggcccucccgaguuaaggugggcccggcccgcg

SEQ ID NO: 496228 - RNA, 64 nt, Human
cgucuccuggguucaagugauucuucugccucagccucccgagcagcugggauuacaggcgccc

SEQ ID NO: 496229 - RNA, 64 nt, Human
ucaaucucuugaccucuugauccacccgacuuggccucccgaagugaugagauuauaggcguga

SEQ ID NO: 496230 - RNA, 64 nt, Human
caccucccggguucacgccauucuccugccucagccucccgaguagcugggauuacgggcgccc

SEQ ID NO: 496231 - RNA, 64 nt, Human; identical to SEQ ID NO: 300382

SEQ ID NO: 496232 - RNA, 64 nt, Human; identical to SEQ ID NO: 300426

SEQ ID NO: 496233 - RNA, 64 nt, Human; identical to SEQ ID NO: 300427

SEQ ID NO: 496234 - RNA, 64 nt, Human; identical to SEQ ID NO: 300428

SEQ ID NO: 496235 - RNA, 64 nt, Human
caccucccagguucacgccauucuccugccucagccucccgaguagcugggacuauaggcgccc

SEQ ID NO: 496236 - RNA, 64 nt, Human
cgccucccggguucaagcgauucuccugccucagccucccgaguaguugggauuacaggcgccu

SEQ ID NO: 496237 - RNA, 64 nt, Human
gcuuggucagcaaacuaaguacuggguaaacucuccucccgaaacuacugaccacccacaguuc

SEQ ID NO: 496238 - RNA, 64 nt, Human
ugccuccuggguucaagcaauucuccugccucagccucccgaguagcugggacuacaggugugc

SEQ ID NO: 496239 - RNA, 64 nt, Human
gcaauggccugaucucggcucacugcaaccucugccucccgaguucaagcaauucuccugccuc

SEQ ID NO: 496240 - RNA, 64 nt, Human
cgccuccuggauucaggugauucuccugucucagccucccgaguaacugggauuacaggcaugc

SEQ ID NO: 496241 - RNA, 52 nt, Human
uagaaaauaauacacauuaacaccucccgauugaaggagaaaaacuuuuugc

SEQ ID NO: 496242 - RNA, 64 nt, Human
ugccuccuggguucaagcgauucugcugccucagccucccgaguagcugggauugcagguaccc

SEQ ID NO: 496243 - RNA, 64 nt, Human
cacgccccucggcggggccgcccucugcuccagcccucccgauuaaagcgugccccgguccaau

SEQ ID NO: 496244 - RNA, 64 nt, Human
ugccucccggguucaagcaauucuccugccucagccucccgaguagcugggauuagaggcgcca

SEQ ID NO: 496245 - RNA, 64 nt, Human
ggccucccggguucaagcaauucuccugccucagccucccgaguagcugggauuacaggcaugg

SEQ ID NO: 496246 - RNA, 64 nt, Human
auaaguggauuguguacccuuuaguuaaauuucaccucccgacuucagcauagaucacaggaaa

SEQ ID NO: 496247 - RNA, 64 nt, Human
cgccuccuggguucacgccauucucccaccucagccucccgaguagcugggacuacaggcgugu

SEQ ID NO: 496248 - RNA, 64 nt, Human
ggaugugaggagccgguacaaggcgcagccagcuccucccgaacucaacucggaaucggaagac

SEQ ID NO: 496249 - RNA, 64 nt, Human
cgccucccagguucaaguaauucuccugccucagccucccgaguggcugggauuagcggcaugc

SEQ ID NO: 496250 - RNA, 61 nt, Human
uucuccuugaagaccuucucccuuuuauguggccccauauuuuauguugcuuuaucuuuga

SEQ ID NO: 496251 - RNA, 61 nt, Human
agcuuucacacagugagaaauagagcaggcugccccauaaauggguaacauauuccuaauc

SEQ ID NO: 496252 - RNA, 61 nt, Human
aacuuccaaggaugacccaaccuuugccuuugccccauauauuggggaaaacccauacacc

SEQ ID NO: 496253 - RNA, 61 nt, Human
uccuauaccacccuuguaacccaguagacuugccccauaugccccaacucauagcaccuaa

SEQ ID NO: 496254 - RNA, 64 nt, Human
ggucagaucccccuccccccagguuccuccuuccccucccgauugagccuuacgacacuuuggu

SEQ ID NO: 496255 - RNA, 64 nt, Human
ugccucccggguucaagcgauucuccugcaucagccucccgaguagcuaggauuacaggcgccc

SEQ ID NO: 496256 - RNA, 64 nt, Human
guauaccaggugucccaccccugccaccauggggccucccgauacggcaaccaccacggaccug

SEQ ID NO: 496257 - RNA, 64 nt, Human
gcaguggugugaucacagcucacugcaaccucgaccucccgaagcucagaugguccuccaaccu

SEQ ID NO: 496258 - RNA, 64 nt, Human
cgccucccagguucaugccauucuccugccucagccucccgaguagcugggacuacaggcaccu

SEQ ID NO: 496259 - RNA, 64 nt, Human
ugccuccuggguucacgccauucuccugccucagccucccgaguagcugggacuacaggcaccu

SEQ ID NO: 496260 - RNA, 64 nt, Human
uuguccaggacuucauugccucacaggcccugagccucccgaaggagaaaccauugucuuccca

SEQ ID NO: 496261 - RNA, 64 nt, Human
cacuuccuggguucaugccauuuuccugccucagccucccgaguagcugggacuacaggugccc

SEQ ID NO: 496262 - RNA, 64 nt, Human
cuggguggaucaccugagaucaggcuagucuugaccucccgaccucaggugauccgccuaucug

SEQ ID NO: 496263 - RNA, 64 nt, Human
gggccaggccggaccugcccccucagugucucucccucccgaguccccagauggagaccccuuu

SEQ ID NO: 496264 - RNA, 64 nt, Human
ggguggugucagacccuggaggccccaacccuguccucccgagcuccucuuccaugcugugcgc

SEQ ID NO: 496265 - RNA, 64 nt, Human
cgccucccauguucaagcgauucuccugccucagccucccgaguagcugggacuauaggcaugc

SEQ ID NO: 496266 - RNA, 52 nt, Human
uuggcuugcugguccacuagggccucccgaggcugggcaugccucaggcuuc

SEQ ID NO: 496267 - RNA, 64 nt, Human
cacuucccugguucaagcaauuccccugccuuugccucccgaguagcugggauuacaggcacac

SEQ ID NO: 496268 - RNA, 64 nt, Human
ggcaucuccaccacggcugggcgucugugccaggccucccgaagguggcgauggugagcagcag

SEQ ID NO: 496269 - RNA, 64 nt, Human
uccugaguagcuggaacuacaaggaagggccaccacaccugacuaacuuuuuuguuuuuuguuu

SEQ ID NO: 496270 - RNA, 64 nt, Human
cucccggcugccgccagggggcggucggaccccgccucccgagcccggggaggggcggggagga

SEQ ID NO: 496271 - RNA, 64 nt, Human
augugaagcacccaucaugccacaccgguacccuccucccgacugaccacuggccuaccccuuu

SEQ ID NO: 496272 - RNA, 64 nt, Human
aaacuccugaccucaggggauccacccgccucggccucccgaagugcugggauuauaggcguaa

SEQ ID NO: 496273 - RNA, 64 nt, Human
cgccucuuggguucaagcgauucuucugcuucagccucccgaguagcugggacuacaggcaccc

SEQ ID NO: 496274 - RNA, 64 nt, Human
caaccuccugggcuaagugauccucccaccucagccucccgaauagcugggacuacagguguga

SEQ ID NO: 496275 - RNA, 64 nt, Human
caccucccggguucaagcuauucuccugccucagccucccgaguagcugggauuacaggcaccu

SEQ ID NO: 496276 - RNA, 64 nt, Human
uccugguugccauggaaauagcagccaacggacaccucccgaugccagugcuaaggcuggaaau

SEQ ID NO: 496277 - RNA, 64 nt, Human
ggcauccagcucagugucauccagggccugugucccucccgaacccagggucaaccugccuacc

SEQ ID NO: 496278 - RNA, 64 nt, Human
gggcaccugggggccaaggcagagggaaggggguccucccgauuagggucgagugucagccugg

SEQ ID NO: 496279 - RNA, 64 nt, Human
uuucccaaggagcaggggugagcaggcaggcuccccucccgaguccugagucccuggauuuagg

SEQ ID NO: 496280 - RNA, 64 nt, Human
gaacuccuuaccucaggugauccacccaccuuggccucccgaagugcugggauuacaggcauga

SEQ ID NO: 496281 - RNA, 64 nt, Human
gcagggagcgggaagugacaagagcucagaucucccucccgaucucccuccccaccuccgaagu

SEQ ID NO: 496282 - RNA, 64 nt, Human
ugcucugugcagauccugucgcccucagcugccuccucccgagaccuaauggucccugcugggc

SEQ ID NO: 496283 - RNA, 64 nt, Human
acgugcuuccuauggguuucagcuggcccaagccccucccgaaucucucugcuaguggugggug

SEQ ID NO: 496284 - RNA, 64 nt, Human
gaacuccugggcucaagcgauccuucugccuuggccucccgaagugcugggauugcaggcauaa

SEQ ID NO: 496285 - RNA, 61 nt, Human
auucaaauuauagaacauguuuuuucccuuugccccauaaucaguauuugccaaauuacau

SEQ ID NO: 496286 - RNA, 64 nt, Human
cgucucccgggcucacgccauucuccugccucagccucccgaguagcugggacuacaggcgccc

SEQ ID NO: 496287 - RNA, 64 nt, Human
gaguggucccaugaaacacuaagggucgucacgcccucccgaggagcucaaggaccugccuguc

SEQ ID NO: 496288 - RNA, 64 nt, Human
ugucaucuagacugcagaguacuugagugcuuugccucccgauaugccagagcuugugguccaa

SEQ ID NO: 496289 - RNA, 64 nt, Human
ugccuccuggguucaagcaauuuuccugccucagccucccgaguagcugggaguacaggcacac

SEQ ID NO: 496290 - RNA, 64 nt, Human
ugcaggcgagcgccgccacgccugacugccucggccucccgaggugccgggauugcagacggag

SEQ ID NO: 496291 - RNA, 64 nt, Human
cgcuucccagguugaagugauucucuugccucagccucccgaguagcugggauuacaggugccc

SEQ ID NO: 496292 - RNA, 64 nt, Human
cgccuccuggguucaagugauucuucugccucagccucccgaguagcugggauuacaggcacgc

SEQ ID NO: 496293 - RNA, 64 nt, Human
cugccaggcgcccugggugguggaaggcagccgcccucccgaagguuggcccccacguggggag

SEQ ID NO: 496294 - RNA, 64 nt, Human
gggaugugguggccugugcccaccuucucucccuccucccgacccgcccccucgcccccacccc

SEQ ID NO: 496295 - RNA, 64 nt, Human
cccugccccacccccgccacgucccacuaggcguccucccgacuccucucccggagccuccuca

SEQ ID NO: 496296 - RNA, 64 nt, Human
agggguccuguuugugccuccccuuagucccuucccucccgauuucccgauucccccacccucc

SEQ ID NO: 496297 - RNA, 64 nt, Human
aaagcacaugaccgcacaaaugcuuacaggguuuccucccgaguaauccaaucucacuccccuu

SEQ ID NO: 496298 - RNA, 64 nt, Human
caggcucuguuccucaauggccuuuugcuacgugccucccgagaaauuugucuuuuuguauaaa

SEQ ID NO: 496299 - RNA, 64 nt, Human
gcucgugaugguggagcuaagguccaggccucucccucccgagugcauuuuuggggagauagua

SEQ ID NO: 496300 - RNA, 64 nt, Human
cgcccccaagguucaagugauucuccugccucagccucccgaguagcugggauuacaggcaccc

SEQ ID NO: 496301 - RNA, 64 nt, Human; identical to SEQ ID NO: 300437

SEQ ID NO: 496302 - RNA, 64 nt, Human; identical to SEQ ID NO: 300438

SEQ ID NO: 496303 - RNA, 64 nt, Human; identical to SEQ ID NO: 300439

SEQ ID NO: 496304 - RNA, 64 nt, Human; identical to SEQ ID NO: 300477

SEQ ID NO: 496305 - RNA, 64 nt, Human
ugccucccggguucacgcccuucuccugccucagccucccgaguagcugggacuacaggugccc

SEQ ID NO: 496306 - RNA, 64 nt, Human
guaugccugaccguuucccugccuccugcuucagccucccgaggccgaagccucagccccucca

SEQ ID NO: 496307 - RNA, 64 nt, Human
cgccucccgaguucaagcaauucuccugccucagccucccgaguagcugggauuacaggugccu

SEQ ID NO: 496308 - RNA, 64 nt, Human
gcaguggcgcgaucuuggcucacugcaagcuccgccucccgaguucaagcaauucuccugccuc

SEQ ID NO: 496309 - RNA, 64 nt, Human
gauacuucugauucuggcuuccuuccugccccacccucccgaccccagucccccugauccugcu

SEQ ID NO: 496310 - RNA, 64 nt, Human
auacgcacucccgaccccagaaacccggauucugccucccgacggcggcgucugggcaggguuc

SEQ ID NO: 496311 - RNA, 64 nt, Human
cccacacuauuucugugcuguccacacucucuugccucccgacccccgcacucccuucuagcac

SEQ ID NO: 496312 - RNA, 64 nt, Human
cgccccccggguucaagugauucuccugccucagccucccgaguagcuggaauuacaggcaugc

SEQ ID NO: 496313 - RNA, 64 nt, Human
auaccagaagucaaggguugggguggcgacacggccucccgaggaagaggucugcuugauggug

SEQ ID NO: 496314 - RNA, 64 nt, Human
cgugccuauccuggcuaaggcagacacacugacaccucccgaaguggaccacaagaaacgcaaa

SEQ ID NO: 496315 - RNA, 64 nt, Human
ugugcuaccgggccccaggcccagccacccgguaccucccgagaggcugucccuggacccuggc

SEQ ID NO: 496316 - RNA, 64 nt, Human
cucccacccgccuccagcagcccucugucggccuccucccgacuugacucaccgucaccuggaa

SEQ ID NO: 496317 - RNA, 64 nt, Human
caccucccugauucaagcgacucuccugccucagccucccgaguagcugggauugcaggcaugc

SEQ ID NO: 496318 - RNA, 64 nt, Human
ugccucccagguucacaccauucuccugccucagccucccgaguagcugggacuacaggugccc

SEQ ID NO: 496319 - RNA, 64 nt, Human
cccuucccaaaacuaaacgauucuccugccucagccucccgaguagcugucuuuauaauaccau

SEQ ID NO: 496320 - RNA, 52 nt, Human; identical to SEQ ID NO: 300410

SEQ ID NO: 496321 - RNA, 62 nt, Human; identical to SEQ ID NO: 300411

SEQ ID NO: 496322 - RNA, 64 nt, Human; identical to SEQ ID NO: 300412

SEQ ID NO: 496323 - RNA, 64 nt, Human; identical to SEQ ID NO: 300441

SEQ ID NO: 496324 - RNA, 64 nt, Human
gcugaacucggggcgccgugcccaccggcaugguccucccgagcuccgacagcauuaccucacc

SEQ ID NO: 496325 - RNA, 64 nt, Human
ugcaaucaugagucaaugcagccuccagccucgaccucccgaggcucaggugauccucccaucu

SEQ ID NO: 496326 - RNA, 64 nt, Human
gguguggcugucaggacaccagccuggugcccauccucccgaccccuacccacuuccauucccg

SEQ ID NO: 496327 - RNA, 64 nt, Human
caccucccggguuuaugccauucuccugucucagccucccgaguagcugggacuacaggcaccc

SEQ ID NO: 496328 - RNA, 64 nt, Human
ggcacuggcccacaaacugucccuguccugucuuccucccgagccauggccucugcuagcucca

SEQ ID NO: 496329 - RNA, 64 nt, Human
auuugaaggaacacugaugaagcccugccauaccccucccgagucuaauaaaacguauaaucac

SEQ ID NO: 496330 - RNA, 64 nt, Human
gcaguggugcaaucucgguucacugcaaccuccaccucccgaguucaagugauuuuccugccuc

SEQ ID NO: 496331 - RNA, 64 nt, Human
cgccucccagguucacgccauucuccugccucagccucccgaguagcugggacuacaggugccc

SEQ ID NO: 496332 - RNA, 64 nt, Human
cgccuccuggguuccaacgauucuccugccucagccucccgaguagcugggccuaaaggugccc

SEQ ID NO: 496333 - RNA, 64 nt, Human
auaacaccgggccgccuccccuuccccguccccuccucccgaagacgccgggacagucgggugu

SEQ ID NO: 496334 - RNA, 64 nt, Human
cgccucccagguucaagcgauucuccugccucagccucccgaguagcuaggauuacaggugcgu

SEQ ID NO: 496335 - RNA, 64 nt, Human
gaagcugggagcaaggaaagggucuuagucacugccucccgaaguugcuugaaagcacucggag

SEQ ID NO: 496336 - RNA, 64 nt, Human
caccuccuggguucaagcgauucuccugccucagccucccgaguagcugggauuacaggugggu

SEQ ID NO: 496337 - RNA, 64 nt, Human
cgccucccagguucaugccauucuccugccucacccucccgaguagcugggacuacaggugccu

SEQ ID NO: 496338 - RNA, 64 nt, Human
ugccucccaaguucaacugauucuucugccucagccucccgaguagcagggauuaccggugugc

SEQ ID NO: 496339 - RNA, 61 nt, Human
caaaauugugaucuuuccuaggaguuugaaugccccauauuuguguccucgccagcucuuu

SEQ ID NO: 496340 - RNA, 61 nt, Human
guggcaccugccaauagcuuugucaaucacagccccauaggaacgucuggaauugcuuggg

SEQ ID NO: 496341 - RNA, 61 nt, Human
gugagaguugugaaauuuuagugucucacuggccccauaaauuccacgcuucaggaaguug

SEQ ID NO: 496342 - RNA, 64 nt, Human
ugccuccccgguucaagcgauucuccugccucagccucccgaguagcugagacuacaggcgugu

SEQ ID NO: 496343 - RNA, 64 nt, Human
accccggucggcagccugccccugugagacccacccucccgagcggccaaucgcauuugagucc

SEQ ID NO: 496344 - RNA, 64 nt, Human
cccagcaagccugagcccgggaagaaccagaggcccucccgagagacccagucacacgucucug

SEQ ID NO: 496345 - RNA, 64 nt, Human
cgccucccggguucaagcgauucuccugccucagccucccgaguagcugggacuccacuaaaag

SEQ ID NO: 496346 - RNA, 64 nt, Human
cgccuccuggguucacgccauucuccugccucagccucccgaguagcugggacuacaggcgccc

SEQ ID NO: 496347 - RNA, 64 nt, Human
ugcuucccagguucaagcgauucuccugccucagccucccgaguagcugggauuacaggugugc

SEQ ID NO: 496348 - RNA, 64 nt, Human
gaacuuuguguaaacgggauuuaguugugagcauccucccgaugcuucaagcugcaugcauuaa

SEQ ID NO: 496349 - RNA, 64 nt, Human
cauggggggacauagagggucccagccuacuggaccucccgagcugcccuucaggucuaaagca

SEQ ID NO: 496350 - RNA, 64 nt, Human
gaacucccgaccucaggugauccgcccaccuuggccucccgaagugcugggauuacaggcguga

SEQ ID NO: 496351 - RNA, 64 nt, Human
ccuccugggcucuccagcgaucuucccacaucagccucccgaguagcugggaccacaaauguga

SEQ ID NO: 496352 - RNA, 64 nt, Human
auucaggccaagugacccugacaugugacaucuaccucccgaccuaccaccccacuggcugguu

SEQ ID NO: 496353 - RNA, 64 nt, Human
ucgauuuucugaucuuaugauucacccaccucuaccucccgaagugcugagauuaugggcguga

SEQ ID NO: 496354 - RNA, 64 nt, Human
ugccucccggguucaagugauucuccugccucagccucccgaguagcugggauuacaggcaugc

SEQ ID NO: 496355 - RNA, 64 nt, Human
caccucccggguucaagcaauucuccugccucagccucccgauuagcugggaucacaggugugc

SEQ ID NO: 496356 - RNA, 64 nt, Human
ugccucccgaguucaagggauucuccugccucagccucccgaguagcugggauuacaggcgccc

SEQ ID NO: 496357 - RNA, 64 nt, Human; identical to SEQ ID NO: 300518

SEQ ID NO: 496358 - RNA, 64 nt, Human; identical to SEQ ID NO: 300519

SEQ ID NO: 496359 - RNA, 64 nt, Human; identical to SEQ ID NO: 300520

SEQ ID NO: 496360 - RNA, 64 nt, Human; identical to SEQ ID NO: 300525

SEQ ID NO: 496361 - RNA, 64 nt, Human
gcaguggcgccaucucagcucacugcaacuucugccucccgaguucaagggauucuccugccuc

SEQ ID NO: 496362 - RNA, 64 nt, Human
ccgucugccuaaaguuaaaccucauacuucuagaccucccgaugggucagacucccauuaguuc

SEQ ID NO: 496363 - RNA, 64 nt, Human
gcuucccaagagcacuuauugacccuuccucaggccucccgaaccgacuuccuccaggcgcugu

SEQ ID NO: 496364 - RNA, 64 nt, Human
gcucugaaccccacgcucacaguggucgaccuugccucccgauuuucggaguuggggaagggcc

SEQ ID NO: 496365 - RNA, 64 nt, Human
ccgccucccggguucaagcaauuauuugccucagccucccgaguagcugggauuauaggcaccc

SEQ ID NO: 496366 - RNA, 64 nt, Human
gacuuuuacguucccauuccuguguuaccaccuuccucccgauuuguucaccuauuuugugcuu

SEQ ID NO: 496367 - RNA, 64 nt, Human
cacuguguccugcccuagagcacaaagaccugcuccucccgagacucucucugacugcagccag

SEQ ID NO: 496368 - RNA, 64 nt, Human
agagugcugggauuacaggcgugagccaccacacccucccgagaucuuuaaaguuuaccaaaau

SEQ ID NO: 496369 - RNA, 64 nt, Human
caagaaguuaauggacuguuuauuguaacuugauccucccgagcugugagcgcagucugaggug

SEQ ID NO: 496370 - RNA, 64 nt, Human
ccugagugugaugaacgugccugacuuugacuucccucccgaauucuaugagcaugccaaggcu

SEQ ID NO: 496371 - RNA, 64 nt, Human
ugcccccuggguucaagcgauucuccugccucagccucccgaguagcugagacuacaggcaccu

SEQ ID NO: 496372 - RNA, 64 nt, Human
caucuccuaggcucaagccauuuucccaccucagccucccgaguagcugggacuacaggugcac

SEQ ID NO: 496373 - RNA, 64 nt, Human
caccucccagguucaagcgacucuccugccucagccucccgaguaguugggauuacaggugacu

SEQ ID NO: 496374 - RNA, 64 nt, Human
caccgcuguggugugccgggauccugagccuaggccucccgauguucccacccgcaugaucccu

SEQ ID NO: 496375 - RNA, 64 nt, Human
ggacuccugaucucaggugaccugcccaccucggccucccgaagugcugggauuacaaggguga

SEQ ID NO: 496376 - RNA, 61 nt, Human
uauuggcauuugaggucggaaacccucuacugccccauaagccaggaaaagugaaaagaga

SEQ ID NO: 496377 - RNA, 61 nt, Human
uggacuuggggagaaugacuuucccuuuuuugccccauaagggcuagcauaagcugaggua

SEQ ID NO: 496378 - RNA, 61 nt, Human
aaaaagaacacccaucguauaaggaaauccagccccauagaaaacaaucugcccaccgacc

SEQ ID NO: 496379 - RNA, 64 nt, Human; identical to SEQ ID NO: 300445

SEQ ID NO: 496380 - RNA, 64 nt, Human
ccccuuccggguucaugccauucuccugccucagccucccgaguagcugggacuacaggcacgu

SEQ ID NO: 496381 - RNA, 64 nt, Human
cgccucccagguacaagagauucuccugccucagccucccgaguagcugggacuacaggcgugu

SEQ ID NO: 496382 - RNA, 64 nt, Human
uugcuugguuugguggggcugcggccacuuaaaaccucccgaucucuuuuugaguccuuuauua

SEQ ID NO: 496383 - RNA, 64 nt, Human
ugccuaccagguucaagcgauucuccugccuccgccucccgaguagcuggaauuacagacgccu

SEQ ID NO: 496384 - RNA, 64 nt, Human
ugccuaagacuugcccaagucccagagcaccucaccucccgaagccaccauccccacccugucu

SEQ ID NO: 496385 - RNA, 64 nt, Human
cuggugcccugcagcugugccaguugggccacagccucccgagugcugacccacauggucaaga

SEQ ID NO: 496386 - RNA, 64 nt, Human; identical to SEQ ID NO: 496075

SEQ ID NO: 496387 - RNA, 64 nt, Human
ugccccccggguucaagcgauucuccugccucagccucccgaguagcugagauuacaggugcgc

SEQ ID NO: 496388 - RNA, 64 nt, Human
uccccaggggcugugcuccgggccaaugcagaggccucccgaaccaagcagcaggauugaagcu

SEQ ID NO: 496389 - RNA, 64 nt, Human
ggccgagcaugguggcucacaccuguugccucagccucccgaguagcugggauuaugggcgccc

SEQ ID NO: 496390 - RNA, 64 nt, Human
caccuccuggguucaagcaauucuccuucuucagccucccgaguagcugggauuacaggcaugc

SEQ ID NO: 496391 - RNA, 64 nt, Human
caccucccggguucaagcaauucuccuucuucagccucccgaguagcugagauuauaggcgugc

SEQ ID NO: 496392 - RNA, 64 nt, Human
uuuagcccacugagaauauacccucaggugacucccucccgauccugaaagggaaagcagcugu

SEQ ID NO: 496393 - RNA, 64 nt, Human
cgccucccggguucaagcgaugcuccugccucagccucccgaguagcugggacuacaggcaccu

SEQ ID NO: 496394 - RNA, 64 nt, Human; identical to SEQ ID NO: 300328

SEQ ID NO: 496395 - RNA, 64 nt, Human; identical to SEQ ID NO: 300329

SEQ ID NO: 496396 - RNA, 64 nt, Human; identical to SEQ ID NO: 300330

SEQ ID NO: 496397 - RNA, 64 nt, Human
ggaaaggcugggagccgcacagcccuccccuccugcgcuggaaacccucccugacccccacccu

SEQ ID NO: 496398 - RNA, 64 nt, Human
gcucacagggaacucugggaagccugggauguaggcgcuggagcuccaguucccaggagcaggg

SEQ ID NO: 496399 - RNA, 64 nt, Human
auuccucaagaugauuauuccugaaaguguggaugcgcuggaugcgcagggaacaucaggaaaa

SEQ ID NO: 496400 - RNA, 64 nt, Human
agcucuacgacgugauggacgcggucccagcgcggcgcuggaaggaguucgugcgcacgcuggg

SEQ ID NO: 496401 - RNA, 64 nt, Human
agcaggugggaacugcgcggugugggcugggccugcgcuggaagcauaucccgugaaaaguguu

SEQ ID NO: 496402 - RNA, 64 nt, Human
gugaccccacaauugacauggcuccuccaucccagcgcuggaagggccagugggaagaggaaau

SEQ ID NO: 496403 - RNA, 64 nt, Human
guggcaagguggaaggcauggacguguggaggaggcgcuggagcugaaggaauggacgagcccu

SEQ ID NO: 496404 - RNA, 64 nt, Human
ggcggggggcggggacguagggcuaagggagggggcgcuggagcuuccaacccgaggcaauaaa

SEQ ID NO: 496405 - RNA, 64 nt, Human
aauccagcuccuggaggagggacccagcuccaucgcgcuggaggagagucaccuccagacaaca

SEQ ID NO: 496406 - RNA, 64 nt, Human
cuuccgcgcacagagccgcaucccgccccgcccugcgcuggacugguucaagcuuccgccucgg

SEQ ID NO: 496407 - RNA, 64 nt, Human
uugaagauucugauucaguaggucugggaguggcgcgcuggauuuugaucaaaauuguagagca

SEQ ID NO: 496408 - RNA, 57 nt, Human
cucagcaaggccccaucugaaucagcugcgcuggauggacaccgccuugcacuguug

SEQ ID NO: 496409 - RNA, 64 nt, Human
cugucuguccgucugucccggaaagaacuauaaagcgcuggaagcgccugcagaugguuuugcg

SEQ ID NO: 496410 - RNA, 61 nt, Human
uuguauuuucugcauauucucuggcaaccuugccccauacuuacuuauuuagcauagucga

SEQ ID NO: 496411 - RNA, 61 nt, Human
uuccuuucuacacauaggguguuccugaaaagccccauagugauugagucuucaaaaccac

SEQ ID NO: 496412 - RNA, 61 nt, Human
agaaaggacagaaucucucccccacucccuugccccauaaccaaacauaagcuagcuaguc

SEQ ID NO: 496413 - RNA, 64 nt, Human
cgguugauacuuaguaacuccguggccaguugaagcgcuggauguuuccuagaacaagaaccac

SEQ ID NO: 496414 - RNA, 64 nt, Human
ugugucugucugugagccuuucacaccugugcuggcgcuggaaaauuauuugugcucagcugac

SEQ ID NO: 496415 - RNA, 64 nt, Human
ccgccugcugcgcgaccugccgcgucugcugcgggcgcuggacgcgcggccuuucgcagaggcc

SEQ ID NO: 496416 - RNA, 64 nt, Human
cuauuuuucucuucauauuuauaugggggggagggcgcuggaugcaaaaguugaagaucgugau

SEQ ID NO: 496417 - RNA, 64 nt, Human
uuuuuuuuuugagacggagucugcucugucgcucgcgcuggagugcaguggcaugaucucggcu

SEQ ID NO: 496418 - RNA, 64 nt, Human
gcucccacgcgggugugcgcugacacugccgggggcgcuggacuguguuggacccauccgugcu

SEQ ID NO: 496419 - RNA, 64 nt, Human
cccuuccuuuuguuaucuccaguuugaugcuauggcgcuggacccagggcccucccaggccauc

SEQ ID NO: 496420 - RNA, 64 nt, Human
cucagcagggaagaggcuuuugagggugauccaggcgcuggagggauggccuaggacaccaggg

SEQ ID NO: 496421 - RNA, 64 nt, Human
caagcuuuuuuuggugagccgaaugggcauggcugcgcuggauccugcgccucuggacgugcua

SEQ ID NO: 496422 - RNA, 64 nt, Human
ugaccucgugaucuguccaccuuggccuugcaaagcgcuggauuacaggcaugagccacuacac

SEQ ID NO: 496423 - RNA, 64 nt, Human
gggggaggacgaccucguaucccgcguccccgccgcgcuggauccggacugaguggccgggccu

SEQ ID NO: 496424 - RNA, 64 nt, Human
ucgcugggcuuuuccucugagauuccagcagguggcgcuggagggagucaggggacauaauggc

SEQ ID NO: 496425 - RNA, 64 nt, Human
agaaggcaaaggccuucagcaaucuauauuaccagcgcuggauccuuugacagagagugguccc

SEQ ID NO: 496426 - RNA, 64 nt, Human
aguacuaccacuuccgccaggccugggugccgcugcgcuggaugucccccgaggccauccugga

SEQ ID NO: 496427 - RNA, 64 nt, Human
cuugcccuggcucacuugucccccccaccgccccgcgcuggagccacugccuaguucuucagcc

SEQ ID NO: 496428 - RNA, 64 nt, Human
caagaagccuguuugguggucucuucacacggacgcgcgugacacaaugcugggugguuuuccc

SEQ ID NO: 496429 - RNA, 64 nt, Human
cuggacucggccuggaccaggggaccucgggacugcgcgugaggccccggcccuccaaauccaa

SEQ ID NO: 496430 - RNA, 64 nt, Human
cccuccgcggcgggcccugcccacaccuccuggggcgcgugaggcccguggggccggggcuucu

SEQ ID NO: 496431 - RNA, 64 nt, Human
ccuagagccggcgagcguuugagaagagggcauggcgcuggagugagaugggauuuggcgucuc

SEQ ID NO: 496432 - RNA, 64 nt, Human
aggcuacgagcaauacuauagcuucacacaguuugcgcuggaauuaaaugaaauggauccauca

SEQ ID NO: 496433 - RNA, 64 nt, Human
aggccagcccacccccagaagccaggaagcccccgcgcuggacuggggcagcuuccccagcagc

SEQ ID NO: 496434 - RNA, 64 nt, Human
aaagguucagguaggcgcuggcugagggcggggggcgcuggacacucucugcccugccucccuc

SEQ ID NO: 496435 - RNA, 64 nt, Human
gcugagugaaacgcagcacaagcugcuggcggaggcgcuggagucgcagacccuguuggggccg

SEQ ID NO: 496436 - RNA, 64 nt, Human
accaccgcaagccaggaagcaggugaagugcccagcgcuggagugcagcgugccacgaggaggg

SEQ ID NO: 496437 - RNA, 64 nt, Human
ugaauuuuagagauggauuaucuugcaugccagagcgcuggaauggaauaaaaugauggcagaa

SEQ ID NO: 496438 - RNA, 64 nt, Human
aggugccugccgaggcgggacagaguguucgcucgcgcuggagaaggcucugcucagcccugag

SEQ ID NO: 496439 - RNA, 64 nt, Human
gggugagggccggggcuccgaugccuucuucgacgcgcuggaccacgucauagacauacacgga

SEQ ID NO: 496440 - RNA, 64 nt, Human
ggucaacuagccucaccgaggugccggagagggagcgcuggacaacuagaauguugaccucgag

SEQ ID NO: 496441 - RNA, 64 nt, Human
aaccguucaacgaggcagucaccgccgucggaaggcgcuggagccugcggggcagcaggggcca

SEQ ID NO: 496442 - RNA, 64 nt, Human
gcccuaaugucugaccuagccuaucaagccuuaggcgcuggaagaacccuucucagacacgcag

SEQ ID NO: 496443 - RNA, 64 nt, Human
ggagcacuaggggcuggggcaggaggcuccuggagcgcuggauucguggcacagucugaggccc

SEQ ID NO: 496444 - RNA, 63 nt, Human
auucacccccagcucugugagcugugcauagaggcgcuggagcggcacgucauccaggcuguc

SEQ ID NO: 496445 - RNA, 64 nt, Human
ccccaacauccaaggacaggagagacauggaguggcgcuggacagucacgacaaggacuugccu

SEQ ID NO: 496446 - RNA, 61 nt, Human
ggauguuucaagccaaggcucggcuauucccgccccauaguaaauuuccuuuucccuggaa

SEQ ID NO: 496447 - RNA, 61 nt, Human
aggcugggccaggaggcagccuccgaaccaugccccauauaacgcuugggugcgugggagg

SEQ ID NO: 496448 - RNA, 61 nt, Human
ucucccugccucguuccuuauauucacagaagccccauaguuucacuggguugcgguuauu

SEQ ID NO: 496449 - RNA, 64 nt, Human
gccuguggcccccagccuccuggaaaacagguuggcgcuggaggagccgggucuuggcauccug

SEQ ID NO: 496450 - RNA, 64 nt, Human
gcucuuauggagccgagauccagucagggugggggcgcuggagccgugggagcccggccagggc

SEQ ID NO: 496451 - RNA, 64 nt, Human
accccccgggacccaugugacccagcggccccucgcgcuggaguggaggaugccuucuacacgu

SEQ ID NO: 496452 - RNA, 64 nt, Human
acagcuuggucuccacacagagcccagcccaggggcgcuggacgugaccaucauguacaagggc

SEQ ID NO: 496453 - RNA, 64 nt, Human
ccccagagacuguaucguggcaccguggcgcguggcgcuggagcgggcguuguggucaaggaug

SEQ ID NO: 496454 - RNA, 64 nt, Human
ugauggggugcagaccccccucauggaguauggggcgcuggacacauggccggggcugcaccag

SEQ ID NO: 496455 - RNA, 64 nt, Human
uuuccauuucugcgccuuuucugucacccggguggcgcuggaaguuaucaguggcuagugaggu

SEQ ID NO: 496456 - RNA, 64 nt, Human
uguucaaaauacuacugacgcaggcaccuucuuggcgcuggagagucaaaggcaucucccuuca

SEQ ID NO: 496457 - RNA, 64 nt, Human
gcaguuccuccugcucuaccaggagcccuugcuggcgcuggauguggauuccaccaacagccgg

SEQ ID NO: 496458 - RNA, 64 nt, Human
gaaaaaggaccuuaguauuuagcauaaaauuccagcgcuggaugaaugcagaucuaguuugguc

SEQ ID NO: 496459 - RNA, 64 nt, Human
agcgccaccccaugcuccccaagaacgcggcucugcgcuggaaggcuuguggccucuugcuccu

SEQ ID NO: 496460 - RNA, 64 nt, Human
gugagcugugagugccuccuguggucucaggcuugcgcuggaccugguucuuagcccuugggca

SEQ ID NO: 496461 - RNA, 64 nt, Human
uggaauagaaaagaugagaggcagaggcagacaggcgcuggacagaggggcaggggagugccaa

SEQ ID NO: 496462 - RNA, 64 nt, Human
gggagagggacacuccuccucggaagagcccgucgcgcuggacagcuuaccuagucuuguagca

SEQ ID NO: 496463 - RNA, 64 nt, Human
acagcauuuugguaaaugccucagcauguuaggagcgcuggaacguuuauucucuucccuccca

SEQ ID NO: 496464 - RNA, 61 nt, Human
cccggcguaggcccugaggggcgcggccccugccccauacuggccucuuuugggcccucuc

SEQ ID NO: 496465 - RNA, 61 nt, Human
aacacauuuagcugcuuuuuuaacaaacucagccccauacuugagucccuuguuguuggga

SEQ ID NO: 496466 - RNA, 61 nt, Human
ccauggccccucuccacaccucaaaacuccugccccauaacguccuccgcauccacuuucc

SEQ ID NO: 496467 - RNA, 64 nt, Human
uggagaauggaaacaggccuucagcccauuggcugcgcuggagaggaaagcaugguuccuuucu

SEQ ID NO: 496468 - RNA, 64 nt, Human
cucacuggcaaaggcuaggcccggagcacccuaggcgcuggauuuugggacaaaacuauuuuuc

SEQ ID NO: 496469 - RNA, 64 nt, Human
cggccagcggcacggccugaggcggcgguggacugcgcuggacgauagcuuggagggauggaga

SEQ ID NO: 496470 - RNA, 64 nt, Human
cccuggcugccuugcugggcccuucugggacugugcgcuggacuuggagccccuuggaguaugg

SEQ ID NO: 496471 - RNA, 64 nt, Human
cgggcuagggacauggcagggccugggcauccuggcgcuggacuugggcgaccugggaggcaca

SEQ ID NO: 496472 - RNA, 64 nt, Human
aaguauaguaaauuugguucguuaaauugugaaggcgcuggaauuacaugaacauaccacccua

SEQ ID NO: 496473 - RNA, 64 nt, Human
cuggagaagggacaugggaaugaauugaaauggggcgcuggacaccuacagcagcacgcauguc

SEQ ID NO: 496474 - RNA, 64 nt, Human
ugcagccacgcgggggcgcgcgggagcucugcgggcgcuggaaccugcagacccggccucgguc

SEQ ID NO: 496475 - RNA, 64 nt, Human
ccaacaccauggcccucacaggcccaacugaccugcgcuggagcugcucuuaucuaggggggag

SEQ ID NO: 496476 - RNA, 64 nt, Human
uuggaagaaaacagccaaaguuggccuaaaauuggcgcuggaauuugggcugggaaaaaucuug

SEQ ID NO: 496477 - RNA, 64 nt, Human
caggccuaggagacuaggagggaaucuggagggggcgcuggaggagugcgaaacgggggaaggg

SEQ ID NO: 496478 - RNA, 64 nt, Human
gguagguauuuaaaaaguugagaaucugcuaacagcgcuggaaguuguuagcgcucuaaguaau

SEQ ID NO: 496479 - RNA, 64 nt, Human
gggcagcagcuccgaggccgacgagauggccaaggcgcuggaggcggagcucaacgaccucaug

SEQ ID NO: 496480 - RNA, 64 nt, Human
ggccccgcuggccacgccgcucccaucaccgcaggcgcuggagccuccaggcccaaacaggcug

SEQ ID NO: 496481 - RNA, 64 nt, Human
ccugugccucagucccgcggauggccaguagggggcgcuggaggacugcggggaucuagggccu

SEQ ID NO: 496482 - RNA, 61 nt, Human
cugugacuugguaacauucuaaacgguccuugccccauagccauccugauugcugauagug

SEQ ID NO: 496483 - RNA, 61 nt, Human
guccacgcccauguaccugaaacauuuggaagccccauaauuguucuaguuagaaaggguu

SEQ ID NO: 496484 - RNA, 61 nt, Human
cgccgccucugcauguaccacagccccccacgccccauagggaggccaagccccggaccau

SEQ ID NO: 496485 - RNA, 64 nt, Human
cucaggauuccugaugcuccaaggcgacugaugggcgcuggaugaaguggcacagucagcuucc

SEQ ID NO: 496486 - RNA, 64 nt, Human
ucuucuccacggcaucgccgccgcccgcguagacgcgcuggacgccgccuccucgccgcccaau

SEQ ID NO: 496487 - RNA, 64 nt, Human
auacuucaggaugagugaaggcuggagccagggagcgcuggaggaaaccagcccuuuagccagc

SEQ ID NO: 496488 - RNA, 64 nt, Human
ccagccugggacuggccagagcugggcccaagcugcgcuggaaucgcagcaggagaggggagug

SEQ ID NO: 496489 - RNA, 64 nt, Human
cgaggguguccgccggccccagcacccaggggacgcgcuggaaagcaaacaggaagauucccgg

SEQ ID NO: 496490 - RNA, 64 nt, Human
auguucgacccagagcagcaccccaaucaccugggcgcuggagguggcuuuggcccugugagug

SEQ ID NO: 496491 - RNA, 61 nt, Human
ggccccucuuugcuggcuggcugccucugcugccccauaccccacacacucaucagccuga

SEQ ID NO: 496492 - RNA, 56 nt, Human
gccugcaggaccaccuguagggaagggccccauaggcagagccccagggcagacag

SEQ ID NO: 496493 - RNA, 61 nt, Human
uaggccaucacauaugguggggcccaagagagccccauaugcacacugccugccugauacc

SEQ ID NO: 496494 - RNA, 64 nt, Human
uuuuuaacuuauugacaaccgagaagguuuaucccgccgauagagggacggccaagaauguacg

SEQ ID NO: 496495 - RNA, 64 nt, Human
aggccccugagggacgagcagagcgcagcccccacgccgauauaagccauagccccaggcccgc

SEQ ID NO: 496496 - RNA, 64 nt, Human
agugccagaccggaggugcgucauucaccggcgacgccgauacgguuccuccaccgaggcccau

SEQ ID NO: 496497 - RNA, 64 nt, Human
ucccccacuuccuuacuuuagcgggcugcaaugccgccgauaugauggcugggagcucuggcag

SEQ ID NO: 496498 - RNA, 64 nt, Human
aaccagacugugacauuucagccugaccaugaagacggcggaggccaggagacguucaacgcca

SEQ ID NO: 496499 - RNA, 61 nt, Human
cuggagguggaggaagggcguccaugccaaggccccauaccugggccgggggcagcacggc

SEQ ID NO: 496500 - RNA, 61 nt, Human
ggcaauuagagaaaggacugacaguggcggugccccauaggaugucauauugaggcccaaa

SEQ ID NO: 496501 - RNA, 61 nt, Human
ugucagacgauuguucuuagaccuccuaaaugccccauauuaaaagaacucauucauagga

SEQ ID NO: 496502 - RNA, 64 nt, Human
acuguguggugaccauggucaucauagugggcucacggcggaaacgggaucauucaaccuauac

SEQ ID NO: 496503 - RNA, 64 nt, Human
acggugacaaaggcugggugagccccugcugggcacggcggaagucacgaccucuccagccagg

SEQ ID NO: 496504 - RNA, 64 nt, Human
acccggccgugugagugcccgggugcugccagccacggcggaagcucccuuggaggcagcccug

SEQ ID NO: 496505 - RNA, 64 nt, Human
guguuuggcccucacauuuaaggugcgugugcguacggcggauuccgugcccaucucauguuuu

SEQ ID NO: 496506 - RNA, 64 nt, Human
agagagagaaaaaaccucaacuguguauuuugucacggcggaaaaucugcucgcaucgaagcau

SEQ ID NO: 496507 - RNA, 64 nt, Human
ggcgagcugggagccagccccaggcuccagggccacggcggagucaugguucucaggacugagc

SEQ ID NO: 496508 - RNA, 64 nt, Human
agagguccagaaugcccuggccagagcgagcaacacggcggaggagaccaucagugccaugaag

SEQ ID NO: 496509 - RNA, 64 nt, Human
acaaagagauuaccaccaccacccccuccuucagacggcggaguuauauucuggguuuuguaaa

SEQ ID NO: 496510 - RNA, 64 nt, Human
cucuacuaaaaauacaaaaacuuagcuggguguaacggcggaugccuguaaucccagcuacuug

SEQ ID NO: 496511 - RNA, 64 nt, Human
uugucuacaggagccaaggugaaagucucugaugacggcggaacuggcuccauuagaccauggu

SEQ ID NO: 496512 - RNA, 64 nt, Human
gaaggaaaggcggggcuccuuccucaaacaucggacggcggaauguggcagaugaaaugugcug

SEQ ID NO: 496513 - RNA, 64 nt, Human
gagaccaacgaaguggagauucgauacguggacuacggcggauauaagagggugaaaguagacg

SEQ ID NO: 496514 - RNA, 64 nt, Human
gagucuggccgccugcagggggguacccgggccaacggcggagggggcggggaagggagauucg

SEQ ID NO: 496515 - RNA, 64 nt, Human
ugcaaaauuucuuaaggaaggcacugaaagaaacacggcggaaucucuccaggagaagcucggc

SEQ ID NO: 496516 - RNA, 64 nt, Human
cagaggaaaagggccgggaucgugaccgggagcgacggcggagccaccggagcgagcgcgagcg

SEQ ID NO: 496517 - RNA, 61 nt, Human
gucuguugccgcacacauuccucucagcuccgccccauacccgucacuacagccucaccuc

SEQ ID NO: 496518 - RNA, 61 nt, Human
ugagugccucccuugccucacucugauccuggccccauaauguccucaguggaaggugaug

SEQ ID NO: 496519 - RNA, 61 nt, Human
caaugccgcgguggaaacgggcuuggagcuggccccauaagggcuggcggcuuccuccgac

SEQ ID NO: 496520 - RNA, 64 nt, Human
aggaggaggucgugggacggggagggugggauggacggcggacaggcaguccccacgcugcugg

SEQ ID NO: 496521 - RNA, 64 nt, Human
ccugccugagagcagagauggaggccuucuguucacggcggauucuuuguuuuaaucuugcgau

SEQ ID NO: 496522 - RNA, 64 nt, Human
gugcgugcguguguguucacguguucucgugcgggcgcgugaguggucuucaaacgaggguccc

SEQ ID NO: 496523 - RNA, 64 nt, Human
cugugcaguaaucgagauugggagaauuugggcagcgcgugagaagugcuaagcuacuuguuuu

SEQ ID NO: 496524 - RNA, 64 nt, Human
agucugaacuaaggccugagcuguggauaccauggcgcgugaguuagauguggucccugcccuc

SEQ ID NO: 496525 - RNA, 64 nt, Human
gacagcugcgggugcccaagcccuugcugggccugcgcgugaggagucccacugcuucuaaagg

SEQ ID NO: 496526 - RNA, 64 nt, Human
cggcugccugcguccauggucuaguggcagccgggcgcgugaggagcggcaggccuugaggcug

SEQ ID NO: 496527 - RNA, 64 nt, Human
gcaucagcagggaccccggcggacgugggcgggcgcgcgugagcucgggcugcccggccgggcg

SEQ ID NO: 496528 - RNA, 64 nt, Human
cuauaaccuagguaaagcauaaucugucagagaagcgcgugagaaauuugaaaugaaggcauuu

SEQ ID NO: 496529 - RNA, 64 nt, Human
cugugcuugcuccuaagcaaaagggaaaaggagcgcgcgugauagaagaaaagcacugggagaa

SEQ ID NO: 496530 - RNA, 64 nt, Human
cagagcuuuaaagaagugggacucagccauguuggcgcgugauugacauuacagcacagaaaac

SEQ ID NO: 496531 - RNA, 64 nt, Human
aaugaguugguagccucugugcacuguuugguggccacaucacaggugauguccuguucacaua

SEQ ID NO: 496532 - RNA, 63 nt, Human
ccagccuccagacccucuagaugcccucaguggccacaucaugcccacucccacuccauccug

SEQ ID NO: 496533 - RNA, 64 nt, Human
uuuaauaaucauaugucagcauucugacuacuuaccacaucaaaucugggcccaaacagccuca

SEQ ID NO: 496534 - RNA, 64 nt, Human
gcaacagcuggggugauggccugugagccacaggccacaucaggaacuuuccccacugccucca

SEQ ID NO: 496535 - RNA, 64 nt, Human
ccuccugaguagcugggaggacaggcauaugccaccacaucacugagaagaaauuuuugauugu

SEQ ID NO: 496536 - RNA, 64 nt, Human
uuggacaaaggaucagcacagcuggccuccagauccacaucaccacucuuccacucgauuguuc

SEQ ID NO: 496537 - RNA, 64 nt, Human
auccuggcccccugggcuugugaacaccuccuagccacaucacuacaguacagugagugacccc

SEQ ID NO: 496538 - RNA, 64 nt, Human
uguuuccauuggaaaauuauaucauuuuggguugccacaucaguuuauaaauuuggcgcucuuu

SEQ ID NO: 496539 - RNA, 64 nt, Human
guaccuaaaagagguaagagcaaaaaguguaauuccacaucauguuacuugagaagugcuuaac

SEQ ID NO: 496540 - RNA, 64 nt, Human
uuuuaaauauuuugccagauuucuuguauuuauuccacaucauuaugccuauaaugugccgcuu

SEQ ID NO: 496541 - RNA, 64 nt, Human
uauuuauuggcauguccaauuugcuugcacuuuuccacaucagaccuuccacuuaaggguacca

SEQ ID NO: 496542 - RNA, 64 nt, Human
aaaaacacuuuccuuucuacugacaaccaguccuccacaucacagcauuuagacauauggguaa

SEQ ID NO: 496543 - RNA, 64 nt, Human
gagguaaaggcuuucuggguauuugcugccaaggccacaucaccaauuuucucgauuuaaaaaa

SEQ ID NO: 496544 - RNA, 64 nt, Human
uccuccuuagagaggccugcuccagcuguucauaccacaucaguguuuccgucugcucaccugc

SEQ ID NO: 496545 - RNA, 64 nt, Human
auaaugaguuauugugacccacagcugugugggaccacaucacuuguuaauaacacaaccuuua

SEQ ID NO: 496546 - RNA, 61 nt, Human
ggcaaucaaggccugagcaaccaaaaggagugccccauauggcuuuucuaccuguaacaug

SEQ ID NO: 496547 - RNA, 61 nt, Human
uguauuuuaacucauuagugcauaaaggcaagccccauauaaugaagucucaggguauaug

SEQ ID NO: 496548 - RNA, 61 nt, Human
uccuagccaggcaccuuaggaguauagggaggccccauauagguccauccuccuaggauga

SEQ ID NO: 496549 - RNA, 61 nt, Human
gaaugugugccuuaaaggcccccuacaaggggccccauacgacagagcuuuuaacuggugc

SEQ ID NO: 496550 - RNA, 64 nt, Human
gagcacaggaguuugaggcugcagugaccuaugaccacaucacuguacgccagcccgggugaga

SEQ ID NO: 496551 - RNA, 64 nt, Human
ucucuuugagguggagagacccauaaagccuugaccacaucacuccauauggggaggagaagga

SEQ ID NO: 496552 - RNA, 64 nt, Human
ccagauagaaaauauaaagucucugaucuauaggccacaucaggauguuauuuuaugaagaguu

SEQ ID NO: 496553 - RNA, 64 nt, Human
cuuaugacuucuaaaaagugaaucuaucagcauuccacaucagauuuaaagcaucaaaugccug

SEQ ID NO: 496554 - RNA, 64 nt, Human
uaaaaugaagcugcaguguacguuacuugaaguuccacaucagaaaaucuuguccuuaggagaa

SEQ ID NO: 496555 - RNA, 64 nt, Human
caggaggaagagguugcagugagccaagaucaugccacaucacuccaaccugggcaacagaaca

SEQ ID NO: 496556 - RNA, 64 nt, Human
gggaugagcuaugaaggcucccugggaguguggcccacaucaguucaacauccucugguuuuuc

SEQ ID NO: 496557 - RNA, 64 nt, Human
uccugcccaggccuguuuuucucucccuuauuuuccacaucauuccuagcauaucaagaccaua

SEQ ID NO: 496558 - RNA, 64 nt, Human
aagauuugcuuuuugccaaguugcaaaguuguauccacaucaggucacuguaaaaauguauuau

SEQ ID NO: 496559 - RNA, 64 nt, Human
ucucacaacucaucuuucccuaagucaucaagcuccacaucacugaggucaaugucauccucca

SEQ ID NO: 496560 - RNA, 64 nt, Human
uuuuggaucccgaauuuugauguaccuuaaacuuccacaucacugcacccugaaacagagcaug

SEQ ID NO: 496561 - RNA, 64 nt, Human
gguuuuacaagaagacugauagucuuucaagcccccacaucacaggcuuagggacggcacuaac

SEQ ID NO: 496562 - RNA, 64 nt, Human
ggauuaacuaauacuuuauaggcuuuucaggaggccacaucacuagcaguagggagaacaagau

SEQ ID NO: 496563 - RNA, 64 nt, Human
aaaaauaugcauuucaccccacaugacuaggaauccacaucagaaugauacagaguuagcaggu

SEQ ID NO: 496564 - RNA, 64 nt, Human
gccugcugcgcagacguccaucacguuagcugucccacaucacaagacuaugccauugggguag

SEQ ID NO: 496565 - RNA, 61 nt, Human
ucuauccaaaacauuuuuggagcauuuuaaagccccauacacagaaguauacgaaagcaca

SEQ ID NO: 496566 - RNA, 61 nt, Human
ggauggaccagauuccucuggcuaacguauggccccauaggucacugggucauacagagag

SEQ ID NO: 496567 - RNA, 61 nt, Human
gggggcuggaaggcaccaggccucaggaggagccccauagucccgccugcagccuguaacc

SEQ ID NO: 496568 - RNA, 64 nt, Human; identical to SEQ ID NO: 300331

SEQ ID NO: 496569 - RNA, 64 nt, Human
gagggcuguaacaguugcugcuaguauuaggguuccacaucauucuaauguauaguuucaaguc

SEQ ID NO: 496570 - RNA, 64 nt, Human
gccuccucaccaacggcagugccaaaaucagcccccacaucaaggugguguucucugugcuuuc

SEQ ID NO: 496571 - RNA, 64 nt, Human
agauacacugacuuggugcaaggccaucugcuuaccacaucacaccacuuggagaucuuugcuu

SEQ ID NO: 496572 - RNA, 64 nt, Human
uuggacaaugccgauaaauguaugaaguuaguauccacaucauaaauucagagugauguuuagc

SEQ ID NO: 496573 - RNA, 64 nt, Human
cccauucuacuacccaccacugcccaccccacccccacaucacacacucuucgaugcuuuccca

SEQ ID NO: 496574 - RNA, 64 nt, Human
ccugcucaugguauguccccagugguuucuucauccacaucaucuaaagccugaacccguucuu

SEQ ID NO: 496575 - RNA, 64 nt, Human
aacccuuggagcaaacauaccucccuugugacucccacaucaaccauuaaaguuauuuaacagc

SEQ ID NO: 496576 - RNA, 64 nt, Human
agguguaauguaugugggaagaccacaucuuguuccacaucaggcaauaauuacuaaagagaau

SEQ ID NO: 496577 - RNA, 64 nt, Human
uuaauguguccagguuccccauauuauuacaguuccacaucaaggccgagugcaccgcccacca

SEQ ID NO: 496578 - RNA, 64 nt, Human
cacuguugacuaccucauuccugguuuuuggccuccacaucaucuuuuuucuuaauauuucaug

SEQ ID NO: 496579 - RNA, 64 nt, Human
caccacgaguccuuugaggcuccuggacagagacccacaucaagaucggaagcccuuugggugg

SEQ ID NO: 496580 - RNA, 64 nt, Human
uucuagacaucucaaaaugugguacucauaccauccacaucagaaucccuuguaggauuuucua

SEQ ID NO: 496581 - RNA, 64 nt, Human
gauuauucuuuaguucucagagguagggacaaaaccacaucagguuuucagaaggaaaaaacau

SEQ ID NO: 496582 - RNA, 64 nt, Human
ccacccgcuagcaguggcgauucagguucucuugccacaucaauaucccagaugguaaagacug

SEQ ID NO: 496583 - RNA, 64 nt, Human
aaccacccagacaucugcuuccacccagccaagcccacaucacaucuccuggccgagagcagcc

SEQ ID NO: 496584 - RNA, 61 nt, Human
uuaaaucucuuuaaugagugaauccaugcaagccccauaaaacaguuccuagcaugcagaa

SEQ ID NO: 496585 - RNA, 61 nt, Human
ugcauuuaugaugcuaaaacagaucccuucugccccauauuccgucuuggcaaaauagugg

SEQ ID NO: 496586 - RNA, 61 nt, Human
auguaauaaauaaaacaauaugagcauaauugccccauaaagaacucauguccugaauuaa

SEQ ID NO: 496587 - RNA, 61 nt, Human
cacgugguguugggacuggaaccauuaugcggccccauaggccucaggagucaucccagaa

SEQ ID NO: 496588 - RNA, 64 nt, Human
ccaucagauaccugugggggaagaucagcgacugccacaucauugaaguggagcccggcacagg

SEQ ID NO: 496589 - RNA, 64 nt, Human
agccaggcccauagugcuugcugggcucucucuuccacaucauccagaagacacacauuugcua

SEQ ID NO: 496590 - RNA, 64 nt, Human
uccuauagucacucaagaagucgaucgagaaguuccacaucaucuuaucggugagcaauauucu

SEQ ID NO: 496591 - RNA, 64 nt, Human
uugugcagaacuggagucuuuacugacccgcuuuccacaucagcccaaggucuuuuuaaugccu

SEQ ID NO: 496592 - RNA, 64 nt, Human
ccacaugguggcaccagcaccacuccuuuccuuaccacaucaacugauuaaagcagugaccagc

SEQ ID NO: 496593 - RNA, 64 nt, Human
cuugugggggcaccugggaggucaaaggucuccaccacaucaaccuauuuuguuuuacccuuuu

SEQ ID NO: 496594 - RNA, 64 nt, Human
aaaugacacuuaaaacaaucacugaaaacuugauccacaucacacccuguuuauuuuccuuaaa

SEQ ID NO: 496595 - RNA, 64 nt, Human
caaaugucagaagcuuggcaugaccucauuccggccacaucauucugugucucugcauccauuu

SEQ ID NO: 496596 - RNA, 64 nt, Human
ggaaaaacccaucauucuaaucuagcuuguauccccacaucaugagaaagagggaagaagaaga

SEQ ID NO: 496597 - RNA, 64 nt, Human
cagcagucuucaacauuugguugcaaaucuccauccacaucagggagcuuuccccaggcaaaua

SEQ ID NO: 496598 - RNA, 64 nt, Human
ggcaguagcugcuuuugucauaaauaucuuccuaccacaucaaaaaugcugcuuuuaaaauuuu

SEQ ID NO: 496599 - RNA, 64 nt, Human
ugcaccuauaaauuauggagcauuguagauuuuaccacaucaauucauagcaguaacuuuaaga

SEQ ID NO: 496600 - RNA, 64 nt, Human
agauucuuucaguucuuuggauucuaaauacaugccacaucaaaccuuugaguagauccauuuc

SEQ ID NO: 496601 - RNA, 64 nt, Human
uguauuuucaugaaaauaccauuuaguaagaauaccacaucaaauaagaaauaaugcuacaauu

SEQ ID NO: 496602 - RNA, 64 nt, Human
gcuggucuugaacaacugggcuuaagcaauccucccacaucagacuccccaagugcuaggauua

SEQ ID NO: 496603 - RNA, 64 nt, Human; identical to SEQ ID NO: 300334

SEQ ID NO: 496604 - RNA, 64 nt, Human; identical to SEQ ID NO: 300335

SEQ ID NO: 496605 - RNA, 64 nt, Human; identical to SEQ ID NO: 300336

SEQ ID NO: 496606 - RNA, 64 nt, Human; identical to SEQ ID NO: 300337

SEQ ID NO: 496607 - RNA, 64 nt, Human
ugcucuuaaacucuagcagggaacucuccucuuaccacaucagcauguaaggugaauaauaacu

SEQ ID NO: 496608 - RNA, 64 nt, Human
guaauaaugcuaaagaaaaagucauccaaucuaaccacaucaauauugucauuccuguauucac

SEQ ID NO: 496609 - RNA, 64 nt, Human
uucugggaacuauuuauugagcaggccugugccuccacaucaucuuguugucucuggggugugg

SEQ ID NO: 496610 - RNA, 64 nt, Human
aacucagggcucacaggccagcaguccaugucagccacaucaggcacauggaacacagugcuau

SEQ ID NO: 496611 - RNA, 64 nt, Human
cugcuguaacauuucccaccaacucucuugcuguccacaucaacagcuaaaucauuuauucaua

SEQ ID NO: 496612 - RNA, 64 nt, Human
augagauaugugggaaggccuuuugcaagugggcccacaucagucaacgucagagaacuuaaac

SEQ ID NO: 496613 - RNA, 64 nt, Human
auguaaaugcuguggaccacugggagcacaaugcccacaucaucuuaagaagaguuuaugugca

SEQ ID NO: 496614 - RNA, 64 nt, Human
uuauugugguggauagccaagcacauugggaucuccacaucaaauacugacauuucuucuacag

SEQ ID NO: 496615 - RNA, 64 nt, Human
cuuuuuuccuuccagccuggauguucggggacccccacaucaccaccuuggauggugucaguua

SEQ ID NO: 496616 - RNA, 64 nt, Human
uucucuguuuccucaggaagucauuacugcgccaccacaucacaugaccuuaacaugaucaaug

SEQ ID NO: 496617 - RNA, 64 nt, Human
uaacuuauuccauaaaaugacaguuguguccuagccacaucagacagcuaucuaagcucuggac

SEQ ID NO: 496618 - RNA, 64 nt, Human
cauuccaggaccuucauuugcauaagguaucaaaccacaucagccucugauuggccaugggcca

SEQ ID NO: 496619 - RNA, 64 nt, Human
gcuugcuaauuggggaugcuucuuagagcaucuuccacaucaacuccccuggcugcuggcuacc

SEQ ID NO: 496620 - RNA, 64 nt, Human
caacucaguugguuuuuaaauggaugcauacaguccacaucauacaauaaaauaaaagguaauu

SEQ ID NO: 496621 - RNA, 64 nt, Human
uugucuaccauguuuucuuuucuagcugaauaaaccacaucaaaggaaagggaccacaguauuu

SEQ ID NO: 496622 - RNA, 61 nt, Human
gcaaugagucugguggggggcacguggacaugccccauaggggccccacccagacuuaaca

SEQ ID NO: 496623 - RNA, 61 nt, Human
uuuauucuguuucacccuacuccuccagugagccccauauuuugggaaauuaucugccuua

SEQ ID NO: 496624 - RNA, 61 nt, Human
agguauauuuuauucugggcaccacacauuugccccauagauaacaauacacgugaugaug

SEQ ID NO: 496625 - RNA, 61 nt, Human
agaggaugagaggaagguguuaguuccaucagccccauaaaauuaugaaccuuuuugcaac

SEQ ID NO: 496626 - RNA, 64 nt, Human
ugacaggcgccgccucgcccccgggcccuuucguccacaucaaaaaugcaucaagucuccacgu

SEQ ID NO: 496627 - RNA, 64 nt, Human
ucacgucccuuccugucucggucugcggucuuuaccacaucaauaggacuuuuuaugcguccgg

SEQ ID NO: 496628 - RNA, 64 nt, Human
gccuguuuaaaaagucauuuuaaagguagaguguccacaucaggcaccauuugugauaugacuc

SEQ ID NO: 496629 - RNA, 64 nt, Human
uacaauaguguggaaagccacaucacaaaaaaagccacaucacaaaaaaaagccagugccuauu

SEQ ID NO: 496630 - RNA, 64 nt, Human
augggauucuggacuucuacaauaguguggaaagccacaucacaaaaaaagccacaucacaaaa

SEQ ID NO: 496631 - RNA, 64 nt, Human
uaaaucugcugaggccacugcugguuauuuuaagccacaucacacuugcuuccacuugccgggc

SEQ ID NO: 496632 - RNA, 64 nt, Human
cacagccgaccagcagccaccccgccugcuucauccacaucaggaggguccggugaggcugcag

SEQ ID NO: 496633 - RNA, 64 nt, Human
agagaauaguuuugacuuaacaugucuguuuagcccacaucacgucaguuaucaacaccgccac

SEQ ID NO: 496634 - RNA, 64 nt, Human
gaacauaauuucauuaucccucaaaaaguuaccaccacaucagaaaaaauaaaaaaaaaauagu

SEQ ID NO: 496635 - RNA, 64 nt, Human
gaagccagugaucugcaagcauuugcucuuguuuccacaucaccucugggauauuucagcuguu

SEQ ID NO: 496636 - RNA, 64 nt, Human
accccacuggaauuuuauuucucucaggugcgugccacaucaauaacaacaguuuuuauguuug

SEQ ID NO: 496637 - RNA, 64 nt, Human
uauuauuauugaucacauuuugauuuuuuucucuccacaucaggauaguuuacugaagcacaau

SEQ ID NO: 496638 - RNA, 64 nt, Human
uagcaccugccuguccuuccugggccccuccuugccacaucaugagcugaggugggaccacagu

SEQ ID NO: 496639 - RNA, 64 nt, Human
cagagacuucguggaucacagcugcagcucaccgccacaucacaggauccguuaacguuaauac

SEQ ID NO: 496640 - RNA, 64 nt, Human
augaacaccccugacucuggagugguguauacugccacaucaguguuugagucaguccccagag

SEQ ID NO: 496641 - RNA, 61 nt, Human
ucugagccuccccugugccuugggcccugaagccccauauguaguauagagcaaagguggc

SEQ ID NO: 496642 - RNA, 61 nt, Human
cuuuuccucaccccaguagauccaaccuccagccccauauagggugaaccucuugauaagc

SEQ ID NO: 496643 - RNA, 61 nt, Human
agauccccuucagcccccugccagagucacugccccauaaucaccaugucagaagggaccc

SEQ ID NO: 496644 - RNA, 61 nt, Human
agcauccuaggcucagcuuaccgggugauaggccccauaagacacacacaugagcagggug

SEQ ID NO: 496645 - RNA, 64 nt, Human
cauguccauccaaaaaccauaaaaucacuggguuccacaucagccuccaugaggccaagccuug

SEQ ID NO: 496646 - RNA, 64 nt, Human
uguggaaaaaaugcuuuaaaaguacuuacuauaaccacaucauaagaauucuggaaaaauagag

SEQ ID NO: 496647 - RNA, 64 nt, Human
agaguggcugcggccccuauuaccuuuguagcagccacaucagaaagcagaagaaaacaguauu

SEQ ID NO: 496648 - RNA, 64 nt, Human
gaaguucugcuacaaccucuagaucugcagcuugccacaucagcuuaaaaucugucaucccaug

SEQ ID NO: 496649 - RNA, 64 nt, Human
aaggugaaguucaaugaugcucuugauuuuaaucccacaucauguaucacuuuuuucuuaaaua

SEQ ID NO: 496650 - RNA, 64 nt, Human
ugaaagacacggcacaaaucucaauauucaucucccacaucaccuucccugggaacuggacagg

SEQ ID NO: 496651 - RNA, 64 nt, Human
caauggccucgugucccccccuaccccgcaacacccacaucaccuccccaccacccggccgggg

SEQ ID NO: 496652 - RNA, 64 nt, Human
guaauguccauuuccaucuuccccgucucccuuuccacaucaaggcacaucagacuucucagag

SEQ ID NO: 496653 - RNA, 64 nt, Human
uguugcaguuuaaaguuaaagugacuuuuaaaggccacaucaccugagacuaggguaaucaucu

SEQ ID NO: 496654 - RNA, 64 nt, Human
aggaagaaccugccaagcuuggucaucuaugacgccacaucagcacaguaggaccccagaaaag

SEQ ID NO: 496655 - RNA, 64 nt, Human
ccucaccuuccagccccagcugagcagccccuccccacaucaucuucagcugcugcccaggcuc

SEQ ID NO: 496656 - RNA, 64 nt, Human
ugcugugcuucccgccguggagggcagagccaccccacaucaggaucggacgugcuaccccucc

SEQ ID NO: 496657 - RNA, 64 nt, Human
ucccguuacacuacuacucagcccucuccugcggccacaucaacggaugcaagucacagucuua

SEQ ID NO: 496658 - RNA, 64 nt, Human
auccaaauaacauuguucccauccuccccacccaccacaucaaaacauaacacaucacagcacu

SEQ ID NO: 496659 - RNA, 64 nt, Human
cuggaacauccccagagugaaagauggagcugggccacaucagaauaaggccuuggccccaucc

SEQ ID NO: 496660 - RNA, 64 nt, Human
agaauguauucaucugcuucuuggguuuaagcacacaccugaaggggagauauugggggacacg

SEQ ID NO: 496661 - RNA, 64 nt, Human
uuaccaucaaguacacacuguuggcaaaaggcuaacaccugacuuuagaaaaugcugauuugag

SEQ ID NO: 496662 - RNA, 64 nt, Human
gugugaacugaacgcugaucaguauuuuuuaucaacaccugagaacuguuacaccuuuuauuuu

SEQ ID NO: 496663 - RNA, 51 nt, Human
aaauccgggcagagagguaaaacaccugaaugccaggaaacaggaagauua

SEQ ID NO: 496664 - RNA, 64 nt, Human
accuccccuuccccuuuccugccccaaggcagauccacaucaccgaagcucccuagaggggcaa

SEQ ID NO: 496665 - RNA, 64 nt, Human
accggugcccgcgagacagaaagaacaaugucagccacaucaggaccgcuggggcuucgagucu

SEQ ID NO: 496666 - RNA, 64 nt, Human
cacgagccugggcgaccaccgggugacauccgucccacaucagggcggccucccaggucccaua

SEQ ID NO: 496667 - RNA, 64 nt, Human
aggucaacccccaccggaccuacaacccgcagucccacaucaucucaggcgggcuggccggggc

SEQ ID NO: 496668 - RNA, 64 nt, Human
caugguauuuauuuguuauucuucaaugacccuuccacaucaacaguauuuaucauguguuaaa

SEQ ID NO: 496669 - RNA, 64 nt, Human
gucauucaaaaaaaaaguaauuggcauacauauuccacaucaucgauccucucugugguguuaa

SEQ ID NO: 496670 - RNA, 64 nt, Human
cuuuucacuguguuuaauuugggaaaauccagauccacaucauuguagagucugaggguuagaa

SEQ ID NO: 496671 - RNA, 64 nt, Human
cauuuacugagugucugucagggaucauucacauccacaucauccucccggccccuccccgugu

SEQ ID NO: 496672 - RNA, 64 nt, Human
ucuguaacaaauugggaucugucuuggcauuaaaccacaucauggaccaaaugugccauacuaa

SEQ ID NO: 496673 - RNA, 64 nt, Human
gaaaauaauccuuugucagaaaagaagguagcuaccacaucauuuugaaaggaccaugagcaac

SEQ ID NO: 496674 - RNA, 64 nt, Human
ccccaaaucaacagaauauacauucuucucagcaccacaucacacuuauuuccacauugaccac

SEQ ID NO: 496675 - RNA, 64 nt, Human
aaaauucauugucucuagagauugucagcuugguccacaucaccagaaaucuaacucccugaaa

SEQ ID NO: 496676 - RNA, 64 nt, Human
agugauugauccuuaccuuguauaucaucuucgaccacaucagaaagaaggaaucauauuccuu

SEQ ID NO: 496677 - RNA, 64 nt, Human
gccacauggagacucaaauucgcaucuucucuauccacaucaugaccaaaggaaccccucccug

SEQ ID NO: 496678 - RNA, 64 nt, Human
gauaggaagugccccagggugagaacgugcccagccacaucaucuuuaucuccugggauuuuca

SEQ ID NO: 496679 - RNA, 64 nt, Human
acguuuaugcauuucaugaugggguccaacaagaacaccugacuugggugaaguugugcaauau

SEQ ID NO: 496680 - RNA, 64 nt, Human
uaagcaccucccgcuccggugaccccauccuugcacaccugacucugucacucaagccuuucuc

SEQ ID NO: 496681 - RNA, 64 nt, Human
uucuaauaccuauguccugagcccugacacucccacaccugagccucagauuccaauagcucac

SEQ ID NO: 496682 - RNA, 64 nt, Human
gcagggaaugaagaagguacugugggccauggccacaccugaugcguuuuuggugggcuuacuu

SEQ ID NO: 496683 - RNA, 64 nt, Human
auucuauuuccuuaagucccuggcacuucucauaccacaucacugaaccuguucaguaacaauc

SEQ ID NO: 496684 - RNA, 64 nt, Human
auguguugaaauauuuauauguacuuugaucucuccacaucacuuauaacuuauguguuuuauu

SEQ ID NO: 496685 - RNA, 64 nt, Human
cagacccaacucuuagagggcacaucaccaggcuccacaucacgggaagugagauggauuucuu

SEQ ID NO: 496686 - RNA, 64 nt, Human
ccaggcugaccccaccagccagucagcuacaacuccacaucaacuccacaugcgcccagcucga

SEQ ID NO: 496687 - RNA, 64 nt, Human
agcggcuucuguuggcuccuaggggugugaaucaccacaucaccugcagggggcgcggcugucu

SEQ ID NO: 496688 - RNA, 64 nt, Human
gaggucccuuucucccucggugaaacacaguccuccacaucaauuuccaaacaaugaauuaggu

SEQ ID NO: 496689 - RNA, 64 nt, Human
uuguggaaugaugcccuggcuuuaagguuuagcuccacaucaugcuucucuugagaauucuauu

SEQ ID NO: 496690 - RNA, 64 nt, Human
gguaaauaggcucuuaccacuugcaaauaacuggccacaucauuaaugacugacuucccaguaa

SEQ ID NO: 496691 - RNA, 64 nt, Human
aucuuccgcuuccuccccaccgauuucagcguguccacaucacagcucccuccagaagcugcaa

SEQ ID NO: 496692 - RNA, 64 nt, Human
uauaaagagaggucuacguauguagcauauaaaaccacaucacuaaguaauagacccacagcuu

SEQ ID NO: 496693 - RNA, 64 nt, Human
gguggccaucccugucuccaucuucuauagugugccacaucagaagcacuuugaccacuauauc

SEQ ID NO: 496694 - RNA, 64 nt, Human
gaaaucugccuagaggauauauguaaggaagauuccacaucaugaguacuugccuuuuaacuuu

SEQ ID NO: 496695 - RNA, 64 nt, Human
cuucugucaaauuauaugguuauuuuuuauauuaccacaucagcauuauauuaaaaguguuuuu

SEQ ID NO: 496696 - RNA, 64 nt, Human
agggcucacaagacacauuugucccccgggcccaccacaucauccucacguguucgguacugag

SEQ ID NO: 496697 - RNA, 64 nt, Human
cgcugccuaugaccgccacuaguuaccgcggggaccacaucaagcuucaggccgacagcuucgg

SEQ ID NO: 496698 - RNA, 64 nt, Human
aacuggcuguaaccccaaauccaagccauuaacuacaccugacaguagcaauugucugauuaau

SEQ ID NO: 496699 - RNA, 64 nt, Human
uagacauccgcgaggucagaugcuuuccaacaugacaccugaacaucuuccuuuaugcaacacc

SEQ ID NO: 496700 - RNA, 64 nt, Human
aaacgggcuccuuccccugcaccuggccugggccacaccugagcgcuguggacuguccugagga

SEQ ID NO: 496701 - RNA, 64 nt, Human; identical to SEQ ID NO: 300341

SEQ ID NO: 496702 - RNA, 64 nt, Human
aaacucaguuuuaggaugaaaccauuguugauauccacaucagucccuguuuagaaaacauuua

SEQ ID NO: 496703 - RNA, 64 nt, Human
guaguuuaaguauguuaaauguggaucuuuuacaccacaucacagugaacacacuggggagacg

SEQ ID NO: 496704 - RNA, 64 nt, Human
ggagaaaaguguuccuuguguuuucaacucauagccacaucaaacauuuuccuuuuguauguac

SEQ ID NO: 496705 - RNA, 64 nt, Human
cuccagccccggcucaguucagggaaaugcuguuccacaucagcccucugcucucugaggcagc

SEQ ID NO: 496706 - RNA, 64 nt, Human
aaaauaucaucuugaauuguaaucccuauaauccccacaucaagggagagaucagguggaggua

SEQ ID NO: 496707 - RNA, 64 nt, Human
cuaggguuuccccaacacgugcgugcauaugaaaccacaucaugauucccgacgugaguuagau

SEQ ID NO: 496708 - RNA, 64 nt, Human
acuugguuuguguuuuagguuaaguagucaaugcccacaucacuucacugucucaagacugagc

SEQ ID NO: 496709 - RNA, 64 nt, Human
guaggggcacagugaauguguguauguaugaaggccacaucaacuuuauguagcaaagggcuug

SEQ ID NO: 496710 - RNA, 64 nt, Human
uccucuucuccucaccgcauuccaccugcaucccccacaucacccugaagaugacuuccugagc

SEQ ID NO: 496711 - RNA, 64 nt, Human
accccuuccuucugccuccagggccugucugccuccacaucacucugaggacagggacaggcaa

SEQ ID NO: 496712 - RNA, 64 nt, Human
aguggaguggugacacgugccagcggucacucugccacaucacuuccuucuugaaagccuaaga

SEQ ID NO: 496713 - RNA, 64 nt, Human
gauaaccggauuucugcucuuuccccugucacucccacaucacacagaaaaauggcauuccucu

SEQ ID NO: 496714 - RNA, 64 nt, Human
aagccugaaagcauuuccugcuucuacaagugugccacaucaauccgguaaugccccaguguua

SEQ ID NO: 496715 - RNA, 64 nt, Human
cccugggccuuucccugugggagggcccuguagaccacaucaggguggggugggggucacuugg

SEQ ID NO: 496716 - RNA, 64 nt, Human
uguuuccuugccccgucgcauuaaugaggcccuuccacaucauuuuuaaacuaauguuuuucua

SEQ ID NO: 496717 - RNA, 64 nt, Human
gauugcugagagccauuuuccuuuacacauaacuacaccugacaccaggcucugcuggauguga

SEQ ID NO: 496718 - RNA, 64 nt, Human
aguagaacggaacuuggggcugguuugguuuuugacaccugaaaugcgaacgcuaugugcuaaa

SEQ ID NO: 496719 - RNA, 64 nt, Human
augaugcuaguucuuacgcuugacaguuacuuacacaccugagaaugugccucucaguaucuua

SEQ ID NO: 496720 - RNA, 64 nt, Human
aguaugcuaaguguacaauauauuuuuuaauuuuacaccugaaacaaagaaauguggucacuaa

SEQ ID NO: 496721 - RNA, 64 nt, Human
agggguccaccucccuuuauaaaccccaccagaaccacaucauuaaaagguuugacugcgcacc

SEQ ID NO: 496722 - RNA, 64 nt, Human
ucacggugaugaaccucuggccucaggauuggccccacaucaccacgccaacaggaccacagcg

SEQ ID NO: 496723 - RNA, 64 nt, Human
ccaggaguccacagacugaugugaccucagguucccacaucaguggccacagggcagggcccac

SEQ ID NO: 496724 - RNA, 64 nt, Human
aaggagaaagcagggcagaaugaugccuagaggaccacaucaggcauggcugacagcuugugcc

SEQ ID NO: 496725 - RNA, 64 nt, Human
gcacaagccaugcuggcucagucugagcugugggccacaucagcuaguggcucuucucaugcau

SEQ ID NO: 496726 - RNA, 64 nt, Human
gacugaccucucaccuccgccuguuguuccugcaccacaucagauaagcaugugaaggagggcc

SEQ ID NO: 496727 - RNA, 64 nt, Human
cguauucuguuuuucuaucaguucgacaugaaguccacaucacaugcuguucuuuucuaguuac

SEQ ID NO: 496728 - RNA, 64 nt, Human
gcugucagugcuucucucacuccuuaguugggguccacaucaguauuggaguuuuguucuuuau

SEQ ID NO: 496729 - RNA, 64 nt, Human
uuucuaaugcuugggcaggugguuacugcauguuccacaucagucaaugcaacuuaggacaaaa

SEQ ID NO: 496730 - RNA, 64 nt, Human
cagagaaaaugaaggaaggccacaagcucagagcccacaucaacacugccccccucccagcacc

SEQ ID NO: 496731 - RNA, 64 nt, Human
acucuggguuccauuugugggagggagggcucauccacaucauggagacuugcuggaugcccca

SEQ ID NO: 496732 - RNA, 64 nt, Human
aggacuuccuuuuaauggaggaugggcuuuuaaaccacaucaucuuguacaacaaccauaucua

SEQ ID NO: 496733 - RNA, 64 nt, Human
aagaacagagaggaggaggagggagaaauggccaccacaucaccccagagaaauuucuggaauc

SEQ ID NO: 496734 - RNA, 64 nt, Human
acuagcauagcaguguacagcuugaagagauguuccacaucaucacuccagcuccuucucuuuu

SEQ ID NO: 496735 - RNA, 64 nt, Human
cucugucugccauuuauuagccaugugaacuuggccacaucacuucaccucccugagccucagu

SEQ ID NO: 496736 - RNA, 64 nt, Human
uuggaaggcgcucuugguaaagaauaacccacaaacaccugaucuugauuggaaagcauuguag

SEQ ID NO: 496737 - RNA, 64 nt, Human
aaaaaaaacagucaauauggauuuagaaaaaggaacaccugaugaagaaaaggagagguagaua

SEQ ID NO: 496738 - RNA, 64 nt, Human
cgugagaguguucucuugggaaaugacuggggagacaccugaaaggagcaaccuccagauguuc

SEQ ID NO: 496739 - RNA, 64 nt, Human
aaaaagguuuaaagcuuauuucccuuucuuauacacaccugaauaaaauugaugugcauguuuu

SEQ ID NO: 496740 - RNA, 64 nt, Human
uauucuucaaauaaaguaaaaugugaaacucaacccacaucaccaccuggaaucagggauugcu

SEQ ID NO: 496741 - RNA, 64 nt, Human
gagguauugaucacagcagccgaagcaccagugcccacaucagggggcuaccaccaugauuccg

SEQ ID NO: 496742 - RNA, 61 nt, Human
gaccuuguuggcaagucugauaccuguugguccacaucaucuuuucagaagaaaauaaaag

SEQ ID NO: 496743 - RNA, 64 nt, Human
augcauuuuauuuuagacacaaagcuuuauuuuuccacaucaugcuuacaaaaaagaauaaugc

SEQ ID NO: 496744 - RNA, 64 nt, Human
aauaguggcugccaguugugcuggcguaaguggcccacaucauggggaaggagugcugugauug

SEQ ID NO: 496745 - RNA, 64 nt, Human
gacguauuuccuguuguagucauuuuuagcucgaccacaucaucaggucuuugccaccgaggca

SEQ ID NO: 496746 - RNA, 64 nt, Human
uuuuugaacaauggaacggaucacugcuuuuuugccacaucacauaguaacugccgguccagaa

SEQ ID NO: 496747 - RNA, 64 nt, Human
agguuugccucugcuuuuguucccugccuuuccgccacaucacacggccucacugggcuuccua

SEQ ID NO: 496748 - RNA, 64 nt, Human
agagccauacugccuugggucaguccagcccccuccacaucacugagccaucaaugagcugaga

SEQ ID NO: 496749 - RNA, 64 nt, Human
uucuugagaaggaucuaauuuuucuguauauagcccacaucacacuugcuuugucuuguauguu

SEQ ID NO: 496750 - RNA, 64 nt, Human
uuauuaccaacacacuggcuggaaaagggacaaaccacaucacgggugagugauacuucucagu

SEQ ID NO: 496751 - RNA, 64 nt, Human
gaauaccaacaagguugcaacguuuacauuauagccacaucaacagaaguaacugguauauucu

SEQ ID NO: 496752 - RNA, 64 nt, Human
ugaagaugggacuccuuggguaucaagaccuaugccacaucacacuggggcuagggaaguaggu

SEQ ID NO: 496753 - RNA, 64 nt, Human
agagguauggagccaagucuucuagguugcuugcccacaucacucuaucucuggccucugauuc

SEQ ID NO: 496754 - RNA, 64 nt, Human
auuuaaggaagaaaacagacuuuucucaaauggaccacaucaucucucacucacagugacaaug

SEQ ID NO: 496755 - RNA, 64 nt, Human
uggccaugaggagaagauggaaaauggucagaucacaccugauggcuuccugucaaaaucugcu

SEQ ID NO: 496756 - RNA, 64 nt, Human
aagaaaaaacaaacucugcucagacgccuaugaaacaccugaaugaacuuugaugaaguacagu

SEQ ID NO: 496757 - RNA, 64 nt, Human
cacuuugguuuugggguguuccugauaauugugcacaccugaguucacagcuucaccacuuguc

SEQ ID NO: 496758 - RNA, 61 nt, Human
cuugauuuuuauuuguuacagguuuccaauggccccauaggaauaagcaauaauguagacu

SEQ ID NO: 496759 - RNA, 64 nt, Human
caaaaaaauaaauaaaugaguacaucuccccuucccacaucacucaaggcauaagcagauuuua

SEQ ID NO: 496760 - RNA, 64 nt, Human
ucuucccccagggcuucccaagcucuuuccacagccacaucagucagggcauggcuccaaucca

SEQ ID NO: 496761 - RNA, 64 nt, Human
ggcgggacgcauccauguuaaaugacgagcugucccacaucaacgcgcggcugaacaugggcau

SEQ ID NO: 496762 - RNA, 64 nt, Human
augauugccucuggaacuauucuucuagacuaucccacaucagaaucacugggaaauuuaaguu

SEQ ID NO: 496763 - RNA, 64 nt, Human
ggaggaaaaugaaaaugcuucuagaaugagugaaccacaucauagcucucacuguuuuuucaau

SEQ ID NO: 496764 - RNA, 64 nt, Human
caguggacauggugugggugacaucagaagggugccacaucaguccccuccccaaccucaguga

SEQ ID NO: 496765 - RNA, 64 nt, Human
ggucucaucccacaaccccugacuuccucccuccccacaucaugaaggcagaggcaugcacauu

SEQ ID NO: 496766 - RNA, 64 nt, Human
uccccugccggggucccuggaaacagugcccaccccacaucacuacauucccucggcccguguu

SEQ ID NO: 496767 - RNA, 64 nt, Human
uccaggaauggugcuuuaugugagauaccccacuccacaucaacauuccagggaugagccaaac

SEQ ID NO: 496768 - RNA, 64 nt, Human
aacucaaggguuuuccagguguagcuaacaguugccacaucacacagaccucgaguuucuggua

SEQ ID NO: 496769 - RNA, 64 nt, Human
uuuguaaucgccaagcaccagcuauaggucacagccacaucacucacagcugaucacugguugg

SEQ ID NO: 496770 - RNA, 64 nt, Human
ucacagggugccugugagaaaggacauuuuacccccacaucauagucacaucacugacuccuag

SEQ ID NO: 496771 - RNA, 64 nt, Human
uggcugugcuggccaggugacuccuaguucuuggccacaucaucagaaagucaaaggucucacu

SEQ ID NO: 496772 - RNA, 64 nt, Human
cuggcuccucggcagagcugccucccgucagggcccacaucaucuaggcuccccagcccccacu

SEQ ID NO: 496773 - RNA, 64 nt, Human
agggccauggcuggucccccaccauaccuccccuccacaucacugacacagcugagcuuguuau

SEQ ID NO: 496774 - RNA, 61 nt, Human
uugaauuguuuucugccuacaccguucaucagccccauaacccaggaaggaacaggcauug

SEQ ID NO: 496775 - RNA, 61 nt, Human
cacguuagauuugccguaccaaucucugaaugccccauaauuauuauuuccaguguuuggg

SEQ ID NO: 496776 - RNA, 61 nt, Human
uaugaaaaugguguacuguauacuuuaacaugccccauacuuuguauuggagaguacaaua

SEQ ID NO: 496777 - RNA, 61 nt, Human
cuggaugcagaaguacccauucaucacaccugccccauagcccccacucugcuguacugau

SEQ ID NO: 496778 - RNA, 64 nt, Human
aacauguguuccauggcugggaauugccuaccacccacaucagcuucuguuuaccuuuuuggca

SEQ ID NO: 496779 - RNA, 64 nt, Human
gugcucuacaccuuagugcagcgcuucuaugcagccacaucacggcaacugaagcggcuggaau

SEQ ID NO: 496780 - RNA, 64 nt, Human
uuauuuuagaagaaaguggaugaucagcucacuaccacaucaaaggugccaacucucuaaaacg

SEQ ID NO: 496781 - RNA, 64 nt, Human
aucacguaucgcagggcuccagcuguuuuagaagccacaucauguuaaacauuaacugguuugg

SEQ ID NO: 496782 - RNA, 64 nt, Human
uuggaucaccuauguuaaaaccuuauuucacauuccacaucauuuuagaauuuauuuucgaagg

SEQ ID NO: 496783 - RNA, 64 nt, Human
accccagcuggagcccacaccuaagggcuggcauccacaucauuucacccugcagugagggaag

SEQ ID NO: 496784 - RNA, 64 nt, Human
caacgggaaauuuguacauugggugcuaucaaugccacaucacagggaccagccaucacagagc

SEQ ID NO: 496785 - RNA, 64 nt, Human
uuuggggaacaugacucccuuuuacuccccuaccccacaucacuuaauuuauuuccguuuuugu

SEQ ID NO: 496786 - RNA, 64 nt, Human
uaguucuguguucacguggcccccgacuccucagccacaucaagucuccuagaccacuguggac

SEQ ID NO: 496787 - RNA, 64 nt, Human
uucccaacaagcgcuagccuguaauuguagcuuuccacaucaagaguccuuauguuauugggau

SEQ ID NO: 496788 - RNA, 64 nt, Human
cugauauaacucaggcugcaauuccauccaguucccacaucaacggagccacacauuuggcacu

SEQ ID NO: 496789 - RNA, 64 nt, Human
guuccaucugccugccaacccaucggaaaggaauccacaucauauuggagaugaccccaucaac

SEQ ID NO: 496790 - RNA, 64 nt, Human
agaagacaucccacuaggaagagagagacuaccuccacaucaagaauauuuaaguuauuaucuc

SEQ ID NO: 496791 - RNA, 64 nt, Human
cccguuucuaucagcccggccagcaugcaggucuccacaucaccaucuagaguaucacgcacac

SEQ ID NO: 496792 - RNA, 64 nt, Human
gcaggggccagccagggacauagccagggaggggccacaucacuucccacuggaaaucucugug

SEQ ID NO: 496793 - RNA, 64 nt, Human
uucaccagacacggccuccacaauagccacacccacaccugagcuguucucagugcuggaacuu

SEQ ID NO: 496794 - RNA, 61 nt, Human
gcuucccacuuaccugauuugucugucgguggccccauauggaaacccugcgugucuguug

SEQ ID NO: 496795 - RNA, 61 nt, Human
cacagaagcaaaccgugccuucuggcucugcgccccauauucccagcaucauagacaucca

SEQ ID NO: 496796 - RNA, 61 nt, Human
uguaaaaauuaaaaguuaugguacuauguuagccccauaauuuuuuuuuuccuuuuaaaac

SEQ ID NO: 496797 - RNA, 64 nt, Human
augagaugccucuguaccgcaaguacuggcccaaccacaucaugcuggugcuucccggcauguu

SEQ ID NO: 496798 - RNA, 64 nt, Human
ugucccauuucuuccuguucucuuuuucuagcuuccacaucagcuuccuuuuuugagaacauau

SEQ ID NO: 496799 - RNA, 64 nt, Human
uguaauaaaauugaggcuccacggaggcccguguccacaucagcugcagcucccacucagacag

SEQ ID NO: 496800 - RNA, 64 nt, Human
cguuucaugaaaggcauggcggcugcauuucauaccacaucaaaauacaguaacauuucuauac

SEQ ID NO: 496801 - RNA, 64 nt, Human
agggacagaaccagaacuagagccugagcccaacccacaucacuauucuucuaacccuuccuga

SEQ ID NO: 496802 - RNA, 64 nt, Human
uuccucaaccuuugcuguaaaaauuucauuugcaccacaucaguacuacuuaauuuaacaagcu

SEQ ID NO: 496803 - RNA, 64 nt, Human
uuucuuuuuggcuuuuuugccuccaccuuuuagcccacaucauuuaacuccacuacugugaaag

SEQ ID NO: 496804 - RNA, 64 nt, Human
gagcugucccugaaucuccaugcagccccaccugccacaucaccaagguaagccaggaauucag

SEQ ID NO: 496805 - RNA, 64 nt, Human
ccacucagcccagcccgccugucccuagauucagccacaucagaaauaaacugugacuacacuu

SEQ ID NO: 496806 - RNA, 64 nt, Human
gcuuuaucaaggccugccaaaucacuggacaucaccacaucacuguggaggaugaaagcacaca

SEQ ID NO: 496807 - RNA, 64 nt, Human
caggaauaccucugagccugcccaccgggagccgccacaucacagcacaaguggcugcagccuc

SEQ ID NO: 496808 - RNA, 64 nt, Human
uccuucauggccuguuuugguccccuaagaaucuccacaucauugucuuucuugugccuuuucc

SEQ ID NO: 496809 - RNA, 64 nt, Human
accccagaagugccuuccaagcuucccccaagauccacaucacccacgacccugccacuguuuu

SEQ ID NO: 496810 - RNA, 64 nt, Human
gagaagucgucacgggucuuucaucccuucauugccacaucagaguugaugcugggcacaaacc

SEQ ID NO: 496811 - RNA, 64 nt, Human
auucauuuuagugaaaggaugcaucagaccuguuccacaucaugcacaugggaaagggugguua

SEQ ID NO: 496812 - RNA, 61 nt, Human
uggcccgaggacaagggcuguaagacagggagccccauaggccaucaucauccuuauccca

SEQ ID NO: 496813 - RNA, 61 nt, Human
guugauuuggaaacaugggcugaaaaugaaggccccauagugcauaggaacaguaaagcca

SEQ ID NO: 496814 - RNA, 61 nt, Human
uagacuguauuuaucuaguggauuccugcaggccccauacugagccuggacugaaaguauc

SEQ ID NO: 496815 - RNA, 61 nt, Human
uggauuuaaaauauauauauacguaacccaagccccauaaccccuaacuggacaaaugagg

SEQ ID NO: 496816 - RNA, 64 nt, Human
agaaaaauauguauauuauuguaaauagaaaugaccacaucagaaugucacacauggcuguucu

SEQ ID NO: 496817 - RNA, 64 nt, Human
ccucuaauuugaccacaaccaaccugggcuucagccacaucagugggcacuggagcuggggugc

SEQ ID NO: 496818 - RNA, 64 nt, Human
accaauaugugggguuggugaccaaucaguugagccacaucaaagcuaaguaagagcauggggc

SEQ ID NO: 496819 - RNA, 64 nt, Human
cagccuccaccuccugggcucuccagcgaucuucccacaucagccucccgaguagcugggacca

SEQ ID NO: 496820 - RNA, 64 nt, Human
gccauugaugcauaugcaccacauuauuauauuuccacaucaguuucuugugugccaaauaaga

SEQ ID NO: 496821 - RNA, 64 nt, Human
cuugaggcuccagacauacucaccucuaccucgaccacaucaaccccaucaccaagaggagguu

SEQ ID NO: 496822 - RNA, 64 nt, Human
uaguagcaaaaacauaaaacaaauaaaacuucccccacaucacagaugauuuuggacaagauuu

SEQ ID NO: 496823 - RNA, 64 nt, Human
ugugucuuuaacuugcgucccauucucagggcccccacaucagugucucguuuacaucucacac

SEQ ID NO: 496824 - RNA, 64 nt, Human
cugugugugcccuggugguggucuuaaggaccuaccacaucaacaucuggacaacccucacuga

SEQ ID NO: 496825 - RNA, 64 nt, Human
ccauggaauucccuccugagugccccacuucuggccacaucagccccacaggacuuugaugaag

SEQ ID NO: 496826 - RNA, 64 nt, Human
gagugacaggugccaccugcgugugucuuggcguccacaucacaccugugacggaagcacuucu

SEQ ID NO: 496827 - RNA, 64 nt, Human
uuuccaacugaguccaaacuuuucuaaugucuguccacaucaugcauuaggaaauguaauuaag

SEQ ID NO: 496828 - RNA, 64 nt, Human
gggaagggccagccaaggacagacuguagaggauccacaucagguggccacgaggacuugcagg

SEQ ID NO: 496829 - RNA, 64 nt, Human
gcaggugugccuuaaccucccuauucagaaagcuccacaucaauaaacaugacacucugaagug

SEQ ID NO: 496830 - RNA, 64 nt, Human
gacuucuguucauucaucccgagaacauuggcuuccacaucacaguaucuacccuuacaugguu

SEQ ID NO: 496831 - RNA, 64 nt, Human
uucuucuacacggcaugugccugcaccagccccaacaccugagcugguuuagcgcaaagaagag

SEQ ID NO: 496832 - RNA, 61 nt, Human
cacaccucuacggcuggggagaucaggcccagccccauaaaggagaaucuacgcugguccu

SEQ ID NO: 496833 - RNA, 61 nt, Human
ggguagcguuuuguuguuguuguuuuuucaugccccauacuacugaauaaacuaguucugu

SEQ ID NO: 496834 - RNA, 61 nt, Human
ccugaccauaagccugagccccucccucccagccccauauucacacacaucccagccccug

SEQ ID NO: 496835 - RNA, 64 nt, Human
gggcgccauccagguuuaacccugcaagcuguuuccacaucagaacucccuucaaacacaaaga

SEQ ID NO: 496836 - RNA, 64 nt, Human
aauauuuccauucaaaaugugguucacagacccgccacaucagcaccauccgagagcuuauuag

SEQ ID NO: 496837 - RNA, 64 nt, Human
uugguucuuugagcucguuucagaggcugaguccccacaucagcuuuaguucuuggacuucccu

SEQ ID NO: 496838 - RNA, 64 nt, Human
cacuuguccagcugagcgccaggauggaacacggccacaucaaagaggcugaggcuggcacagg

SEQ ID NO: 496839 - RNA, 64 nt, Human
aacauuuggcuuuguuuucuuuuuccuuugauuuccacaucaggugugugcgagugugugugug

SEQ ID NO: 496840 - RNA, 64 nt, Human
acuccugcgucggucuauacuacucggccauggcccacaucagcagucaacccugcacucuuuc

SEQ ID NO: 496841 - RNA, 64 nt, Human
cagugcuaacaugcaaccauuccucacgccaccgccacaucagagcugguugggaacccuuugc

SEQ ID NO: 496842 - RNA, 64 nt, Human
uuuaccugcucacuggcucuagccagcccagggaccacaucaaugugagaggaagccuccaccu

SEQ ID NO: 496843 - RNA, 64 nt, Human
ccgugcccugguuccccagacauuccagaaugccccacaucauuggcacaggaguggggcagcc

SEQ ID NO: 496844 - RNA, 64 nt, Human
aggccaaggaugaggccugacucggcuccucccuccacaucagccagggcaucagaaguugggc

SEQ ID NO: 496845 - RNA, 64 nt, Human
ccuggcccugagccauuucugcuguuucaggugcccacaucacccucauuuccuccucgcagua

SEQ ID NO: 496846 - RNA, 64 nt, Human
gcugggauuacaggcgugagccaccuugcccagcccacaucauacaguuugaaaugaaacuuug

SEQ ID NO: 496847 - RNA, 64 nt, Human
gguugaacuugugagaaggcacugaaucugccauccacaucacauauagcagcuauuaugaaau

SEQ ID NO: 496848 - RNA, 64 nt, Human
uccucugccuggccauccugcuggagcaccgcgaccacaucaugcgcaaugggcuggauuauaa

SEQ ID NO: 496849 - RNA, 64 nt, Human
ccauuccucauugggaccaggugggcuguguccgccacaucacccauccccauccccugacucu

SEQ ID NO: 496850 - RNA, 64 nt, Human; identical to SEQ ID NO: 300332

SEQ ID NO: 496851 - RNA, 64 nt, Human; identical to SEQ ID NO: 300344

SEQ ID NO: 496852 - RNA, 64 nt, Human; identical to SEQ ID NO: 300345

SEQ ID NO: 496853 - RNA, 64 nt, Human; identical to SEQ ID NO: 300346

SEQ ID NO: 496854 - RNA, 64 nt, Human
gaccuuagauuuggugaacaacguacuauggaagccacaucacuauugggcccccaggucugau

SEQ ID NO: 496855 - RNA, 64 nt, Human
agacccggcuugcuccaguguagcuuucuacaucccacaucagguauauuagagcuuauccgaa

SEQ ID NO: 496856 - RNA, 64 nt, Human
gaggaggacggcagcugcucguguccugccccugccacaucagugacugcuuuauucuuuucca

SEQ ID NO: 496857 - RNA, 64 nt, Human
ucccugagacaaccugggagacagccuggaucagccacaucaacucaguuguccaccacagggg

SEQ ID NO: 496858 - RNA, 64 nt, Human
gcaaaauucaauuuaagaugggcuucucugagguccacaucauggcaguucauuuacucuugug

SEQ ID NO: 496859 - RNA, 64 nt, Human
gaggcccccaggggugguagaggcuggaaggaagccacaucaggaggacgccacuccggcccuu

SEQ ID NO: 496860 - RNA, 60 nt, Human
cucggcuccaugugccagaggcuccgguccaugcaguacaauggcagcuacuucgacaga

SEQ ID NO: 496861 - RNA, 60 nt, Human
uaggaagcuauugccuaaaucagcgucaacaugcaguaaagguugucuucaacugagcug

SEQ ID NO: 496862 - RNA, 60 nt, Human
gcugcuaaaacuauuuuuaagagaugugaaaugcaguaugggacuaucuuuuuuuccucc

SEQ ID NO: 496863 - RNA, 60 nt, Human
gggacauaaaguuuucaugguagacaguucaugcaguauaugaauugccauaauggaaau

SEQ ID NO: 496864 - RNA, 60 nt, Human
uuggagguaaauuguagcuucuucucauucaugcaguaaauaauacauccuuucacucag

SEQ ID NO: 496865 - RNA, 60 nt, Human
gugacuugauucaaaagaaaauguuauaagaugcaguaaacuaauaacagaauuauuaaa

SEQ ID NO: 496866 - RNA, 60 nt, Human
gaaaguuguauuaauucaguauuugucauuaugcaguauuuuaauaccuacauaagucua

SEQ ID NO: 496867 - RNA, 60 nt, Human
uccaaauaagcaucagauuuaucgccuauuaugcaguaacagucaauaaaauguacuuau

SEQ ID NO: 496868 - RNA, 60 nt, Human
aacacacacguuuucccuacagcagaggccaugcaguauuauauauucauuuugcagaau

SEQ ID NO: 496869 - RNA, 60 nt, Human
aaaucuuuauuuugaacuuuauaaaaagcaaugcaguaccccauagacugguguuaaaug

SEQ ID NO: 496870 - RNA, 61 nt, Human
aagaauaggcuacaguucucucacaccaagggccccauaguuauaaaugugaaauuauauu

SEQ ID NO: 496871 - RNA, 61 nt, Human
gcauuaagcuuuaaagugcuagaaaucuugugccccauaugugcuucuuucaguauuaucc

SEQ ID NO: 496872 - RNA, 61 nt, Human
auucaaagcugagucaguggcucuugcgaaugccccauagcagaagucccgggaagguaaa

SEQ ID NO: 496873 - RNA, 60 nt, Human
ccucgcuggaugggguuuucuguccauccuaugcaguauuugggaaaguucacaagaaac

SEQ ID NO: 496874 - RNA, 60 nt, Human
aaauaggcugcaggucuccagagcauaucgaugcaguacuguacuagagcuguugugacu

SEQ ID NO: 496875 - RNA, 60 nt, Human
guccccuuucucuugauguggaaagucugaaugcaguauuuauagacuucuaagguuuua

SEQ ID NO: 496876 - RNA, 60 nt, Human
aagaacacaguccccauguugagggggaaaaugcaguaauguuugugggagccuggcugg

SEQ ID NO: 496877 - RNA, 60 nt, Human
gacauaagaauauauuaucaauacaguuuuaugcaguaagcucuccuuaccauaaauguu

SEQ ID NO: 496878 - RNA, 60 nt, Human
aaguaccaggcuguagauuugauaagcuagaugcaguagaccgaaaccauccaaaaccug

SEQ ID NO: 496879 - RNA, 60 nt, Human
ugccuuggcugcaguuuuuuuccuucaagaaugcaguacuaacauuuauuugaguggagu

SEQ ID NO: 496880 - RNA, 60 nt, Human
gaugagcuaaucgaaaagcccaugucuccuaugcaguacgcacgaucuggucugggaaca

SEQ ID NO: 496881 - RNA, 60 nt, Human
auuucuuuuuucuaucagauauucauugucaugcaguaguaguaaaaacaucaaagaugc

SEQ ID NO: 496882 - RNA, 60 nt, Human
cauuauauuuauuuuucuuuuauuauucagaugcaguagcauugcuuauguuacauaugu

SEQ ID NO: 496883 - RNA, 60 nt, Human
caacccugcugugcagggugagggccaugcaugcaguaugaggggucuacaccugcaagg

SEQ ID NO: 496884 - RNA, 60 nt, Human
auauggugucuguguacauauagugaagauaugcaguaagagcuaccuuaaagacuuucc

SEQ ID NO: 496885 - RNA, 60 nt, Human
ccccuuuaauugaaggcauuguuuuguuagaugcaguaaugauguuuaccagagauuauu

SEQ ID NO: 496886 - RNA, 60 nt, Human
uaucgaucuggaaagagcuguuuuggaugaaugcaguauaaaauguaaaaacccugcuaa

SEQ ID NO: 496887 - RNA, 60 nt, Human
ugaauuaguuugcaaacuauauaaagacauaugcaguaaaaagucuguuaaugcacaucc

SEQ ID NO: 496888 - RNA, 60 nt, Human
uugagguccaaauuccugggacucaaauguaugcaguacuauucagaaugauauacacac

SEQ ID NO: 496889 - RNA, 61 nt, Human
acugcuguggcgagucuugcuaugucugggugccccauagucacagaacaccuggacaccg

SEQ ID NO: 496890 - RNA, 61 nt, Human
aucgugcccugaggccugacacggcagaucagccccauagugcucaggaggcagcaucugg

SEQ ID NO: 496891 - RNA, 61 nt, Human
auaucugcaauguguaccaaaguuauaucaugccccauaaugcuacugucaaguguuacaa

SEQ ID NO: 496892 - RNA, 60 nt, Human
uaccucaggaggcugcuugugagagagcaaaugcaguaucuucagaaugauuuauuuuuu

SEQ ID NO: 496893 - RNA, 60 nt, Human
uuuauuaguagcuugaaagagcuuaaucauaugcaguaaguauuuuuauuaccaauaaau

SEQ ID NO: 496894 - RNA, 60 nt, Human
guagauuuucauaagccacaauuuuaaaagaugcaguaaucuuccaacuuccaauauuua

SEQ ID NO: 496895 - RNA, 60 nt, Human
cucuuggccggauguccucagggcuggcagaugcaguagacugcaguggacaguccccac

SEQ ID NO: 496896 - RNA, 60 nt, Human
auuauuccucaaguguuaauauacugacuuaugcaguauucaaaccaucuagugcaaugu

SEQ ID NO: 496897 - RNA, 60 nt, Human
gaaaggccagccaagcuuggggcaagcuugaugcaguaggagagacuccuuaugaggcuu

SEQ ID NO: 496898 - RNA, 60 nt, Human
aauauccuugaaagaauaguagcaaacaguaugcaguacuccuguguucuaaguucuuuu

SEQ ID NO: 496899 - RNA, 60 nt, Human
ucacccuacauuccagcaucuuaccuucauaugcaguaaaagaaagaaagaaaaaaaaag

SEQ ID NO: 496900 - RNA, 60 nt, Human
uuuuguuccuuuuuccugcugccauacuguaugcaguacugcaagcuaauaacguugguu

SEQ ID NO: 496901 - RNA, 60 nt, Human
caagacagagcaggggugaacuguagcuugaugcaguaaucugggacaagacugguugcu

SEQ ID NO: 496902 - RNA, 60 nt, Human
aguagaaaaacagacugaaauuuuaaagacaugcaguauuuguaucauuuuaaauucugu

SEQ ID NO: 496903 - RNA, 60 nt, Human
cacuuuuucauacacuugcuauauaguaguaugcaguauuuauauuauuccugaaaauaa

SEQ ID NO: 496904 - RNA, 60 nt, Human
gcugauucgggcuguggccuccacguauuuaugcaguacagucugccugacgccagcccu

SEQ ID NO: 496905 - RNA, 60 nt, Human
aagaguuaaaauggacaaguauugauaucaaugcaguaugaacauuaggaaacaaugaga

SEQ ID NO: 496906 - RNA, 60 nt, Human
gugcguguguggacucacuauggaaauaaaaugcaguagaaagagcauguaucacuuccu

SEQ ID NO: 496907 - RNA, 60 nt, Human
guagcuuuucuaaaacaguacauuccauucaugcaguagauaugaaggcuuuuuccaagu

SEQ ID NO: 496908 - RNA, 61 nt, Human
gcugacgacuaagcaccagccuccacucccugccccauagugaguaucccuccucugugug

SEQ ID NO: 496909 - RNA, 61 nt, Human
augucguggccuccauucucguuucuaugcagccccauaguccaaggacacccaguccaca

SEQ ID NO: 496910 - RNA, 61 nt, Human
aauuggaagccugcuuaaaaaauguaguugagccccauaauuuuacaaaugggcgaacuuu

SEQ ID NO: 496911 - RNA, 60 nt, Human
cauuucuauggguuuuccuuucuuuccuuuaugcaguagaugcuuucuuccuccugcagu

SEQ ID NO: 496912 - RNA, 60 nt, Human
gaacaagacuaacuauuuagaaacauuuagaugcaguauuuuacauacaguucugguuuu

SEQ ID NO: 496913 - RNA, 60 nt, Human
aacucaguacauguuaauauuuaaauaauuaugcaguaacuuucucugggucuguuugga

SEQ ID NO: 496914 - RNA, 55 nt, Human
gucacagggaaggauucuaaaagguaugcaguacagcaguauagaauccaugcca

SEQ ID NO: 496915 - RNA, 60 nt, Human
cuauuuugugcuugaucuuuauugucuaagaugcaguauccuguacuagcuuauaauauu

SEQ ID NO: 496916 - RNA, 60 nt, Human
gaagaauuuauugaauauuuauacuauaaaaugcaguaacauucuacuugcuuauuacau

SEQ ID NO: 496917 - RNA, 60 nt, Human
cguggcuguguccccaucugagggccugguaugcaguaagaucaauaaauacuuguggaa

SEQ ID NO: 496918 - RNA, 60 nt, Human
caaauuguguuuagaaauacuguaauaaauaugcaguagugauauaaagaauuauaucca

SEQ ID NO: 496919 - RNA, 60 nt, Human
uacaaaaguagcuauaccguagucaaaccaaugcaguauuguuuuuacauugaaucucag

SEQ ID NO: 496920 - RNA, 60 nt, Human
gcugauguaaacgguucgagugaagaauuaaugcaguaaguaugacaacacauacacacu

SEQ ID NO: 496921 - RNA, 60 nt, Human
uauuguaauucuauucuuugcagcucaagcaugcaguaugaauacuguguauuuuuuaaa

SEQ ID NO: 496922 - RNA, 60 nt, Human
cuuguguaaauaugagauguugucaaaaugaugcaguaaaugagcaaugacaguguacug

SEQ ID NO: 496923 - RNA, 60 nt, Human
uauguaucugcauaaugucugaagucauuaaugcaguaacaggucaagcucuuuagcauu

SEQ ID NO: 496924 - RNA, 60 nt, Human
uuuacugaccaaagcauguuuuaagcugcaaugcaguagucacgggugguaaccauguag

SEQ ID NO: 496925 - RNA, 60 nt, Human
uucacuuuaucauugcccaagaaugaggauaugcaguaaacagaauucaggcaagauacc

SEQ ID NO: 496926 - RNA, 60 nt, Human
ugggguguuuugagaaaguggcauggaaacaugcaguaguuaaugaguuucucuugguac

SEQ ID NO: 496927 - RNA, 64 nt, Human
accuccaaccccgaggcuuaucgcuagcggauucacaccugagacagacauuucaacaaugaua

SEQ ID NO: 496928 - RNA, 64 nt, Human
uaguauaaaugagcacagugcacauuguccccacacaccugaauuuucagucacuggaggaaca

SEQ ID NO: 496929 - RNA, 64 nt, Human
ugucuuguucccauauaacauuugaacucuuuacacaccugaaccugugggggccuugcccauu

SEQ ID NO: 496930 - RNA, 60 nt, Human
aaaacacuccucuccuauuaacaaaaaaugaugcaguacccauuuuucguauccugcuuu

SEQ ID NO: 496931 - RNA, 60 nt, Human
augcugguuguauuaccacgucaauguccuaugcaguauuguuagacauuuucucauuuu

SEQ ID NO: 496932 - RNA, 60 nt, Human
aauuaaaaccaauauuuauaaaaaguguauaugcaguaugauaccacuuuuaaaaaaaga

SEQ ID NO: 496933 - RNA, 60 nt, Human
cuugguacuacauaaugacuugcuccacacaugcaguaaacuacauaaugauguacuggu

SEQ ID NO: 496934 - RNA, 60 nt, Human
aaaaacugcaguuugaucaaauuuggguauaugcaguaugcuacccacagcgucauuuug

SEQ ID NO: 496935 - RNA, 60 nt, Human
cuuguaaacuucaucuauuucaaauauuuuaugcaguacauuauauuauucuguacaaag

SEQ ID NO: 496936 - RNA, 60 nt, Human
uaaaaugagucauacaucuuuuaaauuggaaugcaguaauagauaugugauuuuacauca

SEQ ID NO: 496937 - RNA, 60 nt, Human
aaggagggaaaguuccagcaguuucaugagaugcaguauugaguguucuaguuccuggaa

SEQ ID NO: 496938 - RNA, 60 nt, Human
ggauuuauuaugacccccuuuguuccaagcaugcaguaucauaagaacuggaaaaacuca

SEQ ID NO: 496939 - RNA, 60 nt, Human
cauauuacauguacuaaggaaugagauuauaugcaguaaacccaacuggaagauuaacaa

SEQ ID NO: 496940 - RNA, 60 nt, Human
uauugguggcaucagucaacaguguaugucaugcaguacagacauagcaagccuuguccu

SEQ ID NO: 496941 - RNA, 60 nt, Human
acagcuaagcuuccacuuauaagugagaacaugcaguauuugguuuuccauuccugaguu

SEQ ID NO: 496942 - RNA, 60 nt, Human
guuugugauauuucguguacugcaaaguguaugcaguauucuugcacugagguuuuuuug

SEQ ID NO: 496943 - RNA, 60 nt, Human
guauaugaucuaacaaaaaugaaacaugaaaugcaguagcaaccacuaaaaaaaaaaauu

SEQ ID NO: 496944 - RNA, 60 nt, Human
uaucuuacugguucaacauuuuucugauauaugcaguauuacagauauucagcaaaagua

SEQ ID NO: 496945 - RNA, 60 nt, Human
auaauuuauucuguugaaaaaaaaaaaagcaugcaguaucuaugaccuaucugcagaagg

SEQ ID NO: 496946 - RNA, 64 nt, Human
cauguaaacuucugacaccaccaggagcugacucacaccugaacugaacaccauugaaggcuua

SEQ ID NO: 496947 - RNA, 64 nt, Human
uuugguucuuacugggugacuuugacuuaauuuaacaccugagccucaguuuucucaucugcca

SEQ ID NO: 496948 - RNA, 64 nt, Human
cccuuuaugaacuguacuggcuguugaccaccagacaccugaccgcaaauaucuuuucuuguau

SEQ ID NO: 496949 - RNA, 60 nt, Human
agaaaauguguguauuuaaagacgaugccuaugcaguauauuguuugggauagauugcaa

SEQ ID NO: 496950 - RNA, 60 nt, Human
gaacuagucuuccuuccuuauuccucgaacaugcaguacauaaaaaggggaaaaggagaa

SEQ ID NO: 496951 - RNA, 60 nt, Human
auuucuugugguuauaacuuaaugaaaacaaugcaguacaggacauauauuuuuuaaaau

SEQ ID NO: 496952 - RNA, 60 nt, Human
aaaacuaauaaauagugacugaaccaauuuaugcaguaaauagacuaaaguucacagggc

SEQ ID NO: 496953 - RNA, 60 nt, Human
ugggggugcaauauaagaaguuuauauaauaugcaguacauuauccaaaagagaagguag

SEQ ID NO: 496954 - RNA, 60 nt, Human
caguacauuauccaaaagagaagguaguuaaugcaguagaaaguagugguaauaauuccu

SEQ ID NO: 496955 - RNA, 60 nt, Human
gacggagucuugcucuguugccacgcuggaaugcaguaacgugaucuuggcucacugcga

SEQ ID NO: 496956 - RNA, 60 nt, Human
auuuaccugugaaucaaaacaaauucaagaaugcaguauccgcgagccugcuugcugaua

SEQ ID NO: 496957 - RNA, 60 nt, Human
cuccuuuaugguuaauacuauuaagcaagaaugcaguacagaauuggauacaguacggau

SEQ ID NO: 496958 - RNA, 60 nt, Human
auuuugaguuauacuguuuucaaagucauuaugcaguauguauaaacuuauaagaauuaa

SEQ ID NO: 496959 - RNA, 50 nt, Human
ggaaacaucugccuucuuaaaugcaguacauucuaaagagagugagcaug

SEQ ID NO: 496960 - RNA, 60 nt, Human
auuacaaaauuuuaaagaagaauauguaacaugcaguacugauauuauaauucucauuuu

SEQ ID NO: 496961 - RNA, 60 nt, Human
ugaaauuuaggucugucaucuuaauauaucaugcaguaaaaggaagaaucuuuuuaaagu

SEQ ID NO: 496962 - RNA, 60 nt, Human
uaaaaaaauauagauguuuauuuauuuuuaaugcaguaauauauggagaaaugaacaaac

SEQ ID NO: 496963 - RNA, 60 nt, Human
gcauguuucuuucccucaccacaacagaacaugcaguacuaaagcaauauauuugugauu

SEQ ID NO: 496964 - RNA, 60 nt, Human
cuuugacuaacgcucagcuuccgggccugcaugcaguagacagaagaggaagaaagaaca

SEQ ID NO: 496965 - RNA, 64 nt, Human
agacgguucuucccuagaagaaaaacaagucuuuacaccugauaaaauauuuugcgaagagagg

SEQ ID NO: 496966 - RNA, 64 nt, Human
aaaugaacgugcaauuagauucguugucauggucacaccugaagaccuuaaagccaaugcaggu

SEQ ID NO: 496967 - RNA, 64 nt, Human
cugagcccaggggaggggagggagcgaggggcucacaccugacauguauucgccuccagggggc

SEQ ID NO: 496968 - RNA, 60 nt, Human
cagggcaacauuaagcaacuuacauaacucaugcaguaauuucugcaguugggagauguu

SEQ ID NO: 496969 - RNA, 60 nt, Human
cauuuguaucaauugaccuuuccccaaaucaugcaguauugaguuaugacuuguuaaauc

SEQ ID NO: 496970 - RNA, 60 nt, Human
caaaucccauuccaguguuacuuucugugaaugcaguaccauauucucauuuucaaugac

SEQ ID NO: 496971 - RNA, 60 nt, Human
ggggggaaugucuguagaacugcaacaucaaugcaguaaguguaguaaaagcuuuaguuu

SEQ ID NO: 496972 - RNA, 60 nt, Human
cuacagauuuugaaaaauguaauaauauuaaugcaguauugcaacaggggugcaauuuaa

SEQ ID NO: 496973 - RNA, 60 nt, Human
uuaaaguuuuuuuuuaaaauauugauuugaaugcaguaggcuuuuuuguauaaaauuauu

SEQ ID NO: 496974 - RNA, 60 nt, Human
ucacugugaaauauuucacauucagccuccaugcaguagagauuugaguuuaauuucaug

SEQ ID NO: 496975 - RNA, 60 nt, Human
uauguaugaaugccagaaauuugucaguucaugcaguaggauaaaaaaaaaaaaaaaaaa

SEQ ID NO: 496976 - RNA, 60 nt, Human
ugcaccuggccucaugucucuggauuuauaaugcaguaugaauauacuuugugcuuuaug

SEQ ID NO: 496977 - RNA, 60 nt, Human
agacaaaguaacccucaacguuuuaucuuuaugcaguacagugggcuuauuguguuaaca

SEQ ID NO: 496978 - RNA, 60 nt, Human
ucuuuguguuuauuuaaaaguuuugaaaauaugcaguacuguuuauauuuuguauaccuu

SEQ ID NO: 496979 - RNA, 60 nt, Human
uaaaaacucuaaaagguuaauuucugucaaaugcaguagaugaugaaagaaagguuggua

SEQ ID NO: 496980 - RNA, 60 nt, Human
gcugugacacccugaaaaagcugaccacaaaugcaguauuaucuugacauaccucugucc

SEQ ID NO: 496981 - RNA, 60 nt, Human
aaggguuugugccaauauucacuacguauuaugcaguauuuauaucuuuuguauguaaaa

SEQ ID NO: 496982 - RNA, 60 nt, Human
uauaucauuuuaugaauugugcuuuucauaaugcaguacauuucaaaauuuuuagauuau

SEQ ID NO: 496983 - RNA, 60 nt, Human
gagaguucauacuaaaauauauuuuugcagaugcaguaaauaugaaaaauauuuaauccc

SEQ ID NO: 496984 - RNA, 64 nt, Human
gggaaguagucaugcaucucagguuuguucugagacaccugaugaccuguuagaugauggugaa

SEQ ID NO: 496985 - RNA, 64 nt, Human
aggugggggcaagcagaaugccucccaggauuucacaccugagcccugccccacccugcugaga

SEQ ID NO: 496986 - RNA, 64 nt, Human
uuguuuuguuuuuguuuccauguuuucuugucacacaccugagcacuuccucccguuggcaaac

SEQ ID NO: 496987 - RNA, 60 nt, Human
auuuuguugauugugcuuuuauguaauaaaaugcaguacuuuaaaacauuuagauugugu

SEQ ID NO: 496988 - RNA, 60 nt, Human
ugcaaauuaugacauagugaauauagaacuaugcaguauuuaagccucaacaauccaaau

SEQ ID NO: 496989 - RNA, 60 nt, Human
guggcaccaccugauuucaugauguaccauaugcaguaacccauguuugagguacagaau

SEQ ID NO: 496990 - RNA, 60 nt, Human
acucaucacauuaaaaaauauuuugaaaacaugcaguaaaguugacucuuggggugcagu

SEQ ID NO: 496991 - RNA, 60 nt, Human
gaugugccacgugggugucacgugucccagaugcaguauucggcagccagccggggaggg

SEQ ID NO: 496992 - RNA, 60 nt, Human
gauacagccucuagcucuucagaucuguacaugcaguauuuaauuuccucuuaaacaugu

SEQ ID NO: 496993 - RNA, 60 nt, Human
uuuguacaguuuauccugauguugcuuguaaugcaguagaggcuauuucgccuucgcuuu

SEQ ID NO: 496994 - RNA, 60 nt, Human
gugugugauaagcuucucaucccugcauagaugcaguauucuuagccuuaguagaaaaac

SEQ ID NO: 496995 - RNA, 60 nt, Human
aguguuuuguaccagugaauuuuugcaauaaugcaguaugguacauuuuucaacuuugaa

SEQ ID NO: 496996 - RNA, 60 nt, Human
uucaccuucuugguugaaguuguguuaacaaugcaguagccagcacguucgaggcgguuu

SEQ ID NO: 496997 - RNA, 60 nt, Human
auuuguauuuuuccagaauucuuuuguccuaugcaguauugcuaaagucgagaauauauu

SEQ ID NO: 496998 - RNA, 60 nt, Human
guguaccaaaugagaaugagguugaaauguaugcaguaagguacucaguaauuaauuggu

SEQ ID NO: 496999 - RNA, 60 nt, Human
cugagugugagaguugugaaauacaaggaaaugcaguaaagccagggaauuuacaauaac

SEQ ID NO: 497000 - RNA, 60 nt, Human
gugucaucaaauuuuuuucuggaaagggccaugcaguaaauaguucaagcuuugugggcu

SEQ ID NO: 497001 - RNA, 60 nt, Human
aagaaagguaggauucagugcuuaccgaugaugcaguacuugauagaagaaaacagucug

SEQ ID NO: 497002 - RNA, 60 nt, Human
cauaugcaauuauauuuauugaauuccuagaugcaguauggauauuuaaauuguuaaaac

SEQ ID NO: 497003 - RNA, 64 nt, Human
gcugcccaauguagagucuagugaccuguucaggacaccugaaauauaauuaaaugacaauuau

SEQ ID NO: 497004 - RNA, 64 nt, Human
uucacggaauuaaaaguagcuugcugucaaagaaacaccugagaugaauuggugugaacgaauu

SEQ ID NO: 497005 - RNA, 64 nt, Human
cuucuguuaccuucagauguauugguuccauccaacaccugaaaagcaaauuuggcaaagacua

SEQ ID NO: 497006 - RNA, 60 nt, Human
ucagguacauuaagcuuuagugaagagugcaugcaguaauuccaaugugacugcaugacg

SEQ ID NO: 497007 - RNA, 60 nt, Human
ucuuuuugggaacaucaauuuuguacuguuaugcaguaaacauuuauaauaauauaauuu

SEQ ID NO: 497008 - RNA, 60 nt, Human
aaaggcauagaauugacucuguuccuaacaaugcaguauucucaauuguguuacugaaaa

SEQ ID NO: 497009 - RNA, 60 nt, Human
aauuuuuugcccaccugccuugauuuaaccaugcaguauucagggucugggaauauggaa

SEQ ID NO: 497010 - RNA, 60 nt, Human
agcaacaucauuuucagacuaacuaaaugaaugcaguauacucuuuucuuuguucucaau

SEQ ID NO: 497011 - RNA, 60 nt, Human
cagaacagucuggcgucuccagacucucacaugcaguaugugcaggcaccugauacuucu

SEQ ID NO: 497012 - RNA, 60 nt, Human
uaugaaaagggauauaaaggcaccgagcugaugcaguauuuguaauauuaaguugaccua

SEQ ID NO: 497013 - RNA, 60 nt, Human
cuaguauauuaagucuccauagcccuccugaugcaguagacagugcuaugcuguggauau

SEQ ID NO: 497014 - RNA, 60 nt, Human
ccaaaugucuuuuagaagauagaugcacuuaugcaguaaauuaucuugggauaguuccca

SEQ ID NO: 497015 - RNA, 60 nt, Human
cacuuuaaaacaagaaucagacauuuuccuaugcaguauuuuuuuuuaaaguuuauuuua

SEQ ID NO: 497016 - RNA, 60 nt, Human
cucccauggauccacucacaugcugcaggcaugcaguagacucacccacagcccacucuc

SEQ ID NO: 497017 - RNA, 60 nt, Human
ugguuuccugccuccauuucucugggaccgaugcaguaucagcagcucuuuuccagauca

SEQ ID NO: 497018 - RNA, 60 nt, Human
aguuucauggaaaggaguacguuguaguuuaugcaguaucugacugcaaaucauauucag

SEQ ID NO: 497019 - RNA, 60 nt, Human
uuccaaacugccaauuuguauuauguccaaaugcaguauccuugaggaauauaguggguc

SEQ ID NO: 497020 - RNA, 60 nt, Human
uuguuuagaaagcaugcauguaauguauguaugcaguaugccuuacuuaaaaagauuaaa

SEQ ID NO: 497021 - RNA, 60 nt, Human
caggcuugugcggggccaggcugggagcccaugcaguagggcagaaggcagcggaggcca

SEQ ID NO: 497022 - RNA, 64 nt, Human
ucuuucuugcccauagaugcauuggcuccauccaacaccugaaaaacaaacuuggcaaggauua

SEQ ID NO: 497023 - RNA, 64 nt, Human
gucaugggucauuccccacaagagccacauccucacaccugacagaugcacggcccaaggggcu

SEQ ID NO: 497024 - RNA, 64 nt, Human
gcagcccacaagcugccacuggccggcgacacugacaccugagcaguguccagaaccuuuuugc

SEQ ID NO: 497025 - RNA, 60 nt, Human
gaucagcugcugaagcccugucccuggauaaugcaguauuucaagacugccuuuaugcug

SEQ ID NO: 497026 - RNA, 60 nt, Human
gugaaaacauuuagggacacccaaagaaugaugcaguauuaaaggggugguagaagcugc

SEQ ID NO: 497027 - RNA, 60 nt, Human
guuaaucagucuugucccuacaagucccugaugcaguauguuuauuugugauguuuaaag

SEQ ID NO: 497028 - RNA, 60 nt, Human
ugucuacagucuauacucaauaccuauaaaaugcaguaagcauguguuacagaaagaggu

SEQ ID NO: 497029 - RNA, 60 nt, Human
caaucugaauuuauuuggcuacacuaaagaaugcaguauauuuaguuuuccauuugcaug

SEQ ID NO: 497030 - RNA, 60 nt, Human
cucaggucugccuuuuuuucuggagaauaaaugcaguaauccucucccaaauaagcacac

SEQ ID NO: 497031 - RNA, 60 nt, Human
cugggaaaggguguggcugaggcagucauaaugcaguaucuuccccugacuccagccaca

SEQ ID NO: 497032 - RNA, 60 nt, Human
aagucaguugguuuuuauuagcugcuugguaugcaguaacuuggguggaggcaaaacacu

SEQ ID NO: 497033 - RNA, 60 nt, Human
gcuauuaaacuuggauuuuucuuuuuauuaaugcaguauguucuuuuuauucaaguauga

SEQ ID NO: 497034 - RNA, 60 nt, Human
uuccuuucuaaauaaaauugauuugauuguaugcaguacuaaggagacuaucagaauuuc

SEQ ID NO: 497035 - RNA, 60 nt, Human
cagaacucaccacucaccaugggccuuuaaaugcaguaaacuccaccuaaccagauucag

SEQ ID NO: 497036 - RNA, 60 nt, Human
ggcguggcuucuucaguggaccaagcugcaaugcaguauugacuugacagagccucuacu

SEQ ID NO: 497037 - RNA, 60 nt, Human
gauucuugcccuuaauucauaauugaaaauaugcaguaacaagcauaaaacucacaucuu

SEQ ID NO: 497038 - RNA, 60 nt, Human
guaucuuaaaaugggaauaauuuuaauauaaugcaguaggugauuaacaaugucuccaaa

SEQ ID NO: 497039 - RNA, 60 nt, Human
gccuucuauauacaucaguggaaacuuaagaugcaguaauuauguuccagauugaccaug

SEQ ID NO: 497040 - RNA, 60 nt, Human
acuuaaaccaaaggcaugucuaucauguggaugcaguaacauuuacauuuaguuuuugau

SEQ ID NO: 497041 - RNA, 61 nt, Human
acuaugggcgcacugccuaacauuuagcccugccccauauggaacauguuaaaaaaaaaaa

SEQ ID NO: 497042 - RNA, 61 nt, Human
cccugagacuccagaaucugcuguugccauagccccauaugugugaauucugcaacuagcc

SEQ ID NO: 497043 - RNA, 61 nt, Human
uuucauauuuauaaaggagucuuaauguucugccccauaagacuuucaaccuugugguugg

SEQ ID NO: 497044 - RNA, 60 nt, Human
ggggaaaagguucaggcuguuaacaauuccaugcaguauuuaaauacauuuacuuuggca

SEQ ID NO: 497045 - RNA, 60 nt, Human
uucacaaaaauugccuccccggcagagauuaugcaguaagauaauuuaacugaauaauac

SEQ ID NO: 497046 - RNA, 60 nt, Human
ccaacuguucacagcaaaugcuuggauuuuaugcaguaggcauuacuacaguacauggcu

SEQ ID NO: 497047 - RNA, 60 nt, Human
aacccagagagcaaagugcauuacuuaaagaugcaguauauacuuuucucauuuuuaaac

SEQ ID NO: 497048 - RNA, 60 nt, Human
uuuaugucagcacacacuuacagagcacaaaugcaguauauaggugcuggauguauguaa

SEQ ID NO: 497049 - RNA, 60 nt, Human
auuccaagaggaugaggaguguuuucuaaaaugcaguaggcuuggggagucggagaguug

SEQ ID NO: 497050 - RNA, 60 nt, Human
uuucuugcuccauaacuacucuaucccacgaugcaguauuguaucauuaauuauuagugu

SEQ ID NO: 497051 - RNA, 60 nt, Human
aaaaucucccuguaauccucuuccuccauuaugcaguacacggacaccuggcuacagacc

SEQ ID NO: 497052 - RNA, 60 nt, Human
gaaugucauuacacucugauuuuuaaaauuaugcaguauuuuccaguucucagagagguc

SEQ ID NO: 497053 - RNA, 60 nt, Human
cuuuauauuuucucuuccauagugagauguaugcaguauguggccauguuuacuaacaua

SEQ ID NO: 497054 - RNA, 60 nt, Human
ugggugaaugugguuauggccgaaaaggauaugcaguaugcuuaaugguagcaacugaaa

SEQ ID NO: 497055 - RNA, 60 nt, Human
uaauauaauugguguagcacagugccuugcaugcaguaggcagccaacaaauccuuaaug

SEQ ID NO: 497056 - RNA, 60 nt, Human
ccacaccacaggauuuccugaaaguuuacaaugcaguagcauuuugggguguaggguggc

SEQ ID NO: 497057 - RNA, 60 nt, Human
acuuagaacauaugcauuaauacuaaaccuaugcaguaauaccauaauuagccuucuaau

SEQ ID NO: 497058 - RNA, 60 nt, Human
uuguguaugaacaaagcuguuguuuuuaccaugcaguauugcaugauuuuaaguuaugug

SEQ ID NO: 497059 - RNA, 60 nt, Human
uaacuacucugggguggcagguuccagagaaugcaguagaccuuuugccacucaucugug

SEQ ID NO: 497060 - RNA, 64 nt, Human
cugcaucaagaguacuguagccugggaaaccugaacaccugaaaugcaugcucuauaaauaaua

SEQ ID NO: 497061 - RNA, 64 nt, Human
cuagaggcgacccuuguuguaaaaggcgaucagaacaccugagggaggaaggggcuugcaguuu

SEQ ID NO: 497062 - RNA, 64 nt, Human
cacacagcugccucagaagcgccgggcuuuccucacaccugagccgggugcgaggaggagcaug

SEQ ID NO: 497063 - RNA, 60 nt, Human
uucucguucuuuaauuugaaaccuagauacaugcaguaaaaacuaggagaaugacuuuua

SEQ ID NO: 497064 - RNA, 60 nt, Human
uaucuaaucaauuagugaugucugccauggaugcaguagaggaaaguggugguacaagug

SEQ ID NO: 497065 - RNA, 60 nt, Human
aucauuuagcucccacuuauaagugaggacaugcaguauuugguuuucuguucccauguu

SEQ ID NO: 497066 - RNA, 60 nt, Human
uaaaauuuaaauaaggaauacauuuucaaaaugcaguaaucaaaaugugaucuaguguaa

SEQ ID NO: 497067 - RNA, 60 nt, Human
guucucuuugcguaggccacuggguuucucaugcaguaagcuuuauaaaaacucauuugc

SEQ ID NO: 497068 - RNA, 60 nt, Human
gccugucucugcaccugucuguccaucugcaugcaguauucucacccauguugaaugccu

SEQ ID NO: 497069 - RNA, 60 nt, Human
auaucaguauuuucuaucuguaucuggacaaugcaguagaaauuauaacaaauacaaagu

SEQ ID NO: 497070 - RNA, 60 nt, Human
cguucauucuaugagucuauuuuucuaaugaugcaguaauuaaauugcaucccaggagau

SEQ ID NO: 497071 - RNA, 56 nt, Human
gaaaugaauccacauucuaguccuuuaugcaguauacaaggagaacuguccuguag

SEQ ID NO: 497072 - RNA, 60 nt, Human
ggggaaaaaaauguuguuuccuaauaucaaaugcaguauauuucuucguucuuuuuaagu

SEQ ID NO: 497073 - RNA, 60 nt, Human
ccuggacugguucucucuaucucuggaguaaugcaguauaaauuggccaucaguacccuc

SEQ ID NO: 497074 - RNA, 60 nt, Human
agguaguauaguagugauuguucuucaagcaugcaguaaagaucacuuuuuuuuuuuuuu

SEQ ID NO: 497075 - RNA, 60 nt, Human
aaaguguauuugccagacaaugaaaacaguaugcaguauuucuuaaaguauugaaauuag

SEQ ID NO: 497076 - RNA, 60 nt, Human
ucugaucuuguuugugcagagugaacucugaugcaguaucagucuuguccugggagccgg

SEQ ID NO: 497077 - RNA, 60 nt, Human
uuacuucaaaggcguaguuuugggaauuugaugcaguaaagauuacccuguuuuaugauu

SEQ ID NO: 497078 - RNA, 60 nt, Human
auuguuaaugcuuugaugaaaaggcuuuauaugcaguagaucuacgaaaauauuguucau

SEQ ID NO: 497079 - RNA, 64 nt, Human
uugcuuuuccugggcggccuuuuaugucuuggagacaccugauguaaaguuucuguaaaucuau

SEQ ID NO: 497080 - RNA, 64 nt, Human
uugauuguccuuaaaccuaagccccacaaacuugacaccugaucaggucugggagcuacaaaau

SEQ ID NO: 497081 - RNA, 64 nt, Human
aaggaaagccucuaaggaaaggaugcaugagcuaacaccugacauuaaagaagcaagccaagug

SEQ ID NO: 497082 - RNA, 60 nt, Human
aaauagagaagacuggcucuguuaguaauuaugcaguauguacucuauuuaaggaucugu

SEQ ID NO: 497083 - RNA, 60 nt, Human
aacauaaaacacacaaggaagguauuauguaugcaguaguauacuagaguuuaggaaaau

SEQ ID NO: 497084 - RNA, 60 nt, Human
auuagaaugauaacauuuauauggauaaagaugcaguauuccuuauucuguacuugauuu

SEQ ID NO: 497085 - RNA, 60 nt, Human
ugaaaauuauugcaagcauugacuauaauuaugcaguacguucucaggaugcauccaggg

SEQ ID NO: 497086 - RNA, 60 nt, Human
uguuugcaguaugaagacacauuucuacuuaugcaguauucucaugacuguacuuuaaag

SEQ ID NO: 497087 - RNA, 60 nt, Human
auauaucauuguguaaauuuaauauaacauaugcaguaauaaaccauuuguuuuacugcu

SEQ ID NO: 497088 - RNA, 60 nt, Human
uucugcagagacuuccaguuuauugcauauaugcaguaaaguguauauauuaugcaguuu

SEQ ID NO: 497089 - RNA, 60 nt, Human
gaggauagcaauggggaaggguugugggcaaugcaguaacagggaaauggcuucagaaau

SEQ ID NO: 497090 - RNA, 60 nt, Human
aguacuuccaaauuuuaagguauggaaugaaugcaguacaucuggaauuguagucgauga

SEQ ID NO: 497091 - RNA, 60 nt, Human
ugaguauacauaauucaaaagaacuacuugaugcaguauagucuuaaggguucugcauac

SEQ ID NO: 497092 - RNA, 60 nt, Human
caauaagcacauauugagcacuugcuguauaugcaguauugagcacuguaggcaagaggg

SEQ ID NO: 497093 - RNA, 60 nt, Human
gcaguauuacacaauaccgcaugagcuaauaugcaguauuuagguaaugcauugaaugaa

SEQ ID NO: 497094 - RNA, 60 nt, Human
auuaaauaaaugaauaaauccaaaacaaacaugcaguacuuuuguuguaugggauuggug

SEQ ID NO: 497095 - RNA, 60 nt, Human
uuuuuguaaauguauuuuguauuuaaugaaaugcaguauaaagguuggugaaguguaaua

SEQ ID NO: 497096 - RNA, 60 nt, Human
uuuacugagcacagccacacucauuuguuuaugcaguacggccugacauugcuuuugcuc

SEQ ID NO: 497097 - RNA, 60 nt, Human
gagggcccaggugucucuccaccagcccccaugcaguagggacuggaagauaugucaucu

SEQ ID NO: 497098 - RNA, 64 nt, Human
cugccugcuccggccaggacugaaccccuucuccacaccugaacaguuggcucaagggccacca

SEQ ID NO: 497099 - RNA, 64 nt, Human
gugggaacuucucacucauuggcuucuuucccacacaccugaagagcacugacugugugccggg

SEQ ID NO: 497100 - RNA, 64 nt, Human
gaagacaaggccccagcccuccucugggagccucacaccugagaccagcaggacaaggccauug

SEQ ID NO: 497101 - RNA, 60 nt, Human
guguuacuuaauguauauucuaaaaagagaaugcaguaacuaaugcccuaaauguuugau

SEQ ID NO: 497102 - RNA, 60 nt, Human
ucccagcagguccauagcaguaggcuuaggaugcaguauauggggccgcauuuaaaagga

SEQ ID NO: 497103 - RNA, 60 nt, Human
aagcuuuccgaggccugaguauugcaauacaugcaguaguacaucauuuuagcaacucua

SEQ ID NO: 497104 - RNA, 60 nt, Human
ccugggugcaugcuaggaugauggggcuugaugcaguagggaagagacgauguaaaaaua

SEQ ID NO: 497105 - RNA, 60 nt, Human
uaagaucuagccccauugacucuucuagaaaugcaguauugcuuugaccugccauguggc

SEQ ID NO: 497106 - RNA, 60 nt, Human
aaucuaauaacauuaaaaugcuggggcaagaugcaguacaaaguugaagagacuuuauuc

SEQ ID NO: 497107 - RNA, 60 nt, Human
ggguaggcaggugucuuggacccaccugaaaugcaguaucaucugauuuacucuuuggga

SEQ ID NO: 497108 - RNA, 60 nt, Human
guguuuuuguuuaccugugggccuugggccaugcaguaucagcuugaccuugcaagguca

SEQ ID NO: 497109 - RNA, 60 nt, Human
uuccaaaaugucauguaguugguuggaguuaugcaguauguagacuuuuuagacuggcuu

SEQ ID NO: 497110 - RNA, 60 nt, Human
uacaguuagucuugucccaauuaaaauacuaugcaguaucucuuacaucaguagcauuuu

SEQ ID NO: 497111 - RNA, 60 nt, Human
uucuucacaugcuggacuagcuuaagaccaaugcaguagcuuauuuccaagccuugcaaa

SEQ ID NO: 497112 - RNA, 60 nt, Human
aaaaagagcuagccaaagcaguguugcuggaugcaguauucucuugcuaagaggaaggaa

SEQ ID NO: 497113 - RNA, 60 nt, Human
cuucuaggugcuguuccgguggauucugaaaugcaguagagggcuuuuguuggcagaaca

SEQ ID NO: 497114 - RNA, 60 nt, Human
cccaccaaagcuaacuuucccccaccccugaugcaguaaaacauugaaaaaaaaaaaaaa

SEQ ID NO: 497115 - RNA, 60 nt, Human
guauuaaagggcuuacauggguauuagcuaaugcaguaguaugauuguuuuauuagcaua

SEQ ID NO: 497116 - RNA, 60 nt, Human
guaaagaaauuuuaugcggaaaaucuuuauaugcaguauagaaaaguuaacacaaguacu

SEQ ID NO: 497117 - RNA, 64 nt, Human
aaacaggacuggaagaagauguuugcucuaagguacaccugacaaaggaacucucauagaaaau

SEQ ID NO: 497118 - RNA, 64 nt, Human
gggucuucaugucuuuucucugacuuuagaguauacaccugacccaguugugguccagagaauc

SEQ ID NO: 497119 - RNA, 64 nt, Human
caucuuccagggccugccggcaucaccugcggccacaccugagauggaccccacgcagcccuga

SEQ ID NO: 497120 - RNA, 60 nt, Human
uuaauguauuuaauuuucuacauagaaaacaugcaguaccuucuuauuacaagccaaauu

SEQ ID NO: 497121 - RNA, 60 nt, Human
aaaauggagaaaagaaaguuuucugaaaaaaugcaguaaauauaagccacauuucuaaag

SEQ ID NO: 497122 - RNA, 60 nt, Human
ugaaauugugccguguugccuuauaugaauaugcaguaugggacuuugaaauaaugauuc

SEQ ID NO: 497123 - RNA, 60 nt, Human
uagaggaaaacaguuauuuugcagcauuacaugcaguacuugugugauguuuugagaaug

SEQ ID NO: 497124 - RNA, 60 nt, Human
augacaaauguuuaaucauuaguuacaagaaugcaguaucuggggcgucaacauggggac

SEQ ID NO: 497125 - RNA, 60 nt, Human
gucaauucaguguuguacuggugaccugggaugcaguaguaggcacuguugauucaaauu

SEQ ID NO: 497126 - RNA, 60 nt, Human
uagaccacagaaguggaauuugaaaguauaaugcaguacauuaauauucauguucaugga

SEQ ID NO: 497127 - RNA, 60 nt, Human
uguggggcacaugauuuauccauaaaggagaugcaguaugcuuacuuaaauuaauaaauu

SEQ ID NO: 497128 - RNA, 60 nt, Human
gguuguuccauuuucauaaaauuggaaacaaugcaguaauagcuuauuguuuuguuuuuu

SEQ ID NO: 497129 - RNA, 60 nt, Human
uuuguugauuuaggaaaaagcauaaauagaaugcaguauaacaccacuuccaaagguaag

SEQ ID NO: 497130 - RNA, 60 nt, Human
uugaaaacauuguauuuuuuuuuuuuaacgaugcaguauuugugcguuccagaaaagggc

SEQ ID NO: 497131 - RNA, 60 nt, Human
aacaguuauacuagaauauauuuuuuccagaugcaguaaaaguaaaauauuuaauccaua

SEQ ID NO: 497132 - RNA, 60 nt, Human
gagaaaucacauuagauugaaacccuacgaaugcaguauaugugggaaagccuuuaguca

SEQ ID NO: 497133 - RNA, 60 nt, Human
uuuuaauacaauuucugcuauaauuuuuguaugcaguaggcguuacuaauaaacauuucu

SEQ ID NO: 497134 - RNA, 60 nt, Human
guuacaguagucagcucugauaaaaaaaugaugcaguagggugaggguaggaaaaagcac

SEQ ID NO: 497135 - RNA, 60 nt, Human
aggaaaagagucuauguauuuucaguauagaugcaguaauugugagccuaucaacauagu

SEQ ID NO: 497136 - RNA, 64 nt, Human
aaucccagcacuuugggaggcugaggcgggcggaacaccugaggucagguguucgagaccagcc

SEQ ID NO: 497137 - RNA, 64 nt, Human
aggagacaagcagaggucucuauuggauuucucaacaccugaagaaaguugcaguguuuuccuc

SEQ ID NO: 497138 - RNA, 64 nt, Human
uaggaaagccuucacuucacguaaucuuuuaaagacaccugagaauauauacuggagagaaacu

SEQ ID NO: 497139 - RNA, 60 nt, Human
auuuuacuauuuguacuuuuauguaauaaaaugcaguacauuuuuaaauuuucagaugau

SEQ ID NO: 497140 - RNA, 60 nt, Human
gaggguucauacugagauauauuuuugcagaugcaguauauauuuaaaacauuuaaucca

SEQ ID NO: 497141 - RNA, 60 nt, Human
uaguauauuuuacuaauacuuuuauauaaaaugcaguauauuuuuuaaauuucagauuau

SEQ ID NO: 497142 - RNA, 60 nt, Human
uuaacaguacuuuauugagguguaaucugcaugcaguaacaugcacaagucucaaguuca

SEQ ID NO: 497143 - RNA, 60 nt, Human
accaugcaaaucgccuuccaugguuuuuaaaugcaguaaauaacauuucuggaugagacu

SEQ ID NO: 497144 - RNA, 60 nt, Human
agaaaaaacacacuguaauauuucaaguguaugcaguagaauguacuguaacugagcccu

SEQ ID NO: 497145 - RNA, 60 nt, Human
aacuaauuuaagaagugauaaagucuccagaugcaguagcucacacuguaaucacaguga

SEQ ID NO: 497146 - RNA, 60 nt, Human
gacaaguugggaaugauguggugauuuagaaugcaguauuggccaaguccaaguugucaa

SEQ ID NO: 497147 - RNA, 60 nt, Human
aaaugugcaguuaauacuuggcgcuugaaaaugcaguagugaauguggaaccaagccugu

SEQ ID NO: 497148 - RNA, 60 nt, Human
accgguaaugggaaaaugcuccgacccucaaugcaguaaauauuuacuugcaggcaacug

SEQ ID NO: 497149 - RNA, 60 nt, Human
cgucgacccuugacccacgaagugcguagcaugcaguauuuaaagcaguguagcuacggu

SEQ ID NO: 497150 - RNA, 60 nt, Human
uaauuuuaaauaaggaaauaaguauguuagaugcaguagacgauacagguugcaugugga

SEQ ID NO: 497151 - RNA, 60 nt, Human
uaaguccucuaaacacacuugggcacggaaaugcaguacuguaaggaagagggaccucca

SEQ ID NO: 497152 - RNA, 60 nt, Human
auauauauauugauuauuuguuuuacacacaugcaguagcacuuugguaagaguuaaaga

SEQ ID NO: 497153 - RNA, 60 nt, Human
ugguaauagacuucagugaacucuguaugaaugcaguagugugugugcaaaauccgcuuc

SEQ ID NO: 497154 - RNA, 60 nt, Human
ggagccacucuguuccuggcucagccucaaaugcaguauuuuuguuguguucuguuguuu

SEQ ID NO: 497155 - RNA, 64 nt, Human
uguugagaaccucccuugaaugucugucacacucacaccugacgggaugguuacuggauuagag

SEQ ID NO: 497156 - RNA, 59 nt, Human
gggcggagaugcagucuuagaggcccuggacaccugacaaagagacagaguccccacua

SEQ ID NO: 497157 - RNA, 64 nt, Human
ucaaguuauaaaauauguugaaaggcacaaaagaacaccugaaaaaugauauuuugucugaaaa

SEQ ID NO: 497158 - RNA, 60 nt, Human
agacugaaauuuuguucuuuaguacuuuucaugcaguagaacggaacuuggggcugguuu

SEQ ID NO: 497159 - RNA, 60 nt, Human
cuacuggaagauuccaggcauguuaaagauaugcaguauugaauauauguaaggaaguau

SEQ ID NO: 497160 - RNA, 60 nt, Human
uuggcuuuuugucuuuuaaauuuuuaaaaaaugcaguaguguguuagagacuagaaaguu

SEQ ID NO: 497161 - RNA, 60 nt, Human
ugaguguuuacaacucaaacaacuuuuugaaugcaguaguuuuuuuuuuuuaaaaacaaa

SEQ ID NO: 497162 - RNA, 60 nt, Human
ugugguuaguggaggcucugugcugcacguaugcaguauccuaucucuuucuacaucaga

SEQ ID NO: 497163 - RNA, 60 nt, Human
acacugauauauacauguugaaguaaugguaugcaguaagauuuuuuuuaauccuauuau

SEQ ID NO: 497164 - RNA, 60 nt, Human
uuguugugccugcuucauuuugcaauaacaaugcaguagaauuuaaaacuuggaugcuua

SEQ ID NO: 497165 - RNA, 60 nt, Human
cuuuucucauuucaaaguugcuaccaguguaugcaguaauuagaacaaagaagaaacauu

SEQ ID NO: 497166 - RNA, 60 nt, Human
uagcagaccuaaagcaagccugaauuggcuaugcaguacauuguauucuguuugggggaa

SEQ ID NO: 497167 - RNA, 60 nt, Human
uucacugacaauaaaguuagcuauuuuaaaaugcaguaccguguggaaaaugcuuuggug

SEQ ID NO: 497168 - RNA, 60 nt, Human
aguacuuugugcucauaaauuggccucuguaugcaguacuaaaauuaaugcagauuucuc

SEQ ID NO: 497169 - RNA, 60 nt, Human
gaauguuggccuugcagcauuuggugucauaugcaguagccaguggauaaacuaaccugu

SEQ ID NO: 497170 - RNA, 60 nt, Human
aauaauuuagugauggaauuuuuuaauaacaugcaguauauaaaugugcagauuuuaugc

SEQ ID NO: 497171 - RNA, 60 nt, Human
guuagcagaucgaauaacuugaaauagaccaugcaguauuccuagcacucaauguaauca

SEQ ID NO: 497172 - RNA, 60 nt, Human
caagagagccacaguagagaggcuuguuuaaugcaguaccauuggagaguuaacagaaua

SEQ ID NO: 497173 - RNA, 61 nt, Human
aagaagaugacaaaugcuagaggcugcuccccccuccgaugcaugcucuucucucacaugg

SEQ ID NO: 497174 - RNA, 64 nt, Human
uccauacucggggggccucagcccuugggaggggacaccugaggcagccagcgcccccucccca

SEQ ID NO: 497175 - RNA, 64 nt, Human
gaggccuuuccucaguccuguggccucucagaggacaccugaugcucaccugccccucuuucuc

SEQ ID NO: 497176 - RNA, 64 nt, Human
gaacauuuugguccaaauucuuguuuuaaaucuuacaccugaaaguaaaauauugggaucacuu

SEQ ID NO: 497177 - RNA, 64 nt, Human
agaggucagaaugagguccuggggagaaucuaagcccuccgauguguguuucuaaaguuguuuu

SEQ ID NO: 497178 - RNA, 64 nt, Human
ggaagaaaggagucugcacaugcagcugcacccucccuccgauccuuccucccaccucccccuc

SEQ ID NO: 497179 - RNA, 64 nt, Human
ccgcuggguggcgccgccgccgccucugucccugcccuccgagcccacugucacgcugccuggu

SEQ ID NO: 497180 - RNA, 64 nt, Human
ugagcucagggggccaccugugcuccccccgcuacccuccgagccgcgccccugucucaggcac

SEQ ID NO: 497181 - RNA, 64 nt, Human
ggaagucccuccacuggauuccuuuguuucuguccccuccgaggagucauuuuggucgacaggc

SEQ ID NO: 497182 - RNA, 64 nt, Human
ucaccccccucacauucucuuaagcacccgguggcccuccgaggccuggcggaaugguggugcc

SEQ ID NO: 497183 - RNA, 64 nt, Human
ugacuguuaucucggacuuugcaggaguuccuuucccuccgaacgcugcuccaugcacaggaaa

SEQ ID NO: 497184 - RNA, 64 nt, Human
gcguuauacacagaguuugggcacacacugcccucccuccgagaugccagaaguuuuuccacag

SEQ ID NO: 497185 - RNA, 64 nt, Human
cuggcugcuaggccagagccaugccaggcugcgucccuccgagcuugggauaaagcaaggggac

SEQ ID NO: 497186 - RNA, 64 nt, Human
ggguguccaaaggaagacguguggcaauagugggcccuccgacagcccccucugccgccucccc

SEQ ID NO: 497187 - RNA, 64 nt, Human
uauuuauccuuugacucuugcacauucuauguaccccuccgauuugugaagccuacaggaaauc

SEQ ID NO: 497188 - RNA, 64 nt, Human
gucgcugggggccaagggcgccgccggcccucugcccuccgaggccgugcaguggcugugccac

SEQ ID NO: 497189 - RNA, 64 nt, Human
uagccugucacuccuugaagccuucucugccugucccuccgauccuuguccaccgucuauuuau

SEQ ID NO: 497190 - RNA, 64 nt, Human
guggccuaagugugauuuaacucuugaagucacacccuccgaaagaugaguagaaaccagcacc

SEQ ID NO: 497191 - RNA, 64 nt, Human
gcagccuggugucuuagcuguccccccaggagugcccuccgagaguccaugggcacccccgguu

SEQ ID NO: 497192 - RNA, 64 nt, Human
ugagagccagaugccuccccaagacugucauugccccuccgaugcugaggccacccacugaccc

SEQ ID NO: 497193 - RNA, 64 nt, Human
aaaacuagagcucuaagcccauucagcccauuucacaccugaaaauguuagugaucaccacuug

SEQ ID NO: 497194 - RNA, 64 nt, Human
guccccuuggggggaugagcuaggggugcaaggaacaccugaugaguagauaaguggagcucau

SEQ ID NO: 497195 - RNA, 64 nt, Human
aaauuaugagccuugcugaguggauacgguacuuacaccugaaccaggauuccuggguucuguu

SEQ ID NO: 497196 - RNA, 64 nt, Human
uagaacaggagcagugugacaugagguggccugaacaccugagggacuggacaucccauguuca

SEQ ID NO: 497197 - RNA, 64 nt, Human
gacugacgguucccugaggauggggcuguuucuccccuccgacuggggcucccugaggaugggg

SEQ ID NO: 497198 - RNA, 64 nt, Human
cgacuggggcucccugaggauggggcuguuucuccccuccgacuggggcucccugaggacaggg

SEQ ID NO: 497199 - RNA, 64 nt, Human
auugggcaggcaaaguccucugcaggccuggaaacccuccgagacaauuacuugcaugggguaa

SEQ ID NO: 497200 - RNA, 64 nt, Human
gaagcgggaggggucacugccggaagagcagcugcccuccgaccccucacuuugugccuuuagu

SEQ ID NO: 497201 - RNA, 64 nt, Human
caggacgagugacucuuccacggugugcugcuuucccuccgagccuguggaaaggcagagcccu

SEQ ID NO: 497202 - RNA, 64 nt, Human
gaucccgucuuccagagaaccugugggcugacugcccuccgaagagaguucuggaugucuggcu

SEQ ID NO: 497203 - RNA, 64 nt, Human
gacugcucccggggccaggcugcccugggagccccccuccgagcccagccagccaggcucucag

SEQ ID NO: 497204 - RNA, 64 nt, Human
guggagguccgagauggcuucuggaggaaggcgccccuccgagggcccaacacuggccagggau

SEQ ID NO: 497205 - RNA, 64 nt, Human
cuaggccccuccuagacccagguggagggcacagcccuccgacccucauggcccccaggggcag

SEQ ID NO: 497206 - RNA, 64 nt, Human
gggcgccuagagcgcggcuggcucuguggaggggcccuccgagggugcccgagugcggcgugga

SEQ ID NO: 497207 - RNA, 64 nt, Human
ccccggaagugucccaagaggcuccgaaggccuccccuccgagcccagcucuccugucuccucc

SEQ ID NO: 497208 - RNA, 64 nt, Human
guuucaaaagcaaaauuaaacaaaaaucucaguccccuccgaagugaacuuuguguuacccugc

SEQ ID NO: 497209 - RNA, 64 nt, Human
uccacgggggcggcaggcuggguucauuccccggcccuccgagccgcgccaacgcacgcaaccc

SEQ ID NO: 497210 - RNA, 64 nt, Human
cgggggauagagagaaggaguggcaggccuaggccccuccgauugucccuuggggguuaccccu

SEQ ID NO: 497211 - RNA, 64 nt, Human
agccuagacccaggugguccugagcugggucccacccuccgagccauggugccccccugccagc

SEQ ID NO: 497212 - RNA, 64 nt, Human
cagggcagagccacugggcacuuuguuuccuuggcccuccgaagcucacuguugcaaauacccc

SEQ ID NO: 497213 - RNA, 64 nt, Human
uguuguuguuauucauagcacugcccuuuuaauuacaccugauuauacuacugaagugacuuau

SEQ ID NO: 497214 - RNA, 64 nt, Human
cuucacagaugugggaaagagcccaucccucugcacaccugagucaaaugucuaucugauugcu

SEQ ID NO: 497215 - RNA, 64 nt, Human
ucccaaagugcugggauuacaggugugagccaccacaccugacccauaggucuucaauaaauau

SEQ ID NO: 497216 - RNA, 64 nt, Human
agccccugagaggagggcuuucccagcccugggacccuccgaggugggugugcgggucucacag

SEQ ID NO: 497217 - RNA, 64 nt, Human
agaaguggcuuacuguagaagcagcuugcugagccccuccgagcgguccccagaauuagcuggu

SEQ ID NO: 497218 - RNA, 64 nt, Human
cagggucuuaggccuaguccucucauuccucccacccuccgagauggucagugugucaugggaa

SEQ ID NO: 497219 - RNA, 64 nt, Human
caccggcagggacagccuggggcugacagggcuccccuccgagggccaguuucaggucuggaag

SEQ ID NO: 497220 - RNA, 64 nt, Human
cgucuggggaggcacauuuaugcacuuuguaucacccuccgaacuccccccacaccuucccuuc

SEQ ID NO: 497221 - RNA, 64 nt, Human
gccucaguuuaccacgucugaggucggggggacccccuccgagucccgcgcugucuucaaaggc

SEQ ID NO: 497222 - RNA, 64 nt, Human
gcugccacccagaucagaucacaugggaaugaggcccuccgaccauuggcagcuccgccucugg

SEQ ID NO: 497223 - RNA, 64 nt, Human
cggccucggcgucccccagucuccaggagccucucccuccgagauacccacccagcuuugucaa

SEQ ID NO: 497224 - RNA, 64 nt, Human
cucccacacucacaucuaucugcuggagaccauccccuccgagauccaggucuucgugaagaau

SEQ ID NO: 497225 - RNA, 64 nt, Human
gccuggcagaugugcccacggaggcccccagcugcccuccgagcccaggccugcagcacugaaa

SEQ ID NO: 497226 - RNA, 64 nt, Human
cuugcacgccaccauucagucaccagacugggugcccuccgauggguggaauaagucugcuuca

SEQ ID NO: 497227 - RNA, 59 nt, Human
accccucuggaggacgguaaccaucugggcccuccgacuuccuucaaccaaaccagggc

SEQ ID NO: 497228 - RNA, 64 nt, Human
agaccaccagaguccuuggacucccccugggucucccuccgagucacucugcagcuuggcccga

SEQ ID NO: 497229 - RNA, 64 nt, Human
agcugaaccccuacucccggagcccccagcagggcccuccgagguggagcagcagcuacaagca

SEQ ID NO: 497230 - RNA, 64 nt, Human
ucagcugaaccccuacccggagcccccagcagggcccuccgagguggaacagcagcuacaagca

SEQ ID NO: 497231 - RNA, 64 nt, Human
cuuauugcccaaauagagaggguggcccuggcuccccuccgagcaacucugcauuuaauuuugu

SEQ ID NO: 497232 - RNA, 64 nt, Human
cccaucuguauuguugcuccuaccuucaaauaugacaccugaaauaauaagucuguuguccaga

SEQ ID NO: 497233 - RNA, 64 nt, Human
gacuauauauuaaugagacucaguaauccaacccacaccugagaacucgucucauuacuuuaua

SEQ ID NO: 497234 - RNA, 64 nt, Human
gcuuuguagcccucacuacuggccaccugaccucacaccugacccugaccccuccucaccuauu

SEQ ID NO: 497235 - RNA, 64 nt, Human
ccccucccguucaccuaccacccaaguccucaugcccuccgagggcugggggaggaggggcuca

SEQ ID NO: 497236 - RNA, 60 nt, Human
agauccuggcugccaacugagcccgcggcucccuccgacccugcuccccacagagccuca

SEQ ID NO: 497237 - RNA, 64 nt, Human
cucugucugcaacaugcuuggggucccuuaagcucccuccgaccucccagaagccuccaguccc

SEQ ID NO: 497238 - RNA, 64 nt, Human
gcuuccugcaucuuccaccgcaccauaccuggagcccuccgaggggugucaggggaaacaggcc

SEQ ID NO: 497239 - RNA, 64 nt, Human
agagaacugggccugaccuaccugaacugacuggcccuccgaggugggucugggacauccuaga

SEQ ID NO: 497240 - RNA, 64 nt, Human
cagcccguccuccucuaccucucuccucuccgcgcccuccgaccucucucggcccccucacccc

SEQ ID NO: 497241 - RNA, 64 nt, Human
ccaagcccgccuccagcaccaagggcgggcagcacccuccgacccucccaugcgggugcacacg

SEQ ID NO: 497242 - RNA, 64 nt, Human
gccugacuucugcuggcaucaagaggugggagggcccuccgaccacuuccaggggaaccugcca

SEQ ID NO: 497243 - RNA, 64 nt, Human
ucgacaugcugccaggaaacaagggaaggggccucccuccgagugagucagugaugaggccgcg

SEQ ID NO: 497244 - RNA, 64 nt, Human
agguagccccugccuuaauccacggggcuccuuucccuccgaagggcugcucuuccccacaggc

SEQ ID NO: 497245 - RNA, 64 nt, Human
aaaagccgcugaccaaaguccaaugcacaauagccccuccgaaaggaaggaaccgcuucacuuc

SEQ ID NO: 497246 - RNA, 64 nt, Human
uggugugcaggucacuaugacaaauguguauucgcccuccgagaagagaauaaaagugacauga

SEQ ID NO: 497247 - RNA, 64 nt, Human
ggccuuucagucccaaagcggccgaugggagucucccuccgacuccagauaugaacagggccca

SEQ ID NO: 497248 - RNA, 64 nt, Human
cucccccggccgcuccucugccggcugccucucccccuccgagcccguccgcucccgagcucgg

SEQ ID NO: 497249 - RNA, 64 nt, Human
aagccacuacuuaagaucggaaguuaagagagcucccuccgaagagaaaauuuuuauacuaaaa

SEQ ID NO: 497250 - RNA, 64 nt, Human
aggggagagaauggcugggugcuggggaguuccccccuccgagcccuccuucccggcccaaccu

SEQ ID NO: 497251 - RNA, 64 nt, Human
cucgagcaugcugccaggggagcuggauggugaaacaccugaagaucucauaucgccucucaaa

SEQ ID NO: 497252 - RNA, 64 nt, Human
gaggggaagcugccaccccucuucugcuccuuagacaccugaauggacuaagaugaaaugcacu

SEQ ID NO: 497253 - RNA, 64 nt, Human
ucaaaagacucuguguauucaucuucccuucuacacaccugagggggagacggcguugggauag

SEQ ID NO: 497254 - RNA, 64 nt, Human
gaacacaguggccagguguccccaggcuccuggccccuccgacgaccucaacucugcccagccc

SEQ ID NO: 497255 - RNA, 64 nt, Human
uggcacccuccugagccggcgugugccgguccagcccuccgagaugccacaauuccuuggaugg

SEQ ID NO: 497256 - RNA, 64 nt, Human
cuagccuguugaauauaccccaccuggugguggccccuccgauguccccacugauggcucugac

SEQ ID NO: 497257 - RNA, 64 nt, Human
cuauuaauagaaaaccgucacagugacccuagaucccuccgaguuaaugaguuaacacaugugc

SEQ ID NO: 497258 - RNA, 64 nt, Human
ggagcugcguggcggcgguggcgacauggcggagcccuccgaggcgggugacgcgcccccugau

SEQ ID NO: 497259 - RNA, 64 nt, Human
acccuccuccccgggguggcguggggcuggggcacccuccgacggcagagccuccuucagaaag

SEQ ID NO: 497260 - RNA, 64 nt, Human
gcaccgggcauccacccaucagcccccgcccugucccuccgaaggacacccagcaggcaccccc

SEQ ID NO: 497261 - RNA, 64 nt, Human
uacaccugcaaguccugguuuauauuggaccccucccuccgagcugcaguucaccuuugaccuu

SEQ ID NO: 497262 - RNA, 64 nt, Human
ccuucaguggcccgcauucuuccaccagccaccacccuccgacccccuagcccuccacaagaag

SEQ ID NO: 497263 - RNA, 64 nt, Human
cuugcccuccccucucuucuccucccaaccaaaacccuccgauccagccccaggccccucugua

SEQ ID NO: 497264 - RNA, 64 nt, Human
ucgcccccuccugcacagccaccagcagccagcccccuccgauacaccucccguccucuccuac

SEQ ID NO: 497265 - RNA, 64 nt, Human
agucaccgccaggcucacaggcugugccacccgucccuccgacagcuccaauacugugacccuc

SEQ ID NO: 497266 - RNA, 64 nt, Human
cgccucccagguucaagcgauucucaugccucagcccuccgaguagcugggaccacagguguac

SEQ ID NO: 497267 - RNA, 64 nt, Human
agugcucaaucccugagccucagcaaaacagcuccccuccgagggaaaucuuauacuuuauugc

SEQ ID NO: 497268 - RNA, 64 nt, Human
aaagagacgucgcuuucauccccaagugcaccgucccuccgaggggauuucugagaauucuccu

SEQ ID NO: 497269 - RNA, 64 nt, Human
cuggcagcuggagcucuuuuccuuguccuuccugcccuccgauggggccaccugugucggggca

SEQ ID NO: 497270 - RNA, 64 nt, Human
cggugugcggagaaggccugagcuggcagggcaaacaccugagagugacuuugacauuaggucc

SEQ ID NO: 497271 - RNA, 64 nt, Human
ccacugaugaaccuuaaagcugaguauuuuauuaacaccugauuuguauuccauuauauucaaa

SEQ ID NO: 497272 - RNA, 64 nt, Human
cuagaccagcauuauuacucaaacuaaaaauaucacaccugaaaaauuuaauuuaggaccuaaa

SEQ ID NO: 497273 - RNA, 64 nt, Human
guacuucagcaauaaccuugccuuugcuaagacccccuccgagggcuucaggggggccugccaa

SEQ ID NO: 497274 - RNA, 64 nt, Human
cugcugccucaggaaucuccugaccacuuguagucccuccgacuucucuagacaucuagucuca

SEQ ID NO: 497275 - RNA, 64 nt, Human
ccucccucuuucccucccuuccucuuuccaucuacccuccgauuguuccugaaccgaugagaaa

SEQ ID NO: 497276 - RNA, 64 nt, Human
uaagcaucgaaaaaagaaaaaaagccaugauguacccuccgagaaagaagaacguaagcacagg

SEQ ID NO: 497277 - RNA, 56 nt, Human
ccuucaagcaaaucuccuaaaaggagcccuccgaugucuucuuugucuucguucac

SEQ ID NO: 497278 - RNA, 64 nt, Human
cucugauccucuugacccuucugggaauguuugcacaccugacacucuugugagacuggcuuau

SEQ ID NO: 497279 - RNA, 64 nt, Human
aaucacaacagcauuacuguucuuauuugcugccacaccugagccagccugcuccuucccagga

SEQ ID NO: 497280 - RNA, 64 nt, Human
uggugcucaguuguagaauguauuguaccuuuuaacaccugauguguacaucccauguaacaga

SEQ ID NO: 497281 - RNA, 64 nt, Human
gccagccguuugcuguccugccgcccggcucagucggccagacuuccucuaggaguggugcugc

SEQ ID NO: 497282 - RNA, 64 nt, Human
cucauauccccaccccuucccacggcgugucccacggccagacacaugcacacacaucacaccc

SEQ ID NO: 497283 - RNA, 64 nt, Human
aagugccgagauuacaggugugagccaccgcgcucggccagagcucuggguuuuaauccuacuu

SEQ ID NO: 497284 - RNA, 64 nt, Human
ugugagagcacuguccccacccaaccugucacaacggccagaaccauacaccagagacacacug

SEQ ID NO: 497285 - RNA, 64 nt, Human
aagugcugggauuacaggcaugagccacugggcgcggccagauaaguuuuuaagguuccuucuu

SEQ ID NO: 497286 - RNA, 64 nt, Human
ccgaagguuucucuuggggguaggggcuccugggcggccagaugaaugggucccugggaaccca

SEQ ID NO: 497287 - RNA, 64 nt, Human
uuaggauacuuuuaucaaaaucuaguaccagcuacggccagaaagggccaggugggaccugaaa

SEQ ID NO: 497288 - RNA, 64 nt, Human
uaggaacuaucuggggaggggcccaguggguccucggccagagcccucucuaaggacagguugg

SEQ ID NO: 497289 - RNA, 64 nt, Human
ccuucagcugcccucgauuuugcuccacgccugccggccagagccucccggcguuucuuccgcc

SEQ ID NO: 497290 - RNA, 64 nt, Human
aucagccacauggaauccugacaucccagccagccggccagacucucaucuugaugucuugaug

SEQ ID NO: 497291 - RNA, 64 nt, Human
ggugcucucuccaggcccaccaugcugggagaggcggccagagccuggggccuccagccuggga

SEQ ID NO: 497292 - RNA, 64 nt, Human
ugaugauggauuaauuccaccaaggaaaagcagaacaccugaaagccagcaauuuccugacacu

SEQ ID NO: 497293 - RNA, 62 nt, Human
cuccacucuuucuuucaauaaaacgcaguugcaaacaccugauuucugaagcgguucugucu

SEQ ID NO: 497294 - RNA, 64 nt, Human
ccaaaccccagggggccccagcagcuucgaaccuacaccugagggcuaccagcagguggcgcuc

SEQ ID NO: 497295 - RNA, 64 nt, Human
gggggaccgugcagcuacgggguucuuggagagucggccagacggcggggggcagcaggaacuu

SEQ ID NO: 497296 - RNA, 64 nt, Human
uuuagaugcaggagaacaguaagauggaugguuccggccagagucgauguggggaggaacagag

SEQ ID NO: 497297 - RNA, 64 nt, Human
cccuggggaaccuacuuucugcucagugaggcuccggccagaaaccuggaguccuuauccuccc

SEQ ID NO: 497298 - RNA, 64 nt, Human
uucacuugggccauuguuggugggggcuccuuuccggccagaccacaaggccagaagcaauaau

SEQ ID NO: 497299 - RNA, 64 nt, Human
ugucuacaaaaaauaaaaaauuagcugggcaugacggccagagcccauggucccagcuacucga

SEQ ID NO: 497300 - RNA, 64 nt, Human
caauaugggcgggcagucgcugcagggagcaccacggccagaaguaacuuauuuuguacuagug

SEQ ID NO: 497301 - RNA, 64 nt, Human
gacggcaccguaucugcagugggcacgggggggccggccagacaggcagacugggaggauggag

SEQ ID NO: 497302 - RNA, 64 nt, Human
caaagugcugagauuaggcguuagccaccgcgcccggccagaaaucacuuuuauauugucacau

SEQ ID NO: 497303 - RNA, 64 nt, Human
gagacacccggaggagcaggugggaagaugaagccggccagagccccucugcccagcaugcccu

SEQ ID NO: 497304 - RNA, 53 nt, Human
gggagccaguccaggagugagaccggccagaugaggcuggccaagccggggag

SEQ ID NO: 497305 - RNA, 64 nt, Human
aucugcuggagcaaagggaaaccgugggcuuuuccggccagauacucuugagcucugugacccu

SEQ ID NO: 497306 - RNA, 64 nt, Human
uuuccuuccguccucaauuucuaccuccauagaccggccagaauuuagcuucacuugagagaga

SEQ ID NO: 497307 - RNA, 64 nt, Human
cgagucuacccagcccuuguuagauucagaggagcggccagaagaucuacaauuaguagaucau

SEQ ID NO: 497308 - RNA, 64 nt, Human
aauuucguuccuaccaguuaaguaguuuucugaacggccagaagaccauucgaaauucaugaua

SEQ ID NO: 497309 - RNA, 64 nt, Human
ugaagcuguagggacucaucuugcauggcaccgccggccagacacugcccaaggaccaguauuu

SEQ ID NO: 497310 - RNA, 64 nt, Human
agcuguuccugcuuugaguuucccuagagcugugcggccagauagcuguuccugaguugcaggc

SEQ ID NO: 497311 - RNA, 64 nt, Human
aucuccaggagaaccuacagauuggaagcagcccacaccugauguggacuccugacccgggacu

SEQ ID NO: 497312 - RNA, 64 nt, Human
guauccucuccgucugggugcccagcucccacgcacaccugagcuuucggcaugcucccaccuc

SEQ ID NO: 497313 - RNA, 64 nt, Human
auacucccuuugucuucccucucuacuccucgcuacaccugagccaggcucuugccaacucugu

SEQ ID NO: 497314 - RNA, 61 nt, Human
uggcacuuuacucauugcacuugaguuuauugccccauaacuaaaggaucaggaugauggu

SEQ ID NO: 497315 - RNA, 64 nt, Human
cggcgcagcucagggaucuccgagucaggacggucggccagacccacgggguaacgggucuaau

SEQ ID NO: 497316 - RNA, 64 nt, Human
gucugugugugaggucacccucaaacugcaccgccggccagauacccuccugaccccgaggacu

SEQ ID NO: 497317 - RNA, 64 nt, Human
cauguccuacuuccucuacucucccgugcacugccggccagagcucaagaagcugcugcacggg

SEQ ID NO: 497318 - RNA, 64 nt, Human
agagaaauuccuuuugggacuggaggcagaaaagcggccagaaggcagcagcccuggcuccuuu

SEQ ID NO: 497319 - RNA, 64 nt, Human
augugucuuggcaggcacucauuucuguggcugucggccagagggaauguucuggagcugccaa

SEQ ID NO: 497320 - RNA, 64 nt, Human
caccccagucagaagccuggcacccccucugcuucggccagaugugcuggcugacuccgacuuc

SEQ ID NO: 497321 - RNA, 64 nt, Human
gugugacagggcccaaggcugggccucccugacccggccagacuggugucuggccuaaugaggg

SEQ ID NO: 497322 - RNA, 64 nt, Human
cucaagugagccuucgguacuccuggugcccgcccggccagaccgucagcuugauaauuacuaa

SEQ ID NO: 497323 - RNA, 64 nt, Human
gagauuguguggggguagaagcugucuggaggcccggccagagaauuugugggguuguggaggu

SEQ ID NO: 497324 - RNA, 64 nt, Human
gcggcgcucccuuccuucccacgcucagcggccccggccagacccuggcagacuucacaccuca

SEQ ID NO: 497325 - RNA, 64 nt, Human
gaugcaggauuuguucucuguccagcagucacuucggccagagcugaagaguugccccgucucu

SEQ ID NO: 497326 - RNA, 64 nt, Human
cucuucacuugaaaucaugucccuauuucuaccccggccagaacauggacagaggccagaagcc

SEQ ID NO: 497327 - RNA, 64 nt, Human
aagugcugggauuacaggcgugagccaccgugcccggccagaaaauacauucuuuacagcaaau

SEQ ID NO: 497328 - RNA, 64 nt, Human
auacuaaagaaguugggggagcucgagagccagacggccagacaggcagaccccuccagaggcc

SEQ ID NO: 497329 - RNA, 64 nt, Human
aggaauagaaaggggcccccaauuuuuuuuuaagcggccagauaauaaauaauguaaccuuugc

SEQ ID NO: 497330 - RNA, 64 nt, Human
ccacaguugcuccuuuguuugcucuucucagccucggccagauuuacaguccaggcagcaaaau

SEQ ID NO: 497331 - RNA, 64 nt, Human
cagguaccuccgggcgggcaagccucugauuugcacaccugaaaaucgcggaauugaguuucga

SEQ ID NO: 497332 - RNA, 64 nt, Human
uauagucuguguccauacucacagaaugaauggcacaccugagaucaacauucacauaguuuag

SEQ ID NO: 497333 - RNA, 64 nt, Human
guccuggcuuugucauaucuacuuaguccauccgacaccugaaucauuccauguaaaacagagc

SEQ ID NO: 497334 - RNA, 64 nt, Human
gauacuugccagucucuccagugugggcaccagccggccagaacagaugcgagcaguccaugac

SEQ ID NO: 497335 - RNA, 64 nt, Human
gccuaauaugauuugccccgauacucaucuugcacggccagaacuguuugguugauuaaaauac

SEQ ID NO: 497336 - RNA, 64 nt, Human
ccacugcuggaggcagcgcuggucgucaccugggcggccagaggcugggaucugcgaaguugaa

SEQ ID NO: 497337 - RNA, 64 nt, Human
auugauguaucuucucaagaucuaucuggacagacggccagagaguaugcuguuucuagucguc

SEQ ID NO: 497338 - RNA, 64 nt, Human
cugaagguuguagggaccuugcccugcugucugccggccagagccucucccaucugacccaggc

SEQ ID NO: 497339 - RNA, 64 nt, Human
ccugggcauguuuccaccguuuucugaguagcugcggccagagugaggcuccugcuguacagug

SEQ ID NO: 497340 - RNA, 64 nt, Human
ucccagugccuuggauggagacggccaguucuggcggccagauguggugcucuggaauccaguc

SEQ ID NO: 497341 - RNA, 64 nt, Human
cauccauccauccguccaccuuccuccagacugucggccagagucuguuucaggagcggcgccc

SEQ ID NO: 497342 - RNA, 64 nt, Human
cguuugucucugacaagaucagcuguaggcucaccggccagagaagaccacugugagcauuuug

SEQ ID NO: 497343 - RNA, 64 nt, Human
agacccucaauaaacgucagcuuccuuccuucugcggccagagccgaggcgggcgggggugaga

SEQ ID NO: 497344 - RNA, 54 nt, Human
agaccaggaagccacccuaacacucggccagacccgcuggcucccaggcccuga

SEQ ID NO: 497345 - RNA, 64 nt, Human
agaggcccaggcugucugccugcgguccuuccuccggccagaguggaggccccaggcugcuagc

SEQ ID NO: 497346 - RNA, 64 nt, Human
ggcgcagcgggacgcggggcucggaucugaaaggcggccagauccacaucuggaucuggaucug

SEQ ID NO: 497347 - RNA, 64 nt, Human
cgcucguacuccuggcaccagcgggcagugcgggcggccagauugcuguggcccauccugauuc

SEQ ID NO: 497348 - RNA, 64 nt, Human
aggggccaggcuugcggagggggagcccgcggagcggccagacuccccggggcgcucagccucc

SEQ ID NO: 497349 - RNA, 64 nt, Human
uggagcccagccugggagcgcaaaacccaagaagcggccagaacgcaccuccggcuccggcgga

SEQ ID NO: 497350 - RNA, 64 nt, Human
agugaguccagucucauuaaauauuggagaauacacaccugaguaagauccugugauugcagca

SEQ ID NO: 497351 - RNA, 64 nt, Human
auugugaaagcuccauguuuagaaauaaaugaaaacaccugagcugguggcuguguacuuugac

SEQ ID NO: 497352 - RNA, 64 nt, Human
ucacuucuuuagccagccccauccccuccaccccacaccugaguucuugccuccuccuuuuggg

SEQ ID NO: 497353 - RNA, 64 nt, Human
gcucagaguuaucccaaagucugagccaccagccacaccugacaggggugagaaguccucgcug

SEQ ID NO: 497354 - RNA, 59 nt, Human
uugaggaucaggaagucuaaagccucaggcggccagagggugugcggagcuggugggga

SEQ ID NO: 497355 - RNA, 64 nt, Human
ugaguagaaggagagacgggguagggaacgggcccggccagaaaagaaccauuucuucugccau

SEQ ID NO: 497356 - RNA, 64 nt, Human
aagugcugggauuccaggcgugagccacugcgcccggccagaauggcauuauauuuaaauaguu

SEQ ID NO: 497357 - RNA, 64 nt, Human
cucugacucugacgucggcacacacggccccggacggccagaggggaaccgccgggugacaccu

SEQ ID NO: 497358 - RNA, 64 nt, Human
gacucuguuugggagcacgggauggccgggggcccggccagagcggggcugcauggcuuucgca

SEQ ID NO: 497359 - RNA, 64 nt, Human
aaaagggcagcccuggccuugccucuggcucugucggccagagccccaacucagccccaaaagc

SEQ ID NO: 497360 - RNA, 64 nt, Human
uggauguguguggggggcgugccucucagaaacgcggccagaagacaagcagggaagugaaagg

SEQ ID NO: 497361 - RNA, 64 nt, Human
cgcccuucucuccagaagccgggcaggcagaauccggccagacgacggggcugagccaucagga

SEQ ID NO: 497362 - RNA, 64 nt, Human
cccaccucccacggccccgccccugcccccgcuccggccagaggggcccuggcuguaauaaaga

SEQ ID NO: 497363 - RNA, 64 nt, Human
gggcacgcaggauucugagcaccaggggcagaggcggccagacaaccucagggaggaguguccu

SEQ ID NO: 497364 - RNA, 64 nt, Human
ggccgaggcagcccagagcagcgggaugagcuggcggccagagaacgcccagcccagcccaccc

SEQ ID NO: 497365 - RNA, 64 nt, Human
accuggggugcucaggaggggguacccggggccccggccagagauacaucaauuacacccccgu

SEQ ID NO: 497366 - RNA, 64 nt, Human
gggaccagcgggcuagucccagggcauggcccagcggccagauucuuuuucccaggauuaaaac

SEQ ID NO: 497367 - RNA, 64 nt, Human
caccaaguagcgagucagcaggggccgccugccccggccagaacgggcagggcugccacugacc

SEQ ID NO: 497368 - RNA, 64 nt, Human
uggcggggucuccgccgccagcccugcagcgggccggccagagggggccccgggggggcgggaa

SEQ ID NO: 497369 - RNA, 64 nt, Human
gaagaugaauucuugaauucugccugcccacccccggccagaucccuggagcuggccuccuucc

SEQ ID NO: 497370 - RNA, 64 nt, Human
accaaaauagaaguaaauuaaaguuguacauuggacaccugacaacccucugccaugaccgaga

SEQ ID NO: 497371 - RNA, 64 nt, Human
cagcacauacaccuaggcuguuuuuccuuccuccacaccugagggacgcagcaacagcuaggau

SEQ ID NO: 497372 - RNA, 64 nt, Human
gcauagccuggaucuccucaaguccccaagauucacaccugacucugaaaucugaagaccucga

SEQ ID NO: 497373 - RNA, 64 nt, Human
aaauauguuaaauuuaggcucagcacaguagcucacaccugaaaucuuagcacuucgggaggcu

SEQ ID NO: 497374 - RNA, 64 nt, Human
ucgcccaaccccuagcacuccggcucugggcuuucggccagaaguuaauuaaccucagagccag

SEQ ID NO: 497375 - RNA, 64 nt, Human
ggcuucccuggcaugauggacaaaggccuggcgucggccagaggggcugcuccagugggcaggg

SEQ ID NO: 497376 - RNA, 64 nt, Human
cucccacaccgugcuggacuucuacgagccgcggcggccagaggacgaugacccuacagaacag

SEQ ID NO: 497377 - RNA, 64 nt, Human
agcugaucgccaacucacuggccacugcaggggacggccagagcgagcugugcaagcuggaagc

SEQ ID NO: 497378 - RNA, 64 nt, Human
caccagcaagugugugggagucgcacuggugugacggccagaacuggacucagauuucagcccc

SEQ ID NO: 497379 - RNA, 64 nt, Human
acgccuguaauccuagcacuuugggaggccgaggcggccagaucacaagguuaggaguucaaga

SEQ ID NO: 497380 - RNA, 64 nt, Human
gccccagugccuuuguccuucccuuggggcuugccggccagacuucucuccccugcggcuccca

SEQ ID NO: 497381 - RNA, 64 nt, Human
acaguguccccaggaaccaccuucuggagccuagcggccagacguggcuucuccugaguucuag

SEQ ID NO: 497382 - RNA, 64 nt, Human
ggauggugaagcucagcaggggucugaggguagccggccagaagaggcuggaaccuccugcuca

SEQ ID NO: 497383 - RNA, 64 nt, Human
ugcccccgcucugccaucagccccugcugcuccucggccagagcucccaggacgcagggagacc

SEQ ID NO: 497384 - RNA, 64 nt, Human
uucacggcaugugcuuucucaggaaccuuucaagcggccagaaccccugcgaaucacacaugac

SEQ ID NO: 497385 - RNA, 64 nt, Human
uggccccuccacccucccuccccucccggcuccccggccagagggagagcuuggucucuggacc

SEQ ID NO: 497386 - RNA, 64 nt, Human
augugagagggguguuugcugagcgcuccgggcacggccagagggcaagugagcaugcacggac

SEQ ID NO: 497387 - RNA, 64 nt, Human
accaaagagagccaggggagggccccggguucggcggccagaggcaggucagggguccccucuc

SEQ ID NO: 497388 - RNA, 64 nt, Human
cucauggcauguacuuucucaggaaccuuucaagcggccagaaccccugcgaaucacacaugac

SEQ ID NO: 497389 - RNA, 64 nt, Human
ccuuuaacagcuugcucuggcaaccccauaaaugacaccugagguccguagaagcuaagcuccu

SEQ ID NO: 497390 - RNA, 64 nt, Human
uuuaucaggagcccacuucugacauaacuaacccacaccugagauaacggcauuaauccauuca

SEQ ID NO: 497391 - RNA, 64 nt, Human
gggcccugacccuaacccuccagcucagcccuguacaccugacccuguaaaugagugggguuug

SEQ ID NO: 497392 - RNA, 61 nt, Human; identical to SEQ ID NO: 497173

SEQ ID NO: 497393 - RNA, 64 nt, Human; identical to SEQ ID NO: 497177

SEQ ID NO: 497394 - RNA, 64 nt, Human; identical to SEQ ID NO: 497178

SEQ ID NO: 497395 - RNA, 64 nt, Human; identical to SEQ ID NO: 497179

SEQ ID NO: 497396 - RNA, 64 nt, Human; identical to SEQ ID NO: 497180

SEQ ID NO: 497397 - RNA, 64 nt, Human; identical to SEQ ID NO: 497181

SEQ ID NO: 497398 - RNA, 64 nt, Human; identical to SEQ ID NO: 497182

SEQ ID NO: 497399 - RNA, 64 nt, Human; identical to SEQ ID NO: 497183

SEQ ID NO: 497400 - RNA, 64 nt, Human
aucccagcacuuuugggaggucaaggugagcagaacaccugaggacaggaguuugagaccagcc

SEQ ID NO: 497401 - RNA, 64 nt, Human
ugcuuuaugggaaguuuuucucugaccagguacaacaccugacuuuaaaggccugaaaugcuac

SEQ ID NO: 497402 - RNA, 64 nt, Human
cuugcaagguuaagcaagguggguggaaacuaagacaccugaacccuccagggccucccgcauc

SEQ ID NO: 497403 - RNA, 64 nt, Human; identical to SEQ ID NO: 497184

SEQ ID NO: 497404 - RNA, 64 nt, Human; identical to SEQ ID NO: 497185

SEQ ID NO: 497405 - RNA, 64 nt, Human; identical to SEQ ID NO: 497186

SEQ ID NO: 497406 - RNA, 64 nt, Human; identical to SEQ ID NO: 497187

SEQ ID NO: 497407 - RNA, 64 nt, Human; identical to SEQ ID NO: 497188

SEQ ID NO: 497408 - RNA, 64 nt, Human; identical to SEQ ID NO: 497189

SEQ ID NO: 497409 - RNA, 64 nt, Human; identical to SEQ ID NO: 497190

SEQ ID NO: 497410 - RNA, 64 nt, Human; identical to SEQ ID NO: 497191

SEQ ID NO: 497411 - RNA, 64 nt, Human; identical to SEQ ID NO: 497192

SEQ ID NO: 497412 - RNA, 64 nt, Human; identical to SEQ ID NO: 497197

SEQ ID NO: 497413 - RNA, 64 nt, Human; identical to SEQ ID NO: 497198

SEQ ID NO: 497414 - RNA, 64 nt, Human; identical to SEQ ID NO: 497199

SEQ ID NO: 497415 - RNA, 64 nt, Human; identical to SEQ ID NO: 497200

SEQ ID NO: 497416 - RNA, 64 nt, Human; identical to SEQ ID NO: 497201

SEQ ID NO: 497417 - RNA, 64 nt, Human; identical to SEQ ID NO: 497202

SEQ ID NO: 497418 - RNA, 64 nt, Human; identical to SEQ ID NO: 497203

SEQ ID NO: 497419 - RNA, 64 nt, Human
ugggcugugccguccacuggggacuggggaugggacaccugaggacauucugagacuucuuucu

SEQ ID NO: 497420 - RNA, 64 nt, Human
uguuuuccaaggaaaugguaaccuguuucugagaacaccugaaaucaauggcuauacauuccaa

SEQ ID NO: 497421 - RNA, 64 nt, Human
ucugaaagcuaacaccccacuuugacccucgaccacaccugaaaaugucucaaaucuccaggag

SEQ ID NO: 497422 - RNA, 64 nt, Human; identical to SEQ ID NO: 497204

SEQ ID NO: 497423 - RNA, 64 nt, Human; identical to SEQ ID NO: 497205

SEQ ID NO: 497424 - RNA, 64 nt, Human; identical to SEQ ID NO: 497206

SEQ ID NO: 497425 - RNA, 64 nt, Human; identical to SEQ ID NO: 497207

SEQ ID NO: 497426 - RNA, 64 nt, Human; identical to SEQ ID NO: 497208

SEQ ID NO: 497427 - RNA, 64 nt, Human; identical to SEQ ID NO: 497209

SEQ ID NO: 497428 - RNA, 64 nt, Human; identical to SEQ ID NO: 497210

SEQ ID NO: 497429 - RNA, 64 nt, Human; identical to SEQ ID NO: 497211

SEQ ID NO: 497430 - RNA, 64 nt, Human; identical to SEQ ID NO: 497212

SEQ ID NO: 497431 - RNA, 64 nt, Human; identical to SEQ ID NO: 497216

SEQ ID NO: 497432 - RNA, 64 nt, Human; identical to SEQ ID NO: 497217

SEQ ID NO: 497433 - RNA, 64 nt, Human; identical to SEQ ID NO: 497218

SEQ ID NO: 497434 - RNA, 64 nt, Human; identical to SEQ ID NO: 497219

SEQ ID NO: 497435 - RNA, 64 nt, Human; identical to SEQ ID NO: 497220

SEQ ID NO: 497436 - RNA, 64 nt, Human; identical to SEQ ID NO: 497221

SEQ ID NO: 497437 - RNA, 64 nt, Human; identical to SEQ ID NO: 497222

SEQ ID NO: 497438 - RNA, 64 nt, Human
uccaccuuuaaacacggggcuugcaacuuagcucacaccugaccaaucagagagcucacuaaaa

SEQ ID NO: 497439 - RNA, 64 nt, Human
auaggaaaaucuuaaaauucuugggaguguugucacaccugaaaauuaugagucucuaugaucu

SEQ ID NO: 497440 - RNA, 64 nt, Human
uuugucaguuguugugacugagagauaaugaaugacaccugaaaugcauaugguauuuuuggga

SEQ ID NO: 497441 - RNA, 64 nt, Human; identical to SEQ ID NO: 497223

SEQ ID NO: 497442 - RNA, 64 nt, Human; identical to SEQ ID NO: 497224

SEQ ID NO: 497443 - RNA, 64 nt, Human; identical to SEQ ID NO: 497225

SEQ ID NO: 497444 - RNA, 64 nt, Human; identical to SEQ ID NO: 497226

SEQ ID NO: 497445 - RNA, 59 nt, Human; identical to SEQ ID NO: 497227

SEQ ID NO: 497446 - RNA, 64 nt, Human; identical to SEQ ID NO: 497228

SEQ ID NO: 497447 - RNA, 64 nt, Human; identical to SEQ ID NO: 497229

SEQ ID NO: 497448 - RNA, 64 nt, Human; identical to SEQ ID NO: 497230

SEQ ID NO: 497449 - RNA, 64 nt, Human; identical to SEQ ID NO: 497231

SEQ ID NO: 497450 - RNA, 64 nt, Human; identical to SEQ ID NO: 497235

SEQ ID NO: 497451 - RNA, 60 nt, Human; identical to SEQ ID NO: 497236

SEQ ID NO: 497452 - RNA, 64 nt, Human; identical to SEQ ID NO: 497237

SEQ ID NO: 497453 - RNA, 64 nt, Human; identical to SEQ ID NO: 497238

SEQ ID NO: 497454 - RNA, 64 nt, Human; identical to SEQ ID NO: 497239

SEQ ID NO: 497455 - RNA, 64 nt, Human; identical to SEQ ID NO: 497240

SEQ ID NO: 497456 - RNA, 64 nt, Human; identical to SEQ ID NO: 497241

SEQ ID NO: 497457 - RNA, 64 nt, Human
gugagcacuguccucaggagagucacagggcuugacaccugacucugagcuggaacaguagggg

SEQ ID NO: 497458 - RNA, 64 nt, Human
gaugaauagccccacccuucuugcuguccccaacacaccugaugucacuuugagccauauaguu

SEQ ID NO: 497459 - RNA, 64 nt, Human
uuguggaaauguuucagauuaaaugauaguaaaaacaccugacaacuaaacauaguaaguaaua

SEQ ID NO: 497460 - RNA, 64 nt, Human
augcaauuuucaacuauucugaaaccagcaggacacaccugacuuuaauaguuuuagcugaaau

SEQ ID NO: 497461 - RNA, 64 nt, Human; identical to SEQ ID NO: 497242

SEQ ID NO: 497462 - RNA, 64 nt, Human; identical to SEQ ID NO: 497243

SEQ ID NO: 497463 - RNA, 64 nt, Human; identical to SEQ ID NO: 497244

SEQ ID NO: 497464 - RNA, 64 nt, Human; identical to SEQ ID NO: 497245

SEQ ID NO: 497465 - RNA, 64 nt, Human; identical to SEQ ID NO: 497246

SEQ ID NO: 497466 - RNA, 64 nt, Human; identical to SEQ ID NO: 497247

SEQ ID NO: 497467 - RNA, 64 nt, Human; identical to SEQ ID NO: 497248

SEQ ID NO: 497468 - RNA, 64 nt, Human; identical to SEQ ID NO: 497249

SEQ ID NO: 497469 - RNA, 64 nt, Human; identical to SEQ ID NO: 497250

SEQ ID NO: 497470 - RNA, 64 nt, Human; identical to SEQ ID NO: 497254

SEQ ID NO: 497471 - RNA, 64 nt, Human; identical to SEQ ID NO: 497255

SEQ ID NO: 497472 - RNA, 64 nt, Human; identical to SEQ ID NO: 497256

SEQ ID NO: 497473 - RNA, 64 nt, Human; identical to SEQ ID NO: 497257

SEQ ID NO: 497474 - RNA, 64 nt, Human; identical to SEQ ID NO: 497258

SEQ ID NO: 497475 - RNA, 64 nt, Human; identical to SEQ ID NO: 497259

SEQ ID NO: 497476 - RNA, 64 nt, Human; identical to SEQ ID NO: 497260

SEQ ID NO: 497477 - RNA, 64 nt, Human
agacccggacagagcuucagaggaguguugagugacaccugaggaugcggcugcacacacucag

SEQ ID NO: 497478 - RNA, 64 nt, Human
gacagcuuugcaggugcuggcacuaacuucauugacaccugagucacagcugcccagugggauu

SEQ ID NO: 497479 - RNA, 64 nt, Human
ggggauagcagcaaaccaccuaucuggccccaacacaccugagagaauucagcagcccagacug

SEQ ID NO: 497480 - RNA, 64 nt, Human; identical to SEQ ID NO: 497261

SEQ ID NO: 497481 - RNA, 64 nt, Human; identical to SEQ ID NO: 497262

SEQ ID NO: 497482 - RNA, 64 nt, Human; identical to SEQ ID NO: 497263

SEQ ID NO: 497483 - RNA, 64 nt, Human; identical to SEQ ID NO: 497264

SEQ ID NO: 497484 - RNA, 64 nt, Human; identical to SEQ ID NO: 497265

SEQ ID NO: 497485 - RNA, 64 nt, Human; identical to SEQ ID NO: 497266

SEQ ID NO: 497486 - RNA, 64 nt, Human; identical to SEQ ID NO: 497267

SEQ ID NO: 497487 - RNA, 64 nt, Human; identical to SEQ ID NO: 497268

SEQ ID NO: 497488 - RNA, 64 nt, Human; identical to SEQ ID NO: 497269

SEQ ID NO: 497489 - RNA, 64 nt, Human; identical to SEQ ID NO: 497273

SEQ ID NO: 497490 - RNA, 64 nt, Human; identical to SEQ ID NO: 497274

SEQ ID NO: 497491 - RNA, 64 nt, Human; identical to SEQ ID NO: 497275

SEQ ID NO: 497492 - RNA, 64 nt, Human; identical to SEQ ID NO: 497276

SEQ ID NO: 497493 - RNA, 56 nt, Human; identical to SEQ ID NO: 497277

SEQ ID NO: 497494 - RNA, 64 nt, Human
guuuugaaaagaaaagguccggggaugguggcucacaccugaaaucccagcacuuugggaggcc

SEQ ID NO: 497495 - RNA, 64 nt, Human
uaagaccauaauguaguuauaaauggaaauguuuacaccugaagugaguauuuucaaauuaaaa

SEQ ID NO: 497496 - RNA, 64 nt, Human
cgacgaccagggaggaggaaucggcggacgcgggacaccugaggaaaggguacuaccuuaaaaa

SEQ ID NO: 497497 - RNA, 64 nt, Human; identical to SEQ ID NO: 497281

SEQ ID NO: 497498 - RNA, 64 nt, Human; identical to SEQ ID NO: 497282

SEQ ID NO: 497499 - RNA, 64 nt, Human
caugauccagguggcucugagaagcuuggccuggacaccugagccugcggccgguacuccugcc

SEQ ID NO: 497500 - RNA, 64 nt, Human
gguuuaacacugugcagggcuguggagcucugagacaccugaaccccuacccauccccugcacc

SEQ ID NO: 497501 - RNA, 64 nt, Human
ucauucugggcagugcccagccaccggcugacccacaccugacacuuccagccagucugcugcc

SEQ ID NO: 497502 - RNA, 64 nt, Human; identical to SEQ ID NO: 497283

SEQ ID NO: 497503 - RNA, 64 nt, Human; identical to SEQ ID NO: 497284

SEQ ID NO: 497504 - RNA, 64 nt, Human; identical to SEQ ID NO: 497285

SEQ ID NO: 497505 - RNA, 64 nt, Human; identical to SEQ ID NO: 497286

SEQ ID NO: 497506 - RNA, 64 nt, Human; identical to SEQ ID NO: 497287

SEQ ID NO: 497507 - RNA, 64 nt, Human; identical to SEQ ID NO: 497288

SEQ ID NO: 497508 - RNA, 64 nt, Human; identical to SEQ ID NO: 497289

SEQ ID NO: 497509 - RNA, 64 nt, Human; identical to SEQ ID NO: 497290

SEQ ID NO: 497510 - RNA, 64 nt, Human; identical to SEQ ID NO: 497291

SEQ ID NO: 497511 - RNA, 64 nt, Human; identical to SEQ ID NO: 497295

SEQ ID NO: 497512 - RNA, 64 nt, Human; identical to SEQ ID NO: 497296

SEQ ID NO: 497513 - RNA, 64 nt, Human; identical to SEQ ID NO: 497297

SEQ ID NO: 497514 - RNA, 64 nt, Human; identical to SEQ ID NO: 497298

SEQ ID NO: 497515 - RNA, 64 nt, Human; identical to SEQ ID NO: 497299

SEQ ID NO: 497516 - RNA, 64 nt, Human; identical to SEQ ID NO: 497300

SEQ ID NO: 497517 - RNA, 64 nt, Human; identical to SEQ ID NO: 497301

SEQ ID NO: 497518 - RNA, 64 nt, Human; identical to SEQ ID NO: 497495

SEQ ID NO: 497519 - RNA, 64 nt, Human
aggccccaccuuuggugcuuuccagaaucccguaacaccugauuaacugaggcauccacuucuu

SEQ ID NO: 497520 - RNA, 64 nt, Human
cacuuacagcugaagccaucagcaucuggcaggcacaccugagucaccauguagcgcugcuacu

SEQ ID NO: 497521 - RNA, 64 nt, Human; identical to SEQ ID NO: 497302

SEQ ID NO: 497522 - RNA, 64 nt, Human; identical to SEQ ID NO: 497303

SEQ ID NO: 497523 - RNA, 53 nt, Human; identical to SEQ ID NO: 497304

SEQ ID NO: 497524 - RNA, 64 nt, Human; identical to SEQ ID NO: 497305

SEQ ID NO: 497525 - RNA, 64 nt, Human; identical to SEQ ID NO: 497306

SEQ ID NO: 497526 - RNA, 64 nt, Human; identical to SEQ ID NO: 497307

SEQ ID NO: 497527 - RNA, 64 nt, Human; identical to SEQ ID NO: 497308

SEQ ID NO: 497528 - RNA, 64 nt, Human; identical to SEQ ID NO: 497309

SEQ ID NO: 497529 - RNA, 64 nt, Human; identical to SEQ ID NO: 497310

SEQ ID NO: 497530 - RNA, 64 nt, Human; identical to SEQ ID NO: 497315

SEQ ID NO: 497531 - RNA, 64 nt, Human; identical to SEQ ID NO: 497316

SEQ ID NO: 497532 - RNA, 64 nt, Human; identical to SEQ ID NO: 497317

SEQ ID NO: 497533 - RNA, 64 nt, Human; identical to SEQ ID NO: 497318

SEQ ID NO: 497534 - RNA, 64 nt, Human; identical to SEQ ID NO: 497319

SEQ ID NO: 497535 - RNA, 64 nt, Human; identical to SEQ ID NO: 497320

SEQ ID NO: 497536 - RNA, 64 nt, Human; identical to SEQ ID NO: 497321

SEQ ID NO: 497537 - RNA, 64 nt, Human
auccccuaggccuaucugagacccauacaggcccacaccugagcuccugucugccugaggaggg

SEQ ID NO: 497538 - RNA, 64 nt, Human
gaucuuauccuaguaucuguaaugcucacuuggcacaccugacuugugggcuguguguaaggug

SEQ ID NO: 497539 - RNA, 64 nt, Human
uccuuugguuuucugccagucauccagcugauacacaccugaugauuuuaaagaaagccacaca

SEQ ID NO: 497540 - RNA, 64 nt, Human
gagaaaggcucaauuuggugcucacguguccuuaacaccugaucuggcccaagcugggcucccu

SEQ ID NO: 497541 - RNA, 64 nt, Human; identical to SEQ ID NO: 497322

SEQ ID NO: 497542 - RNA, 64 nt, Human; identical to SEQ ID NO: 497323

SEQ ID NO: 497543 - RNA, 64 nt, Human; identical to SEQ ID NO: 497324

SEQ ID NO: 497544 - RNA, 64 nt, Human; identical to SEQ ID NO: 497325

SEQ ID NO: 497545 - RNA, 64 nt, Human; identical to SEQ ID NO: 497326

SEQ ID NO: 497546 - RNA, 64 nt, Human; identical to SEQ ID NO: 497327

SEQ ID NO: 497547 - RNA, 64 nt, Human; identical to SEQ ID NO: 497328

SEQ ID NO: 497548 - RNA, 64 nt, Human; identical to SEQ ID NO: 497329

SEQ ID NO: 497549 - RNA, 64 nt, Human; identical to SEQ ID NO: 497330

SEQ ID NO: 497550 - RNA, 64 nt, Human; identical to SEQ ID NO: 497334

SEQ ID NO: 497551 - RNA, 64 nt, Human; identical to SEQ ID NO: 497335

SEQ ID NO: 497552 - RNA, 64 nt, Human; identical to SEQ ID NO: 497336

SEQ ID NO: 497553 - RNA, 64 nt, Human; identical to SEQ ID NO: 497337

SEQ ID NO: 497554 - RNA, 64 nt, Human; identical to SEQ ID NO: 497338

SEQ ID NO: 497555 - RNA, 64 nt, Human; identical to SEQ ID NO: 497339

SEQ ID NO: 497556 - RNA, 64 nt, Human; identical to SEQ ID NO: 497340

SEQ ID NO: 497557 - RNA, 64 nt, Human
gccuguccugcagaguccccauggcauggagcuuacaccugacugacuggagcccccuccccga

SEQ ID NO: 497558 - RNA, 64 nt, Human
ugugcuguuggaaaacauggaaaaugcauccuuaacaccugagccucuggucaucuucaguauu

SEQ ID NO: 497559 - RNA, 64 nt, Human
aggcacagauguuuugagaacuuuauuugcagagacaccugagaaucgauggcucagucugcuc

SEQ ID NO: 497560 - RNA, 64 nt, Human; identical to SEQ ID NO: 497341

SEQ ID NO: 497561 - RNA, 64 nt, Human; identical to SEQ ID NO: 497342

SEQ ID NO: 497562 - RNA, 64 nt, Human; identical to SEQ ID NO: 497343

SEQ ID NO: 497563 - RNA, 54 nt, Human; identical to SEQ ID NO: 497344

SEQ ID NO: 497564 - RNA, 64 nt, Human; identical to SEQ ID NO: 497345

SEQ ID NO: 497565 - RNA, 64 nt, Human; identical to SEQ ID NO: 497346

SEQ ID NO: 497566 - RNA, 64 nt, Human; identical to SEQ ID NO: 497347

SEQ ID NO: 497567 - RNA, 64 nt, Human; identical to SEQ ID NO: 497348

SEQ ID NO: 497568 - RNA, 64 nt, Human; identical to SEQ ID NO: 497349

SEQ ID NO: 497569 - RNA, 59 nt, Human; identical to SEQ ID NO: 497354

SEQ ID NO: 497570 - RNA, 64 nt, Human; identical to SEQ ID NO: 497355

SEQ ID NO: 497571 - RNA, 64 nt, Human; identical to SEQ ID NO: 497356

SEQ ID NO: 497572 - RNA, 64 nt, Human; identical to SEQ ID NO: 497357

SEQ ID NO: 497573 - RNA, 64 nt, Human; identical to SEQ ID NO: 497358

SEQ ID NO: 497574 - RNA, 64 nt, Human; identical to SEQ ID NO: 497359

SEQ ID NO: 497575 - RNA, 64 nt, Human; identical to SEQ ID NO: 497360

SEQ ID NO: 497576 - RNA, 64 nt, Human
ggugccgcuccucacucaaccccaggcuagggguacaccugacccagcuggccucggcccgggg

SEQ ID NO: 497577 - RNA, 64 nt, Human
ggacuuuugaccaccuugggcuggcacucuuagcacaccugagacagauuuaagccucccuaag

SEQ ID NO: 497578 - RNA, 64 nt, Human
agggacagguccugggugagggugggagauuuagacaccugaaacugggcguggagagaagagc

SEQ ID NO: 497579 - RNA, 64 nt, Human
auaaaacugggccuguagcucaagagaaaaguugacaccugagaaacaucuagaaauugccuau

SEQ ID NO: 497580 - RNA, 64 nt, Human; identical to SEQ ID NO: 497361

SEQ ID NO: 497581 - RNA, 64 nt, Human; identical to SEQ ID NO: 497362

SEQ ID NO: 497582 - RNA, 64 nt, Human; identical to SEQ ID NO: 497363

SEQ ID NO: 497583 - RNA, 64 nt, Human; identical to SEQ ID NO: 497364

SEQ ID NO: 497584 - RNA, 64 nt, Human; identical to SEQ ID NO: 497365

SEQ ID NO: 497585 - RNA, 64 nt, Human; identical to SEQ ID NO: 497366

SEQ ID NO: 497586 - RNA, 64 nt, Human; identical to SEQ ID NO: 497367

SEQ ID NO: 497587 - RNA, 64 nt, Human; identical to SEQ ID NO: 497368

SEQ ID NO: 497588 - RNA, 64 nt, Human; identical to SEQ ID NO: 497369

SEQ ID NO: 497589 - RNA, 64 nt, Human; identical to SEQ ID NO: 497374

SEQ ID NO: 497590 - RNA, 64 nt, Human; identical to SEQ ID NO: 497375

SEQ ID NO: 497591 - RNA, 64 nt, Human; identical to SEQ ID NO: 497376

SEQ ID NO: 497592 - RNA, 64 nt, Human; identical to SEQ ID NO: 497377

SEQ ID NO: 497593 - RNA, 64 nt, Human; identical to SEQ ID NO: 497378

SEQ ID NO: 497594 - RNA, 64 nt, Human; identical to SEQ ID NO: 497379

SEQ ID NO: 497595 - RNA, 64 nt, Human; identical to SEQ ID NO: 497380

SEQ ID NO: 497596 - RNA, 64 nt, Human
ggugccgccuuccugaauuggcaguggucagagcacaccugaacccuauccugggcuggugaug

SEQ ID NO: 497597 - RNA, 64 nt, Human
ucuauacacacacauacauaaauauaccacauauacaccugauagucaaauaagguacagaaau

SEQ ID NO: 497598 - RNA, 64 nt, Human
gacacuggccauaccacuggacaggguuauguuaacaccugaauugcugggucuugagagagcc

SEQ ID NO: 497599 - RNA, 64 nt, Human; identical to SEQ ID NO: 497381

SEQ ID NO: 497600 - RNA, 64 nt, Human; identical to SEQ ID NO: 497382

SEQ ID NO: 497601 - RNA, 64 nt, Human; identical to SEQ ID NO: 497383

SEQ ID NO: 497602 - RNA, 64 nt, Human; identical to SEQ ID NO: 497384

SEQ ID NO: 497603 - RNA, 64 nt, Human; identical to SEQ ID NO: 497385

SEQ ID NO: 497604 - RNA, 64 nt, Human; identical to SEQ ID NO: 497386

SEQ ID NO: 497605 - RNA, 64 nt, Human; identical to SEQ ID NO: 497387

SEQ ID NO: 497606 - RNA, 64 nt, Human; identical to SEQ ID NO: 497388

SEQ ID NO: 497607 - RNA, 64 nt, Human
uggccaccaccucuucuacuugcugucugaaaaaacaccugacuaguacagcugagaucuuggc

SEQ ID NO: 497608 - RNA, 64 nt, Human
ucaugaagaggaggccucguggcauauucaguuuacaccugaaauauuccuugaugggacagcu

SEQ ID NO: 497609 - RNA, 64 nt, Human
aagagacauggagacugcagucacuugggaguagacaccugaaacuaaaaagucaaacuucauu

SEQ ID NO: 497610 - RNA, 64 nt, Human
cccaggccugugucccaagcaguacccaggcuuugcagaccacgcggggcagggcuccacugaa

SEQ ID NO: 497611 - RNA, 64 nt, Human
aaucuuguuuugccaauuuucuuugaaaauucuggcagaccaagguucuuuuuguuuacauaau

SEQ ID NO: 497612 - RNA, 64 nt, Human
cugcagugugacuuaacuuguguauugcauuccagcagaccacugaaccagacagcgaagccaa

SEQ ID NO: 497613 - RNA, 64 nt, Human
uggaccccuauuuaucucaaaacucuuaauauaugcagaccaacaggucuuugcauuccuuuua

SEQ ID NO: 497614 - RNA, 64 nt, Human
aacuuuauuuacaaaaacagaugacaucccagaugcagaccaugggcaaccaaccauugcacug

SEQ ID NO: 497615 - RNA, 64 nt, Human
cauucuuguuuuuucaucucauuauccaaguucugcagaccacacaggaacuugcuucauggcu

SEQ ID NO: 497616 - RNA, 64 nt, Human
gaaacucuaagcucccaccuaauaagaagcauaggcagaccagccagagggagagccaauggcc

SEQ ID NO: 497617 - RNA, 64 nt, Human
acacccagugcccacgcaugcucacauacauacagcagaccacaacccuguugccaagcagugc

SEQ ID NO: 497618 - RNA, 64 nt, Human
ugagccagcaauaccgcugcccccuggcgacagggcagaccaaugaugccaggcagcugucaca

SEQ ID NO: 497619 - RNA, 64 nt, Human
uauacugaaggggugacagagagaggucuucauggcagaccaggccuucacagcuaauggggag

SEQ ID NO: 497620 - RNA, 64 nt, Human
auauaaucaaauacaguguggguuaggaccuguggcagaccauuauaauaaagcauggccccgu

SEQ ID NO: 497621 - RNA, 64 nt, Human
auauauuauaacaaacauucuauaucgguauguagcagaccaaucucuaaaauagcuaauucuu

SEQ ID NO: 497622 - RNA, 64 nt, Human
cauacagcacugcuggaggaagaggaagauuugugcagaccaagagcaccacagacuacaacug

SEQ ID NO: 497623 - RNA, 64 nt, Human
uggaauccucaaaccugucacuuuggucagaugugcagaccauuacuaaggucuaugucugcaa

SEQ ID NO: 497624 - RNA, 64 nt, Human
guuuucuagggacacaaccaaaucauaacauauagcagaccaaucuauuuuugugugcugugug

SEQ ID NO: 497625 - RNA, 64 nt, Human
cgggguuucacuguguuggccaggcuggucucgaacaccugaccucaggugauccauucgucuu

SEQ ID NO: 497626 - RNA, 64 nt, Human
caccugaucugcaucuuuguuugcaucuccagagacaccugaggccccagagcuugaggcaaag

SEQ ID NO: 497627 - RNA, 64 nt, Human
cgccaggccuccucucguaccuuggacaaaggauacaccugaaccagaauaguuuucuuacccu

SEQ ID NO: 497628 - RNA, 64 nt, Human
gaggcgccacucacggacgucagggacaucaaggacaccugaggggucaggauauccccacccc

SEQ ID NO: 497629 - RNA, 64 nt, Human
cagaaagcaacuguacacaguagaauucuguggcgcagaccaugcuguauuaacacaucacuug

SEQ ID NO: 497630 - RNA, 64 nt, Human
aaugagaggauuuaggaugagcccgauagguguggcagaccaaauggacauuucucuaaaaaac

SEQ ID NO: 497631 - RNA, 64 nt, Human
agcauccugauuuuucuguaggaacuuuucuuuggcagaccaagugaagacucaggaauggugu

SEQ ID NO: 497632 - RNA, 64 nt, Human
cauuucuuguacuuuguaagucguuugcgagaaugcagaccaccucacuaaacuguaaacggua

SEQ ID NO: 497633 - RNA, 64 nt, Human
ucacuuagucaugugcaauucgcguugcagaguggcagaccauuaguugcugaguucugucagc

SEQ ID NO: 497634 - RNA, 64 nt, Human
cagcaccaaagaaugccagccuaucaggaaacaggcagaccagggccccgugggggcagcccag

SEQ ID NO: 497635 - RNA, 64 nt, Human
guagggagggcggcaggggccuggagauccuccugcagaccacgcccguccugccuguggcgcc

SEQ ID NO: 497636 - RNA, 64 nt, Human
auauaucuuguaaaauuuagaccacuccuuuaaugcagaccaaaauaaggcacagcuuuaauuc

SEQ ID NO: 497637 - RNA, 64 nt, Human
cacggugccucaaccaacuggacaagggauggcggcagaccaggggccaggccaaagcacuggc

SEQ ID NO: 497638 - RNA, 64 nt, Human
aaaggguugaaugacaauagugcccccguuuuuagcagaccagccuuaacucuggguuugaauc

SEQ ID NO: 497639 - RNA, 64 nt, Human
ccccuugcugcuggcucccaucucccucccauuugcagaccaggaaggaagagcaagcuguaca

SEQ ID NO: 497640 - RNA, 64 nt, Human
ugcuccccaauggccaaaaucacaucaccaggccgcagaccagcccuauagagaaaaauggaca

SEQ ID NO: 497641 - RNA, 64 nt, Human
guuuagaauuucaagcagauggugauaauaaaaagcagaccaacuuuuaguuagcuguauuguu

SEQ ID NO: 497642 - RNA, 64 nt, Human
guucaucaaaacaggugacagugaguaaccaaaugcagaccaguucuaugcaggauaaugauaa

SEQ ID NO: 497643 - RNA, 64 nt, Human
ggugauuuuagcagcugugauguugguaccuggugcagaccaggccaaaguucuggaaagcucc

SEQ ID NO: 497644 - RNA, 64 nt, Human
gauucucagaccaaauucuagaccaaagacacaggcagaccaaguccccaggccccgccuggaa

SEQ ID NO: 497645 - RNA, 64 nt, Human
aaauagaggccuggccuccaggugccggauccagacaccugaccuagaaugccugcccgcuauc

SEQ ID NO: 497646 - RNA, 64 nt, Human
ccugaaaccuagcuuuucugcacuuccauuucugacaccugaaaaugaaaaugauaauccuaac

SEQ ID NO: 497647 - RNA, 64 nt, Human
ggggcaggaugggccauggaggugccccacccccacaccugacaaucacccacacuccuggggc

SEQ ID NO: 497648 - RNA, 64 nt, Human
cucugcugccccaaccuuucaaggaggaaaccagacaccugagacaggagccuguaugcagccc

SEQ ID NO: 497649 - RNA, 64 nt, Human
uaucagacuuccuuucaacuguccuccccuccaagcagaccaccuguccccuucuaucccagcu

SEQ ID NO: 497650 - RNA, 64 nt, Human
gaacaaauugaaaaucugaagaccgaugcugcaagcagaccauaugcagaugugcgaguuauug

SEQ ID NO: 497651 - RNA, 64 nt, Human
cgugggggguggaggguggcgaggugcggagacugcagaccagugcuucacuguguggaguggg

SEQ ID NO: 497652 - RNA, 64 nt, Human
acgacaugguguugucuguggagaccgguggccugcagaccauugcccaccgggagccgacacc

SEQ ID NO: 497653 - RNA, 64 nt, Human
ggaaaacgguggccuaggguacaggcaacaaugagcagaccaaccuaaauuuggggaaauuagg

SEQ ID NO: 497654 - RNA, 64 nt, Human
ucaucugaucucugcuggaucuacagacaccgaugcagaccacucgauuucaugaccggcccua

SEQ ID NO: 497655 - RNA, 64 nt, Human
guguuuuuuaaaugcuguauguagaggaaaaucugcagaccacuggaauacauuuguuaaacuc

SEQ ID NO: 497656 - RNA, 64 nt, Human
ccagcugaccccuuucuacccuguggauuacacugcagaccagcacggcaccuguggggauggg

SEQ ID NO: 497657 - RNA, 64 nt, Human
ggaagaggagaaaauguggcuccucuggagcuuggcagaccacuuuucggucuuugcgugaugu

SEQ ID NO: 497658 - RNA, 64 nt, Human
uagccuggaauccauauauauaaagugaaggagggcagaccacacgcccucucagccaggcucc

SEQ ID NO: 497659 - RNA, 64 nt, Human
ggaugccaagaaugcauuauuccacaaaaaaacagcagaccaacauauagaguguuuaaaauag

SEQ ID NO: 497660 - RNA, 64 nt, Human
ugaggacgcccgacagagcuugugcaccuaagcugcagaccaagccuuugcccagaauuuaagg

SEQ ID NO: 497661 - RNA, 64 nt, Human
ucccugaugacagagccaacuucuacccauugcagcagaccaauguguacacgacuacuuacua

SEQ ID NO: 497662 - RNA, 64 nt, Human
cucacuaucuugucucucauacacauauccaucugcagaccauggucccuaaaccugcaguuuc

SEQ ID NO: 497663 - RNA, 64 nt, Human
ucaaugguggucgugugauugaagccuacaaggggcagaccacgcugauucaguacaccagcaa

SEQ ID NO: 497664 - RNA, 64 nt, Human
gccacaguccugagcuuguaagauggugcagcaugcagaccagacuuguccccaaggucucagc

SEQ ID NO: 497665 - RNA, 64 nt, Human
uccugugcugcguguccaucaucagcugaccaagacaccugaggacacaucuuggcacccagag

SEQ ID NO: 497666 - RNA, 64 nt, Human
gcuuccuuucucguuccuaacuuuuccuucacuuacaccugacugacccuccugaacugcacua

SEQ ID NO: 497667 - RNA, 64 nt, Human
uguauuaguguguucucaugcuguugauaaagacacaccugagaugguaauuuguaaagaaaaa

SEQ ID NO: 497668 - RNA, 64 nt, Human
cuaggcaugguggcacacgccuguaaucccagcuacaccugaggcugaggcaggagaauugcuu

SEQ ID NO: 497669 - RNA, 64 nt, Human
agcaugcccgagagccuggacagcccaaccucuggcagaccagggguuaccagccucacagcug

SEQ ID NO: 497670 - RNA, 64 nt, Human
uagagagaaagucaaagauuacagaagugcugaagcagaccauucuuccuuucuucccaauguc

SEQ ID NO: 497671 - RNA, 64 nt, Human
gaaagagaacacugccuuacagucaccucauguugcagaccauguuuaugguaauacacacuuu

SEQ ID NO: 497672 - RNA, 64 nt, Human
gcugggcauggggcacccaugugccgagagccuugcagaccaugacaggucccuauuaaacaca

SEQ ID NO: 497673 - RNA, 64 nt, Human
aaaauuguauuaugugauccuaaggacaggaauagcagaccagccaacgggauggccuugggua

SEQ ID NO: 497674 - RNA, 64 nt, Human
guacugagguuugaggaaaaauaaauguugaucagcagaccacguauuuaaaauucugaaucuu

SEQ ID NO: 497675 - RNA, 64 nt, Human
caggacgcaugcagggcccccaugcaggcagccugcagaccacacucugccuggccuugagccg

SEQ ID NO: 497676 - RNA, 64 nt, Human
ggaaauccuuuugccuaaauucugaacuuggucugcagaccauccagaggaauaaaaagguugg

SEQ ID NO: 497677 - RNA, 64 nt, Human
cccugucgacuauugccacccugcuucuccaagagcagaccaggccaccucauccguaaggacu

SEQ ID NO: 497678 - RNA, 64 nt, Human
ucucuccaccccugggcuaugcaggccagcccgugcagaccacccccgacgcguccacuugcaa

SEQ ID NO: 497679 - RNA, 64 nt, Human
agggauaaaagucgaucuucaaacauuaacuuaagcagaccaaaaauucugaugaccgcaucua

SEQ ID NO: 497680 - RNA, 64 nt, Human
agguaccgcacgagagggugcgggggcuugggaagcagaccaggguuggacaaaaccccaugag

SEQ ID NO: 497681 - RNA, 64 nt, Human
ucuugugaaggcagggggaaggugggguccuggagcagaccaccccgccugcccucauggcccc

SEQ ID NO: 497682 - RNA, 64 nt, Human
ccuguaaucccagcacuuugggaggccaaggcgggcagaccaugaggucaggagauugagacca

SEQ ID NO: 497683 - RNA, 64 nt, Human
gcagccacuuccaggccagggugguggcuucucugcagaccagcugaggggaggacuccugggu

SEQ ID NO: 497684 - RNA, 64 nt, Human
gucagaagcugcccuugaacaaguggcaucuuacgcagaccaacagaguauuugagaaaauuga

SEQ ID NO: 497685 - RNA, 64 nt, Human
ugauaauggauuaauuccucaaaggaagagcagaacaccugaaaaucagcaauuuccugacaac

SEQ ID NO: 497686 - RNA, 64 nt, Human
ugaugauggauuaauuccuccaaggaagagcagaacaccugaaagccagcaauuuccugacacu

SEQ ID NO: 497687 - RNA, 64 nt, Human
ccuuguuugucagccuccuguucauguuccccacacaccugaaggugguagaaucuuuucagcc

SEQ ID NO: 497688 - RNA, 64 nt, Human
caccugguagacccaaggacuuggguggaucaggacaccugaagaagagaagcuuccggcaacc

SEQ ID NO: 497689 - RNA, 64 nt, Human
augcugaugcaauuccuccaucaucucuggacgugcagaccagauccagaagaaaggccuggcg

SEQ ID NO: 497690 - RNA, 64 nt, Human
uuugggggguuagggcaagggguuccucuggauugcagaccacaucgcacagaccccuggcucu

SEQ ID NO: 497691 - RNA, 64 nt, Human
agagcaagguagaggaaggagucccagccucugggcagaccagaggcccagagggagagaguag

SEQ ID NO: 497692 - RNA, 64 nt, Human
gcuguuugugcaugagcucauuaaaaucgugacagcagaccaaugagugagaaacugccccauu

SEQ ID NO: 497693 - RNA, 64 nt, Human
gugaauggggagguggcagccacagaagccuagggcagaccaagaagaaagguacagccccugc

SEQ ID NO: 497694 - RNA, 64 nt, Human
agcagcagaacaagugccuccuggacuguucacggcagaccagaacguuucuggccuggguuuu

SEQ ID NO: 497695 - RNA, 64 nt, Human
uggggucuggggccuggagagacccucccacccagcagaccaggagauagcugggggacaaggg

SEQ ID NO: 497696 - RNA, 63 nt, Human
uccugugccagccuucaugacccagcccgcucugcagaccaccucuucuucugggagcuguga

SEQ ID NO: 497697 - RNA, 64 nt, Human
uuuuugggagaguuaagguauaauuugaagguuggcagaccaguugcgcugauuacucuuagag

SEQ ID NO: 497698 - RNA, 64 nt, Human
agugaaaacaccaugucauggaguguaggaaagagcagaccaaaaucagcccuagagccaacca

SEQ ID NO: 497699 - RNA, 64 nt, Human
caggugccccccucaccuugaugggugcguucccgcagaccaaagagagugugacucccuugcc

SEQ ID NO: 497700 - RNA, 64 nt, Human
uuuggaagaaauaauauguaagaauggccucaaggcagaccacuuuaaguuuggcuagacuuca

SEQ ID NO: 497701 - RNA, 64 nt, Human
ccucuacucuuacagagccuugagagacccagcugcagaccaugccagacccacugaaaugacc

SEQ ID NO: 497702 - RNA, 64 nt, Human
uaaaaagacggcuguauauaacauauuggguaaugcagaccaaauuaaguguuuugccuuguuu

SEQ ID NO: 497703 - RNA, 64 nt, Human
agggcuggugaauccaugacaagguccgggagcagcagaccaaaaccacagcagccuccuauua

SEQ ID NO: 497704 - RNA, 64 nt, Human
aucguucugccuuguccacugggggaccagcccugcagaccacucugacaagucuucagcccac

SEQ ID NO: 497705 - RNA, 64 nt, Human
acaccugccugcccacgcuccuucuuuagcucugacaccugaguacacgaucacccacucuuac

SEQ ID NO: 497706 - RNA, 64 nt, Human
gacugcugugccuuucacacuugaaugaagagaaacaccugagcuauauauuuuuuuaaagcaa

SEQ ID NO: 497707 - RNA, 64 nt, Human
guaugugugugcacaucugagcacgugcacauguacaccugagccaaaaacacgagaacccacu

SEQ ID NO: 497708 - RNA, 64 nt, Human
gcugcuuuauuuaaauauaagguagcuaguuuuuacaccugagauaaauaauaagcuuagagug

SEQ ID NO: 497709 - RNA, 64 nt, Human
guuuccuuguuccugcuagugcugcuuuacaaaugcagaccauucuaucauaccuggcggggcu

SEQ ID NO: 497710 - RNA, 64 nt, Human
aagccgagaacccagggccagcaguggagccucagcagaccagggccugguccuugcuaacugc

SEQ ID NO: 497711 - RNA, 64 nt, Human
uucugagugcugcuagcccagaccuguggacgaggcagaccacaacgugaaagaaggaccagcc

SEQ ID NO: 497712 - RNA, 64 nt, Human
accagucccaugcuggcugaagaggaccagaggagcagaccagcacuucaaccuaguccgcuga

SEQ ID NO: 497713 - RNA, 64 nt, Human
gucuugauucugugcugcgcugccgcugggcgaugcagaccaccugucuucuacugaaggacag

SEQ ID NO: 497714 - RNA, 64 nt, Human
gacaguaaacaugacagacugauagaaaguauuggcagaccaggcgugguggcgggcacuugua

SEQ ID NO: 497715 - RNA, 64 nt, Human
ccccuccagggagagagcagcagagaccucaucagcagaccaaggaaguggugggugcuccccc

SEQ ID NO: 497716 - RNA, 64 nt, Human
caaagaccugcagccaccagugcuucacuagcgugcagaccagcccugucccgccucccuguca

SEQ ID NO: 497717 - RNA, 64 nt, Human
uuuuagcuuuuauuuucaccucaaugugauuuaagcagaccaaaauuucuaauucugcuaauuc

SEQ ID NO: 497718 - RNA, 64 nt, Human
aaccgcaaguaugggagauuuaggcccugcagaggcagaccauuccuuaguaucucacaaagca

SEQ ID NO: 497719 - RNA, 64 nt, Human
cugagaaugugacagcuuuccgccuaacuagaaugcagaccagaaugaguucaacucauucugu

SEQ ID NO: 497720 - RNA, 64 nt, Human
ggaaauauucccuagaaacuuccaaauccccuaagcagaccacugauaaaaccauguagaaaau

SEQ ID NO: 497721 - RNA, 64 nt, Human
gggaaaauucauguugcugcagaaguaggcuaaggcagaccacccacuucugcugaaaugcauu

SEQ ID NO: 497722 - RNA, 64 nt, Human
gagguuacagugacaugcccucgaaagauuuggugcagaccaacugucgcggcuguuaccugga

SEQ ID NO: 497723 - RNA, 64 nt, Human
cuguggugcaggugaauggcacgcccguaaugcugcagaccacgugugcugugcacagcggcuc

SEQ ID NO: 497724 - RNA, 60 nt, Human
acuacuacacagcguucugagcagagacacgcagaccagcugaggaggacaaagauaagg

SEQ ID NO: 497725 - RNA, 64 nt, Human
uaguguaacgugccaguggaguggaaagaccgcaacaccugaauccuggguuuuguaauguuuu

SEQ ID NO: 497726 - RNA, 64 nt, Human
auaucaagauuauugcaaaaaucuuauuccaaacacaccugaaucaaaucguuacgcaacucuu

SEQ ID NO: 497727 - RNA, 64 nt, Human
gucuucauuuuuggcacucuuauuuaacaaugccacaccugaagcacuuggaucuguucagagc

SEQ ID NO: 497728 - RNA, 64 nt, Human
agauuacaggcgugagccaccaugccuggccaaaacaccugauuuuuaaaugguagcaauugug

SEQ ID NO: 497729 - RNA, 64 nt, Human
agguaggaggcacguucuuggucacuguuccauugcagaccagacuugcuggccugaccacaag

SEQ ID NO: 497730 - RNA, 64 nt, Human
cgcggagcucucuccaugguagcccagggcgcuggcagaccaugcuccgccuccaccagggcca

SEQ ID NO: 497731 - RNA, 64 nt, Human
uuuccacacggggccgugauugacccuaaaaauugcagaccagcacauacacuggacacugcag

SEQ ID NO: 497732 - RNA, 64 nt, Human
ggcaguuacuccuggccaugguugcugagcaugggcagaccaguggaggccacccuacuguguu

SEQ ID NO: 497733 - RNA, 64 nt, Human
cugcuuuugaucuuuugauuccucuugggcugaagcagaccaaguuccccccaggcaccccagu

SEQ ID NO: 497734 - RNA, 64 nt, Human
gcaggaguuugccaacgccauucuucagcagauagcagaccauugucccgacauccuagagcaa

SEQ ID NO: 497735 - RNA, 64 nt, Human
gaagcgacccagaaauggcagggacacuucucuugcagaccaagagggacccuggagcaccuua

SEQ ID NO: 497736 - RNA, 64 nt, Human
gacuuucuuuguuuccucuuuaaaaguuuacaaugcagaccauuuuuugucccuuccuuuuguu

SEQ ID NO: 497737 - RNA, 64 nt, Human
cgauucuaccaggcccuccagcugcguggucuccgcagaccaggcucugugugggcuagaggaa

SEQ ID NO: 497738 - RNA, 64 nt, Human
ggagggggggagggagcuauuagagaaggaugaggcagaccauguacaguuaaaauuauaaaau

SEQ ID NO: 497739 - RNA, 64 nt, Human
cauacacccaaauuauugcauuaagaauccuggagcagaccauagcugaagcuguuauuuucag

SEQ ID NO: 497740 - RNA, 64 nt, Human
guuagugaccuggccagagggugccaagaggggggcagaccaguggggaucugaucccaaagau

SEQ ID NO: 497741 - RNA, 64 nt, Human
uguuaauuuauagcuguuuagaggggaaagcagugcagaccacuuauuaagcccgcugaggacu

SEQ ID NO: 497742 - RNA, 54 nt, Human
acauuguugaguggcacugaacaagcagaccaacaacacugaggaagauagagu

SEQ ID NO: 497743 - RNA, 64 nt, Human
uuguuaguuacauauucccucgcaaaccuggagugcagaccacaggggaagcuaucuuugcccu

SEQ ID NO: 497744 - RNA, 64 nt, Human
uggcuaagaacugcacugcuuuguuuaaaggacugcagaccaaggagcgagcuuucucucagag

SEQ ID NO: 497745 - RNA, 64 nt, Human
cccuuaccggagcuaggauaagguagcaugagugacaccugagauuagaggcuggggcucacug

SEQ ID NO: 497746 - RNA, 64 nt, Human
gccugucuuagucuguuuguguugcuauaaaagaacaccugagacuggguaauugauaaagaaa

SEQ ID NO: 497747 - RNA, 64 nt, Human
aaccaguguacagucgccagauagggaccggugaacaccugauuccaaacauguaggauggggg

SEQ ID NO: 497748 - RNA, 64 nt, Human
uacauccacauguuuauuuaauauguuucucuuaacaccugaaacuuguuuuaaaacaaaaagc

SEQ ID NO: 497749 - RNA, 64 nt, Human
gccccacucccccauguguauacacaaggaaauugcagaccaauuaguugucuuggccugacuc

SEQ ID NO: 497750 - RNA, 64 nt, Human
ugcuugagccauguuguuugaauugcugccaauagcagaccauaucccuaucauguuguuggcu

SEQ ID NO: 497751 - RNA, 64 nt, Human
ggaguaaauagcuacucuuagaaaagagggauaagcagaccauguagguuuucugucucucaaa

SEQ ID NO: 497752 - RNA, 64 nt, Human
uguauacaccuaacauagaaaauuaaagauagcugcagaccauuagaaauaauacaauuguuuu

SEQ ID NO: 497753 - RNA, 64 nt, Human
gugcacuggagaaggcgaggucaagugcccaacugcagaccaacuaccccuccucagacaacag

SEQ ID NO: 497754 - RNA, 64 nt, Human
gcuaagggcgggaaacugaccuagugccuguguugcagaccauuucugaggucuccaccaucca

SEQ ID NO: 497755 - RNA, 64 nt, Human
gaaccuugcaucaaggcuccuugguguggccacagcagaccagaugggaaauuauuuguguuga

SEQ ID NO: 497756 - RNA, 64 nt, Human
uugggguuggggcuggggguggacuggugugagggcagaccagggccagguagacggggcuguu

SEQ ID NO: 497757 - RNA, 64 nt, Human
aggcugagaaggguggagcuuggcccuggggaaggcagaccagggucugauggcuucuagggau

SEQ ID NO: 497758 - RNA, 64 nt, Human
accucgugguagacuaugacggugacucuuggcagcagaccagugggggauggcuggguccccc

SEQ ID NO: 497759 - RNA, 64 nt, Human
agccuccgcagaggcugggggccuccacccagcagcagaccaaccaggaagcagcuugaacugg

SEQ ID NO: 497760 - RNA, 64 nt, Human
ucgagcgccugcugcggcucagugacuacaacgugcagaccagccagggugccauccugcaggc

SEQ ID NO: 497761 - RNA, 64 nt, Human
ugaccccaccuagagcuuuuaaccaaacaacauugcagaccaccagaguccuuggacucccccu

SEQ ID NO: 497762 - RNA, 64 nt, Human
cuuugggacauggugccucaugcucucugggauugcagaccauccaggucugucuucgccccug

SEQ ID NO: 497763 - RNA, 64 nt, Human
gcugaggcaggcagaucaccugaggcuaggaguugcagaccagccuggccaacauggcaaaacc

SEQ ID NO: 497764 - RNA, 64 nt, Human
uaaggaagcaggguagagcuggaggauaagagaugcagaccaugaagggccccauuuuaugcua

SEQ ID NO: 497765 - RNA, 64 nt, Human
ucagaguauaaugaugacccuucuugaguuuugaacaccugaaauuguaaucacugaaauauua

SEQ ID NO: 497766 - RNA, 64 nt, Human
agagacucaaacuacuguuuuauuaaaaaaguaaacaccugagcacagcuggccuacacaggag

SEQ ID NO: 497767 - RNA, 64 nt, Human
accagcaaaacaacggaugaauguagcccuuccaacaccugacagaaugagaccaaacgcagcc

SEQ ID NO: 497768 - RNA, 64 nt, Human
ugagaguauccacaaagcaaugucucagguguggacaccugagagcauguuuuagaaagcuuug

SEQ ID NO: 497769 - RNA, 64 nt, Human
uggcaucagcagacccagggugcuucugucuccugcagaccacgccagggagugcagacaccac

SEQ ID NO: 497770 - RNA, 64 nt, Human
aacagcagcagcucguuggcuccaaaaccagggagcagaccaugcccucccaacccuggaguug

SEQ ID NO: 497771 - RNA, 64 nt, Human
ggggagguggaaggggcggggggcggggcagacagcagaccaccaaggguucagggaacaaaga

SEQ ID NO: 497772 - RNA, 64 nt, Human
gagcaccagaggccuuccuccuccagggcccucugcagaccaggcugagauggaggaaccugcu

SEQ ID NO: 497773 - RNA, 64 nt, Human
ccgccagagucacagcagugccgagguguccgcggcagaccacacagaccgucugaaaugcgcc

SEQ ID NO: 497774 - RNA, 64 nt, Human
accgagccccugaacugcuguugggaaccaccacgcagaccaccagcaucgacauguggugagg

SEQ ID NO: 497775 - RNA, 64 nt, Human
aggaggcaccaggaaaucccgcgggguggcccaugcagaccaggcgcacguggcucauggggca

SEQ ID NO: 497776 - RNA, 64 nt, Human
agcccccuccccuucccucugucuucuguguuuggcagaccagccccagcgaggacuuguuggu

SEQ ID NO: 497777 - RNA, 64 nt, Human
agcgcugaucaucccguguugcccgugcguugcugcagaccaucuggggucuugcccaagcacc

SEQ ID NO: 497778 - RNA, 64 nt, Human
gcaggaauuaugucguaagucacugacccuaacugcagaccaugaaguaaauuauguaacuagg

SEQ ID NO: 497779 - RNA, 64 nt, Human
cccccuuuacagaggcacccuggugccccgccuggcagaccaccgcacacagaucaagcggggc

SEQ ID NO: 497780 - RNA, 64 nt, Human
cuguggcgagccauuugucccaagugccaaagaagcagaccauuggggcucccagccaggcccu

SEQ ID NO: 497781 - RNA, 64 nt, Human
guggugaggacacccgaggccuccugggagaccugcagaccacgcccaccucauuuacauguuc

SEQ ID NO: 497782 - RNA, 64 nt, Human
guggauccagcuguucucaccagccuggagguuagcagaccagagugggugggcaggaccuugg

SEQ ID NO: 497783 - RNA, 64 nt, Human
ccuggucacgagguggccagagcacaauguauaggcagaccagugguccuuccucucccaaugu

SEQ ID NO: 497784 - RNA, 57 nt, Human
agaacuggaucuaugaaugacaggagggcagaccacauugcuuuucacauccauuuc

SEQ ID NO: 497785 - RNA, 64 nt, Human
caagugaugugcagcuucuccggcucugagaagaacaccugagagcgcuuuccagccagugccc

SEQ ID NO: 497786 - RNA, 64 nt, Human
agucacuuacuaaauauaguggauauaaaauagaacaccugacuuugcucuuagaccauaaccc

SEQ ID NO: 497787 - RNA, 64 nt, Human
aauggguaguaagagcaaauuuucauuuuaaagcacaccugagaugauucucauacaaccgaaa

SEQ ID NO: 497788 - RNA, 64 nt, Human
ggacacguguccacgcaccacagacacacccacgacaccugaucucguaucacuagcuugcggc

SEQ ID NO: 497789 - RNA, 64 nt, Human
cgaaugucuuaguguuacccuccccuagucaacagcagaccagccuggccaaugccuaugggug

SEQ ID NO: 497790 - RNA, 64 nt, Human
agcuccagccugucugcuccccagcucuguaguggcagaccagcgucaccuuugaaguauacgu

SEQ ID NO: 497791 - RNA, 64 nt, Human
gagaccccgcagcugggugggaugaacaagcaacgcagaccacaagcgagugccugggagggag

SEQ ID NO: 497792 - RNA, 64 nt, Human
cggguguggguucugugggucggguguggguucugcagaccaggugcggauucuguguagguuc

SEQ ID NO: 497793 - RNA, 64 nt, Human
agucccccacauccaaagccccucagccugccuugcagaccaaugggcuccauguucuguagcc

SEQ ID NO: 497794 - RNA, 64 nt, Human
gcuuguuugguaucccacugaaauguucuguguugcagaccagagucuguuuaugucaggggga

SEQ ID NO: 497795 - RNA, 64 nt, Human
ccaccauucagucaagugaggugacacuccaguugcagaccaucgcacaccaaauuuggcaaaa

SEQ ID NO: 497796 - RNA, 64 nt, Human
ccggccagccccgccccugccgaucuacuggaccgcagaccaccuucugcccccgugggccagg

SEQ ID NO: 497797 - RNA, 64 nt, Human
gccccagcaccccucuccuuuggccuccggcagugcagaccagaggggaccuuuuaaggaaaga

SEQ ID NO: 497798 - RNA, 64 nt, Human
uguuucaccucauuuggaacaaaagaggacagaagcagaccacucugugcaccaaccuaaaaaa

SEQ ID NO: 497799 - RNA, 64 nt, Human
aaaagccacuuuaaaaacagcugaagugaccuuagcagaccagagauuuuauuuuuuuaaagag

SEQ ID NO: 497800 - RNA, 64 nt, Human
cgcagggcgcccagcgccguccggcggccccgccgcagaccagcuggcggguguggagaccagg

SEQ ID NO: 497801 - RNA, 64 nt, Human
cccucgggaagccuuggacagaacccuccaccccgcagaccaggcgucgugugugugugggaga

SEQ ID NO: 497802 - RNA, 64 nt, Human
cuuucuuugggcaagguuaagccuuuacugcauagcagaccacacagaagggugugggccacca

SEQ ID NO: 497803 - RNA, 64 nt, Human
uuguuauacgaacauuuuaacaauguuaauucuugcagaccaugaacauaagcuaccuucccau

SEQ ID NO: 497804 - RNA, 64 nt, Human
gggucguacggggcugggagcccugcguuuugaggcagaccacugcccuuccgaccucaguccu

SEQ ID NO: 497805 - RNA, 64 nt, Human
ccagagguucaagaccagccugggcaacacagugacaccugacucuacuaaaaaauuaaaaaau

SEQ ID NO: 497806 - RNA, 64 nt, Human
gaaaggaggcccccacagcugauccugccacagcacaccugacucacucggcucuguuagugua

SEQ ID NO: 497807 - RNA, 64 nt, Human
ugggguuucgccaucuuggccaggcuggucucaaacaccugaccucaagugauccgccugccuu

SEQ ID NO: 497808 - RNA, 64 nt, Human
cagacaccccccaaccacacacaucucaugcuguacaccugaggcugcucacgucucacgccca

SEQ ID NO: 497809 - RNA, 64 nt, Human
guuuucaucagucacucacaugugcucaaggaaugcagaccacugugcuuaccaaauucugaag

SEQ ID NO: 497810 - RNA, 64 nt, Human
uggacugggggccauuugcuuccuguggccuucagcagaccaggcccugucccuaccuggagcc

SEQ ID NO: 497811 - RNA, 64 nt, Human
ccuuagucagcucagacaaccauaagagaauaccgcagaccaaauggcuuagaaauuaauuuaa

SEQ ID NO: 497812 - RNA, 64 nt, Human
ugggcccuccaagcccaagccuccugcuccgggggcagaccagacucugacucuccucuugggg

SEQ ID NO: 497813 - RNA, 64 nt, Human
acauccaccuccagucccuggccaggggugagaggcagaccagcagauggacuugaucccucug

SEQ ID NO: 497814 - RNA, 64 nt, Human
guaaauggacuauauaaauaccuucguauauauggcagaccacaggacuucuguccaagagaac

SEQ ID NO: 497815 - RNA, 64 nt, Human
gugugguaaggucuucaguccgagaucacuccuugcagaccaucagacaauuccuuuuggagac

SEQ ID NO: 497816 - RNA, 64 nt, Human
guguggaagggucuucaguccaaggucacuccuugcagaccaucagacaauuccuuuuggagac

SEQ ID NO: 497817 - RNA, 64 nt, Human
aaaaaaaaaaagaaagugaugcacagaguggcaggcagaccauccacauaaguuuuauagguac

SEQ ID NO: 497818 - RNA, 53 nt, Human
agguggaggccgaccaguaggcugcagaccagggacauggguuaguuaaggcg

SEQ ID NO: 497819 - RNA, 64 nt, Human
uguaaggaaauguuauuggaagcugauucccagagcagaccacauauacagcaggaugugccug

SEQ ID NO: 497820 - RNA, 64 nt, Human
aacuuggaguggagaggaaaagcaucagaaagaggcagaccauccaccaggccuuugagaaagg

SEQ ID NO: 497821 - RNA, 64 nt, Human
ccgucugccuggaaauucuggaacuguggcuuuggcagaccaucuccagcauccugcuuccuag

SEQ ID NO: 497822 - RNA, 64 nt, Human
cagaaccgcacagccagagccccaggucagaagugcagaccaggguucucagcacagugcccgu

SEQ ID NO: 497823 - RNA, 64 nt, Human
agucgcuggaccaguguguggagacccugcagaagcagaccaggguuggcaaggcuggcaccaa

SEQ ID NO: 497824 - RNA, 64 nt, Human
agaucccaucucacacaacacacuuccacguaaugcagaccacacuuuuccauuuuguccugcc

SEQ ID NO: 497825 - RNA, 64 nt, Human
ucaccucacauacucccugcucccugugguagagacaccugagagaaaggggaggggucaacaa

SEQ ID NO: 497826 - RNA, 64 nt, Human
uauacugagagugucauguuuccacaaagggcugacaccugagccuggauuuucacucaucccu

SEQ ID NO: 497827 - RNA, 64 nt, Human
gacaguguuuggcugagccgagacuggagcaucuacaccugaggacaagacgcugcccacccgc

SEQ ID NO: 497828 - RNA, 64 nt, Human
gggcagaaaaucaaaagaagaacaauauuucaugacaccugaaaauucuaugaaauucagauuu

SEQ ID NO: 497829 - RNA, 64 nt, Human
auucugggcuugggguguggggugggguggagucgcagaccagagcugucugaacucauguguc

SEQ ID NO: 497830 - RNA, 64 nt, Human
gcucuaggagaacaaaugugcuuucuguaaaaaggcagaccagggauguaauguuuuuaauguu

SEQ ID NO: 497831 - RNA, 64 nt, Human
gcaguccagagaaaggaaagauugagguggcagagcagaccacucucccuucccaaacugucca

SEQ ID NO: 497832 - RNA, 64 nt, Human
uggauccuccauugcucgccuuggccaggaaccagcagaccaacugccuuuugugagaccuucc

SEQ ID NO: 497833 - RNA, 64 nt, Human
ugcucagagcacggcuccucgcaggggugaaggggcagaccaacgaaaccagaugagaccaacg

SEQ ID NO: 497834 - RNA, 64 nt, Human
gagcccuggcuucuccucacggugcuuccuggcugcagaccacaacccuccgcuggucgcuggu

SEQ ID NO: 497835 - RNA, 64 nt, Human
uguuucaaagacugggcgaaaggcuguccggagggcagaccaggugccuugccgcagagaaaac

SEQ ID NO: 497836 - RNA, 64 nt, Human
agagggcuugcuuagggcagcuucuugcugcucagcagaccaugaccuguagguucaccuauaa

SEQ ID NO: 497837 - RNA, 64 nt, Human; identical to SEQ ID NO: 497834

SEQ ID NO: 497838 - RNA, 64 nt, Human
guuucuguaaaaucaggauacguggcuuuaguaagcagaccaagcgcuucguggcagggaaagc

SEQ ID NO: 497839 - RNA, 64 nt, Human
cuguccuucugccacggaugcucaagguuccugggcagaccagcaccucuggaggacaauggac

SEQ ID NO: 497840 - RNA, 64 nt, Human
acgagagaggcugagggugguggcggccccugaggcagaccaggccaggcuuccccuccuaccu

SEQ ID NO: 497841 - RNA, 64 nt, Human
guccccuuccccacccacugccugagccuucugagcagaccagguaccuuggcugcaccggugu

SEQ ID NO: 497842 - RNA, 64 nt, Human
gauagagguggggccaagcccaggcugcccgacugcagaccacgugcucuucccuggccaccca

SEQ ID NO: 497843 - RNA, 64 nt, Human
aggcggagggucucccugggcacccugcaggcaggcagaccacgguguggggggugccccacaa

SEQ ID NO: 497844 - RNA, 64 nt, Human
ggacgacccggggcgggcugaugucuucuugggggcagaccagagagcucaaguuucagaguca

SEQ ID NO: 497845 - RNA, 64 nt, Human
aaaugcguuggguguccauaaaauuugcaacaccacaccugauggaaaaauguaauugcuuacc

SEQ ID NO: 497846 - RNA, 64 nt, Human
ucagccuuucaauaaaaguuaugcacaaaugugaacaccugagauggagcugaacauuucuuca

SEQ ID NO: 497847 - RNA, 64 nt, Human
cgccagggaacgauggccucccaauagauaggaaacaccugaagcuggugaucagccacuuccu

SEQ ID NO: 497848 - RNA, 64 nt, Human
uucuacaaccagagccccccacaaugaugauuaaacaccugacacaucuugcucuugugugucu

SEQ ID NO: 497849 - RNA, 64 nt, Human
auaacuccuccccaccccaacaacaacauucccagcagaccaacucccacccccucuuugaggu

SEQ ID NO: 497850 - RNA, 64 nt, Human
uuggaaucugccuggaacaaagaacugcaccuaagcagaccagaagcaaaaugucuucuucacg

SEQ ID NO: 497851 - RNA, 64 nt, Human
aaguugaagagaagagacgcccauccgugaaggagcagaccauccauccgauccuccccuuccc

SEQ ID NO: 497852 - RNA, 64 nt, Human
ugguuggaguauucccucagccuauagcaucaaagcagaccaguggccaacagccccaagggga

SEQ ID NO: 497853 - RNA, 64 nt, Human
cccagcuauuggccaggccccuguuacaaacugcgcagaccacccauagcccugcugcugccac

SEQ ID NO: 497854 - RNA, 64 nt, Human
cuccccuaccuggcccauucacugagucuucucagcagaccauuucaaauuauuaauaaauggg

SEQ ID NO: 497855 - RNA, 63 nt, Human
ucucugccccucacauuuagccgacugacugcugcagaccaccgccaacugcagcucuccauc

SEQ ID NO: 497856 - RNA, 64 nt, Human; identical to SEQ ID NO: 497850

SEQ ID NO: 497857 - RNA, 58 nt, Human; identical to SEQ ID NO: 167130

SEQ ID NO: 497858 - RNA, 64 nt, Human; identical to SEQ ID NO: 167131

SEQ ID NO: 497859 - RNA, 64 nt, Human
uguuaaguuuuccagacuacuacccuucccacauacaccugagccacuguggugggucacagug

SEQ ID NO: 497860 - RNA, 64 nt, Human
aaggggggaaugggaguugucuccccuucuccccacaccugaucugcucucggcuggucccaga

SEQ ID NO: 497861 - RNA, 64 nt, Human
uaaauuaauauguuuguguguauauaugugccucacaccugaauugaaaauuaaagacugguuu

SEQ ID NO: 497862 - RNA, 64 nt, Human; identical to SEQ ID NO: 167132

SEQ ID NO: 497863 - RNA, 64 nt, Human; identical to SEQ ID NO: 167133

SEQ ID NO: 497864 - RNA, 64 nt, Human; identical to SEQ ID NO: 167134

SEQ ID NO: 497865 - RNA, 64 nt, Human; identical to SEQ ID NO: 167135

SEQ ID NO: 497866 - RNA, 64 nt, Human; identical to SEQ ID NO: 167136

SEQ ID NO: 497867 - RNA, 64 nt, Human; identical to SEQ ID NO: 167137

SEQ ID NO: 497868 - RNA, 64 nt, Human; identical to SEQ ID NO: 167138

SEQ ID NO: 497869 - RNA, 64 nt, Human; identical to SEQ ID NO: 167139

SEQ ID NO: 497870 - RNA, 64 nt, Human; identical to SEQ ID NO: 167140

SEQ ID NO: 497871 - RNA, 64 nt, Human; identical to SEQ ID NO: 167141

SEQ ID NO: 497872 - RNA, 64 nt, Human; identical to SEQ ID NO: 167142

SEQ ID NO: 497873 - RNA, 64 nt, Human; identical to SEQ ID NO: 167143

SEQ ID NO: 497874 - RNA, 64 nt, Human; identical to SEQ ID NO: 167144

SEQ ID NO: 497875 - RNA, 64 nt, Human; identical to SEQ ID NO: 167145

SEQ ID NO: 497876 - RNA, 64 nt, Human; identical to SEQ ID NO: 167146

SEQ ID NO: 497877 - RNA, 64 nt, Human
agggacugguugagggaguggggaggugguaagaacaccugacaacuucugaauauuggacauu

SEQ ID NO: 497878 - RNA, 64 nt, Human
caggggcucugggcccguaccgccaacucgggucacaccugaacgcugcugccagccgaugccc

SEQ ID NO: 497879 - RNA, 64 nt, Human
aguauaauuguaaaucaucacagauuuugaauucacaccugaagacaugcucucacauauagag

SEQ ID NO: 497880 - RNA, 64 nt, Human; identical to SEQ ID NO: 167147

SEQ ID NO: 497881 - RNA, 64 nt, Human; identical to SEQ ID NO: 167148

SEQ ID NO: 497882 - RNA, 64 nt, Human; identical to SEQ ID NO: 167149

SEQ ID NO: 497883 - RNA, 64 nt, Human; identical to SEQ ID NO: 167150

SEQ ID NO: 497884 - RNA, 64 nt, Human; identical to SEQ ID NO: 167151

SEQ ID NO: 497885 - RNA, 64 nt, Human; identical to SEQ ID NO: 167152

SEQ ID NO: 497886 - RNA, 64 nt, Human; identical to SEQ ID NO: 167153

SEQ ID NO: 497887 - RNA, 64 nt, Human; identical to SEQ ID NO: 167154

SEQ ID NO: 497888 - RNA, 64 nt, Human; identical to SEQ ID NO: 167155

SEQ ID NO: 497889 - RNA, 64 nt, Human; identical to SEQ ID NO: 167156

SEQ ID NO: 497890 - RNA, 64 nt, Human; identical to SEQ ID NO: 167157

SEQ ID NO: 497891 - RNA, 64 nt, Human; identical to SEQ ID NO: 167158

SEQ ID NO: 497892 - RNA, 64 nt, Human; identical to SEQ ID NO: 167159

SEQ ID NO: 497893 - RNA, 64 nt, Human; identical to SEQ ID NO: 167160

SEQ ID NO: 497894 - RNA, 64 nt, Human; identical to SEQ ID NO: 167161

SEQ ID NO: 497895 - RNA, 64 nt, Human
gggaggguugagggaggcucuggaaagcccagccacaccugagucccuggcaguagccuugggg

SEQ ID NO: 497896 - RNA, 64 nt, Human
augaggguguuuccucuaaaccuacgagggaggaacaccugaucuuacagaaaauaccaccucg

SEQ ID NO: 497897 - RNA, 64 nt, Human
ggucugacccuccccugcucgccucccucaccccacaccugacacagagcaggcacucaauaaa

SEQ ID NO: 497898 - RNA, 64 nt, Human; identical to SEQ ID NO: 167162

SEQ ID NO: 497899 - RNA, 64 nt, Human; identical to SEQ ID NO: 167163

SEQ ID NO: 497900 - RNA, 64 nt, Human; identical to SEQ ID NO: 167164

SEQ ID NO: 497901 - RNA, 64 nt, Human; identical to SEQ ID NO: 167165

SEQ ID NO: 497902 - RNA, 64 nt, Human; identical to SEQ ID NO: 167166

SEQ ID NO: 497903 - RNA, 64 nt, Human; identical to SEQ ID NO: 167167

SEQ ID NO: 497904 - RNA, 64 nt, Human; identical to SEQ ID NO: 167168

SEQ ID NO: 497905 - RNA, 64 nt, Human; identical to SEQ ID NO: 167169

SEQ ID NO: 497906 - RNA, 64 nt, Human; identical to SEQ ID NO: 167170

SEQ ID NO: 497907 - RNA, 64 nt, Human; identical to SEQ ID NO: 167171

SEQ ID NO: 497908 - RNA, 64 nt, Human; identical to SEQ ID NO: 167172

SEQ ID NO: 497909 - RNA, 64 nt, Human; identical to SEQ ID NO: 167173

SEQ ID NO: 497910 - RNA, 64 nt, Human; identical to SEQ ID NO: 167174

SEQ ID NO: 497911 - RNA, 64 nt, Human; identical to SEQ ID NO: 167175

SEQ ID NO: 497912 - RNA, 64 nt, Human; identical to SEQ ID NO: 167176

SEQ ID NO: 497913 - RNA, 64 nt, Human
uagaaaccagcuacaguauggcccacuuaauaaaacaccugaaacaaaaacugcauggaucacu

SEQ ID NO: 497914 - RNA, 64 nt, Human
agcugaaguuuagaugagacagaaaugaggagacacaccugaggcugguuucuuucaugcuccu

SEQ ID NO: 497915 - RNA, 64 nt, Human
cgggguuucaccaugcuggccaggcuggucucaaacaccugaccuugugauccguccgccuugg

SEQ ID NO: 497916 - RNA, 64 nt, Human; identical to SEQ ID NO: 167177

SEQ ID NO: 497917 - RNA, 64 nt, Human; identical to SEQ ID NO: 167178

SEQ ID NO: 497918 - RNA, 64 nt, Human; identical to SEQ ID NO: 167179

SEQ ID NO: 497919 - RNA, 64 nt, Human; identical to SEQ ID NO: 167181

SEQ ID NO: 497920 - RNA, 64 nt, Human; identical to SEQ ID NO: 167182

SEQ ID NO: 497921 - RNA, 64 nt, Human; identical to SEQ ID NO: 167183

SEQ ID NO: 497922 - RNA, 64 nt, Human; identical to SEQ ID NO: 167184

SEQ ID NO: 497923 - RNA, 64 nt, Human; identical to SEQ ID NO: 167185

SEQ ID NO: 497924 - RNA, 63 nt, Human; identical to SEQ ID NO: 167186

SEQ ID NO: 497925 - RNA, 64 nt, Human; identical to SEQ ID NO: 167187

SEQ ID NO: 497926 - RNA, 64 nt, Human; identical to SEQ ID NO: 167188

SEQ ID NO: 497927 - RNA, 64 nt, Human; identical to SEQ ID NO: 167189

SEQ ID NO: 497928 - RNA, 64 nt, Human; identical to SEQ ID NO: 167190

SEQ ID NO: 497929 - RNA, 64 nt, Human; identical to SEQ ID NO: 167191

SEQ ID NO: 497930 - RNA, 64 nt, Human; identical to SEQ ID NO: 167192

SEQ ID NO: 497931 - RNA, 64 nt, Human
caccacacacacacauacacacacacacacacacacaccugaggccaccagaagacacuuccau

SEQ ID NO: 497932 - RNA, 64 nt, Human
uuguucaauucaucuagauuauaaccuuaaugugacaccugagaccuuuagacaguugacccug

SEQ ID NO: 497933 - RNA, 64 nt, Human
acucucuaggcuucggacacaaauaggcuccucuacaccugaagacaaaggcaaagucaaaugg

SEQ ID NO: 497934 - RNA, 64 nt, Human; identical to SEQ ID NO: 167193

SEQ ID NO: 497935 - RNA, 64 nt, Human; identical to SEQ ID NO: 167194

SEQ ID NO: 497936 - RNA, 64 nt, Human; identical to SEQ ID NO: 167195

SEQ ID NO: 497937 - RNA, 64 nt, Human; identical to SEQ ID NO: 167196

SEQ ID NO: 497938 - RNA, 64 nt, Human; identical to SEQ ID NO: 167197

SEQ ID NO: 497939 - RNA, 64 nt, Human; identical to SEQ ID NO: 167198

SEQ ID NO: 497940 - RNA, 64 nt, Human; identical to SEQ ID NO: 167199

SEQ ID NO: 497941 - RNA, 64 nt, Human; identical to SEQ ID NO: 167200

SEQ ID NO: 497942 - RNA, 64 nt, Human; identical to SEQ ID NO: 167201

SEQ ID NO: 497943 - RNA, 64 nt, Human; identical to SEQ ID NO: 167202

SEQ ID NO: 497944 - RNA, 64 nt, Human; identical to SEQ ID NO: 167203

SEQ ID NO: 497945 - RNA, 64 nt, Human; identical to SEQ ID NO: 167204

SEQ ID NO: 497946 - RNA, 64 nt, Human; identical to SEQ ID NO: 167205

SEQ ID NO: 497947 - RNA, 64 nt, Human; identical to SEQ ID NO: 167206

SEQ ID NO: 497948 - RNA, 64 nt, Human; identical to SEQ ID NO: 167207

SEQ ID NO: 497949 - RNA, 64 nt, Human
cagaaggaaaccgaaacugacuugcucaccuggaacaccugauggugaaaccaaacaaauacaa

SEQ ID NO: 497950 - RNA, 64 nt, Human
uuuaucacuuucauugguaaaacuuuuaaauucaacaccugaaaaucaugagggaaaaugauua

SEQ ID NO: 497951 - RNA, 64 nt, Human
uaagcauuauaaacuaaaaugaaaaccaaaccagacaccugacauagagucuuuauuuuacccc

SEQ ID NO: 497952 - RNA, 64 nt, Human; identical to SEQ ID NO: 167208

SEQ ID NO: 497953 - RNA, 64 nt, Human; identical to SEQ ID NO: 167209

SEQ ID NO: 497954 - RNA, 64 nt, Human; identical to SEQ ID NO: 167210

SEQ ID NO: 497955 - RNA, 64 nt, Human; identical to SEQ ID NO: 167211

SEQ ID NO: 497956 - RNA, 64 nt, Human; identical to SEQ ID NO: 167212

SEQ ID NO: 497957 - RNA, 64 nt, Human; identical to SEQ ID NO: 167213

SEQ ID NO: 497958 - RNA, 64 nt, Human
uucauagugagaauccuguguucccacuucagugacaccugaauuguuuguuguuguuuuuuuu

SEQ ID NO: 497959 - RNA, 64 nt, Human
agaaguuuguaaauguuccagaacaaccuagagaacaccugaguacuaagcagcaguuuugcaa

SEQ ID NO: 497960 - RNA, 64 nt, Human
uggcugcuuuuuagaauaaugcaagauaaaaaucacaccugagggcugaaaacggagagggaau

SEQ ID NO: 497961 - RNA, 64 nt, Human
caagucaaauggauucaucaccugucaugcauugacaccugauacccagacuuaauugguauuu

SEQ ID NO: 497962 - RNA, 64 nt, Human
aguagaguguagacccuuucauguacuguacuguacaccugauacuguaaacauacuguaauaa

SEQ ID NO: 497963 - RNA, 64 nt, Human
gauuauuucauuuuaaaaccauagaauaaaaaugacaccugagcuucucuaugaaugagaacgg

SEQ ID NO: 497964 - RNA, 64 nt, Human
uucaagucauauagauuccuacucgaaaaucuugacaccugacuuuccaggaugcacauuuuca

SEQ ID NO: 497965 - RNA, 64 nt, Human
cuggccauggagccucauugcaaguuguucuugaacaccugaggccuuccuggugcccaccagg

SEQ ID NO: 497966 - RNA, 64 nt, Human
guuauuuauuuugccuguccuuaucccugcuuggacaccugagcaucugauuccugucccccug

SEQ ID NO: 497967 - RNA, 64 nt, Human
aauuucuuugcuguaucuggugaaacccacaaaaacaccugaaaaaacucaagcugacuuccac

SEQ ID NO: 497968 - RNA, 64 nt, Human
cuccucccuuacccuccucugcugggaaccuagcacaccugaaucagcuggacauacugcugga

SEQ ID NO: 497969 - RNA, 64 nt, Human
agaacuuacaggauguuagagacaaaacaagcagacaccugaaacaaucaacgcccaauaaaac

SEQ ID NO: 497970 - RNA, 62 nt, Human
uucaauauugaaguauugaaauaaaauauucuuuacaccugaaguaaauacauuuuucuuuu

SEQ ID NO: 497971 - RNA, 61 nt, Human
augaccgauggacuuucugaagcuaaagaccacaccugaaucagggcugugguaaucaucu

SEQ ID NO: 497972 - RNA, 64 nt, Human
auaaaaggccuuagaaccaguuagugaucugccuacaccugaaucccugaaacaucugaacugu

SEQ ID NO: 497973 - RNA, 64 nt, Human
aaauauuaacuccagaaacuaggccugacuggggacaccugagaguaguauaguagugcaaaau

SEQ ID NO: 497974 - RNA, 58 nt, Human
caggaaaccuucgaaucugagaacuuccacaccugaggcaccugagagaggaacucug

SEQ ID NO: 497975 - RNA, 64 nt, Human
ggggugagagaccagcagcccaagggcuccagacacaccugaacacaucgugaugaugacgucc

SEQ ID NO: 497976 - RNA, 64 nt, Human
aaagguugggaguggcuuuuccucugguagccacacaccugagcacuacggacagggaggcagg

SEQ ID NO: 497977 - RNA, 64 nt, Human
gcuaacaccccuacuaggucccagagggccagaaacaccugacuuaccucugaguuuagacuag

SEQ ID NO: 497978 - RNA, 64 nt, Human
cagaguguccccagagacaugcaagucaugggucacaccugacaaauggaaggaguuccucuaa

SEQ ID NO: 497979 - RNA, 64 nt, Human; identical to SEQ ID NO: 301194

SEQ ID NO: 497980 - RNA, 64 nt, Human; identical to SEQ ID NO: 301195

SEQ ID NO: 497981 - RNA, 64 nt, Human; identical to SEQ ID NO: 301196

SEQ ID NO: 497982 - RNA, 64 nt, Human; identical to SEQ ID NO: 301197

SEQ ID NO: 497983 - RNA, 64 nt, Human; identical to SEQ ID NO: 301198

SEQ ID NO: 497984 - RNA, 64 nt, Human; identical to SEQ ID NO: 301199

SEQ ID NO: 497985 - RNA, 64 nt, Human; identical to SEQ ID NO: 301200

SEQ ID NO: 497986 - RNA, 64 nt, Human; identical to SEQ ID NO: 302444

SEQ ID NO: 497987 - RNA, 64 nt, Human; identical to SEQ ID NO: 302461

SEQ ID NO: 497988 - RNA, 64 nt, Human; identical to SEQ ID NO: 302462

SEQ ID NO: 497989 - RNA, 64 nt, Human; identical to SEQ ID NO: 302463

SEQ ID NO: 497990 - RNA, 64 nt, Human; identical to SEQ ID NO: 302464

SEQ ID NO: 497991 - RNA, 64 nt, Human; identical to SEQ ID NO: 302465

SEQ ID NO: 497992 - RNA, 64 nt, Human; identical to SEQ ID NO: 302466

SEQ ID NO: 497993 - RNA, 64 nt, Human; identical to SEQ ID NO: 302467

SEQ ID NO: 497994 - RNA, 64 nt, Human; identical to SEQ ID NO: 300347

SEQ ID NO: 497995 - RNA, 64 nt, Human; identical to SEQ ID NO: 300348

SEQ ID NO: 497996 - RNA, 64 nt, Human; identical to SEQ ID NO: 300349

SEQ ID NO: 497997 - RNA, 64 nt, Human; identical to SEQ ID NO: 302468

SEQ ID NO: 497998 - RNA, 64 nt, Human; identical to SEQ ID NO: 302469

SEQ ID NO: 497999 - RNA, 64 nt, Human; identical to SEQ ID NO: 302470

SEQ ID NO: 498000 - RNA, 64 nt, Human; identical to SEQ ID NO: 302471

SEQ ID NO: 498001 - RNA, 64 nt, Human; identical to SEQ ID NO: 302472

SEQ ID NO: 498002 - RNA, 64 nt, Human; identical to SEQ ID NO: 302473

SEQ ID NO: 498003 - RNA, 64 nt, Human; identical to SEQ ID NO: 302474

SEQ ID NO: 498004 - RNA, 64 nt, Human; identical to SEQ ID NO: 302475

SEQ ID NO: 498005 - RNA, 64 nt, Human; identical to SEQ ID NO: 302476

SEQ ID NO: 498006 - RNA, 64 nt, Human; identical to SEQ ID NO: 302480

SEQ ID NO: 498007 - RNA, 64 nt, Human; identical to SEQ ID NO: 302481

SEQ ID NO: 498008 - RNA, 64 nt, Human; identical to SEQ ID NO: 302482

SEQ ID NO: 498009 - RNA, 64 nt, Human; identical to SEQ ID NO: 302483

SEQ ID NO: 498010 - RNA, 64 nt, Human; identical to SEQ ID NO: 302484

SEQ ID NO: 498011 - RNA, 64 nt, Human; identical to SEQ ID NO: 302485

SEQ ID NO: 498012 - RNA, 64 nt, Human; identical to SEQ ID NO: 300342

SEQ ID NO: 498013 - RNA, 64 nt, Human; identical to SEQ ID NO: 300446

SEQ ID NO: 498014 - RNA, 64 nt, Human; identical to SEQ ID NO: 300447

SEQ ID NO: 498015 - RNA, 64 nt, Human; identical to SEQ ID NO: 302486

SEQ ID NO: 498016 - RNA, 64 nt, Human; identical to SEQ ID NO: 302487

SEQ ID NO: 498017 - RNA, 64 nt, Human
gaagacuucaagccuuaaaaggaggcugccguggagcacggauacagaaacugagacacgugga

SEQ ID NO: 498018 - RNA, 64 nt, Human
cugucugccucagaacauagccgugaucaagaugagcacggaggcucgugucccagcaccuggc

SEQ ID NO: 498019 - RNA, 64 nt, Human
guuucuucucaaaauggauuucauauaauuucggagcacggaagcacacacaagcucuuuauga

SEQ ID NO: 498020 - RNA, 64 nt, Human
ggguagcugagucugcuuaggggacugcaugggaagcacggaauauaggguuagauguguguua

SEQ ID NO: 498021 - RNA, 64 nt, Human
gcucuggaggcugcugcugaccugggccaugaggagcacggaggagaaggacuggcagauccca

SEQ ID NO: 498022 - RNA, 64 nt, Human
ucccagccuccacuuucagagugaaauucaaggcagcacggacaugugcccaucaggcacagaa

SEQ ID NO: 498023 - RNA, 64 nt, Human
ugggauuaccgaagaguccccuuccuugcgugucagcacggaugcugugacugccaccugcguc

SEQ ID NO: 498024 - RNA, 64 nt, Human
guggugaggguucuaggggaucucagauguguguagcacggagccugcuguguccugggugcuc

SEQ ID NO: 498025 - RNA, 64 nt, Human
ucauucaggaaaucaaaucagucuuccggucugcagcacggaaaagcacauaaucuuucuuugc

SEQ ID NO: 498026 - RNA, 64 nt, Human
cuagaaaauuuuauggcuaucgaagaaaugaagaagcacggaaguacucaugucggauucccag

SEQ ID NO: 498027 - RNA, 64 nt, Human
aacaaaucccauauguugggcaacaguucaaauaagcacggagaaguguugcccaaacuugguu

SEQ ID NO: 498028 - RNA, 64 nt, Human
ucguuucuuuuucaucucccccccacccacaaagagcacggagccagccuuccacuuuucccag

SEQ ID NO: 498029 - RNA, 64 nt, Human; identical to SEQ ID NO: 300351

SEQ ID NO: 498030 - RNA, 64 nt, Human; identical to SEQ ID NO: 300352

SEQ ID NO: 498031 - RNA, 64 nt, Human; identical to SEQ ID NO: 300353

SEQ ID NO: 498032 - RNA, 64 nt, Human
auuugaacucagaucugucugauaggaaugugaaagcacggacucuuacugcuaacuuuugugu

SEQ ID NO: 498033 - RNA, 64 nt, Human
caguuggaugaauagagaagggaaaaguugcuggagcacggagugaagaugggaggagcuguua

SEQ ID NO: 498034 - RNA, 64 nt, Human
aucuugugaaccccuaaauccgcucccuccuaacagcacggauucucuuggggcucuucuucag

SEQ ID NO: 498035 - RNA, 64 nt, Human
uuuucacauuaggcuguugguucaaacuuuugggagcacggacugucaguucucugggaagugg

SEQ ID NO: 498036 - RNA, 64 nt, Human
ucuuacacaucugacuccgcagugccugcaggggagcacggagccgcgggacagccaagcaccu

SEQ ID NO: 498037 - RNA, 64 nt, Human
gauuauggucuuuagauuaauacugauuauauagagcacggaaagauaaagaauugaacauuuu

SEQ ID NO: 498038 - RNA, 64 nt, Human
ugauguauugcuucuucacguuuuguuuuuauugagcacggaguagaauuccagggcugccuug

SEQ ID NO: 498039 - RNA, 64 nt, Human
ccuuggggagggcuccuagugcugagcuuggagcagcacggacagcagcauuguuuaugggaau

SEQ ID NO: 498040 - RNA, 64 nt, Human
cuccccacggugcgugcccuggugcugcgggugcagcacggaaaccccggcuucuacuguacag

SEQ ID NO: 498041 - RNA, 64 nt, Human
cucccaaacaggaaacccuggugaagguucaggaagcacggagauucucuccaacaaaggucca

SEQ ID NO: 498042 - RNA, 64 nt, Human
gggguucgcaccgugcugggcucccccugacuguagcacggaguguuggggcugggggccagcu

SEQ ID NO: 498043 - RNA, 64 nt, Human
uuaugcagaaaaaaauugaacaaaacaggguaccagcacggaagacuuucuuaaaacgcaaccu

SEQ ID NO: 498044 - RNA, 57 nt, Human
accgggacacagaauuauagaugucugagcacggacucucccaggccugccugcaug

SEQ ID NO: 498045 - RNA, 64 nt, Human
gaaagggcaccccagcgggggcauguguggaggcagcacggaacauguagguuauagaucguca

SEQ ID NO: 498046 - RNA, 64 nt, Human
ugguuauuauuuauauuauuuauuccuguucaguagcacggaaugaucuccaaacauuccuagg

SEQ ID NO: 498047 - RNA, 64 nt, Human; identical to SEQ ID NO: 300354

SEQ ID NO: 498048 - RNA, 64 nt, Human; identical to SEQ ID NO: 300355

SEQ ID NO: 498049 - RNA, 64 nt, Human; identical to SEQ ID NO: 300356

SEQ ID NO: 498050 - RNA, 64 nt, Human
ucauguggaaagaggagcugggaccgcggcgagcagcacggagcggaagggagagcaggggaga

SEQ ID NO: 498051 - RNA, 64 nt, Human
uuggaugaggagugguugggcugugccugggccuagcacggacauggucuguccugacagcacu

SEQ ID NO: 498052 - RNA, 64 nt, Human
cauugaacuugucuauggcaaugcuucuuucacaagcacggacugggcugaggucaacucugau

SEQ ID NO: 498053 - RNA, 64 nt, Human
acauagcaagcugaacuguccuaaggcaggggcgagcacggaacaauggggccuucagcuggag

SEQ ID NO: 498054 - RNA, 64 nt, Human
ucagggacaagaccagucccccagcgugguggucagcacggaagcuccaccuucuggguggagg

SEQ ID NO: 498055 - RNA, 64 nt, Human
gggccugaggaggggucucuccaggcauuguuccagcacggaggugaugugucacgggcccuga

SEQ ID NO: 498056 - RNA, 64 nt, Human
aaacuuucauucaagguugaagaagaaaugaagaagcacggaaguacucauaugggauucccag

SEQ ID NO: 498057 - RNA, 64 nt, Human
accugccuuggcaagccuauuuuagugauauggcagcacggauauaacacuaugcauuaaaagc

SEQ ID NO: 498058 - RNA, 64 nt, Human
ucgaguucuuggggcgcagagaacuuaggagagaagcacggaggagcccccggcagagcacccg

SEQ ID NO: 498059 - RNA, 64 nt, Human
ucuagacaccaagggggaguaagcugagcugucuagcacggauuggagacucccucucccuggu

SEQ ID NO: 498060 - RNA, 64 nt, Human
ccggggcccacuccgauccgccugggcucagcuaagcacggaagccaagggggcugugccgugg

SEQ ID NO: 498061 - RNA, 64 nt, Human
aaacagaugcuccuguuugcugggggagggugugagcacggaguauuucugucccucgugaagu

SEQ ID NO: 498062 - RNA, 64 nt, Human
uagcccugaguccuaggaggagcaccucugcaccagcacggaccucucgcuccacccagcucug

SEQ ID NO: 498063 - RNA, 64 nt, Human
aaccguuccugaaaggccaccaggcgcccaguguagcacggaagaugcccacgugccugagcca

SEQ ID NO: 498064 - RNA, 64 nt, Human
gcguaccucccucaccgucuggggcucuucugggagcacggagcauccccuguuccuguuucac

SEQ ID NO: 498065 - RNA, 64 nt, Human; identical to SEQ ID NO: 300361

SEQ ID NO: 498066 - RNA, 64 nt, Human; identical to SEQ ID NO: 300362

SEQ ID NO: 498067 - RNA, 64 nt, Human; identical to SEQ ID NO: 300363

SEQ ID NO: 498068 - RNA, 64 nt, Human
aaggccuucccccaccacugggcagaggcuggacagcacggacuucuagagagagccgcguugc

SEQ ID NO: 498069 - RNA, 64 nt, Human
agcccuauuuucacuccuuccaguggucgacaugagcacggacuccuaaaccuuuuccacgcca

SEQ ID NO: 498070 - RNA, 64 nt, Human
gcgccgacguccugcccaccacgcacucccggagagcacggaaccgcacgcacgucaggcaccg

SEQ ID NO: 498071 - RNA, 64 nt, Human
cccaugucccagccacuucugggucccagccagcagcacggauguuacuguccugcuccuuccc

SEQ ID NO: 498072 - RNA, 64 nt, Human
gcccugugguccugucccagugcagagggccuggagcacggauugugaauaaagccgcacaugc

SEQ ID NO: 498073 - RNA, 64 nt, Human
uccggaguaccggcgggaggagguguacauccgcagcacggacuuugaccgcacgcuggagagu

SEQ ID NO: 498074 - RNA, 64 nt, Human
aucagugaauggaucccaacaccccaaccacaggagcacggauucccuguaccucaacacccag

SEQ ID NO: 498075 - RNA, 64 nt, Human
ggugucacaugcccacagcagccucggugacgagagcacggagcccaagagguggggugucgug

SEQ ID NO: 498076 - RNA, 64 nt, Human
gccccaccggcgcgcucuucgcgcccgccccugcagcacggacaauaaaccuccgccaaugcac

SEQ ID NO: 498077 - RNA, 64 nt, Human
ucaacucaaggguggucagcucaaugcuacacagagcacggacuuuuggauucuuugcaguacu

SEQ ID NO: 498078 - RNA, 64 nt, Human
caucaucaccgacauguccuucuuaucuggaaagagcacggaaaugcagcggccuccuugaaga

SEQ ID NO: 498079 - RNA, 64 nt, Human
agugcuggagagggugggcugagggacuggggccagcacggaccacccaaggccucugcuuccc

SEQ ID NO: 498080 - RNA, 64 nt, Human
uccaggagacauauuuccagcagcuggcaccugcagcacggagcuccggcuucccaaacccuca

SEQ ID NO: 498081 - RNA, 64 nt, Human
cggcugggagcaugaccuuggcgucuguucugggagcacggaugauaagcucuggaagcuggca

SEQ ID NO: 498082 - RNA, 54 nt, Human; identical to SEQ ID NO: 300364

SEQ ID NO: 498083 - RNA, 64 nt, Human; identical to SEQ ID NO: 300365

SEQ ID NO: 498084 - RNA, 64 nt, Human; identical to SEQ ID NO: 300366

SEQ ID NO: 498085 - RNA, 64 nt, Human; identical to SEQ ID NO: 301194

SEQ ID NO: 498086 - RNA, 64 nt, Human; identical to SEQ ID NO: 301195

SEQ ID NO: 498087 - RNA, 64 nt, Human; identical to SEQ ID NO: 301196

SEQ ID NO: 498088 - RNA, 64 nt, Human; identical to SEQ ID NO: 301197

SEQ ID NO: 498089 - RNA, 64 nt, Human; identical to SEQ ID NO: 301198

SEQ ID NO: 498090 - RNA, 64 nt, Human; identical to SEQ ID NO: 301199

SEQ ID NO: 498091 - RNA, 64 nt, Human; identical to SEQ ID NO: 301200

SEQ ID NO: 498092 - RNA, 64 nt, Human; identical to SEQ ID NO: 302444

SEQ ID NO: 498093 - RNA, 64 nt, Human; identical to SEQ ID NO: 302461

SEQ ID NO: 498094 - RNA, 64 nt, Human; identical to SEQ ID NO: 302462

SEQ ID NO: 498095 - RNA, 64 nt, Human; identical to SEQ ID NO: 302463

SEQ ID NO: 498096 - RNA, 64 nt, Human; identical to SEQ ID NO: 300368

SEQ ID NO: 498097 - RNA, 64 nt, Human; identical to SEQ ID NO: 300369

SEQ ID NO: 498098 - RNA, 64 nt, Human; identical to SEQ ID NO: 300370

SEQ ID NO: 498099 - RNA, 64 nt, Human; identical to SEQ ID NO: 302464

SEQ ID NO: 498100 - RNA, 64 nt, Human; identical to SEQ ID NO: 302465

SEQ ID NO: 498101 - RNA, 64 nt, Human; identical to SEQ ID NO: 302466

SEQ ID NO: 498102 - RNA, 64 nt, Human; identical to SEQ ID NO: 302467

SEQ ID NO: 498103 - RNA, 64 nt, Human; identical to SEQ ID NO: 302468

SEQ ID NO: 498104 - RNA, 64 nt, Human; identical to SEQ ID NO: 302469

SEQ ID NO: 498105 - RNA, 64 nt, Human; identical to SEQ ID NO: 302470

SEQ ID NO: 498106 - RNA, 64 nt, Human; identical to SEQ ID NO: 302471

SEQ ID NO: 498107 - RNA, 64 nt, Human; identical to SEQ ID NO: 302472

SEQ ID NO: 498108 - RNA, 64 nt, Human; identical to SEQ ID NO: 302473

SEQ ID NO: 498109 - RNA, 64 nt, Human; identical to SEQ ID NO: 302474

SEQ ID NO: 498110 - RNA, 64 nt, Human; identical to SEQ ID NO: 302475

SEQ ID NO: 498111 - RNA, 64 nt, Human; identical to SEQ ID NO: 302476

SEQ ID NO: 498112 - RNA, 64 nt, Human; identical to SEQ ID NO: 302480

SEQ ID NO: 498113 - RNA, 64 nt, Human; identical to SEQ ID NO: 302481

SEQ ID NO: 498114 - RNA, 64 nt, Human; identical to SEQ ID NO: 300371

SEQ ID NO: 498115 - RNA, 64 nt, Human; identical to SEQ ID NO: 300372

SEQ ID NO: 498116 - RNA, 64 nt, Human; identical to SEQ ID NO: 300280

SEQ ID NO: 498117 - RNA, 64 nt, Human; identical to SEQ ID NO: 302482

SEQ ID NO: 498118 - RNA, 64 nt, Human; identical to SEQ ID NO: 302483

SEQ ID NO: 498119 - RNA, 64 nt, Human; identical to SEQ ID NO: 302484

SEQ ID NO: 498120 - RNA, 64 nt, Human; identical to SEQ ID NO: 302485

SEQ ID NO: 498121 - RNA, 64 nt, Human; identical to SEQ ID NO: 302486

SEQ ID NO: 498122 - RNA, 64 nt, Human; identical to SEQ ID NO: 302487

SEQ ID NO: 498123 - RNA, 64 nt, Human; identical to SEQ ID NO: 498017

SEQ ID NO: 498124 - RNA, 64 nt, Human; identical to SEQ ID NO: 498018

SEQ ID NO: 498125 - RNA, 64 nt, Human; identical to SEQ ID NO: 498019

SEQ ID NO: 498126 - RNA, 64 nt, Human; identical to SEQ ID NO: 498020

SEQ ID NO: 498127 - RNA, 64 nt, Human; identical to SEQ ID NO: 498021

SEQ ID NO: 498128 - RNA, 64 nt, Human; identical to SEQ ID NO: 498022

SEQ ID NO: 498129 - RNA, 64 nt, Human; identical to SEQ ID NO: 498023

SEQ ID NO: 498130 - RNA, 64 nt, Human; identical to SEQ ID NO: 498024

SEQ ID NO: 498131 - RNA, 64 nt, Human; identical to SEQ ID NO: 242305

SEQ ID NO: 498132 - RNA, 64 nt, Human; identical to SEQ ID NO: 240134

SEQ ID NO: 498133 - RNA, 64 nt, Human; identical to SEQ ID NO: 242257

SEQ ID NO: 498134 - RNA, 64 nt, Human; identical to SEQ ID NO: 498025

SEQ ID NO: 498135 - RNA, 64 nt, Human; identical to SEQ ID NO: 498026

SEQ ID NO: 498136 - RNA, 64 nt, Human; identical to SEQ ID NO: 498027

SEQ ID NO: 498137 - RNA, 64 nt, Human; identical to SEQ ID NO: 498028

SEQ ID NO: 498138 - RNA, 64 nt, Human; identical to SEQ ID NO: 498032

SEQ ID NO: 498139 - RNA, 64 nt, Human; identical to SEQ ID NO: 498033

SEQ ID NO: 498140 - RNA, 64 nt, Human; identical to SEQ ID NO: 498034

SEQ ID NO: 498141 - RNA, 64 nt, Human; identical to SEQ ID NO: 498035

SEQ ID NO: 498142 - RNA, 64 nt, Human; identical to SEQ ID NO: 498036

SEQ ID NO: 498143 - RNA, 64 nt, Human; identical to SEQ ID NO: 498037

SEQ ID NO: 498144 - RNA, 64 nt, Human; identical to SEQ ID NO: 498038

SEQ ID NO: 498145 - RNA, 64 nt, Human; identical to SEQ ID NO: 498039

SEQ ID NO: 498146 - RNA, 64 nt, Human; identical to SEQ ID NO: 498040

SEQ ID NO: 498147 - RNA, 64 nt, Human; identical to SEQ ID NO: 498041

SEQ ID NO: 498148 - RNA, 64 nt, Human; identical to SEQ ID NO: 498042

SEQ ID NO: 498149 - RNA, 64 nt, Human; identical to SEQ ID NO: 242259

SEQ ID NO: 498150 - RNA, 64 nt, Human; identical to SEQ ID NO: 242260

SEQ ID NO: 498151 - RNA, 64 nt, Human; identical to SEQ ID NO: 242402

SEQ ID NO: 498152 - RNA, 64 nt, Human; identical to SEQ ID NO: 498043

SEQ ID NO: 498153 - RNA, 57 nt, Human; identical to SEQ ID NO: 498044

SEQ ID NO: 498154 - RNA, 64 nt, Human; identical to SEQ ID NO: 498045

SEQ ID NO: 498155 - RNA, 64 nt, Human; identical to SEQ ID NO: 498046

SEQ ID NO: 498156 - RNA, 64 nt, Human; identical to SEQ ID NO: 498050

SEQ ID NO: 498157 - RNA, 64 nt, Human; identical to SEQ ID NO: 498051

SEQ ID NO: 498158 - RNA, 64 nt, Human; identical to SEQ ID NO: 498052

SEQ ID NO: 498159 - RNA, 64 nt, Human; identical to SEQ ID NO: 498053

SEQ ID NO: 498160 - RNA, 64 nt, Human; identical to SEQ ID NO: 498054

SEQ ID NO: 498161 - RNA, 64 nt, Human; identical to SEQ ID NO: 498055

SEQ ID NO: 498162 - RNA, 64 nt, Human; identical to SEQ ID NO: 498056

SEQ ID NO: 498163 - RNA, 64 nt, Human; identical to SEQ ID NO: 498057

SEQ ID NO: 498164 - RNA, 64 nt, Human; identical to SEQ ID NO: 498058

SEQ ID NO: 498165 - RNA, 64 nt, Human; identical to SEQ ID NO: 498059

SEQ ID NO: 498166 - RNA, 64 nt, Human; identical to SEQ ID NO: 498060

SEQ ID NO: 498167 - RNA, 64 nt, Human; identical to SEQ ID NO: 240135

SEQ ID NO: 498168 - RNA, 64 nt, Human; identical to SEQ ID NO: 240155

SEQ ID NO: 498169 - RNA, 64 nt, Human; identical to SEQ ID NO: 240853

SEQ ID NO: 498170 - RNA, 64 nt, Human; identical to SEQ ID NO: 498061

SEQ ID NO: 498171 - RNA, 64 nt, Human; identical to SEQ ID NO: 498062

SEQ ID NO: 498172 - RNA, 64 nt, Human; identical to SEQ ID NO: 498063

SEQ ID NO: 498173 - RNA, 64 nt, Human; identical to SEQ ID NO: 498064

SEQ ID NO: 498174 - RNA, 64 nt, Human; identical to SEQ ID NO: 498068

SEQ ID NO: 498175 - RNA, 64 nt, Human; identical to SEQ ID NO: 498069

SEQ ID NO: 498176 - RNA, 64 nt, Human; identical to SEQ ID NO: 498070

SEQ ID NO: 498177 - RNA, 64 nt, Human; identical to SEQ ID NO: 498071

SEQ ID NO: 498178 - RNA, 64 nt, Human; identical to SEQ ID NO: 498072

SEQ ID NO: 498179 - RNA, 64 nt, Human; identical to SEQ ID NO: 498073

SEQ ID NO: 498180 - RNA, 64 nt, Human; identical to SEQ ID NO: 498074

SEQ ID NO: 498181 - RNA, 64 nt, Human; identical to SEQ ID NO: 498075

SEQ ID NO: 498182 - RNA, 64 nt, Human; identical to SEQ ID NO: 498076

SEQ ID NO: 498183 - RNA, 64 nt, Human; identical to SEQ ID NO: 498077

SEQ ID NO: 498184 - RNA, 64 nt, Human; identical to SEQ ID NO: 498078

SEQ ID NO: 498185 - RNA, 64 nt, Human; identical to SEQ ID NO: 240298

SEQ ID NO: 498186 - RNA, 58 nt, Human; identical to SEQ ID NO: 240600

SEQ ID NO: 498187 - RNA, 64 nt, Human; identical to SEQ ID NO: 300449

SEQ ID NO: 498188 - RNA, 64 nt, Human; identical to SEQ ID NO: 498079

SEQ ID NO: 498189 - RNA, 64 nt, Human; identical to SEQ ID NO: 498080

SEQ ID NO: 498190 - RNA, 64 nt, Human; identical to SEQ ID NO: 498081

SEQ ID NO: 498191 - RNA, 64 nt, Human
ucugccugaguuuuaauuuuuguccaaaguuauuuuaaucuauacaauuaaaaacuuuugccua

SEQ ID NO: 498192 - RNA, 64 nt, Human
auauaaauauucugguuuuguauuuuuguauauuuuaaucuaaggcccucauuuccugcacugu

SEQ ID NO: 498193 - RNA, 64 nt, Human
auauguucaucaccaacaaucagcugucauuuuauuaaucuaucccuuuugugcaugcaccauu

SEQ ID NO: 498194 - RNA, 64 nt, Human
cagauccuguaguauuuccaguagacauggccuuuuaaucuaagggcuuaagacugauuagucu

SEQ ID NO: 498195 - RNA, 64 nt, Human
cuugaacaaacugucauacguaugggaccuacacuuaaucuauaugcuuuacacuagcuuucug

SEQ ID NO: 498196 - RNA, 64 nt, Human
auaugcacagauccaguuagugaguuugucaagcuuaaucuaauugguuaagucuaaagagauu

SEQ ID NO: 498197 - RNA, 64 nt, Human
aguucuaaguaguuggaaacaaaauugacgcauguuaaucuaugcaaagagaaaggaaaggaug

SEQ ID NO: 498198 - RNA, 64 nt, Human; identical to SEQ ID NO: 240354

SEQ ID NO: 498199 - RNA, 64 nt, Human; identical to SEQ ID NO: 240440

SEQ ID NO: 498200 - RNA, 64 nt, Human; identical to SEQ ID NO: 300270

SEQ ID NO: 498201 - RNA, 64 nt, Human
ugugacaaaaugauacugugagaaauggggcauuuuaaucuaagugguuauaacaguggauucu

SEQ ID NO: 498202 - RNA, 64 nt, Human
ccuauuauaugccaaggcauuugcaaaaaucucauuaaucuaaaucaaaauagcuuuaaagaaa

SEQ ID NO: 498203 - RNA, 64 nt, Human
cuccgggcagucagcucuccauccaucccccucuuuaaucuaugaaucuauaggcucggugugu

SEQ ID NO: 498204 - RNA, 64 nt, Human
aacaguuuuuaaaacugauuuuagaaaaagaagcuuaaucuaacguuuucaaacacaaggucuc

SEQ ID NO: 498205 - RNA, 64 nt, Human
ccuagauaacuaaucugcuuuuaaucacgauguuuuaaucuaccucugucucuuuaaccaugcu

SEQ ID NO: 498206 - RNA, 64 nt, Human
cgucuguguauaaaagcaggaaauagccaaagcuuuaaucuagccuaauuuauuuuuccccuua

SEQ ID NO: 498207 - RNA, 64 nt, Human
uuagcuaaccuauucaaagaccuuuuccuguugauuaaucuauuuucauauuuauaaaggaguc

SEQ ID NO: 498208 - RNA, 64 nt, Human
cuagaauuuauuuuucaugaaauauugauguauuuuaaucuauguuaaaauaucuucaaugagg

SEQ ID NO: 498209 - RNA, 64 nt, Human
uuuuggggauguuguauagggauuaguauuuuuuuuaaucuaggugauuccaauauucagccaa

SEQ ID NO: 498210 - RNA, 64 nt, Human
uugccugaguuuuaauuuuuguccaaaguuaauuuuaaucuauacaauuaaaaccuuuugccua

SEQ ID NO: 498211 - RNA, 64 nt, Human
uuuccccuaguucuuacagguuucguuguguuuuuuaaucuaauaaaauagaaagaucccuuuu

SEQ ID NO: 498212 - RNA, 64 nt, Human
accucuugauauuuuaggauugaggaauaagucauuaaucuaaggacugauuacaguggcugga

SEQ ID NO: 498213 - RNA, 64 nt, Human
aguuauuuccuccauaauaacccugcauuucccauuaaucuacauaucuucccacagcagcuuu

SEQ ID NO: 498214 - RNA, 64 nt, Human
caaaguaagauuuugucagaauaaauugagaccauuaaucuaauauaauacuuguucaugagca

SEQ ID NO: 498215 - RNA, 64 nt, Human
accaagaauuaccccuaaaacagagacccuguauuuaaucuacuuugaucagagaaguagaauu

SEQ ID NO: 498216 - RNA, 64 nt, Human
guaaauugaauaauuuaucaagugcaggaauguguuaaucuaauggguuuugacuuaaaugcac

SEQ ID NO: 498217 - RNA, 64 nt, Human; identical to SEQ ID NO: 300276

SEQ ID NO: 498218 - RNA, 64 nt, Human; identical to SEQ ID NO: 300277

SEQ ID NO: 498219 - RNA, 64 nt, Human; identical to SEQ ID NO: 300278

SEQ ID NO: 498220 - RNA, 64 nt, Human
ggaggcggggcugcaucuggcuuggugguagcauuuaaucuauugcauugguguuuuucagaug

SEQ ID NO: 498221 - RNA, 64 nt, Human
guuuauuuuagcuacucaguaguaauguauucuauuaaucuacuaauauauauuucuugucuau

SEQ ID NO: 498222 - RNA, 64 nt, Human
aauguuaacauuaugauuuaaaagugcauuaaccuuaaucuagauaauaaaagcuuuuuggggc

SEQ ID NO: 498223 - RNA, 64 nt, Human
gacauauauguauauuaaaauaauugccuauuuauuaaucuacaaauagacaacguuggcaugu

SEQ ID NO: 498224 - RNA, 64 nt, Human
auucagacuuguaaauagaacuauuucaauguaguuaaucuaaaaacaaaaaagaaaaccccag

SEQ ID NO: 498225 - RNA, 64 nt, Human
uguguuuuauuggcccuuuucuuuauucagccccuuaaucuauuuucagucuucuggcacguaa

SEQ ID NO: 498226 - RNA, 64 nt, Human
ccauuaugugggcagguuauggaagcaaaauugguuaaucuacaccuuaacucuggcugcugca

SEQ ID NO: 498227 - RNA, 64 nt, Human
agaaacauuuuauaugcuccuuuggauaugcaauuuaaucuagauuaucuauuuuucucccaug

SEQ ID NO: 498228 - RNA, 64 nt, Human
uuaaacucugccagaaaaaaauaacuauuuuguuuuaaucuacuuuuuguauuuaguaguuauu

SEQ ID NO: 498229 - RNA, 64 nt, Human
guggcccuaucagccuucuccuuccuuuacuccuuuaaucuacuucuuugacuaccaguggaga

SEQ ID NO: 498230 - RNA, 64 nt, Human
acaaaugaucuaguucagaaggaagcaaaaucccuuaaucuaugugcaccguugggaccaaugc

SEQ ID NO: 498231 - RNA, 64 nt, Human
cauuauaugaaagcuaccaugugucagagaugauuuaaucuauuuaaguguuggacugcuagga

SEQ ID NO: 498232 - RNA, 64 nt, Human
agucauaggacauuuuuauuuuauggaauagauuuuaaucuauuuacuacuauuaagguaaauu

SEQ ID NO: 498233 - RNA, 64 nt, Human
uaauuaagcuacuuucucuuuuucccuucuuguuuuaaucuaguggguuuuuuauuuuauuuuu

SEQ ID NO: 498234 - RNA, 64 nt, Human
uuggcuauggcccuccccaucuacucuuuaaacuuuaaucuauaacuuuucaucaguuuuguuc

SEQ ID NO: 498235 - RNA, 64 nt, Human
uugucuuuauaugugaauuaaguuauauuaaauuuuaaucuauaguaaaaacauaguccuggaa

SEQ ID NO: 498236 - RNA, 64 nt, Human; identical to SEQ ID NO: 300280

SEQ ID NO: 498237 - RNA, 64 nt, Human; identical to SEQ ID NO: 300284

SEQ ID NO: 498238 - RNA, 64 nt, Human; identical to SEQ ID NO: 300285

SEQ ID NO: 498239 - RNA, 64 nt, Human
auuaagaaaugcuguauucuuaaauaugaaacaguuaaucuaaagucuuauuauuucuucuagu

SEQ ID NO: 498240 - RNA, 64 nt, Human
uauccuuaaauuuaaauacauacuuauguuuguauuaaucuaucaauauaugcauacaugaaua

SEQ ID NO: 498241 - RNA, 64 nt, Human
uucuucuaauggcaauguuuguccuuaccaggauuuaaucuauagaauugucucucaacucugc

SEQ ID NO: 498242 - RNA, 64 nt, Human
cuguguuuagcucauuuaaaucaaaauguguacuuuaaucuaaaauguuuuaauaaucuguauu

SEQ ID NO: 498243 - RNA, 64 nt, Human
aagcccaaacaugacuuuguuuuuaaaaaguucauuaaucuaaugucuaggauuauaaaacauu

SEQ ID NO: 498244 - RNA, 64 nt, Human
uaaccauauaauuaaauuacaaagguauacauaauuaaucuaauaaaggaucaugaggaaugcc

SEQ ID NO: 498245 - RNA, 64 nt, Human
gguuuauucaauccuguccuggguagggcgaaaguuaaucuagccaugugauuuuucagaaaag

SEQ ID NO: 498246 - RNA, 64 nt, Human
agcaguugauaccuagcagcguuauugaugggcauuaaucuauguuaguuggcaccuuaagaua

SEQ ID NO: 498247 - RNA, 64 nt, Human
gggaaaaagacacacccacaccguagaacauauauuaaucuacuggcgaaugggaaaggagacc

SEQ ID NO: 498248 - RNA, 64 nt, Human
ggaaaaccuuaaaaauugagacaauucaaucuauuuaaucuauuaaauuuuuucucugaauugg

SEQ ID NO: 498249 - RNA, 64 nt, Human
cucacuggauucucaugguaggauuucugagaucuuaaucuaagcuccaaaguugucuacuuuu

SEQ ID NO: 498250 - RNA, 64 nt, Human
aauacauucagguuccaagccugaccauccuuguuuaaucuaucauacucuuccagguuuuuuu

SEQ ID NO: 498251 - RNA, 64 nt, Human
gacauuuuucuaggaaauaaaauuccucgguguauuaaucuaagguuucaaaguauaaaaguau

SEQ ID NO: 498252 - RNA, 64 nt, Human
uuaauuuaaaauucucauuuauagaguauuuuauuuaaucuaguauaaaaaaucuagccuauuu

SEQ ID NO: 498253 - RNA, 64 nt, Human
ugauauaugcaugugugugaugguauguauggauuuaaucuaaucuaauaauugugccccgcag

SEQ ID NO: 498254 - RNA, 64 nt, Human
uaagcuuccaagaagguuuuggauacuagaaguauuaaucuauggcuuuucucccaguaaaacc

SEQ ID NO: 498255 - RNA, 64 nt, Human; identical to SEQ ID NO: 300286

SEQ ID NO: 498256 - RNA, 50 nt, Human; identical to SEQ ID NO: 300287

SEQ ID NO: 498257 - RNA, 64 nt, Human; identical to SEQ ID NO: 300288

SEQ ID NO: 498258 - RNA, 64 nt, Human
uauuguuguauuauuauuguugauguugucaugguuaaucuauuuuuuaaaauugaaaugaagc

SEQ ID NO: 498259 - RNA, 64 nt, Human
uggauuauagaagagaaaauucacaucugccuuguuaaucuaauaaauauaauuacagccccuu

SEQ ID NO: 498260 - RNA, 64 nt, Human
guuuacuauacauuugggggcuaccuggucacauuuaaucuagguuuuuuuuucuuuuuuuaag

SEQ ID NO: 498261 - RNA, 64 nt, Human
ugagucgcccuugccaaauauguuacuguauuaauuaaucuaauauugagugauuauuuguaaa

SEQ ID NO: 498262 - RNA, 64 nt, Human
uauauauauauaauauauauuaaaaaugaaacaauuaaucuagauuuuaacauuuucagaaacu

SEQ ID NO: 498263 - RNA, 64 nt, Human
caguaaccauggggaagaaaucuggucuaauuuauuaaucuaaaaaaggagaauugaauucugg

SEQ ID NO: 498264 - RNA, 64 nt, Human
ucauuuaaauuguuaggaggcuuggagcuauuaguuaaucuaucuuccaauacacuguuuaaua

SEQ ID NO: 498265 - RNA, 64 nt, Human
cauuguauugccauuauuuuguauuugguaaagguuaaucuaggaaguuaccaacuguuuaaug

SEQ ID NO: 498266 - RNA, 64 nt, Human
ugccaaugucaaucaaucacaguauuagccucuguuaaucuauuuacuguugcuuccauauaca

SEQ ID NO: 498267 - RNA, 64 nt, Human
auuccuaauuuggaaauuaaaguuuaccuuucuguuaaucuauguauaaauguuacucugaguu

SEQ ID NO: 498268 - RNA, 64 nt, Human
gcacuggaacaacacagaugagauauucuacacauuaaucuacuuaucuggaaucacuuugccu

SEQ ID NO: 498269 - RNA, 64 nt, Human
ucccacuugaauaacguaauucuucauaguuuuuuuaaucuauggauaaauggaaaccuaauua

SEQ ID NO: 498270 - RNA, 64 nt, Human
cuauaaauuuaguaauuaucaugccuugcucuuuuuaaucuauaugacugaugcaagccccucu

SEQ ID NO: 498271 - RNA, 64 nt, Human
accauuuuagcaaauuaugguuauauguuuuaauuuaaucuacagaauguuuuauaguaaaauu

SEQ ID NO: 498272 - RNA, 64 nt, Human
uguuuuugcacauaauccauauuugcuguucaaguuaaucuagaaauuuauucaauucuguaug

SEQ ID NO: 498273 - RNA, 64 nt, Human
ugauauauaaagguguaauuaagacagaguucuguuaaucuaaucaaguuugcuguuaguugug

SEQ ID NO: 498274 - RNA, 58 nt, Human; identical to SEQ ID NO: 300290

SEQ ID NO: 498275 - RNA, 64 nt, Human; identical to SEQ ID NO: 300291

SEQ ID NO: 498276 - RNA, 64 nt, Human; identical to SEQ ID NO: 300292

SEQ ID NO: 498277 - RNA, 64 nt, Human
uuuguauuauuaauauaucauguuaccuuauauauuaaucuacucuugauucugcuaauuauua

SEQ ID NO: 498278 - RNA, 64 nt, Human
ucaaauaccacuaugaauaaggauucagggguuuuuaaucuacuuuccauaaauuaccaauauc

SEQ ID NO: 498279 - RNA, 64 nt, Human
auguauaaccugguggguggguucagaguaccuuuuaaucuaguaugcuuaacuugauguuaau

SEQ ID NO: 498280 - RNA, 64 nt, Human
gugcuaacaguacaacagcagauuugggucaggcuuaaucuaaguguuaacuuuuuuuucuggu

SEQ ID NO: 498281 - RNA, 64 nt, Human
cucgcugacaucuggggcuuugacccuuucuuuuuuaaucuacuuuugcuaagaugcauuuaau

SEQ ID NO: 498282 - RNA, 64 nt, Human
ggaaauugucuuuagaagaaagaauuguauuucuuuaaucuaguaugguuacuccagauaagug

SEQ ID NO: 498283 - RNA, 64 nt, Human
uauuuuuuuguaaauauuauguguguguuuuuuuuuaaucuaugggaauauuucuuuuggaaaa

SEQ ID NO: 498284 - RNA, 64 nt, Human
cccuauugcauuaaaguacaaauacuauguauuuuuaaucuaugaugguuuaugugaauaggau

SEQ ID NO: 498285 - RNA, 64 nt, Human
ugaagcuaaaauuacuuguggaucuuuuuuuuuuuuaaucuauugcucuuuggaaauaaaaaaa

SEQ ID NO: 498286 - RNA, 64 nt, Human
ccuuuaaugauccacaauaaucccuuugaucacguuaaucuaaaucuagaugucuuugucuaau

SEQ ID NO: 498287 - RNA, 64 nt, Human
ugguuugauuauuguuuccacacugaucagcuguuuaaucuauuugggaaaugaagaugcacau

SEQ ID NO: 498288 - RNA, 64 nt, Human
gaacaccauugucaucucauauugaucagguauuuuaaucuagcacuuacauauuguugauaaa

SEQ ID NO: 498289 - RNA, 64 nt, Human
aucauuaauuaugcacuuuguccucuggaccauuuuaaucuaaaauugcucucaaggaucuagu

SEQ ID NO: 498290 - RNA, 64 nt, Human
aauuaaaguacucuuuguaagguacaguuaccgauuaaucuagagauaaaauauuuucuuaaaa

SEQ ID NO: 498291 - RNA, 64 nt, Human
uggagauagacucaaaacaguuauuuuuuuacaauuaaucuacaaagggaauuaauauuguuga

SEQ ID NO: 498292 - RNA, 64 nt, Human
aacuucacaugcauuccgcuugagaccauaguguuuaaucuauggcaccaagcaucguuuccuc

SEQ ID NO: 498293 - RNA, 64 nt, Human; identical to SEQ ID NO: 300293

SEQ ID NO: 498294 - RNA, 64 nt, Human; identical to SEQ ID NO: 300294

SEQ ID NO: 498295 - RNA, 64 nt, Human; identical to SEQ ID NO: 300295

SEQ ID NO: 498296 - RNA, 64 nt, Human
aacgguauagaucacaagggggggauguuaaauguuaaucuaaaauauagcuaaaaaaagauuu

SEQ ID NO: 498297 - RNA, 64 nt, Human
gcagacuuacaaagcuugggacaguuauuggagauuaaucuaccauuuauugaaugcauacucu

SEQ ID NO: 498298 - RNA, 64 nt, Human
gcugucaaagagaaacaaggaaaugauagcuuuguuaaucuagccucuuucuuugucccacaua

SEQ ID NO: 498299 - RNA, 64 nt, Human
gguuuaggaggucugaacacacacaguggagagguuaaucuagguugggaaacugaguaaaagu

SEQ ID NO: 498300 - RNA, 64 nt, Human
uugaaucuuaacuuuccaucagucuucaguguuuuuaaucuaaggaauaauuaucuuccugcau

SEQ ID NO: 498301 - RNA, 64 nt, Human
ccugaacauuagaacccuaauguucaggaagauuuuaaucuaagcauuuuuauggaaauauuuu

SEQ ID NO: 498302 - RNA, 64 nt, Human
uaucuucccccccaccccccgccccauggaauauuuaaucuauuuaaucuucuugcauuuauuu

SEQ ID NO: 498303 - RNA, 64 nt, Human
guuaaguauguccccagaacugcauggaacaugcuuaaucuaaacaaugauuuguuguucaccu

SEQ ID NO: 498304 - RNA, 64 nt, Human
aacacauaauuaguaaccacucuacuguuucaaguuaaucuaguaauagagcuuacauauauuu

SEQ ID NO: 498305 - RNA, 64 nt, Human
aaagcuuugcugugauuuaaaaaugccagcaauuuuaaucuagcaguguugaagcugggaauuu

SEQ ID NO: 498306 - RNA, 64 nt, Human
caacagaugugaaugaaugaaaguugagucuuucuuaaucuagacagcaaacuuaacaggcuuu

SEQ ID NO: 498307 - RNA, 64 nt, Human
agccccuucucccaggguccagagccaggaccccuuaaucuagguaaauugacagaaauaucau

SEQ ID NO: 498308 - RNA, 64 nt, Human
acuuagucaauaaaaccuugaaauaaagaugggcuuaaucuaauguacugcaugaguaguuggu

SEQ ID NO: 498309 - RNA, 64 nt, Human
aaagccauggucaucuggugaugaagagaaaaguuuaaucuaaaugauaugugcauuuccucau

SEQ ID NO: 498310 - RNA, 64 nt, Human
uauauccacaucuaagaaaauuuacuguaacuucuuaaucuaagaaaauuauguauuuuuguca

SEQ ID NO: 498311 - RNA, 64 nt, Human
gaauauucuuugcguuguaagacagaauacggguuuaaucuagucuaggcaccagauuuuuuuc

SEQ ID NO: 498312 - RNA, 64 nt, Human; identical to SEQ ID NO: 300297

SEQ ID NO: 498313 - RNA, 64 nt, Human; identical to SEQ ID NO: 300298

SEQ ID NO: 498314 - RNA, 64 nt, Human; identical to SEQ ID NO: 300299

SEQ ID NO: 498315 - RNA, 64 nt, Human
auaaugacauaaucugcuuagcagaaaaugacgauuaaucuauaggaaagcucaaguaaaugca

SEQ ID NO: 498316 - RNA, 64 nt, Human
guuuuuaaaggcaacauagcauucuacagcaggguuaaucuauuaucaagaacagucacccugg

SEQ ID NO: 498317 - RNA, 64 nt, Human
ucuaaaacgucaauuagaaaauuaucugcgguuguuaaucuacuguauauuuuuguuugguaua

SEQ ID NO: 498318 - RNA, 64 nt, Human
auuaacaaaaaauauauauuuuuaaaaaguucccuuaaucuaugacaugguagcaaugauuucc

SEQ ID NO: 498319 - RNA, 64 nt, Human
uaguguuaaacaaaaaauagguuuacuaaauauguuaaucuauucuuuuaacauaagccucacc

SEQ ID NO: 498320 - RNA, 64 nt, Human
auggagaaucacuuuucuagacaucuaccuauacuuaaucuaagaaacaaaguaaucuacugua

SEQ ID NO: 498321 - RNA, 64 nt, Human
aauauaucagauaugcaaaggccuaaacugagaauuaaucuaaaagucaguguuauuuaaacau

SEQ ID NO: 498322 - RNA, 64 nt, Human
aacaucacauacauucuuggaacuucccagugguuuaaucuaugugcaugguuagggagccagg

SEQ ID NO: 498323 - RNA, 64 nt, Human
ccuagauccaguucuuguuuuuuggcauaaauacuuaaucuauuuuaaauuuauaaaaucugag

SEQ ID NO: 498324 - RNA, 64 nt, Human
agguugggagcacaccuagcuagaguuauuuguguuaaucuauucaggaugcucuaagaaaacg

SEQ ID NO: 498325 - RNA, 64 nt, Human
uguucauuaauacuguuuucuaauuuuuccauaguuaaucuauaauuaauuacuucacuauaca

SEQ ID NO: 498326 - RNA, 64 nt, Human
guauauacauauauauuaauacugguauuuuuacuuaaucuauaaaaugucguuaaaaaguugu

SEQ ID NO: 498327 - RNA, 64 nt, Human
ccccaccuaauuccugcauccaaggcagguguuguuaaucuaucauagcacuuaaaaaaaaaaa

SEQ ID NO: 498328 - RNA, 64 nt, Human
gcuggaaacaaaaaugagcguguuuucucuccuguuaaucuagagugugcaguuacacaugugu

SEQ ID NO: 498329 - RNA, 64 nt, Human
ucugacacaaguguauuauuucuggcuuuuugaauuaaucuagaaaaugaaaagauggaguugu

SEQ ID NO: 498330 - RNA, 64 nt, Human
cuuauuaugugcuuaagauacaauagguuagaguuuaaucuaaauaucuugaaagcuauauugu

SEQ ID NO: 498331 - RNA, 64 nt, Human; identical to SEQ ID NO: 300303

SEQ ID NO: 498332 - RNA, 64 nt, Human; identical to SEQ ID NO: 300304

SEQ ID NO: 498333 - RNA, 64 nt, Human; identical to SEQ ID NO: 300305

SEQ ID NO: 498334 - RNA, 64 nt, Human
ugcuguacucuucauuugauguaacaaaaugcuauuaaucuaaauauuuguaaauaaaguaccu

SEQ ID NO: 498335 - RNA, 64 nt, Human
cacaggcuuguuaccaccaugcucggcuuuugcauuaaucuaagaaaaggggagagaaguuaau

SEQ ID NO: 498336 - RNA, 64 nt, Human
gcuuuuuuuaaucaauuguagagaauagucauuuuuaaucuaaauuagagaauugugauacaau

SEQ ID NO: 498337 - RNA, 64 nt, Human
uggcuuauaaaugguguuuaaauaugcauucauuuuaaucuacugaacaaauauugggauaacu

SEQ ID NO: 498338 - RNA, 64 nt, Human
cuucaggguuaaaauguauaaaaguuauguguaauuaaucuauaaugccauaaaugauaaugca

SEQ ID NO: 498339 - RNA, 61 nt, Human
acaaacggaguuuugacugaguauuugauaguuaaucuaccagugugagcuugccuauuuc

SEQ ID NO: 498340 - RNA, 64 nt, Human
uucuaaagcugcuucagacugcuucaugaggagguuaaucuacaauuaaacaauauuuccucuu

SEQ ID NO: 498341 - RNA, 64 nt, Human
cuuucaauguuuaauaaaacaaaaagagaaauccuuaaucuaaaagcuaaauuauuuuugaaug

SEQ ID NO: 498342 - RNA, 64 nt, Human
uuauguuccagauugaccaugaauaaaauauuuuuuaaucuaaauguagagaaguugggauuaa

SEQ ID NO: 498343 - RNA, 64 nt, Human
uauuaagaugugauucucuuuuuuauccuuaauguuaaucuacuuaaccuggcccccucuaaca

SEQ ID NO: 498344 - RNA, 64 nt, Human
cuagugccacaugugaaauuggauuuugaugaucuuaaucuauauucuacccuuauaauaaaag

SEQ ID NO: 498345 - RNA, 64 nt, Human
cacacauccaccgaugcauuuguggcuagaaauuuuaaucuaaacuuuuuuuaaaaaaaaucau

SEQ ID NO: 498346 - RNA, 64 nt, Human
guauuguuuuugagccaguauuuaacagaguuuuuuaaucuauaagauuuuuuuugaaucuauu

SEQ ID NO: 498347 - RNA, 64 nt, Human
guggcauuucuaugcaggcagcacagcagacuaguuaaucuauugcuuggacuuaacuaguuau

SEQ ID NO: 498348 - RNA, 64 nt, Human
uuaucaacugcaaugggagaaguauguauugcuguuaaucuauauguauucuuaaaaucugcau

SEQ ID NO: 498349 - RNA, 64 nt, Human
ucuaauccuuuuccuuauuugccuucuacuccccuuaaucuaaucuaaaagcucuguuccaugc

SEQ ID NO: 498350 - RNA, 64 nt, Human; identical to SEQ ID NO: 300375

SEQ ID NO: 498351 - RNA, 64 nt, Human; identical to SEQ ID NO: 300379

SEQ ID NO: 498352 - RNA, 64 nt, Human; identical to SEQ ID NO: 300380

SEQ ID NO: 498353 - RNA, 64 nt, Human
cucuuuaaaaguuaauaauuauauuagcaaaguguuaaucuaaugaaguaaaaaacuccugugu

SEQ ID NO: 498354 - RNA, 64 nt, Human
uagaagaggccuuuggaagaaaauuauguaaaguuuaaucuauaacaaaugcuuuauuauuuau

SEQ ID NO: 498355 - RNA, 64 nt, Human
auauagugcaauagugcaacaucucugaauccuuuuaaucuagagaaggcauuucauauuuggg

SEQ ID NO: 498356 - RNA, 64 nt, Human
uuuuuccuugguuaagaaaucaaauuugcagaauuuaaucuacaaguuguauuaugcuuugaaa

SEQ ID NO: 498357 - RNA, 64 nt, Human
acuauauuacacuuauccaucagguuucauuguauuaaucuauccuuugagguaauacuauuug

SEQ ID NO: 498358 - RNA, 64 nt, Human
aaccaaguaaaaucaguccuagaggcuaugguucuuaaucuauggagcuugcuuuaagaagcca

SEQ ID NO: 498359 - RNA, 64 nt, Human
aucccucaaaaaauucuauagggagacagcagccuuaaucuacauaauucuucaucucgccaau

SEQ ID NO: 498360 - RNA, 64 nt, Human
aauaauguauguacagcuggugcuuaguuuuuuuuuaaucuaaauuuaauuaccuuauuggaua

SEQ ID NO: 498361 - RNA, 64 nt, Human
ggaauauuucaagcucugcaacagggggcaaagauuaaucuaccuugcaguguaggaauucuau

SEQ ID NO: 498362 - RNA, 64 nt, Human
ucugagcaacgccugcuucuccauaucacagacuuuaaucuacacugcggagagcaaaccagcu

SEQ ID NO: 498363 - RNA, 64 nt, Human
auuauacuaacuuauuuauguuaaaagauuuuuuuuaaucuagacaauauacaagccaaagugg

SEQ ID NO: 498364 - RNA, 64 nt, Human
agaagcauuucuguaaaauuagaaauuacuuuuuuuaaucuauuuaaaguuuggcuugaagaau

SEQ ID NO: 498365 - RNA, 64 nt, Human
uccuagacauaacugucuaaguaaaagcgcucuauuaaucuaaaacacuacaagagaauuuaac

SEQ ID NO: 498366 - RNA, 64 nt, Human
gacuaggguccaaagcauuuuauaauauuuuuuuuuaaucuaggaaaaagacccaaacaaaucu

SEQ ID NO: 498367 - RNA, 64 nt, Human
caccuuuuauaggcacccuguaguuuuauaguucuuaaucuaaacauuuuauauuuccuucuuu

SEQ ID NO: 498368 - RNA, 64 nt, Human
auuauugaugaauuuucauaagguggaauugaucuuaaucuacuaacagagaaggguagacagu

SEQ ID NO: 498369 - RNA, 64 nt, Human; identical to SEQ ID NO: 300307

SEQ ID NO: 498370 - RNA, 64 nt, Human; identical to SEQ ID NO: 300308

SEQ ID NO: 498371 - RNA, 64 nt, Human; identical to SEQ ID NO: 300309

SEQ ID NO: 498372 - RNA, 64 nt, Human
aggaacaauauuuuaaaaaauauuuacagagauuuuaaucuaauaauucuuaagcaaaugugug

SEQ ID NO: 498373 - RNA, 64 nt, Human
gguuugcccacugucucugcaggaaggcuccggcuuaaucuaggaaguagauuccagcugcacg

SEQ ID NO: 498374 - RNA, 64 nt, Human
uuuagccagcacauuaaauuuuagauuuuauuuuuuaaucuaauuuuuuucuaaucaaaaagaa

SEQ ID NO: 498375 - RNA, 64 nt, Human
uggggacauuuuauaaucuauaugcugcacccacuuaaucuacugugguguuuuguuuauuagu

SEQ ID NO: 498376 - RNA, 64 nt, Human
ucuuuaucccauuuuaucauccuuucaguuuuuauuaaucuacuguaucaauaaaauucuguaa

SEQ ID NO: 498377 - RNA, 64 nt, Human
gagguuaucuugcugcacucuguagcaaauuuguuuaaucuacauuauaauaaaauuucuugcu

SEQ ID NO: 498378 - RNA, 64 nt, Human
uuugacauuuucaccaaaauauaguuugcacuuuuuaaucuaaagucaucccuucugagugaaa

SEQ ID NO: 498379 - RNA, 64 nt, Human
auuucaguuuaauaucaaccaaaaaauuaaaauuuuaaucuaacccuuauguguauaaauuggu

SEQ ID NO: 498380 - RNA, 64 nt, Human
acaguaauuuuaucuaaauuacagugcaguuuaguuaaucuauuaauacugacucagugucugc

SEQ ID NO: 498381 - RNA, 64 nt, Human
ucuuuggaguuaguguuauuccaggauauuuuacuuaaucuaaaaguuaauuuauguugcucau

SEQ ID NO: 498382 - RNA, 64 nt, Human
uuugaguuuagucacugcaaauuugacugugacuuuaaucuaaauuacuauguaaacaaaaagu

SEQ ID NO: 498383 - RNA, 64 nt, Human
cuacuccacugcagaacuugcagaaugcgugguguuaaucuacagagaacugcagcccuuauuc

SEQ ID NO: 498384 - RNA, 64 nt, Human
acuuuauaugcaucaacaagaucaccagugaaguuuaaucuagcuaaacacugguccugcuccu

SEQ ID NO: 498385 - RNA, 64 nt, Human
ccccagccaucuaugaauuaauuuaaauauauuuuuaaucuacuacuucaggaaaauaugguaa

SEQ ID NO: 498386 - RNA, 64 nt, Human
aucuuauguccuuuccuacauguaaaauauuuuguuaaucuaugccauuaguaguauuauauau

SEQ ID NO: 498387 - RNA, 64 nt, Human
ccuuuggcagugacuagauuuccacuaaugugucuuaaucuaucccuccagcuggcaguuacug

SEQ ID NO: 498388 - RNA, 64 nt, Human; identical to SEQ ID NO: 300310

SEQ ID NO: 498389 - RNA, 64 nt, Human; identical to SEQ ID NO: 300311

SEQ ID NO: 498390 - RNA, 64 nt, Human; identical to SEQ ID NO: 300312

SEQ ID NO: 498391 - RNA, 64 nt, Human
ugagugcacaagugaguuguugcccuggguuucuuuaaucuauucagcuagaacuuugaaggac

SEQ ID NO: 498392 - RNA, 64 nt, Human
accaguuaauaugugcacuaaacaagcacgacuauuaaucuaucauguuaugauauaauaaacu

SEQ ID NO: 498393 - RNA, 64 nt, Human
ucagaaucaaaccagauaauucucuaauucuucuuuaaucuaaaguagauagcuucccacugga

SEQ ID NO: 498394 - RNA, 64 nt, Human
uuaacauacuaacauuucuccuuuggaggaaguuuuaaucuacuucaggaugcauauuauuauc

SEQ ID NO: 498395 - RNA, 64 nt, Human
auaggaacuuaaauaaugugaaacuggauuaaacuuaaucuaaauggaaccacucuaucaagua

SEQ ID NO: 498396 - RNA, 64 nt, Human
gugaaacuccaccucaaaaaaaaaaaaaaaagaguuaaucuaggagauaaugaauggccuagua

SEQ ID NO: 498397 - RNA, 64 nt, Human
agugguucuuacuugauccaaaaaaugucaagaauuaaucuaggaggccgggccugguggcuca

SEQ ID NO: 498398 - RNA, 64 nt, Human
ugugcuuuucacauaaaauugagacaguguauauuuaaucuaauuuaaauuuuaaagagauacu

SEQ ID NO: 498399 - RNA, 64 nt, Human
gcaaaagguuguccuuuuuuuuuuuuuuuuuuuuuuaaucuacugacaaguugcucuaguaacc

SEQ ID NO: 498400 - RNA, 64 nt, Human
cuggcuucaugacccuguagcaucuuuggccacuuuaaucuagggugaccuagcaauccugcag

SEQ ID NO: 498401 - RNA, 64 nt, Human
guuuuauuuuuguggcugugguuuuuuccccuuuuuaaucuaacugccuguugacauugacacu

SEQ ID NO: 498402 - RNA, 64 nt, Human
gauuucauuugccauaauucacauaagacgaauuuuaaucuaaaaguacuuucuugcuuguauu

SEQ ID NO: 498403 - RNA, 64 nt, Human
aagccagggauaaaagcaccucaggcacauaacauuaaucuaguaauguaauucucugcacauc

SEQ ID NO: 498404 - RNA, 64 nt, Human
uuuccuuacccaguauaaauauauauauauauauuuaaucuauuuuuauuagaaguuuuucugc

SEQ ID NO: 498405 - RNA, 64 nt, Human
cccuguccuuucucagagugguucugagauuauuuuaaucuaauucuaaggaauaugagcuuua

SEQ ID NO: 498406 - RNA, 64 nt, Human
aaauaugaccuuuuuuacuugaagccaaugaauuuuaaucuauagauucuuuaauauuagcaca

SEQ ID NO: 498407 - RNA, 64 nt, Human; identical to SEQ ID NO: 242542

SEQ ID NO: 498408 - RNA, 64 nt, Human; identical to SEQ ID NO: 242543

SEQ ID NO: 498409 - RNA, 64 nt, Human
guaaagucucucucucucuuuuuuuuuuuuuuacuuaaucuagcuagaaucuauuucuguugau

SEQ ID NO: 498410 - RNA, 64 nt, Human
auuuagcauuuuaggagaccgcugucaacugguuuuaaucuaugaugcuaauguguuuuccacu

SEQ ID NO: 498411 - RNA, 64 nt, Human
caaaaacagcuucacuuuagcaaugaucagauuguuaaucuacagauuuuauuuuuuaaaauuu

SEQ ID NO: 498412 - RNA, 64 nt, Human
uuaauccuuugucauuauguagcagauguuuuucuuaaucuagcauuugucuuuauacuuuaua

SEQ ID NO: 498413 - RNA, 64 nt, Human
aacacugauccuucagaagaagcuucauucccucuuaaucuaguuaagccaggacauccagaau

SEQ ID NO: 498414 - RNA, 64 nt, Human
aacucuuugacaaauugcacagagcucuuuggcauuaaucuaauuuuaauguacugauaaaaac

SEQ ID NO: 498415 - RNA, 64 nt, Human
caauguauaaaucaaaucaucuguacuagcacuguuaaucuagaagaaagugguugcauagaga

SEQ ID NO: 498416 - RNA, 64 nt, Human
accucacugcacagcuucuagguagccuuccaacuuaaucuaacuugagccucacaguaacccu

SEQ ID NO: 498417 - RNA, 64 nt, Human
cuucauuauuaauugaauaguacauguuaacauuuuaaucuauuuaaauuuacuuugaaauaua

SEQ ID NO: 498418 - RNA, 64 nt, Human
ucuacucaacuacaaagauuuauuuaauguacucuuaaucuaacugaguuuuguuaccaaugac

SEQ ID NO: 498419 - RNA, 64 nt, Human
ucagcuaaacauaaggaauguuuucauaacaauauuaaucuaugggugcuucuguaagauggau

SEQ ID NO: 498420 - RNA, 64 nt, Human
aucccuguguaugcugaacuacagagcaugauguuuaaucuaauuuaaggagccacugauugua

SEQ ID NO: 498421 - RNA, 64 nt, Human
ccucucgcaagagggucucuuuguucaauuuuuuuuaaucuaaaaugauugugccucugcccaa

SEQ ID NO: 498422 - RNA, 64 nt, Human
gaauggauggacuugcucucuauguaauaugaaauuaaucuauuuuauuaaaauuuaaaaggac

SEQ ID NO: 498423 - RNA, 64 nt, Human
ggguagcaaaaaaaucaccuuuuaguuuuaguuuuuaaucuaaagauguuagacagaugcugag

SEQ ID NO: 498424 - RNA, 64 nt, Human
uucuguguuauagaacauucuaugaauguaguaauuaaucuauuuugcuccauacaugcaacug

SEQ ID NO: 498425 - RNA, 64 nt, Human; identical to SEQ ID NO: 242544

SEQ ID NO: 498426 - RNA, 54 nt, Human; identical to SEQ ID NO: 242453

SEQ ID NO: 498427 - RNA, 64 nt, Human; identical to SEQ ID NO: 242454

SEQ ID NO: 498428 - RNA, 64 nt, Human
acaacuauauauuaacauggcuucaauuguuuuuuuaaucuauuaucauuauuuuucuuuuuau

SEQ ID NO: 498429 - RNA, 64 nt, Human
ccaucccuuuauuuccuguaagaaauguuuuuaguuaaucuauaaucuauagaaauaaugcuua

SEQ ID NO: 498430 - RNA, 64 nt, Human
uuaaaauggguaggcuucucauguggcucauucuuuaaucuauucucuuuuauuugguuugguu

SEQ ID NO: 498431 - RNA, 64 nt, Human
gguuuguuuucuacauugauggaauuuuucucuuuuaaucuaucuacagcuuauagcaguucaa

SEQ ID NO: 498432 - RNA, 64 nt, Human
cagcucuuccccucccucauuuaauuugcugcuuuuaaucuacguggucugagaauuugugaaa

SEQ ID NO: 498433 - RNA, 64 nt, Human
ccugugguuuguuaucaguacaauucuuuguugcuuaaucuagagcuaugcacaccaaauugcu

SEQ ID NO: 498434 - RNA, 64 nt, Human
auauuuuuuggggaagugaggugugcccaguuuuuuaaucuaacaacuacuuuuggggacuugc

SEQ ID NO: 498435 - RNA, 64 nt, Human
ccccagccuuagaugccucgcucuuuucaaucucuuaaucuaaaugcuuuuuaaagagauuauu

SEQ ID NO: 498436 - RNA, 64 nt, Human
cugcgcccugggacagcggagagacggcuucucuuuaaucuaggucccauugugucuugaggga

SEQ ID NO: 498437 - RNA, 64 nt, Human
aauacugaaccacuuguagauuugauuuuuuuuuuuaaucuacugcauuuagggaguauucuaa

SEQ ID NO: 498438 - RNA, 64 nt, Human
cuaaugugcugaccuaugugccugcauuuuuuuuuuaaucuagacauguuuggagugagagaaa

SEQ ID NO: 498439 - RNA, 64 nt, Human
ccuauuucauaaccaggcuguuugacaaauacuuuuaaucuaguagucauuguaauaucuugcu

SEQ ID NO: 498440 - RNA, 64 nt, Human
uuuguaaaaauaauucagauauuaaacuccaauuuuaaucuaucauccaaggguagauguaguu

SEQ ID NO: 498441 - RNA, 64 nt, Human
cuacuuccaagacuuauuuucacauguggggagguuaaucuaggaaugacucguuuaaggccua

SEQ ID NO: 498442 - RNA, 64 nt, Human
uaggagaaaaauaugggacaauucaugauuauacuuaaucuaauuugauuaguuuauaaauuga

SEQ ID NO: 498443 - RNA, 64 nt, Human
aauguaaauguauccugaagguggggaggaauguuuaaucuaccauguccgugugucaucuugg

SEQ ID NO: 498444 - RNA, 64 nt, Human; identical to SEQ ID NO: 242351

SEQ ID NO: 498445 - RNA, 64 nt, Human; identical to SEQ ID NO: 300314

SEQ ID NO: 498446 - RNA, 64 nt, Human; identical to SEQ ID NO: 300315

SEQ ID NO: 498447 - RNA, 64 nt, Human
gaaaaguuguuuuguugaaauacuguacguacgcuuaaucuaaauuugcauugacuauguuuua

SEQ ID NO: 498448 - RNA, 64 nt, Human
cgggagaaaaauaugggacauuucuugauuguacuuaaucuaauuugauuagauuauagagucc

SEQ ID NO: 498449 - RNA, 64 nt, Human
aacgauuuaauuuauucuaauuagauuaacccuauuaaucuauggauuggguaucaaaaugaau

SEQ ID NO: 498450 - RNA, 64 nt, Human
aaagagagaacugaagcuuuugaugaaggugcuauuaaucuagaaaggcaaacccauuucacug

SEQ ID NO: 498451 - RNA, 64 nt, Human
uuaucagcaaagcuuuguuuacugaaggagcuauuuaaucuauguuacauuaaaaaagaaacgc

SEQ ID NO: 498452 - RNA, 64 nt, Human
guuuuucagauuucauuuuuuguaaaaucagaaauuaaucuaaacauauucagugauaaguuca

SEQ ID NO: 498453 - RNA, 64 nt, Human
uccucuugcauuucacuugaguggagguuuauaguuaaucuauaacuacauauugaauagggcu

SEQ ID NO: 498454 - RNA, 64 nt, Human
caagcucugugguacagccuuuuuuuaaaauaaauuaaucuauauugguugacaaacaagccac

SEQ ID NO: 498455 - RNA, 64 nt, Human
ugccagagaggagaaaacccuuucaagggaaauuuuaaucuaaaaggaaaaaaccaaaauauug

SEQ ID NO: 498456 - RNA, 64 nt, Human
uccagauuuacugaaaaugucagaucauuuuguauuaaucuauuuucaucuuugugugaagcca

SEQ ID NO: 498457 - RNA, 64 nt, Human
acuagugaauaagugaaauaaaggaaacucgucauuaaucuaaagacagaguucaaaggaauug

SEQ ID NO: 498458 - RNA, 64 nt, Human
cauaaaacguuagagcuggaaggaaucuuaacuauuaaucuaguucaaugcccuuauuuuacag

SEQ ID NO: 498459 - RNA, 64 nt, Human
auccugccccgcuccccaucgccugcccgcagcagcgacgaaacguccaucugaggagccuggg

SEQ ID NO: 498460 - RNA, 64 nt, Human
gucuuuaccaauaauauuuagagcuagucuccaagcgacgaaaaaaauguuuuaauauuugcaa

SEQ ID NO: 498461 - RNA, 64 nt, Human
ggugagaaggcguccacaaaagaggggagaaaaggcgacgaaucaggacacagugaacuuggga

SEQ ID NO: 498462 - RNA, 64 nt, Human
cacccaaaccggcaggugcgauuuuguuaacccagcgacgaacuuuccgaaaaauaaagacacc

SEQ ID NO: 498463 - RNA, 64 nt, Human
cacagcacagccaacacgcaccugccucaggacugcgacgaaaccgguggggcugguucuguaa

SEQ ID NO: 498464 - RNA, 64 nt, Human; identical to SEQ ID NO: 242545

SEQ ID NO: 498465 - RNA, 64 nt, Human; identical to SEQ ID NO: 242546

SEQ ID NO: 498466 - RNA, 64 nt, Human; identical to SEQ ID NO: 242547

SEQ ID NO: 498467 - RNA, 64 nt, Human; identical to SEQ ID NO: 242548

SEQ ID NO: 498468 - RNA, 64 nt, Human; identical to SEQ ID NO: 242549

SEQ ID NO: 498469 - RNA, 64 nt, Human; identical to SEQ ID NO: 242550

SEQ ID NO: 498470 - RNA, 64 nt, Human; identical to SEQ ID NO: 242551

SEQ ID NO: 498471 - RNA, 64 nt, Human; identical to SEQ ID NO: 242552

SEQ ID NO: 498472 - RNA, 64 nt, Human; identical to SEQ ID NO: 242553

SEQ ID NO: 498473 - RNA, 64 nt, Human; identical to SEQ ID NO: 242554

SEQ ID NO: 498474 - RNA, 64 nt, Human; identical to SEQ ID NO: 242555

SEQ ID NO: 498475 - RNA, 64 nt, Human; identical to SEQ ID NO: 242556

SEQ ID NO: 498476 - RNA, 64 nt, Human; identical to SEQ ID NO: 242557

SEQ ID NO: 498477 - RNA, 64 nt, Human; identical to SEQ ID NO: 240726

SEQ ID NO: 498478 - RNA, 64 nt, Human; identical to SEQ ID NO: 240123

SEQ ID NO: 498479 - RNA, 64 nt, Human; identical to SEQ ID NO: 242436

SEQ ID NO: 498480 - RNA, 64 nt, Human; identical to SEQ ID NO: 242437

SEQ ID NO: 498481 - RNA, 64 nt, Human; identical to SEQ ID NO: 242438

SEQ ID NO: 498482 - RNA, 64 nt, Human; identical to SEQ ID NO: 242470

SEQ ID NO: 498483 - RNA, 64 nt, Human; identical to SEQ ID NO: 240124

SEQ ID NO: 498484 - RNA, 64 nt, Human; identical to SEQ ID NO: 240125

SEQ ID NO: 498485 - RNA, 64 nt, Human; identical to SEQ ID NO: 242471

SEQ ID NO: 498486 - RNA, 64 nt, Human; identical to SEQ ID NO: 242472

SEQ ID NO: 498487 - RNA, 64 nt, Human; identical to SEQ ID NO: 242276

SEQ ID NO: 498488 - RNA, 64 nt, Human; identical to SEQ ID NO: 240126

SEQ ID NO: 498489 - RNA, 64 nt, Human; identical to SEQ ID NO: 242487

SEQ ID NO: 498490 - RNA, 64 nt, Human; identical to SEQ ID NO: 242488

SEQ ID NO: 498491 - RNA, 64 nt, Human; identical to SEQ ID NO: 242489

SEQ ID NO: 498492 - RNA, 64 nt, Human; identical to SEQ ID NO: 242504

SEQ ID NO: 498493 - RNA, 64 nt, Human; identical to SEQ ID NO: 240127

SEQ ID NO: 498494 - RNA, 64 nt, Human; identical to SEQ ID NO: 242505

SEQ ID NO: 498495 - RNA, 64 nt, Human; identical to SEQ ID NO: 242506

SEQ ID NO: 498496 - RNA, 64 nt, Human; identical to SEQ ID NO: 242385

SEQ ID NO: 498497 - RNA, 64 nt, Human; identical to SEQ ID NO: 240128

SEQ ID NO: 498498 - RNA, 64 nt, Human; identical to SEQ ID NO: 242521

SEQ ID NO: 498499 - RNA, 64 nt, Human; identical to SEQ ID NO: 242522

SEQ ID NO: 498500 - RNA, 64 nt, Human; identical to SEQ ID NO: 242523

SEQ ID NO: 498501 - RNA, 64 nt, Human; identical to SEQ ID NO: 242352

SEQ ID NO: 498502 - RNA, 64 nt, Human; identical to SEQ ID NO: 240129

SEQ ID NO: 498503 - RNA, 64 nt, Human; identical to SEQ ID NO: 242538

SEQ ID NO: 498504 - RNA, 64 nt, Human; identical to SEQ ID NO: 242539

SEQ ID NO: 498505 - RNA, 64 nt, Human; identical to SEQ ID NO: 242540

SEQ ID NO: 498506 - RNA, 64 nt, Human; identical to SEQ ID NO: 242334

SEQ ID NO: 498507 - RNA, 64 nt, Human; identical to SEQ ID NO: 240130

SEQ ID NO: 498508 - RNA, 64 nt, Human; identical to SEQ ID NO: 242182

SEQ ID NO: 498509 - RNA, 64 nt, Human; identical to SEQ ID NO: 242183

SEQ ID NO: 498510 - RNA, 64 nt, Human; identical to SEQ ID NO: 242184

SEQ ID NO: 498511 - RNA, 64 nt, Human; identical to SEQ ID NO: 242335

SEQ ID NO: 498512 - RNA, 64 nt, Human; identical to SEQ ID NO: 240131

SEQ ID NO: 498513 - RNA, 64 nt, Human; identical to SEQ ID NO: 242201

SEQ ID NO: 498514 - RNA, 64 nt, Human; identical to SEQ ID NO: 242202

SEQ ID NO: 498515 - RNA, 64 nt, Human; identical to SEQ ID NO: 242203

SEQ ID NO: 498516 - RNA, 64 nt, Human; identical to SEQ ID NO: 242353

SEQ ID NO: 498517 - RNA, 64 nt, Human; identical to SEQ ID NO: 240132

SEQ ID NO: 498518 - RNA, 64 nt, Human; identical to SEQ ID NO: 242220

SEQ ID NO: 498519 - RNA, 64 nt, Human; identical to SEQ ID NO: 242221

SEQ ID NO: 498520 - RNA, 64 nt, Human; identical to SEQ ID NO: 242222

SEQ ID NO: 498521 - RNA, 64 nt, Human; identical to SEQ ID NO: 242240

SEQ ID NO: 498522 - RNA, 64 nt, Human; identical to SEQ ID NO: 240133

SEQ ID NO: 498523 - RNA, 64 nt, Human; identical to SEQ ID NO: 242241

SEQ ID NO: 498524 - RNA, 64 nt, Human; identical to SEQ ID NO: 242277

SEQ ID NO: 498525 - RNA, 64 nt, Human; identical to SEQ ID NO: 242278

SEQ ID NO: 498526 - RNA, 64 nt, Human; identical to SEQ ID NO: 242144

SEQ ID NO: 498527 - RNA, 64 nt, Human; identical to SEQ ID NO: 240136

SEQ ID NO: 498528 - RNA, 64 nt, Human; identical to SEQ ID NO: 242368

SEQ ID NO: 498529 - RNA, 64 nt, Human; identical to SEQ ID NO: 242369

SEQ ID NO: 498530 - RNA, 64 nt, Human; identical to SEQ ID NO: 242370

SEQ ID NO: 498531 - RNA, 64 nt, Human; identical to SEQ ID NO: 242049

SEQ ID NO: 498532 - RNA, 64 nt, Human; identical to SEQ ID NO: 240137

SEQ ID NO: 498533 - RNA, 64 nt, Human; identical to SEQ ID NO: 242336

SEQ ID NO: 498534 - RNA, 64 nt, Human; identical to SEQ ID NO: 242403

SEQ ID NO: 498535 - RNA, 64 nt, Human; identical to SEQ ID NO: 240138

SEQ ID NO: 498536 - RNA, 64 nt, Human; identical to SEQ ID NO: 242386

SEQ ID NO: 498537 - RNA, 64 nt, Human; identical to SEQ ID NO: 242387

SEQ ID NO: 498538 - RNA, 64 nt, Human; identical to SEQ ID NO: 242306

SEQ ID NO: 498539 - RNA, 64 nt, Human; identical to SEQ ID NO: 240154

SEQ ID NO: 498540 - RNA, 64 nt, Human; identical to SEQ ID NO: 242419

SEQ ID NO: 498541 - RNA, 64 nt, Human; identical to SEQ ID NO: 242420

SEQ ID NO: 498542 - RNA, 64 nt, Human; identical to SEQ ID NO: 242421

SEQ ID NO: 498543 - RNA, 64 nt, Human; identical to SEQ ID NO: 242289

SEQ ID NO: 498544 - RNA, 64 nt, Human; identical to SEQ ID NO: 241969

SEQ ID NO: 498545 - RNA, 64 nt, Human; identical to SEQ ID NO: 241970

SEQ ID NO: 498546 - RNA, 64 nt, Human; identical to SEQ ID NO: 241971

SEQ ID NO: 498547 - RNA, 64 nt, Human; identical to SEQ ID NO: 242290

SEQ ID NO: 498548 - RNA, 64 nt, Human; identical to SEQ ID NO: 240156

SEQ ID NO: 498549 - RNA, 64 nt, Human; identical to SEQ ID NO: 241979

SEQ ID NO: 498550 - RNA, 64 nt, Human; identical to SEQ ID NO: 241980

SEQ ID NO: 498551 - RNA, 64 nt, Human; identical to SEQ ID NO: 241981

SEQ ID NO: 498552 - RNA, 64 nt, Human; identical to SEQ ID NO: 242307

SEQ ID NO: 498553 - RNA, 64 nt, Human; identical to SEQ ID NO: 240172

SEQ ID NO: 498554 - RNA, 64 nt, Human; identical to SEQ ID NO: 242011

SEQ ID NO: 498555 - RNA, 64 nt, Human; identical to SEQ ID NO: 242012

SEQ ID NO: 498556 - RNA, 64 nt, Human; identical to SEQ ID NO: 242013

SEQ ID NO: 498557 - RNA, 64 nt, Human; identical to SEQ ID NO: 242030

SEQ ID NO: 498558 - RNA, 64 nt, Human; identical to SEQ ID NO: 240173

SEQ ID NO: 498559 - RNA, 64 nt, Human; identical to SEQ ID NO: 242031

SEQ ID NO: 498560 - RNA, 64 nt, Human; identical to SEQ ID NO: 242032

SEQ ID NO: 498561 - RNA, 64 nt, Human; identical to SEQ ID NO: 242125

SEQ ID NO: 498562 - RNA, 64 nt, Human; identical to SEQ ID NO: 300316

SEQ ID NO: 498563 - RNA, 64 nt, Human; identical to SEQ ID NO: 300317

SEQ ID NO: 498564 - RNA, 64 nt, Human; identical to SEQ ID NO: 240174

SEQ ID NO: 498565 - RNA, 64 nt, Human; identical to SEQ ID NO: 242050

SEQ ID NO: 498566 - RNA, 64 nt, Human; identical to SEQ ID NO: 242051

SEQ ID NO: 498567 - RNA, 64 nt, Human; identical to SEQ ID NO: 241281

SEQ ID NO: 498568 - RNA, 64 nt, Human; identical to SEQ ID NO: 240190

SEQ ID NO: 498569 - RNA, 64 nt, Human; identical to SEQ ID NO: 242106

SEQ ID NO: 498570 - RNA, 64 nt, Human; identical to SEQ ID NO: 242107

SEQ ID NO: 498571 - RNA, 64 nt, Human; identical to SEQ ID NO: 242108

SEQ ID NO: 498572 - RNA, 64 nt, Human; identical to SEQ ID NO: 242126

SEQ ID NO: 498573 - RNA, 64 nt, Human; identical to SEQ ID NO: 240191

SEQ ID NO: 498574 - RNA, 64 nt, Human; identical to SEQ ID NO: 242127

SEQ ID NO: 498575 - RNA, 64 nt, Human; identical to SEQ ID NO: 241908

SEQ ID NO: 498576 - RNA, 64 nt, Human; identical to SEQ ID NO: 240192

SEQ ID NO: 498577 - RNA, 64 nt, Human; identical to SEQ ID NO: 242145

SEQ ID NO: 498578 - RNA, 64 nt, Human; identical to SEQ ID NO: 242146

SEQ ID NO: 498579 - RNA, 64 nt, Human; identical to SEQ ID NO: 240869

SEQ ID NO: 498580 - RNA, 64 nt, Human; identical to SEQ ID NO: 240208

SEQ ID NO: 498581 - RNA, 64 nt, Human; identical to SEQ ID NO: 300322

SEQ ID NO: 498582 - RNA, 64 nt, Human; identical to SEQ ID NO: 300323

SEQ ID NO: 498583 - RNA, 64 nt, Human; identical to SEQ ID NO: 300324

SEQ ID NO: 498584 - RNA, 64 nt, Human; identical to SEQ ID NO: 242291

SEQ ID NO: 498585 - RNA, 64 nt, Human; identical to SEQ ID NO: 242323

SEQ ID NO: 498586 - RNA, 64 nt, Human; identical to SEQ ID NO: 240209

SEQ ID NO: 498587 - RNA, 64 nt, Human; identical to SEQ ID NO: 242324

SEQ ID NO: 498588 - RNA, 57 nt, Human; identical to SEQ ID NO: 242325

SEQ ID NO: 498589 - RNA, 64 nt, Human; identical to SEQ ID NO: 242087

SEQ ID NO: 498590 - RNA, 64 nt, Human; identical to SEQ ID NO: 240210

SEQ ID NO: 498591 - RNA, 64 nt, Human; identical to SEQ ID NO: 242404

SEQ ID NO: 498592 - RNA, 64 nt, Human; identical to SEQ ID NO: 242068

SEQ ID NO: 498593 - RNA, 64 nt, Human; identical to SEQ ID NO: 240226

SEQ ID NO: 498594 - RNA, 64 nt, Human; identical to SEQ ID NO: 240817

SEQ ID NO: 498595 - RNA, 64 nt, Human; identical to SEQ ID NO: 240818

SEQ ID NO: 498596 - RNA, 64 nt, Human; identical to SEQ ID NO: 242088

SEQ ID NO: 498597 - RNA, 64 nt, Human; identical to SEQ ID NO: 240227

SEQ ID NO: 498598 - RNA, 64 nt, Human; identical to SEQ ID NO: 240834

SEQ ID NO: 498599 - RNA, 64 nt, Human; identical to SEQ ID NO: 240835

SEQ ID NO: 498600 - RNA, 64 nt, Human; identical to SEQ ID NO: 240836

SEQ ID NO: 498601 - RNA, 64 nt, Human; identical to SEQ ID NO: 240780

SEQ ID NO: 498602 - RNA, 64 nt, Human; identical to SEQ ID NO: 240228

SEQ ID NO: 498603 - RNA, 64 nt, Human; identical to SEQ ID NO: 240852

SEQ ID NO: 498604 - RNA, 64 nt, Human; identical to SEQ ID NO: 240870

SEQ ID NO: 498605 - RNA, 64 nt, Human; identical to SEQ ID NO: 240244

SEQ ID NO: 498606 - RNA, 64 nt, Human; identical to SEQ ID NO: 240887

SEQ ID NO: 498607 - RNA, 64 nt, Human; identical to SEQ ID NO: 240888

SEQ ID NO: 498608 - RNA, 64 nt, Human; identical to SEQ ID NO: 240889

SEQ ID NO: 498609 - RNA, 64 nt, Human; identical to SEQ ID NO: 241909

SEQ ID NO: 498610 - RNA, 64 nt, Human; identical to SEQ ID NO: 240245

SEQ ID NO: 498611 - RNA, 64 nt, Human; identical to SEQ ID NO: 240959

SEQ ID NO: 498612 - RNA, 64 nt, Human; identical to SEQ ID NO: 240960

SEQ ID NO: 498613 - RNA, 64 nt, Human; identical to SEQ ID NO: 240961

SEQ ID NO: 498614 - RNA, 64 nt, Human; identical to SEQ ID NO: 242163

SEQ ID NO: 498615 - RNA, 64 nt, Human; identical to SEQ ID NO: 240246

SEQ ID NO: 498616 - RNA, 64 nt, Human; identical to SEQ ID NO: 241029

SEQ ID NO: 498617 - RNA, 64 nt, Human; identical to SEQ ID NO: 241030

SEQ ID NO: 498618 - RNA, 64 nt, Human; identical to SEQ ID NO: 240871

SEQ ID NO: 498619 - RNA, 64 nt, Human; identical to SEQ ID NO: 240262

SEQ ID NO: 498620 - RNA, 64 nt, Human; identical to SEQ ID NO: 241931

SEQ ID NO: 498621 - RNA, 64 nt, Human; identical to SEQ ID NO: 241949

SEQ ID NO: 498622 - RNA, 64 nt, Human; identical to SEQ ID NO: 300325

SEQ ID NO: 498623 - RNA, 64 nt, Human; identical to SEQ ID NO: 300326

SEQ ID NO: 498624 - RNA, 64 nt, Human; identical to SEQ ID NO: 240263

SEQ ID NO: 498625 - RNA, 64 nt, Human; identical to SEQ ID NO: 241950

SEQ ID NO: 498626 - RNA, 51 nt, Human; identical to SEQ ID NO: 241951

SEQ ID NO: 498627 - RNA, 64 nt, Human; identical to SEQ ID NO: 240762

SEQ ID NO: 498628 - RNA, 64 nt, Human; identical to SEQ ID NO: 240264

SEQ ID NO: 498629 - RNA, 64 nt, Human; identical to SEQ ID NO: 241992

SEQ ID NO: 498630 - RNA, 64 nt, Human; identical to SEQ ID NO: 241993

SEQ ID NO: 498631 - RNA, 64 nt, Human; identical to SEQ ID NO: 241994

SEQ ID NO: 498632 - RNA, 64 nt, Human; identical to SEQ ID NO: 240672

SEQ ID NO: 498633 - RNA, 64 nt, Human; identical to SEQ ID NO: 240280

SEQ ID NO: 498634 - RNA, 64 nt, Human; identical to SEQ ID NO: 242089

SEQ ID NO: 498635 - RNA, 50 nt, Human; identical to SEQ ID NO: 240636

SEQ ID NO: 498636 - RNA, 64 nt, Human; identical to SEQ ID NO: 240281

SEQ ID NO: 498637 - RNA, 64 nt, Human; identical to SEQ ID NO: 242164

SEQ ID NO: 498638 - RNA, 64 nt, Human; identical to SEQ ID NO: 242165

SEQ ID NO: 498639 - RNA, 64 nt, Human; identical to SEQ ID NO: 240618

SEQ ID NO: 498640 - RNA, 64 nt, Human; identical to SEQ ID NO: 240282

SEQ ID NO: 498641 - RNA, 64 nt, Human; identical to SEQ ID NO: 240564

SEQ ID NO: 498642 - RNA, 64 nt, Human; identical to SEQ ID NO: 240565

SEQ ID NO: 498643 - RNA, 64 nt, Human; identical to SEQ ID NO: 240566

SEQ ID NO: 498644 - RNA, 64 nt, Human; identical to SEQ ID NO: 240601

SEQ ID NO: 498645 - RNA, 64 nt, Human; identical to SEQ ID NO: 240602

SEQ ID NO: 498646 - RNA, 64 nt, Human; identical to SEQ ID NO: 240654

SEQ ID NO: 498647 - RNA, 64 nt, Human; identical to SEQ ID NO: 240299

SEQ ID NO: 498648 - RNA, 64 nt, Human; identical to SEQ ID NO: 240620

SEQ ID NO: 498649 - RNA, 64 nt, Human; identical to SEQ ID NO: 240727

SEQ ID NO: 498650 - RNA, 64 nt, Human; identical to SEQ ID NO: 240300

SEQ ID NO: 498651 - RNA, 64 nt, Human; identical to SEQ ID NO: 240637

SEQ ID NO: 498652 - RNA, 64 nt, Human; identical to SEQ ID NO: 240638

SEQ ID NO: 498653 - RNA, 64 nt, Human; identical to SEQ ID NO: 240798

SEQ ID NO: 498654 - RNA, 64 nt, Human; identical to SEQ ID NO: 240316

SEQ ID NO: 498655 - RNA, 64 nt, Human; identical to SEQ ID NO: 240673

SEQ ID NO: 498656 - RNA, 64 nt, Human; identical to SEQ ID NO: 240674

SEQ ID NO: 498657 - RNA, 64 nt, Human; identical to SEQ ID NO: 240529

SEQ ID NO: 498658 - RNA, 64 nt, Human; identical to SEQ ID NO: 240317

SEQ ID NO: 498659 - RNA, 64 nt, Human; identical to SEQ ID NO: 240710

SEQ ID NO: 498660 - RNA, 64 nt, Human; identical to SEQ ID NO: 240763

SEQ ID NO: 498661 - RNA, 64 nt, Human; identical to SEQ ID NO: 240318

SEQ ID NO: 498662 - RNA, 64 nt, Human; identical to SEQ ID NO: 240728

SEQ ID NO: 498663 - RNA, 64 nt, Human; identical to SEQ ID NO: 300381

SEQ ID NO: 498664 - RNA, 64 nt, Human; identical to SEQ ID NO: 240493

SEQ ID NO: 498665 - RNA, 52 nt, Human; identical to SEQ ID NO: 240334

SEQ ID NO: 498666 - RNA, 64 nt, Human; identical to SEQ ID NO: 240764

SEQ ID NO: 498667 - RNA, 64 nt, Human; identical to SEQ ID NO: 241889

SEQ ID NO: 498668 - RNA, 64 nt, Human; identical to SEQ ID NO: 240335

SEQ ID NO: 498669 - RNA, 64 nt, Human; identical to SEQ ID NO: 240781

SEQ ID NO: 498670 - RNA, 64 nt, Human; identical to SEQ ID NO: 240782

SEQ ID NO: 498671 - RNA, 64 nt, Human; identical to SEQ ID NO: 240582

SEQ ID NO: 498672 - RNA, 64 nt, Human; identical to SEQ ID NO: 240336

SEQ ID NO: 498673 - RNA, 64 nt, Human; identical to SEQ ID NO: 240799

SEQ ID NO: 498674 - RNA, 57 nt, Human; identical to SEQ ID NO: 240800

SEQ ID NO: 498675 - RNA, 64 nt, Human; identical to SEQ ID NO: 240494

SEQ ID NO: 498676 - RNA, 64 nt, Human; identical to SEQ ID NO: 240352

SEQ ID NO: 498677 - RNA, 64 nt, Human; identical to SEQ ID NO: 241910

SEQ ID NO: 498678 - RNA, 64 nt, Human; identical to SEQ ID NO: 241911

SEQ ID NO: 498679 - RNA, 64 nt, Human; identical to SEQ ID NO: 240457

SEQ ID NO: 498680 - RNA, 64 nt, Human; identical to SEQ ID NO: 240353

SEQ ID NO: 498681 - RNA, 64 nt, Human; identical to SEQ ID NO: 242069

SEQ ID NO: 498682 - RNA, 64 nt, Human; identical to SEQ ID NO: 242070

SEQ ID NO: 498683 - RNA, 64 nt, Human; identical to SEQ ID NO: 240439

SEQ ID NO: 498684 - RNA, 64 nt, Human; identical to SEQ ID NO: 240441

SEQ ID NO: 498685 - RNA, 64 nt, Human; identical to SEQ ID NO: 241890

SEQ ID NO: 498686 - RNA, 64 nt, Human; identical to SEQ ID NO: 241891

SEQ ID NO: 498687 - RNA, 64 nt, Human; identical to SEQ ID NO: 240367

SEQ ID NO: 498688 - RNA, 64 nt, Human; identical to SEQ ID NO: 240368

SEQ ID NO: 498689 - RNA, 64 nt, Human; identical to SEQ ID NO: 240369

SEQ ID NO: 498690 - RNA, 64 nt, Human; identical to SEQ ID NO: 240385

SEQ ID NO: 498691 - RNA, 64 nt, Human; identical to SEQ ID NO: 240386

SEQ ID NO: 498692 - RNA, 64 nt, Human; identical to SEQ ID NO: 240387

SEQ ID NO: 498693 - RNA, 64 nt, Human; identical to SEQ ID NO: 300272

SEQ ID NO: 498694 - RNA, 64 nt, Human; identical to SEQ ID NO: 300273

SEQ ID NO: 498695 - RNA, 64 nt, Human; identical to SEQ ID NO: 300274

SEQ ID NO: 498696 - RNA, 64 nt, Human; identical to SEQ ID NO: 300275

SEQ ID NO: 498697 - RNA, 64 nt, Human; identical to SEQ ID NO: 300250

SEQ ID NO: 498698 - RNA, 64 nt, Human; identical to SEQ ID NO: 300251

SEQ ID NO: 498699 - RNA, 64 nt, Human; identical to SEQ ID NO: 300252

SEQ ID NO: 498700 - RNA, 64 nt, Human; identical to SEQ ID NO: 300253

SEQ ID NO: 498701 - RNA, 64 nt, Human; identical to SEQ ID NO: 300254

SEQ ID NO: 498702 - RNA, 64 nt, Human; identical to SEQ ID NO: 300255

SEQ ID NO: 498703 - RNA, 64 nt, Human; identical to SEQ ID NO: 300256

SEQ ID NO: 498704 - RNA, 64 nt, Human; identical to SEQ ID NO: 300257

SEQ ID NO: 498705 - RNA, 64 nt, Human; identical to SEQ ID NO: 300258

SEQ ID NO: 498706 - RNA, 64 nt, Human; identical to SEQ ID NO: 300259

SEQ ID NO: 498707 - RNA, 64 nt, Human; identical to SEQ ID NO: 300260

SEQ ID NO: 498708 - RNA, 64 nt, Human; identical to SEQ ID NO: 300261

SEQ ID NO: 498709 - RNA, 64 nt, Human; identical to SEQ ID NO: 300265

SEQ ID NO: 498710 - RNA, 64 nt, Human; identical to SEQ ID NO: 300266

SEQ ID NO: 498711 - RNA, 64 nt, Human; identical to SEQ ID NO: 300267

SEQ ID NO: 498712 - RNA, 64 nt, Human; identical to SEQ ID NO: 300268

SEQ ID NO: 498713 - RNA, 64 nt, Human; identical to SEQ ID NO: 300269

SEQ ID NO: 498714 - RNA, 64 nt, Human; identical to SEQ ID NO: 300555

SEQ ID NO: 498715 - RNA, 64 nt, Human; identical to SEQ ID NO: 300556

SEQ ID NO: 498716 - RNA, 64 nt, Human; identical to SEQ ID NO: 300557

SEQ ID NO: 498717 - RNA, 64 nt, Human; identical to SEQ ID NO: 300558

SEQ ID NO: 498718 - RNA, 64 nt, Human; identical to SEQ ID NO: 300559

SEQ ID NO: 498719 - RNA, 64 nt, Human; identical to SEQ ID NO: 300560

SEQ ID NO: 498720 - RNA, 64 nt, Human; identical to SEQ ID NO: 300561

SEQ ID NO: 498721 - RNA, 64 nt, Human; identical to SEQ ID NO: 300562

SEQ ID NO: 498722 - RNA, 64 nt, Human; identical to SEQ ID NO: 300563

SEQ ID NO: 498723 - RNA, 64 nt, Human; identical to SEQ ID NO: 300564

SEQ ID NO: 498724 - RNA, 64 nt, Human; identical to SEQ ID NO: 300565

SEQ ID NO: 498725 - RNA, 64 nt, Human; identical to SEQ ID NO: 300569

SEQ ID NO: 498726 - RNA, 64 nt, Human; identical to SEQ ID NO: 300570

SEQ ID NO: 498727 - RNA, 64 nt, Human; identical to SEQ ID NO: 300571

SEQ ID NO: 498728 - RNA, 64 nt, Human; identical to SEQ ID NO: 300572

SEQ ID NO: 498729 - RNA, 64 nt, Human; identical to SEQ ID NO: 300573

SEQ ID NO: 498730 - RNA, 64 nt, Human; identical to SEQ ID NO: 300574

SEQ ID NO: 498731 - RNA, 64 nt, Human; identical to SEQ ID NO: 300575

SEQ ID NO: 498732 - RNA, 64 nt, Human; identical to SEQ ID NO: 300576

SEQ ID NO: 498733 - RNA, 64 nt, Human; identical to SEQ ID NO: 300577

SEQ ID NO: 498734 - RNA, 64 nt, Human; identical to SEQ ID NO: 300578

SEQ ID NO: 498735 - RNA, 64 nt, Human; identical to SEQ ID NO: 300579

SEQ ID NO: 498736 - RNA, 64 nt, Human; identical to SEQ ID NO: 300580

SEQ ID NO: 498737 - RNA, 64 nt, Human; identical to SEQ ID NO: 300581

SEQ ID NO: 498738 - RNA, 64 nt, Human; identical to SEQ ID NO: 300582

SEQ ID NO: 498739 - RNA, 64 nt, Human; identical to SEQ ID NO: 300583

SEQ ID NO: 498740 - RNA, 64 nt, Human; identical to SEQ ID NO: 300584

SEQ ID NO: 498741 - RNA, 64 nt, Human; identical to SEQ ID NO: 300588

SEQ ID NO: 498742 - RNA, 64 nt, Human; identical to SEQ ID NO: 300589

SEQ ID NO: 498743 - RNA, 64 nt, Human; identical to SEQ ID NO: 300590

SEQ ID NO: 498744 - RNA, 64 nt, Human; identical to SEQ ID NO: 300591

SEQ ID NO: 498745 - RNA, 64 nt, Human; identical to SEQ ID NO: 300592

SEQ ID NO: 498746 - RNA, 64 nt, Human; identical to SEQ ID NO: 300593

SEQ ID NO: 498747 - RNA, 64 nt, Human; identical to SEQ ID NO: 300594

SEQ ID NO: 498748 - RNA, 64 nt, Human; identical to SEQ ID NO: 300595

SEQ ID NO: 498749 - RNA, 64 nt, Human; identical to SEQ ID NO: 300596

SEQ ID NO: 498750 - RNA, 64 nt, Human; identical to SEQ ID NO: 300597

SEQ ID NO: 498751 - RNA, 64 nt, Human; identical to SEQ ID NO: 300598

SEQ ID NO: 498752 - RNA, 64 nt, Human; identical to SEQ ID NO: 300599

SEQ ID NO: 498753 - RNA, 64 nt, Human; identical to SEQ ID NO: 300600

SEQ ID NO: 498754 - RNA, 60 nt, Human
uaacauaggcaagaggaguucuaacacauuucguacaaaaaaauaaucaagugcauuucu

SEQ ID NO: 498755 - RNA, 60 nt, Human
gaaguggaauguggcuuuccuaggaaugggucguacaaagcuaagugguaaugaugcuau

SEQ ID NO: 498756 - RNA, 60 nt, Human
aaguuuuaguugccuacccuagcucuuuucucguacaauuuugccaauaccaaguuucaa

SEQ ID NO: 498757 - RNA, 60 nt, Human
cuauguacaaccuacccuguguauaacauuucguacaauauuauuguuuuacuuuucagc

SEQ ID NO: 498758 - RNA, 60 nt, Human
uaaaugacccucccaagcaccaugucagugucguacaaucuaccaaccaaccagugcuga

SEQ ID NO: 498759 - RNA, 60 nt, Human
ugaggccaccugggaugagaauauagauagucguacaacaacccaggggauccagauaca

SEQ ID NO: 498760 - RNA, 60 nt, Human
gcaguguauuugcuucucaugaacuauuucucguacaaaucauuaaauaguucauuggau

SEQ ID NO: 498761 - RNA, 60 nt, Human
auuacaguaauuuuauuauaggacuuugccucguacaauuaauagugauauuuuggacaa

SEQ ID NO: 498762 - RNA, 60 nt, Human
gaugcuauaugugaaaacauucuguaagcuucguacaaaugugaaguauuaauauuaucg

SEQ ID NO: 498763 - RNA, 60 nt, Human
guuauggcuaacuaaaaaaaagaaaauguaucguacaaguuaaaaugcacgggcccaagg

SEQ ID NO: 498764 - RNA, 60 nt, Human
acuguuacaaauccuucuuguuuuggcaucucguacaacauuauuaagacacagcugaga

SEQ ID NO: 498765 - RNA, 60 nt, Human
cuacucuagaaagcauggaaauuaaguguuucguacaaaaauuuuaaaaaguuaccaaag

SEQ ID NO: 498766 - RNA, 60 nt, Human
uuuuuuagcaguacuuuagcuugaaaguacucguacaaauacuguuagauuuaguugcaa

SEQ ID NO: 498767 - RNA, 60 nt, Human
uucccauuucuuuugcgugcagucuuugauucguacaauagaaggaacacguagaaugua

SEQ ID NO: 498768 - RNA, 64 nt, Human
cccaucaaagcaaaauauggccucaccaccagccccaaaucagugcucagacccucucuguguc

SEQ ID NO: 498769 - RNA, 64 nt, Human
ccagacuccaugacucaucugaucccuuuuauggccaaaucauccuucagaguagggaacacuc

SEQ ID NO: 498770 - RNA, 64 nt, Human
augagguucccuaccuuuuucuucucuucauugaccaaaucaaccaaucacuacagcugcucug

SEQ ID NO: 498771 - RNA, 64 nt, Human
uaagacugaauguguaauaggagcacugccuuugccaaaucaaaugagugacagguuaacuaga

SEQ ID NO: 498772 - RNA, 64 nt, Human
guccuugaaauuugcaguucuguaugcuucuauuccaaaucauucauuaccaauaaaaacgaaa

SEQ ID NO: 498773 - RNA, 64 nt, Human
uuucuguucagacuuguugcaacagcagucauacccaaaucauuugcacuuuaaaacuggaaga

SEQ ID NO: 498774 - RNA, 64 nt, Human
ugcauuucaugcuaucagaaacaguauuuucuucccaaaucaaaauaaaagaaauaugaucaga

SEQ ID NO: 498775 - RNA, 64 nt, Human
gaugcagaccaugggcaaccaaccauugcacuggccaaaucauuauuuauggagaaauccucuu

SEQ ID NO: 498776 - RNA, 64 nt, Human
guucaauguuuguaggguuuuaagucauucauuuccaaaucauuuuuuuuuuucuuuuggggaa

SEQ ID NO: 498777 - RNA, 64 nt, Human
aaugcuaugccuuuuuugcaccuuuguacagcagccaaaucaugaacucaaaauguauuugauc

SEQ ID NO: 498778 - RNA, 64 nt, Human
ugggauuccuacuuaggugucugcccucagggguccaaaucacuucaggacaccccaagagaug

SEQ ID NO: 498779 - RNA, 64 nt, Human
uccccauuucccaucugcaccccuucucuccuccccaaaucaauacacuaguuguuucuacccc

SEQ ID NO: 498780 - RNA, 64 nt, Human
cugcauuuggguuauuauuauuuuuguaacaaucccaaaucaaaucugucuccaggcuggagag

SEQ ID NO: 498781 - RNA, 64 nt, Human
gagagcccagggggaggacagcuugucugcugcuccaaaucacuuagaucugauuccuguuuug

SEQ ID NO: 498782 - RNA, 64 nt, Human
gaccuguguucagccacacccagugguagcuccaccaaaucaugaacagccuaauuuugagugu

SEQ ID NO: 498783 - RNA, 64 nt, Human
auguuggugaaggcagccacucucuugcuuguccccaaaucaccuaacccucauccagggcuau

SEQ ID NO: 498784 - RNA, 64 nt, Human
uacuucagagcuuugcuaaacuaaccuaauuuguccaaaucaccccaaaaccaccaucucugac

SEQ ID NO: 498785 - RNA, 64 nt, Human
ccugcagucuggguucccagacugaguccucuccccaaaucagggcucuagacccgagcccucc

SEQ ID NO: 498786 - RNA, 64 nt, Human
agugacucaccugcaguugggagccagcuacaacccaaaucauuuuaaaauuuucaauucuuug

SEQ ID NO: 498787 - RNA, 64 nt, Human
caucugcuuuuucguucugcgauaugcccaguucccaaaucaauuauagguaccuguuuaggag

SEQ ID NO: 498788 - RNA, 64 nt, Human
gcauauaauuuuuaauaucuuuacuucuaucaucccaaaucaaagaacucuucucuauuauguu

SEQ ID NO: 498789 - RNA, 64 nt, Human
cuggauugucaacaacugaaaguacauauuucauccaaaucaagcuaaaauuuauuuaaguuga

SEQ ID NO: 498790 - RNA, 64 nt, Human
aauguuuugacagggccucuuuuguauaggacugccaaaucauggguuuugccuuuuguuguug

SEQ ID NO: 498791 - RNA, 64 nt, Human
aaaaauauaauguugauaauauauauuaagugugccaaaucaguuugacuacucucuguuuuag

SEQ ID NO: 498792 - RNA, 64 nt, Human
agaaaaaugaagccaagacaggguaaauaacaugccaaaucacaaacuaguaagagacauaguu

SEQ ID NO: 498793 - RNA, 64 nt, Human
auuuagagaaugcuuaagggauuccaaucccgauccaaaucauaauuuguucuuaaguauacug

SEQ ID NO: 498794 - RNA, 64 nt, Human
acacagcaaaaaauuguuuacuuuguuggacaaaccaaaucaguucucaaaaaaugaccggugc

SEQ ID NO: 498795 - RNA, 64 nt, Human
caccucccaccugcauugcucucccucgugcuccccaaaucaccacaaccaaccaauaccgcga

SEQ ID NO: 498796 - RNA, 64 nt, Human
agccugaccccgccucaccaauacacggacacaaccaaaucauaacauauagcagaccaaucua

SEQ ID NO: 498797 - RNA, 64 nt, Human
auauuccagugucagcuuucuuuagcuggaauugccaaaucauuuguugcuccugcugcucuca

SEQ ID NO: 498798 - RNA, 64 nt, Human
auugcugaaugguucuuuaguuauuaaccuagacccaaaucaaagaccaguuggauuuaugaua

SEQ ID NO: 498799 - RNA, 64 nt, Human
guguuucugcccauuggagcacccgcacacuacuccaaaucaaaaccacuaagaguuccucccg

SEQ ID NO: 498800 - RNA, 64 nt, Human
gugcuuaugcucuuaauugccaccucuaacagcaccaaaucaaaaucucuccacuuucagcugu

SEQ ID NO: 498801 - RNA, 64 nt, Human
uuugaaaaaguguacaugaagaauguagcccucuccaaaucaaggaucuuuuggaccuggcuaa

SEQ ID NO: 498802 - RNA, 64 nt, Human
uauagcuuagcauuagugacuuauuucaaaagacccaaaucaaaaaguuaguuugaaagcauuu

SEQ ID NO: 498803 - RNA, 64 nt, Human
aucaagggagcaagaggaagccaagaaaacuuggccaaaucaaaguacuugauggggaagauga

SEQ ID NO: 498804 - RNA, 55 nt, Human
acucauacugggaauucuagggcugccaaaucauuuuauguccuauauacuugac

SEQ ID NO: 498805 - RNA, 64 nt, Human
ucucccuuuuacuggaaaacaggaauauugacuaccaaaucacaaugcaauugaagccguacug

SEQ ID NO: 498806 - RNA, 64 nt, Human
ucucauuuguucuauaccagaaugggaaauuuccccaaaucagaaaaucacauccuaacaaaga

SEQ ID NO: 498807 - RNA, 64 nt, Human
cacaccucccucacagucuuauagcacaauauacccaaaucagcccccccaguccgagggcugg

SEQ ID NO: 498808 - RNA, 64 nt, Human
ugucuaccauuguacuuauaacuguuauuaaauaccaaaucaaauaauauaaaagcuguaacau

SEQ ID NO: 498809 - RNA, 64 nt, Human
acuuuugauaauauaaugccuuucaaauuaguuaccaaaucauaaacagaguggaauaaauaua

SEQ ID NO: 498810 - RNA, 64 nt, Human
cuaucuuugccacccucaugcugugugacucaaaccaaaucacugaacuuugcugagccuguaa

SEQ ID NO: 498811 - RNA, 64 nt, Human
auuaaaugucuuaucaaguucugucaauacuugcccaaaucaauggguuugcaaaauuuguuaa

SEQ ID NO: 498812 - RNA, 64 nt, Human
guuguugggaauauauaauuuacuggaccucagcccaaaucaagaugcuuaaaauuguacuugu

SEQ ID NO: 498813 - RNA, 64 nt, Human
aagagaugccagaacuacuuccauaacuaacucaccaaaucaaaucaucaguccucauauucuu

SEQ ID NO: 498814 - RNA, 64 nt, Human
aaaaaaucuagcuaugucagaugcagcagaguuuccaaaucagauuccucaaaccaccuuugaa

SEQ ID NO: 498815 - RNA, 64 nt, Human
gaucucuagagcagugggaaacuaccccgcugcaccaaaucaaguagcuucaccuuguguaugc

SEQ ID NO: 498816 - RNA, 64 nt, Human
cucuuggccucuccugaggccucauaaugggagaccaaaucaaaaaugucccaugucacuugag

SEQ ID NO: 498817 - RNA, 64 nt, Human
ggguggucauuuuuuucaaguucucucaagugucccaaaucaggguagcaaucuuguugccaca

SEQ ID NO: 498818 - RNA, 64 nt, Human
auuuugucaggugcaauaaaaacaaaauuaaaacccaaaucaucaagaaaaccuguauuccugg

SEQ ID NO: 498819 - RNA, 64 nt, Human
aggaguccaaguagaucucgaaguaaaucugaaaccaaaucaagacacagaacaaggucugucu

SEQ ID NO: 498820 - RNA, 64 nt, Human
cuuccacacacaaaaaauaccucacagagcuucaccaaaucacagauucaggaggaauuuggcu

SEQ ID NO: 498821 - RNA, 64 nt, Human
cuaaaacuuagugcuuccagguaguuauaguacuccaaaucaaggaccaacuuaaacguuaauu

SEQ ID NO: 498822 - RNA, 64 nt, Human
gauuagaucuuuuaagcccaucaauuauagaaagccaaaucaaaauauguugaugaaaaauagc

SEQ ID NO: 498823 - RNA, 64 nt, Human
uaauuuuaaugucugcuuagcaccccacugauaaccaaaucacaguuuauuuaaauaauuuuaa

SEQ ID NO: 498824 - RNA, 64 nt, Human
guauguacuuggaaauacagaauaacuuuaucacccaaaucacuggcauugacauuauugguaa

SEQ ID NO: 498825 - RNA, 64 nt, Human
guuaaaaaagacacuuuuuauuaugaaucagauuccaaaucauuaacuauuuuugcaaaacugg

SEQ ID NO: 498826 - RNA, 64 nt, Human
uccuggacucaagcaauccucccaccuuggccuuccaaaucacugggauuauaggcaugagcca

SEQ ID NO: 498827 - RNA, 64 nt, Human
caugucccuucuaugaucccuuaagaaagcugcaccaaaucaucugccuguuuuuucuugauac

SEQ ID NO: 498828 - RNA, 64 nt, Human
agucccaaagcgggacgccgcagguguuuggcacccaaaucacaucucaccuccgaacuguuca

SEQ ID NO: 498829 - RNA, 64 nt, Human
caacacuucuccaucccccaacuggugucuuaccccaaaucagaccaucugagcccacuacuau

SEQ ID NO: 498830 - RNA, 64 nt, Human
ggucacccagcaguccuccagcaagguagaaacaccaaaucaaugaguuuaugcuagaauuuuu

SEQ ID NO: 498831 - RNA, 64 nt, Human
ugaguucaguauacacaagugucugcuacagucgccaaaucaccaguauuugcuuauauagcaa

SEQ ID NO: 498832 - RNA, 64 nt, Human
ugaaggaauauuucuccuggcucuacuaucaauaccaaaucauuagcugcugugcuguuuuaga

SEQ ID NO: 498833 - RNA, 64 nt, Human
uugaguuacucaguuaccuaagcuugcuauucauccaaaucauuuucuagagucacuguauaag

SEQ ID NO: 498834 - RNA, 64 nt, Human
uguguuaauacuaccuccuuguacaucacuauacccaaaucaguuauucaaauuguuaggaauu

SEQ ID NO: 498835 - RNA, 64 nt, Human
agcuacuucaaauugucuguuaaauuuauuaugcccaaaucaaccucugaaaaaagguuuuucc

SEQ ID NO: 498836 - RNA, 64 nt, Human
aguugcugcuauugcacugccagugcagcccacaccaaaucacaacccaagauacucagauagg

SEQ ID NO: 498837 - RNA, 64 nt, Human
aaaucacaaguggccgaaaaaaaaaauuaugcucccaaaucauucuacugaugugcuugacuga

SEQ ID NO: 498838 - RNA, 64 nt, Human
ugcaguuacacuaaaaggugaccaaugauggucaccaaaucagcugcuacuacuccuguaggaa

SEQ ID NO: 498839 - RNA, 64 nt, Human
uuuaagugauaugaaauacuugucaugucuuuggccaaaucagaagauauucauccugcuucaa

SEQ ID NO: 498840 - RNA, 64 nt, Human
uggcacugaugcaauguauggcuuuucucuugccccaaaucacaaacauauguaucuuugggga

SEQ ID NO: 498841 - RNA, 64 nt, Human
aauuaacacuaguaacagugaaagcacaagauuuccaaaucagucguuuucucaaaaaaauauc

SEQ ID NO: 498842 - RNA, 64 nt, Human
auuucucuaggguauauaacugggaguaaaauugccaaaucauaugguaagaauauguuuaauu

SEQ ID NO: 498843 - RNA, 64 nt, Human
auuuguaauuaauuugccucccuaaagagcaauaccaaaucacauuuuuuucaugccccuaucu

SEQ ID NO: 498844 - RNA, 64 nt, Human
accccguuuaguuacagcugaacuccuccaucuuccaaaucaaucaggcccauccaucccaugc

SEQ ID NO: 498845 - RNA, 64 nt, Human
uugcuuauuccacauuaauuuacuuuucucuauaccaaaucacccauggaauaguuauugaaca

SEQ ID NO: 498846 - RNA, 64 nt, Human
acaaacuuugaaaacaagugugacacugaccagcccaaaucauaaucauguuuucuugcuguga

SEQ ID NO: 498847 - RNA, 64 nt, Human
uuuaauauuuguuuuugcuuguaaucucacugagccaaaucagagaucuuaaacauucagucag

SEQ ID NO: 498848 - RNA, 64 nt, Human
auuuuucuuauucauaaaucugacaggcauaaacccaaaucaaagauaauuuggugcccauuau

SEQ ID NO: 498849 - RNA, 64 nt, Human
ugcuaccgcuuaaacgacucagcaucucgacuucccaaaucaaaggcccuuuucagggccgccc

SEQ ID NO: 498850 - RNA, 64 nt, Human
aucuaaguguaaaaguggcucauaucuucuccagccaaaucagcuaggccauggccuugccuug

SEQ ID NO: 498851 - RNA, 64 nt, Human
aacaugacuguuuguuuuccuuuaaaaauaugcaccaaaucaucucucaucacuuuucucugag

SEQ ID NO: 498852 - RNA, 64 nt, Human
ucuucugaauugacuguauuucagugagcugcccccaaaucaaguuuagugcccucauccauuu

SEQ ID NO: 498853 - RNA, 64 nt, Human
aaugugcuugucauuuguaucaauugaccuuuccccaaaucaugcaguauugaguuaugacuug

SEQ ID NO: 498854 - RNA, 64 nt, Human
guggcuauaaugagaauugcaugauugcuuuaaaccaaaucaggugguggauuuuuuuuuucuu

SEQ ID NO: 498855 - RNA, 64 nt, Human
agggcguuuucuguccuguggugugcauucucuaccaaaucaagcaggagaucuuuugcacgac

SEQ ID NO: 498856 - RNA, 64 nt, Human
ccacuccaggaagagucauuacuacauaugcuagccaaaucaauccaugcagaugauauauuaa

SEQ ID NO: 498857 - RNA, 64 nt, Human
gccugacugaauuaagcuugcuuguuuuaaacaaccaaaucauuggaacagaaaaggauuuaaa

SEQ ID NO: 498858 - RNA, 64 nt, Human
ugggaagcauaguuuauuugcaaguguucaccuuccaaaucaugaggcauagcaugacuuauuc

SEQ ID NO: 498859 - RNA, 64 nt, Human
cucccgcaaaggcggcagaacuacaucggggccaccaaaucaccacucuucagccccaucccac

SEQ ID NO: 498860 - RNA, 64 nt, Human
cagaaacuccccugagaccuuacuccuuccagccccaaaucauuuacuuuucugugguccagcc

SEQ ID NO: 498861 - RNA, 64 nt, Human
gccuucuuccuugcucugcgcugggaucauacucccaaaucacauuacuaaaugccaacaauua

SEQ ID NO: 498862 - RNA, 64 nt, Human
uuuagcuuuugcugugugugugugugugugccuuccaaaucaugccauaauuguaauguugaau

SEQ ID NO: 498863 - RNA, 64 nt, Human
guacauauuccacuugacugggaagcuguguggcccaaaucacuguuugaguggaggaauguuu

SEQ ID NO: 498864 - RNA, 64 nt, Human
cuuucacccuagccugacuggaagcagaaaaugaccaaaucaguauuuuuuuuaaugaaauauu

SEQ ID NO: 498865 - RNA, 64 nt, Human
uugauuuugguauuccaugauuuuuauuuucaaaccaaaucaggauugacaaaagcugugcaug

SEQ ID NO: 498866 - RNA, 64 nt, Human
caauuacggcuuugacagugccaccucuuugaugccaaaucagcaaccauuguuguuaugaucu

SEQ ID NO: 498867 - RNA, 64 nt, Human
aggcuuuaaaaaaaaaaaaacuuucaaagauccgccaaaucauucauagcaaauuguacauauu

SEQ ID NO: 498868 - RNA, 64 nt, Human
guguguugcagauuuauuuggccauuuagaauaaccaaaucaaucuggcuaacuaggaauuuau

SEQ ID NO: 498869 - RNA, 64 nt, Human
auaaaugaugauugaacuggaauaauauuggggaccaaaucaaaugaaugauuaaauuaugaag

SEQ ID NO: 498870 - RNA, 64 nt, Human
uuuaaaucugaacaucacuccaauuauuaaugaaccaaaucauacgauaaguuacuguuugcau

SEQ ID NO: 498871 - RNA, 64 nt, Human
aggaaaacuuagaaacaggcagaguuggaagcagccaaaucacaguggguguugugugugugug

SEQ ID NO: 498872 - RNA, 64 nt, Human
uagaguguuauacuugguaauauagaggagaugaccaaaucagugcuggggaaguagauuuggc

SEQ ID NO: 498873 - RNA, 64 nt, Human
uagaguguuauacuugggaauauaaaggaggugaccaaaucagugugaggagguagauuuggcu

SEQ ID NO: 498874 - RNA, 64 nt, Human
aauuugccuacucacuaaaauauguuuguaacccccaaaucaauacuguggcacuuucucaguu

SEQ ID NO: 498875 - RNA, 64 nt, Human
uacaaaauaaaaaccugcuucagugucuuaaugaccaaaucacauuaucuauuuuagcacucau

SEQ ID NO: 498876 - RNA, 64 nt, Human
uucuuuuuuuaauuuaagguuuaaaauuccuuuuccaaaucauguugauuuugcucuuugcuuu

SEQ ID NO: 498877 - RNA, 64 nt, Human
uuuuguuuaaaaggaaauguugauguuuucaacuccaaaucaauucuaaaaacuucaagcacuu

SEQ ID NO: 498878 - RNA, 64 nt, Human
uuugagaaauucaaacauuucugcagaacagauaccaaaucaauagcuaggaaucauguucaau

SEQ ID NO: 498879 - RNA, 64 nt, Human
ucaacuuggagagaggugacagacggcagaucuuccaaaucaaauuccuuuccaguucuucccc

SEQ ID NO: 498880 - RNA, 64 nt, Human
ucuuccuaaaaaaaugcaaagauuuacauugcugccaaaucauuucaacugaaaagaacaguau

SEQ ID NO: 498881 - RNA, 64 nt, Human
aaacaaaggugagcuugcccaggacuuggcauuuccaaaucaaaguuuuuagauaugaacaccu

SEQ ID NO: 498882 - RNA, 64 nt, Human
gcggaccuaggagacaucuacagaacgcuccaccccaaaucaacagaauauacauucuucucag

SEQ ID NO: 498883 - RNA, 64 nt, Human
aaaaauuggccuucuaaaaaacauauaucagauuccaaaucaagguuaaacauaugauagaaca

SEQ ID NO: 498884 - RNA, 64 nt, Human
acauuggguagcauuaacuguaaguuuugugcuuccaaaucacuuuuugguuuuuaagaauuuc

SEQ ID NO: 498885 - RNA, 64 nt, Human
cacaggguggaaccgccuuugucaagagcacauuccaaaucaaacuugcaaaugagacucccgc

SEQ ID NO: 498886 - RNA, 64 nt, Human
uuuacauuuaaagcuguucauccauggugccuccccaaaucauaagaccaaagaccaccaaacg

SEQ ID NO: 498887 - RNA, 64 nt, Human
ucaagcuuaaauugaaguuuaaauucaucuauaaccaaaucaaaugaucagaggaaauucugua

SEQ ID NO: 498888 - RNA, 64 nt, Human
uuccauggcauauuuacucuuacuuuacuucgugccaaaucaaaugaaacaagccgucuuacaa

SEQ ID NO: 498889 - RNA, 64 nt, Human
uaguuuuaaauguauguauuauaaauaucuguaaccaaaucauuugaaggcuugauaaauuuuu

SEQ ID NO: 498890 - RNA, 64 nt, Human
cucucuaaacagcaaagccaaagcacucugcacaccaaaucaccuguucagagguuuaugcaug

SEQ ID NO: 498891 - RNA, 64 nt, Human
augguuaggaacauugaaaaauggcugcaaauagccaaaucaaacuuaagaaccagaucucugc

SEQ ID NO: 498892 - RNA, 64 nt, Human
ccaaacuugggccgcugcaccgcggcgccuccgcccaaaucaauaaacugugucugucccagga

SEQ ID NO: 498893 - RNA, 64 nt, Human
gauuacauguauagcaguaguuuuggugaauucaccaaaucagcuuccacuuagcauuaggagg

SEQ ID NO: 498894 - RNA, 64 nt, Human
auugagagccacccucauacccuguaauuuugucccaaaucaaauaucaaccuaccaacaacug

SEQ ID NO: 498895 - RNA, 64 nt, Human
auaccuuauuaucugcagggacucaaagcuguacccaaaucaagaaagacaaaauaacaauaga

SEQ ID NO: 498896 - RNA, 64 nt, Human
accagauagggcuuugcuacaaggcacaaaugauccaaaucaaggaggcuacaaaagggcagcc

SEQ ID NO: 498897 - RNA, 64 nt, Human
cuacugccaucauacuaaucaugcaaaaagauugccaaaucauguuugguaggaggacuuuuga

SEQ ID NO: 498898 - RNA, 64 nt, Human
uuccaccaaauaaauauuacguaaaaaauucauaccaaaucaaugagaauacuggcaaggaaua

SEQ ID NO: 498899 - RNA, 64 nt, Human
aguuauuucugaaaauuaaagaccauuauugcuaccaaaucaaugugacuauuucauaugcauu

SEQ ID NO: 498900 - RNA, 64 nt, Human
cucuuucagaaaauaaaagcagggauaacacuucccaaaucauuuugugaggccaggauuaccc

SEQ ID NO: 498901 - RNA, 64 nt, Human
ugcagccacagcucauguguaccaaaguagaaaaccaaaucacagagaaauaaaaacaugcuuc

SEQ ID NO: 498902 - RNA, 64 nt, Human
cugucuuggaaagugugggcagccacagaugcccccaaaucagagcucacagugagugagcccc

SEQ ID NO: 498903 - RNA, 64 nt, Human
gucccuagugacaugauugagcaguaaagaacggccaaaucacacagucagcuaaaagcacugu

SEQ ID NO: 498904 - RNA, 64 nt, Human
gaauguccuguggaauuaugccuucaguucuuuuccaaaucauuccuagccaaagcucugacuc

SEQ ID NO: 498905 - RNA, 64 nt, Human
aaaacaucucuggugccaacguaauacuucugaaccaaaucacugugacucaaggaaagucacu

SEQ ID NO: 498906 - RNA, 64 nt, Human
ucuagaggugagcuucucaaucuuuaauguguauccaaaucaccuggggaauagaugccgauuc

SEQ ID NO: 498907 - RNA, 64 nt, Human
guuuuaguucuguagaaggcaagaguaggguagaccaaaucaaaugcucacuggggucaggcug

SEQ ID NO: 498908 - RNA, 64 nt, Human
ucaaauguaaaaacgcuggcaggaaaacacaaggccaaaucaaucauuuaaaaaaucauuucau

SEQ ID NO: 498909 - RNA, 64 nt, Human
cuuuccacuuugcccccuguccucucuguguuccccaaaucagagaauagcccgccauccccca

SEQ ID NO: 498910 - RNA, 64 nt, Human
gcccaccuccgauucacagagguuucagggggacccaaaucacugcugguuuucaauuuuuuuu

SEQ ID NO: 498911 - RNA, 64 nt, Human
uccugagguuggacuuccuugcuuuucucuacuuccaaaucacaauuucuuacaaccaagcuuu

SEQ ID NO: 498912 - RNA, 64 nt, Human
gucugauacccucugcaucaagcguaagaaggucccaaaucauaaccauuuuaagaacagauga

SEQ ID NO: 498913 - RNA, 64 nt, Human
cugcccauauagaugcccuucuacauccuggagcccaaaucagucaugugggugggaaguuccc

SEQ ID NO: 498914 - RNA, 64 nt, Human
ggaguuuauuuaaaagaaauaaaugacaaucaaaccaaaucaucaguuaucaaugucuguuuaa

SEQ ID NO: 498915 - RNA, 64 nt, Human
caggaagcaccgagggaguugggcccuagcuuccccaaaucaguagcuugaagaaaggcaaagg

SEQ ID NO: 498916 - RNA, 64 nt, Human
uccaaagcugugaccuguccuucauuguugagccccaaaucauugcucaggguccauucccugc

SEQ ID NO: 498917 - RNA, 64 nt, Human
gccacuaaauggggagauggggcuguuaagcuguccaaaucaacaagggucauauaaauggccu

SEQ ID NO: 498918 - RNA, 64 nt, Human
gcugccucugcauagcuguuugagaaauucaggcccaaaucaugcagccuauccaauaaguaag

SEQ ID NO: 498919 - RNA, 64 nt, Human
cugcccucauuaaucugugauuccaccucuugcaccaaaucaauaucuauuuguugagcacuua

SEQ ID NO: 498920 - RNA, 64 nt, Human
ccucaaguuugucucucuugaccaaucauuuuuuccaaaucaaucaccagaaggagacaccagu

SEQ ID NO: 498921 - RNA, 64 nt, Human
ccacucuccuuggauggguguugcucccuuauccccaaaucacucuauacauccaauucaggaa

SEQ ID NO: 498922 - RNA, 64 nt, Human
guucaguuuguacccauuuuuccuuaaccaacacccaaaucaaacaauuaaaauauacaguguu

SEQ ID NO: 498923 - RNA, 64 nt, Human
gaaaaguuuuuauaugggcaacuuuaugcgaaauccaaaucaacacaaugcacucugcaguuag

SEQ ID NO: 498924 - RNA, 64 nt, Human
gaguuacugggaagaaucagagauaaaaaccaacccaaaucauuccucuggcacauuauuucua

SEQ ID NO: 498925 - RNA, 64 nt, Human
ucuccugggccccugcucuucccgagagcugcccccaaaucagacauaccucuguggcucuccu

SEQ ID NO: 498926 - RNA, 64 nt, Human
gccaggcacuacacagagaggaaguggauuuguuccaaaucagauauacaugucuagauguuac

SEQ ID NO: 498927 - RNA, 64 nt, Human
guggucacugugauauaauaaaucauaaaggaaaccaaaucacaaaggagaugguguggcuuag

SEQ ID NO: 498928 - RNA, 64 nt, Human
ccuuaccaagcagucuauggaaacaaccccucauccaaaucauggguuaguuaagaaucuaacu

SEQ ID NO: 498929 - RNA, 64 nt, Human
aaggucaaaacugaagcuuuuuauuuaggcuuuuccaaaucaaggauaaauaucuuacgcacga

SEQ ID NO: 498930 - RNA, 64 nt, Human
uuucuuugaaucaggaaggcaggugagguaagggccaaaucacucuccuccauagcaggaagcc

SEQ ID NO: 498931 - RNA, 64 nt, Human
uuauccccguaaucaaugugggccuauuaaaaaaccaaaucaugauacaagaaacaaccuugga

SEQ ID NO: 498932 - RNA, 64 nt, Human
guaugugaguauuuaucccauuuuaugcaauuaaccaaaucaaccaaaaaaagugaccaugaag

SEQ ID NO: 498933 - RNA, 64 nt, Human
aaauuucuguaaaugguaugucuccuuagaauacccaaaucauaauuuuauuuguacacacugu

SEQ ID NO: 498934 - RNA, 64 nt, Human
aucuucagaaaauauuauuugaccuacaguauguccaaaucaauuuaauaaaaucgcuuuauaa

SEQ ID NO: 498935 - RNA, 64 nt, Human
auucugauucaucuuccucccaagaaaagcaaagccaaaucaagaccacagauaggaaccuaag

SEQ ID NO: 498936 - RNA, 64 nt, Human
cuaacauagcuuaagcuauugguuccuaaaaaucccaaaucaagaucuauguagaauauaaagg

SEQ ID NO: 498937 - RNA, 64 nt, Human
uuaacuguauaucagggucaguuuuuguucaugcccaaaucacuacaccuuccucauuggccuu

SEQ ID NO: 498938 - RNA, 64 nt, Human
accauuacuuaaaagaugauugauuauugcuauaccaaaucagaugaacucuguucaucacuuu

SEQ ID NO: 498939 - RNA, 64 nt, Human
gugggcauuuucacaacaaucucuccccagccucccaaaucaagucucuccaucacuugaucaa

SEQ ID NO: 498940 - RNA, 64 nt, Human
guguugucgcaaaggggauaaucugggaaagacaccaaaucaugggcucacuuuaaaaaaagaa

SEQ ID NO: 498941 - RNA, 64 nt, Human
guccugaaaacucuugccaaaucaguuuugcaagccaaaucauuauuaaaagugcgggcagaac

SEQ ID NO: 498942 - RNA, 64 nt, Human
uaugauaauaaaacagugguccugaaaacucuugccaaaucaguuuugcaagccaaaucauuau

SEQ ID NO: 498943 - RNA, 64 nt, Human
cugugguuaaaguuuuggcaguuuauugauuaguccaaaucacaggcuaaggccugaucuccag

SEQ ID NO: 498944 - RNA, 64 nt, Human
gggaggauuauuuuaacagaucaagaaaaugaagccaaaucaagugaauuaaauuccucacaau

SEQ ID NO: 498945 - RNA, 64 nt, Human
ccauuuauccuugagacucagaccacaucugcaaccaaaucagcauccugucauuucgugaaug

SEQ ID NO: 498946 - RNA, 64 nt, Human
agauaguauuuacuaaagaaacgguuguuuuaacccaaaucauuaccagagugguaaagcagac

SEQ ID NO: 498947 - RNA, 64 nt, Human
uguacagauccacguguacuggcaccucagaagaccaaaucauggacuguacaagucucuauac

SEQ ID NO: 498948 - RNA, 64 nt, Human
ggauccauggaagucaggagcauuaaaucccaaaccaaaucaacuccagauauaucagugucaa

SEQ ID NO: 498949 - RNA, 64 nt, Human
aguuauuauauuauaugacgacuucauucacuucccaaaucacaggguggugcuucugucgcuu

SEQ ID NO: 498950 - RNA, 64 nt, Human
cuuguccaaggcuuuaugcaucggauuuauuuuuccaaaucaagaggacagugauagaugcauu

SEQ ID NO: 498951 - RNA, 64 nt, Human
uuuucaucuaaaagguuauauucuaguugugucaccaaaucaucaaaaaaccuuaaaaaagaag

SEQ ID NO: 498952 - RNA, 64 nt, Human
gcuuccguauuuuaauuuacugauuccagcaagaccaaaucauuguaucaaauuauuuuuaagu

SEQ ID NO: 498953 - RNA, 64 nt, Human
uuuuauuuaaaugucaauaguuguuuuuuaaaauccaaaucagaggugcaggccaccaguuaaa

SEQ ID NO: 498954 - RNA, 64 nt, Human
ccugguugggcuuaccuugcccgucaguucccugccaaaucauccccaaagugguuuggagcaa

SEQ ID NO: 498955 - RNA, 64 nt, Human
ugccagcaccaggcacugcuuucacguaaaauguccaaaucacaucuucagcaagaaagcaacc

SEQ ID NO: 498956 - RNA, 64 nt, Human
ugauuaaguguuuccuuacauuauuuuuuaaaaaccaaaucauuuuucuuuaacuaacuucuau

SEQ ID NO: 498957 - RNA, 64 nt, Human
aacauaggugguucugugauaacaucaguguuuuccaaaucaaaggaacgcuuuaaaaaauagg

SEQ ID NO: 498958 - RNA, 64 nt, Human
uuaaaucaauuaguuucagcuaaacugacuagaaccaaaucaaaguguaauucucccuccagcu

SEQ ID NO: 498959 - RNA, 64 nt, Human
cucaaauaaaacaugagauaacauuuuaagacuuccaaaucagagaagugcuucaaauuauuuu

SEQ ID NO: 498960 - RNA, 64 nt, Human
gaauaucggauucaugcaucaguuuauggugaauccaaaucaaugucuugaauccuuugaaaac

SEQ ID NO: 498961 - RNA, 64 nt, Human
gaugccuuuuuuuuuccggcuuaagccuuaagugccaaaucacaagagaaaaagcaguaacagu

SEQ ID NO: 498962 - RNA, 64 nt, Human
uggcauuuuacuugguauaggaauuuaaugagaaccaaaucacaaaaauaccagaucuccuuuu

SEQ ID NO: 498963 - RNA, 64 nt, Human
uaguggagugagaaagggaggguggagggugaggccaaaucagguccagcaaaagucaguaggg

SEQ ID NO: 498964 - RNA, 64 nt, Human
cuccugccucaccgucugccuugcuccucucuucccaaaucaucaccgccaugggcccagcccc

SEQ ID NO: 498965 - RNA, 64 nt, Human
gccuuuggcccaggcuccacggcgacaguugggcccaaaucagaaaggagagagggggccaaug

SEQ ID NO: 498966 - RNA, 64 nt, Human
guccucccaagcugugcugggaagcccggacugaccaaaucacccaaucccaguucuuccugca

SEQ ID NO: 498967 - RNA, 64 nt, Human
ucaacaguggcaaucagcacacagaggaaaggacccaaaucacuauguagcuuaaagauuucug

SEQ ID NO: 498968 - RNA, 58 nt, Human
cuggaucggauaaacuuuaauaccuccuccaaaucaucauucaccaaccauaccagag

SEQ ID NO: 498969 - RNA, 64 nt, Human
gggaggcucucuggcuuuaguuuuguuuuguuuuccaaaucaagguaacuugcucccuucugcc

SEQ ID NO: 498970 - RNA, 64 nt, Human
acacaucauguuccuguccacauacugguuuuccccaaaucagcugauaaauucaguguaauuc

SEQ ID NO: 498971 - RNA, 64 nt, Human
ccacauuuauaaaauaaugguuuuaucccugcccccaaaucaucagguuccucggguuuaagag

SEQ ID NO: 498972 - RNA, 64 nt, Human
cugguuccaucaguauaccugcucuccuaugaccccaaaucauagucaauggugccucaaacau

SEQ ID NO: 498973 - RNA, 64 nt, Human
cuaguaguaccacaguggcuaaaguagaagaaaaccaaaucaaaugggaugugucuuuugggag

SEQ ID NO: 498974 - RNA, 64 nt, Human
gucaugaacaacacugaagaaacgucaaagugaaccaaaucauuguuuuuauuuuacaaaggca

SEQ ID NO: 498975 - RNA, 64 nt, Human
uguauucucacagguguuaugugcaggacacaauccaaaucauaaaccuggcucaugcccaaca

SEQ ID NO: 498976 - RNA, 64 nt, Human
ucuguuuuuuuauugagaaaaugauucacgaauuccaaaucagauugccaggaagaaauaggac

SEQ ID NO: 498977 - RNA, 64 nt, Human
acugcucugguuaucuaauauguaacaagccaccccaaaucauaguggcuuaaaacaacacuca

SEQ ID NO: 498978 - RNA, 64 nt, Human
uuuggccauguucuuuuguuuuucuauuccugucccaaaucaaagagcaugguucucaggaaaa

SEQ ID NO: 498979 - RNA, 64 nt, Human
ucgugcacaacacagcuucuguugacucuaacuuccaaaucaaaaucauuugguugaaacagac

SEQ ID NO: 498980 - RNA, 64 nt, Human
ucauuggacuggaauguuuggagaauguuaauuuccaaaucaggaaccacaaacugcccucuaa

SEQ ID NO: 498981 - RNA, 64 nt, Human
ccagcaacacuccggucagccccuggcaaucccaccaaaucauccugaaucugaucuuuuuaua

SEQ ID NO: 498982 - RNA, 64 nt, Human
cgguucucccacuuuuccauaagcagaacaagaaccaaaucaaacgucuuaacgcguauagaga

SEQ ID NO: 498983 - RNA, 64 nt, Human
guggacucucucaguuguauguugcuauaauccuccaaaucaaagcucuuucugcuugugcaag

SEQ ID NO: 498984 - RNA, 64 nt, Human
auuauacauuggaauuuuugucaugacacauuugccaaaucaguaggauauauuuguuuuggca

SEQ ID NO: 498985 - RNA, 64 nt, Human
cauuuuuauacaccaacgacauccaagcugagagccaaaucaagaaugcaauccuauucacaau

SEQ ID NO: 498986 - RNA, 64 nt, Human
uuuaggacauugcaaaucuucuagaaguucucccccaaaucaggucaaugugugcccuccugag

SEQ ID NO: 498987 - RNA, 64 nt, Human
aagaaguucgcaccccugcugacaccagaacagcccaaaucagaguucccagggccagacaggc

SEQ ID NO: 498988 - RNA, 64 nt, Human
cgucugugcugcuuccaccuggugcuuccuguucccaaaucacaagggccugaagguggucccu

SEQ ID NO: 498989 - RNA, 64 nt, Human
gcagcauacccagagauccggggcccccccacccccaaaucacgagugcagcuggagcuugcuc

SEQ ID NO: 498990 - RNA, 64 nt, Human
caucaagcacugauggugucagggcugguaguuaccaaaucaggguuaagaaacaucagggcca

SEQ ID NO: 498991 - RNA, 64 nt, Human
ucaccccaaccucuggcucugagcccuguucugaccaaaucaugaugaugaguauuugggggug

SEQ ID NO: 498992 - RNA, 64 nt, Human
gaggcuuuaauauguaaaagugaaagaguucacuccaaaucaguagagaguaauauugaagaca

SEQ ID NO: 498993 - RNA, 53 nt, Human
augaaaauaguggaagguaauugccaaaucaagagaacugacuugcaagcuac

SEQ ID NO: 498994 - RNA, 64 nt, Human
gccuguggcccuauuacuauccaguuggccucucccaaaucaacuucaagucuuuuauagagaa

SEQ ID NO: 498995 - RNA, 64 nt, Human
cagcuuaaagagcacuagggauggggaacgaaugccaaaucagacuccaccuagagcaccagga

SEQ ID NO: 498996 - RNA, 64 nt, Human
aauuauuacuaaaauuguauuuacaauaguggugccaaaucaaaugguaauuuaaauaaaaucu

SEQ ID NO: 498997 - RNA, 64 nt, Human
uuuucuaaguuauggucauauauacccaaacaaaccaaaucaaacuaaauuacugcauauaauu

SEQ ID NO: 498998 - RNA, 64 nt, Human
auuagugagaaucacaaaguauuuuguagaaggcccaaaucacagaauaaaggacuaagagugg

SEQ ID NO: 498999 - RNA, 64 nt, Human
ggucagacaucaucuccuuggcugcccuuugaaaccaaaucacuugccuuggggauaaagugcu

SEQ ID NO: 499000 - RNA, 64 nt, Human
acggaaagcgccaaauggcuguuuaaaaagugccccaaaucaaauugaauagccuucagaauag

SEQ ID NO: 499001 - RNA, 64 nt, Human
uguaacuuuagcuuuauggaacuauauaguaaucccaaaucaaguuauuuugaauauuuuuaug

SEQ ID NO: 499002 - RNA, 64 nt, Human
aaacauauaaacaauuauuuaucacuuuuaugacccaaaucacaauaaaauugucauuuaggau

SEQ ID NO: 499003 - RNA, 64 nt, Human
ccagaaauuugaaaagaauauucagaaauccuucccaaaucauaagggcaccuauugagauuca

SEQ ID NO: 499004 - RNA, 64 nt, Human
aauucuguuucugaccuguuuuaaaugaaccaaaccaaaucauacuuucucuucaaauuuagca

SEQ ID NO: 499005 - RNA, 64 nt, Human
aauucuguuugugaccuguuuuaaaugaaccaaaccaaaucauacuuuuucuuugaauuuagca

SEQ ID NO: 499006 - RNA, 64 nt, Human
gccggcuggagccaggcccccucgcacgcagcccccaaaucauggacgcaccuguggggagcac

SEQ ID NO: 499007 - RNA, 64 nt, Human
caauauuuaauauucuacucgagcuuuauggaagccaaaucaugugcaugugugugugugcgug

SEQ ID NO: 499008 - RNA, 60 nt, Human
cuaugaugccugacaacuaaauauccuuauccaaaucaauaaagagagaauccucccucc

SEQ ID NO: 499009 - RNA, 64 nt, Human
gcguauuucuggaucuccuucccuccuuucucguccaaaucaugaaauguuuggccuuagucaa

SEQ ID NO: 499010 - RNA, 64 nt, Human
uuguaccaaguuucccuucucccaguccaagaccccaaaucaccacaaaggacccaauccccag

SEQ ID NO: 499011 - RNA, 64 nt, Human
cauuucuauacaccaguaauguccaagcuaugaaccaaaucaagaauggaaucccauucacagu

SEQ ID NO: 499012 - RNA, 64 nt, Human
gaaauguaugugacacaggcuuuaucaaggccugccaaaucacuggacaucaccacaucacugu

SEQ ID NO: 499013 - RNA, 64 nt, Human
gauuauccacaccccagcccuuaauccccaucccccaaaucacuggauccugcagccccacauc

SEQ ID NO: 499014 - RNA, 64 nt, Human
cagcaccuccugccugccagcuggcgucuuguauccaaaucaagaugaggaagagggggccugu

SEQ ID NO: 499015 - RNA, 64 nt, Human
cguugcuucaggcaugggggguggggggagcgucccaaaucaauaagaagguagaaugaguuau

SEQ ID NO: 499016 - RNA, 64 nt, Human
ccugauucuuuggcuuguuaaucgagaauaucccccaaaucacuugucucuguuccucagaguu

SEQ ID NO: 499017 - RNA, 64 nt, Human
acgaggagcgaacacugcacuaagauuugguuugccaaaucagauucuuuggucaagagucagu

SEQ ID NO: 499018 - RNA, 64 nt, Human
cuagaagaccccaaugccguaacuccuaggacccccaaaucauggaaucccaaauccccaggga

SEQ ID NO: 499019 - RNA, 64 nt, Human
aaagacuugacauuguaaaaauauaauuucucucccaaaucacuaaguuuaauauacuucugaa

SEQ ID NO: 499020 - RNA, 64 nt, Human
gaaaucacuggggacaggaaaccacuuccuuuugccaaaucagaucccguccaaagugccuccc

SEQ ID NO: 499021 - RNA, 64 nt, Human
caggaaggauccugccuugauuuuacuucagaaaccaaaucagucuucuauaaucuggggucgg

SEQ ID NO: 499022 - RNA, 64 nt, Human
aaacccuaugaguauuccagacuacagaguuugcccaaaucaacuguaaaugacacuuguguaa

SEQ ID NO: 499023 - RNA, 64 nt, Human
gcucagucagacacagacauucaucugugucugaccaaaucaggggacuuccccaccuguggug

SEQ ID NO: 499024 - RNA, 64 nt, Human
agccucucugguagcugagacugcaugcccagcuccaaaucaccuugauucauaucagcaguaa

SEQ ID NO: 499025 - RNA, 64 nt, Human
cuggaccagcagagcaacaucggaauucuucacuccaaaucaugugcuuaacuguaaaauacuc

SEQ ID NO: 499026 - RNA, 64 nt, Human
ggggaaaaccaggcaauuucguuccuggaaucaaccaaaucauguuuuccucuuggauggaagu

SEQ ID NO: 499027 - RNA, 64 nt, Human
guugaaaacccuuguaaauaggagagguugcaaaccaaaucaagaguauuuauuacuauuacug

SEQ ID NO: 499028 - RNA, 64 nt, Human
ugugcugggcgaaaacccuuaugacuccccccuuccaaaucaggcuggguugucacugagacua

SEQ ID NO: 499029 - RNA, 64 nt, Human
ccucagcugaacuggcacgcgacgaggacgcauuccaaaucauacucacgggaggaaucuuuua

SEQ ID NO: 499030 - RNA, 64 nt, Human
uaaacuguguaggggagccacauuuacauaggaaccaaaucaaugaauuuagggguuacgauua

SEQ ID NO: 499031 - RNA, 64 nt, Human
gccugcaggugcuccccgcccugagacccaggccccaaaucagcaauaaugaacaaacccuugg

SEQ ID NO: 499032 - RNA, 64 nt, Human
aauacuauauuaaucuuauuuaacuaaguuuuauccaaaucauguuaacuuaagaaacauuuga

SEQ ID NO: 499033 - RNA, 64 nt, Human
aucaaacauucacucggaaucaaaggugccaauuccaaaucaagacccuaaugauuucucccaa

SEQ ID NO: 499034 - RNA, 64 nt, Human
acuuguauauuuaaauucuuuguaauaauaauauccaaaucaucaucuugugucaugguuuaau

SEQ ID NO: 499035 - RNA, 64 nt, Human
agagcuucccucaggcucccugaaacagcuaggcccaaaucacaaguacaguccuuuccaacac

SEQ ID NO: 499036 - RNA, 64 nt, Human
cggccagcccacuccccagccagagagggcuugaccaaaucaaauugagguggugacuuuuguu

SEQ ID NO: 499037 - RNA, 64 nt, Human
cgauaaguguugagguaggcucgagaacugcuccccaaaucagugagaauugcauuaggagccc

SEQ ID NO: 499038 - RNA, 64 nt, Human
ggccaaggucugagcacuggaguggcucgccaggccaaaucacccuuagaaggcugcagauaac

SEQ ID NO: 499039 - RNA, 64 nt, Human
cauuacuaauggauaccauucucaacaagucaauccaaaucagcccguuaaggagaaagaaauu

SEQ ID NO: 499040 - RNA, 64 nt, Human
uccucaaucuuuuaccuuuuccaaaucccaauccccaaaucaguuuuucucuuucuuacucccu

SEQ ID NO: 499041 - RNA, 64 nt, Human
cuuugaagaaaaagcaaaaacaagaacaaaaacaccaaaucauuugaaaucacuguccauuaaa

SEQ ID NO: 499042 - RNA, 64 nt, Human
cagcguuuuguuucuuucuguccauacuuaaagaccaaaucauuuguuugcuuugaagaaaaag

SEQ ID NO: 499043 - RNA, 64 nt, Human
gcuaggaauagugauccugcuauaaugugagaacccaaaucauguuuauaaaauaggacgcugg

SEQ ID NO: 499044 - RNA, 64 nt, Human
ucugcagugccuucacuacacugccuuacauaaaccaaaucacaauaaaguucauauucaguac

SEQ ID NO: 499045 - RNA, 54 nt, Human
ugguggaauaucucaucuaaacggccaaaucaagagcugcagauuaucagcaaa

SEQ ID NO: 499046 - RNA, 64 nt, Human
aucuuaaauuuagacaauaaacaaaacuuuguuaccaaaucacucagaaauggccaauguuugc

SEQ ID NO: 499047 - RNA, 64 nt, Human
ucaaugguucuauugacuuuuugcgucacuuaauccaaaucaaccaaauucaggguugaaucug

SEQ ID NO: 499048 - RNA, 64 nt, Human
acuuugggaauuugcuuuagccagaauaaagaaaccaaaucaugaaaauuauggaagacuauuc

SEQ ID NO: 499049 - RNA, 59 nt, Human
aacuucguguccuggaucgccuucuucaccacggccagcgucuacgacggcaaguaccu

SEQ ID NO: 499050 - RNA, 59 nt, Human
gacuuugguccacguccugagccacugaccacggccagucucucuuuuuauaugugcag

SEQ ID NO: 499051 - RNA, 59 nt, Human
cugagggacuucucagaggcagggcagcacacggccagccccgcggccuggcgcuccga

SEQ ID NO: 499052 - RNA, 59 nt, Human
auauccccaccccuucccacggcgugucccacggccagacacaugcacacacaucacac

SEQ ID NO: 499053 - RNA, 59 nt, Human
aagaccacaguggccaagaucacaguggccacggccacggccacagucaugguggccac

SEQ ID NO: 499054 - RNA, 59 nt, Human
acaguggccaagaucacaguggccacggccacggccacagucaugguggccacggccac

SEQ ID NO: 499055 - RNA, 59 nt, Human
gccacggccacggccacagucaugguggccacggccacagccacuaaucaggaggccag

SEQ ID NO: 499056 - RNA, 59 nt, Human
aucucagagcuuacaggcugagccaagcccacggccaugcacagggacacucacacagg

SEQ ID NO: 499057 - RNA, 59 nt, Human
cuccacucagcccugacaacccauccacacacggccaggccuguuuaucuacacugcug

SEQ ID NO: 499058 - RNA, 59 nt, Human
aauuguguaucuuccagccaggaauccuacacggccagcauguauuucuacaaauaaag

SEQ ID NO: 499059 - RNA, 59 nt, Human
caggaugacuggggagcuuggcagaaguucacggccagugcaggaauccagguagugga

SEQ ID NO: 499060 - RNA, 59 nt, Human
cgugugucugugaccgccugucucaguggcacggccacuuccuuucuguagcuggguua

SEQ ID NO: 499061 - RNA, 59 nt, Human
gaugcccugggguccgugguuguggucaucacggccaucauauucuaugugcuuccccu

SEQ ID NO: 499062 - RNA, 59 nt, Human
guauggaguugguuucaucuucuggugcccacggccauuggcauugccagccucauucc

SEQ ID NO: 499063 - RNA, 59 nt, Human
ccggcucccaagccagcguugcgcagaugcacggccagcucagaggcggccuuucccgc

SEQ ID NO: 499064 - RNA, 59 nt, Human
uaccuagauggcaccuccuuuggugaaaccacggccaauguuccuuagcugcaccaggc

SEQ ID NO: 499065 - RNA, 59 nt, Human
cagcucagagucaccuggggcacaugugucacggccacucagcucucgcccgccugugc

SEQ ID NO: 499066 - RNA, 59 nt, Human
aucauaugcucaacucugaaaaccuugaacacggccaaaauccauaaagauuauaaaag

SEQ ID NO: 499067 - RNA, 59 nt, Human
uuaaaaguuuucuuucuccaaccugagggcacggccaaaaagaucugguuauuuuuuag

SEQ ID NO: 499068 - RNA, 59 nt, Human
uacucacuuaaagcccgccugacagaaaccacggccacauuugguucuaagaaacccuc

SEQ ID NO: 499069 - RNA, 59 nt, Human
ggccgaccagcacuugggaucugaugggacacggccagugccuaggggugccaagucca

SEQ ID NO: 499070 - RNA, 59 nt, Human
aggcaggcuagaggaggcacaggcccugccacggccaacucaggucagccagccugagg

SEQ ID NO: 499071 - RNA, 59 nt, Human
ggacuggggcugaagguugaagaggugagcacggccaacaaagcuguugaugguaggug

SEQ ID NO: 499072 - RNA, 59 nt, Human
cuucagcuccugcaccgacaucaggaacccacggccaccaccuccuccccucaaggcau

SEQ ID NO: 499073 - RNA, 59 nt, Human
agucaucaacuggaaaaaaagcaaaaacccacggccaaaauaaauugguacuguuuguu

SEQ ID NO: 499074 - RNA, 59 nt, Human
aguuugcacucuuugagcgcgcugagcgucacggccaaggugggcuucccaccccaccc

SEQ ID NO: 499075 - RNA, 59 nt, Human
cugcgugugagcgugccugacaucucacgcacggccacuccagagccggucccuguccu

SEQ ID NO: 499076 - RNA, 59 nt, Human
uaugggcgggcagucgcugcagggagcaccacggccagaaguaacuuauuuuguacuag

SEQ ID NO: 499077 - RNA, 59 nt, Human
ccuucauugugaggaagggugcuccaagucacggccacuagguugucuucacccaugua

SEQ ID NO: 499078 - RNA, 59 nt, Human
gggcccccugcggccugggccccccugcccacggccagcuuccugcugaugaacaugcu

SEQ ID NO: 499079 - RNA, 59 nt, Human
cccgucccucuccaggggccccgcauacacacggccaugcacgcacacacugggccugg

SEQ ID NO: 499080 - RNA, 59 nt, Human
gcccugucaccgacgggucaccucgcccacacggccagcaccgacucaccacagcccuu

SEQ ID NO: 499081 - RNA, 59 nt, Human
cuguccgugggcagcccaguccccacagucacggccaagccacgcagaacgaacaugac

SEQ ID NO: 499082 - RNA, 59 nt, Human
gagcugcacacaccuggguggacacaaggcacggccacgucaugucucuaaacugcggu

SEQ ID NO: 499083 - RNA, 59 nt, Human
cuggcaccccuggcugugacuguggccgccacggccacccggaaugugaagggcgcucc

SEQ ID NO: 499084 - RNA, 59 nt, Human
caaucagaacuggcuguggaccacccuagcacggccaccucucagggccacuggcaggc

SEQ ID NO: 499085 - RNA, 59 nt, Human
acagcagggcagugcacccuggcaccaugcacggccagcaagaaucaaggcccgcagau

SEQ ID NO: 499086 - RNA, 59 nt, Human
cucggccgccagcagaugagccgcgcggccacggccaacccgcccgccccggcgcaggc

SEQ ID NO: 499087 - RNA, 59 nt, Human
uguuucuugagcucccaguaggggcuggccacggccaggugugggagggacuucgaaga

SEQ ID NO: 499088 - RNA, 59 nt, Human
gaugugcaacugguuugcacugcacaccccacggccauguaacucuccuguccacauau

SEQ ID NO: 499089 - RNA, 59 nt, Human
ccaggcucgcucagccccacagcccugugcacggccauuaaagcuucccacagacacug

SEQ ID NO: 499090 - RNA, 59 nt, Human
accagggugaggguugugcccagcugggccacggccaugcgugggguggcccaauaaac

SEQ ID NO: 499091 - RNA, 59 nt, Human
ggcuuugggguccucugggagcugaagcacacggccauguuggagagcaaaacuuaaua

SEQ ID NO: 499092 - RNA, 59 nt, Human
gcggggagggcgccucuggccccccaccucacggccaguucccgcgggcaccgccucgc

SEQ ID NO: 499093 - RNA, 59 nt, Human
gccauccccuuccugcugcacaccugcaccacggccauggggaggcugcucccuggggg

SEQ ID NO: 499094 - RNA, 59 nt, Human
uugaucuaaggggccgcgauggucagggccacggccaagggccacgggaacuuggagag

SEQ ID NO: 499095 - RNA, 59 nt, Human
uuucagcucuaggcaugcagacaaccccacacggccacaccaccacaugcccaagugua

SEQ ID NO: 499096 - RNA, 59 nt, Human
cugagugaggaguggacgcuguccauugccacggccaugagggcuggagaccagaacag

SEQ ID NO: 499097 - RNA, 59 nt, Human
uucaguccccaggagcaggagcugcugcucacggccagcgacgacgccaccaucaaagc

SEQ ID NO: 499098 - RNA, 59 nt, Human
acugggcacaggagcucccagcuuuuguccacggccagcaggaugggcugucguguaua

SEQ ID NO: 499099 - RNA, 59 nt, Human
gaagagagacuuuuacccuggggcacucacacggccaagcuucugccaccacuucauua

SEQ ID NO: 499100 - RNA, 59 nt, Human
cucgagacccucuggugccaggcuugcuucacggccaucuuguguugucacugcagagu

SEQ ID NO: 499101 - RNA, 59 nt, Human
gggcuccaggacccgucccaauaaccacccacggccaggagggccaaggccccgugcug

SEQ ID NO: 499102 - RNA, 59 nt, Human
ccaggcagccccgaaagaagagccugggccacggccacguauaaaccuccgagggguca

SEQ ID NO: 499103 - RNA, 59 nt, Human
ucugggaaucuuuccagcccgcaggucgccacggccaucccuuugcucccagccuggcu

SEQ ID NO: 499104 - RNA, 59 nt, Human
cagccacagcuccuccagaaagggacagccacggccaagugguugcuggucuuugggcc

SEQ ID NO: 499105 - RNA, 59 nt, Human
caagccccuacugauuucuggguuucugccacggccacagguucauauccagaggaaug

SEQ ID NO: 499106 - RNA, 59 nt, Human
caccugccugucugauccaagagcugagacacggccacccagcaccagucacuccucug

SEQ ID NO: 499107 - RNA, 59 nt, Human
ggcuuuaaggcugcccuuguaauagacgucacggccaagcucacagcuauugacaacca

SEQ ID NO: 499108 - RNA, 59 nt, Human
gccggcgauugggaccagcugggccccaccacggccacgccaggcaaagcgccagcagc

SEQ ID NO: 499109 - RNA, 59 nt, Human
accgcuaaaaugcacgccaucaucgagcgcacggccagcuucgugugcaggcagggagc

SEQ ID NO: 499110 - RNA, 59 nt, Human
cugccugccccaccacagcuggaguuggccacggccaagaacgacaugaaccggcaccu

SEQ ID NO: 499111 - RNA, 59 nt, Human
auauauauaaauauauuauacucacucaucacggccaucuuuguuguaaccauuucugu

SEQ ID NO: 499112 - RNA, 59 nt, Human
cagagccauggguucugugcuggagggugcacggccaagaucuccagacugcugguucc

SEQ ID NO: 499113 - RNA, 59 nt, Human
agcauaagagaagaaacugucucagaucucacggccaggccucucuccugcugcuguuu

SEQ ID NO: 499114 - RNA, 59 nt, Human
cguucuuauagaugauuuuguagaauaugcacggccaguagucacagguggaaaacgca

SEQ ID NO: 499115 - RNA, 59 nt, Human
agccuaacugcagggugaaaaagucccugcacggccaccacccucgagacugccucuuc

SEQ ID NO: 499116 - RNA, 59 nt, Human
uaauaugauuugccccgauacucaucuugcacggccagaacuguuugguugauuaaaau

SEQ ID NO: 499117 - RNA, 59 nt, Human
agcagcuagacacacgccagggcgccaagcacggccagcuccgcggacccauggacaag

SEQ ID NO: 499118 - RNA, 59 nt, Human
aagggccgugcccgcccaccucugcugcccacggccacccacccuucuccccugccccg

SEQ ID NO: 499119 - RNA, 59 nt, Human
gugaauaggaauacuguuuaaugaaacuccacggccauaacaauauuuaacuuuaaaag

SEQ ID NO: 499120 - RNA, 59 nt, Human
gcuucccuuccauuaagcugaaauugccccacggccauauccacccauugacucugccu

SEQ ID NO: 499121 - RNA, 59 nt, Human
aaagugcugggauuacuggugugagccaccacggccagcugcuagcacauuucuuaccu

SEQ ID NO: 499122 - RNA, 59 nt, Human
gggaacugcuggcucgccuggcaccaccacacggccacagccagccaucugcucugcca

SEQ ID NO: 499123 - RNA, 59 nt, Human
cucccaagguucaaauacuuuuuauuagacacggccaggcagagaagaccaugggaguu

SEQ ID NO: 499124 - RNA, 59 nt, Human
ggccuucucugaaggacauugcggacagccacggccaggccagagggagugacagaggc

SEQ ID NO: 499125 - RNA, 59 nt, Human
uguggaggcuauguagcuggugcgcugcucacggccauucacugcccaugcugagcgcc

SEQ ID NO: 499126 - RNA, 59 nt, Human
ccuccaggaggaaaggcaagacacgcuuacacggccauuugucucuuuucccaaugcgg

SEQ ID NO: 499127 - RNA, 59 nt, Human
gagguccccucgucccauccagcuaccaccacggccaccacugcagccgggggcuggcc

SEQ ID NO: 499128 - RNA, 59 nt, Human
ugugcauggacgugccugagggguccgggcacggccauacgcaggaccccugugcccgg

SEQ ID NO: 499129 - RNA, 59 nt, Human
caggcgaggcccuuggcgggcacgggugucacggccaggcagaugaccucguacucagg

SEQ ID NO: 499130 - RNA, 59 nt, Human
cagaaccagccaaagaagcacuuccugggcacggccaccagcucucccgccuccagugu

SEQ ID NO: 499131 - RNA, 59 nt, Human
gaggcaggucccgagcccccuguccuucccacggccacugcagucaccccugucugcgc

SEQ ID NO: 499132 - RNA, 59 nt, Human
aggcccucccuguuaauaaacagcucuaacacggccaggcugggcucugggauucugac

SEQ ID NO: 499133 - RNA, 55 nt, Human; identical to SEQ ID NO: 102895

SEQ ID NO: 499134 - RNA, 59 nt, Human
gaggaccaggcaucgcugugugaggacggcacggccagcgccugcugugagugggucuc

SEQ ID NO: 499135 - RNA, 59 nt, Human
acaauaaaccauccucuuccaacccacgccacggccaugcugugggggaccugcuccuc

SEQ ID NO: 499136 - RNA, 59 nt, Human
ccugagccccuuuccccaccacaacccaccacggccaggcagagaagggcaacucccaa

SEQ ID NO: 499137 - RNA, 59 nt, Human
gacaccccauuuccuucaccagguccccccacggccauagcccuugcagccaaacuuug

SEQ ID NO: 499138 - RNA, 59 nt, Human
ggcagccaggauggagcacccaugggucucacggccaugcuucagggucuucagguccu

SEQ ID NO: 499139 - RNA, 59 nt, Human
acugggcccccaggccauccaggcuuugccacggccaguugguccucccuggggaacug

SEQ ID NO: 499140 - RNA, 59 nt, Human
cauucucacugcauccucccugcaguagccacggccaggcccuuaggaggagcagugac

SEQ ID NO: 499141 - RNA, 59 nt, Human
acguggaaggucaugaaugggccgcaaaccacggccagcugcuugucuuuguauggcuu

SEQ ID NO: 499142 - RNA, 59 nt, Human
ucuccucuuguuucugccuuaauaauucccacggccacaggcaaggggguugcaguggc

SEQ ID NO: 499143 - RNA, 59 nt, Human
cgccccgcccacgccgcggccaccgggcccacggccaccagaaugcaauugagaaaucg

SEQ ID NO: 499144 - RNA, 56 nt, Human; identical to SEQ ID NO: 37267

SEQ ID NO: 499145 - RNA, 59 nt, Human
cugacaugcacaccucccccugcccccaccacggccacuggccaucuccacccccagcu

SEQ ID NO: 499146 - RNA, 59 nt, Human
ggcagggcaaggagacuccgcucacuccccacggccagcgugggcacaggacugacccu

SEQ ID NO: 499147 - RNA, 59 nt, Human
gaccagccuuaccugugacacugcacccucacggccacccgacuacuuugccuccuugg

SEQ ID NO: 499148 - RNA, 59 nt, Human
cgggggcgugugcucugcgggacaguccccacggccagcgacguccaggucaccaaugg

SEQ ID NO: 499149 - RNA, 59 nt, Human
aaagugcugggauuacaggcaugagccaccacggccagcccacaaugauauuacaaacc

SEQ ID NO: 499150 - RNA, 59 nt, Human
aaauaggguuggcgcauacccacccccgccacggccacaagcccuggcauccccugcaa

SEQ ID NO: 499151 - RNA, 59 nt, Human
gcugugaagauagacugauuggaguggaccacggccaagcuugcuccguccucggacag

SEQ ID NO: 499152 - RNA, 59 nt, Human
ggagacucaccgcagaggccacgugaacccacggccacagagaggcaggacggcagagc

SEQ ID NO: 499153 - RNA, 59 nt, Human
uguauacgcuucaguuuuuccacauuguccacggccagcacaugaaagcaucacuucuu

SEQ ID NO: 499154 - RNA, 59 nt, Human
cacuuguccagcugagcgccaggauggaacacggccacaucaaagaggcugaggcuggc

SEQ ID NO: 499155 - RNA, 59 nt, Human
gcuuggagaaagggcagugggacgcuggccacggccaggguggugucgggagcaggccu

SEQ ID NO: 499156 - RNA, 59 nt, Human
aagcccugaguuucaaguauccuuguugacacggccaugaccacuuuccccgugggcca

SEQ ID NO: 499157 - RNA, 59 nt, Human
ugagagggguguuugcugagcgcuccgggcacggccagagggcaagugagcaugcacgg

SEQ ID NO: 499158 - RNA, 59 nt, Human
cucgaagacugguuucuagcacuaccggucacggccaugucguccuagaaggguccaga

SEQ ID NO: 499159 - RNA, 59 nt, Human
caucugcccagccucacugaggcucaggacacggccacaccaagugcagcccucguccu

SEQ ID NO: 499160 - RNA, 59 nt, Human
cugaccccaucauacccaaagugcaaucucacggccagguucuaugcccuguccaagcg

SEQ ID NO: 499161 - RNA, 59 nt, Human
cuucgucuucugagggccgggcacggucacacggccacccgccccgcgcaccccacgcc

SEQ ID NO: 499162 - RNA, 59 nt, Human
gacgcccggguuccauggacccuccuccccacggccaugccucugcucuugggcgccca

SEQ ID NO: 499163 - RNA, 59 nt, Human
caucauaccagcccccaggaccacuaccccacggccagccagggguccagagcuagccc

SEQ ID NO: 499164 - RNA, 59 nt, Human
guccagguggcagggaaagccgagcggcccacggccaggucggagcaguacuugacccu

SEQ ID NO: 499165 - RNA, 50 nt, Human; identical to SEQ ID NO: 179371

SEQ ID NO: 499166 - RNA, 59 nt, Human
gagcccugggcacccaccuccacccccgccacggccacccuccuucccgccgcccgacc

SEQ ID NO: 499167 - RNA, 64 nt, Human
ggaaauagggggagauucaagucauauagauuccuacucgaaaaucuugacaccugacuuucca

SEQ ID NO: 499168 - RNA, 64 nt, Human
ucccuccuguacccuggccagaacaucucacugauacucgaauucuuuuggcaaacuucgcugu

SEQ ID NO: 499169 - RNA, 64 nt, Human
auguuccgagucugcagcuccacacuuuaaaucauacucgaaugcaggacaaguccuaaauauu

SEQ ID NO: 499170 - RNA, 64 nt, Human
aaagagagcugcccacaacuugccaaaacagauauacucgaaucagacugaaaaaaaaaaaaaa

SEQ ID NO: 499171 - RNA, 64 nt, Human
gaaagaacauuauuguucuuuaauuccuacaagguacucgaaaaccuuaagugaaaaagauuuc

SEQ ID NO: 499172 - RNA, 64 nt, Human
uaauuucauuccauucuauuguuuacacaacgauuacucgaagaugacugcaaagguaaaagga

SEQ ID NO: 499173 - RNA, 64 nt, Human
cugaaagcagauuugguuccauaccucuuaaaauuacucgaaggcauuggccuugaaaaccugg

SEQ ID NO: 499174 - RNA, 64 nt, Human
ugaguaaguggagguguuauguaaaggcauauuguacucgaaaucugaagaccugcagcagauu

SEQ ID NO: 499175 - RNA, 64 nt, Human
gaauucuuagcacugguguaaauaucauggugccuacucgaaagaaauguagaugcuaugcauu

SEQ ID NO: 499176 - RNA, 64 nt, Human
augcuuccuguuguggucuggccaaugccaaauguacucgaaugauguuaagggcucuguaaaa

SEQ ID NO: 499177 - RNA, 64 nt, Human
caauguucugacaagggucccuauaaccuuaaccuacucgaaaccgguuugggauggauaugau

SEQ ID NO: 499178 - RNA, 64 nt, Human
aaaauguuccaggccaggauucggauucuugaauuacucgaagccuucucugggaagaaaggga

SEQ ID NO: 499179 - RNA, 64 nt, Human
ccucagaaggaauaaucgguaaauuaagaauugcuacucgaaggugccagaaugacacaaagga

SEQ ID NO: 499180 - RNA, 64 nt, Human
ugaaaggcacugucauuuaaacauaaaccuggaguacucgaaauagaauucagguuuacaagau

SEQ ID NO: 499181 - RNA, 64 nt, Human
gcuguguagcacacugagugacgcaaucaauguuuacucgaacagaaugcauuucuucacuccg

SEQ ID NO: 499182 - RNA, 64 nt, Human
caggcuuccagcacauucucccccauuuggaggauacucgaaugucagguuuuugguuuuauua

SEQ ID NO: 499183 - RNA, 64 nt, Human
ugcuucuauuauuucucucucccuuauauuuuacuacucgaagaaaggcagaagaaguuacaaa

SEQ ID NO: 499184 - RNA, 64 nt, Human
auucagccugcugaagaguauuccacuuucuguguacucgaauugcuuucuguuugcuuuacca

SEQ ID NO: 499185 - RNA, 64 nt, Human
auuugaauggccuuguaaacagcucacugucuaauacucgaaggacaaguaacaauuuauauug

SEQ ID NO: 499186 - RNA, 64 nt, Human
uuggcaucagguggcagcugaauaucuuuugaauuacucgaagguaaagccagaugccagaaug

SEQ ID NO: 499187 - RNA, 64 nt, Human
gagaagagagguaucuguuaaaacauuacugcucuacucgaaacaagauggaagccuaaagccc

SEQ ID NO: 499188 - RNA, 64 nt, Human
uuuccaaaauauuuauauuucaguuuuuuuaugguacucgaaaaaucaaaccuucugaaaauua

SEQ ID NO: 499189 - RNA, 64 nt, Human
aaaaccccuggccuuugggccaggaggaaucuguuacucgaauccacccaggaacucccuggca

SEQ ID NO: 499190 - RNA, 64 nt, Human
gccgggcgugguggugcgugccuguagucccagcuacucgaaagguugaggcaagagaaucgcu

SEQ ID NO: 499191 - RNA, 64 nt, Human; identical to SEQ ID NO: 31718

SEQ ID NO: 499192 - RNA, 64 nt, Human; identical to SEQ ID NO: 31719

SEQ ID NO: 499193 - RNA, 64 nt, Human
cggaagagaggggugcccuaucccuggcaaccccuccacguagcguaccccagcaccugccacc

SEQ ID NO: 499194 - RNA, 64 nt, Human
uuuggggacaaauccacauuggggucuagaaacauccacguaucucaucagccaucuuguccug

SEQ ID NO: 499195 - RNA, 64 nt, Human
acagaauggggacagcaagggcagaaguguccucuccacguaacucauuaugccccuccugggg

SEQ ID NO: 499196 - RNA, 64 nt, Human
caccugacaacacuguugcauuggcaguuaaguuuccacguaaacuuucggggacacauucaaa

SEQ ID NO: 499197 - RNA, 64 nt, Human
gagaguaagucagcaucgguauaaaaucgcuuacuccacguaacucuucuucugauaggguuug

SEQ ID NO: 499198 - RNA, 64 nt, Human
ucagcaccuugcaaagaugcagucaccauagauguccacguagcagagacugacuuaggaucug

SEQ ID NO: 499199 - RNA, 64 nt, Human
gccauacccuggaacuggcccacccacugugucuuccacguaagggagaccuuugcaaagggca

SEQ ID NO: 499200 - RNA, 64 nt, Human
aguggggaaaaaaagguuaacaguaaaaauuucuuccacguaauucaauuucucacaauagaca

SEQ ID NO: 499201 - RNA, 64 nt, Human
ggauucacugacuuguuuuuauauugaaaaaaguuccacguauuguagaaaacguaaauaaacu

SEQ ID NO: 499202 - RNA, 64 nt, Human
ccacccuuuuaagaguuacgcuagcagaucuuacuccacguauacuuuuugguuugugaaggca

SEQ ID NO: 499203 - RNA, 64 nt, Human
cugcccccugacgcugcugauucgggcuguggccuccacguauuuaugcaguacagucugccug

SEQ ID NO: 499204 - RNA, 64 nt, Human
gagccuggggugagcucucuguacauguuguuguuccacguauggguugacuuggcaugcuggg

SEQ ID NO: 499205 - RNA, 64 nt, Human
aacuuguuuucuucauccaaaaaaguuuauuucuuccacguacuuaaauuuucuguguggguau

SEQ ID NO: 499206 - RNA, 64 nt, Human
uccucugauggccaaagcccuggaaucaaggguuuccacguacccugccuaauacccgacguag

SEQ ID NO: 499207 - RNA, 64 nt, Human
uuuuggcacugcuuuggauuggggucaauugcaguccacguaacuggcugcagagaaaucuacc

SEQ ID NO: 499208 - RNA, 64 nt, Human
ucacaacagcugccuggaagagcagcccuaggcuuccacguacugcagccuccagagaguaucu

SEQ ID NO: 499209 - RNA, 64 nt, Human; identical to SEQ ID NO: 31720

SEQ ID NO: 499210 - RNA, 64 nt, Human; identical to SEQ ID NO: 31721

SEQ ID NO: 499211 - RNA, 64 nt, Human; identical to SEQ ID NO: 31722

SEQ ID NO: 499212 - RNA, 64 nt, Human
auguauuuaaacaauaaacuaaaaggaaauaaucuccacguacuaccaucuugauuaaauugug

SEQ ID NO: 499213 - RNA, 64 nt, Human
ugcuugugugucuguguguguggguguauguauguccacguacuagaaaaauuaccugugugag

SEQ ID NO: 499214 - RNA, 64 nt, Human
auguagcaaaaaccuaguaaauucugaaugcuuuuccacguagacuuaucuggaaugugaacac

SEQ ID NO: 499215 - RNA, 64 nt, Human
guauuuauuuuuucacuuguaaaaaaauaauguuuccacguaaagaacucuguuauauccuaga

SEQ ID NO: 499216 - RNA, 64 nt, Human
uggugguauugugggcagagaucuuuaguucaaauccacguauuuuuuaaaagagagaaccgga

SEQ ID NO: 499217 - RNA, 64 nt, Human
gugaaccuuucuaaauguggucuuguucacaugcuccacguagcuguaacuucacaucaucagc

SEQ ID NO: 499218 - RNA, 64 nt, Human
ucugaccugccgcagucaccucucacuuaucucuuccacguacugcacggucguauuucaugag

SEQ ID NO: 499219 - RNA, 64 nt, Human
augaagcccaaauagaaggggucuggcccgggcauccacguagggggcaggggcaggggcgggc

SEQ ID NO: 499220 - RNA, 64 nt, Human
ugauuuuucauugaauucuacaagcuaauauuguuccacguauguagucuuagaccaauagcug

SEQ ID NO: 499221 - RNA, 64 nt, Human
uagguauauccaugaaugcaauuugcauuuaaauuccacguauccuguaguuuuaauuccucau

SEQ ID NO: 499222 - RNA, 64 nt, Human
caaacaaccuuggcuguaaccuauagaaucucuauccacguaucagguuauagacugguuuuuc

SEQ ID NO: 499223 - RNA, 64 nt, Human
gucacaguuauuaauauguuacauuuguuuaguuuccacguaaucuuuaucucuaccuagauuu

SEQ ID NO: 499224 - RNA, 64 nt, Human
ucuugaucagacauucagagauuagucuuagguuuccacguaagucacugaaaacaguaaaaca

SEQ ID NO: 499225 - RNA, 64 nt, Human
uagaauuagcuuuuucauccccuuacccuuagaauccacguauuccccuucccacuagccuagg

SEQ ID NO: 499226 - RNA, 64 nt, Human
gccagcuaugcgccucauccucauugcuucugccuccacguaaaugaaaccaaaggccucagca

SEQ ID NO: 499227 - RNA, 64 nt, Human
guguuuugcuacguuuuuuugauuauuacaccccuccacguauuaugugacucuuacaccaguu

SEQ ID NO: 499228 - RNA, 64 nt, Human; identical to SEQ ID NO: 31723

SEQ ID NO: 499229 - RNA, 64 nt, Human; identical to SEQ ID NO: 31724

SEQ ID NO: 499230 - RNA, 64 nt, Human; identical to SEQ ID NO: 31725

SEQ ID NO: 499231 - RNA, 64 nt, Human
cagguguguucuacaccugcaugagugaaggauuuccacguagacaccuaggaagagcccgcau

SEQ ID NO: 499232 - RNA, 64 nt, Human
accaauguuugcuguuuaaauugcauguucuaauuccacguaucuuccagucucuuuuauaaag

SEQ ID NO: 499233 - RNA, 64 nt, Human
ggcuggcugccuucacagccagcugugaggucaguccacguacccucccagaaauagguuuacg

SEQ ID NO: 499234 - RNA, 64 nt, Human
aaugcugccagagcgauugcggccccucaccuuguccacguaucaggaaugugaaugugggacc

SEQ ID NO: 499235 - RNA, 64 nt, Human
uugcuagucucccuccccggcuuugugcugguauuccacguauuccugcauuaauauugcacac

SEQ ID NO: 499236 - RNA, 64 nt, Human
gcugcaucuauaaugucagcuuauccuaaggcuguccacguacuuaauuuacuuaaguguucau

SEQ ID NO: 499237 - RNA, 64 nt, Human
aggucccauccagauccaacuauagguccaagaguccacguaagcagguuugcaaggcucuaaa

SEQ ID NO: 499238 - RNA, 64 nt, Human
gguuuguuuucuguuuguugguuuguuuguuucuuccacguaaggaaaaguaguguaaacagua

SEQ ID NO: 499239 - RNA, 64 nt, Human
ccgagaaaggucgaugacacagccgcaaaucuaauccacguaguucccauuuacuccuuaaucu

SEQ ID NO: 499240 - RNA, 64 nt, Human
guccaucuuuucuuucaggcauuuucaucugcuguccacguauuucacuugacugaaagcucau

SEQ ID NO: 499241 - RNA, 64 nt, Human
agccagcggccgacaaagcagaaacacccgcugcuccacguagccccugcucgcuguccuugcu

SEQ ID NO: 499242 - RNA, 64 nt, Human
aguuugcaggugcacaaacuaugagggucuuguauccacguaacacagguaguuacaaaaacau

SEQ ID NO: 499243 - RNA, 64 nt, Human
aagugagaggagaucccaucucacacaacacacuuccacguaaugcagaccacacuuuuccauu

SEQ ID NO: 499244 - RNA, 64 nt, Human
cuauaacaaaucauccugucaaguguaaccacuguccacguaguugaacuucugggaucaagaa

SEQ ID NO: 499245 - RNA, 64 nt, Human
uagcgaaagccuacuguaauaugcacccaucucauccacguaguaaagugaacuuaaaaauuca

SEQ ID NO: 499246 - RNA, 64 nt, Human
uuaggcauugagacuucaagcuuuucuuuuuuuguccacguaucuuugggucuuugauaaagaa

SEQ ID NO: 499247 - RNA, 64 nt, Human; identical to SEQ ID NO: 31726

SEQ ID NO: 499248 - RNA, 61 nt, Human; identical to SEQ ID NO: 31727

SEQ ID NO: 499249 - RNA, 64 nt, Human; identical to SEQ ID NO: 31728

SEQ ID NO: 499250 - RNA, 64 nt, Human
caugucaucagucuuaaaaaaaaaauuuuacaaauccacguauuugucccauucuuggaguagu

SEQ ID NO: 499251 - RNA, 64 nt, Human
cugugcuugcuccccgagcucagggauugccgaguccacguaacugaccuguacuccacgaggc

SEQ ID NO: 499252 - RNA, 64 nt, Human
uccugcaaggggcucaacccccuaccccgaccccuccacguaucuuuccuaggcagaucacguu

SEQ ID NO: 499253 - RNA, 64 nt, Human
uccaguauaucuaauaaguguuuuucauauuauuuccacguaagggaaauaagguaguacuuuu

SEQ ID NO: 499254 - RNA, 64 nt, Human
cccccugagguguaauuuuuuuguucuauuuuuuuccacguacuccacagccaacaucacgagg

SEQ ID NO: 499255 - RNA, 64 nt, Human
guuuaagucuguggaaaaggaagcacgggagaaauccacguaaccuuugcuuucuuuuuaaggg

SEQ ID NO: 499256 - RNA, 64 nt, Human; identical to SEQ ID NO: 31729

SEQ ID NO: 499257 - RNA, 64 nt, Human; identical to SEQ ID NO: 31730

SEQ ID NO: 499258 - RNA, 64 nt, Human; identical to SEQ ID NO: 31731

SEQ ID NO: 499259 - RNA, 64 nt, Human; identical to SEQ ID NO: 31732

SEQ ID NO: 499260 - RNA, 64 nt, Human; identical to SEQ ID NO: 31733

SEQ ID NO: 499261 - RNA, 64 nt, Human; identical to SEQ ID NO: 31734

SEQ ID NO: 499262 - RNA, 64 nt, Human; identical to SEQ ID NO: 31735

SEQ ID NO: 499263 - RNA, 64 nt, Human; identical to SEQ ID NO: 31736

SEQ ID NO: 499264 - RNA, 64 nt, Human; identical to SEQ ID NO: 31737

SEQ ID NO: 499265 - RNA, 64 nt, Human; identical to SEQ ID NO: 31738

SEQ ID NO: 499266 - RNA, 64 nt, Human; identical to SEQ ID NO: 31739

SEQ ID NO: 499267 - RNA, 64 nt, Human; identical to SEQ ID NO: 31740

SEQ ID NO: 499268 - RNA, 64 nt, Human; identical to SEQ ID NO: 31741

SEQ ID NO: 499269 - RNA, 64 nt, Human; identical to SEQ ID NO: 31742

SEQ ID NO: 499270 - RNA, 64 nt, Human; identical to SEQ ID NO: 31743

SEQ ID NO: 499271 - RNA, 64 nt, Human; identical to SEQ ID NO: 31744

SEQ ID NO: 499272 - RNA, 64 nt, Human; identical to SEQ ID NO: 31745

SEQ ID NO: 499273 - RNA, 64 nt, Human; identical to SEQ ID NO: 31746

SEQ ID NO: 499274 - RNA, 64 nt, Human; identical to SEQ ID NO: 31747

SEQ ID NO: 499275 - RNA, 64 nt, Human; identical to SEQ ID NO: 31748

SEQ ID NO: 499276 - RNA, 64 nt, Human; identical to SEQ ID NO: 31749

SEQ ID NO: 499277 - RNA, 64 nt, Human; identical to SEQ ID NO: 31750

SEQ ID NO: 499278 - RNA, 64 nt, Human; identical to SEQ ID NO: 31751

SEQ ID NO: 499279 - RNA, 64 nt, Human; identical to SEQ ID NO: 31752

SEQ ID NO: 499280 - RNA, 64 nt, Human; identical to SEQ ID NO: 31753

SEQ ID NO: 499281 - RNA, 62 nt, Human; identical to SEQ ID NO: 31754

SEQ ID NO: 499282 - RNA, 64 nt, Human; identical to SEQ ID NO: 31755

SEQ ID NO: 499283 - RNA, 64 nt, Human; identical to SEQ ID NO: 31756

SEQ ID NO: 499284 - RNA, 64 nt, Human; identical to SEQ ID NO: 31757

SEQ ID NO: 499285 - RNA, 54 nt, Human; identical to SEQ ID NO: 31758

SEQ ID NO: 499286 - RNA, 64 nt, Human; identical to SEQ ID NO: 31759

SEQ ID NO: 499287 - RNA, 64 nt, Human; identical to SEQ ID NO: 31760

SEQ ID NO: 499288 - RNA, 64 nt, Human; identical to SEQ ID NO: 31761

SEQ ID NO: 499289 - RNA, 64 nt, Human; identical to SEQ ID NO: 31762

SEQ ID NO: 499290 - RNA, 64 nt, Human; identical to SEQ ID NO: 31763

SEQ ID NO: 499291 - RNA, 64 nt, Human; identical to SEQ ID NO: 31764

SEQ ID NO: 499292 - RNA, 64 nt, Human; identical to SEQ ID NO: 31765

SEQ ID NO: 499293 - RNA, 64 nt, Human; identical to SEQ ID NO: 31766

SEQ ID NO: 499294 - RNA, 64 nt, Human; identical to SEQ ID NO: 31767

SEQ ID NO: 499295 - RNA, 64 nt, Human; identical to SEQ ID NO: 31768

SEQ ID NO: 499296 - RNA, 64 nt, Human; identical to SEQ ID NO: 31769

SEQ ID NO: 499297 - RNA, 64 nt, Human; identical to SEQ ID NO: 31770

SEQ ID NO: 499298 - RNA, 64 nt, Human; identical to SEQ ID NO: 31771

SEQ ID NO: 499299 - RNA, 64 nt, Human; identical to SEQ ID NO: 31772

SEQ ID NO: 499300 - RNA, 64 nt, Human; identical to SEQ ID NO: 31773

SEQ ID NO: 499301 - RNA, 64 nt, Human; identical to SEQ ID NO: 31774

SEQ ID NO: 499302 - RNA, 64 nt, Human; identical to SEQ ID NO: 31775

SEQ ID NO: 499303 - RNA, 64 nt, Human; identical to SEQ ID NO: 31776

SEQ ID NO: 499304 - RNA, 64 nt, Human; identical to SEQ ID NO: 31777

SEQ ID NO: 499305 - RNA, 64 nt, Human; identical to SEQ ID NO: 31778

SEQ ID NO: 499306 - RNA, 64 nt, Human; identical to SEQ ID NO: 31779

SEQ ID NO: 499307 - RNA, 64 nt, Human; identical to SEQ ID NO: 31780

SEQ ID NO: 499308 - RNA, 64 nt, Human; identical to SEQ ID NO: 31781

SEQ ID NO: 499309 - RNA, 64 nt, Human; identical to SEQ ID NO: 31782

SEQ ID NO: 499310 - RNA, 64 nt, Human; identical to SEQ ID NO: 31783

SEQ ID NO: 499311 - RNA, 64 nt, Human; identical to SEQ ID NO: 31784

SEQ ID NO: 499312 - RNA, 64 nt, Human; identical to SEQ ID NO: 31785

SEQ ID NO: 499313 - RNA, 64 nt, Human; identical to SEQ ID NO: 31786

SEQ ID NO: 499314 - RNA, 64 nt, Human; identical to SEQ ID NO: 31787

SEQ ID NO: 499315 - RNA, 64 nt, Human; identical to SEQ ID NO: 31788

SEQ ID NO: 499316 - RNA, 51 nt, Human; identical to SEQ ID NO: 31789

SEQ ID NO: 499317 - RNA, 64 nt, Human; identical to SEQ ID NO: 31790

SEQ ID NO: 499318 - RNA, 64 nt, Human; identical to SEQ ID NO: 31791

SEQ ID NO: 499319 - RNA, 64 nt, Human; identical to SEQ ID NO: 31792

SEQ ID NO: 499320 - RNA, 64 nt, Human; identical to SEQ ID NO: 31793

SEQ ID NO: 499321 - RNA, 64 nt, Human; identical to SEQ ID NO: 31794

SEQ ID NO: 499322 - RNA, 64 nt, Human; identical to SEQ ID NO: 31795

SEQ ID NO: 499323 - RNA, 64 nt, Human; identical to SEQ ID NO: 31796

SEQ ID NO: 499324 - RNA, 64 nt, Human; identical to SEQ ID NO: 31797

SEQ ID NO: 499325 - RNA, 64 nt, Human; identical to SEQ ID NO: 31798

SEQ ID NO: 499326 - RNA, 64 nt, Human; identical to SEQ ID NO: 31799

SEQ ID NO: 499327 - RNA, 64 nt, Human; identical to SEQ ID NO: 31800

SEQ ID NO: 499328 - RNA, 64 nt, Human; identical to SEQ ID NO: 31801

SEQ ID NO: 499329 - RNA, 64 nt, Human; identical to SEQ ID NO: 31802

SEQ ID NO: 499330 - RNA, 64 nt, Human; identical to SEQ ID NO: 31803

SEQ ID NO: 499331 - RNA, 64 nt, Human; identical to SEQ ID NO: 31804

SEQ ID NO: 499332 - RNA, 64 nt, Human; identical to SEQ ID NO: 31805

SEQ ID NO: 499333 - RNA, 64 nt, Human; identical to SEQ ID NO: 31806

SEQ ID NO: 499334 - RNA, 64 nt, Human; identical to SEQ ID NO: 31807

SEQ ID NO: 499335 - RNA, 64 nt, Human; identical to SEQ ID NO: 31808

SEQ ID NO: 499336 - RNA, 64 nt, Human; identical to SEQ ID NO: 31809

SEQ ID NO: 499337 - RNA, 64 nt, Human; identical to SEQ ID NO: 31810

SEQ ID NO: 499338 - RNA, 64 nt, Human; identical to SEQ ID NO: 31811

SEQ ID NO: 499339 - RNA, 64 nt, Human; identical to SEQ ID NO: 31812

SEQ ID NO: 499340 - RNA, 64 nt, Human; identical to SEQ ID NO: 31813

SEQ ID NO: 499341 - RNA, 64 nt, Human; identical to SEQ ID NO: 31814

SEQ ID NO: 499342 - RNA, 64 nt, Human; identical to SEQ ID NO: 31815

SEQ ID NO: 499343 - RNA, 64 nt, Human; identical to SEQ ID NO: 31816

SEQ ID NO: 499344 - RNA, 64 nt, Human; identical to SEQ ID NO: 31817

SEQ ID NO: 499345 - RNA, 64 nt, Human; identical to SEQ ID NO: 31818

SEQ ID NO: 499346 - RNA, 64 nt, Human; identical to SEQ ID NO: 31819

SEQ ID NO: 499347 - RNA, 64 nt, Human; identical to SEQ ID NO: 31820

SEQ ID NO: 499348 - RNA, 64 nt, Human; identical to SEQ ID NO: 31821

SEQ ID NO: 499349 - RNA, 64 nt, Human; identical to SEQ ID NO: 31822

SEQ ID NO: 499350 - RNA, 64 nt, Human; identical to SEQ ID NO: 31823

SEQ ID NO: 499351 - RNA, 64 nt, Human; identical to SEQ ID NO: 31824

SEQ ID NO: 499352 - RNA, 64 nt, Human; identical to SEQ ID NO: 31825

SEQ ID NO: 499353 - RNA, 64 nt, Human; identical to SEQ ID NO: 31826

SEQ ID NO: 499354 - RNA, 64 nt, Human; identical to SEQ ID NO: 31827

SEQ ID NO: 499355 - RNA, 64 nt, Human; identical to SEQ ID NO: 31828

SEQ ID NO: 499356 - RNA, 64 nt, Human; identical to SEQ ID NO: 31829

SEQ ID NO: 499357 - RNA, 64 nt, Human; identical to SEQ ID NO: 31830

SEQ ID NO: 499358 - RNA, 64 nt, Human; identical to SEQ ID NO: 31831

SEQ ID NO: 499359 - RNA, 64 nt, Human; identical to SEQ ID NO: 31832

SEQ ID NO: 499360 - RNA, 64 nt, Human; identical to SEQ ID NO: 31833

SEQ ID NO: 499361 - RNA, 64 nt, Human; identical to SEQ ID NO: 31834

SEQ ID NO: 499362 - RNA, 64 nt, Human; identical to SEQ ID NO: 31835

SEQ ID NO: 499363 - RNA, 64 nt, Human; identical to SEQ ID NO: 31836

SEQ ID NO: 499364 - RNA, 64 nt, Human; identical to SEQ ID NO: 31837

SEQ ID NO: 499365 - RNA, 64 nt, Human; identical to SEQ ID NO: 31838

SEQ ID NO: 499366 - RNA, 64 nt, Human; identical to SEQ ID NO: 31839

SEQ ID NO: 499367 - RNA, 64 nt, Human; identical to SEQ ID NO: 31840

SEQ ID NO: 499368 - RNA, 64 nt, Human; identical to SEQ ID NO: 31841

SEQ ID NO: 499369 - RNA, 64 nt, Human; identical to SEQ ID NO: 31842

SEQ ID NO: 499370 - RNA, 64 nt, Human; identical to SEQ ID NO: 31843

SEQ ID NO: 499371 - RNA, 56 nt, Human; identical to SEQ ID NO: 31844

SEQ ID NO: 499372 - RNA, 64 nt, Human; identical to SEQ ID NO: 31845

SEQ ID NO: 499373 - RNA, 64 nt, Human; identical to SEQ ID NO: 31846

SEQ ID NO: 499374 - RNA, 64 nt, Human; identical to SEQ ID NO: 31847

SEQ ID NO: 499375 - RNA, 64 nt, Human; identical to SEQ ID NO: 31848

SEQ ID NO: 499376 - RNA, 64 nt, Human
uucaucuccagcuugguguuccauggccccuaggcgaggugaucagggaguggggccaaugggc

SEQ ID NO: 499377 - RNA, 64 nt, Human
ccuguucccugcuccgcuuccccauaccccagcccgaggugaagcccacaccuacacacccucu

SEQ ID NO: 499378 - RNA, 64 nt, Human
cuucuacagaauuuucgucuuuaccuaugugaagcgaggugacgugauacgucacuggcgccgu

SEQ ID NO: 499379 - RNA, 64 nt, Human
ggcucuccagccgcagcucagcugcacugcguuccgaggugaagucuugccccugaauuuugca

SEQ ID NO: 499380 - RNA, 64 nt, Human
ggcucacaccuguaaucccagcacuuugagaggccgaggugagacgggaagauggcuugaacuc

SEQ ID NO: 499381 - RNA, 64 nt, Human
guucccaagccuauuggaggaauguggguguggccgaggugauggcaagaaaggugcaagaaag

SEQ ID NO: 499382 - RNA, 64 nt, Human
gguuuccuaaaggagacgagcgaauuaacggugucgaggugagccagggccagggggaccccgg

SEQ ID NO: 499383 - RNA, 64 nt, Human
acucugcaaaaugggggugucccccgauccuggccgaggugaggaacagacagggggggucuag

SEQ ID NO: 499384 - RNA, 64 nt, Human
caccaccgccacccagcagucagagaggaccuuucgaggugaugcacuguaaauccggcauuga

SEQ ID NO: 499385 - RNA, 64 nt, Human
uuacacuaaguaaguggagggaaugaaaguguuucgaggugaauguggauauaauuucccucuu

SEQ ID NO: 499386 - RNA, 64 nt, Human
ccacccuuugggcucagaggaggguggcuuuuuucgaggugagccauguuguagacacaugaua

SEQ ID NO: 499387 - RNA, 64 nt, Human
ucauuggcgcauuaccccauaaaacuuuuugagacgaggugagaucugaguauaaagauagguc

SEQ ID NO: 499388 - RNA, 64 nt, Human
gaaaaugccaugaauuaccuggauguucuuuuuacgaggugacaagaguuggggacagaacucc

SEQ ID NO: 499389 - RNA, 64 nt, Human
uguccgucagugccagugccugugccagagguggcgaggugaguccuccagagcuuccuggccg

SEQ ID NO: 499390 - RNA, 64 nt, Human
ccuacucuguggaugaugugauuguccuggaaaucgaggugaaaggcucaguagaaccuuucca

SEQ ID NO: 499391 - RNA, 64 nt, Human
gguucgagcccaacuucaugcucuucgagaagugcgaggugaacggugcgggggcgcacccucu

SEQ ID NO: 499392 - RNA, 64 nt, Human
uacaccauaugcaugcacuagaauuauuaacuaacgaggugagguauugcaaauguucaaaaaa

SEQ ID NO: 499393 - RNA, 64 nt, Human
ugauuuagaaaagggacagaucagccccugaagacgaggugaaaagucaauuuuacaauuugua

SEQ ID NO: 499394 - RNA, 64 nt, Human
gagacgcagucaggcgcacgcccgcaagaggcggcgaggugacaaguuuggagugcgcccccuu

SEQ ID NO: 499395 - RNA, 64 nt, Human
cccugaaggggcugcugacugccccagaaucugccgaggugagaacagcauccugaggcacagc

SEQ ID NO: 499396 - RNA, 64 nt, Human
ggcucacgccuguaaucccagcacuuugggaggccgaggugagcggaucaccugaggucaggag

SEQ ID NO: 499397 - RNA, 64 nt, Human
acauccucuauugagaguuacagcaaguguuaaacgaggugaguucacauaacaggaauucugg

SEQ ID NO: 499398 - RNA, 64 nt, Human
gggaaauuuuuaaaaaacuauucucaauuauauacgaggugaugggacuucuuaacacacauuu

SEQ ID NO: 499399 - RNA, 64 nt, Human
aguuuaagaaguauucuaaacuguucuagaugaccgaggugaugaguucacauacacuggaagc

SEQ ID NO: 499400 - RNA, 64 nt, Human
gcugcuggagcccagucaccccgggaccgugggccgaggugacugcagacccucccagggaggc

SEQ ID NO: 499401 - RNA, 64 nt, Human
aucaggcagagaggcugggaugauggagaaagcucgaggugaaguuuuaaaaaaaaaguugugg

SEQ ID NO: 499402 - RNA, 64 nt, Human
ccaacucaggcacaugcuuagcuguaaagggaagcgaggugaagucguccugcagcguauuaga

SEQ ID NO: 499403 - RNA, 52 nt, Human; identical to SEQ ID NO: 425079

SEQ ID NO: 499404 - RNA, 64 nt, Human
ccugugguggagcauacacaggguacucuggggucgaggugagaggugaugugguauucagugc

SEQ ID NO: 499405 - RNA, 64 nt, Human
uggaccugcuuacagagcaagccacgccucuuuccgaggugaaggugggaccauuccuugggaa

SEQ ID NO: 499406 - RNA, 64 nt, Human
uccuuaugguaaauguaaacauguagacugcauucgaggugaccuaaaguagagaggucaugaa

SEQ ID NO: 499407 - RNA, 64 nt, Human
ugccaaagugucccuugggucacacagcuaaagccgaggugaccaguuguaccccgagugccag

SEQ ID NO: 499408 - RNA, 64 nt, Human
gcagaucaggggcucuggggaaacugcuggaacucgaggugaggaucagccuuuuccagcaucc

SEQ ID NO: 499409 - RNA, 64 nt, Human
uggacagagcucaaagaggcccucuuaccgcuagcgaggugauaggacaucuggcuugccacaa

SEQ ID NO: 499410 - RNA, 64 nt, Human
caagggcucugcuggucuuucugagucacagcugcgaggugaugggggcuggggccccaggcgu

SEQ ID NO: 499411 - RNA, 64 nt, Human
gggaauugcacucuuggaagaucccgcauggguucgaggugaggccgcuucagaaccucaaaug

SEQ ID NO: 499412 - RNA, 64 nt, Human
gauucuuggucaggugugcccacagaugcggaggcgaggugagugauuccaucauuucaguucu

SEQ ID NO: 499413 - RNA, 64 nt, Human
gccuggcugcaggccugacuacugcccacaccaacgaggugaucuagcagauacauggcaacgu

SEQ ID NO: 499414 - RNA, 64 nt, Human
accgguggcuucucgcugcgcagccuccagggcccgaggugaucccgguggugggauccacgcu

SEQ ID NO: 499415 - RNA, 64 nt, Human
ugcucauuuucuggucugaccggcggaacccccacgaggugaagccagccuaugccaccaggua

SEQ ID NO: 499416 - RNA, 64 nt, Human
agaugucucaccacaaagaaggaggauaagggagcgaggugauggauauguuaauuagcuugau

SEQ ID NO: 499417 - RNA, 64 nt, Human
caggcacgccuguaaucccagcacuuugggaggccgaggugaaaggaucacuugagcccaggaa

SEQ ID NO: 499418 - RNA, 64 nt, Human
cugcagauaacccuauacauuaauacugguaucucgaggugacucuucugaccaagggugguua

SEQ ID NO: 499419 - RNA, 64 nt, Human
gguguguauauauaaaagguuguguacaacuccacgaggugaaaaauauucaguaacuuguuua

SEQ ID NO: 499420 - RNA, 64 nt, Human
cucccaguauggccccaccugcucuuuccucccccgaggugaggccccgccugcucuuuccucc

SEQ ID NO: 499421 - RNA, 64 nt, Human
caccuugcuccccgggaacccauggaaggagaagcgaggugaugcagcagcaggggcaagaccc

SEQ ID NO: 499422 - RNA, 64 nt, Human
caagaaauaggaaaccccccaaugucuguugaacagcuaucacguugaaccacgugaaacugcu

SEQ ID NO: 499423 - RNA, 64 nt, Human
aguuuuugccacuguaaauaaaaacaguauccguagcuaucaggaucauugcgcacucauauau

SEQ ID NO: 499424 - RNA, 64 nt, Human
gggcgcuguuuucucagcuccaauuucaagagugagcuaucaaacccagagcggaaggagggag

SEQ ID NO: 499425 - RNA, 64 nt, Human
uuguaggucuuuacuagugcuaaguauuauggugagcuaucauuaaagugugccaucuuggaua

SEQ ID NO: 499426 - RNA, 64 nt, Human
aucuuuuuguaguuugagaauagaccuauucaagagcuaucaggguuaaaagcugcacugacca

SEQ ID NO: 499427 - RNA, 64 nt, Human
cccagcccugggaaccacucccaccacaggcauaagcuaucaccuagcagccucaaaacggguc

SEQ ID NO: 499428 - RNA, 64 nt, Human
gcuuauuccauggaacaagaauuaaaaaugaauaagcuaucaauauauaauuuaaguacaaguu

SEQ ID NO: 499429 - RNA, 64 nt, Human
agcugcuucguggagguaacuucaaaaaaguaaaagcuaucaucagcaucaucuuagacuugua

SEQ ID NO: 499430 - RNA, 64 nt, Human
uuuuuguucggaguucuauacuaucagcccagaaagcuaucaauguccaagugaagugagauga

SEQ ID NO: 499431 - RNA, 64 nt, Human
guguugucuuccagagucaugaaugauuuuguuuagcuaucaggucuacuaccucuaaggacau

SEQ ID NO: 499432 - RNA, 64 nt, Human
ccccacaccuuucacggacacugacaagauccagagcuaucaauaccucaguuaugcaaccuua

SEQ ID NO: 499433 - RNA, 64 nt, Human
cuccugguuuccuuucucauuucuuucuaacuguagcuaucauuacuggcuguggauagcccau

SEQ ID NO: 499434 - RNA, 64 nt, Human
acaaccaaaauccuuuuguuaguuucaguaccucagcuaucaacauuucugagcuaccauucaa

SEQ ID NO: 499435 - RNA, 64 nt, Human
uguguuaaugaguagugaaaugaugcggaaagacagcuaucaggaagaggaaauacagaagccu

SEQ ID NO: 499436 - RNA, 64 nt, Human
gaaauuucauuuuuagauuaaacugugauggaugagcuaucauaauucaaguauacauuucuuu

SEQ ID NO: 499437 - RNA, 64 nt, Human
cugacauggaccuacugcauaaaguuguagcuccagcuaucaggaugucccugaaacuucacca

SEQ ID NO: 499438 - RNA, 64 nt, Human
cauuguacuuucuagcccuaauuugugagguugcagcuaucauuauauucugcauguauguaua

SEQ ID NO: 499439 - RNA, 64 nt, Human
gacacaacaguacagaaauaagugcuaauuucaaagcuaucauuuucuauuuuucuaagauaaa

SEQ ID NO: 499440 - RNA, 64 nt, Human
cuuucuugguaauuuagaugugaaaccucuacagagcuaucauguaaaaacuacauaagguggu

SEQ ID NO: 499441 - RNA, 64 nt, Human
cugaaaaauaagugauuucaguaaccuucuggaaagcuaucaguuucaaauaauauuuucucug

SEQ ID NO: 499442 - RNA, 57 nt, Human
cucuuuugguuuuuagguagaaacuggagcuaucaauauuuucauguaaguauuuca

SEQ ID NO: 499443 - RNA, 64 nt, Human
uucccugugauugcccuguuaaguauuuaaccauagcuaucauguguuucccaaaucuucucua

SEQ ID NO: 499444 - RNA, 64 nt, Human
uuuugaaaacagauuugguaucauucuaaaguuuagcuaucaagcacucaccauugugaagaau

SEQ ID NO: 499445 - RNA, 64 nt, Human
uauuacuucucacuuuauaucuuauauucuaaauagcuaucaccucagcagucuuuugccuauu

SEQ ID NO: 499446 - RNA, 64 nt, Human
acacauaauggcagcucacacagggacgugacagagcuaucauuaugcacuugggagaaaauua

SEQ ID NO: 499447 - RNA, 64 nt, Human
aaaaauugauuguggugccucaggugaaaugagaagcuaucaguaacagcuacucucaucgaaa

SEQ ID NO: 499448 - RNA, 64 nt, Human
ucgcagcugcccuagcaaggggagacauugugguagcuaucagacauggacagaaacugacuua

SEQ ID NO: 499449 - RNA, 64 nt, Human
acacuauuaaugacaggagucaaucagccuuuacagcuaucaaaauauaaugagaucccaauga

SEQ ID NO: 499450 - RNA, 64 nt, Human
uugaguugcuucaugguuuaugcucgccauggaaagcuaucaguaacaguuucaugcuuauacc

SEQ ID NO: 499451 - RNA, 64 nt, Human
cacuuuuuaaaagacguauauucaacauaaaaucagcuaucagacuucagauuagacuuuauuu

SEQ ID NO: 499452 - RNA, 64 nt, Human
aaugcuuguacuagaccaccucauuuggauauauagcuaucacauuuguaagauucuguuuuua

SEQ ID NO: 499453 - RNA, 64 nt, Human
ccucacuacuggcuugguuuggucuacuggaagcagcuaucaaccgacuuuguucuuccaaguc

SEQ ID NO: 499454 - RNA, 64 nt, Human
gugaaaaugaaguagcugugagaauaccugucccagcuaucaaugagcacaacauuucaguaga

SEQ ID NO: 499455 - RNA, 64 nt, Human
uguacauuauaaaccuucagaagcuauuuuuuuaagcuaucagcaauacucaucagagcagcua

SEQ ID NO: 499456 - RNA, 64 nt, Human
gaagaaauaagugcauucuucugcuuuucaccccagcuaucaauacaugcaucuuuaucagcag

SEQ ID NO: 499457 - RNA, 64 nt, Human
gcauauccaucuuggauucaauccaaggugcuuuagcuaucaguaguaccaaaggaucuuuuua

SEQ ID NO: 499458 - RNA, 64 nt, Human
aagaagaacaggaaaagagaugaaguggcaguugagcuaucacuauggcaaaaacauaaauauu

SEQ ID NO: 499459 - RNA, 64 nt, Human
uuuuuguaagucaaaagugauuaagaggaguuuaagcuaucauuuccagauguauuucuauaaa

SEQ ID NO: 499460 - RNA, 64 nt, Human
uaagaaaaauuguguaaauuuguaccuugaauuuagcuaucaaccuaauuuuccucuuaguugg

SEQ ID NO: 499461 - RNA, 64 nt, Human
cugaucuccauaaauuacuuagucuucuauguauagcuaucaaggaaauaaaaccaauuuugcc

SEQ ID NO: 499462 - RNA, 64 nt, Human
accacauguaucacgggucacuugaaauucuuucagcuaucaguaggcuaaugucaaaauuguu

SEQ ID NO: 499463 - RNA, 64 nt, Human
auuguaauuacucucuguguguuuuuuuauugcuagcuaucauuaccaguuagaauuaacauua

SEQ ID NO: 499464 - RNA, 64 nt, Human
cauaaagaucaauucauugauuuguuuuuuguaaagcuaucauucaauauauauuauaaauuaa

SEQ ID NO: 499465 - RNA, 64 nt, Human
aguaauuauuuuuaaaguucuuauacuuuuuaaaagcuaucacacaaagacuuuuuuuuuuuuu

SEQ ID NO: 499466 - RNA, 64 nt, Human
ggucacuaaaucauuggcguuuauaaagauucuuagcuaucaagggcugcauuguauuuuauau

SEQ ID NO: 499467 - RNA, 64 nt, Human
uuuaaggcacccagacauaagggucaacaggguuagcuaucacuguccaguuuggugggaggaa

SEQ ID NO: 499468 - RNA, 64 nt, Human
guauuuuuguacauaaagaguuuauucuauuaugagcuaucaaaguuuacauuuuuguacugca

SEQ ID NO: 499469 - RNA, 64 nt, Human
aaauucauaucauaaagucaguuguauuccuugaagcuaucaucguguguacuuggcugguacu

SEQ ID NO: 499470 - RNA, 64 nt, Human
cauuucauuuucuuaaggcacacuuccuacacacagcuaucaggggaaaaagcuauaaaugucc

SEQ ID NO: 499471 - RNA, 64 nt, Human
aaaauggguuggugcuucuaaccugauggcacuuagcuaucagaagaccacaaaaauugacuca

SEQ ID NO: 499472 - RNA, 64 nt, Human
gcugauuuuucuuuuuuuuaaguucuauuuuaaaagcuaucaaacagcgacauagccauacauc

SEQ ID NO: 499473 - RNA, 64 nt, Human
ggaccaagacgcuguuacgcaggcccuucuuuccagcuaucagcacuuucagcaucggcucuuc

SEQ ID NO: 499474 - RNA, 64 nt, Human
gacuacuuuaucugaggccagaacucucacacacagcuaucaagugcuaaguuuaaaauaauca

SEQ ID NO: 499475 - RNA, 64 nt, Human
cauuaggcauacuuucagaagcaaccuggagaacagcuaucaaucauauucaaaaccaguacaa

SEQ ID NO: 499476 - RNA, 64 nt, Human
aggaccccaaaaagcuuuuggguauguggguuauagcuaucaauauuuaugguacuagaacuua

SEQ ID NO: 499477 - RNA, 64 nt, Human
uuacagacugaaaaaugucucauacauauuuugcagcuaucaugauccuaguucaaugcuaggc

SEQ ID NO: 499478 - RNA, 64 nt, Human
gaauuugcuuuaugugcuggaaaaaacaucacauagcuaucacagggccuggaccucuaaaauu

SEQ ID NO: 499479 - RNA, 64 nt, Human
ucugaaggcagacuucauucugaggcuuuggacaagcuaucaccgggaacccucccuguccccu

SEQ ID NO: 499480 - RNA, 64 nt, Human
uuuuaauuuguguauauuugggaugauauuuaggagcuaucaaucaaauuuuacaucucacaau

SEQ ID NO: 499481 - RNA, 64 nt, Human
gaauguaauuuuuauuuucugaaauacagauuugagcuaucagaccaacaaaccuucccccuga

SEQ ID NO: 499482 - RNA, 64 nt, Human
uccaccuaauauuauugaagacaauuauuuucuuagcuaucaauaggcuuaauaguuuuaguua

SEQ ID NO: 499483 - RNA, 64 nt, Human
cuacuugauauugaaaucuccuucagccauuagaagcuaucaaauaaaguagguguaaaaacaa

SEQ ID NO: 499484 - RNA, 64 nt, Human
cuuauuuccuucaggaagauccuuuuccacaggaagcuaucaaagaaaaguaaacuagacacca

SEQ ID NO: 499485 - RNA, 64 nt, Human
uuuuagaguaauuagcaaucaaacauuuucuuugagcuaucaaagcuccauauucucuuguccu

SEQ ID NO: 499486 - RNA, 64 nt, Human
ucuuuugugugaauuacugaauauuucagagcaaagcuaucaacuuggagaaacagggauuaaa

SEQ ID NO: 499487 - RNA, 64 nt, Human
acccaucuuggaggcugauuacuuacugcaccaaagcuaucacuggggugagauuuacuguuug

SEQ ID NO: 499488 - RNA, 64 nt, Human
uacaugguauuguaaugaauaucugcuuuaauauagcuaucauuucuuuuccaaaauuacuucu

SEQ ID NO: 499489 - RNA, 64 nt, Human
aauuggaagagacuucaaagacugucaaguggaaagcuaucauuuccuaaauuaaggaacuuag

SEQ ID NO: 499490 - RNA, 64 nt, Human
ucccucugcccucuguaaauguguugagugauauagcuaucagauguauugaaggcaaaguucu

SEQ ID NO: 499491 - RNA, 64 nt, Human
aaaaauggaaggaacuuauauaacaagugagcauagcuaucaaaagccacaaaguuuuggucag

SEQ ID NO: 499492 - RNA, 64 nt, Human
cuucauauuaauuucuaguacagaaaaucuugacagcuaucagaaugccuuggucauaguguug

SEQ ID NO: 499493 - RNA, 64 nt, Human
ugaggaacaggauccacuuugaacaguccgcuaaagcuaucaaaaaaaaguccaaaugacagau

SEQ ID NO: 499494 - RNA, 64 nt, Human
gcuugaugcccagccccguuuuaaggacauuaaaagcuaucaggccaagaccccagcuucauua

SEQ ID NO: 499495 - RNA, 64 nt, Human
auuuccucaucugcuaauauaaguguacagcugcagcuaucaaggcuauaagagaaaguggaau

SEQ ID NO: 499496 - RNA, 64 nt, Human
uuauaccuugguacggugcagugauaucauuaagagcuaucaauauguguagggcuuggcuugg

SEQ ID NO: 499497 - RNA, 64 nt, Human
aguuacagauguuuugacuuugaugaggauauuuagcuaucaaucuaauagucaccuaaaauau

SEQ ID NO: 499498 - RNA, 64 nt, Human
uacaaacugggugagcacuacugcaucauuguucagcuaucauugcuugcacguaauuucauuu

SEQ ID NO: 499499 - RNA, 64 nt, Human
ccuucuugaccacggcagccuccugucuucuaggagcuaucaagggucucuaagaacugggcau

SEQ ID NO: 499500 - RNA, 64 nt, Human
ucuucacccacccuacaguuugcuaacuccuugaagcuaucaaauuaguaagaccaucuaucac

SEQ ID NO: 499501 - RNA, 64 nt, Human
gcaagauacacuugaaauuuaaauggacauuacaagcuaucaaauucuacaugacacaggacau

SEQ ID NO: 499502 - RNA, 64 nt, Human
ucauuaaugugcauauaucauuauuuucagaugcagcuaucauuauuccaaaauacaaaauaaa

SEQ ID NO: 499503 - RNA, 64 nt, Human
auaaccccagagggcgcucagccaagcuuagagcagcuaucaaauuauaaguuaucaucaucuu

SEQ ID NO: 499504 - RNA, 64 nt, Human
aguuauuaaaucuucugauaauauauguuuacuuagcuaucagaagccaaguaugauucuuuau

SEQ ID NO: 499505 - RNA, 64 nt, Human
uugaaguagcacagcccguccuugcaugugcacgagcuaucauuugaguaaaaguauacaugga

SEQ ID NO: 499506 - RNA, 64 nt, Human
cccacucccuacccuuaauccccacaugggaagaagcuaucaucacagguacaaacaucgcuug

SEQ ID NO: 499507 - RNA, 64 nt, Human
ucuauauaaauugucuggcugaggcagggccuucagcuaucauuugguuaauaaauacauuuua

SEQ ID NO: 499508 - RNA, 64 nt, Human
gcccugcacuuucuucacuguguucaagugucauagcuaucaggccacuaucauggauaucaug

SEQ ID NO: 499509 - RNA, 64 nt, Human
ucuggaauuuuuuuguaauuuuuuaaaucuuagcagcuaucauuaguguuuguguauuuuaugu

SEQ ID NO: 499510 - RNA, 64 nt, Human
cauaggacucuagguuaugagagcugaaccacauagcuaucaguuucaguuuuuacuuccuauu

SEQ ID NO: 499511 - RNA, 64 nt, Human
ugggucuccguguuuaugagucacagauuuugaaagcuaucaggaaaugacuagaguggauccu

SEQ ID NO: 499512 - RNA, 64 nt, Human
gauuggggguuggaccagagugauguccucucucagcuaucacaucacaagauaaugcuggcuc

SEQ ID NO: 499513 - RNA, 64 nt, Human
uaauacuuccagaagugcgggguaggggaagaagagcuaucaggagaaagcuugguucugugaa

SEQ ID NO: 499514 - RNA, 64 nt, Human
aggaauguuagaggaagucuuugucagcccuuauagcuaucaugugaauaaaguuaagucaacu

SEQ ID NO: 499515 - RNA, 64 nt, Human
agaggagcacuugucuccccagggcugccauggcagcuaucaggggaauagaagggagaaagag

SEQ ID NO: 499516 - RNA, 64 nt, Human
uuuugaauuuuauuuuuaggaaaauucugaagccagcuaucacagguuuguuagcuaauaauag

SEQ ID NO: 499517 - RNA, 64 nt, Human
guccuguauuuacaguuguuuuugacuaugcaggagcuaucagugcuagagugagcaugcuuca

SEQ ID NO: 499518 - RNA, 64 nt, Human
auuagcugggcauggugcgggcaccuguaguccuagcuaucaagaggcugagacaggagaaaca

SEQ ID NO: 499519 - RNA, 64 nt, Human
cgagacuccgucucaaaaaaaaaaaaaugcacauagcuaucaagugugcuuuagcuugaaaagg

SEQ ID NO: 499520 - RNA, 64 nt, Human
uauuuuuuugugacguguauuuuuugugacuugaagcuaucauauagauccuguauuucugaua

SEQ ID NO: 499521 - RNA, 64 nt, Human
cucagaacaucaaacaaaaaugcccugguggcaaagcuaucaccauuuaaugucuucucucagu

SEQ ID NO: 499522 - RNA, 64 nt, Human
cugcucauuguggccaguuuagaguucuauuagaagcuaucaaucaccuugcauuucaaaaugg

SEQ ID NO: 499523 - RNA, 64 nt, Human
cucauugucuuguuauguacaaacuaguuuuuauagcuaucaacauuaggaguaacuuucaacc

SEQ ID NO: 499524 - RNA, 64 nt, Human
ggaggggacgucuuauuaacaaacgggggcgcauagcuaucaccuguagcucccucccuaccug

SEQ ID NO: 499525 - RNA, 64 nt, Human
auauaagaaugaucuaauauuuuuuuaaaguaauagcuaucaguaauagcugaguguuuuuucc

SEQ ID NO: 499526 - RNA, 64 nt, Human
guaggaucacuugagucuaggaguucggggcugcagcuaucaucugcagcuauaaucauagcuc

SEQ ID NO: 499527 - RNA, 64 nt, Human
auaaaaggaaauuuuagcaaggauuaaagaaaaaagcuaucagcuguauguuaagagagacucu

SEQ ID NO: 499528 - RNA, 64 nt, Human
aaagcgagagagacuauugccauaugaacucaaaagcuaucaugguguucacucuacauaucag

SEQ ID NO: 499529 - RNA, 64 nt, Human
auuuuaaauuguuuaaauaucuggaaauacuuuuagcuaucauuuauaaagauaguuuuguucu

SEQ ID NO: 499530 - RNA, 64 nt, Human
augaugaaucuagucugaaucagcuguuauuccaagcuaucaugcuuaagcuaugucaacagca

SEQ ID NO: 499531 - RNA, 64 nt, Human
cugauggccaugaaaggacaaguauggagaugaaagcuaucacacugagaauagugggauguag

SEQ ID NO: 499532 - RNA, 64 nt, Human
uucauggacauuucaugucaggauugcaagcauuagcuaucacagcaaaggauuccuagccuau

SEQ ID NO: 499533 - RNA, 64 nt, Human
guuuuauauuauaauagaaagccagccacugcuuagcuaucauagucaccauuuucucacuguu

SEQ ID NO: 499534 - RNA, 64 nt, Human
uauauauauuccuaaagcuugguggagguaguggagcuaucacacacucaaaugagcuuguaua

SEQ ID NO: 499535 - RNA, 64 nt, Human
augaugggcuaaacaggcaacuuuucaaaaacacagcuaucauagaaaagaaacuugccucaug

SEQ ID NO: 499536 - RNA, 64 nt, Human
uggauuauuuaauaaacagcacuuuuagacaacuagcuaucaaagcuagaucucagcugggugc

SEQ ID NO: 499537 - RNA, 64 nt, Human
uuaaaagucucuguagacaucucugugaagagcaagcuaucauuaaacaugucuguuuaucagc

SEQ ID NO: 499538 - RNA, 64 nt, Human
gaaagaguggcaugguccacccucucaagggccuagcuaucaugauacgaggcgaaugggugac

SEQ ID NO: 499539 - RNA, 64 nt, Human
ucuuuuuuguuuaggcauguucaauuaaugcuguagcuaucauagcuuugcucuuaccugaagc

SEQ ID NO: 499540 - RNA, 64 nt, Human
cuugugcucccaaagugcugagauuacaggcgugagcuaucacacccagccucccccuuuuuuu

SEQ ID NO: 499541 - RNA, 64 nt, Human
cuucuguguauugcuuuuaagagagccaucaguuagcuaucagacucuagguugaugcauuuug

SEQ ID NO: 499542 - RNA, 64 nt, Human
gggccccccugccccaccgcacccccagaauauaagcuaucaagaguauuaauuuauugggaau

SEQ ID NO: 499543 - RNA, 64 nt, Human
guagggagaauaaugucuaguaauguggaagaauagcuaucauuccugucucuguggcacccga

SEQ ID NO: 499544 - RNA, 64 nt, Human
uuugaggguuugggaugggagaaguauuuugcagagcuaucaauguccaaauaauuuaaaaaaa

SEQ ID NO: 499545 - RNA, 64 nt, Human
cucugcuucaguccacaguacauaaaauguacucagcuaucagcucuauaagagcuggaugcac

SEQ ID NO: 499546 - RNA, 64 nt, Human
gguuucuggggccucaggguucugggaaagcaacagcuaucagagagagaagggccagacccca

SEQ ID NO: 499547 - RNA, 64 nt, Human
uguugagacuccguaaucucaaguucucuuugugagcuaucagcaucugccagucucuuguccu

SEQ ID NO: 499548 - RNA, 64 nt, Human
aaguguuuuuuaaauaaaacaaaucucauuguaaagcuaucagucauuuaguagaauagaaaag

SEQ ID NO: 499549 - RNA, 64 nt, Human
acagaaaugguacugauggccucucauacaauggagcuaucauaguuucugguaaacaaaaggu

SEQ ID NO: 499550 - RNA, 64 nt, Human
uuuuugcacucagugaaaagcugaagugcaaaagagcuaucaaagacaagaggauaaaagacug

SEQ ID NO: 499551 - RNA, 64 nt, Human
cuuggccucccaaagugcugggaucacaggcgugagcuaucacaccuggccccagaaguguuuc

SEQ ID NO: 499552 - RNA, 64 nt, Human
cuguaguauucuuuggggugccccucuccuucuuagcuaucauugcuuccuccuccccaacugu

SEQ ID NO: 499553 - RNA, 64 nt, Human
aacccacuguucuuguauuguauugcccagggggagcuaucacuguacuuguagaguggugcug

SEQ ID NO: 499554 - RNA, 64 nt, Human
ugaugauuuccuagcaggacuuacagaaauaaagagcuaucaugcugugguuuauuaugguuug

SEQ ID NO: 499555 - RNA, 64 nt, Human
caucaugcaccagaggacgcaugucggugggaagagcuaucagugugacguguauuaagccagc

SEQ ID NO: 499556 - RNA, 64 nt, Human
aacccacuguucuacuguuguauugcccaguaggagcuaucacuauauuuugcagaauggaaac

SEQ ID NO: 499557 - RNA, 64 nt, Human
ucucagaugggugcugaaauauuuuaauaaucagagcuaucauagacaaaacauuuguuuuaua

SEQ ID NO: 499558 - RNA, 64 nt, Human
gcugaugagggcaccucuugugcugaguccccucagcuaucaguguucuucucaaggacacauu

SEQ ID NO: 499559 - RNA, 64 nt, Human
cagggucgaaucuggaaugggagggucuggcuucagcuaucagggcacccuccccagggauugg

SEQ ID NO: 499560 - RNA, 64 nt, Human
uggguucaggggacucagcccugaggugaaagggagcuaucaggaacagcuaugggagccccag

SEQ ID NO: 499561 - RNA, 64 nt, Human
uacucuugauaaaagcuguugcaggccuuugcuaagcuaucaaaguaacguauuaauuuuguau

SEQ ID NO: 499562 - RNA, 64 nt, Human
gucaccacggggccugcuucuuaucugacacagcagcuaucagagucuagugguugugcuuuua

SEQ ID NO: 499563 - RNA, 64 nt, Human
aggugggaaaccuccucucauuuguggcuuagagagcuaucaccauuucagaacuaugaugcuu

SEQ ID NO: 499564 - RNA, 64 nt, Human
aaaacaaacaaacaaaaaaaaaaucuguuagauaagcuaucaaaaugcagcuguuguuuuguuu

SEQ ID NO: 499565 - RNA, 64 nt, Human
ucugaguaaaggcaggcuguuaucuuuagaaucaagcuaucacagggagauaggcaaugcugug

SEQ ID NO: 499566 - RNA, 64 nt, Human
gcuguccuugaggaaccuuugguguguggugggaagcuaucagaacaagaaauguaggcauuuc

SEQ ID NO: 499567 - RNA, 64 nt, Human
uguuauaaauacucacaggauaccuuauuucccuagcuaucaucuccugacuuaauguuuuuua

SEQ ID NO: 499568 - RNA, 64 nt, Human
uaguaucaauauuguuucaacuugauguccucuaagcuaucauccaguuacccaagauguccca

SEQ ID NO: 499569 - RNA, 64 nt, Human
aucagaaucuaaaugaaaauagcgaacauuuaaaagcuaucaccauuguaguagaaucauccuu

SEQ ID NO: 499570 - RNA, 64 nt, Human
ugcuugaaagucuucugaagucugaugugaauugagcuaucaagcaaugcuaucauagcacagu

SEQ ID NO: 499571 - RNA, 64 nt, Human
gugugcuagaugaaaagcgugcaauaugcuuuaaagcuaucaacaaaaacugaauauuauaagc

SEQ ID NO: 499572 - RNA, 64 nt, Human
gcagagcugagggauguggucagcaguccccaccagcuaucagauaaggcaaacuacccugccc

SEQ ID NO: 499573 - RNA, 64 nt, Human
auaagaucaucuaccuauaauuugaauaauuuugagcuaucaaaaugucuuuguaauuuucaca

SEQ ID NO: 499574 - RNA, 64 nt, Human; identical to SEQ ID NO: 31106

SEQ ID NO: 499575 - RNA, 64 nt, Human; identical to SEQ ID NO: 31107

SEQ ID NO: 499576 - RNA, 64 nt, Human; identical to SEQ ID NO: 31108

SEQ ID NO: 499577 - RNA, 64 nt, Human; identical to SEQ ID NO: 31109

SEQ ID NO: 499578 - RNA, 64 nt, Human; identical to SEQ ID NO: 31110

SEQ ID NO: 499579 - RNA, 64 nt, Human; identical to SEQ ID NO: 31111

SEQ ID NO: 499580 - RNA, 64 nt, Human; identical to SEQ ID NO: 31112

SEQ ID NO: 499581 - RNA, 64 nt, Human; identical to SEQ ID NO: 31113

SEQ ID NO: 499582 - RNA, 64 nt, Human; identical to SEQ ID NO: 31114

SEQ ID NO: 499583 - RNA, 64 nt, Human; identical to SEQ ID NO: 31115

SEQ ID NO: 499584 - RNA, 64 nt, Human; identical to SEQ ID NO: 31116

SEQ ID NO: 499585 - RNA, 62 nt, Human
ccugcuggaaagauagcaguguucuccugacuucgcccuacugcaugcagccaaauaaaagg

SEQ ID NO: 499586 - RNA, 62 nt, Human
acguguuggaaaaaccaaguggcuuugggguuucgcccuaucccacucccucucuuuccugc

SEQ ID NO: 499587 - RNA, 62 nt, Human
ugugauaguucagucccagggaaagagaaaacucgcccuaggcccuaggugggaagaugguu

SEQ ID NO: 499588 - RNA, 64 nt, Human; identical to SEQ ID NO: 31117

SEQ ID NO: 499589 - RNA, 64 nt, Human; identical to SEQ ID NO: 31118

SEQ ID NO: 499590 - RNA, 64 nt, Human; identical to SEQ ID NO: 31119

SEQ ID NO: 499591 - RNA, 64 nt, Human; identical to SEQ ID NO: 31120

SEQ ID NO: 499592 - RNA, 64 nt, Human; identical to SEQ ID NO: 31121

SEQ ID NO: 499593 - RNA, 64 nt, Human; identical to SEQ ID NO: 31122

SEQ ID NO: 499594 - RNA, 64 nt, Human; identical to SEQ ID NO: 31123

SEQ ID NO: 499595 - RNA, 64 nt, Human; identical to SEQ ID NO: 31124

SEQ ID NO: 499596 - RNA, 64 nt, Human; identical to SEQ ID NO: 31125

SEQ ID NO: 499597 - RNA, 64 nt, Human; identical to SEQ ID NO: 31126

SEQ ID NO: 499598 - RNA, 64 nt, Human; identical to SEQ ID NO: 31127

SEQ ID NO: 499599 - RNA, 64 nt, Human; identical to SEQ ID NO: 31128

SEQ ID NO: 499600 - RNA, 64 nt, Human; identical to SEQ ID NO: 31129

SEQ ID NO: 499601 - RNA, 64 nt, Human; identical to SEQ ID NO: 31130

SEQ ID NO: 499602 - RNA, 64 nt, Human; identical to SEQ ID NO: 31131

SEQ ID NO: 499603 - RNA, 62 nt, Human
caggaguauauaaaaaagaaagaaaacaaaacucgcccuacaggaagaaaaggauucuccuc

SEQ ID NO: 499604 - RNA, 62 nt, Human
guuuccaaaacauuuacauauugaucuacuccucgcccuagaccaaaccuaauuccauucuu

SEQ ID NO: 499605 - RNA, 62 nt, Human
ugaguucacgaauuaggggcaggagcuggaagucgcccuaggaacaccagauuuccugguuc

SEQ ID NO: 499606 - RNA, 64 nt, Human; identical to SEQ ID NO: 31132

SEQ ID NO: 499607 - RNA, 64 nt, Human; identical to SEQ ID NO: 31133

SEQ ID NO: 499608 - RNA, 64 nt, Human; identical to SEQ ID NO: 31134

SEQ ID NO: 499609 - RNA, 64 nt, Human; identical to SEQ ID NO: 31135

SEQ ID NO: 499610 - RNA, 64 nt, Human; identical to SEQ ID NO: 31136

SEQ ID NO: 499611 - RNA, 64 nt, Human; identical to SEQ ID NO: 31137

SEQ ID NO: 499612 - RNA, 64 nt, Human; identical to SEQ ID NO: 31138

SEQ ID NO: 499613 - RNA, 64 nt, Human; identical to SEQ ID NO: 31139

SEQ ID NO: 499614 - RNA, 64 nt, Human; identical to SEQ ID NO: 31140

SEQ ID NO: 499615 - RNA, 64 nt, Human; identical to SEQ ID NO: 31141

SEQ ID NO: 499616 - RNA, 64 nt, Human; identical to SEQ ID NO: 31142

SEQ ID NO: 499617 - RNA, 64 nt, Human; identical to SEQ ID NO: 31143

SEQ ID NO: 499618 - RNA, 64 nt, Human; identical to SEQ ID NO: 31144

SEQ ID NO: 499619 - RNA, 64 nt, Human; identical to SEQ ID NO: 31145

SEQ ID NO: 499620 - RNA, 64 nt, Human; identical to SEQ ID NO: 31146

SEQ ID NO: 499621 - RNA, 62 nt, Human
aaacuagcuggagcuuggaugaaacucaguagucgcccuaagcaugguuaaaccgcgcccug

SEQ ID NO: 499622 - RNA, 62 nt, Human
cccugaguccugagcgaaaacaggagaguuagucgcccuacagaaaacccagcuagacuauu

SEQ ID NO: 499623 - RNA, 62 nt, Human
gccucugcuccccaggggaguugugucuguaaucgcccuacuauucaguggcgagaaauaaa

SEQ ID NO: 499624 - RNA, 64 nt, Human; identical to SEQ ID NO: 31147

SEQ ID NO: 499625 - RNA, 64 nt, Human; identical to SEQ ID NO: 31148

SEQ ID NO: 499626 - RNA, 64 nt, Human; identical to SEQ ID NO: 31149

SEQ ID NO: 499627 - RNA, 64 nt, Human; identical to SEQ ID NO: 31150

SEQ ID NO: 499628 - RNA, 64 nt, Human; identical to SEQ ID NO: 31151

SEQ ID NO: 499629 - RNA, 64 nt, Human; identical to SEQ ID NO: 31152

SEQ ID NO: 499630 - RNA, 64 nt, Human; identical to SEQ ID NO: 31153

SEQ ID NO: 499631 - RNA, 50 nt, Human; identical to SEQ ID NO: 31154

SEQ ID NO: 499632 - RNA, 64 nt, Human; identical to SEQ ID NO: 31155

SEQ ID NO: 499633 - RNA, 64 nt, Human; identical to SEQ ID NO: 31156

SEQ ID NO: 499634 - RNA, 64 nt, Human; identical to SEQ ID NO: 31157

SEQ ID NO: 499635 - RNA, 64 nt, Human; identical to SEQ ID NO: 31158

SEQ ID NO: 499636 - RNA, 64 nt, Human; identical to SEQ ID NO: 31159

SEQ ID NO: 499637 - RNA, 64 nt, Human; identical to SEQ ID NO: 31160

SEQ ID NO: 499638 - RNA, 62 nt, Human
uccuuccccaagagaggaaauaaaagccaccuucgcccuagggccaagaguugggccccguc

SEQ ID NO: 499639 - RNA, 62 nt, Human
accuucccguuggucggaaacuuuuccaucugucgcccuagaaaaagagaaagcuuaccauc

SEQ ID NO: 499640 - RNA, 62 nt, Human
ucaagugagguaaauucacccaucacagggucucgcccuaccauccuggaauuauuucacuu

SEQ ID NO: 499641 - RNA, 62 nt, Human
acagagggcucccggucagcuucccaggcccuucgcccuaugcccagagggcagacugccuc

SEQ ID NO: 499642 - RNA, 62 nt, Human
ucuuucuagcccuucaaagaugcugccaguguucgcccuagaguuauuacaaagccagugcc

SEQ ID NO: 499643 - RNA, 62 nt, Human
acuacccggccggagccgcccaccgucuugggucgcccuacccucacucaagucugucugcc

SEQ ID NO: 499644 - RNA, 62 nt, Human
cuugccuguuuccgaagcccccacacugccuuucgcccuacugagacugguccccucaaaag

SEQ ID NO: 499645 - RNA, 62 nt, Human
ccuucucagccccaaaaccugaaggaggaauuucgcccuacucuggccccuuuguugugggc

SEQ ID NO: 499646 - RNA, 62 nt, Human
cauauucugugaucacggauguuggcucccccucgcccuaugcaagcaaacacacucucacc

SEQ ID NO: 499647 - RNA, 62 nt, Human
cagggcaacuugaggucugacuuuuggcucccucgcccuaagaggcucuuccucucuuuugc

SEQ ID NO: 499648 - RNA, 62 nt, Human
uuagacgucauagcuccuuaguucugcuccugucgcccuaacuuggcaugggcaaguugaag

SEQ ID NO: 499649 - RNA, 62 nt, Human
agccaucuugcugccgacacccugcuuuccccucgcccuagggcucccuugccgcccuccug

SEQ ID NO: 499650 - RNA, 62 nt, Human
ggcugccauucccuucuuccuccucaucaccaucgcccuagggaccaagacugaauccuccu

SEQ ID NO: 499651 - RNA, 62 nt, Human
accuguaccugcacggucacccgcuccgugugucgcccuauauugagggcucaagcuuuccc

SEQ ID NO: 499652 - RNA, 62 nt, Human
ugcaaugaccuucaacaaccggccaccagaugucgcccuacucaccugagcgcucagcuuca

SEQ ID NO: 499653 - RNA, 62 nt, Human
aggaggggccggaucuuucuccgauaaaaccgucgcccuacagacccagcuguccccacgcc

SEQ ID NO: 499654 - RNA, 62 nt, Human
uuccuggagccuccagccaguccuguccucccucgcccuaccaagagggcaccugaggagac

SEQ ID NO: 499655 - RNA, 62 nt, Human
ccccggcccccggcuucugucuggacauugcaucgcccuaguuuucuuucuuuaaaaaaaaa

SEQ ID NO: 499656 - RNA, 62 nt, Human
ugaucccagccgccccugucccgucgcuguccucgcccuacauugaguacacgccggccagc

SEQ ID NO: 499657 - RNA, 62 nt, Human; identical to SEQ ID NO: 356718

SEQ ID NO: 499658 - RNA, 62 nt, Human; identical to SEQ ID NO: 357299

SEQ ID NO: 499659 - RNA, 62 nt, Human; identical to SEQ ID NO: 357300

SEQ ID NO: 499660 - RNA, 62 nt, Human; identical to SEQ ID NO: 357301

SEQ ID NO: 499661 - RNA, 62 nt, Human; identical to SEQ ID NO: 357302

SEQ ID NO: 499662 - RNA, 62 nt, Human; identical to SEQ ID NO: 357359

SEQ ID NO: 499663 - RNA, 62 nt, Human; identical to SEQ ID NO: 357360

SEQ ID NO: 499664 - RNA, 62 nt, Human; identical to SEQ ID NO: 356719

SEQ ID NO: 499665 - RNA, 62 nt, Human; identical to SEQ ID NO: 357319

SEQ ID NO: 499666 - RNA, 62 nt, Human; identical to SEQ ID NO: 357320

SEQ ID NO: 499667 - RNA, 62 nt, Human; identical to SEQ ID NO: 357321

SEQ ID NO: 499668 - RNA, 62 nt, Human; identical to SEQ ID NO: 357322

SEQ ID NO: 499669 - RNA, 62 nt, Human; identical to SEQ ID NO: 357339

SEQ ID NO: 499670 - RNA, 62 nt, Human; identical to SEQ ID NO: 357340

SEQ ID NO: 499671 - RNA, 62 nt, Human; identical to SEQ ID NO: 356720

SEQ ID NO: 499672 - RNA, 62 nt, Human; identical to SEQ ID NO: 357341

SEQ ID NO: 499673 - RNA, 62 nt, Human; identical to SEQ ID NO: 357342

SEQ ID NO: 499674 - RNA, 62 nt, Human; identical to SEQ ID NO: 357415

SEQ ID NO: 499675 - RNA, 62 nt, Human; identical to SEQ ID NO: 357416

SEQ ID NO: 499676 - RNA, 62 nt, Human; identical to SEQ ID NO: 356736

SEQ ID NO: 499677 - RNA, 62 nt, Human; identical to SEQ ID NO: 357395

SEQ ID NO: 499678 - RNA, 62 nt, Human; identical to SEQ ID NO: 357396

SEQ ID NO: 499679 - RNA, 62 nt, Human; identical to SEQ ID NO: 357397

SEQ ID NO: 499680 - RNA, 62 nt, Human; identical to SEQ ID NO: 357398

SEQ ID NO: 499681 - RNA, 62 nt, Human; identical to SEQ ID NO: 357511

SEQ ID NO: 499682 - RNA, 62 nt, Human; identical to SEQ ID NO: 357512

SEQ ID NO: 499683 - RNA, 62 nt, Human; identical to SEQ ID NO: 356737

SEQ ID NO: 499684 - RNA, 62 nt, Human; identical to SEQ ID NO: 357417

SEQ ID NO: 499685 - RNA, 62 nt, Human; identical to SEQ ID NO: 357418

SEQ ID NO: 499686 - RNA, 62 nt, Human; identical to SEQ ID NO: 357221

SEQ ID NO: 499687 - RNA, 62 nt, Human; identical to SEQ ID NO: 357222

SEQ ID NO: 499688 - RNA, 62 nt, Human; identical to SEQ ID NO: 356738

SEQ ID NO: 499689 - RNA, 62 nt, Human; identical to SEQ ID NO: 357437

SEQ ID NO: 499690 - RNA, 62 nt, Human; identical to SEQ ID NO: 357438

SEQ ID NO: 499691 - RNA, 62 nt, Human; identical to SEQ ID NO: 357493

SEQ ID NO: 499692 - RNA, 62 nt, Human; identical to SEQ ID NO: 357494

SEQ ID NO: 499693 - RNA, 62 nt, Human; identical to SEQ ID NO: 356808

SEQ ID NO: 499694 - RNA, 62 nt, Human; identical to SEQ ID NO: 357473

SEQ ID NO: 499695 - RNA, 62 nt, Human; identical to SEQ ID NO: 357474

SEQ ID NO: 499696 - RNA, 62 nt, Human; identical to SEQ ID NO: 357475

SEQ ID NO: 499697 - RNA, 62 nt, Human; identical to SEQ ID NO: 357476

SEQ ID NO: 499698 - RNA, 62 nt, Human; identical to SEQ ID NO: 357223

SEQ ID NO: 499699 - RNA, 62 nt, Human; identical to SEQ ID NO: 357224

SEQ ID NO: 499700 - RNA, 62 nt, Human; identical to SEQ ID NO: 356809

SEQ ID NO: 499701 - RNA, 62 nt, Human; identical to SEQ ID NO: 357513

SEQ ID NO: 499702 - RNA, 62 nt, Human; identical to SEQ ID NO: 357514

SEQ ID NO: 499703 - RNA, 62 nt, Human; identical to SEQ ID NO: 357552

SEQ ID NO: 499704 - RNA, 62 nt, Human; identical to SEQ ID NO: 357553

SEQ ID NO: 499705 - RNA, 62 nt, Human; identical to SEQ ID NO: 356810

SEQ ID NO: 499706 - RNA, 62 nt, Human; identical to SEQ ID NO: 357610

SEQ ID NO: 499707 - RNA, 62 nt, Human; identical to SEQ ID NO: 357611

SEQ ID NO: 499708 - RNA, 62 nt, Human; identical to SEQ ID NO: 357612

SEQ ID NO: 499709 - RNA, 62 nt, Human; identical to SEQ ID NO: 357613

SEQ ID NO: 499710 - RNA, 62 nt, Human; identical to SEQ ID NO: 357650

SEQ ID NO: 499711 - RNA, 62 nt, Human; identical to SEQ ID NO: 357651

SEQ ID NO: 499712 - RNA, 62 nt, Human; identical to SEQ ID NO: 356900

SEQ ID NO: 499713 - RNA, 62 nt, Human; identical to SEQ ID NO: 357652

SEQ ID NO: 499714 - RNA, 62 nt, Human; identical to SEQ ID NO: 357653

SEQ ID NO: 499715 - RNA, 62 nt, Human; identical to SEQ ID NO: 357141

SEQ ID NO: 499716 - RNA, 62 nt, Human; identical to SEQ ID NO: 357142

SEQ ID NO: 499717 - RNA, 62 nt, Human; identical to SEQ ID NO: 357143

SEQ ID NO: 499718 - RNA, 62 nt, Human; identical to SEQ ID NO: 357144

SEQ ID NO: 499719 - RNA, 62 nt, Human; identical to SEQ ID NO: 357161

SEQ ID NO: 499720 - RNA, 62 nt, Human; identical to SEQ ID NO: 357162

SEQ ID NO: 499721 - RNA, 62 nt, Human; identical to SEQ ID NO: 357163

SEQ ID NO: 499722 - RNA, 62 nt, Human; identical to SEQ ID NO: 357164

SEQ ID NO: 499723 - RNA, 62 nt, Human; identical to SEQ ID NO: 357181

SEQ ID NO: 499724 - RNA, 62 nt, Human; identical to SEQ ID NO: 357182

SEQ ID NO: 499725 - RNA, 62 nt, Human; identical to SEQ ID NO: 357183

SEQ ID NO: 499726 - RNA, 62 nt, Human; identical to SEQ ID NO: 357184

SEQ ID NO: 499727 - RNA, 62 nt, Human; identical to SEQ ID NO: 357201

SEQ ID NO: 499728 - RNA, 62 nt, Human; identical to SEQ ID NO: 357202

SEQ ID NO: 499729 - RNA, 62 nt, Human; identical to SEQ ID NO: 357203

SEQ ID NO: 499730 - RNA, 62 nt, Human; identical to SEQ ID NO: 357204

SEQ ID NO: 499731 - RNA, 62 nt, Human; identical to SEQ ID NO: 357241

SEQ ID NO: 499732 - RNA, 62 nt, Human; identical to SEQ ID NO: 357242

SEQ ID NO: 499733 - RNA, 62 nt, Human; identical to SEQ ID NO: 357243

SEQ ID NO: 499734 - RNA, 62 nt, Human; identical to SEQ ID NO: 357244

SEQ ID NO: 499735 - RNA, 62 nt, Human; identical to SEQ ID NO: 357279

SEQ ID NO: 499736 - RNA, 62 nt, Human; identical to SEQ ID NO: 357280

SEQ ID NO: 499737 - RNA, 62 nt, Human; identical to SEQ ID NO: 357281

SEQ ID NO: 499738 - RNA, 62 nt, Human; identical to SEQ ID NO: 357282

SEQ ID NO: 499739 - RNA, 62 nt, Human; identical to SEQ ID NO: 357690

SEQ ID NO: 499740 - RNA, 62 nt, Human; identical to SEQ ID NO: 357691

SEQ ID NO: 499741 - RNA, 62 nt, Human; identical to SEQ ID NO: 357692

SEQ ID NO: 499742 - RNA, 62 nt, Human; identical to SEQ ID NO: 357693

SEQ ID NO: 499743 - RNA, 62 nt, Human; identical to SEQ ID NO: 357694

SEQ ID NO: 499744 - RNA, 62 nt, Human; identical to SEQ ID NO: 357695

SEQ ID NO: 499745 - RNA, 62 nt, Human; identical to SEQ ID NO: 357696

SEQ ID NO: 499746 - RNA, 62 nt, Human; identical to SEQ ID NO: 357697

SEQ ID NO: 499747 - RNA, 62 nt, Human; identical to SEQ ID NO: 357698

SEQ ID NO: 499748 - RNA, 62 nt, Human; identical to SEQ ID NO: 357699

SEQ ID NO: 499749 - RNA, 62 nt, Human; identical to SEQ ID NO: 357700

SEQ ID NO: 499750 - RNA, 62 nt, Human; identical to SEQ ID NO: 357701

SEQ ID NO: 499751 - RNA, 62 nt, Human; identical to SEQ ID NO: 357702

SEQ ID NO: 499752 - RNA, 62 nt, Human; identical to SEQ ID NO: 357703

SEQ ID NO: 499753 - RNA, 62 nt, Human; identical to SEQ ID NO: 357704

SEQ ID NO: 499754 - RNA, 62 nt, Human; identical to SEQ ID NO: 357705

SEQ ID NO: 499755 - RNA, 62 nt, Human; identical to SEQ ID NO: 357706

SEQ ID NO: 499756 - RNA, 62 nt, Human; identical to SEQ ID NO: 357707

SEQ ID NO: 499757 - RNA, 62 nt, Human; identical to SEQ ID NO: 357708

SEQ ID NO: 499758 - RNA, 62 nt, Human; identical to SEQ ID NO: 357709

SEQ ID NO: 499759 - RNA, 62 nt, Human; identical to SEQ ID NO: 357710

SEQ ID NO: 499760 - RNA, 62 nt, Human; identical to SEQ ID NO: 357711

SEQ ID NO: 499761 - RNA, 62 nt, Human; identical to SEQ ID NO: 357712

SEQ ID NO: 499762 - RNA, 62 nt, Human; identical to SEQ ID NO: 357713

SEQ ID NO: 499763 - RNA, 62 nt, Human; identical to SEQ ID NO: 357714

SEQ ID NO: 499764 - RNA, 62 nt, Human; identical to SEQ ID NO: 357715

SEQ ID NO: 499765 - RNA, 62 nt, Human; identical to SEQ ID NO: 357716

SEQ ID NO: 499766 - RNA, 62 nt, Human; identical to SEQ ID NO: 357717

SEQ ID NO: 499767 - RNA, 62 nt, Human; identical to SEQ ID NO: 357718

SEQ ID NO: 499768 - RNA, 62 nt, Human; identical to SEQ ID NO: 357719

SEQ ID NO: 499769 - RNA, 62 nt, Human; identical to SEQ ID NO: 357720

SEQ ID NO: 499770 - RNA, 62 nt, Human; identical to SEQ ID NO: 357721

SEQ ID NO: 499771 - RNA, 62 nt, Human; identical to SEQ ID NO: 357722

SEQ ID NO: 499772 - RNA, 62 nt, Human; identical to SEQ ID NO: 357723

SEQ ID NO: 499773 - RNA, 62 nt, Human; identical to SEQ ID NO: 357724

SEQ ID NO: 499774 - RNA, 62 nt, Human; identical to SEQ ID NO: 357725

SEQ ID NO: 499775 - RNA, 62 nt, Human; identical to SEQ ID NO: 357726

SEQ ID NO: 499776 - RNA, 62 nt, Human; identical to SEQ ID NO: 357727

SEQ ID NO: 499777 - RNA, 62 nt, Human; identical to SEQ ID NO: 357728

SEQ ID NO: 499778 - RNA, 62 nt, Human; identical to SEQ ID NO: 357729

SEQ ID NO: 499779 - RNA, 62 nt, Human; identical to SEQ ID NO: 357730

SEQ ID NO: 499780 - RNA, 62 nt, Human; identical to SEQ ID NO: 357731

SEQ ID NO: 499781 - RNA, 62 nt, Human; identical to SEQ ID NO: 357732

SEQ ID NO: 499782 - RNA, 62 nt, Human; identical to SEQ ID NO: 357733

SEQ ID NO: 499783 - RNA, 62 nt, Human; identical to SEQ ID NO: 357734

SEQ ID NO: 499784 - RNA, 62 nt, Human; identical to SEQ ID NO: 357735

SEQ ID NO: 499785 - RNA, 60 nt, Human; identical to SEQ ID NO: 357736

SEQ ID NO: 499786 - RNA, 62 nt, Human; identical to SEQ ID NO: 357737

SEQ ID NO: 499787 - RNA, 62 nt, Human; identical to SEQ ID NO: 357738

SEQ ID NO: 499788 - RNA, 62 nt, Human; identical to SEQ ID NO: 357739

SEQ ID NO: 499789 - RNA, 62 nt, Human; identical to SEQ ID NO: 357740

SEQ ID NO: 499790 - RNA, 62 nt, Human; identical to SEQ ID NO: 357741

SEQ ID NO: 499791 - RNA, 62 nt, Human; identical to SEQ ID NO: 357742

SEQ ID NO: 499792 - RNA, 62 nt, Human; identical to SEQ ID NO: 357743

SEQ ID NO: 499793 - RNA, 62 nt, Human; identical to SEQ ID NO: 357744

SEQ ID NO: 499794 - RNA, 62 nt, Human; identical to SEQ ID NO: 357745

SEQ ID NO: 499795 - RNA, 62 nt, Human; identical to SEQ ID NO: 357746

SEQ ID NO: 499796 - RNA, 62 nt, Human; identical to SEQ ID NO: 357747

SEQ ID NO: 499797 - RNA, 62 nt, Human; identical to SEQ ID NO: 357748

SEQ ID NO: 499798 - RNA, 62 nt, Human; identical to SEQ ID NO: 357749

SEQ ID NO: 499799 - RNA, 62 nt, Human; identical to SEQ ID NO: 357750

SEQ ID NO: 499800 - RNA, 62 nt, Human; identical to SEQ ID NO: 357751

SEQ ID NO: 499801 - RNA, 62 nt, Human; identical to SEQ ID NO: 357752

SEQ ID NO: 499802 - RNA, 62 nt, Human; identical to SEQ ID NO: 357753

SEQ ID NO: 499803 - RNA, 62 nt, Human; identical to SEQ ID NO: 357754

SEQ ID NO: 499804 - RNA, 62 nt, Human; identical to SEQ ID NO: 357755

SEQ ID NO: 499805 - RNA, 62 nt, Human; identical to SEQ ID NO: 357756

SEQ ID NO: 499806 - RNA, 62 nt, Human; identical to SEQ ID NO: 357757

SEQ ID NO: 499807 - RNA, 62 nt, Human; identical to SEQ ID NO: 357758

SEQ ID NO: 499808 - RNA, 62 nt, Human; identical to SEQ ID NO: 357759

SEQ ID NO: 499809 - RNA, 62 nt, Human; identical to SEQ ID NO: 357760

SEQ ID NO: 499810 - RNA, 62 nt, Human; identical to SEQ ID NO: 357761

SEQ ID NO: 499811 - RNA, 62 nt, Human; identical to SEQ ID NO: 357762

SEQ ID NO: 499812 - RNA, 62 nt, Human; identical to SEQ ID NO: 357763

SEQ ID NO: 499813 - RNA, 62 nt, Human; identical to SEQ ID NO: 357764

SEQ ID NO: 499814 - RNA, 62 nt, Human; identical to SEQ ID NO: 357765

SEQ ID NO: 499815 - RNA, 62 nt, Human; identical to SEQ ID NO: 357766

SEQ ID NO: 499816 - RNA, 62 nt, Human; identical to SEQ ID NO: 357767

SEQ ID NO: 499817 - RNA, 62 nt, Human; identical to SEQ ID NO: 357768

SEQ ID NO: 499818 - RNA, 62 nt, Human; identical to SEQ ID NO: 357769

SEQ ID NO: 499819 - RNA, 62 nt, Human; identical to SEQ ID NO: 357770

SEQ ID NO: 499820 - RNA, 62 nt, Human; identical to SEQ ID NO: 357771

SEQ ID NO: 499821 - RNA, 62 nt, Human; identical to SEQ ID NO: 357772

SEQ ID NO: 499822 - RNA, 62 nt, Human; identical to SEQ ID NO: 357773

SEQ ID NO: 499823 - RNA, 62 nt, Human; identical to SEQ ID NO: 357774

SEQ ID NO: 499824 - RNA, 62 nt, Human; identical to SEQ ID NO: 357775

SEQ ID NO: 499825 - RNA, 62 nt, Human; identical to SEQ ID NO: 357776

SEQ ID NO: 499826 - RNA, 62 nt, Human; identical to SEQ ID NO: 357777

SEQ ID NO: 499827 - RNA, 62 nt, Human; identical to SEQ ID NO: 357778

SEQ ID NO: 499828 - RNA, 62 nt, Human; identical to SEQ ID NO: 357779

SEQ ID NO: 499829 - RNA, 62 nt, Human; identical to SEQ ID NO: 357780

SEQ ID NO: 499830 - RNA, 62 nt, Human; identical to SEQ ID NO: 357781

SEQ ID NO: 499831 - RNA, 62 nt, Human; identical to SEQ ID NO: 357782

SEQ ID NO: 499832 - RNA, 62 nt, Human; identical to SEQ ID NO: 357783

SEQ ID NO: 499833 - RNA, 62 nt, Human; identical to SEQ ID NO: 357784

SEQ ID NO: 499834 - RNA, 52 nt, Human; identical to SEQ ID NO: 357785

SEQ ID NO: 499835 - RNA, 62 nt, Human; identical to SEQ ID NO: 357786

SEQ ID NO: 499836 - RNA, 62 nt, Human; identical to SEQ ID NO: 357787

SEQ ID NO: 499837 - RNA, 62 nt, Human; identical to SEQ ID NO: 357788

SEQ ID NO: 499838 - RNA, 62 nt, Human; identical to SEQ ID NO: 356718

SEQ ID NO: 499839 - RNA, 62 nt, Human; identical to SEQ ID NO: 357299

SEQ ID NO: 499840 - RNA, 62 nt, Human; identical to SEQ ID NO: 357300

SEQ ID NO: 499841 - RNA, 62 nt, Human; identical to SEQ ID NO: 357301

SEQ ID NO: 499842 - RNA, 62 nt, Human; identical to SEQ ID NO: 357302

SEQ ID NO: 499843 - RNA, 62 nt, Human; identical to SEQ ID NO: 357359

SEQ ID NO: 499844 - RNA, 62 nt, Human; identical to SEQ ID NO: 357360

SEQ ID NO: 499845 - RNA, 62 nt, Human; identical to SEQ ID NO: 356719

SEQ ID NO: 499846 - RNA, 62 nt, Human; identical to SEQ ID NO: 357319

SEQ ID NO: 499847 - RNA, 62 nt, Human; identical to SEQ ID NO: 357320

SEQ ID NO: 499848 - RNA, 62 nt, Human; identical to SEQ ID NO: 357321

SEQ ID NO: 499849 - RNA, 62 nt, Human; identical to SEQ ID NO: 357322

SEQ ID NO: 499850 - RNA, 62 nt, Human; identical to SEQ ID NO: 357339

SEQ ID NO: 499851 - RNA, 62 nt, Human; identical to SEQ ID NO: 357340

SEQ ID NO: 499852 - RNA, 62 nt, Human; identical to SEQ ID NO: 356720

SEQ ID NO: 499853 - RNA, 62 nt, Human; identical to SEQ ID NO: 357341

SEQ ID NO: 499854 - RNA, 62 nt, Human; identical to SEQ ID NO: 357342

SEQ ID NO: 499855 - RNA, 62 nt, Human; identical to SEQ ID NO: 357415

SEQ ID NO: 499856 - RNA, 62 nt, Human; identical to SEQ ID NO: 357416

SEQ ID NO: 499857 - RNA, 62 nt, Human; identical to SEQ ID NO: 356736

SEQ ID NO: 499858 - RNA, 62 nt, Human; identical to SEQ ID NO: 357395

SEQ ID NO: 499859 - RNA, 62 nt, Human; identical to SEQ ID NO: 357396

SEQ ID NO: 499860 - RNA, 62 nt, Human; identical to SEQ ID NO: 357397

SEQ ID NO: 499861 - RNA, 62 nt, Human; identical to SEQ ID NO: 357398

SEQ ID NO: 499862 - RNA, 62 nt, Human; identical to SEQ ID NO: 357511

SEQ ID NO: 499863 - RNA, 62 nt, Human; identical to SEQ ID NO: 357512

SEQ ID NO: 499864 - RNA, 62 nt, Human; identical to SEQ ID NO: 356737

SEQ ID NO: 499865 - RNA, 62 nt, Human; identical to SEQ ID NO: 357417

SEQ ID NO: 499866 - RNA, 62 nt, Human; identical to SEQ ID NO: 357418

SEQ ID NO: 499867 - RNA, 62 nt, Human; identical to SEQ ID NO: 357221

SEQ ID NO: 499868 - RNA, 62 nt, Human; identical to SEQ ID NO: 357222

SEQ ID NO: 499869 - RNA, 62 nt, Human; identical to SEQ ID NO: 356738

SEQ ID NO: 499870 - RNA, 62 nt, Human; identical to SEQ ID NO: 357437

SEQ ID NO: 499871 - RNA, 62 nt, Human; identical to SEQ ID NO: 357438

SEQ ID NO: 499872 - RNA, 62 nt, Human; identical to SEQ ID NO: 357493

SEQ ID NO: 499873 - RNA, 62 nt, Human; identical to SEQ ID NO: 357494

SEQ ID NO: 499874 - RNA, 62 nt, Human; identical to SEQ ID NO: 356808

SEQ ID NO: 499875 - RNA, 62 nt, Human; identical to SEQ ID NO: 357473

SEQ ID NO: 499876 - RNA, 62 nt, Human; identical to SEQ ID NO: 357474

SEQ ID NO: 499877 - RNA, 62 nt, Human; identical to SEQ ID NO: 357475

SEQ ID NO: 499878 - RNA, 62 nt, Human; identical to SEQ ID NO: 357476

SEQ ID NO: 499879 - RNA, 62 nt, Human; identical to SEQ ID NO: 357223

SEQ ID NO: 499880 - RNA, 62 nt, Human; identical to SEQ ID NO: 357224

SEQ ID NO: 499881 - RNA, 62 nt, Human; identical to SEQ ID NO: 356809

SEQ ID NO: 499882 - RNA, 62 nt, Human; identical to SEQ ID NO: 357513

SEQ ID NO: 499883 - RNA, 62 nt, Human; identical to SEQ ID NO: 357514

SEQ ID NO: 499884 - RNA, 62 nt, Human; identical to SEQ ID NO: 357552

SEQ ID NO: 499885 - RNA, 62 nt, Human; identical to SEQ ID NO: 357553

SEQ ID NO: 499886 - RNA, 62 nt, Human; identical to SEQ ID NO: 356810

SEQ ID NO: 499887 - RNA, 62 nt, Human; identical to SEQ ID NO: 357610

SEQ ID NO: 499888 - RNA, 62 nt, Human; identical to SEQ ID NO: 357611

SEQ ID NO: 499889 - RNA, 62 nt, Human; identical to SEQ ID NO: 357612

SEQ ID NO: 499890 - RNA, 62 nt, Human; identical to SEQ ID NO: 357613

SEQ ID NO: 499891 - RNA, 62 nt, Human; identical to SEQ ID NO: 357650

SEQ ID NO: 499892 - RNA, 62 nt, Human; identical to SEQ ID NO: 357651

SEQ ID NO: 499893 - RNA, 62 nt, Human; identical to SEQ ID NO: 356900

SEQ ID NO: 499894 - RNA, 62 nt, Human; identical to SEQ ID NO: 357652

SEQ ID NO: 499895 - RNA, 62 nt, Human; identical to SEQ ID NO: 357653

SEQ ID NO: 499896 - RNA, 62 nt, Human; identical to SEQ ID NO: 357141

SEQ ID NO: 499897 - RNA, 62 nt, Human; identical to SEQ ID NO: 357142

SEQ ID NO: 499898 - RNA, 62 nt, Human; identical to SEQ ID NO: 357143

SEQ ID NO: 499899 - RNA, 62 nt, Human; identical to SEQ ID NO: 357144

SEQ ID NO: 499900 - RNA, 62 nt, Human; identical to SEQ ID NO: 357161

SEQ ID NO: 499901 - RNA, 62 nt, Human; identical to SEQ ID NO: 357162

SEQ ID NO: 499902 - RNA, 62 nt, Human; identical to SEQ ID NO: 357163

SEQ ID NO: 499903 - RNA, 62 nt, Human; identical to SEQ ID NO: 357164

SEQ ID NO: 499904 - RNA, 62 nt, Human; identical to SEQ ID NO: 357181

SEQ ID NO: 499905 - RNA, 62 nt, Human; identical to SEQ ID NO: 357182

SEQ ID NO: 499906 - RNA, 62 nt, Human; identical to SEQ ID NO: 357183

SEQ ID NO: 499907 - RNA, 62 nt, Human; identical to SEQ ID NO: 357184

SEQ ID NO: 499908 - RNA, 62 nt, Human; identical to SEQ ID NO: 357201

SEQ ID NO: 499909 - RNA, 62 nt, Human; identical to SEQ ID NO: 357202

SEQ ID NO: 499910 - RNA, 62 nt, Human; identical to SEQ ID NO: 357203

SEQ ID NO: 499911 - RNA, 62 nt, Human; identical to SEQ ID NO: 357204

SEQ ID NO: 499912 - RNA, 62 nt, Human; identical to SEQ ID NO: 357241

SEQ ID NO: 499913 - RNA, 62 nt, Human; identical to SEQ ID NO: 357242

SEQ ID NO: 499914 - RNA, 62 nt, Human; identical to SEQ ID NO: 357243

SEQ ID NO: 499915 - RNA, 62 nt, Human; identical to SEQ ID NO: 357244

SEQ ID NO: 499916 - RNA, 62 nt, Human; identical to SEQ ID NO: 357279

SEQ ID NO: 499917 - RNA, 62 nt, Human; identical to SEQ ID NO: 357280

SEQ ID NO: 499918 - RNA, 62 nt, Human; identical to SEQ ID NO: 357281

SEQ ID NO: 499919 - RNA, 62 nt, Human; identical to SEQ ID NO: 357282

SEQ ID NO: 499920 - RNA, 62 nt, Human; identical to SEQ ID NO: 357690

SEQ ID NO: 499921 - RNA, 62 nt, Human; identical to SEQ ID NO: 357691

SEQ ID NO: 499922 - RNA, 62 nt, Human; identical to SEQ ID NO: 357692

SEQ ID NO: 499923 - RNA, 62 nt, Human; identical to SEQ ID NO: 357693

SEQ ID NO: 499924 - RNA, 62 nt, Human; identical to SEQ ID NO: 357694

SEQ ID NO: 499925 - RNA, 62 nt, Human; identical to SEQ ID NO: 357695

SEQ ID NO: 499926 - RNA, 62 nt, Human; identical to SEQ ID NO: 357696

SEQ ID NO: 499927 - RNA, 62 nt, Human; identical to SEQ ID NO: 357697

SEQ ID NO: 499928 - RNA, 62 nt, Human; identical to SEQ ID NO: 357698

SEQ ID NO: 499929 - RNA, 62 nt, Human; identical to SEQ ID NO: 357699

SEQ ID NO: 499930 - RNA, 62 nt, Human; identical to SEQ ID NO: 357700

SEQ ID NO: 499931 - RNA, 62 nt, Human; identical to SEQ ID NO: 357701

SEQ ID NO: 499932 - RNA, 62 nt, Human; identical to SEQ ID NO: 357702

SEQ ID NO: 499933 - RNA, 62 nt, Human; identical to SEQ ID NO: 357703

SEQ ID NO: 499934 - RNA, 62 nt, Human; identical to SEQ ID NO: 357704

SEQ ID NO: 499935 - RNA, 62 nt, Human; identical to SEQ ID NO: 357705

SEQ ID NO: 499936 - RNA, 62 nt, Human; identical to SEQ ID NO: 357706

SEQ ID NO: 499937 - RNA, 62 nt, Human; identical to SEQ ID NO: 357707

SEQ ID NO: 499938 - RNA, 62 nt, Human; identical to SEQ ID NO: 357708

SEQ ID NO: 499939 - RNA, 62 nt, Human; identical to SEQ ID NO: 357709

SEQ ID NO: 499940 - RNA, 62 nt, Human; identical to SEQ ID NO: 357710

SEQ ID NO: 499941 - RNA, 62 nt, Human; identical to SEQ ID NO: 357711

SEQ ID NO: 499942 - RNA, 62 nt, Human; identical to SEQ ID NO: 357712

SEQ ID NO: 499943 - RNA, 62 nt, Human; identical to SEQ ID NO: 357713

SEQ ID NO: 499944 - RNA, 62 nt, Human; identical to SEQ ID NO: 357714

SEQ ID NO: 499945 - RNA, 62 nt, Human; identical to SEQ ID NO: 357715

SEQ ID NO: 499946 - RNA, 62 nt, Human; identical to SEQ ID NO: 357716

SEQ ID NO: 499947 - RNA, 62 nt, Human; identical to SEQ ID NO: 357717

SEQ ID NO: 499948 - RNA, 62 nt, Human; identical to SEQ ID NO: 357718

SEQ ID NO: 499949 - RNA, 62 nt, Human; identical to SEQ ID NO: 357719

SEQ ID NO: 499950 - RNA, 62 nt, Human; identical to SEQ ID NO: 357720

SEQ ID NO: 499951 - RNA, 62 nt, Human; identical to SEQ ID NO: 357721

SEQ ID NO: 499952 - RNA, 62 nt, Human; identical to SEQ ID NO: 357722

SEQ ID NO: 499953 - RNA, 62 nt, Human; identical to SEQ ID NO: 357723

SEQ ID NO: 499954 - RNA, 62 nt, Human; identical to SEQ ID NO: 357724

SEQ ID NO: 499955 - RNA, 62 nt, Human; identical to SEQ ID NO: 357725

SEQ ID NO: 499956 - RNA, 62 nt, Human; identical to SEQ ID NO: 357726

SEQ ID NO: 499957 - RNA, 62 nt, Human; identical to SEQ ID NO: 357727

SEQ ID NO: 499958 - RNA, 62 nt, Human; identical to SEQ ID NO: 357728

SEQ ID NO: 499959 - RNA, 62 nt, Human; identical to SEQ ID NO: 357729

SEQ ID NO: 499960 - RNA, 62 nt, Human; identical to SEQ ID NO: 357730

SEQ ID NO: 499961 - RNA, 62 nt, Human; identical to SEQ ID NO: 357731

SEQ ID NO: 499962 - RNA, 62 nt, Human; identical to SEQ ID NO: 357732

SEQ ID NO: 499963 - RNA, 62 nt, Human; identical to SEQ ID NO: 357733

SEQ ID NO: 499964 - RNA, 62 nt, Human; identical to SEQ ID NO: 357734

SEQ ID NO: 499965 - RNA, 62 nt, Human; identical to SEQ ID NO: 357735

SEQ ID NO: 499966 - RNA, 60 nt, Human; identical to SEQ ID NO: 357736

SEQ ID NO: 499967 - RNA, 62 nt, Human; identical to SEQ ID NO: 357737

SEQ ID NO: 499968 - RNA, 62 nt, Human; identical to SEQ ID NO: 357738

SEQ ID NO: 499969 - RNA, 62 nt, Human; identical to SEQ ID NO: 357739

SEQ ID NO: 499970 - RNA, 62 nt, Human; identical to SEQ ID NO: 357740

SEQ ID NO: 499971 - RNA, 62 nt, Human; identical to SEQ ID NO: 357741

SEQ ID NO: 499972 - RNA, 62 nt, Human; identical to SEQ ID NO: 357742

SEQ ID NO: 499973 - RNA, 62 nt, Human; identical to SEQ ID NO: 357743

SEQ ID NO: 499974 - RNA, 62 nt, Human; identical to SEQ ID NO: 357744

SEQ ID NO: 499975 - RNA, 62 nt, Human; identical to SEQ ID NO: 357745

SEQ ID NO: 499976 - RNA, 62 nt, Human; identical to SEQ ID NO: 357746

SEQ ID NO: 499977 - RNA, 62 nt, Human; identical to SEQ ID NO: 357747

SEQ ID NO: 499978 - RNA, 62 nt, Human; identical to SEQ ID NO: 357748

SEQ ID NO: 499979 - RNA, 62 nt, Human; identical to SEQ ID NO: 357749

SEQ ID NO: 499980 - RNA, 62 nt, Human; identical to SEQ ID NO: 357750

SEQ ID NO: 499981 - RNA, 62 nt, Human; identical to SEQ ID NO: 357751

SEQ ID NO: 499982 - RNA, 62 nt, Human; identical to SEQ ID NO: 357752

SEQ ID NO: 499983 - RNA, 62 nt, Human; identical to SEQ ID NO: 357753

SEQ ID NO: 499984 - RNA, 62 nt, Human; identical to SEQ ID NO: 357754

SEQ ID NO: 499985 - RNA, 62 nt, Human; identical to SEQ ID NO: 357755

SEQ ID NO: 499986 - RNA, 62 nt, Human; identical to SEQ ID NO: 357756

SEQ ID NO: 499987 - RNA, 62 nt, Human; identical to SEQ ID NO: 357757

SEQ ID NO: 499988 - RNA, 62 nt, Human; identical to SEQ ID NO: 357758

SEQ ID NO: 499989 - RNA, 62 nt, Human; identical to SEQ ID NO: 357759

SEQ ID NO: 499990 - RNA, 62 nt, Human; identical to SEQ ID NO: 357760

SEQ ID NO: 499991 - RNA, 62 nt, Human; identical to SEQ ID NO: 357761

SEQ ID NO: 499992 - RNA, 62 nt, Human; identical to SEQ ID NO: 357762

SEQ ID NO: 499993 - RNA, 62 nt, Human; identical to SEQ ID NO: 357763

SEQ ID NO: 499994 - RNA, 62 nt, Human; identical to SEQ ID NO: 357764

SEQ ID NO: 499995 - RNA, 62 nt, Human; identical to SEQ ID NO: 357765

SEQ ID NO: 499996 - RNA, 62 nt, Human; identical to SEQ ID NO: 357766

SEQ ID NO: 499997 - RNA, 62 nt, Human; identical to SEQ ID NO: 357767

SEQ ID NO: 499998 - RNA, 62 nt, Human; identical to SEQ ID NO: 357768

SEQ ID NO: 499999 - RNA, 62 nt, Human; identical to SEQ ID NO: 357769

SEQ ID NO: 500000 - RNA, 62 nt, Human; identical to SEQ ID NO: 357770

SEQ ID NO: 500001 - RNA, 62 nt, Human; identical to SEQ ID NO: 357771

SEQ ID NO: 500002 - RNA, 62 nt, Human; identical to SEQ ID NO: 357772

SEQ ID NO: 500003 - RNA, 62 nt, Human; identical to SEQ ID NO: 357773

SEQ ID NO: 500004 - RNA, 62 nt, Human; identical to SEQ ID NO: 357774

SEQ ID NO: 500005 - RNA, 62 nt, Human; identical to SEQ ID NO: 357775

SEQ ID NO: 500006 - RNA, 62 nt, Human; identical to SEQ ID NO: 357776

SEQ ID NO: 500007 - RNA, 62 nt, Human; identical to SEQ ID NO: 357777

SEQ ID NO: 500008 - RNA, 62 nt, Human; identical to SEQ ID NO: 357778

SEQ ID NO: 500009 - RNA, 62 nt, Human; identical to SEQ ID NO: 357779

SEQ ID NO: 500010 - RNA, 62 nt, Human; identical to SEQ ID NO: 357780

SEQ ID NO: 500011 - RNA, 62 nt, Human; identical to SEQ ID NO: 357781

SEQ ID NO: 500012 - RNA, 62 nt, Human; identical to SEQ ID NO: 357782

SEQ ID NO: 500013 - RNA, 62 nt, Human; identical to SEQ ID NO: 357783

SEQ ID NO: 500014 - RNA, 62 nt, Human; identical to SEQ ID NO: 357784

SEQ ID NO: 500015 - RNA, 52 nt, Human; identical to SEQ ID NO: 357785

SEQ ID NO: 500016 - RNA, 62 nt, Human; identical to SEQ ID NO: 357786

SEQ ID NO: 500017 - RNA, 62 nt, Human; identical to SEQ ID NO: 357787

SEQ ID NO: 500018 - RNA, 62 nt, Human; identical to SEQ ID NO: 357788

SEQ ID NO: 500019 - RNA, 64 nt, Human; identical to SEQ ID NO: 409141

SEQ ID NO: 500020 - RNA, 64 nt, Human; identical to SEQ ID NO: 409142

SEQ ID NO: 500021 - RNA, 64 nt, Human; identical to SEQ ID NO: 409146

SEQ ID NO: 500022 - RNA, 64 nt, Human; identical to SEQ ID NO: 409147

SEQ ID NO: 500023 - RNA, 64 nt, Human; identical to SEQ ID NO: 409148

SEQ ID NO: 500024 - RNA, 64 nt, Human; identical to SEQ ID NO: 409149

SEQ ID NO: 500025 - RNA, 64 nt, Human; identical to SEQ ID NO: 409150

SEQ ID NO: 500026 - RNA, 61 nt, Human
cuccuccuggcugcaccuggguagggaugguggcaucgaugccccucugucugcugaagga

SEQ ID NO: 500027 - RNA, 61 nt, Human
aagaggauggggccugagcuggggaagggguggcaucgaggaccuucuugcauucuccugu

SEQ ID NO: 500028 - RNA, 61 nt, Human
gauuguuuuauguaaaaggaaaaucuuguauggcaucgaauagccuuaaugaguuuaauuc

SEQ ID NO: 500029 - RNA, 61 nt, Human
auggccacugauguguguuuguggauaccugggcaucgacccagccugcaggugagcucug

SEQ ID NO: 500030 - RNA, 61 nt, Human
uuuuauagaaaagaagugauaguaguuaauuggcaucgauuuuucagauauugcacuaccu

SEQ ID NO: 500031 - RNA, 61 nt, Human
uacacagaagcaccuuggcauagagcacccaggcaucgaccucuuccaggagaacugauuc

SEQ ID NO: 500032 - RNA, 61 nt, Human
cacuggaauugaugggaaaugguuucuaaauggcaucgaagcuggucuuuaaugagucuuu

SEQ ID NO: 500033 - RNA, 61 nt, Human
augugucucaggcuguggugacucucacaugggcaucgaagaaguacaacccacauagccc

SEQ ID NO: 500034 - RNA, 61 nt, Human
gggucccugcagucgacaucauguuuggcugggcaucgaugccuccuuucugggacucccg

SEQ ID NO: 500035 - RNA, 61 nt, Human
gggacaugugaaaugaugggcauuccagugaggcaucgaaugccuucugagggcuuuguag

SEQ ID NO: 500036 - RNA, 61 nt, Human
uccuccaaaaaaagauuuaaaaaaagauuucggcaucgacacggacguuguugcacaaagc

SEQ ID NO: 500037 - RNA, 61 nt, Human
uacuuaauaucaagacaagugaaaaaauauuggcaucgaugaaaccgauaacauuggccuc

SEQ ID NO: 500038 - RNA, 61 nt, Human
cguagacucacgcugacugcaggcagcggggggcaucgaggggugcuuagccccagggcac

SEQ ID NO: 500039 - RNA, 61 nt, Human
auucuaccguggaaugucccuggaguacuauggcaucgaggcggacgacaaccccuucuuc

SEQ ID NO: 500040 - RNA, 61 nt, Human
ggugugggcccaggcagggcuggggugugcuggcaucgacagcccccacucugggcacuag

SEQ ID NO: 500041 - RNA, 61 nt, Human
cccucuucucuccaggcuaaagaaucccgaaggcaucgaggccauuucugcugcaacaagg

SEQ ID NO: 500042 - RNA, 61 nt, Human
cacugacagacuugaagcugacauuuggcagggcaucgaagggaugcauccaugaagucac

SEQ ID NO: 500043 - RNA, 61 nt, Human
uguuaaaugcacuguuauugccaugugaagaggcaucgacuuugauaccaccaucauguuc

SEQ ID NO: 500044 - RNA, 61 nt, Human
uuucgugaaugaaucucagacgcuguaacccggcaucgagugcugaccuuguaauguauga

SEQ ID NO: 500045 - RNA, 61 nt, Human
uuucauuuugauuaauaauucuuggaugcuuggcaucgaucguaucacugcuccuagaagg

SEQ ID NO: 500046 - RNA, 61 nt, Human
agccuccacccgggugagcuggggcccacguggcaucgauccucccugcccgcgaagugac

SEQ ID NO: 500047 - RNA, 61 nt, Human
cuguuacuggcuaaauuaaaacccuuggcagggcaucgacugugugcgaggcaaugcucua

SEQ ID NO: 500048 - RNA, 61 nt, Human
aagcaacguaugguaaauauugaaaacuccaggcaucgaaaacaagagcagaagcaccuuc

SEQ ID NO: 500049 - RNA, 61 nt, Human
cugagaaugagggcaccgacugugaagcuggggcaucgaugacccaagacuuuaucuucug

SEQ ID NO: 500050 - RNA, 61 nt, Human
cagccuccagcaaggcaaauuugacacaaaaggcaucgagaguacugacgaggcgaagaug

SEQ ID NO: 500051 - RNA, 61 nt, Human
uucggauugaauugguguggggugugguccaggcaucgagauguguaaagaccuccccagg

SEQ ID NO: 500052 - RNA, 61 nt, Human
acccccacauuccuuugaccagccuugugagggcaucgaugcugccccgggcuaccuggcu

SEQ ID NO: 500053 - RNA, 61 nt, Human
cagugauccccaagcauccaguacagaaccaggcaucgagcuagcucccugcacggccgca

SEQ ID NO: 500054 - RNA, 61 nt, Human
uuugugaugaugguuugguuuccagaccugaggcaucgaaugggcuaaaggucagccagaa

SEQ ID NO: 500055 - RNA, 61 nt, Human
uggaaucugaaggcgugagucugcaucuuagggcaucgaucuuccucacaccacaaaucug

SEQ ID NO: 500056 - RNA, 61 nt, Human
acauuuuugguuggggcagaggcaugcuccuggcaucgaguggguggagaccagagaagcc

SEQ ID NO: 500057 - RNA, 61 nt, Human
ccaaaacguugacuaccugccucuuuccucgggcaucgacgugcucauuuccaaagaugau

SEQ ID NO: 500058 - RNA, 61 nt, Human
guuuggaggauguucucugcgcucccaggccggcaucgagugucaucaauuucuaccaccu

SEQ ID NO: 500059 - RNA, 61 nt, Human
uacuuguucgaagcuuacagcuuguuuuccaggcaucgaauaacuguugagauuguucuac

SEQ ID NO: 500060 - RNA, 64 nt, Human
ccaauggaaacucagaucccaaaagucccuaaagcagucguagagucucaccaucuccaaggau

SEQ ID NO: 500061 - RNA, 64 nt, Human
auuuucucuaggcuuuuuuccuuuugggguucuacagucguaaaagagauaauaagauuaguug

SEQ ID NO: 500062 - RNA, 64 nt, Human
guuacuacccucacccuuuaccuuccucagguaacagucguagauaccagcuuuuuuuuuuuuu

SEQ ID NO: 500063 - RNA, 64 nt, Human
ccuggucugaacuaguugagagaguaguuuugaacagucguaaccguggcugguguuuguaguu

SEQ ID NO: 500064 - RNA, 64 nt, Human
cugagaaagguagacagcuacccaugaucuagcccagucguauuuuagagcuaauaaaacugau

SEQ ID NO: 500065 - RNA, 64 nt, Human
uagggucuuaacucuuguccaggcuggaggagugcagucguacagucauggcucacugaagucu

SEQ ID NO: 500066 - RNA, 64 nt, Human
uucccauaucauggggaaaauucgugucuauuuucagucguacgcauagacgccccaggauggg

SEQ ID NO: 500067 - RNA, 64 nt, Human
aaaccauuauuuacuuggaugauggugaauaguacagucguaaguaacugucuggaggugccuc

SEQ ID NO: 500068 - RNA, 64 nt, Human
gaucccuuaccagucacauuuguggacugguggccagucguauaccaucccuggaaggauucug

SEQ ID NO: 500069 - RNA, 64 nt, Human
agauaaucaccgaauacaccagggcuccucauuucagucguaacgcauccauugagauuggaau

SEQ ID NO: 500070 - RNA, 64 nt, Human
aaucuuacaaauguagcaguugugaaagagucuucagucguaguguccaccuuacucaacauca

SEQ ID NO: 500071 - RNA, 64 nt, Human
uagguccuaccuaaauguccagcaggacauuagacagucguacaggguacagaauaauucuucg

SEQ ID NO: 500072 - RNA, 64 nt, Human
gaagauggcgaccguaacacuccuuagaaacuggcagucguauguuaguuucacuugucuacuu

SEQ ID NO: 500073 - RNA, 64 nt, Human
aggagaaagcuaacggaacacauccaaagaccaucagucguauuggaaguacuacuaacccauu

SEQ ID NO: 500074 - RNA, 64 nt, Human
agacacacccagugcgugaagaccaacaaagucacagucguaucucuagaaagcucuaaagacc

SEQ ID NO: 500075 - RNA, 64 nt, Human
cacaaccagccccaugcaugcugcugccucugggcagucguagaaucucccacuucaguuucuc

SEQ ID NO: 500076 - RNA, 64 nt, Human
uguuguauggcugucuaauuuguugcaaauucugcagucguacuauaauucaggccuguuuggu

SEQ ID NO: 500077 - RNA, 64 nt, Human
augcuuucucuaacagagaaauucuuagugacuccagucguagaaaaacgucuuuacaaccuga

SEQ ID NO: 500078 - RNA, 64 nt, Human
uuggguuuuugguuuuugcaguccuauuuaucugcagucguauuaaguccuauugcuagaauag

SEQ ID NO: 500079 - RNA, 64 nt, Human
gcccgggacagggucuugcaagcagccuccugggcagucguaaggguugcggcgugaugucuuc

SEQ ID NO: 500080 - RNA, 64 nt, Human
ucaaauaaaacacuagucagguaccguuuuaucccagucguacucuuccagguuuggaagaccc

SEQ ID NO: 500081 - RNA, 64 nt, Human
cugaaugaaccauggagcggauggcauuguccugcagucguauaguauagcagugcaggaacaa

SEQ ID NO: 500082 - RNA, 64 nt, Human
aaaaaaaaaaagagaagaagaugacgaugaugaccagucguacuaucuuacugagccacaguga

SEQ ID NO: 500083 - RNA, 64 nt, Human
aaaccaccagugacauuuaaaaauauauuuuuagcagucguaauguuagucaccaagggaaggu

SEQ ID NO: 500084 - RNA, 64 nt, Human
aaaaaauguuagaccaaauaaugcggcuaauuaacagucguaugauuucuagcccauggguuua

SEQ ID NO: 500085 - RNA, 64 nt, Human
gcaccaaccugcauuuguaugugucccgaauccacagucguacugauucuaauggggacacaga

SEQ ID NO: 500086 - RNA, 64 nt, Human
gcagccaccccuucaagagucacaggcauccauccagucguaucuuucagagaaaaaaaaaguu

SEQ ID NO: 500087 - RNA, 64 nt, Human
ccagagucacgcuggcaaccacgaguuugggaagcagucguauucucucucucucucucucucu

SEQ ID NO: 500088 - RNA, 64 nt, Human
guauaugcagguaguugucaccauggauugaguccagucguaguaauuaauauguuuaaucaga

SEQ ID NO: 500089 - RNA, 64 nt, Human
aggcugugacgcccuaugaccgcagagaucuagacagucguaacaguccccaggcuccagcugg

SEQ ID NO: 500090 - RNA, 64 nt, Human
cucuacccuccucccccacguccugucucagcugcagucguaaguccgugcaccauccuugacg

SEQ ID NO: 500091 - RNA, 64 nt, Human
gcugagacuuaucagccagaauguguucuucggacagucguacacaucuuacagaaaacccucc

SEQ ID NO: 500092 - RNA, 64 nt, Human
gggguagcagguccaucuccagcagcugguccaacagucguauccuggugaaugucuguucagc

SEQ ID NO: 500093 - RNA, 64 nt, Human; identical to SEQ ID NO: 200951

SEQ ID NO: 500094 - RNA, 64 nt, Human; identical to SEQ ID NO: 200952

SEQ ID NO: 500095 - RNA, 64 nt, Human; identical to SEQ ID NO: 200953

SEQ ID NO: 500096 - RNA, 64 nt, Human; identical to SEQ ID NO: 200969

SEQ ID NO: 500097 - RNA, 64 nt, Human; identical to SEQ ID NO: 200970

SEQ ID NO: 500098 - RNA, 64 nt, Human; identical to SEQ ID NO: 200971

SEQ ID NO: 500099 - RNA, 64 nt, Human; identical to SEQ ID NO: 200987

SEQ ID NO: 500100 - RNA, 64 nt, Human; identical to SEQ ID NO: 200988

SEQ ID NO: 500101 - RNA, 64 nt, Human; identical to SEQ ID NO: 200989

SEQ ID NO: 500102 - RNA, 51 nt, Human; identical to SEQ ID NO: 200995

SEQ ID NO: 500103 - RNA, 64 nt, Human; identical to SEQ ID NO: 200996

SEQ ID NO: 500104 - RNA, 64 nt, Human; identical to SEQ ID NO: 200997

SEQ ID NO: 500105 - RNA, 64 nt, Human; identical to SEQ ID NO: 200998

SEQ ID NO: 500106 - RNA, 64 nt, Human; identical to SEQ ID NO: 200999

SEQ ID NO: 500107 - RNA, 54 nt, Human; identical to SEQ ID NO: 201000

SEQ ID NO: 500108 - RNA, 64 nt, Human; identical to SEQ ID NO: 201001

SEQ ID NO: 500109 - RNA, 64 nt, Human; identical to SEQ ID NO: 201002

SEQ ID NO: 500110 - RNA, 51 nt, Human; identical to SEQ ID NO: 201003

SEQ ID NO: 500111 - RNA, 64 nt, Human; identical to SEQ ID NO: 201004

SEQ ID NO: 500112 - RNA, 64 nt, Human; identical to SEQ ID NO: 201005

SEQ ID NO: 500113 - RNA, 64 nt, Human; identical to SEQ ID NO: 201006

SEQ ID NO: 500114 - RNA, 64 nt, Human; identical to SEQ ID NO: 201007

SEQ ID NO: 500115 - RNA, 64 nt, Human; identical to SEQ ID NO: 201008

SEQ ID NO: 500116 - RNA, 64 nt, Human; identical to SEQ ID NO: 201009

SEQ ID NO: 500117 - RNA, 64 nt, Human; identical to SEQ ID NO: 201010

SEQ ID NO: 500118 - RNA, 64 nt, Human; identical to SEQ ID NO: 201011

SEQ ID NO: 500119 - RNA, 64 nt, Human; identical to SEQ ID NO: 201012

SEQ ID NO: 500120 - RNA, 64 nt, Human; identical to SEQ ID NO: 201013

SEQ ID NO: 500121 - RNA, 64 nt, Human; identical to SEQ ID NO: 201014

SEQ ID NO: 500122 - RNA, 64 nt, Human; identical to SEQ ID NO: 201015

SEQ ID NO: 500123 - RNA, 64 nt, Human; identical to SEQ ID NO: 201016

SEQ ID NO: 500124 - RNA, 64 nt, Human; identical to SEQ ID NO: 201017

SEQ ID NO: 500125 - RNA, 64 nt, Human; identical to SEQ ID NO: 201018

SEQ ID NO: 500126 - RNA, 64 nt, Human; identical to SEQ ID NO: 201019

SEQ ID NO: 500127 - RNA, 64 nt, Human; identical to SEQ ID NO: 201020

SEQ ID NO: 500128 - RNA, 64 nt, Human; identical to SEQ ID NO: 201021

SEQ ID NO: 500129 - RNA, 64 nt, Human; identical to SEQ ID NO: 201022

SEQ ID NO: 500130 - RNA, 64 nt, Human
ccuaaccugcucuugcacacuuuccuucugagccuccauggagaccagccugcaagccggccca

SEQ ID NO: 500131 - RNA, 64 nt, Human
cauuuauuuccaaccccaacagacacugacaggguccauggaauucuucgggaaauccuccaag

SEQ ID NO: 500132 - RNA, 64 nt, Human
ucaaagugucuuucuaccagggcaccagaucccuuccauggagcaggucaucucggguucacug

SEQ ID NO: 500133 - RNA, 64 nt, Human
gaggagcagugucggggagcuuggggccugguguuccauggagagggagaaaggaacaagcuug

SEQ ID NO: 500134 - RNA, 64 nt, Human
agccuaacugccaauaucaaguugcagauuuuaauccauggaaauuguguuuugugcugaauug

SEQ ID NO: 500135 - RNA, 64 nt, Human
ucuccaacguugagacuuugcagauggcacagacuccauggauaauagguaaacuuggggccgg

SEQ ID NO: 500136 - RNA, 64 nt, Human
aaugcuaaccuguggaaaguugguuuuguaaaauuccauggaucuugcuggagaagcauccaag

SEQ ID NO: 500137 - RNA, 64 nt, Human
gaagcuuugaagcgcuacuuagcaucuccuuucuuccauggagcucucacgauucaaacaugac

SEQ ID NO: 500138 - RNA, 64 nt, Human
cuaacaguagcauugugauggccaguauauccaguccauggauaaagaaaaugcaucugcaucu

SEQ ID NO: 500139 - RNA, 64 nt, Human
aggcagccccuuuggggaagaggagggugcauuuuccauggagcccaugucagaguccacucca

SEQ ID NO: 500140 - RNA, 64 nt, Human
uaggugggcauuuuucugugugcccccaaaaagcuccauggaaacaggcaccugguagcugcgg

SEQ ID NO: 500141 - RNA, 64 nt, Human
cugcccagcaguuccagcuguggcaaaagucucuuccauggacaaguguuugcauggggguuca

SEQ ID NO: 500142 - RNA, 59 nt, Human
agauuccagcucaucacuagaggcagcccuccauggacccaugaaaacugagaugagga

SEQ ID NO: 500143 - RNA, 54 nt, Human
caccugugacugaggauugaugacuccauggagccuggcccaggagaaccagag

SEQ ID NO: 500144 - RNA, 64 nt, Human
uaggagcuggcuggcagguguugggaccugcugcuccauggaugcaugcccuaagagugucacu

SEQ ID NO: 500145 - RNA, 64 nt, Human
aaaacuuuaugaacuucaccaccacuagugucuguccauggaguuagaggggacaucacuuaga

SEQ ID NO: 500146 - RNA, 64 nt, Human
cucuguacagaaguaaguaaaaguaggaauaguuuccauggauauuuuuauuuuuauuaacuuu

SEQ ID NO: 500147 - RNA, 64 nt, Human
uuaauaucgugccaagccucaaaaauaggcuuauuccauggaacaagaauuaaaaaugaauaag

SEQ ID NO: 500148 - RNA, 64 nt, Human
caucucgggacgcaugaccuucacgagcaauaaguccauggagaucgagguguugguggacgcc

SEQ ID NO: 500149 - RNA, 64 nt, Human
gcugccccuggguccgguggacggccgcuccugcuccauggacucugccuacggcacccucucc

SEQ ID NO: 500150 - RNA, 64 nt, Human
uauuuuguuccauuuauuuuugcaggcaaucuuuuccauggagggcaggguauccauucuuuac

SEQ ID NO: 500151 - RNA, 64 nt, Human
uggaucuguucuuugugaaagaauuccugauuucuccauggagcauguacacaacaauuuugau

SEQ ID NO: 500152 - RNA, 64 nt, Human
augcccggcgucccgucuaaagguguucugcagauccauggaaagcuuccugggaaacguaugc

SEQ ID NO: 500153 - RNA, 64 nt, Human
aacuugcauuauaugugcucuugaaucuguugucuccauggaccauuccucggaguagugguga

SEQ ID NO: 500154 - RNA, 64 nt, Human
cugcucaauauugggaaauauauugaggaguuauuccauggaaauacaaugcuuuccaccuacu

SEQ ID NO: 500155 - RNA, 64 nt, Human
ccacagcuccacuugcaucuucucaccaaagccuuccauggaugcacagggagcuucuuucucc

SEQ ID NO: 500156 - RNA, 64 nt, Human
agcauaugugcuuauaugcacacacacacacauuuccauggacccaggucuugcuugugucccc

SEQ ID NO: 500157 - RNA, 64 nt, Human
uaggagcagggcuggaccccaagccccucccucuuccauggagagaagagugaucuggcuucuc

SEQ ID NO: 500158 - RNA, 64 nt, Human
gaauacccagccaacucuccaccaucaauguaacuccauggacauugcugcucuuggugguguu

SEQ ID NO: 500159 - RNA, 64 nt, Human
agcauuagacuuuuaauugagugugcaaucguuuuccauggaguuugguccguucauuauuuuu

SEQ ID NO: 500160 - RNA, 64 nt, Human
aacagguccaggagaggcccauggagcagucucuuccauggaguaagaaggaagggagcaugua

SEQ ID NO: 500161 - RNA, 64 nt, Human; identical to SEQ ID NO: 90373

SEQ ID NO: 500162 - RNA, 64 nt, Human; identical to SEQ ID NO: 90374

SEQ ID NO: 500163 - RNA, 64 nt, Human; identical to SEQ ID NO: 90375

SEQ ID NO: 500164 - RNA, 63 nt, Human
acagcucuggccacaacagggcauuuuacaggugcgaaugacaguagcauuaugaguagugug

SEQ ID NO: 500165 - RNA, 64 nt, Human
uguuucaaaugcuuaaauauauaauacauuuuuuuccauggaagugagggaauauuucaguuuc

SEQ ID NO: 500166 - RNA, 64 nt, Human
aauuugcuguugccucaagaaaaagugcuuuuucuccauggaugaggcuagacccuaagaagua

SEQ ID NO: 500167 - RNA, 64 nt, Human
caccgugugcucaggccaggugugaauccugagguccauggaggugcagagaugagauuacucc

SEQ ID NO: 500168 - RNA, 64 nt, Human
aaagauuuacuuccuguccugccauucgugugcuuccauggacaaaccugauuuuuuucucuua

SEQ ID NO: 500169 - RNA, 64 nt, Human
gggcagaaaaugacauucaucuuuugaguccucauccauggagugcuguguuuggggggcugca

SEQ ID NO: 500170 - RNA, 64 nt, Human
cuugcccuaaagcaggaguccccccuaccugggguccauggacucccugaaauuguaugcaaaa

SEQ ID NO: 500171 - RNA, 64 nt, Human
guggggaggguggaggggugacaguggaggaaaauccauggauauccacgcagcagccccucuu

SEQ ID NO: 500172 - RNA, 64 nt, Human
gagcccaguuacugcacuugccacuaccaugcuguccauggaaggaauaaucagcaguucaguu

SEQ ID NO: 500173 - RNA, 64 nt, Human
uaugcaagaagaauauaaauaaauaaaaauauucuccauggagaauuugaacaaaauuuucuuc

SEQ ID NO: 500174 - RNA, 64 nt, Human
agcucagagccauacaaaaguaggcuggauucaguccauggaccauagauugcugucccccucg

SEQ ID NO: 500175 - RNA, 64 nt, Human
cuguacuuugguugauuuuuaagugggcuuccauuccauggauuuaaucagucccaagaagauc

SEQ ID NO: 500176 - RNA, 64 nt, Human
aacauacagaaccuguccaucuuuaagaccuucauccauggaaucuacuauacaggaggaugca

SEQ ID NO: 500177 - RNA, 64 nt, Human
acugaaaacagaauggaagcccugaagucaacacuccauggagaagcgugucuuuccuaauguc

SEQ ID NO: 500178 - RNA, 64 nt, Human
gaggcagaugcugcacugcacuacuccaaugucuuccauggagccucaggugcucccccucuca

SEQ ID NO: 500179 - RNA, 64 nt, Human
ccucagcagagucuucuugugcugccuuugggcuuccauggagcaggaggaacauaccacagaa

SEQ ID NO: 500180 - RNA, 64 nt, Human
ucuaaccacgagacccucaaccagcccaacaucuuccauggacacaugacauugaagaccaucc

SEQ ID NO: 500181 - RNA, 64 nt, Human; identical to SEQ ID NO: 90401

SEQ ID NO: 500182 - RNA, 64 nt, Human; identical to SEQ ID NO: 90402

SEQ ID NO: 500183 - RNA, 64 nt, Human; identical to SEQ ID NO: 90403

SEQ ID NO: 500184 - RNA, 63 nt, Human
ggaugugggaguugaaagaaagugguguaucaagcgaaugaacuacagcugugaggguuuagc

SEQ ID NO: 500185 - RNA, 64 nt, Human
uucagaagacuaaccagcuuagucagaagaugguuccauggaagaaaaaggccaaggaguuuga

SEQ ID NO: 500186 - RNA, 64 nt, Human
cccuuuugugcucuucugugaucacaggaccauuuccauggaaugcagauucauacccagccag

SEQ ID NO: 500187 - RNA, 64 nt, Human
cauauaugacauguuuauauuguaaaugcacuuuuccauggaauaauuuagggaaguguuuuaa

SEQ ID NO: 500188 - RNA, 64 nt, Human
guaagaaggaaugcgaguaaggauuggcuugaauuccauggaauuucuaguaugagacuauuua

SEQ ID NO: 500189 - RNA, 64 nt, Human
uguugagguaccuccaaggaccggccuuugcaccuccauggaaacgaagcaccaucauucccgu

SEQ ID NO: 500190 - RNA, 64 nt, Human
cugcaaccaauacuguuguucuccucgcugaccuuccauggaggccguguguuggagagugccc

SEQ ID NO: 500191 - RNA, 64 nt, Human
aguuauaauaaccugguuaucuaaccuguuccauuccauggaaccauggaggaggaagacccuc

SEQ ID NO: 500192 - RNA, 64 nt, Human
aaugcuuucuauguucauauacuguuuaccuuuuuccauggagucuccuggcaaagaauaaaau

SEQ ID NO: 500193 - RNA, 64 nt, Human
aaacugaauuauaagaggcugauaauuccagugguccauggaaugcuugaaaaaugugcaaaac

SEQ ID NO: 500194 - RNA, 64 nt, Human
uuacagcaguuuguacgagcucuuaaguguugauuccauggaacugacggcuuugcuuguuuug

SEQ ID NO: 500195 - RNA, 64 nt, Human
ccccucugugaagguggcuggagcaggccucugguccauggacuguccuuccuggcccuugcau

SEQ ID NO: 500196 - RNA, 64 nt, Human
cuuuauccuuaggaaaaugcuucuguuguaauaguccauggacaauauaaacugaaaaauguca

SEQ ID NO: 500197 - RNA, 64 nt, Human
aaggugguauaaaaacauagacuggaggagguaauccauggagagagaaaaagaagagggcuca

SEQ ID NO: 500198 - RNA, 64 nt, Human
auuucagaauguccuuaggccauucuccuucucuuccauggagaauccagccucacaaaaggau

SEQ ID NO: 500199 - RNA, 64 nt, Human
cgccacagggccuccagggagcauucgggucaaauccauggacacccugggcuacaaaccaagg

SEQ ID NO: 500200 - RNA, 64 nt, Human
acaaggccaugguuaauucuuaaggcaaggcaaauccauggaugagaagugcaaugggcauagu

SEQ ID NO: 500201 - RNA, 63 nt, Human
gccaggaggggcuguccaaucacauucaggcaugcgaaugagcugggcccugggugagguggg

SEQ ID NO: 500202 - RNA, 63 nt, Human
gcaaaggcugcgcagcguuaaugcgcauugcgugcgaaugaaccccugugaacgguugacuag

SEQ ID NO: 500203 - RNA, 64 nt, Human; identical to SEQ ID NO: 257840

SEQ ID NO: 500204 - RNA, 64 nt, Human; identical to SEQ ID NO: 257847

SEQ ID NO: 500205 - RNA, 64 nt, Human
uauuuuuuuacuugagcaaagaacuaaggauuuuuccauggacaugggcagcaauucacgcugu

SEQ ID NO: 500206 - RNA, 64 nt, Human
ugguuuucaaaugucaaauacaugaguaucucccuccauggacuggagaauugaaaaauugguu

SEQ ID NO: 500207 - RNA, 64 nt, Human
gccuggggauucacccagugguccccagaggugcuccauggaggcaacaagucauuccaugaag

SEQ ID NO: 500208 - RNA, 64 nt, Human
cggguuuuucaauaggaaaauaaggugagacucuuccauggagaagucuggcuuaguaagggaa

SEQ ID NO: 500209 - RNA, 64 nt, Human
uuguaaacacuauagcaucuguuaagauccaguguccauggaaacauucccacaugccgugacu

SEQ ID NO: 500210 - RNA, 64 nt, Human
ccgacuuugugcaaagcaaugcuaaucaggguucuccauggagcuucccucagcucuuaccuca

SEQ ID NO: 500211 - RNA, 64 nt, Human
uggucuaagcgguugucuagcuucauguccuguuuccauggauuguuuguaaccagcuuuuguu

SEQ ID NO: 500212 - RNA, 64 nt, Human
cugggaauuucaucuuucugccuccaccccuggguccauggagcuuucccgugauugcucuuuc

SEQ ID NO: 500213 - RNA, 64 nt, Human
aguucaacucuuucuuuguuacauuuaaacuauauccauggauaucagucugcuuuggacuccu

SEQ ID NO: 500214 - RNA, 64 nt, Human
cucccucuugugguucacuaaaaaacuugguuauuccauggaguugugcaaagcuauggcuucc

SEQ ID NO: 500215 - RNA, 64 nt, Human
cuuccaaguucuccggauauucacaaaacugccuuccauggagguccccuccucuccuagcuuc

SEQ ID NO: 500216 - RNA, 64 nt, Human
uaauaugagaucaucaaacauugauaguagggacuccauggaauauuugcccaguaaugguaag

SEQ ID NO: 500217 - RNA, 64 nt, Human
aauggcuccagugggucuaaacaaccacauccuauccauggauaggucuagucauaacacuuua

SEQ ID NO: 500218 - RNA, 64 nt, Human
aacucugaagauggacucuaaacuuugguuuaccuccauggaaaauaaagauuuagaaaccagg

SEQ ID NO: 500219 - RNA, 64 nt, Human
cagugaauaguaacuaaagaagccccuaccuugcuccauggauuaauuccuucuguucauuuuc

SEQ ID NO: 500220 - RNA, 64 nt, Human
uacucgcccaccuggaugucccaaagugcuagauuccauggaauuuuccugcauggagugcuac

SEQ ID NO: 500221 - RNA, 64 nt, Human; identical to SEQ ID NO: 257857

SEQ ID NO: 500222 - RNA, 64 nt, Human; identical to SEQ ID NO: 257864

SEQ ID NO: 500223 - RNA, 64 nt, Human; identical to SEQ ID NO: 257874

SEQ ID NO: 500224 - RNA, 64 nt, Human; identical to SEQ ID NO: 257881

SEQ ID NO: 500225 - RNA, 64 nt, Human
aagcggaggcaaacguuaacaaaccccaucgugguccauggagccuuucaaaaugggugcccug

SEQ ID NO: 500226 - RNA, 64 nt, Human
uaaaguauuucauagauaauuuugaguuuuaaaguccauggaggugauugguucucuuuacaca

SEQ ID NO: 500227 - RNA, 64 nt, Human
caaugacaggguaauauuuuauuuaucuucgaauuccauggacaaaauuaggcucacuuaaauu

SEQ ID NO: 500228 - RNA, 64 nt, Human
ggaugcagaagcgugcgugggaaugcagcuguuuuccauggaaccagacgcuacagagacugca

SEQ ID NO: 500229 - RNA, 64 nt, Human
gaagaauuuuaaugaaaaaauuacccagauuggcuccauggaaaaggaggaacagcguuuccgu

SEQ ID NO: 500230 - RNA, 64 nt, Human
ugcccucuguuuccccucagaacacccuguaccauccauggagcacgaggccuucagaaaagac

SEQ ID NO: 500231 - RNA, 64 nt, Human
uuugcucugcugucauccuguguacccuugucaauccauggagcugguucacuguaacuagcag

SEQ ID NO: 500232 - RNA, 64 nt, Human
uuauggugucacaaaaagacaaaugauuguaggauccauggaagugcacuuaggcuugcugugg

SEQ ID NO: 500233 - RNA, 64 nt, Human
cuugcuggaugauaccauaauguaucaaggagcguccauggauacaagauaagauguguaccuu

SEQ ID NO: 500234 - RNA, 64 nt, Human
uauagcaagccauuucauauaagaggcuugaacauccauggauuuugguauagaggagggguuu

SEQ ID NO: 500235 - RNA, 54 nt, Human
uucacgauggaaguugcuaaauucuccauggacauagagagaaaggaaugauau

SEQ ID NO: 500236 - RNA, 64 nt, Human
uuaaugcuugguagccuggggcuagauguggaacuccauggaucuguguucugacuggcaccuu

SEQ ID NO: 500237 - RNA, 64 nt, Human
ucacaacccucuucccuauuucccuaaaaguaucuccauggaaugaacugugcaaaaucuguag

SEQ ID NO: 500238 - RNA, 64 nt, Human
ggcccgugcccgccugcggcucaagcggaccagcuccauggauuccccaggagguccccugccc

SEQ ID NO: 500239 - RNA, 64 nt, Human
gguguuguauauuguguugaugacguacguuauuuccauggaagauagccgcuguggcagcugu

SEQ ID NO: 500240 - RNA, 64 nt, Human
cuguccuccucuucaggacaugcuccauuuauuuuccauggaagacacagggucagagaucugu

SEQ ID NO: 500241 - RNA, 54 nt, Human
acaccaaccaugcaaucuagcgaguccauggagcugagcagcaggaggaggagc

SEQ ID NO: 500242 - RNA, 52 nt, Human
uccagauacuaaauuauuagauuccauggaaacuugggacuguuaucuaccu

SEQ ID NO: 500243 - RNA, 57 nt, Human; identical to SEQ ID NO: 23186

SEQ ID NO: 500244 - RNA, 64 nt, Human; identical to SEQ ID NO: 90389

SEQ ID NO: 500245 - RNA, 64 nt, Human
aguaccacucuccccucccacaaacuucaacuccuccauggauggggcgacacggggagaacau

SEQ ID NO: 500246 - RNA, 64 nt, Human
acuguaauaauuuagcccucauuagguauuuaauuccauggauaaaccucagcuauauaauaga

SEQ ID NO: 500247 - RNA, 64 nt, Human
ccugggagaggcauguuagguuucagagauuuucuccauggagcaaggugcagugcuagaauau

SEQ ID NO: 500248 - RNA, 64 nt, Human
caguggugggguuugagcaaugcuucucugcccuuccauggaaaguggaaccagaaauggugcc

SEQ ID NO: 500249 - RNA, 64 nt, Human
cuaccuaauuccucaaugaccuuuaucuaaaaucuccauggaagcaauaaauucccuuuugaug

SEQ ID NO: 500250 - RNA, 64 nt, Human
guuugcuaaaccaaucuugcuaucccuaugccucuccauggagucaguguggaccucaugauua

SEQ ID NO: 500251 - RNA, 64 nt, Human
auucuuguaauuagguucuuguuaauacagucauuccauggaauuacuuuuuaaaauuccugug

SEQ ID NO: 500252 - RNA, 64 nt, Human
uggauguaaaaagcaaggagagaccccaacugucuccauggagaagaacuaggaaucaccacaa

SEQ ID NO: 500253 - RNA, 64 nt, Human
cacagauuuuuucuuuacaaucuuguucuccuuguccauggaccaucaauaguugacuugccag

SEQ ID NO: 500254 - RNA, 64 nt, Human
ccuuuccugaggacccggcagaaaugcagaaccauccauggacugugauucugaggcugcugag

SEQ ID NO: 500255 - RNA, 64 nt, Human
ugaaauucagaauuuuucuuuuuaauauauuucuuccauggaagaguugucaucacuaaaacuu

SEQ ID NO: 500256 - RNA, 64 nt, Human
cauuaagaaacucucuauuauuguguugcuauuuuccauggagucacaggcacacuaugacuuc

SEQ ID NO: 500257 - RNA, 64 nt, Human
acuuuuuauuucugcuauuugcuguuguguaauauccauggacauguaauccacuuacuccauc

SEQ ID NO: 500258 - RNA, 64 nt, Human
uucuagagaagaaagaacaacaucagcaguaaaguccauggaauagcuaguggucuguguuucu

SEQ ID NO: 500259 - RNA, 64 nt, Human
acauucagacucucagcuggucuuguguuacacauccauggaccgguucacuccaucauauaca

SEQ ID NO: 500260 - RNA, 64 nt, Human
cagcauuguggaaucauguuggaagcuccacauguccauggaaguuugugauguacggccgacc

SEQ ID NO: 500261 - RNA, 64 nt, Human; identical to SEQ ID NO: 257891

SEQ ID NO: 500262 - RNA, 64 nt, Human; identical to SEQ ID NO: 257898

SEQ ID NO: 500263 - RNA, 64 nt, Human; identical to SEQ ID NO: 257908

SEQ ID NO: 500264 - RNA, 64 nt, Human; identical to SEQ ID NO: 257915

SEQ ID NO: 500265 - RNA, 64 nt, Human
uggguuuucuggccauguugggaaucauggucauuccauggagaccuccccuugaggaggugaa

SEQ ID NO: 500266 - RNA, 64 nt, Human
ccaggcccuggcugcuucaugccagaggcccaaauccauggacugaaggagaugccccuucuac

SEQ ID NO: 500267 - RNA, 64 nt, Human
ccauucuuuggaacaaaucccccccacuccaaaguccauggauucaauggacucauccauuugu

SEQ ID NO: 500268 - RNA, 64 nt, Human
gauacagcgccacuccugcccccucuuggccccauccauggacucuugccucggugcagucucc

SEQ ID NO: 500269 - RNA, 64 nt, Human
gugccagaaaccgcccugagaucugccggucaucuccauggacuucugcaccccauuccauacc

SEQ ID NO: 500270 - RNA, 63 nt, Human
aggucccuaagacgagauaacuugacaaucaguuccauggacauggugaccacagccagcugg

SEQ ID NO: 500271 - RNA, 64 nt, Human
cuccucccaggauuccacaacaaaauucuuaucuuccauggaugcuuuaauuggaaguggguug

SEQ ID NO: 500272 - RNA, 64 nt, Human
acaagauuacgaaugcuuuugacuuuuuuuuuuguccauggaauauuugacagaugaaguagga

SEQ ID NO: 500273 - RNA, 64 nt, Human
cacauggaagacgcuauuccaggaucuuuaaauuuccauggaugcauauaggauguuugggagc

SEQ ID NO: 500274 - RNA, 64 nt, Human
gaacuauacuaccaaaagagcccaaaugaccaaauccauggauaauugcuucacagccuuggcc

SEQ ID NO: 500275 - RNA, 64 nt, Human
gccaggcgcuggugagcccuggucaaugagcgcuuccauggaaaccgcucggcugauuacauuu

SEQ ID NO: 500276 - RNA, 64 nt, Human
ggaagguuuccagucaggacucgcuguaccaauauccauggaggaauaugggagcguuucgcuc

SEQ ID NO: 500277 - RNA, 64 nt, Human
ucuaaaaaagggggagcuggccuccacccuauguuccauggauucggaacaagauuucagacau

SEQ ID NO: 500278 - RNA, 64 nt, Human
ugagugaaggaaugauauucauauauucauuuauuccauggacauuuaguuagugcuuuuuaua

SEQ ID NO: 500279 - RNA, 64 nt, Human
ccugagguaguucaugaaaaugcugugcacucauuccauggaauaaauguuggaaagcugaucu

SEQ ID NO: 500280 - RNA, 64 nt, Human
aucuucaugcuuggaaaucuagacaagaagagaauccauggauggacauggucgaggaauucgg

SEQ ID NO: 500281 - RNA, 64 nt, Human; identical to SEQ ID NO: 257922

SEQ ID NO: 500282 - RNA, 64 nt, Human; identical to SEQ ID NO: 257932

SEQ ID NO: 500283 - RNA, 64 nt, Human; identical to SEQ ID NO: 257940

SEQ ID NO: 500284 - RNA, 64 nt, Human; identical to SEQ ID NO: 257950

SEQ ID NO: 500285 - RNA, 64 nt, Human
uaauggauccuguuuuauaauacuuccaagccuguccauggauauaucaaaugucuucacuugu

SEQ ID NO: 500286 - RNA, 64 nt, Human
aucuguuacuuauuguaaauacugcccuagugucuccauggaccaaauuuauauuuauaauugu

SEQ ID NO: 500287 - RNA, 64 nt, Human
agaugugagauggaaaaacaaauucuggggcaaauccauggaaauuguuccaauuggcacaacc

SEQ ID NO: 500288 - RNA, 64 nt, Human
ggcucaagaggcccagggagcaaugggagggggcuccauggaggaggugucccaagcuuugaau

SEQ ID NO: 500289 - RNA, 64 nt, Human
uuaacauaaauguccuuuuaugauugucuaggauuccauggauggauggaauauaauugaguca

SEQ ID NO: 500290 - RNA, 64 nt, Human; identical to SEQ ID NO: 500279

SEQ ID NO: 500291 - RNA, 64 nt, Human
cauaaaaaauguugaguuaucaccaccuuucaauuccauggaccugauuuuuccagaaagaugu

SEQ ID NO: 500292 - RNA, 64 nt, Human
cacagaaauaucgaccaacaccucccuggucacauccauggaaucagagcaagauuuccuuucu

SEQ ID NO: 500293 - RNA, 64 nt, Human
aauugguuuguguacauuagaauguaugcacacauccauggacacucaggauauaguuggccua

SEQ ID NO: 500294 - RNA, 64 nt, Human
gcagagccaauacugaucaacugaaaguaaaguauccauggaguccucauugacaccucuuuuc

SEQ ID NO: 500295 - RNA, 64 nt, Human
agaaaguuggaguaggagacuuucacaagugguuuccauggagauagaaugaagcauucugugg

SEQ ID NO: 500296 - RNA, 64 nt, Human
gcauccuuaaaauacuuugaaaauauggccuugauccauggauuaaaucaguaucuaagugaau

SEQ ID NO: 500297 - RNA, 64 nt, Human
aaguaagccacacuauaucuucaugaguugcaaauccauggaaacacaguaaaccagcccugaa

SEQ ID NO: 500298 - RNA, 64 nt, Human
agccacggaggcguaggggccgcgcccuggccucuccauggacgugcggccccuugcuuccccu

SEQ ID NO: 500299 - RNA, 64 nt, Human
aacugccugaaguucgcacauucagauuguuguguccauggaguuuuaggaggggauggccuuu

SEQ ID NO: 500300 - RNA, 64 nt, Human
uucaaaggagggaaaacuuucuacgaaucuaagauccauggagcuagaauuguagaacuaggcu

SEQ ID NO: 500301 - RNA, 64 nt, Human; identical to SEQ ID NO: 257957

SEQ ID NO: 500302 - RNA, 64 nt, Human; identical to SEQ ID NO: 257967

SEQ ID NO: 500303 - RNA, 64 nt, Human; identical to SEQ ID NO: 257974

SEQ ID NO: 500304 - RNA, 64 nt, Human; identical to SEQ ID NO: 257984

SEQ ID NO: 500305 - RNA, 64 nt, Human
ggggaggagagaugcauacccguuucucaacugcuccauggauugaaaaaauaacaguuuaaaa

SEQ ID NO: 500306 - RNA, 64 nt, Human; identical to SEQ ID NO: 305569

SEQ ID NO: 500307 - RNA, 64 nt, Human; identical to SEQ ID NO: 305570

SEQ ID NO: 500308 - RNA, 64 nt, Human; identical to SEQ ID NO: 305571

SEQ ID NO: 500309 - RNA, 64 nt, Human; identical to SEQ ID NO: 305572

SEQ ID NO: 500310 - RNA, 64 nt, Human; identical to SEQ ID NO: 305573

SEQ ID NO: 500311 - RNA, 64 nt, Human; identical to SEQ ID NO: 305574

SEQ ID NO: 500312 - RNA, 64 nt, Human; identical to SEQ ID NO: 305575

SEQ ID NO: 500313 - RNA, 64 nt, Human; identical to SEQ ID NO: 305576

SEQ ID NO: 500314 - RNA, 64 nt, Human; identical to SEQ ID NO: 305577

SEQ ID NO: 500315 - RNA, 64 nt, Human; identical to SEQ ID NO: 305578

SEQ ID NO: 500316 - RNA, 64 nt, Human; identical to SEQ ID NO: 305579

SEQ ID NO: 500317 - RNA, 64 nt, Human; identical to SEQ ID NO: 305580

SEQ ID NO: 500318 - RNA, 64 nt, Human; identical to SEQ ID NO: 305581

SEQ ID NO: 500319 - RNA, 64 nt, Human; identical to SEQ ID NO: 305582

SEQ ID NO: 500320 - RNA, 64 nt, Human; identical to SEQ ID NO: 257818

SEQ ID NO: 500321 - RNA, 64 nt, Human; identical to SEQ ID NO: 257825

SEQ ID NO: 500322 - RNA, 64 nt, Human; identical to SEQ ID NO: 257832

SEQ ID NO: 500323 - RNA, 64 nt, Human
guuugagaguguacccagccagacugucuuuaucuccauggauuuucaucagggcaaagaucac

SEQ ID NO: 500324 - RNA, 64 nt, Human
ucaccuacuaaugucucuucuaacaucuuagagguccauggagaaggcauauggagaacauguu

SEQ ID NO: 500325 - RNA, 64 nt, Human
uacuugcacccagaaucuagugauuuuagucagauccauggaacagagcagcuucguaauacau

SEQ ID NO: 500326 - RNA, 64 nt, Human
uuuuaauuucagccauuccuagaguuacugaauauccauggagaucucaauucucuguguccaa

SEQ ID NO: 500327 - RNA, 64 nt, Human
guccgucaacugaugaguggauuaauaaaauguuuccauggaauauuccuuggauuacucagcc

SEQ ID NO: 500328 - RNA, 64 nt, Human
auuccauuuauaugaaauauacauacuaggcaaauccauggagauggaacauagauuagugguu

SEQ ID NO: 500329 - RNA, 64 nt, Human
augaaaacugcuguuuuaaagugguuuauuauguuccauggaagaaacuggucuuauugaaugc

SEQ ID NO: 500330 - RNA, 64 nt, Human
gaagcauggagggaaaggagguuguaaaauagacuccauggagacucuuaggaagcaguagauu

SEQ ID NO: 500331 - RNA, 64 nt, Human
aaaaaaaaaaaaaaaagccucagcauuuuaucauuccauggaaggagaaucuuuugaaagaaag

SEQ ID NO: 500332 - RNA, 64 nt, Human
aaaaugguagccacucacccuucacaaacugaaguccauggaccacggaagucgagaauuaaug

SEQ ID NO: 500333 - RNA, 64 nt, Human
cccauucuggauuuuuacuacaggcccuucaauauccauggagucucuucugagccauacaggg

SEQ ID NO: 500334 - RNA, 64 nt, Human
ucaaguaacuugccaaagguuacaagauauucauuccauggaugcacaaagaagugcaucuagu

SEQ ID NO: 500335 - RNA, 64 nt, Human
uggucugugcugacacuaaggaaucuucaugugguccauggacagcuauuucuaucuauucagu

SEQ ID NO: 500336 - RNA, 64 nt, Human
uaggaugaccuccacccuccuuggacaugaauccuccauggagggccugcuggcugaacaugcu

SEQ ID NO: 500337 - RNA, 64 nt, Human
acagcccccgggaaucuacugcuuccuaagagucuccauggagucuauuuuacaaccuccuuuc

SEQ ID NO: 500338 - RNA, 64 nt, Human
ggaggcagcauggagagaggccugugcuagaagcuccauggacgugucugcacaggguccucag

SEQ ID NO: 500339 - RNA, 64 nt, Human; identical to SEQ ID NO: 90384

SEQ ID NO: 500340 - RNA, 64 nt, Human; identical to SEQ ID NO: 90385

SEQ ID NO: 500341 - RNA, 64 nt, Human; identical to SEQ ID NO: 90386

SEQ ID NO: 500342 - RNA, 64 nt, Human; identical to SEQ ID NO: 90387

SEQ ID NO: 500343 - RNA, 64 nt, Human
uucuuuggaggaaaauguaugcauuuauaaguguuccauggaaucaguuuuuauuguaucgaua

SEQ ID NO: 500344 - RNA, 64 nt, Human
ugaaaguguaucaagaacucagcauuucuuugcauccauggacuugguuuggagacauaaggaa

SEQ ID NO: 500345 - RNA, 64 nt, Human
ggaacggaauuuugagggcaaagaaaccuguguuuccauggaauugcugagacguggcuccugg

SEQ ID NO: 500346 - RNA, 64 nt, Human
ccagcuggguucuccagggagcaggaguuggaccuccauggagccacuaggccuggccuccucu

SEQ ID NO: 500347 - RNA, 64 nt, Human
aauaugaccgucggcacacugcuguuccuccaguuccauggacagguucuguuuucacuuuuuc

SEQ ID NO: 500348 - RNA, 64 nt, Human
ggcugcuggcugcugcugccucgcgcgcugggguuccauggaggaacugggccugccgccccgg

SEQ ID NO: 500349 - RNA, 64 nt, Human
aaagacgguguuuuucaugggagcucuuuucugauccauggauaacaacucucacuuuagugga

SEQ ID NO: 500350 - RNA, 64 nt, Human
gagggaggcaguguccuuccugacagcacuugccuccauggaucuucuguacacagaacucuua

SEQ ID NO: 500351 - RNA, 64 nt, Human
agacccuggacguuuuucugcucucuucuggcccuccauggagucaugggccucggccucggcg

SEQ ID NO: 500352 - RNA, 64 nt, Human
aaugccccagaaauuuuccacacccuccucgguauccauggagagccuggggccagauaucugg

SEQ ID NO: 500353 - RNA, 64 nt, Human
gaagugaucuccuggaagacaagugccuucucccuccauggaucugugaucuucccagcucugc

SEQ ID NO: 500354 - RNA, 64 nt, Human
uuuuaaaguccacucccccaaaauacugauuucuuccauggauuauuuuuauaugauuuguaca

SEQ ID NO: 500355 - RNA, 64 nt, Human
cgcgcugguggagcuggaguugcaccgcggcagcuccauggaaaucaaucugggggagaaggac

SEQ ID NO: 500356 - RNA, 64 nt, Human
auggucagugguguccccaaggauagugcuggcuuccauggaaacccucacuccuggagauucc

SEQ ID NO: 500357 - RNA, 64 nt, Human
aaccagacagaauuuggaaacauuuucauaaagcuccauggagaguuuuaaagaaacauaugua

SEQ ID NO: 500358 - RNA, 64 nt, Human
guuuccugugauuuuaaaauaccgcgucuguuccuccauggaccagaguaauuggcacauuuua

SEQ ID NO: 500359 - RNA, 64 nt, Human; identical to SEQ ID NO: 90426

SEQ ID NO: 500360 - RNA, 64 nt, Human; identical to SEQ ID NO: 90427

SEQ ID NO: 500361 - RNA, 64 nt, Human; identical to SEQ ID NO: 90428

SEQ ID NO: 500362 - RNA, 64 nt, Human; identical to SEQ ID NO: 90429

SEQ ID NO: 500363 - RNA, 64 nt, Human
ccucccucccaggcacccagcacuuuaagccugcuccauggaggcagagaggcccggcaagcac

SEQ ID NO: 500364 - RNA, 64 nt, Human
agaacccuguaucuccuccauagauucuuaguauuccauggaacauauuuugaaaaccuuggga

SEQ ID NO: 500365 - RNA, 64 nt, Human
uacuagaaaggcagugccucagcccuucccugaauccauggagguguucuguuuggggcuuuuu

SEQ ID NO: 500366 - RNA, 64 nt, Human
cccucagcaacuggggccaggggccuggagacacuccauggagcucugcuugugaauuccagau

SEQ ID NO: 500367 - RNA, 55 nt, Human
aacaugaugccaucauuuaaggaaauccauggaccaaggauggaauacagauuga

SEQ ID NO: 500368 - RNA, 64 nt, Human
uuucauggcuuauaccccauugguuuauuuuauauccauggaccuuucuuucucugcuuucuug

SEQ ID NO: 500369 - RNA, 64 nt, Human
agagaggggaaggguacagagaaaccaucuacauuccauggaauguuuuuaauaaguaggcaag

SEQ ID NO: 500370 - RNA, 64 nt, Human
aaaguugguugccuuuaucauccugcugguuuuauccauggacugaacacccaacagcagugca

SEQ ID NO: 500371 - RNA, 64 nt, Human
uacgucucuaacuauugaggguaaacacaagcuuuccauggaauccugggaaaauuaauaauga

SEQ ID NO: 500372 - RNA, 64 nt, Human
cucccagccuaggcccuuaaucuugcuguuauuuuccauggacuaaaggucuggucaucugagc

SEQ ID NO: 500373 - RNA, 64 nt, Human
gcuuucaggaagcacacagucuacuacggugguuuccauggaagucacagagucaucaucuggc

SEQ ID NO: 500374 - RNA, 64 nt, Human
cugcccaggaacccagacuggacuucagucucccuccauggagacaaaggcuucccagagccac

SEQ ID NO: 500375 - RNA, 64 nt, Human
auguagacgaugcuuuaaagccuccgauccauguuccauggaagguacaucagcaauuaauucu

SEQ ID NO: 500376 - RNA, 64 nt, Human
cgcagacgccggccacaccauccaccuggccgccuccauggacccuugguggcuuuuguaaauu

SEQ ID NO: 500377 - RNA, 64 nt, Human
aaauuaaggaagcauuuucccauugaaaguguguuccauggaaagucacauuccagauuugaag

SEQ ID NO: 500378 - RNA, 64 nt, Human
uccaagaauauuauauucuucaaaaugguuaagcuccauggaguuagaugacuacacuuaaugc

SEQ ID NO: 500379 - RNA, 64 nt, Human; identical to SEQ ID NO: 90391

SEQ ID NO: 500380 - RNA, 64 nt, Human; identical to SEQ ID NO: 90393

SEQ ID NO: 500381 - RNA, 64 nt, Human; identical to SEQ ID NO: 90394

SEQ ID NO: 500382 - RNA, 64 nt, Human; identical to SEQ ID NO: 90395

SEQ ID NO: 500383 - RNA, 64 nt, Human
cuaucucuugauguuuucuugucaucuugaaggcuccauggaaugagauaaagcauugacccac

SEQ ID NO: 500384 - RNA, 64 nt, Human
agcaaaccaagugccggagcaccagcgccgccuuuccauggagacucguaagcagcuucaucug

SEQ ID NO: 500385 - RNA, 64 nt, Human
cccccuuccggaaaugaaaacaggaggcugugcuuccauggagcugggugucaagagaagaacu

SEQ ID NO: 500386 - RNA, 64 nt, Human
auacauaaacuauguagcaaaaguaucuguaaaauccauggaaaauaaaaguuguaucauucuu

SEQ ID NO: 500387 - RNA, 64 nt, Human
agugaugcccgcagaaggcgucugggccuaaggauccauggaagucaggagcauuaaaucccaa

SEQ ID NO: 500388 - RNA, 64 nt, Human
caggaagagcagcgcuguguugcagaauggaguuuccauggauuucuaccagaccacugaagga

SEQ ID NO: 500389 - RNA, 64 nt, Human
uuuaauaccucauucugucuaugcaagaugaaaauccauggaguuuuuucuuggcuuuuguacc

SEQ ID NO: 500390 - RNA, 64 nt, Human
aagaggcagagugagucacugcacgcaccuggccuccauggacgagcaagggcaucccagaaac

SEQ ID NO: 500391 - RNA, 64 nt, Human
caucccuguggggagugcagggccagauggggacuccauggagacagccgaccggcgacagccu

SEQ ID NO: 500392 - RNA, 64 nt, Human
ugaggagaguucuuuuuugcuuaaagcccccuucuccauggaguguuggcuucucaauagagug

SEQ ID NO: 500393 - RNA, 64 nt, Human
uugcaaaagccaagagguguaaacaacccaaguguccauggauggaugaauggacaaacaaaau

SEQ ID NO: 500394 - RNA, 64 nt, Human
uuaacuaaaaagaagaauuuuuuuaaguauuaauuccauggacaauauaaaaucugugugauug

SEQ ID NO: 500395 - RNA, 64 nt, Human
auacucuguagucucaguucguguuugauuccauuccauggaaauaaaaaguauguuguacaua

SEQ ID NO: 500396 - RNA, 64 nt, Human
gggaacugcuggcucuaagaaccuucuauucacauccauggauugggcccacuacucauagcag

SEQ ID NO: 500397 - RNA, 64 nt, Human
uucuuauuggugaaaaccagggggaugaguggcuuccauggagagauuuccugauuucucaggg

SEQ ID NO: 500398 - RNA, 64 nt, Human
uuuggcuggaaguccaugggccacccuguucuuguccauggaggacuccgaggguuccaaguau

SEQ ID NO: 500399 - RNA, 64 nt, Human; identical to SEQ ID NO: 90396

SEQ ID NO: 500400 - RNA, 64 nt, Human; identical to SEQ ID NO: 90397

SEQ ID NO: 500401 - RNA, 64 nt, Human; identical to SEQ ID NO: 90398

SEQ ID NO: 500402 - RNA, 64 nt, Human; identical to SEQ ID NO: 90400

SEQ ID NO: 500403 - RNA, 64 nt, Human
aggggauggcagcuacugccaccuuccagaugguuccauggaguucugaucuuugggcauggcc

SEQ ID NO: 500404 - RNA, 64 nt, Human
cccgcuuugcacaccacagagugcccucacccacuccauggaccucaagcagcccucagagcug

SEQ ID NO: 500405 - RNA, 64 nt, Human
auaaguguuuuuacuugugaggaaugagaagccauccauggaaauuugaacugagugggggcag

SEQ ID NO: 500406 - RNA, 64 nt, Human
gcagcagauagucccaguauacucacuuaucucauccauggauguaaaugaugaugaaucaaca

SEQ ID NO: 500407 - RNA, 64 nt, Human
gugcuugaccuguuuucuuaaaaggccuacguccuccauggaagugccagcucauuacuaccac

SEQ ID NO: 500408 - RNA, 64 nt, Human
auauuuuauguuuuaugauauggguuagggauucuccauggacuccagaaacccuaaaauacaa

SEQ ID NO: 500409 - RNA, 64 nt, Human
gcaucuugccuuugggauugggauccaaggguucuccauggauggauccaagucauagagggga

SEQ ID NO: 500410 - RNA, 64 nt, Human
ugaggacuagggcaggcagcugggggcacuugguuccauggagccuggauaaacagugcuuugg

SEQ ID NO: 500411 - RNA, 64 nt, Human
guccccaccgcggcggcccuucucagccccucccuccauggagggacccauagggcuagacacu

SEQ ID NO: 500412 - RNA, 64 nt, Human
accuagaguuguuacuuuuuugaugggaugacauuccauggauuuauguacugaaauggauuuc

SEQ ID NO: 500413 - RNA, 64 nt, Human
gcgcaggcccaccuuggcauggccgccucaggccuccauggagggagcugcuauguccccacca

SEQ ID NO: 500414 - RNA, 64 nt, Human
ccugaccguggggguccagaugguccaggcccucuccauggaccuguauguggggguggucucu

SEQ ID NO: 500415 - RNA, 64 nt, Human
augaagccagcccucgguaucugcagguuucucauccauggauucaaccaacugcaaauggaaa

SEQ ID NO: 500416 - RNA, 64 nt, Human
ugugaggaagccgcuggggccaguuggucccccuuccauggacuuuguuaguuucuccaagcag

SEQ ID NO: 500417 - RNA, 64 nt, Human
ccccccuaggggcuuucugucugccccagggugcuccauggaucucccuguggcagcaggcaug

SEQ ID NO: 500418 - RNA, 64 nt, Human
uuuggguaggggaggggagcucggcugucagaacuccauggauauguuucuuuggauggagggg

SEQ ID NO: 500419 - RNA, 64 nt, Human; identical to SEQ ID NO: 90405

SEQ ID NO: 500420 - RNA, 64 nt, Human; identical to SEQ ID NO: 90406

SEQ ID NO: 500421 - RNA, 64 nt, Human; identical to SEQ ID NO: 90407

SEQ ID NO: 500422 - RNA, 64 nt, Human; identical to SEQ ID NO: 90408

SEQ ID NO: 500423 - RNA, 64 nt, Human
cugacuggaggaggccugucccaauucugcccgcuccauggaaaagcgggcuugacugcauugc

SEQ ID NO: 500424 - RNA, 64 nt, Human
agagcgguaccuuuccuacugucuuuucuuugacuccauggaggaauuuguaacgaucggugug

SEQ ID NO: 500425 - RNA, 64 nt, Human
cagccucacaccagcugccuccuccacucagcauuccauggaccaaauugugcccuggguagcc

SEQ ID NO: 500426 - RNA, 64 nt, Human
ugccucuugacugucccuucucuuccuaccuccauccauggaaaauuaguuauuuucugauccu

SEQ ID NO: 500427 - RNA, 64 nt, Human
cugcaccuucugauuuuacuuaagcagcuaccauuccauggacuugccucccagagcagcacaa

SEQ ID NO: 500428 - RNA, 64 nt, Human
ugugcaaacaaaaggugugccuggcagccauuucuccauggaguugcuaaguggccggaaaaca

SEQ ID NO: 500429 - RNA, 64 nt, Human
gauuuuaaaaguuauuaauauuuuaauuuaaucuuccauggauuuugguggguuuugaacauaa

SEQ ID NO: 500430 - RNA, 64 nt, Human
gauaaaacucaaaccuacccagccuuccccccacuccauggaaguccuugggaugggcgucugc

SEQ ID NO: 500431 - RNA, 64 nt, Human
caugcucauaugugugcacgcuuggacacccaccuccauggacaccuagccacccuguugugug

SEQ ID NO: 500432 - RNA, 64 nt, Human
accucgcccccgcaagccccagccccgaggaccguccauggaccuuauuuuuauaugagauuaa

SEQ ID NO: 500433 - RNA, 64 nt, Human
aggggacgcuaacuccccuugauaaagucucgguuccauggaggacuugaguggccccaaaggc

SEQ ID NO: 500434 - RNA, 64 nt, Human
agacauuucuaaaacauaugugcuucauuaugaauccauggauggcucaauucuuaaauguaaa

SEQ ID NO: 500435 - RNA, 64 nt, Human
cucaaaaaaauaaaaauaaaaaaaaaaucuuaguuccauggaauuuuaagcauuguucccccuc

SEQ ID NO: 500436 - RNA, 64 nt, Human
aggccgcaggugucuuucuguuaugugaaugaguuccauggaggggcauaugugugauuccacc

SEQ ID NO: 500437 - RNA, 64 nt, Human
ggccucaaaauaccgacugcguccauucucugccuccauggaaacagccccuagaaucugaaag

SEQ ID NO: 500438 - RNA, 64 nt, Human
ccuccccucccgcugccccagaaguuucuaucauuccauggagaaagcuguguuccaaugaauc

SEQ ID NO: 500439 - RNA, 64 nt, Human; identical to SEQ ID NO: 90430

SEQ ID NO: 500440 - RNA, 64 nt, Human; identical to SEQ ID NO: 90431

SEQ ID NO: 500441 - RNA, 64 nt, Human; identical to SEQ ID NO: 257842

SEQ ID NO: 500442 - RNA, 64 nt, Human
caagaaaaaaagauacuauggggucaaguguaacuccauggaaaugccacgucugcucuucagu

SEQ ID NO: 500443 - RNA, 50 nt, Human
uggccccacggcagcgcugauccauggagacugcgagaccguggcacccc

SEQ ID NO: 500444 - RNA, 64 nt, Human
uuccagugccugacuauagggaggcacuccugauuccauggagcagcccggacuuugagaaugg

SEQ ID NO: 500445 - RNA, 64 nt, Human
cuccauagcugcaacgccuccugcccagccgguuuccauggaaacaacugcucaguuccuugug

SEQ ID NO: 500446 - RNA, 64 nt, Human
ugaagcagccucacucuuaacuucguguucacacuccauggaaaccccagacugggacacaggc

SEQ ID NO: 500447 - RNA, 64 nt, Human
gguuuccagggaauuugaaugauuguauuuuguguccauggaacguuuauagacauggaggcag

SEQ ID NO: 500448 - RNA, 64 nt, Human
ugacaguaaagggcaggaagggaauacaaagguauccauggagguagcaccacaggaagcaggc

SEQ ID NO: 500449 - RNA, 64 nt, Human
auccccagcuccacacggccugcacaccuguguuuccauggaaaugccaccgugucugcuccca

SEQ ID NO: 500450 - RNA, 64 nt, Human
cugagcgggggcauccccuccuuuguacauagucuccauggaugucccugcccuguagccacca

SEQ ID NO: 500451 - RNA, 64 nt, Human
uggugcccagacucaaggccuccagccacuuauuuccauggauuccccuggacauauucccaug

SEQ ID NO: 500452 - RNA, 64 nt, Human
gcugagugauacugcccuccagcucuuuccuccuuccauggaaccugacguagcugcaaaggac

SEQ ID NO: 500453 - RNA, 64 nt, Human
gugcuagaguuggggagugagaugaguggugcuguccauggaaucaggccacagcaggaacugc

SEQ ID NO: 500454 - RNA, 64 nt, Human
uuugaucuuuuccuuuugcuuuuugaauagagacuccauggaguuggucauggaaugggcuggg

SEQ ID NO: 500455 - RNA, 64 nt, Human
uguguauauaugugugcccuggacuguuucaagguccauggaguacggcuggugugucauacug

SEQ ID NO: 500456 - RNA, 64 nt, Human
uguagaaaacugauaauaauacaaaugauuguuguccauggaaaggcaaauaaauuuucuacag

SEQ ID NO: 500457 - RNA, 64 nt, Human
gggggccuuggagcuccugcucuucucccgcaccuccauggaugcacugcugccgagcagagcg

SEQ ID NO: 500458 - RNA, 64 nt, Human; identical to SEQ ID NO: 90380

SEQ ID NO: 500459 - RNA, 64 nt, Human; identical to SEQ ID NO: 90381

SEQ ID NO: 500460 - RNA, 64 nt, Human; identical to SEQ ID NO: 90382

SEQ ID NO: 500461 - RNA, 64 nt, Human; identical to SEQ ID NO: 90409

SEQ ID NO: 500462 - RNA, 64 nt, Human
cuagcuuuucacuagcugugaaccagccuuccuguccauggacgugaaacugcauaguaaugag

SEQ ID NO: 500463 - RNA, 64 nt, Human
aaccuugccgaucaccaggcauaaccuaauuuuauccauggaagaaacacagaaaggcaucuaa

SEQ ID NO: 500464 - RNA, 64 nt, Human
gagcccauacucaauaaucaugccauccugccuuuccauggaauaacugauggaugguuagaaa

SEQ ID NO: 500465 - RNA, 64 nt, Human
aacuagaaaguaugauaaacaacaguuggaggaauccauggaaaauagacgagaaaauguaaau

SEQ ID NO: 500466 - RNA, 64 nt, Human
ucagccccugccuugauguccccauuuagccaucuccauggagcuccugcuggagggcccugaa

SEQ ID NO: 500467 - RNA, 64 nt, Human
gccccacacggccaucugcccaguccuugacucguccauggagcugagggucggaggaaccuuc

SEQ ID NO: 500468 - RNA, 64 nt, Human
caucaguaauaacuaguuggccaacugacugugguccauggacuacacagugaguagagguucu

SEQ ID NO: 500469 - RNA, 64 nt, Human
ggaaucucaaaaguucuuugggacaaaacagaaguccauggaguuaucuaagcucuuguaagug

SEQ ID NO: 500470 - RNA, 64 nt, Human
uccacuagcccagggggggacgcagaccccacacuccauggagucuggaaugcaugggagcugc

SEQ ID NO: 500471 - RNA, 64 nt, Human
uccacuagcccagggaggacccagaccuccacacuccauggagacucaguucuccuaggaccau

SEQ ID NO: 500472 - RNA, 64 nt, Human
ucgaagcaaccauggaucaaaaguauuuggagcauccauggauugcagugaucauuaaucaaaa

SEQ ID NO: 500473 - RNA, 64 nt, Human
gagccuucucugaugugacucauguauccaaacauccauggauuucccauaaauuugagguaug

SEQ ID NO: 500474 - RNA, 64 nt, Human
ucuuuuucaagacauacugguuucaugugacaccuccauggauuuuuuuccagccucuaaguca

SEQ ID NO: 500475 - RNA, 64 nt, Human
ggagcuguggcccgcggagaagcagucaucaucauccauggaguggcugcuggugcccggggag

SEQ ID NO: 500476 - RNA, 64 nt, Human
uucgaagcccugaacuugagacaccaaguuugucuccauggaaacacguagccgcugcaguugg

SEQ ID NO: 500477 - RNA, 64 nt, Human
acucuccugcgggauugcagauaugugaauggacuccauggacagaaaagcuacgaauguaugg

SEQ ID NO: 500478 - RNA, 64 nt, Human; identical to SEQ ID NO: 90412

SEQ ID NO: 500479 - RNA, 64 nt, Human; identical to SEQ ID NO: 90413

SEQ ID NO: 500480 - RNA, 63 nt, Human; identical to SEQ ID NO: 90414

SEQ ID NO: 500481 - RNA, 64 nt, Human; identical to SEQ ID NO: 90415

SEQ ID NO: 500482 - RNA, 64 nt, Human
aacuagaauauucaacuccauauggaaaaucauauccauggaucucuuuggcauuaugaagaau

SEQ ID NO: 500483 - RNA, 64 nt, Human
uccucggcguugacaggcagcuggggggacaugauccauggacaaggccaucccggccguggga

SEQ ID NO: 500484 - RNA, 64 nt, Human
gguguuugagugcagagacacuggucuggggugauccauggaggaccauuaaaaugugacaccu

SEQ ID NO: 500485 - RNA, 64 nt, Human
cuaaaaaaauguauauggguaaggaccugaaagauccauggaaaaguuaacccaguugagauuu

SEQ ID NO: 500486 - RNA, 64 nt, Human
ggggaagauuuccccuuuagaucaaacugccccuuccauggaaaagcuggaaaaaaacucugga

SEQ ID NO: 500487 - RNA, 64 nt, Human
ccaauagcaaauucaaagcaagcaacuugcaggcuccauggaacuuuuaaugaaggacaguguc

SEQ ID NO: 500488 - RNA, 64 nt, Human
caaaagacucacucacaaacuucugaacacaaacuccauggaugaaagcuguuuauuuuguuuc

SEQ ID NO: 500489 - RNA, 64 nt, Human
caccauccgcccaccucgggcugaccccaccuccuccauggacagugugagccccgggccgugc

SEQ ID NO: 500490 - RNA, 64 nt, Human
agaugcagacucccguguaguuucagauucuugguccauggaugacaccaccugcccaugcuuc

SEQ ID NO: 500491 - RNA, 64 nt, Human
agaggcagacucccauguggucccagauccuugguccauggaugacaccaccuucccaugcuuc

SEQ ID NO: 500492 - RNA, 64 nt, Human
cccucuagaauuaccacugagauacacuauuugauccauggauaaccgguaaugggaaaaugcu

SEQ ID NO: 500493 - RNA, 64 nt, Human
cccauaagacccccaggaagcuaggcacuuucuuuccauggaaacauuuagacacaaaccuccc

SEQ ID NO: 500494 - RNA, 64 nt, Human
ugguaugagcuaugaccaagagcaggcuuccugcuccauggaguccugaguugcucuggggcag

SEQ ID NO: 500495 - RNA, 64 nt, Human
cgaguacagacuuuguccuauuggcaacaaggaguccauggagcuuuagagagaugcacucagc

SEQ ID NO: 500496 - RNA, 64 nt, Human
gacgguaaagcuggaggugccugagaccagggcuuccauggagcgggacacacuguaaauggau

SEQ ID NO: 500497 - RNA, 64 nt, Human
ccugcuggaccuggacccacugaagaggucgggcuccauggagcagagguuggccucccuggag

SEQ ID NO: 500498 - RNA, 64 nt, Human; identical to SEQ ID NO: 90410

SEQ ID NO: 500499 - RNA, 64 nt, Human; identical to SEQ ID NO: 90416

SEQ ID NO: 500500 - RNA, 64 nt, Human; identical to SEQ ID NO: 90417

SEQ ID NO: 500501 - RNA, 64 nt, Human; identical to SEQ ID NO: 90418

SEQ ID NO: 500502 - RNA, 64 nt, Human
aaucacucugagcauccacaacaaaaauucaaacuccauggacuuuugcuucuuugcuaguagc

SEQ ID NO: 500503 - RNA, 64 nt, Human
ggaugaacccauuccacuguaugaggcaaaaguuuccauggaagcuguucagaaaaaucaagga

SEQ ID NO: 500504 - RNA, 64 nt, Human
ccugggguggggacacaaucaccccagguugagauccauggagccaggucuguuugccaccaag

SEQ ID NO: 500505 - RNA, 64 nt, Human
caugacggugggcagagaggccugucuuaaaguuuccauggaauuguuuuauaaaauaucuuaa

SEQ ID NO: 500506 - RNA, 64 nt, Human
uuucgacuucaaagauacugacaugaagcggcuuuccauggagauagagaaagaaaaguaugua

SEQ ID NO: 500507 - RNA, 64 nt, Human
aucuugcugcuccucuuggcacucaggggcaccuuccauggagccagaccggguggaggggcuu

SEQ ID NO: 500508 - RNA, 64 nt, Human
acagacccgggacccagcugugcuacccaccccuuccauggacugaauaagauggacuaacagg

SEQ ID NO: 500509 - RNA, 64 nt, Human
agcuccaucuuccauuccugguuuuagggcagaauccauggagacugcuuccagaaggcaucug

SEQ ID NO: 500510 - RNA, 64 nt, Human
ugucccccuggccuccaggcuccuccucugccucuccauggaguggguggggaggugguggggg

SEQ ID NO: 500511 - RNA, 64 nt, Human
ggaaagaaagacccaagacguuggaauggcuguuuccauggacacaaucuccauagugacaaug

SEQ ID NO: 500512 - RNA, 64 nt, Human
aucccaaggcauccaucagagcagacgcccggguuccauggacccuccuccccacggccaugcc

SEQ ID NO: 500513 - RNA, 64 nt, Human
ccuuaaaucguuuagcauggcaugagggccacauuccauggacgggaagaccccuuccucuuca

SEQ ID NO: 500514 - RNA, 64 nt, Human
aagggccuagauuuggagacuuuguuccuuagcauccauggaugcagaaaugagugauaaauuu

SEQ ID NO: 500515 - RNA, 56 nt, Human
uaccauccgccucaucuugauauuguuccauggacauuaaaugagaccuuuucugc

SEQ ID NO: 500516 - RNA, 64 nt, Human
auucccagccugacuagaacuccugucuucuuucuccauggagccuaccucugucugagacagg

SEQ ID NO: 500517 - RNA, 53 nt, Human
aggcccauaccaacaaguaaaacuccauggaaucuucuccugugauaucugac

SEQ ID NO: 500518 - RNA, 64 nt, Human
aaguucaguuuuguuucuuugcgugcagugucuuuccauggauaaugcauuugauuuaucagug

SEQ ID NO: 500519 - RNA, 64 nt, Human; identical to SEQ ID NO: 257849

SEQ ID NO: 500520 - RNA, 64 nt, Human; identical to SEQ ID NO: 257859

SEQ ID NO: 500521 - RNA, 64 nt, Human; identical to SEQ ID NO: 257866

SEQ ID NO: 500522 - RNA, 64 nt, Human
aggaacauggaaaauggagggccaccacuuagguuccauggagaauauguggcaugaucuugac

SEQ ID NO: 500523 - RNA, 64 nt, Human
uuaucuccugaaaaaagcaguucuuaacccaguguccauggacucagaaacuccaugaugcccc

SEQ ID NO: 500524 - RNA, 64 nt, Human
ugcuccagaaaguuuaaggggucuguuucucaucuccauggacaucuucaacagcuucaccuga

SEQ ID NO: 500525 - RNA, 58 nt, Human
aaagcugcucauugaaauagauuccugcuccauggaguucaugcaaccuggugcaaga

SEQ ID NO: 500526 - RNA, 64 nt, Human
ucugaacagcagaguuauggaguaucagaaucuuuccauggaaaccuccauauggccuuucuau

SEQ ID NO: 500527 - RNA, 64 nt, Human; identical to SEQ ID NO: 90358

SEQ ID NO: 500528 - RNA, 64 nt, Human; identical to SEQ ID NO: 90359

SEQ ID NO: 500529 - RNA, 64 nt, Human; identical to SEQ ID NO: 90360

SEQ ID NO: 500530 - RNA, 64 nt, Human; identical to SEQ ID NO: 90361

SEQ ID NO: 500531 - RNA, 64 nt, Human; identical to SEQ ID NO: 90362

SEQ ID NO: 500532 - RNA, 64 nt, Human; identical to SEQ ID NO: 90363

SEQ ID NO: 500533 - RNA, 64 nt, Human; identical to SEQ ID NO: 90364

SEQ ID NO: 500534 - RNA, 64 nt, Human; identical to SEQ ID NO: 90365

SEQ ID NO: 500535 - RNA, 64 nt, Human; identical to SEQ ID NO: 90366

SEQ ID NO: 500536 - RNA, 64 nt, Human; identical to SEQ ID NO: 90367

SEQ ID NO: 500537 - RNA, 64 nt, Human; identical to SEQ ID NO: 90368

SEQ ID NO: 500538 - RNA, 64 nt, Human; identical to SEQ ID NO: 90369

SEQ ID NO: 500539 - RNA, 54 nt, Human; identical to SEQ ID NO: 23168

SEQ ID NO: 500540 - RNA, 64 nt, Human; identical to SEQ ID NO: 90371

SEQ ID NO: 500541 - RNA, 64 nt, Human; identical to SEQ ID NO: 90372

SEQ ID NO: 500542 - RNA, 64 nt, Human; identical to SEQ ID NO: 305583

SEQ ID NO: 500543 - RNA, 64 nt, Human; identical to SEQ ID NO: 305584

SEQ ID NO: 500544 - RNA, 64 nt, Human; identical to SEQ ID NO: 305585

SEQ ID NO: 500545 - RNA, 64 nt, Human; identical to SEQ ID NO: 305586

SEQ ID NO: 500546 - RNA, 64 nt, Human; identical to SEQ ID NO: 303826

SEQ ID NO: 500547 - RNA, 64 nt, Human; identical to SEQ ID NO: 303827

SEQ ID NO: 500548 - RNA, 55 nt, Human; identical to SEQ ID NO: 302739

SEQ ID NO: 500549 - RNA, 64 nt, Human; identical to SEQ ID NO: 305534

SEQ ID NO: 500550 - RNA, 64 nt, Human; identical to SEQ ID NO: 305535

SEQ ID NO: 500551 - RNA, 64 nt, Human; identical to SEQ ID NO: 305536

SEQ ID NO: 500552 - RNA, 64 nt, Human; identical to SEQ ID NO: 305398

SEQ ID NO: 500553 - RNA, 64 nt, Human; identical to SEQ ID NO: 305399

SEQ ID NO: 500554 - RNA, 64 nt, Human; identical to SEQ ID NO: 302740

SEQ ID NO: 500555 - RNA, 64 nt, Human; identical to SEQ ID NO: 305566

SEQ ID NO: 500556 - RNA, 64 nt, Human; identical to SEQ ID NO: 305567

SEQ ID NO: 500557 - RNA, 64 nt, Human; identical to SEQ ID NO: 257876

SEQ ID NO: 500558 - RNA, 64 nt, Human; identical to SEQ ID NO: 257883

SEQ ID NO: 500559 - RNA, 64 nt, Human; identical to SEQ ID NO: 257893

SEQ ID NO: 500560 - RNA, 64 nt, Human; identical to SEQ ID NO: 305568

SEQ ID NO: 500561 - RNA, 64 nt, Human; identical to SEQ ID NO: 305381

SEQ ID NO: 500562 - RNA, 64 nt, Human; identical to SEQ ID NO: 305382

SEQ ID NO: 500563 - RNA, 64 nt, Human; identical to SEQ ID NO: 302741

SEQ ID NO: 500564 - RNA, 64 nt, Human; identical to SEQ ID NO: 305295

SEQ ID NO: 500565 - RNA, 64 nt, Human; identical to SEQ ID NO: 305296

SEQ ID NO: 500566 - RNA, 64 nt, Human; identical to SEQ ID NO: 305297

SEQ ID NO: 500567 - RNA, 64 nt, Human; identical to SEQ ID NO: 305383

SEQ ID NO: 500568 - RNA, 64 nt, Human; identical to SEQ ID NO: 302923

SEQ ID NO: 500569 - RNA, 64 nt, Human; identical to SEQ ID NO: 305330

SEQ ID NO: 500570 - RNA, 64 nt, Human; identical to SEQ ID NO: 305331

SEQ ID NO: 500571 - RNA, 64 nt, Human; identical to SEQ ID NO: 305332

SEQ ID NO: 500572 - RNA, 64 nt, Human; identical to SEQ ID NO: 305347

SEQ ID NO: 500573 - RNA, 64 nt, Human; identical to SEQ ID NO: 305348

SEQ ID NO: 500574 - RNA, 64 nt, Human; identical to SEQ ID NO: 302924

SEQ ID NO: 500575 - RNA, 62 nt, Human
gggucugccagccagcccuccuccccgacccagcgccuaagcucacagagugucgucgccca

SEQ ID NO: 500576 - RNA, 62 nt, Human
aaaauacaaaaauuagccgggcaugguggcgggcgccuaaaaucccagcuacucgggagacu

SEQ ID NO: 500577 - RNA, 62 nt, Human
gcucucuacccaagcuguuacucccucauggggcgccuaaggagacucaaguggacccauca

SEQ ID NO: 500578 - RNA, 64 nt, Human; identical to SEQ ID NO: 305349

SEQ ID NO: 500579 - RNA, 64 nt, Human; identical to SEQ ID NO: 305432

SEQ ID NO: 500580 - RNA, 64 nt, Human; identical to SEQ ID NO: 305433

SEQ ID NO: 500581 - RNA, 64 nt, Human; identical to SEQ ID NO: 303125

SEQ ID NO: 500582 - RNA, 64 nt, Human; identical to SEQ ID NO: 305400

SEQ ID NO: 500583 - RNA, 64 nt, Human; identical to SEQ ID NO: 305551

SEQ ID NO: 500584 - RNA, 64 nt, Human; identical to SEQ ID NO: 305552

SEQ ID NO: 500585 - RNA, 64 nt, Human; identical to SEQ ID NO: 303126

SEQ ID NO: 500586 - RNA, 64 nt, Human; identical to SEQ ID NO: 305415

SEQ ID NO: 500587 - RNA, 64 nt, Human; identical to SEQ ID NO: 305416

SEQ ID NO: 500588 - RNA, 64 nt, Human; identical to SEQ ID NO: 305417

SEQ ID NO: 500589 - RNA, 64 nt, Human; identical to SEQ ID NO: 305364

SEQ ID NO: 500590 - RNA, 64 nt, Human; identical to SEQ ID NO: 305365

SEQ ID NO: 500591 - RNA, 64 nt, Human; identical to SEQ ID NO: 303127

SEQ ID NO: 500592 - RNA, 64 nt, Human; identical to SEQ ID NO: 305434

SEQ ID NO: 500593 - RNA, 64 nt, Human; identical to SEQ ID NO: 257900

SEQ ID NO: 500594 - RNA, 64 nt, Human; identical to SEQ ID NO: 257910

SEQ ID NO: 500595 - RNA, 64 nt, Human; identical to SEQ ID NO: 257917

SEQ ID NO: 500596 - RNA, 64 nt, Human; identical to SEQ ID NO: 305181

SEQ ID NO: 500597 - RNA, 64 nt, Human; identical to SEQ ID NO: 305182

SEQ ID NO: 500598 - RNA, 64 nt, Human; identical to SEQ ID NO: 303150

SEQ ID NO: 500599 - RNA, 64 nt, Human; identical to SEQ ID NO: 305466

SEQ ID NO: 500600 - RNA, 64 nt, Human; identical to SEQ ID NO: 305467

SEQ ID NO: 500601 - RNA, 64 nt, Human; identical to SEQ ID NO: 305468

SEQ ID NO: 500602 - RNA, 64 nt, Human; identical to SEQ ID NO: 305483

SEQ ID NO: 500603 - RNA, 64 nt, Human; identical to SEQ ID NO: 305484

SEQ ID NO: 500604 - RNA, 64 nt, Human; identical to SEQ ID NO: 303151

SEQ ID NO: 500605 - RNA, 64 nt, Human; identical to SEQ ID NO: 305485

SEQ ID NO: 500606 - RNA, 64 nt, Human; identical to SEQ ID NO: 305276

SEQ ID NO: 500607 - RNA, 64 nt, Human; identical to SEQ ID NO: 305277

SEQ ID NO: 500608 - RNA, 61 nt, Human; identical to SEQ ID NO: 303152

SEQ ID NO: 500609 - RNA, 64 nt, Human; identical to SEQ ID NO: 305500

SEQ ID NO: 500610 - RNA, 64 nt, Human; identical to SEQ ID NO: 305501

SEQ ID NO: 500611 - RNA, 64 nt, Human; identical to SEQ ID NO: 257927

SEQ ID NO: 500612 - RNA, 64 nt, Human; identical to SEQ ID NO: 257934

SEQ ID NO: 500613 - RNA, 64 nt, Human; identical to SEQ ID NO: 257944

SEQ ID NO: 500614 - RNA, 64 nt, Human; identical to SEQ ID NO: 305502

SEQ ID NO: 500615 - RNA, 64 nt, Human; identical to SEQ ID NO: 305219

SEQ ID NO: 500616 - RNA, 64 nt, Human; identical to SEQ ID NO: 305220

SEQ ID NO: 500617 - RNA, 61 nt, Human; identical to SEQ ID NO: 303169

SEQ ID NO: 500618 - RNA, 64 nt, Human; identical to SEQ ID NO: 305553

SEQ ID NO: 500619 - RNA, 64 nt, Human; identical to SEQ ID NO: 305200

SEQ ID NO: 500620 - RNA, 64 nt, Human; identical to SEQ ID NO: 305201

SEQ ID NO: 500621 - RNA, 64 nt, Human; identical to SEQ ID NO: 303184

SEQ ID NO: 500622 - RNA, 64 nt, Human; identical to SEQ ID NO: 305105

SEQ ID NO: 500623 - RNA, 64 nt, Human; identical to SEQ ID NO: 305106

SEQ ID NO: 500624 - RNA, 64 nt, Human; identical to SEQ ID NO: 305107

SEQ ID NO: 500625 - RNA, 64 nt, Human; identical to SEQ ID NO: 305221

SEQ ID NO: 500626 - RNA, 64 nt, Human; identical to SEQ ID NO: 303185

SEQ ID NO: 500627 - RNA, 64 nt, Human; identical to SEQ ID NO: 305124

SEQ ID NO: 500628 - RNA, 64 nt, Human; identical to SEQ ID NO: 305125

SEQ ID NO: 500629 - RNA, 51 nt, Human; identical to SEQ ID NO: 257951

SEQ ID NO: 500630 - RNA, 64 nt, Human; identical to SEQ ID NO: 257952

SEQ ID NO: 500631 - RNA, 64 nt, Human; identical to SEQ ID NO: 257953

SEQ ID NO: 500632 - RNA, 64 nt, Human; identical to SEQ ID NO: 305126

SEQ ID NO: 500633 - RNA, 64 nt, Human; identical to SEQ ID NO: 305143

SEQ ID NO: 500634 - RNA, 64 nt, Human; identical to SEQ ID NO: 305144

SEQ ID NO: 500635 - RNA, 64 nt, Human; identical to SEQ ID NO: 303186

SEQ ID NO: 500636 - RNA, 64 nt, Human; identical to SEQ ID NO: 305145

SEQ ID NO: 500637 - RNA, 64 nt, Human; identical to SEQ ID NO: 305238

SEQ ID NO: 500638 - RNA, 64 nt, Human; identical to SEQ ID NO: 305239

SEQ ID NO: 500639 - RNA, 64 nt, Human; identical to SEQ ID NO: 303201

SEQ ID NO: 500640 - RNA, 64 nt, Human; identical to SEQ ID NO: 305183

SEQ ID NO: 500641 - RNA, 64 nt, Human; identical to SEQ ID NO: 305517

SEQ ID NO: 500642 - RNA, 50 nt, Human; identical to SEQ ID NO: 305518

SEQ ID NO: 500643 - RNA, 64 nt, Human; identical to SEQ ID NO: 303202

SEQ ID NO: 500644 - RNA, 64 nt, Human; identical to SEQ ID NO: 305202

SEQ ID NO: 500645 - RNA, 64 nt, Human; identical to SEQ ID NO: 305162

SEQ ID NO: 500646 - RNA, 64 nt, Human; identical to SEQ ID NO: 305163

SEQ ID NO: 500647 - RNA, 64 nt, Human
auccugcagaagaguccuggugguggcagccucaccgcggcacacguucuagcucauucuuggc

SEQ ID NO: 500648 - RNA, 64 nt, Human; identical to SEQ ID NO: 303203

SEQ ID NO: 500649 - RNA, 64 nt, Human; identical to SEQ ID NO: 305240

SEQ ID NO: 500650 - RNA, 64 nt, Human; identical to SEQ ID NO: 304972

SEQ ID NO: 500651 - RNA, 64 nt, Human; identical to SEQ ID NO: 304973

SEQ ID NO: 500652 - RNA, 64 nt, Human; identical to SEQ ID NO: 303286

SEQ ID NO: 500653 - RNA, 64 nt, Human; identical to SEQ ID NO: 305278

SEQ ID NO: 500654 - RNA, 64 nt, Human; identical to SEQ ID NO: 305314

SEQ ID NO: 500655 - RNA, 64 nt, Human; identical to SEQ ID NO: 305315

SEQ ID NO: 500656 - RNA, 64 nt, Human; identical to SEQ ID NO: 303287

SEQ ID NO: 500657 - RNA, 64 nt, Human; identical to SEQ ID NO: 305366

SEQ ID NO: 500658 - RNA, 64 nt, Human; identical to SEQ ID NO: 305449

SEQ ID NO: 500659 - RNA, 64 nt, Human; identical to SEQ ID NO: 305450

SEQ ID NO: 500660 - RNA, 64 nt, Human; identical to SEQ ID NO: 303288

SEQ ID NO: 500661 - RNA, 64 nt, Human; identical to SEQ ID NO: 305451

SEQ ID NO: 500662 - RNA, 64 nt, Human; identical to SEQ ID NO: 305164

SEQ ID NO: 500663 - RNA, 64 nt, Human; identical to SEQ ID NO: 257954

SEQ ID NO: 500664 - RNA, 64 nt, Human; identical to SEQ ID NO: 257955

SEQ ID NO: 500665 - RNA, 64 nt, Human; identical to SEQ ID NO: 257956

SEQ ID NO: 500666 - RNA, 64 nt, Human; identical to SEQ ID NO: 303809

SEQ ID NO: 500667 - RNA, 64 nt, Human; identical to SEQ ID NO: 304877

SEQ ID NO: 500668 - RNA, 64 nt, Human; identical to SEQ ID NO: 304878

SEQ ID NO: 500669 - RNA, 64 nt, Human; identical to SEQ ID NO: 304879

SEQ ID NO: 500670 - RNA, 64 nt, Human; identical to SEQ ID NO: 304896

SEQ ID NO: 500671 - RNA, 64 nt, Human; identical to SEQ ID NO: 304897

SEQ ID NO: 500672 - RNA, 64 nt, Human; identical to SEQ ID NO: 303810

SEQ ID NO: 500673 - RNA, 64 nt, Human; identical to SEQ ID NO: 304898

SEQ ID NO: 500674 - RNA, 64 nt, Human; identical to SEQ ID NO: 304934

SEQ ID NO: 500675 - RNA, 64 nt, Human; identical to SEQ ID NO: 304935

SEQ ID NO: 500676 - RNA, 64 nt, Human; identical to SEQ ID NO: 303811

SEQ ID NO: 500677 - RNA, 64 nt, Human; identical to SEQ ID NO: 304915

SEQ ID NO: 500678 - RNA, 64 nt, Human; identical to SEQ ID NO: 304916

SEQ ID NO: 500679 - RNA, 64 nt, Human; identical to SEQ ID NO: 304917

SEQ ID NO: 500680 - RNA, 64 nt, Human; identical to SEQ ID NO: 304991

SEQ ID NO: 500681 - RNA, 63 nt, Human
ugucagggcugaggagaacagaagcucugguaagcgaaugagccccuagaugauaaccaggaa

SEQ ID NO: 500682 - RNA, 63 nt, Human
uuuucugggagaacuuaaaggcccauaguaacugcgaaugaagcaauauaccacuaaccugca

SEQ ID NO: 500683 - RNA, 63 nt, Human
uuucaccaccucgaggagauuugcuccccauuagcgaaugaaauugaugcaguccuaccuaac

SEQ ID NO: 500684 - RNA, 64 nt, Human; identical to SEQ ID NO: 304992

SEQ ID NO: 500685 - RNA, 64 nt, Human; identical to SEQ ID NO: 303828

SEQ ID NO: 500686 - RNA, 64 nt, Human; identical to SEQ ID NO: 304953

SEQ ID NO: 500687 - RNA, 64 nt, Human; identical to SEQ ID NO: 304954

SEQ ID NO: 500688 - RNA, 64 nt, Human; identical to SEQ ID NO: 304955

SEQ ID NO: 500689 - RNA, 64 nt, Human; identical to SEQ ID NO: 305086

SEQ ID NO: 500690 - RNA, 64 nt, Human; identical to SEQ ID NO: 305087

SEQ ID NO: 500691 - RNA, 64 nt, Human; identical to SEQ ID NO: 303843

SEQ ID NO: 500692 - RNA, 64 nt, Human; identical to SEQ ID NO: 304993

SEQ ID NO: 500693 - RNA, 64 nt, Human; identical to SEQ ID NO: 304858

SEQ ID NO: 500694 - RNA, 64 nt, Human; identical to SEQ ID NO: 304859

SEQ ID NO: 500695 - RNA, 64 nt, Human; identical to SEQ ID NO: 303844

SEQ ID NO: 500696 - RNA, 57 nt, Human; identical to SEQ ID NO: 305010

SEQ ID NO: 500697 - RNA, 64 nt, Human; identical to SEQ ID NO: 305011

SEQ ID NO: 500698 - RNA, 64 nt, Human; identical to SEQ ID NO: 305012

SEQ ID NO: 500699 - RNA, 63 nt, Human
ggcuguagcaucccuaccacccaggacacuggugcgaaugacacaacucaaguugggagggga

SEQ ID NO: 500700 - RNA, 63 nt, Human
gagaaagaaagaaacagaaaaaccuaaaagaaagcgaaugaauuugacaccuguugguuggau

SEQ ID NO: 500701 - RNA, 63 nt, Human
uguuuuucucuuugcaaagacauagcuaggaaagcgaaugauaagggaaaaguucucagggaa

SEQ ID NO: 500702 - RNA, 64 nt, Human; identical to SEQ ID NO: 305257

SEQ ID NO: 500703 - RNA, 61 nt, Human; identical to SEQ ID NO: 305258

SEQ ID NO: 500704 - RNA, 64 nt, Human; identical to SEQ ID NO: 303845

SEQ ID NO: 500705 - RNA, 64 nt, Human; identical to SEQ ID NO: 305029

SEQ ID NO: 500706 - RNA, 64 nt, Human; identical to SEQ ID NO: 305030

SEQ ID NO: 500707 - RNA, 64 nt, Human; identical to SEQ ID NO: 305031

SEQ ID NO: 500708 - RNA, 64 nt, Human; identical to SEQ ID NO: 304936

SEQ ID NO: 500709 - RNA, 64 nt, Human; identical to SEQ ID NO: 303860

SEQ ID NO: 500710 - RNA, 64 nt, Human; identical to SEQ ID NO: 305088

SEQ ID NO: 500711 - RNA, 64 nt, Human; identical to SEQ ID NO: 305259

SEQ ID NO: 500712 - RNA, 64 nt, Human; identical to SEQ ID NO: 303861

SEQ ID NO: 500713 - RNA, 64 nt, Human; identical to SEQ ID NO: 305519

SEQ ID NO: 500714 - RNA, 64 nt, Human; identical to SEQ ID NO: 304668

SEQ ID NO: 500715 - RNA, 64 nt, Human; identical to SEQ ID NO: 304669

SEQ ID NO: 500716 - RNA, 57 nt, Human; identical to SEQ ID NO: 303862

SEQ ID NO: 500717 - RNA, 64 nt, Human
aaaagcaggaaaaacaaaugggaaaugggggggcgggggggaggaagaggcugcacugcagcca

SEQ ID NO: 500718 - RNA, 64 nt, Human
uuuguuaaaauucauaggaaauguuauuuugugggggggggauggcaugguguuuguggacugg

SEQ ID NO: 500719 - RNA, 64 nt, Human
aagaagcuuucuuuaaaacuaaaaggguuuuuuggggggggaguuggcggggaggaaauaaggc

SEQ ID NO: 500720 - RNA, 64 nt, Human; identical to SEQ ID NO: 304649

SEQ ID NO: 500721 - RNA, 64 nt, Human; identical to SEQ ID NO: 304650

SEQ ID NO: 500722 - RNA, 64 nt, Human; identical to SEQ ID NO: 304651

SEQ ID NO: 500723 - RNA, 64 nt, Human; identical to SEQ ID NO: 304670

SEQ ID NO: 500724 - RNA, 64 nt, Human; identical to SEQ ID NO: 303877

SEQ ID NO: 500725 - RNA, 64 nt, Human; identical to SEQ ID NO: 304706

SEQ ID NO: 500726 - RNA, 64 nt, Human; identical to SEQ ID NO: 304707

SEQ ID NO: 500727 - RNA, 64 nt, Human; identical to SEQ ID NO: 304708

SEQ ID NO: 500728 - RNA, 64 nt, Human; identical to SEQ ID NO: 304725

SEQ ID NO: 500729 - RNA, 64 nt, Human; identical to SEQ ID NO: 304726

SEQ ID NO: 500730 - RNA, 64 nt, Human; identical to SEQ ID NO: 303878

SEQ ID NO: 500731 - RNA, 64 nt, Human; identical to SEQ ID NO: 304727

SEQ ID NO: 500732 - RNA, 64 nt, Human; identical to SEQ ID NO: 304801

SEQ ID NO: 500733 - RNA, 63 nt, Human; identical to SEQ ID NO: 304802

SEQ ID NO: 500734 - RNA, 64 nt, Human; identical to SEQ ID NO: 303879

SEQ ID NO: 500735 - RNA, 63 nt, Human
agcagagcuggcacaccgauucugggaagccccgcgaaugauggcuuuugaauuaaugaggca

SEQ ID NO: 500736 - RNA, 63 nt, Human
ggggugggggggagaaauaauguuauuuccuaugcgaaugacguguaucccuguacccauggu

SEQ ID NO: 500737 - RNA, 63 nt, Human
cucauugugauuuugguuugcauuucccugauggcgaaugauauugagcaucuuuucaugagc

SEQ ID NO: 500738 - RNA, 64 nt, Human; identical to SEQ ID NO: 304744

SEQ ID NO: 500739 - RNA, 64 nt, Human; identical to SEQ ID NO: 304745

SEQ ID NO: 500740 - RNA, 64 nt, Human; identical to SEQ ID NO: 304746

SEQ ID NO: 500741 - RNA, 64 nt, Human; identical to SEQ ID NO: 305048

SEQ ID NO: 500742 - RNA, 64 nt, Human; identical to SEQ ID NO: 305049

SEQ ID NO: 500743 - RNA, 64 nt, Human; identical to SEQ ID NO: 303894

SEQ ID NO: 500744 - RNA, 64 nt, Human; identical to SEQ ID NO: 304782

SEQ ID NO: 500745 - RNA, 64 nt, Human; identical to SEQ ID NO: 304783

SEQ ID NO: 500746 - RNA, 64 nt, Human; identical to SEQ ID NO: 304784

SEQ ID NO: 500747 - RNA, 64 nt, Human; identical to SEQ ID NO: 304687

SEQ ID NO: 500748 - RNA, 64 nt, Human; identical to SEQ ID NO: 304688

SEQ ID NO: 500749 - RNA, 64 nt, Human; identical to SEQ ID NO: 303895

SEQ ID NO: 500750 - RNA, 64 nt, Human; identical to SEQ ID NO: 304803

SEQ ID NO: 500751 - RNA, 64 nt, Human; identical to SEQ ID NO: 305067

SEQ ID NO: 500752 - RNA, 64 nt, Human; identical to SEQ ID NO: 305068

SEQ ID NO: 500753 - RNA, 63 nt, Human
ugcuagacacucauuuagugcccagggaguccagcgaaugacgucuguggccaagcgaggucu

SEQ ID NO: 500754 - RNA, 63 nt, Human
cagguagaguucaaccaguucgugacuguuguagcgaaugaaguuaaaaaaaugucuuucuga

SEQ ID NO: 500755 - RNA, 63 nt, Human
cuuuaauuuuacccaggaaggacucacauuggggcgaaugaaccaaguuucgccaugcuggau

SEQ ID NO: 500756 - RNA, 64 nt, Human; identical to SEQ ID NO: 303896

SEQ ID NO: 500757 - RNA, 64 nt, Human; identical to SEQ ID NO: 304820

SEQ ID NO: 500758 - RNA, 64 nt, Human; identical to SEQ ID NO: 304821

SEQ ID NO: 500759 - RNA, 64 nt, Human; identical to SEQ ID NO: 304822

SEQ ID NO: 500760 - RNA, 64 nt, Human; identical to SEQ ID NO: 304763

SEQ ID NO: 500761 - RNA, 64 nt, Human; identical to SEQ ID NO: 304764

SEQ ID NO: 500762 - RNA, 64 nt, Human; identical to SEQ ID NO: 303911

SEQ ID NO: 500763 - RNA, 64 nt, Human; identical to SEQ ID NO: 304860

SEQ ID NO: 500764 - RNA, 64 nt, Human; identical to SEQ ID NO: 304592

SEQ ID NO: 500765 - RNA, 64 nt, Human; identical to SEQ ID NO: 304593

SEQ ID NO: 500766 - RNA, 64 nt, Human; identical to SEQ ID NO: 303912

SEQ ID NO: 500767 - RNA, 64 nt, Human; identical to SEQ ID NO: 304974

SEQ ID NO: 500768 - RNA, 64 nt, Human; identical to SEQ ID NO: 304543

SEQ ID NO: 500769 - RNA, 64 nt, Human; identical to SEQ ID NO: 304544

SEQ ID NO: 500770 - RNA, 64 nt, Human; identical to SEQ ID NO: 303913

SEQ ID NO: 500771 - RNA, 64 nt, Human
guggaagugcuuuucuacuaaggccucuuacuuugggggggaugugcccuacagaagacauaga

SEQ ID NO: 500772 - RNA, 64 nt, Human
guuaauaggaaccaaaaaauaaugaugggcagaagggggggaauagccacaggggacaaaccuu

SEQ ID NO: 500773 - RNA, 64 nt, Human
auuuuaguaugcucuauuguauaauuuuuuuggagggggggauggaguuucgcuguuguugccc

SEQ ID NO: 500774 - RNA, 64 nt, Human; identical to SEQ ID NO: 305050

SEQ ID NO: 500775 - RNA, 64 nt, Human; identical to SEQ ID NO: 304509

SEQ ID NO: 500776 - RNA, 64 nt, Human; identical to SEQ ID NO: 304510

SEQ ID NO: 500777 - RNA, 64 nt, Human; identical to SEQ ID NO: 303928

SEQ ID NO: 500778 - RNA, 64 nt, Human; identical to SEQ ID NO: 304458

SEQ ID NO: 500779 - RNA, 64 nt, Human; identical to SEQ ID NO: 304459

SEQ ID NO: 500780 - RNA, 63 nt, Human; identical to SEQ ID NO: 304460

SEQ ID NO: 500781 - RNA, 64 nt, Human; identical to SEQ ID NO: 304511

SEQ ID NO: 500782 - RNA, 64 nt, Human; identical to SEQ ID NO: 303929

SEQ ID NO: 500783 - RNA, 64 nt, Human; identical to SEQ ID NO: 304475

SEQ ID NO: 500784 - RNA, 64 nt, Human; identical to SEQ ID NO: 304476

SEQ ID NO: 500785 - RNA, 64 nt, Human; identical to SEQ ID NO: 304477

SEQ ID NO: 500786 - RNA, 64 nt, Human; identical to SEQ ID NO: 304492

SEQ ID NO: 500787 - RNA, 64 nt, Human; identical to SEQ ID NO: 304493

SEQ ID NO: 500788 - RNA, 64 nt, Human; identical to SEQ ID NO: 303930

SEQ ID NO: 500789 - RNA, 63 nt, Human
cuacggggccagucuuucccguggcugccaccagcgaaugaaacuuuuguaugauacauaaag

SEQ ID NO: 500790 - RNA, 63 nt, Human
uaauuuguaggaaaaagcaaguucgucuguugugcgaaugacugaaugggacagaguugauuu

SEQ ID NO: 500791 - RNA, 63 nt, Human
ucauuauuucaucaugacugaaagaagacacgagcgaaugauuuaaauagaacuugauuguug

SEQ ID NO: 500792 - RNA, 64 nt, Human; identical to SEQ ID NO: 304494

SEQ ID NO: 500793 - RNA, 64 nt, Human; identical to SEQ ID NO: 304560

SEQ ID NO: 500794 - RNA, 64 nt, Human; identical to SEQ ID NO: 304561

SEQ ID NO: 500795 - RNA, 64 nt, Human; identical to SEQ ID NO: 303932

SEQ ID NO: 500796 - RNA, 64 nt, Human; identical to SEQ ID NO: 304545

SEQ ID NO: 500797 - RNA, 64 nt, Human; identical to SEQ ID NO: 304689

SEQ ID NO: 500798 - RNA, 64 nt, Human; identical to SEQ ID NO: 303933

SEQ ID NO: 500799 - RNA, 64 nt, Human; identical to SEQ ID NO: 304562

SEQ ID NO: 500800 - RNA, 64 nt, Human; identical to SEQ ID NO: 304574

SEQ ID NO: 500801 - RNA, 64 nt, Human; identical to SEQ ID NO: 304575

SEQ ID NO: 500802 - RNA, 64 nt, Human; identical to SEQ ID NO: 303934

SEQ ID NO: 500803 - RNA, 64 nt, Human; identical to SEQ ID NO: 304576

SEQ ID NO: 500804 - RNA, 64 nt, Human; identical to SEQ ID NO: 304356

SEQ ID NO: 500805 - RNA, 64 nt, Human; identical to SEQ ID NO: 304357

SEQ ID NO: 500806 - RNA, 64 nt, Human; identical to SEQ ID NO: 303935

SEQ ID NO: 500807 - RNA, 64 nt, Human
gaccuaugcaaggacgguguggaccaacucgcgcccgcggcauggugcccgccggccugccggg

SEQ ID NO: 500808 - RNA, 64 nt, Human
gggccuguggcagcggcgcccagcucccugguggccgcggcagccucaguggcagcagcugccg

SEQ ID NO: 500809 - RNA, 64 nt, Human
gacguuuuucaaacagaaaaugcaggcuggggagccgcggcagggcggguggggcuacccugug

SEQ ID NO: 500810 - RNA, 64 nt, Human; identical to SEQ ID NO: 304594

SEQ ID NO: 500811 - RNA, 64 nt, Human; identical to SEQ ID NO: 304630

SEQ ID NO: 500812 - RNA, 64 nt, Human; identical to SEQ ID NO: 304631

SEQ ID NO: 500813 - RNA, 64 nt, Human; identical to SEQ ID NO: 303936

SEQ ID NO: 500814 - RNA, 64 nt, Human; identical to SEQ ID NO: 304611

SEQ ID NO: 500815 - RNA, 64 nt, Human; identical to SEQ ID NO: 304612

SEQ ID NO: 500816 - RNA, 64 nt, Human; identical to SEQ ID NO: 304613

SEQ ID NO: 500817 - RNA, 64 nt, Human; identical to SEQ ID NO: 304407

SEQ ID NO: 500818 - RNA, 64 nt, Human; identical to SEQ ID NO: 304408

SEQ ID NO: 500819 - RNA, 61 nt, Human; identical to SEQ ID NO: 303937

SEQ ID NO: 500820 - RNA, 64 nt, Human; identical to SEQ ID NO: 304632

SEQ ID NO: 500821 - RNA, 64 nt, Human; identical to SEQ ID NO: 304339

SEQ ID NO: 500822 - RNA, 64 nt, Human; identical to SEQ ID NO: 304340

SEQ ID NO: 500823 - RNA, 64 nt, Human; identical to SEQ ID NO: 303938

SEQ ID NO: 500824 - RNA, 64 nt, Human; identical to SEQ ID NO: 304765

SEQ ID NO: 500825 - RNA, 63 nt, Human
uaacucaucuaguuaauaauguuuuuauuccaugcgaaugauuugauauuuucauccuuauuu

SEQ ID NO: 500826 - RNA, 63 nt, Human
ccuuguuuaugcuuuauuugugguaaugaaagagcgaaugacugaacagccauggcaaggcag

SEQ ID NO: 500827 - RNA, 63 nt, Human
agggagccggggcagccacagggagagacaugggcgaaugagugagaaauuuuuacaaaauua

SEQ ID NO: 500828 - RNA, 64 nt, Human; identical to SEQ ID NO: 304288

SEQ ID NO: 500829 - RNA, 64 nt, Human; identical to SEQ ID NO: 304289

SEQ ID NO: 500830 - RNA, 64 nt, Human; identical to SEQ ID NO: 303939

SEQ ID NO: 500831 - RNA, 64 nt, Human; identical to SEQ ID NO: 304839

SEQ ID NO: 500832 - RNA, 64 nt, Human; identical to SEQ ID NO: 304840

SEQ ID NO: 500833 - RNA, 64 nt, Human; identical to SEQ ID NO: 304841

SEQ ID NO: 500834 - RNA, 64 nt, Human; identical to SEQ ID NO: 304254

SEQ ID NO: 500835 - RNA, 64 nt, Human; identical to SEQ ID NO: 304255

SEQ ID NO: 500836 - RNA, 64 nt, Human; identical to SEQ ID NO: 303940

SEQ ID NO: 500837 - RNA, 64 nt, Human; identical to SEQ ID NO: 305069

SEQ ID NO: 500838 - RNA, 64 nt, Human; identical to SEQ ID NO: 304237

SEQ ID NO: 500839 - RNA, 64 nt, Human; identical to SEQ ID NO: 304238

SEQ ID NO: 500840 - RNA, 64 nt, Human; identical to SEQ ID NO: 303941

SEQ ID NO: 500841 - RNA, 64 nt, Human; identical to SEQ ID NO: 304220

SEQ ID NO: 500842 - RNA, 64 nt, Human; identical to SEQ ID NO: 304221

SEQ ID NO: 500843 - RNA, 64 nt, Human
ugcuauuugauaccaagggcuuuuuaaaugucaugggggggaaaaacccaacuuggugaacucc

SEQ ID NO: 500844 - RNA, 64 nt, Human
auggcucugccuguccuuccccagucaccagggugggggggacaggggcagcugagugcauuca

SEQ ID NO: 500845 - RNA, 64 nt, Human
cgcggauuggaagccagccugcugucgcucuguggggggggacacgucuucccacugcuuagag

SEQ ID NO: 500846 - RNA, 64 nt, Human; identical to SEQ ID NO: 304222

SEQ ID NO: 500847 - RNA, 64 nt, Human; identical to SEQ ID NO: 304239

SEQ ID NO: 500848 - RNA, 64 nt, Human; identical to SEQ ID NO: 303942

SEQ ID NO: 500849 - RNA, 64 nt, Human; identical to SEQ ID NO: 304256

SEQ ID NO: 500850 - RNA, 64 nt, Human; identical to SEQ ID NO: 304271

SEQ ID NO: 500851 - RNA, 64 nt, Human; identical to SEQ ID NO: 304272

SEQ ID NO: 500852 - RNA, 64 nt, Human; identical to SEQ ID NO: 303943

SEQ ID NO: 500853 - RNA, 63 nt, Human; identical to SEQ ID NO: 304273

SEQ ID NO: 500854 - RNA, 64 nt, Human; identical to SEQ ID NO: 304322

SEQ ID NO: 500855 - RNA, 64 nt, Human; identical to SEQ ID NO: 304323

SEQ ID NO: 500856 - RNA, 64 nt, Human; identical to SEQ ID NO: 303944

SEQ ID NO: 500857 - RNA, 64 nt, Human; identical to SEQ ID NO: 304290

SEQ ID NO: 500858 - RNA, 64 nt, Human; identical to SEQ ID NO: 304390

SEQ ID NO: 500859 - RNA, 64 nt, Human; identical to SEQ ID NO: 304391

SEQ ID NO: 500860 - RNA, 64 nt, Human; identical to SEQ ID NO: 303945

SEQ ID NO: 500861 - RNA, 63 nt, Human
cauuucucugcaaagaauucucuauggagugaagcgaaugaagugaauaauuucuuaccaaau

SEQ ID NO: 500862 - RNA, 63 nt, Human
acugggggaaggaaacuuauuggaaaacuugaugcgaaugaguuucugcuuggcacagucucu

SEQ ID NO: 500863 - RNA, 63 nt, Human
acuaaaaauauaagaaauuagccggacaugguggcgaaugacuguaaucccagcuacucagga

SEQ ID NO: 500864 - RNA, 64 nt, Human; identical to SEQ ID NO: 304305

SEQ ID NO: 500865 - RNA, 64 nt, Human; identical to SEQ ID NO: 304306

SEQ ID NO: 500866 - RNA, 64 nt, Human; identical to SEQ ID NO: 304307

SEQ ID NO: 500867 - RNA, 64 nt, Human; identical to SEQ ID NO: 304135

SEQ ID NO: 500868 - RNA, 64 nt, Human; identical to SEQ ID NO: 304136

SEQ ID NO: 500869 - RNA, 64 nt, Human; identical to SEQ ID NO: 303946

SEQ ID NO: 500870 - RNA, 64 nt, Human; identical to SEQ ID NO: 304324

SEQ ID NO: 500871 - RNA, 64 nt, Human; identical to SEQ ID NO: 304341

SEQ ID NO: 500872 - RNA, 64 nt, Human; identical to SEQ ID NO: 303947

SEQ ID NO: 500873 - RNA, 64 nt, Human; identical to SEQ ID NO: 304358

SEQ ID NO: 500874 - RNA, 64 nt, Human; identical to SEQ ID NO: 304373

SEQ ID NO: 500875 - RNA, 64 nt, Human; identical to SEQ ID NO: 304374

SEQ ID NO: 500876 - RNA, 64 nt, Human; identical to SEQ ID NO: 303948

SEQ ID NO: 500877 - RNA, 64 nt, Human; identical to SEQ ID NO: 304392

SEQ ID NO: 500878 - RNA, 64 nt, Human; identical to SEQ ID NO: 304118

SEQ ID NO: 500879 - RNA, 62 nt, Human
agauugcugcugcuuucugagcccgcaccugugcgccuaaacugcugauuggccucaacugc

SEQ ID NO: 500880 - RNA, 62 nt, Human
agagagacacagcugcagaggccaccuggauugcgccuaauguguuugagcaucacuuagga

SEQ ID NO: 500881 - RNA, 64 nt, Human; identical to SEQ ID NO: 304119

SEQ ID NO: 500882 - RNA, 64 nt, Human; identical to SEQ ID NO: 303949

SEQ ID NO: 500883 - RNA, 64 nt, Human; identical to SEQ ID NO: 304375

SEQ ID NO: 500884 - RNA, 64 nt, Human; identical to SEQ ID NO: 304033

SEQ ID NO: 500885 - RNA, 64 nt, Human; identical to SEQ ID NO: 304034

SEQ ID NO: 500886 - RNA, 64 nt, Human; identical to SEQ ID NO: 303950

SEQ ID NO: 500887 - RNA, 64 nt, Human; identical to SEQ ID NO: 304409

SEQ ID NO: 500888 - RNA, 64 nt, Human; identical to SEQ ID NO: 304424

SEQ ID NO: 500889 - RNA, 64 nt, Human; identical to SEQ ID NO: 304425

SEQ ID NO: 500890 - RNA, 64 nt, Human; identical to SEQ ID NO: 303965

SEQ ID NO: 500891 - RNA, 64 nt, Human; identical to SEQ ID NO: 304441

SEQ ID NO: 500892 - RNA, 64 nt, Human; identical to SEQ ID NO: 304442

SEQ ID NO: 500893 - RNA, 64 nt, Human; identical to SEQ ID NO: 304443

SEQ ID NO: 500894 - RNA, 64 nt, Human; identical to SEQ ID NO: 304186

SEQ ID NO: 500895 - RNA, 64 nt, Human; identical to SEQ ID NO: 304187

SEQ ID NO: 500896 - RNA, 62 nt, Human
aagaagcuuugccgcuuuugugccucucacaggcgccuaaagucauugccaugggaggaaga

SEQ ID NO: 500897 - RNA, 62 nt, Human
aaauuuaguggacagguaugaaaaguguaauugcgccuaacuaccagauggagagcuucaga

SEQ ID NO: 500898 - RNA, 62 nt, Human
ccggccccuuuucgcccccugccugccauacugcgccuaacucgguauuaauccaaagcuua

SEQ ID NO: 500899 - RNA, 64 nt, Human; identical to SEQ ID NO: 303966

SEQ ID NO: 500900 - RNA, 60 nt, Human; identical to SEQ ID NO: 304526

SEQ ID NO: 500901 - RNA, 64 nt, Human; identical to SEQ ID NO: 304527

SEQ ID NO: 500902 - RNA, 55 nt, Human; identical to SEQ ID NO: 304528

SEQ ID NO: 500903 - RNA, 64 nt, Human; identical to SEQ ID NO: 304169

SEQ ID NO: 500904 - RNA, 64 nt, Human; identical to SEQ ID NO: 304170

SEQ ID NO: 500905 - RNA, 64 nt, Human; identical to SEQ ID NO: 303967

SEQ ID NO: 500906 - RNA, 64 nt, Human; identical to SEQ ID NO: 304171

SEQ ID NO: 500907 - RNA, 64 nt, Human; identical to SEQ ID NO: 303982

SEQ ID NO: 500908 - RNA, 64 nt, Human; identical to SEQ ID NO: 303983

SEQ ID NO: 500909 - RNA, 64 nt, Human; identical to SEQ ID NO: 303984

SEQ ID NO: 500910 - RNA, 64 nt, Human; identical to SEQ ID NO: 303999

SEQ ID NO: 500911 - RNA, 64 nt, Human; identical to SEQ ID NO: 304000

SEQ ID NO: 500912 - RNA, 64 nt, Human; identical to SEQ ID NO: 304001

SEQ ID NO: 500913 - RNA, 64 nt, Human; identical to SEQ ID NO: 304035

SEQ ID NO: 500914 - RNA, 63 nt, Human
caagcaccuagccucgcucuuggcagguacucagcgaaugaaugcuguauauguugggugcaa

SEQ ID NO: 500915 - RNA, 63 nt, Human
uacuugaaaugaaauccuuugcuucuuuuuuaagcgaaugauugcuuuuaauguuugcacuga

SEQ ID NO: 500916 - RNA, 63 nt, Human
ucccagccgaugggucacauccuucuaagcgaagcgaaugaugcuguagguuacacuguauuu

SEQ ID NO: 500917 - RNA, 64 nt, Human; identical to SEQ ID NO: 304050

SEQ ID NO: 500918 - RNA, 64 nt, Human; identical to SEQ ID NO: 304051

SEQ ID NO: 500919 - RNA, 64 nt, Human; identical to SEQ ID NO: 304052

SEQ ID NO: 500920 - RNA, 64 nt, Human; identical to SEQ ID NO: 304067

SEQ ID NO: 500921 - RNA, 64 nt, Human; identical to SEQ ID NO: 304068

SEQ ID NO: 500922 - RNA, 64 nt, Human; identical to SEQ ID NO: 304069

SEQ ID NO: 500923 - RNA, 64 nt, Human; identical to SEQ ID NO: 304084

SEQ ID NO: 500924 - RNA, 64 nt, Human; identical to SEQ ID NO: 304085

SEQ ID NO: 500925 - RNA, 64 nt, Human; identical to SEQ ID NO: 304086

SEQ ID NO: 500926 - RNA, 64 nt, Human; identical to SEQ ID NO: 305587

SEQ ID NO: 500927 - RNA, 64 nt, Human; identical to SEQ ID NO: 305588

SEQ ID NO: 500928 - RNA, 64 nt, Human; identical to SEQ ID NO: 305589

SEQ ID NO: 500929 - RNA, 64 nt, Human; identical to SEQ ID NO: 305590

SEQ ID NO: 500930 - RNA, 64 nt, Human; identical to SEQ ID NO: 305591

SEQ ID NO: 500931 - RNA, 64 nt, Human; identical to SEQ ID NO: 305592

SEQ ID NO: 500932 - RNA, 63 nt, Human
cccccuguacauaauuuuuaaaaccuuuuuuuagcgaaugaaauauugaaguauaagauuccu

SEQ ID NO: 500933 - RNA, 63 nt, Human
gccuccuuaguggcacugccggggggccccagagcgaaugagggcagagaugcccggggcagg

SEQ ID NO: 500934 - RNA, 63 nt, Human
gugauaugaaaaaaucauugagcauucauuauugcgaaugaaguggggaugcauuauuucuga

SEQ ID NO: 500935 - RNA, 64 nt, Human; identical to SEQ ID NO: 305593

SEQ ID NO: 500936 - RNA, 53 nt, Human; identical to SEQ ID NO: 305594

SEQ ID NO: 500937 - RNA, 64 nt, Human; identical to SEQ ID NO: 305595

SEQ ID NO: 500938 - RNA, 64 nt, Human; identical to SEQ ID NO: 305596

SEQ ID NO: 500939 - RNA, 64 nt, Human; identical to SEQ ID NO: 305597

SEQ ID NO: 500940 - RNA, 64 nt, Human; identical to SEQ ID NO: 305598

SEQ ID NO: 500941 - RNA, 64 nt, Human; identical to SEQ ID NO: 305599

SEQ ID NO: 500942 - RNA, 64 nt, Human; identical to SEQ ID NO: 305600

SEQ ID NO: 500943 - RNA, 64 nt, Human; identical to SEQ ID NO: 305601

SEQ ID NO: 500944 - RNA, 64 nt, Human; identical to SEQ ID NO: 305602

SEQ ID NO: 500945 - RNA, 64 nt, Human; identical to SEQ ID NO: 305603

SEQ ID NO: 500946 - RNA, 64 nt, Human; identical to SEQ ID NO: 305604

SEQ ID NO: 500947 - RNA, 64 nt, Human; identical to SEQ ID NO: 305605

SEQ ID NO: 500948 - RNA, 57 nt, Human; identical to SEQ ID NO: 305606

SEQ ID NO: 500949 - RNA, 64 nt, Human; identical to SEQ ID NO: 305607

SEQ ID NO: 500950 - RNA, 62 nt, Human; identical to SEQ ID NO: 500575

SEQ ID NO: 500951 - RNA, 62 nt, Human; identical to SEQ ID NO: 500576

SEQ ID NO: 500952 - RNA, 62 nt, Human; identical to SEQ ID NO: 500577

SEQ ID NO: 500953 - RNA, 64 nt, Human; identical to SEQ ID NO: 305608

SEQ ID NO: 500954 - RNA, 64 nt, Human; identical to SEQ ID NO: 305609

SEQ ID NO: 500955 - RNA, 59 nt, Human; identical to SEQ ID NO: 305610

SEQ ID NO: 500956 - RNA, 64 nt, Human; identical to SEQ ID NO: 305611

SEQ ID NO: 500957 - RNA, 64 nt, Human; identical to SEQ ID NO: 305612

SEQ ID NO: 500958 - RNA, 64 nt, Human; identical to SEQ ID NO: 305613

SEQ ID NO: 500959 - RNA, 64 nt, Human; identical to SEQ ID NO: 305614

SEQ ID NO: 500960 - RNA, 64 nt, Human; identical to SEQ ID NO: 305615

SEQ ID NO: 500961 - RNA, 64 nt, Human; identical to SEQ ID NO: 305616

SEQ ID NO: 500962 - RNA, 64 nt, Human; identical to SEQ ID NO: 305617

SEQ ID NO: 500963 - RNA, 64 nt, Human; identical to SEQ ID NO: 305618

SEQ ID NO: 500964 - RNA, 64 nt, Human; identical to SEQ ID NO: 305619

SEQ ID NO: 500965 - RNA, 64 nt, Human; identical to SEQ ID NO: 305620

SEQ ID NO: 500966 - RNA, 62 nt, Human; identical to SEQ ID NO: 500879

SEQ ID NO: 500967 - RNA, 62 nt, Human; identical to SEQ ID NO: 500880

SEQ ID NO: 500968 - RNA, 62 nt, Human; identical to SEQ ID NO: 500896

SEQ ID NO: 500969 - RNA, 62 nt, Human; identical to SEQ ID NO: 500897

SEQ ID NO: 500970 - RNA, 62 nt, Human; identical to SEQ ID NO: 500898

SEQ ID NO: 500971 - RNA, 62 nt, Human; identical to SEQ ID NO: 495654

SEQ ID NO: 500972 - RNA, 64 nt, Human
cacugaaauauaccucaggcugaaauuuggggugggauagcaggucaguugaucuucugcagga

SEQ ID NO: 500973 - RNA, 64 nt, Human
uagcaaggccacuggguugcuauccucuugcuggggauagcaaccacugguuugcaaccacugg

SEQ ID NO: 500974 - RNA, 64 nt, Human
gaggaauuuaaccacauacaucauugaagacaagggauagcaguuuguuuuuauucaaagacau

SEQ ID NO: 500975 - RNA, 64 nt, Human
aauucugugaagaaugucauugguaguuugauagggauagcauugaacuauuugcucaacucaa

SEQ ID NO: 500976 - RNA, 64 nt, Human
auugcuuuuucuguguauuuuguauugggcugggggauagcaucaaagguugaacuuuuugagc

SEQ ID NO: 500977 - RNA, 64 nt, Human
cggagagucugcuuccugagcuuuuccggucugaggauagcauugucauuucuucucugagggu

SEQ ID NO: 500978 - RNA, 64 nt, Human
aggauugccucagcuccucccccucaggcugggaggauagcacaggcuaggggcucggggugga

SEQ ID NO: 500979 - RNA, 64 nt, Human
auaacuuauugugaaggguuagcuuuacuguacaggauagcagggaacuggacaucucagggua

SEQ ID NO: 500980 - RNA, 64 nt, Human
cuccccuuaacuauuauuguuagauaaacagauuggauagcaaggcugcuguucuggauuaucu

SEQ ID NO: 500981 - RNA, 64 nt, Human
ucuaugcagcauuuaccagaaaagaguauuccugggauagcagaaugcauaacacugaguguua

SEQ ID NO: 500982 - RNA, 64 nt, Human
gauuaccuguggucacugaacacacgaauaacuuggauagcaaauccugagacaauggaaaacc

SEQ ID NO: 500983 - RNA, 64 nt, Human
aguuccgaggagcaccugggaagcucugggugcaggauagcaguccagaguccauggccccgcc

SEQ ID NO: 500984 - RNA, 64 nt, Human
uugucuuggucgcugcuucuagaaucuaugcaggggauagcagugaggucagaagucuuucccg

SEQ ID NO: 500985 - RNA, 63 nt, Human
caggacacucaaccccaggaggggagccgcucggcgaaugagcugggugggugcccaggagcc

SEQ ID NO: 500986 - RNA, 63 nt, Human
cuuucuccaggaugccaacugcacuagcugugugcgaaugacguaucuugugcauuuuaacuu

SEQ ID NO: 500987 - RNA, 63 nt, Human
cuagauugucugugauuggacagacuaugaugagcgaaugaagaaguuggucaguauuguggc

SEQ ID NO: 500988 - RNA, 64 nt, Human
uucaauaagggaauacugauugugcauuguaucuggauagcaugccuaauugugcauuucugaa

SEQ ID NO: 500989 - RNA, 64 nt, Human
uuguggcuucgcugauuaaagagaguggcaccaaggauagcaaugucuggauuggccuccauga

SEQ ID NO: 500990 - RNA, 64 nt, Human
gugcgauuuauuuaaguuguauauaaaaauaaaaggauagcauuuuuauacaaauaucuuuaaa

SEQ ID NO: 500991 - RNA, 52 nt, Human
ucccugcauuugaacucugaaaggauagcaugccaccugcaacucacugcau

SEQ ID NO: 500992 - RNA, 64 nt, Human
ucuaaaagaaucuuuuucaaaucccugaaaaucaggauagcacauuuugcuacugacugugaca

SEQ ID NO: 500993 - RNA, 64 nt, Human
ucaauaagcaucaaacucuuaguuacucauucagggauagcacugagcaaagcauugagcaaag

SEQ ID NO: 500994 - RNA, 64 nt, Human
cuuuuuauuuucauuuucugucacagacacucagggauagcaguaccauuuuacuuccgcaagc

SEQ ID NO: 500995 - RNA, 64 nt, Human
ucaauacuguaugccuucuguauuuuaauggaguggauagcauuguuuucuuuuacagacuagc

SEQ ID NO: 500996 - RNA, 64 nt, Human
guggcaccugccagaggggaaagcaggcaugacaggauagcaucucccaggugagagccuuuug

SEQ ID NO: 500997 - RNA, 64 nt, Human
cauuacuucaacauggugcuaagugcuuacuucgggauagcaggggccggacgccuauacaccu

SEQ ID NO: 500998 - RNA, 64 nt, Human
uuaauugccguguguggcagguggcugcccuauuggauagcacaggucuagagaaaugauaccu

SEQ ID NO: 500999 - RNA, 64 nt, Human
ggcauagccugggccaagcaggguggggaauggaggauagcaugggauguauggagaggaugga

SEQ ID NO: 501000 - RNA, 64 nt, Human
auggaugcaagugauucuaaguuuguggauuuguggauagcagagggaucgggaccucuuggag

SEQ ID NO: 501001 - RNA, 64 nt, Human
cccucccgggacccaggaccccccgugguggacuccgcggcacaugcuucccaaggugguccca

SEQ ID NO: 501002 - RNA, 64 nt, Human
caaggagcgggcgcgcuucgaacaggcgggcgagccgcggcagccacaggcgcgggcccuccuu

SEQ ID NO: 501003 - RNA, 64 nt, Human
cuuuuaugugugcuggugcuauguguguucauguccgcggcagcugucuuuuugcuacuauaag

SEQ ID NO: 501004 - RNA, 61 nt, Human
ugcacccugaagauguguaguggaccgcacuccgcggcaccuucccuaaucaucucgaucu

SEQ ID NO: 501005 - RNA, 64 nt, Human
uuugugauuuuuuuuuuuuuuuuuugguacuucaggauagcaaauaucuaucugcuauuaaaug

SEQ ID NO: 501006 - RNA, 64 nt, Human
gaaaauguuaguggccauuuugcaacaaugaagaggauagcacuuuaucuagaugaaaacugga

SEQ ID NO: 501007 - RNA, 64 nt, Human
gauuuuuaagcuaugaaaaauacaauggggggaaggauagcauuuggagauauaccuaauguua

SEQ ID NO: 501008 - RNA, 64 nt, Human
aauugaagaauggaucccaaaaacuucagaaagaggauagcaaaaaaagaucuagugcgauuuu

SEQ ID NO: 501009 - RNA, 54 nt, Human
uaaaagaauguacaguauaauaagggauagcaagguguuuuccuccauuuaaaa

SEQ ID NO: 501010 - RNA, 64 nt, Human
uguaccagguggugguuauggggucugaaccaaaggauagcagcucuucauuccucuucugaca

SEQ ID NO: 501011 - RNA, 64 nt, Human
ugacugcguaugccaaaaagggacaggaggcaugggauagcaggucuggugacacagcuagggu

SEQ ID NO: 501012 - RNA, 64 nt, Human
uagcuauagcuuuacucagcaugacuguagauaaggauagcagcaaacaaucauuggagcuuaa

SEQ ID NO: 501013 - RNA, 64 nt, Human
agccccugccaaggagacccuggaggggcucugaggauagcaaucagagguugggcuggcugga

SEQ ID NO: 501014 - RNA, 64 nt, Human
aacucauuguuucccucauggccgaccagggcggggauagcaugcccaauuuuagcccugaagc

SEQ ID NO: 501015 - RNA, 64 nt, Human
cuuucuguugguguauccccccccuguauaguuaggauagcauuuuugauuuaugcauggaaac

SEQ ID NO: 501016 - RNA, 64 nt, Human
uagaaacugggacggauucaagucacaugcacgcggauagcaguaagccacacaccugccacuu

SEQ ID NO: 501017 - RNA, 64 nt, Human
uacuugacaucauuuuacucuuggaauaguggguggauagcaaguauauucuaaaaaacuuugu

SEQ ID NO: 501018 - RNA, 64 nt, Human
ugucuccgccagagucacagcagugccgagguguccgcggcagaccacacagaccgucugaaau

SEQ ID NO: 501019 - RNA, 64 nt, Human
aagaugugaaagaagagcagccuaggcagaggcuccgcggcaggaggagccggugcucuggaag

SEQ ID NO: 501020 - RNA, 64 nt, Human
aucgccuugaaagcucugaagaggcccuggguugccgcggcagcaguggucuguuugaugcugc

SEQ ID NO: 501021 - RNA, 64 nt, Human
gucccuuggcuaugagcaggcuuugggggcccuuccgcggcagccccgggggccgagguagggu

SEQ ID NO: 501022 - RNA, 64 nt, Human
cccgugggcacccacggacguggcuuggugcugaggauagcagagcccccagccaucacugcug

SEQ ID NO: 501023 - RNA, 64 nt, Human
agcgagacucugucucaaauaauuauuucacagaggauagcaagcuccagaagguucuauuacc

SEQ ID NO: 501024 - RNA, 64 nt, Human
uuuaaaguuuugcugaagaaugugucugugguuaggauagcacaagcauuaacuuuuguuuuau

SEQ ID NO: 501025 - RNA, 64 nt, Human
caauagcccacagcugagaauguggaauaccuaaggauagcaccgcuuuuguucucgcaaaaac

SEQ ID NO: 501026 - RNA, 64 nt, Human
aauuuuguuugaaauucauauaucuuauuucaaaggauagcauaauaucugcauuaugcuggaa

SEQ ID NO: 501027 - RNA, 64 nt, Human
ugagccucucuuccacaagagcuccuccauguuuggauagcaguugaagagguugugugggugg

SEQ ID NO: 501028 - RNA, 64 nt, Human
cuccucaaauuccugcacggaccugggacuuggaggauagcaaagaaggaggcccugggcuccc

SEQ ID NO: 501029 - RNA, 64 nt, Human
uauuguuucuuguuuggguuuggaauggaaauauggauagcagcauaaaguacuuuuauuuuga

SEQ ID NO: 501030 - RNA, 64 nt, Human
aaaugugaaaaguuguugaucuugaaauaucucaggauagcacuuuuggcaaacucuuagccaa

SEQ ID NO: 501031 - RNA, 64 nt, Human
aaagcccauguguuccaaagcgucuuuaacucugggauagcauuggaagccgcugucaugacag

SEQ ID NO: 501032 - RNA, 64 nt, Human
cguuucccagacaccccucugcuaggccaucccuggauagcaagugaauuaacuuaagggcacu

SEQ ID NO: 501033 - RNA, 64 nt, Human
caauguuacaaaauuuaaggguauguuaacuaaaggauagcauuucuaagauauuuugaauauu

SEQ ID NO: 501034 - RNA, 64 nt, Human
agggagacgguggggaggcuucccaugauuuggaggauagcaacaucaguuaugggagcuguga

SEQ ID NO: 501035 - RNA, 64 nt, Human; identical to SEQ ID NO: 257839

SEQ ID NO: 501036 - RNA, 64 nt, Human
uguaaaaugugccuaguuuaccaaaauuaacaaagggggggaaaggaccuuagaacuuuuuaag

SEQ ID NO: 501037 - RNA, 64 nt, Human
agccugccauggcagcuccaacaaggaccgucugggauagcaccucucagucaacaucgugggg

SEQ ID NO: 501038 - RNA, 64 nt, Human
uuccagcagccuguuccacacccccacaccaucaggauagcacagggaaacuguaguuuaagug

SEQ ID NO: 501039 - RNA, 64 nt, Human
gaucccauccuuagccauagcgagcgguggugguggauagcaucacaagaaacgagccugaaaa

SEQ ID NO: 501040 - RNA, 64 nt, Human
gguggaaagaaguauaccuuucccuggggcccuaggauagcaaagugagccauagugggccagg

SEQ ID NO: 501041 - RNA, 64 nt, Human
guggugcugcuauucgacaaaccaguuuuagcagggauagcagcauucuuauagcuguuuguga

SEQ ID NO: 501042 - RNA, 64 nt, Human
cugugccacagcuacagaugcagaagguuucucuggauagcacaccucugaauguaaaucauga

SEQ ID NO: 501043 - RNA, 64 nt, Human
uagagggcacgcagcgugagggugugucuucccuggauagcagcagccucagccucugccuguc

SEQ ID NO: 501044 - RNA, 64 nt, Human
accuuuuguguuucugguauuuaauaacuugaagggauagcaaaauauacuguguauucagagg

SEQ ID NO: 501045 - RNA, 64 nt, Human
uaaaaccaaaaacaacagugacaauagagucucaggauagcagagucugaaaauaccuuggucu

SEQ ID NO: 501046 - RNA, 64 nt, Human
uggagaauuaauugagcaauugaggagugucucaggauagcacaggccaagguaggggaguaaa

SEQ ID NO: 501047 - RNA, 64 nt, Human
ugccgugugugcuuagacccguaguuuccucaguggauagcacucaauuuauuccguagugaua

SEQ ID NO: 501048 - RNA, 64 nt, Human
caagggcuagaaaagaauguaaucugauauggaaggauagcagcuucuaauuuucaaucaucug

SEQ ID NO: 501049 - RNA, 64 nt, Human
accgggccugucaugggguggggggaggggggagggauagcauuaggagauauacuaacguaaa

SEQ ID NO: 501050 - RNA, 64 nt, Human; identical to SEQ ID NO: 257963

SEQ ID NO: 501051 - RNA, 64 nt, Human; identical to SEQ ID NO: 257964

SEQ ID NO: 501052 - RNA, 64 nt, Human; identical to SEQ ID NO: 257965

SEQ ID NO: 501053 - RNA, 64 nt, Human; identical to SEQ ID NO: 257966

SEQ ID NO: 501054 - RNA, 64 nt, Human
gauauuuuugaugacuguauuguaaauacuacagggauagcacuauaguauuguagucaugaga

SEQ ID NO: 501055 - RNA, 59 nt, Human
uaaaaagagagugcaaguagcauuaagauggauagcacauaauggcacuugucuaugua

SEQ ID NO: 501056 - RNA, 64 nt, Human
auuugccgugaguuuggacggcaccccugcuggcggauagcaagacucuguggaguuuguucag

SEQ ID NO: 501057 - RNA, 64 nt, Human
cucaugaugcuaauaguuuuuuguauacaugggaggauagcacauuugacaguuuuugcauuuu

SEQ ID NO: 501058 - RNA, 64 nt, Human
cugucagucauuaaaaacagcauuagcaggaugaggauagcaauggggaaggguugugggcaau

SEQ ID NO: 501059 - RNA, 64 nt, Human
caugcugggcucuggaccaugagcugaguaggaaggauagcagaggccaacccugaccuuccug

SEQ ID NO: 501060 - RNA, 64 nt, Human
agggagaggaugggggaggggacaaauuagaauaggauagcaucugaugccugagaacccucuc

SEQ ID NO: 501061 - RNA, 64 nt, Human
aaaccagggcaguucuagaggagugcuggugacuggauagcaguuuuaaguggcguucaccuag

SEQ ID NO: 501062 - RNA, 64 nt, Human
gugcuguaacacaguaaauauguacuuguagccuggauagcagacuguguucaacuuuuuaaaa

SEQ ID NO: 501063 - RNA, 64 nt, Human
cacuuccugccuaucacgguccggaggacaccuuggauagcacgggaggagaaguugacuuugu

SEQ ID NO: 501064 - RNA, 64 nt, Human
ccagcagggcuucggccaggggcuuuccacuugaggauagcagcuucacuaggcuggccggcca

SEQ ID NO: 501065 - RNA, 64 nt, Human
caggagcagcagggaagcucugggccaccucccuggauagcaggaacuugaccugccaugugug

SEQ ID NO: 501066 - RNA, 62 nt, Human
gucauuacaguaguuuguaacauuuguagauuggauagcauuuuuaugauuugaugaguuuc

SEQ ID NO: 501067 - RNA, 64 nt, Human
gccccugggacggacagggcuggcugucucucagccgcggcagcagggagcgggcagaggccgc

SEQ ID NO: 501068 - RNA, 64 nt, Human
ucuuggggacaugggucgcccaugagagcgcagcccgcggcaaucaauaaacagcaggugauac

SEQ ID NO: 501069 - RNA, 64 nt, Human
ugggaugccaccuggagccccacccaggagcuggccgcggcaccuuacgcuucagcuguugauc

SEQ ID NO: 501070 - RNA, 64 nt, Human
cggcccccgccuccauacccgggcccagggaagcccgcggcagcggcagccuggauccaggggc

SEQ ID NO: 501071 - RNA, 64 nt, Human
agcaccuggccccaggacugagguccugagaaggggauagcacugcccaggacgugugucccua

SEQ ID NO: 501072 - RNA, 64 nt, Human
cugugucccggggccgacucuucucaggggcuguggauagcacugugaaggucagugcccgugg

SEQ ID NO: 501073 - RNA, 64 nt, Human
uuccucgugggucccagagaccucaucagccuugggauagcaaacuccagguuccugaaauauc

SEQ ID NO: 501074 - RNA, 64 nt, Human
accugagauggagaggccaggagagaguauaaggggauagcagcaaaccaccuaucuggcccca

SEQ ID NO: 501075 - RNA, 64 nt, Human
uggagucccaugaggaugugggcccuuuaauaaaggauagcaaacagggagcuuguggccuguu

SEQ ID NO: 501076 - RNA, 64 nt, Human
gaccucuccucuggccugugggguuauaagugauggauagcagaaagggagaacugacuccugu

SEQ ID NO: 501077 - RNA, 64 nt, Human
aggaagggaagauggaacaggcucagaucucaugggauagcacguggagcucuuggcuggggcu

SEQ ID NO: 501078 - RNA, 64 nt, Human
guugauucaaacuugcuucuaagccugaguccagggauagcaaugguacugaccagcuauggac

SEQ ID NO: 501079 - RNA, 64 nt, Human
cuggggccuguuggggggaugggggcuaggggagggauagcauuaggagaaauaccugauguag

SEQ ID NO: 501080 - RNA, 64 nt, Human
auaaagaccuauguacuuaauccuuuaacucugcggauagcauuugguagguagugauuaacug

SEQ ID NO: 501081 - RNA, 64 nt, Human
cuggaaaaauugcaacaacacuuuacuaccuaacggauagcauuuguaaauacucuagguaucu

SEQ ID NO: 501082 - RNA, 64 nt, Human
ugaggagcaugaggaauucaggagcagaaggucaggauagcaugagauagucucaauguggcca

SEQ ID NO: 501083 - RNA, 64 nt, Human
uguuuuugggguuuuuuguagugccuuuuguuuuggauagcagcuaucuuguuggaugugaggu

SEQ ID NO: 501084 - RNA, 64 nt, Human
aagccacccuccguuugcacguuaacucuaugccggauagcagcugugcacgagacaaucuugc

SEQ ID NO: 501085 - RNA, 64 nt, Human
cucccggcccugcucugauuaggacagcgaccucggauagcacagccagcuacuccacccugcc

SEQ ID NO: 501086 - RNA, 64 nt, Human
uuauuagucuuggaagcagagucuggguugguguggauagcaaaggaggaagucugagccccuc

SEQ ID NO: 501087 - RNA, 64 nt, Human
gcugcagucccucagugcuggugguaucguguggggauagcaauacuucucugcccuucauugu

SEQ ID NO: 501088 - RNA, 64 nt, Human
gccauaaggaaagcgggucaauagggcugccucuggauagcauuacuucaaagcuggguuagag

SEQ ID NO: 501089 - RNA, 64 nt, Human
cuagagucaccaaggucacagugccacuuucacgggauagcaggcucuugggacuuuuacacag

SEQ ID NO: 501090 - RNA, 64 nt, Human
guugcccuuuuccuugacuauuacacugccuggaggauagcagagaagccugucuguacuucau

SEQ ID NO: 501091 - RNA, 64 nt, Human
gucucggaaucauacagacccucagcugacgucgggauagcaaggcuagaagccuagaagcagg

SEQ ID NO: 501092 - RNA, 64 nt, Human
ggcccucugguagacacaggauagauaacucuuuggauagcaugucuuuuuuucuguuaauuag

SEQ ID NO: 501093 - RNA, 64 nt, Human
uuaacccuagcgauggcuugggagaugggggguuggauagcauccucuuucuuggcccuuccuu

SEQ ID NO: 501094 - RNA, 64 nt, Human
uuucuccuaggagcaacuugugcaaguacuucaaggauagcaggaauauaaaaauucucaaaga

SEQ ID NO: 501095 - RNA, 63 nt, Human
uucacaugcacaggugcucucagcucugccaaagcgaaugaaugguguuuccggaggagcaag

SEQ ID NO: 501096 - RNA, 63 nt, Human
agagaugugagggcuccuuccucaggaugcccagcgaaugagggguagagccacucuggggcc

SEQ ID NO: 501097 - RNA, 63 nt, Human
aagaggaggccguugauucacuucacgcuuucagcgaaugacaaaaucaucuuugugaaggcc

SEQ ID NO: 501098 - RNA, 52 nt, Human
gcagcuaugcagccgggugaaugcgaaugaacuucacguucuccaaagcacu

SEQ ID NO: 501099 - RNA, 64 nt, Human; identical to SEQ ID NO: 257967

SEQ ID NO: 501100 - RNA, 64 nt, Human; identical to SEQ ID NO: 257968

SEQ ID NO: 501101 - RNA, 64 nt, Human
agccucaccagacuagccauugcugcagugugggccgcggcagccaagaguggagagcgggaga

SEQ ID NO: 501102 - RNA, 64 nt, Human
uggucguggggcccuacugacccgcccucugcccccgcggcaaccgcucccacgccugcccacu

SEQ ID NO: 501103 - RNA, 64 nt, Human
ggacuuccugcugacccugagagccucuggggugccgcggcaccacggggcaugcaugauugug

SEQ ID NO: 501104 - RNA, 64 nt, Human
ugacgccaacgccagcaccaaugucgcgccugucccgcggcacucagccugcacgcccuccgcg

SEQ ID NO: 501105 - RNA, 64 nt, Human
ucaguaacgcagcgggaaucaaucugcacugacaccgcggcaggaacugaagcugcccuggcaa

SEQ ID NO: 501106 - RNA, 64 nt, Human
ugguuggccgugcaagcuaauguggguccugugaccgcggcagcuccucagcggagccgcagac

SEQ ID NO: 501107 - RNA, 64 nt, Human
aguguaaaccguggcugucuccugcagugagccaccgcggcaggcacguugacuguuuuacuga

SEQ ID NO: 501108 - RNA, 64 nt, Human
ggagagccuguccgagacacccgggccuagcucuccgcggcagccucggaaggcccuggucucc

SEQ ID NO: 501109 - RNA, 64 nt, Human
acucuaagucuccaagaauacagaaaaugcuuuuccgcggcacgaaucagacucaucuacacag

SEQ ID NO: 501110 - RNA, 58 nt, Human
ucugcggcggcacagccugacucacaccccgcggcaggacuucuagagaagcccagga

SEQ ID NO: 501111 - RNA, 64 nt, Human
gggagggcucuggagggcccuggaggggggguccccgcggcagcugaccuccggucaccugcuu

SEQ ID NO: 501112 - RNA, 64 nt, Human
auggcaagggggucugucucugccgaugcuccuuccgcggcacugacucugcgccgugucacau

SEQ ID NO: 501113 - RNA, 64 nt, Human
gggcagugaggcccagcccagcgccccguccaccccgcggcagcuccucgccucagcuccgcac

SEQ ID NO: 501114 - RNA, 64 nt, Human
cccgagcuccccgagaguccucagugaaaggauuccgcggcacugccucuauuauuauaccgua

SEQ ID NO: 501115 - RNA, 64 nt, Human
uggacgagcacgcgcugguggagcuggaguugcaccgcggcagcuccauggaaaucaaucuggg

SEQ ID NO: 501116 - RNA, 64 nt, Human
gcaguagagacgacccccagccccgggccccagcccgcggcacuaacgacaggugagaggggua

SEQ ID NO: 501117 - RNA, 64 nt, Human
ugcgucccggacccaucuacgcugaggacggagaccgcggcaucaaccagcccaucaucuacag

SEQ ID NO: 501118 - RNA, 64 nt, Human
cagcccuccccacagacgagccccccacauggugccgcggcacguccccccugugacgcguucc

SEQ ID NO: 501119 - RNA, 64 nt, Human
cucccagcuucgcuccuuaucacugcauugugaagaggaggaaaagugaaucacggagagagaa

SEQ ID NO: 501120 - RNA, 64 nt, Human
gcuagcgucccuacugccucccgacuccucaguggaggaggagcugcggucccucuggugucug

SEQ ID NO: 501121 - RNA, 64 nt, Human
agcuaaucccauggcgagaugggggcucacuccggaggaggagccaggcagcagggccuuccug

SEQ ID NO: 501122 - RNA, 64 nt, Human
gaugggcucgcugaaccucgaggaacuccaggacgaggaggacaugggacuugcguggacaguc

SEQ ID NO: 501123 - RNA, 64 nt, Human
ugacagaggugccuguucugacuuagaaccucuggaggaggaggggggugccuuggucucgugu

SEQ ID NO: 501124 - RNA, 64 nt, Human
uuuaauucauuaaccagugguuagcccuuaaggggaggaggacggauugauuccacauuccacu

SEQ ID NO: 501125 - RNA, 64 nt, Human
cccacuccaggacuguugaugaaagggacagauugaggaggaagugggcucugaggcugcaggg

SEQ ID NO: 501126 - RNA, 64 nt, Human
cagccuucagcuggacucaggguuggggucacuggaggaggagguggcuuccugccccauuguu

SEQ ID NO: 501127 - RNA, 64 nt, Human
auagauaccuuugggcugccugggacaggcuccugaggaggauugagggugaaagucucccacg

SEQ ID NO: 501128 - RNA, 64 nt, Human
agaacggaagcaggcaccacuaacuuaugaaaaggaggaggaacaggaccaaggggugagcugc

SEQ ID NO: 501129 - RNA, 64 nt, Human
uaggaccuugggccccaaaagcugguggugaaaugaggaggagccaauuuaagaagacccuuau

SEQ ID NO: 501130 - RNA, 64 nt, Human
gcuugagguuccaaccuggagccacagugugugagaggaggaggagagggagaauucuguucuc

SEQ ID NO: 501131 - RNA, 64 nt, Human
ugagguuccaaccuggagccacagugugugagaggaggaggagagggagaauucuguucuccca

SEQ ID NO: 501132 - RNA, 64 nt, Human
cuagugcugcagucccacuucaaagccauuuucugaggaggaugguuuaggucuggcaauuguc

SEQ ID NO: 501133 - RNA, 64 nt, Human
uaacuuucuugguaugcuggccagaaagggaaaugaggaggagaguagaaaccacagcucuuag

SEQ ID NO: 501134 - RNA, 64 nt, Human
guaagccaguaugaaugccagugguuggggggcggggggggagucaguugacauaagauuuagu

SEQ ID NO: 501135 - RNA, 64 nt, Human
auuuucuaacuuguaaguucuauuuaaagggggugggggggaaucuugggaacguuguggggua

SEQ ID NO: 501136 - RNA, 64 nt, Human
uggcaaugcuggaaaauuuuuaucccagaggggugggggggaggggggaggggaagccagaguc

SEQ ID NO: 501137 - RNA, 64 nt, Human
uguuuguuuguuuaagauuuuggggaagagauuugaggaggaaagaaaggagauggggugagag

SEQ ID NO: 501138 - RNA, 64 nt, Human
cccagccaaggcccugccaaccaacugccucucugaggaggagguggccaagaagcggaaaaac

SEQ ID NO: 501139 - RNA, 64 nt, Human
ccaguauuccuacuuauaguuggugagcaugagggaggaggaaucauggcuaccuucuccuggc

SEQ ID NO: 501140 - RNA, 64 nt, Human
gccggauggggagagucaacaggaaaaaaggagggaggaggaaaagccacaagagacauucugu

SEQ ID NO: 501141 - RNA, 64 nt, Human
gaugacuuccccugccuccuacuccaguaugacagaggaggauguaaggccuuagccaugaucu

SEQ ID NO: 501142 - RNA, 64 nt, Human
gguaaaagaugaaaauguugaguuugacucugaugaggaggaaccaccugaucuccccuuggac

SEQ ID NO: 501143 - RNA, 64 nt, Human
cagcucagcuauggacacaucugagccagccaaggaggaggaugauuacgacgugaugcaggac

SEQ ID NO: 501144 - RNA, 64 nt, Human
cuaaacuaagaaggauccuggacagggagaaguggaggaggauaagguaccaggacucaggcuu

SEQ ID NO: 501145 - RNA, 64 nt, Human
gcaagaggugguggaauccuugugccggguaguagaggaggauaagggcaaaaccaggcccagg

SEQ ID NO: 501146 - RNA, 64 nt, Human
ucccaaggagccagaguccucccaagauccccuggaggaggagggaucccugcugccugcacug

SEQ ID NO: 501147 - RNA, 64 nt, Human
aacuuggauaggcaguagauauuuuugcccaccugaggaggaacucagucaagcuguugcuuaa

SEQ ID NO: 501148 - RNA, 64 nt, Human
cauuuguucuuuccagagcuaacugauaagaguggaggaggaaugccuucuccuaagagucagu

SEQ ID NO: 501149 - RNA, 64 nt, Human
cuggaaaggggagagccugcuggcacccaccguggaggaggaaggcaagaggggguggaggggu

SEQ ID NO: 501150 - RNA, 64 nt, Human
cagauacauggggaacugcauaucggaggugguggaggaggaggaggaggaggaaggcaaagcc

SEQ ID NO: 501151 - RNA, 64 nt, Human
auacauggggaacugcauaucggaggugguggaggaggaggaggaggaggaaggcaaagccccu

SEQ ID NO: 501152 - RNA, 64 nt, Human; identical to SEQ ID NO: 257957

SEQ ID NO: 501153 - RNA, 64 nt, Human; identical to SEQ ID NO: 257958

SEQ ID NO: 501154 - RNA, 64 nt, Human; identical to SEQ ID NO: 257962

SEQ ID NO: 501155 - RNA, 64 nt, Human
cauggggaacugcauaucggaggugguggaggaggaggaggaggaggaaggcaaagccccugga

SEQ ID NO: 501156 - RNA, 64 nt, Human
ggggaacugcauaucggaggugguggaggaggaggaggaggaggaaggcaaagccccuggaaau

SEQ ID NO: 501157 - RNA, 64 nt, Human
gaacugcauaucggaggugguggaggaggaggaggaggaggaaggcaaagccccuggaaaugug

SEQ ID NO: 501158 - RNA, 64 nt, Human
ccccaccgaagaaggccugagcaagggggaggaagaggaggaagguuggaccuucaucagacca

SEQ ID NO: 501159 - RNA, 64 nt, Human
caugguggccugugccuauagucccaacuacuuagaggaggaucgcuugaucucaggagguuga

SEQ ID NO: 501160 - RNA, 64 nt, Human
uuugagagccuccaacugauccaagugucauccggaggaggagguggcccguaugugcaggacc

SEQ ID NO: 501161 - RNA, 64 nt, Human
acuggcucuccagccccaggaggagaacaggagggaggaggagaugaaagaggagggacagguu

SEQ ID NO: 501162 - RNA, 64 nt, Human
aaggccccauucucccacaggauggugaggcugggaggaggaagacugagguagagauuccagg

SEQ ID NO: 501163 - RNA, 64 nt, Human
ccacagcuucaugacccacccugaauucgccauagaggaggaguugccacgaacaccacuccug

SEQ ID NO: 501164 - RNA, 64 nt, Human
ggaguugccacgaacaccacuccuggaugaggaagaggaggaaaauccugacaaggcuucuaag

SEQ ID NO: 501165 - RNA, 64 nt, Human
gccuaaccaggagaggggagaagugaaaaaccgugaggaggacucuauuuggauccuggauuug

SEQ ID NO: 501166 - RNA, 64 nt, Human
ggcucacgcguucugggagcucaaggccaccuuggaggaggaugccacgcacuuccucucucgg

SEQ ID NO: 501167 - RNA, 64 nt, Human
ucuuuuaggacagauucucagaugggaugaucuggaggaggaggaaaaagauacacucccuugg

SEQ ID NO: 501168 - RNA, 64 nt, Human
uuuaggacagauucucagaugggaugaucuggaggaggaggaaaaagauacacucccuuggggc

SEQ ID NO: 501169 - RNA, 64 nt, Human
agauauucagguggccagaagagcuugucagcaagaggaggacagaauucucccagcguuaaca

SEQ ID NO: 501170 - RNA, 64 nt, Human; identical to SEQ ID NO: 257969

SEQ ID NO: 501171 - RNA, 64 nt, Human; identical to SEQ ID NO: 257970

SEQ ID NO: 501172 - RNA, 64 nt, Human; identical to SEQ ID NO: 257971

SEQ ID NO: 501173 - RNA, 64 nt, Human
uuuccuuaaaaaauaaaguacguguuuacuuggugaggaggaggcagaaccagcucuuuggugc

SEQ ID NO: 501174 - RNA, 64 nt, Human
gaucugagggcgcuggcuugcgagcugggccagggaggaggaggguuggggggcuccgguggaa

SEQ ID NO: 501175 - RNA, 64 nt, Human
ugacaaaacgcacacaucaacccacagaccuuaggaggaggaaggcgagggcggggugacuucu

SEQ ID NO: 501176 - RNA, 64 nt, Human
ggcucugcucgucgggggcugggagauguuccuggaggaggacacucccaucagaacuuggcag

SEQ ID NO: 501177 - RNA, 64 nt, Human
cuguucugcuguggccugagcuccccagaguccugaggaggagcgccaguugccccucgcucac

SEQ ID NO: 501178 - RNA, 64 nt, Human
ugagcaggaggaggaagaggaggaggaggaggaggaggaggaaggcgaggacaguggcacuuca

SEQ ID NO: 501179 - RNA, 64 nt, Human
ggaugagcaggaggaggaagaggaggaggaggaggaggaggaggaaggcgaggacaguggcacu

SEQ ID NO: 501180 - RNA, 64 nt, Human
ggaggaugagcaggaggaggaagaggaggaggaggaggaggaggaggaaggcgaggacaguggc

SEQ ID NO: 501181 - RNA, 64 nt, Human
ggaggaggaugagcaggaggaggaagaggaggaggaggaggaggaggaggaaggcgaggacagu

SEQ ID NO: 501182 - RNA, 64 nt, Human
agaggaggaggaugagcaggaggaggaagaggaggaggaggaggaggaggaggaaggcgaggac

SEQ ID NO: 501183 - RNA, 64 nt, Human
ggaagaggaggaggaugagcaggaggaggaagaggaggaggaggaggaggaggaggaaggcgag

SEQ ID NO: 501184 - RNA, 64 nt, Human
ccuggaagaggaggaggaugagcaggaggaggaagaggaggaggaggaggaggaggaggaaggc

SEQ ID NO: 501185 - RNA, 64 nt, Human
ccugcagagccuggaagaggaggaggaugagcaggaggaggaagaggaggaggaggaggaggag

SEQ ID NO: 501186 - RNA, 64 nt, Human
aggcagucagcagccccugcagagccuggaagaggaggaggaugagcaggaggaggaagaggag

SEQ ID NO: 501187 - RNA, 64 nt, Human
cccaggcagucagcagccccugcagagccuggaagaggaggaggaugagcaggaggaggaagag

SEQ ID NO: 501188 - RNA, 64 nt, Human; identical to SEQ ID NO: 257972

SEQ ID NO: 501189 - RNA, 64 nt, Human; identical to SEQ ID NO: 257973

SEQ ID NO: 501190 - RNA, 64 nt, Human; identical to SEQ ID NO: 257974

SEQ ID NO: 501191 - RNA, 56 nt, Human
gcggaaaccagggucacugagcuacagaggaggacaugcccugggauguaguagua

SEQ ID NO: 501192 - RNA, 64 nt, Human
gagagaaaguagaugaguacuugccuaggacugggaggaggauugcgaggaaauggagauucac

SEQ ID NO: 501193 - RNA, 64 nt, Human
ggccgggagacagaugaggcgagaggaggaggaggaggaggagaaggcucugggcuccucugca

SEQ ID NO: 501194 - RNA, 64 nt, Human
ucaggccgggagacagaugaggcgagaggaggaggaggaggaggagaaggcucugggcuccucu

SEQ ID NO: 501195 - RNA, 64 nt, Human
guaucaggccgggagacagaugaggcgagaggaggaggaggaggaggagaaggcucugggcucc

SEQ ID NO: 501196 - RNA, 64 nt, Human
cugguaucaggccgggagacagaugaggcgagaggaggaggaggaggaggagaaggcucugggc

SEQ ID NO: 501197 - RNA, 64 nt, Human
uaucugguaucaggccgggagacagaugaggcgagaggaggaggaggaggaggagaaggcucug

SEQ ID NO: 501198 - RNA, 64 nt, Human
ucagacacugaccuucugcugggaaagcagcccugaggaggaagaggaggcgagggaaucagaa

SEQ ID NO: 501199 - RNA, 64 nt, Human
gaaggaccuugcagaggacgaagaggaggaggaugaggaggacacagaagauggcgucagcuuc

SEQ ID NO: 501200 - RNA, 64 nt, Human
aagauggaagaaggaccuugcagaggacgaagaggaggaggaugaggaggacacagaagauggc

SEQ ID NO: 501201 - RNA, 64 nt, Human
gacaagauggaagaaggaccuugcagaggacgaagaggaggaggaugaggaggacacagaagau

SEQ ID NO: 501202 - RNA, 64 nt, Human
uggagacuauauuaugcugaagaaggcuguucgugaggaggagaugcgagcacccagaacgucu

SEQ ID NO: 501203 - RNA, 64 nt, Human
cuauaaaucuuccuagcagcaauuugagcuaccugaggaggaggcagggcagaaagggcgaggg

SEQ ID NO: 501204 - RNA, 64 nt, Human
augugucugaugacauuccuggugaagcaaaggagaggaggaugggucagcccucacugggugu

SEQ ID NO: 501205 - RNA, 64 nt, Human
uggaggaacauugggaaggaagcccgcggggagagaggaggagagaaguggccagggcuugugg

SEQ ID NO: 501206 - RNA, 64 nt, Human; identical to SEQ ID NO: 257975

SEQ ID NO: 501207 - RNA, 64 nt, Human; identical to SEQ ID NO: 257976

SEQ ID NO: 501208 - RNA, 64 nt, Human; identical to SEQ ID NO: 257980

SEQ ID NO: 501209 - RNA, 64 nt, Human
ccccucuugaccuaccccagauauuuguguggaagaggaggaaucaccauuuacaagguggaca

SEQ ID NO: 501210 - RNA, 64 nt, Human
acuuuggggcuggaggugacaguaggugagggcagaggaggagaucagaaaaucccucugacau

SEQ ID NO: 501211 - RNA, 64 nt, Human
aaaucuaauugcuuuuuuuuuuaauuguuggggagaggaggaugagcagaacuccuaugcagcc

SEQ ID NO: 501212 - RNA, 64 nt, Human
aaagcugucauuacagacaacagguuucagugaugaggaggacaacacugccuuucaaacuuuu

SEQ ID NO: 501213 - RNA, 64 nt, Human
ggaaaggaggaggggagugguggguuuauagggggaggaggaggcagguggucuaagugcugac

SEQ ID NO: 501214 - RNA, 64 nt, Human
ucagcaacaaacaaacuuuguuugggaagcuauggaggaggacuuuuagauuuagugaagaugg

SEQ ID NO: 501215 - RNA, 64 nt, Human
uuggaggaagcuggggaaagugguuagggagggagaggaggaagacugagaaaucucugcaucc

SEQ ID NO: 501216 - RNA, 64 nt, Human
ugcccucugccaaccucccugcuggcccaggugagaggaggaagaggggucuggaaagaaaccc

SEQ ID NO: 501217 - RNA, 64 nt, Human
gaagugaaagaaggcaaggagguaggaagagagggaggaggaaaggaaggagagaugccucagg

SEQ ID NO: 501218 - RNA, 64 nt, Human
gacugugggggagaugccccuucuuauagcacuggaggaggaaaacaaauucuugucccccuca

SEQ ID NO: 501219 - RNA, 64 nt, Human
gaaaagcaagaagaaaagacagcagcaucaagaggaggaggacaucuuggauguaagggaugag

SEQ ID NO: 501220 - RNA, 64 nt, Human
caggaaaagcaagaagaaaagacagcagcaucaagaggaggaggacaucuuggauguaagggau

SEQ ID NO: 501221 - RNA, 64 nt, Human
augcagccgaagaaagaagaggcagcaacaggaggaggaggacuugaaccuagaagauagaggu

SEQ ID NO: 501222 - RNA, 64 nt, Human
cccaugcagccgaagaaagaagaggcagcaacaggaggaggaggacuugaaccuagaagauaga

SEQ ID NO: 501223 - RNA, 64 nt, Human
ccccaaaaaaaagaaaaagaaaaggaggcagaaagaggaggaagaagcuacagcaucugaaagg

SEQ ID NO: 501224 - RNA, 64 nt, Human
aagcaagauuuuaaagugauuuuugagaagacuugggggggacaauaauagacauucaugucag

SEQ ID NO: 501225 - RNA, 64 nt, Human
aaaaaaaaaaaauacauuuaguauagcggggggugggggggagaaauaauguuauuuccuaugc

SEQ ID NO: 501226 - RNA, 64 nt, Human
aggguggggagggagccucggguggggugggagcgggggggacagugccccgggaacccggugg

SEQ ID NO: 501227 - RNA, 64 nt, Human
caggagggcccucagcuccuagggcugucgaauagaggaggagagagaaauggucuagccaggg

SEQ ID NO: 501228 - RNA, 64 nt, Human
uuaaagcuccagccaaaaacuggacaaggauagagaggaggagggaagaacaaaagagcccuuc

SEQ ID NO: 501229 - RNA, 64 nt, Human
ugggugcgaguuccuccugcauaugaaccgaggggaggaggagaagcugagcacgugugacauu

SEQ ID NO: 501230 - RNA, 64 nt, Human
ggaaacauguggauaaagggaaccaugaaaaugagaggaggaaagacauccagaucagcuguuu

SEQ ID NO: 501231 - RNA, 64 nt, Human
ccuugcuuucuagcagaggucaccugaagugugugaggaggaucaucauuuuccucaucccccc

SEQ ID NO: 501232 - RNA, 64 nt, Human
ucaaagcaaacacgugggugcagaagacccaugggaggaggagguggggcccacucaacacacc

SEQ ID NO: 501233 - RNA, 64 nt, Human
gcuucucagccaccccgugguguaacaaguggaggaggaggagggggugagaacaccuuuccuc

SEQ ID NO: 501234 - RNA, 64 nt, Human
ggggcuucucagccaccccgugguguaacaaguggaggaggaggagggggugagaacaccuuuc

SEQ ID NO: 501235 - RNA, 64 nt, Human
acacccuucucugagccuucccaccugcgggguggaggaggaacuucccaagugcuuuuaaaaa

SEQ ID NO: 501236 - RNA, 64 nt, Human
cagcuccacccaccuggagacgaauguagccagagaggaggaaggagggaaacugaagacaccg

SEQ ID NO: 501237 - RNA, 64 nt, Human
gacagauaggcaugccccaggcccugagugagcagaggaggacuguagggugagagggaaagaa

SEQ ID NO: 501238 - RNA, 64 nt, Human
ugccccucuguuggaggcacaguuuuagaauaaggaggaggagggagaagagaaaauguaaagg

SEQ ID NO: 501239 - RNA, 50 nt, Human
ccauguccauugagagcugagaggaggagccucgcauuccugggaagagg

SEQ ID NO: 501240 - RNA, 64 nt, Human
cugcuguugccaucagaggaggaugaccgugcuugaggaggaagaauggguucaagaucaucau

SEQ ID NO: 501241 - RNA, 64 nt, Human
gguuccuuucccagagguucugcuguugccaucagaggaggaugaccgugcuugaggaggaaga

SEQ ID NO: 501242 - RNA, 64 nt, Human; identical to SEQ ID NO: 257897

SEQ ID NO: 501243 - RNA, 64 nt, Human; identical to SEQ ID NO: 257898

SEQ ID NO: 501244 - RNA, 64 nt, Human; identical to SEQ ID NO: 257899

SEQ ID NO: 501245 - RNA, 64 nt, Human
ggaccugggaggagggaguguguccuuugagcaagaggaggaacuccuggugccuuucugagcc

SEQ ID NO: 501246 - RNA, 64 nt, Human
ggggcgcaggacucggucaagggaggggcaagaggaggaggagagccugccguuccaacuugcc

SEQ ID NO: 501247 - RNA, 64 nt, Human
cugggggcgcaggacucggucaagggaggggcaagaggaggaggagagccugccguuccaacuu

SEQ ID NO: 501248 - RNA, 64 nt, Human
gcagagggagguagaagccaucauggagggcgacgaggaggacagaggcugcugcugcugcaaa

SEQ ID NO: 501249 - RNA, 64 nt, Human
uuuuuccccucuccccuauuuuuuaaguaccuuggaggaggagagguuggugacaugcauggug

SEQ ID NO: 501250 - RNA, 64 nt, Human
augggguggggggacauucagacgggcaguguuagaggaggagaugggagcggugacuacacac

SEQ ID NO: 501251 - RNA, 64 nt, Human
agcucacgaccuuggagccccguggagcuggacugaggaggaggcugcacagcgggagagcagc

SEQ ID NO: 501252 - RNA, 64 nt, Human
gguuuguuugaagagacuguaccagagggccagggaggaggagaaaggaauugagcuggccuau

SEQ ID NO: 501253 - RNA, 64 nt, Human
ccagcuuccuucagagagcagugcuuuuggcggggaggaggaaaucccuucauacuugaacguu

SEQ ID NO: 501254 - RNA, 64 nt, Human
acaaggacauaggaucauagauuggguagggagggaggaggauuucuggaacuuuucucaaagg

SEQ ID NO: 501255 - RNA, 64 nt, Human
acuugcugguggguuuuauguugugcaauacuaggaggaggaggcaggugaucuaugcugaucu

SEQ ID NO: 501256 - RNA, 64 nt, Human
gugggcuggggagugcagaaguugggcagaaagggaggaggagggcaacagggaaugaagcugg

SEQ ID NO: 501257 - RNA, 64 nt, Human
uagugaucaggaaacagaucucagcaaagccacugaggaggaggcugugcugaguuuguguggc

SEQ ID NO: 501258 - RNA, 64 nt, Human
ucccuccaccuggggcagcagcaggaggccuggggaggaggaaaaucaggcagucggccuggag

SEQ ID NO: 501259 - RNA, 64 nt, Human
cuggaaacacuaggugccugcccagggaggaacggaggaggacucgcgcuacaagaggccacuc

SEQ ID NO: 501260 - RNA, 64 nt, Human; identical to SEQ ID NO: 257901

SEQ ID NO: 501261 - RNA, 64 nt, Human; identical to SEQ ID NO: 257902

SEQ ID NO: 501262 - RNA, 64 nt, Human; identical to SEQ ID NO: 257903

SEQ ID NO: 501263 - RNA, 62 nt, Human
agacguuuucaucccgcuaaucuugggaauaagaggaggaagcggcuggcaacugaaggcug

SEQ ID NO: 501264 - RNA, 64 nt, Human
agguggggaaugaauggaagcugacgggcagagagaggaggauuaaaaaaaagaaauagacaua

SEQ ID NO: 501265 - RNA, 64 nt, Human
cgcuguuaccgccgcucagcgccccggcugggcggaggaggagacgcccaugccccucagggga

SEQ ID NO: 501266 - RNA, 64 nt, Human
ugggaagagguuucuguaaccccugcccuggugugaggaggaaauggcucuggccuggcugccu

SEQ ID NO: 501267 - RNA, 64 nt, Human
caggcaagcuggaacuuggguggggaggggacaugaggaggauaaacagcugacuguggcuuca

SEQ ID NO: 501268 - RNA, 64 nt, Human
gguggugugguguugggaagggguccugcagggggaggaggacuuggagggucugggggcagcu

SEQ ID NO: 501269 - RNA, 64 nt, Human
ccugucccagcuccaggaaggggaguucuggguggaggaggaggaguuccucagggaguuugac

SEQ ID NO: 501270 - RNA, 64 nt, Human
gucccagcuccaggaaggggaguucuggguggaggaggaggaguuccucagggaguuugacgag

SEQ ID NO: 501271 - RNA, 64 nt, Human
ucaaaaacuugggcuuucuaaucagaauuuccaggaggaggaaagugugugcugaauauuuuaa

SEQ ID NO: 501272 - RNA, 64 nt, Human
aaucaggaucugaguuauuuugcuaaacuugggggaggaggaacaaauaaauggagucuuuauu

SEQ ID NO: 501273 - RNA, 64 nt, Human
ccccaguccgagggcugggcccgagguauggucggaggaggagcuccugccugcgguuuugugu

SEQ ID NO: 501274 - RNA, 64 nt, Human
ccaucuccgacgacugaggcaagagggcgccagugaggaggaagggaaggcgguucagagaugu

SEQ ID NO: 501275 - RNA, 64 nt, Human
aauacauaucauguacaguuuuauuuuauaacgugaggaggaaaaacagucuuuggauuaaccc

SEQ ID NO: 501276 - RNA, 64 nt, Human
aucuggagauuucuagaguggaucucuuaugaaugaggaggaauguggaaaguuucacauuuag

SEQ ID NO: 501277 - RNA, 58 nt, Human
ccuuccugccaguggucugaagagcccagaggaggaguuuggccagguggacuguggc

SEQ ID NO: 501278 - RNA, 64 nt, Human; identical to SEQ ID NO: 257904

SEQ ID NO: 501279 - RNA, 64 nt, Human; identical to SEQ ID NO: 257908

SEQ ID NO: 501280 - RNA, 64 nt, Human; identical to SEQ ID NO: 257909

SEQ ID NO: 501281 - RNA, 64 nt, Human
aacccagccggaaggggugguggucaacgggagggaggaggagcagacggcagaggaaauccuc

SEQ ID NO: 501282 - RNA, 64 nt, Human
cuggccucuggccugggaaaagggcaggagccuagaggaggaaaaaggcugguggacagaccca

SEQ ID NO: 501283 - RNA, 64 nt, Human
gcaguugaccuuugccaaacacuuuacaguucuggaggaggagguaacauagaugccugggccu

SEQ ID NO: 501284 - RNA, 64 nt, Human
gagccuucuguagaccauauagaaaaagauuauagaggaggagaaucuacugcuggcaauuggg

SEQ ID NO: 501285 - RNA, 64 nt, Human
ugugccuucauaggucaucuaggguuuuauaaaggaggaggagacaauauuuuuucaaacuuuu

SEQ ID NO: 501286 - RNA, 64 nt, Human
ccgagcugagguagaaaaacgucuccgagaaggggaggaggaucauguacgcccggaaguagga

SEQ ID NO: 501287 - RNA, 64 nt, Human
gcaugugccugaccagguaagaaacugaaagcaagaggaggaagauaaaugcccggagauucca

SEQ ID NO: 501288 - RNA, 64 nt, Human
gguguaccaagguugggggugagccuacccuuucgaggaggaguauuuuaaucaccaacauugu

SEQ ID NO: 501289 - RNA, 64 nt, Human
ugguuuggggucaguuuuuaaaugaaauaguagcgaggaggauuuucuguuuuggaaaacacca

SEQ ID NO: 501290 - RNA, 64 nt, Human
gaacacuaaugaugccaggaagagaguaaggcuagaggaggagacucauuuuaaccccagucca

SEQ ID NO: 501291 - RNA, 64 nt, Human
uguguacauuucaagaauuuggguuuuuuggagggaggaggaaacuguuuacuuuuuuccucca

SEQ ID NO: 501292 - RNA, 64 nt, Human
uucuguguucugaaauacuggguagagaauggcugaggaggagauuaccagagaaguugcuuug

SEQ ID NO: 501293 - RNA, 64 nt, Human
gguuaucuaaccuguuccauuccauggaaccauggaggaggaagacccucaguuauuuugucac

SEQ ID NO: 501294 - RNA, 64 nt, Human
cagauggcggugaucagcagagagauugaacuuugaggaggaagcagaaucuuugcaagaaagu

SEQ ID NO: 501295 - RNA, 64 nt, Human
cuuggaacccuggaaacccccuucuuaaauuugggaggaggaguaugccuuuggugucccccuc

SEQ ID NO: 501296 - RNA, 64 nt, Human; identical to SEQ ID NO: 257911

SEQ ID NO: 501297 - RNA, 64 nt, Human; identical to SEQ ID NO: 257912

SEQ ID NO: 501298 - RNA, 64 nt, Human; identical to SEQ ID NO: 257913

SEQ ID NO: 501299 - RNA, 64 nt, Human
ccacaaccccuaggccccucaggagcuuugcagagaggaggacguguacuccaggcgaggccuc

SEQ ID NO: 501300 - RNA, 64 nt, Human
cagagcuccuggcccuggccagaagcaggagugugaggaggagacagccucagcggacaagcag

SEQ ID NO: 501301 - RNA, 64 nt, Human
auuucacuggcagccuccacuagaauuuggugaagaggaggaggaggagauugaugacaagcaa

SEQ ID NO: 501302 - RNA, 64 nt, Human
ucacuggcagccuccacuagaauuuggugaagaggaggaggaggagauugaugacaagcaaguu

SEQ ID NO: 501303 - RNA, 64 nt, Human
cuggcagccuccacuagaauuuggugaagaggaggaggaggagauugaugacaagcaaguuacu

SEQ ID NO: 501304 - RNA, 64 nt, Human
uugaugagacagucugugacuucaugauaggaaagaggaggaugaggucugggguucuuuaaag

SEQ ID NO: 501305 - RNA, 64 nt, Human
ggagaaacccuugaaaagacaucaagcacagaaggaggaggaggagguuuaggucaagaagaag

SEQ ID NO: 501306 - RNA, 64 nt, Human
gaaacccuugaaaagacaucaagcacagaaggaggaggaggagguuuaggucaagaagaagaug

SEQ ID NO: 501307 - RNA, 64 nt, Human
ggauaggaccuaauguagcacagcgggacucaaagaggaggacauuuucucuugccagugcacu

SEQ ID NO: 501308 - RNA, 64 nt, Human
agcauaugucaaggagcacuugcaggcagaaugggaggaggacauggagcugauggaguccagg

SEQ ID NO: 501309 - RNA, 64 nt, Human
gccagcacgccuguccucccccggggccaaggcagaggaggaggacgacauccugaccugcugc

SEQ ID NO: 501310 - RNA, 64 nt, Human
agcacgccuguccucccccggggccaaggcagaggaggaggacgacauccugaccugcugcuga

SEQ ID NO: 501311 - RNA, 64 nt, Human
uccagaggaucaugaagacugggcuuccaauggggaggaggaaagaugcaauaugucucuuaca

SEQ ID NO: 501312 - RNA, 64 nt, Human
uaccacaacaauucugacuacaauaagacauuuugaggaggauauuuggcuacuguaaacaugg

SEQ ID NO: 501313 - RNA, 52 nt, Human
gauucagcagaagauccugauggaggaggaggauaccaagagagaggugccc

SEQ ID NO: 501314 - RNA, 64 nt, Human; identical to SEQ ID NO: 257914

SEQ ID NO: 501315 - RNA, 64 nt, Human; identical to SEQ ID NO: 257915

SEQ ID NO: 501316 - RNA, 64 nt, Human; identical to SEQ ID NO: 257916

SEQ ID NO: 501317 - RNA, 55 nt, Human
gauucagcagaagauccugauggaggaggaggauaccaagagagaggugcccaag

SEQ ID NO: 501318 - RNA, 64 nt, Human
cucagaagaauguuggccaugagacuaucauucagaggaggaggggauuucucucuucaaggcc

SEQ ID NO: 501319 - RNA, 64 nt, Human
gauggugugaugagagagaugggaggggcacaaagaggaggaccccugaaggagcagaguccau

SEQ ID NO: 501320 - RNA, 64 nt, Human
gcucacgccuguaauccuagcacuuugggaggcugaggaggaaggaucacuugagcccagaagu

SEQ ID NO: 501321 - RNA, 64 nt, Human
uuaccaaagagauauugauauugaaggaauuugggaggaggaaaagaaaccuggggugaauacu

SEQ ID NO: 501322 - RNA, 64 nt, Human
ggccaguuuccuguuuguggggcagcuggggccugaggaggagggguucacuuccuccucccac

SEQ ID NO: 501323 - RNA, 64 nt, Human
cacaccucccucaccgcgcaggacccugagugaggaggaggagcuggaaaccugggguggguug

SEQ ID NO: 501324 - RNA, 64 nt, Human
ccccacaccucccucaccgcgcaggacccugagugaggaggaggagcuggaaaccugggguggg

SEQ ID NO: 501325 - RNA, 64 nt, Human
agggguuuaacaacaugcuccguagacgaagggagaggaggagagaaggcuuccuggguuugca

SEQ ID NO: 501326 - RNA, 64 nt, Human
ugaagagaacugucgugucugauuugcacuauuggaggaggacuaaaguugccugacaacuuua

SEQ ID NO: 501327 - RNA, 64 nt, Human
aguugacuuugcaccugucuucaggcugccaggggaggaggagaagccagcaggcaccacuuuu

SEQ ID NO: 501328 - RNA, 64 nt, Human
aauugaaacuuaucucaaauggagauuuuggugggaggaggagaaaacaauuguuuuuaaauca

SEQ ID NO: 501329 - RNA, 64 nt, Human
uggagaaguuccuuagcagggaggaggaagaggagaggaggaagcaaagaaucacaaggaaccu

SEQ ID NO: 501330 - RNA, 64 nt, Human
aacauuuguaccccuggagaaguuccuuagcagggaggaggaagaggagaggaggaagcaaaga

SEQ ID NO: 501331 - RNA, 64 nt, Human
ucccccagcccgacaccuguaaagggucggugcugaggaggaauagugaaggagggaggccucu

SEQ ID NO: 501332 - RNA, 64 nt, Human; identical to SEQ ID NO: 257918

SEQ ID NO: 501333 - RNA, 64 nt, Human; identical to SEQ ID NO: 257919

SEQ ID NO: 501334 - RNA, 64 nt, Human; identical to SEQ ID NO: 257920

SEQ ID NO: 501335 - RNA, 64 nt, Human
ugacugagaacaggcuuggaaaagguuuucuggggaggaggaggcuggaggccaggacacuguu

SEQ ID NO: 501336 - RNA, 64 nt, Human
gcgaguugccuuagagcgcaagggccaggcccuggaggaggaugaagacacagagacaagguga

SEQ ID NO: 501337 - RNA, 64 nt, Human
cucacaguacagcaugugccuuaaugcuucauaugaggaggaugucccugggccagggucugug

SEQ ID NO: 501338 - RNA, 64 nt, Human
acuacauaacuuccuacguauccugcagcgggaggaggaggagcaccuccgccagauccugcag

SEQ ID NO: 501339 - RNA, 64 nt, Human
ugaacuacauaacuuccuacguauccugcagcgggaggaggaggagcaccuccgccagauccug

SEQ ID NO: 501340 - RNA, 64 nt, Human
ggguccucugggaaguuacucuagaaaacgaagggaggaggagcacaagauccucagcaacgaa

SEQ ID NO: 501341 - RNA, 64 nt, Human
ugcugggaggucagcuggucaaggcagaggaggagaggaggaaaggaugggggcugaagagcag

SEQ ID NO: 501342 - RNA, 64 nt, Human
gugcugucugcugggaggucagcuggucaaggcagaggaggagaggaggaaaggaugggggcug

SEQ ID NO: 501343 - RNA, 64 nt, Human
accaguuucucaggcuggggagcacagaggggaggaggaggacuaaaugaaaaguuguucccag

SEQ ID NO: 501344 - RNA, 64 nt, Human
aucaccaguuucucaggcuggggagcacagaggggaggaggaggacuaaaugaaaaguuguucc

SEQ ID NO: 501345 - RNA, 64 nt, Human
cauggauuugguuaugauggaaaggaagaaugcagaggaggagaaaagugacagauccuccauu

SEQ ID NO: 501346 - RNA, 64 nt, Human
agagcccagcacaggagcuuucucuggcagaauugaggaggaagagguggcccucugacuugac

SEQ ID NO: 501347 - RNA, 64 nt, Human
cugacuuaggagucagagcccggcaggggcugaggaggaggagcagggggugcugcguggaagg

SEQ ID NO: 501348 - RNA, 64 nt, Human
ugccugacuuaggagucagagcccggcaggggcugaggaggaggagcagggggugcugcgugga

SEQ ID NO: 501349 - RNA, 64 nt, Human
agagagauuaugagcaaauguauugcuucuuuuagaggaggaagcauacaaccucuuuugugug

SEQ ID NO: 501350 - RNA, 64 nt, Human; identical to SEQ ID NO: 257921

SEQ ID NO: 501351 - RNA, 64 nt, Human; identical to SEQ ID NO: 257922

SEQ ID NO: 501352 - RNA, 64 nt, Human; identical to SEQ ID NO: 257926

SEQ ID NO: 501353 - RNA, 64 nt, Human
aaacuuaguuaaauaauuccauccacuuauggaggaggaggagaauguggaagagguaaaaagc

SEQ ID NO: 501354 - RNA, 64 nt, Human
aucaaacuuaguuaaauaauuccauccacuuauggaggaggaggagaauguggaagagguaaaa

SEQ ID NO: 501355 - RNA, 64 nt, Human
gacacugccuuggguggaccaggcuuccaagaaagaggaggagaguugaaaagagaggagaaga

SEQ ID NO: 501356 - RNA, 64 nt, Human
acugaaguauucacuacucuuguaaaccaaccaagaggaggagaaagaugacccagaaguggau

SEQ ID NO: 501357 - RNA, 64 nt, Human
agagaggaggccagcaggcccagaguccccaggggaggaggaccaggucaagggacguucugug

SEQ ID NO: 501358 - RNA, 64 nt, Human
gggugugguggccugugaggggccccuggcccaggaggaggauugugcugauguagugaccaag

SEQ ID NO: 501359 - RNA, 64 nt, Human
cauucccauugaccaucuggucccaggagcucaggaggaggaccccaggggagaggagagcugu

SEQ ID NO: 501360 - RNA, 64 nt, Human
agaaaggagaauagugguugccagggacugcagggaggaggaaauggggggugggguuauuguu

SEQ ID NO: 501361 - RNA, 64 nt, Human
agagcacacagccuucggaaacccccaaggugucgaggaggaucagauccagauaagagaagau

SEQ ID NO: 501362 - RNA, 64 nt, Human
gcucacacguguaaucccaacacuuugggaggcugaggaggaaggauagcuugaggccaggagu

SEQ ID NO: 501363 - RNA, 64 nt, Human
acggagcugcagacgaaggcaggggacccauggcgaggaggaauggccagcaccccaggcaguc

SEQ ID NO: 501364 - RNA, 64 nt, Human
uucagaagcacucggcuucccaauguuagagaaggaggaggaagcccauagacccccaagcccc

SEQ ID NO: 501365 - RNA, 64 nt, Human
ccuggcaucgguccugcggagguggaaaguucgagaggaggagcuauuugcgaggaagcccugu

SEQ ID NO: 501366 - RNA, 64 nt, Human
aguggcuugacuuugagcuaaggcugaaguacaggaggaggaggaggagagggccggauguggg

SEQ ID NO: 501367 - RNA, 64 nt, Human
ggcuugacuuugagcuaaggcugaaguacaggaggaggaggaggagagggccggaugugggugu

SEQ ID NO: 501368 - RNA, 64 nt, Human
cugaaaaaaaugaguuccuauuuuuucugggagagggggggauugauuagaaaaaaauguagug

SEQ ID NO: 501369 - RNA, 64 nt, Human
uguaagagugauuuuuucaauauauuuuauuccugggggggaucaugcuacacucucaaaagaa

SEQ ID NO: 501370 - RNA, 64 nt, Human
ucugauugauaggauuagagugcuuaaauuuuuggggggggaagggugggguaaaguguaagug

SEQ ID NO: 501371 - RNA, 64 nt, Human
uugacuuugagcuaaggcugaaguacaggaggaggaggaggagagggccggaugugggugugga

SEQ ID NO: 501372 - RNA, 64 nt, Human
ucagaaaaccacuuuauugcaaugcagagguugagaggaggacuugguugauguuuaaagagaa

SEQ ID NO: 501373 - RNA, 64 nt, Human
aaaaaccucucuccucagccuuccaccuccaagagaggaggaaaaacaguugucugcugucugu

SEQ ID NO: 501374 - RNA, 58 nt, Human
gcagugacaaauccaacugaccagaagggaggaggaagcucacugguggcuguuccug

SEQ ID NO: 501375 - RNA, 64 nt, Human
ccuaucucugucugcccauaucaaaauuauaaaugaggaggacagcaggccccaagaaaguagg

SEQ ID NO: 501376 - RNA, 64 nt, Human
uuuccccacugcaggacccacuuugagaaggaccgaggaggaggauuuggguuguuuuguuagg

SEQ ID NO: 501377 - RNA, 64 nt, Human
ccccacugcaggacccacuuugagaaggaccgaggaggaggauuuggguuguuuuguuaggggu

SEQ ID NO: 501378 - RNA, 64 nt, Human
uacugugcugaaagucagcccacgucggagcggugaggaggagccacagcacauggggugccac

SEQ ID NO: 501379 - RNA, 64 nt, Human
cuccagaguguucucagcuagauuugauuugguugaggaggaacuguggcccuccguaaguuau

SEQ ID NO: 501380 - RNA, 64 nt, Human
guuuacuaaauaaaugacuggggcaagcaaaauugaggaggaaauuagaaacuguuugacaaac

SEQ ID NO: 501381 - RNA, 64 nt, Human
uuagagauaucuguaacucaaauuuuucuuaggugaggaggauuauuaacuggcacauauguac

SEQ ID NO: 501382 - RNA, 64 nt, Human
ggaguuugggagguguaaacagcccaugcacguggaggaggagcuggcuuucagccccagaccc

SEQ ID NO: 501383 - RNA, 64 nt, Human
aggggcuaagaaggcucagggcagacaaagucaagaggaggaaguuuuuguggacaaugaaaag

SEQ ID NO: 501384 - RNA, 64 nt, Human
auggcucaagagggcugcaaggccaacacuauucgaggaggaggcuguuauuuugggccugaug

SEQ ID NO: 501385 - RNA, 64 nt, Human
gguuuaguccuauuaucaggauauaaucaucugugaggaggauauuuuaaauacuguaaaugau

SEQ ID NO: 501386 - RNA, 64 nt, Human; identical to SEQ ID NO: 257928

SEQ ID NO: 501387 - RNA, 64 nt, Human; identical to SEQ ID NO: 257929

SEQ ID NO: 501388 - RNA, 64 nt, Human; identical to SEQ ID NO: 257930

SEQ ID NO: 501389 - RNA, 64 nt, Human
agggagucuguggccguccaggugaaucacagcugaggaggaaauccagaugagaccaaugcac

SEQ ID NO: 501390 - RNA, 60 nt, Human
aaacaacgaaagcugaauaguguuggaacugaggaggaagccauagcucagggucaucaa

SEQ ID NO: 501391 - RNA, 64 nt, Human
acuguuucauguauuuuuuaaagacauuugaggggaggaggauuauuaugaaugggaaaaaaag

SEQ ID NO: 501392 - RNA, 64 nt, Human
cuggagcucaagcagugaggaggaggagaaggaggaggaggagagcgcgagugagcaggggcca

SEQ ID NO: 501393 - RNA, 63 nt, Human
cccuggagcucaagcagugaggaggaggagaaggaggaggaggagagcgcgagugagcagggg

SEQ ID NO: 501394 - RNA, 51 nt, Human
cccuggagcucaagcagugaggaggaggagaaggaggaggaggagagcgcg

SEQ ID NO: 501395 - RNA, 64 nt, Human
caggugcuguguguaaguggagaacuuggggauagaggaggaagcuccucguggcccuuccaag

SEQ ID NO: 501396 - RNA, 64 nt, Human
gguaaauaauuccaaacucucaucgggucauaaagaggaggagaaacagggugagucaagguaa

SEQ ID NO: 501397 - RNA, 64 nt, Human
uaaauaauagacuuuuuuuacaggcaaaaugaaagaggaggaagucuggguuuuaugaauagca

SEQ ID NO: 501398 - RNA, 64 nt, Human
cccccaucuagccauuucggaagacaccgaggaagaggaggaagaugaagaccaggacuacagc

SEQ ID NO: 501399 - RNA, 64 nt, Human
ucuaaguuuaccaugcaguuguuuaccaaaaauagaggaggagagucuuaacuuuugcucuugg

SEQ ID NO: 501400 - RNA, 64 nt, Human
ggagaaaaagaaacacaagagacuuaaaggacaggaggaggagauggccauaggagaggagggu

SEQ ID NO: 501401 - RNA, 64 nt, Human
uuauucaugauagcuggcccacaggucaugaauugaggaggaauuugcuuucaaaaagcaagaa

SEQ ID NO: 501402 - RNA, 64 nt, Human
gacugugcgcuagacacugccaggcccgggccucgaggaggaaaagacaguagggaagacauua

SEQ ID NO: 501403 - RNA, 64 nt, Human
cacucuccaauugacccgccugggaacaagggaugaggaggaguugggggcuggggggaauccu

SEQ ID NO: 501404 - RNA, 64 nt, Human; identical to SEQ ID NO: 257931

SEQ ID NO: 501405 - RNA, 64 nt, Human; identical to SEQ ID NO: 257932

SEQ ID NO: 501406 - RNA, 64 nt, Human; identical to SEQ ID NO: 257933

SEQ ID NO: 501407 - RNA, 64 nt, Human
aaguaagcugcuuagaaggcccuggaagggaagugaggaggagggacaaggaagaugacuaguu

SEQ ID NO: 501408 - RNA, 64 nt, Human
ccagacauauugggguuuuuguaguugaaugaaugaggaggaugaauuucagcaaauuuugaac

SEQ ID NO: 501409 - RNA, 64 nt, Human
uugcuaagcagaagauccugcagacccuuaucuggaggaggaagagaagcaggagagagaaagc

SEQ ID NO: 501410 - RNA, 64 nt, Human
ucucuaggaacagacaacucuaaacucguccccagaggaggacuugaaugaggaaaccaacacu

SEQ ID NO: 501411 - RNA, 64 nt, Human
uuaaagggagucucucaccagcccaggcccucaggaggaggagauaccaggaggcagggaugcu

SEQ ID NO: 501412 - RNA, 64 nt, Human
ggccugccccagccagaauggggggcgggguggagaggaggacccccauuggcuaagccaagcu

SEQ ID NO: 501413 - RNA, 64 nt, Human
aaucacagguccagagagcuuuauggaagcgggagaggaggagcacuuacucauguuguauuug

SEQ ID NO: 501414 - RNA, 64 nt, Human
agaacaggacauagcacgaaucuguuaccaguaggaggaggaugagccacagaaauugcauaau

SEQ ID NO: 501415 - RNA, 64 nt, Human
ucagcuuucaagacauuucuuaaccaucagagcagaggaggaaagacucacuaccucagaaaaa

SEQ ID NO: 501416 - RNA, 64 nt, Human
aaaaaaaaaaaaaaauugaauaucacuccuccaggaggaggaucuuuugaaauuggaauuguau

SEQ ID NO: 501417 - RNA, 64 nt, Human
uacgcaacagauaaugugggaaaaaaagagauaagaggaggaagcuaauaagagacugucaaga

SEQ ID NO: 501418 - RNA, 64 nt, Human
cuggggacagaagggcccauguacuuguugggaggaggaggaaagggaaggcuggcagguaggu

SEQ ID NO: 501419 - RNA, 64 nt, Human
ccacuggggacagaagggcccauguacuuguugggaggaggaggaaagggaaggcuggcaggua

SEQ ID NO: 501420 - RNA, 64 nt, Human
uaagucaagccuccuauucuguuaguacuuauuagaggaggagaugguuuucauugcauaguga

SEQ ID NO: 501421 - RNA, 64 nt, Human
gguggggagucaggggugggaggagaaggaggaagaggaggaaggccagacuggccugcccuuu

SEQ ID NO: 501422 - RNA, 64 nt, Human; identical to SEQ ID NO: 257935

SEQ ID NO: 501423 - RNA, 64 nt, Human; identical to SEQ ID NO: 257936

SEQ ID NO: 501424 - RNA, 64 nt, Human; identical to SEQ ID NO: 257937

SEQ ID NO: 501425 - RNA, 64 nt, Human
cuaggccuggugugggcaggcagaggccaguacagaggaggagccauuguggcagugcccugug

SEQ ID NO: 501426 - RNA, 64 nt, Human
cagcacugacucaggaacagcaagucagggcagagaggaggagggaggcugucaggauggaaau

SEQ ID NO: 501427 - RNA, 64 nt, Human
uagcauccagcaagucaaugucaccgacagugaugaggaggaagaagaaaaagugcucagggau

SEQ ID NO: 501428 - RNA, 64 nt, Human
gcuggugcacuuaauccagcucugcccuuggggggaggaggaccugugugucaggcucugccau

SEQ ID NO: 501429 - RNA, 64 nt, Human
uguagaccccagaaugaaacaugggguuggaguggaggaggagcugucucagcaagaggagacc

SEQ ID NO: 501430 - RNA, 64 nt, Human
ggcuguccagcgaucagccauggcgacacuaaaggaggaggagccggggacucccaggcuggag

SEQ ID NO: 501431 - RNA, 64 nt, Human
uaggaaauuuuuucuuguugugagguagggaagugaggaggaaagccaugccgaagcaaauguu

SEQ ID NO: 501432 - RNA, 64 nt, Human
ccggggacccacucugcccagccggagggacgcggaggaggaagaggguagacaggggcgaccu

SEQ ID NO: 501433 - RNA, 64 nt, Human
ccucccucuuuuccccuugcccccucugcagccggaggaggagauguugaggggaggaggccag

SEQ ID NO: 501434 - RNA, 64 nt, Human
ggaagcgcagcagcgggagcuaggggcgggggcggaggaggacacgaacuggaaggggguucac

SEQ ID NO: 501435 - RNA, 64 nt, Human
ucgggccuuuggcgagagcuccacggaaagugaugaggaggaagaagagggcuguggucauaca

SEQ ID NO: 501436 - RNA, 64 nt, Human
uucccucucuucugccugauagagggaagaggaagaggaggacgaacagagauccugaaauucu

SEQ ID NO: 501437 - RNA, 64 nt, Human
aaaaaaucugugagggucugacuugcucaaaccagaggaggaaacagaaaccccugcacaucuu

SEQ ID NO: 501438 - RNA, 64 nt, Human
cacacuggaccccacuggcugagaaucugggggugaggaggacaagaaggagaggaaaauguuu

SEQ ID NO: 501439 - RNA, 64 nt, Human
ggccagcccuggacauuguccaggaaggccuggggaggaggagugaagucugugcauagauggg

SEQ ID NO: 501440 - RNA, 64 nt, Human; identical to SEQ ID NO: 257938

SEQ ID NO: 501441 - RNA, 64 nt, Human; identical to SEQ ID NO: 257939

SEQ ID NO: 501442 - RNA, 64 nt, Human; identical to SEQ ID NO: 257940

SEQ ID NO: 501443 - RNA, 64 nt, Human
cuccuagccacgucccuugggaccggugggacuggaggaggaacggucacccuccucccccaug

SEQ ID NO: 501444 - RNA, 64 nt, Human
gcgagaggagaggaaaaacgaucgcugugaaaaugaggaggauugcuucuugugaaaccacagg

SEQ ID NO: 501445 - RNA, 64 nt, Human
agagcaggcaagggaaacuggggagauggggauggaggaggaaggcugauauccucuggggagc

SEQ ID NO: 501446 - RNA, 64 nt, Human
ggagcuggguggccuugagggagaccccagccccgaggaggaugagggcauccagaaggcaucc

SEQ ID NO: 501447 - RNA, 64 nt, Human
cacacacguugacgggccgcaggagggaggcggggaggaggaacgggcagccacaggacugagc

SEQ ID NO: 501448 - RNA, 64 nt, Human
uugaguugcuauucuaugcugaagagccugcuuagaggaggaguaccaggagggagccagcauu

SEQ ID NO: 501449 - RNA, 64 nt, Human
ccagagcuuggcaggaggcucccggcggaccaaggaggaggagcugcagugcuaaguccagcca

SEQ ID NO: 501450 - RNA, 64 nt, Human
agacucugucucaauuaauuuuuuuuuuuuaaaggaggaggaucuccauggguaagugguuucu

SEQ ID NO: 501451 - RNA, 64 nt, Human
gggggcagagaagugaugaagggaaauguucuuagaggaggaaauauccuuuguccuguucaga

SEQ ID NO: 501452 - RNA, 64 nt, Human
ucaugcuggagggaggcugggcggguacagcgcggaggaggagggaggccaggcgggcauggcg

SEQ ID NO: 501453 - RNA, 64 nt, Human
cggaggaggagggaggccaggcgggcauggcguggaggaggagggaggccgggcggucacagca

SEQ ID NO: 501454 - RNA, 64 nt, Human
uggaggaggagggaggccgggcggucacagcauggaggaggagggaggcgcugcugguguucuu

SEQ ID NO: 501455 - RNA, 64 nt, Human
aaauacaaacaaaaaugugagagcagugagguccgaggaggaugaacucagaaagcaccagcca

SEQ ID NO: 501456 - RNA, 64 nt, Human
uagaacacgagugacaguuuguuaaaaagcuuuagaggaggaaugaaaacaaagugaaguacac

SEQ ID NO: 501457 - RNA, 64 nt, Human
guagaugcccccgcgagacggguuagggaaagcggaggaggaaagcgaggggguggggggcuuc

SEQ ID NO: 501458 - RNA, 64 nt, Human; identical to SEQ ID NO: 257945

SEQ ID NO: 501459 - RNA, 64 nt, Human; identical to SEQ ID NO: 257946

SEQ ID NO: 501460 - RNA, 64 nt, Human; identical to SEQ ID NO: 257947

SEQ ID NO: 501461 - RNA, 64 nt, Human
cggucccacagcucuccucccagggcagccugaggaggaggaggccgggugccuguuugguggc

SEQ ID NO: 501462 - RNA, 64 nt, Human
aggcggucccacagcucuccucccagggcagccugaggaggaggaggccgggugccuguuuggu

SEQ ID NO: 501463 - RNA, 64 nt, Human
gugcaugcagacagcccgccccaaagaaaaaucagaggaggagaaauggaaaccccggaacaau

SEQ ID NO: 501464 - RNA, 64 nt, Human
caccaugaagacagggucaucgaccaacaacaacgaggaggagaagucccggcuguuggagaag

SEQ ID NO: 501465 - RNA, 64 nt, Human
aaaguccauggauucaauggacucauccauuugugaggaggacuucucgcccucuggcuggaag

SEQ ID NO: 501466 - RNA, 64 nt, Human
ugcaaucuagcgaguccauggagcugagcagcaggaggaggagccgugacccuguggaaggugc

SEQ ID NO: 501467 - RNA, 64 nt, Human
guucaaggacuaaccuuauuuauuugggaaaggggaggaggaaggaaaugauaugguacccaga

SEQ ID NO: 501468 - RNA, 64 nt, Human
ugauggcccugcuuccucugagugagaugcccaggaggaggagcccuagggaagaagucaggga

SEQ ID NO: 501469 - RNA, 64 nt, Human
auucuuggccaguccucuuucccgcagcugcagagaggaggaagacuauuaaaggacaguccug

SEQ ID NO: 501470 - RNA, 64 nt, Human
cagagccuggggccagccaguacaguccugagccgaggaggagggacugcaaguggaagagagc

SEQ ID NO: 501471 - RNA, 64 nt, Human
gguuuuugagcuaugagaaaguggaugggagugggaggaggagagaugggugaagacaaaagag

SEQ ID NO: 501472 - RNA, 64 nt, Human
uugggcaguaucuuccugaugucuucuuagcuaagaggaggaaaaaaaggcugaaaaaauaggg

SEQ ID NO: 501473 - RNA, 64 nt, Human
uuuguuauuuucaacuguucuaugcugugacgaugaggaggagaugucuguuggauucaugucu

SEQ ID NO: 501474 - RNA, 64 nt, Human
ucagauauucugggguuaaagucacaucauaugugaggaggaaaaguuuaacaugaacuaacau

SEQ ID NO: 501475 - RNA, 64 nt, Human
ggaagcauccauucauugggaaaucacggggacagaggaggaauucacgggaucagagcacuga

SEQ ID NO: 501476 - RNA, 64 nt, Human; identical to SEQ ID NO: 257843

SEQ ID NO: 501477 - RNA, 64 nt, Human; identical to SEQ ID NO: 257844

SEQ ID NO: 501478 - RNA, 64 nt, Human; identical to SEQ ID NO: 257845

SEQ ID NO: 501479 - RNA, 64 nt, Human
cccagccacguuuacaggaaggugugccccagaggaggaggaaucagcucccucgcuccagugg

SEQ ID NO: 501480 - RNA, 64 nt, Human
ggccccagccacguuuacaggaaggugugccccagaggaggaggaaucagcucccucgcuccag

SEQ ID NO: 501481 - RNA, 64 nt, Human
accuucaccugacuggaucaagcccacuaacaucgaggaggacagucugcauuacucagaguuc

SEQ ID NO: 501482 - RNA, 64 nt, Human
gcagagagcacagugaucaccagcgugagugguggaggaggacacuuggauuuuuuuuuuuguu

SEQ ID NO: 501483 - RNA, 64 nt, Human
ugaggaagagcacaggcuucaugcacauugcacagaggaggagauucauggggacagcaggcac

SEQ ID NO: 501484 - RNA, 50 nt, Human
auugcuguucaaggaaguaagaggaggaggugauguagcacuuccaagau

SEQ ID NO: 501485 - RNA, 64 nt, Human
ucugagcaguuuuccaggaggccggggggagcaggaggaggaaagguagcccccgagggauguc

SEQ ID NO: 501486 - RNA, 64 nt, Human
ugucuccaccccaugggcccacacccaggugggggaggaggaagccacugcaucuguuggcuca

SEQ ID NO: 501487 - RNA, 64 nt, Human
gggcaucugucugugggagcccagaggcugcagggaggaggaggagggagguaucuggugugag

SEQ ID NO: 501488 - RNA, 64 nt, Human
caucugucugugggagcccagaggcugcagggaggaggaggagggagguaucuggugugagcgu

SEQ ID NO: 501489 - RNA, 64 nt, Human
agaccagcagagcagggagccacuugccaggguggaggaggagcauuguccaggcauggccugu

SEQ ID NO: 501490 - RNA, 64 nt, Human
cauguuucucaagcaguuuuucugaguaguuucugaggaggaacaaauuacaaguguacccaau

SEQ ID NO: 501491 - RNA, 64 nt, Human
agaagcauccccuggcccggugggaagcccagacgaggaggacggggaaccggauuacgugaau

SEQ ID NO: 501492 - RNA, 64 nt, Human
acuguggagauaagaaggggauggaaugggggaagaggaggagcaggaggcccucauccuucug

SEQ ID NO: 501493 - RNA, 64 nt, Human
uacuggccgugaccagagagugcauuuacagaacgaggaggaagaggugaguccugggaaggag

SEQ ID NO: 501494 - RNA, 64 nt, Human; identical to SEQ ID NO: 257846

SEQ ID NO: 501495 - RNA, 64 nt, Human; identical to SEQ ID NO: 257847

SEQ ID NO: 501496 - RNA, 64 nt, Human; identical to SEQ ID NO: 257848

SEQ ID NO: 501497 - RNA, 64 nt, Human
gagggcccaggcaggcggccuauccugauccuuggaggaggaggaagaggaggccacuguggcc

SEQ ID NO: 501498 - RNA, 64 nt, Human
ggcccaggcaggcggccuauccugauccuuggaggaggaggaagaggaggccacuguggcccgu

SEQ ID NO: 501499 - RNA, 64 nt, Human
guugaagaggacgagaggacgaccuucucugauagaggaggaccacgcuucagucaaaggcaua

SEQ ID NO: 501500 - RNA, 64 nt, Human
guugaaagguaauuugagagaaauaugaagaacugaggaggaaaaaaaaaaaaaagaaaagaac

SEQ ID NO: 501501 - RNA, 64 nt, Human
ggaaggggcuuccuggccaaggcccccucuuccagaggaggagcagggaucuggguuuccuuuu

SEQ ID NO: 501502 - RNA, 64 nt, Human
ucuggcccacccccaacaggaauucuauaguaaggaggaggagaaggggggcuccuucccucuc

SEQ ID NO: 501503 - RNA, 64 nt, Human
aggaggcugaggcagaagaauggcaugaacccgggaggaggagcuugcagugagccgagauagc

SEQ ID NO: 501504 - RNA, 64 nt, Human
cagggacacucuccuucagggaaaauguuauguggaggaggacgaauaaauuuauuuuguuuuc

SEQ ID NO: 501505 - RNA, 64 nt, Human
cagacggggcagaugccaggacucagcccauccugaggaggacacguguccucauggagagggu

SEQ ID NO: 501506 - RNA, 64 nt, Human
ccacuuugugccuggagagcuuucaggggagguggaggaggagggucugccaagcuacugcaac

SEQ ID NO: 501507 - RNA, 64 nt, Human
ccugagaagcuuugaccuugaagggcuucugggagaggaggaauuucugcauggggcgugaagg

SEQ ID NO: 501508 - RNA, 64 nt, Human
gaagugacucugggagggcccggcgcagaggauugaggaggagggaucuggccuccucauggca

SEQ ID NO: 501509 - RNA, 64 nt, Human
uaggcuggcaacuccgggggcucaacgguggaaagaggaggaugcuguuucucugucaccucca

SEQ ID NO: 501510 - RNA, 64 nt, Human
aaugcuggugacuaaaauaagguuuacucugaaagaggaggaauuuuauucaaagcauucaaac

SEQ ID NO: 501511 - RNA, 64 nt, Human
cagugugugcacucgaugaugcggcccugcaacggaggaggacagugagacgaugccacugcgc

SEQ ID NO: 501512 - RNA, 64 nt, Human; identical to SEQ ID NO: 257948

SEQ ID NO: 501513 - RNA, 64 nt, Human; identical to SEQ ID NO: 257949

SEQ ID NO: 501514 - RNA, 64 nt, Human; identical to SEQ ID NO: 257950

SEQ ID NO: 501515 - RNA, 64 nt, Human
ggggacuuaucuccugcagagauuggagaagguagaggaggagaaagaauccaaagauucucac

SEQ ID NO: 501516 - RNA, 64 nt, Human
ucugcaaggcaugugucuauucaggguuucccaggaggaggaggccccugaaggggugcggcag

SEQ ID NO: 501517 - RNA, 64 nt, Human
uugcgcccucucccugccccucaccccagagggugaggaggaaugaggggcauuggugguuagg

SEQ ID NO: 501518 - RNA, 62 nt, Human
uggaucacaaacaccgguaaaaugagcagguggaggaggacggcgccugugcccacggcugc

SEQ ID NO: 501519 - RNA, 64 nt, Human
aauggagcaggaggaaaagcagaguuggucuagagaggaggagggcggggcuggaggaaugugg

SEQ ID NO: 501520 - RNA, 64 nt, Human
gauucuguagugaagaggucugacaccauguguggaggaggaggaacgaucagucaagagaugu

SEQ ID NO: 501521 - RNA, 64 nt, Human
ucuguagugaagaggucugacaccauguguggaggaggaggaacgaucagucaagagauguccu

SEQ ID NO: 501522 - RNA, 64 nt, Human
aaugugauucuucuaaagcaaagucauuggaugggaggaggaagaaaaagucccauaaaggaac

SEQ ID NO: 501523 - RNA, 64 nt, Human
guguaugaaccccgagccauuucccuguuguccugaggaggaacuccaggccucccaucgugug

SEQ ID NO: 501524 - RNA, 51 nt, Human
ucccagugaucuguauuugaugaggaggagccgaggccccagcuucaucca

SEQ ID NO: 501525 - RNA, 64 nt, Human
gccuggggaggagggggaggaagacaagaaggaagaggaggaggagaaggaagacgaggagcug

SEQ ID NO: 501526 - RNA, 64 nt, Human
uggggaggagggggaggaagacaagaaggaagaggaggaggagaaggaagacgaggagcuggac

SEQ ID NO: 501527 - RNA, 64 nt, Human
cacccaugcauaggagagacucuaacauacuuuagaggaggagaaagagauuccagucaaaauu

SEQ ID NO: 501528 - RNA, 64 nt, Human
uuuugcaacuugauagcuaaugcaccuuuucugugaggaggaggggaucgugauuucagaauga

SEQ ID NO: 501529 - RNA, 64 nt, Human
cuuuuuccacuuccuccucuuucuuuccccagcugaggaggaaccuggggcauuuagggcagag

SEQ ID NO: 501530 - RNA, 64 nt, Human; identical to SEQ ID NO: 257850

SEQ ID NO: 501531 - RNA, 64 nt, Human; identical to SEQ ID NO: 257854

SEQ ID NO: 501532 - RNA, 64 nt, Human; identical to SEQ ID NO: 257855

SEQ ID NO: 501533 - RNA, 64 nt, Human
aaggcucaucuugagaagcaggcggguugggugggaggaggaagaaagggaagaauuagguuug

SEQ ID NO: 501534 - RNA, 64 nt, Human
uuuguugccacugagaagcaggcggguugggugggaggaggaagaaagggaagaauuagguuug

SEQ ID NO: 501535 - RNA, 64 nt, Human
aacucaagucucaccauucuguccugggagagaagaggaggaucucaucucucaucuguccaaa

SEQ ID NO: 501536 - RNA, 64 nt, Human
gaugacuucagcaguggcagguguuuucagcuuggaggaggaaguacugcuaucucgcauucuu

SEQ ID NO: 501537 - RNA, 64 nt, Human
cgccuugcaggggaggccuggcugcagagaggcggaggaggaagcuggcgcugggggaggcuga

SEQ ID NO: 501538 - RNA, 64 nt, Human
ucaacuaaauuuuaaugaacgaaugaaugacagagaggaggaaaaaagaugaggauugcauaca

SEQ ID NO: 501539 - RNA, 64 nt, Human
guauuuaaguggauugaauaacugagucuacauggaggaggaaaugcuagagaacagcaggucu

SEQ ID NO: 501540 - RNA, 64 nt, Human
gccuaaauuuauaaugaucaugaaacccuaggcagaggaggagaaauugaagguccagggcaau

SEQ ID NO: 501541 - RNA, 64 nt, Human
cagggcacauuucugaccgaacccucucaaggcagaggaggaguuugguggguuucauacaccc

SEQ ID NO: 501542 - RNA, 64 nt, Human
ggcaguuaacuggcuuuacaguaaacauugaagagaggaggauuuguuuauugucacugggaau

SEQ ID NO: 501543 - RNA, 64 nt, Human
aguuggugaaaugcgcagccggcuguggacgggggaggaggaaggggacagagggagcagguag

SEQ ID NO: 501544 - RNA, 64 nt, Human
ugggacccgaggauuucugggaccccgcaguugggaggaggaaguaguccagccuuccaggugg

SEQ ID NO: 501545 - RNA, 64 nt, Human
gcccaagcacugaaaauggaaccuggcgaaagcagaggaggagaaugaagaaagauggagucaa

SEQ ID NO: 501546 - RNA, 64 nt, Human
uaggcuguggccagugccuggucaucagaagagggaggaggagcccaggcgucuguuuauguau

SEQ ID NO: 501547 - RNA, 64 nt, Human
aacuguguucucccuggcauucagagaggagggagaggaggaagaggaaggggagggaagcuuc

SEQ ID NO: 501548 - RNA, 64 nt, Human; identical to SEQ ID NO: 257856

SEQ ID NO: 501549 - RNA, 64 nt, Human; identical to SEQ ID NO: 257857

SEQ ID NO: 501550 - RNA, 64 nt, Human; identical to SEQ ID NO: 257858

SEQ ID NO: 501551 - RNA, 64 nt, Human
gggugguaaguuuccuccuuucucaaccuuccacgaggaggaaagaagugugcagucauuccac

SEQ ID NO: 501552 - RNA, 64 nt, Human
uuuucugacgccugccaaggacgcgacgaccagggaggaggaaucggcggacgcgggacaccug

SEQ ID NO: 501553 - RNA, 64 nt, Human
aggggcuuaaaaaaaaaggcaaagaacacagaaagaggaggagcaagugggauguuuauguccc

SEQ ID NO: 501554 - RNA, 64 nt, Human
uaaaaggcugcggcagcgccuuucuucuuaaagugaggaggacaaauuugcaaaagaaauaggc

SEQ ID NO: 501555 - RNA, 64 nt, Human
ccugcccccgguggagggguuguugcuuucuggggaggaggacgguugacggcccugcuuggau

SEQ ID NO: 501556 - RNA, 64 nt, Human
gauuguaccuucccaagcccgcccagugggaugggaggaggaggagaaggggggccuugggccg

SEQ ID NO: 501557 - RNA, 64 nt, Human
uguaccuucccaagcccgcccagugggaugggaggaggaggagaaggggggccuugggccgcug

SEQ ID NO: 501558 - RNA, 64 nt, Human
caccuccaucucagucuuggccuggcuaugaggggaggaggaaugggagagggggcucaggggc

SEQ ID NO: 501559 - RNA, 64 nt, Human
uguccaggagcaggccacuacugcccagagagcagaggaggagguuguuggcagggacugcaga

SEQ ID NO: 501560 - RNA, 64 nt, Human
agugcccucggcaugggcaccugggugugggguggaggaggagggcucgcgccucuggucucgg

SEQ ID NO: 501561 - RNA, 64 nt, Human
cucuuucaggcgggaaugggagggcgggcacagggaggaggagaggaagagaaaaggaagaauu

SEQ ID NO: 501562 - RNA, 64 nt, Human
gaggcccggugaccacggaacucaccgucugggggaggaggagagaaggaagggguggggggcc

SEQ ID NO: 501563 - RNA, 64 nt, Human
gagccagggaccgccgcgucgccgauuagaggacgaggaggagagauuccgcacgcaaccgaaa

SEQ ID NO: 501564 - RNA, 64 nt, Human
gguaucucucucuagagcgagcaagagagggagagaggaggaaaaaauacacauaauacaaaca

SEQ ID NO: 501565 - RNA, 64 nt, Human
cagugaaauggaccugacagcccaaacugucagagaggaggaaagcaggcauuugauuuuggua

SEQ ID NO: 501566 - RNA, 64 nt, Human; identical to SEQ ID NO: 257860

SEQ ID NO: 501567 - RNA, 64 nt, Human; identical to SEQ ID NO: 257861

SEQ ID NO: 501568 - RNA, 61 nt, Human; identical to SEQ ID NO: 257862

SEQ ID NO: 501569 - RNA, 64 nt, Human
gagacuuucuuugacacccagaagacccggcaacgaggaggaaggccucgcggugaggcagaaa

SEQ ID NO: 501570 - RNA, 63 nt, Human
ccagcuaccccaaugugugagcugauggauggugaggaggaaggacuuaaggacagcaugucu

SEQ ID NO: 501571 - RNA, 64 nt, Human
ucauuccucuuucccaagggcauccuccuugaaagaggaggacagaccucucuggaagcagcaa

SEQ ID NO: 501572 - RNA, 64 nt, Human
cugccaggucaagaaguuuucccucuuuuguggugaggaggacacaggccugggaaaaauagga

SEQ ID NO: 501573 - RNA, 64 nt, Human
cuugcuggagugucucccagccaaucagggccuugaggaggauguauccuccagccaaucaggg

SEQ ID NO: 501574 - RNA, 64 nt, Human
gccugaaagcuuccccgagguuugcagggucagggaggaggaacggugggggugggcagucacu

SEQ ID NO: 501575 - RNA, 64 nt, Human
cuguuaaaaugggaucaucaucuuugaaaggggggaggaggaguaaaagcccgauuauaauggu

SEQ ID NO: 501576 - RNA, 64 nt, Human
acuuccuucguggaggaaguggacucgaauccuggaggaggaaauaaagggaaagggaagucgu

SEQ ID NO: 501577 - RNA, 64 nt, Human
ucaagagaugucucuacucaaacugugccugcaggaggaggaacagagaagccugggcugcugg

SEQ ID NO: 501578 - RNA, 64 nt, Human
ggagcacuuggcuccuggcagagggagaggacaggaggaggagccuuccccaggaggaacgagg

SEQ ID NO: 501579 - RNA, 64 nt, Human
gugcccgguagccagcaugagccacacuaggaaagaggaggagggugcagccaaacuuaaggca

SEQ ID NO: 501580 - RNA, 64 nt, Human
cuuucccaaagcgauacacuugcuuuggucaccagaggaggacagagcuuagagcagcugugga

SEQ ID NO: 501581 - RNA, 54 nt, Human
acucagagcaacugaacugagacagaggaggaaaacagagcaucagaagccugc

SEQ ID NO: 501582 - RNA, 64 nt, Human
gguuccugggaacauguggcacaaguaaugggaugaggaggaauugggggugggggucuucuac

SEQ ID NO: 501583 - RNA, 64 nt, Human
cucacucgaggccuggggaaggggacucaggggcgaggaggaugacuggguccggucgccagga

SEQ ID NO: 501584 - RNA, 64 nt, Human; identical to SEQ ID NO: 257863

SEQ ID NO: 501585 - RNA, 64 nt, Human; identical to SEQ ID NO: 257864

SEQ ID NO: 501586 - RNA, 64 nt, Human; identical to SEQ ID NO: 257865

SEQ ID NO: 501587 - RNA, 64 nt, Human
ccaaagagggauguuuggaaaaaacucugaaggagaggaggaauuaguugggaugccaauuucc

SEQ ID NO: 501588 - RNA, 64 nt, Human
acgugggauucagagaaaggcaagggagguaagggaggaggagcuucugggguccccagggcug

SEQ ID NO: 501589 - RNA, 64 nt, Human
gcaacucuucucucucuuucuuccccacacccaagaggaggauuggugguagggggcaggcaga

SEQ ID NO: 501590 - RNA, 64 nt, Human
gaccaaagaccuugugcccuucccaggagccgcggaggaggacagugagggaggaauggaaacg

SEQ ID NO: 501591 - RNA, 64 nt, Human
ugucaugcaccacauuugugugcagauaccaaaagaggaggaaagaagaaaaaaauuaaugugu

SEQ ID NO: 501592 - RNA, 64 nt, Human
gggacugaucagaggugaagggacagagagaggagaggaggaagauugagcugggggcaacagc

SEQ ID NO: 501593 - RNA, 64 nt, Human
ugaaugagagaauaaaaugccaaucccaagggaagaggaggagcaggggugcccaggcccugau

SEQ ID NO: 501594 - RNA, 64 nt, Human
caacaaggacugauucaaucugcaugccagccuggaggaggaaagggagccugcucucccuccc

SEQ ID NO: 501595 - RNA, 64 nt, Human
uccuaugaugcagacauggugaauuuaauucaaggaggaggagaauguuuuaggcaggugguua

SEQ ID NO: 501596 - RNA, 64 nt, Human
gacaugucccuaugacauagcaguggugagccuggaggaggaccuggaugauguccccaucccu

SEQ ID NO: 501597 - RNA, 64 nt, Human
ggucuuuuagccugcccuugcauggcgccugcuggaggaggagagagcucugcuggcaugagcc

SEQ ID NO: 501598 - RNA, 50 nt, Human
aacgccauguguggaacuaggaggaggaauauuccaucuuggcagaaacc

SEQ ID NO: 501599 - RNA, 64 nt, Human
uaacccaaggcggagaaugaaggugguggcggcagaggaggagggcagcagcugagaggccagg

SEQ ID NO: 501600 - RNA, 64 nt, Human
uacauaggugguauuacuguuggucaaaaaucaugaggaggaacaguugaauccagccugaacg

SEQ ID NO: 501601 - RNA, 64 nt, Human
agaagacugaaaaccauggagauuauuuuuauuggaggaggaagcaucauucaugaaccgaucu

SEQ ID NO: 501602 - RNA, 64 nt, Human; identical to SEQ ID NO: 257867

SEQ ID NO: 501603 - RNA, 64 nt, Human; identical to SEQ ID NO: 257868

SEQ ID NO: 501604 - RNA, 64 nt, Human; identical to SEQ ID NO: 257872

SEQ ID NO: 501605 - RNA, 64 nt, Human
aaggaccuuugacuuuuucuucguugaggcuucugaggaggaaaaacaaaccuaaaauagaaau

SEQ ID NO: 501606 - RNA, 63 nt, Human
ccucaggcuccuugcucugacgcaggccuccuggaggaggaaguggaggccgcugcguagacc

SEQ ID NO: 501607 - RNA, 64 nt, Human
agggucccuggacuggggguugguguuuucuauagaggaggaaaggcccucccucacccugcuc

SEQ ID NO: 501608 - RNA, 64 nt, Human
cacagcguucugagcagagacacgcagaccagcugaggaggacaaagauaagguggcauucacc

SEQ ID NO: 501609 - RNA, 64 nt, Human
uguaggagauuagugaggcaaggugcugcucagagaggaggaccucauuguucuuaggaccuug

SEQ ID NO: 501610 - RNA, 64 nt, Human
cugcucccuuacagaccugguaguuuggggaaaggaggaggagagcccuucagguuugcugaaa

SEQ ID NO: 501611 - RNA, 64 nt, Human
cuucuggcuuccaacuggagacucacaggccuuggaggaggaggcagguacccucuaugccaau

SEQ ID NO: 501612 - RNA, 64 nt, Human
cacagguacuacacauuuuauuauggacuccucugaggaggaguuuuuaauuguauuugcuaga

SEQ ID NO: 501613 - RNA, 64 nt, Human
aagaagaaaagagaagaaggagaaggagaugaaggaggaggaggaggagaaggagaagaagaag

SEQ ID NO: 501614 - RNA, 64 nt, Human
aagaaaagagaagaaggagaaggagaugaaggaggaggaggaggagaaggagaagaagaagaag

SEQ ID NO: 501615 - RNA, 64 nt, Human
aaaagagaagaaggagaaggagaugaaggaggaggaggaggagaaggagaagaagaagaagaag

SEQ ID NO: 501616 - RNA, 64 nt, Human
gccuugggauuaauaaacaugcacugagaagcaagaggaggagaaaaagaugucuuuuucuucc

SEQ ID NO: 501617 - RNA, 64 nt, Human
gcuggccuguggcaggccuaggaccucaggcggggaggaggagcugccgcaaggcccuguccca

SEQ ID NO: 501618 - RNA, 64 nt, Human
ggguaccucaugaggaccaggguggagcugagaagaggaggaggugggggcuggaggugcuggu

SEQ ID NO: 501619 - RNA, 64 nt, Human
ccugaugcaagaugggcaucggcagcggggccuggaggaggagcugcggaggcuucagagcgag

SEQ ID NO: 501620 - RNA, 64 nt, Human; identical to SEQ ID NO: 257873

SEQ ID NO: 501621 - RNA, 64 nt, Human; identical to SEQ ID NO: 257874

SEQ ID NO: 501622 - RNA, 64 nt, Human; identical to SEQ ID NO: 257875

SEQ ID NO: 501623 - RNA, 64 nt, Human
uguggaccccccuuucaggcccugucugcagucagaggaggacgugagccaguuugauacccgc

SEQ ID NO: 501624 - RNA, 64 nt, Human
ggcugguggagacggggccugggcucccgggcccgaggaggaaaaggauugccaaggcuccagg

SEQ ID NO: 501625 - RNA, 64 nt, Human
ugacgugugagggaggacaggcgggaggaggugugaggaggaggcucccgaggggaaggggcgg

SEQ ID NO: 501626 - RNA, 64 nt, Human
ccagaagggaugaagccgggggaucuauggaacagaggaggagcgaugcaguugggagaggaag

SEQ ID NO: 501627 - RNA, 64 nt, Human
ggaguaugcagaaguuggguagagagguuaagaagaggaggaagugagacggggaagggaggag

SEQ ID NO: 501628 - RNA, 64 nt, Human
ugggacagaagaagaggaugaggaugagauggaagaggaggaggaggaggagcuggaggaggag

SEQ ID NO: 501629 - RNA, 64 nt, Human
gacagaagaagaggaugaggaugagauggaagaggaggaggaggaggagcuggaggaggagguc

SEQ ID NO: 501630 - RNA, 64 nt, Human
agaagaagaggaugaggaugagauggaagaggaggaggaggaggagcuggaggaggaggucgac

SEQ ID NO: 501631 - RNA, 64 nt, Human
agaagaggaugaggaugagauggaagaggaggaggaggaggagcuggaggaggaggucgacgag

SEQ ID NO: 501632 - RNA, 64 nt, Human
ggaugagauggaagaggaggaggaggaggagcuggaggaggaggucgacgagcugcagacgaca

SEQ ID NO: 501633 - RNA, 64 nt, Human
uccacagcccuggaggaacuggggcuccuggaaggaggaggaggcucuccacuguccacccuaa

SEQ ID NO: 501634 - RNA, 64 nt, Human
ggugccggaugcaggaaggaggugcagacggaaggaggaggaaggaaggacggaagcaaggaag

SEQ ID NO: 501635 - RNA, 64 nt, Human
cgaauuccccuuuaagaccaaggagauaaggguggaggaggacacgaaagugaacuccaccguc

SEQ ID NO: 501636 - RNA, 64 nt, Human
acuggugguuggggguaaggagcggggcacgggggaggaggagguagggggcaguaaaaaacuu

SEQ ID NO: 501637 - RNA, 64 nt, Human
auucaggaccugggaauacaggguucagagaggagaggaggaagauggugacaugauuugguua

SEQ ID NO: 501638 - RNA, 64 nt, Human; identical to SEQ ID NO: 242554

SEQ ID NO: 501639 - RNA, 64 nt, Human; identical to SEQ ID NO: 242437

SEQ ID NO: 501640 - RNA, 64 nt, Human; identical to SEQ ID NO: 242351

SEQ ID NO: 501641 - RNA, 64 nt, Human
ggcucggcuuuguagagccccgcucaggcacagggaggaggagaugccagggcuccugccuuuu

SEQ ID NO: 501642 - RNA, 64 nt, Human
ccaauggagaccauuguaagugguggggcugggagaggaggaacagaaggaaagccauagcgcu

SEQ ID NO: 501643 - RNA, 64 nt, Human
auguggaagagcugcuggcugcaucagggaacaggaggaggaagagggucaggguggagaggaa

SEQ ID NO: 501644 - RNA, 64 nt, Human
aauaacaacagccacccugcccagucuggaagaagaggaggaagacucuggagccaaggcagag

SEQ ID NO: 501645 - RNA, 64 nt, Human
ugggaaugcgcucuucaccaggaagaaggcccgggaggaggauccgggcuuuggacuccuuguu

SEQ ID NO: 501646 - RNA, 64 nt, Human
gaagguccuacaggucuccggccacccacacaaggaggaggaagaggaaauggugacccaagug

SEQ ID NO: 501647 - RNA, 64 nt, Human
uauuuucauauuacucugcuuugugcacuuuauggaggaggaagcuagaggaaaaauggaaaug

SEQ ID NO: 501648 - RNA, 64 nt, Human
ugaccgaguucagcuccguaagguggcggcaccugaggaggaagcagccaggaguggcugggga

SEQ ID NO: 501649 - RNA, 64 nt, Human
gguaaaaggugccagggaaguugugggcaccugagaggaggaacagauguggaggaccugaggg

SEQ ID NO: 501650 - RNA, 64 nt, Human
uuacuuguugcugauucaagaaacagaaguagaagaggaggagggauucuggucuucacugcca

SEQ ID NO: 501651 - RNA, 64 nt, Human
uaggccuuagaaggggaugagucagauuuuuacagaggaggagggcagggcuuggguccagugg

SEQ ID NO: 501652 - RNA, 64 nt, Human
uuaauauauaccacuggugugugugggagggagggaggaggaauacuagcccuuuuuauauauu

SEQ ID NO: 501653 - RNA, 64 nt, Human
ugguaugcaaaauuuugucuauauauauuugugugaggaggaaauucauaacuuuccucagauu

SEQ ID NO: 501654 - RNA, 64 nt, Human
aggggugugggaggaagcuugaguuugaugcagggaggaggaaggcugaggaaugacuuggcuc

SEQ ID NO: 501655 - RNA, 64 nt, Human
cccucccaggagcccagccccucuggccaggacugaggaggaguggagggaagcagggagggag

SEQ ID NO: 501656 - RNA, 64 nt, Human; identical to SEQ ID NO: 257877

SEQ ID NO: 501657 - RNA, 60 nt, Human; identical to SEQ ID NO: 257878

SEQ ID NO: 501658 - RNA, 64 nt, Human; identical to SEQ ID NO: 257879

SEQ ID NO: 501659 - RNA, 64 nt, Human
gaauaaguccuaaucuccagagaaaugguggggggaggaggaggcuuauugcuucccagcauuu

SEQ ID NO: 501660 - RNA, 64 nt, Human
aggccauucccuaacucccuccugccccuggucugaggaggagggacucuggaguagcagaggg

SEQ ID NO: 501661 - RNA, 64 nt, Human
acuuccaggaggaccccaacccggcccggagagggaggaggaggccuccaggggcgcggagcuc

SEQ ID NO: 501662 - RNA, 64 nt, Human
cagccucggacuucucaguggguggagugccagggaggaggaggcacacggagaccuggggcuc

SEQ ID NO: 501663 - RNA, 64 nt, Human
aguggagcauuuagcccaggucuuaauucuccaagaggaggaauacauaguaugguaaggcaag

SEQ ID NO: 501664 - RNA, 64 nt, Human
ugugaaggaaggugcagagucagaagaugaagaagaggaggaugugaaacucuuaaguauaucu

SEQ ID NO: 501665 - RNA, 64 nt, Human
ggccggacgaguucauggggaucugggggguggggaggaggaagccguugaaucugggagggaa

SEQ ID NO: 501666 - RNA, 64 nt, Human
auauuuagcucuguggaauucagugacaaaaugggaggaggaaagagaguuuguaaggucaugc

SEQ ID NO: 501667 - RNA, 64 nt, Human
gccugugccacccucagagaagaagaaaggagcugaggaggagaagccaaagaggaggaggcag

SEQ ID NO: 501668 - RNA, 64 nt, Human
agaagaagaaaggagcugaggaggagaagccaaagaggaggaggcaggagaagcaggcagccug

SEQ ID NO: 501669 - RNA, 64 nt, Human
uggugagguggguuugggaggaaagagaggccuagaggaggaguugaaagcucugcuguugucu

SEQ ID NO: 501670 - RNA, 64 nt, Human
caacaccagcaacucgagagcugggaaacucaaggaggaggaagaaaaucaaaaccacccuacu

SEQ ID NO: 501671 - RNA, 64 nt, Human
cccuacucccuggggugaggaaagaacaggaggggaggaggaggagugugcucugcacuugccu

SEQ ID NO: 501672 - RNA, 64 nt, Human
uacucccuggggugaggaaagaacaggaggggaggaggaggagugugcucugcacuugccuugc

SEQ ID NO: 501673 - RNA, 64 nt, Human
ugaacaacaguugguuuaaaauaugaggggcaaggaggaggaugcauuucaaaagcuugauuga

SEQ ID NO: 501674 - RNA, 64 nt, Human; identical to SEQ ID NO: 257880

SEQ ID NO: 501675 - RNA, 64 nt, Human; identical to SEQ ID NO: 257881

SEQ ID NO: 501676 - RNA, 64 nt, Human; identical to SEQ ID NO: 257882

SEQ ID NO: 501677 - RNA, 64 nt, Human
ugggugggggaaaacaaucagguuucuucaggcugaggaggacuugcucaggccgauuccaaac

SEQ ID NO: 501678 - RNA, 64 nt, Human
gauauauagagaugcauucacagggguuggcugggaggaggaagaccauucugugaccaaaaua

SEQ ID NO: 501679 - RNA, 64 nt, Human
agauauugguguuuuagaguuaguucuacccagcgaggaggaggcggggagagaaacugcguuc

SEQ ID NO: 501680 - RNA, 64 nt, Human
ccucucccaagaugagaaaguccucaagugaggggaggaggaagcagauagaugguccagcagg

SEQ ID NO: 501681 - RNA, 64 nt, Human
cuguucaguaaggccaauguuaacaacacguuuagaggaggaaaaguucaaccucaaguuaaau

SEQ ID NO: 501682 - RNA, 64 nt, Human
cuuuaccaccaugcaggaacagacuuuugguggugaggaggaagaacaaauaauagaagaaaau

SEQ ID NO: 501683 - RNA, 64 nt, Human
ugcaaauuucauggcaguucaugcagucggucaagaggaggauuuuguuuuguaguuugcagau

SEQ ID NO: 501684 - RNA, 64 nt, Human
ccugagaggcccauggacaguccugugucuggaugaggaggacucagugcuggcagauggcagu

SEQ ID NO: 501685 - RNA, 64 nt, Human
cgagcuuguuuucagugacuggcuugagucauaggaggaggagucugguacagcugcaggagag

SEQ ID NO: 501686 - RNA, 64 nt, Human
cugggccacugccauuggguuagucaagaugaaggaggaggacuggcugccuccauuuugccuu

SEQ ID NO: 501687 - RNA, 64 nt, Human
accugggcucuccacagccccaucaaagaacagagaggaggaggagggagaaauggccaccaca

SEQ ID NO: 501688 - RNA, 64 nt, Human
ugggcucuccacagccccaucaaagaacagagaggaggaggagggagaaauggccaccacauca

SEQ ID NO: 501689 - RNA, 64 nt, Human
cgguagcgacuauuacgacccgucagagccgacggaggaggaggagccuuccaaacagagaggu

SEQ ID NO: 501690 - RNA, 64 nt, Human
uagcgacuauuacgacccgucagagccgacggaggaggaggagccuuccaaacagagaggugag

SEQ ID NO: 501691 - RNA, 64 nt, Human
ggagagugaggggccccgccagcccgauggggaugaggaggagagcacagcccucagcaucaac

SEQ ID NO: 501692 - RNA, 64 nt, Human; identical to SEQ ID NO: 257884

SEQ ID NO: 501693 - RNA, 64 nt, Human; identical to SEQ ID NO: 257885

SEQ ID NO: 501694 - RNA, 53 nt, Human; identical to SEQ ID NO: 257886

SEQ ID NO: 501695 - RNA, 64 nt, Human
gggggggcggaagcgggagcgcaaggcugccgucgaggaggacaccucccugucggagagugag

SEQ ID NO: 501696 - RNA, 64 nt, Human
aaacaaagggggguggggcuuuaagagugaaggugaggaggagaucacacaccguauguguuug

SEQ ID NO: 501697 - RNA, 64 nt, Human
ccccaacucuuguuucccccauaaaguuaggcaugaggaggagcacucauuaaaggcagaagac

SEQ ID NO: 501698 - RNA, 64 nt, Human
cauccccccucgggaaauggaaggaaugucuaaggaggaggagggcuguguguggcuuggaaug

SEQ ID NO: 501699 - RNA, 64 nt, Human
ccuggcuguggcccccauuccucaggacugcacagaggaggacuggcuccggcuccgucgggcu

SEQ ID NO: 501700 - RNA, 64 nt, Human
cagccauaggagggcaggguaggguagggccucugaggaggagggaaaaagugaaggagaggcu

SEQ ID NO: 501701 - RNA, 64 nt, Human
guuugugcauaugaagggagauggggguuagguggaggaggagagcagcgugguuagcuaaggu

SEQ ID NO: 501702 - RNA, 64 nt, Human
ggcuuuggaccaccugaaagaccaaggggauagggaggaggaggcuucagccaucagcaauaaa

SEQ ID NO: 501703 - RNA, 64 nt, Human
ccuccagaagcccucgucugggaauucgagagaggaggaggacccagggccaaaggaauccuca

SEQ ID NO: 501704 - RNA, 64 nt, Human
ugcccuccagaagcccucgucugggaauucgagagaggaggaggacccagggccaaaggaaucc

SEQ ID NO: 501705 - RNA, 64 nt, Human
cugggacuggcucauccaccuaugugcgggagccgaggaggacggcgugggcccuguccuguau

SEQ ID NO: 501706 - RNA, 52 nt, Human
uucccccauaacaggucugagagaggaggagguaucuugggaucaagacugc

SEQ ID NO: 501707 - RNA, 64 nt, Human
cgccucugacccuuggcuugagucccacgugggggaggaggaggcaggcagcaccagcaggggu

SEQ ID NO: 501708 - RNA, 64 nt, Human
cacaagaaggcuaauugguggugagacagcaggggaggaggaagagcugugguuuguaacuugu

SEQ ID NO: 501709 - RNA, 64 nt, Human
uccuguuucccugugcuguccccaugcuguguuggaggaggaaguggcucuccuuccaccaaca

SEQ ID NO: 501710 - RNA, 64 nt, Human; identical to SEQ ID NO: 257890

SEQ ID NO: 501711 - RNA, 64 nt, Human; identical to SEQ ID NO: 257891

SEQ ID NO: 501712 - RNA, 64 nt, Human; identical to SEQ ID NO: 257892

SEQ ID NO: 501713 - RNA, 64 nt, Human
gucauccuaacuuuuccccuacucuugccauagagaggaggagaagaaacuaaccaacaugcag

SEQ ID NO: 501714 - RNA, 64 nt, Human
gaagucugugacaagaagcugcuuauuagaggaggaggaggagucaggugaggaggcugcagaa

SEQ ID NO: 501715 - RNA, 64 nt, Human
ccagaagucugugacaagaagcugcuuauuagaggaggaggaggagucaggugaggaggcugca

SEQ ID NO: 501716 - RNA, 64 nt, Human
uauccagaagucugugacaagaagcugcuuauuagaggaggaggaggagucaggugaggaggcu

SEQ ID NO: 501717 - RNA, 64 nt, Human
ugccaugaagacuguccggagcuucgccaaugaggaggaggaggcagagguguaccugcggaag

SEQ ID NO: 501718 - RNA, 64 nt, Human
cagugccaugaagacuguccggagcuucgccaaugaggaggaggaggcagagguguaccugcgg

SEQ ID NO: 501719 - RNA, 64 nt, Human
uagaugaaguuuacugaaucagaggaaucagacagaggaggauagcucuuuccagaauccacac

SEQ ID NO: 501720 - RNA, 64 nt, Human
gcuucuugugcugcagaagcucguugacaagacugaggaggauuucaagagcaaccaaguaaag

SEQ ID NO: 501721 - RNA, 64 nt, Human
gacuuuguaaccacacucauuccuuucaaacacagaggaggaauuauugcuucaucugacuuua

SEQ ID NO: 501722 - RNA, 64 nt, Human
gcugcuccuggcugaggggcuucaaccacucgccgaggaggagcagagggccuaggaggacccc

SEQ ID NO: 501723 - RNA, 64 nt, Human
ugaucuacucaaacauuggagaaaaaaacugccagaggaggaguugccaauuggcagugugucu

SEQ ID NO: 501724 - RNA, 64 nt, Human
cuugccaggguauuaggaaggacaggaaaaguaggaggaggaucuggggcauugcccuaggaaa

SEQ ID NO: 501725 - RNA, 64 nt, Human
uacaacagguaguuuguggacaggcgccuggugugaggaggacaaaauaaaccguguauuuauu

SEQ ID NO: 501726 - RNA, 64 nt, Human
ugggggucugcgccacaguuugguccagaggagggaggaggaagggaagaccccagugguggga

SEQ ID NO: 501727 - RNA, 64 nt, Human
acugcugccuuucaggaaagcaccaccaacgcuggaggaggagccggcccucacgcccgccccg

SEQ ID NO: 501728 - RNA, 64 nt, Human; identical to SEQ ID NO: 257958

SEQ ID NO: 501729 - RNA, 64 nt, Human; identical to SEQ ID NO: 257962

SEQ ID NO: 501730 - RNA, 64 nt, Human; identical to SEQ ID NO: 257963

SEQ ID NO: 501731 - RNA, 64 nt, Human
acaagucacuaaucauacucugaugccugaacuugaggaggaaaauacauguauauuuuuguuc

SEQ ID NO: 501732 - RNA, 64 nt, Human
aucucgggaguccucuagcaggccuaagacaugugaggaggaaaaggaaaaaaagcaaaaagca

SEQ ID NO: 501733 - RNA, 64 nt, Human
uacuucaggagacagaaggcccaugcugaugggggaggaggagggaugugggcauuuuggacac

SEQ ID NO: 501734 - RNA, 64 nt, Human
cguaggacagaaugugaggaggaaguaacacacagaggaggauguguguguaugcauguguuug

SEQ ID NO: 501735 - RNA, 64 nt, Human
uuuguguaacuauuuguaccguaggacagaaugugaggaggaaguaacacacagaggaggaugu

SEQ ID NO: 501736 - RNA, 64 nt, Human
cauguuaucaucuguuucucguguccgccugguugaggaggacccacgagugcugccgaggugu

SEQ ID NO: 501737 - RNA, 64 nt, Human
accuaggaggucuuauucaaagcccucauugacagaggaggaaacaggccaaggcaggacaugg

SEQ ID NO: 501738 - RNA, 64 nt, Human
guguaguuacuagucuuuugacauggaugauucugaggaggaagcuguuauugaauguauagag

SEQ ID NO: 501739 - RNA, 64 nt, Human
gcagaaugcuagcucugagccaguucaguaccuggaggaggagcaggggcguggagggcgugga

SEQ ID NO: 501740 - RNA, 64 nt, Human
aggacacacugauguagcugaucucucauuuacagaggaggauucuaaaguucagagagggaaa

SEQ ID NO: 501741 - RNA, 64 nt, Human
aucuuuuuuuaauugccauuugauuuuuauuguggaggaggaggaucuaauauauaauauucaa

SEQ ID NO: 501742 - RNA, 64 nt, Human
uuuuuuuaauugccauuugauuuuuauuguggaggaggaggaucuaauauauaauauucaauac

SEQ ID NO: 501743 - RNA, 64 nt, Human
uggaguaagggaagauuucuguauacuugcuggagaggaggaauguguauaguuacucauuuag

SEQ ID NO: 501744 - RNA, 58 nt, Human
acaccauagacaugagcuagggaaggcugaggaggacaggagaagggcccagacacuc

SEQ ID NO: 501745 - RNA, 64 nt, Human
ucgagaagaagugaccaugggcugggaggagguggaggaggaggaagaggagaaggaaaaguga

SEQ ID NO: 501746 - RNA, 64 nt, Human; identical to SEQ ID NO: 257964

SEQ ID NO: 501747 - RNA, 64 nt, Human; identical to SEQ ID NO: 257965

SEQ ID NO: 501748 - RNA, 64 nt, Human; identical to SEQ ID NO: 257966

SEQ ID NO: 501749 - RNA, 64 nt, Human
agaagaagugaccaugggcugggaggagguggaggaggaggaagaggagaaggaaaagugacga

SEQ ID NO: 501750 - RNA, 64 nt, Human
aggaggaagaggagaaggaaaagugacgaagagagaggaggaggggggccccagauggcccuuc

SEQ ID NO: 501751 - RNA, 64 nt, Human
acagucucccgggacuuggacucgagggagugacgaggaggagcuccgagcugcgccugagccg

SEQ ID NO: 501752 - RNA, 64 nt, Human
gcuccagagcuggcuguaccccaugguagccucugaggaggacgcuguggggugagguccaggg

SEQ ID NO: 501753 - RNA, 64 nt, Human
caguucgguuaugcagucaauuauuucuuuuuaagaggaggaggauucacuuggguguugggau

SEQ ID NO: 501754 - RNA, 64 nt, Human
uucgguuaugcagucaauuauuucuuuuuaagaggaggaggauucacuuggguguugggaucaa

SEQ ID NO: 501755 - RNA, 64 nt, Human
gggcccuaggacccuaggaugccauucuugccaggaggaggaaugagagugauguuggccaaca

SEQ ID NO: 501756 - RNA, 64 nt, Human
cucuuaacauaggaucauuuggaacaggaguucugaggaggagagagugaggguuuugcuauug

SEQ ID NO: 501757 - RNA, 64 nt, Human
gguguccuaaggagacuccuggaagcugaauggagaggaggaagaaaaugaagaaggagugauu

SEQ ID NO: 501758 - RNA, 64 nt, Human
ggugaugucaggguugggcgcgggaagaaaaggagaggaggaagcugaggcaacuuugggauuc

SEQ ID NO: 501759 - RNA, 64 nt, Human
caucuuucguaagaucagugaugugaagaaagaggaggaggagcgccuccggcagaagaaugag

SEQ ID NO: 501760 - RNA, 64 nt, Human
gaucaucuuucguaagaucagugaugugaagaaagaggaggaggagcgccuccggcagaagaau

SEQ ID NO: 501761 - RNA, 64 nt, Human
ugccagcaaugaguuggcacuggcagagcuggaggaggaggagggcaaacccgagggcccagcg

SEQ ID NO: 501762 - RNA, 64 nt, Human
gcgugccagcaaugaguuggcacuggcagagcuggaggaggaggagggcaaacccgagggccca

SEQ ID NO: 501763 - RNA, 64 nt, Human
uuguaguuucauuccuugguucugaaacucuguggaggaggaagaugggagcugaugagaauca

SEQ ID NO: 501764 - RNA, 64 nt, Human; identical to SEQ ID NO: 257968

SEQ ID NO: 501765 - RNA, 64 nt, Human; identical to SEQ ID NO: 257969

SEQ ID NO: 501766 - RNA, 64 nt, Human; identical to SEQ ID NO: 257970

SEQ ID NO: 501767 - RNA, 64 nt, Human
caacaacggccgagccugcaccgacaacccccuggaggaggaguaccuagcacaguugcaggag

SEQ ID NO: 501768 - RNA, 64 nt, Human
agcugcauaugaguaaaguuaccccaaccacagugaggaggaagauguucacauacuggaacug

SEQ ID NO: 501769 - RNA, 64 nt, Human
ucacugagugaaggcacauaaagcaauugaggaggaggaggaaccccucgucccccuaggagca

SEQ ID NO: 501770 - RNA, 64 nt, Human
gguucacugagugaaggcacauaaagcaauugaggaggaggaggaaccccucgucccccuagga

SEQ ID NO: 501771 - RNA, 64 nt, Human
uuggguucacugagugaaggcacauaaagcaauugaggaggaggaggaaccccucgucccccua

SEQ ID NO: 501772 - RNA, 64 nt, Human
ccagugccccaucaccggccuucuccuggcaggagaggaggagcagagagcuggguccugggcu

SEQ ID NO: 501773 - RNA, 64 nt, Human
auuguuauacaccaguaaagaaggcuguacucaagaggaggagcugacacauuucacuuggcug

SEQ ID NO: 501774 - RNA, 64 nt, Human
gggacguuuuucauaugcaacgugcugcucucaggaggaggagggaauggcaggaaccggacag

SEQ ID NO: 501775 - RNA, 64 nt, Human
cuggaccaacccucaguaccgucugaagcuccuggaggaggacgaugacccugaugacucggag

SEQ ID NO: 501776 - RNA, 64 nt, Human
auuauugauagagaguaguuagaugcuguuaaaagaggaggaaacuacuugaggagggacccaa

SEQ ID NO: 501777 - RNA, 64 nt, Human
caguaacuguagucuugugagcauauugagggcagaggaggacuuaguuuuucauauguguuuc

SEQ ID NO: 501778 - RNA, 64 nt, Human
ggagccucuugagggagaugagaggccucuuugugaggaggacauuagcuguguggccucucuc

SEQ ID NO: 501779 - RNA, 64 nt, Human
ccuuggcccuuuuucuuuauugacuagaccaccagaggaggaugugugggauuguaggcaaacc

SEQ ID NO: 501780 - RNA, 64 nt, Human
ggagauggaggaugucaucaggcuggcccagaaggaggaggagaugaagguagggcgugcaaca

SEQ ID NO: 501781 - RNA, 64 nt, Human
cugggagguggucugaagcagacagggaaugggagaggaggaugggaaguagacaguggcuggu

SEQ ID NO: 501782 - RNA, 64 nt, Human; identical to SEQ ID NO: 257971

SEQ ID NO: 501783 - RNA, 64 nt, Human; identical to SEQ ID NO: 257972

SEQ ID NO: 501784 - RNA, 64 nt, Human; identical to SEQ ID NO: 257973

SEQ ID NO: 501785 - RNA, 64 nt, Human
acucccuggagcacgugcagcuguuugaccugaugaggaggauguuagaauuugacccugccca

SEQ ID NO: 501786 - RNA, 64 nt, Human
ucuagcgaugggacugcccauuuccucagcugcagaggaggaaagggaaaggguaggccuguag

SEQ ID NO: 501787 - RNA, 64 nt, Human
acauaagcaugucucauccuugccccacuggugagaggaggaccuugugccugcccagagccug

SEQ ID NO: 501788 - RNA, 64 nt, Human
aggguuuggugauugggaauggaugggggacagugaggaggacacaccagcccauuaguuguua

SEQ ID NO: 501789 - RNA, 64 nt, Human
cuuuggguguuuuuuaaagcaaugugaguccacugaggaggaagagacccugggauuucacccu

SEQ ID NO: 501790 - RNA, 64 nt, Human
cccuccucugccgccaccgcagcagccacaggcagaggaggacgaggacgacugggaauccuag

SEQ ID NO: 501791 - RNA, 64 nt, Human
uugcuuugguauuugcuuggacugacauuugagggaggaggaggcugggauccucuggcugaga

SEQ ID NO: 501792 - RNA, 64 nt, Human
auaccaaauauuggggaaagugggauaaagggaggaggaggagcuagcagacacauccaguauc

SEQ ID NO: 501793 - RNA, 64 nt, Human
aucauaccaaauauuggggaaagugggauaaagggaggaggaggagcuagcagacacauccagu

SEQ ID NO: 501794 - RNA, 64 nt, Human
aaauggaaugguaugcuuuucacccuugaaguuugaggaggaucuugauauguuuuaacauuau

SEQ ID NO: 501795 - RNA, 64 nt, Human
cacccccauaggagauggacuggagagugaggaggaggaggagccuugguccaugcugagcauc

SEQ ID NO: 501796 - RNA, 64 nt, Human
ccccacccccauaggagauggacuggagagugaggaggaggaggagccuugguccaugcugagc

SEQ ID NO: 501797 - RNA, 64 nt, Human
ccgccccacccccauaggagauggacuggagagugaggaggaggaggagccuugguccaugcug

SEQ ID NO: 501798 - RNA, 64 nt, Human
ucuucugcagcaguacuaucagcagcugaucucugaggaggaggcacugcacaggcaguuauuu

SEQ ID NO: 501799 - RNA, 64 nt, Human
gagacucucauuuccccaagcauaacugcaaggagaggaggaauuccuaggagccaaagaguuu

SEQ ID NO: 501800 - RNA, 64 nt, Human; identical to SEQ ID NO: 257975

SEQ ID NO: 501801 - RNA, 64 nt, Human; identical to SEQ ID NO: 257976

SEQ ID NO: 501802 - RNA, 64 nt, Human; identical to SEQ ID NO: 257980

SEQ ID NO: 501803 - RNA, 64 nt, Human
cuuugccuugacagaguggcccaggguuucaagggaggaggaaccucccccuaccuaggacccu

SEQ ID NO: 501804 - RNA, 64 nt, Human
cccaagccuggcaccaagccugaggggccucuuggaggaggagguguucaucugcaccacagag

SEQ ID NO: 501805 - RNA, 64 nt, Human
caggaugguaccuggccccaaaaggaauccuggagaggaggacagugacaacaggugacuucau

SEQ ID NO: 501806 - RNA, 64 nt, Human
uggagaacucuuggccaaagguuuuugcggggaggaggaggaaaccagcuuucugguuaagguu

SEQ ID NO: 501807 - RNA, 64 nt, Human
caguggagaacucuuggccaaagguuuuugcggggaggaggaggaaaccagcuuucugguuaag

SEQ ID NO: 501808 - RNA, 64 nt, Human
cauucccagugaccccuucugggugccaacuacugaggaggaauacuugcacuuuggggagaag

SEQ ID NO: 501809 - RNA, 64 nt, Human
ucaacagagagaaggagaagaacacgcagcugaagaggaggaucgaggagcuggaggcagagcu

SEQ ID NO: 501810 - RNA, 64 nt, Human
acagggagcgaggagccccucggaggagccuccagaggaggaaauccccaaggaggaugggauc

SEQ ID NO: 501811 - RNA, 64 nt, Human
agcgccgggcuuuccucacaccugagccgggugcgaggaggagcaugcacggaccaagcgcggc

SEQ ID NO: 501812 - RNA, 64 nt, Human
cagccauugccauccaguggggagauggguuagggaggaggacgggcugacuccucuccuguaa

SEQ ID NO: 501813 - RNA, 64 nt, Human
gaaaguuguggggcauaagacaccgggaaugagggaggaggaagacaguuguguuuucucuuua

SEQ ID NO: 501814 - RNA, 64 nt, Human
gcgggcagggagugcggggaugcggaucagcugggaggaggaggggaggggaacuuccacccga

SEQ ID NO: 501815 - RNA, 64 nt, Human
aacccacccgcgcccugggacgcagccacgccaggaggaggacacggccgccgagagcaaggca

SEQ ID NO: 501816 - RNA, 64 nt, Human
ccuaccucacagggguguugugaggauuaaaugugaggaggauaguggcagaugagugauggac

SEQ ID NO: 501817 - RNA, 64 nt, Human
cugucucaggcuucuguggcaggacuggcccagggaggaggaagccagcagcacaccuggggaa

SEQ ID NO: 501818 - RNA, 64 nt, Human; identical to SEQ ID NO: 257981

SEQ ID NO: 501819 - RNA, 64 nt, Human; identical to SEQ ID NO: 257982

SEQ ID NO: 501820 - RNA, 64 nt, Human; identical to SEQ ID NO: 257983

SEQ ID NO: 501821 - RNA, 64 nt, Human
cggggugguggcaauggucguggaggccgagggcgaggaggacccaugggccguggaggcuaug

SEQ ID NO: 501822 - RNA, 64 nt, Human
ggcuauggaggugguggcagugguggugguggccgaggaggauuucccaguggaggugguggcg

SEQ ID NO: 501823 - RNA, 64 nt, Human
ggaggcugcuggccguuuccuacugccugggcuggaggaggagcuggaagaggccgugggccgc

SEQ ID NO: 501824 - RNA, 64 nt, Human
uguaauaaaauauguaaugggguugaaagcuggggaggaggaucuacugcuguacagcuaauaa

SEQ ID NO: 501825 - RNA, 64 nt, Human
auugggaaaaauuacccaguauaguucagguuaugaggaggaucagccacacaauccagugcuu

SEQ ID NO: 501826 - RNA, 64 nt, Human
cuuaacuagccgagagaugcugccucuaggcagagaggaggagagguguugccggcuggagggc

SEQ ID NO: 501827 - RNA, 64 nt, Human
caaccagugaacaccagcugugaaggccuugggagaggaggaacaggcccuugggcagaugcag

SEQ ID NO: 501828 - RNA, 64 nt, Human
cccucugagcaacagacugcuugucuugcuaggagaggaggauggggggcugagcacucaggcu

SEQ ID NO: 501829 - RNA, 64 nt, Human
ucuccaacucccucacgagguggggcucaggcuggaggaggagggauuaagauccccuugcucc

SEQ ID NO: 501830 - RNA, 64 nt, Human
cuguggggcaggaacaggaagugacgggaaccuugaggaggaaacgccuguguuagggagagag

SEQ ID NO: 501831 - RNA, 64 nt, Human
gcagcagccuggugugcugauccggggccacacggaggaggagccgccccagccugaggucugc

SEQ ID NO: 501832 - RNA, 64 nt, Human
aggcaggacuucucaccagcagucguggggaacggaggaggacauggggagguuguggggccuc

SEQ ID NO: 501833 - RNA, 64 nt, Human
guuccuguccuguuuccccuuccucuuuggggcugaggaggagguuaaaggccaaaugcuguuu

SEQ ID NO: 501834 - RNA, 64 nt, Human
gaagacauguacugaugacacaccauggauuucagaggaggaaguacggagucguugcauaauc

SEQ ID NO: 501835 - RNA, 64 nt, Human
uaagcuaccaugcugggccugaacauaauuucaagaggaggauuuauaaaaccauuuucuguaa

SEQ ID NO: 501836 - RNA, 64 nt, Human; identical to SEQ ID NO: 257985

SEQ ID NO: 501837 - RNA, 64 nt, Human
aggacguagaguuauugaaaaugcagaugguucugaggaggaaacggacacucgagacgcagac

SEQ ID NO: 501838 - RNA, 64 nt, Human
ccaacagggaggaggucggauuaggggagguucagaggaggagaaugucucaaaaaaaaaggac

SEQ ID NO: 501839 - RNA, 64 nt, Human
agucagauuguagagguccuggcggcugauucuagaggaggaagaggcucugugagaugaauag

SEQ ID NO: 501840 - RNA, 64 nt, Human
gguggcccaccuguggagaggacuggcugcccuggaggaggaaagggaggaagucuacacagag

SEQ ID NO: 501841 - RNA, 64 nt, Human
gaucaacagcuuuuucuccgucucccacaacaucgaggaggaagaauucaaugacuaugaggcc

SEQ ID NO: 501842 - RNA, 64 nt, Human
guaccacgggcaugaggagcugaagagaacugcugaggaggauuuuccuaaaguuacugcugac

SEQ ID NO: 501843 - RNA, 64 nt, Human
aggagggagucacuccaggaauaagacaaaaggagaggaggaggccaucaccucuggccucuuc

SEQ ID NO: 501844 - RNA, 64 nt, Human
uuucuuugcacuggucuugaagagaguggacgaugaggaggauacuguggccccgcugccagga

SEQ ID NO: 501845 - RNA, 64 nt, Human
acugaugcggcuggaacaggagcuggcagugggggaggaggagagggaagauggucccugggca

SEQ ID NO: 501846 - RNA, 64 nt, Human
ccccugcagcacacagcgacuugcguugacaaaggaggaggaaacgauuacucuguaaacaaag

SEQ ID NO: 501847 - RNA, 64 nt, Human
ugcacuuccagcccacccgggcagugcugagagggaggaggagaacaaggauggcccagccucc

SEQ ID NO: 501848 - RNA, 64 nt, Human
uagcugaaaagggcacucccaacccugggcuggggaggaggagagagucccagagcucaucccc

SEQ ID NO: 501849 - RNA, 64 nt, Human
gucucuccccaaaccccuuuagauggggagggaagaggaggagaggggaggggaccugcccccu

SEQ ID NO: 501850 - RNA, 64 nt, Human
caccuggggagaucccaccugccguaggcacauggaggaggagcccagaguugggcacuggcaa

SEQ ID NO: 501851 - RNA, 64 nt, Human
cggcccucccuggcccggccacuccgaaggcagggaggaggacuuggcaacuggcuuuucuccu

SEQ ID NO: 501852 - RNA, 64 nt, Human
uuaagaggagaaagugcacugccuuccagcccaggaggaggacagcauuuuguauuuguuccac

SEQ ID NO: 501853 - RNA, 64 nt, Human
auugaaguaagagcaguucucuccguugccucucgaggaggaggugcgaaguccuggaguauug

SEQ ID NO: 501854 - RNA, 64 nt, Human
ugcauucccuucuccugcugauagcagucagcuugaggaggaugaaggaaggcagccucagaca

SEQ ID NO: 501855 - RNA, 64 nt, Human
uccugggaccaggcugggaggggaguguggcagggaggaggaagaggaaggugagaaugaguag

SEQ ID NO: 501856 - RNA, 64 nt, Human
ucauguuggacugagaccuaacucacuggacucagaggaggaaucguggaaaacaagagcaaaa

SEQ ID NO: 501857 - RNA, 64 nt, Human
auaggguguggcuccuaccagcaaacagcugaaagaggaggaccccugccuuccucugaggaca

SEQ ID NO: 501858 - RNA, 64 nt, Human
ugcauuugugucugccugccucaugcucucuauagaggaggauggucaucgugacagcagcagc

SEQ ID NO: 501859 - RNA, 64 nt, Human
ucgguguuuaaagucaacaaccaugccagggauugaggaggacuacuauuugaagcaaugggca

SEQ ID NO: 501860 - RNA, 64 nt, Human
gugaaaauccagggcuguuaaaguuuaguggcaggaggaggaguuaaggugaucuugugagaag

SEQ ID NO: 501861 - RNA, 64 nt, Human
uuggccagugccgaguggaaugccugguuugggggaggaggagggacuggguucagcuguggug

SEQ ID NO: 501862 - RNA, 64 nt, Human
gugccagcagcugcagcaagaauacagccgcaaggaggaggagugccaggcaggggcugccgag

SEQ ID NO: 501863 - RNA, 64 nt, Human
caauagccagcuuucgacacauaccuggcugucugaggaggaaggccuccuggaaacugggagc

SEQ ID NO: 501864 - RNA, 64 nt, Human
gaagcuguggagugacuagaucacaggagcacuggaggaggagugggcucucugugcagccuca

SEQ ID NO: 501865 - RNA, 64 nt, Human
gaucaugcccaaguaccacgcagugcggauccgggaggaggagcgcuacccaccuccagggagc

SEQ ID NO: 501866 - RNA, 64 nt, Human
gcgcaugaaccuggaccccuucggcagcuacucagaggaggacauuuggugggcuuuggagcug

SEQ ID NO: 501867 - RNA, 64 nt, Human; identical to SEQ ID NO: 257894

SEQ ID NO: 501868 - RNA, 64 nt, Human; identical to SEQ ID NO: 257895

SEQ ID NO: 501869 - RNA, 64 nt, Human; identical to SEQ ID NO: 257896

SEQ ID NO: 501870 - RNA, 64 nt, Human
ugcaggagaaaauuaaaguguuuucuuuauaucagaggaggaaauaguagaggucagugaaggu

SEQ ID NO: 501871 - RNA, 64 nt, Human
agcagcaggacagacccccacgaggccccccagagaggaggaagaucccacggaggaacacaug

SEQ ID NO: 501872 - RNA, 64 nt, Human
gucaagccgcauaacagaccaauuuuuauuccacgaggaggaguaccuggaaauuaggcaaguu

SEQ ID NO: 501873 - RNA, 64 nt, Human
uacucuuggcccaccgcagaucuguagccagucagaggaggaggagaaggagccccucagcaga

SEQ ID NO: 501874 - RNA, 64 nt, Human
ucuuggcccaccgcagaucuguagccagucagaggaggaggagaaggagccccucagcagagug

SEQ ID NO: 501875 - RNA, 64 nt, Human
ccagcccaagcccccucaagagucugggucgggggaggaggaguggguggccuccuugaugggc

SEQ ID NO: 501876 - RNA, 64 nt, Human
uucccaacaguccgaagccuaggauaugagggcugaggaggacucaaaccguugcagucagaga

SEQ ID NO: 501877 - RNA, 64 nt, Human
uggugggaccacccggccacagaaauggcggugggaggaggacucuucucacgaccuccucgca

SEQ ID NO: 501878 - RNA, 64 nt, Human
aacaaguuggccugcacugguguuuuguuguggggaggaggauggggaguaggacauaccagcu

SEQ ID NO: 501879 - RNA, 64 nt, Human
aauaccacccaagaagaaagaaagguccaagcaugaggaggaccaguuccucagguccuccaga

SEQ ID NO: 501880 - RNA, 64 nt, Human
uccaaguggucuucuguagaggaaagcaugauaagaggaggaagacauaaaguuggggguggag

SEQ ID NO: 501881 - RNA, 64 nt, Human
ccuccuccagcugcuucaggcuaaaacccaggaugaggaggaacagguaagggcaggaugcugg

SEQ ID NO: 501882 - RNA, 64 nt, Human
uaaauuuuuuacauuccgagcaagggauaaguuugaggaggaucguaucuaucgucaucuggag

SEQ ID NO: 501883 - RNA, 64 nt, Human
guuggauauccaguaaugaucaaggccucagagggaggaggagggaagggaauuagaaaaguca

SEQ ID NO: 501884 - RNA, 64 nt, Human
gcugccagccccuuugccauagccugauuuuggggaggaggaaggggcgauuugagggagaagg

SEQ ID NO: 501885 - RNA, 64 nt, Human; identical to SEQ ID NO: 257819

SEQ ID NO: 501886 - RNA, 64 nt, Human; identical to SEQ ID NO: 257820

SEQ ID NO: 501887 - RNA, 64 nt, Human; identical to SEQ ID NO: 257821

SEQ ID NO: 501888 - RNA, 64 nt, Human
gccuggcguccccucccucugucuucagcacccagaggaggagagagccggcaguucccugcag

SEQ ID NO: 501889 - RNA, 64 nt, Human
uuacucauagaggagaaaaccagagaaagaugaagaggaggaguuaggucuauuugaaaugcca

SEQ ID NO: 501890 - RNA, 64 nt, Human
uccacaauucaaaagcaccuaaaaagaauaggcugaggaggaagucuucuaccaggcauauuca

SEQ ID NO: 501891 - RNA, 64 nt, Human
ccccugcauuggaacuggaggcagggaacauggggaggaggagggucggugccuucaagaaaac

SEQ ID NO: 501892 - RNA, 64 nt, Human
cccgugcagacuggaggggacgcugguagagauggaggaggaggcaauugggauggcgcuaggc

SEQ ID NO: 501893 - RNA, 64 nt, Human
cuggaggggcauggccagcagcuugcguuagaaugaggaggaaggagagaaggggaggagggcg

SEQ ID NO: 501894 - RNA, 64 nt, Human
cugcugagaaaacacuccgccacgugaagagacagaggaggauggcaggaguuaccucgggaaa

SEQ ID NO: 501895 - RNA, 64 nt, Human
gugagaguuuguuuucuggaaugguaggugcugggaggaggaguuugauggagggcuuccuggc

SEQ ID NO: 501896 - RNA, 64 nt, Human
uugaggaagaggggaaggugcguauuuauucagggaggaggaaaaguggugcagggacagggag

SEQ ID NO: 501897 - RNA, 64 nt, Human
uucacaaagaaggugagagagaaggaaaccuugggaggaggacauuacugguuguucuggcugg

SEQ ID NO: 501898 - RNA, 64 nt, Human
aacuaggaaauaaaaugugccccucccagucugggaggaggauguugcagagcccucucccaua

SEQ ID NO: 501899 - RNA, 64 nt, Human
caaacugcucagcgcgucucagcucagugccgaggaggaggaagaaaaacaggccgagugaagg

SEQ ID NO: 501900 - RNA, 64 nt, Human
gagcaaacugcucagcgcgucucagcucagugccgaggaggaggaagaaaaacaggccgaguga

SEQ ID NO: 501901 - RNA, 64 nt, Human
gaggcaccaggaaaggggugguagucagaggagggaggaggaauaaggggaaggaagagagagg

SEQ ID NO: 501902 - RNA, 64 nt, Human
uuuugaaaauuugaauaaggcuguuugcugacaggaggaggaaguaguggagaucauuucaucu

SEQ ID NO: 501903 - RNA, 64 nt, Human; identical to SEQ ID NO: 257822

SEQ ID NO: 501904 - RNA, 64 nt, Human; identical to SEQ ID NO: 257823

SEQ ID NO: 501905 - RNA, 64 nt, Human; identical to SEQ ID NO: 257824

SEQ ID NO: 501906 - RNA, 64 nt, Human
uuucaaucauuuuaggauugucaaaaggaggauugaggaggaucagaucaauaauggaggcaau

SEQ ID NO: 501907 - RNA, 64 nt, Human
agugccuagaacucccguggugguccugagcagagaggaggauguccuccugccugccugaagg

SEQ ID NO: 501908 - RNA, 64 nt, Human
gaggucagaacauucgaaucucugccccucacuugaggaggagcuggccugcgguggagggauc

SEQ ID NO: 501909 - RNA, 64 nt, Human
auuauaaguacagaaaugguucuccguguggugggaggaggagguucgggugcuggguaagugc

SEQ ID NO: 501910 - RNA, 64 nt, Human
cccuggaaccagcaagucccagacaaggagagcggaggaggaagucaugggaacgcagccucca

SEQ ID NO: 501911 - RNA, 64 nt, Human
aagggagcagggcuuacugagcaguggguugcaggaggaggagcugggcagggccugcaccagg

SEQ ID NO: 501912 - RNA, 64 nt, Human
cuugcucccugccccagaccuguuucuucuaagggaggaggacaugguggagaccagggacagg

SEQ ID NO: 501913 - RNA, 64 nt, Human
ucccuagaguccagcacacugcaggaggcguucggaggaggaguuccgccccacccucuacagc

SEQ ID NO: 501914 - RNA, 64 nt, Human
accacgugaccccagccaaucgggacaguucaaggaggaggagaccccuauuacacagguugga

SEQ ID NO: 501915 - RNA, 64 nt, Human
gguauauuggaagaggcagagccugaggugguaggaggaggacccuggaaauggacugguuuga

SEQ ID NO: 501916 - RNA, 64 nt, Human
agcacgucuggcugcgagggcacacagggccggggaggaggauuaggcuggacugaucgcgggu

SEQ ID NO: 501917 - RNA, 64 nt, Human
gcucaucaggcuccuggagguggacguguaugaugaggaggagaucaacaccggugagugcuga

SEQ ID NO: 501918 - RNA, 64 nt, Human
aacuggugaugauggagagcccuguggccacacagaggaggaagacagcagccuggcagcagcc

SEQ ID NO: 501919 - RNA, 64 nt, Human
gggaggcugaggugggaaaaugacuugagcccaggaggaggaggcugcagugagcuaagauugc

SEQ ID NO: 501920 - RNA, 64 nt, Human
ggacggccgugcauuuucucgucucacgcaguucgaggaggacccuagaaagccaggagcugug

SEQ ID NO: 501921 - RNA, 64 nt, Human; identical to SEQ ID NO: 257826

SEQ ID NO: 501922 - RNA, 64 nt, Human; identical to SEQ ID NO: 257827

SEQ ID NO: 501923 - RNA, 64 nt, Human; identical to SEQ ID NO: 257828

SEQ ID NO: 501924 - RNA, 64 nt, Human
cgcccgccccccacccucuagguggcccccguccgaggaggaucguuuucuaagugcaauacuu

SEQ ID NO: 501925 - RNA, 64 nt, Human
aucgggggcagagucguuggagacugaagaggaagaggaggaggagaaggggagugagcggccg

SEQ ID NO: 501926 - RNA, 64 nt, Human
gggggcagagucguuggagacugaagaggaagaggaggaggagaaggggagugagcggccgccc

SEQ ID NO: 501927 - RNA, 64 nt, Human
cugugcauccuggccaagcgucacccucacacuggaggaggaugucugcucuggacuuaucacc

SEQ ID NO: 501928 - RNA, 64 nt, Human
ccagggaccccucccggccucccucgcacacugggaggaggaagccgccgagacugcagggagc

SEQ ID NO: 501929 - RNA, 64 nt, Human
acuguucgucuaccugguggcagggucugagcgggaggaggagggaaagaguguguucugagcu

SEQ ID NO: 501930 - RNA, 64 nt, Human
gcagcccuucucagcuccacccugcccggggagggaggaggagcucugguuucagagcagugcc

SEQ ID NO: 501931 - RNA, 64 nt, Human
aggguggagcagaaaggggaccccggagccgagcgaggaggaccaggcagccgccgcugccgcg

SEQ ID NO: 501932 - RNA, 64 nt, Human
aacaaacaaacacaugggggagagagacuuggaagaggaggaggaggaggagaaggaggagaga

SEQ ID NO: 501933 - RNA, 64 nt, Human
aaacaaacacaugggggagagagacuuggaagaggaggaggaggaggagaaggaggagagagag

SEQ ID NO: 501934 - RNA, 64 nt, Human
caaacacaugggggagagagacuuggaagaggaggaggaggaggagaaggaggagagagagggg

SEQ ID NO: 501935 - RNA, 64 nt, Human
acacaugggggagagagacuuggaagaggaggaggaggaggagaaggaggagagagaggggaag

SEQ ID NO: 501936 - RNA, 64 nt, Human
auucaagacugaauagaaguauuucagucuugcagaggaggaaaugcucagagcuccgaggugc

SEQ ID NO: 501937 - RNA, 64 nt, Human
ccauggucgggacagugcccuggccuuugccggggaggaggaugcucugagauucagggugggg

SEQ ID NO: 501938 - RNA, 64 nt, Human
ccagugacuuccccaggaguguggaggggguggugaggaggagcaccugggcucucuaccccuc

SEQ ID NO: 501939 - RNA, 64 nt, Human; identical to SEQ ID NO: 257829

SEQ ID NO: 501940 - RNA, 64 nt, Human; identical to SEQ ID NO: 257830

SEQ ID NO: 501941 - RNA, 64 nt, Human; identical to SEQ ID NO: 257831

SEQ ID NO: 501942 - RNA, 64 nt, Human
ccggcagcuggcgcaccaggcccagcagcagcuggaggaggaggaggaggauacgccagucagc

SEQ ID NO: 501943 - RNA, 64 nt, Human
gcagcuggcgcaccaggcccagcagcagcuggaggaggaggaggaggauacgccagucagcccc

SEQ ID NO: 501944 - RNA, 64 nt, Human
gcuggcgcaccaggcccagcagcagcuggaggaggaggaggaggauacgccagucagccccaag

SEQ ID NO: 501945 - RNA, 64 nt, Human
ggcgcaccaggcccagcagcagcuggaggaggaggaggaggauacgccagucagccccaaggag

SEQ ID NO: 501946 - RNA, 64 nt, Human
acuggacauggggccuggggaggggagcuggccagaggaggaccccuuucccguggcauuagaa

SEQ ID NO: 501947 - RNA, 64 nt, Human
agugaaauguuaucucagggacauucaaacaaaggaggaggagucauagggaagagaaagaaau

SEQ ID NO: 501948 - RNA, 64 nt, Human
aucucaguccucacacaaccaucccuguuuuauagaggaggaaguggcuuagagaauguaacug

SEQ ID NO: 501949 - RNA, 64 nt, Human
ggccugucacugacugguuuaccaaagucgaugugaggaggaggcuuuauaccugaggggauga

SEQ ID NO: 501950 - RNA, 64 nt, Human
aagggagggcgggcuagaaggccaaaagaaggaugaggaggacaauaauauuuauuuuugcauc

SEQ ID NO: 501951 - RNA, 64 nt, Human
ucgccggccggucucaggccgcacagacguuccagaggaggagggugacauuuuuacucccuuu

SEQ ID NO: 501952 - RNA, 64 nt, Human
ucugcauagaauucaaacgagauucacccagcgcgaggaggaagaaacagcaguuccugggaac

SEQ ID NO: 501953 - RNA, 64 nt, Human
gugcccgaaccgccgcuggggccucggagacuuggaggaggacgcucuggaaccaucaucccgc

SEQ ID NO: 501954 - RNA, 64 nt, Human
ucucgggccagccccuccucuccccgccuucugggaggaggaggucacacgcugaugggcacug

SEQ ID NO: 501955 - RNA, 64 nt, Human
caagagccagcuugcaccacccaccugggaggccgaggaggagguccccugggcacagggccuc

SEQ ID NO: 501956 - RNA, 64 nt, Human
cuggcccccacccccgacucugaaucccgggcgggaggaggacccccgcaccgcccccucccca

SEQ ID NO: 501957 - RNA, 64 nt, Human; identical to SEQ ID NO: 257836

SEQ ID NO: 501958 - RNA, 64 nt, Human; identical to SEQ ID NO: 257837

SEQ ID NO: 501959 - RNA, 64 nt, Human; identical to SEQ ID NO: 257838

SEQ ID NO: 501960 - RNA, 64 nt, Human
guggggggccucaggcgggaucucggggcggggggaggaggauggugaccuugggagucgcccu

SEQ ID NO: 501961 - RNA, 64 nt, Human
cacacgcaccagcucuauuugggggaaguguagugaggaggagcccagaggaccccaggggagu

SEQ ID NO: 501962 - RNA, 64 nt, Human
cagcuucgcuguccugauggcccugaccagccaggaggaggaucccgugcugacugucaucacc

SEQ ID NO: 501963 - RNA, 60 nt, Human
agugucuuccaguccccugacgaggacgaggaggaggacuaugagcaguggcuggagauc

SEQ ID NO: 501964 - RNA, 57 nt, Human
agugucuuccaguccccugacgaggacgaggaggaggacuaugagcaguggcuggag

SEQ ID NO: 501965 - RNA, 64 nt, Human
acagacaaugucgagggacaaaagauagaagauggaggaggaaagacauuauacgugggcuugg

SEQ ID NO: 501966 - RNA, 64 nt, Human
ggccaaguugggggcccaggaggcggggagggaggaggaggagaagaugcgcaguuaccucaug

SEQ ID NO: 501967 - RNA, 64 nt, Human
uagggccaaguugggggcccaggaggcggggagggaggaggaggagaagaugcgcaguuaccuc

SEQ ID NO: 501968 - RNA, 64 nt, Human
gugcuaaugccccuuggggaaauggggcugugaggaggaggauuauaacuuaggccuagccucu

SEQ ID NO: 501969 - RNA, 64 nt, Human
cuggugcuaaugccccuuggggaaauggggcugugaggaggaggauuauaacuuaggccuagcc

SEQ ID NO: 501970 - RNA, 60 nt, Human
ccagccagcaguccaaguagcuggacccacgaggaggaaccaggcuacuuuccccaguac

SEQ ID NO: 501971 - RNA, 64 nt, Human
uucaucuggaaguuaaagugaggccacugaagaggaggaggagggucuagaggccugaaauccu

SEQ ID NO: 501972 - RNA, 64 nt, Human
aacuucaucuggaaguuaaagugaggccacugaagaggaggaggagggucuagaggccugaaau

SEQ ID NO: 501973 - RNA, 64 nt, Human
ggaaaaggaggggagaggaggggaaggggaggcagaggaggaacaucuggaaaaaaagcagccu

SEQ ID NO: 501974 - RNA, 64 nt, Human
augcuuccccugggaaucuaaacugggaauggccgaggaggaaggggcuccgugcacuugcagg

SEQ ID NO: 501975 - RNA, 64 nt, Human; identical to SEQ ID NO: 257899

SEQ ID NO: 501976 - RNA, 64 nt, Human; identical to SEQ ID NO: 257900

SEQ ID NO: 501977 - RNA, 64 nt, Human; identical to SEQ ID NO: 257901

SEQ ID NO: 501978 - RNA, 64 nt, Human
caggggugggaggcagguggacuccuggguccccgaggaggaggggacuggggucccggauucu

SEQ ID NO: 501979 - RNA, 64 nt, Human
guguggagugaaagagucacuguggugggggcgagaggaggacuugggagcuggaggugugaca

SEQ ID NO: 501980 - RNA, 64 nt, Human
acccagccugucacgacagagccugggcacuucagaggaggagccaggaucgaauggaaggggg

SEQ ID NO: 501981 - RNA, 64 nt, Human
uuaccugguauucuuugaauuuuuuuuuuuuuuggaggaggaagagagcaacaaauuugauuau

SEQ ID NO: 501982 - RNA, 64 nt, Human
gcuggccugauacgugucaaaggagagagggauagaggaggauugaauagaaggagacuaagac

SEQ ID NO: 501983 - RNA, 64 nt, Human
ucaccauggugcccaucguguuacuccauugucagaggaggaaacggggucaggcaggaaagca

SEQ ID NO: 501984 - RNA, 64 nt, Human
cccccaucccuaggcuaaagagccaugaguccuggaggaggagaggaccccucccaaaggacug

SEQ ID NO: 501985 - RNA, 64 nt, Human
gauaauuacaaacgggucacagguacuagucuuggaggaggaacuuuuuuuggucucugcuguc

SEQ ID NO: 501986 - RNA, 64 nt, Human
ccccaaaguuuagggauugaaaacaugcuucuuugaggaggaaaccccuuuagguucagaagaa

SEQ ID NO: 501987 - RNA, 64 nt, Human
aacauuuggcugggucauuuuaauaguuagagaugaggaggaguaaaagugaaauuuuugugaa

SEQ ID NO: 501988 - RNA, 64 nt, Human
uuccucuagucaagugugauauaucaagaaaucugaggaggaugcagguuuugugguccugaug

SEQ ID NO: 501989 - RNA, 61 nt, Human
agcugcaaacccucaucugaagaggacgaaugaggaggaccacuguggugcaugcugguga

SEQ ID NO: 501990 - RNA, 64 nt, Human
aucccuuucugaaauucuccaacucucuggucaggaggaggagcaccauuggggcgggguaggc

SEQ ID NO: 501991 - RNA, 64 nt, Human
gagaaaaaaagaaaauuccccacuuggaaagaaagaggaggaacacuggauucuuacuuucugg

SEQ ID NO: 501992 - RNA, 64 nt, Human
accaagggaaggccccauuccggggcuguuccccgaggaggaagggaaggggcucugugugccc

SEQ ID NO: 501993 - RNA, 64 nt, Human; identical to SEQ ID NO: 257895

SEQ ID NO: 501994 - RNA, 64 nt, Human; identical to SEQ ID NO: 257896

SEQ ID NO: 501995 - RNA, 64 nt, Human; identical to SEQ ID NO: 257897

SEQ ID NO: 501996 - RNA, 64 nt, Human
agacuccaaggagcuacugacauuccuaagaguggaggaggaggaggagccuugcugggccagg

SEQ ID NO: 501997 - RNA, 64 nt, Human
cuccaaggagcuacugacauuccuaagaguggaggaggaggaggagccuugcugggccagggaa

SEQ ID NO: 501998 - RNA, 64 nt, Human
caaggagcuacugacauuccuaagaguggaggaggaggaggagccuugcugggccagggaaaca

SEQ ID NO: 501999 - RNA, 64 nt, Human
uagggccugcauggagaaggguucugcccugccugaggaggaggacacagcacaagggcacauu

SEQ ID NO: 502000 - RNA, 64 nt, Human
ggccugcauggagaaggguucugcccugccugaggaggaggacacagcacaagggcacauugcc

SEQ ID NO: 502001 - RNA, 64 nt, Human
cuuuuuuaaacaaagaacuuugcacuuggccagagaggaggagaaagcccauuuucucccuucc

SEQ ID NO: 502002 - RNA, 63 nt, Human
gcgagccucaccccacuuaacauauccugcggggaggaggagccccaggggugcuagucugga

SEQ ID NO: 502003 - RNA, 64 nt, Human
cuggggcccuagaagccggggcggccccagcggggaggaggagcaaggacauguaccaugccag

SEQ ID NO: 502004 - RNA, 64 nt, Human
cggguucaacuaaauccaggaggagcuguggucagaggaggagccggcgccuggccacgccaac

SEQ ID NO: 502005 - RNA, 64 nt, Human
gcagaguugcagaggucccuguagagauaaagcugaggaggaggcugugugugauggcucuggc

SEQ ID NO: 502006 - RNA, 64 nt, Human
gcuuuucccugugggccagggaugcucggucccagaggaggaccuagugacaucaugggacagg

SEQ ID NO: 502007 - RNA, 64 nt, Human
ugcguuggcagaacccugggugggcaggcacccggaggaggagcagcagcugugucauccugug

SEQ ID NO: 502008 - RNA, 64 nt, Human
ggcccaguaugauucuguugucgcugaucucccggaggaggaggcuguugaccugaaaacagug

SEQ ID NO: 502009 - RNA, 64 nt, Human
ccagacuuugaugacuagcacccaccccauagcugaggaggagucacaguggaacugucccagc

SEQ ID NO: 502010 - RNA, 64 nt, Human
gacagccugggguuccccugaggggcacgggcuggaggaggaggcauggcacaagugacccugg

SEQ ID NO: 502011 - RNA, 64 nt, Human; identical to SEQ ID NO: 257902

SEQ ID NO: 502012 - RNA, 64 nt, Human; identical to SEQ ID NO: 257903

SEQ ID NO: 502013 - RNA, 64 nt, Human; identical to SEQ ID NO: 257904

SEQ ID NO: 502014 - RNA, 64 nt, Human
cuacccccuucucuuccaaguuucccacucacuugaggaggaaaaauggcaaaagaaagcuguc

SEQ ID NO: 502015 - RNA, 64 nt, Human
aacagcaugaacucagagcauuguuuuaggguuggaggaggaacacgcuuucuuuacaucacua

SEQ ID NO: 502016 - RNA, 64 nt, Human
gucucccugccugucaaucaccaccuuuccuccagaggaggaaaauuaucuccccugcaaagcc

SEQ ID NO: 502017 - RNA, 64 nt, Human
gugacaucgccgggggagguugugggcaacgguggaggaggagagacgggaggggaccauuugg

SEQ ID NO: 502018 - RNA, 64 nt, Human
ugcugccagagagaccugcugccggagagaaggggaggaggacuccagcugggcucgguccccc

SEQ ID NO: 502019 - RNA, 64 nt, Human
aggaucucccuggggcaggaaguggguggacuuggaggaggaacggcaagggccgguccccaca

SEQ ID NO: 502020 - RNA, 64 nt, Human
caguucugcgccuuggggccagccaguacucagagaggaggaccuucucaaccacguacagaac

SEQ ID NO: 502021 - RNA, 64 nt, Human
ccucgggagaccccguggcugucuccgccccaucgaggaggaggcccgucagccauggcugcca

SEQ ID NO: 502022 - RNA, 64 nt, Human
ugccuuaucgucugcaaguguucuccaagggaaggaggaggaaacugugguguuccuuucuucc

SEQ ID NO: 502023 - RNA, 64 nt, Human
aauaguagcaagagcugcaaagcaggcaggaagggaggaggagagccaggugagcaguggagag

SEQ ID NO: 502024 - RNA, 64 nt, Human
gagugccugaggcaggagaauugcaugaacccgggaggaggaggaggagguugcagugagccga

SEQ ID NO: 502025 - RNA, 64 nt, Human
ugccugaggcaggagaauugcaugaacccgggaggaggaggaggagguugcagugagccgagau

SEQ ID NO: 502026 - RNA, 64 nt, Human
cugaggcaggagaauugcaugaacccgggaggaggaggaggagguugcagugagccgagauagc

SEQ ID NO: 502027 - RNA, 64 nt, Human
cgcucuucacucuggccucgcugagcggcugcccgaggaggagcucuaggccgacgcccaccgc

SEQ ID NO: 502028 - RNA, 64 nt, Human
ugucuuuagagcacagggacagagggggaaauaagaggaggagaaagcucucuauaccaaagac

SEQ ID NO: 502029 - RNA, 64 nt, Human; identical to SEQ ID NO: 257909

SEQ ID NO: 502030 - RNA, 64 nt, Human; identical to SEQ ID NO: 257910

SEQ ID NO: 502031 - RNA, 64 nt, Human; identical to SEQ ID NO: 257911

SEQ ID NO: 502032 - RNA, 64 nt, Human
ugagcgugugauuguagacagaggggugaagaaggaggaggaagaggcagagaaggaggagacc

SEQ ID NO: 502033 - RNA, 64 nt, Human
ugggagggaguuacugaagucuuacuacagaaaugaggaggaugcuaaaaaugucacgaauaug

SEQ ID NO: 502034 - RNA, 64 nt, Human
ugugagcaacccacccacuggaagaucaccuacugaggaggauccuccagggccgcuccccgga

SEQ ID NO: 502035 - RNA, 64 nt, Human
ccaggucaggcuguccacaccacaugggagcccagaggaggaggggcccgccuuagccauguga

SEQ ID NO: 502036 - RNA, 64 nt, Human
cggccucuagcacccagaaacagggaggguccucgaggaggacacaccagggucucagccuuuu

SEQ ID NO: 502037 - RNA, 64 nt, Human
agcugaccuguuggcugaaaaggcccagaucaccgaggaggaggcaaaacuucuggcccagaag

SEQ ID NO: 502038 - RNA, 64 nt, Human
aaugcagcgcaucaaggccacagcgauucgcacggaggaggagaagcgccugauggagcagaag

SEQ ID NO: 502039 - RNA, 64 nt, Human
gcagccagcucugucuccagggaggccuggccuggaggaggaguccacuaacaggaaacacuuc

SEQ ID NO: 502040 - RNA, 64 nt, Human
gauggcuacucaccccucugggauggcuaugggagaggaggagugauggggaccgccaccuuuu

SEQ ID NO: 502041 - RNA, 64 nt, Human
gauggccccaaagcugggccagaguuaagggaaagaggaggaaguccuaagcagagaaguagca

SEQ ID NO: 502042 - RNA, 64 nt, Human
cccgccgaccguggcguuggcccugcuguccucagaggaggaggaggaggaggcagcuccggca

SEQ ID NO: 502043 - RNA, 64 nt, Human
gccgaccguggcguuggcccugcuguccucagaggaggaggaggaggaggcagcuccggcagcc

SEQ ID NO: 502044 - RNA, 64 nt, Human
gaccguggcguuggcccugcuguccucagaggaggaggaggaggaggcagcuccggcagccaca

SEQ ID NO: 502045 - RNA, 64 nt, Human
cguggcguuggcccugcuguccucagaggaggaggaggaggaggcagcuccggcagccacagaa

SEQ ID NO: 502046 - RNA, 64 nt, Human
uagacuggggggaucagcugcccauugcucccaagaggaggagagggaggcugcagaugccugg

SEQ ID NO: 502047 - RNA, 64 nt, Human; identical to SEQ ID NO: 257912

SEQ ID NO: 502048 - RNA, 64 nt, Human; identical to SEQ ID NO: 257913

SEQ ID NO: 502049 - RNA, 64 nt, Human; identical to SEQ ID NO: 257914

SEQ ID NO: 502050 - RNA, 64 nt, Human
aagccaccuucaggccugggaaggaagacacugggaggaggagaggccuggaaagcuuugguag

SEQ ID NO: 502051 - RNA, 64 nt, Human
gccccuugaagacagcagaaugucccuuugcaaugaggaggagaucugggcugggcgggccagc

SEQ ID NO: 502052 - RNA, 64 nt, Human
cugucuuuacuuuaaucuccuaauccugucagcugaggaggauguaugucaccucaggaccaug

SEQ ID NO: 502053 - RNA, 64 nt, Human
cugggguccccccucucccugguuccaccuuucugaggaggagccuggagucagggcuggguuu

SEQ ID NO: 502054 - RNA, 64 nt, Human
augaccagaggauuauuuuccugccuuggcagaggaggaggagucaagggagcagggcagcucu

SEQ ID NO: 502055 - RNA, 64 nt, Human
uccaugaccagaggauuauuuuccugccuuggcagaggaggaggagucaagggagcagggcagc

SEQ ID NO: 502056 - RNA, 64 nt, Human
cuccugcuccugaaccaggaggcuucaugugggggaggaggagaggucuccaugugacacaugg

SEQ ID NO: 502057 - RNA, 64 nt, Human
ccagaggguggaaggcccuggcaggaagcaggaggaggaggagagggggguccaggucuuuuca

SEQ ID NO: 502058 - RNA, 64 nt, Human
gguccagaggguggaaggcccuggcaggaagcaggaggaggaggagagggggguccaggucuuu

SEQ ID NO: 502059 - RNA, 64 nt, Human
uucauuguccccagguaaguaugugaugagcaaugaggaggaguggaaaacaaaacccagaaag

SEQ ID NO: 502060 - RNA, 64 nt, Human
cugaggagugguggaccaggcucgaacacuggccgaggaggagcucucugccugccagaagagu

SEQ ID NO: 502061 - RNA, 64 nt, Human
aucuacucaacuauccgaauauguccauuucgcagaggaggaaagugaggcccagggagugcag

SEQ ID NO: 502062 - RNA, 64 nt, Human
ggacugguucugaggccagaaaggugugaggagagaggaggaaaagucuuccuaauugugcccc

SEQ ID NO: 502063 - RNA, 64 nt, Human
uuuucauaaaaaccaagcagaagugaagagaaaagaggaggacugauggaaagacagacucugg

SEQ ID NO: 502064 - RNA, 64 nt, Human
uggaaccucuccauauacuuucuaagcucugggggaggaggaggaugggaccuccuggacccag

SEQ ID NO: 502065 - RNA, 64 nt, Human; identical to SEQ ID NO: 257916

SEQ ID NO: 502066 - RNA, 64 nt, Human; identical to SEQ ID NO: 257917

SEQ ID NO: 502067 - RNA, 64 nt, Human; identical to SEQ ID NO: 257918

SEQ ID NO: 502068 - RNA, 64 nt, Human
aaccucuccauauacuuucuaagcucugggggaggaggaggaugggaccuccuggacccagcuu

SEQ ID NO: 502069 - RNA, 64 nt, Human
aaaugugaagaaacuccuuucaucucagcagguagaggaggacugaugacacgagcugccaugg

SEQ ID NO: 502070 - RNA, 64 nt, Human
auagaacaaucauggagccuaggagcagagagaugaggaggaguucauugcuucccagcuugug

SEQ ID NO: 502071 - RNA, 64 nt, Human
ccaguccugagagaacuccaucaauccaguccaagaggaggaggacgaaggccuagacucagcu

SEQ ID NO: 502072 - RNA, 64 nt, Human
guccugagagaacuccaucaauccaguccaagaggaggaggacgaaggccuagacucagcugaa

SEQ ID NO: 502073 - RNA, 64 nt, Human
acugcacugggagguccuggcugcugcgaagcuggaggaggacugcgugggcugagaugccacc

SEQ ID NO: 502074 - RNA, 64 nt, Human
aggguggcugugaagggaagucuuuguugcaaaggaggaggaggaaaagggaggacuugguagg

SEQ ID NO: 502075 - RNA, 64 nt, Human
guggcugugaagggaagucuuuguugcaaaggaggaggaggaaaagggaggacuugguaggguu

SEQ ID NO: 502076 - RNA, 64 nt, Human
gcuccucauccggacugaggaagacgaggacagggaggaggaaaaggaggaagaggaggacaaa

SEQ ID NO: 502077 - RNA, 64 nt, Human
ggaagacgaggacagggaggaggaaaaggaggaagaggaggacaaaaagggggaggagaagguu

SEQ ID NO: 502078 - RNA, 64 nt, Human
cagccaguguuuuuccugaccucuguucuuuggagaggaggauggaagggagggguccggcacg

SEQ ID NO: 502079 - RNA, 64 nt, Human
acccgcuccccugcgaccaugccaggcacgcugggaggaggacggcagcugcucguguccugcc

SEQ ID NO: 502080 - RNA, 64 nt, Human
auuuuuggugaacuguuguguccuuuaaaaaauggaggaggauagguucuuuggguaaauugag

SEQ ID NO: 502081 - RNA, 64 nt, Human
aggagucgagagagugcaguucagggaaaaaggagaggaggaaacagugaggcagggagaaagg

SEQ ID NO: 502082 - RNA, 64 nt, Human
aacauuugcuguagcaucuggucucacggacucugaggaggaauuggaaauuggucucuuuuga

SEQ ID NO: 502083 - RNA, 64 nt, Human; identical to SEQ ID NO: 257919

SEQ ID NO: 502084 - RNA, 64 nt, Human; identical to SEQ ID NO: 257920

SEQ ID NO: 502085 - RNA, 64 nt, Human; identical to SEQ ID NO: 257921

SEQ ID NO: 502086 - RNA, 64 nt, Human
uugauuuuaguauugcuucguguccuccacacaggaggaggauguauucagccuuuaggaugau

SEQ ID NO: 502087 - RNA, 64 nt, Human
cacccagccuuuucauuuucgauugcacagcggggaggaggaauggcuuuguggucgucguugu

SEQ ID NO: 502088 - RNA, 64 nt, Human
acaacuggguaugcaucagguaucuaauagcagggaggaggaaggccuguugcugcaaucauug

SEQ ID NO: 502089 - RNA, 64 nt, Human
agaagaggaggaggaggaggaggaggaggaggaggaggaggaggccagguccugguggagccuu

SEQ ID NO: 502090 - RNA, 64 nt, Human
ggaagaagaggaggaggaggaggaggaggaggaggaggaggaggaggccagguccugguggagc

SEQ ID NO: 502091 - RNA, 64 nt, Human
ggaggaagaagaggaggaggaggaggaggaggaggaggaggaggaggaggccagguccuggugg

SEQ ID NO: 502092 - RNA, 64 nt, Human
ggaggaggaagaagaggaggaggaggaggaggaggaggaggaggaggaggaggccagguccugg

SEQ ID NO: 502093 - RNA, 64 nt, Human
ggaggaggaggaagaagaggaggaggaggaggaggaggaggaggaggaggaggaggccaggucc

SEQ ID NO: 502094 - RNA, 64 nt, Human
ggaggaggaggaggaagaagaggaggaggaggaggaggaggaggaggaggaggaggaggccagg

SEQ ID NO: 502095 - RNA, 64 nt, Human
ggaggaggaggaggaggaagaagaggaggaggaggaggaggaggaggaggaggaggaggaggcc

SEQ ID NO: 502096 - RNA, 64 nt, Human
cccaaccccaugggaggaggaggaagaggaggaggaggaggaggaggaggaggaggaggaggag

SEQ ID NO: 502097 - RNA, 64 nt, Human
aaccccaaccccaugggaggaggaggaagaggaggaggaggaggaggaggaggaggaggaggag

SEQ ID NO: 502098 - RNA, 64 nt, Human
cccaaccccaaccccaugggaggaggaggaagaggaggaggaggaggaggaggaggaggaggag

SEQ ID NO: 502099 - RNA, 64 nt, Human
aaucccaaccccaaccccaugggaggaggaggaagaggaggaggaggaggaggaggaggaggag

SEQ ID NO: 502100 - RNA, 64 nt, Human
cauggcccuaaucccaaccccaaccccaugggaggaggaggaagaggaggaggaggaggaggag

SEQ ID NO: 502101 - RNA, 64 nt, Human; identical to SEQ ID NO: 257839

SEQ ID NO: 502102 - RNA, 64 nt, Human; identical to SEQ ID NO: 257840

SEQ ID NO: 502103 - RNA, 64 nt, Human; identical to SEQ ID NO: 257841

SEQ ID NO: 502104 - RNA, 64 nt, Human
gaucauggcccuaaucccaaccccaaccccaugggaggaggaggaggaggaagaagaggaggag

SEQ ID NO: 502105 - RNA, 64 nt, Human
augugaucaggccccaccccuguaaucaggcaaggaggaggagucagaugaggcccugcaccuu

SEQ ID NO: 502106 - RNA, 64 nt, Human
guccugagagaacuccaucaauccaguccaagaggaggaggacgaaggauccucacaggaggau

SEQ ID NO: 502107 - RNA, 64 nt, Human
ccaguccugagagaacuccaucaauccaguccaagaggaggaggacgaaggauccucacaggag

SEQ ID NO: 502108 - RNA, 64 nt, Human
ucucccucucccuuccccugacuguuccacccaggaggaggaaacuucacauagccgugcucac

SEQ ID NO: 502109 - RNA, 57 nt, Human
gcaucucccucuugagcuaggaacccagaggaggaggccucaauagagcacugccua

SEQ ID NO: 502110 - RNA, 64 nt, Human
agacaaagacaagagcaucagacaaaggaaaagagaggaggauagagucaaggucaguucagga

SEQ ID NO: 502111 - RNA, 64 nt, Human
caaagagacuagaagagucuuaaauuauaugugggaggaggagggauagaacaucacaacacug

SEQ ID NO: 502112 - RNA, 64 nt, Human
uggcaaaugugaugugcucccuuccagcuggugagaggaggaguuagagcuggucguuuuguga

SEQ ID NO: 502113 - RNA, 64 nt, Human
uuccuacccaucccugcaugaagcagcuuugagagaggaggaagagggagucugagcaugagcu

SEQ ID NO: 502114 - RNA, 64 nt, Human
caguucauugugggggccugauuguuugucgcuggaggaggacggcuuacauguuuguuucugu

SEQ ID NO: 502115 - RNA, 64 nt, Human; identical to SEQ ID NO: 502114

SEQ ID NO: 502116 - RNA, 64 nt, Human
uggcccagcgcguccuuggaaaucuguggcccuggaggaggaacaggagggcccugggaccagg

SEQ ID NO: 502117 - RNA, 64 nt, Human; identical to SEQ ID NO: 257926

SEQ ID NO: 502118 - RNA, 64 nt, Human; identical to SEQ ID NO: 257927

SEQ ID NO: 502119 - RNA, 64 nt, Human; identical to SEQ ID NO: 257928

SEQ ID NO: 502120 - RNA, 64 nt, Human; identical to SEQ ID NO: 257929

SEQ ID NO: 502121 - RNA, 64 nt, Human; identical to SEQ ID NO: 257930

SEQ ID NO: 502122 - RNA, 64 nt, Human; identical to SEQ ID NO: 257931

SEQ ID NO: 502123 - RNA, 59 nt, Human
ccucgccuggcgggaccccgcagcagccccggccccauccccgcccagagccgggcguc

SEQ ID NO: 502124 - RNA, 59 nt, Human
acguuggagccgagccugaacaugccccucggccccagcacauggaaaacccccuuccu

SEQ ID NO: 502125 - RNA, 59 nt, Human
agcgggggcugcagccgaccgcccugcuccggccccaguguggugggcgaggguggcgc

SEQ ID NO: 502126 - RNA, 59 nt, Human
aggacgugaggggcuggcagcaggcagggcggccccaggccucugcccuccucucaggu

SEQ ID NO: 502127 - RNA, 59 nt, Human
ugccuuucugggagcagaaacagccauugcggccccaggaggggaacugagucacgcug

SEQ ID NO: 502128 - RNA, 59 nt, Human
guauacaucaucucauuuaaucuucacaacggccccaggagauaaguacuaacuuucuc

SEQ ID NO: 502129 - RNA, 59 nt, Human
augaucauggaagcuuggcucugaccccacggccccagcuggagcuggcugagagcagu

SEQ ID NO: 502130 - RNA, 59 nt, Human
uuuccuuuaccuacccaaauccuauaaaacggccccaccccuaucucccuucgcugaca

SEQ ID NO: 502131 - RNA, 64 nt, Human; identical to SEQ ID NO: 257933

SEQ ID NO: 502132 - RNA, 64 nt, Human; identical to SEQ ID NO: 257934

SEQ ID NO: 502133 - RNA, 64 nt, Human; identical to SEQ ID NO: 257935

SEQ ID NO: 502134 - RNA, 64 nt, Human; identical to SEQ ID NO: 257936

SEQ ID NO: 502135 - RNA, 59 nt, Human
ggguaaugcucauaaaaggacuguucccgcggccccaaggugccuguuguucacacuua

SEQ ID NO: 502136 - RNA, 59 nt, Human
cggucacugcuguguucagccccucagcucggccccagccuauuucccgccuccauuug

SEQ ID NO: 502137 - RNA, 59 nt, Human
cagccagugcagugagaacagcagccccacggccccaugggaggcggcgcugcucuccc

SEQ ID NO: 502138 - RNA, 59 nt, Human
cuggcacggcccugcguagcagcaccagccggccccaccccugcucgccccuaucgcuc

SEQ ID NO: 502139 - RNA, 59 nt, Human
aucuccauuuuuuaaaaagguuucucugacggccccacggcccgagccgcggugagcgu

SEQ ID NO: 502140 - RNA, 59 nt, Human
gcauugucacuuggaucuuguggugaggacggccccaucuuucuugccacagauugagg

SEQ ID NO: 502141 - RNA, 59 nt, Human
aggcuuccaggcucuuccuggaccugagucggccccacaugggaaccuaguacucucug

SEQ ID NO: 502142 - RNA, 59 nt, Human
cugcaggaguguccugcccaugccccagucggccccaucucucauccuuuuggauaagu

SEQ ID NO: 502143 - RNA, 59 nt, Human
ccaucugucccuccguccaggagcucucacggccccaucuguuguaccuucccauguau

SEQ ID NO: 502144 - RNA, 59 nt, Human
cccggugagggcggcaggcagggguuauccggccccacuuucuggaugacagacuugag

SEQ ID NO: 502145 - RNA, 59 nt, Human
aauggucugugcuuuaaaugguaacgcuacggccccaggucacugcgaggcacuuacca

SEQ ID NO: 502146 - RNA, 59 nt, Human
ggccagggccuaacaguguuucuuccccucggccccacggcccauacucaccccuucac

SEQ ID NO: 502147 - RNA, 59 nt, Human
cuucacaaucccagaguggcaggcgggaccggccccauggucuggcuccugucaccugg

SEQ ID NO: 502148 - RNA, 59 nt, Human
ccauucugcuuucuugccacacagugggccggccccaggcuccccuggucuccuccccg

SEQ ID NO: 502149 - RNA, 59 nt, Human
cucgucagggcccugcagugacggcgccccggccccacacucgccucccgggccccacg

SEQ ID NO: 502150 - RNA, 64 nt, Human; identical to SEQ ID NO: 257937

SEQ ID NO: 502151 - RNA, 64 nt, Human; identical to SEQ ID NO: 257938

SEQ ID NO: 502152 - RNA, 64 nt, Human; identical to SEQ ID NO: 257939

SEQ ID NO: 502153 - RNA, 59 nt, Human
cugggauuacaggcaugagccaccgcgcccggccccaaucaucuguuuuuaaacaaucg

SEQ ID NO: 502154 - RNA, 59 nt, Human
gccagaagcacccagcccugcccagcaaccggccccagcagcagguccuggugcuggcg

SEQ ID NO: 502155 - RNA, 59 nt, Human
gcccuccccucagcgcaggcugcagagcccggccccaccucccugcgcccuugaggggc

SEQ ID NO: 502156 - RNA, 59 nt, Human
cuggcgugagaggagcggcagccacacugcggccccacgcccaaggacugggcugcucu

SEQ ID NO: 502157 - RNA, 59 nt, Human
cucggaccagaccccccuccacagcugcccggccccagacccaucucuuggauugaggg

SEQ ID NO: 502158 - RNA, 59 nt, Human
uggcgguguccaggggcgccccgccccugcggccccaccagguacugaaagacccgcag

SEQ ID NO: 502159 - RNA, 59 nt, Human
ucuaaggacaaaaccgagucggucaccagcggccccauguccccagagggcucaccuuc

SEQ ID NO: 502160 - RNA, 59 nt, Human
gcuguccugugagagccccugccccagagcggccccacuaagcgcauguggcuccuggg

SEQ ID NO: 502161 - RNA, 56 nt, Human; identical to SEQ ID NO: 313978

SEQ ID NO: 502162 - RNA, 59 nt, Human
cgguugagccuggcagaguaccaugcgcucggccccagcugcaggaaacagcaggcccc

SEQ ID NO: 502163 - RNA, 59 nt, Human
acaagacccccggggaaugcaggugcugccggccccaggaccccucuucaagagccacu

SEQ ID NO: 502164 - RNA, 59 nt, Human
uguccuuggccaggcccaaggagaggacucggccccauggggugugccagucuugcagu

SEQ ID NO: 502165 - RNA, 59 nt, Human
cuggaacaagccccuccagaugagugccccggccccaggccagcuucacugccgucucu

SEQ ID NO: 502166 - RNA, 59 nt, Human
ugauaaaagauggccauauuaccccuuuucggccccauguaucucaguaccccauggag

SEQ ID NO: 502167 - RNA, 59 nt, Human
gugaguggugggcaggccaguggcagggccggccccagccccugcauggauuccuugug

SEQ ID NO: 502168 - RNA, 64 nt, Human; identical to SEQ ID NO: 257944

SEQ ID NO: 502169 - RNA, 64 nt, Human; identical to SEQ ID NO: 257945

SEQ ID NO: 502170 - RNA, 64 nt, Human; identical to SEQ ID NO: 257946

SEQ ID NO: 502171 - RNA, 59 nt, Human
ccuaccucugugcccuguaccagcagaggcggccccacgugggcugugcuacauacagg

SEQ ID NO: 502172 - RNA, 59 nt, Human
aaauguaucccuugaccaacaucacugcccggccccagccccagguaaacaccauucua

SEQ ID NO: 502173 - RNA, 59 nt, Human
cagcuugagccugucacguggucaaggcccggccccaucagaggcugggggaggcggca

SEQ ID NO: 502174 - RNA, 59 nt, Human
caacagcagugagcccugggcagaugccccggccccagggcuucccccaggaacuccau

SEQ ID NO: 502175 - RNA, 53 nt, Human; identical to SEQ ID NO: 314343

SEQ ID NO: 502176 - RNA, 59 nt, Human
uugugaggaggccugucugcaucuccuuccggccccacugggguccaggggugcccaga

SEQ ID NO: 502177 - RNA, 59 nt, Human
ccaugugagccuuugcuuuccucuggccccggccccacccugaacacagcucauacaca

SEQ ID NO: 502178 - RNA, 59 nt, Human
ccugcucacucaugggggcuuccagaccccggccccaccagggcuugugucauagggag

SEQ ID NO: 502179 - RNA, 59 nt, Human
ucaguggggaaaagggcagaaccagugcccggccccacacugccucuguggccuggacu

SEQ ID NO: 502180 - RNA, 59 nt, Human
gcagaacucucugacuggggccccuggcccggccccacccagccgacauguuuucuuug

SEQ ID NO: 502181 - RNA, 59 nt, Human
cuagccaggcuggcacugccacucacacucggccccagggcccaggagggacagugccu

SEQ ID NO: 502182 - RNA, 59 nt, Human
caagagucgagccggcagagcaaggggcgcggccccagggcccugcgcccacuuugcac

SEQ ID NO: 502183 - RNA, 59 nt, Human
ucucuugucucucccucugaagauggacucggccccacauacacauuuuuguguuacag

SEQ ID NO: 502184 - RNA, 59 nt, Human
ccagcaccugcccucccagucucccaccccggccccaggcuggaagcccucccuccacu

SEQ ID NO: 502185 - RNA, 59 nt, Human
agccuuacgcgcccgacgcgcgccacccgcggccccagcuuuccgccugcacccgcgag

SEQ ID NO: 502186 - RNA, 64 nt, Human; identical to SEQ ID NO: 257947

SEQ ID NO: 502187 - RNA, 64 nt, Human; identical to SEQ ID NO: 257948

SEQ ID NO: 502188 - RNA, 64 nt, Human; identical to SEQ ID NO: 257949

SEQ ID NO: 502189 - RNA, 59 nt, Human
uacugggaucccuaaaaacgccccugguccggccccacucugcgccccucgaucuccca

SEQ ID NO: 502190 - RNA, 59 nt, Human
gaaccugcgucuuggaccauugccccucccggccccaaaccacaggggcucaggucgug

SEQ ID NO: 502191 - RNA, 59 nt, Human
ugcagauuccuccaugucagcucccaucacggccccaaagacagagucacuugguugcu

SEQ ID NO: 502192 - RNA, 59 nt, Human
cacuuggucaucugagccuugaguguguccggccccagccaccagccuguccccacuau

SEQ ID NO: 502193 - RNA, 59 nt, Human
gcguccucugugggggcugccggaagacacggccccaggagucaggccccuguggucag

SEQ ID NO: 502194 - RNA, 59 nt, Human
aagcggcagcaucggaugucagcccccugcggccccagcuggagauggauaugagacua

SEQ ID NO: 502195 - RNA, 59 nt, Human
ugcuagccuagucccuggaggagggaguccggccccaggccagggacuaaggagcaaug

SEQ ID NO: 502196 - RNA, 59 nt, Human
uuucuccaugggagcuccuggugccgccucggccccagccuguccccagccccucaauc

SEQ ID NO: 502197 - RNA, 59 nt, Human
cagcucccacccagccugacggcgccucccggccccaagcugccuuccucgauguggcc

SEQ ID NO: 502198 - RNA, 59 nt, Human
cuugcaggcuagcucccgcccugccugcccggccccaccgaggccugagcacguucccg

SEQ ID NO: 502199 - RNA, 59 nt, Human
gggccucagcuucccuucccacauuccuccggccccaggagcaaccccuugggcuaggu

SEQ ID NO: 502200 - RNA, 59 nt, Human
ugugcgaguucccuugccacgcggggccccggccccaucaagucccucuggggacgucc

SEQ ID NO: 502201 - RNA, 59 nt, Human
ucccggcucugugcgggccgcacccuggacggccccauccggacgcugaagcugccguu

SEQ ID NO: 502202 - RNA, 59 nt, Human
caccgcucagggcagggaggucugaacugcggccccagagccuuuggccuaagcuggac

SEQ ID NO: 502203 - RNA, 59 nt, Human
uguggggcuugugggaggggcacauacaucggccccaggauucuaacaucuccuggucu

SEQ ID NO: 502204 - RNA, 64 nt, Human; identical to SEQ ID NO: 257841

SEQ ID NO: 502205 - RNA, 64 nt, Human; identical to SEQ ID NO: 257842

SEQ ID NO: 502206 - RNA, 64 nt, Human; identical to SEQ ID NO: 257843

SEQ ID NO: 502207 - RNA, 59 nt, Human
ggguuuugaacuagguggauacuaaaucucggccccacucuucauuggcuuaaccuaaa

SEQ ID NO: 502208 - RNA, 59 nt, Human
cucaggugccacagccugguucggccuggcggccccaggaggcagcagcaaccuugggc

SEQ ID NO: 502209 - RNA, 59 nt, Human
gaggaugugggagggcccuggacauggcccggccccacugcugagugcccgugucccca

SEQ ID NO: 502210 - RNA, 59 nt, Human
uccagcggugccugccacugaggcaggugcggccccaggaccaucaccaggaaugcgag

SEQ ID NO: 502211 - RNA, 59 nt, Human
agcgccaacgagcagugccgcguggccuucggccccaaggcugucgccugcaccuucgc

SEQ ID NO: 502212 - RNA, 59 nt, Human
cagcacuuuuuauacagaggacaccgccucggccccacguccuuagaggccagagcaca

SEQ ID NO: 502213 - RNA, 59 nt, Human
cauccgggauagggcagaggaggugcuggcggccccagggaaggaggguguguacccca

SEQ ID NO: 502214 - RNA, 59 nt, Human
guuuuaugggccuguguauccccuucucccggccccagccugccucccuccugcccgcc

SEQ ID NO: 502215 - RNA, 58 nt, Human; identical to SEQ ID NO: 314377

SEQ ID NO: 502216 - RNA, 59 nt, Human
acccgauucuggggagcaucuucccgcuccggccccacgaccuccacaggguuacauug

SEQ ID NO: 502217 - RNA, 59 nt, Human
aaagacacugccugggcugaccccgguggcggccccagcaccucagccugcacaguguc

SEQ ID NO: 502218 - RNA, 59 nt, Human
gcccccagccagcgcuccagccaaagcggcggccccaggguuaauugcggagaacagga

SEQ ID NO: 502219 - RNA, 59 nt, Human
gcugcugcaccaaccucacugcccucccucggccccacccacccucugguccuucugac

SEQ ID NO: 502220 - RNA, 59 nt, Human
uguguggauguggcccgagcaggcucaggcggccccacucacccacagcauccgccgcc

SEQ ID NO: 502221 - RNA, 59 nt, Human
acacauggccucgccaucguggguaaaaucggccccacagcacgucugcaccagcgggc

SEQ ID NO: 502222 - RNA, 64 nt, Human; identical to SEQ ID NO: 257848

SEQ ID NO: 502223 - RNA, 64 nt, Human; identical to SEQ ID NO: 257849

SEQ ID NO: 502224 - RNA, 64 nt, Human; identical to SEQ ID NO: 257850

SEQ ID NO: 502225 - RNA, 59 nt, Human
cugcagcugggugaccagagccccgggcacggccccagcuccguggggcucucacggug

SEQ ID NO: 502226 - RNA, 59 nt, Human
aacggaguacagacgucucaagacugaaacggccccauugccuggucuaguagcggauc

SEQ ID NO: 502227 - RNA, 59 nt, Human
auuguucucuauccuccccugacccccgacggccccaugcuaggugcaccaucuuccuc

SEQ ID NO: 502228 - RNA, 59 nt, Human
cacauucugggaagcaucaaauagacacacggccccagccaccugcaacuuaugugcac

SEQ ID NO: 502229 - RNA, 59 nt, Human
guuugcuugcuugaaaccuaaucuauagacggccccacagcucgugcacacacugcuuc

SEQ ID NO: 502230 - RNA, 59 nt, Human
acacugguuccccacugcccugugccuuccggccccagaaggaucuuccuggaugccaa

SEQ ID NO: 502231 - RNA, 59 nt, Human
ugcucuggugaggcagccucuguuuaaaccggccccacaugaagagaacaucccuugag

SEQ ID NO: 502232 - RNA, 59 nt, Human
aagccaaaccugcugccacagcccucccccggccccagauagcagccccagggaggaug

SEQ ID NO: 502233 - RNA, 59 nt, Human
acaguuaccagcuuuccugaauggauucccggccccaucccucacccccacccucacuu

SEQ ID NO: 502234 - RNA, 59 nt, Human
uggccugccguugcccugagcugcagccucggccccaggauccugcucacagucaccgc

SEQ ID NO: 502235 - RNA, 59 nt, Human
gcuccaggagggaauaucuguugccccugcggccccagacaccagccagacccaggcug

SEQ ID NO: 502236 - RNA, 59 nt, Human
gccaccgccacccgcagcgagggcggagccggccccaggugcuccccugacagucccuc

SEQ ID NO: 502237 - RNA, 59 nt, Human
ggauucccuuccggaugcaggcgaggccgcggccccagaguccccgcaccaggcagagc

SEQ ID NO: 502238 - RNA, 59 nt, Human
caaauucaccguuaggaaacagugagcuccggccccaccucgugaacacaaagccucgg

SEQ ID NO: 502239 - RNA, 59 nt, Human
ggccagcccuguugucuuucaaagaaccucggccccagugauggcugaucucacuccca

SEQ ID NO: 502240 - RNA, 64 nt, Human; identical to SEQ ID NO: 257854

SEQ ID NO: 502241 - RNA, 64 nt, Human; identical to SEQ ID NO: 257855

SEQ ID NO: 502242 - RNA, 64 nt, Human; identical to SEQ ID NO: 257856

SEQ ID NO: 502243 - RNA, 59 nt, Human
cuauauuguagcuuugcuuaaaauggggucggccccaacugcauccuccucuuuggcgg

SEQ ID NO: 502244 - RNA, 53 nt, Human; identical to SEQ ID NO: 314400

SEQ ID NO: 502245 - RNA, 59 nt, Human
ugaacuggcucugagcacccugccgcccgcggccccagcuucaggacaagccccugcuu

SEQ ID NO: 502246 - RNA, 59 nt, Human
ucacugccugaccuggacuaagaaccccacggccccacuguccacacacugccucccca

SEQ ID NO: 502247 - RNA, 59 nt, Human
aaguaaaacuguacuguugcgugugcaagcggccccacuagagccuuccagccuucugg

SEQ ID NO: 502248 - RNA, 59 nt, Human
cugauaauucauuuuggauaggccuuucucggccccagacugagguaccauggcucugg

SEQ ID NO: 502249 - RNA, 59 nt, Human
cacgugguguugggacuggaaccauuaugcggccccauaggccucaggagucaucccag

SEQ ID NO: 502250 - RNA, 59 nt, Human
cccuccugccgcccagcuucgugacuccacggccccacgcgccccuugcugccuuccgc

SEQ ID NO: 502251 - RNA, 59 nt, Human
ggcuggggggcggggcggggagcggcaggcggccccacccugcacugguccaaggucgg

SEQ ID NO: 502252 - RNA, 59 nt, Human
gacgugcugcucccuugugugagugaccacggccccaagcccagggcuggaggcagguc

SEQ ID NO: 502253 - RNA, 59 nt, Human
cugcguccucucggugagcugugcagugccggccccagauccucacacccagggagcag

SEQ ID NO: 502254 - RNA, 59 nt, Human
aaacacuagagcugcagguaccagccacucggccccaggggguuauggccacagaggga

SEQ ID NO: 502255 - RNA, 59 nt, Human
gcucgccccuugacuggcuaaguggggcccggccccagcuggaucgaagggcggguugc

SEQ ID NO: 502256 - RNA, 59 nt, Human
ccacguccugccucucccugggguuuacacggccccaauaaagccugcucuggccuacg

SEQ ID NO: 502257 - RNA, 59 nt, Human
uugcugccacaccacauugccucaacaaccggccccagagugcccaggcacuccugagg

SEQ ID NO: 502258 - RNA, 51 nt, Human; identical to SEQ ID NO: 257951

SEQ ID NO: 502259 - RNA, 64 nt, Human; identical to SEQ ID NO: 257952

SEQ ID NO: 502260 - RNA, 64 nt, Human; identical to SEQ ID NO: 257953

SEQ ID NO: 502261 - RNA, 59 nt, Human
acugcuccucagcguccaguccuccugggcggccccagguccuggacaauaagcaacag

SEQ ID NO: 502262 - RNA, 59 nt, Human
gaaaccuuuagggcagcuugccccggccccggccccagccagaguuccugcggagugaa

SEQ ID NO: 502263 - RNA, 59 nt, Human
ugggugcccccccucucccuucuccuucccggccccaccaacacucugagauccgagag

SEQ ID NO: 502264 - RNA, 59 nt, Human
cucagcuauuacugcgcuuucccuccccacggccccaacuccagggcaggagcaacugg

SEQ ID NO: 502265 - RNA, 59 nt, Human
ccggcuccuccuugcggcgcugacccggccggccccacacccgcucuuccucuucuuug

SEQ ID NO: 502266 - RNA, 59 nt, Human
ucggcggggccccacucagagcagcuggccggccccaggcagugagggccuuagcaccu

SEQ ID NO: 502267 - RNA, 59 nt, Human
cugccggggugggaagaguuucucuccaucggccccaugcgggucaccucccuaguccc

SEQ ID NO: 502268 - RNA, 59 nt, Human
ccacucacaccauccuaugagcccacgcccggccccacucccaccauccugugaacccc

SEQ ID NO: 502269 - RNA, 59 nt, Human
ccauucacuccauccugugagaccacgcccggccccacucacucuauccugugagacca

SEQ ID NO: 502270 - RNA, 59 nt, Human
ccacucacaacaucuuguaagacugugcccggccccauucacuccauccugugagacca

SEQ ID NO: 502271 - RNA, 59 nt, Human
cacucacaccaaccugugagccccacucccggccccacucacaacaucuuguaagacug

SEQ ID NO: 502272 - RNA, 59 nt, Human
cacucccaccauccugugagccccacucccggccccacucacuccauccugugagcccc

SEQ ID NO: 502273 - RNA, 59 nt, Human
cacucacaccaaccugugagccccacucccggccccacucacuccaucuuguaagacua

SEQ ID NO: 502274 - RNA, 59 nt, Human
ccacucccaccauccugugagcccaugcccggccccacucacaccaaccugugagcccc

SEQ ID NO: 502275 - RNA, 59 nt, Human
ccucucacaccauccugugagaccacgcccggccccacucccaccaucuuguaagacug

SEQ ID NO: 502276 - RNA, 64 nt, Human; identical to SEQ ID NO: 257858

SEQ ID NO: 502277 - RNA, 64 nt, Human; identical to SEQ ID NO: 257859

SEQ ID NO: 502278 - RNA, 64 nt, Human; identical to SEQ ID NO: 257860

SEQ ID NO: 502279 - RNA, 59 nt, Human
ccgaguccucagguacagcgggcugugcccggccccacccccugggcagauguccccca

SEQ ID NO: 502280 - RNA, 59 nt, Human
aaccccauugcuaacaacaugguacauuccggccccaccacucagagccuuccgaagcc

SEQ ID NO: 502281 - RNA, 59 nt, Human
aucugcacacccgggcagugcucagagcccggccccaggcccccgcgcuccucacuccu

SEQ ID NO: 502282 - RNA, 59 nt, Human
cugcugcccugcccagcccgacccugccccggccccacuuccaccuugcgcauuuggua

SEQ ID NO: 502283 - RNA, 59 nt, Human
ucagccccaucgccccaacuccaaccucucggccccaucgccccaccgcagcuacuccc

SEQ ID NO: 502284 - RNA, 59 nt, Human
uaccuaaagguuccuugauauguccucuccggccccacuucguucucaguuccacuggu

SEQ ID NO: 502285 - RNA, 59 nt, Human
ccucuggggagggggccaucugcugcgcccggccccacugacagaucugaagagcacag

SEQ ID NO: 502286 - RNA, 59 nt, Human
accauuggggcucccagccaggcccuugucggccccaccagugccucucccugcugcuc

SEQ ID NO: 502287 - RNA, 59 nt, Human
ucuugcaacacugugaggggcagccagggcggccccaauaaagcccuugaauacuuuga

SEQ ID NO: 502288 - RNA, 59 nt, Human
cccccaggaaaggacgcauccaccgguagcggccccagcugacugucgccgugugcugg

SEQ ID NO: 502289 - RNA, 59 nt, Human
gaccccucccgggaccccucccggcugggcggccccacagacccgcuggaacccagcag

SEQ ID NO: 502290 - RNA, 59 nt, Human
caccacccuccccgacacacagguucaugcggccccaggggccucccuccuguugaaga

SEQ ID NO: 502291 - RNA, 59 nt, Human
gacaaguggucugggacagggaggagcaacggccccagcgcgcaacgcucugcgcguuc

SEQ ID NO: 502292 - RNA, 59 nt, Human
aguauccucagaaauguauucugcacccccggccccacccaugcugagggaaggggagc

SEQ ID NO: 502293 - RNA, 59 nt, Human
ggccgggagagcuucccugacgggagucgcggccccaccgaggcgucggccgcccgaag

SEQ ID NO: 502294 - RNA, 64 nt, Human; identical to SEQ ID NO: 257861

SEQ ID NO: 502295 - RNA, 61 nt, Human; identical to SEQ ID NO: 257862

SEQ ID NO: 502296 - RNA, 64 nt, Human; identical to SEQ ID NO: 257863

SEQ ID NO: 502297 - RNA, 59 nt, Human
gacucccuuucugccaccccaggcugguccggccccaggugugggguccgcucucucca

SEQ ID NO: 502298 - RNA, 59 nt, Human
uccuccaccacccuacaccccccuccccccggccccaagccccugugucuccuuguuac

SEQ ID NO: 502299 - RNA, 59 nt, Human
acuccgaugagcugcucaucgaccuggagcggccccagagcaacagcagcgcugucaca

SEQ ID NO: 502300 - RNA, 59 nt, Human
cucccgagcuccgacagcauuaccucacccggccccaucuguugccccgguccagcccu

SEQ ID NO: 502301 - RNA, 59 nt, Human
cagacugcaggggccgcgccuggcucaggcggccccacccccgggacguggggucacuu

SEQ ID NO: 502302 - RNA, 59 nt, Human
agcccaucccuccggccccugugccucugcggccccagcccagcucccagggccgucac

SEQ ID NO: 502303 - RNA, 59 nt, Human
ggcgacaggagccagcgggacgccgcacgcggccccagacucagggagcagggccaggc

SEQ ID NO: 502304 - RNA, 59 nt, Human
aaagcucaagagugacgugaggugggcaccggccccaagugcagagucaaggcagggag

SEQ ID NO: 502305 - RNA, 59 nt, Human
ccauguuuacagagggccccugggcugcgcggccccagccugggcacccugauuuuuaa

SEQ ID NO: 502306 - RNA, 59 nt, Human
ccagcccuggaccccagcagaugaggaaacggccccauuuacugaccccgcccccuuuu

SEQ ID NO: 502307 - RNA, 59 nt, Human
agaauggaggcaacgccagaauccagcaccggccccauuuacccaacucuguacaaagc

SEQ ID NO: 502308 - RNA, 59 nt, Human
ccuguguaaugucaaaaaaaaucaauaugcggccccauuuuguaaaggaucauuaaaau

SEQ ID NO: 502309 - RNA, 59 nt, Human
cugcuggagccgccugcagacgcgguccucggccccacgugaaccaggcucggcggcga

SEQ ID NO: 502310 - RNA, 59 nt, Human
gggaggagggggcacagcugugccaagcccggccccacugguguguccucacaauguga

SEQ ID NO: 502311 - RNA, 59 nt, Human
agaauaaaacuagccuaguccugucccuccggccccaguggagacaggcgucuaagaac

SEQ ID NO: 502312 - RNA, 64 nt, Human; identical to SEQ ID NO: 257865

SEQ ID NO: 502313 - RNA, 64 nt, Human; identical to SEQ ID NO: 257866

SEQ ID NO: 502314 - RNA, 64 nt, Human; identical to SEQ ID NO: 257867

SEQ ID NO: 502315 - RNA, 59 nt, Human
cgaagguggguggggccccucuguaaauacggccccaggguggugagagagucccaugc

SEQ ID NO: 502316 - RNA, 59 nt, Human
agaaggggaaagccuucaucuuggcgaaccggccccaccacccccuccuacccgggccu

SEQ ID NO: 502317 - RNA, 59 nt, Human
gcccucgcaccgcuccccaccccacucagcggccccaucggaacugagaauugcaaaac

SEQ ID NO: 502318 - RNA, 59 nt, Human
acugacagccugcaggguuuccuugggcgcggccccaaaauugccuucaaaacaaaccc

SEQ ID NO: 502319 - RNA, 59 nt, Human
ugaaccccucggccccgcccccguggacccggccccaccccgaauaccccggccacgcu

SEQ ID NO: 502320 - RNA, 59 nt, Human
cgccccgccccgccccgccccggcaggcccggccccaccccgccccgcccccgcugccu

SEQ ID NO: 502321 - RNA, 59 nt, Human
cggccugccucaccccugaauagcuccuucggccccaucuccauccucagcagaugaca

SEQ ID NO: 502322 - RNA, 59 nt, Human
ucaggcuccuggggcccuagaagccggggcggccccagcggggaggaggagcaaggaca

SEQ ID NO: 502323 - RNA, 59 nt, Human
guguccacacggugcauuccugucccccucggccccaggcuggcucagcucuccagugc

SEQ ID NO: 502324 - RNA, 59 nt, Human
cuuggugagcgccgccccaacgagacucgcggccccaggcccaggccccaccccggcgg

SEQ ID NO: 502325 - RNA, 59 nt, Human
ccagacuaccccggacccugucccugccgcggccccagccuugaccuguuugacuugag

SEQ ID NO: 502326 - RNA, 59 nt, Human
cagcgugacccaacuuuucuagugugccacggccccaccaccuccugcaguacccacac

SEQ ID NO: 502327 - RNA, 59 nt, Human
gacagccaugccagagagaggccuuugaccggccccagagcuaaaagcaccagagaaaa

SEQ ID NO: 502328 - RNA, 59 nt, Human
cauucccacccagcgcgcagucuccaccucggccccagcaaagcgcuaagcagccggag

SEQ ID NO: 502329 - RNA, 59 nt, Human
ggacugaggucgccgggaccacccugagccggccccaggcucguggacugagugggaag

SEQ ID NO: 502330 - RNA, 64 nt, Human; identical to SEQ ID NO: 257868

SEQ ID NO: 502331 - RNA, 64 nt, Human; identical to SEQ ID NO: 257872

SEQ ID NO: 502332 - RNA, 64 nt, Human; identical to SEQ ID NO: 257873

SEQ ID NO: 502333 - RNA, 59 nt, Human
gggcugcccagcgcccagcgugcacgggacggccccacgacagagggagucagcccggg

SEQ ID NO: 502334 - RNA, 59 nt, Human
ccgaggcgacgcaccucgaggguguccgccggccccagcacccaggggacgcgcuggaa

SEQ ID NO: 502335 - RNA, 59 nt, Human
gcugggauuauaggcaugagccaccaggccggccccaggauuuuauauuaagccuucuu

SEQ ID NO: 502336 - RNA, 59 nt, Human
ggcauggccugggucgcacccccuccccacggccccacccacagggaccucaacuucug

SEQ ID NO: 502337 - RNA, 59 nt, Human
agcggaaggagggacuucccaccggcauccggccccagugccauguuuuaucaucugga

SEQ ID NO: 502338 - RNA, 59 nt, Human
ggugcugggcuuuagagaacaugggaaggcggccccagaccugcgggaacgccuuuccc

SEQ ID NO: 502339 - RNA, 59 nt, Human
aaucagccgggaugccugcaucccacccccggccccagggcccaccacauaaaaucugg

SEQ ID NO: 502340 - RNA, 59 nt, Human
aaagugcugcacucaaaugaugggaaguccggccccaguacacaggggcuugacuuuuu

SEQ ID NO: 502341 - RNA, 59 nt, Human
uccuguugaauugccccugggccugcccccggccccauuugugccauaaaggguugcuu

SEQ ID NO: 502342 - RNA, 59 nt, Human
aggcagucccaggccugccgucuccagcacggccccaagguggacacuagccccugcug

SEQ ID NO: 502343 - RNA, 59 nt, Human
ucacauaccaccuucguccccccaggccccggccccacuccuggcucucauuauuuuua

SEQ ID NO: 502344 - RNA, 59 nt, Human
ucucacccugaggguccccagccucucaccggccccagcugaccucguccauucagccc

SEQ ID NO: 502345 - RNA, 59 nt, Human
cucacauucaaggcccuuccugucuuggccggccccacugcccccccauucuaugcccc

SEQ ID NO: 502346 - RNA, 59 nt, Human
auccccuagacacccucuguuuccuuucccggccccaccuggccggcccucugccccug

SEQ ID NO: 502347 - RNA, 59 nt, Human
gcggcgacugccgagcuccgcccuccaggcggccccacccgccugccguccuggggcgc

SEQ ID NO: 502348 - RNA, 64 nt, Human; identical to SEQ ID NO: 257875

SEQ ID NO: 502349 - RNA, 64 nt, Human; identical to SEQ ID NO: 257876

SEQ ID NO: 502350 - RNA, 64 nt, Human; identical to SEQ ID NO: 257877

SEQ ID NO: 502351 - RNA, 59 nt, Human
acgcggacaacugacccgccaggcgggagcggccccacacguguuugcuuaaagucugc

SEQ ID NO: 502352 - RNA, 59 nt, Human; identical to SEQ ID NO: 502153

SEQ ID NO: 502353 - RNA, 59 nt, Human
cuguucagggaggcagcucauuuccaccccggccccaggacacccagccugugccccac

SEQ ID NO: 502354 - RNA, 59 nt, Human
ucuugaucaggcuuucucaagcccuccaucggccccaccagaucuccauucuuugccau

SEQ ID NO: 502355 - RNA, 59 nt, Human
accuccgcugucaccacauccugagcacucggccccauccccccacaggagggaagcug

SEQ ID NO: 502356 - RNA, 59 nt, Human
auuugcccuccuccucagcuagggccacgcggccccacauugcacuucuggggggugac

SEQ ID NO: 502357 - RNA, 59 nt, Human
aggaaugggccccucgaagugggccgggccggccccaccugccucugcccagauuugcc

SEQ ID NO: 502358 - RNA, 59 nt, Human
ugccucucccauggcuuacagcuucuacccggccccaaggcuacccaguauuuuaucgu

SEQ ID NO: 502359 - RNA, 59 nt, Human
ccccaauccaucagugccaaacuagccaacggccccagcuucucagcucgcuggauggc

SEQ ID NO: 502360 - RNA, 60 nt, Human; identical to SEQ ID NO: 257878

SEQ ID NO: 502361 - RNA, 64 nt, Human; identical to SEQ ID NO: 257879

SEQ ID NO: 502362 - RNA, 64 nt, Human; identical to SEQ ID NO: 257880

SEQ ID NO: 502363 - RNA, 59 nt, Human
cgacgcucaccgcggcucgggccguggggccgucagagaaaccuuuuuaaaaaauggag

SEQ ID NO: 502364 - RNA, 59 nt, Human
uccuggaugccucugaagagagggacagaccgucagaaacuggagaguuucuauuaaag

SEQ ID NO: 502365 - RNA, 59 nt, Human
cucuuggucgcccuuucuuaccaucugagccgucagagcagugacccaucuguacucau

SEQ ID NO: 502366 - RNA, 59 nt, Human
uuccuuucaguugcagucccaauuuuacuccgucagaaagcagcccuccccucccuccc

SEQ ID NO: 502367 - RNA, 59 nt, Human
gccccguguaggcaucgucggucgguuugccgucagagauggcgcaucucgcugcaucc

SEQ ID NO: 502368 - RNA, 59 nt, Human
gagggaaagagacccagaaaggacacaacccgucagagaccugggagcaggggcaauga

SEQ ID NO: 502369 - RNA, 59 nt, Human
auaugccuguaauucaguguauuucaguuccgucagaaaguguaaauguuaguuucuug

SEQ ID NO: 502370 - RNA, 64 nt, Human; identical to SEQ ID NO: 257882

SEQ ID NO: 502371 - RNA, 64 nt, Human; identical to SEQ ID NO: 257883

SEQ ID NO: 502372 - RNA, 64 nt, Human; identical to SEQ ID NO: 257884

SEQ ID NO: 502373 - RNA, 59 nt, Human
uuugagauggugaguggauagucaguagaccgucagaaccacuggccagagagggagcu

SEQ ID NO: 502374 - RNA, 59 nt, Human
ugucccagggaaucuaggagagaugaggcccgucagagucaagagaugucaucccccca

SEQ ID NO: 502375 - RNA, 59 nt, Human
ccgccugccgagcagagaaggcacagcagccgucagaguccaugagaggugaaaccaca

SEQ ID NO: 502376 - RNA, 59 nt, Human
cacaccuuuggccucaucgcugaccugggccgucagagcuuccagugcgcagccuucug

SEQ ID NO: 502377 - RNA, 59 nt, Human
ugcuuuucccaucuccccccaagucuguuccgucagagcuucuggcugcuccugaaugg

SEQ ID NO: 502378 - RNA, 59 nt, Human
cuuaaugacugaaagauaaguggguagcaccgucagagagaaaauguuggaucugcccu

SEQ ID NO: 502379 - RNA, 59 nt, Human
augggcgcccugcacacccguuucuggggccgucagacuuggauacaucguaaacuccg

SEQ ID NO: 502380 - RNA, 59 nt, Human
gcacaggugggugauguccuuggcugcugccgucagaggcagcccccugcacagggagg

SEQ ID NO: 502381 - RNA, 59 nt, Human
uccauccccgcuaccguccuggccagcuaccgucagagagaaccagagcuccaagucuu

SEQ ID NO: 502382 - RNA, 59 nt, Human
ggcggcugaaagccagcagcacgaacugcccgucagagaagugcacagccugggccaga

SEQ ID NO: 502383 - RNA, 59 nt, Human
aaagacaaagguuagucugaucuccagacccgucagaauggaauacacagcccacaucu

SEQ ID NO: 502384 - RNA, 59 nt, Human
cacccucaccaggacucgucucuccauucccgucagaguuugcuuugauuucccuuucc

SEQ ID NO: 502385 - RNA, 59 nt, Human
gcaucggcaagggcucucgggagcugcugccgucagacuccugccucaagccugagugg

SEQ ID NO: 502386 - RNA, 59 nt, Human
gcacccuuugcuccacccacagcagggccccgucagacucugccagcgcguccugcccg

SEQ ID NO: 502387 - RNA, 59 nt, Human
caggccugaccagggccugcacagguuaaccgucagacuuccggggcauucaggugggg

SEQ ID NO: 502388 - RNA, 59 nt, Human
caguccugcuccccucaccuuccuugggcccgucagagucuuuuguggugcugugcuuc

SEQ ID NO: 502389 - RNA, 64 nt, Human; identical to SEQ ID NO: 257885

SEQ ID NO: 502390 - RNA, 53 nt, Human; identical to SEQ ID NO: 257886

SEQ ID NO: 502391 - RNA, 64 nt, Human; identical to SEQ ID NO: 257890

SEQ ID NO: 502392 - RNA, 59 nt, Human
gugcucugugucuucgcuuccaccgacagccgucagacaucaggcuccccggccaccau

SEQ ID NO: 502393 - RNA, 59 nt, Human
ggcuagagugggcuaggcccuggcuuugcccgucagauuugaacgaaugugugucccuu

SEQ ID NO: 502394 - RNA, 59 nt, Human
gguucacuuacgguagcgacuauuacgacccgucagagccgacggaggaggaggagccu

SEQ ID NO: 502395 - RNA, 59 nt, Human
gcccucccuggcugcuuccucucgcucauccgucagaugcaaucugugggccgccccuc

SEQ ID NO: 502396 - RNA, 59 nt, Human
ggggacauucagcugaugcauuauauaccccgucagagcacacuuguaucuuuuaccuu

SEQ ID NO: 502397 - RNA, 59 nt, Human
auagagagacucugggccacccucaaacaccgucagaugcauuagcagcccacugcaug

SEQ ID NO: 502398 - RNA, 59 nt, Human
auuuacuuccucccaagaguuuggacugcccgucagauuguugcugcacauaguugccu

SEQ ID NO: 502399 - RNA, 59 nt, Human
uuauacaaucagaaggugcuuugugcugaccgucagauugugucaagucaggugugcaa

SEQ ID NO: 502400 - RNA, 59 nt, Human
ccccacccccaccagagacacacugggaaccgucagagucagcuccuucccccucgcaa

SEQ ID NO: 502401 - RNA, 59 nt, Human
auucgggacuccaacacccuggagugguuccgucagaccaugaggagccaagaccagca

SEQ ID NO: 502402 - RNA, 59 nt, Human
ggagcugggcuggugugcaguggcaggucccgucagaagagaugaggcuccugggacag

SEQ ID NO: 502403 - RNA, 59 nt, Human
caacagggacugcauuugcuccucucugcccgucagacauaagcucucacagcgcuaag

SEQ ID NO: 502404 - RNA, 59 nt, Human
gauucgucauuugcaaaacacacauaauaccgucagagugcugugaaaaaccuuaaggg

SEQ ID NO: 502405 - RNA, 59 nt, Human
aguggagacagggcagggguucugaguuuccgucagaugcagugaaaucacaguucccu

SEQ ID NO: 502406 - RNA, 59 nt, Human
acuggaauuggacaccuuguuuccaaccuccgucagacuguugcaguagaagaaugauu

SEQ ID NO: 502407 - RNA, 59 nt, Human
cccuggccaucagcgacgcuguccgccccccgucagaucccaugugugccauguuuauc

SEQ ID NO: 502408 - RNA, 64 nt, Human; identical to SEQ ID NO: 257954

SEQ ID NO: 502409 - RNA, 64 nt, Human; identical to SEQ ID NO: 257955

SEQ ID NO: 502410 - RNA, 64 nt, Human; identical to SEQ ID NO: 257956

SEQ ID NO: 502411 - RNA, 59 nt, Human
acugauguccggagagacagugacagccuccgucagacucccgcgugaagaugucacaa

SEQ ID NO: 502412 - RNA, 59 nt, Human
accguaucaauguaagcaaugugggaaagccgucagaucagccucaagacuucaaaugc

SEQ ID NO: 502413 - RNA, 59 nt, Human
ucuggccuugagcuucuaaaucucuguauccgucagaucucugugguuacaagaaacag

SEQ ID NO: 502414 - RNA, 59 nt, Human
caggagguuuguucaggucccccaaaccaccgucagauuugaugauuuccuagcaggac

SEQ ID NO: 502415 - RNA, 59 nt, Human
ucccuucccccagucaguccugaguccugccgucagacucuggcagggcucccagaggu

SEQ ID NO: 502416 - RNA, 59 nt, Human
gugagaugccugugagagccuucccgcacccgucagaagcucagagccuucuuggaccc

SEQ ID NO: 502417 - RNA, 59 nt, Human
cggcuguuagggaucugaacuugguuuucccgucagaagaaucagcaggacagaucgua

SEQ ID NO: 502418 - RNA, 59 nt, Human
cugugaauaaagagaugggagauuugauuccgucagaagagacuguaauccgugucguc

SEQ ID NO: 502419 - RNA, 59 nt, Human
acaaauuuuugaccacaccuccguuuucuccgucagacuucucucccuucuaagcaggc

SEQ ID NO: 502420 - RNA, 59 nt, Human
ugggagccagaaugccugaguccuucuguccgucagaaucuccgcugccucuccagccc

SEQ ID NO: 502421 - RNA, 64 nt, Human
gcagccaccacucucagggauccugccccaaaugcggucggagcgccagugacccugaggaagc

SEQ ID NO: 502422 - RNA, 64 nt, Human
ugaacccgagguugguuuggggagacaggugaggcggucggaucuacagaacaacccaccauuu

SEQ ID NO: 502423 - RNA, 64 nt, Human
guagggagcuggggaaacgacugcccgaggaaugcggucggaggauuguguugcuguggacgug

SEQ ID NO: 502424 - RNA, 64 nt, Human
uucccgcaggcuccuggacuggaagcucccuccgcggucggauucuggagggugggaggcaucu

SEQ ID NO: 502425 - RNA, 64 nt, Human
cccccgucguucccucccggcugccgccagggggcggucggaccccgccucccgagcccgggga

SEQ ID NO: 502426 - RNA, 64 nt, Human
aaguuuguguggaagugagcucgcccgaguuguccggucggaguuguagccagucuuucagggg

SEQ ID NO: 502427 - RNA, 64 nt, Human; identical to SEQ ID NO: 257844

SEQ ID NO: 502428 - RNA, 64 nt, Human; identical to SEQ ID NO: 257845

SEQ ID NO: 502429 - RNA, 64 nt, Human; identical to SEQ ID NO: 257846

SEQ ID NO: 502430 - RNA, 64 nt, Human
ucauaaagccuucaucacucccacauuuuucuuacggucggagcaucagaacaagcgucuagac

SEQ ID NO: 502431 - RNA, 64 nt, Human
cuccugauggugggcccucugugcucuucucuuccggucggaucucucuccucucugaccugga

SEQ ID NO: 502432 - RNA, 64 nt, Human
cuggcggccugggccgucccgcaccgaacccaggcggucggagcccggcggggaggcgcgaggu

SEQ ID NO: 502433 - RNA, 64 nt, Human
caaggggguccccgcccgccagugccaaagcgcccggucggaggcggaaggaagugauauuuau

SEQ ID NO: 502434 - RNA, 64 nt, Human; identical to SEQ ID NO: 502421

SEQ ID NO: 502435 - RNA, 64 nt, Human; identical to SEQ ID NO: 502422

SEQ ID NO: 502436 - RNA, 64 nt, Human; identical to SEQ ID NO: 502423

SEQ ID NO: 502437 - RNA, 64 nt, Human; identical to SEQ ID NO: 502424

SEQ ID NO: 502438 - RNA, 64 nt, Human; identical to SEQ ID NO: 502425

SEQ ID NO: 502439 - RNA, 64 nt, Human; identical to SEQ ID NO: 502426

SEQ ID NO: 502440 - RNA, 64 nt, Human; identical to SEQ ID NO: 502430

SEQ ID NO: 502441 - RNA, 64 nt, Human; identical to SEQ ID NO: 502431

SEQ ID NO: 502442 - RNA, 64 nt, Human; identical to SEQ ID NO: 502432

SEQ ID NO: 502443 - RNA, 64 nt, Human; identical to SEQ ID NO: 502433

SEQ ID NO: 502444 - RNA, 64 nt, Human; identical to SEQ ID NO: 257892

SEQ ID NO: 502445 - RNA, 64 nt, Human; identical to SEQ ID NO: 257893

SEQ ID NO: 502446 - RNA, 64 nt, Human; identical to SEQ ID NO: 257894

SEQ ID NO: 502447 - RNA, 64 nt, Human; identical to SEQ ID NO: 257818

SEQ ID NO: 502448 - RNA, 64 nt, Human; identical to SEQ ID NO: 257819

SEQ ID NO: 502449 - RNA, 64 nt, Human; identical to SEQ ID NO: 257820

SEQ ID NO: 502450 - RNA, 64 nt, Human; identical to SEQ ID NO: 257821

SEQ ID NO: 502451 - RNA, 64 nt, Human; identical to SEQ ID NO: 257822

SEQ ID NO: 502452 - RNA, 64 nt, Human; identical to SEQ ID NO: 257823

SEQ ID NO: 502453 - RNA, 64 nt, Human; identical to SEQ ID NO: 257824

SEQ ID NO: 502454 - RNA, 64 nt, Human; identical to SEQ ID NO: 257825

SEQ ID NO: 502455 - RNA, 64 nt, Human; identical to SEQ ID NO: 257826

SEQ ID NO: 502456 - RNA, 64 nt, Human; identical to SEQ ID NO: 257827

SEQ ID NO: 502457 - RNA, 64 nt, Human; identical to SEQ ID NO: 257828

SEQ ID NO: 502458 - RNA, 64 nt, Human; identical to SEQ ID NO: 257829

SEQ ID NO: 502459 - RNA, 64 nt, Human; identical to SEQ ID NO: 257830

SEQ ID NO: 502460 - RNA, 64 nt, Human; identical to SEQ ID NO: 257831

SEQ ID NO: 502461 - RNA, 64 nt, Human; identical to SEQ ID NO: 257832

SEQ ID NO: 502462 - RNA, 64 nt, Human; identical to SEQ ID NO: 257836

SEQ ID NO: 502463 - RNA, 64 nt, Human; identical to SEQ ID NO: 257837

SEQ ID NO: 502464 - RNA, 64 nt, Human; identical to SEQ ID NO: 257838

SEQ ID NO: 502465 - RNA, 64 nt, Human; identical to SEQ ID NO: 257981

SEQ ID NO: 502466 - RNA, 64 nt, Human; identical to SEQ ID NO: 257982

SEQ ID NO: 502467 - RNA, 64 nt, Human; identical to SEQ ID NO: 257983

SEQ ID NO: 502468 - RNA, 64 nt, Human; identical to SEQ ID NO: 257984

SEQ ID NO: 502469 - RNA, 64 nt, Human; identical to SEQ ID NO: 257985

SEQ ID NO: 502470 - RNA, 64 nt, Human; identical to SEQ ID NO: 90928

SEQ ID NO: 502471 - RNA, 64 nt, Human; identical to SEQ ID NO: 90929

SEQ ID NO: 502472 - RNA, 64 nt, Human; identical to SEQ ID NO: 90930

SEQ ID NO: 502473 - RNA, 64 nt, Human; identical to SEQ ID NO: 90931

SEQ ID NO: 502474 - RNA, 64 nt, Human; identical to SEQ ID NO: 90932

SEQ ID NO: 502475 - RNA, 64 nt, Human; identical to SEQ ID NO: 90933

SEQ ID NO: 502476 - RNA, 64 nt, Human
ucagaacuaaaguguuuuggguggguuuuguugcgggggggaggguaacaauggguggucuucu

SEQ ID NO: 502477 - RNA, 64 nt, Human
uguagaggagaaacuggaacucucgagcguugcugggggggauuguaaaauggugugaccacug

SEQ ID NO: 502478 - RNA, 64 nt, Human
auuuugguuuagugcaaaguauaaaauuauauuugggggggaauaagauuauauggacuuucuu

SEQ ID NO: 502479 - RNA, 64 nt, Human; identical to SEQ ID NO: 90934

SEQ ID NO: 502480 - RNA, 64 nt, Human; identical to SEQ ID NO: 90935

SEQ ID NO: 502481 - RNA, 64 nt, Human; identical to SEQ ID NO: 90936

SEQ ID NO: 502482 - RNA, 64 nt, Human; identical to SEQ ID NO: 90937

SEQ ID NO: 502483 - RNA, 64 nt, Human; identical to SEQ ID NO: 90938

SEQ ID NO: 502484 - RNA, 64 nt, Human; identical to SEQ ID NO: 90939

SEQ ID NO: 502485 - RNA, 64 nt, Human; identical to SEQ ID NO: 90940

SEQ ID NO: 502486 - RNA, 64 nt, Human; identical to SEQ ID NO: 90941

SEQ ID NO: 502487 - RNA, 64 nt, Human; identical to SEQ ID NO: 90942

SEQ ID NO: 502488 - RNA, 64 nt, Human; identical to SEQ ID NO: 90943

SEQ ID NO: 502489 - RNA, 64 nt, Human; identical to SEQ ID NO: 90944

SEQ ID NO: 502490 - RNA, 64 nt, Human; identical to SEQ ID NO: 90945

SEQ ID NO: 502491 - RNA, 64 nt, Human; identical to SEQ ID NO: 90946

SEQ ID NO: 502492 - RNA, 64 nt, Human; identical to SEQ ID NO: 90947

SEQ ID NO: 502493 - RNA, 64 nt, Human; identical to SEQ ID NO: 90948

SEQ ID NO: 502494 - RNA, 64 nt, Human
gcccaaccaccugcugcuggcgcccuagguggcugggggggaagacaacggagaccggugucgc

SEQ ID NO: 502495 - RNA, 64 nt, Human
ugaggccccaucucaaaaaaaaaaaaaggggggggggggggaguugggcuguguuggaaugggc

SEQ ID NO: 502496 - RNA, 64 nt, Human
ucaacuaaaagaugaggauuaagagcaagaaguugggggggaugugaaaauaauuuuaugaggu

SEQ ID NO: 502497 - RNA, 64 nt, Human; identical to SEQ ID NO: 90949

SEQ ID NO: 502498 - RNA, 64 nt, Human; identical to SEQ ID NO: 90950

SEQ ID NO: 502499 - RNA, 64 nt, Human; identical to SEQ ID NO: 90951

SEQ ID NO: 502500 - RNA, 64 nt, Human; identical to SEQ ID NO: 90952

SEQ ID NO: 502501 - RNA, 64 nt, Human; identical to SEQ ID NO: 90953

SEQ ID NO: 502502 - RNA, 64 nt, Human; identical to SEQ ID NO: 90954

SEQ ID NO: 502503 - RNA, 64 nt, Human; identical to SEQ ID NO: 90955

SEQ ID NO: 502504 - RNA, 64 nt, Human; identical to SEQ ID NO: 90956

SEQ ID NO: 502505 - RNA, 64 nt, Human; identical to SEQ ID NO: 90957

SEQ ID NO: 502506 - RNA, 64 nt, Human; identical to SEQ ID NO: 90958

SEQ ID NO: 502507 - RNA, 50 nt, Human; identical to SEQ ID NO: 90959

SEQ ID NO: 502508 - RNA, 64 nt, Human; identical to SEQ ID NO: 90960

SEQ ID NO: 502509 - RNA, 64 nt, Human; identical to SEQ ID NO: 90961

SEQ ID NO: 502510 - RNA, 64 nt, Human; identical to SEQ ID NO: 90962

SEQ ID NO: 502511 - RNA, 64 nt, Human; identical to SEQ ID NO: 90963

SEQ ID NO: 502512 - RNA, 64 nt, Human; identical to SEQ ID NO: 242488

SEQ ID NO: 502513 - RNA, 64 nt, Human; identical to SEQ ID NO: 240128

SEQ ID NO: 502514 - RNA, 64 nt, Human; identical to SEQ ID NO: 242539

SEQ ID NO: 502515 - RNA, 64 nt, Human; identical to SEQ ID NO: 90964

SEQ ID NO: 502516 - RNA, 64 nt, Human; identical to SEQ ID NO: 90965

SEQ ID NO: 502517 - RNA, 64 nt, Human; identical to SEQ ID NO: 90966

SEQ ID NO: 502518 - RNA, 64 nt, Human; identical to SEQ ID NO: 90967

SEQ ID NO: 502519 - RNA, 64 nt, Human; identical to SEQ ID NO: 90968

SEQ ID NO: 502520 - RNA, 64 nt, Human; identical to SEQ ID NO: 90969

SEQ ID NO: 502521 - RNA, 64 nt, Human; identical to SEQ ID NO: 90970

SEQ ID NO: 502522 - RNA, 64 nt, Human; identical to SEQ ID NO: 90971

SEQ ID NO: 502523 - RNA, 64 nt, Human; identical to SEQ ID NO: 90972

SEQ ID NO: 502524 - RNA, 64 nt, Human; identical to SEQ ID NO: 90973

SEQ ID NO: 502525 - RNA, 64 nt, Human; identical to SEQ ID NO: 90974

SEQ ID NO: 502526 - RNA, 64 nt, Human; identical to SEQ ID NO: 90975

SEQ ID NO: 502527 - RNA, 64 nt, Human; identical to SEQ ID NO: 90976

SEQ ID NO: 502528 - RNA, 64 nt, Human; identical to SEQ ID NO: 90977

SEQ ID NO: 502529 - RNA, 64 nt, Human; identical to SEQ ID NO: 90978

SEQ ID NO: 502530 - RNA, 64 nt, Human; identical to SEQ ID NO: 242335

SEQ ID NO: 502531 - RNA, 64 nt, Human; identical to SEQ ID NO: 242220

SEQ ID NO: 502532 - RNA, 64 nt, Human; identical to SEQ ID NO: 240134

SEQ ID NO: 502533 - RNA, 64 nt, Human; identical to SEQ ID NO: 90979

SEQ ID NO: 502534 - RNA, 64 nt, Human; identical to SEQ ID NO: 90980

SEQ ID NO: 502535 - RNA, 64 nt, Human; identical to SEQ ID NO: 90981

SEQ ID NO: 502536 - RNA, 64 nt, Human; identical to SEQ ID NO: 90982

SEQ ID NO: 502537 - RNA, 64 nt, Human; identical to SEQ ID NO: 90983

SEQ ID NO: 502538 - RNA, 64 nt, Human; identical to SEQ ID NO: 90984

SEQ ID NO: 502539 - RNA, 52 nt, Human; identical to SEQ ID NO: 90985

SEQ ID NO: 502540 - RNA, 64 nt, Human; identical to SEQ ID NO: 90986

SEQ ID NO: 502541 - RNA, 64 nt, Human; identical to SEQ ID NO: 90987

SEQ ID NO: 502542 - RNA, 64 nt, Human; identical to SEQ ID NO: 90988

SEQ ID NO: 502543 - RNA, 64 nt, Human; identical to SEQ ID NO: 90989

SEQ ID NO: 502544 - RNA, 64 nt, Human; identical to SEQ ID NO: 90990

SEQ ID NO: 502545 - RNA, 64 nt, Human; identical to SEQ ID NO: 90991

SEQ ID NO: 502546 - RNA, 64 nt, Human; identical to SEQ ID NO: 90992

SEQ ID NO: 502547 - RNA, 64 nt, Human; identical to SEQ ID NO: 90993

SEQ ID NO: 502548 - RNA, 64 nt, Human; identical to SEQ ID NO: 242277

SEQ ID NO: 502549 - RNA, 64 nt, Human; identical to SEQ ID NO: 242049

SEQ ID NO: 502550 - RNA, 64 nt, Human; identical to SEQ ID NO: 242306

SEQ ID NO: 502551 - RNA, 64 nt, Human; identical to SEQ ID NO: 90994

SEQ ID NO: 502552 - RNA, 64 nt, Human; identical to SEQ ID NO: 90995

SEQ ID NO: 502553 - RNA, 64 nt, Human; identical to SEQ ID NO: 90996

SEQ ID NO: 502554 - RNA, 64 nt, Human; identical to SEQ ID NO: 90997

SEQ ID NO: 502555 - RNA, 64 nt, Human; identical to SEQ ID NO: 90998

SEQ ID NO: 502556 - RNA, 64 nt, Human; identical to SEQ ID NO: 90999

SEQ ID NO: 502557 - RNA, 64 nt, Human; identical to SEQ ID NO: 91000

SEQ ID NO: 502558 - RNA, 64 nt, Human; identical to SEQ ID NO: 91001

SEQ ID NO: 502559 - RNA, 64 nt, Human; identical to SEQ ID NO: 91002

SEQ ID NO: 502560 - RNA, 64 nt, Human; identical to SEQ ID NO: 91003

SEQ ID NO: 502561 - RNA, 64 nt, Human; identical to SEQ ID NO: 91004

SEQ ID NO: 502562 - RNA, 64 nt, Human; identical to SEQ ID NO: 91005

SEQ ID NO: 502563 - RNA, 64 nt, Human; identical to SEQ ID NO: 91006

SEQ ID NO: 502564 - RNA, 64 nt, Human; identical to SEQ ID NO: 91007

SEQ ID NO: 502565 - RNA, 64 nt, Human; identical to SEQ ID NO: 91008

SEQ ID NO: 502566 - RNA, 64 nt, Human; identical to SEQ ID NO: 241969

SEQ ID NO: 502567 - RNA, 64 nt, Human; identical to SEQ ID NO: 241981

SEQ ID NO: 502568 - RNA, 64 nt, Human; identical to SEQ ID NO: 240173

SEQ ID NO: 502569 - RNA, 64 nt, Human; identical to SEQ ID NO: 91009

SEQ ID NO: 502570 - RNA, 64 nt, Human; identical to SEQ ID NO: 91010

SEQ ID NO: 502571 - RNA, 64 nt, Human; identical to SEQ ID NO: 91011

SEQ ID NO: 502572 - RNA, 64 nt, Human; identical to SEQ ID NO: 91012

SEQ ID NO: 502573 - RNA, 64 nt, Human; identical to SEQ ID NO: 91013

SEQ ID NO: 502574 - RNA, 64 nt, Human; identical to SEQ ID NO: 91014

SEQ ID NO: 502575 - RNA, 64 nt, Human; identical to SEQ ID NO: 91015

SEQ ID NO: 502576 - RNA, 64 nt, Human; identical to SEQ ID NO: 91016

SEQ ID NO: 502577 - RNA, 64 nt, Human; identical to SEQ ID NO: 91017

SEQ ID NO: 502578 - RNA, 64 nt, Human; identical to SEQ ID NO: 91018

SEQ ID NO: 502579 - RNA, 64 nt, Human; identical to SEQ ID NO: 91019

SEQ ID NO: 502580 - RNA, 64 nt, Human; identical to SEQ ID NO: 91020

SEQ ID NO: 502581 - RNA, 64 nt, Human; identical to SEQ ID NO: 91021

SEQ ID NO: 502582 - RNA, 64 nt, Human; identical to SEQ ID NO: 91022

SEQ ID NO: 502583 - RNA, 64 nt, Human; identical to SEQ ID NO: 91023

SEQ ID NO: 502584 - RNA, 64 nt, Human; identical to SEQ ID NO: 240190

SEQ ID NO: 502585 - RNA, 64 nt, Human; identical to SEQ ID NO: 240192

SEQ ID NO: 502586 - RNA, 64 nt, Human; identical to SEQ ID NO: 242291

SEQ ID NO: 502587 - RNA, 64 nt, Human; identical to SEQ ID NO: 91024

SEQ ID NO: 502588 - RNA, 64 nt, Human; identical to SEQ ID NO: 91025

SEQ ID NO: 502589 - RNA, 64 nt, Human; identical to SEQ ID NO: 91026

SEQ ID NO: 502590 - RNA, 64 nt, Human; identical to SEQ ID NO: 91027

SEQ ID NO: 502591 - RNA, 64 nt, Human; identical to SEQ ID NO: 91028

SEQ ID NO: 502592 - RNA, 64 nt, Human; identical to SEQ ID NO: 91029

SEQ ID NO: 502593 - RNA, 64 nt, Human; identical to SEQ ID NO: 91030

SEQ ID NO: 502594 - RNA, 64 nt, Human; identical to SEQ ID NO: 91031

SEQ ID NO: 502595 - RNA, 64 nt, Human; identical to SEQ ID NO: 91032

SEQ ID NO: 502596 - RNA, 64 nt, Human; identical to SEQ ID NO: 91033

SEQ ID NO: 502597 - RNA, 64 nt, Human; identical to SEQ ID NO: 91034

SEQ ID NO: 502598 - RNA, 64 nt, Human; identical to SEQ ID NO: 91035

SEQ ID NO: 502599 - RNA, 64 nt, Human; identical to SEQ ID NO: 91036

SEQ ID NO: 502600 - RNA, 64 nt, Human; identical to SEQ ID NO: 91037

SEQ ID NO: 502601 - RNA, 64 nt, Human; identical to SEQ ID NO: 91038

SEQ ID NO: 502602 - RNA, 64 nt, Human; identical to SEQ ID NO: 242068

SEQ ID NO: 502603 - RNA, 64 nt, Human; identical to SEQ ID NO: 240227

SEQ ID NO: 502604 - RNA, 64 nt, Human; identical to SEQ ID NO: 240228

SEQ ID NO: 502605 - RNA, 64 nt, Human; identical to SEQ ID NO: 91039

SEQ ID NO: 502606 - RNA, 64 nt, Human
uuaggcuucucacccacugcguauuaacuggcagagaauuuaggggagguucagaagacagagu

SEQ ID NO: 502607 - RNA, 64 nt, Human
gggaaaugcacaauuuuuuuuuguuaggcuguaaagaauuuaagcuguaaauuacauaaguuag

SEQ ID NO: 502608 - RNA, 64 nt, Human
uggucauauuauuauuaauuuugccaaaagaagaagaauuuauugaauauuuauacuauaaaau

SEQ ID NO: 502609 - RNA, 64 nt, Human
aacagggaugcuggcucuuggcuaagagguguucagaauuuaggcaacacucaauuuaccugcg

SEQ ID NO: 502610 - RNA, 64 nt, Human
aaaggguaucagauucuauugugacuucauagugagaauuuauuauagauuauuuuuuagcuau

SEQ ID NO: 502611 - RNA, 64 nt, Human
aacuggugacaauugagccucuugacugguacucagaauuuagugacacgugguccugauuuuu

SEQ ID NO: 502612 - RNA, 64 nt, Human
uacuaagacaugcuguuaacucagucugacuggaagaauuuaggaccacugcauccugucuuaa

SEQ ID NO: 502613 - RNA, 64 nt, Human
uguuuaacugaaaaaaauguagaaauauauguaaagaauuuaagacaagaguacugaauggaug

SEQ ID NO: 502614 - RNA, 64 nt, Human
aauccagcaaauucaaggaaccaggcuaugacuaagaauuuagguggaauugaugucugggcaa

SEQ ID NO: 502615 - RNA, 64 nt, Human
aaggcuuuguaguacaagauugaaaaacucaacaagaauuuaauucuaaaagcaaaaauugguu

SEQ ID NO: 502616 - RNA, 64 nt, Human
uauugcagauaauguucucauuuauuuuugauguagaauuuacauugccauggguguuaaauaa

SEQ ID NO: 502617 - RNA, 64 nt, Human
aggagccauccuuaagucugcucccacccucaguagaauuuauuuucuacaaagugguaguaau

SEQ ID NO: 502618 - RNA, 64 nt, Human
auuuaauuguggccauccaaaugaauauuauugcagaauuuaucuuguucauaaugauuuguaa

SEQ ID NO: 502619 - RNA, 64 nt, Human
aaauauccucuuauuguugaucaaaggaggcaaaagaauuuagaggcaaaugacaagcgauagg

SEQ ID NO: 502620 - RNA, 64 nt, Human; identical to SEQ ID NO: 241909

SEQ ID NO: 502621 - RNA, 64 nt, Human; identical to SEQ ID NO: 241029

SEQ ID NO: 502622 - RNA, 64 nt, Human; identical to SEQ ID NO: 241950

SEQ ID NO: 502623 - RNA, 64 nt, Human; identical to SEQ ID NO: 91040

SEQ ID NO: 502624 - RNA, 64 nt, Human; identical to SEQ ID NO: 91041

SEQ ID NO: 502625 - RNA, 64 nt, Human; identical to SEQ ID NO: 91042

SEQ ID NO: 502626 - RNA, 64 nt, Human; identical to SEQ ID NO: 91043

SEQ ID NO: 502627 - RNA, 64 nt, Human; identical to SEQ ID NO: 91044

SEQ ID NO: 502628 - RNA, 64 nt, Human; identical to SEQ ID NO: 91045

SEQ ID NO: 502629 - RNA, 64 nt, Human; identical to SEQ ID NO: 91046

SEQ ID NO: 502630 - RNA, 64 nt, Human; identical to SEQ ID NO: 91047

SEQ ID NO: 502631 - RNA, 64 nt, Human; identical to SEQ ID NO: 91048

SEQ ID NO: 502632 - RNA, 64 nt, Human; identical to SEQ ID NO: 91049

SEQ ID NO: 502633 - RNA, 64 nt, Human; identical to SEQ ID NO: 91050

SEQ ID NO: 502634 - RNA, 64 nt, Human; identical to SEQ ID NO: 91051

SEQ ID NO: 502635 - RNA, 64 nt, Human; identical to SEQ ID NO: 91052

SEQ ID NO: 502636 - RNA, 64 nt, Human; identical to SEQ ID NO: 91053

SEQ ID NO: 502637 - RNA, 64 nt, Human; identical to SEQ ID NO: 91054

SEQ ID NO: 502638 - RNA, 64 nt, Human
cacauucucagaagcucuugaugucucuaaugaagggggggaaugcuguuaaugagaacaguca

SEQ ID NO: 502639 - RNA, 64 nt, Human
uuaacucccuuuuuacacuuuaugguaaguagcagggggggaaaugcauuuauagaucauuucu

SEQ ID NO: 502640 - RNA, 64 nt, Human
gaggggcugucugugucuccagaaaggggacaucgggggggaggggggcucagaaaggagaagg

SEQ ID NO: 502641 - RNA, 64 nt, Human; identical to SEQ ID NO: 91055

SEQ ID NO: 502642 - RNA, 64 nt, Human; identical to SEQ ID NO: 91056

SEQ ID NO: 502643 - RNA, 64 nt, Human; identical to SEQ ID NO: 91057

SEQ ID NO: 502644 - RNA, 64 nt, Human; identical to SEQ ID NO: 91047

SEQ ID NO: 502645 - RNA, 64 nt, Human; identical to SEQ ID NO: 91059

SEQ ID NO: 502646 - RNA, 64 nt, Human; identical to SEQ ID NO: 91060

SEQ ID NO: 502647 - RNA, 64 nt, Human; identical to SEQ ID NO: 91061

SEQ ID NO: 502648 - RNA, 64 nt, Human; identical to SEQ ID NO: 91062

SEQ ID NO: 502649 - RNA, 64 nt, Human; identical to SEQ ID NO: 91063

SEQ ID NO: 502650 - RNA, 64 nt, Human; identical to SEQ ID NO: 91064

SEQ ID NO: 502651 - RNA, 61 nt, Human; identical to SEQ ID NO: 91065

SEQ ID NO: 502652 - RNA, 53 nt, Human; identical to SEQ ID NO: 91066

SEQ ID NO: 502653 - RNA, 64 nt, Human; identical to SEQ ID NO: 91067

SEQ ID NO: 502654 - RNA, 64 nt, Human; identical to SEQ ID NO: 91068

SEQ ID NO: 502655 - RNA, 64 nt, Human; identical to SEQ ID NO: 91069

SEQ ID NO: 502656 - RNA, 64 nt, Human
cggcccaggccuccuuucgugcuuugugcuuggugggggggauuucgagggacuuugcacugga

SEQ ID NO: 502657 - RNA, 64 nt, Human
cuauucuaaaagugucuuucuaucacuguuaagggggggggaaagugagguucgaggaugacgu

SEQ ID NO: 502658 - RNA, 64 nt, Human
uagugacaugcaguuauauauuuuguuuuuaaaagggggggagcaaaagaaacaccaguguuag

SEQ ID NO: 502659 - RNA, 64 nt, Human; identical to SEQ ID NO: 91070

SEQ ID NO: 502660 - RNA, 64 nt, Human; identical to SEQ ID NO: 91071

SEQ ID NO: 502661 - RNA, 64 nt, Human; identical to SEQ ID NO: 91072

SEQ ID NO: 502662 - RNA, 64 nt, Human; identical to SEQ ID NO: 91073

SEQ ID NO: 502663 - RNA, 64 nt, Human; identical to SEQ ID NO: 91074

SEQ ID NO: 502664 - RNA, 64 nt, Human; identical to SEQ ID NO: 91075

SEQ ID NO: 502665 - RNA, 64 nt, Human; identical to SEQ ID NO: 91076

SEQ ID NO: 502666 - RNA, 64 nt, Human; identical to SEQ ID NO: 91077

SEQ ID NO: 502667 - RNA, 64 nt, Human; identical to SEQ ID NO: 91078

SEQ ID NO: 502668 - RNA, 64 nt, Human; identical to SEQ ID NO: 91079

SEQ ID NO: 502669 - RNA, 64 nt, Human; identical to SEQ ID NO: 91080

SEQ ID NO: 502670 - RNA, 64 nt, Human; identical to SEQ ID NO: 91081

SEQ ID NO: 502671 - RNA, 64 nt, Human; identical to SEQ ID NO: 91082

SEQ ID NO: 502672 - RNA, 64 nt, Human; identical to SEQ ID NO: 91083

SEQ ID NO: 502673 - RNA, 64 nt, Human; identical to SEQ ID NO: 91084

SEQ ID NO: 502674 - RNA, 64 nt, Human
uauuuuuccagcauacaagauuuaaauuugggaagggggggauguccucaauuagaacuuuuug

SEQ ID NO: 502675 - RNA, 64 nt, Human
aagucacgaaggauugcuugacaucaggagacuugggggggauuguagcagacgucugggcuuu

SEQ ID NO: 502676 - RNA, 64 nt, Human
ugugugcugccucaggaggggagggcugguaggagggggggagaggucucuguccuacugcucu

SEQ ID NO: 502677 - RNA, 64 nt, Human; identical to SEQ ID NO: 91085

SEQ ID NO: 502678 - RNA, 64 nt, Human; identical to SEQ ID NO: 91086

SEQ ID NO: 502679 - RNA, 64 nt, Human; identical to SEQ ID NO: 91087

SEQ ID NO: 502680 - RNA, 64 nt, Human; identical to SEQ ID NO: 91088

SEQ ID NO: 502681 - RNA, 64 nt, Human; identical to SEQ ID NO: 91089

SEQ ID NO: 502682 - RNA, 64 nt, Human; identical to SEQ ID NO: 91090

SEQ ID NO: 502683 - RNA, 64 nt, Human; identical to SEQ ID NO: 91091

SEQ ID NO: 502684 - RNA, 64 nt, Human; identical to SEQ ID NO: 91092

SEQ ID NO: 502685 - RNA, 64 nt, Human; identical to SEQ ID NO: 91093

SEQ ID NO: 502686 - RNA, 64 nt, Human; identical to SEQ ID NO: 91094

SEQ ID NO: 502687 - RNA, 64 nt, Human; identical to SEQ ID NO: 91095

SEQ ID NO: 502688 - RNA, 64 nt, Human; identical to SEQ ID NO: 91096

SEQ ID NO: 502689 - RNA, 64 nt, Human; identical to SEQ ID NO: 91097

SEQ ID NO: 502690 - RNA, 64 nt, Human; identical to SEQ ID NO: 91098

SEQ ID NO: 502691 - RNA, 64 nt, Human; identical to SEQ ID NO: 91099

SEQ ID NO: 502692 - RNA, 64 nt, Human
auagcauugucuauuuuucucuucauauuuauaugggggggagggcgcuggaugcaaaaguuga

SEQ ID NO: 502693 - RNA, 64 nt, Human
ccaccaagcaaaaguuucagccuggaaaaaaaaugggggggaaggguggaugaaaaggagggag

SEQ ID NO: 502694 - RNA, 64 nt, Human
uuauuccuguaauucagccaccugauuuugugaggggggggaauaauaugugguuuuuguacaa

SEQ ID NO: 502695 - RNA, 64 nt, Human; identical to SEQ ID NO: 91100

SEQ ID NO: 502696 - RNA, 64 nt, Human; identical to SEQ ID NO: 91101

SEQ ID NO: 502697 - RNA, 64 nt, Human; identical to SEQ ID NO: 91102

SEQ ID NO: 502698 - RNA, 64 nt, Human; identical to SEQ ID NO: 91103

SEQ ID NO: 502699 - RNA, 64 nt, Human; identical to SEQ ID NO: 91104

SEQ ID NO: 502700 - RNA, 64 nt, Human; identical to SEQ ID NO: 91105

SEQ ID NO: 502701 - RNA, 64 nt, Human; identical to SEQ ID NO: 91106

SEQ ID NO: 502702 - RNA, 64 nt, Human; identical to SEQ ID NO: 91107

SEQ ID NO: 502703 - RNA, 64 nt, Human; identical to SEQ ID NO: 91108

SEQ ID NO: 502704 - RNA, 64 nt, Human; identical to SEQ ID NO: 91109

SEQ ID NO: 502705 - RNA, 64 nt, Human; identical to SEQ ID NO: 91110

SEQ ID NO: 502706 - RNA, 64 nt, Human; identical to SEQ ID NO: 91111

SEQ ID NO: 502707 - RNA, 64 nt, Human; identical to SEQ ID NO: 91112

SEQ ID NO: 502708 - RNA, 64 nt, Human; identical to SEQ ID NO: 91113

SEQ ID NO: 502709 - RNA, 64 nt, Human; identical to SEQ ID NO: 91114

SEQ ID NO: 502710 - RNA, 64 nt, Human
ucugcugccgcccuuccuggaggcugccuauguugggggggacccugccucagcugacccggcc

SEQ ID NO: 502711 - RNA, 64 nt, Human
ugugggcaggucccuggagccggggggggggggggggggggaggaccgggccgcugggcccuca

SEQ ID NO: 502712 - RNA, 64 nt, Human
uggcagcguaugagaaguugggaccauagagcaagggggggaggggaguguugcagcaggcauu

SEQ ID NO: 502713 - RNA, 64 nt, Human; identical to SEQ ID NO: 91115

SEQ ID NO: 502714 - RNA, 64 nt, Human; identical to SEQ ID NO: 91116

SEQ ID NO: 502715 - RNA, 64 nt, Human; identical to SEQ ID NO: 91117

SEQ ID NO: 502716 - RNA, 64 nt, Human; identical to SEQ ID NO: 91118

SEQ ID NO: 502717 - RNA, 64 nt, Human; identical to SEQ ID NO: 91119

SEQ ID NO: 502718 - RNA, 64 nt, Human; identical to SEQ ID NO: 91120

SEQ ID NO: 502719 - RNA, 64 nt, Human; identical to SEQ ID NO: 91121

SEQ ID NO: 502720 - RNA, 64 nt, Human; identical to SEQ ID NO: 91122

SEQ ID NO: 502721 - RNA, 64 nt, Human; identical to SEQ ID NO: 91123

SEQ ID NO: 502722 - RNA, 64 nt, Human; identical to SEQ ID NO: 91124

SEQ ID NO: 502723 - RNA, 64 nt, Human; identical to SEQ ID NO: 91125

SEQ ID NO: 502724 - RNA, 64 nt, Human; identical to SEQ ID NO: 91126

SEQ ID NO: 502725 - RNA, 64 nt, Human; identical to SEQ ID NO: 91127

SEQ ID NO: 502726 - RNA, 64 nt, Human; identical to SEQ ID NO: 91128

SEQ ID NO: 502727 - RNA, 52 nt, Human; identical to SEQ ID NO: 91129

SEQ ID NO: 502728 - RNA, 64 nt, Human
acuauuuuuuuuauaguuguaguuuugauuuaaagggggggaaacaaguugacauuugucauuu

SEQ ID NO: 502729 - RNA, 64 nt, Human
gcuuuuuaugcuuuagaaguuaaacaauaucuuugggggggaacuaauuuauuuucaucacuug

SEQ ID NO: 502730 - RNA, 64 nt, Human
gaaggcuugaugcugucucagcagccucagcugugggggggaagcgcgugugcaucgugucaac

SEQ ID NO: 502731 - RNA, 64 nt, Human; identical to SEQ ID NO: 91130

SEQ ID NO: 502732 - RNA, 64 nt, Human; identical to SEQ ID NO: 91131

SEQ ID NO: 502733 - RNA, 64 nt, Human; identical to SEQ ID NO: 91132

SEQ ID NO: 502734 - RNA, 64 nt, Human; identical to SEQ ID NO: 91133

SEQ ID NO: 502735 - RNA, 64 nt, Human; identical to SEQ ID NO: 91134

SEQ ID NO: 502736 - RNA, 64 nt, Human; identical to SEQ ID NO: 91135

SEQ ID NO: 502737 - RNA, 52 nt, Human; identical to SEQ ID NO: 91136

SEQ ID NO: 502738 - RNA, 64 nt, Human; identical to SEQ ID NO: 91137

SEQ ID NO: 502739 - RNA, 64 nt, Human; identical to SEQ ID NO: 91138

SEQ ID NO: 502740 - RNA, 64 nt, Human; identical to SEQ ID NO: 91139

SEQ ID NO: 502741 - RNA, 64 nt, Human; identical to SEQ ID NO: 91140

SEQ ID NO: 502742 - RNA, 64 nt, Human; identical to SEQ ID NO: 91141

SEQ ID NO: 502743 - RNA, 64 nt, Human; identical to SEQ ID NO: 91142

SEQ ID NO: 502744 - RNA, 64 nt, Human; identical to SEQ ID NO: 91143

SEQ ID NO: 502745 - RNA, 64 nt, Human; identical to SEQ ID NO: 91144

SEQ ID NO: 502746 - RNA, 64 nt, Human
auugcuauuuuuguagucuuugcuugacuuuuuugggggggauuagcaaagcagaaaacuggcu

SEQ ID NO: 502747 - RNA, 64 nt, Human
guccgccugauuaagggucuucuuuuacuuuugcgggggggaggggggaggaguuggggaggga

SEQ ID NO: 502748 - RNA, 64 nt, Human
ucauucauucuaaucauuguaugugcuucacuacgggggggagaaggaaacguuagcaucaugu

SEQ ID NO: 502749 - RNA, 64 nt, Human; identical to SEQ ID NO: 91145

SEQ ID NO: 502750 - RNA, 64 nt, Human; identical to SEQ ID NO: 91146

SEQ ID NO: 502751 - RNA, 64 nt, Human; identical to SEQ ID NO: 91147

SEQ ID NO: 502752 - RNA, 64 nt, Human; identical to SEQ ID NO: 91148

SEQ ID NO: 502753 - RNA, 64 nt, Human; identical to SEQ ID NO: 91149

SEQ ID NO: 502754 - RNA, 64 nt, Human; identical to SEQ ID NO: 91150

SEQ ID NO: 502755 - RNA, 64 nt, Human; identical to SEQ ID NO: 91151

SEQ ID NO: 502756 - RNA, 58 nt, Human; identical to SEQ ID NO: 91152

SEQ ID NO: 502757 - RNA, 64 nt, Human; identical to SEQ ID NO: 91153

SEQ ID NO: 502758 - RNA, 64 nt, Human; identical to SEQ ID NO: 91154

SEQ ID NO: 502759 - RNA, 64 nt, Human; identical to SEQ ID NO: 91155

SEQ ID NO: 502760 - RNA, 64 nt, Human; identical to SEQ ID NO: 91156

SEQ ID NO: 502761 - RNA, 64 nt, Human; identical to SEQ ID NO: 91157

SEQ ID NO: 502762 - RNA, 64 nt, Human; identical to SEQ ID NO: 91158

SEQ ID NO: 502763 - RNA, 64 nt, Human; identical to SEQ ID NO: 91159

SEQ ID NO: 502764 - RNA, 62 nt, Human
cgcagcuuucuuucccuggggaggaaaacaucgugggggggaggggagggcggggcggaggg

SEQ ID NO: 502765 - RNA, 64 nt, Human
uuguacaauauuaaaaaaaugcacagaaaccauugggggggauucagaggugcauccacggauc

SEQ ID NO: 502766 - RNA, 64 nt, Human
acuuuccuugagaccaagagagugcgguggggaugggggggagagcacggguccccgucugaca

SEQ ID NO: 502767 - RNA, 64 nt, Human; identical to SEQ ID NO: 91160

SEQ ID NO: 502768 - RNA, 64 nt, Human; identical to SEQ ID NO: 91161

SEQ ID NO: 502769 - RNA, 64 nt, Human; identical to SEQ ID NO: 91162

SEQ ID NO: 502770 - RNA, 64 nt, Human; identical to SEQ ID NO: 91163

SEQ ID NO: 502771 - RNA, 64 nt, Human; identical to SEQ ID NO: 91164

SEQ ID NO: 502772 - RNA, 64 nt, Human; identical to SEQ ID NO: 91165

SEQ ID NO: 502773 - RNA, 64 nt, Human; identical to SEQ ID NO: 91166

SEQ ID NO: 502774 - RNA, 64 nt, Human; identical to SEQ ID NO: 91167

SEQ ID NO: 502775 - RNA, 64 nt, Human; identical to SEQ ID NO: 91168

SEQ ID NO: 502776 - RNA, 64 nt, Human; identical to SEQ ID NO: 91169

SEQ ID NO: 502777 - RNA, 64 nt, Human; identical to SEQ ID NO: 91170

SEQ ID NO: 502778 - RNA, 64 nt, Human; identical to SEQ ID NO: 91171

SEQ ID NO: 502779 - RNA, 64 nt, Human; identical to SEQ ID NO: 91172

SEQ ID NO: 502780 - RNA, 64 nt, Human; identical to SEQ ID NO: 91173

SEQ ID NO: 502781 - RNA, 64 nt, Human; identical to SEQ ID NO: 91174

SEQ ID NO: 502782 - RNA, 64 nt, Human
ccuaaagucauugccaugggaggaagacgauuuggggggggaggggggggggggcaggguaggu

SEQ ID NO: 502783 - RNA, 64 nt, Human
cuaaaguaguuuaagucuccuuuacugaauguaagggggggaucgaaaagaagguauuuuucca

SEQ ID NO: 502784 - RNA, 64 nt, Human
uucaucuuggcacagaaauuguuugggggauggggggggggacugggggagggguagcugcuau

SEQ ID NO: 502785 - RNA, 64 nt, Human; identical to SEQ ID NO: 91175

SEQ ID NO: 502786 - RNA, 64 nt, Human; identical to SEQ ID NO: 91176

SEQ ID NO: 502787 - RNA, 64 nt, Human; identical to SEQ ID NO: 91177

SEQ ID NO: 502788 - RNA, 63 nt, Human; identical to SEQ ID NO: 91178

SEQ ID NO: 502789 - RNA, 64 nt, Human; identical to SEQ ID NO: 91179

SEQ ID NO: 502790 - RNA, 64 nt, Human; identical to SEQ ID NO: 91180

SEQ ID NO: 502791 - RNA, 64 nt, Human; identical to SEQ ID NO: 91181

SEQ ID NO: 502792 - RNA, 64 nt, Human; identical to SEQ ID NO: 91182

SEQ ID NO: 502793 - RNA, 64 nt, Human; identical to SEQ ID NO: 91183

SEQ ID NO: 502794 - RNA, 64 nt, Human; identical to SEQ ID NO: 91184

SEQ ID NO: 502795 - RNA, 64 nt, Human; identical to SEQ ID NO: 91185

SEQ ID NO: 502796 - RNA, 64 nt, Human; identical to SEQ ID NO: 91186

SEQ ID NO: 502797 - RNA, 64 nt, Human; identical to SEQ ID NO: 91187

SEQ ID NO: 502798 - RNA, 64 nt, Human; identical to SEQ ID NO: 91188

SEQ ID NO: 502799 - RNA, 64 nt, Human; identical to SEQ ID NO: 91189

SEQ ID NO: 502800 - RNA, 64 nt, Human
ugucagcugguguugcugacacuuuccuuauggugggggggauacaaaaguauuuauuaugauu

SEQ ID NO: 502801 - RNA, 64 nt, Human
uucaaauuuuugcaucaguuaaaaaaaaaggggugggggggaaugggccaaagucugagucuua

SEQ ID NO: 502802 - RNA, 64 nt, Human
uguugaugucguguugucuugggggaccccucuggggggggaccugcccugugcccccuccucc

SEQ ID NO: 502803 - RNA, 64 nt, Human; identical to SEQ ID NO: 91190

SEQ ID NO: 502804 - RNA, 64 nt, Human; identical to SEQ ID NO: 91191

SEQ ID NO: 502805 - RNA, 64 nt, Human; identical to SEQ ID NO: 91192

SEQ ID NO: 502806 - RNA, 64 nt, Human; identical to SEQ ID NO: 91193

SEQ ID NO: 502807 - RNA, 64 nt, Human; identical to SEQ ID NO: 91194

SEQ ID NO: 502808 - RNA, 64 nt, Human; identical to SEQ ID NO: 91195

SEQ ID NO: 502809 - RNA, 64 nt, Human; identical to SEQ ID NO: 91196

SEQ ID NO: 502810 - RNA, 64 nt, Human; identical to SEQ ID NO: 91197

SEQ ID NO: 502811 - RNA, 64 nt, Human; identical to SEQ ID NO: 91198

SEQ ID NO: 502812 - RNA, 64 nt, Human; identical to SEQ ID NO: 91199

SEQ ID NO: 502813 - RNA, 64 nt, Human; identical to SEQ ID NO: 91200

SEQ ID NO: 502814 - RNA, 64 nt, Human; identical to SEQ ID NO: 91201

SEQ ID NO: 502815 - RNA, 56 nt, Human; identical to SEQ ID NO: 91202

SEQ ID NO: 502816 - RNA, 64 nt, Human; identical to SEQ ID NO: 91203

SEQ ID NO: 502817 - RNA, 64 nt, Human; identical to SEQ ID NO: 91204

SEQ ID NO: 502818 - RNA, 64 nt, Human
uguguaauuucugagccauuguacugucugggcugggggggacacuguccaagggaguggcccc

SEQ ID NO: 502819 - RNA, 64 nt, Human
ucggcugcagcagugauuccaacaagcagcuauugggggggaaacacagcauuuaaaaagauca

SEQ ID NO: 502820 - RNA, 64 nt, Human
aaguauuuagauaugguguccuuuucuguuuuuggggggggaguuuuguuguguuuuuuuaaag

SEQ ID NO: 502821 - RNA, 64 nt, Human; identical to SEQ ID NO: 91205

SEQ ID NO: 502822 - RNA, 64 nt, Human; identical to SEQ ID NO: 91206

SEQ ID NO: 502823 - RNA, 64 nt, Human; identical to SEQ ID NO: 91207

SEQ ID NO: 502824 - RNA, 64 nt, Human; identical to SEQ ID NO: 91208

SEQ ID NO: 502825 - RNA, 64 nt, Human; identical to SEQ ID NO: 91209

SEQ ID NO: 502826 - RNA, 64 nt, Human; identical to SEQ ID NO: 91210

SEQ ID NO: 502827 - RNA, 64 nt, Human; identical to SEQ ID NO: 91211

SEQ ID NO: 502828 - RNA, 64 nt, Human; identical to SEQ ID NO: 91212

SEQ ID NO: 502829 - RNA, 64 nt, Human; identical to SEQ ID NO: 91213

SEQ ID NO: 502830 - RNA, 64 nt, Human; identical to SEQ ID NO: 91214

SEQ ID NO: 502831 - RNA, 64 nt, Human; identical to SEQ ID NO: 91215

SEQ ID NO: 502832 - RNA, 64 nt, Human; identical to SEQ ID NO: 91216

SEQ ID NO: 502833 - RNA, 64 nt, Human; identical to SEQ ID NO: 91217

SEQ ID NO: 502834 - RNA, 64 nt, Human; identical to SEQ ID NO: 91218

SEQ ID NO: 502835 - RNA, 64 nt, Human; identical to SEQ ID NO: 91219

SEQ ID NO: 502836 - RNA, 64 nt, Human
gguggaggcguuacaacuaccugcucuguguguggggggggaggggggagggggguacgcauau

SEQ ID NO: 502837 - RNA, 64 nt, Human
auccaacuccuggggcugggaccguaguagcugcgggggggaagaaacacagggucggugagcc

SEQ ID NO: 502838 - RNA, 64 nt, Human
gccguuuuuccuuagaaaucagagaaaugggaaagggggggaaacugauuuuacacuuaaauaa

SEQ ID NO: 502839 - RNA, 64 nt, Human; identical to SEQ ID NO: 91220

SEQ ID NO: 502840 - RNA, 64 nt, Human; identical to SEQ ID NO: 91221

SEQ ID NO: 502841 - RNA, 64 nt, Human; identical to SEQ ID NO: 91222

SEQ ID NO: 502842 - RNA, 64 nt, Human; identical to SEQ ID NO: 91223

SEQ ID NO: 502843 - RNA, 64 nt, Human; identical to SEQ ID NO: 91224

SEQ ID NO: 502844 - RNA, 64 nt, Human; identical to SEQ ID NO: 91225

SEQ ID NO: 502845 - RNA, 64 nt, Human; identical to SEQ ID NO: 91226

SEQ ID NO: 502846 - RNA, 64 nt, Human; identical to SEQ ID NO: 91227

SEQ ID NO: 502847 - RNA, 64 nt, Human; identical to SEQ ID NO: 91228

SEQ ID NO: 502848 - RNA, 64 nt, Human; identical to SEQ ID NO: 91229

SEQ ID NO: 502849 - RNA, 54 nt, Human; identical to SEQ ID NO: 91230

SEQ ID NO: 502850 - RNA, 64 nt, Human; identical to SEQ ID NO: 91231

SEQ ID NO: 502851 - RNA, 64 nt, Human; identical to SEQ ID NO: 91232

SEQ ID NO: 502852 - RNA, 64 nt, Human; identical to SEQ ID NO: 91233

SEQ ID NO: 502853 - RNA, 64 nt, Human; identical to SEQ ID NO: 91234

SEQ ID NO: 502854 - RNA, 64 nt, Human
guaauaccugaauauccaacgguauagaucacaagggggggauguuaaauguuaaucuaaaaua

SEQ ID NO: 502855 - RNA, 64 nt, Human
cauuuucccagauaauugggucuuggacucuugagggggggaaauguuggagcagguagcuagu

SEQ ID NO: 502856 - RNA, 64 nt, Human
ggagcuaguuacugggaguaagggaggguggggugggggggaguucagguuuaugugugugcau

SEQ ID NO: 502857 - RNA, 64 nt, Human
guuuuguuuuguuuuuuucccuccucuuuuuuuugggggggagugugugugggguuuguuuuuu

SEQ ID NO: 502858 - RNA, 64 nt, Human
uggaagucggaaacauggucagaacacgaucugggggggggauccugucuuccuccccacccca

SEQ ID NO: 502859 - RNA, 64 nt, Human
acugucccgagcgguauaggugagaauggaguuggggggggacacuagguccuccgggguucac

SEQ ID NO: 502860 - RNA, 64 nt, Human
guuugacaguggccugcugcacuggcggauuggugggggggacaccacugagcauauccagacc

SEQ ID NO: 502861 - RNA, 64 nt, Human
cucuuuggaauuuuccugggaccuacagaauaaagggggggauggacaggggguuuucaaaagg

SEQ ID NO: 502862 - RNA, 64 nt, Human
cccuggcaaggggcuguuggguagaagugguggugggggggacaaaagacaaaaaaauccacca

SEQ ID NO: 502863 - RNA, 64 nt, Human
uagguacuagcugccuugauuuuuuuuugugggugggggggauuuuuucauuccuuauugaacu

SEQ ID NO: 502864 - RNA, 64 nt, Human
uauuaugcaguaacagucaauaaaauguacuuaugggggggaauuacucaauuauucuaucaga

SEQ ID NO: 502865 - RNA, 64 nt, Human
caccagaggacaucuuggggagggggagggagcugggggggagggaaaugacuaaugaagcuaa

SEQ ID NO: 502866 - RNA, 64 nt, Human
cguucuuggccuccuagcucugcccccuccccuggggggggagagauggggcggggcuuggaag

SEQ ID NO: 502867 - RNA, 64 nt, Human
aaaccaagacagaauugggaagccagugcggcccgggggggaggaagagggaaaaggaagaugg

SEQ ID NO: 502868 - RNA, 64 nt, Human
ccagccaggaaucuaaagcuuuggguuuucugaggggggggaggagggaacuggagguuauugg

SEQ ID NO: 502869 - RNA, 64 nt, Human
ccaaagcauuuggauaaagaccguuauaggaaaugggggggaaauggcuaaaagagaacaauuc

SEQ ID NO: 502870 - RNA, 64 nt, Human
cccacacugcaccauaaccgccacacccuucggggggggggaggguacagagggucucuaagca

SEQ ID NO: 502871 - RNA, 64 nt, Human
augcaacccuccccacgucuuccagcugggggaugggggggagucauaggaaaagcccccaucu

SEQ ID NO: 502872 - RNA, 64 nt, Human
cccugccugcuguggagcccauuguggaggcggugggggggagaaggccuccccugaggauccc

SEQ ID NO: 502873 - RNA, 64 nt, Human
ggccaucugggcaggaggccuggggaugaggguggggggggacccccaggucccggaggggaag

SEQ ID NO: 502874 - RNA, 64 nt, Human
cuuugcuucuuuuauuagacuaguguugacuuuggggggggacauuuauucacaaaugagaagu

SEQ ID NO: 502875 - RNA, 64 nt, Human
uugucaguggcaggugccugaacagaggguggaugggggggauaccggagggggucuugucuuc

SEQ ID NO: 502876 - RNA, 64 nt, Human
uuuauguauguauuuguaaaugugauagaagucugggggggaguugggggauggcggcagaugu

SEQ ID NO: 502877 - RNA, 64 nt, Human
uuuauuuuuuugcgggggaggguagggagugggugggggggagggggguaaggccaagacuggg

SEQ ID NO: 502878 - RNA, 64 nt, Human
uggagcagaauccugcacauuaaaggaugggguugggggggauacauuuauuuuauuuucucac

SEQ ID NO: 502879 - RNA, 64 nt, Human
auguaauguuuuaguuccuuacaaacaggguugggggggggaagggcgugcaaaaacuaacauu

SEQ ID NO: 502880 - RNA, 64 nt, Human
cuuuucauuagcaguugcucacaugucuuugggugggggggagaagaagaauuggccaucuuaa

SEQ ID NO: 502881 - RNA, 64 nt, Human
ggugagcgugagccucucugacugcuucuuccccgggggggacugcaaaccgcucaggguugcg

SEQ ID NO: 502882 - RNA, 64 nt, Human
uaauauguuuguaaacucauguacaguuuuuuuugggggggaggcaaugggaaggguagaaauu

SEQ ID NO: 502883 - RNA, 64 nt, Human
agaggaccauaaccugggggucaggggaaggcaugggggggaccagaaaccagaagaacaauca

SEQ ID NO: 502884 - RNA, 64 nt, Human
cucccagggagcaagggcagggacagggccggucgggggggacccuccaaggccaggccuuggg

SEQ ID NO: 502885 - RNA, 64 nt, Human
auggacaugugcaccaguauguaccugcaggcaugggggggaggggggcguguuucugggccug

SEQ ID NO: 502886 - RNA, 64 nt, Human
cccgcugucugugcugugagagucgccgcucgcugggggggaagggggggacacagcuacacgc

SEQ ID NO: 502887 - RNA, 64 nt, Human
ugugcugugagagucgccgcucgcugggggggaagggggggacacagcuacacgcccauuaaag

SEQ ID NO: 502888 - RNA, 64 nt, Human
uacaucugguagacgcccucaggagccggcugccgggggggacucaacagcagagcucugagca

SEQ ID NO: 502889 - RNA, 64 nt, Human
aacaagucacuuuacccuccuuaggacccauuuugggggggaaaaaccaacacauuccagagcu

SEQ ID NO: 502890 - RNA, 64 nt, Human
cacuggaaaagaaaucagcgggauuuuggggguggggggggaugggagguaccuuagagggagu

SEQ ID NO: 502891 - RNA, 64 nt, Human
caguuauugaguuuuugugauccuaucucagucugggggggaacauucucaagaggugaaauac

SEQ ID NO: 502892 - RNA, 64 nt, Human
auauaugauuccccaggcccugcaggauuuuggggggggggaggugggagggcaagggagggga

SEQ ID NO: 502893 - RNA, 64 nt, Human
aaggcuccugagacacaugggugcuauugggguugggggggaggugagguaccagccuuggaua

SEQ ID NO: 502894 - RNA, 64 nt, Human
ugucucuguaauauuuuaucuucuuuaaaaaaaagggggggaaauaccaaagugugaaauacug

SEQ ID NO: 502895 - RNA, 64 nt, Human
caggagaggagugucgccgggaggccuucagggugggggggaaggggacaugggcaggaagcac

SEQ ID NO: 502896 - RNA, 64 nt, Human
caauaaacguuuuggcuaucuuaagccauuguaugggggggauuaggaaguaggagggauuguc

SEQ ID NO: 502897 - RNA, 64 nt, Human
auaagucuggggugagguggggagggaggcugcagggggggaggugggcagaggggccuuacag

SEQ ID NO: 502898 - RNA, 64 nt, Human
caguguacuaggucaaucaggaggcaucuggaaagggggggaaaaaagcaaaaaacaaaauuaa

SEQ ID NO: 502899 - RNA, 64 nt, Human
uggucuuccuaugugucagaaacaacugugucuugggggggaagacccucgcugcgccgcuucc

SEQ ID NO: 502900 - RNA, 64 nt, Human
caaaaaagaggugggugggaugaaacauguuuuggggggggaugcacugaaaaucugagaacua

SEQ ID NO: 502901 - RNA, 64 nt, Human
auuucccaagcguuucuuuccaccuggagggaaagggggggacgcccccagugagauucaaauc

SEQ ID NO: 502902 - RNA, 64 nt, Human
ccuacuuuucucacucccuaucagggauauuuuggggggggaugguaaagggugggcuaaggaa

SEQ ID NO: 502903 - RNA, 64 nt, Human
ccgcccccccgaagccaugucacugaaaaggccugggggggaugguauauggcccuuuccccac

SEQ ID NO: 502904 - RNA, 64 nt, Human
gucacagcggaugacagacuuucuacggggaggagggggggaucaucaggaagcccagaacacu

SEQ ID NO: 502905 - RNA, 64 nt, Human
aaaaauguaaauauaaauuugguugagaucuggagggggggagggagcuauuagagaaggauga

SEQ ID NO: 502906 - RNA, 64 nt, Human
guuuuauagacucuugucuuuggaauuggggggagggggggaguguuucaaucuguuauauguu

SEQ ID NO: 502907 - RNA, 64 nt, Human
accacacacacacacaaaagugaaaaacuguguugggggggagacacuacuccuacuuaucuug

SEQ ID NO: 502908 - RNA, 64 nt, Human
acaaaacgggguucacaagccauggucgggguccgggggggacagaaauggauuuucuuggcaa

SEQ ID NO: 502909 - RNA, 64 nt, Human
aggggagggguagcgggggaggggggcuucagaagggggggaacaccccagaucucagggaacc

SEQ ID NO: 502910 - RNA, 64 nt, Human
caauccuuugcccucaaaucagugacccaagggagggggggauuuaaagggaaggagugggcaa

SEQ ID NO: 502911 - RNA, 64 nt, Human
auagccaugauuaacugcuauucguggugggggugggggggaacccuaugauuuacuaugcaga

SEQ ID NO: 502912 - RNA, 64 nt, Human
guuuuuuuuuuuuuuuuuuuuuuuuuuuuugggcgggggggagguuuaugaaguuuugcucuuu

SEQ ID NO: 502913 - RNA, 64 nt, Human
uagcauaaaucaguaaauuaguugaguuguuuuugggggggagguggggguagggggcacagaa

SEQ ID NO: 502914 - RNA, 64 nt, Human
ggguguggggauuggaguauaggguaggggagaagggggggagcauucgggggaguggggagug

SEQ ID NO: 502915 - RNA, 64 nt, Human
aauauuuauauacuacugaccaagauguuggggugggggggauuguuuuuuguaaaaaugucau

SEQ ID NO: 502916 - RNA, 64 nt, Human
gccaaaaugcaaaggggaaaaaaaggcagggauugggggggauggggaaguggcccaauaaauu

SEQ ID NO: 502917 - RNA, 64 nt, Human
caucauucauguaguaucuauaauuuguaacagugggggggaaagaugacaugguauuuaauaa

SEQ ID NO: 502918 - RNA, 64 nt, Human
uuucugcauugacauaaauacauuuucuaagggggggggggaagaaauuaaaaaacaccuguua

SEQ ID NO: 502919 - RNA, 64 nt, Human
aagauacauccuuaaacuuuuuuuuuuuuggggggggggggacggagucuugcugcaacgccca

SEQ ID NO: 502920 - RNA, 64 nt, Human
uucuguuuuguuugcaaaaugguaagggggugucgggggggaugggguguauuuuguugcaagu

SEQ ID NO: 502921 - RNA, 64 nt, Human
agaucccagcacuacuuuuuauuacuggagaaaugggggggauagaaaauucuacuuugaauua

SEQ ID NO: 502922 - RNA, 64 nt, Human
cagaggccuaaguuugcuggccugugguuuucuugggggggagggcaggggccccuguggguuc

SEQ ID NO: 502923 - RNA, 64 nt, Human
gcagccauauuccacaguuccuauaauuuuuacugggggggauuugugauaggaaaguccuugg

SEQ ID NO: 502924 - RNA, 64 nt, Human
cgaaucuuauuuuuccuguccugcccgugagggugggggggaccgggccccucucuagggaccc

SEQ ID NO: 502925 - RNA, 64 nt, Human
gaaaaguguuuuaaugcugccauaaaagggaggcgggggggaggaagggaaaauaaaggcaucu

SEQ ID NO: 502926 - RNA, 64 nt, Human
caaacaguaacgugugcgcacgcgcagcgggguggggggggagagagaguuuuaacaauccauu

SEQ ID NO: 502927 - RNA, 64 nt, Human
gggacggugggagggggguuauggugcaaguguugggggggagaauggggaaaggacacacaca

SEQ ID NO: 502928 - RNA, 64 nt, Human
gguaugggagggguuggaaaccaaguugucuccugggggggagaaaacagguuuuauuuuugug

SEQ ID NO: 502929 - RNA, 64 nt, Human
auucugccucagguacuuugauagaguguggggugggggggaccugcuuuggagaucagccuca

SEQ ID NO: 502930 - RNA, 64 nt, Human
acaggaagaagggacucacagcauaaacgggggugggggggauccugauuuugaaaauaaucua

SEQ ID NO: 502931 - RNA, 64 nt, Human
ucuccccuccccacuuacucgaggagagaggugagggggggaugacuugcggguucugaucagg

SEQ ID NO: 502932 - RNA, 64 nt, Human
ccgcccggccagccgccccguccgggagggaggugggggggaucagccccccgcccggccagcc

SEQ ID NO: 502933 - RNA, 64 nt, Human
caccaggcccauguuuauugaccacagucugagggggggggaaggggacugcgguggacaccag

SEQ ID NO: 502934 - RNA, 64 nt, Human
ccuaauaauaugguucaacugugaauguagaagugggggggaggggggagaaaaagaaaacucu

SEQ ID NO: 502935 - RNA, 64 nt, Human
gcucacacccagacucacuggccacaccucagcagggggggagucgagugucagucucuuucug

SEQ ID NO: 502936 - RNA, 64 nt, Human
agccccaggaugggcuucccuggagggggagggugggggggaguucuguuccuugugccccgag

SEQ ID NO: 502937 - RNA, 64 nt, Human
aacugggcuccugaacgccaggaaccuggggucugggggggagcugggcuccuuguuccgagcc

SEQ ID NO: 502938 - RNA, 64 nt, Human
gugacagcugcucccccuccaccugaguuggggugggggggaaagggagggcgagcccuuggga

SEQ ID NO: 502939 - RNA, 64 nt, Human
uuuccuacugaauguaccaaguuccaauuuuuaagggggggaaagguuucaaauggggaaaaac

SEQ ID NO: 502940 - RNA, 64 nt, Human
acuugcucuugauagaaaugcuuagaaacacucugggggggaaaaaagcuccuuccauauacug

SEQ ID NO: 502941 - RNA, 64 nt, Human
ucaugaugaugaguauuuggggguggguggguaagggggggagugggaggggacggaaccaacu

SEQ ID NO: 502942 - RNA, 64 nt, Human
agagaauguauucuguauccgugaauugcuuuaugggggggagggagggcuaauuauauauuuu

SEQ ID NO: 502943 - RNA, 64 nt, Human
agagagacgugguaggucuccaagagucccacccgggggggaagaagcaaagccaucucccacc

SEQ ID NO: 502944 - RNA, 64 nt, Human
cagcuggaaggggaaaagucagggccuucccggcgggggggaaggaggugggcaucgggggcau

SEQ ID NO: 502945 - RNA, 64 nt, Human
caaaacgucccuaaggcguccucgagaugaagacgggggggagcccccagccagguggagaccc

SEQ ID NO: 502946 - RNA, 64 nt, Human
guacaugaagugggggcagugggcagggugcccugggggggaggcauagagggcccuggggguc

SEQ ID NO: 502947 - RNA, 64 nt, Human
ggcaccgagaggcaggccuggcugcgcagggcgcgggggggaggcuggggucccgccgccguga

SEQ ID NO: 502948 - RNA, 64 nt, Human
uuacagagcuuuuuucuguugcucuccgagacuggggggggauuguuucuucuuuuccuugucu

SEQ ID NO: 502949 - RNA, 64 nt, Human
cccuugacaccauccugaaugagggguccagccugggggggacucuaccaaggucuucuugggc

SEQ ID NO: 502950 - RNA, 64 nt, Human
ggauguucacucuauuuauuggggaaggagggaggggggggacacuuaacuuauuccuuuguac

SEQ ID NO: 502951 - RNA, 64 nt, Human
gagccccccucccuucccuccccccuugggggucgggggggacauuggaaaggagggaccccgc

SEQ ID NO: 502952 - RNA, 54 nt, Human
ccacucuggccauccacuagcccagggggggacgcagaccccacacuccaugga

SEQ ID NO: 502953 - RNA, 64 nt, Human
gucagaauuugccauuauugcacaucacauuuuugggggggaaagugcuuaugaauggugcagg

SEQ ID NO: 502954 - RNA, 64 nt, Human
cugggcuggggggaggguagacgugggggcgcuggggggggacuggggugggcuuuuaauuucc

SEQ ID NO: 502955 - RNA, 64 nt, Human
gggaguacuggggagcccucgcggcaagcagggugggggggacuugggggcaugccgggcccuc

SEQ ID NO: 502956 - RNA, 64 nt, Human
cccccagcacugcccuaccccuccacuccgagcugggggggaaucugugucugcuaugggaggg

SEQ ID NO: 502957 - RNA, 64 nt, Human
ggggccaccaugcucauccuacaaacggggaggugggggggacuucuggugggcaagggccccu

SEQ ID NO: 502958 - RNA, 64 nt, Human
acuuacuauugaacaugaaauaauccuagguguugggggggaaaguacugugaauaaugugugu

SEQ ID NO: 502959 - RNA, 64 nt, Human
cucucaguguguuggagagguaggggugcggggugggggggagcugaaucuucaaucggaauaa

SEQ ID NO: 502960 - RNA, 64 nt, Human
gccaagcgcuggggggaagacggggagucagggagggggggaaaucucggaagagggaggaguc

SEQ ID NO: 502961 - RNA, 64 nt, Human
auccgagacauccucuuggcuggcgcuugcugcagggggggacccccccccguccccaggugaa

SEQ ID NO: 502962 - RNA, 64 nt, Human
aucucugguuccuaguuucugauuauucggggaugggggggaugggaggggacagggauucacg

SEQ ID NO: 502963 - RNA, 64 nt, Human
ugugcugggacgacccuugucucccuggguaggggggggggaaugggggagggcugaugaggcc

SEQ ID NO: 502964 - RNA, 64 nt, Human
ucaagugacuuuuggaaaucaaccuuuuuuauuugggggggaggauggggaaaagagcugagag

SEQ ID NO: 502965 - RNA, 64 nt, Human
ccugacuugcagacucggcuugggcagcacuucggggggggaggggguguuaugggagggggac

SEQ ID NO: 502966 - RNA, 64 nt, Human
auugcauuuuuacugauuuucuacaaaagugcaugggggggauuaauuaaaccuucugacugga

SEQ ID NO: 502967 - RNA, 64 nt, Human
cuucugccacuggcggcuucccuucuuggcucuugggggggacuagauccuguggagaagauga

SEQ ID NO: 502968 - RNA, 64 nt, Human
uaguggcauauggaccggaaaggguuaauuuaaagggggggaaccucaaaaguuuuuuuaaaaa

SEQ ID NO: 502969 - RNA, 64 nt, Human
gugggcugccccaaccccaaaugugcccagggaggggggggaacccaaggcacaggccccgccc

SEQ ID NO: 502970 - RNA, 64 nt, Human
acauugaggauuaggauuuuaacauaugaauuuugggggggaugcaaucauucagcccauaaua

SEQ ID NO: 502971 - RNA, 64 nt, Human
accacacugacaucagcuccagcucccccagguugggggggagggggcuccucccaugggaggu

SEQ ID NO: 502972 - RNA, 64 nt, Human
gcuuggcugagggucugggaaaugagcagggauggggggggauguggaucagguuuacuagcac

SEQ ID NO: 502973 - RNA, 64 nt, Human
gacaauugauguuuaaugggggcgguuggggugggggggggagucaauaucuccuauugauuaa

SEQ ID NO: 502974 - RNA, 64 nt, Human
uugugaaugcauuuuccugguguuugaaaaagaagggggggagaauuccaggugccuuaauaua

SEQ ID NO: 502975 - RNA, 64 nt, Human
caccaaacuguuaaaugugguuucucuucggggagggggggauugggggaggggccccagaggg

SEQ ID NO: 502976 - RNA, 64 nt, Human
ccaccagugauuucuccuguuucuuggugggggugggggggaagguacguauucugcaauaugg

SEQ ID NO: 502977 - RNA, 64 nt, Human
auauuugguggggugggugggaaggaagggauuugggggggaaucuuccugccgccucccccac

SEQ ID NO: 502978 - RNA, 64 nt, Human
aggaugauuauuaggcccucgacccucgggccucgggggggagggcccugcacgccgccacccc

SEQ ID NO: 502979 - RNA, 64 nt, Human
agacaauugauguuuaaugggggcgguugggguugggggggagucaauaucuccuauugauuaa

SEQ ID NO: 502980 - RNA, 64 nt, Human
auuuucuguuaaaauugucaaauauauuuuaugaagaauuuauaaaaggggaaaaugauuguaa

SEQ ID NO: 502981 - RNA, 64 nt, Human
ccugagcaaccaggggagaccuuguuucuacaaaagaauuuaaaaauuagcugggcgugguggc

SEQ ID NO: 502982 - RNA, 64 nt, Human
gauauauagauauauauccauacauuuuauugucagaauuuagacugaaacuacacauuggcaa

SEQ ID NO: 502983 - RNA, 64 nt, Human
aauauaaugguaauucauuuuugauguuuugugaagaauuuaaauuuaaacgaauguucuuaaa

SEQ ID NO: 502984 - RNA, 64 nt, Human
cuaauguaauaauauaucuuaauucaaggaaccuagaauuuauuuuucuccuuagagauaagga

SEQ ID NO: 502985 - RNA, 64 nt, Human
cagauugcucuacuugcuaauauuuguauagaauagaauuuauguaaacuaguaaccaguugau

SEQ ID NO: 502986 - RNA, 64 nt, Human
aagaccuuucagaugguuuauuugcuuucagcagagaauuuauuucauacaguuacuuaagagu

SEQ ID NO: 502987 - RNA, 64 nt, Human
aucucuuuauagcuuucccaaaaucuuuuaaaaaagaauuuaauuaaaugacagucuuuugguu

SEQ ID NO: 502988 - RNA, 64 nt, Human
ugccaauaaaguugcaugguaaauauuucauuacagaauuuauguuagagcuuucaugccaaga

SEQ ID NO: 502989 - RNA, 64 nt, Human
uuuuaauaaaaucaaauaauucuaaaagugcuagagaauuuaacuaaaagcugguucccaaaug

SEQ ID NO: 502990 - RNA, 64 nt, Human
aaaaaucaugaacauucuaagagaaaauaaauauagaauuuaaaaaauuauucugguuuguguu

SEQ ID NO: 502991 - RNA, 64 nt, Human
aaggaaacaaucuauuacuuuuuuccuuaaaaggagaauuuauagcacuguaauacagcuuaaa

SEQ ID NO: 502992 - RNA, 64 nt, Human
uuuauaaaguaggaaguuaagugaaucauagauuagaauuuaauacucuuauggaaauaauuuu

SEQ ID NO: 502993 - RNA, 64 nt, Human
uccaagacaaaguuuuucagaaaagaggaaaaaaagaauuuaaaaaaggaucuccacucuucau

SEQ ID NO: 502994 - RNA, 64 nt, Human; identical to SEQ ID NO: 240672

SEQ ID NO: 502995 - RNA, 64 nt, Human; identical to SEQ ID NO: 240282

SEQ ID NO: 502996 - RNA, 64 nt, Human; identical to SEQ ID NO: 240298

SEQ ID NO: 502997 - RNA, 64 nt, Human
ugaagaggcuucuccuguuuuauauauuaugugaagaauuuagaucuuauauugguuugcacaa

SEQ ID NO: 502998 - RNA, 64 nt, Human
ucacugcauugagagaauaguuguuaauuuguuuagaauuuaaguucuacucagaaucauaaca

SEQ ID NO: 502999 - RNA, 64 nt, Human
gacauaucugcagucccagcacagugggacaaaaagaauuuagaccccaaaaguguccucggca

SEQ ID NO: 503000 - RNA, 64 nt, Human
aggugagggcccuauagguaguuggccuguuggcagaauuuauuuaggaacagcccuuuugaaa

SEQ ID NO: 503001 - RNA, 64 nt, Human
gaauucaaccuuuguucuaacacauacuagagcaagaauuuacuugauuuggaauaauuaauag

SEQ ID NO: 503002 - RNA, 64 nt, Human
agcuuucaucacacccuuuuaacauuuaucuaaaagaauuuaaauucuuuuucaaaaauuacac

SEQ ID NO: 503003 - RNA, 64 nt, Human
uauauuuauuuacaaaacacuucauuauuuauaaagaauuuacuaacaguuuaucuuauuuaua

SEQ ID NO: 503004 - RNA, 64 nt, Human
aaacuuuuucuuuaaaauucaauuaaguuacaccagaauuuacaggcaagauuuuuuuuuucau

SEQ ID NO: 503005 - RNA, 64 nt, Human
caugugcuugguugauggccaugcaucuucagucagaauuuauauauaaauguaugcacccauu

SEQ ID NO: 503006 - RNA, 64 nt, Human
cucuuuacgugcuaauuuguaaucuuguuuuguaagaauuuauccuacccuugaaacaggcuca

SEQ ID NO: 503007 - RNA, 64 nt, Human
auguggauuacaaguccugcuuugacacugggcaagaauuuaagauuguucuaucucuacuagu

SEQ ID NO: 503008 - RNA, 64 nt, Human
aagcagaaaaccugagcuccccacucacugcccuagaauuuauggcaaggagcaaaucuacagc

SEQ ID NO: 503009 - RNA, 64 nt, Human
uaccuuacaguuaaucguuucuuaauaaagaagcagaauuuagaaaccacaggauaguguaccc

SEQ ID NO: 503010 - RNA, 64 nt, Human
uaaaauuugaauccauaauauaucuaauuacaggagaauuuacaacaucucaaguacguaaauu

SEQ ID NO: 503011 - RNA, 64 nt, Human
cugaauuuagcugauuuaaaauucuuaauauucaagaauuuauacuuauuuuuuccuuaaaagc

SEQ ID NO: 503012 - RNA, 64 nt, Human; identical to SEQ ID NO: 242551

SEQ ID NO: 503013 - RNA, 64 nt, Human; identical to SEQ ID NO: 242552

SEQ ID NO: 503014 - RNA, 64 nt, Human; identical to SEQ ID NO: 242553

SEQ ID NO: 503015 - RNA, 64 nt, Human
uuggugacaguaauaaaucaaugugaggauggauagaauuuaguauaugauagagaaaauguca

SEQ ID NO: 503016 - RNA, 64 nt, Human
ucuucguugcaaguuauaguuguggauaaaggggagaauuuauugcucuugcaaaccaauuaug

SEQ ID NO: 503017 - RNA, 64 nt, Human
gaaauucaaacaguaaugcaaaagugucugcauuagaauuuacggugucuaaaauucauguuuu

SEQ ID NO: 503018 - RNA, 64 nt, Human
aaucaaguucuuuuugaaauuuuaucaguaauccagaauuuaguaguccaugccuucucacuca

SEQ ID NO: 503019 - RNA, 64 nt, Human
uuuacaauuuccauucuuuugugccacgaguguuagaauuuaaaugaauacuuuuacaaagucu

SEQ ID NO: 503020 - RNA, 64 nt, Human
aaaagcuugauaugacagagaagaagaaggcucaagaauuuauucaccaguuccucugcaaccc

SEQ ID NO: 503021 - RNA, 64 nt, Human
cauuuacugauuugcagugaugaauauuuuuaugagaauuuaaacuuagcaagaauggccaugg

SEQ ID NO: 503022 - RNA, 64 nt, Human
cacugcgccuggcccagcguuacuuuucuugauaagaauuuacagauaagacacucagagagac

SEQ ID NO: 503023 - RNA, 64 nt, Human
uguuuuguuuaaccuugaugaauuguauaaagagagaauuuaaaaaauuacauucuuuauuuuc

SEQ ID NO: 503024 - RNA, 64 nt, Human
ucauguacauuacagauauuaucuaaauucuucuagaauuuauuuuucaugaaauauugaugua

SEQ ID NO: 503025 - RNA, 64 nt, Human
accauauaaaaacgauaauugcuuuauuuggaaaagaauuuaggaauacuaaggacaauuauuu

SEQ ID NO: 503026 - RNA, 64 nt, Human
uuuucugagcucuaagaauuaucagaaacaggaaagaauuuagaaaaacuugagaaaaccuaau

SEQ ID NO: 503027 - RNA, 64 nt, Human
uggaaaauccaauuugaauaagucaugcuuuccuagaauuuaaaaauaaaaaagucuuccucug

SEQ ID NO: 503028 - RNA, 64 nt, Human
aucugugaaaugaacaaggaagugaggcuucccaagaauuuagcuugcugugcaguggcugcag

SEQ ID NO: 503029 - RNA, 64 nt, Human
aaucuuuaguagauuugauuaaauaaugauucacagaauuuaguaacagaaucaaacuaagcca

SEQ ID NO: 503030 - RNA, 64 nt, Human; identical to SEQ ID NO: 240300

SEQ ID NO: 503031 - RNA, 64 nt, Human; identical to SEQ ID NO: 240673

SEQ ID NO: 503032 - RNA, 64 nt, Human; identical to SEQ ID NO: 240763

SEQ ID NO: 503033 - RNA, 64 nt, Human
gacccuguauuuaaucuacuuugaucagagaaguagaauuuauaacagguuagcuaaaauuggg

SEQ ID NO: 503034 - RNA, 64 nt, Human
uuuuuuuuuuuuuuuuuuucaauauuuuaaaaggagaauuuaaauacugugcuuacugugaaau

SEQ ID NO: 503035 - RNA, 64 nt, Human
guuggcuuaaaaagagguugagcaccagaaucucagaauuuaccaccaaagaacucauccaugu

SEQ ID NO: 503036 - RNA, 64 nt, Human
auaaauuugguucuaauagaacucaguuuuaacuagaauuuauucaauuccucugggaauguua

SEQ ID NO: 503037 - RNA, 64 nt, Human
ucuccccuuuuucuaugauuccaaaaggaccaguagaauuuaaauugguugguugauuguuuau

SEQ ID NO: 503038 - RNA, 64 nt, Human
uaaaauguugcuuuguaccuggugucuuuuauuaagaauuuacuccccccauuucucacagaga

SEQ ID NO: 503039 - RNA, 64 nt, Human
acuuugaaaaguggagaaaguguauucuuuaaagagaauuuacuucuaaaagccacaggugcuu

SEQ ID NO: 503040 - RNA, 64 nt, Human
uccugucaaaaucaauucagaaauucuaacuuggagaauuuaacauuuuacucuuguaaaucau

SEQ ID NO: 503041 - RNA, 64 nt, Human
uuauuguugaacuauaauuaauaauuuggauggcagaauuuaucucuuuuuuguaaacucucau

SEQ ID NO: 503042 - RNA, 64 nt, Human
cuuuugcauagaugguuugucaauuuaaaauuccagaauuuauuauugccauauuuucacaugc

SEQ ID NO: 503043 - RNA, 64 nt, Human
guguucaguuucuacacaacuuuaucauccgcuaagaauuuaaaaaucacauucucuguucagc

SEQ ID NO: 503044 - RNA, 64 nt, Human
uguuaauaaauuucaguuuaguucuguaaugucaagaauuuaagaauuaaaaaacggauugguu

SEQ ID NO: 503045 - RNA, 64 nt, Human
gaaaagaguguccaagaggaguaaaggucaugacagaauuuacucccaggacaaucuaaguucu

SEQ ID NO: 503046 - RNA, 64 nt, Human
ggaaguugagguaaugcuuaacauuguugcugugagaauuuacugcccuauguuucccagagcc

SEQ ID NO: 503047 - RNA, 64 nt, Human
cccugucucaaaaagaaaaaaaaaguugaccuugagaauuuauaauauucugagaaaacuggaa

SEQ ID NO: 503048 - RNA, 64 nt, Human; identical to SEQ ID NO: 240781

SEQ ID NO: 503049 - RNA, 64 nt, Human; identical to SEQ ID NO: 240352

SEQ ID NO: 503050 - RNA, 64 nt, Human; identical to SEQ ID NO: 242069

SEQ ID NO: 503051 - RNA, 64 nt, Human
cucuuggugcuucaguuuccucaucugugaaauuagaauuuauaauaauugcaccuaccuccca

SEQ ID NO: 503052 - RNA, 64 nt, Human
gaaauugcacuuuuccugacuuaccuagaaaucaagaauuuaggaaauuaauguggacacuaua

SEQ ID NO: 503053 - RNA, 64 nt, Human
ucaguagcaauacacuaggaaguaaaauauauuuagaauuuaaacauugugugccagugguccu

SEQ ID NO: 503054 - RNA, 64 nt, Human
uaaaaguuuaauuccuuacagaagaaccaguggaagaauuuaaauuuggcacuacgaucaaaac

SEQ ID NO: 503055 - RNA, 64 nt, Human
cggugucagagcauuuuaacuagccacucagaugagaauuuauguuuaacuucucuuuuuacuc

SEQ ID NO: 503056 - RNA, 64 nt, Human
aaguuucaacuucuggcgguuaaaauauuaaugcagaauuuacuaagauuuuauucauuugcau

SEQ ID NO: 503057 - RNA, 64 nt, Human
acauuaagugacuguaucauguucgguuuaauaaagaauuuaugcagcaccauuuaacguuuug

SEQ ID NO: 503058 - RNA, 64 nt, Human
uggaagauugguuuaaaaagaaaaguguaaugcaagaauuuaaagaaauauuuuuaaagccaca

SEQ ID NO: 503059 - RNA, 64 nt, Human
uuaguauuaucuguuuauaaugccuguuaauaaaagaauuuacaguuugguaaaauugcugcua

SEQ ID NO: 503060 - RNA, 64 nt, Human
uucaguggaagguuauugcuauugucauuugcauagaauuuaagugauugauuuaaaaaaacug

SEQ ID NO: 503061 - RNA, 64 nt, Human
aaauuaucugcuacauaaauuauugaagcuuuucagaauuuacaacucuggugacuucugaugu

SEQ ID NO: 503062 - RNA, 64 nt, Human
acacuauauauguaaaguuuccaguacuagucccagaauuuagaauaugcucaacacaaaguaa

SEQ ID NO: 503063 - RNA, 64 nt, Human
caaacuuaaauggaagaauucugaaagagaggauagaauuuaaagaacaagaguauauaaaguu

SEQ ID NO: 503064 - RNA, 64 nt, Human
uuucucccauaaccuuuguacacuaaaaaaugaaagaauuuagaauguauuugaugauagcauu

SEQ ID NO: 503065 - RNA, 64 nt, Human
guauuugaugauagcauucucacuaagacacaugagaauuuaacuuuauaaccgcgugaguuaa

SEQ ID NO: 503066 - RNA, 64 nt, Human; identical to SEQ ID NO: 240441

SEQ ID NO: 503067 - RNA, 64 nt, Human; identical to SEQ ID NO: 240386

SEQ ID NO: 503068 - RNA, 64 nt, Human
cccaacagcuuuguugauguagcuuguaucucugagaauuuauuguauuaaaauuaauacugag

SEQ ID NO: 503069 - RNA, 64 nt, Human
ggugccauccacauuuuaacaguaccugugccugagaauuuaauuuuuaaaagacuuugaugug

SEQ ID NO: 503070 - RNA, 64 nt, Human
agaauugcuugaaguaagcaacugauggcauuugagaauuuauguaucacugaguuuuuuggga

SEQ ID NO: 503071 - RNA, 64 nt, Human
cucuugcuacagucgccuuugcuacugcuuuaagagaauuuacagguauugauaaagaacaaga

SEQ ID NO: 503072 - RNA, 64 nt, Human
ggccucgagccugcaacaguccaaaccggaagggagaauuuauuuuuugaaacugaaggaaguc

SEQ ID NO: 503073 - RNA, 64 nt, Human
caaugaaaucuuacuuuucagugacugaaaagauagaauuuauuugcuaauaaucauuuaucaa

SEQ ID NO: 503074 - RNA, 64 nt, Human
caucaucccauuuauaagaagagaagagcauguuagaauuuauguucaccuuuauuacaauuuc

SEQ ID NO: 503075 - RNA, 64 nt, Human
cugugaaacuucauauugcugaagacauacacuaagaauuuauguagauaauguacuuuuauga

SEQ ID NO: 503076 - RNA, 64 nt, Human
aaaggcagaaaugauucaggggaaaaucgggccuagaauuuacacuggguugacuaguuaugau

SEQ ID NO: 503077 - RNA, 64 nt, Human
aaaaaguacugugaccugagagacacccuccucuagaauuuaguggcgggucugggcuggcaga

SEQ ID NO: 503078 - RNA, 64 nt, Human
gacgggaaauacacauuaugcuaauguugaugacagaauuuauuugguugccuuguguguuaau

SEQ ID NO: 503079 - RNA, 64 nt, Human
ugcaguccuuccaugugggagcagaggugugaagagaauuuacgugguugugaugccaaaauca

SEQ ID NO: 503080 - RNA, 64 nt, Human
uggacuugacagcuucuuuugccacaagcaagagagaauuuaacacuguuucaaacccggggga

SEQ ID NO: 503081 - RNA, 64 nt, Human
ucuuguagugagcaguguauggucucuuuuguucagaauuuaaaacugauaaccaaugaaagcc

SEQ ID NO: 503082 - RNA, 64 nt, Human
gucuagagccuguugguguucugucccuacuuuaagaauuuaauugcucacuuauucugaaagc

SEQ ID NO: 503083 - RNA, 64 nt, Human
guauacaaaagcuauuuaauucuuuaaaaaguaaaaacucuacauggucgcaaaaauguguuua

SEQ ID NO: 503084 - RNA, 64 nt, Human
guugcaguaacaaacuccagucuguugcaguaacaaacucuagaauauugacauucucuguggg

SEQ ID NO: 503085 - RNA, 64 nt, Human
gggauggggaaaauaaacuuaacucuacaaaagcaaacucuaaugcaugcaagaaucauuaggu

SEQ ID NO: 503086 - RNA, 64 nt, Human
uguuguggcuuuuaaugccagaagaaaaguuaccagaauuuauaauuuauaguaauuuuuugau

SEQ ID NO: 503087 - RNA, 64 nt, Human
auguauacauaagguauuaaugauauaguuauugagaauuuauauuaacuuuuuuuucaagaac

SEQ ID NO: 503088 - RNA, 64 nt, Human
ccucuguguacaaaccaagagcuuuuacagauccagaauuuauuaguuuaaaaugcaggugaac

SEQ ID NO: 503089 - RNA, 64 nt, Human
ucaaaaccaaaaggaaucagaauaaggaucacugagaauuuaaaaaaauaaaaaaggaaguaaa

SEQ ID NO: 503090 - RNA, 64 nt, Human
uauauaauuacuugauagcacaauaaacauagaaagaauuuauaugaaugucuauauuuaagga

SEQ ID NO: 503091 - RNA, 64 nt, Human
ucaaacuguggacuugauuuuguuagcuuuuuucagaauuuaucuuucauucaguucccuucca

SEQ ID NO: 503092 - RNA, 64 nt, Human
aauugcaaagauguuuacaucaaagcuucuucacagaauuuaagcaagaaauauuuuaauauag

SEQ ID NO: 503093 - RNA, 64 nt, Human
cuaugugcaccguugggaccaaugccuuaauuaaagaauuuaaaaaaguuguaauagagaauau

SEQ ID NO: 503094 - RNA, 64 nt, Human
ccuccccugcuguuguaaauacuguaauuaucggagaauuuaaauuauucucauuuguaacugc

SEQ ID NO: 503095 - RNA, 64 nt, Human
cauaacuagagcacgggcguuauguaaguuucuaagaauuuagaggauaaauaauaaagguucu

SEQ ID NO: 503096 - RNA, 64 nt, Human
gucucuuguggcaauagcacuuugaagaaaauagagaauuuaauauauggugauugggauaugu

SEQ ID NO: 503097 - RNA, 64 nt, Human
uaaaugaacauaugaauguaauuuauauauuccuagaauuuaaguuacuuugugagauuugggc

SEQ ID NO: 503098 - RNA, 64 nt, Human
cacuuuuggaaaacuguuaccugagacccaggggagaauuuacuggccauuuuaguuguaucac

SEQ ID NO: 503099 - RNA, 64 nt, Human
cucucugaaaacugcaaauggaaaggaauucaaaagaauuuagauuaaaaguuaaauaaaaagu

SEQ ID NO: 503100 - RNA, 64 nt, Human
cugaaguagaauugauuguucagcuggagcccagagaauuuaauuuaauguuuuuucuuuguac

SEQ ID NO: 503101 - RNA, 64 nt, Human
auuguuucguaacacagcauuguauaugugaagcaaacucuaaaauuauaaaugacaaccugaa

SEQ ID NO: 503102 - RNA, 64 nt, Human
uucaaaaacuuaaaaaucaggagauuccuucauaaaacucuagcauucuaguuucauuuaaaaa

SEQ ID NO: 503103 - RNA, 64 nt, Human
caaaauuaguaccucaaaguaaaaauugaacuguaaacucuaucagcauuguuucaaaauaguc

SEQ ID NO: 503104 - RNA, 64 nt, Human
aagauguggggaaaauucucauaagcuacugaugagaauuuauaaauuauuaugacaccuuugg

SEQ ID NO: 503105 - RNA, 64 nt, Human
caugcccagggcuaucugaaacaaugucucauuaagaauuuaggguucuuccaugggcuuacug

SEQ ID NO: 503106 - RNA, 64 nt, Human
uggacuuccugaguccaaucccaccuccugguguagaauuuacacugcugcaccugaggucgau

SEQ ID NO: 503107 - RNA, 64 nt, Human
aaaaugccaagaaugucuuagaauugcacaauuuagaauuuauagagccuuuaaucaccuuguc

SEQ ID NO: 503108 - RNA, 64 nt, Human
uuggguuagaguuaugguaggcaaaaagaaaaggagaauuuaggaaauaaauaugcuauaaaca

SEQ ID NO: 503109 - RNA, 64 nt, Human
uugauuuauaaaucuuucaaauuaguuccuuuuuagaauuuaccaacagguucaaagcauacuu

SEQ ID NO: 503110 - RNA, 64 nt, Human
uguuuucuucuaggggccaccuuaucuuaguuccagaauuuagucuuccuuuggaauacuaccu

SEQ ID NO: 503111 - RNA, 64 nt, Human
acuuugauuggcuggcaaacauuuuaucauugucagaauuuaauuuagauuucaaaaauagcuu

SEQ ID NO: 503112 - RNA, 64 nt, Human
uagacuaauuaaccuaagcuaccuuuaacaacguagaauuuagauggguucauauaugugagaa

SEQ ID NO: 503113 - RNA, 64 nt, Human
agugaaaagaagccauucaaccagagaacaagcuagaauuuauuuugcuucugugguuguaaaa

SEQ ID NO: 503114 - RNA, 64 nt, Human
uuuuguaaaccagucauucugaauuauagugaugagaauuuaaauauaugcuuuucuagaauuu

SEQ ID NO: 503115 - RNA, 64 nt, Human
aagcugugacauuuaucuaccugguuuauggaauagaauuuauugcugaaucaugcuccaguau

SEQ ID NO: 503116 - RNA, 64 nt, Human
uuguuuguugcuugcuuugguaauugaauucugaagaauuuaucugcaugacgauaacuaggca

SEQ ID NO: 503117 - RNA, 64 nt, Human
uugcauaggaauugcacaauccaugaacagcauuagaauuuacagcaagaacagaaauaaaaua

SEQ ID NO: 503118 - RNA, 64 nt, Human
accuugagaggaaggacaagaagaaagaugggauagaauuuaaauagagaagaaugccauuuua

SEQ ID NO: 503119 - RNA, 64 nt, Human
auuauuagggcauacucgggcuguuuccaaauauaaacucuauugcaauaucuuauuucaucuu

SEQ ID NO: 503120 - RNA, 64 nt, Human
aagagaaugaaugacagaaaaaaaaaagagagacaaacucuaggaacaaugccgauucauucca

SEQ ID NO: 503121 - RNA, 64 nt, Human
aaaguguuuguuacccuaaguuuuuuacauuuuuaaacucuaauuacauaugugaauguuauua

SEQ ID NO: 503122 - RNA, 64 nt, Human
uugugcaccuaagcugcagaccaagccuuugcccagaauuuaaggauuccaauggacgaccuau

SEQ ID NO: 503123 - RNA, 64 nt, Human
ugccuuaucugaauucuucuugaaacuugagcuuaaacucuaauagcuguuucccuuucuauuc

SEQ ID NO: 503124 - RNA, 64 nt, Human
aaaaaauauaauaagaaaaaaguagagauucuccaaacucuagccugguuuccuagauugagaa

SEQ ID NO: 503125 - RNA, 64 nt, Human
aaauguauaaauguuauuuuugauguuuauauauaaacucuauauccuaauuuacuaauacuca

SEQ ID NO: 503126 - RNA, 64 nt, Human
uuguuucuuugcacagacauuuugucaaauauuaaaacucuacuuuuuuauggcacauauuagc

SEQ ID NO: 503127 - RNA, 64 nt, Human
uguucuuucagaaaaauguuuuuccaauuaguauaaacucuacaaauucccucuugguguaaaa

SEQ ID NO: 503128 - RNA, 64 nt, Human
cugaauaagauuagaguguuucuuaauucauuucaaacucuaaaauuagauuaaugguggugcu

SEQ ID NO: 503129 - RNA, 64 nt, Human
uaauuucuauuuuuuuuucuauuucaauguauuuaaacucuagacacaguuuuuauccuggauu

SEQ ID NO: 503130 - RNA, 64 nt, Human
gagccauuaucagucaugccuuauuuucuugcuaaaacucuauguaaauuuaaguaugcaaaau

SEQ ID NO: 503131 - RNA, 64 nt, Human
cagcuuuuaugucaaaaaagugagacagggaugaaaacucuaaaaagccauugaugagauguau

SEQ ID NO: 503132 - RNA, 64 nt, Human
auuuucccuucauguuuuaacuuauuguugcugaaaacucuauguccggcuuuaacuaucuucu

SEQ ID NO: 503133 - RNA, 64 nt, Human
gagagccaaaccucauaauuauguguguuccagaaaacucuaaauauaacagacccuacagggg

SEQ ID NO: 503134 - RNA, 64 nt, Human
aaacaaaauaauguguaauuuuccauuugggggcaaacucuauucuugugagcauuauuaaauc

SEQ ID NO: 503135 - RNA, 64 nt, Human
guuuugguuagaaagugaauuuaaaaaacaaaccaaacucuaaacuuucucagauuaaaagucc

SEQ ID NO: 503136 - RNA, 64 nt, Human
uagacauggcagcuacugcaucuucaugugucacaaacucuacaucugcuucuccuguggcucu

SEQ ID NO: 503137 - RNA, 64 nt, Human
aaguugcuggaaccaaaauggagucacuuaugccaaacucuaauaaaauggagucggggggcca

SEQ ID NO: 503138 - RNA, 64 nt, Human
cagaacagucuaaucaaugccaaguauccaaggcaaacucuaauacccauccauugugcaaaac

SEQ ID NO: 503139 - RNA, 64 nt, Human
aauuccaaagccuuccuauugggcgaauucccucaaacucuauuugaccugacagccauacgua

SEQ ID NO: 503140 - RNA, 64 nt, Human
gugccuuugcuaugaauuaauaugcacuuucugaaaacucuaaagccugggaaacauuuuaguu

SEQ ID NO: 503141 - RNA, 64 nt, Human
guuuccaaucucugggaccucuguacccaaacugaaacucuaaauuggggcccuaacuaauuuu

SEQ ID NO: 503142 - RNA, 64 nt, Human
guacuguagucacucaguauuuguauauguugcuagaauuuagauuguaaaauagugaaauuuu

SEQ ID NO: 503143 - RNA, 64 nt, Human
acaaaaaacaaacaaacaaaaaagcuauggcacuagaauuuaagaaauguuuugguuucauuuu

SEQ ID NO: 503144 - RNA, 64 nt, Human
ggugcuuguuggaagagugcuuacuuaccucgagagaauuuacaggaguccacaugacaguguc

SEQ ID NO: 503145 - RNA, 64 nt, Human
aagucauaguccaaucucuucaaggacccaagauagaauuuaggaauuuugugaagcugcauua

SEQ ID NO: 503146 - RNA, 64 nt, Human
acugaaauuauuauuagccaaugcauuggugcauagaauuuacuagggcuacuucuggaagcca

SEQ ID NO: 503147 - RNA, 64 nt, Human
gugugguucaagcuguaacuguugaaauuauuuuagaauuuaugacgauuucucagcagggccu

SEQ ID NO: 503148 - RNA, 64 nt, Human
gcuauuaucauucuuuuaagaauuauaagccaaaagaauuuacgccuuaaugugucauuauaua

SEQ ID NO: 503149 - RNA, 64 nt, Human
auuccguauaccaaaauccauuuccuuuguaacaagaauuuaccaguaacugugaucuagguug

SEQ ID NO: 503150 - RNA, 64 nt, Human
uucucaauaucaacauauuuaauuuggacucuuuagaauuuauacacuaauaaauuuaaaugau

SEQ ID NO: 503151 - RNA, 64 nt, Human
uauggcccaaaaugaccaacgaaauuguuacaauagaauuuauccaauuuugaucuuuuuauau

SEQ ID NO: 503152 - RNA, 64 nt, Human
uucauagccuacauuuuaguuucuaaagccaagaagaauuuauuacaaaucagaacuuuggagg

SEQ ID NO: 503153 - RNA, 64 nt, Human
agguggcuugagcucagcuccuggagggacagugagaauuuauuuguauaugccgucaucacaa

SEQ ID NO: 503154 - RNA, 64 nt, Human
gaauugggcuguauguauauuguucuuccuccuuagaauuuagagauacaagaguucuacuuag

SEQ ID NO: 503155 - RNA, 64 nt, Human
cuuuaccacauccucaaacuuuguuaaacauaagagaauuuauaccagagagaaacccuacaca

SEQ ID NO: 503156 - RNA, 64 nt, Human
gauugaaauuuguagcauuuuguauuauuuacacagaauuuauuuguauaugaaacucauacca

SEQ ID NO: 503157 - RNA, 64 nt, Human
gcauugagaugaugaacaagggguuagcaauagcaaacucuauaauuauuuugacuaauuacuu

SEQ ID NO: 503158 - RNA, 64 nt, Human
uugccaucugucacucacuauauucacaaaaauaaaacucuacaacucauucuaacauugcuua

SEQ ID NO: 503159 - RNA, 64 nt, Human
cuccaggucaucuguguguuuagccuuucaggguaaacucuagaggguucaguuuauaauuccc

SEQ ID NO: 503160 - RNA, 64 nt, Human
cucagauucuaaagcauuuaaagacaauucuagcagaauuuaucaaaacaagaugaaacacaga

SEQ ID NO: 503161 - RNA, 64 nt, Human
auguacuguagaaugugauggaaaagcauugaugagaauuuauuggcaguucagauuguguuuu

SEQ ID NO: 503162 - RNA, 64 nt, Human
gugcuuuccaucuuagaaaucugauuguucugucagaauuuauauuuacagguuucaaagcaau

SEQ ID NO: 503163 - RNA, 64 nt, Human
uaauguuuaaaauuucuuagaaaacaauggaaugagaauuuaagccucaaauuugaacaugugg

SEQ ID NO: 503164 - RNA, 64 nt, Human
cugccauacccuugaccagaaauuuuucuucuaaagaauuuaauucuaaaaguuauagacauuc

SEQ ID NO: 503165 - RNA, 64 nt, Human
agaggagcauauacugaaaagaaggcaguaucacagaauuuauacuauaaaaagggcaggguag

SEQ ID NO: 503166 - RNA, 64 nt, Human
ugagucuggguccauuauuuuggcagaacuccuaagaauuuaugggagccuauauaaacauauc

SEQ ID NO: 503167 - RNA, 64 nt, Human
ggacuauuaaauucaucuuagaauaaauuagugaagaauuuaauuuuagaauaaauaauccaau

SEQ ID NO: 503168 - RNA, 64 nt, Human
uuuuacuaggcaaaauguuugaaguauguucaguagaauuuaggggcuuugguucuuacagauu

SEQ ID NO: 503169 - RNA, 64 nt, Human
gugcuaguucugcaauaaagcauacauuuuuucaagaauuuaaauacuaaaaaucagauaaaug

SEQ ID NO: 503170 - RNA, 64 nt, Human
uuuaaagaacaaaucacacauuuaaaaaaucuguagaauuuauuuuaacuaugaccuuuaauug

SEQ ID NO: 503171 - RNA, 64 nt, Human
aucuucuauuucuaccacauuuugcacauucaacagaauuuauauguuguaauaggaauuaucu

SEQ ID NO: 503172 - RNA, 64 nt, Human
cccuauuccucaacugaaugucuuucaauaaauaagaauuuaucauuuauuuucugcaacuuuu

SEQ ID NO: 503173 - RNA, 64 nt, Human
guucucguuuuguaguucagaaagugaggcucaaagaauuuauguaaccuucccagagucacag

SEQ ID NO: 503174 - RNA, 64 nt, Human
uuucugucaaccacggacguuugccuucauguguagaauuuacuguuguuaugcaaauuauauu

SEQ ID NO: 503175 - RNA, 64 nt, Human
auccaaucaaagugucauuugcaacccagauguaaaacucuaaugauuuggccaugaggcgcug

SEQ ID NO: 503176 - RNA, 64 nt, Human
ugauuugcacucuguaguguuuaaagaaacaaagaaacucuaauauugaaucucuuaaauuuag

SEQ ID NO: 503177 - RNA, 64 nt, Human
gucuuuuucauuaaaaauuuaaaacuuuucccauaaacucuauacuucuaaggugccaccaccu

SEQ ID NO: 503178 - RNA, 64 nt, Human
gauuuuuaaguaaagaaagacaauuggacccuuaagaauuuaugcauuuguaaaguugcuguug

SEQ ID NO: 503179 - RNA, 64 nt, Human
ggaaaagaaagggaaguaaauugaaaaaggggggagaauuuauuguaguggcugccuaaaaacc

SEQ ID NO: 503180 - RNA, 64 nt, Human
gagcaguaguacuaaggcgucuuuuguaggcuuaagaauuuauccuaauggccuuuauaggacc

SEQ ID NO: 503181 - RNA, 64 nt, Human
accuuccauccaguugcugaugcuuugucuucagagaauuuacccuuaaccaagcaguguuaga

SEQ ID NO: 503182 - RNA, 64 nt, Human
ucuaaaaaaaaguaaaaaauacauagaauacuugagaauuuagcagggacagggaaaaauuucc

SEQ ID NO: 503183 - RNA, 64 nt, Human
guggcaaagaacuggauauuaaacuuugcaaaagagaauuuagaugagagaugcaauuuuuuaa

SEQ ID NO: 503184 - RNA, 64 nt, Human
guuuccuaaaucagcauuuuucuuuagucauuuaagaauuuaccagaaauauuugcucaauaug

SEQ ID NO: 503185 - RNA, 64 nt, Human
guuucuucuaauuauaaaauguuuaaacuuucugagaauuuaaaaagccaccacuguucccagu

SEQ ID NO: 503186 - RNA, 64 nt, Human
ccauucugcagcguuucucuuucccuuggaaaagagaauuuaucauuacuguuacauuuguaca

SEQ ID NO: 503187 - RNA, 64 nt, Human
ucagugaauuguguaggagagguugucuguggccagaauuuaaaccuauacucacuuucccaaa

SEQ ID NO: 503188 - RNA, 64 nt, Human
uuggucuucaauaaugcuaaauaucuacauuuuuagaauuuaucaacauuuaacuagauaauug

SEQ ID NO: 503189 - RNA, 64 nt, Human
gaucauuaucucuuuccuuuuuuauguuaaugagagaauuuagccuccacucaacaauguucaa

SEQ ID NO: 503190 - RNA, 64 nt, Human
aagguggaagucaaaucaguauucuguaauuguuagaauuuauuuuuuaagaacuuacaacuca

SEQ ID NO: 503191 - RNA, 64 nt, Human
acauccaggaguuauguuuaaguaaaaauccuugagaauuuauuaugucagauguuuuuucauu

SEQ ID NO: 503192 - RNA, 64 nt, Human
aucagagugaaugugccuucuuaaccagagcuacagaauuuagugaauaauuaaaguacaaacu

SEQ ID NO: 503193 - RNA, 64 nt, Human
guugcacaaaaccacuuuuuuuuccccaaguauuaaacucuaauguaccaaugaugaauuuauc

SEQ ID NO: 503194 - RNA, 64 nt, Human
gaaaaaaaaaaaaaagauaauucauacugaaaagaaacucuacaaacuugaaagaugugacagu

SEQ ID NO: 503195 - RNA, 64 nt, Human
uuccuuauucaacaugagaaagcucaugggcaagaaacucuaugaauaaccaagauggagccgg

SEQ ID NO: 503196 - RNA, 64 nt, Human
cucacugaaucuaaccauagcugaccuuuguaguagaauuuacaacuuauaauuacaaugcaca

SEQ ID NO: 503197 - RNA, 64 nt, Human
gugagauauuucaggugggaucaaagaggucauaagaauuuauuuucuuuugugggguguaacu

SEQ ID NO: 503198 - RNA, 64 nt, Human
aauugucuauuaaaugcaagacgugguaauauacagaauuuaucaggcauuaccaagucuaggc

SEQ ID NO: 503199 - RNA, 64 nt, Human
ugcuaugcuuauaugucuucuauaaauccaaugcagaauuuaaaauuucaguuuacucuaguua

SEQ ID NO: 503200 - RNA, 64 nt, Human
auaaacuacauagggguguuuauuugugucacaaagaauuuaaaauaacacuugcccaugcuau

SEQ ID NO: 503201 - RNA, 64 nt, Human
uaaaaucauuuuuacaaguacagcauucuuggaaagaauuuaacacccaaaaaggggaaaaugu

SEQ ID NO: 503202 - RNA, 64 nt, Human
guaaaguaugacggaacaagguagcagaugguacagaauuuauacuauuuaagaagagaugugg

SEQ ID NO: 503203 - RNA, 64 nt, Human
auaucuauaaaauagauauaaauuuuuaagagaaagaauuuaguauuaucaaagggauaaagaa

SEQ ID NO: 503204 - RNA, 64 nt, Human
cugcauaacuaaaaucacaaaccuauuccucaaaagaauuuaauuuuauauuuaugagggggcc

SEQ ID NO: 503205 - RNA, 64 nt, Human
aaagaugucacuucauguuggguuauaaucccacagaauuuacuuuaaaugucacguaaaaaca

SEQ ID NO: 503206 - RNA, 64 nt, Human
gguguauaugguccacugguuucaggccaaaucuagaauuuagugauacuggcucagaagaauu

SEQ ID NO: 503207 - RNA, 64 nt, Human
ggccaaaucuagaauuuagugauacuggcucagaagaauuuaaguucuauucagccuuccuggg

SEQ ID NO: 503208 - RNA, 64 nt, Human
caugauuuugcuacuaucauuuuucacuuuucaaagaauuuaaccuauuuuacagcaguucagu

SEQ ID NO: 503209 - RNA, 64 nt, Human
uuccguccucaauuucuaccuccauagaccggccagaauuuagcuucacuugagagagaucugg

SEQ ID NO: 503210 - RNA, 64 nt, Human
auucauaauaaugucuacauugaaaaauuuaucaagaauuuaaaggauuucauggaagaaccaa

SEQ ID NO: 503211 - RNA, 64 nt, Human
acgccauugcacuccagccugggcaacaagagcaaaacucuaucucaaagaaaaaaagaaaauu

SEQ ID NO: 503212 - RNA, 64 nt, Human
acaaugcucuuccccuugaccacuucucaguaugaaacucuaugucuucaacuuucagaccccc

SEQ ID NO: 503213 - RNA, 64 nt, Human
cuuuaagaguuuaaaaucaucagaaaggaaaaacaaacucuauauuguucagcaugcaauacau

SEQ ID NO: 503214 - RNA, 64 nt, Human
aaauuucauuuuagcuuuacaaguccaaaaacacagaauuuauauauucagauacucuagcacu

SEQ ID NO: 503215 - RNA, 64 nt, Human
aucggcauuaacgucaaguacacacuacugagagagaauuuauucucuguuuaccacuaauuau

SEQ ID NO: 503216 - RNA, 64 nt, Human
aauauuuagcccuuccuugguagguagcuucucuagaauuuaauugugcuuuuuuuuuuuuuuu

SEQ ID NO: 503217 - RNA, 64 nt, Human
auagugauaauguuaacauguuuguaauugcuacagaauuuaaggguauuuuuaucucugugcu

SEQ ID NO: 503218 - RNA, 64 nt, Human
uaggaaaccaagauuagaaacauuagaaauuugcagaauuuaagaaauuauguuuugugguaau

SEQ ID NO: 503219 - RNA, 64 nt, Human
uuucuuaggaauugaugaaggcuuauugguaucaagaauuuaaaccaaauuaaaacugacagag

SEQ ID NO: 503220 - RNA, 64 nt, Human
agaagaaacuaugggacucugagccuugcuuuagagaauuuacaguggacaaauaggugucauc

SEQ ID NO: 503221 - RNA, 64 nt, Human
uaauuuuaaacuauuuugcagcauagcuaccuucagaauuuaguguaucuuuuaauguuguaug

SEQ ID NO: 503222 - RNA, 64 nt, Human
aaguagaagagucauaggauuugaaagcuguuagagaauuuagcuuccaggacuguucaaucuu

SEQ ID NO: 503223 - RNA, 64 nt, Human
agcaguuugggaagaaagugcugcugaaauuuccagaauuuaauugauugguuacauaaacuuu

SEQ ID NO: 503224 - RNA, 64 nt, Human
ccugucagacacuuaaaaaaauaaccugagaugaagaauuuacaauugaagacauugacuuuag

SEQ ID NO: 503225 - RNA, 64 nt, Human
gguuuaaguuauggaguuuuaugucccugggaguagaauuuacauuuguuaaauugaccacugu

SEQ ID NO: 503226 - RNA, 64 nt, Human
auuccuugucuugauaaaguggaauuggcaaacuagaauuuaguuuguacucaguggacagugc

SEQ ID NO: 503227 - RNA, 64 nt, Human
acuguaaugagacaagccuuucuucugucacugcagaauuuagaaggggccgugagcagucuuc

SEQ ID NO: 503228 - RNA, 64 nt, Human
aaugcuaaaugaagaaucuguacuuuguauguauagaauuuaucuaauaaaucauucauagauc

SEQ ID NO: 503229 - RNA, 64 nt, Human
cagggaucaguccuguuagaagucugugagccucaaacucuaccuguucucugcaaucauccaa

SEQ ID NO: 503230 - RNA, 64 nt, Human
caggugauuuauguggagaugauuuuucaccuuuaaacucuaagccaaguguaagaaacucuug

SEQ ID NO: 503231 - RNA, 64 nt, Human; identical to SEQ ID NO: 359120

SEQ ID NO: 503232 - RNA, 64 nt, Human
ucauguuacuuuuugaguuuauaaacauaaaaacagaauuuacuucuguuacagaccuaguuac

SEQ ID NO: 503233 - RNA, 64 nt, Human
cugggaucuaaacagcaauaacuaacauuaacagagaauuuaaaauguucuuagugcuguguua

SEQ ID NO: 503234 - RNA, 64 nt, Human
agcacuuuggcccaaaagaguuaucgcccgggcuagaauuuagcagacagcuguuccacgcggg

SEQ ID NO: 503235 - RNA, 64 nt, Human
aaaaaaacaaaaaaaacggauccaagaagaaaagagaauuuauuuccuucuccacucucuccau

SEQ ID NO: 503236 - RNA, 64 nt, Human
uuuaucauuaccauuaagaaguuaaaugaacaucagaauuuaaaaucauaaauauaaucuaaua

SEQ ID NO: 503237 - RNA, 64 nt, Human
gguuuuauauuauuauuccacuaggaauggcauaagaauuuauagauaaauucuuguaacauua

SEQ ID NO: 503238 - RNA, 64 nt, Human
gcuucugucuuaauacaaagcuguuaccuucuacagaauuuaagucugaagauguaaagagaga

SEQ ID NO: 503239 - RNA, 64 nt, Human
ccaggggaguuaaagcacaugaaaaagacaguggagaauuuacggaaugacaugaaugcugcua

SEQ ID NO: 503240 - RNA, 64 nt, Human
cuugcauuuuuuaaaaacuagacauuguggcuugagaauuuaucaaucaucuuuccgaaaugac

SEQ ID NO: 503241 - RNA, 64 nt, Human
uaaguaaaaagugauacuccaccuuguguuucaaagaauuuaguuccaccucuucauaccaguu

SEQ ID NO: 503242 - RNA, 64 nt, Human
augaaagauacuaucucauguaugcuuuaaauagagaauuuauuucuuuuaaaaauaaagcuau

SEQ ID NO: 503243 - RNA, 64 nt, Human
ugcuggauauauuauaugcaauuaauaguaguuaagaauuuauucauuugguagauauguuuau

SEQ ID NO: 503244 - RNA, 64 nt, Human
uagaaucuuuaaauauccauugcaucauuuguucagaauuuaacauccauuccaauguuggagg

SEQ ID NO: 503245 - RNA, 64 nt, Human
cuuuuuaaauggcucuaagaauaagccacagcaaagaauuuaaaguggcuccuuuaauugguga

SEQ ID NO: 503246 - RNA, 64 nt, Human
ccuuucugggaugcaauacuaggaaguaaagugaagaauuuaucucuuuaguuagugauuauau

SEQ ID NO: 503247 - RNA, 64 nt, Human; identical to SEQ ID NO: 359128

SEQ ID NO: 503248 - RNA, 64 nt, Human; identical to SEQ ID NO: 359137

SEQ ID NO: 503249 - RNA, 64 nt, Human; identical to SEQ ID NO: 359144

SEQ ID NO: 503250 - RNA, 64 nt, Human
acuucugaaguucaaauuagugccucggaaauguagaauuuauuauuugucauuuuuuuuuuuu

SEQ ID NO: 503251 - RNA, 64 nt, Human
acuacuagggcaugauacaguaagguguaauuacagaauuuacgaaauguaaauggccucuaca

SEQ ID NO: 503252 - RNA, 64 nt, Human
ggccuagaagauuuuggucuacuuuucugugaacagaauuuaaaacauacaaagagauaaauca

SEQ ID NO: 503253 - RNA, 64 nt, Human
ucagcuucuucuuucauucuaauccuugcuauuaagaauuuaagacuugugcuuacaauauuuu

SEQ ID NO: 503254 - RNA, 64 nt, Human
gccacuggccguaucugagggcugcuccccuuuuagaauuuaccucuuaugagcuccauguugc

SEQ ID NO: 503255 - RNA, 64 nt, Human
uguuugggguuguauauuuuguuaaaaagauuaaagaauuuaugaguuggcuuggacaaguuua

SEQ ID NO: 503256 - RNA, 64 nt, Human
uaguaaugaaugcaaucaguauuagccaaaauaaagaauuuaugagucauugcucauugucuug

SEQ ID NO: 503257 - RNA, 64 nt, Human
auaucauaccuaauuuuuauagugcuuuacuaucagaauuuauauuguuuauuauaucuuuuaa

SEQ ID NO: 503258 - RNA, 64 nt, Human
aguauuaaaaauaacuuuuuuguuugauaacuugagaauuuagaagauuuugccaaguaugugu

SEQ ID NO: 503259 - RNA, 64 nt, Human
uuaacagauuguuuauagagugauuuuacuagaaagaauuuaauaaacucgaaguuuagguuua

SEQ ID NO: 503260 - RNA, 64 nt, Human
uuuuugucuuauagacuuuuuaaaauguacauaaagaauuuaagaaagaauauauuugucaaau

SEQ ID NO: 503261 - RNA, 64 nt, Human
uaagaaaguuuuauuuaaauauuaauauuaaucaagaauuuaacagauauaugugacagaaauc

SEQ ID NO: 503262 - RNA, 64 nt, Human
aaagcagucaauaaauguuugccagacugggugcagaauuuauucagguggguguacucuggcc

SEQ ID NO: 503263 - RNA, 64 nt, Human
gguuuuaucugcaguaauauguauaucaucuauuagaauuuacuuaaugaaaaacugaagagaa

SEQ ID NO: 503264 - RNA, 64 nt, Human
gcauucgauuaguuuuugauuuuuugcaacaucuagaauuuaauuuucacaucacuguacauaa

SEQ ID NO: 503265 - RNA, 64 nt, Human; identical to SEQ ID NO: 359153

SEQ ID NO: 503266 - RNA, 64 nt, Human; identical to SEQ ID NO: 359160

SEQ ID NO: 503267 - RNA, 64 nt, Human; identical to SEQ ID NO: 359168

SEQ ID NO: 503268 - RNA, 64 nt, Human
aauuauuuuggggaggaacuacacagucgugauuagaauuuaucugaugguuuuguauuauaac

SEQ ID NO: 503269 - RNA, 64 nt, Human
agcaauccuccugauuguauuguuuuaaacuuuaagaauuuaucaaaaugccgguacuuaggac

SEQ ID NO: 503270 - RNA, 64 nt, Human
auucagucauaacccaacgcucauucaacaucaaagaauuuauaccuaagagaacuuauuuggg

SEQ ID NO: 503271 - RNA, 64 nt, Human
gugugauacgugggacaguucacauagacaucagagaauuuauuccagaaaggagccuccugaa

SEQ ID NO: 503272 - RNA, 64 nt, Human
uugauaguuagauucagggccaggcuguaagucuagaauuuagauauccugaucccccagauac

SEQ ID NO: 503273 - RNA, 64 nt, Human
uuguugaaguauauggcuaucaugacuaagugcuagaauuuauaguuacaggcgguguccuuuu

SEQ ID NO: 503274 - RNA, 64 nt, Human
uugcaaaaaaaaaaaaaagucagugcuucuaaaaagaauuuaagauaaugguuuuuaaaaugcc

SEQ ID NO: 503275 - RNA, 64 nt, Human
cauacuauuaaugcuauuuuuuuggacaucgaagagaauuuaacuuagcaguuaguuauaugga

SEQ ID NO: 503276 - RNA, 64 nt, Human
auuauagccacaucccuuugaaacaagauaacugagaauuuaaaaauaagaaaauacauaagac

SEQ ID NO: 503277 - RNA, 64 nt, Human
acaaaguaggcacaagucuacaauaagcuaaaucagaauuuacaaauacaagugucccagguag

SEQ ID NO: 503278 - RNA, 64 nt, Human
uuacaugaaaguuuucauuaaagagcugaaaacaagaauuuagagagccauuccuagaaaaugu

SEQ ID NO: 503279 - RNA, 64 nt, Human
gcucugaacuuuagaguauaggaaauuaacuauuagaauuuaaagaauuucuugaauuucugua

SEQ ID NO: 503280 - RNA, 64 nt, Human
cagaaacguggcaucauuugggaagaaccaagguagaauuuaauuuucuggacuuuaaaucucc

SEQ ID NO: 503281 - RNA, 64 nt, Human
gucugcauguuuauuuuuacuucccuggguggacagaauuuaauuucucgagcuguuuuucuca

SEQ ID NO: 503282 - RNA, 64 nt, Human
gaaccaauauguacauguuugcaauuaugcugugagaauuuaaauguguuagauggaaaaugcu

SEQ ID NO: 503283 - RNA, 64 nt, Human; identical to SEQ ID NO: 359172

SEQ ID NO: 503284 - RNA, 64 nt, Human; identical to SEQ ID NO: 359177

SEQ ID NO: 503285 - RNA, 64 nt, Human; identical to SEQ ID NO: 359182

SEQ ID NO: 503286 - RNA, 64 nt, Human
uugcuuuguuuuuaagacacugaaaagaaaagcuagaauuuauuuauucagacuuuaaagaaca

SEQ ID NO: 503287 - RNA, 64 nt, Human
gucaagcucuuaggggagcagaagaaaagcaggaagaauuuaaauguuuaauuuuuuuuuuaaa

SEQ ID NO: 503288 - RNA, 64 nt, Human
uccugauggggugagacuaucuacugucuuuugaagaauuuauauuuggaaaguaaaaaaguaa

SEQ ID NO: 503289 - RNA, 64 nt, Human
uacagagaacuucaguugaaucauagcuggaaacagaauuuauuuccucuauuugcuucauucu

SEQ ID NO: 503290 - RNA, 64 nt, Human
aaaauuacuaauucucaaauggcucaagaacauuagaauuuaaguaccuuuuagaguaauuauu

SEQ ID NO: 503291 - RNA, 64 nt, Human
aaggaauuugguuucgugcuuguguaauaaagccagaauuuacuuguucuuuaucucccccuuu

SEQ ID NO: 503292 - RNA, 64 nt, Human
cugaauauacuaaauaacagaaaaguuacagauaagaauuuauuucuacugaacucuauaguua

SEQ ID NO: 503293 - RNA, 64 nt, Human
acaaaaacacacguagacugauggaacagaauagagaauuuagaaaugagaccacacaccuaua

SEQ ID NO: 503294 - RNA, 64 nt, Human
accuauuguaucauauuagagaauuugcagacuaagaauuuaugagaaaauauauguauucagu

SEQ ID NO: 503295 - RNA, 64 nt, Human
guaaagguggacauuuuugagauuuuuauaauaaagaauuuaauugcucugcauuugucaagua

SEQ ID NO: 503296 - RNA, 64 nt, Human
uaauacucuguaugcuuuuuugauacugauuuugagaauuuaaagcagauuaccuuuuaaaacu

SEQ ID NO: 503297 - RNA, 64 nt, Human
aucauuugagguuuucuacaauuugguauaacuaagaauuuaaaaauguuuuaucauauauauu

SEQ ID NO: 503298 - RNA, 64 nt, Human
aaaauuacuuaaaacgugaauacaucaucacaguagaauuuauuaugagagcauguaguaugua

SEQ ID NO: 503299 - RNA, 64 nt, Human
aagugaaaaaagaacuguguuuuuaaacuguaggagaauuuaauaaaucagcaaggguauuuua

SEQ ID NO: 503300 - RNA, 64 nt, Human
cuacagaggagugcuuuucuucucaauuguuagaagaauuuauguuaaacuuuaagguaagggu

SEQ ID NO: 503301 - RNA, 64 nt, Human; identical to SEQ ID NO: 359190

SEQ ID NO: 503302 - RNA, 64 nt, Human; identical to SEQ ID NO: 359201

SEQ ID NO: 503303 - RNA, 64 nt, Human; identical to SEQ ID NO: 359206

SEQ ID NO: 503304 - RNA, 64 nt, Human
uuguaugacuucaacaacgucaaggagggcauuuagaauuuagaaucugagcacaucacaccag

SEQ ID NO: 503305 - RNA, 64 nt, Human
acuuugcguuuuuccucugggaccuacagugaugagaauuuaaugauuaucuccuccacuauaa

SEQ ID NO: 503306 - RNA, 64 nt, Human
agcucaucaaaugagagcccuuuuauuuccaagcagaauuuagucagauaauuuugcuucuagg

SEQ ID NO: 503307 - RNA, 64 nt, Human
acaguacauucuaguuggaaucguuuacucugcuagaauuuaggugugagauuuuuuguuuccc

SEQ ID NO: 503308 - RNA, 64 nt, Human
ugacaaagcaguugaacaaaaauuauggcauuuaagaauuuaacaugucuuagcuguaaaaaug

SEQ ID NO: 503309 - RNA, 64 nt, Human
cauaagccucaccuuucauuuuaaagguuuccauagaauuuaguuauuuuaucuuucagccaua

SEQ ID NO: 503310 - RNA, 64 nt, Human
ucauaucaacuguuaaacuuuuuuuuaagguuaaagaauuuaauccauugugaaacacuuaacu

SEQ ID NO: 503311 - RNA, 64 nt, Human
gcuuuugcccuuugucaucaccaacacaacagauagaauuuaaauauaaguauauggugugcgu

SEQ ID NO: 503312 - RNA, 64 nt, Human
aaggccucuucucaacuuuuuucccuugggcuggagaauuuagaaucagaaguuuccuggaguu

SEQ ID NO: 503313 - RNA, 64 nt, Human
uggugaaagcaaauucccuuucccaggagucaagagaauuuaugugagguggcucccgccugua

SEQ ID NO: 503314 - RNA, 64 nt, Human
guuuaaaacuuaaaauuaguacuguuuuauugagagaauuuaguuauauuuuaaaucagaagua

SEQ ID NO: 503315 - RNA, 64 nt, Human
agugugguagaaaaagaaauaaugguagcaguagagaauuuauaaauaagaguuuaucuuuaug

SEQ ID NO: 503316 - RNA, 64 nt, Human
ugguggggcuugauguagauuuuacucuauguacagaauuuaacguugaauauauuaaaauaac

SEQ ID NO: 503317 - RNA, 64 nt, Human
ccuuggagccgcccuccugaagcuugaaaauggaagaauuuaguuuuguugguugaauugaaaa

SEQ ID NO: 503318 - RNA, 64 nt, Human
aggcaaggagacuuuuuaucauuaggaaacaaaaagaauuuagaaggaaugaaagcagcccgua

SEQ ID NO: 503319 - RNA, 64 nt, Human; identical to SEQ ID NO: 359211

SEQ ID NO: 503320 - RNA, 64 nt, Human; identical to SEQ ID NO: 359221

SEQ ID NO: 503321 - RNA, 64 nt, Human; identical to SEQ ID NO: 359228

SEQ ID NO: 503322 - RNA, 64 nt, Human
caccauuuuuguauuaacguagaaacuaagcaucagaauuuaugaacaaagaauauguuauuuu

SEQ ID NO: 503323 - RNA, 64 nt, Human
caguucuugaaaacacuguuucugguaaugaagcagaauuuaaguugguaauauuaaggugaau

SEQ ID NO: 503324 - RNA, 64 nt, Human
auuggaguauggccagggcaggaguacacagaauagaauuuagacugucccuugaguagaaucc

SEQ ID NO: 503325 - RNA, 64 nt, Human
aaaguguucaaacacuaucccuaaugccugcggcagaauuuauauacgauccauucauuggggc

SEQ ID NO: 503326 - RNA, 64 nt, Human
aauacaguuaucacugauauauguagacacuuuuagaauuuauuaaauccuugaccuugugcau

SEQ ID NO: 503327 - RNA, 64 nt, Human
cucuaguauucuaaacugaccccaugaccaacugagaauuuauuuuuguuucauugguuguuuc

SEQ ID NO: 503328 - RNA, 64 nt, Human
aacaaauugcuuguucuugagaacuuucccaucaagaauuuaguagaagcagguauacuucuau

SEQ ID NO: 503329 - RNA, 64 nt, Human
auuuuaugugacaacugccaaaaaaguauuuuuaagaauuuaagcgaaauaaacaguuacucuu

SEQ ID NO: 503330 - RNA, 64 nt, Human
aacauguaguuuagauauucaaaaguaugcauguagaauuuaaagaauauguuaaaaauuauua

SEQ ID NO: 503331 - RNA, 64 nt, Human
uuaacauugguuucagaaagaaucuuagcuaccuagaauuuacagucucuguuucauggcaaca

SEQ ID NO: 503332 - RNA, 64 nt, Human
caaucauaauuaguaaacagguguaccaauaaaaagaauuuacaugauagguuaacaaggacca

SEQ ID NO: 503333 - RNA, 64 nt, Human
uaccuguauuaaaagauuccagucuucucuuugaagaauuuaagaaacuuauucgcaauagaca

SEQ ID NO: 503334 - RNA, 64 nt, Human
ucuauaauuuuuaccuucauaugcagagaaauuaagaauuuacaucuuuuacaaauauguauau

SEQ ID NO: 503335 - RNA, 64 nt, Human
caggggaaauguugaaaaggaagguggaaaaccaagaauuuaguuugccaaugauugccucuga

SEQ ID NO: 503336 - RNA, 64 nt, Human
uuauagaauugaaguuaacauucuuauuuucaagagaauuuauggacguuguagaaauguacaa

SEQ ID NO: 503337 - RNA, 64 nt, Human; identical to SEQ ID NO: 359235

SEQ ID NO: 503338 - RNA, 64 nt, Human; identical to SEQ ID NO: 359243

SEQ ID NO: 503339 - RNA, 64 nt, Human; identical to SEQ ID NO: 359248

SEQ ID NO: 503340 - RNA, 64 nt, Human
auuaagaagcauaaugacaacaaaaaaagcaggcagaauuuaugaauaaguguuguuuauuauu

SEQ ID NO: 503341 - RNA, 64 nt, Human
gaauuauacuuguuugaaucaaggcaacucuucuagaauuuauuguucaauucugucauauuua

SEQ ID NO: 503342 - RNA, 64 nt, Human
ucuuagaaccaagaauuuggucaugaaccauuaaagaauuuagagagaacuuagcucuuuuuag

SEQ ID NO: 503343 - RNA, 64 nt, Human
aaccaaauaccaugucagaaaacacuauauaguaagaauuuaucagauuagagcagcaggagaa

SEQ ID NO: 503344 - RNA, 64 nt, Human
gcaucguugcauuuuacaguaucuucaaaaauacagaauuuauagaauaauuucuccucauuua

SEQ ID NO: 503345 - RNA, 64 nt, Human
gaacuccuuggauaugauauuauuuggaauaaacagaauuuaucauugaacccaaaguaggaaa

SEQ ID NO: 503346 - RNA, 64 nt, Human
uuuauugcauuuaugauucaguggcugggaauugagaauuuauuugaaauagaauagguaacac

SEQ ID NO: 503347 - RNA, 64 nt, Human
aaucuuuuuuuaaaguucagguaugacaaaguauagaauuuauucauuuaacauauucacauuu

SEQ ID NO: 503348 - RNA, 64 nt, Human
guuaaccuuuaagagauuuguuuuuccucaaaggagaauuuaaagguauuuuuuaaaauucuaa

SEQ ID NO: 503349 - RNA, 64 nt, Human
aaaauagauuuuuucccuaagaaagaauguuuguagaauuuaaaguggacagaugccuguugga

SEQ ID NO: 503350 - RNA, 64 nt, Human
gacauaauuuacaugcaauauguuuaucaacucaagaauuuaauauaguugguacacaacuagu

SEQ ID NO: 503351 - RNA, 64 nt, Human
acggacucuguggguaaccuguuagguuuuacuaagaauuuaggaaaaauuuacuccucuuuau

SEQ ID NO: 503352 - RNA, 64 nt, Human
aaguuuuuggcaaaaaugcaaauaagguuauguuagaauuuacacugaggagaaaauugucaau

SEQ ID NO: 503353 - RNA, 64 nt, Human
uaagauaauauauguugaucccuugcuguagaggagaauuuagaguaauuugggguuugucuug

SEQ ID NO: 503354 - RNA, 64 nt, Human
gacugcaauaaaccuuuaaauuggauuuucagugagaauuuagaagcaaucacuaccuuucucg

SEQ ID NO: 503355 - RNA, 64 nt, Human; identical to SEQ ID NO: 357247

SEQ ID NO: 503356 - RNA, 64 nt, Human; identical to SEQ ID NO: 357252

SEQ ID NO: 503357 - RNA, 64 nt, Human; identical to SEQ ID NO: 357257

SEQ ID NO: 503358 - RNA, 64 nt, Human
aucauauuuauguaaaguauauguauuugagugcagaauuuaaauaaggcucuaccucaaagac

SEQ ID NO: 503359 - RNA, 64 nt, Human
ucaaauguugcaguagaugggcagcuucaagagaagaauuuaaacucuuugucucauugaaagu

SEQ ID NO: 503360 - RNA, 64 nt, Human
cugcaaucaccucucugagcucagugguauuuugagaauuuaauguuuaacuguaccccuuucc

SEQ ID NO: 503361 - RNA, 64 nt, Human
auugcaugagaugagaaagaaggacaaacucuuaagaauuuaaaaaguguuuugagaaugauuu

SEQ ID NO: 503362 - RNA, 64 nt, Human
uacucuguaaugucauguuuguacugauaguuuaagaauuuaauuuccuguacaacuuuuugua

SEQ ID NO: 503363 - RNA, 64 nt, Human
caaauauugacugcagcaaacaagaauuauauucagaauuuaugaggguacuguuaggaguaua

SEQ ID NO: 503364 - RNA, 64 nt, Human
agaaaucuguagcuagauuuuuguuguuauagauagaauuuacuguuucugaaacccaaauaca

SEQ ID NO: 503365 - RNA, 64 nt, Human
guuuaacuaacauagauaacuccccccaaacuugagaauuuaugcauucccuuuaaacagaaca

SEQ ID NO: 503366 - RNA, 64 nt, Human
acuguuaccucuaccaucuuaauguaguaacuuuagaauuuaaauuuuuauauuacuauuuucc

SEQ ID NO: 503367 - RNA, 64 nt, Human
ugacccuuggaggaaccaaaggcugugcauuguuagaauuuagcccagaugcaggauaaacuag

SEQ ID NO: 503368 - RNA, 64 nt, Human
uauuacuguauaguuguucagcuaaacuuugagaagaauuuaauuaugucucaugagguaucaa

SEQ ID NO: 503369 - RNA, 64 nt, Human
ucugcuucaagccuuuaggaauuaagaucugaucagaauuuaacuaaaggguaguuguuuuaca

SEQ ID NO: 503370 - RNA, 64 nt, Human
aggcagcaugcucagugggaacacagcaagauucagaauuuaaaguaguugcuucauggcucug

SEQ ID NO: 503371 - RNA, 64 nt, Human
uuugagaccuggcuauggaaaagaaagacacuugagaauuuaguguuggggucuguacagauga

SEQ ID NO: 503372 - RNA, 64 nt, Human
aggcuguauuccucaauaccuaauuuguguccaaagaauuuauagcuuuucuggacauuuuuua

SEQ ID NO: 503373 - RNA, 64 nt, Human; identical to SEQ ID NO: 359281

SEQ ID NO: 503374 - RNA, 64 nt, Human; identical to SEQ ID NO: 359288

SEQ ID NO: 503375 - RNA, 64 nt, Human; identical to SEQ ID NO: 359298

SEQ ID NO: 503376 - RNA, 64 nt, Human
caaccuccuucuuaucugugauaaaucuauagaaagaauuuagcugcaaguggacaaaggaaca

SEQ ID NO: 503377 - RNA, 64 nt, Human
gccacuuuauuaucaugcuuuggggcugugcuuaagaauuuaagcucuguuuuaaagccgaaga

SEQ ID NO: 503378 - RNA, 64 nt, Human
uucugccauauuucaaaaugguagaauaaauuacagaauuuauuacuacucauuucaguguuua

SEQ ID NO: 503379 - RNA, 64 nt, Human
aagaaaacuaaugaauaaauuaguuugucauucuagaauuuaaaguucuaagauuaguauaaag

SEQ ID NO: 503380 - RNA, 64 nt, Human
ucacuuuuacaagcacugcucuagauauacuugaagaauuuaauagguacagaaguuuauucug

SEQ ID NO: 503381 - RNA, 64 nt, Human
uuucauuuuuuauuaagaaaaaauuuuauuuuacagaauuuaccuucucuguauauaugugcau

SEQ ID NO: 503382 - RNA, 64 nt, Human
agugaguggugugacucuuacuccuuaggugcccagaauuuaccaucaucucugaaggaguuac

SEQ ID NO: 503383 - RNA, 64 nt, Human
uccuuauguccugucauauaauuaaagacucaagagaauuuaugugaaaugcuuucuguaugcc

SEQ ID NO: 503384 - RNA, 64 nt, Human
uuuugcguaacugagacuccuugauaugcuucagagaauuuaggcaaacacuggccauggccgu

SEQ ID NO: 503385 - RNA, 64 nt, Human
gaaaaauucaugaauaccauagagaaaauauuuuagaauuuaauguuucuuauauuuauguaaa

SEQ ID NO: 503386 - RNA, 64 nt, Human
uauuuuuguggguguguauauaucugauuugggaagaauuuaaaaaacacauagcuuuuuaauu

SEQ ID NO: 503387 - RNA, 64 nt, Human
uuaggggaguucaguauuuaaugaaacccuauggagaauuuaucccuuuacaaugugaauaguc

SEQ ID NO: 503388 - RNA, 64 nt, Human
aauaccaacauuaacagcagaaugaugcaaugaaagaauuuaaaaagguuacaaacccacacca

SEQ ID NO: 503389 - RNA, 64 nt, Human
cuugggggaagggcuugaauugaagcuuuacuuuagaauuuagcccugguuugaaauuuuccau

SEQ ID NO: 503390 - RNA, 64 nt, Human
aacugguaguucauuguaaaugaacauaaugaacagaauuuaugacuccacuguggaaaaugcu

SEQ ID NO: 503391 - RNA, 64 nt, Human; identical to SEQ ID NO: 359305

SEQ ID NO: 503392 - RNA, 64 nt, Human; identical to SEQ ID NO: 359312

SEQ ID NO: 503393 - RNA, 64 nt, Human; identical to SEQ ID NO: 359322

SEQ ID NO: 503394 - RNA, 64 nt, Human
acagccuucuucucuuaaucacaagauuauuuucagaauuuaaucuuugaggaaaagguuugag

SEQ ID NO: 503395 - RNA, 64 nt, Human
uuacacagauaaaauauauacuugaaauaagcugagaauuuaaaccuauuauuguuauaaugaa

SEQ ID NO: 503396 - RNA, 64 nt, Human
gcugacucagcacuuauuucuguaguuuuaaaaaagaauuuaauguuuuugguuguauuuuuuu

SEQ ID NO: 503397 - RNA, 64 nt, Human
uaaucuauggauugagaacuugaaaauguagaguagaauuuauaacuaucauauggaugucauc

SEQ ID NO: 503398 - RNA, 64 nt, Human
ugaguuaaauuaucuuuauuauuuuuuaaaaauaagaauuuagaagugguaaaauuauggccca

SEQ ID NO: 503399 - RNA, 64 nt, Human
cucauugcuucuucaauauccuuuuuuaaagaacagaauuuauguauuguaugacagacauugu

SEQ ID NO: 503400 - RNA, 64 nt, Human
acuaccugugcacaagaaaugauggcacaucacgagaauuuagaccuggauuuuaccaugaacc

SEQ ID NO: 503401 - RNA, 64 nt, Human
uucccacauagaaauaacaaugcauguauuacccagaauuuaauguugcguaccuuauguucaa

SEQ ID NO: 503402 - RNA, 64 nt, Human
uuuuuuuuuuccuugguuaagaaaucaaauuugcagaauuuaaucuacaaguuguauuaugcuu

SEQ ID NO: 503403 - RNA, 64 nt, Human
aaaaguuuuaauuccuuccagaagaaccaguggaagaauuuaaauuuggcgcuacgaucaaaac

SEQ ID NO: 503404 - RNA, 64 nt, Human
aaaaguaacauuuggguuucacuccauaucuagaagaauuuagcucacaaaacaauuuuugugu

SEQ ID NO: 503405 - RNA, 64 nt, Human
acaaauugcuuaugggagauagcacuguaauuagagaauuuauuucauauaaaauaauaauaua

SEQ ID NO: 503406 - RNA, 64 nt, Human
gaaaaugcauuccgaaucugugagggcccaaaacagaauuuaggggugggugaaagcacuugug

SEQ ID NO: 503407 - RNA, 64 nt, Human
aguacuugucccaaaaguuuuuguuuccuagcuuagaauuuauaaucagauuagguuuuggaga

SEQ ID NO: 503408 - RNA, 64 nt, Human
accagguuuguugaucuuuuaguuaugggcucaaagaauuuauucaucucuaacaugauauugg

SEQ ID NO: 503409 - RNA, 64 nt, Human; identical to SEQ ID NO: 359329

SEQ ID NO: 503410 - RNA, 64 nt, Human; identical to SEQ ID NO: 359340

SEQ ID NO: 503411 - RNA, 64 nt, Human; identical to SEQ ID NO: 359347

SEQ ID NO: 503412 - RNA, 64 nt, Human
cacauaaaagaauguagaauggcugaagagaucaagaauuuaaagcuucuagucuuaacauacu

SEQ ID NO: 503413 - RNA, 64 nt, Human
uguuuaacuguuuuguuuacccauauuuucuugaagaauuuacaagauugaaaaaguacuaaaa

SEQ ID NO: 503414 - RNA, 64 nt, Human
aaggagaaccagcacagcuuagauuucauaguucagaauuuaguguauccauaaugcauucuuc

SEQ ID NO: 503415 - RNA, 64 nt, Human
gucuuuggaagagaagugcaaggcuuuccuuugaagaauuuaaauuaguccgguaggaugucag

SEQ ID NO: 503416 - RNA, 64 nt, Human
ugcuaacacauuuucagaauaauuauugcauaguagaauuuauuacuccagaacagaaagaccu

SEQ ID NO: 503417 - RNA, 64 nt, Human
agagagcccagccugaugccagaacaaaggacagagaauuuaagcacagaaaucccagaccugu

SEQ ID NO: 503418 - RNA, 64 nt, Human
uugcauuuucuccucuccuuccccacuuacucagagaauuuaaagucuguagagucagcacagc

SEQ ID NO: 503419 - RNA, 64 nt, Human
gaagcacagcacccaugggaaggguccaucucagagaauuuacgagcagggaugaaggccuccc

SEQ ID NO: 503420 - RNA, 64 nt, Human
aagcucuucuuauucauguguaagggagguccauagaauuuagguggucugucaacuauucuac

SEQ ID NO: 503421 - RNA, 64 nt, Human
auuggaacugauaacuccauuuuaaaaugagcaaagaauuuauuucuuauaccaacagguauau

SEQ ID NO: 503422 - RNA, 64 nt, Human
cuucugcaaaugauaaaggaugauggcucuauugagaauuuacaauuuuuugucauuuuuuuaa

SEQ ID NO: 503423 - RNA, 64 nt, Human
aaacauaaauagguuuguugauauucaggccuucagaauuuaaggguuuuaaauauagcauuca

SEQ ID NO: 503424 - RNA, 64 nt, Human
auauuucaauacugcugaaacagacaugaaauaaagaauuuaaagaaugauuuuguuugguuuu

SEQ ID NO: 503425 - RNA, 64 nt, Human
acauuggagagcuuagaggauaagucucuggagcagaauuuaucacacacaaaaguuacaccaa

SEQ ID NO: 503426 - RNA, 64 nt, Human
auuuaaaaagaaauucacugguucuuuacaaaauagaauuuaucaucaaguuauuacacaaacu

SEQ ID NO: 503427 - RNA, 64 nt, Human; identical to SEQ ID NO: 359357

SEQ ID NO: 503428 - RNA, 64 nt, Human; identical to SEQ ID NO: 359364

SEQ ID NO: 503429 - RNA, 64 nt, Human; identical to SEQ ID NO: 359374

SEQ ID NO: 503430 - RNA, 64 nt, Human
ucugucuuuugcugaucuacaaauaaaugaauugagaauuuaguccauagaggucccuggcuac

SEQ ID NO: 503431 - RNA, 64 nt, Human
aacagaagucuuaagauuagaaugagaaccaaagagaauuuaacccugccauuuuuuuuuuuuu

SEQ ID NO: 503432 - RNA, 64 nt, Human
aggagcaggcagugggugggagcuccuuuuagguagaauuuaacaugacuucugccccagcuuu

SEQ ID NO: 503433 - RNA, 64 nt, Human
uuagcugaaugaggauauuuuaagaaguugaaagagaauuuauuuucaaguugugaguaaaucc

SEQ ID NO: 503434 - RNA, 64 nt, Human
uaaaacgaucuuucagauuuagagugacuauguaagaauuuaggauuuccucuuuuccaggcac

SEQ ID NO: 503435 - RNA, 64 nt, Human
ccuauugggguugagagggaaaaugugaaaucucagaauuuaucucccuuagaagagagccagu

SEQ ID NO: 503436 - RNA, 64 nt, Human
cccuccccucacacacaaauugacucuuauuuauagaauuuaauauauauauauauauauauau

SEQ ID NO: 503437 - RNA, 64 nt, Human
ugagauuuguuauuuugaucagaguauucaaaucagaauuuaaaucuaguguuucuauuuuagu

SEQ ID NO: 503438 - RNA, 64 nt, Human
auacuagcagauacuauccagugaagcauaaauuagaauuuaauuugauguucaaaaacaguuc

SEQ ID NO: 503439 - RNA, 64 nt, Human
ugaugcugaaugggggaggggggcagcacgucagagaauuuacuauuaaucccagaguuuucuc

SEQ ID NO: 503440 - RNA, 64 nt, Human
augugauuuuuuauuuugcagugugcugcaggaaagaauuuaauggaagugaugccaaauauuu

SEQ ID NO: 503441 - RNA, 64 nt, Human
aauaaacgggagacugucaugcucaugcaugaauagaauuuagucaaauaaaaaauuuugguca

SEQ ID NO: 503442 - RNA, 64 nt, Human
guaaaagcgcucuauuaaucuaaaacacuacaagagaauuuaacaccaucucucaaaugcuuuu

SEQ ID NO: 503443 - RNA, 64 nt, Human
uaucaaauguuguaguaucaucaugaagauucagagaauuuacacuaggaacaccuuauaaguu

SEQ ID NO: 503444 - RNA, 64 nt, Human
uuuuccacucuuauuagcacugcaaaagcuccugagaauuuaaaaacacaguaauucucuggau

SEQ ID NO: 503445 - RNA, 64 nt, Human; identical to SEQ ID NO: 359381

SEQ ID NO: 503446 - RNA, 64 nt, Human; identical to SEQ ID NO: 359388

SEQ ID NO: 503447 - RNA, 64 nt, Human
gcauauccauaagcaggucuuagagcauuauuccaaacucuagcuguuucaguaguucuaugag

SEQ ID NO: 503448 - RNA, 64 nt, Human
uguuauuuaauugaaaucugcuugugugcuuauaagaauuuacugaguucucacuucccuuaca

SEQ ID NO: 503449 - RNA, 64 nt, Human
gaagauuugaugcuggagagguuaaggugcaauaagaauuuagggagaaauguuguucauuauu

SEQ ID NO: 503450 - RNA, 64 nt, Human
uuuucucucuacguuagucucagguccucuucccagaauuuacaaagcaauucacuaccuuuug

SEQ ID NO: 503451 - RNA, 64 nt, Human
aguucaaggaauauccuaaaauuuagccuuguucagaauuuacugcacauaaaaaaggguauuu

SEQ ID NO: 503452 - RNA, 64 nt, Human
gguaugaauagacagaacccuauccaguggaaggagaauuuaauaaagauagugcugaaagaau

SEQ ID NO: 503453 - RNA, 64 nt, Human
aauuauuuagauaccaauuuuuaaaauacuggagagaauuuauaugucuuuuuccagaguucug

SEQ ID NO: 503454 - RNA, 64 nt, Human
cguuuuuauuuugcacacuuuucucauuuuccugagaauuuaccagaaaaaaaaaagauacaua

SEQ ID NO: 503455 - RNA, 64 nt, Human
uuagaauaauuguggguugacagauuuuuaaaauagaauuuagaguauuugggguuuuguuugu

SEQ ID NO: 503456 - RNA, 64 nt, Human
auguaaaucucuugcugaaauaguuuuuaaaaucagaauuuaguuaucuaucagacucaaaauc

SEQ ID NO: 503457 - RNA, 64 nt, Human
gggaaggcacaaaacaugagagaaaguguuguacagaauuuaucauggauuauugacugcugag

SEQ ID NO: 503458 - RNA, 64 nt, Human
agaauaaaaaagggcgguggaggggaaaacauuaagaauuuauucauuauuucucgaguacuuu

SEQ ID NO: 503459 - RNA, 64 nt, Human
uuuuaaaaguuuacauaaguuuuuuuuaaccccuagaauuuaauauuuguagaugcagguaaau

SEQ ID NO: 503460 - RNA, 64 nt, Human
ggaaaagacuaguauuugggcaauauuugaagaaagaauuuaacaggcacugauggggagaaag

SEQ ID NO: 503461 - RNA, 64 nt, Human
aaagcucuccacaucucuuggcuggaucauagcaagaauuuacuguuggcucuucucucugccg

SEQ ID NO: 503462 - RNA, 64 nt, Human
acucuccuacgaguucugcugaucaggaaauuuaagaauuuaucuuaaaaaugcaaggaaaaaa

SEQ ID NO: 503463 - RNA, 64 nt, Human
gcuaaaaggagaugccaauguugaaugaagucugaaacucuaguaugugcauaguuugacgugc

SEQ ID NO: 503464 - RNA, 64 nt, Human
ggugucagcccugcuagggagucacuguacacacaaacucuacuggaauuccugccaacaucug

SEQ ID NO: 503465 - RNA, 64 nt, Human
cucuuaaauuugucgagugauuuuuagccucugaaaacucuaugcuggccacugauuccuuuga

SEQ ID NO: 503466 - RNA, 64 nt, Human
aaauuuuugaaaacuugcuaauaaccuuuuguucagaauuuaguagauuguuuaaugcaggaca

SEQ ID NO: 503467 - RNA, 64 nt, Human
auugccaauuuuccugauuuccuuaagguaggagagaauuuaacguguacuucaucgacacaac

SEQ ID NO: 503468 - RNA, 64 nt, Human
aaagcuugaauugaggagucaagagucacuaagcagaauuuagaaagagaaguuuuuaaaaagc

SEQ ID NO: 503469 - RNA, 64 nt, Human
uuguuuggaaguguguuucaaaauaaacaugucuagaauuuaaaguuuucagagauuguuaaaa

SEQ ID NO: 503470 - RNA, 64 nt, Human
agcuauggcugccauuggaggcuguuaucugugaagaauuuauuuuagauuuaggagcaccauc

SEQ ID NO: 503471 - RNA, 64 nt, Human
aacuuugcuuauaaugcuuuuuauagcccagcacagaauuuaaagccauaccaccaaaaguacc

SEQ ID NO: 503472 - RNA, 64 nt, Human
gaucuugucauuauagaugaguuuugccaguucaagaauuuaauggaaucagauauuguaagca

SEQ ID NO: 503473 - RNA, 64 nt, Human
gcuaugaggcauguuacaggaauguaauuuucucagaauuuacacucacucgcagucauuuauu

SEQ ID NO: 503474 - RNA, 64 nt, Human
uuuuuaaaaauagacuguaguauccuuucauuggagaauuuacaaaaauaucaucuacagcuca

SEQ ID NO: 503475 - RNA, 64 nt, Human
uuugcuccaacaagggcuuuauguugcugguaagagaauuuauuuacuaaaugcacuauguaua

SEQ ID NO: 503476 - RNA, 64 nt, Human
cugucaccagcacaagagaauuagagcuucagugagaauuuagaaaaauuauacuaaagugaga

SEQ ID NO: 503477 - RNA, 64 nt, Human
aagauuauuaccaagugaaaaauucagaaugaauagaauuuacacuaacaugcuauauaaaaug

SEQ ID NO: 503478 - RNA, 64 nt, Human
agaucacauuuauacccaaagcuuucuaguaaucagaauuuacuuaauuagaauugacucauaa

SEQ ID NO: 503479 - RNA, 64 nt, Human
uucagcuuuacagacaagaacaauuuaaaucuaaagaauuuaguagauuccuucagugucacaa

SEQ ID NO: 503480 - RNA, 64 nt, Human
aucaggaaggcauuuucaaucauucaaaauguggagaauuuaauggcuaaaucuuuaaaagcca

SEQ ID NO: 503481 - RNA, 64 nt, Human
gaugugaaggacaugagacuaagagaaaccuugcaaacucuauaaagaaacuuuugaaaaagug

SEQ ID NO: 503482 - RNA, 53 nt, Human
gcccuguuugcuuuuuauaaaccaaacucuaucugaaaucccaacaaaaaaaa

SEQ ID NO: 503483 - RNA, 64 nt, Human
acauuuauuuuuuauuugauuccuaggauuuaguaaacucuagcugucuauuuaaaauguacug

SEQ ID NO: 503484 - RNA, 64 nt, Human
gaugugaagggcacagaagugacuuugaauaagaagaauuuaguguaucuguaauuuuauuauc

SEQ ID NO: 503485 - RNA, 64 nt, Human
guuucccaauuccccagcaauuaagauuucgagcagaauuuaucuaaauguguuucaaggaaac

SEQ ID NO: 503486 - RNA, 64 nt, Human
aaacaaacugcagguuuuuuucaaacuaauuuuaagaauuuagucuuauuucguuguaaacugu

SEQ ID NO: 503487 - RNA, 64 nt, Human
cauuaaaaagauuggcauuauuuuccucaucagcagaauuuauaacagugugugguaucuagaa

SEQ ID NO: 503488 - RNA, 64 nt, Human
uggaggaaauaaugaauuuacuaauuaaaccuuuagaauuuaugacuuacuguuagagucuguc

SEQ ID NO: 503489 - RNA, 64 nt, Human
uuuguaauuaaucgaagucacauuuccugaccuaagaauuuauuuuagguuuccuguaaaguac

SEQ ID NO: 503490 - RNA, 64 nt, Human
gaaaaaguauugacuggagggguugaauuccuugagaauuuauuuuauagucuaaaucacaaau

SEQ ID NO: 503491 - RNA, 64 nt, Human
gccucaaucuuugggagaguuucaguacuggcauagaauuuaaaugucaaaauucuuucugaaa

SEQ ID NO: 503492 - RNA, 64 nt, Human
acugcuugaccauccucugacuuccugggccccuagaauuuauaaggucccuagauaucccaga

SEQ ID NO: 503493 - RNA, 64 nt, Human
aaaauagggggaauaguauuuuagaauuuuaugcagaauuuaauucucuuuuuacgguuaagau

SEQ ID NO: 503494 - RNA, 64 nt, Human
auaauauucaauacaauuguaauguagaaauauaagaauuuagaaaaaaguaaacuugccauuu

SEQ ID NO: 503495 - RNA, 64 nt, Human
caguuaaagcaaaguuauuaauuauuaauauaugagaauuuaaaauuuuauaaauaaguuagaa

SEQ ID NO: 503496 - RNA, 64 nt, Human
gacguggcucauuaauguuacuaaguuggaagugagaauuuaugaacauuaauucauuuuaaga

SEQ ID NO: 503497 - RNA, 64 nt, Human
uaauauacaaguuuucuuuaaagcccucuccuuuagaauuuaaaauauuguaccauugaagagu

SEQ ID NO: 503498 - RNA, 64 nt, Human
auaugucagaaacuggcauaaacaugauuguaguagaauuuauuuuccaguaccaauagggaaa

SEQ ID NO: 503499 - RNA, 64 nt, Human
augauuauaaaauagauuuucaugggaauuuuaaaaacucuauccaaaacauuuuuggagcauu

SEQ ID NO: 503500 - RNA, 64 nt, Human
agaagccacacugauccaagaugggagguuuuaaaaacucuacagugggaacuucacauaucuc

SEQ ID NO: 503501 - RNA, 64 nt, Human
ccucacuuggcauugaagaauuccuuccagagauaaacucuaugagauaugugggaaggccuuu

SEQ ID NO: 503502 - RNA, 64 nt, Human
uggcagucuacaagaagucucuuaaugcuaaugaagaauuuaaaggucuuuuuaaggaaaugaa

SEQ ID NO: 503503 - RNA, 64 nt, Human
uuaucuauuugagauugaugacaaccugugugagagaauuuaucacaccacguccuuauuggaa

SEQ ID NO: 503504 - RNA, 64 nt, Human
ccaccuguaagaacagaaaaucgucuuauaguugagaauuuauccucaagagucagcuggcagg

SEQ ID NO: 503505 - RNA, 64 nt, Human
gauucgaaaagcuggucccccaggaucuaauuucagaauuuaccacccaaacccggaacagaug

SEQ ID NO: 503506 - RNA, 64 nt, Human
gcuuucugguuagcugaaggcaagugugaaaaucagaauuuagaauauuuagagcuaagcuucu

SEQ ID NO: 503507 - RNA, 64 nt, Human
agcuguggcagauugcaggagccaucguguggggagaauuuaauaaaagcccuuuugaaaauga

SEQ ID NO: 503508 - RNA, 64 nt, Human
aaauaauagauugaugauuuucuuuauuuccuagagaauuuauuuuauaaauacuuuguuuaca

SEQ ID NO: 503509 - RNA, 64 nt, Human
gauagcuggacaugucagcauguuaaguaaaaggagaauuuaugaaauaguaaugcaauucuga

SEQ ID NO: 503510 - RNA, 64 nt, Human
acuauuugagcucauauuuuuauaauucugauugagaauuuaggggcaugguaauuuuuaccaa

SEQ ID NO: 503511 - RNA, 64 nt, Human
gaaagagaucuguaaaaccugcccaggaacuuacagaauuuacuuugcagaagcguuaucauac

SEQ ID NO: 503512 - RNA, 64 nt, Human
cuagguuucugauaaaagggaugaucuuaacugaagaauuuaaagagauacuuaaacagagcaa

SEQ ID NO: 503513 - RNA, 64 nt, Human
uaaacuaacuccaggauucaggaguuuuaauguuagaauuuagauuuaacagauagaguguggc

SEQ ID NO: 503514 - RNA, 64 nt, Human
cacccucucuuauccccuccuccaagagcaguagagaauuuaagcacaagccuauuugugaaag

SEQ ID NO: 503515 - RNA, 64 nt, Human
uuaaaguuguuagugaguggaaugaauugaaggcagaauuuaaaguuugguugauaacaggaua

SEQ ID NO: 503516 - RNA, 64 nt, Human
cuaauuuggcuucaaguuucaugaaucuguaacuagaauuuaauuuucaccccaauaauguucu

SEQ ID NO: 503517 - RNA, 64 nt, Human
aaaacaguccagacauuuguuucaucaggacaccaaacucuaaaaaagaagcaccacgagaugg

SEQ ID NO: 503518 - RNA, 64 nt, Human
gauucuuuguuguuguuuuuauuuuaaaaggcacaaacucuagauauuaguugaauguugaggc

SEQ ID NO: 503519 - RNA, 64 nt, Human
aaauuuuaaaagcauuuuuaaaaaaacuucuacaaaacucuaguaugggcuucugacuuuuucc

SEQ ID NO: 503520 - RNA, 64 nt, Human
uugaguuuuauguagcuuuagacuuuaaaaaguuagaauuuauucuguaacuaaaaauuauuug

SEQ ID NO: 503521 - RNA, 64 nt, Human
ucaaguagaguguauacuauauccuauguuguggagaauuuauauguuggagacuaacugaauu

SEQ ID NO: 503522 - RNA, 64 nt, Human
guuuucuagaauuuuuuucuggauauuauauguaagaauuuauuguuugagggaaauacgaggu

SEQ ID NO: 503523 - RNA, 64 nt, Human
uauuauauaagguagggauuugauuuuauuucgaagaauuuaccaauugguucaguaugugaaa

SEQ ID NO: 503524 - RNA, 64 nt, Human
acucuccugucgagagugaaggaaguugaugcacagaauuuaccucaucucacagagcccacgu

SEQ ID NO: 503525 - RNA, 64 nt, Human
uuagaaguuacacuaaggaccagggguuggaaucagaauuuaguuuaagauuugaggaaaaggg

SEQ ID NO: 503526 - RNA, 64 nt, Human
caggagccuucauuucagcuucaauuaauagggaagaauuuaugauagcucuauagaugcugaa

SEQ ID NO: 503527 - RNA, 64 nt, Human
ggauguuacaaguuugcuaaaagaagagaggggaagaauuuaauggacugugaauuucaaaaaa

SEQ ID NO: 503528 - RNA, 64 nt, Human
cuuuucuuaaaugacacaagcagguuuagaguggagaauuuacccuuuccaaauuuaugguucc

SEQ ID NO: 503529 - RNA, 64 nt, Human
aaauuagcaauggcuaaacaguaucaaguacugcagaauuuaucacugaaauggauaagaggaa

SEQ ID NO: 503530 - RNA, 64 nt, Human
guuuucuuuuaaaaagcuccuguuuuuggaaaguagaauuuauggguacaacguauguucauua

SEQ ID NO: 503531 - RNA, 64 nt, Human
uucaggaugcagcugggacaagcagggauaaaaaagaauuuagccuugagccuccaucaaggcc

SEQ ID NO: 503532 - RNA, 64 nt, Human
aucuuuaauuaaugagguaauucgggcaaagaguagaauuuaagacaaaacggaagcugggaag

SEQ ID NO: 503533 - RNA, 64 nt, Human
gauauuuauuuuggggagaguuuggaggggagggagaauuuauuaauaaaagaaucuuuaacuu

SEQ ID NO: 503534 - RNA, 64 nt, Human
gcaaugaauggacccuccugucacucugcugaacagaauuuauuuucugagucaaauauaauuu

SEQ ID NO: 503535 - RNA, 64 nt, Human
cuaauucuuuacaaauguugacugaagauagauaaaacucuaauuaaaaauuuaaaagguuaaa

SEQ ID NO: 503536 - RNA, 64 nt, Human; identical to SEQ ID NO: 503126

SEQ ID NO: 503537 - RNA, 64 nt, Human; identical to SEQ ID NO: 503127

SEQ ID NO: 503538 - RNA, 64 nt, Human
agugaauagggcagaacaguucagccuugagguuagaauuuagcaggagcuauccugacuuaau

SEQ ID NO: 503539 - RNA, 64 nt, Human
guauuuaauaaaaaaugaagucuaaaugugucagagaauuuaugugagaaaggacuaaagcaca

SEQ ID NO: 503540 - RNA, 64 nt, Human
uggguguuccuggcaguuuaaaaaaauugguuggagaauuuagguuuuuauuaguaccauagua

SEQ ID NO: 503541 - RNA, 64 nt, Human
uacuuccguccauccauucagaaagcauuuauuaagaauuuacucaggcaugauggcccauacu

SEQ ID NO: 503542 - RNA, 64 nt, Human
uuaauuagcugcaauauauacggccuguguacacagaauuuaaucacuucggcagguugaacaa

SEQ ID NO: 503543 - RNA, 64 nt, Human
uguaaaggaaaacguauuuguaauugaauccagaagaauuuaguuacacauagacauaacucuu

SEQ ID NO: 503544 - RNA, 64 nt, Human
agccugggcaacguaguaaaaccucaucuauacaagaauuuaaaaauaagcugggcgugguggu

SEQ ID NO: 503545 - RNA, 64 nt, Human; identical to SEQ ID NO: 503534

SEQ ID NO: 503546 - RNA, 64 nt, Human
gagaccgaagauuggcuacuguaaagcaguugaaagaauuuauucagcaaccagaaaauaagcu

SEQ ID NO: 503547 - RNA, 64 nt, Human
gagacugaagauuggucacuguaaagcaguugaaagaauuuauucagcaaccagaaaauaagcu

SEQ ID NO: 503548 - RNA, 64 nt, Human
aauucguacauacaauuuggaaucaaaugucauaagaauuuauuauauaaauuuaucaagaaua

SEQ ID NO: 503549 - RNA, 64 nt, Human
uuaggauccucaagcaucucuaccguaaguccaaagaauuuaggucccuauugucacuuuguuu

SEQ ID NO: 503550 - RNA, 64 nt, Human
acuauuagacuguguagugaugugacuuccaaguagaauuuaaucuccccauugagugugucau

SEQ ID NO: 503551 - RNA, 64 nt, Human
uaacgugguucuuauuuaacugucuaguuuugauagaauuuaccaggucuggcugaaugaagau

SEQ ID NO: 503552 - RNA, 64 nt, Human
cugcgucauggcucaaggauucaaugcauuuuuaagaauuuauuauuaaaucaguuuuguguac

SEQ ID NO: 503553 - RNA, 64 nt, Human; identical to SEQ ID NO: 503128

SEQ ID NO: 503554 - RNA, 64 nt, Human; identical to SEQ ID NO: 503129

SEQ ID NO: 503555 - RNA, 64 nt, Human; identical to SEQ ID NO: 503130

SEQ ID NO: 503556 - RNA, 64 nt, Human
aaguccacauggagauuuggaggacacugguuaaagaauuuauuucuuuguauaguauacuaug

SEQ ID NO: 503557 - RNA, 64 nt, Human
cuuucacuugaagcagguuugagaggccuaggccagaauuuaaauuccuuuuaugaauagauuu

SEQ ID NO: 503558 - RNA, 64 nt, Human
aucacugcuuuuuccuuagcuuaaugacuuacuuagaauuuauccuuuauuuuaaaugaucugu

SEQ ID NO: 503559 - RNA, 64 nt, Human
cucccaucggagggagaagggguccuggggagagagaauuuauccagaggccugcugcagaugg

SEQ ID NO: 503560 - RNA, 64 nt, Human
uguuaaaaccuuauuucacauuccacaucauuuuagaauuuauuuucgaaggggaauaguuuca

SEQ ID NO: 503561 - RNA, 64 nt, Human
gugcaauuaauaauaacucauuuauaccuuccacagaauuuaauaaagauucuacuuguuucug

SEQ ID NO: 503562 - RNA, 64 nt, Human
agaaccaccaaaucugacuuuuacauuuggucucagaauuuagguuccugcccuguugguuuuu

SEQ ID NO: 503563 - RNA, 64 nt, Human
agcacccagcacugccacauguccaccaaggaacagaauuuauuuucuucuuuuuuuaacaagu

SEQ ID NO: 503564 - RNA, 64 nt, Human
aucuacagaaagaauggagggaagauagaaauggagaauuuaaaagaaaaguugcccgcugugu

SEQ ID NO: 503565 - RNA, 64 nt, Human
cagcaaccuuggcauugauacauaggcacucuacagaauuuaaguuuucagagguaagucuguu

SEQ ID NO: 503566 - RNA, 64 nt, Human
auauugaggaugacaggcuggcagcuauguucagagaauuuacccagcaaaauguaaguucuug

SEQ ID NO: 503567 - RNA, 64 nt, Human
aucuuguuucuagcccucaacugcugaaagccucagaauuuagauuaauugagaaaacacccac

SEQ ID NO: 503568 - RNA, 64 nt, Human
guugcuaccgagugucugucuaagaacacagaggagaauuuauuaucauugaagaauagcuuaa

SEQ ID NO: 503569 - RNA, 64 nt, Human
uagacaggaaagccaggccaggagaguccgaaugagaauuuauugugaaucgauucccaagcuc

SEQ ID NO: 503570 - RNA, 64 nt, Human
uuacagaagaacgcuuucugauccuggccccuaaagaauuuacuugugcuaaguaauaaaauuc

SEQ ID NO: 503571 - RNA, 64 nt, Human; identical to SEQ ID NO: 503131

SEQ ID NO: 503572 - RNA, 64 nt, Human; identical to SEQ ID NO: 503132

SEQ ID NO: 503573 - RNA, 64 nt, Human; identical to SEQ ID NO: 503133

SEQ ID NO: 503574 - RNA, 64 nt, Human
gcuucuuauccugaacacuugacaccuugaggguagaauuuagcguuugguuuuuaccuccuag

SEQ ID NO: 503575 - RNA, 64 nt, Human
guguaugauacuuuguaaaguugauacuuuccuaagaauuuaacaugucauauuuuugaaauag

SEQ ID NO: 503576 - RNA, 64 nt, Human
ugaucccaguagacuaugacuuuugauaauuagcagaauuuaacuacugaguaguugauuauuu

SEQ ID NO: 503577 - RNA, 64 nt, Human
cuauucaagaugauguucacuccaaauacacuacagaauuuagucaacauuuuauauaauguuu

SEQ ID NO: 503578 - RNA, 64 nt, Human
gguuguuuucuuucaagauacucuaaucagccauagaauuuaguguaaauauuuuuuuuuccaa

SEQ ID NO: 503579 - RNA, 64 nt, Human
aaugaucauaucaauuggcagugacuuuguauagagaauuuaaguagaaaaguugcagauguau

SEQ ID NO: 503580 - RNA, 64 nt, Human
gugaaguuuacaaaggaaccaaaaugauaaugggagaauuuagucuuaaaaguuuagguuguca

SEQ ID NO: 503581 - RNA, 64 nt, Human
aguguugaauaaacauaccugugugauaaaacacagaauuuacauauacacugaagaugaguuu

SEQ ID NO: 503582 - RNA, 64 nt, Human
gaaaaaaauguucaguuacuuguaacuacugagcagaauuuaaucaauccuuuauuaaauucag

SEQ ID NO: 503583 - RNA, 64 nt, Human
gcaaauacuuugaucuaagaauugaaauguaucaagaauuuauauuuugccugcaggaaaauuc

SEQ ID NO: 503584 - RNA, 64 nt, Human
uguuuucugaagagcgguaaaaucuagaagcuuaagaauuuacaguuccuucaauaaccaugau

SEQ ID NO: 503585 - RNA, 64 nt, Human
uucuaucucaucuugaugaugauagucaucaucaagaauuuaaugauuaaaauagcaugccuuu

SEQ ID NO: 503586 - RNA, 64 nt, Human
uucuuucucaucuugaugaugaucgucaucaucaagaauuuaaugauuaaaauagcaugccuuu

SEQ ID NO: 503587 - RNA, 64 nt, Human
agaaagaagcuaaaucugcauagauuuaguuuguagaauuuaauuuaaaauuuaaauuuuaaca

SEQ ID NO: 503588 - RNA, 64 nt, Human
aauuauuuuugaggccuucauuuuagcuaaguuuagaauuuauauuaggcaacuaugauuugag

SEQ ID NO: 503589 - RNA, 64 nt, Human; identical to SEQ ID NO: 503134

SEQ ID NO: 503590 - RNA, 64 nt, Human; identical to SEQ ID NO: 503135

SEQ ID NO: 503591 - RNA, 64 nt, Human; identical to SEQ ID NO: 503136

SEQ ID NO: 503592 - RNA, 64 nt, Human
auauauauauauauauacacguauauauauaaagagaauuuaauaaaacaggggaaaaccaagg

SEQ ID NO: 503593 - RNA, 64 nt, Human
cauuuacguuucucugaugcucccuugaagccauagaauuuaggggcuuuuuuaaaaaaauaaa

SEQ ID NO: 503594 - RNA, 64 nt, Human
cagucuugcacauauuuuguuaaauguacagcugagaauuuaauuuuuucugguguacaaugcu

SEQ ID NO: 503595 - RNA, 64 nt, Human
aggcagggguugcaauccuagucucugauaaaacagaauuuaaaccaacaaagaucaaaagaga

SEQ ID NO: 503596 - RNA, 64 nt, Human
auuuaauccauaauuaagucuaugcaaauaucagagaauuuaugguagaaauauauaagguacu

SEQ ID NO: 503597 - RNA, 64 nt, Human
aaaauuuuaauccaaauuugucuauguaaauaccagaauuuauaguagaaauauaugaggaagc

SEQ ID NO: 503598 - RNA, 64 nt, Human
caaguccuauagauccugaguccuaaauguuucuagaauuuauacuguuuuuuaucuuuaaugu

SEQ ID NO: 503599 - RNA, 64 nt, Human
gaaggggagugacaggauccgauguaccuauuuaagaauuuaagagggucgggugcgguggcuc

SEQ ID NO: 503600 - RNA, 64 nt, Human
caggagugaagccuucaaaaugauaaguaaggucagaauuuagcaaaaguauaaugagggacau

SEQ ID NO: 503601 - RNA, 64 nt, Human
gggauagaaacuacaaaugcaacaaaugcgucaaagaauuuagugugcacucaagccuuacuac

SEQ ID NO: 503602 - RNA, 64 nt, Human
ucuucaaacacaaguuuuucuaauaacucauuagagaauuuauacuggagagacuucacaauua

SEQ ID NO: 503603 - RNA, 64 nt, Human
gucucacugacuguuuuuguaugguccaugaucuagaauuuaaaaaaauuuuaaaggguugaaa

SEQ ID NO: 503604 - RNA, 64 nt, Human
uuccaggauuugaaauuguaugauguguuacauaagaauuuauuugcuaucgacauucccguau

SEQ ID NO: 503605 - RNA, 64 nt, Human
auguggcuuuguuccaccuggcucaccggcggucagaauuuaagguuaucucucuuguuuccua

SEQ ID NO: 503606 - RNA, 64 nt, Human
aguuucaauuuguugugauuucaacuggucuuguagaauuuaagcaacuccuuuuauuaagcuu

SEQ ID NO: 503607 - RNA, 64 nt, Human; identical to SEQ ID NO: 503137

SEQ ID NO: 503608 - RNA, 64 nt, Human; identical to SEQ ID NO: 503138

SEQ ID NO: 503609 - RNA, 64 nt, Human; identical to SEQ ID NO: 503139

SEQ ID NO: 503610 - RNA, 64 nt, Human
uaaaaauuuuaaucauuaagucuguaaauaucagagaauuuacaguagaaauauguaaggcacu

SEQ ID NO: 503611 - RNA, 64 nt, Human
aacagcacaaaccaggucagaguuacuuucgguuagaauuuauugccauuuauuccuuuuuaua

SEQ ID NO: 503612 - RNA, 64 nt, Human
auguguagggaggcuuuuaauuauggcucaaaacagaauuuaucuuguuaauaauuccucuaga

SEQ ID NO: 503613 - RNA, 64 nt, Human
uuacauuuuaauuuuugaaacugaugucuuucccagaauuuauguacucuauaacggugugaau

SEQ ID NO: 503614 - RNA, 64 nt, Human
ggggagaaaaaaugaccacugaacuuacauuaagagaauuuacaacuauauauuaacauggcuu

SEQ ID NO: 503615 - RNA, 64 nt, Human
augaauaagugugaucauuucugugauaaaauacagaauuuagaaacaaaaucuaccuauaguu

SEQ ID NO: 503616 - RNA, 64 nt, Human
uuuuuaccucauaauucacaauuuauuaagcaucagaauuuauauggaaaaaauagaauaucaa

SEQ ID NO: 503617 - RNA, 64 nt, Human
uucuuugguaugaccuguguuaacucagauucagagaauuuauaauguauuuuuuuaauaacau

SEQ ID NO: 503618 - RNA, 64 nt, Human
acuauaauaacauaaaguucagaagaguguaaauagaauuuauauuacauaaagucuuuauauu

SEQ ID NO: 503619 - RNA, 64 nt, Human
aggaaagugaaauuguuacaauacuguuaacuacagaauuuauuuggaaaucaccaguuuuaac

SEQ ID NO: 503620 - RNA, 64 nt, Human
cauucaauguagaagacuuuuaggaaaauaucagagaauuuaaugaaggaaagaagccuuggca

SEQ ID NO: 503621 - RNA, 64 nt, Human
auuguagaacacccaauuggugugggagaauuagagaauuuauuugugucagaaaauacuccag

SEQ ID NO: 503622 - RNA, 64 nt, Human
cuucagucaagcuucauccuaugcaaaacauaggagaauuuauacaggagagaaaccucacaag

SEQ ID NO: 503623 - RNA, 64 nt, Human
uuuccauuuggaaaucacaccuuaaagacauaggagaauuuauacuggagagaaagcuuacaaa

SEQ ID NO: 503624 - RNA, 64 nt, Human
cuucagucaaaguuuaaauccugugagucaucaaagaauuuauaucagagagaaaccauacaag

SEQ ID NO: 503625 - RNA, 64 nt, Human; identical to SEQ ID NO: 503140

SEQ ID NO: 503626 - RNA, 64 nt, Human
uauacuugggaauaaauucagcaucuuuucaaauaaacucuaugaaagacgcugaugugguguu

SEQ ID NO: 503627 - RNA, 64 nt, Human
guuuaacucuacaaaaauuuguuacuuguuuuuuaaacucuauauauaaaguucgacuuaauca

SEQ ID NO: 503628 - RNA, 64 nt, Human
uugcaguuagaauucauuccuuugacaacgucagagaauuuaugccugagagauuccuugaaaa

SEQ ID NO: 503629 - RNA, 64 nt, Human
cgcaaaaaccaauuguguccugaaaauuguuucaagaauuuaauauuuuuaugaaaauuauuuu

SEQ ID NO: 503630 - RNA, 64 nt, Human
ugaauaugcaccuucuccagaguuaugugguuuuagaauuuagaagagcauguaucuuuauuaa

SEQ ID NO: 503631 - RNA, 64 nt, Human
uguuucacucuuuaacucaaauguauucuuuguuagaauuuacccuagauucuuauuuaauguc

SEQ ID NO: 503632 - RNA, 64 nt, Human
cagccggccuuuuauaugggucuucacucugacuagaauuuagucucugugucagcacagugua

SEQ ID NO: 503633 - RNA, 64 nt, Human
ggaguguuccauaguuuauuguuuuccuauuaugagaauuuaggccaagugugguggcucaugc

SEQ ID NO: 503634 - RNA, 64 nt, Human
gcccuggcugagggacauguacugccucucaucuagaauuuauuuuccuagcacuucaccaccu

SEQ ID NO: 503635 - RNA, 64 nt, Human
aaagaaauggguuuauuuuuccagcauaaaccucagaauuuaaggaaagaaaaugaugucuguu

SEQ ID NO: 503636 - RNA, 64 nt, Human
cggggaauggguuuuuguuuuuccuucauuguugagaauuuaaggaccuuugauacugcugcac

SEQ ID NO: 503637 - RNA, 64 nt, Human
uuuuccaguugaaaacaaacuaagaaguccuuuaagaauuuauaauccguuccccauuaacuua

SEQ ID NO: 503638 - RNA, 64 nt, Human
uaaaauuaauucuuuauccagagucgggugcuuuagaauuuauaagucacuuauguguuuugcu

SEQ ID NO: 503639 - RNA, 64 nt, Human
gauuaaugacuggcuacagaguaacaaaaaauaaagaauuuaauguacaguaaauucucuccca

SEQ ID NO: 503640 - RNA, 64 nt, Human
gagacuuugaugucagcaguugcugguaaaaugaagaauuuaaagaaaaaaaugucaaaaguag

SEQ ID NO: 503641 - RNA, 64 nt, Human
uuacagaaucuauuggaucuuuggcuggaaaacuagaauuuauagcaguuuauuaaugauaccu

SEQ ID NO: 503642 - RNA, 64 nt, Human
uuucugaacaagguucagaaaacauuguuuacuaagaauuuagucuaauaauuucaguuaggcg

SEQ ID NO: 503643 - RNA, 63 nt, Human
gugacauuuugccaacuuaaacgagaaaaagaccccccgcacccggcacacucccccuuccuc

SEQ ID NO: 503644 - RNA, 63 nt, Human
ggaaagcagguucugugggaccccccgccccgccccccgcacuccuucauagcagcaguagug

SEQ ID NO: 503645 - RNA, 63 nt, Human
caguuggcagagaaggccucuugugcucacgcucccccgcaguccccagcccuucugccuuuc

SEQ ID NO: 503646 - RNA, 64 nt, Human
gguggcaaugaagacacucugucuguugggcccuagaauuuaauguggauuuccuccuuccuuc

SEQ ID NO: 503647 - RNA, 64 nt, Human
gggcccagaucuggucccuugcagcuaguuuucuagaauuuaucacacuucugugagaccccca

SEQ ID NO: 503648 - RNA, 64 nt, Human
uggccccaaaacagagagcaagacaguuguccagagaauuuagauaugaguuaagagcugccag

SEQ ID NO: 503649 - RNA, 64 nt, Human
acacaaaacaucagacuagaccuuuguaugggagagaauuuacuguacauuaaauucuuuauuu

SEQ ID NO: 503650 - RNA, 64 nt, Human
aggauuuucuguauagauuacucaugucagaccaagaauuuaaauuauuuugagagaggcauuu

SEQ ID NO: 503651 - RNA, 64 nt, Human
uucuuugcuuuguuuuuauaaaugaauuuuucauagaauuuacaguauauucaaaggaagaaag

SEQ ID NO: 503652 - RNA, 64 nt, Human
aauuauuggucaucauuuguaccuuagaaguacaagaauuuaaguaaaagaaauguucauuuuu

SEQ ID NO: 503653 - RNA, 64 nt, Human
auugauaguucuuagagagaccagauauaaucuaagaauuuauaugaaagauuuguaucauuag

SEQ ID NO: 503654 - RNA, 64 nt, Human
uaacauacagaauuuuaaauaccacaacuggggcagaauuuaaagcugcaacacagcuggugau

SEQ ID NO: 503655 - RNA, 64 nt, Human
cuuuccauaguuaauaacaugcaaaauaaugagaagaauuuauuuuaaggugacagcuauacug

SEQ ID NO: 503656 - RNA, 64 nt, Human
auuuauucccacuucaaaugacaaguucauauauagaauuuacgggagaaacuugagaccauuu

SEQ ID NO: 503657 - RNA, 64 nt, Human
cuguagaaguggacgauuuguucuagcaccuuugagaauuuacuuuauggagcguauguaaguu

SEQ ID NO: 503658 - RNA, 64 nt, Human
uaaagcauauaccauacacuuaagaaauuugagcagaauuuaaaaaagaaagaaaauaaauugu

SEQ ID NO: 503659 - RNA, 64 nt, Human
auacuacauuauuaauggguuuuguguacuguaaagaauuuagcuguaucaaacuagugcauga

SEQ ID NO: 503660 - RNA, 64 nt, Human
acaacaaagaucaugcuggagcuauuugcacaaaagaauuuaacaucucagaauuucaggcaau

SEQ ID NO: 503661 - RNA, 63 nt, Human
gcacagcguggcuuuuccuaaacugguguuuuucccccgcauuugguggauuuuuuauuauua

SEQ ID NO: 503662 - RNA, 63 nt, Human
gaggggcaguauugggggacugugcuagcuuuacccccgcaggacauacacaggagccuuuga

SEQ ID NO: 503663 - RNA, 63 nt, Human
agaaagcgguccucugaaaugguuuccucccaacccccgcauuuaaagggacucaaggugccu

SEQ ID NO: 503664 - RNA, 64 nt, Human
augcuaugucuguugcaagugaccacaaugugaaagaauuuaagucuuugaucgaaggaaaaua

SEQ ID NO: 503665 - RNA, 64 nt, Human
uuuugcaaaagaaguugaucugaaauuccucuguagaauuuagcuuauacaauucagagaauag

SEQ ID NO: 503666 - RNA, 64 nt, Human
acugccuuuuuuuguagaaauaaaaauugaccuuagaauuuaucgucagauaaacuuguaaaga

SEQ ID NO: 503667 - RNA, 64 nt, Human
caaaaaaaaaguuaaaaaauauugcccggcuccuagaauuuauuuauuuccugacuuacagcaa

SEQ ID NO: 503668 - RNA, 64 nt, Human
uaugauugaaucuaugggaauuauuccucagaagagaauuuaaagguguacccauauauaucuc

SEQ ID NO: 503669 - RNA, 64 nt, Human
ucgccccuguggggaggggacggggaaggaagaaagaauuuaaaggaccggaaugcgagagucc

SEQ ID NO: 503670 - RNA, 64 nt, Human
cuaaagcuccucugcacauagaggggagaaaaagagaauuuaggcaacuccacucccccuucac

SEQ ID NO: 503671 - RNA, 64 nt, Human
uuagaaaaguuuguuuugugaaguuaggaauauuagaauuuagguacuguuaaguaaguaaugu

SEQ ID NO: 503672 - RNA, 64 nt, Human
auuagaauuuagguacuguuaaguaaguaauguuagaauuuaagauucauguuauuaacgauga

SEQ ID NO: 503673 - RNA, 64 nt, Human
uuuuuacaaucauucagauugugaauucaggcucagaauuuacccagucaucagauacugauuc

SEQ ID NO: 503674 - RNA, 64 nt, Human
augccaaaugaaauauuaguauuuguacacagaaagaauuuauugauuugaucuuauuaccuag

SEQ ID NO: 503675 - RNA, 64 nt, Human
acuuacaucaagaauguaguguagcucauuauugagaauuuaggaaagccugaauccauuaauu

SEQ ID NO: 503676 - RNA, 64 nt, Human
ggcuuuuguuuuagaauuuuguucaaauuauagcagaauuuaggcaaaaauaaaacagacaugu

SEQ ID NO: 503677 - RNA, 64 nt, Human
uuugaaaaggguuuacuagugugguccuccggguagaauuuagcuguaagcauguuguuagcca

SEQ ID NO: 503678 - RNA, 64 nt, Human
cuuugccuuaaugaguauuugcuuuaaauuucuaagaauuuauaucauaacuagagacccaaau

SEQ ID NO: 503679 - RNA, 63 nt, Human
uauucaaaaaguacaucuucccccccccccccccccccgcaaaauaauucuguggcagggcaa

SEQ ID NO: 503680 - RNA, 63 nt, Human
guggucuucaagccuggcccagugagagugaggcccccgcacgcaagccucagccacucccag

SEQ ID NO: 503681 - RNA, 63 nt, Human
uguaauauucuccccacccaccccacgcccgcacccccgcacccuuaagaagguauuuuguaa

SEQ ID NO: 503682 - RNA, 64 nt, Human
uauaauuaaauccaugagaauuuuuccucacuagagaauuuaaaggugcaccuguagauaucau

SEQ ID NO: 503683 - RNA, 64 nt, Human
ugucaggcugucaguguuuggugcacgcuggggaagaauuuacuuuggaaaguagaaaagccca

SEQ ID NO: 503684 - RNA, 64 nt, Human
uugugccugcuucauuuugcaauaacaaugcaguagaauuuaaaacuuggaugcuuaagaggcc

SEQ ID NO: 503685 - RNA, 64 nt, Human
ggaagugaaauaugggaggaguaaagaaaacugaagaauuuaaaguuuuccugaagacaguaau

SEQ ID NO: 503686 - RNA, 64 nt, Human
agaauuuguaaaauaaauguucguaucauaauugagaauuuauagccaaggauccucaaaacag

SEQ ID NO: 503687 - RNA, 64 nt, Human
aaaauuuccccuuuaaguuaugauggcugccuauagaauuuagacuguuucucacccugaucca

SEQ ID NO: 503688 - RNA, 64 nt, Human
uuucuagggauaaaaugauggccacccaaagcagagaauuuauccuuugguuagcauuuuggaa

SEQ ID NO: 503689 - RNA, 64 nt, Human
ugcacauacugaaugcauauauguagaaccauacagaauuuagguggauaagggcuagaaauuu

SEQ ID NO: 503690 - RNA, 64 nt, Human
agaaacuuuuuuaauaccugugccauucucaauaagaauuuaugagaugccagcggcauagccc

SEQ ID NO: 503691 - RNA, 64 nt, Human
cuaaaaauauugcugaaguuauucuugaucagauagaauuuaaccuaaaaugugaacucuuacu

SEQ ID NO: 503692 - RNA, 64 nt, Human
uuugccuacucccaagaagauauugguaagcuauagaauuuagauaugcaccucugauaagcaa

SEQ ID NO: 503693 - RNA, 64 nt, Human
aagcauggauaccuggauauccuuggcuucuuugagaauuuaagagaaauuaaaucugaauaaa

SEQ ID NO: 503694 - RNA, 60 nt, Human; identical to SEQ ID NO: 395465

SEQ ID NO: 503695 - RNA, 60 nt, Human; identical to SEQ ID NO: 395466

SEQ ID NO: 503696 - RNA, 60 nt, Human; identical to SEQ ID NO: 394320

SEQ ID NO: 503697 - RNA, 64 nt, Human
uuuuuuuuuuuuaaguuuguuuuggaaauaacagaaaagauauuuauuggccaggaaguuggug

SEQ ID NO: 503698 - RNA, 64 nt, Human
uuugaagacccaauaaaaauacucaacuuuuuaaaaaagauagugaaguggucuugauugauuu

SEQ ID NO: 503699 - RNA, 64 nt, Human
acaagaaaugaguucuuacucugauuuuuuuguaaaaagauaauuuuugagacuugaaaaauac

SEQ ID NO: 503700 - RNA, 64 nt, Human
uauuuguuuaaauuguguguauugaagauuaggaaaaagauaguaguuauuuuuccuaaaugaa

SEQ ID NO: 503701 - RNA, 64 nt, Human
aaauuugucauuuauuauguauaaaauaccauugaaaagauauuacuguuaauuuuuuauuuaa

SEQ ID NO: 503702 - RNA, 64 nt, Human
ucuuugaauaauccacucauuaauuuuuaauaugaaaagauauauauuuguacuuguaagcauu

SEQ ID NO: 503703 - RNA, 64 nt, Human
uuaaaaaucaauuuaaaucaugacuaauaugguaaaaagauaaagcaucaaagcaguauuucuc

SEQ ID NO: 503704 - RNA, 64 nt, Human
uauauacauauauauauauauuuccuaaaagaagaaaagauaccuuucuguucaacuuguauca

SEQ ID NO: 503705 - RNA, 64 nt, Human
ggaaaggcuagguucaguagaugagacauuauuuaaaagauaaauuuaaaaagaugguaaauga

SEQ ID NO: 503706 - RNA, 64 nt, Human
augaaaauaaaauaugaaaauaaugaaagaaaugaaaagauagcuuuuaauugugguauauaua

SEQ ID NO: 503707 - RNA, 64 nt, Human
ugacauguauuuuguuaugaauaguuuaucuuccaaaagauauuuugcucuauuuuaaagugua

SEQ ID NO: 503708 - RNA, 64 nt, Human
uugaauaucccacuguauauuauuuuuauauguaaaaagauaaguuuaauacuguaucaggguu

SEQ ID NO: 503709 - RNA, 50 nt, Human
uguccccuuccucuaauuaaaaaagauagaaacugucuuuuucaauaaaa

SEQ ID NO: 503710 - RNA, 64 nt, Human
caaggaauugccuccagccugaguccuaggcucuaaaagauauuacauauuugaacuaauagag

SEQ ID NO: 503711 - RNA, 64 nt, Human
aucuugauuuuaccucauauacuguacauuccaaaaacucuaaacuuuuuaaagauuauagaua

SEQ ID NO: 503712 - RNA, 64 nt, Human
cacugcagauuacagaaaguuaaguguauacuacaaacucuaauuaaagauaaaaaucuuuucu

SEQ ID NO: 503713 - RNA, 64 nt, Human
uauaugguuaucuggguuauaucuauuuuuauguaaacucuauuuuguuuuuggcaagaaguga

SEQ ID NO: 503714 - RNA, 64 nt, Human
caaaucuuucccacuagccauuuaauaaguuaaaaaaagauacaaaaacaaaaaccuacuaguc

SEQ ID NO: 503715 - RNA, 64 nt, Human
aggcaacauucuucaccacaacgaagaaacagauaaaagauacccaauuuugacuugauuucau

SEQ ID NO: 503716 - RNA, 64 nt, Human
augauuuaggaaaugagugugugcaccaaagacaaaaagauauugucuauuguuugugugcuug

SEQ ID NO: 503717 - RNA, 64 nt, Human
gaguucaagcuuggaaauaauggaguuuauagagaaaagauauauuuuuaaaagcucuagguca

SEQ ID NO: 503718 - RNA, 64 nt, Human
agaucacacaaauaacagcuuucuuauucagugaaaaagauauuuuauuucugauguuuuauuu

SEQ ID NO: 503719 - RNA, 64 nt, Human
uuucuauuuaaaggaacaagcggggaagggugcuaaaagauaauacguuuauuuauucacacuu

SEQ ID NO: 503720 - RNA, 64 nt, Human
agauucucagaugggaugaucuggaggaggaggaaaaagauacacucccuuggggcugagcaug

SEQ ID NO: 503721 - RNA, 64 nt, Human
aauauuaucuuagaaaaauuaauaugcaauuuccaaaagauauuuugguaagacaacaaccucc

SEQ ID NO: 503722 - RNA, 64 nt, Human
cuguacucuuaauuuuaaggaauuucaaugaaccaaaagauaacugucaauuuauuuggaugga

SEQ ID NO: 503723 - RNA, 64 nt, Human
cuauagggaauauuguauagaaaauaucuucaagaaaagauaggaccaucagugacaguuaagu

SEQ ID NO: 503724 - RNA, 64 nt, Human
ccaaaaacauuuuugaggggcacauguggggucaaaaagauagccaauuuccauuacauggguu

SEQ ID NO: 503725 - RNA, 64 nt, Human
auaaaagaaguauaaggcaaucauauauucauucaaaagauauuuauuuagcaacugcuaugug

SEQ ID NO: 503726 - RNA, 64 nt, Human
aaucaaugaaauauaauagcuaucuuuugguagcaaaagauauaaauuguauauguuuauacag

SEQ ID NO: 503727 - RNA, 64 nt, Human
cacacucccaaaaaacucacaaaacauuuugcuaaaaagauaugacugcuugaaauagucucuc

SEQ ID NO: 503728 - RNA, 64 nt, Human
aaggagaagagauauuuuggguugaaaaaaaguaaaaagauaauguagcugcauuucuuuaguu

SEQ ID NO: 503729 - RNA, 64 nt, Human
aagccaaacuaucaguauuuuguauauccugcauaaacucuaauuuaguuccucaacauauuuu

SEQ ID NO: 503730 - RNA, 64 nt, Human; identical to SEQ ID NO: 503141

SEQ ID NO: 503731 - RNA, 64 nt, Human
uugucauagaucacaaaagaaucauaaugcuaacaaacucuauuucuuccuuauuaaaucugua

SEQ ID NO: 503732 - RNA, 64 nt, Human
ggggauaaguuuagugaggggauuggaauccccaaaaagauaacauuuuucuucugcuuuuaaa

SEQ ID NO: 503733 - RNA, 64 nt, Human
ucuaauuauaucgaaauacaguuauuaaaauguuaaaagauaaguuuguuauauauuaauaugc

SEQ ID NO: 503734 - RNA, 64 nt, Human
caaggauuggcagugcuugugcccaaccucguaaaaaagauaaaguuccuuguccucauuacca

SEQ ID NO: 503735 - RNA, 64 nt, Human
uuaguauaaacucauaauaaacucugccuuuaaaaaaagauaaauauuuccuacgucuguucac

SEQ ID NO: 503736 - RNA, 64 nt, Human
aagcucuuagaaucccaggcggacacccuuucucaaaagauauccccuaagaguccuuucugcu

SEQ ID NO: 503737 - RNA, 64 nt, Human
cacgcacuguguugggcuuaguaauaaaaaaaagaaaagauaagugcuuguucuagcauaaauu

SEQ ID NO: 503738 - RNA, 64 nt, Human
cagugccucagacaaauguguauuuaacuuauguaaaagauaagucuggaaauaaaugucuguu

SEQ ID NO: 503739 - RNA, 64 nt, Human
gcuuuugugcauuacauccucuagagggaacauaaaaagauaccaauaaaauuuuguagcugaa

SEQ ID NO: 503740 - RNA, 64 nt, Human
aucacuuaaaggcacaaauaggauguacuguugaaaaagauaaagagugcaggugcaguuucau

SEQ ID NO: 503741 - RNA, 64 nt, Human
cagaucaacuuaaaggauaauaaaauuuuuaaagaaaagauauucuaauguacucucaauaauu

SEQ ID NO: 503742 - RNA, 64 nt, Human
auuuaaacuuugaugcuuaguuauguugcuggagaaaagauacuuauguuuugcucaucuaacu

SEQ ID NO: 503743 - RNA, 64 nt, Human
augaccugcuaauauauuuuaagaacauguuuuaaaaagauacacucuaucacauauuuaagca

SEQ ID NO: 503744 - RNA, 64 nt, Human
uuuauuccacuauuuugcauuuaaaugauaacauaaaagauauaaaaaauuuaaaacugcuauu

SEQ ID NO: 503745 - RNA, 64 nt, Human
ccacuugauuuaguugaucaccaucucagucuucaaaagauaacaucaugaggugugggaaguc

SEQ ID NO: 503746 - RNA, 64 nt, Human
cugaauauuaacaguguucugauuaaaaacaaaaaaaagauacauaugccuuguaaauggcuca

SEQ ID NO: 503747 - RNA, 60 nt, Human; identical to SEQ ID NO: 394337

SEQ ID NO: 503748 - RNA, 60 nt, Human; identical to SEQ ID NO: 394991

SEQ ID NO: 503749 - RNA, 60 nt, Human; identical to SEQ ID NO: 394356

SEQ ID NO: 503750 - RNA, 64 nt, Human
caccacacacacaugcuccaaaagaggaaagaaaaaaagauaauuuuuaggacuugauaauugc

SEQ ID NO: 503751 - RNA, 64 nt, Human
gagucgcuuugugguauagaagggaguaaggaauaaaagauauagaauaguaaucuaguugaac

SEQ ID NO: 503752 - RNA, 64 nt, Human
uuucuacacacccauagugcacacuuguauauugaaaagauagggaagagagaaacauuuaugg

SEQ ID NO: 503753 - RNA, 64 nt, Human
uaacagacuuugacucuaugaccuaugaagaauaaaaagauaaucugaagguguuugagucaga

SEQ ID NO: 503754 - RNA, 64 nt, Human
aggcucuccacuuugaaacuuuaguuugaauuuuaaaagauaggaaguaauacaguuuaaguuc

SEQ ID NO: 503755 - RNA, 64 nt, Human
auucgguguugagcucuguguuguauuacuuccuaaaagauaaugcuuaaacauuaagcauuag

SEQ ID NO: 503756 - RNA, 64 nt, Human
cuguuugucccuuuacuggguuugggggguuguuaaaagauagggaaugaagaaugcaaaaugg

SEQ ID NO: 503757 - RNA, 64 nt, Human
uuucugugggaaucacaagaguuuauccacuaaaaaaagauauguaaaaaagauacuuuccagc

SEQ ID NO: 503758 - RNA, 64 nt, Human
cacaagaguuuauccacuaaaaaaagauauguaaaaaagauacuuuccagcacauaaauaaagg

SEQ ID NO: 503759 - RNA, 64 nt, Human
uguuuguucuauuauucccuuuuuauauagcagcaaaagauaagaauaaaaucacauaaccaag

SEQ ID NO: 503760 - RNA, 64 nt, Human
agauauaccaauauuuaacauuguuacaaagaagaaaagauacagauuuggugaauuuguuacu

SEQ ID NO: 503761 - RNA, 64 nt, Human
uguauuaauaacuugaaaaggagcauuucacuauaaaagauaaugaaguagguaaugaaaucag

SEQ ID NO: 503762 - RNA, 64 nt, Human
ugaugucagaagaaauggcucgagcucagaagauaaaagauaaguaggguaugcugauccucuu

SEQ ID NO: 503763 - RNA, 64 nt, Human
uacaaaguggcauauauugcaauuuauuuuaauuaaaagauaccuauuuauauauuucuuuaua

SEQ ID NO: 503764 - RNA, 64 nt, Human
uugaaucuucauuggugcuaaugauggacaguuaaaaagauagcuaguguauauuguuaugggu

SEQ ID NO: 503765 - RNA, 64 nt, Human
cggcauuugaagagagcgaggagaaccauucuggaaacucuaggcuaugcauguuuaaagaucu

SEQ ID NO: 503766 - RNA, 64 nt, Human
acaucaucaggacugcauugcucaggcauuuucuaaacucuaaauuuacgagcuguacaaaaaa

SEQ ID NO: 503767 - RNA, 64 nt, Human
guuuccuguauaauauaugaauguuucugagaagaaacucuaaauaguugaaaggcuaaccugc

SEQ ID NO: 503768 - RNA, 64 nt, Human
uuuuaacuggcuuuaaaacuguaacacaucacauaaaagauacuuuaccagguauguauugcau

SEQ ID NO: 503769 - RNA, 64 nt, Human
gugaauguuaaguaucaucucuuaucuaaauauuaaaagauaagucaaacauuuucaugagugg

SEQ ID NO: 503770 - RNA, 64 nt, Human
gauuacgguccucuuucucacauacugcaaacuuaaaagauacauacaccaaauauaggucugu

SEQ ID NO: 503771 - RNA, 64 nt, Human
gcccaucugcagagcaaugacugugcucaccaguaaaagauaaccuuucuuucugaaauaguca

SEQ ID NO: 503772 - RNA, 64 nt, Human
aucauuaauuaauauaagcauaggaaauggucuuaaaagauacugcauucauucaucagauauu

SEQ ID NO: 503773 - RNA, 64 nt, Human
uucaaaaauauuuauauugucacucauuuacguaaaaagauauuucuaauuuacuguugcccau

SEQ ID NO: 503774 - RNA, 64 nt, Human
aacacucugucuccaaaaaaaaguuucugaagguaaaagauauacuaaaggauauacauauacu

SEQ ID NO: 503775 - RNA, 64 nt, Human
gaggugggcauggauaguguggaguggggggaagaaaagauaggggggaugaauacuaggggaa

SEQ ID NO: 503776 - RNA, 64 nt, Human
uaccuuaaaguuacggaauacuuuguuuuaaaggaaaagauaauaaguuuaguuauaucuuuuu

SEQ ID NO: 503777 - RNA, 64 nt, Human
uaucaacagaauuuguguguuuucgauuuaagcuaaaagauaauuuaagaacauuuauuucccc

SEQ ID NO: 503778 - RNA, 64 nt, Human
ugugaaaagucuggggauuucaaacugaaaauccaaaagauaaguaaaugagugggaacucucu

SEQ ID NO: 503779 - RNA, 64 nt, Human
gccagaaauagggauggaagugcauccucugggaaaaagauaauggcuucugauucaacauagc

SEQ ID NO: 503780 - RNA, 64 nt, Human
ccuugaauacaggagcccucuccucauagugcugaaaagauacugaugcauugaccucauuuca

SEQ ID NO: 503781 - RNA, 64 nt, Human
uucauaccaaugaaaucuuacuuuucagugacugaaaagauagaauuuauuugcuaauaaucau

SEQ ID NO: 503782 - RNA, 64 nt, Human
ucaguguaaagugugugauugaaggugauaagggaaaagauaaagaccagaaauucccuuuuca

SEQ ID NO: 503783 - RNA, 64 nt, Human
agagugguguuuuuguucaggugggaaggauuggaaacucuagucuuuucuagaaacagaaaau

SEQ ID NO: 503784 - RNA, 64 nt, Human
aaaguuggagccuggcaugggcagggagcccacaaaacucuaaccaaacuggaggcuggcaugg

SEQ ID NO: 503785 - RNA, 64 nt, Human; identical to SEQ ID NO: 503157

SEQ ID NO: 503786 - RNA, 64 nt, Human
ucauccucuaauuucuaugacugcauuuuaagggaaaagauaaaauucuuccccuuaaaauucg

SEQ ID NO: 503787 - RNA, 64 nt, Human
aaacuaccaccuggccuagccuaaguaggaagugaaaagauaauucaccaaacaaugauuaauc

SEQ ID NO: 503788 - RNA, 64 nt, Human
cugugcugucuuaaugguuuaugucaggaaaugaaaaagauacuguaccaaaucuggaauuaca

SEQ ID NO: 503789 - RNA, 64 nt, Human
agcauuuuccuucuagucuauuucagccuagaagaaaagauaaugaguaaaacaaauugcguug

SEQ ID NO: 503790 - RNA, 64 nt, Human
auguaccucuuguuuacauaauuugcauaauuuuaaaagauaauguugccaaacuuuggaaaug

SEQ ID NO: 503791 - RNA, 64 nt, Human
agacuagugauacaaacuuuaagaaaacaggauaaaaagauacccauugccugugucuacugau

SEQ ID NO: 503792 - RNA, 64 nt, Human
aaauaauuagcaaaucaaauccagcaauguauaaaaaagauaauaggguuuauuccuggaaagu

SEQ ID NO: 503793 - RNA, 64 nt, Human
ggaaacuguaaauauauuuugcaaauuguuguucaaaagauaauuggaaaaaauugaauauauu

SEQ ID NO: 503794 - RNA, 64 nt, Human
uugugccuauuuaugaauaaauauuacaaauucuaaaagauaaguguguuugcaaaaaaaaaga

SEQ ID NO: 503795 - RNA, 64 nt, Human
caguacaguauuuaagugcccauaaggcagcaugaaaagauaacucuaaaguuaagcaugggca

SEQ ID NO: 503796 - RNA, 64 nt, Human
ggaaauuagaucgacuggagaagaaaaaaaagaaaaaagauagaaaaaagaaaaaguuucagaa

SEQ ID NO: 503797 - RNA, 64 nt, Human
gcaaaguagcuuugaauuuucucuguaagagaauaaaagauaaaauaauguauuuucuuuauuu

SEQ ID NO: 503798 - RNA, 64 nt, Human
aguaauggagucuuuuuuuuggcaggucugcaguaaaagauaacauuuucuuuucuuaguccuc

SEQ ID NO: 503799 - RNA, 64 nt, Human
ucauggagguucaccuuugugacugauuggugauaaaagauagccaagugucuuacaagcagcu

SEQ ID NO: 503800 - RNA, 64 nt, Human
gugaguagggaaaaaaaucuacaguagauaaagcaaaagauaauuaggcaacaaagcauuuuca

SEQ ID NO: 503801 - RNA, 64 nt, Human
cucaauaugguuuuacugugccuuacacaaagagaaacucuauacagaauguauaucauggggu

SEQ ID NO: 503802 - RNA, 64 nt, Human
ugcuacuuauuuuaaagacuuguucagugacuguaaacucuaugaaaccagaaaccgaaucugc

SEQ ID NO: 503803 - RNA, 64 nt, Human
auacagaccguguaacuggacagcugagugucauaaacucuaaaauaguccaggcuauaguaau

SEQ ID NO: 503804 - RNA, 64 nt, Human
uuuuauauccagucauaaaguugacuuucagcacaaaagauacuuauaaacaaauaaaaaauuu

SEQ ID NO: 503805 - RNA, 64 nt, Human
uguguaacuuuuuuuuaguauuugcccggggggaaaaagauauuguauuaucauauaugcuuuu

SEQ ID NO: 503806 - RNA, 64 nt, Human
auauuugacuuugcuuaugcaggccauaaguuccaaaagauaauuucccugcccacaaaggcau

SEQ ID NO: 503807 - RNA, 64 nt, Human
aaaacauuuuuacugcugcuuaguuuuuggacugaaaagauauuaaaacucaagaaggaccaag

SEQ ID NO: 503808 - RNA, 64 nt, Human
gaaauagacuacuguacacgucuaccuagguucaaaaagauaacugucuugcuuucauggaaua

SEQ ID NO: 503809 - RNA, 64 nt, Human
uaaaguuuguacacagguaacaaaaaguuacuuuaaaagauauauaaagggcuguaagcuaauu

SEQ ID NO: 503810 - RNA, 64 nt, Human
ucaguuuucucuugggaagaguuuuauguuguuuaaaagauauuuugauaacuuaaccugcuuu

SEQ ID NO: 503811 - RNA, 64 nt, Human
uuuauauaugagugggauacucaaucuggccuuaaaaagauacacaaagaugggcugugggucc

SEQ ID NO: 503812 - RNA, 64 nt, Human
gagaacugacugaacuugggaaauaauuugaacaaaaagauaaaucuucacagauaugaauacu

SEQ ID NO: 503813 - RNA, 64 nt, Human
agaugauacagguaagauuggaacucaugaagacaaaagauaagacaguggcauagaguuaaua

SEQ ID NO: 503814 - RNA, 64 nt, Human
ggcacagaucuuugagaaucucauacaucugugaaaaagauaaugugaaauaaacaguaaaaaa

SEQ ID NO: 503815 - RNA, 64 nt, Human
aagagaaaaaaguuucugaaaacaaugaaaccauaaaagauaauauucuaaaaacugagaaauc

SEQ ID NO: 503816 - RNA, 64 nt, Human
gccuuuugaucuguccaggagaacagaagggaaaaaaagauacuugaaagaaacugaaggaaau

SEQ ID NO: 503817 - RNA, 64 nt, Human
caugggccagccuagcccuugucccuuuuaauauaaaagauauauauauauauauauauauaua

SEQ ID NO: 503818 - RNA, 64 nt, Human
guguuagaaaucaacaaaacuccuuuuuaaaaagaaaagauauuaagccugccuacuucuacaa

SEQ ID NO: 503819 - RNA, 64 nt, Human
aaguugcacagcagaaaacagaauugaaguugggaaacucuagagucugggcaaaauguuuggu

SEQ ID NO: 503820 - RNA, 64 nt, Human
uuccuagaaauuaauuuccuucaauagcauccuaaaacucuauuuuuauuuggggcagaguaau

SEQ ID NO: 503821 - RNA, 64 nt, Human
uguuguuguuguuguuuucuuaaguguuacauuaaaacucuaaccaaggaaaggguucuuuaag

SEQ ID NO: 503822 - RNA, 64 nt, Human
aguuagcgauuuacuacaauuucagagcuuuaacaaaagauaaaaauaaaucgucaccaauugu

SEQ ID NO: 503823 - RNA, 64 nt, Human
uccuucauccuugugacauuucauuucaguaaggaaaagauaacaaagugcaauuaucagcauu

SEQ ID NO: 503824 - RNA, 64 nt, Human
uuaucuuugcagcugaguacuuaaauucuuuuuaaaaagauacccuuuggauugaucacauugu

SEQ ID NO: 503825 - RNA, 64 nt, Human
guucauuuaaucugccuguuuugaucuguuuugaaaaagauaaagagccucaaaucagaccagc

SEQ ID NO: 503826 - RNA, 64 nt, Human
aacuguuccauuuguuuauguaaagugauauuaaaaaagauauaaacuauaacuguccguuacu

SEQ ID NO: 503827 - RNA, 64 nt, Human
aagauauaaacuauaacuguccguuacuuuuggcaaaagauacaaccacauaauguauauaauu

SEQ ID NO: 503828 - RNA, 64 nt, Human
aggcaauaguaucaauauccuaaauguagaaauuaaaagauacuguauaauuuuaugccuuugc

SEQ ID NO: 503829 - RNA, 64 nt, Human
uucccuucaaggucauuuacuuguacgagacagaaaaagauagcauuggggacaugggaugggg

SEQ ID NO: 503830 - RNA, 64 nt, Human
auuauuaaucuucugacauuuucuuauguuuuuaaaaagauaagagcaucuagugcauuaaaug

SEQ ID NO: 503831 - RNA, 64 nt, Human
acuguaguuaacuaugguuuuuuauuagucuauuaaaagauacguggagauauuaaauuauacc

SEQ ID NO: 503832 - RNA, 64 nt, Human
agaauuguaggggcuggccugagcuguuuauuucaaaagauacuauucaauuuaaagcuauuuu

SEQ ID NO: 503833 - RNA, 64 nt, Human
uguucucuaucauuuaauaauauacuuguggacuaaaagauauaagugcuguauaaaaucagcc

SEQ ID NO: 503834 - RNA, 64 nt, Human
uguucagccggcacugagaagaacgaacacaagaaaaagauaagaaauacuagaguaaaggcca

SEQ ID NO: 503835 - RNA, 64 nt, Human
guuuucuuuuuaucuuauuuuuacucguccguugaaaagauaaucaaggccuacauuuuagcug

SEQ ID NO: 503836 - RNA, 64 nt, Human
aguucaaaagucagaaaugauucuaauuuaaacaaaaagauacuaaauauacagaaguuaaauu

SEQ ID NO: 503837 - RNA, 60 nt, Human; identical to SEQ ID NO: 394357

SEQ ID NO: 503838 - RNA, 60 nt, Human; identical to SEQ ID NO: 395012

SEQ ID NO: 503839 - RNA, 60 nt, Human; identical to SEQ ID NO: 395143

SEQ ID NO: 503840 - RNA, 64 nt, Human
auuugacauaggaugagagucagaguauagguuuaaaagauaaaaucuuuaguuaauaauuuug

SEQ ID NO: 503841 - RNA, 64 nt, Human
cuuuugugauugaaaagacccuaucaagaaggugaaaagauaaccugcagaaugggagaaaaua

SEQ ID NO: 503842 - RNA, 64 nt, Human
uguuggagugaagcauuuaaaagaguaaggguaaaaaagauaaaguccugaaccuuucaaaaug

SEQ ID NO: 503843 - RNA, 64 nt, Human
auuacuguaagccaguuuuagcugcacugauuucaaaagauauaagaauauuacuauccuucaa

SEQ ID NO: 503844 - RNA, 64 nt, Human
aggagacauuuugcuguuacauucugccaggggcaaaagauacuaggcccaggagucaagaaaa

SEQ ID NO: 503845 - RNA, 64 nt, Human
cguaagccuugaauaccagguagccucaggagugaaaagauaaauguccuagaucauuaccuua

SEQ ID NO: 503846 - RNA, 64 nt, Human
agacucugucucaaaaaaaaaaaaaaagaaaagaaaaagauaaagggauugugaaaagagcauu

SEQ ID NO: 503847 - RNA, 64 nt, Human
aauacugaaguuaagugcauuguuuucaggaaucaaaagauaaaggggccgggugugguggcuc

SEQ ID NO: 503848 - RNA, 64 nt, Human
auuaaaacaaccaagacaaagaaaggaggggaaaaaaagauaaaaagcaagccaggguucccug

SEQ ID NO: 503849 - RNA, 64 nt, Human
auccuugauuuaaugaaauuaaauuuuuuauuucaaaagauaggcuucuguuuaucaaaggcgu

SEQ ID NO: 503850 - RNA, 64 nt, Human
ucuagccaucaucaaggugcuauaagaguuguauaaaagauauuuuuggcauuucuaggcaagu

SEQ ID NO: 503851 - RNA, 64 nt, Human
uuaaguugcagcauaaauccaagggcccacugggaaaagauacugucggguuuuuccauucagc

SEQ ID NO: 503852 - RNA, 64 nt, Human
uaauugaguuuuauagcacuauuuucagaauacgaaaagauacacaaucauucuguuuuuugaa

SEQ ID NO: 503853 - RNA, 64 nt, Human
guagagacugaaugugaagucaagucugagcacaaaaagauaaugcacgaugagauugccuacc

SEQ ID NO: 503854 - RNA, 64 nt, Human
uuucagcuaaaaauggagucuaauauauuguuucaaaagauacauuuuuacccaccauaaaugu

SEQ ID NO: 503855 - RNA, 64 nt, Human
gugguaacuucuguguuauuuuacucuuaaaaccaaacucuaccuuuucuuguuguuuuuuuuu

SEQ ID NO: 503856 - RNA, 64 nt, Human
ucaagcuccugugggcaacucaauuguuuuaagaaaacucuauuucuguucauauuaauucacu

SEQ ID NO: 503857 - RNA, 64 nt, Human
agcuccagauugugaaaucauacaggaagugggaaaacucuauccacuggagauaguauuugga

SEQ ID NO: 503858 - RNA, 64 nt, Human
aagaucacaccacaauguuuucaagaaacaucugaaaagauaaaacaaagaacaaauaacuuau

SEQ ID NO: 503859 - RNA, 64 nt, Human
ucugcuggaucucaaagaugugccaagccaaggaaaaagauacaagagcagaauaguacuuaaa

SEQ ID NO: 503860 - RNA, 64 nt, Human
gauuuugcaggacccugaucuuuugugguccuguaaaagauacugaggaaugucuuucagccaa

SEQ ID NO: 503861 - RNA, 64 nt, Human
acuuaauggccuccagguccauccauguuguugcaaaagauaagauuucauuauuuuuuuuugg

SEQ ID NO: 503862 - RNA, 64 nt, Human
aaaauaaauaauacacucacauguuuccacacccaaaagauauauagagugaaaagucucccuc

SEQ ID NO: 503863 - RNA, 64 nt, Human
cuacauagaacauacaguugagugggaguaaacaaaaagauaaacaugcguguuaauggcuguu

SEQ ID NO: 503864 - RNA, 64 nt, Human
gcuagcuugcuguuaaaccacauugaagucuguuaaaagauauuuauuuuucuuguaaauaucu

SEQ ID NO: 503865 - RNA, 64 nt, Human
ggacuguguuuccauccuggccuagaggagcaguaaaagauagcauuugguuugacauggccuu

SEQ ID NO: 503866 - RNA, 64 nt, Human
gcaauacuuuucuuaguaaaggaaaaacagcauaaaaagauaccuggucugccuuguacaagaa

SEQ ID NO: 503867 - RNA, 64 nt, Human
uguguguguguguguguaagaugucuuccuaucaaaaagauaucaaaggcacauggaauauauu

SEQ ID NO: 503868 - RNA, 64 nt, Human
auaaauuaaaacaaguuacuuuuuucaaauguguaaaagauaaugacuguauuaaacuuuguau

SEQ ID NO: 503869 - RNA, 64 nt, Human
uugcauacaguuauugacuuuuucccagcugauuaaaagauagucaagaaauucugcaauauag

SEQ ID NO: 503870 - RNA, 64 nt, Human
auauaaagaggaacuucaauuaugaaaaauuuuuaaaagauauauauaucuauauaucuauaua

SEQ ID NO: 503871 - RNA, 64 nt, Human
uauauauauauaaaauaaauauauauaaaccuaaaaaagauauauuaaaaauauaaaacugcgu

SEQ ID NO: 503872 - RNA, 64 nt, Human
auacuguguuuaaagcuuuuucucuggaugcaaaaaaagauaagaauaucaggaaaauauaugu

SEQ ID NO: 503873 - RNA, 64 nt, Human
gcacuaggauuaauuuguuuacaagaagaaauuuaaacucuacguuugguuuucacauacagca

SEQ ID NO: 503874 - RNA, 64 nt, Human
gacuugaauuuaguuuuuuaccuauaccuaugugaaacucuauuauggaacccaauggacauau

SEQ ID NO: 503875 - RNA, 64 nt, Human
cccaauguuauccacucuguugcuuuugucuggaaaacucuacaguguuugugggaugucccca

SEQ ID NO: 503876 - RNA, 64 nt, Human
agauuuuauccacagugucauuuuuuacugucagaaaagauaccccuuuugucauugcaacuau

SEQ ID NO: 503877 - RNA, 64 nt, Human
aggauuuacgguuugugaaaaauguguacuguggaaaagauaauaaauugaagacauuauugug

SEQ ID NO: 503878 - RNA, 64 nt, Human
auuuauagccugugguagugcacaugguuaacauaaaagauaacacugguucacaucauacaug

SEQ ID NO: 503879 - RNA, 64 nt, Human
cauugcacagucccacuaaaccuugugaaagaagaaaagauaacugaaugaagcauuugaguau

SEQ ID NO: 503880 - RNA, 64 nt, Human
ucuccaugaugugacuuccggagauaaaggauucaaaagauaaagacaaaguacgcucagaguu

SEQ ID NO: 503881 - RNA, 64 nt, Human
aaaaguguauaugcaguaugauaccacuuuuaaaaaaagauaaauuuauagaaaaaaguuuaua

SEQ ID NO: 503882 - RNA, 64 nt, Human
uuuuuucaacuagcuuccugggguaaacuuuucuaaaagauaaaauggaaaggaacuccaaacu

SEQ ID NO: 503883 - RNA, 64 nt, Human
uuuuuuucuucuuuucuagccuaaaccugagaagaaaagauauuuccucuuuggaaugcugugu

SEQ ID NO: 503884 - RNA, 64 nt, Human
aggagaugaagagcaucuccaagaagagaugguaaaaagauauauaaauacauauccuucuaag

SEQ ID NO: 503885 - RNA, 64 nt, Human
uaaaaaauuaaagcugcuaaaauugagugguuaaaaaagauaccuuauccuauuccuccccacc

SEQ ID NO: 503886 - RNA, 64 nt, Human
uauguaacuguauacugaauucugacaaaauaaaaaaagauaccuuauugacgaaauauuuagg

SEQ ID NO: 503887 - RNA, 64 nt, Human
auauugcaaauggucaauucgauuuuaauuucucaaaagauacucuguuauccagaagauuaaa

SEQ ID NO: 503888 - RNA, 64 nt, Human
acagaaagagaauguagccauucuagccaccguuaaaagauacacagugagguguuguguuuug

SEQ ID NO: 503889 - RNA, 64 nt, Human
aaucuaaaaagcauauaaaaguuucacacagcauaaaagauaccaaaauaucauaugguugaaa

SEQ ID NO: 503890 - RNA, 64 nt, Human
agaauugauaucaauucaaaacauagaaaacuguaaaagauaaaucaggagauggcugauucau

SEQ ID NO: 503891 - RNA, 60 nt, Human; identical to SEQ ID NO: 394897

SEQ ID NO: 503892 - RNA, 60 nt, Human; identical to SEQ ID NO: 394395

SEQ ID NO: 503893 - RNA, 60 nt, Human; identical to SEQ ID NO: 395259

SEQ ID NO: 503894 - RNA, 64 nt, Human
auuggcaauaccuagugauacggauuuagcuaacaaaagauaugaagaacuauuauauugaggc

SEQ ID NO: 503895 - RNA, 64 nt, Human
uucauaauccauuuagcaauccaggccucuguugaaaagauaauaugagggagaagggaacaca

SEQ ID NO: 503896 - RNA, 64 nt, Human
uauaauguaauauauaaacuaaaauuuauggcacaaaagauaaauauggcuuugaaauuaaaga

SEQ ID NO: 503897 - RNA, 64 nt, Human
auuacaguguaaagucuccauuuaaccuguuuauaaaagauacaaggccacacuaaacuacuca

SEQ ID NO: 503898 - RNA, 64 nt, Human
cuguguacuuuuucuuuuuaugugaaaauuuaauaaaagauacccugucuuguaaacucuauuu

SEQ ID NO: 503899 - RNA, 64 nt, Human
gaagcauagccuugaaggaccugacagcaguaugaaaagauaaauaggccaggcaugguggcuc

SEQ ID NO: 503900 - RNA, 64 nt, Human
caaaaaggauuuugaagcugauccuauuuaguuaaaaagauaauuuugcuuucaacuguagguc

SEQ ID NO: 503901 - RNA, 64 nt, Human
aguuagagaaaagauggauuuaaugagauaaaugaaaagauauuuaaccuaauauaucaaggca

SEQ ID NO: 503902 - RNA, 64 nt, Human
gggcuuuugaacagaagaguaaauacagaauugaaaaagauaaacacucaaccaaacaauguga

SEQ ID NO: 503903 - RNA, 64 nt, Human
gccagaaaaguccccacuauuuuacuaacuuguuaaaagauaucuauauaauugccuggccuua

SEQ ID NO: 503904 - RNA, 64 nt, Human
gcuugauuuguuaacuucuaccuccaacccacaaaaaagauauuugaucugaguuucuaucacu

SEQ ID NO: 503905 - RNA, 64 nt, Human
cauuucuauagcaugauuucuucaaguaaaaggcaaaagauauaaauuuuauaauugacuugag

SEQ ID NO: 503906 - RNA, 64 nt, Human
aagucuugcaaugacaagagguuucauggucuuaaaaagauacuuuaugugguugaagaugaaa

SEQ ID NO: 503907 - RNA, 64 nt, Human
uccaucuccuucugccacugaauuucacacuugaaaaagauaaggucaugggggcggaugaaug

SEQ ID NO: 503908 - RNA, 64 nt, Human
gauaauucuauacauaaaaguuccuacuuguuaaaaaagauacaaaccuuguuuuuccagaagg

SEQ ID NO: 503909 - RNA, 64 nt, Human
cacauaguuucugguauauuuguugggaaagauaaaacucuagcaguuguugaggggaggaugu

SEQ ID NO: 503910 - RNA, 64 nt, Human
cugaguggaguauucaaaaacuugcuuagaaagaaaacucuaggaacagauggcuucacugaag

SEQ ID NO: 503911 - RNA, 64 nt, Human
uuacuuaaaaaaauaaaaauauaaguaaggaucaaaacucuaaaauuuugcaugaaaauuacau

SEQ ID NO: 503912 - RNA, 64 nt, Human
gagagacaaacaucuugucauuuucacuguuuguaaaagauaauucagauuguuugucuccuug

SEQ ID NO: 503913 - RNA, 64 nt, Human
gcuaccacuguggucgcgugcuacagguuugacaaaaagauaucauguuucgauuuuuuugugu

SEQ ID NO: 503914 - RNA, 64 nt, Human
cacaguauuuuauucagguuucugcaaaaaaauaaaaagauaacuuuuuuaaacaaacaugaau

SEQ ID NO: 503915 - RNA, 64 nt, Human
caaguaaauauuacaagaagauaaccuugugguuaaaagauaaggaaaaauaugagauuaugag

SEQ ID NO: 503916 - RNA, 64 nt, Human
aagagaauuauuauuaaggauugacuagaaccuuaaaagauauauguggauguuuguuuuguac

SEQ ID NO: 503917 - RNA, 64 nt, Human
ucauuugacauuuuuuguuugcugaagugaaaaaaaaagauaaagguuguacgguggucuuuga

SEQ ID NO: 503918 - RNA, 64 nt, Human
caaagcugcuuuauucaauaaaaaaaagaaaugaaaaagauauaugaauaugacaaaguauugc

SEQ ID NO: 503919 - RNA, 64 nt, Human
aucccaaguccauuuuuuccuguacacuacaaacaaaagauauauuagagacuuuugaaaaaug

SEQ ID NO: 503920 - RNA, 64 nt, Human
aauaauuuguugauaaguuuacauaaacagaaauaaaagauacuaucuuuaccguaguaguuca

SEQ ID NO: 503921 - RNA, 64 nt, Human
aaugaauuguuuuuguaccuaaccauuguaauccaaaagauaagggugugguuuacaugcuuuu

SEQ ID NO: 503922 - RNA, 64 nt, Human
ugaauauauauucuaguguccacaagauuuagcaaaaagauaaagcuuggguggaauaucauuu

SEQ ID NO: 503923 - RNA, 64 nt, Human
ucuuugguuuuuguguuuugcugcacacaaaaacaaaagauauaaaaauggaucauaaacauuu

SEQ ID NO: 503924 - RNA, 64 nt, Human
uagaaugaaaucucaguaaugaauuaaagcaacaaaaagauauugauuggcaaaaagcaagaua

SEQ ID NO: 503925 - RNA, 64 nt, Human
cauuccuaaaaauguauuugaacauugguucuguaaaagauaauggacuaaaaaaguagagagg

SEQ ID NO: 503926 - RNA, 64 nt, Human
uugaauuacuguaucuuuuacuuuuuuuuuuuugaaaagauaaacuuguaaauagagugauuug

SEQ ID NO: 503927 - RNA, 64 nt, Human
uccggcugcaaaacucuuucaucuugcaaaacugaaacucuacacccauuaaaaaauaacucgc

SEQ ID NO: 503928 - RNA, 64 nt, Human
auguaaaaaucugaugguuaaaccaucggaggagaaacucuagacugcaagaacuguuuuuacc

SEQ ID NO: 503929 - RNA, 64 nt, Human
ccugagugguuacccucaagcuuugugcucaaauaaacucuauacuuaaucauaguuucugaau

SEQ ID NO: 503930 - RNA, 64 nt, Human
gucauuuguagauauauauuuccaaauauucuaaaaaagauacuguauaugucaaaaauauuuu

SEQ ID NO: 503931 - RNA, 64 nt, Human
ugagccaccgcacccggccugaaaauauuuucuaaaaagauaaaaaauauacauaacgaugaaa

SEQ ID NO: 503932 - RNA, 64 nt, Human
cucugcauuuuaaucuguuuaguagucauuuuuuaaaagauaaucaguuuuccaaauauaucua

SEQ ID NO: 503933 - RNA, 64 nt, Human
aaacuguuuguuggcucacagaaguucugacaauaaaagauacuagcuaacacgcuguguguuu

SEQ ID NO: 503934 - RNA, 64 nt, Human
cuauggaaauacaguguuguccaucuuaguaaauaaaagauaauuucagaaacaugaacaggau

SEQ ID NO: 503935 - RNA, 64 nt, Human
gaaaccauuugugaauuuacagacuccaaaaacaaaaagauaauuuagagucucaaaguaagau

SEQ ID NO: 503936 - RNA, 64 nt, Human
uaucauacucuucuaaaacuugaguggcugucuuaaaagauauaaggggaaagauaauauuguc

SEQ ID NO: 503937 - RNA, 64 nt, Human
aaaguacuguuucaguacauucagagaacuagauaaaagauauaacuuaagcuuugauaguggc

SEQ ID NO: 503938 - RNA, 64 nt, Human
cuuuaucaguauuuuaaaaauguuaaugcaggagaaaagauaucacaacucuauggaaaaugac

SEQ ID NO: 503939 - RNA, 64 nt, Human
gcuaaggaaagugaaauuucagugccaauuaauuaaaagauacacugucucucuucauaggacu

SEQ ID NO: 503940 - RNA, 64 nt, Human
aaauuuaacuccaaguuucuccaugggcaaagucaaaagauaaugcuagguuaugucaauuuuu

SEQ ID NO: 503941 - RNA, 64 nt, Human
gugagugccauaagaaagucaauauauauuguuuaaaagauauuucagucuaggaaagauuuuc

SEQ ID NO: 503942 - RNA, 64 nt, Human
caaauuuuaccaaaagauggagaaaagcacauuaaaaagauaccaacauucagaaauucauuuc

SEQ ID NO: 503943 - RNA, 64 nt, Human
aauuuuagauacuuaacauuuauuuaacuuaaauaaaagauaacugucagauaaaacuuuauuu

SEQ ID NO: 503944 - RNA, 64 nt, Human
gacuuuuugguuaaauaauugagauuuaauuuuuaaaagauauucuuacucauuugcuagguug

SEQ ID NO: 503945 - RNA, 64 nt, Human
uuuugccuuuccuccuauuuuuuuuuaaccuguuaaacucuaaagccauagcuuuuguuuuaua

SEQ ID NO: 503946 - RNA, 64 nt, Human
uccccuaaggagaaaugaucuuagacacuuggauaaacucuauagaaaauugaguguuucuauu

SEQ ID NO: 503947 - RNA, 64 nt, Human
uuuuuuuuuuaaauaagucacaguccuguugucaaaacucuaauagacagcaaagagggucugu

SEQ ID NO: 503948 - RNA, 64 nt, Human
auaguugcagaaggcuuuauauaugcuuauaaugaaaagauauuuuuuguauauugacagcaua

SEQ ID NO: 503949 - RNA, 64 nt, Human
aaugaauugauguuuaguuugcuuuagucauuuaaaaagauauuguaccaggaugugcuauuaa

SEQ ID NO: 503950 - RNA, 64 nt, Human
uccgucucaaaaaaaaaaaaaaaaaaaaaaaaaaaaaagauacuucuccaaaguguucucaugu

SEQ ID NO: 503951 - RNA, 64 nt, Human
gugcgccuagacagguacgucuguuuuuuauuuuaaaagauaugcuauguagauauaaguugag

SEQ ID NO: 503952 - RNA, 64 nt, Human
guccauuggauacuuuccuuuuuaucaucuuaaaaaaagauaacuaguacuaaucauuguagug

SEQ ID NO: 503953 - RNA, 64 nt, Human
gcaaaauguuuaaagacacaacggaauagacccaaaaagauaauuucuaucugauuugcuuuaa

SEQ ID NO: 503954 - RNA, 64 nt, Human
aaguaucuguuuaaccuguucgugugguauaugaaaaagauaccuaagcacuagaauauccagc

SEQ ID NO: 503955 - RNA, 64 nt, Human
uuagcccccacauggggcugcucuugcuucuacuaaaagauacagcaguuacccccuuauccac

SEQ ID NO: 503956 - RNA, 64 nt, Human
aaauauucagagccauuuuuuuuaagggaaaugaaaaagauacucuggguuuuuuauacucccc

SEQ ID NO: 503957 - RNA, 64 nt, Human
gcccucuuggggcuccaggauuugcugaaagagaaaaagauaugguuugugaacuggggcauca

SEQ ID NO: 503958 - RNA, 64 nt, Human
gcucugugaugguaaauaaaauuggagcagacagaaaagauauagcaaaugaagaaauauuuua

SEQ ID NO: 503959 - RNA, 64 nt, Human
gcuguaaugggcagagcauauuuuuuuuguauuuaaaagauaaacuucaauauggaaugcuaga

SEQ ID NO: 503960 - RNA, 64 nt, Human
gauguggagcuuccuauucugugaaaaaccaagaaaaagauaugguuguauacucaaauuguac

SEQ ID NO: 503961 - RNA, 64 nt, Human
uaugcugaaaucaagcacgugagaguuuuuguuuaaaagauaagagacacagcauguauuaugc

SEQ ID NO: 503962 - RNA, 64 nt, Human
aaaaauguguuuucaagcuguuguuuuaagaagcaaaagauaguucugcaaauucaaagauaca

SEQ ID NO: 503963 - RNA, 64 nt, Human
auuuacuuaacucuggcauguucacaaaaaguagaaacucuaagagaccauuaccauuuauuca

SEQ ID NO: 503964 - RNA, 64 nt, Human
acacugaccuuaggcauggagaaaauuacuuguuaaacucuaguucuuaaguuguuagccaagu

SEQ ID NO: 503965 - RNA, 64 nt, Human
agaugcuuuuuuaaauuuaagaauaagacacacaaaacucuauuaaaaaaaaaaaagaaauaaa

SEQ ID NO: 503966 - RNA, 64 nt, Human
auuugaagcaguugauauaauggguuuauacuuuaaaagauagacauggugccaugaaguuggg

SEQ ID NO: 503967 - RNA, 64 nt, Human
cacaguguuugucuuccacagggaagcuuaaaacaaaagauauuuuuaacccacugacagaaca

SEQ ID NO: 503968 - RNA, 64 nt, Human
gagaacucugcacuaugaacccaaacccagcucaaaaagauaaaaucuagucauuuaagauaau

SEQ ID NO: 503969 - RNA, 64 nt, Human
gaaacugaggggacauaaucaucacucaguagguaaaagauaccuuuuguaaaguugucaucuc

SEQ ID NO: 503970 - RNA, 64 nt, Human
uuuacuguaauauaaaguauucaacaauuucaauaaaagauaaauuauuaauuggguguuacca

SEQ ID NO: 503971 - RNA, 64 nt, Human
caugggugggaccagaaaucuuuaugaauaaaugaaaagauaagggauuuggaagccacagguu

SEQ ID NO: 503972 - RNA, 64 nt, Human
cguuuucuuugauuuuuaauuuuuuuuuuuuauuaaaagauaccaguaugagaugaaaacuucc

SEQ ID NO: 503973 - RNA, 64 nt, Human
gggaaagagagagagaaaagagcagauuuuaaaaaaaagauaugacugagcauugcucagauca

SEQ ID NO: 503974 - RNA, 64 nt, Human
ggaauauaguuucauuucauugcaaaggcaguauaaaagauauauaaaauagcauaauaugaga

SEQ ID NO: 503975 - RNA, 64 nt, Human
auuuuuuuaugagcaauaucaauuuggagugaccaaaagauacuuaaaaauggguuuauuuuga

SEQ ID NO: 503976 - RNA, 64 nt, Human
agagauuuuguaauaucauucuaaauagauuaagaaaagauauaauuucuuuacugcaguuaaa

SEQ ID NO: 503977 - RNA, 63 nt, Human
uuucuuuaucuccuuggaauuaaagagggcuuuuaaaagauaauuugacugauccaugcuucu

SEQ ID NO: 503978 - RNA, 64 nt, Human
gcuauaaaaacacugaagacugcuuauuucuuuaaaaagauacaacucaucuuaccaagaccaa

SEQ ID NO: 503979 - RNA, 64 nt, Human
cuacccuuucccaguuagguuugcuuuuugaccaaaaagauaacaaauaccagguauggcaagu

SEQ ID NO: 503980 - RNA, 64 nt, Human
aauauguagaaacauuacuaugaaaucaguuuuuaaaagauauacuuucucuuuguccugaggu

SEQ ID NO: 503981 - RNA, 64 nt, Human
uucauauguuuuugcuuuuacuguauuucuuuaaaaacucuaaaucuuuauucaugugucacug

SEQ ID NO: 503982 - RNA, 64 nt, Human
auucuggauccauaccccauaccuacugaauuagaaacucuaggggaugaauagugguguucuc

SEQ ID NO: 503983 - RNA, 64 nt, Human
gcuucucuguaaccgcuucuggggccacaccccaaaacucuacacccucugccccagaacaauu

SEQ ID NO: 503984 - RNA, 64 nt, Human
ggggacagagcaagacucuaucuccaaaaaacaaaaaagauaagcagcuuuagaauauggcgca

SEQ ID NO: 503985 - RNA, 64 nt, Human
uaugaaguaucuguuuuugaaauucacuuuauuuaaaagauaagcagcugacugggcacggugc

SEQ ID NO: 503986 - RNA, 64 nt, Human
ggagagggugcacauguuuuuauguggaguguuuaaaagauaaauuuauaccacuguaaugugc

SEQ ID NO: 503987 - RNA, 64 nt, Human
gaauauuacauuuauuucuggaaguguguuuucaaaaagauauuuacauagucuguaaacuaga

SEQ ID NO: 503988 - RNA, 64 nt, Human
aaggaagucugcucuguacaauugucccucauuuaaaagauauauuaagcuuuucuuuucuguu

SEQ ID NO: 503989 - RNA, 64 nt, Human
aauauaguaaacacuuggaaaugguggugcuuuaaaaagauauuaauagauaauaugaaaaucu

SEQ ID NO: 503990 - RNA, 64 nt, Human
uugacacugugcuaauaguuauauucaguacaugaaaagauacuacuguguugaaagcuuuuua

SEQ ID NO: 503991 - RNA, 64 nt, Human
gaguaucuuauucugcacuuaugcauuaguuaaaaaaagauaaaggauguaucagucaguucuu

SEQ ID NO: 503992 - RNA, 64 nt, Human
cuuauuuaugucuuauuugaagaugaauagucuuaaaagauaaagacauaaaugggacaauugu

SEQ ID NO: 503993 - RNA, 64 nt, Human
uccuguugcacugaaacucuuggccauguagaggaaaagauauggaguuauguggauuucauca

SEQ ID NO: 503994 - RNA, 64 nt, Human
uaugugaaaaaaguugaauguuauaguaaaaaaaaaaagauauuuauguauguacaguuugcua

SEQ ID NO: 503995 - RNA, 64 nt, Human
aaacaaaaagggagcuauuccagauuuuaaaaauaaaagauauaguaacuaaaagcaguugugg

SEQ ID NO: 503996 - RNA, 64 nt, Human
uaaauauaccugaugcgcuguagaaugaaaauguaaaagauaaccuguauguguuccgagcuuu

SEQ ID NO: 503997 - RNA, 64 nt, Human
acaaguuaguauuaaugcguuggcccacguagcaaaaagauauuugauuaucuuaaaaauuguu

SEQ ID NO: 503998 - RNA, 64 nt, Human
agauguuaaaauaaaugguuuggugcuuuuuauaaaaagauaaucucagugcuuuccuccuuca

SEQ ID NO: 503999 - RNA, 64 nt, Human
auuuggguuuaauguuauagaaauaaaugaugauaaacucuaacuaauaaaggaaagagaauau

SEQ ID NO: 504000 - RNA, 64 nt, Human
cucgcagaugcacacccacaaguauucaguucucaaacucuagacgaguguuggcaacuggauu

SEQ ID NO: 504001 - RNA, 64 nt, Human
aaaccuuagcuugguugucuaaagacaugggugcaaacucuaggcuagcucugccaaucacuua

SEQ ID NO: 504002 - RNA, 64 nt, Human
cauauaccguaacauucuggcaaauaacaauuagaaaagauagguuuaacaaaaaaauuuacuu

SEQ ID NO: 504003 - RNA, 64 nt, Human
guuuuaaaaaaccgaguugguuuuauugaauuuaaaaagauagguaacuaaguagcauuuaaaa

SEQ ID NO: 504004 - RNA, 64 nt, Human
aaucccuucugucuuucuguucucacaaagauggaaaagauacaagagcuugccggaaauaaag

SEQ ID NO: 504005 - RNA, 64 nt, Human
uaugauaugaaaaaaucaccaauuuuuuacauauaaaagauaccuuuuuaaaaaaauagguuuu

SEQ ID NO: 504006 - RNA, 64 nt, Human
auuaaaucucuauuuccuaaauaucauucuauacaaaagauauuuuuuaaacgguaaggauuaa

SEQ ID NO: 504007 - RNA, 64 nt, Human
gagaagugccccuuagaaaguuaaaagaauguagaaaagauacucagucuuaauccuaugcaaa

SEQ ID NO: 504008 - RNA, 64 nt, Human
uccaaagauugaaagcuuaauaaucuccuaccuaaaaagauaaaauuaauugcaaucuaccaua

SEQ ID NO: 504009 - RNA, 64 nt, Human
auuauguaagcauuuguacaucuucuuuggaaauaaaagauaaaagagcgauacacaaagcuuu

SEQ ID NO: 504010 - RNA, 64 nt, Human
uuuuuuuucacguuagaagacaugaagaaauuuuaaaagauaaacaucuauauugugaaccauc

SEQ ID NO: 504011 - RNA, 64 nt, Human
aaagauaaacaucuauauugugaaccaucagcugaaaagauaaauuuguguucaauauauaggc

SEQ ID NO: 504012 - RNA, 61 nt, Human
acauaggcgcuacaagguaaaauaucuuugaaaaagauagaaggugggcaaggggagcuug

SEQ ID NO: 504013 - RNA, 64 nt, Human
uuguuuuaaguuuuacuaauuucuauauguaaauaaaagauauaaugauugugcaaauuuauau

SEQ ID NO: 504014 - RNA, 64 nt, Human
uuuuauaugccuuuuuauauucugaaauuauaacaaaagauacuuucuaacaguaguauuuuua

SEQ ID NO: 504015 - RNA, 64 nt, Human
uggaagacauaauccuuuggaaacuguuaauacuaaaagauauguuucugauacaauagcaaac

SEQ ID NO: 504016 - RNA, 64 nt, Human
uauacugugcaaucaguucuuugaaaaaaaagucaaaagauagagaauacaagaaaaguuuuug

SEQ ID NO: 504017 - RNA, 60 nt, Human; identical to SEQ ID NO: 395391

SEQ ID NO: 504018 - RNA, 60 nt, Human; identical to SEQ ID NO: 394396

SEQ ID NO: 504019 - RNA, 60 nt, Human; identical to SEQ ID NO: 394705

SEQ ID NO: 504020 - RNA, 64 nt, Human
ggauaagcagguuaucacauagcauagaauucuuaaaagauacauguggggaaaaguagucuca

SEQ ID NO: 504021 - RNA, 64 nt, Human
uucugaaguggcacaaaccuguguuuauauauuuaaaagauacucuaggaugaucacuugugcu

SEQ ID NO: 504022 - RNA, 64 nt, Human
uuccaagagccugagagugagguggaauuauuuuaaaagauaaauauuauauuauauauauaua

SEQ ID NO: 504023 - RNA, 64 nt, Human
ggaauggauaauuuagaaacaaaccaaaaaaaaaaaaagauauuugaaguguuuuuauaggaga

SEQ ID NO: 504024 - RNA, 64 nt, Human
uuauaaauuuuauaacagaauuaaaguagauuuuaaaagauaaaauguguaauuuuguuuauau

SEQ ID NO: 504025 - RNA, 64 nt, Human
gccaaaugguggaacuaauuuauuucuuuugaggaaaagauaauaaagaauguaauuaaauuua

SEQ ID NO: 504026 - RNA, 64 nt, Human
gauuaccucuugcccuugggugcuaucuagcaguaaaagauaaauuuguugaauauugguaauu

SEQ ID NO: 504027 - RNA, 64 nt, Human
gaagguaauccaaaggcauccauuuucuaggcuuaaaagauauauuuuugauauauuuaauuau

SEQ ID NO: 504028 - RNA, 64 nt, Human
cuaagacugauauuuuaggccucuuguucacaucaaaagauauuggugucagaauaccagcauu

SEQ ID NO: 504029 - RNA, 64 nt, Human
auccccgucuuuacaaaaacaaacaaacaaacaaaaaagauauugcaguuguguuguaagcguc

SEQ ID NO: 504030 - RNA, 64 nt, Human
agaugucauucucuauauggcacuuuaaaggaagaaaagauauguuucucauucuaaaauaugc

SEQ ID NO: 504031 - RNA, 64 nt, Human
aaaagaaguaaccucagcacuacuauucucucuuaaaagauaagcuauuuaaccccaaacauuu

SEQ ID NO: 504032 - RNA, 64 nt, Human
uauuucaagaucuaguccaaucuuuuucuagagaaaaagauaaucugaagcucacaaagaugaa

SEQ ID NO: 504033 - RNA, 64 nt, Human
aggcauaggcagccuauagggcccaaagaaggcaaaaagauaagauuuacucaaguagcauuug

SEQ ID NO: 504034 - RNA, 64 nt, Human
gggacaagcaggcuuguuuccaccaauagugccaaaaagauauugccuaaugugcaccugugag

SEQ ID NO: 504035 - RNA, 64 nt, Human
ccucaucccuaggguguuguguagaacucuuuuuaaacucuaugcuccgaguagaguucaucuu

SEQ ID NO: 504036 - RNA, 64 nt, Human
ugcuuucacuucaagacuuuccuucuuuucacuaaaacucuagaagguguuacaagggggaggg

SEQ ID NO: 504037 - RNA, 64 nt, Human
gggaauaaaguguagaccauaugaaaugaacugcaaacucuaauagcccaggucuuaauugccu

SEQ ID NO: 504038 - RNA, 64 nt, Human
uugcaugauaggaaaauugagaaagaauacguauaaaagauagagaggcauaacaucaaugcag

SEQ ID NO: 504039 - RNA, 64 nt, Human
cagaaaauaacagaugcuggugagguuguggagaaaaagauaugcuuauacacuguugguggaa

SEQ ID NO: 504040 - RNA, 64 nt, Human
ccacgaaaauacccagcgcagcaucuacacauucaaaagauaagcugaguguucccaccaggaa

SEQ ID NO: 504041 - RNA, 64 nt, Human
uugguuuauguuaaauaaaaaaucaguaucauggaaaagauaugaccauaauuuagucuccuca

SEQ ID NO: 504042 - RNA, 64 nt, Human
ccagugcgucucuuuuguuccuggcuuugacaugaaaagauagguuugaguucaaauuuugcau

SEQ ID NO: 504043 - RNA, 64 nt, Human
uuuaaaguaaagauguauuuauucugaagaaucuaaaagauaacagauuauuugcuuaugaaag

SEQ ID NO: 504044 - RNA, 64 nt, Human
aaaauucagaacauagcaaauaccuuugaaguauaaaagauaaaauucauuuuuagugaacccu

SEQ ID NO: 504045 - RNA, 64 nt, Human
ucaaaugauauacauuuaaagggcagauuuuuuaaaaagauacuacuauaauaaacauuuccag

SEQ ID NO: 504046 - RNA, 64 nt, Human
ggccaacaguuuccuuauuuacauccuuaccucuaaaagauacuucaaagugacaaaaacgugu

SEQ ID NO: 504047 - RNA, 64 nt, Human
gaacacauuccacacuuugaaaucuucguggaacaaaagauauuuguggaaccaaucuuugugg

SEQ ID NO: 504048 - RNA, 64 nt, Human
aaaauuguaaaauagucuucuuuuauacuguaaaaaaagauauaccaaaaagucuuauaauagg

SEQ ID NO: 504049 - RNA, 64 nt, Human
gaacccauccacucugggcagguaagagaaaagaaaaagauaaggaaagaagagagaagagaga

SEQ ID NO: 504050 - RNA, 64 nt, Human
uuuuucaaagaaaauuauucucaucucaaugccaaaaagauaguuucuacacaucaccugcuug

SEQ ID NO: 504051 - RNA, 64 nt, Human
aggggacuucaaaaguucacgaaaaaauugaauuaaaagauaaaaauuaaaaaauguuuuauuu

SEQ ID NO: 504052 - RNA, 64 nt, Human
uuuauguucuuccacaauugaucugauguucaggaaaagauaauaaaggcaaauuaguuagugg

SEQ ID NO: 504053 - RNA, 64 nt, Human
auuauauaaaauacauaauauuuuucaauuuugaaaacucuaauuguccauucuugcuugacuc

SEQ ID NO: 504054 - RNA, 64 nt, Human
gauuuuuccaggcuuccauuuagcaaauguuugaaaacucuagauuuuucucauaucaggugau

SEQ ID NO: 504055 - RNA, 64 nt, Human
ccacacaucccuucaacccacacggucugcaaccaaacucuaauucaaccugccagaaggaaug

SEQ ID NO: 504056 - RNA, 64 nt, Human
uaagauuuacauugcacuaugacauaaucccgaaaaaagauacauauacuuaaauagaagugug

SEQ ID NO: 504057 - RNA, 64 nt, Human
caggaccacaaaaaugaaagcaugucucaauaguaaaagauaacaagaucuuucaggaaagacg

SEQ ID NO: 504058 - RNA, 64 nt, Human
gaugaaaucguaauucaugguugaguuucagaacaaaagauauucauugcacauuaaccauuua

SEQ ID NO: 504059 - RNA, 64 nt, Human
gccuggacagcuuagugagaucccgucuccgaagaaaagauauguauucuaauuggcagauugu

SEQ ID NO: 504060 - RNA, 64 nt, Human
aguggggagagaagaagaaauuauuguucaugguaaaagauauuuagcaacuaugguauucuua

SEQ ID NO: 504061 - RNA, 64 nt, Human
acaucucuacuuauuuaugaacagacuuuuuuuaaaaagauaaaaaaacagcuuuauugaggua

SEQ ID NO: 504062 - RNA, 64 nt, Human
gauuuuauguacaaugauuuauacucuccuuuugaaaagauaccauaaagcacauaagcuagau

SEQ ID NO: 504063 - RNA, 64 nt, Human
gaacucuacaacauucugugggauauauuguucaaaaagauauuguuguuuuccaugauuuagc

SEQ ID NO: 504064 - RNA, 64 nt, Human
acacuuaucagaaucuuccucaagcacuugcuggaaaagauaucagauuggaacuucuuguuua

SEQ ID NO: 504065 - RNA, 64 nt, Human
aacugggcugagagagcuugaaaguccuuuucauaaaagauaacuauuuccuuuucuuguugaa

SEQ ID NO: 504066 - RNA, 64 nt, Human
uuauaaacuauauuagagggacuggguuuaaaaaaaaagauauaggguagaaauaagagcuaua

SEQ ID NO: 504067 - RNA, 64 nt, Human
gaaauuguguuaugacugauagccuucagcuacaaaaagauaggacugaccugguuuaaagugu

SEQ ID NO: 504068 - RNA, 64 nt, Human
cuaucuuaagaccaauaucucuuuguuuuuaaacaaaagauauuauuuuguguaugaaucuaaa

SEQ ID NO: 504069 - RNA, 64 nt, Human
auacuguauaauuccauuuacaugaagcauccagaaaagauaaauguauagggacaaaaaguag

SEQ ID NO: 504070 - RNA, 64 nt, Human
aucggcuuagaaacaugccucauuucuaggaaauaaaagauagaggugagagaugauuuacuuu

SEQ ID NO: 504071 - RNA, 64 nt, Human
uuuuacaguuacuuccuuccugccccaaaauuauaaacucuaaguguaaaaaaaagucuuaaca

SEQ ID NO: 504072 - RNA, 64 nt, Human
acgauauguuaaaccaaccuuucauuccugaaaaaaacucuagucauuugguauuauucuuuug

SEQ ID NO: 504073 - RNA, 64 nt, Human
uaauugucuucauuucaauuaaggcugaaagcauaaacucuagaggugacucagucaggacuga

SEQ ID NO: 504074 - RNA, 64 nt, Human
aauucugaccaccuuuuggcuuugaguauuuuccaaaagauauuugaaauccuaaugaggaaau

SEQ ID NO: 504075 - RNA, 64 nt, Human
uuaaaaauaacuauaauugcauuguuuguaacacaaaagauaaaugcuugaggggaugaauacu

SEQ ID NO: 504076 - RNA, 64 nt, Human
uguuauauuauaaggauaugcacguuuguucuggaaaagauagaauuugucucuaaaagacuug

SEQ ID NO: 504077 - RNA, 64 nt, Human
uaauuuugauccugcccucuccagcugcuccuucaaaagauacaucaaaagauagaaacucugg

SEQ ID NO: 504078 - RNA, 64 nt, Human
ugcccucuccagcugcuccuucaaaagauacaucaaaagauagaaacucugggcugggcacagu

SEQ ID NO: 504079 - RNA, 64 nt, Human
gcgacaagagcaaaacuccgucucaaaaaaaaaaaaaagauacaaagucugcauuugauauaau

SEQ ID NO: 504080 - RNA, 64 nt, Human
aauuuugcuuaaaaucuauuuuucauaugaaaauaaaagauaacaaucaacuugggucuguccu

SEQ ID NO: 504081 - RNA, 64 nt, Human
guguggagcauuaacuuguggaugauucagaguuaaaagauaaaaagacgccagaguucucgcu

SEQ ID NO: 504082 - RNA, 64 nt, Human
ucaccacaaagggacuccugugaaacugcugccaaaaagauaccaauaacacuaacaauaccga

SEQ ID NO: 504083 - RNA, 64 nt, Human
uuuguagcuuuuuguaaauuauuuaaagugauguaaaagauauuuuuggaaaauacuguuguuc

SEQ ID NO: 504084 - RNA, 64 nt, Human
uuuuacaguuacauccagcuguuagauaugcaggaaaagauaguuugcuggcuagcucuauuca

SEQ ID NO: 504085 - RNA, 64 nt, Human; identical to SEQ ID NO: 504070

SEQ ID NO: 504086 - RNA, 64 nt, Human; identical to SEQ ID NO: 504069

SEQ ID NO: 504087 - RNA, 64 nt, Human
ggcuaaauagacuagucauguccuuacaggucuuaaaagauaacauguaaauguuuuuaaaaug

SEQ ID NO: 504088 - RNA, 64 nt, Human
cuuuuuccuuauuauaauuugauaaggugauuauaaaagauacauggaaggaaguggaaccaga

SEQ ID NO: 504089 - RNA, 64 nt, Human
aacaauugauuugaugcuaauaauaauuuucuuuaaacucuaccauucauuaugugguaacugu

SEQ ID NO: 504090 - RNA, 64 nt, Human
uucaggacagacuccgcaugggacuuguccaaaaaaacucuaaucaaaagaggaaaauuuugga

SEQ ID NO: 504091 - RNA, 64 nt, Human
cuggagcaccagggcuaaauggggagcuaucuggaaacucuagauuuucugucauacccacauc

SEQ ID NO: 504092 - RNA, 64 nt, Human
cauauuuacuucuaauucuacucucagaggugcaaaaagauacuuaucuaacuggacacuuuua

SEQ ID NO: 504093 - RNA, 64 nt, Human
gcucugguuaaaacaguaauaggcacuugaaaaaaaaagauaaauuauugaaugaguaguauua

SEQ ID NO: 504094 - RNA, 64 nt, Human
uugacucuuuuggucaguuuuaacaauucuccuuaaaagauauuuuggagugaugaauguaguu

SEQ ID NO: 504095 - RNA, 64 nt, Human
uaauccuguaacuggguuugaaaaaauaaucaacaaaagauacaauucaaggguuagguugcag

SEQ ID NO: 504096 - RNA, 64 nt, Human
caccucugaacccaggcacuuuaaacuucuauagaaaagauaucguguacauaggaacuggugu

SEQ ID NO: 504097 - RNA, 64 nt, Human
ggaauauagagaggguucauguggcauuuuagagaaaagauaauuuauccucauucaacacagg

SEQ ID NO: 504098 - RNA, 64 nt, Human
guaacucuuucugaggagcuguuacugaauauuaaaaagauagacuucaacuaugugucugaug

SEQ ID NO: 504099 - RNA, 64 nt, Human
ggucaggauagauucauuucuugcaacauaguggaaaagauauaagcugcaguaauuugcucuu

SEQ ID NO: 504100 - RNA, 64 nt, Human
ugcauaacucuugggaaguugagcuuugcuaaauaaaagauauuucugcugaucaaagaugauc

SEQ ID NO: 504101 - RNA, 64 nt, Human
acuucauuuuugcaguacuuuuuaauuuugauaaaaaagauacaaaguucauaauaucaaaaua

SEQ ID NO: 504102 - RNA, 64 nt, Human
uuugcuucaugugcagauaaccaaaaaucauuuuaaaagauaucaaacuuauugaugggcaauu

SEQ ID NO: 504103 - RNA, 64 nt, Human
cuuuugacaaaggaaugaagaacauacacuggggaaaagauaaugucuuuaauaaauggugcug

SEQ ID NO: 504104 - RNA, 64 nt, Human
gagugauuuaaaaauaaaaccaaaacaaaacacaaaaagauauuccacaggacaugccacuuua

SEQ ID NO: 504105 - RNA, 64 nt, Human
agguaauuuacuugacuguucuauuuguuuguccaaaagauaaaaugaugagagagauucgaga

SEQ ID NO: 504106 - RNA, 64 nt, Human
caaacuagagaucaguugacaaaggagaagugacaaaagauaagcugcagaaggaccucagaag

SEQ ID NO: 504107 - RNA, 64 nt, Human
uagaaauuucucaauauugugucuuuuucuuuugaaacucuaaacacuucagaaaaaaacacua

SEQ ID NO: 504108 - RNA, 64 nt, Human
agacauccugacucucgagcugggaagaugaaagaaacucuauuauauauuuggccuacuuucc

SEQ ID NO: 504109 - RNA, 64 nt, Human
ggcuagacuuccucagcccgagggcugcccuuccaaacucuaucggcugaugcagcgcugcugg

SEQ ID NO: 504110 - RNA, 64 nt, Human
ugaucaccaguuguaccaaaacacuaauuuuugaaaaagauagguuaaaguauuugacaaaagu

SEQ ID NO: 504111 - RNA, 64 nt, Human
cagagcaagacucggucucaaaaacaaaauuuaaaaaagauauaaggcaguacuguaaauucag

SEQ ID NO: 504112 - RNA, 64 nt, Human
guucucuuaccccacugccacauaccucuguuuuaaaagauaaguccacuaacugugaguaaaa

SEQ ID NO: 504113 - RNA, 64 nt, Human
gcuccagaauaucuuugagaaugacaacuuaauuaaaagauacuuaggcacuuuuuuuuuuuuu

SEQ ID NO: 504114 - RNA, 64 nt, Human
uauuugcuuguugaaaaaaaaaacuggcaaagugaaaagauacagucaaaaaucuagaauuucu

SEQ ID NO: 504115 - RNA, 64 nt, Human
agcaauaugauuuguuacuauaauuaaccuguauaaaagauacauuuuauggugguuucaguag

SEQ ID NO: 504116 - RNA, 64 nt, Human
ucguuuucuuuuucauggugccuuucuuucuaagaaaagauagaaagaauggggccagguucau

SEQ ID NO: 504117 - RNA, 64 nt, Human
auuagguaccuagcagaugugcacaauauaaacaaaaagauaucuggccuaccuuacuacuaaa

SEQ ID NO: 504118 - RNA, 64 nt, Human
cuagacaccuucgcuuguuaucuugucaagauagaaaagauaguaucauuucacccuugccagu

SEQ ID NO: 504119 - RNA, 64 nt, Human
gaucuuuaauaacacaucccuauagaaaguggauaaaagauauaccaaaacuguaauacagaua

SEQ ID NO: 504120 - RNA, 64 nt, Human
aacacucugggaaugaggaacaagacuuuuucuaaaaagauaguggaaguucaagggauguacc

SEQ ID NO: 504121 - RNA, 64 nt, Human
cuuuauucuaauguaucccaaaccuaaucuuuuuaaaagauagaagauacuuuuaagacaacuu

SEQ ID NO: 504122 - RNA, 64 nt, Human
guccuuuccuucacugauuugcuuuaaaaaaaauaaaagauaaugauuuauugcagaauuauga

SEQ ID NO: 504123 - RNA, 64 nt, Human
acuuuuucacaaugacuggcacagauuacucagcaaaagauagcaaaacgggugguugaagaua

SEQ ID NO: 504124 - RNA, 64 nt, Human
guuggugaacaacaaaaaagagaucuauuucuuuaaaagauauuugugcagaaacugcauguaa

SEQ ID NO: 504125 - RNA, 64 nt, Human
agaagcagacaauuuauaaaacuacacaaugucuaaacucuauguugcucaguguacuuaaaau

SEQ ID NO: 504126 - RNA, 64 nt, Human
gaaccaagaaguaacugccacuuuugcauaaauaaaacucuagacaaaugguuaacgcaggcag

SEQ ID NO: 504127 - RNA, 64 nt, Human
gcuuuacuuuucagguaauuauggaaaauauuuuaaacucuagaagcuucaauaaugaugugug

SEQ ID NO: 504128 - RNA, 64 nt, Human
uuuuacugcaacccacaggcccacaguaugcuugaaaagauaaauuauaucaauuuccucauau

SEQ ID NO: 504129 - RNA, 64 nt, Human
augaaaugcaguuuuuuuucucguuuuuaauuuaaaaagauauuaaccucaucacuacuaacuc

SEQ ID NO: 504130 - RNA, 64 nt, Human
cuuaaucuauauucuacccuuauaauaaaagaucaaaagauauaucuccuaugaacagauugga

SEQ ID NO: 504131 - RNA, 64 nt, Human
cucagaacaugacuccuugggagauccccaucacaaaagauauugauggacuccuaagccaggc

SEQ ID NO: 504132 - RNA, 64 nt, Human
cuugguuugguaguucuuguuuuuaauaaggggaaaaagauaaaauaaccccuauuuuuccugu

SEQ ID NO: 504133 - RNA, 64 nt, Human
ucacaaugaagcuuccagauagcaccguuuugcuaaaagauacauucucauuguuuuccaacag

SEQ ID NO: 504134 - RNA, 64 nt, Human
auuuggcaagagaaacaguuuauuaauguuuuugaaaagauaagucauauucauacuuaauacc

SEQ ID NO: 504135 - RNA, 64 nt, Human
ucgguggugacucuucggccccuggggaaaaacaaaaagauauugcugagaugaccucuuuuaa

SEQ ID NO: 504136 - RNA, 64 nt, Human
uuuuauauuguccuccaccuccaucauuuucaauaaaagauagggcuuuugcucccuuguucuu

SEQ ID NO: 504137 - RNA, 64 nt, Human
ucugucucaaaaaaaauaaaauaaaauaaauaaaaaaagauauaguauuaaugccuguauuuau

SEQ ID NO: 504138 - RNA, 64 nt, Human
uuuuccuucagcuugaaagcuuuuuuuuaaaaggaaaagauaccaaaugccugcugcuaccacc

SEQ ID NO: 504139 - RNA, 64 nt, Human
uuauauuaaaauauggcuauaaauauauaaaaagaaaagauaaagaugaucuacucagaaauuu

SEQ ID NO: 504140 - RNA, 64 nt, Human
gucaauaugaggauggugguuuauucucagaagaaaaagauauguaaggucuuuuagcuccuua

SEQ ID NO: 504141 - RNA, 64 nt, Human
ggagacuccaucucaaaaaaaaaaaaaaaaaaaaaaaagauaaaaagucagaaaucugaaaagu

SEQ ID NO: 504142 - RNA, 64 nt, Human
caagcuaagaaaaaauucuguuuauaaaagaaggaaaagauaguuuauguuuuuagccuaagua

SEQ ID NO: 504143 - RNA, 64 nt, Human
cugaauggaguuaaacuuuagugcuacagaaaagaaacucuauggucuuauauuuacaacacuu

SEQ ID NO: 504144 - RNA, 64 nt, Human
uaucaaauuaccuauauuggcauugcuggauuauaaacucuauaucuguaauauaaaguguuug

SEQ ID NO: 504145 - RNA, 64 nt, Human
uuucuccauaagugcaggacuguuacucacuacuaaacucuaccaagaauggaaacaaagaaua

SEQ ID NO: 504146 - RNA, 64 nt, Human
uuggcaaauaagguuuggaagcagaagagcaaaaaaaagauauuguuaaaaugaggccuccaug

SEQ ID NO: 504147 - RNA, 64 nt, Human
aauguucuuaaauguucucacuacaaaaaaagaaaaaagauaacuacgugaggugauggauaug

SEQ ID NO: 504148 - RNA, 64 nt, Human
cuccaucaacaaccagggagacugcaccugauggaaaagauauaugacugcuucaugacauucc

SEQ ID NO: 504149 - RNA, 64 nt, Human
cuuuauacagauaaggucaguagaguuccagaauaaaagauaugacuuuucugaguuauuuaug

SEQ ID NO: 504150 - RNA, 64 nt, Human
accucuuaggaaccaaagaaugccucuacaagcaaaaagauaguugaaaauaguuaagauccaa

SEQ ID NO: 504151 - RNA, 64 nt, Human
aguugauugcuccucuggcagagagaaggagcucaaaagauacuugaugucuuucauguaaguu

SEQ ID NO: 504152 - RNA, 64 nt, Human
gugaacuauuugagggguauggggucuagaaguuaaaagauacgcaugucuucuguucuuuucc

SEQ ID NO: 504153 - RNA, 64 nt, Human
ccugagucaaaaggauagccaaggguggaguggaaaaagauauggugaaggcagaacugcucac

SEQ ID NO: 504154 - RNA, 64 nt, Human
gguacaguuauuuaacaggcauacacaagcagggaaaagauaauccauuuagaucuuuaaugcu

SEQ ID NO: 504155 - RNA, 64 nt, Human
ucugacagcaacaacggucccacaaacaagucacaaaagauaccguuaaacuuuuuuuuuuuuu

SEQ ID NO: 504156 - RNA, 64 nt, Human
aaaugauagcuuagaaaacacuagaguucauacuaaaagauauuuugcaaauacacuaaauggg

SEQ ID NO: 504157 - RNA, 64 nt, Human
ggaaagaauuccuacaauauauauucuggcugauaaaagauacauuuguauguugugaagaugu

SEQ ID NO: 504158 - RNA, 64 nt, Human
uuaacccaaaagauuauuuuuugguuccuaaagaaaaagauauuuuuaaucugucaauuauuuc

SEQ ID NO: 504159 - RNA, 64 nt, Human
aaaaaaaacuuuuuuuuaaauuaaaaaggaaaauaaaagauauugaggucuuccuaguguuacu

SEQ ID NO: 504160 - RNA, 64 nt, Human
gccugcuaugucuucccaauguuuauugggcaauaaaagauaagugcagucacagagaacucac

SEQ ID NO: 504161 - RNA, 64 nt, Human
aauaaauguagcaaaauuucuuucuaaccugccuaaacucuaggccauuuuauaagguuauguu

SEQ ID NO: 504162 - RNA, 64 nt, Human
uccaauuguuauuaagccacucugugacauuagaaaacucuacuguuuuaagcuuuaguuuccu

SEQ ID NO: 504163 - RNA, 64 nt, Human
gugacuuuauuugcaaagcugugaauaaaaccacaaacucuaaaguagcacaagccuccuucaa

SEQ ID NO: 504164 - RNA, 64 nt, Human
uacuaaaauguaacuuuuuaaucaucugguuuuuaaaagauaaacaguuuagcccaucucucca

SEQ ID NO: 504165 - RNA, 64 nt, Human
accgaagccuugugcauaaggauuuuuucccaggaaaagauagacuuuauaaacagugggagcc

SEQ ID NO: 504166 - RNA, 64 nt, Human
ugauauguuucguggguugaauugugucccccauaaaagauauguugaaguucuaaccccaggu

SEQ ID NO: 504167 - RNA, 64 nt, Human
gccuuccaagaguauauguuucuuuaaucaguuuaaaagauaaaggcauuuuggguuuuaagac

SEQ ID NO: 504168 - RNA, 64 nt, Human
aaaaugccaaccuuagaaaagacaauaaaugcacaaaagauauaaacaggaacagcaaauauuu

SEQ ID NO: 504169 - RNA, 64 nt, Human
ccagcuaacagucccuauggaaagauggcaucaaaaaagauagaucuauauauauauauaaaua

SEQ ID NO: 504170 - RNA, 64 nt, Human
ugaggucccagcucccugauccuaugcucuauuuaaaagauaaccuuuggccuuagacuccguu

SEQ ID NO: 504171 - RNA, 64 nt, Human
acacagcgagacuccgucucgaggaaaaaaaaagaaaagauacgugccugcggugaggaagcug

SEQ ID NO: 504172 - RNA, 64 nt, Human
uuuggucagaagccaggaacuggugucauuccuuaaaagauacgugccggggccagguguggug

SEQ ID NO: 504173 - RNA, 64 nt, Human
uugggucuuggcugaaaaaaaaaaaugcuuuuaaaaaagauaaaaugaaaaggagagcucucuu

SEQ ID NO: 504174 - RNA, 64 nt, Human
ugcguuacagaugucugcugaccucacaagagugaaaagauaaacugugcauguguuuccacuu

SEQ ID NO: 504175 - RNA, 64 nt, Human
guaacaauucaauugaauuuuaaaaugacaccugaaaagauacaucugauauuuucuauauaga

SEQ ID NO: 504176 - RNA, 64 nt, Human
uuuuauauguaguacuaacuaaggucccauaauaaaaagauaguaucuuuuaaaaugaaauguu

SEQ ID NO: 504177 - RNA, 64 nt, Human
ccucacaccuguuagguuacaucugcuauugucaaaaagauaagagauagcaagugucagcaag

SEQ ID NO: 504178 - RNA, 64 nt, Human
uccucaggaguauucucuaaccugauauuuucuaaaaagauauguugauucaacuuuguuuagc

SEQ ID NO: 504179 - RNA, 64 nt, Human
aaugucaccacacacacuucaugaagccucuggaaaacucuacaguauacuugugagagaauga

SEQ ID NO: 504180 - RNA, 64 nt, Human
augaucuucuucaagccauuauuuuaacucaagaaaacucuagagaagaaaagugaagaaguca

SEQ ID NO: 504181 - RNA, 64 nt, Human
auuagcaucaucacagaccuauacuugcuuucugaaacucuaccacauacugaaggaauacagg

SEQ ID NO: 504182 - RNA, 64 nt, Human
ccauauuuuaaaaguaccaauuuuguuuuuacagaaaagauaaaacucaaaagagaacagugua

SEQ ID NO: 504183 - RNA, 64 nt, Human
uaggcuuuugggcauaugcuagucugagcuuccgaaaagauacauauauguuucccuuuucauu

SEQ ID NO: 504184 - RNA, 64 nt, Human
uucugauggguaacuugcaggaauauucuauuggaaaagauaacaggaaguacaagugcuucuu

SEQ ID NO: 504185 - RNA, 64 nt, Human
uuuguuaaccauuucagagaguuuggcaauuuuuaaaagauaauaagguaucauuuuuaaguau

SEQ ID NO: 504186 - RNA, 64 nt, Human
aaaauucauuugaaagucugauggcuuuuacaauaaaagauauuaagaauuguuauccuuaacu

SEQ ID NO: 504187 - RNA, 64 nt, Human
aaaucuauuuuuuaacaaucuuuuuauuauuuguaaaagauauaaaaacaacucccaucaguag

SEQ ID NO: 504188 - RNA, 64 nt, Human
uccugcaguauaugaaguauuguaccagaguauuaaaagauauguaauauuuuauugauaaauc

SEQ ID NO: 504189 - RNA, 64 nt, Human
agauggcagguuugcaauccaagcaggaagaaggaaaagauacccaaaggucaagaacacagug

SEQ ID NO: 504190 - RNA, 64 nt, Human
caggauaacacagauaagggcuuuauuguacaauaaaagauauguaugaaugcaucaguagcug

SEQ ID NO: 504191 - RNA, 64 nt, Human
auugcuuuuaacugugggacuuaguuaauucuucaaaagauaaagaugaacaggaagaaaaaga

SEQ ID NO: 504192 - RNA, 64 nt, Human
ugagaagugcaaauguucgcauccuuuuguuuuuaaaagauaugaugucagaauaaaaugugga

SEQ ID NO: 504193 - RNA, 64 nt, Human
uuuucucauuuuccugagaauuuaccagaaaaaaaaaagauacauagauuugucucuguguuuu

SEQ ID NO: 504194 - RNA, 64 nt, Human
aguuugugccuccuacacagucaaagaaagagaaaaaagauaaaguagaaaaagaaaaaaguga

SEQ ID NO: 504195 - RNA, 64 nt, Human
uauuauuauugucaucccaagaaaaaauauauuaaaaagauauuugaaauuucauuauaaaauc

SEQ ID NO: 504196 - RNA, 64 nt, Human
uaucauguuaauacuauuauugucaucccaagaaaaaagauauuuuaaaaauuuauuugaaaag

SEQ ID NO: 504197 - RNA, 64 nt, Human
acauauuguguauauguuuuuauuuucaaaugauaaacucuagacauauauuuugcaaaaugag

SEQ ID NO: 504198 - RNA, 64 nt, Human
augaaggaagaauucuauggaaauuacaaauccaaaacucuaugaugaugucuuccuagggagu

SEQ ID NO: 504199 - RNA, 64 nt, Human
guuagacagacucacauuacuuuuuuucagagguaaacucuagauuacugugucaacccaauac

SEQ ID NO: 504200 - RNA, 64 nt, Human
uuuuucuauuggaaaugguuacaaguuauacuccaaaagauauuugaauuaucuugauuggaau

SEQ ID NO: 504201 - RNA, 64 nt, Human
aagccacugcagcuaaguauuaauccccagugcuaaaagauaccaggcaucuaguuuagcaaug

SEQ ID NO: 504202 - RNA, 64 nt, Human
auagaaaggaauuuuaaauaguuugacacuugaaaaaagauacuauuuauaaguugaagaaagu

SEQ ID NO: 504203 - RNA, 64 nt, Human
aaaauguaaaaugcucaugaagguuuugaaugccaaaagauauuuuagaaucaauuuauaaagg

SEQ ID NO: 504204 - RNA, 64 nt, Human
aaaaugcauuuuggcauggugggauggauguugcaaaagauauccggagccuccagucugucau

SEQ ID NO: 504205 - RNA, 64 nt, Human
uauauaaaauacauaaaacaauagauuagaaaucaaaagauaucucuggccugcaauauuuuac

SEQ ID NO: 504206 - RNA, 64 nt, Human
cuuuugaagacuauacaaggcuucaaaaaagacuaaaagauauacagagaagacauaaugaauu

SEQ ID NO: 504207 - RNA, 64 nt, Human
acacaaccaaguucaugggaauuuuguguaaaauaaaagauaacaugccugagggagagccugg

SEQ ID NO: 504208 - RNA, 64 nt, Human
aucuaccuaccucaaaggggugguauaagguuuaaaaagauaaagauucagauuuuuuuuaccc

SEQ ID NO: 504209 - RNA, 64 nt, Human
agacuuaaggcuucauugugggguuaaaaaaaaaaaaagauacaaagaaauaugucucaaaaaa

SEQ ID NO: 504210 - RNA, 64 nt, Human
aaguucugaaaauggugaauauguggguaaauauaaaagauauuucucucuuuuuaaaaucuuu

SEQ ID NO: 504211 - RNA, 64 nt, Human
gauaaacagaauacuuuuaaaacaccuugagaaaaaaagauaauacauacacaugaacaaagaa

SEQ ID NO: 504212 - RNA, 64 nt, Human
agacugcaucucaaaaaagaaaaauaaacgaaguaaaagauauuuaucagagcuguuacaggaa

SEQ ID NO: 504213 - RNA, 64 nt, Human
ucagaauuuacacucacucgcagucauuuauuuaaaaagauaaaacaagauaauggguucuuug

SEQ ID NO: 504214 - RNA, 64 nt, Human
ugugggugggacugcacauucuuuuccucuuaguaaaagauaggcccacuuuauuccaagaaua

SEQ ID NO: 504215 - RNA, 64 nt, Human
ccacucugccuucccuggugcugguuuugcucucaaacucuauauagaacucucggccgggcgc

SEQ ID NO: 504216 - RNA, 64 nt, Human
uacauuguacaaggaaugaaagugucacggguaaaaacucuaaaagguuaauuucugucaaaug

SEQ ID NO: 504217 - RNA, 64 nt, Human
cuuuacuaugcauaagaaaauucaaacuggagagaaacucuacaaaugugaagaauguggcaaa

SEQ ID NO: 504218 - RNA, 64 nt, Human
uaagacaucucaugucauauaaaaguuaaauguaaaaagauacaguccauuuuguccugcacac

SEQ ID NO: 504219 - RNA, 64 nt, Human
gagauccuuuuucaauguaacaauuauauuuaugaaaagauauguuacacuaacuucucagaag

SEQ ID NO: 504220 - RNA, 64 nt, Human
gaacauuuauccaggaauugauacguuuauuaggaaaagauauuuuuauaggcuuggauguuuu

SEQ ID NO: 504221 - RNA, 51 nt, Human
cuggaaaaggucuuuuuuaauaaaagauauaauaguauggcaauuauauug

SEQ ID NO: 504222 - RNA, 64 nt, Human
gugaauuuauuuguguguucuuuacuuauauaaaaaaagauaacuuuaaggaugugcaaguaca

SEQ ID NO: 504223 - RNA, 64 nt, Human
caguauuccacaggcacaccuuaauuucauuguaaaaagauauauauauuuugucuauuuuugu

SEQ ID NO: 504224 - RNA, 64 nt, Human
uucuuaauauacuauuauuagaauaguagaggauaaaagauaauguuauccaguuacaaaggaa

SEQ ID NO: 504225 - RNA, 64 nt, Human
cauaauuucauuuuaauuaauuauaggaaagaagaaaagauaauacccauuuguucuaucaccc

SEQ ID NO: 504226 - RNA, 64 nt, Human
accuucaugucuuucaguugauuuguauuucugcaaaagauauuucaaggauuaucaagguaug

SEQ ID NO: 504227 - RNA, 64 nt, Human
cuguucacauuugucucuaaaagucuucaucgcuaaaagauaccauaauuugcugaggcuucuu

SEQ ID NO: 504228 - RNA, 64 nt, Human
gaugaccuugauggaaaaaaaauauuuuuuaaaaaaaagauauacuguggaaggggggagaauc

SEQ ID NO: 504229 - RNA, 64 nt, Human
uccuucaaugcguguauguaaucuuuguuaguauaaaagauauuaaauauaggugccaagaauu

SEQ ID NO: 504230 - RNA, 64 nt, Human
gguuguuuuaguauuagacuuuuuuuucaaugccaaaagauagaagauuaaauauucuugaaua

SEQ ID NO: 504231 - RNA, 64 nt, Human
uguuaagugacuauaugccaugggauauauggaaaaaagauauuaaugcagauuaauuuauauu

SEQ ID NO: 504232 - RNA, 64 nt, Human
cauccagaaaggccagauuuuaccuaccaagaaaaaaagauauuuuuccagagaguuagguaua

SEQ ID NO: 504233 - RNA, 64 nt, Human
uaauguuaaaguuaguuuauaaaugugaguaaauaaacucuaaguuuguauugaaguagugcua

SEQ ID NO: 504234 - RNA, 64 nt, Human
ggcaacaccagcaaauuauauguggacagguucuaaacucuauauauacauauauauauauaua

SEQ ID NO: 504235 - RNA, 64 nt, Human
gugccacugcacuccagccugagcaacaaaagcaaaacucuaucuuuaaaaaaaaaaaaaaaaa

SEQ ID NO: 504236 - RNA, 64 nt, Human
uguucugauuagaaaugaccaauauuauacuaagaaaagauacgacuuuauuuucugguagaua

SEQ ID NO: 504237 - RNA, 64 nt, Human
gaaagcaaagcagaaaacagugccccaaauggaaaaaagauacucacacagaacaaaacaguuc

SEQ ID NO: 504238 - RNA, 64 nt, Human
aucauggaaguauaacuuauuccagacuaaacauaaaagauaaucuugaccugaguagagaaga

SEQ ID NO: 504239 - RNA, 64 nt, Human
ucaggaaaacuauggggaaauaguuacauuucacaaaagauauuuuaaacucuuuguaaaacuu

SEQ ID NO: 504240 - RNA, 64 nt, Human
caguguucuuccucuuuucucccuuaugaaaaagaaaagauagcacaaaacuuaagacuuaccu

SEQ ID NO: 504241 - RNA, 64 nt, Human
cccuuuaaggauuaacuaguuaaggauuaauagcaaaagauauuaaauaugcuaacauagcuau

SEQ ID NO: 504242 - RNA, 64 nt, Human
ggcgacagagcgagacuuugucucaaaaaagaagaaaagauauuauucccaucaugauuucuug

SEQ ID NO: 504243 - RNA, 64 nt, Human
gaaaagaaauuaaucacaacuaucucucuugccuaaaagauaaauauagguaaacccaaggaaa

SEQ ID NO: 504244 - RNA, 64 nt, Human
uauuaaacuuuuucuaaaaagugaaaaaaaaaaaaaaagauauaagaacucaaggucccauacu

SEQ ID NO: 504245 - RNA, 64 nt, Human
uggccuugcugcuguuuugauuuauggaauuugaaaaagauaauuauaaugccugcaauguguc

SEQ ID NO: 504246 - RNA, 64 nt, Human
uuucuagcuccacaucugucugcacauaggaaggaaaagauaggacucuaaaccuagucaucuu

SEQ ID NO: 504247 - RNA, 64 nt, Human
ccaacuugugacucauagggucugaacucacuccaaaagauaauaacugcagucuaauuuuucc

SEQ ID NO: 504248 - RNA, 64 nt, Human
uacugacccagaggggaaugagggcugaguuaugaaaagauaacuucaugaagacuuaacuggc

SEQ ID NO: 504249 - RNA, 64 nt, Human
ggucuagcugaaucuucagagugggaggucuccaaaaagauauuaccuuauugggcuuaacaau

SEQ ID NO: 504250 - RNA, 64 nt, Human
cuggcagagaugauucuagauuaacuaucccaguaaaagauaugauauuuuccauagauaccuc

SEQ ID NO: 504251 - RNA, 64 nt, Human
uuuuuacaaugacuucagcucuguuuuuagcuagaaacucuaaaaacaaaaauaauaauaaaga

SEQ ID NO: 504252 - RNA, 64 nt, Human
caaaaggaaaaaaaaauugagauuacacuggcauaaacucuaguuugcacaguucacagcuacu

SEQ ID NO: 504253 - RNA, 64 nt, Human
gcuacugaauagccggauuuuucaguucugucagaaacucuaaauuuccaaaaaucuaagugaa

SEQ ID NO: 504254 - RNA, 64 nt, Human
aauuacaaacaugaggaaugauucacugaagaugaaaagauaggacggaugugauaugaaaaaa

SEQ ID NO: 504255 - RNA, 64 nt, Human
ggaauguugaaugucuuuggcucaguucauuuaaaaaagauaucuauuugaaaguucucagagu

SEQ ID NO: 504256 - RNA, 64 nt, Human
gggacggucuuuucuaaacuuuaacaugagacuuaaaagauauaauaagggaaaagauaagcag

SEQ ID NO: 504257 - RNA, 64 nt, Human
acuuuaacaugagacuuaaaagauauaauaagggaaaagauaagcagauuucgcaaccaaaaaa

SEQ ID NO: 504258 - RNA, 64 nt, Human
gcacagaguuguuacauuuuuaagugcugcauuuaaaagauacaguuacucagaauucucuagu

SEQ ID NO: 504259 - RNA, 64 nt, Human
acaaaguugagccacgguccuuacuuaaagauugaaaagauaacauguaggccaggcaggucac

SEQ ID NO: 504260 - RNA, 64 nt, Human
acugguacaguccagccaguaaaaaacacuuccaaaaagauacacagaagaggaacuaaaugac

SEQ ID NO: 504261 - RNA, 64 nt, Human
uugauuuuucaucucuuuaaccaaacuuguggccaaaagauauuugaccguuuccaaaauucag

SEQ ID NO: 504262 - RNA, 64 nt, Human
acacuuugcuacaaucuugcuagugcguuuucuuaaaagauaaucuauuuacuguaaaaauaaa

SEQ ID NO: 504263 - RNA, 64 nt, Human
acuuuuucuacuuuuccuacuuuuuuguagaaaaaaaagauaaugccucugcuucuauuucucu

SEQ ID NO: 504264 - RNA, 64 nt, Human
uucuguauuaauguaaauaagauuaucuauugcaaaaagauauuucaaaccuaaauugugguca

SEQ ID NO: 504265 - RNA, 64 nt, Human
uuuaggagaaaaaacaauuugguuuacugauaacaaaagauaauuggaaacaugagaguauuug

SEQ ID NO: 504266 - RNA, 64 nt, Human
caaggacauuuggauuuacuuuuacagaauauugaaaagauaagacaaauuauaaauaaguucu

SEQ ID NO: 504267 - RNA, 64 nt, Human
uaaauuugccaacuaguaaugcauacuggaaaucaaaagauacugaaagaauggugaacuucuc

SEQ ID NO: 504268 - RNA, 64 nt, Human
uuuucccaucacucuuuacaugguggugauguccaaaagauacccaaauuuuaauauuccagaa

SEQ ID NO: 504269 - RNA, 64 nt, Human
acaguucuuuuuaaaacacuggaagacucauguuaaacucuaauugugaaggcagaaucucugc

SEQ ID NO: 504270 - RNA, 64 nt, Human
uuguauuagcuuaaugucuacauaucuuuggccaaaacucuauugucauauuagaaacauguua

SEQ ID NO: 504271 - RNA, 64 nt, Human
uuguuuacaaagaguuuaguuuuuaagacauccaaaacucuaugcuagagcaaaaaucaaauag

SEQ ID NO: 504272 - RNA, 64 nt, Human
cugacucuuaaaaaaaaaaaaaaaaaaaaaaaaaaaaagauaacuagaacuucuagaacaucuu

SEQ ID NO: 504273 - RNA, 64 nt, Human
uauguaccauugucagcuaugacuaaaaauuugaaaaagauaaaaauuucuagcaagccuuuga

SEQ ID NO: 504274 - RNA, 64 nt, Human
uauaaacucaaccacauuuuaauguugaaccaaaaaaagauaauaaaauaaaaaaguauauguu

SEQ ID NO: 504275 - RNA, 64 nt, Human
ugauucccuuuaaagugcaaaauggucaccuucuaaaagauauauucauaguuauuaaugaccc

SEQ ID NO: 504276 - RNA, 64 nt, Human
guaauugaaauucaugcaaggaaacaacucauagaaaagauaaauauggaugcccuucacaugu

SEQ ID NO: 504277 - RNA, 64 nt, Human
cauggguuauauucauuauuaggccaucagucauaaaagauaauuuuccaucuuuuuuuuuuuu

SEQ ID NO: 504278 - RNA, 64 nt, Human
cuacaaaauugcauguaacuuuauaaauauuuuuaaaagauauaguuuuguaaauauuuaauau

SEQ ID NO: 504279 - RNA, 64 nt, Human
aauuacucauccuuaaaguuuacuccacuuugacaaaagauacgcccuucucccugcacauaaa

SEQ ID NO: 504280 - RNA, 64 nt, Human
cucccaggacuuggggguggggugaaaagcguacaaaagauacuuaaaagggcuccugggguac

SEQ ID NO: 504281 - RNA, 64 nt, Human
ucaaaaacuuuugcaaucuuaagcagagauaaauaaaagauagcaauaugagacacagguggac

SEQ ID NO: 504282 - RNA, 64 nt, Human
gcacuucugccuugaguccccaggggaaaaaaaaaaaagauauuuaugaaauaaaugguaauuu

SEQ ID NO: 504283 - RNA, 64 nt, Human
uuuauugaaaaaaaaagaaaaagaaagcaagaaaaaaagauacuauggggucaaguguaacucc

SEQ ID NO: 504284 - RNA, 64 nt, Human
ugaugcuggguaaguagaguaaguuaaacuugguaaaagauaaucuaaaaauuccauaguucuc

SEQ ID NO: 504285 - RNA, 64 nt, Human
uaaaaaagacagcaaacuuuuuuuuuuauuuaaaaaaagauauauuaacaguuuuagaagucag

SEQ ID NO: 504286 - RNA, 64 nt, Human
uccuucaauuucuguauaaaagcagaucuuuuuaaaaagauacuucuguaacuuaagaaaccug

SEQ ID NO: 504287 - RNA, 64 nt, Human
gaauugcccacaguugggcagaaucaucuaacacaaacucuauuuuauaaucgaguguugaaua

SEQ ID NO: 504288 - RNA, 64 nt, Human
accugagaucagcagagccacccuagaucagcugaaacucuaagcacaaaaauaaaaacuuauc

SEQ ID NO: 504289 - RNA, 64 nt, Human
aggauuacaggcccgugcccagcccuaaaguuuuaaacucuaggggaauuaacaguauuucuuu

SEQ ID NO: 504290 - RNA, 64 nt, Human
uuguggcaccugaagacaucuucaaaauuggcagaaaagauaauaguuauaaaaauuuuaguuc

SEQ ID NO: 504291 - RNA, 64 nt, Human
ugauauuugugucuguuacuacuuuuuuaauacaaaaagauaaaaacgcccaggacuuugugga

SEQ ID NO: 504292 - RNA, 64 nt, Human
ccuggagaauggcaaaaugauuuaaagagaaaaaaaaagauauuuuaaauuugaugcucauuuu

SEQ ID NO: 504293 - RNA, 64 nt, Human
aaacaaggauuacagugaaugugaaaaaaaaaaaaaaagauaccugaauagacauuucuaugac

SEQ ID NO: 504294 - RNA, 64 nt, Human
ugaaugauuaguugggauuaccaaacauuuuuuaaaaagauauuaucaauaaauauuuuuuuaa

SEQ ID NO: 504295 - RNA, 64 nt, Human
aaaguccuugcacagacaccagugagugaguucuaaaagauacccuuggaauuaucagacucag

SEQ ID NO: 504296 - RNA, 64 nt, Human
cucuccauucuccagguccaaggcagagauccugaaaagauagggcuauuguccccugccuccu

SEQ ID NO: 504297 - RNA, 64 nt, Human
ugucagaacccugaaaguauuaguucuaaaaaaaaaaagauauauacuagaaguaauuguuuua

SEQ ID NO: 504298 - RNA, 64 nt, Human
uuuucaucuuaauauguaccaguggcacuuaaccaaaagauacagugauauagccauguacugu

SEQ ID NO: 504299 - RNA, 64 nt, Human
cuaaauaaaaaacuaauucauaacuaaugcauagaaaagauacauaaagcaaugugaaaguuuc

SEQ ID NO: 504300 - RNA, 64 nt, Human
agagugcugaguuaaacgcaaauuucagguaaacaaaagauaauuuucuagcauuaauaugccc

SEQ ID NO: 504301 - RNA, 64 nt, Human
uggggucugaggcacaugggagugggaccagcagaaaagauacucaggucaguuaacuaaugag

SEQ ID NO: 504302 - RNA, 64 nt, Human
gccgauggaaaggcaucugccauaaaagaaaagcaaaagauaaaaagcccaaccgaugugggga

SEQ ID NO: 504303 - RNA, 64 nt, Human
gaauauccuggagugguccccagaagcauccaagaaaagauauuuggggacguagccuaacauu

SEQ ID NO: 504304 - RNA, 64 nt, Human
gaagagagucugcagaaguugggggaaaacuuuuaaaagauacccucauugugucaaagagugu

SEQ ID NO: 504305 - RNA, 64 nt, Human
auuucuggaccuuguuguuguuaaauaucaguagaaacucuacauaauuuagaguguauguagg

SEQ ID NO: 504306 - RNA, 64 nt, Human
gagggagacugauccccugaccaauucaccugauaaacucuagggacacuggcagcuguggaaa

SEQ ID NO: 504307 - RNA, 64 nt, Human
ggguugagagcuuucugccuuagccuaccaugugaaacucuacccugaagaaagggauggauag

SEQ ID NO: 504308 - RNA, 64 nt, Human
guguuuauuaaaauucugaauuuuggggauuuucaaaagauaauauuuuacauacacuguaugu

SEQ ID NO: 504309 - RNA, 51 nt, Human
ccaauuguacucaugugugauaaaagauagaguauccuuaugguugaguuu

SEQ ID NO: 504310 - RNA, 64 nt, Human
uuaauauaaaugcaaauaacaaaugccaaauuaaaaaagauaaacacaagauugguguuuuuuu

SEQ ID NO: 504311 - RNA, 64 nt, Human
aggcacuguacuuaauacuaggauacagaaaugcaaaagauacggcccaugcaauuuuauuaaa

SEQ ID NO: 504312 - RNA, 64 nt, Human
aaaggagccacagcugacgccaaaaagaaaagaaaaaagauauauauauauauauauauauaua

SEQ ID NO: 504313 - RNA, 64 nt, Human
auggcgagucuccgugcugguguuuaagucauuaaaaagauacucaaagagaauggccugccug

SEQ ID NO: 504314 - RNA, 64 nt, Human
aacaagaguggcacuccaucucagaaaaaaaaaaaaaagauaauucauacugaaaagaaacucu

SEQ ID NO: 504315 - RNA, 64 nt, Human
auaugugaaagcaugugacuaauuguugcugcauaaaagauaugagauucuuuuuuauuaggca

SEQ ID NO: 504316 - RNA, 64 nt, Human
uuuuuauuaggcauuauuuaugaccuuuucuaugaaaagauaaggacauuaaaauguaagaugc

SEQ ID NO: 504317 - RNA, 64 nt, Human
ccuaauaguauuuuugugaggaugaaaugcuaauaaaagauaaaaccuuuaaaagaguauuugg

SEQ ID NO: 504318 - RNA, 64 nt, Human
cuugcugguuuauuauaaaagcaagguuuauuauaaaagauacuacaaaggauacagaugaaga

SEQ ID NO: 504319 - RNA, 64 nt, Human
aaugcacagaugccuauacauacauauacaaauaaaaagauacgauucgcaauggagaauuuca

SEQ ID NO: 504320 - RNA, 64 nt, Human
cauaaaguaauuacucaaaccauaauguaaaguaaaaagauaaccauacuauacauagaaagcc

SEQ ID NO: 504321 - RNA, 64 nt, Human
guaccacaguauuuauguguaugaauuaaggauuaaaagauaauguggauaaauaaacuauuga

SEQ ID NO: 504322 - RNA, 64 nt, Human
uggaggacagaagcgacuuuugugccgggacuuaaaaagauaaggaggccaggugugguggcuc

SEQ ID NO: 504323 - RNA, 64 nt, Human
agugagaagaugugauuuggaccauggcacuuaaaaacucuauaaccucaggcaagucuuuuaa

SEQ ID NO: 504324 - RNA, 64 nt, Human
gauguauuuauaauguuucuaauaugaaaucacuaaacucuaguacauuauagcaggugcuuug

SEQ ID NO: 504325 - RNA, 64 nt, Human
ucagaauucccagaguuuacucauucuuguuauuaaacucuagccaguugacaucuucgcaauu

SEQ ID NO: 504326 - RNA, 64 nt, Human
aaagccuuuaacuggcucuuaauccuuaugaaacaaaagauaauucauacuagagagaaacccu

SEQ ID NO: 504327 - RNA, 64 nt, Human
aguuuuguuuuguuuuuuucuggaaaaaaaagaaaaaagauacgacucucagaagccuguuuaa

SEQ ID NO: 504328 - RNA, 64 nt, Human
ugcauaaggaucaagacagacaaugucgagggacaaaagauagaagauggaggaggaaagacau

SEQ ID NO: 504329 - RNA, 64 nt, Human
guuuuauguaaguauugcuuauucaaguaguuuuaaaagauauguaauugguuguuguuucaug

SEQ ID NO: 504330 - RNA, 64 nt, Human
uacauaucuuuuuaaagaucgcuuuauaaaaacaaaaagauaacauuaacauuuauugaaacaa

SEQ ID NO: 504331 - RNA, 64 nt, Human
agcuuuauccaggucucagagcucaauacgcaucaaaagauacaucuuugaugaagucacacaa

SEQ ID NO: 504332 - RNA, 64 nt, Human
ugugaaguacuuuauucuuucauauuuuaaaaauaaaagauaauuauccaugagaaagcuacuc

SEQ ID NO: 504333 - RNA, 64 nt, Human
gauagauaacauggcuuuuacuccuuacuguuugaaaagauaaguacuuuagcuucuuucugca

SEQ ID NO: 504334 - RNA, 64 nt, Human
aggugguauuaaauauuaaguucuuauguaugucaaaagauaucauuuugaaauucauccaucu

SEQ ID NO: 504335 - RNA, 64 nt, Human
gaagguagauaacuuuuaggaccuugaugugaggaaaagauaaaauuuaaacaauaaauuugcc

SEQ ID NO: 504336 - RNA, 64 nt, Human
auuugccacuuagauuuucuagcagcaaaguccgaaaagauaguuauauacaaaauucuguuuu

SEQ ID NO: 504337 - RNA, 64 nt, Human
ccacagccaucugguuaugucuuauuuuuuuccuaaaagauaauguuuauuuuuaaaaaggaag

SEQ ID NO: 504338 - RNA, 64 nt, Human
uggacguugugacucuugccuuuuaagaagaaaaaaaagauaggacaaaguauuugaagcucuu

SEQ ID NO: 504339 - RNA, 64 nt, Human
gaaacuuucaaaauagugaaaugaauauuuaaauaaaagauauaaaugccaaagucuuuaccaa

SEQ ID NO: 504340 - RNA, 64 nt, Human
ccuccaaagacagacagaaucaccugaggcguucaaaagauauaaccaaauaaacaagucaucc

SEQ ID NO: 504341 - RNA, 64 nt, Human
cuaaaaaaaacacauuucaaauaggcuucccacuaaacucuauauuuuaguguaaaccaggaau

SEQ ID NO: 504342 - RNA, 64 nt, Human
aagaaacaguccaguacuugacccaugccccaacaaacucuacuauccaauauggggcagcuua

SEQ ID NO: 504343 - RNA, 64 nt, Human
uauaugccugggagcagauuugcuggaucauaugaaacucuauuuaacccuugagggacuccca

SEQ ID NO: 504344 - RNA, 64 nt, Human
aaaauauuuuuguccugaguagugucacugggccaaaagauagaucaggacgacagccuuuagu

SEQ ID NO: 504345 - RNA, 64 nt, Human
aggcagcaagucuuaacaaaccaacaucuuugcgaaaagauaaaccuggagauauuauaaggga

SEQ ID NO: 504346 - RNA, 64 nt, Human
gugugugucggggggacagagggaaccauuuaagaaaagauaccaaaguagaagucaaaagaaa

SEQ ID NO: 504347 - RNA, 64 nt, Human
guggggauuaucuuggggagaggcugaaaagcacaaaagauagucuucccuguacguauuggug

SEQ ID NO: 504348 - RNA, 64 nt, Human
gccacauaaccuugcggcaagucugauggaaagaaaaagauaaaccauccgugggguagaugca

SEQ ID NO: 504349 - RNA, 64 nt, Human
uuuaguaaaauuggagguagcaaacacuaaggugaaaagauaaugaucucauuguuuauuaacc

SEQ ID NO: 504350 - RNA, 64 nt, Human
acagcccacugggugccaagcucagagggggaaaaaaagauagccagagagagaccuggcccuc

SEQ ID NO: 504351 - RNA, 64 nt, Human
ucacacuguugucuguuacugauuuuuuuugauaaaaagauaauaaaaccugguacuuucuaaa

SEQ ID NO: 504352 - RNA, 64 nt, Human
aaaggccccauuugucaggggugagagaaaagucaaaagauaaauuggggccuuguaaaaggcc

SEQ ID NO: 504353 - RNA, 64 nt, Human
gaacacgcuuucuuuacaucacuaguguagacucaaaagauaugcaagugucaaauaugcaaaa

SEQ ID NO: 504354 - RNA, 64 nt, Human
auuuugggcagaaugcugacuaguagacuaacauaaaagauauaaaaggcaauaacuauuguuu

SEQ ID NO: 504355 - RNA, 64 nt, Human
aaauagucuugaagucaauuuaguuuauuuauuuaaaagauaaugcauccugaaagggaucauu

SEQ ID NO: 504356 - RNA, 64 nt, Human
uaauguuuagggucaguuuguaguauucuugagaaaaagauaaaggguuauaauuugaauguga

SEQ ID NO: 504357 - RNA, 64 nt, Human
aguauugauuuauaucuuagacuacuuuagcaauaaaagauaaaucucaacuuuaauaaguuau

SEQ ID NO: 504358 - RNA, 64 nt, Human
guuaugcaaagcaggugauuugucuuaaucagauaaaagauagaggcuaugggggccucaagau

SEQ ID NO: 504359 - RNA, 64 nt, Human
gggaaagaaauaccaacccugcaauaaguguacuaaacucuacgcucugguuaauguaauguac

SEQ ID NO: 504360 - RNA, 64 nt, Human
agaaaaugcccaccccuccuccuuuacccagcauaaacucuaugguuaauucuuaaaauaaugc

SEQ ID NO: 504361 - RNA, 64 nt, Human
gagauuugcucaaaugaucaauaagcuuuaaauuaaacucuacuucaagaaaacucuguggucc

SEQ ID NO: 504362 - RNA, 64 nt, Human
uaaacagagaaaaaggaaaguaaaaauauggcauaaaagauaagaauuggcucuccuguacagg

SEQ ID NO: 504363 - RNA, 64 nt, Human
gccuggccaacauggugaaaccccgucuccacgaaaaagauaaaaauaagcugggcgugguggc

SEQ ID NO: 504364 - RNA, 64 nt, Human
uuucaaaaaaauaaaaauuggaagaagagcuuaaaaaagauaagauuuuaaagagucccaaguu

SEQ ID NO: 504365 - RNA, 64 nt, Human
uuugacuuacacgggacauuuguguuuuuggaggaaaagauacccugauucuuugaaucuuccu

SEQ ID NO: 504366 - RNA, 64 nt, Human
uuaucgugguuguuaauuugaaguaauaaaguagaaaagauaaagugaugcaggcagcccuuug

SEQ ID NO: 504367 - RNA, 64 nt, Human
guaaaauuucugaauacuaaucuuagaaauguguaaaagauauuauuuugauuguuaaacaaau

SEQ ID NO: 504368 - RNA, 64 nt, Human
uggucagucaagucccaauaaauggucagcacaaaaaagauauucuugaaaauugcucuuuauu

SEQ ID NO: 504369 - RNA, 64 nt, Human
aaaaaaaaaaaaaaaaaaaaaaaaaaaaaaaaaaaaaagauacauuggucuuuaaacccaaacc

SEQ ID NO: 504370 - RNA, 64 nt, Human
augguaguacccacccgguauuccuaaaauccuaaaaagauacaccuugcaguagcagaggcaa

SEQ ID NO: 504371 - RNA, 64 nt, Human
ugccagguauuuucuaaaauuccaccugaaagccaaaagauaaaauaaauaaguugauuuuaau

SEQ ID NO: 504372 - RNA, 64 nt, Human
uaauuauaaugacuuucugucuggaucuuauaggaaaagauacuuucuuuuuucuuccaucuuu

SEQ ID NO: 504373 - RNA, 64 nt, Human
guauucauuuaugccuaaaucucuauaacagaugaaaagauaauuaauaaaauccuaauuaaaa

SEQ ID NO: 504374 - RNA, 64 nt, Human
ggagcugcaaggaaauacaaaaauuuuuaaaaagaaaagauauuggaugcuccuuguauucugu

SEQ ID NO: 504375 - RNA, 64 nt, Human
uaaucuaguuggagagauaagaaacguacaaaccaaaagauaacagaauaucugaagcauguac

SEQ ID NO: 504376 - RNA, 64 nt, Human
uguauaauuaugaacaugcacaaguuucugcaugaaaagauauuaauauauuaaucacauguau

SEQ ID NO: 504377 - RNA, 64 nt, Human; identical to SEQ ID NO: 503119

SEQ ID NO: 504378 - RNA, 64 nt, Human
uaaugggagacuugagugauaauaggggauuuuaaaacucuacagauggcauaccugugccugc

SEQ ID NO: 504379 - RNA, 64 nt, Human
aucuugucacuguguaccauucaaaguguuuauaaaacucuagauucaucaaaugagauuugcu

SEQ ID NO: 504380 - RNA, 64 nt, Human
ucuggauaggaacuacuugaaauaguaauuuguuaaaagauaugacaaaaugaaaaugcuuaaa

SEQ ID NO: 504381 - RNA, 64 nt, Human
agaaauaaugccgcauuuuucccccauuguaccaaaaagauaaaaaaaugguaaacacugauca

SEQ ID NO: 504382 - RNA, 64 nt, Human
uaucaaucuaucuaguagcuaucuauauauuuucaaaagauagcuuaugucuaaaacaguggug

SEQ ID NO: 504383 - RNA, 64 nt, Human
auuggccauaagcaacaauuuucagauuugcacaaaaagauaccuuaaaauuugaaacauugcu

SEQ ID NO: 504384 - RNA, 64 nt, Human
gugugaauucaccgugaaauaggugagauaaauuaaaagauacuuaauucccgccuuaugccuc

SEQ ID NO: 504385 - RNA, 64 nt, Human
uagcaauaacauacaugagauaacucaagaaaucaaaagauaguugauucuugccuuguaccuc

SEQ ID NO: 504386 - RNA, 64 nt, Human
uucaaaauuuaaaaacuugugauuuaagaagaggaaaagauaagcuacagauugagaugaauuu

SEQ ID NO: 504387 - RNA, 64 nt, Human
uaacuuugaauguuuuaacagcaagaauuuuaagaaaagauaaacaccauuuuauuuauuuaua

SEQ ID NO: 504388 - RNA, 64 nt, Human
aacuuaugaaguaaaguuucugauaguagucuuuaaaagauauaagacuuaauauguuuuauuc

SEQ ID NO: 504389 - RNA, 64 nt, Human
aucauucauugaaagugaucacuuuaccauuuugaaaagauauuucguguucuuucacugcaaa

SEQ ID NO: 504390 - RNA, 64 nt, Human
auaauuuuaaggaaaucuuacaaguauuacauuaaaaagauacuaugacugccaccugccauuu

SEQ ID NO: 504391 - RNA, 64 nt, Human
ucuguauuugcuuuucacaguaggccugaugacuaaaagauaugcuuuauuacacgcuauuuuc

SEQ ID NO: 504392 - RNA, 64 nt, Human
uugaauacauuuguauuuauguggcuguaaugacaaaagauacaaaagcuuuuuaaaauuuaga

SEQ ID NO: 504393 - RNA, 64 nt, Human
augagaugccaguaguguucaaaguuguauuuuuaaaagauaaauauuccuuuuuauaccucag

SEQ ID NO: 504394 - RNA, 64 nt, Human
cuagauccuugagagggaccuggcuuuccuuuuuaaaagauauuuuacugaagagcuaaaaacu

SEQ ID NO: 504395 - RNA, 64 nt, Human
acagagauguuuauggugagguuuaaaggauaugaaacucuacauuuaaacaaguauuuuauau

SEQ ID NO: 504396 - RNA, 64 nt, Human
gagaggguucuaauugguucugcaauuugcucuuaaacucuagcagggaacucuccucuuacca

SEQ ID NO: 504397 - RNA, 64 nt, Human
aauauuuguuuuuuagcaauugucauaguaaauaaaacucuaagcaaguguaucuacaguuuuu

SEQ ID NO: 504398 - RNA, 64 nt, Human
gaaugagcaguaaaacugaugacauaaagaaauuaaaagauauuuaauucuugccuuauacuca

SEQ ID NO: 504399 - RNA, 64 nt, Human
aguaaaauacaugagauaaagaccucaagaaguuaaaagauacuuaauucuugccuuauaccuc

SEQ ID NO: 504400 - RNA, 64 nt, Human
gaauuagcaguaaaauacaugauacaaggaacucaaaagauaguuaauucuugccuuauaccuc

SEQ ID NO: 504401 - RNA, 64 nt, Human; identical to SEQ ID NO: 504385

SEQ ID NO: 504402 - RNA, 64 nt, Human
ucuguuguagaaaaacuaugugaugaaacuuugaaaaagauauuuaugauguuaacauuucagg

SEQ ID NO: 504403 - RNA, 64 nt, Human
aagcuuuagaagcuauuuuacuacauagguaaagaaaagauaaacuaacuuguaacaaagacca

SEQ ID NO: 504404 - RNA, 64 nt, Human
ugacucagucuguucacugguugagcuuugagugaaaagauaacacaggucuauugacucacac

SEQ ID NO: 504405 - RNA, 64 nt, Human
ucuuggcgagacacagcuugagaacagaagggcgucgggggaaccugccgcaaggagcagagac

SEQ ID NO: 504406 - RNA, 64 nt, Human
ugcccugagcgagggcugcccuggaggcuccggcucgggggaucugccccuaccccucauggaa

SEQ ID NO: 504407 - RNA, 64 nt, Human
ggaugaaucccuagaaguggaauugcuggguaucucgggggagcuuugugccuugauggaucaa

SEQ ID NO: 504408 - RNA, 64 nt, Human
ucacuggccuggcggagaugcuucuaaggcauggucgggggagagggccaacaacugucccucc

SEQ ID NO: 504409 - RNA, 64 nt, Human
cugaacgaagacuuccgccgcgaagcccgauagaucgggggaaaauggggccuucgaccccagc

SEQ ID NO: 504410 - RNA, 64 nt, Human
ugagaagaauccuuuccucuucuuugauagugggucgggggauucuucaggaaugguuuggagc

SEQ ID NO: 504411 - RNA, 64 nt, Human
aguaacuuaaccagcacauuucuccuguuuacacucgggggauuuuuuuguuuucugaugacau

SEQ ID NO: 504412 - RNA, 64 nt, Human
gugaaguguugggggauggagggcgggugagcagucgggggacaaaaagucuauuuuuccuuca

SEQ ID NO: 504413 - RNA, 64 nt, Human; identical to SEQ ID NO: 503120

SEQ ID NO: 504414 - RNA, 64 nt, Human
cauguguuacaauucaguuauuucuguaguuuguaaacucuaaagugacauuacuauuauuuua

SEQ ID NO: 504415 - RNA, 64 nt, Human
acgagguuccuagagcucugcugacccuuggccgaaacucuaaaauguaccuauuaaagauaaa

SEQ ID NO: 504416 - RNA, 64 nt, Human
agaggaggccgccagcccggaggcugcagcccagaaacucuaccucauccacacuggugcaggg

SEQ ID NO: 504417 - RNA, 64 nt, Human
aucuaauuuauuuauuuauugccuggccggugacucgggggaggaggcgacccugucaucuguc

SEQ ID NO: 504418 - RNA, 64 nt, Human
uccaaagcaguuaacccaacuccuaacaacauuuucgggggaucugaccuuuuuuuuccaguug

SEQ ID NO: 504419 - RNA, 64 nt, Human
acugaggggagccuucguggcccucaggaugccuucgggggacagauucugcccagucucuggg

SEQ ID NO: 504420 - RNA, 64 nt, Human
cggguugggggugggugagggaauggggugggagucgggggaagugcaguccuuggagauguac

SEQ ID NO: 504421 - RNA, 64 nt, Human
gggacccaggcuacgagcgggagggaggcgggagucgggggaagacgcggcaggccggccgagg

SEQ ID NO: 504422 - RNA, 64 nt, Human
caucccuuacucaguugccgggacauccccagucucgggggaagaagaugccaugggcuuauac

SEQ ID NO: 504423 - RNA, 64 nt, Human
aaaugggaccuaagguguugguauuuuccaggugucgggggaaaugaacuggugaagggguuuu

SEQ ID NO: 504424 - RNA, 64 nt, Human
uaaaccguucccaccgucagggagaccuacaguuucgggggaccacccuggucuggccuuguau

SEQ ID NO: 504425 - RNA, 64 nt, Human
cauugggccaguaggcaucuuagcuuggcaggugucgggggaaugggccagauggaccugcuag

SEQ ID NO: 504426 - RNA, 64 nt, Human
gcucacucccggggccaccaaacgggccccucucucgggggaaccggacagcagcuuggcaaag

SEQ ID NO: 504427 - RNA, 64 nt, Human
aacuugaaguucaucuauuugauauaagacaccuucgggggaaauaauuccugugaauauucuu

SEQ ID NO: 504428 - RNA, 64 nt, Human
gccgcacucuccuggacgccauauagcuuuaagaucgggggaggguaaauaaugcaaaaauugc

SEQ ID NO: 504429 - RNA, 64 nt, Human
acugccgguaaaggagccugcauguucaggccccucgggggauuggggggacuggggaggcgca

SEQ ID NO: 504430 - RNA, 64 nt, Human
gacucuucagccccugcucccauccaguggccagucgggggaggagaaagacgcgauuaacacu

SEQ ID NO: 504431 - RNA, 64 nt, Human
guugcucuguguuggugaaauugcuguggggguaucgggggauauggccaguaaaguauugaga

SEQ ID NO: 504432 - RNA, 64 nt, Human
caagcuaguuuugagaaaggaaggccaaauugggucgggggagggugggagugaggaaguuaaa

SEQ ID NO: 504433 - RNA, 64 nt, Human
uuuauggauacauuggagcuuuugaaagaauuguaaacucuaggaaggggaaauaucugugucu

SEQ ID NO: 504434 - RNA, 64 nt, Human
gcuucuuuuuauuugccuccuagucauaauaguaaaacucuacuccucuacuccgaggaguccc

SEQ ID NO: 504435 - RNA, 64 nt, Human
uuggaugcagauuuuuaaaaaaccucuuguuuuaaaacucuauaaacuugucauugguaaauag

SEQ ID NO: 504436 - RNA, 64 nt, Human
gaaaguuggacauguguguggcucaacaguuuucucgggggaguucagugaccuuuugguggcc

SEQ ID NO: 504437 - RNA, 64 nt, Human
ccgauucauuccacgcagcaguauugggggugguucgggggagggguguuucggauuuucuuuu

SEQ ID NO: 504438 - RNA, 64 nt, Human
cccaagucugguagagcagucgggcagcuaguuuucgggggaggaugauguggugggacagagg

SEQ ID NO: 504439 - RNA, 64 nt, Human
cugggccuuauuaaagagcaacuucuauuuccagucgggggaguaacacuaaagcuacaagaaa

SEQ ID NO: 504440 - RNA, 64 nt, Human
agccccuucaauuauuucccaucuccacaaauagucgggggaaaaaauuaaaauuuuccuuuau

SEQ ID NO: 504441 - RNA, 64 nt, Human
uuguagccaggaaauaagaagagcuuacacagagucgggggaucuuaauuagacaugcuguaac

SEQ ID NO: 504442 - RNA, 64 nt, Human
gguacgauuucacguuaucagugcaguuccguucucgggggaaagguaagcacauagcuaacuc

SEQ ID NO: 504443 - RNA, 64 nt, Human
gaugaggaagaacaagggauaguucuguaaguguucgggggacaucagcaugugugguucuuuc

SEQ ID NO: 504444 - RNA, 64 nt, Human
ucccaauuauauguucauuuuguauauuuuuuggucgggggaaaaauugaccugcaguaaaaaa

SEQ ID NO: 504445 - RNA, 64 nt, Human
uugaauguguaagcauuguauacauugaucaaguucgggggaauaaagacagaccacaccuaaa

SEQ ID NO: 504446 - RNA, 64 nt, Human
cacuuccugcacgcgccacuccgccuaggggcccucgggggagaccgcaggcuccucuggccgc

SEQ ID NO: 504447 - RNA, 64 nt, Human
cuuugugcauugcugcuaugaacuuugaccugagucgggggagaggauggcagagacuuuauua

SEQ ID NO: 504448 - RNA, 64 nt, Human
cgcggccucccaggcagugcucaugcgcuggccgucgggggaggcaggggcacagccuccaugu

SEQ ID NO: 504449 - RNA, 64 nt, Human
gcaguggugugagucguuucacggcugaugucccucgggggauuaaaggaucuaaagagaaaau

SEQ ID NO: 504450 - RNA, 64 nt, Human
ccguugaaguuccagggagcuugcccgggucuccucgggggagcagaugagggcccugcccccg

SEQ ID NO: 504451 - RNA, 64 nt, Human
aguaaaucccacgacauaagcugguaucagugguucgggggaaauaguuccauucuaugacucu

SEQ ID NO: 504452 - RNA, 64 nt, Human
aauuuugauuccauuaauagguagucuaugcaacaaacucuacucaauuaaaguaaaacuaagu

SEQ ID NO: 504453 - RNA, 64 nt, Human
cauauaauaggggguguaugugugaauuuuguuuaaacucuacuguauauugaaaugaaauuca

SEQ ID NO: 504454 - RNA, 64 nt, Human
caaucccauuaaaaaaaggcucuuuccuuuagagaaacucuauuuugaugucaauauagauuac

SEQ ID NO: 504455 - RNA, 64 nt, Human
caaaaccuugacugccuauggaggaagacuguguucgggggagcuggcauagcuagugcagagu

SEQ ID NO: 504456 - RNA, 64 nt, Human
cccggcccacgcagagccccggagcaccacggggucgggggaggagcacccccagccuccccca

SEQ ID NO: 504457 - RNA, 64 nt, Human
augaguuuuaucauccacacggggcagccggcccucgggggaggccuugcccaccuuggugagg

SEQ ID NO: 504458 - RNA, 64 nt, Human
gcucuucggcaccgccuugggcucccgcggccacucgggggagacgguaguacacgggccuggu

SEQ ID NO: 504459 - RNA, 64 nt, Human
gcaagcagcugggugggcagaaugcagaguagacucgggggaggauccuuucacuuuccgcuuc

SEQ ID NO: 504460 - RNA, 64 nt, Human
ugagguguggcauaugggcaccuggcacugggagucgggggagcacguccaggcguggugcauc

SEQ ID NO: 504461 - RNA, 64 nt, Human
cgcagcagauaccucgguccagaucuccggauugucgggggacgcaggacucuucgaggaaaac

SEQ ID NO: 504462 - RNA, 64 nt, Human
cauuugacacaaagcuucuaaagcagguaaauugucgggggagagaguuagcauguaugaaugu

SEQ ID NO: 504463 - RNA, 64 nt, Human
ggcuaggagggaggggugacagccaaaaagggcuucgggggagugguuacccugcucccugccc

SEQ ID NO: 504464 - RNA, 64 nt, Human
acaggaacaaacgaggucccuguuaggguucuacucgggggagggagggggcuccaugaaaggu

SEQ ID NO: 504465 - RNA, 64 nt, Human
gggaggggcuccagcaggaggccgugggugccauucgggggaaagugggggaacgacacacacu

SEQ ID NO: 504466 - RNA, 64 nt, Human
cagcuccgcacggcccgugggaggaaggccaggcucgggggagccuccuccagcccggccgacc

SEQ ID NO: 504467 - RNA, 64 nt, Human
ccuggaaggggcaggaccuccggccuuguccauuucgggggaaacuugggcccugccaaggggc

SEQ ID NO: 504468 - RNA, 64 nt, Human
uguguugccugcugagcugugcccuauuguguggucgggggaugaggauauggcagggaagcuu

SEQ ID NO: 504469 - RNA, 64 nt, Human
acuuuaaucuuaugcuuaaaaugccagauguuguucgggggacaacuuguaucuuucuagcagc

SEQ ID NO: 504470 - RNA, 64 nt, Human
cauuuaguaaaaauucagugguuccccgcuauccucgggggauguguuuuuuuguuuuguuuug

SEQ ID NO: 504471 - RNA, 64 nt, Human
gggguguuuguucccauuggaugcauuucuaucaaaacucuaucaaaugugauggcuagauucu

SEQ ID NO: 504472 - RNA, 64 nt, Human
agauacuggcacugauuguaauuaaaaugagagaaaacucuagcgcaucuucuggcacgguuuu

SEQ ID NO: 504473 - RNA, 64 nt, Human; identical to SEQ ID NO: 503123

SEQ ID NO: 504474 - RNA, 64 nt, Human
gggucaacucugcuuuucccgcaaccugggguugucgggggagcgcuggcccgacgcaguggca

SEQ ID NO: 504475 - RNA, 64 nt, Human
ccaacucagugcacucaagacgcaucuccaguuuucgggggaagcugguauuugacauagugug

SEQ ID NO: 504476 - RNA, 64 nt, Human
uccauuuugccuguguggggcugacaaccaagccucgggggaaaugguaaguggcaggaguugg

SEQ ID NO: 504477 - RNA, 64 nt, Human
ucuuccccuccuccaguucuuuggaaauuugugaucgggggaucuuaguugcuuauuuguuuug

SEQ ID NO: 504478 - RNA, 64 nt, Human
gucccucccccagcccgaggcccacggagguuccucgggggacagucucaguuucgugccguua

SEQ ID NO: 504479 - RNA, 64 nt, Human
uggaguauaggguaggggagaagggggggagcauucgggggaguggggaguggggggaaggaaa

SEQ ID NO: 504480 - RNA, 64 nt, Human
uucuggcauguuuggaaaucaaaaugucacauucucgggggaggaagcccagaaaauuggguau

SEQ ID NO: 504481 - RNA, 64 nt, Human
auccagugauuucuacccuguggaggcugaggggucgggggaagaaaacagaugaccucagccu

SEQ ID NO: 504482 - RNA, 64 nt, Human
cuguguggucaugucccacagcaagcuuuugggaucgggggaauaagaggguaugggggaaagg

SEQ ID NO: 504483 - RNA, 64 nt, Human
ugugaugggcacaggcugcugcccuucugucuggucgggggauuccucuucuucaagcugcuca

SEQ ID NO: 504484 - RNA, 64 nt, Human
gccaccucauaggacucaguucccuucugaacacucgggggacaugggccucuaacugcccacu

SEQ ID NO: 504485 - RNA, 64 nt, Human
guggaugugcagugauaagcgggcauugcgugccucgggggaugccuaguucguggcuuccugg

SEQ ID NO: 504486 - RNA, 64 nt, Human
gggcgccgccgagcccccucuucccgccuugcgcucgggggagcccccgcgcccccggcccagc

SEQ ID NO: 504487 - RNA, 64 nt, Human
guugaggaagaacaggggauaguucuguaaguguucgggggacgucaacaugugugguuguuuc

SEQ ID NO: 504488 - RNA, 64 nt, Human
agggcucagcugaaggaccccgucugcaggagagucgggggaccagguuugggaauacacuugc

SEQ ID NO: 504489 - RNA, 64 nt, Human
ccuggccucacugcuucgugccuuagcucgggggucgggggagaaccccgggacggggguggga

SEQ ID NO: 504490 - RNA, 64 nt, Human
cagacugagugacaguacucaguauaucugagauaaacucuauaauguuuuggauaaaaauaac

SEQ ID NO: 504491 - RNA, 64 nt, Human
gucuuauuaaccaugucuguuggucaaaaucugcaaacucuaaaagaagaaaagaagaaaaaac

SEQ ID NO: 504492 - RNA, 64 nt, Human; identical to SEQ ID NO: 503121

SEQ ID NO: 504493 - RNA, 64 nt, Human
gagaugucagguggggaugaagaagaggggcaggucgggggagggugaugccagggauuccaag

SEQ ID NO: 504494 - RNA, 64 nt, Human
ucccaucuucacucuucacuugaguuggcuguguucgggggagcagagagagccagacagcccc

SEQ ID NO: 504495 - RNA, 64 nt, Human
ugacucccagcccaagcccccucaagagucugggucgggggaggaggaguggguggccuccuug

SEQ ID NO: 504496 - RNA, 64 nt, Human
cccucguguguccacaccgcagugccucugccccucgggggacuggacacacauccugccagag

SEQ ID NO: 504497 - RNA, 64 nt, Human
ucucuauuucaaguacacuuauccuuugguauacucgggggauugguuccaggaccacccaugu

SEQ ID NO: 504498 - RNA, 64 nt, Human
uuuggguuugucaggauggaauccuacagccuccucgggggaaagcacaccucaugcugagcgc

SEQ ID NO: 504499 - RNA, 64 nt, Human
gggcauucgccacgcaugugaccugggauagcuuucgggggaggagagaccuuccucuccugcg

SEQ ID NO: 504500 - RNA, 64 nt, Human
cuaucucuccagccucggcccacacgcaagggagucgggggacggacggcccgcugcuggccgc

SEQ ID NO: 504501 - RNA, 64 nt, Human
uggcuccuggcaccuguaccucuggacucuccuaucgggggauuaaaaaaaaaaguaaaaugac

SEQ ID NO: 504502 - RNA, 64 nt, Human
gcuucccagcucuucggguacaacccugagcaggucgggggacacagggccgaggcaggccuuc

SEQ ID NO: 504503 - RNA, 64 nt, Human
agucgcacccaagcugcguggagacccaggagccucgggggaucuggaaacaguuuaggccaau

SEQ ID NO: 504504 - RNA, 64 nt, Human
gagaaguguuuucuggcaggcccuagguaaagggucgggggaggggggagccuuguagggaggc

SEQ ID NO: 504505 - RNA, 64 nt, Human
agaaauugauuucuauuuuuaauuucaguuaguaucgggggaaaaaaauccagacugaacaguu

SEQ ID NO: 504506 - RNA, 64 nt, Human
ugcaugcuucuggcuggagcaccucccuggggagucgggggauuggguugugggcaguccccau

SEQ ID NO: 504507 - RNA, 64 nt, Human
acccaguuuuggcugcugguucccagcaggggacucgggggauauacaguggcugcaccaaauu

SEQ ID NO: 504508 - RNA, 64 nt, Human
caaggcuagagggcuccgggugugugugcaggugucgggggagugaccuccacuccucaaccuc

SEQ ID NO: 504509 - RNA, 64 nt, Human
uuuucacucucugcacugacuuuuuaauuauuuaaaacucuagaaagaugaacaaagguuaauu

SEQ ID NO: 504510 - RNA, 64 nt, Human
augugaaaauuuaauaaaagauacccugucuuguaaacucuauuuugaaauaaacuauucuuga

SEQ ID NO: 504511 - RNA, 64 nt, Human
uugugaaauuauaauaaguuuguaguuacaugugaaacucuaaaugcauggcaacuguuaaugu

SEQ ID NO: 504512 - RNA, 64 nt, Human
uucccagggccucaccuaccuagggucucacuagucgggggauuuaccuaccuggggccucggc

SEQ ID NO: 504513 - RNA, 64 nt, Human
aggcacccuugggcgcacccacuggggccaggggucgggggaguguugggagccuccuccccac

SEQ ID NO: 504514 - RNA, 64 nt, Human
agccgcccuccccgauggcggggaucugggagggucgggggagcaaaaggcggugagagaggau

SEQ ID NO: 504515 - RNA, 64 nt, Human
uuuuuuuuccaacaaguggauaaaagucugugacucgggggaaaguggaaggagaaaugcagcc

SEQ ID NO: 504516 - RNA, 64 nt, Human
uguuucaggugugauccccugggcccguuuguugucgggggagaagacuuagacccuuuugggu

SEQ ID NO: 504517 - RNA, 64 nt, Human
aguuguuuggacuucuuccugugccagguccaagucgggggaccugaagaaucaaucuguguga

SEQ ID NO: 504518 - RNA, 64 nt, Human
gagcaaguggccgacuggggugcgggugcacaggucgggggagcacaggccacagagcgcagcc

SEQ ID NO: 504519 - RNA, 64 nt, Human
ggugccagcaagggggcggccggcuggugggugcucgggggacggccguguugguuccauguaa

SEQ ID NO: 504520 - RNA, 64 nt, Human
cagagaacagugcaacaaaugccagcauugccauucgggggaaaaaaaaaaaaaaaaaaaaaag

SEQ ID NO: 504521 - RNA, 64 nt, Human
aaaucauuuagucuaacaacugcccaguuuccagucgggggaacugaggcagagcaagguagug

SEQ ID NO: 504522 - RNA, 64 nt, Human
aauagcuugagaaacccaaaguacuaugcugcagucgggggagagguggauugcagcaguaucc

SEQ ID NO: 504523 - RNA, 64 nt, Human
acgaggucaggagauagagaccauccuggccaacacggugaaacccugucucuacuaaaaauac

SEQ ID NO: 504524 - RNA, 64 nt, Human
auaaggucgggagauuaagaccauccuggcuaacacggugaaaccccgucucuacuaaaaauag

SEQ ID NO: 504525 - RNA, 64 nt, Human
aucacgaggucagaucaagaacauccuggcuaacacggugaaacuccaucucuacuaaaaauac

SEQ ID NO: 504526 - RNA, 64 nt, Human
acgaggucaggaguucgagaccauccuggcuaacacggugaaacccaaucucuacuaaaaauac

SEQ ID NO: 504527 - RNA, 64 nt, Human
ggggaaaauacaaguuauauccugaaagccuuuaaaacucuaugguaggaucaaagauucaaau

SEQ ID NO: 504528 - RNA, 64 nt, Human
uaaaacccuucaucaugauauccuguggauuuaaaaacucuaauuccauguuuucuucccaucu

SEQ ID NO: 504529 - RNA, 64 nt, Human; identical to SEQ ID NO: 503124

SEQ ID NO: 504530 - RNA, 64 nt, Human
cugaggucaggaguucgagaccagccuggccaacacggugaaaccccaucucuacuaaaaaugc

SEQ ID NO: 504531 - RNA, 64 nt, Human
acaaggucaggagaucgagaccauccuggcgaacacggugaaaccccgucucuacuaaaaaaaa

SEQ ID NO: 504532 - RNA, 64 nt, Human
aagaugguuucuuaccuuugagcacaaaauuuccacggugaaauaaagucaacauuauaagcuu

SEQ ID NO: 504533 - RNA, 64 nt, Human
acgaggucaggaguucgagaccagccugaccaacacggugaaaccccgucucuacuaaaaauac

SEQ ID NO: 504534 - RNA, 64 nt, Human
acgaggucaggagaucgagaccauccuggcuaacacggugaaaccccgucucuacuaaaaauac

SEQ ID NO: 504535 - RNA, 64 nt, Human
acuuugucuugccuguaugcagcccucguguaauacggugaauuagagugguauuucacuuugu

SEQ ID NO: 504536 - RNA, 64 nt, Human
augcacgaagucacaaugcaccauccaugagaagacggugaaaugauguaaugacagagaaggc

SEQ ID NO: 504537 - RNA, 64 nt, Human
acgaggucaggagaucgagaccauccuggcuaacacggugaaaccccgucucuacauaaaaaau

SEQ ID NO: 504538 - RNA, 64 nt, Human
augaggucagaagaucaagaccauacuggcuaacacggugaaaccccgucucuacuaaaaauac

SEQ ID NO: 504539 - RNA, 64 nt, Human
acgaggucaggagaucgagaccauccuggcuaacacggugaaaccccaucucuacuaaaaauac

SEQ ID NO: 504540 - RNA, 64 nt, Human
gcgacaacagugcggacaccccggcugcuagcccacggugaagcccggcgggguugcccaccag

SEQ ID NO: 504541 - RNA, 64 nt, Human
acgaggucaggagauggagaccauccuggcuaacacggugaaaccccuuaucuaugcgccugua

SEQ ID NO: 504542 - RNA, 64 nt, Human
augagaucaggagaucgagaccauccuggcuaacacggugaaaccccgucucuacuaaaagugc

SEQ ID NO: 504543 - RNA, 64 nt, Human
augaggucagaagaucgagaccauccuggcuaacacggugaaacccagccucuacuaaaaauac

SEQ ID NO: 504544 - RNA, 64 nt, Human
agucuugauagcaagcguuauuuuggugguagaaacggugaaaucucuagccucuuuguguuuu

SEQ ID NO: 504545 - RNA, 64 nt, Human
aaggauuuuuuugcauuucuuuacacugaguguaaaacucuacaaagaguuauaguauuuacua

SEQ ID NO: 504546 - RNA, 64 nt, Human
uuauacaaaaaaugaaauucuuccaacagcagagaaacucuaaaaaguuugauaguaccuauca

SEQ ID NO: 504547 - RNA, 64 nt, Human
uacgucuuaggugaaaguuaugaccaaccagauuaaacucuacccacauccugcauuuuaaggu

SEQ ID NO: 504548 - RNA, 64 nt, Human
aucagaccugaaaaaacaacacugggggagggggacggugaaggccaaguucccaaugagggug

SEQ ID NO: 504549 - RNA, 64 nt, Human
uugaggccuggaguucaagaccaccuuggcgaacacggugaaaccccgucucuacaaaaaauac

SEQ ID NO: 504550 - RNA, 64 nt, Human
gggugccuguccucuccugccuccugggauucagacggugaagacugacuucugggacgaggau

SEQ ID NO: 504551 - RNA, 64 nt, Human
acaaggucaggagaucgagaccauccuggcuaacacggugaaaccccaucucuacuaaaaauac

SEQ ID NO: 504552 - RNA, 64 nt, Human
ucaauuaccacaccaucucccaugaagaaagggaacggugaaguacuaagcgcuagaggaagca

SEQ ID NO: 504553 - RNA, 64 nt, Human
acgaggucaggagaucgagaccaucccggcuaaaacggugaaaccccgucucuacuaaaaauac

SEQ ID NO: 504554 - RNA, 64 nt, Human
acgaggucaggagaucgagaccauccuggcuaacacggugaaacccgucucuacuaaaaaugca

SEQ ID NO: 504555 - RNA, 64 nt, Human
uaaacugugagacucacagaggggaaagauacugacggugaaaccagcauggaaaacgucuuua

SEQ ID NO: 504556 - RNA, 64 nt, Human
acgaggucaggagauugagaccauccuggcuacgacggugaaaccccgucucuacuaaaaauac

SEQ ID NO: 504557 - RNA, 64 nt, Human
auuaggucaggagaucgagaccauccuuacuaagacggugaacccccaucucuauuaaaaauac

SEQ ID NO: 504558 - RNA, 64 nt, Human
acaaggucaggagaucgagaccauccuggcuaacacggugaaaccccgucucuacuaaaaauau

SEQ ID NO: 504559 - RNA, 64 nt, Human
gccucgagguggaagcuguauagagcccggguccacggugaacagucaguggcagggaguuugc

SEQ ID NO: 504560 - RNA, 64 nt, Human
acgacaucaggagaucgagaccauccuggcuaacacggugaaaccccgucucuacuaaaaauac

SEQ ID NO: 504561 - RNA, 64 nt, Human
acaaggucaggagaucaagaccauccuggcuaacacggugaaaccccgucucuacuaaaaauac

SEQ ID NO: 504562 - RNA, 64 nt, Human
augaauucaagagagauguccacggacgaaacauacggugaauaauucacgcucacgucguucu

SEQ ID NO: 504563 - RNA, 64 nt, Human
ccccguagcagcuauucacucuaccaguguaaacaaacucuaagcuagggcaagacagcacaga

SEQ ID NO: 504564 - RNA, 64 nt, Human
uucaguuaauucuuagauacacuaaaaaucugagaaacucuacauguaacuauuucuucagagu

SEQ ID NO: 504565 - RNA, 64 nt, Human; identical to SEQ ID NO: 503125

SEQ ID NO: 504566 - RNA, 64 nt, Human
acauagucuggcuguacccaggaauggagccugcacggugaauggcuuuguauagaaccucuuu

SEQ ID NO: 504567 - RNA, 64 nt, Human
acgaggucaagagauccagaccauccuggcuaacacggugaaaccccgucucuaauaaaaauac

SEQ ID NO: 504568 - RNA, 64 nt, Human
gagcucuugcuaucucucaagagugcugagaaccacggugaaagugcugcucuaggcccacaag

SEQ ID NO: 504569 - RNA, 64 nt, Human
cuguggagaugaugcaguuggcccaaccucacugacggugaaaaaauguuugccaggguccaga

SEQ ID NO: 504570 - RNA, 64 nt, Human
aaaauggagagcguauucugauagaaggacgucgacggugaauguucuggugguuguugccugu

SEQ ID NO: 504571 - RNA, 64 nt, Human
uuuuuuuggcuugacucaggauuuaaaaacuggaacggugaaggugacagcagucgguuggagc

SEQ ID NO: 504572 - RNA, 64 nt, Human
uuuucggcaucgggccaucucagauacuuggcugacggugaaccgcauggaacagugcaggacg

SEQ ID NO: 504573 - RNA, 64 nt, Human
ccgcgcucaggaggucaagaccagccugggcaacacggugaaaccccaucucuauuaaaauaca

SEQ ID NO: 504574 - RNA, 64 nt, Human
gcaugaggccugcagguggccuauuuugacucagacggugaaaaaagcaaauuaacucauuugg

SEQ ID NO: 504575 - RNA, 64 nt, Human
acgaggucaggagaucgagaccauccuggcuaacacggugaaacccugucucuacuaaaaauac

SEQ ID NO: 504576 - RNA, 64 nt, Human
augaggucaggagaucgagaccauccuggcuaacacggugaaaccccgucucuacuaaaaauac

SEQ ID NO: 504577 - RNA, 64 nt, Human
cugaggucaggaguucgagaccagccuggccaacacggugaaaccccgccucuacuaaaaauac

SEQ ID NO: 504578 - RNA, 64 nt, Human
acgaggucaggagaucgagaccauccuggcuaacacggugaaaccccgucucuacuaaaaaaua

SEQ ID NO: 504579 - RNA, 64 nt, Human
cugagcucaggaguuugagaccagccugggcaacacggugaaaccccgucucuacuaaaauaca

SEQ ID NO: 504580 - RNA, 57 nt, Human
ucucccaguauauugacugauguuuggacggugaaaauaaaagaguuuuacuucucu

SEQ ID NO: 504581 - RNA, 64 nt, Human
aaaggaauaaacauaauguguggccucuauauacaaacucuauuucugucaaugacaucaaagc

SEQ ID NO: 504582 - RNA, 64 nt, Human
gugcuuaguguuugaugucauuaacaguuucguaaaacucuacaguguagaaagauuuugauac

SEQ ID NO: 504583 - RNA, 54 nt, Human
ucacagagcauugccauugacaucaaacucuauggcguggccuuaucgauugca

SEQ ID NO: 504584 - RNA, 64 nt, Human
acgaggucaggagaucgagaccauccuggcuaacacggugaaaccccauuuccacuaaaaauac

SEQ ID NO: 504585 - RNA, 64 nt, Human
ggagucagaaacagaguuggugcugcucagcaggacggugaaacaaugauacuucuuuuuaucu

SEQ ID NO: 504586 - RNA, 64 nt, Human
augaggucaggagaucgagaccauccuggcuaacacggugaaaccccgucucuacugaaaauac

SEQ ID NO: 504587 - RNA, 64 nt, Human
auuacacaccuacauacgcccccaacacacgcgcacggugaagaggacgcccgagcccaccccu

SEQ ID NO: 504588 - RNA, 64 nt, Human
accaggucaggagaucaagaccauccuggcuaacacggugaaaacccaucucuacuaaaaaugc

SEQ ID NO: 504589 - RNA, 64 nt, Human
acgaagucaggagaucgagaccauccuggcuaacacggugaaaccccgucucuacuaaaaauac

SEQ ID NO: 504590 - RNA, 64 nt, Human
aucacaaagucaggacgagaccauccuggcuaacacggugaaacccugucucuacuaaaaauac

SEQ ID NO: 504591 - RNA, 64 nt, Human
ucccccaggggauuuucuaaguagauggggggacacggugaacuggcuguguccaucuuuguca

SEQ ID NO: 504592 - RNA, 64 nt, Human
uugaggucaggagcucgagaccagccuggccaacacggugaaaccccaucucuacuaaaaaaaa

SEQ ID NO: 504593 - RNA, 64 nt, Human
auguggugauaaugaaaagaaugauucagucuugacggugaauggaagacacuuaccuaacaag

SEQ ID NO: 504594 - RNA, 64 nt, Human; identical to SEQ ID NO: 504575

SEQ ID NO: 504595 - RNA, 64 nt, Human
ucaggauggcugcgggcaaugaagccuuaguaaaacggugaaaaguacucccagacggacgcgg

SEQ ID NO: 504596 - RNA, 64 nt, Human
cugaggucaggaguucaagaccagccuggccaacacggugaaaccccgucucuacuaaaaaaua

SEQ ID NO: 504597 - RNA, 64 nt, Human
aguggugccucgcaugcugauaacaauucugggcacggugaagcccaaugcaaacagguaagga

SEQ ID NO: 504598 - RNA, 64 nt, Human
uugaggucaggaguucaagaccagccuggccaacacggugaaaccccaucucucuaaaaauaca

SEQ ID NO: 504599 - RNA, 64 nt, Human
acauaggagaagcauuuggccaauaaaguuguugaaacucuauagaccuggggcugcaguuggg

SEQ ID NO: 504600 - RNA, 64 nt, Human
acuuucccaguuuaaaaaacuaguacucuuguuaaaacucuaaacuugacuaaauacagaggac

SEQ ID NO: 504601 - RNA, 64 nt, Human
acauugaugggcaacuagaauuacagcaguuucaaaacucuaccauggauaaugcaaacaaacc

SEQ ID NO: 504602 - RNA, 64 nt, Human
ggcgggcggaucacgaggucaggaguucgagaccacggugaaacccugucucuacuaaaaaaua

SEQ ID NO: 504603 - RNA, 64 nt, Human
acgaggucaggagaucaaggccauccuggcuaacacggugaaacccugucucuacuaaaaauac

SEQ ID NO: 504604 - RNA, 64 nt, Human
uguccacuggcuucuggagcugaaggucugcgucacggugaaaauucgggauguuuacagagca

SEQ ID NO: 504605 - RNA, 64 nt, Human
cuaauauuagacauacaaguugcugccuguuauaacggugaauuauaccuuugugcaugccuag

SEQ ID NO: 504606 - RNA, 64 nt, Human
augagguuaggagagcgagaccauccuggcuaacacggugaaaccccgucuuuacuaaaaauac

SEQ ID NO: 504607 - RNA, 64 nt, Human
gcucccgaugcugcauggggcgcugccagaucucacggugaaccauuuuggcagaauacagcau

SEQ ID NO: 504608 - RNA, 64 nt, Human
acaaggucaggaguucgagaccauccugucuaacacggugaaaccccaucucuacuaaaaauac

SEQ ID NO: 504609 - RNA, 64 nt, Human
acgaggucaggagaucgagaccauccuggccaacacggugaaaccucgucuccacuaaaaauac

SEQ ID NO: 504610 - RNA, 64 nt, Human
gccgaggcgggcggaucagaccauccuggcuaacacggugaaaccccaccucuacuaaaauuaa

SEQ ID NO: 504611 - RNA, 64 nt, Human
acgaggucaggagauccagaccauccuggcuaacacggugaaaccccgucucuacuaaaaauac

SEQ ID NO: 504612 - RNA, 64 nt, Human
acgagguagggagaucaagaccauccuggcuaacacggugaaaccccgucucuacuaaaaauac

SEQ ID NO: 504613 - RNA, 64 nt, Human
auaaggucaggagaucaagaccauccuggcuaacacggugaaaccccgucucuacuaaaaguac

SEQ ID NO: 504614 - RNA, 64 nt, Human
acaaggucaggagaucgagaccauccuggcuaacacggugaaacccugucuccaccaaaaauac

SEQ ID NO: 504615 - RNA, 64 nt, Human
uguaaaguuuucaaaguucuccauccuggcuaacacggugaaacaccgucucuaccagaaaaua

SEQ ID NO: 504616 - RNA, 64 nt, Human
aagaacaguuggcacuuugcagauggccagugucacggugaaggcuggguugcccccacggguc

SEQ ID NO: 504617 - RNA, 64 nt, Human
ugauuauuauaguacauauaccauguaaacucucaaacucuauuuagcugugaaauaguggugu

SEQ ID NO: 504618 - RNA, 64 nt, Human
auaggcgagguaaccuugaauuucagggcccuggaaacucuagcugaaaccugccuuuccuaau

SEQ ID NO: 504619 - RNA, 64 nt, Human
ucacuuuacaacuuugcuccuaacuguggguugaaaacucuagcuaaagaaaguuaucaaaucu

SEQ ID NO: 504620 - RNA, 64 nt, Human
acugcauccagccaggcugcagggagugaggcacacggugaacauggccacugacuuuucugcc

SEQ ID NO: 504621 - RNA, 64 nt, Human
uuuaaagguguaaaaaagauguuucacuaauguaacggugaaagagaaucccuguuguacuuua

SEQ ID NO: 504622 - RNA, 64 nt, Human
aaagguggaagaaaaaaaaagccaaauucuguuuacggugaaaaaggauuuuguuuuucaccca

SEQ ID NO: 504623 - RNA, 64 nt, Human
uuguguguuuauacuguguauuuuuuuuaaauucacggugaacagcacuuuuauuauuuccagu

SEQ ID NO: 504624 - RNA, 64 nt, Human
acgaggucaggagaucaagaccauccuggcuaacacggugaaaccccgucucuacuaaaaaaaa

SEQ ID NO: 504625 - RNA, 64 nt, Human
acaaggucaggaguucgagaccagccuggccaacacggugaaaccccgacucuacuaaaaauac

SEQ ID NO: 504626 - RNA, 64 nt, Human; identical to SEQ ID NO: 504534

SEQ ID NO: 504627 - RNA, 64 nt, Human
acaaagucaggagauugagaccguccuggcuaacacggugaaaccucgucucuacuaaaaauac

SEQ ID NO: 504628 - RNA, 64 nt, Human
cccugggccccaggccagcucccaucgcugggggacggugaacggccauguguuaauguuacga

SEQ ID NO: 504629 - RNA, 64 nt, Human
augaggucaggagauggagaccauccuggcuaacacggugaaaccccgucucuacuaaaaguac

SEQ ID NO: 504630 - RNA, 64 nt, Human
ccuacccccacccccuuugauccuuucuacuuccacggugaaaggacugaggucggacuacaga

SEQ ID NO: 504631 - RNA, 64 nt, Human
agcagggaugggucagguggcagcauccaaaaccacggugaagauacuaggguccagaggccga

SEQ ID NO: 504632 - RNA, 64 nt, Human
acgaggucaggagacugagaccauccuggcuaacacggugaaaccccaucucuacuaaaaauac

SEQ ID NO: 504633 - RNA, 64 nt, Human; identical to SEQ ID NO: 504611

SEQ ID NO: 504634 - RNA, 64 nt, Human
acaaggucaggagaucgagaccguccuggcuaacacggugaaaccccaucucuacuaaaaauau

SEQ ID NO: 504635 - RNA, 64 nt, Human
acuuucugguacccaguauauuggagucugucagaaacucuauaauaggccaccaguuuuuauu

SEQ ID NO: 504636 - RNA, 64 nt, Human
cuuuuuuucuuaugcaaacgucaugcaauaaaacaaacucuaauguuuggcauccuuguugggc

SEQ ID NO: 504637 - RNA, 64 nt, Human
uaagaugggcagcuaguucguagcuuucccaaauaaacucuaaacauuaaucaaucaucugugu

SEQ ID NO: 504638 - RNA, 64 nt, Human
acgaggucaggagaucgagaaaauccuggcuaacacggugaaaccccaucucuacuaaaaauac

SEQ ID NO: 504639 - RNA, 64 nt, Human
cugaggucucgaguucgagaccaggcuggccaacacggugaaacgcugucucuacuaaaaauac

SEQ ID NO: 504640 - RNA, 64 nt, Human
agaaaaagaaaaaaaaagcauucccaaucuugacacggugaaauccaggucucggguccgauua

SEQ ID NO: 504641 - RNA, 64 nt, Human
uccaagggcuacaucaaccgaccuuucggguuucacggugaagaaguacuaacgcauugaucuc

SEQ ID NO: 504642 - RNA, 64 nt, Human
acgaggucaggagaucgacaccauccuggcuaacacggugaaaccccgucucuacuaaaaaaua

SEQ ID NO: 504643 - RNA, 64 nt, Human
cacauuaacaacuugggaaaaaaauggcaauguuacggugaauucucaggugaacuuuuuucag

SEQ ID NO: 504644 - RNA, 64 nt, Human; identical to SEQ ID NO: 504575

SEQ ID NO: 504645 - RNA, 64 nt, Human
cacgaggucaggagauugagaccuccuggcuaacacggugaaaccccgucuuuacuaaaaauac

SEQ ID NO: 504646 - RNA, 64 nt, Human
ucaggugcauagcaagugaaagcaaguguucacaacggugaaacuugagcgucauuuuucuuag

SEQ ID NO: 504647 - RNA, 64 nt, Human
cgagaguccagguggccuuggagaggaaagaggaacggugaagacaagcugcgagagcugggag

SEQ ID NO: 504648 - RNA, 64 nt, Human
acgaggucaggagaucgagaccauccuggcuaacacggugaaaccccgucucuacuaaaaaaca

SEQ ID NO: 504649 - RNA, 64 nt, Human
ucacuuuuuguggauuuguguauccggucaccaaacggugaauauuauagaagaaugggggaag

SEQ ID NO: 504650 - RNA, 64 nt, Human
aaaaauccgcuucuacuuuugguacccgguugcuacggugaaaugaaggugccccgcauccaga

SEQ ID NO: 504651 - RNA, 64 nt, Human
acuuuaauuuuucuuggguggcuuagagacuaagggaggagacaucuggccuuuuuagaaccug

SEQ ID NO: 504652 - RNA, 64 nt, Human
gguugcuucauuggcccugggacuucucucugcaggaggagagaacgcugccucuccucuggau

SEQ ID NO: 504653 - RNA, 64 nt, Human
gagccuuaaaaagucuuauuuugugaaggggcaaaaacucuaggagucacaacucucagucauu

SEQ ID NO: 504654 - RNA, 64 nt, Human
aucccugagcucugagccaagggugaggauggggaaacucuaagcucccaccuaauaagaagca

SEQ ID NO: 504655 - RNA, 64 nt, Human
aaauagccaaaaagucuacugugguauuuguaauaaacucuaucugcugaaagggccugcaggc

SEQ ID NO: 504656 - RNA, 64 nt, Human
acaguccacgucaccacgaaucacacaacaaaaaggaggagagauauuuuggguucagaagaag

SEQ ID NO: 504657 - RNA, 64 nt, Human
cugacccucugaccuccuuccugggccugcggcuggaggagaagaucacagagccauucuuggu

SEQ ID NO: 504658 - RNA, 64 nt, Human
agguuccaaccuggagccacagugugugagaggaggaggagagggagaauucuguucucccaga

SEQ ID NO: 504659 - RNA, 64 nt, Human
gcuuuagcagcuuaauuaaaucuguuggacugggggaggagagagcuguucucuagugguuaac

SEQ ID NO: 504660 - RNA, 64 nt, Human
cucagcuugcgggguggggggagucaugcccaggggaggagacuuuuuaucuggaggggagaga

SEQ ID NO: 504661 - RNA, 64 nt, Human
gaggagggcaggguugggugggcaauggaaggagggaggagagaaaugaauggaauaaaugcag

SEQ ID NO: 504662 - RNA, 64 nt, Human
ggggcucagcaggucccuguugaagggaggaaggggaggagagaaggagaaaggcaagcaggca

SEQ ID NO: 504663 - RNA, 64 nt, Human
acuuucuugguaugcuggccagaaagggaaaugaggaggagaguagaaaccacagcucuuagua

SEQ ID NO: 504664 - RNA, 64 nt, Human
aaagugcuuucuaaaaggaaauuuuuucaccuuuggaggagaauauauuagaguuguggguaau

SEQ ID NO: 504665 - RNA, 64 nt, Human
gccucuccucaguuucccaucugcugugccucugggaggagagggacuccuggggggccugccc

SEQ ID NO: 504666 - RNA, 64 nt, Human
ucacuuggcuccucagcaaggaagcaaacgccuuggaggagaagcacaugguugcccuuuuguc

SEQ ID NO: 504667 - RNA, 64 nt, Human
cccacagcuggacgcacagaacagucucuccgugggaggagacauuauggggcguccaccacca

SEQ ID NO: 504668 - RNA, 64 nt, Human
agacauacaaauccuugcuuugucagcuugcaaaggaggagaguuuaggauuagggccagggcc

SEQ ID NO: 504669 - RNA, 64 nt, Human
cuuccccucagagugacuuggggagggagaaauaggaggagacguccagcucuguccucucuuc

SEQ ID NO: 504670 - RNA, 64 nt, Human
gcauagcuagugagacagagcucaccuccuacaaggaggagaauguugcaaaccguuuuccccu

SEQ ID NO: 504671 - RNA, 64 nt, Human
aguauaguuucuuuaucuuccaagagggugcuggggaggagaaagagguguguuucucaagguu

SEQ ID NO: 504672 - RNA, 64 nt, Human; identical to SEQ ID NO: 503083

SEQ ID NO: 504673 - RNA, 64 nt, Human
ucucuaaacaaggcuuaucaccaauggagacagaaaacucuaguucaagagcuguaccuccuuu

SEQ ID NO: 504674 - RNA, 64 nt, Human
uguuuucauugauuuaaacagugugauuugugauaaacucuauaagaccccuuccguuuuuuuc

SEQ ID NO: 504675 - RNA, 64 nt, Human
ggaggcugcugcugaccugggccaugaggagcacggaggagaaggacuggcagaucccaggugc

SEQ ID NO: 504676 - RNA, 64 nt, Human
uccucccucagccuugcuacccugugacuuacugggaggagaaagagucaccugaaggggaaca

SEQ ID NO: 504677 - RNA, 64 nt, Human
aaaaacaaacaaaaaacaaaacccuggaguguuaggaggagagugaagguagaggggugaggaa

SEQ ID NO: 504678 - RNA, 64 nt, Human
gaagaauucagaugucagugggagccuccaggugggaggagagcaugccuaaacccugguggcc

SEQ ID NO: 504679 - RNA, 64 nt, Human
acaggcuaagucaggaacaucggaugccagggagggaggagaaagccgaagcgaaaggggucag

SEQ ID NO: 504680 - RNA, 64 nt, Human
ucgccuuaucauccucacuguggaguaaugagggggaggagaaucuuuaucagaaacugguuuu

SEQ ID NO: 504681 - RNA, 64 nt, Human
ucuccucuuucagagcacuggcucuccagccccaggaggagaacaggagggaggaggagaugaa

SEQ ID NO: 504682 - RNA, 64 nt, Human
uggcucuccagccccaggaggagaacaggagggaggaggagaugaaagaggagggacagguucu

SEQ ID NO: 504683 - RNA, 64 nt, Human
aggaugccccaagucaggaagaccauuaagaauaggaggagagggcucugccucaacuuuccua

SEQ ID NO: 504684 - RNA, 64 nt, Human
gagaugguccugucgagaggacuaggaaccgauaggaggagaguccuucucggcagagcucacu

SEQ ID NO: 504685 - RNA, 64 nt, Human
ucucuguacccuuccuggugcugccgugcccccaggaggagaugaccagugccuuggccacaau

SEQ ID NO: 504686 - RNA, 64 nt, Human
gggugauaagaggacuucuuggggccagaacuguggaggagagcacauuugauuaucauauuga

SEQ ID NO: 504687 - RNA, 64 nt, Human
cggcagcucugugcccuuggccagcauguggaguggaggagaugcugccccugugguuggaaca

SEQ ID NO: 504688 - RNA, 64 nt, Human
uucauaugugacaaaauuaucucgaccuuacauaggaggagaauacuugaagcaguaugcugcu

SEQ ID NO: 504689 - RNA, 64 nt, Human
gggaagcaaaaaccaaaaugugugacugggcuuuggaggagacuggagccucagcccuguccug

SEQ ID NO: 504690 - RNA, 64 nt, Human
auaaagucuuuugugaauuauuuccugaagucguggaggagauuaaacaaaaacagaaagcaca

SEQ ID NO: 504691 - RNA, 64 nt, Human
cgggggcugcauuucacacuccuccaccugucucaaacucuaaggucggcacuugacaccaagg

SEQ ID NO: 504692 - RNA, 64 nt, Human
ugacccacuucugcaggcauagguccagagcaccaaacucuaguggacaauucagacucuccug

SEQ ID NO: 504693 - RNA, 64 nt, Human
uuaaaucugacauuuaauuguuuuauaauaauccaaacucuaugaaagcaauuuuaaaaauuau

SEQ ID NO: 504694 - RNA, 64 nt, Human
gcguuggugccacuucuuaaaggccuggaaccagggaggagaggaaaugcuauuguugugggcu

SEQ ID NO: 504695 - RNA, 64 nt, Human
gcagugucuguccugccagucccaaggcccugugggaggagacuggccugcaucucucuaagac

SEQ ID NO: 504696 - RNA, 64 nt, Human
ccgggagacagaugaggcgagaggaggaggaggaggaggagaaggcucugggcuccucugcaaa

SEQ ID NO: 504697 - RNA, 64 nt, Human
gagacuauauuaugcugaagaaggcuguucgugaggaggagaugcgagcacccagaacgucuuu

SEQ ID NO: 504698 - RNA, 64 nt, Human
accggggcugaggccacacagauaggggccugauggaggagaggauagaaguugaauguccuga

SEQ ID NO: 504699 - RNA, 64 nt, Human
accacucugcuuugcccaagugugacagcacuggggaggagagacaggauaaagggcagauguc

SEQ ID NO: 504700 - RNA, 64 nt, Human
gggaaaagggcccuuucaaagaaguggauaagagggaggagaucauugagugacccagaaagcu

SEQ ID NO: 504701 - RNA, 64 nt, Human
acccauaaagccuugaccacaucacuccauauggggaggagaaggaucccugucaccuucuccu

SEQ ID NO: 504702 - RNA, 64 nt, Human
gaggaacauugggaaggaagcccgcggggagagaggaggagagaaguggccagggcuuguggac

SEQ ID NO: 504703 - RNA, 64 nt, Human
uuaccugagaccaguugggagcacuggagugcagggaggagaggggaagggccagucugggcug

SEQ ID NO: 504704 - RNA, 64 nt, Human
guuagggcuucaaugaugcugagucuggaaaaggggaggagacccuugggaggacuccaggcag

SEQ ID NO: 504705 - RNA, 64 nt, Human
cuauucauaaugaugaaauuucaacuacauacaaggaggagaaaauaagaacccagucauaaca

SEQ ID NO: 504706 - RNA, 64 nt, Human
acuuggcucaucguucagggaacccaggaaaaugggaggagaacgccgcguggacugaagcucu

SEQ ID NO: 504707 - RNA, 64 nt, Human
uuuggggcuggaggugacaguaggugagggcagaggaggagaucagaaaaucccucugacaucu

SEQ ID NO: 504708 - RNA, 64 nt, Human
ucagcugcacugacacccugguccugacuucccuggaggagaaguauuccuguugcugucuuca

SEQ ID NO: 504709 - RNA, 64 nt, Human
uuuuucuaauggacaaaucaccaaacacugggaaggaggagagaggagggaucucucccauaga

SEQ ID NO: 504710 - RNA, 64 nt, Human; identical to SEQ ID NO: 503084

SEQ ID NO: 504711 - RNA, 64 nt, Human
uuuguuaagccucagaaauaugaggaagccuguaaaacucuaguggggagauauuaacuuggag

SEQ ID NO: 504712 - RNA, 64 nt, Human
aauaagauuugaguaaugaaagucuguagucuuaaaacucuaaaacaguuguacugcuuccaag

SEQ ID NO: 504713 - RNA, 64 nt, Human
uggcuuguuuuuggaaagaaauucugaagagaguggaggagaggagaaauguccucauauuuga

SEQ ID NO: 504714 - RNA, 64 nt, Human
gccagccccuccucaccacucuuccccuugcaguggaggagagagccagaguggauacuauuuu

SEQ ID NO: 504715 - RNA, 64 nt, Human
auuuucuccauggggaagacagccaugcucuucaggaggagacuccaagggcaaaggagggugu

SEQ ID NO: 504716 - RNA, 64 nt, Human
ccugcucugguggagcugacaaccuuugaggcugggaggagagcagccucugggcaucguuccc

SEQ ID NO: 504717 - RNA, 64 nt, Human
ugcccuaacggcccuccccugcaacauccgucuuggaggagaggcugcagccacagcacccuac

SEQ ID NO: 504718 - RNA, 64 nt, Human
uggggugagggguaaguuuaggcuuucgcggaggggaggagacauggagccugggaacuccuug

SEQ ID NO: 504719 - RNA, 64 nt, Human
ggagggcccucagcuccuagggcugucgaauagaggaggagagagaaauggucuagccaggguu

SEQ ID NO: 504720 - RNA, 64 nt, Human
cuauuuggagacggaaaaacuggaauucuaacaaggaggagaggagacuaaaucacaucaauuu

SEQ ID NO: 504721 - RNA, 64 nt, Human
cagaccccagagcaguauuaaugaugcagagguuggaggagagagguggagacuguggcucaga

SEQ ID NO: 504722 - RNA, 64 nt, Human
gggaguccagccgugcacugugccagaugccucaggaggagaacccuccccaguguacugugaa

SEQ ID NO: 504723 - RNA, 64 nt, Human
caaguucagcauaguggaggggagaggcagaacuggaggagaggugcagugaagguucucuaca

SEQ ID NO: 504724 - RNA, 64 nt, Human
aggccuccucaaccuucaccuccuuucccaccaaggaggagaaguaggaaguuuucuuaaaggg

SEQ ID NO: 504725 - RNA, 64 nt, Human
ggacaacagaagccccaugccgccuguccaguucggaggagaacuagcugcugccuugccuucc

SEQ ID NO: 504726 - RNA, 64 nt, Human
ggugcgaguuccuccugcauaugaaccgaggggaggaggagaagcugagcacgugugacauugc

SEQ ID NO: 504727 - RNA, 64 nt, Human
uuguuugcuucaacugucuccuaccucugcucuuggaggagauggggacagggcuggagucaaa

SEQ ID NO: 504728 - RNA, 64 nt, Human
ucuuuguggaauggauagccucccacuaggacugggaggagaauaacccaggucuuaaggaccc

SEQ ID NO: 504729 - RNA, 64 nt, Human
uaagauugaaaguaagaaaacggauuuaggaugaaaacucuagaacuacccuaugcuguuuaua

SEQ ID NO: 504730 - RNA, 64 nt, Human
guaaacuuauuuuauuauacagauuauuucuuaaaaacucuauuuauaccuuaacaugaaaucc

SEQ ID NO: 504731 - RNA, 64 nt, Human
aacucugcagaaacauuuguuucacccagacuucaaacucuagcccugacuaugaugccccugu

SEQ ID NO: 504732 - RNA, 64 nt, Human
aaagccaucugggcagucaggggcaaggacuguuggaggagaguuagcccaaguauaggcucug

SEQ ID NO: 504733 - RNA, 64 nt, Human
accagcaugaugauaauauucaugaccugaugugggaggagacagccaaccucaggcuuagauc

SEQ ID NO: 504734 - RNA, 64 nt, Human
agcuccuggaggagggacccagcuccaucgcgcuggaggagagucaccuccagacaacaucugc

SEQ ID NO: 504735 - RNA, 64 nt, Human
cugggguggucaccucgucagugccuuuuguucuggaggagaggaccccccccgccugccgaga

SEQ ID NO: 504736 - RNA, 64 nt, Human
ggcgcaggacucggucaagggaggggcaagaggaggaggagagccugccguuccaacuugccca

SEQ ID NO: 504737 - RNA, 64 nt, Human
uuggugacucuguccuucgcccugugcacccuggggaggagagcucugggaacagccgcucaca

SEQ ID NO: 504738 - RNA, 64 nt, Human
guaauggaggcuagggguggauugggaggugaguggaggagagucucugaccagcugcagagcc

SEQ ID NO: 504739 - RNA, 64 nt, Human
uuuccccucuccccuauuuuuuaaguaccuuggaggaggagagguuggugacaugcaugguggg

SEQ ID NO: 504740 - RNA, 64 nt, Human
cagucauuggcuucuuaucuggaugaaggcuuuuggaggagaaccaaaacgacaaguuccaaga

SEQ ID NO: 504741 - RNA, 64 nt, Human
ccuuaaagcccuuucaguagaugaggguugucagggaggagaaaugaagaagcuauguuaauuu

SEQ ID NO: 504742 - RNA, 64 nt, Human
gcuuucauuucagguguguuggucuauaugacagggaggagaguaaaggagagcaggagcaauu

SEQ ID NO: 504743 - RNA, 64 nt, Human
gggguggggggacauucagacgggcaguguuagaggaggagaugggagcggugacuacacacac

SEQ ID NO: 504744 - RNA, 64 nt, Human
gcuaggagaucugagggcaggcgggcagcugcagggaggagaggugagaaaggaagcgucuucu

SEQ ID NO: 504745 - RNA, 64 nt, Human
uuuguuugaagagacuguaccagagggccagggaggaggagaaaggaauugagcuggccuaucu

SEQ ID NO: 504746 - RNA, 64 nt, Human
ggccccaucuggauguucugcagauccccacaugggaggagauucccaaguagaggcagccaga

SEQ ID NO: 504747 - RNA, 64 nt, Human
ugaagagguuugucagacaauaggauagauguuaggaggagacacaccucuugucugagaaccu

SEQ ID NO: 504748 - RNA, 64 nt, Human; identical to SEQ ID NO: 503085

SEQ ID NO: 504749 - RNA, 64 nt, Human
acaccuccugauaguaguaaaauuagaaaaaaacaaacucuacuaauuuuuagauauucauuaa

SEQ ID NO: 504750 - RNA, 64 nt, Human
uaaaacaaagguggcacuuuuuuauguuaaccuuaaacucuaggccuuacuggaagccacugau

SEQ ID NO: 504751 - RNA, 64 nt, Human
agggcuguggcuggguggucagcagaaacccccaggaggagagagaugcugcucccgccugauu

SEQ ID NO: 504752 - RNA, 64 nt, Human
gagucagggcccuaggugaccuauucuaacucaaggaggagagcuauguacagggagagcauuu

SEQ ID NO: 504753 - RNA, 64 nt, Human
accccaaaggaugcaagugccuacaguauuaucaggaggagaacaugaaaauauuaagacaaaa

SEQ ID NO: 504754 - RNA, 64 nt, Human
gggaacccaaguuacguccuggugaaagcagaaaggaggagacaggauggcugucaacaacguc

SEQ ID NO: 504755 - RNA, 64 nt, Human
cccugggcagagccagcucgggugaggggugaguggaggagacccauggcggacaaucacucuc

SEQ ID NO: 504756 - RNA, 64 nt, Human
ccugcuccaggguagaccugagaugaaccucccuggaggagacuuauuucaaugaguccaccau

SEQ ID NO: 504757 - RNA, 62 nt, Human
ugcaggagucacacggucauaggccaucaaagcuggaggagaccucagaaucauucauucac

SEQ ID NO: 504758 - RNA, 64 nt, Human
guuugcagguuucuguguguggggugggguauggggaggagaaccuucaugguggcccaccugg

SEQ ID NO: 504759 - RNA, 64 nt, Human
cuguuaccgccgcucagcgccccggcugggcggaggaggagacgcccaugccccucaggggaaa

SEQ ID NO: 504760 - RNA, 56 nt, Human
auaaaaaauucaguaguuaggggcagggaggagaaauaaaguggugauagucuggu

SEQ ID NO: 504761 - RNA, 64 nt, Human
gugggcucuuccccuugguuuguaacgaagugaaggaggagaacuugggagccagguucucccu

SEQ ID NO: 504762 - RNA, 64 nt, Human
acucacuucucuuccuugggaucccuaagaccguggaggagagagaggcaauggcuccuucaca

SEQ ID NO: 504763 - RNA, 64 nt, Human
gcucagagcaagggaaauugagaaaagggcccaaggaggagauggugucuuagaugccacagga

SEQ ID NO: 504764 - RNA, 64 nt, Human
uucccagaaugcaggggagagcaggaugccggguggaggagacaggcaaggugccguuggcaca

SEQ ID NO: 504765 - RNA, 64 nt, Human
augggauugccacucacccacccacacugguaagggaggagaauuugugcuucuggagcuucuc

SEQ ID NO: 504766 - RNA, 64 nt, Human
gccuucuguagaccauauagaaaaagauuauagaggaggagaaucuacugcuggcaauugggaa

SEQ ID NO: 504767 - RNA, 64 nt, Human
ggaguaaaucucuccaccuccucuaacucucugaaaacucuagaguuggagcaagucuuccauu

SEQ ID NO: 504768 - RNA, 64 nt, Human
uguacacggcagucccgccacccagcccccuuguaaacucuagucacuauaaacacacccguac

SEQ ID NO: 504769 - RNA, 64 nt, Human
aggaggaagagaugagaaaggaagacagagaaagaaacucuaugaucacgguuuuuccaaaauu

SEQ ID NO: 504770 - RNA, 64 nt, Human
cagaaagcgcggguccagaugagggccaggaaggggaggagagugagggccaagaacgagccuu

SEQ ID NO: 504771 - RNA, 64 nt, Human
ugccuucauaggucaucuaggguuuuauaaaggaggaggagacaauauuuuuucaaacuuuuug

SEQ ID NO: 504772 - RNA, 64 nt, Human
ccucgcccucugaaaguccucaugccuggcagucggaggagagcgcccagacucugaacucagc

SEQ ID NO: 504773 - RNA, 64 nt, Human
acacuaaugaugccaggaagagaguaaggcuagaggaggagacucauuuuaaccccaguccagu

SEQ ID NO: 504774 - RNA, 64 nt, Human
agagagagagagagagagagagagagagaaagauggaggagaagaacuuggauuccccugggua

SEQ ID NO: 504775 - RNA, 64 nt, Human
cuugaacccagaaggaggacuuugggccaauuucggaggagagaagaaagugcaacguggggag

SEQ ID NO: 504776 - RNA, 64 nt, Human
gagcccagggcaucccaugggggugcugcagccaggaggagaggaaaggacauggguagcaauu

SEQ ID NO: 504777 - RNA, 64 nt, Human
ugaagggcuauguggcugagcggaagggugagagggaggagaugcaggaugcccacgucauccu

SEQ ID NO: 504778 - RNA, 64 nt, Human
cuguguucugaaauacuggguagagaauggcugaggaggagauuaccagagaaguugcuuugcu

SEQ ID NO: 504779 - RNA, 64 nt, Human
aacuaucaguguuuuuaaagauaaauuacacaagggaggagaaagaucccugugcuaggacugc

SEQ ID NO: 504780 - RNA, 64 nt, Human
acaaguaucagcaaaaggauuuguuuucacucugggaggagaggguggagaaagcacuugcuuu

SEQ ID NO: 504781 - RNA, 64 nt, Human
ugacagagcaggacaugagacauagauacaguggggaggagaaguggggaaagguggagcagag

SEQ ID NO: 504782 - RNA, 64 nt, Human
ucugucccccuccagguucggcacccaggucuccggaggagacacaguuacccgaacccuucgc

SEQ ID NO: 504783 - RNA, 64 nt, Human
gagcuccuggcccuggccagaagcaggagugugaggaggagacagccucagcggacaagcagcu

SEQ ID NO: 504784 - RNA, 64 nt, Human
aggaagagaggagauggauuucaguugggaguuaggaggagaguaggugagaugaucagacacc

SEQ ID NO: 504785 - RNA, 64 nt, Human
aauccuagagccagcugauaauauuuaauaaucuggaggagagaauaaugauguaccaauaagu

SEQ ID NO: 504786 - RNA, 64 nt, Human
auacucaauucuuaaccaaaaucuuggucuccacaaacucuaccaucccuuuucucuucacucu

SEQ ID NO: 504787 - RNA, 64 nt, Human
aauugggagcucugccguacgccagggcgguuccaaacucuaaaccguucccaccgucagggag

SEQ ID NO: 504788 - RNA, 64 nt, Human
ucaauuuuaaacugaagcauuuuaauauggguagaaacucuacaccaaauacacuaaacauuuu

SEQ ID NO: 504789 - RNA, 64 nt, Human
ggcagccuccacuagaauuuggugaagaggaggaggaggagauugaugacaagcaaguuacuca

SEQ ID NO: 504790 - RNA, 64 nt, Human
uucccaucccagcugaaauacugaggggucuccaggaggagacuagauuuaugaauacacgagg

SEQ ID NO: 504791 - RNA, 64 nt, Human
uucagccccugcucccauccaguggccagucgggggaggagaaagacgcgauuaacacuguggc

SEQ ID NO: 504792 - RNA, 64 nt, Human
gcaggugcccugcuggauaucugggucuggaacaggaggagaaagggugucugcugccugguga

SEQ ID NO: 504793 - RNA, 64 nt, Human
acgaggcuggggcugaaagcagaagcaugcacagggaggagaccacuuuuauugcuugucuggg

SEQ ID NO: 504794 - RNA, 64 nt, Human
auggcagaagguaacaacuauguugaaauaucaaggaggagauuaagcuuuauauuugcuuauu

SEQ ID NO: 504795 - RNA, 64 nt, Human
uacaucuucucuuuccuuguuuuccucuacaauuggaggagaaacaaauauauuucuuacuagc

SEQ ID NO: 504796 - RNA, 64 nt, Human
ggaaggaaguccgggagaaccauaugaaggagcaggaggagaggaagaaacuuuuuuuccuucu

SEQ ID NO: 504797 - RNA, 64 nt, Human
uaagaaaaguuggaaaaagaucuucaaccuuucgggaggagagaaaacacuuaguucauuggcu

SEQ ID NO: 504798 - RNA, 64 nt, Human
gagaagagaaagucagccuuucuggggcuuucauggaggagacuugcccaaggggcuucccugc

SEQ ID NO: 504799 - RNA, 64 nt, Human
ggcucuaaaaugagaugugauauggcuugaaaugggaggagacacuuucugacagugggggguc

SEQ ID NO: 504800 - RNA, 64 nt, Human
ucuuuuaggucuagggacaggagugaauagaaagggaggagagcucuauuauguucuauacaca

SEQ ID NO: 504801 - RNA, 64 nt, Human
aaugcauauucacaaaguuaucugauagggccuuggaggagaagguccaguuuuaaaaaaugac

SEQ ID NO: 504802 - RNA, 64 nt, Human
ggguuuaacaacaugcuccguagacgaagggagaggaggagagaaggcuuccuggguuugcaac

SEQ ID NO: 504803 - RNA, 64 nt, Human
uugacuuugcaccugucuucaggcugccaggggaggaggagaagccagcaggcaccacuuuucu

SEQ ID NO: 504804 - RNA, 64 nt, Human
aguaugucagcuuuucucacccucuucugugcugggaggagagucuaacuguaaccuuuagguu

SEQ ID NO: 504805 - RNA, 64 nt, Human; identical to SEQ ID NO: 503101

SEQ ID NO: 504806 - RNA, 64 nt, Human
uaggcacuuugcuauuucuuuucuaaacuaucaaaaacucuagcaguuugaaaagccuaauauu

SEQ ID NO: 504807 - RNA, 64 nt, Human
ucaucuccaucuuuagccuuuacaccaccaaucaaaacucuagguacaccaacacaaccuggaa

SEQ ID NO: 504808 - RNA, 64 nt, Human
aguggacagcguggugagccguggccggacggcaggaggagaggggagcccccucuggcugugu

SEQ ID NO: 504809 - RNA, 64 nt, Human
cugcccauccagaagggacuccccagggccugggggaggagacccuuggaaaaguccucucuuc

SEQ ID NO: 504810 - RNA, 64 nt, Human
cuucuguggcccccagcaagcucaccaccuccuuggaggagagagacauacaaggacagugggu

SEQ ID NO: 504811 - RNA, 64 nt, Human
uugaaacuuaucucaaauggagauuuuggugggaggaggagaaaacaauuguuuuuaaaucaca

SEQ ID NO: 504812 - RNA, 64 nt, Human
cugcuaggggguuagaguggucucagcggcagguggaggagagcaggaugcugggcucaagcgc

SEQ ID NO: 504813 - RNA, 64 nt, Human
caaggggcaggacaggcccucagaagcagcucuuggaggagaugagcauuuuguuuugcacagg

SEQ ID NO: 504814 - RNA, 64 nt, Human
acuggccuuggccacacugggauucggagaggaaggaggagagccccaugcuuccugucugccu

SEQ ID NO: 504815 - RNA, 64 nt, Human
ugcuucagccuggccugggcagcccuggaagcucggaggagaggccaccuucuuaggugccugu

SEQ ID NO: 504816 - RNA, 64 nt, Human
cucuguguccaaguggauugagcauauaugccuaggaggagauagacuguuaaucguuggauuu

SEQ ID NO: 504817 - RNA, 64 nt, Human
ggauguccugugccucccagauuccucgauucugggaggagaggcugccgcauucugcugcucc

SEQ ID NO: 504818 - RNA, 64 nt, Human
cagaagggaggggagacagaggggauuaaagaggggaggagagagugcagagcuccaggaaagg

SEQ ID NO: 504819 - RNA, 64 nt, Human
gcugucugcugggaggucagcuggucaaggcagaggaggagaggaggaaaggaugggggcugaa

SEQ ID NO: 504820 - RNA, 64 nt, Human
uggauuugguuaugauggaaaggaagaaugcagaggaggagaaaagugacagauccuccauuuu

SEQ ID NO: 504821 - RNA, 64 nt, Human
gagaaaguggccccagggagagaauggaggacugggaggagaagcauuaacugagcuccaaggg

SEQ ID NO: 504822 - RNA, 64 nt, Human
acuuaguuaaauaauuccauccacuuauggaggaggaggagaauguggaagagguaaaaagcug

SEQ ID NO: 504823 - RNA, 64 nt, Human
cacugccuuggguggaccaggcuuccaagaaagaggaggagaguugaaaagagaggagaagacu

SEQ ID NO: 504824 - RNA, 64 nt, Human
acgcauguuauggugcuaauguacuuucacuuuuaaacucuagaucagaauuguugacuugcau

SEQ ID NO: 504825 - RNA, 64 nt, Human
auaacuaccauauuaaauaacaaauguucauuauaaacucuaggaaagauugaauaaaaucugu

SEQ ID NO: 504826 - RNA, 64 nt, Human
uuuuccaaagagugauagucuuuugcuuuuggcaaaacucuacuuaauccaauggguuuuuccc

SEQ ID NO: 504827 - RNA, 64 nt, Human
cacgaugccagagagaacuuagcaggguguccccggaggagagguuugggaagcuccacggaga

SEQ ID NO: 504828 - RNA, 64 nt, Human
ugaaguauucacuacucuuguaaaccaaccaagaggaggagaaagaugacccagaaguggauuc

SEQ ID NO: 504829 - RNA, 64 nt, Human
acaaauccagacaccagccuuuaggguggccuugggaggagagggccaggcuguccugggugug

SEQ ID NO: 504830 - RNA, 64 nt, Human
uuugaaauguuggguuuccagagagagucaugcuggaggagaaggaaguaggccagaaguccag

SEQ ID NO: 504831 - RNA, 64 nt, Human
ugugggacugggggugugggaguuggugagagcaggaggagagguggggacagcaagaagccac

SEQ ID NO: 504832 - RNA, 61 nt, Human
aauucugcaguaaaaagugagccuccgccuuggaggagacuacugguucgcccaucuguuu

SEQ ID NO: 504833 - RNA, 64 nt, Human
cuucucuaaagugcuguuggagcauggaggagcuggaggagauggggauggacugacagcuaag

SEQ ID NO: 504834 - RNA, 64 nt, Human
agucagccugugcaaaggccccguggccagggguggaggagaauauguggguguggacaggaug

SEQ ID NO: 504835 - RNA, 64 nt, Human
cuuggcagagagauagccgggcuccagggaguggggaggagagagggggagaccccuuugccuu

SEQ ID NO: 504836 - RNA, 64 nt, Human
uauuuggagacuuuaauuucugugugagaccaaaggaggagagauguguuuuguucaaaauuua

SEQ ID NO: 504837 - RNA, 64 nt, Human
cccucauuuucaagaaggggaaacugaggcccagggaggagaguaacugaaggucacagcacgg

SEQ ID NO: 504838 - RNA, 64 nt, Human
gacuuugagcuaaggcugaaguacaggaggaggaggaggagagggccggauguggguguggaca

SEQ ID NO: 504839 - RNA, 64 nt, Human
agggccggauguggguguggacagcaguaguggcggaggagagcucggggcugggcugccuggc

SEQ ID NO: 504840 - RNA, 64 nt, Human
agggaagggugcuguguuuucauagcauggagucggaggagagggccauuuagcagggggagca

SEQ ID NO: 504841 - RNA, 64 nt, Human
uguaguagauauccucugcuuaaaaacucacuacggaggagaauuaaguccuacuuuuaaagaa

SEQ ID NO: 504842 - RNA, 51 nt, Human
aagauggaacagaaguuuaauggaggagaccuauguguauuuuuuucuaaa

SEQ ID NO: 504843 - RNA, 64 nt, Human; identical to SEQ ID NO: 503102

SEQ ID NO: 504844 - RNA, 64 nt, Human
auuugauggaggaaaacauaaggcagucuguaacaaacucuaucaaagcaggccugacugacca

SEQ ID NO: 504845 - RNA, 64 nt, Human
ucauuuccauucaggaugccggcuuuauuaacaaaaacucuaacaagucaccuccacuaugugg

SEQ ID NO: 504846 - RNA, 64 nt, Human
gggaagugagagaguaugguggcaauaucacaagggaggagagaggaaaacaauuaucuucucu

SEQ ID NO: 504847 - RNA, 64 nt, Human
ccagcaagcauuuaucagaaauagaaucacaauaggaggagaauuugacugucugauauuauga

SEQ ID NO: 504848 - RNA, 64 nt, Human
ggauggagcccaucucuccaguuccucccucaguggaggagaucccugugccuggggaagcagu

SEQ ID NO: 504849 - RNA, 64 nt, Human
guauuuggaggaaucagggguuuggaaggaguagggaggagaaugaaggaaaaugcaaccagca

SEQ ID NO: 504850 - RNA, 64 nt, Human
gaccugguggcccuuuccuagugccucugcuuggggaggagaaccucuguccacguggaggcua

SEQ ID NO: 504851 - RNA, 64 nt, Human
gccuucauuuugucuguagccccaggcaacagugggaggagagaacugguuuccagcaguccau

SEQ ID NO: 504852 - RNA, 64 nt, Human
acuccuucuuucagccccaccuccccagggcccuggaggagacccccacccugcaauccacacc

SEQ ID NO: 504853 - RNA, 51 nt, Human
agagaagcgagucuucuugaaggaggagaucggugguaaggucggaaacua

SEQ ID NO: 504854 - RNA, 64 nt, Human
cugcacaagcaggaagcgccugggagucccggaaggaggagagcgcacacccaggcagcccucu

SEQ ID NO: 504855 - RNA, 64 nt, Human
auuagaauauaaaaaauguuauuacugaggaaagggaggagaggacaaguguaauaaaucaaaa

SEQ ID NO: 504856 - RNA, 64 nt, Human
ggugcaaaacgagacagaagagugagaagcagauggaggagaagagaagagccaaccagaagag

SEQ ID NO: 504857 - RNA, 64 nt, Human
agcgcaaggcauacaccagaaaacgcuguccuguggaggagauguuaaaguaacccaucuugca

SEQ ID NO: 504858 - RNA, 64 nt, Human
gggagaauacauuaguuaauauaugugaaaguauggaggagaugugcaauaaauauuuguguua

SEQ ID NO: 504859 - RNA, 64 nt, Human
auuuacaggagcguuccuaggaaaaggaauuuuaggaggagaauuugugagcagugaaucugac

SEQ ID NO: 504860 - RNA, 64 nt, Human
uagcaugugacuuuccaagaguuuagguugugcuggaggagagguuuccuucagauugcugauu

SEQ ID NO: 504861 - RNA, 64 nt, Human
ucagucaacugaccaaacacugcuuugaauuauaggaggagaacaauaaccuaccauccgcaag

SEQ ID NO: 504862 - RNA, 64 nt, Human; identical to SEQ ID NO: 359341

SEQ ID NO: 504863 - RNA, 64 nt, Human; identical to SEQ ID NO: 359342

SEQ ID NO: 504864 - RNA, 64 nt, Human; identical to SEQ ID NO: 359343

SEQ ID NO: 504865 - RNA, 64 nt, Human
guccggcugacacgggcgccuucccgggggagugggaggagagggaggggagggauuuuuuaug

SEQ ID NO: 504866 - RNA, 64 nt, Human
ggagcucaagcagugaggaggaggagaaggaggaggaggagagcgcgagugagcaggggccaag

SEQ ID NO: 504867 - RNA, 53 nt, Human
cccuggagcucaagcagugaggaggaggagaaggaggaggaggagagcgcgag

SEQ ID NO: 504868 - RNA, 64 nt, Human
cuuuuccuucccucaaagcuuccauuccacauccggaggagaagaaggaaaugaauuucucuac

SEQ ID NO: 504869 - RNA, 64 nt, Human
aucuuuucagaagaaaagcauuuaauugccaaugggaggagaagcccauaauguuacuguaacu

SEQ ID NO: 504870 - RNA, 64 nt, Human
aaugacagaaugcuuuuaggcacauucaauggaaggaggagauguaggucuguauauguuaccc

SEQ ID NO: 504871 - RNA, 64 nt, Human
uaaauaauuccaaacucucaucgggucauaaagaggaggagaaacagggugagucaagguaaag

SEQ ID NO: 504872 - RNA, 64 nt, Human
auuucucuuucaucaaaacaaaacagcagcugugggaggagaaaugagagggcuuaaaugaaau

SEQ ID NO: 504873 - RNA, 64 nt, Human
gcuuuaccagcugaaaguugggacucuggagagcggaggagagagaggcagaagaacccuggcc

SEQ ID NO: 504874 - RNA, 64 nt, Human; identical to SEQ ID NO: 504869

SEQ ID NO: 504875 - RNA, 64 nt, Human
cccagagagaaaaagagagagcagggugggguaaggaggagaaaauaaaccaacaauuaggucu

SEQ ID NO: 504876 - RNA, 64 nt, Human
uaccaguaaaagacauagaccaauggggaggaggggaggagagauggauauuucagcccucucc

SEQ ID NO: 504877 - RNA, 64 nt, Human
aaucacaucuguaguacuuagccaaagacaauuuggaggagaauaucagccuucuggaaguagc

SEQ ID NO: 504878 - RNA, 64 nt, Human
uaaguuuaccaugcaguuguuuaccaaaaauagaggaggagagucuuaacuuuugcucuuggau

SEQ ID NO: 504879 - RNA, 64 nt, Human
gaggggacgguggggggaugauaugaaugucacaggaggagacaccuucugucuuuguuucaaa

SEQ ID NO: 504880 - RNA, 64 nt, Human
agaaaaagaaacacaagagacuuaaaggacaggaggaggagauggccauaggagaggaggguuc

SEQ ID NO: 504881 - RNA, 64 nt, Human; identical to SEQ ID NO: 359344

SEQ ID NO: 504882 - RNA, 64 nt, Human; identical to SEQ ID NO: 359345

SEQ ID NO: 504883 - RNA, 64 nt, Human; identical to SEQ ID NO: 359346

SEQ ID NO: 504884 - RNA, 64 nt, Human
ucagugagggcucuggauugagagggaggcccugggaggagagaagggggcagagucuucccua

SEQ ID NO: 504885 - RNA, 64 nt, Human
cgcugccauaugucccuguccuccaggcuguaggggaggagagccuggccgggggagacagacu

SEQ ID NO: 504886 - RNA, 64 nt, Human
aaagggagucucucaccagcccaggcccucaggaggaggagauaccaggaggcagggaugcugg

SEQ ID NO: 504887 - RNA, 64 nt, Human
gcuuuauuuaugaaccugguuuucgggagucaggggaggagaugacuuugcuucugugcacagc

SEQ ID NO: 504888 - RNA, 64 nt, Human
ugagggggagccuggggacggguuuggguccccaggaggagagccuuggguauaaucuauuuuu

SEQ ID NO: 504889 - RNA, 64 nt, Human
gauggggccggcagguccuguguccccugcaccuggaggagagcaggcuagaggcacagcggcc

SEQ ID NO: 504890 - RNA, 64 nt, Human
uccucauuguuuggccucaugggaccgaggggcuggaggagaggcggagcugugccccagcugu

SEQ ID NO: 504891 - RNA, 64 nt, Human
aacgagaagugcuuuauacugaacgugguugaugggaggagagacgaggcauucgggccggugg

SEQ ID NO: 504892 - RNA, 64 nt, Human
agucaagccuccuauucuguuaguacuuauuagaggaggagaugguuuucauugcauagugaca

SEQ ID NO: 504893 - RNA, 64 nt, Human
gagacuaaacugguuuguugcagccaaagauuuuggaggagaaggacauuuuacugcagugaga

SEQ ID NO: 504894 - RNA, 64 nt, Human
ccaauagaguugguuggguggggagucaggggugggaggagaaggaggaagaggaggaaggcca

SEQ ID NO: 504895 - RNA, 64 nt, Human
caccaaaugaggaauguuuguuccuggaaaggcuggaggagaaccauuacaacaccuauauauc

SEQ ID NO: 504896 - RNA, 64 nt, Human
ggaccuggccaggccagccacuccugaagccccgggaggagaggaaggcagcggcgaacgccag

SEQ ID NO: 504897 - RNA, 64 nt, Human
ggaccuccaagcuccucugacugaaccuacugugggaggagaagcagcugaugacagagagagg

SEQ ID NO: 504898 - RNA, 64 nt, Human
ggcaauagacuucccucacugucuccgccugcagggaggagaauguaccccacugcaccugagc

SEQ ID NO: 504899 - RNA, 64 nt, Human
uuaaaucagagauuauucaacagagagggagaaaggaggagacagagggaggaccuguuguguu

SEQ ID NO: 504900 - RNA, 64 nt, Human; identical to SEQ ID NO: 359348

SEQ ID NO: 504901 - RNA, 64 nt, Human; identical to SEQ ID NO: 359349

SEQ ID NO: 504902 - RNA, 64 nt, Human; identical to SEQ ID NO: 359350

SEQ ID NO: 504903 - RNA, 64 nt, Human
gcugaggcucaggggugugccugucuguuacacuggaggagagaagaaugagccuacgcugaag

SEQ ID NO: 504904 - RNA, 64 nt, Human
ucccucuuuuccccuugcccccucugcagccggaggaggagauguugaggggaggaggccagcc

SEQ ID NO: 504905 - RNA, 64 nt, Human
cagugaggugagacuucccagaccccggaggcguggaggagaggagacuguuugaugugguaca

SEQ ID NO: 504906 - RNA, 64 nt, Human
guguccacccuccggcccccgucuuguaaaaaggggaggagaauuagccaaacacuguaagcuu

SEQ ID NO: 504907 - RNA, 64 nt, Human
ucccuucugagugaugucacaucuuggcagggguggaggagagccugguugcccagggauuugu

SEQ ID NO: 504908 - RNA, 64 nt, Human
gaagggcugguuuguccgaaaagugagaggaggcggaggagagagccugcgaggucaagcugca

SEQ ID NO: 504909 - RNA, 64 nt, Human
ugucaaggcagcagaaaggagucacccagccaaaggaggagauggcucagcggggcugcaccaa

SEQ ID NO: 504910 - RNA, 64 nt, Human
ggaucgaaucucucagcgaccaggugcugcugcuggaggagaggcuaggugccugugaguccuc

SEQ ID NO: 504911 - RNA, 64 nt, Human
ccagcaacaguagcagccugcucccauuugcuggggaggagaucaucuuguuccccuggccccc

SEQ ID NO: 504912 - RNA, 64 nt, Human
ccccugugauggaaauaaaguguuuagggcagugggaggagaaaauucuccaggugaaugggga

SEQ ID NO: 504913 - RNA, 64 nt, Human
agcagaaccccuccuugucggguagccggaauggggaggagaacaucaucgauaacccuuaucu

SEQ ID NO: 504914 - RNA, 64 nt, Human
aucacucacucacuccccacucccccacccauggggaggagaccuuugaugaauucuuccucuc

SEQ ID NO: 504915 - RNA, 64 nt, Human
cuuguuaacauauaaaguuauaaaugaaggacaaggaggagauggaaaauguguauuuauuguu

SEQ ID NO: 504916 - RNA, 64 nt, Human
aaaugaaacccuccccaaaauacaagaaguucugggaggagacauugucuucagacuacaaugu

SEQ ID NO: 504917 - RNA, 64 nt, Human
cacuuggagaguuugaggaauggaaaugagaaucggaggagaaauaaggccagaggcucacauu

SEQ ID NO: 504918 - RNA, 64 nt, Human
ugacucagcgccucaaaugaagagacugguguggggaggagagagaugcagagagccuuuggaa

SEQ ID NO: 504919 - RNA, 64 nt, Human; identical to SEQ ID NO: 359354

SEQ ID NO: 504920 - RNA, 64 nt, Human; identical to SEQ ID NO: 359355

SEQ ID NO: 504921 - RNA, 64 nt, Human; identical to SEQ ID NO: 359356

SEQ ID NO: 504922 - RNA, 64 nt, Human
uccugucuuuccaaaaguccaaggagcgcgggucggaggagacaaacucuuuggaaauaacccu

SEQ ID NO: 504923 - RNA, 64 nt, Human
gcaugcagacagcccgccccaaagaaaaaucagaggaggagaaauggaaaccccggaacaaugc

SEQ ID NO: 504924 - RNA, 64 nt, Human
ccaugaagacagggucaucgaccaacaacaacgaggaggagaagucccggcuguuggagaagga

SEQ ID NO: 504925 - RNA, 64 nt, Human
ugcgcauugauguacauauuuuccuccagucuggggaggagagagacuggaaacguuccuggac

SEQ ID NO: 504926 - RNA, 64 nt, Human
ggguccucucuaccuuugaaaacucuccugggguggaggagaccagggcaggauagacagaccu

SEQ ID NO: 504927 - RNA, 64 nt, Human
gcuggauguuugugguggggccucauggugccuaggaggagauaaagaugaggagguuuuuccu

SEQ ID NO: 504928 - RNA, 64 nt, Human
acaugugcaaggcugucagcagggacaucguguuggaggagaucaagcucauuagcaagacugg

SEQ ID NO: 504929 - RNA, 64 nt, Human
cucacgaaugccagaggcagugaugucccauccuggaggagaggaaacagugacuaaaagcugg

SEQ ID NO: 504930 - RNA, 64 nt, Human
uuuuugagcuaugagaaaguggaugggagugggaggaggagagaugggugaagacaaaagaguu

SEQ ID NO: 504931 - RNA, 64 nt, Human
uguuauuuucaacuguucuaugcugugacgaugaggaggagaugucuguuggauucaugucuuu

SEQ ID NO: 504932 - RNA, 64 nt, Human
acuuacauuuguggggaagccaacagacacagcaggaggagagggagguggcgcugguggacca

SEQ ID NO: 504933 - RNA, 64 nt, Human
gagauuuugauaucauuuggcuuauaaauccacaggaggagauaauguauggaaaacauuuaaa

SEQ ID NO: 504934 - RNA, 64 nt, Human
uaccacuuuuucagaauuggguuuauugcgagcaggaggagauacuuaaaacaugcacauauac

SEQ ID NO: 504935 - RNA, 64 nt, Human
ggauuaaaaaauauucagaaauguauugggggguggaggagaauaagaggcagagcaagagcua

SEQ ID NO: 504936 - RNA, 64 nt, Human
gcucuguccuuacauguauuugaugugcaucagcggaggagaacacuggcuuggcccugcuccg

SEQ ID NO: 504937 - RNA, 64 nt, Human
gggcuggaugacgggguuggcacuguggcguccaggaggagaugccugguucugcccaaaauaa

SEQ ID NO: 504938 - RNA, 64 nt, Human
uggggaauauguuuugggauguauuauggagcuaaaacucuaaccucuuaauaguuuuauagaa

SEQ ID NO: 504939 - RNA, 64 nt, Human
gccuagucugaaaaauaacaguuugaguucuuugaaacucuaaaauauauuuuucucauaccug

SEQ ID NO: 504940 - RNA, 64 nt, Human
gcauauauauggaauuucuuacuuuuuuucucccaaacucuauuuaauaaacuuauuuuaaugu

SEQ ID NO: 504941 - RNA, 64 nt, Human
aggaagagcacaggcuucaugcacauugcacagaggaggagauucauggggacagcaggcacug

SEQ ID NO: 504942 - RNA, 64 nt, Human
auugcuccuaaagauuauaauuuuaaaagucacaggaggagacaaauugcucacggucaugcca

SEQ ID NO: 504943 - RNA, 64 nt, Human
acuggauggcagcacaaagacaauaugagcagagggaggagaagaaggggugcucaggcugcgg

SEQ ID NO: 504944 - RNA, 64 nt, Human
acuuuauuccaaugcuaauggcagacaccaggaaggaggagaggaaccauuugugcagaucauc

SEQ ID NO: 504945 - RNA, 64 nt, Human
agcccuccuggugggaagacagcuggaaaggcugggaggagaagggaggggcuggggguuccca

SEQ ID NO: 504946 - RNA, 64 nt, Human
auggccugagccucccgaggcuugcugccccguaggaggagacugucuucccgugggcauaucu

SEQ ID NO: 504947 - RNA, 64 nt, Human
acacugagggaaagauuaaaaucuguggaauaaaggaggagauuuuauuuacagauuuuuuuaa

SEQ ID NO: 504948 - RNA, 64 nt, Human
cacgccuguaaucccagcuacucaggaggcugagggaggagaaucccuugaacccgggaggcgg

SEQ ID NO: 504949 - RNA, 64 nt, Human
cgucuacacugucacucagacaccuguggcauguggaggagacugcccuguccugagccuggaa

SEQ ID NO: 504950 - RNA, 64 nt, Human
ggcagaaggaggcugggucccugaaucaccgacuggaggagaguuaccuacaagagccuucauc

SEQ ID NO: 504951 - RNA, 64 nt, Human
uggcccacccccaacaggaauucuauaguaaggaggaggagaaggggggcuccuucccucuccu

SEQ ID NO: 504952 - RNA, 64 nt, Human
ggccacaucuugaaaacucguggaaagggaaaggggaggagaugggacuuugaccacacacagu

SEQ ID NO: 504953 - RNA, 64 nt, Human
cuuggcuaugggauagggaggagggaauuacuagggaggagagaaagggacaaaagcacccugc

SEQ ID NO: 504954 - RNA, 64 nt, Human
cagugggaaggauaagguguccaacagaaaguguggaggagaaacucuuggccuaucaagugcu

SEQ ID NO: 504955 - RNA, 64 nt, Human
ggacaugcugagaggacgaagccaaggaaauuagggaggagagucaaagggaucaaggagaguu

SEQ ID NO: 504956 - RNA, 64 nt, Human
aagugugggcaggaguggagagcuggugcccucaggaggagaccacagcauguccaucagcuca

SEQ ID NO: 504957 - RNA, 64 nt, Human; identical to SEQ ID NO: 359358

SEQ ID NO: 504958 - RNA, 64 nt, Human; identical to SEQ ID NO: 359359

SEQ ID NO: 504959 - RNA, 64 nt, Human; identical to SEQ ID NO: 359360

SEQ ID NO: 504960 - RNA, 64 nt, Human
ugaagauuccaguggucagugucgguggggggugggaggagagagcggcagagaagcucugaga

SEQ ID NO: 504961 - RNA, 64 nt, Human
uguuucacaacacuccuggccaccgagccaugguggaggagaugcagggccaccugaagcgggc

SEQ ID NO: 504962 - RNA, 64 nt, Human
ggaaucuuuucugaaggcuacauggacccgcuggggaggagaggguguuuccucccagaguuac

SEQ ID NO: 504963 - RNA, 64 nt, Human
ucaucaaacaucggaguaguuuaguuguuugacaggaggagaauaaggcugaaagccucaagug

SEQ ID NO: 504964 - RNA, 62 nt, Human
cacucucccugaauaaguaacugcgacccgugggaggagaugccggggaccugggccgcgcu

SEQ ID NO: 504965 - RNA, 64 nt, Human
ggacuuaucuccugcagagauuggagaagguagaggaggagaaagaauccaaagauucucacug

SEQ ID NO: 504966 - RNA, 64 nt, Human
uuaaaaaagauuuuguuuguuuuaagguggagagggaggagaagccugaauuggggagcuuggg

SEQ ID NO: 504967 - RNA, 64 nt, Human
ugaaauccagaccuguuuuugaaaggacagcacaggaggagaaaagugacugggacgaugcuuc

SEQ ID NO: 504968 - RNA, 64 nt, Human
uggcauugaccuaaacggacagagaaaugcacauggaggagaacuacguugaaaucaagauccu

SEQ ID NO: 504969 - RNA, 64 nt, Human
gccacccgaggaagcaguauuaucugcgguggggggaggagauauaggacaggaaaaccacgug

SEQ ID NO: 504970 - RNA, 64 nt, Human
guauauacauauuuuaaauuaugcaagcaaacuaggaggagaaugugcaauuuugagggauacc

SEQ ID NO: 504971 - RNA, 64 nt, Human
ggagacuggguggggaggguuggagacugggcugggaggagagcaagcaggaacagggauggag

SEQ ID NO: 504972 - RNA, 64 nt, Human
aaacggagugaccgccgugaauguagacgcccuaggaggagaacuugaacaaagucucuggguc

SEQ ID NO: 504973 - RNA, 64 nt, Human
cugguuccugggggacugggugggaaggguggugggaggagauaagagauacaaacugagacuc

SEQ ID NO: 504974 - RNA, 64 nt, Human
ccaggugggccaacuggguuucccuggcugggcaggaggagagggcagaggaagacccccucuc

SEQ ID NO: 504975 - RNA, 64 nt, Human
ggagaagaaagaggaaaaagaaguaaaggaguuaggaggagacacuuaaaugaaagauuggcaa

SEQ ID NO: 504976 - RNA, 64 nt, Human; identical to SEQ ID NO: 359361

SEQ ID NO: 504977 - RNA, 64 nt, Human; identical to SEQ ID NO: 359362

SEQ ID NO: 504978 - RNA, 59 nt, Human; identical to SEQ ID NO: 359363

SEQ ID NO: 504979 - RNA, 64 nt, Human
uguguuggcaacacagcgugugcauggggcugcuggaggagagcauuccagagcaguacaucug

SEQ ID NO: 504980 - RNA, 64 nt, Human
gggaggagggggaggaagacaagaaggaagaggaggaggagaaggaagacgaggagcuggacug

SEQ ID NO: 504981 - RNA, 64 nt, Human
ggccugcucagcugcccggagagccgccgccgcuggaggagaccgacuggucgcacucgcagcu

SEQ ID NO: 504982 - RNA, 64 nt, Human
cccaugcauaggagagacucuaacauacuuuagaggaggagaaagagauuccagucaaaauugu

SEQ ID NO: 504983 - RNA, 64 nt, Human
ggucugagacagcagccacugggguugaggagggggaggagaccccugagacccagaggugccc

SEQ ID NO: 504984 - RNA, 64 nt, Human
cauaguuaugugaauagauuagauaaacauaaaaggaggagacauacaaugggggaagaagaag

SEQ ID NO: 504985 - RNA, 64 nt, Human
cagcacauauuugcaugggagggggagaugggugggaggagaugaaaauaucagcuuuucuuau

SEQ ID NO: 504986 - RNA, 64 nt, Human
gauuugaccaaaucgagugauagggauccuggugggaggagagagggcacaucuccagaaaaau

SEQ ID NO: 504987 - RNA, 64 nt, Human
uuuccuuaacaguaaaggguacauaugcauagugggaggagaucagaccuuuacaagugaagga

SEQ ID NO: 504988 - RNA, 64 nt, Human
accccugaaccccacacacucugccaugcacacaggaggagagcuggaccugagggccaccgca

SEQ ID NO: 504989 - RNA, 64 nt, Human
uuuuccauauuggcauguagcuacaaauauuaaaggaggagaaaagguaauauaauuuuagguu

SEQ ID NO: 504990 - RNA, 64 nt, Human
guugcuucuagccuacugagauccaugugacauuggaggagaucuuuuaaauguuuaguauucg

SEQ ID NO: 504991 - RNA, 64 nt, Human
uugcauuaagucuaaacugagaagguaauuacugggaggagaaugagcagcuuugacuuugaca

SEQ ID NO: 504992 - RNA, 64 nt, Human
ggggcaggucuguccggcacagcagcucccucaaggaggagaagagugaggagaaaggaaacuc

SEQ ID NO: 504993 - RNA, 64 nt, Human
gauaucuuuuaugugcaacaguauccuuugcaugggaggagaguuacucuugaaaggcaggcag

SEQ ID NO: 504994 - RNA, 64 nt, Human
uuaugugucuuacaggcuuugauagaaggggaggggaggagagaugcauacccguuucucaacu

SEQ ID NO: 504995 - RNA, 64 nt, Human; identical to SEQ ID NO: 359365

SEQ ID NO: 504996 - RNA, 64 nt, Human; identical to SEQ ID NO: 359366

SEQ ID NO: 504997 - RNA, 64 nt, Human; identical to SEQ ID NO: 359367

SEQ ID NO: 504998 - RNA, 64 nt, Human
cuaaauuuauaaugaucaugaaacccuaggcagaggaggagaaauugaagguccagggcaauga

SEQ ID NO: 504999 - RNA, 64 nt, Human
caaucucauucuggauauguguucauugaguaaaggaggagagacccucauacgcuauuuaaau

SEQ ID NO: 505000 - RNA, 64 nt, Human
gucuuacuuguaacagcguaauuaaacacaucauggaggagagaaacuuaaaauuaaaauagua

SEQ ID NO: 505001 - RNA, 64 nt, Human
uacaauuccaaaaaucaucaugguuggaaauuugggaggagauuauuugugaacuuguuacccu

SEQ ID NO: 505002 - RNA, 64 nt, Human
ccaagcacugaaaauggaaccuggcgaaagcagaggaggagaaugaagaaagauggagucaaac

SEQ ID NO: 505003 - RNA, 64 nt, Human
ugauuuagauuuugauauugauuuagaagacacaggaggagaccaucaaaugaauuaauaucac

SEQ ID NO: 505004 - RNA, 64 nt, Human
cccuuacagagcauacaacagagggggcacccggggaggagagcacauacuguguuccaauuuc

SEQ ID NO: 505005 - RNA, 64 nt, Human
uaccuucccaagcccgcccagugggaugggaggaggaggagaaggggggccuugggccgcugca

SEQ ID NO: 505006 - RNA, 64 nt, Human
gccucucacugugaauuuguggugggcgggggcuggaggagagggugggggacuggcuccgucc

SEQ ID NO: 505007 - RNA, 64 nt, Human
aaguucacugggcuccacccccaccuccaggaggggaggagaggaccugacaucuguagguggc

SEQ ID NO: 505008 - RNA, 64 nt, Human
ucugagacucacgucccccagggcaagugcuuguggaggagagcaagucucaagagcgcaguau

SEQ ID NO: 505009 - RNA, 64 nt, Human
cggccagagggaauguucuggagcugccaaggagggaggagacucggguuggcuaauccccgga

SEQ ID NO: 505010 - RNA, 64 nt, Human
agagcaggggcuguucugcagcaccgcagggaagggaggagagauaccugcugcuuccauugcu

SEQ ID NO: 505011 - RNA, 64 nt, Human
cuuucaggcgggaaugggagggcgggcacagggaggaggagaggaagagaaaaggaagaauuca

SEQ ID NO: 505012 - RNA, 64 nt, Human
acaguucuacaagacugcaggaauucuccuuaagggaggagagcaagcagguguggccccagcu

SEQ ID NO: 505013 - RNA, 64 nt, Human
aucagucccuucauuucuugagacucaacuccugggaggagagggucucaagaguugucccugg

SEQ ID NO: 505014 - RNA, 64 nt, Human; identical to SEQ ID NO: 359368

SEQ ID NO: 505015 - RNA, 64 nt, Human; identical to SEQ ID NO: 359369

SEQ ID NO: 505016 - RNA, 64 nt, Human; identical to SEQ ID NO: 359373

SEQ ID NO: 505017 - RNA, 64 nt, Human
ggcccggugaccacggaacucaccgucugggggaggaggagagaaggaagggguggggggccug

SEQ ID NO: 505018 - RNA, 64 nt, Human
gaguggcccucaccgaggaccggcugccccgccuggaggagauccgcaucuggggaccccucca

SEQ ID NO: 505019 - RNA, 64 nt, Human
gccagggaccgccgcgucgccgauuagaggacgaggaggagagauuccgcacgcaaccgaaagg

SEQ ID NO: 505020 - RNA, 64 nt, Human
caagucuuacuccccaggagcucccagggcccaaggaggagaaugcugccuccuuucagucugg

SEQ ID NO: 505021 - RNA, 64 nt, Human
augccacugguguuaagauauauuuugaguggauggaggagaaauaaacuuauuccuccuuaaa

SEQ ID NO: 505022 - RNA, 64 nt, Human
auucuuaauguguaacuuaaacauacuuugaaguggaggagagucauaagacagaacauuuggc

SEQ ID NO: 505023 - RNA, 64 nt, Human
uaaucaaggccccagaguguguaugcuuccagguggaggagaaaggggaaucucccaaaauuua

SEQ ID NO: 505024 - RNA, 64 nt, Human
aacaccauucuggaaguuuggcugcccacaggcaggaggagaagcaugaagagaaaaccuguuu

SEQ ID NO: 505025 - RNA, 64 nt, Human
uggagacaaugagacauuuaguuaguuguccuacggaggagaggcaguagagucaggcugcagu

SEQ ID NO: 505026 - RNA, 64 nt, Human
gccacacucugcuuucuuccugccauggaccccuggaggagaccuauggagggacaguuuugac

SEQ ID NO: 505027 - RNA, 64 nt, Human
aauggcguggggggaagggggaaggauggagaugggaggagaggguaaaagaauaguacucuga

SEQ ID NO: 505028 - RNA, 64 nt, Human
uuacuguugcagcuugugcugagccugcccaguuggaggagacugggcaccccugccuccugcc

SEQ ID NO: 505029 - RNA, 64 nt, Human
cagacagggagaaguugagcagguaucaacuaggggaggagagagggucuccaguguucccccc

SEQ ID NO: 505030 - RNA, 64 nt, Human
cccagcaaguguauggugggaaggaggccaggacggaggagaugaaguggcggcagugggcgga

SEQ ID NO: 505031 - RNA, 64 nt, Human
ugugggcccacuugccccacugugcuagggcgcgggaggagagagcacuguggucgcccucugc

SEQ ID NO: 505032 - RNA, 64 nt, Human
ugcuuagagcacaggccccucuguugggggauggggaggagagcagucugcccuugggagcgua

SEQ ID NO: 505033 - RNA, 64 nt, Human; identical to SEQ ID NO: 359375

SEQ ID NO: 505034 - RNA, 64 nt, Human; identical to SEQ ID NO: 359376

SEQ ID NO: 505035 - RNA, 64 nt, Human; identical to SEQ ID NO: 359377

SEQ ID NO: 505036 - RNA, 64 nt, Human
ugguggccgaccccaugcagccgccaccaaucgcggaggagauugaccugcugguguucgaccu

SEQ ID NO: 505037 - RNA, 64 nt, Human
ugaccucgagccgaggcccuacuugcagcgcaccggaggagaggcucucuagucugaaggcacc

SEQ ID NO: 505038 - RNA, 64 nt, Human
agagggcugagggugagguguggaagggacagggggaggagaugggcagcauuguugagagauu

SEQ ID NO: 505039 - RNA, 64 nt, Human
caaacuuaaggcaccggcaaguguugucagcacuggaggagaccccgccaguggggugaggcca

SEQ ID NO: 505040 - RNA, 63 nt, Human
cccaagauguaaaaaucugaugguuaaaccaucggaggagaaacucuagacugcaagaacugu

SEQ ID NO: 505041 - RNA, 64 nt, Human
accuuuucagggcuggcuccugauccacuuugggggaggagaacaugaguagauaauuucaggg

SEQ ID NO: 505042 - RNA, 64 nt, Human
agcauuugcuuccucuagacuacagcagggaaagggaggagaaaucugaugucucaacuggcac

SEQ ID NO: 505043 - RNA, 64 nt, Human
accuggccagagcagcccagccccaauaugcuuaggaggagacagaguucccucuguauagccu

SEQ ID NO: 505044 - RNA, 64 nt, Human
guccccuggagaccagaagcugaggcccucucagggaggagacauccaagcaaaucauuuggaa

SEQ ID NO: 505045 - RNA, 64 nt, Human
agggggcagaggcaaaucaccgggcagagggaggggaggagaggaggccgcacucucccugucu

SEQ ID NO: 505046 - RNA, 64 nt, Human
agucauaccuucgaggugguagcaguagauuccaggaggagaaggguacuugcuagguauccug

SEQ ID NO: 505047 - RNA, 64 nt, Human
ccugggaagcgcucuccuagcacguccauuuccaggaggagaagcaagcagaugagagguuuuc

SEQ ID NO: 505048 - RNA, 64 nt, Human
cagcagaagccaagacaggaugcacagcugaauuggaggagaguagcucccuucucacacaaac

SEQ ID NO: 505049 - RNA, 64 nt, Human
cuuccacaggaacggugcuggaccaccuggucggggaggagaccauggcugacuaccugcugua

SEQ ID NO: 505050 - RNA, 64 nt, Human
cuuuacaacuucaggcuaaagggaggggauguugggaggagaaaccaucacaagauucccucgg

SEQ ID NO: 505051 - RNA, 64 nt, Human
ucagugcugaguuggcagagaaacacagggccuaggaggagaaaaguguuccuuguguuuucaa

SEQ ID NO: 505052 - RNA, 64 nt, Human; identical to SEQ ID NO: 359378

SEQ ID NO: 505053 - RNA, 64 nt, Human; identical to SEQ ID NO: 359379

SEQ ID NO: 505054 - RNA, 64 nt, Human; identical to SEQ ID NO: 359380

SEQ ID NO: 505055 - RNA, 64 nt, Human
cuaugaugcagacauggugaauuuaauucaaggaggaggagaauguuuuaggcaggugguuaua

SEQ ID NO: 505056 - RNA, 64 nt, Human
cuguggaauugugauugaaggauuuuaaagcaggggaggagaguagggggcaucucuguacacu

SEQ ID NO: 505057 - RNA, 64 nt, Human
ucuuuuagccugcccuugcauggcgccugcuggaggaggagagagcucugcuggcaugagccac

SEQ ID NO: 505058 - RNA, 64 nt, Human
ggugaagaccucagggucucagaaaguaggcaggggaggagaggguaagggaaagguggagggg

SEQ ID NO: 505059 - RNA, 64 nt, Human
ccucuccgacgacucagugccuaucggcaugcugggaggagacuacuacaggugacgcugcguu

SEQ ID NO: 505060 - RNA, 64 nt, Human
guaucauuaaaguaaagauuuaagucuguauaaaggaggagaguuacugauuggcaaaaaagau

SEQ ID NO: 505061 - RNA, 64 nt, Human
gcucccuuacagaccugguaguuuggggaaaggaggaggagagcccuucagguuugcugaaaag

SEQ ID NO: 505062 - RNA, 64 nt, Human
gauuuauacaguugaaaacuuguaaucuuccccaggaggagaagaagguuucuggagcagugga

SEQ ID NO: 505063 - RNA, 62 nt, Human
aggacuuccugggcccauaggugaagccuucuggaggagaaggugacguggcccagcgucca

SEQ ID NO: 505064 - RNA, 64 nt, Human
agacucagcuccaggcugcuuggcagcccagccuggaggagaaggcuaaugacggaggggcccc

SEQ ID NO: 505065 - RNA, 64 nt, Human
gggagagcagcaagggggaccaggugcgccaucaggaggagagaagcuaaaccuaggggggaca

SEQ ID NO: 505066 - RNA, 64 nt, Human
aagagaagaaggagaaggagaugaaggaggaggaggaggagaaggagaagaagaagaagaagaa

SEQ ID NO: 505067 - RNA, 64 nt, Human
cuugggauuaauaaacaugcacugagaagcaagaggaggagaaaaagaugucuuuuucuuccag

SEQ ID NO: 505068 - RNA, 64 nt, Human
gaaggggcaagggucaaacugacucacucuaccaggaggagaccagguugcaguggcguaaggc

SEQ ID NO: 505069 - RNA, 64 nt, Human
gaggcuugagacuuuccuuugugugguaggacuuggaggagaaauccccuggacuuucacuaac

SEQ ID NO: 505070 - RNA, 64 nt, Human
ucuguccuaccuccacucucugccccuaaagaugggaggagaccagcgguccaugggucuggcc

SEQ ID NO: 505071 - RNA, 64 nt, Human; identical to SEQ ID NO: 503103

SEQ ID NO: 505072 - RNA, 64 nt, Human
gaagaagaagggaaccgauuugaguuggugggcaaaacucuaaaaaucuaaaucugaugcuuau

SEQ ID NO: 505073 - RNA, 64 nt, Human
aaauuauuauucauauagaccacuguaguagauaaaacucuaugguacaccugcuuauguguug

SEQ ID NO: 505074 - RNA, 64 nt, Human
aagucucggcccucucaggcccgcgucucugccuggaggagacuguguaggguccggcgugggg

SEQ ID NO: 505075 - RNA, 64 nt, Human
uuguggcuaggccagccuaggauguggguucuguggaggagaggcgggguaauggggaggcuga

SEQ ID NO: 505076 - RNA, 64 nt, Human
agaaugaugaccagcaccucagaaacuuccagagggaggagaggauuugauggcuaccaaauug

SEQ ID NO: 505077 - RNA, 64 nt, Human
uagccccuuuuaguugguuuuaguugcucuggggggaggagagaagguagagcuguucuuaaau

SEQ ID NO: 505078 - RNA, 64 nt, Human
ggcaucagucuuugguuaccccccagccccaguaggaggagagcaggcagagcuugucaucccc

SEQ ID NO: 505079 - RNA, 64 nt, Human
ggcuguccagugcccauuccucaccuuuucccggggaggagagagcagcuucugccacuuccca

SEQ ID NO: 505080 - RNA, 59 nt, Human
ccucuuccgccagaaccugagggugguggggaggagaagguuguaggcauggaagagag

SEQ ID NO: 505081 - RNA, 64 nt, Human
gugcagaugagcagucacacuguuacuccacagcggaggagaccagcucagaggcccaggaauc

SEQ ID NO: 505082 - RNA, 64 nt, Human
agacgaggggcuuccucuagagucucacugcuggggaggagaggacugggccugauggaaguua

SEQ ID NO: 505083 - RNA, 64 nt, Human
gcuagucuuaucuggccugguuauuuccuugcggggaggagaggguuugcuaaucugcucccag

SEQ ID NO: 505084 - RNA, 64 nt, Human
guuuguucuacauggcuuugauaauuguuugaggggaggagauggaaacaauguggagucuccc

SEQ ID NO: 505085 - RNA, 64 nt, Human
cucggcuuuguagagccccgcucaggcacagggaggaggagaugccagggcuccugccuuuugc

SEQ ID NO: 505086 - RNA, 64 nt, Human
uguuuucuuggguggggagcagggacgggcggagggaggagagcagguuucagauccuuacuug

SEQ ID NO: 505087 - RNA, 64 nt, Human
ucuguuuguaacucaucauagaaacauuguggugggaggagaggggauagucuacagcuaauga

SEQ ID NO: 505088 - RNA, 64 nt, Human
gccuaggccaaagcuagcccaaggcuggggaaggggaggagacuccaggucagaaugugagguc

SEQ ID NO: 505089 - RNA, 63 nt, Human
ugcaguuuguguuggccuaaggcuguggggaggggaggagaacugcucacuccuuuucccucc

SEQ ID NO: 505090 - RNA, 64 nt, Human; identical to SEQ ID NO: 359382

SEQ ID NO: 505091 - RNA, 64 nt, Human; identical to SEQ ID NO: 359383

SEQ ID NO: 505092 - RNA, 64 nt, Human; identical to SEQ ID NO: 359384

SEQ ID NO: 505093 - RNA, 64 nt, Human
ccuagagggguugagccuucuuccuccuuggguuggaggagaccagggugccucuuaucuccuu

SEQ ID NO: 505094 - RNA, 64 nt, Human
accauagccaguuuccagaugggccacagacuggggaggagaaucaguggcccagccagaaguu

SEQ ID NO: 505095 - RNA, 64 nt, Human
gucuauaaugaaugauauagaaggugguuucgaaggaggagacuccagacaaggaaaacagaaa

SEQ ID NO: 505096 - RNA, 64 nt, Human
aaaacaaaaaugcaucuaugugguugaaaguuugggaggagauucaccaauaucugaggagaag

SEQ ID NO: 505097 - RNA, 64 nt, Human
gguugggcaugcugugguugcugagggaugagggggaggagagagguaggagcuggagaugaag

SEQ ID NO: 505098 - RNA, 64 nt, Human
caugcuuccuggggccuccagcagcuccacuaauggaggagaggcaguagccuccgacacagaa

SEQ ID NO: 505099 - RNA, 64 nt, Human
caggacugcagagcagauggcagaugcacauguuggaggagagagccuugggagccacugccac

SEQ ID NO: 505100 - RNA, 64 nt, Human
cggauuucaugucccugugacugguggggcccauggaggagacaggaagccucaaguuccagug

SEQ ID NO: 505101 - RNA, 64 nt, Human
accacggccuggaggagggagguugugguuggauggaggagaugaucuugucuggaagucuaga

SEQ ID NO: 505102 - RNA, 64 nt, Human
ugcaaguaggcuuugaggggugaaggagauugguggaggagaguaaauaaucuagaggcaagag

SEQ ID NO: 505103 - RNA, 64 nt, Human
cucacugccuauaagaggaaauaagagagaaaguggaggagagggacaaaaggaguaauuauuu

SEQ ID NO: 505104 - RNA, 64 nt, Human
gagguuauuccuaaaccuauuuauuugguguuuuggaggagaucacacacuaagagaacguuga

SEQ ID NO: 505105 - RNA, 64 nt, Human
cugugccacccucagagaagaagaaaggagcugaggaggagaagccaaagaggaggaggcagga

SEQ ID NO: 505106 - RNA, 64 nt, Human
gucugcggggauccuguuacaaaggugaaacccaggaggagaguguggaguccagagugcugcc

SEQ ID NO: 505107 - RNA, 64 nt, Human
acauacugcuccaccgcugaacuucgggugccggggaggagaaauugggcugaugugagcuccc

SEQ ID NO: 505108 - RNA, 64 nt, Human
ggagggugggcaaggcugggagggauaucaacuuggaggagaacaccuagacccaaggacuuuu

SEQ ID NO: 505109 - RNA, 64 nt, Human; identical to SEQ ID NO: 359337

SEQ ID NO: 505110 - RNA, 64 nt, Human; identical to SEQ ID NO: 359338

SEQ ID NO: 505111 - RNA, 64 nt, Human; identical to SEQ ID NO: 359339

SEQ ID NO: 505112 - RNA, 64 nt, Human
uuuucauaaauuaaucuggguguuggggguagugggaggagaacggucagaaucaaagugacau

SEQ ID NO: 505113 - RNA, 64 nt, Human
accagggauugcaggccccaucuccaggcuaaggggaggagagcaucaucacuuuccauuagcu

SEQ ID NO: 505114 - RNA, 64 nt, Human
gggagauggugaggggugccagugaggggugcguggaggagaggccugggcuccucuacuggau

SEQ ID NO: 505115 - RNA, 64 nt, Human
caaggucccuacucuuguggaguuuacuucugguggaggagacagaugauaaguaaacaaauaa

SEQ ID NO: 505116 - RNA, 64 nt, Human
aggccuuuccgcggugggauguugagcugaggccggaggagaaguagcagucgcuggcagagca

SEQ ID NO: 505117 - RNA, 64 nt, Human
ccuccccuguccaggucccgcucccgguccccucggaggagagcccacuccccugagagacgga

SEQ ID NO: 505118 - RNA, 64 nt, Human
ugaggcgaaguacccaugaagcugcccagacuugggaggagaagaguaucggugcccaugguga

SEQ ID NO: 505119 - RNA, 64 nt, Human
augauuuugaggacgacugugacagccugacuugggaggagacugaggagacccugcugcuuug

SEQ ID NO: 505120 - RNA, 64 nt, Human
agagugaggggccccgccagcccgauggggaugaggaggagagcacagcccucagcaucaacga

SEQ ID NO: 505121 - RNA, 64 nt, Human
auuuccuacaguguuguucccucccucaaggcugggaggagauaaacaccaacccaggaauucu

SEQ ID NO: 505122 - RNA, 64 nt, Human
acaaagggggguggggcuuuaagagugaaggugaggaggagaucacacaccguauguguuugcu

SEQ ID NO: 505123 - RNA, 64 nt, Human
aaguucuucaguccugagcccuacaugugggguuggaggagaacuauaacggaaaaaccucuga

SEQ ID NO: 505124 - RNA, 64 nt, Human
caggacagacugagcuuucuguugcaaauaccuuggaggagaaaguaauuucuaaauauacaga

SEQ ID NO: 505125 - RNA, 64 nt, Human
ugagccgcaucuucuccaucuggcagggugggauggaggagaagaauuuucagaccccagcggc

SEQ ID NO: 505126 - RNA, 64 nt, Human
uugugcauaugaagggagauggggguuagguggaggaggagagcagcgugguuagcuaagguua

SEQ ID NO: 505127 - RNA, 64 nt, Human
agaaaagaaaucuuuggggcacugcaucuguuuuggaggagaugagaucagaacucuggggaaa

SEQ ID NO: 505128 - RNA, 64 nt, Human; identical to SEQ ID NO: 359282

SEQ ID NO: 505129 - RNA, 64 nt, Human; identical to SEQ ID NO: 359283

SEQ ID NO: 505130 - RNA, 64 nt, Human; identical to SEQ ID NO: 359284

SEQ ID NO: 505131 - RNA, 64 nt, Human
aaggcuccucuggguuugaggguccaagggacaaggaggagaagccuagcaggauuucagaugc

SEQ ID NO: 505132 - RNA, 64 nt, Human
ugaaauguugaggguggggagaaaagacuuuaagggaggagagccaucuauuuuguuccuaaag

SEQ ID NO: 505133 - RNA, 64 nt, Human
uucagaagaaaauaaaagcauuuaauugccaaugggaggagaagcccauacugcuacuauaacu

SEQ ID NO: 505134 - RNA, 64 nt, Human
cauccuaacuuuuccccuacucuugccauagagaggaggagaagaaacuaaccaacaugcagca

SEQ ID NO: 505135 - RNA, 64 nt, Human
gaaggcaaggccugaagaugggagauuccuaaguggaggagaacugugccuuacugaccuaaau

SEQ ID NO: 505136 - RNA, 64 nt, Human
ggcaggcggccccacccugcacugguccaaggucggaggagacaggggaugaggaaggccucag

SEQ ID NO: 505137 - RNA, 64 nt, Human
uagaauucugaacuuuaucuguucuguuucugugggaggagaaggggaaguauguuuugggggg

SEQ ID NO: 505138 - RNA, 64 nt, Human
uccagaaugcccuggccagagcgagcaacacggcggaggagaccaucagugccaugaagacugu

SEQ ID NO: 505139 - RNA, 64 nt, Human
cugcagcgugucuccuggcacgcugggcccuccgggaggagagcugcagauuucgaguaugucg

SEQ ID NO: 505140 - RNA, 64 nt, Human
ucauagguuugaacagugggagauaccagaggugggaggagaaaaaguuauuuauuaccguucc

SEQ ID NO: 505141 - RNA, 64 nt, Human
ucagucuuuggagacccagcugccuuuguggaagggaggagacggucaugacacaaagcuuuau

SEQ ID NO: 505142 - RNA, 64 nt, Human
uaugagaggcugacaaacaucaggggacaucuggggaggagaucccugucaugucucuugugcc

SEQ ID NO: 505143 - RNA, 64 nt, Human
cucccucccggugagcugcugcccugggcagaggggaggagaauuccaggacaagagugucaag

SEQ ID NO: 505144 - RNA, 64 nt, Human
ucacacagguuugugaucuaagugccagaaccauggaggagacucuggccuuaucuguagggac

SEQ ID NO: 505145 - RNA, 64 nt, Human
ugugaaaaauuuuauuuucggcguugcaaugcggggaggagaagucagauuauguacauaguuu

SEQ ID NO: 505146 - RNA, 64 nt, Human
gagggcagcucugcaguugggaggggcaccguccggaggagaccaggccucuacacacccccca

SEQ ID NO: 505147 - RNA, 64 nt, Human; identical to SEQ ID NO: 359285

SEQ ID NO: 505148 - RNA, 64 nt, Human; identical to SEQ ID NO: 359286

SEQ ID NO: 505149 - RNA, 64 nt, Human; identical to SEQ ID NO: 359287

SEQ ID NO: 505150 - RNA, 64 nt, Human
gagcaaauguccucuucuccuugcugcuagagugggaggagaaagaugucuugccuuaaaaguu

SEQ ID NO: 505151 - RNA, 60 nt, Human
uuguguuucuguccucaagaucugcccccuggaggagaagacgagcgucuuaccgaauuc

SEQ ID NO: 505152 - RNA, 64 nt, Human
auacaaaauggacuaaauaauuuuaagagauaguggaggagaggggguacagacuuccuucuua

SEQ ID NO: 505153 - RNA, 64 nt, Human
auaaauguaauugccauuuuucaaagauuaaguaggaggagagggguuucuugcucuccagagc

SEQ ID NO: 505154 - RNA, 64 nt, Human
augguauuccccuuacuaaaaaaaguguguauuaggaggagagagaggaaaaaaagaggaaaga

SEQ ID NO: 505155 - RNA, 64 nt, Human
ucugccuacaaaucagggguaaaaauaccuguugggaggagaaaugagaacauagaggaaagcc

SEQ ID NO: 505156 - RNA, 64 nt, Human
gccuugaaguaguugaucuaauaaaugagagcagggaggagauucauugacucugaaaugauuu

SEQ ID NO: 505157 - RNA, 64 nt, Human
gaagcacaggccaggggaucugggugugugagugggaggagagggcagagguccccugagguca

SEQ ID NO: 505158 - RNA, 64 nt, Human
cugcagagaaacgcgcuccuuggcggacacugggggaggagaggaagaagcgcggcuaacuuau

SEQ ID NO: 505159 - RNA, 64 nt, Human
gcagccaguguugguggagcugccucuagcacauggaggagagugaaagucagccugccccucu

SEQ ID NO: 505160 - RNA, 64 nt, Human
gaaugaccuuugacuugcaugcucaacagggaguggaggagaggagacaaggcucuggacagcc

SEQ ID NO: 505161 - RNA, 64 nt, Human
cuuaacauaggaucauuuggaacaggaguucugaggaggagagagugaggguuuugcuauugac

SEQ ID NO: 505162 - RNA, 64 nt, Human
ccccacuccagugcugcccacacucccagcugcuggaggagaggggagaugccaaggugcccug

SEQ ID NO: 505163 - RNA, 64 nt, Human
uuuuuuuuucaguaaaagggaauauuacaauguuggaggagagauaaguuauagggagcuggau

SEQ ID NO: 505164 - RNA, 64 nt, Human
gugguggggugcagaguuggcaggagugggagaaggaggagagaaaagcugguccucugcaguc

SEQ ID NO: 505165 - RNA, 64 nt, Human
cuucagcaggggaugaggaugaggaugaauccggggaggagaggcugcccuccugcuuugacua

SEQ ID NO: 505166 - RNA, 64 nt, Human; identical to SEQ ID NO: 359289

SEQ ID NO: 505167 - RNA, 64 nt, Human; identical to SEQ ID NO: 359290

SEQ ID NO: 505168 - RNA, 64 nt, Human; identical to SEQ ID NO: 359291

SEQ ID NO: 505169 - RNA, 64 nt, Human
cugccgccgccgccgcccaccagcaggcccugcgggaggagagcggugcgggcgacaagggcug

SEQ ID NO: 505170 - RNA, 64 nt, Human
uuggagaccugcauuugccaacaccuuuuuaaggggaggagagagcacuuaguuucugaacuag

SEQ ID NO: 505171 - RNA, 60 nt, Human
augcuguuccccggagguaacccaccccuuggaggagagagaccccgcacccggcucgug

SEQ ID NO: 505172 - RNA, 64 nt, Human
ggucuucaaaguuaagaguguaagugaaaaaucuggaggagaggauaauuuccacuguguggaa

SEQ ID NO: 505173 - RNA, 64 nt, Human
aaaaauaaagacuagagcaaaauaaugcaacgcaggaggagaaaagaaaugcacuaagacaaga

SEQ ID NO: 505174 - RNA, 64 nt, Human
caucaccucuugugggccuuuggaaauguauguuggaggagacauuuuggauuguugcaaugac

SEQ ID NO: 505175 - RNA, 64 nt, Human
cugccguuccuaauaauuccagguuugguagcguggaggagaacuuugauggaaagagaaccuu

SEQ ID NO: 505176 - RNA, 64 nt, Human
agauggaggaugucaucaggcuggcccagaaggaggaggagaugaagguagggcgugcaacauc

SEQ ID NO: 505177 - RNA, 64 nt, Human
acuccugaacacacccagguggaaccaucuuuggggaggagaggcccgugugaggggucugaua

SEQ ID NO: 505178 - RNA, 64 nt, Human
gggucuuauguuuguuuugccucuucuguuucuuggaggagaguugaggcuuuucuuaggugca

SEQ ID NO: 505179 - RNA, 64 nt, Human
guaaugaacuucuggaucuccagucagauacuauggaggagagagugauggagggcugaggaga

SEQ ID NO: 505180 - RNA, 64 nt, Human
ucuccuggcccugccccuuguuggggaaguugcaggaggagagguggauggcaaugugauuggu

SEQ ID NO: 505181 - RNA, 64 nt, Human
cuaucacgguccggaggacaccuuggauagcacgggaggagaaguugacuuugugaccccuagu

SEQ ID NO: 505182 - RNA, 64 nt, Human
acacucgacccagucuaaagugggugccauucacggaggagagggagguuggagacuucaaccg

SEQ ID NO: 505183 - RNA, 64 nt, Human
ucagacaggccuccacggcuauggagagaaggcuggaggagacacaauggaugguucauguucu

SEQ ID NO: 505184 - RNA, 64 nt, Human
guuucuggagagcacguuuucuucauugauaaguggaggagaaaugcagcacagcuuucaagau

SEQ ID NO: 505185 - RNA, 64 nt, Human; identical to SEQ ID NO: 359292

SEQ ID NO: 505186 - RNA, 64 nt, Human; identical to SEQ ID NO: 359293

SEQ ID NO: 505187 - RNA, 64 nt, Human; identical to SEQ ID NO: 359297

SEQ ID NO: 505188 - RNA, 64 nt, Human
ggaacgugcugacugggacucccagcuggagcugggaggagagguccacuucccuuagaacacc

SEQ ID NO: 505189 - RNA, 64 nt, Human
uuugcaaaggugccauaugggcucacagcacccuggaggagaagggccucaaacugugcaugua

SEQ ID NO: 505190 - RNA, 64 nt, Human
gcucaagccauggcaggcguggcaagcaaaguggggaggagacagucccugcuugugacaagug

SEQ ID NO: 505191 - RNA, 64 nt, Human
acaggagaaugauggaaggaagggaggaaggaaaggaggagaaaaaugugucuucagcuggcag

SEQ ID NO: 505192 - RNA, 64 nt, Human
agaaugaguacauaagcaggcuggcucaggacaaggaggagaugaagguagggcgugcaacauc

SEQ ID NO: 505193 - RNA, 64 nt, Human
gcuguuccuugaaaauguguuguugcuguguccuggaggagacaugaguuccgagaugacccaa

SEQ ID NO: 505194 - RNA, 64 nt, Human
cacaagaucacccuuccuggacgggacuauugaaggaggagaaugggagagccuccccugggcc

SEQ ID NO: 505195 - RNA, 64 nt, Human
cccagcgcugagcugggugcacggugugauuccaggaggagagccaggccugcccugcccugcu

SEQ ID NO: 505196 - RNA, 64 nt, Human
ggggaaagccuuggguguaaaucaguguaaacuuggaggagagauuuuucuaucauguagagua

SEQ ID NO: 505197 - RNA, 64 nt, Human
cucaugccucgagcuuggcaaccgaaaacccgagggaggagaagggaccugccuugugacaucu

SEQ ID NO: 505198 - RNA, 64 nt, Human
auggcaccuaacugcaggcgggcguggucagcugggaggagagcugugcccagcccaaccggcc

SEQ ID NO: 505199 - RNA, 64 nt, Human
agaggagaccagucaguacuucuuggagggggcaggaggagagaggaaaagggagggcgagaau

SEQ ID NO: 505200 - RNA, 64 nt, Human
ugaguugaugucacuuagguccagggcaucccugggaggagagaguagugacacucaggaucca

SEQ ID NO: 505201 - RNA, 64 nt, Human
cuaagauacagacccccccaacuccccaaagcggggaggagauauuuauuuuggggagaguuug

SEQ ID NO: 505202 - RNA, 64 nt, Human
acuggaacagccccacuggagucaaggcuccgagggaggagagaggggcucgggaagggagcug

SEQ ID NO: 505203 - RNA, 64 nt, Human
acucuuuugguaaccagacaccaaucaaauaaggggaggagacgaaaauggaaugauuucuucc

SEQ ID NO: 505204 - RNA, 64 nt, Human; identical to SEQ ID NO: 359299

SEQ ID NO: 505205 - RNA, 64 nt, Human; identical to SEQ ID NO: 359300

SEQ ID NO: 505206 - RNA, 64 nt, Human; identical to SEQ ID NO: 359301

SEQ ID NO: 505207 - RNA, 64 nt, Human
ugccgagccagaagccgaagccacuugcccuccuggaggagaccugcaagcucccugagcggug

SEQ ID NO: 505208 - RNA, 64 nt, Human
uggaggucuacgcagaugccgacgaaauccuccaggaggagaucaaggaguacaagguggggcu

SEQ ID NO: 505209 - RNA, 58 nt, Human
aacacuggcuggccaucugagccugccuggaggagaaggaggaacccccaugccaaug

SEQ ID NO: 505210 - RNA, 64 nt, Human
gggaaagcauccaaauuuaaagggcugguacauaggaggagagaaaauggggaugccaagaauu

SEQ ID NO: 505211 - RNA, 64 nt, Human
gcccagggcagaccuucagggccagagcccuggcggaggagaggcccuuugccaggagcacagc

SEQ ID NO: 505212 - RNA, 64 nt, Human
gcaaagcccucacucaccuucuggucucagcaagggaggagagucuguugcuggcauagcccug

SEQ ID NO: 505213 - RNA, 64 nt, Human
cuccccuccagcucccugugcccccaggguccugggaggagagacacugguggggauaggccag

SEQ ID NO: 505214 - RNA, 64 nt, Human
uccccacagugaccugacugggggugagggagaaggaggagagagcccauguguggugugugug

SEQ ID NO: 505215 - RNA, 64 nt, Human
uggcagcagccccaccccgagcgcacacugugauggaggagacugagcucccuggggcgggcag

SEQ ID NO: 505216 - RNA, 64 nt, Human
cuagguucacauccagggcugugucuuccuugggggaggagauggugucguuuagaucagggua

SEQ ID NO: 505217 - RNA, 64 nt, Human
uaacuagccgagagaugcugccucuaggcagagaggaggagagguguugccggcuggagggcca

SEQ ID NO: 505218 - RNA, 64 nt, Human
cacauguucuugccauccucuuuccuggcucuguggaggagaaccaccugcaggacccucaccc

SEQ ID NO: 505219 - RNA, 64 nt, Human
gaagucaugaaugucugggaguuuuucuguguggggaggagacagagacccauaacuaaauaug

SEQ ID NO: 505220 - RNA, 64 nt, Human
cggcaggacauuucuuaaccauggggcugugaugggaggagaggagaggcugggaaagccgggu

SEQ ID NO: 505221 - RNA, 64 nt, Human
uugggggcaccaucuggacggggaugguuccccaggaggagacccuccccugccuccgaggccu

SEQ ID NO: 505222 - RNA, 64 nt, Human
cuacuaugcuuagguguuggacaggauagggguaggaggagaggaggcaggcugcuguccugaa

SEQ ID NO: 505223 - RNA, 64 nt, Human; identical to SEQ ID NO: 359302

SEQ ID NO: 505224 - RNA, 64 nt, Human; identical to SEQ ID NO: 359303

SEQ ID NO: 505225 - RNA, 64 nt, Human; identical to SEQ ID NO: 359304

SEQ ID NO: 505226 - RNA, 64 nt, Human
aacagggaggaggucggauuaggggagguucagaggaggagaaugucucaaaaaaaaaggacaa

SEQ ID NO: 505227 - RNA, 64 nt, Human
ccgagcgugugccacuggaccucaguccucgccuggaggagacgcuggacuucggcgaggugga

SEQ ID NO: 505228 - RNA, 64 nt, Human
guggggaagcugaauguugagggagguggaggaaggaggagaugagcagugucaguaaauacug

SEQ ID NO: 505229 - RNA, 64 nt, Human
ucccugggccccugaggaaauaagcagcuggucuggaggagaggacugcaauccauggcgaaaa

SEQ ID NO: 505230 - RNA, 64 nt, Human
caagccuggaaggaggcaauaagugggaaagguaggaggagagaaggcuggggagggcugggca

SEQ ID NO: 505231 - RNA, 64 nt, Human
ugucugaaaucacauggugagaaggaggaugaagggaggagagagcuuuugcucugggucucca

SEQ ID NO: 505232 - RNA, 64 nt, Human
guggaggccacaguuguagcaggcgcuaggcccgggaggagagugcauggugcagagggggcug

SEQ ID NO: 505233 - RNA, 60 nt, Human
gccccagcugcagcagcugaagaccgcgguggaggagauccacaaugccguaggugaggc

SEQ ID NO: 505234 - RNA, 64 nt, Human
ugaugcggcuggaacaggagcuggcagugggggaggaggagagggaagauggucccugggcacu

SEQ ID NO: 505235 - RNA, 64 nt, Human
gcagagcacagagcaggagaagggcuugggcccuggaggagaaagccauucuggacaccagggg

SEQ ID NO: 505236 - RNA, 64 nt, Human
cacuuccagcccacccgggcagugcugagagggaggaggagaacaaggauggcccagccucccc

SEQ ID NO: 505237 - RNA, 64 nt, Human
gcugaaaagggcacucccaacccugggcuggggaggaggagagagucccagagcucaucccccc

SEQ ID NO: 505238 - RNA, 64 nt, Human
gaagggggaggaauagaaaaagacaaacugccuuggaggagauaaaccaauuuuaugucuauca

SEQ ID NO: 505239 - RNA, 64 nt, Human
gagaccucccuucagccugagccaagcugcauugggaggagaaggcagggugagggaucuggga

SEQ ID NO: 505240 - RNA, 64 nt, Human
cucuccccaaaccccuuuagauggggagggaagaggaggagaggggaggggaccugcccccucc

SEQ ID NO: 505241 - RNA, 64 nt, Human
ggcacugaggaugcuguucucaguuugacuguggggaggagagagaaugggguacuagcacccc

SEQ ID NO: 505242 - RNA, 64 nt, Human; identical to SEQ ID NO: 359385

SEQ ID NO: 505243 - RNA, 64 nt, Human; identical to SEQ ID NO: 359386

SEQ ID NO: 505244 - RNA, 64 nt, Human; identical to SEQ ID NO: 359387

SEQ ID NO: 505245 - RNA, 64 nt, Human
cagagagaggagacgaagaguuugggacagugggggaggagaugggaagggaugggauuucugg

SEQ ID NO: 505246 - RNA, 64 nt, Human
uggguggcauauuggggaccugggaaugugugaaggaggagaucaaauuucaguggcuuuggac

SEQ ID NO: 505247 - RNA, 64 nt, Human
ugugcuuaucuaaaucuuggaacuuugagcuaggggaggagaauguauuagacuaaauacaaac

SEQ ID NO: 505248 - RNA, 64 nt, Human
uucccccaucuucaucccaacagcccagcaagaaggaggagacagagagcuccucccuggguug

SEQ ID NO: 505249 - RNA, 64 nt, Human
ccagccuccucaaccucuuggggccccgugauggggaggagagggcaggugcggggaggcucug

SEQ ID NO: 505250 - RNA, 64 nt, Human
uaagaguuguucaguaugcaaaacuuggaaagauggaggagaaaaagaaaaggaagaaaaaaau

SEQ ID NO: 505251 - RNA, 64 nt, Human
gaguuuccuggaugcuaauuucacacuuucgguuggaggagaucuccauuguuccuaccccucc

SEQ ID NO: 505252 - RNA, 64 nt, Human
uucccuguucugcccacucuggggaauagggaggggaggagaggagaggagagggaggauccug

SEQ ID NO: 505253 - RNA, 64 nt, Human
uugcaacacacagacacacgcacacacacacacaggaggagaaaucucacuuuucuccaugagu

SEQ ID NO: 505254 - RNA, 64 nt, Human
ugacagaggcgaaggcagauggggcacugacccaggaggagaaagcagccauuggcacugugag

SEQ ID NO: 505255 - RNA, 64 nt, Human
caagguuuugaugacaauuagggccaaaauuuuaggaggagauguaggaugcaggagaaaauua

SEQ ID NO: 505256 - RNA, 64 nt, Human
uuuugcuggcacugaucuggagaucugcagaucuggaggagacgggaaggagucgauucuuaaa

SEQ ID NO: 505257 - RNA, 64 nt, Human
ccccaucucacagacaaggaaacugaggccagagggaggagagaauugcucauggcuccagaac

SEQ ID NO: 505258 - RNA, 64 nt, Human
uuggcccaccgcagaucuguagccagucagaggaggaggagaaggagccccucagcagaguggu

SEQ ID NO: 505259 - RNA, 64 nt, Human
ggcugcagggccuguccacagcuccuguggggguggaggagacuccucuggagaagggugagaa

SEQ ID NO: 505260 - RNA, 64 nt, Human
gccaaggcccucgucaaacccugagucaugacugggaggagaaggagcaggaucagacgguaga

SEQ ID NO: 505261 - RNA, 64 nt, Human; identical to SEQ ID NO: 359306

SEQ ID NO: 505262 - RNA, 64 nt, Human; identical to SEQ ID NO: 359307

SEQ ID NO: 505263 - RNA, 64 nt, Human; identical to SEQ ID NO: 359308

SEQ ID NO: 505264 - RNA, 64 nt, Human
cccuuccccguccccugcagccugggucuggaugggaggagagccacugggccccuguccccag

SEQ ID NO: 505265 - RNA, 64 nt, Human
aaggccacuacauugaggaggggggaggggggagggaggagaaggguuacuugcugcucacacu

SEQ ID NO: 505266 - RNA, 64 nt, Human
gagacagcucucucucccaccuccuccccagaugggaggagagccugaggcccaagcaggaccc

SEQ ID NO: 505267 - RNA, 64 nt, Human
cugcugucccuccaccuccuguauauaccaccuaggaggagaugccaccaagcccucaagaagu

SEQ ID NO: 505268 - RNA, 64 nt, Human
acucuagguugcuggguccauggggaggauugggggaggagaagcagugccuucccucucgugu

SEQ ID NO: 505269 - RNA, 64 nt, Human
ggauaaauaaaggcaaagacugaagacaaacaugggaggagaagugacuggaaaagaacuggug

SEQ ID NO: 505270 - RNA, 64 nt, Human
cucuguucaguuugacaugaaauuggcugaugugggaggagaucuuaagcaugucaugucugau

SEQ ID NO: 505271 - RNA, 64 nt, Human
ugacaugcacucagcucuuggcuccacugggaugggaggagaggacaagggaaaugucaggggc

SEQ ID NO: 505272 - RNA, 64 nt, Human
uuuccuuuuuucuuuggcauucucuggaaugcaaggaggagacuucauuuacuucccaauaaac

SEQ ID NO: 505273 - RNA, 64 nt, Human
cuggcguccccucccucugucuucagcacccagaggaggagagagccggcaguucccugcagga

SEQ ID NO: 505274 - RNA, 64 nt, Human
cuugaaaaguucagggaccguccaggggagauggggaggagauauggagugagucaccugcucc

SEQ ID NO: 505275 - RNA, 64 nt, Human
gacauguggcuguuugaauaagagaaggacaaagggaggagaaagcacaugugcuccagugagu

SEQ ID NO: 505276 - RNA, 64 nt, Human
ugaguugggggaugggauccuagguagggccaggggaggagacccauaaauguucccuuggggg

SEQ ID NO: 505277 - RNA, 64 nt, Human
gagauccccuuccuugcugagaggguugggggcaggaggagauuuggcagugccugcagguugc

SEQ ID NO: 505278 - RNA, 64 nt, Human
cagcccagcccgcccagccccagguggguaguggggaggagagcuggcauuccuccagguggca

SEQ ID NO: 505279 - RNA, 64 nt, Human
cuugugaauuuuucuaaaggugcuauuuaacaugggaggagagcgugugcggcuccagcccagc

SEQ ID NO: 505280 - RNA, 64 nt, Human; identical to SEQ ID NO: 359309

SEQ ID NO: 505281 - RNA, 64 nt, Human; identical to SEQ ID NO: 359310

SEQ ID NO: 505282 - RNA, 64 nt, Human; identical to SEQ ID NO: 359311

SEQ ID NO: 505283 - RNA, 64 nt, Human
augccgggggagccaccagccccucacuggguucggaggagagucaggaagggccacgacaaag

SEQ ID NO: 505284 - RNA, 64 nt, Human
cucccgaaguggaccacaagaaacgcaaaauccgggaggagauugagcauuuuggaaucaagau

SEQ ID NO: 505285 - RNA, 64 nt, Human
uggggccaucagaaaugucuuuucaucuuuuucuggaggagacgaaugauagggccugguuuac

SEQ ID NO: 505286 - RNA, 64 nt, Human
ccauucccacacaugugcccagaguagggggcauggaggagauggucccuguccuacugcagga

SEQ ID NO: 505287 - RNA, 64 nt, Human
ccuuccuguaccuggguggauggagcgggaggauggaggagacgggacaucuuucaccucaggc

SEQ ID NO: 505288 - RNA, 64 nt, Human
aagagaaaagaugaaugcuggguggguguguccaggaggagagcaggggagagagugagcguga

SEQ ID NO: 505289 - RNA, 64 nt, Human
ggccguccugggaugguacccugugcucucccguggaggagaggggauggcugaggacacuggc

SEQ ID NO: 505290 - RNA, 64 nt, Human
ggcccccaacccccaggcagcccggcagaggacgggaggagaccagucccccacccagccguac

SEQ ID NO: 505291 - RNA, 64 nt, Human
cacgugaccccagccaaucgggacaguucaaggaggaggagaccccuauuacacagguuggaau

SEQ ID NO: 505292 - RNA, 64 nt, Human
ucaucaggcuccuggagguggacguguaugaugaggaggagaucaacaccggugagugcugagc

SEQ ID NO: 505293 - RNA, 64 nt, Human
aaagcagggaggaagggagaccacugugucaccuggaggagaagucaucucaugacaacagaag

SEQ ID NO: 505294 - RNA, 64 nt, Human
uucgccacgcaugugaccugggauagcuuucgggggaggagagaccuuccucuccugcggacuu

SEQ ID NO: 505295 - RNA, 64 nt, Human
cuuaguuaguaugcugauaaauguaagauuaguaggaggagaagugaauguaaauuuuauuaua

SEQ ID NO: 505296 - RNA, 64 nt, Human
gggucccugccuccgcucugccccuggguggcugggaggagaggcccucucgggggugaccugg

SEQ ID NO: 505297 - RNA, 64 nt, Human
gggcagagucguuggagacugaagaggaagaggaggaggagaaggggagugagcggccgccccc

SEQ ID NO: 505298 - RNA, 64 nt, Human
cgcugccgaguccgggccggggccucugcccgcgggaggagauuuuuuuuuuucauauuuuuaa

SEQ ID NO: 505299 - RNA, 64 nt, Human; identical to SEQ ID NO: 359316

SEQ ID NO: 505300 - RNA, 64 nt, Human; identical to SEQ ID NO: 359317

SEQ ID NO: 505301 - RNA, 64 nt, Human; identical to SEQ ID NO: 359318

SEQ ID NO: 505302 - RNA, 64 nt, Human
uuguuucuucuuuuccuugucuuugaacuuccuuggaggagagcuugggagacgucccggggcc

SEQ ID NO: 505303 - RNA, 64 nt, Human
ggggacucuuucagcccucgcgcccgcccguuugggaggagaagucucuaugcaauuggccccg

SEQ ID NO: 505304 - RNA, 64 nt, Human
cccaccuuagcugucuccugccccagggagggauggaggagauaauuugcuuauauuaaaaaca

SEQ ID NO: 505305 - RNA, 64 nt, Human
uuauuguacuuggugggguguuuggggugggggcggaggagagcuuguucucgugggguugucg

SEQ ID NO: 505306 - RNA, 64 nt, Human
agguccuggggcgugcacccgcccugggcaguggggaggagaguggccugaguuacuucacccc

SEQ ID NO: 505307 - RNA, 64 nt, Human
ggacuacugugcuuccggaggcucccuguguccuggaggagaaaagcauuagagggggcagcug

SEQ ID NO: 505308 - RNA, 64 nt, Human
gacagaugcagggaugugugcugcagggcugcugggaggagaguggugggggccugagggcuga

SEQ ID NO: 505309 - RNA, 64 nt, Human
gguguggagggcucugucuguugcugaggaccaaggaggagaagagaccuuugcugccccauca

SEQ ID NO: 505310 - RNA, 64 nt, Human
aggugaugccugccucagccagggagggcuuccuggaggagaaggagccagcuagacauggaua

SEQ ID NO: 505311 - RNA, 64 nt, Human
acaugggggagagagacuuggaagaggaggaggaggaggagaaggaggagagagaggggaagag

SEQ ID NO: 505312 - RNA, 64 nt, Human
agagagacuuggaagaggaggaggaggaggagaaggaggagagagaggggaagagacaaagugg

SEQ ID NO: 505313 - RNA, 64 nt, Human
cuaaggagagcaugagagaaggcuggcauuggcaggaggagagcaccaggacgaggaugggaag

SEQ ID NO: 505314 - RNA, 64 nt, Human
ucucccucucuccgcaguuccuucccuggcugccggaggagaccccacuaacccagccugccug

SEQ ID NO: 505315 - RNA, 64 nt, Human
ucuucagcgggaaaguggagcugguggaggggagggaggagacaucucccucuuugucagauac

SEQ ID NO: 505316 - RNA, 64 nt, Human
aaugugcuauuucuuuauucaguauaauagcacuggaggagacugugguagccaucuucguaaa

SEQ ID NO: 505317 - RNA, 64 nt, Human
guugagacauaucuguccaugucugucuaaaaggggaggagaugagggagaaaaaagggaaucu

SEQ ID NO: 505318 - RNA, 64 nt, Human; identical to SEQ ID NO: 359253

SEQ ID NO: 505319 - RNA, 64 nt, Human; identical to SEQ ID NO: 359254

SEQ ID NO: 505320 - RNA, 64 nt, Human; identical to SEQ ID NO: 357246

SEQ ID NO: 505321 - RNA, 64 nt, Human
ccauggugcaggucucugagcaaggcggagguguggaggagaggccggcuugggguggggccuc

SEQ ID NO: 505322 - RNA, 64 nt, Human
aagcaagccccccaggcccagcccacgugcagagggaggagaaugagguucuguguuuugaagg

SEQ ID NO: 505323 - RNA, 64 nt, Human
gccagcugacguuggagagccagccagacuccucggaggagaagucagcauuuuugaagcccuc

SEQ ID NO: 505324 - RNA, 64 nt, Human
cugucugcagggaacgccaccauguugacccucuggaggagagcgcuguggagccccucccgug

SEQ ID NO: 505325 - RNA, 64 nt, Human
ggcccugcuuuuccucgugccuaguguccagaaaggaggagaagggcuguugucugggauuaaa

SEQ ID NO: 505326 - RNA, 64 nt, Human
ccacccucucucuccccuuggagcucuugccaaaggaggagacaagcagaggucucuauuggau

SEQ ID NO: 505327 - RNA, 64 nt, Human
accaccgucacucagcccugggcguagccggacaggaggagagcagugaugcggauggguaccc

SEQ ID NO: 505328 - RNA, 64 nt, Human
ggugugccuggagcagggacggagggggagaaugggaggagacaaggagcugaaggaguaguuc

SEQ ID NO: 505329 - RNA, 64 nt, Human
uuacaccagaagaccaugggugaagucuagauggggaggagaagugaggccagggacagucuug

SEQ ID NO: 505330 - RNA, 61 nt, Human
gggccggggggcuguucugacccgcuaggguggaggagaggagugggguuuguugaugaac

SEQ ID NO: 505331 - RNA, 64 nt, Human
ggaaacccaaucaugagguccuugugccugguauggaggagacugcagucaggauaugcauucc

SEQ ID NO: 505332 - RNA, 64 nt, Human
ccaaguugggggcccaggaggcggggagggaggaggaggagaagaugcgcaguuaccucauguc

SEQ ID NO: 505333 - RNA, 64 nt, Human
cagaugcucccauccacuauuaaugcacuaggugggaggagagggcggcaaugacacugcaccu

SEQ ID NO: 505334 - RNA, 64 nt, Human
uuuaagcgcauuuuuuaaaacuuaaaauguauuuggaggagaaauccugcaaguaaucuuaaua

SEQ ID NO: 505335 - RNA, 64 nt, Human
aucacaguuuggcgauuguggagggccuccugaaggaggagaugaguaaauauauuuuuuugga

SEQ ID NO: 505336 - RNA, 64 nt, Human
ggaggaagggacccagcugggucugggccacaagggaggagacugcaccccacugccucugggc

SEQ ID NO: 505337 - RNA, 64 nt, Human; identical to SEQ ID NO: 359319

SEQ ID NO: 505338 - RNA, 64 nt, Human; identical to SEQ ID NO: 359320

SEQ ID NO: 505339 - RNA, 64 nt, Human; identical to SEQ ID NO: 359321

SEQ ID NO: 505340 - RNA, 64 nt, Human
caggccaagaccuuaggacauugggauuuuugugggaggagaguaauagguaauuagacacuga

SEQ ID NO: 505341 - RNA, 64 nt, Human
ugagauccgccuggagugacacccccagaccucuggaggagacaauggaugcaaacagcccaca

SEQ ID NO: 505342 - RNA, 64 nt, Human
gggagcuggggaucuggauuccugguucccugaaggaggagagggaugauagcuuggauucccu

SEQ ID NO: 505343 - RNA, 64 nt, Human
agagaaacauauauuauauauuauauagagagagggaggagagcgagagagagugaggacaccg

SEQ ID NO: 505344 - RNA, 64 nt, Human
acaggaaauauuauuucuuguaaaacauaacacuggaggagaugccuuaugacggagccaucug

SEQ ID NO: 505345 - RNA, 64 nt, Human
uugggacucaggagcucagucaaggccacaggcuggaggagagacggggcugggcgcaaggugg

SEQ ID NO: 505346 - RNA, 64 nt, Human
ccccgaugcuccgaagccugaucuuccaggguggggaggagaaaaucccaccuccccugaccuc

SEQ ID NO: 505347 - RNA, 64 nt, Human
cccaucccuaggcuaaagagccaugaguccuggaggaggagaggaccccucccaaaggacugga

SEQ ID NO: 505348 - RNA, 64 nt, Human
gaaaaaucaggcagggaaucgaaacgacagugcuggaggagacucaggaagcagaggcgucccu

SEQ ID NO: 505349 - RNA, 64 nt, Human
gcagcacaaagaaacagccuuacacugggcacauggaggagacguccacccugcagccaggacu

SEQ ID NO: 505350 - RNA, 64 nt, Human
agugaaccacaagacucccuccagugaggagcugggaggagacaucccaggaaaagaauuugau

SEQ ID NO: 505351 - RNA, 64 nt, Human
ugugggcuuguugccuucagccggcuucccugagggaggagaacacuggauuauuggaaauguu

SEQ ID NO: 505352 - RNA, 64 nt, Human
agacucugcuuggguuugguuguaagauaaaccuggaggagaagcacaguugucccauugaauu

SEQ ID NO: 505353 - RNA, 64 nt, Human
uuuuuaaacaaagaacuuugcacuuggccagagaggaggagaaagcccauuuucucccuuccua

SEQ ID NO: 505354 - RNA, 64 nt, Human
gcugcccuuuuucuaagcccggccucgucucgccggaggagacgcugcaauaaagguugggaga

SEQ ID NO: 505355 - RNA, 64 nt, Human
cugcggguccacuucugagugacugaccuccacuggaggagacccauugcugggaggagcugag

SEQ ID NO: 505356 - RNA, 64 nt, Human; identical to SEQ ID NO: 359323

SEQ ID NO: 505357 - RNA, 64 nt, Human; identical to SEQ ID NO: 359324

SEQ ID NO: 505358 - RNA, 64 nt, Human; identical to SEQ ID NO: 359325

SEQ ID NO: 505359 - RNA, 64 nt, Human
acaccgugcuccggcuaaugauucgacagaggcuggaggagauagccgagaccccagcaacaau

SEQ ID NO: 505360 - RNA, 64 nt, Human
auuccauggcuaacuggcgagggggugauuagagggaggagaaugagccucggccucuuccgug

SEQ ID NO: 505361 - RNA, 64 nt, Human
caggcccugaaggauggggagguuuuggacagagggaggagagaguuagaaaaauuuuugguag

SEQ ID NO: 505362 - RNA, 64 nt, Human
gggaggcuccccugcccuccuucuccuuaggaguggaggagauguguguucugcuccucuacgu

SEQ ID NO: 505363 - RNA, 64 nt, Human
uacggucuguccucaccaagggauggggguuuggggaggagagugacauuuucaucauuagcuu

SEQ ID NO: 505364 - RNA, 63 nt, Human
cacgagaucagagcaucugaacugcccugccuuggaggagagacuuuugggugagguccaaag

SEQ ID NO: 505365 - RNA, 64 nt, Human
ggcaccuggagucccagcuacuccggaggcugagggaggagaauggugugaacccgggaggugg

SEQ ID NO: 505366 - RNA, 64 nt, Human
cuggauuugugggaauggcuuugcgugagaaaggggaggagagugguugcugcccucagccggc

SEQ ID NO: 505367 - RNA, 64 nt, Human
gccgcuguguccccgcgggcagugacgugaguggggaggagacucaggcccacauugcccacac

SEQ ID NO: 505368 - RNA, 64 nt, Human
ggcguguccccugccugugagugacaucgguucaggaggagacagucaggaagccuccugcuga

SEQ ID NO: 505369 - RNA, 64 nt, Human
gacaucgccgggggagguugugggcaacgguggaggaggagagacgggaggggaccauuuggga

SEQ ID NO: 505370 - RNA, 64 nt, Human
ugagcugugggucugaucaccccaagucccgcccggaggagaggcacagccagggcgugugguu

SEQ ID NO: 505371 - RNA, 64 nt, Human
guaagaaguugacuggcaaaagagcagugcugaaggaggagauccagguuuaaaucuggcuuau

SEQ ID NO: 505372 - RNA, 64 nt, Human
gcaaacugaugggcucuuugcgccgugcagggugggaggagaagaccaaacgaaguaacgucug

SEQ ID NO: 505373 - RNA, 64 nt, Human
uaguagcaagagcugcaaagcaggcaggaagggaggaggagagccaggugagcaguggagagaa

SEQ ID NO: 505374 - RNA, 64 nt, Human
uuuccaaaaacaaagugcaaagcugcuugaaucaggaggagauuaacacacugaaccgcuacaa

SEQ ID NO: 505375 - RNA, 64 nt, Human; identical to SEQ ID NO: 359222

SEQ ID NO: 505376 - RNA, 64 nt, Human; identical to SEQ ID NO: 359223

SEQ ID NO: 505377 - RNA, 64 nt, Human; identical to SEQ ID NO: 359224

SEQ ID NO: 505378 - RNA, 64 nt, Human
gaccucaugaacuggaaggggucaaggugacccgggaggagagcucaagacagggcacaggcua

SEQ ID NO: 505379 - RNA, 64 nt, Human
ucuagaaagaacuugcuuuguacagggcugagauggaggagaaaaaaaugcccccuucagaaug

SEQ ID NO: 505380 - RNA, 64 nt, Human
ucuuuagagcacagggacagagggggaaauaagaggaggagaaagcucucuauaccaaagacug

SEQ ID NO: 505381 - RNA, 64 nt, Human
gaggggugaagaaggaggaggaagaggcagagaaggaggagaccagggcugggaaagaaacuuc

SEQ ID NO: 505382 - RNA, 64 nt, Human
ggccggcugguugugggcacuggcggucaaguguggaggagagggguggaggcugccccauuga

SEQ ID NO: 505383 - RNA, 64 nt, Human
acuggggagaagacaaaauugguguuuagauucuggaggagaaaaaaugaguuacaaugucagg

SEQ ID NO: 505384 - RNA, 64 nt, Human
caauugccuggaggcuucugugagaucgggagagggaggagaggcagucucuugacaaaauaaa

SEQ ID NO: 505385 - RNA, 64 nt, Human
gaaguggccuagugcaagaugagcugggaacaagggaggagagagcaggagcuggggcagaggc

SEQ ID NO: 505386 - RNA, 64 nt, Human
ucagguuccagcaagucaggcuagggaccuggggggaggagacccauggacuucacccauacuc

SEQ ID NO: 505387 - RNA, 64 nt, Human
acuuuucacagccuccaagggcagcagugcacauggaggagacgucucccacgaggccaaggcc

SEQ ID NO: 505388 - RNA, 64 nt, Human
uaauaaaucuguaucagaugacuccggaaaugugggaggagagaauuacugcuugguacgcaga

SEQ ID NO: 505389 - RNA, 64 nt, Human
cuuuggaaguucagcagaugaaagcccaggccagggaggagaaggcuagaaagcaggugagcac

SEQ ID NO: 505390 - RNA, 64 nt, Human
ugcagcgcaucaaggccacagcgauucgcacggaggaggagaagcgccugauggagcagaaggu

SEQ ID NO: 505391 - RNA, 64 nt, Human
cucccccaucuucuuaagaagcaggggggcagguggaggagagugaggggagagcugcccggug

SEQ ID NO: 505392 - RNA, 64 nt, Human
cuuccccucucugguccucagcuuccuccaucauggaggagaugggaucauggauuuucugggc

SEQ ID NO: 505393 - RNA, 64 nt, Human
aggccaucggcugucucugcauuucauuggcuguggaggagagacuccuaggauggcugcuguc

SEQ ID NO: 505394 - RNA, 64 nt, Human; identical to SEQ ID NO: 359225

SEQ ID NO: 505395 - RNA, 64 nt, Human; identical to SEQ ID NO: 359226

SEQ ID NO: 505396 - RNA, 64 nt, Human; identical to SEQ ID NO: 359227

SEQ ID NO: 505397 - RNA, 64 nt, Human
cuuugcccaccuccacucuaauucccauccauuaggaggagaggggugcugggccuuggaccuu

SEQ ID NO: 505398 - RNA, 64 nt, Human
gcaggaccgccucucaccugaccaggcuguagggggaggagacacuggcaggagaugugcuguc

SEQ ID NO: 505399 - RNA, 64 nt, Human
ccugcgaccucccugcccugccgccacaugcaguggaggagaggccuguggcccaaagaaccug

SEQ ID NO: 505400 - RNA, 64 nt, Human
ccugcgaccuacccgcccugccgccacaugcaguggaggagaggccuguggcccgaagagccug

SEQ ID NO: 505401 - RNA, 64 nt, Human
agggcugcuccaggcaggucagagcagugcagggggaggagaggagaaagggaggaagcugggc

SEQ ID NO: 505402 - RNA, 64 nt, Human
cauuuugcucuucuugugggaacacacacuucaaggaggagauagugacuuugagauaggaaca

SEQ ID NO: 505403 - RNA, 64 nt, Human
gacuggggggaucagcugcccauugcucccaagaggaggagagggaggcugcagaugccuggga

SEQ ID NO: 505404 - RNA, 64 nt, Human
gccaccuucaggccugggaaggaagacacugggaggaggagaggccuggaaagcuuugguaggu

SEQ ID NO: 505405 - RNA, 64 nt, Human
cccuugaagacagcagaaugucccuuugcaaugaggaggagaucugggcugggcgggccagcug

SEQ ID NO: 505406 - RNA, 64 nt, Human
aggagaaggcaggaaugcuggagccuggaauaagggaggagaggggacuggagaguguggggaa

SEQ ID NO: 505407 - RNA, 64 nt, Human
aggagaaggcagaaaugcuggggccuggaauaagggaggagaggggacuggagaguguggggaa

SEQ ID NO: 505408 - RNA, 64 nt, Human
aggagaaggcaggaacacuggagccugcaauaagggaggagagaggacuggagaguguggggaa

SEQ ID NO: 505409 - RNA, 64 nt, Human
ccuccacucuauaagcagucaucuugggagaccgggaggagaagguggugggcuaguccugugu

SEQ ID NO: 505410 - RNA, 64 nt, Human
ccugcuccugaaccaggaggcuucaugugggggaggaggagaggucuccaugugacacaugggc

SEQ ID NO: 505411 - RNA, 64 nt, Human
agaggguggaaggcccuggcaggaagcaggaggaggaggagagggggguccaggucuuuucagg

SEQ ID NO: 505412 - RNA, 64 nt, Human
ggcucuucagaccacacagcccugaccgggccuuggaggagagccauggacaggcuccuccaug

SEQ ID NO: 505413 - RNA, 64 nt, Human; identical to SEQ ID NO: 359229

SEQ ID NO: 505414 - RNA, 64 nt, Human; identical to SEQ ID NO: 359230

SEQ ID NO: 505415 - RNA, 64 nt, Human; identical to SEQ ID NO: 359231

SEQ ID NO: 505416 - RNA, 64 nt, Human
aguucagggccagguuggccaccgugggcgaccuggaggagauccagcgugcgcacgcagagua

SEQ ID NO: 505417 - RNA, 64 nt, Human
ggauccuggacgaccccuccccaccucagccuggggaggagaagcuggcagcccucacugcagg

SEQ ID NO: 505418 - RNA, 64 nt, Human
ccuguaggaaaauggcgauggcugagaaaagcccggaggagaugcuccuagcuaugacuuccag

SEQ ID NO: 505419 - RNA, 52 nt, Human
aguuuaagucagucaguuaaggggaggagaaggagagguuauaccuucaggg

SEQ ID NO: 505420 - RNA, 64 nt, Human
gugccuuuccugggguuucuuuucuguucuuuucggaggagagggcccgagaaggggccauacc

SEQ ID NO: 505421 - RNA, 64 nt, Human
agcuuauuuguauuuuuccucuuucacuucuuauggaggagaguguuuaacugaguuagaaugu

SEQ ID NO: 505422 - RNA, 64 nt, Human
ucgccaaaaucccugccuuggauauguugaagcuggaggagauuuugaacugugauugugaggc

SEQ ID NO: 505423 - RNA, 64 nt, Human
caguauacaagauaagcuuccaggcugcauagaaggaggagagggaaaauguuuuguaagaaac

SEQ ID NO: 505424 - RNA, 64 nt, Human
aaacuaaugaaaacaaucucuguaauggcagauaggaggagaugaaaaguucuguugcauggau

SEQ ID NO: 505425 - RNA, 64 nt, Human
cugugccuacuaaagguaucuucuggaguuuuugggaggagagaaacuggaaaauuaaauugua

SEQ ID NO: 505426 - RNA, 64 nt, Human
ggcagaaucuuaaaugguaccauuggugucacugggaggagaaauugggguguguuacuguuua

SEQ ID NO: 505427 - RNA, 64 nt, Human
gugaggagggaguguuauuuccuugggaaccuagggaggagagguuccuuuguugggaaacuuu

SEQ ID NO: 505428 - RNA, 57 nt, Human
gauaccugcagcaucuuuagucaaguuggaggagaaagacaacacuuggucuaagac

SEQ ID NO: 505429 - RNA, 64 nt, Human
aggaggaaaaggaggaagaggaggacaaaaagggggaggagaagguucuucguccaaaggagga

SEQ ID NO: 505430 - RNA, 64 nt, Human
gcucuuugugagugaggguggccaaacuaccgccggaggagauggggucucagagcgagagcug

SEQ ID NO: 505431 - RNA, 64 nt, Human
aaaugugaggaagggaaggagggagagacgggagggaggagagagaggagaagggaggcagggg

SEQ ID NO: 505432 - RNA, 64 nt, Human; identical to SEQ ID NO: 359232

SEQ ID NO: 505433 - RNA, 64 nt, Human; identical to SEQ ID NO: 359233

SEQ ID NO: 505434 - RNA, 64 nt, Human; identical to SEQ ID NO: 359234

SEQ ID NO: 505435 - RNA, 64 nt, Human
auugguuucugaguagugaaggccacuugaagcuggaggagaaacuaaagccuuauugagaaaa

SEQ ID NO: 505436 - RNA, 64 nt, Human
cugucagaaauauccagauuuaaauuucauaauuggaggagagggaccaaagagaaucauuuug

SEQ ID NO: 505437 - RNA, 64 nt, Human
uacauuuauaauuauugucauguccgaauagauaggaggagaaaaacaauuacacacuaauuua

SEQ ID NO: 505438 - RNA, 64 nt, Human
auuacucuggcacaugcucaaugguauauugcagggaggagaggaguagauuuagauuugagua

SEQ ID NO: 505439 - RNA, 64 nt, Human
uuguuugcuuaaaaauguaauugggggcggcgggggaggagaggggaaagagacauucgcuugg

SEQ ID NO: 505440 - RNA, 64 nt, Human
guugggaggcugcuggcugcacagacccgugaggggaggagaggggcugcugugcaggggugug

SEQ ID NO: 505441 - RNA, 64 nt, Human
cugugacuuaguggacaggggagggggcaaagggggaggagaagaaaauguucuuccaguuacu

SEQ ID NO: 505442 - RNA, 64 nt, Human; identical to SEQ ID NO: 206290

SEQ ID NO: 505443 - RNA, 64 nt, Human; identical to SEQ ID NO: 206291

SEQ ID NO: 505444 - RNA, 64 nt, Human; identical to SEQ ID NO: 206292

SEQ ID NO: 505445 - RNA, 64 nt, Human; identical to SEQ ID NO: 359215

SEQ ID NO: 505446 - RNA, 64 nt, Human; identical to SEQ ID NO: 359216

SEQ ID NO: 505447 - RNA, 64 nt, Human; identical to SEQ ID NO: 359220

SEQ ID NO: 505448 - RNA, 64 nt, Human; identical to SEQ ID NO: 206308

SEQ ID NO: 505449 - RNA, 64 nt, Human; identical to SEQ ID NO: 206309

SEQ ID NO: 505450 - RNA, 64 nt, Human; identical to SEQ ID NO: 206310

SEQ ID NO: 505451 - RNA, 64 nt, Human; identical to SEQ ID NO: 206326

SEQ ID NO: 505452 - RNA, 64 nt, Human; identical to SEQ ID NO: 206327

SEQ ID NO: 505453 - RNA, 64 nt, Human; identical to SEQ ID NO: 206328

SEQ ID NO: 505454 - RNA, 64 nt, Human; identical to SEQ ID NO: 206344

SEQ ID NO: 505455 - RNA, 64 nt, Human; identical to SEQ ID NO: 206345

SEQ ID NO: 505456 - RNA, 64 nt, Human; identical to SEQ ID NO: 206346

SEQ ID NO: 505457 - RNA, 64 nt, Human; identical to SEQ ID NO: 206362

SEQ ID NO: 505458 - RNA, 64 nt, Human; identical to SEQ ID NO: 206363

SEQ ID NO: 505459 - RNA, 64 nt, Human; identical to SEQ ID NO: 206364

SEQ ID NO: 505460 - RNA, 64 nt, Human; identical to SEQ ID NO: 206380

SEQ ID NO: 505461 - RNA, 64 nt, Human; identical to SEQ ID NO: 206381

SEQ ID NO: 505462 - RNA, 64 nt, Human; identical to SEQ ID NO: 206382

SEQ ID NO: 505463 - RNA, 64 nt, Human; identical to SEQ ID NO: 359326

SEQ ID NO: 505464 - RNA, 64 nt, Human; identical to SEQ ID NO: 359327

SEQ ID NO: 505465 - RNA, 64 nt, Human; identical to SEQ ID NO: 359328

SEQ ID NO: 505466 - RNA, 64 nt, Human
ccggaaaauugugcucuagaagaauaaaacugaaaaacucuagagaauuuuuuuuccccauuga

SEQ ID NO: 505467 - RNA, 64 nt, Human; identical to SEQ ID NO: 206398

SEQ ID NO: 505468 - RNA, 64 nt, Human; identical to SEQ ID NO: 206399

SEQ ID NO: 505469 - RNA, 64 nt, Human; identical to SEQ ID NO: 206400

SEQ ID NO: 505470 - RNA, 64 nt, Human; identical to SEQ ID NO: 206416

SEQ ID NO: 505471 - RNA, 64 nt, Human; identical to SEQ ID NO: 206417

SEQ ID NO: 505472 - RNA, 64 nt, Human; identical to SEQ ID NO: 206418

SEQ ID NO: 505473 - RNA, 64 nt, Human; identical to SEQ ID NO: 206419

SEQ ID NO: 505474 - RNA, 64 nt, Human; identical to SEQ ID NO: 206420

SEQ ID NO: 505475 - RNA, 64 nt, Human; identical to SEQ ID NO: 206421

SEQ ID NO: 505476 - RNA, 64 nt, Human; identical to SEQ ID NO: 206422

SEQ ID NO: 505477 - RNA, 64 nt, Human; identical to SEQ ID NO: 206423

SEQ ID NO: 505478 - RNA, 64 nt, Human; identical to SEQ ID NO: 206424

SEQ ID NO: 505479 - RNA, 64 nt, Human; identical to SEQ ID NO: 206425

SEQ ID NO: 505480 - RNA, 64 nt, Human; identical to SEQ ID NO: 206426

SEQ ID NO: 505481 - RNA, 64 nt, Human; identical to SEQ ID NO: 206427

SEQ ID NO: 505482 - RNA, 64 nt, Human; identical to SEQ ID NO: 359208

SEQ ID NO: 505483 - RNA, 64 nt, Human; identical to SEQ ID NO: 359209

SEQ ID NO: 505484 - RNA, 64 nt, Human; identical to SEQ ID NO: 359210

SEQ ID NO: 505485 - RNA, 64 nt, Human; identical to SEQ ID NO: 359239

SEQ ID NO: 505486 - RNA, 64 nt, Human; identical to SEQ ID NO: 206428

SEQ ID NO: 505487 - RNA, 64 nt, Human; identical to SEQ ID NO: 206429

SEQ ID NO: 505488 - RNA, 64 nt, Human; identical to SEQ ID NO: 206430

SEQ ID NO: 505489 - RNA, 64 nt, Human; identical to SEQ ID NO: 206431

SEQ ID NO: 505490 - RNA, 64 nt, Human; identical to SEQ ID NO: 206432

SEQ ID NO: 505491 - RNA, 64 nt, Human; identical to SEQ ID NO: 206433

SEQ ID NO: 505492 - RNA, 64 nt, Human; identical to SEQ ID NO: 206434

SEQ ID NO: 505493 - RNA, 64 nt, Human; identical to SEQ ID NO: 206435

SEQ ID NO: 505494 - RNA, 64 nt, Human; identical to SEQ ID NO: 206436

SEQ ID NO: 505495 - RNA, 64 nt, Human; identical to SEQ ID NO: 206437

SEQ ID NO: 505496 - RNA, 64 nt, Human; identical to SEQ ID NO: 206438

SEQ ID NO: 505497 - RNA, 64 nt, Human; identical to SEQ ID NO: 206439

SEQ ID NO: 505498 - RNA, 64 nt, Human; identical to SEQ ID NO: 206440

SEQ ID NO: 505499 - RNA, 64 nt, Human; identical to SEQ ID NO: 206441

SEQ ID NO: 505500 - RNA, 64 nt, Human; identical to SEQ ID NO: 206442

SEQ ID NO: 505501 - RNA, 64 nt, Human; identical to SEQ ID NO: 359240

SEQ ID NO: 505502 - RNA, 64 nt, Human; identical to SEQ ID NO: 359241

SEQ ID NO: 505503 - RNA, 64 nt, Human; identical to SEQ ID NO: 359232

SEQ ID NO: 505504 - RNA, 64 nt, Human; identical to SEQ ID NO: 359244

SEQ ID NO: 505505 - RNA, 64 nt, Human; identical to SEQ ID NO: 206443

SEQ ID NO: 505506 - RNA, 64 nt, Human; identical to SEQ ID NO: 206444

SEQ ID NO: 505507 - RNA, 64 nt, Human; identical to SEQ ID NO: 206445

SEQ ID NO: 505508 - RNA, 64 nt, Human; identical to SEQ ID NO: 206446

SEQ ID NO: 505509 - RNA, 64 nt, Human; identical to SEQ ID NO: 206447

SEQ ID NO: 505510 - RNA, 64 nt, Human; identical to SEQ ID NO: 206448

SEQ ID NO: 505511 - RNA, 56 nt, Human; identical to SEQ ID NO: 206449

SEQ ID NO: 505512 - RNA, 64 nt, Human; identical to SEQ ID NO: 206450

SEQ ID NO: 505513 - RNA, 64 nt, Human; identical to SEQ ID NO: 206451

SEQ ID NO: 505514 - RNA, 64 nt, Human; identical to SEQ ID NO: 206452

SEQ ID NO: 505515 - RNA, 64 nt, Human; identical to SEQ ID NO: 206453

SEQ ID NO: 505516 - RNA, 64 nt, Human; identical to SEQ ID NO: 206454

SEQ ID NO: 505517 - RNA, 64 nt, Human; identical to SEQ ID NO: 206455

SEQ ID NO: 505518 - RNA, 64 nt, Human; identical to SEQ ID NO: 206456

SEQ ID NO: 505519 - RNA, 64 nt, Human; identical to SEQ ID NO: 206457

SEQ ID NO: 505520 - RNA, 64 nt, Human; identical to SEQ ID NO: 359249

SEQ ID NO: 505521 - RNA, 64 nt, Human; identical to SEQ ID NO: 359250

SEQ ID NO: 505522 - RNA, 64 nt, Human; identical to SEQ ID NO: 359251

SEQ ID NO: 505523 - RNA, 64 nt, Human; identical to SEQ ID NO: 359252

SEQ ID NO: 505524 - RNA, 64 nt, Human; identical to SEQ ID NO: 206458

SEQ ID NO: 505525 - RNA, 64 nt, Human; identical to SEQ ID NO: 206459

SEQ ID NO: 505526 - RNA, 64 nt, Human; identical to SEQ ID NO: 206460

SEQ ID NO: 505527 - RNA, 64 nt, Human; identical to SEQ ID NO: 206461

SEQ ID NO: 505528 - RNA, 64 nt, Human; identical to SEQ ID NO: 206462

SEQ ID NO: 505529 - RNA, 64 nt, Human; identical to SEQ ID NO: 206463

SEQ ID NO: 505530 - RNA, 64 nt, Human; identical to SEQ ID NO: 206464

SEQ ID NO: 505531 - RNA, 64 nt, Human; identical to SEQ ID NO: 206465

SEQ ID NO: 505532 - RNA, 64 nt, Human; identical to SEQ ID NO: 206466

SEQ ID NO: 505533 - RNA, 64 nt, Human; identical to SEQ ID NO: 206467

SEQ ID NO: 505534 - RNA, 64 nt, Human; identical to SEQ ID NO: 206468

SEQ ID NO: 505535 - RNA, 64 nt, Human; identical to SEQ ID NO: 206469

SEQ ID NO: 505536 - RNA, 64 nt, Human; identical to SEQ ID NO: 206470

SEQ ID NO: 505537 - RNA, 64 nt, Human; identical to SEQ ID NO: 206471

SEQ ID NO: 505538 - RNA, 64 nt, Human; identical to SEQ ID NO: 206472

SEQ ID NO: 505539 - RNA, 64 nt, Human; identical to SEQ ID NO: 359330

SEQ ID NO: 505540 - RNA, 64 nt, Human; identical to SEQ ID NO: 359331

SEQ ID NO: 505541 - RNA, 64 nt, Human; identical to SEQ ID NO: 359335

SEQ ID NO: 505542 - RNA, 64 nt, Human; identical to SEQ ID NO: 359336

SEQ ID NO: 505543 - RNA, 64 nt, Human; identical to SEQ ID NO: 206473

SEQ ID NO: 505544 - RNA, 64 nt, Human; identical to SEQ ID NO: 206474

SEQ ID NO: 505545 - RNA, 64 nt, Human; identical to SEQ ID NO: 206475

SEQ ID NO: 505546 - RNA, 64 nt, Human; identical to SEQ ID NO: 206476

SEQ ID NO: 505547 - RNA, 64 nt, Human; identical to SEQ ID NO: 206477

SEQ ID NO: 505548 - RNA, 53 nt, Human; identical to SEQ ID NO: 206478

SEQ ID NO: 505549 - RNA, 64 nt, Human; identical to SEQ ID NO: 206479

SEQ ID NO: 505550 - RNA, 64 nt, Human; identical to SEQ ID NO: 206480

SEQ ID NO: 505551 - RNA, 64 nt, Human; identical to SEQ ID NO: 206481

SEQ ID NO: 505552 - RNA, 64 nt, Human; identical to SEQ ID NO: 206482

SEQ ID NO: 505553 - RNA, 64 nt, Human; identical to SEQ ID NO: 206483

SEQ ID NO: 505554 - RNA, 64 nt, Human; identical to SEQ ID NO: 206484

SEQ ID NO: 505555 - RNA, 64 nt, Human; identical to SEQ ID NO: 206485

SEQ ID NO: 505556 - RNA, 64 nt, Human; identical to SEQ ID NO: 206486

SEQ ID NO: 505557 - RNA, 64 nt, Human; identical to SEQ ID NO: 206487

SEQ ID NO: 505558 - RNA, 64 nt, Human; identical to SEQ ID NO: 241890

SEQ ID NO: 505559 - RNA, 64 nt, Human; identical to SEQ ID NO: 241891

SEQ ID NO: 505560 - RNA, 64 nt, Human; identical to SEQ ID NO: 240367

SEQ ID NO: 505561 - RNA, 64 nt, Human; identical to SEQ ID NO: 240368

SEQ ID NO: 505562 - RNA, 64 nt, Human; identical to SEQ ID NO: 206488

SEQ ID NO: 505563 - RNA, 64 nt, Human; identical to SEQ ID NO: 206489

SEQ ID NO: 505564 - RNA, 64 nt, Human; identical to SEQ ID NO: 206490

SEQ ID NO: 505565 - RNA, 64 nt, Human; identical to SEQ ID NO: 206491

SEQ ID NO: 505566 - RNA, 64 nt, Human; identical to SEQ ID NO: 206492

SEQ ID NO: 505567 - RNA, 64 nt, Human; identical to SEQ ID NO: 206493

SEQ ID NO: 505568 - RNA, 64 nt, Human; identical to SEQ ID NO: 206494

SEQ ID NO: 505569 - RNA, 64 nt, Human; identical to SEQ ID NO: 206495

SEQ ID NO: 505570 - RNA, 64 nt, Human; identical to SEQ ID NO: 206496

SEQ ID NO: 505571 - RNA, 64 nt, Human; identical to SEQ ID NO: 206497

SEQ ID NO: 505572 - RNA, 64 nt, Human; identical to SEQ ID NO: 206498

SEQ ID NO: 505573 - RNA, 64 nt, Human; identical to SEQ ID NO: 206499

SEQ ID NO: 505574 - RNA, 64 nt, Human; identical to SEQ ID NO: 206500

SEQ ID NO: 505575 - RNA, 64 nt, Human; identical to SEQ ID NO: 206501

SEQ ID NO: 505576 - RNA, 64 nt, Human; identical to SEQ ID NO: 206502

SEQ ID NO: 505577 - RNA, 64 nt, Human; identical to SEQ ID NO: 240387

SEQ ID NO: 505578 - RNA, 64 nt, Human; identical to SEQ ID NO: 206503

SEQ ID NO: 505579 - RNA, 64 nt, Human; identical to SEQ ID NO: 206504

SEQ ID NO: 505580 - RNA, 64 nt, Human; identical to SEQ ID NO: 206505

SEQ ID NO: 505581 - RNA, 64 nt, Human; identical to SEQ ID NO: 206506

SEQ ID NO: 505582 - RNA, 64 nt, Human; identical to SEQ ID NO: 206507

SEQ ID NO: 505583 - RNA, 64 nt, Human; identical to SEQ ID NO: 206508

SEQ ID NO: 505584 - RNA, 64 nt, Human; identical to SEQ ID NO: 206509

SEQ ID NO: 505585 - RNA, 64 nt, Human; identical to SEQ ID NO: 206510

SEQ ID NO: 505586 - RNA, 64 nt, Human; identical to SEQ ID NO: 206511

SEQ ID NO: 505587 - RNA, 64 nt, Human; identical to SEQ ID NO: 206512

SEQ ID NO: 505588 - RNA, 64 nt, Human; identical to SEQ ID NO: 206513

SEQ ID NO: 505589 - RNA, 64 nt, Human; identical to SEQ ID NO: 206514

SEQ ID NO: 505590 - RNA, 64 nt, Human; identical to SEQ ID NO: 206515

SEQ ID NO: 505591 - RNA, 64 nt, Human; identical to SEQ ID NO: 206516

SEQ ID NO: 505592 - RNA, 64 nt, Human; identical to SEQ ID NO: 206517

SEQ ID NO: 505593 - RNA, 64 nt, Human; identical to SEQ ID NO: 206518

SEQ ID NO: 505594 - RNA, 64 nt, Human; identical to SEQ ID NO: 206519

SEQ ID NO: 505595 - RNA, 64 nt, Human; identical to SEQ ID NO: 206520

SEQ ID NO: 505596 - RNA, 64 nt, Human; identical to SEQ ID NO: 206521

SEQ ID NO: 505597 - RNA, 64 nt, Human; identical to SEQ ID NO: 206522

SEQ ID NO: 505598 - RNA, 64 nt, Human; identical to SEQ ID NO: 206523

SEQ ID NO: 505599 - RNA, 64 nt, Human; identical to SEQ ID NO: 206524

SEQ ID NO: 505600 - RNA, 64 nt, Human; identical to SEQ ID NO: 206525

SEQ ID NO: 505601 - RNA, 64 nt, Human; identical to SEQ ID NO: 206526

SEQ ID NO: 505602 - RNA, 64 nt, Human; identical to SEQ ID NO: 206527

SEQ ID NO: 505603 - RNA, 64 nt, Human; identical to SEQ ID NO: 206528

SEQ ID NO: 505604 - RNA, 64 nt, Human; identical to SEQ ID NO: 206529

SEQ ID NO: 505605 - RNA, 64 nt, Human; identical to SEQ ID NO: 206530

SEQ ID NO: 505606 - RNA, 64 nt, Human; identical to SEQ ID NO: 206531

SEQ ID NO: 505607 - RNA, 64 nt, Human; identical to SEQ ID NO: 206532

SEQ ID NO: 505608 - RNA, 64 nt, Human; identical to SEQ ID NO: 240439

SEQ ID NO: 505609 - RNA, 64 nt, Human; identical to SEQ ID NO: 240354

SEQ ID NO: 505610 - RNA, 64 nt, Human; identical to SEQ ID NO: 240440

SEQ ID NO: 505611 - RNA, 64 nt, Human; identical to SEQ ID NO: 240369

SEQ ID NO: 505612 - RNA, 64 nt, Human; identical to SEQ ID NO: 206533

SEQ ID NO: 505613 - RNA, 64 nt, Human; identical to SEQ ID NO: 206534

SEQ ID NO: 505614 - RNA, 64 nt, Human; identical to SEQ ID NO: 206535

SEQ ID NO: 505615 - RNA, 64 nt, Human; identical to SEQ ID NO: 206536

SEQ ID NO: 505616 - RNA, 64 nt, Human; identical to SEQ ID NO: 206537

SEQ ID NO: 505617 - RNA, 64 nt, Human; identical to SEQ ID NO: 206538

SEQ ID NO: 505618 - RNA, 64 nt, Human; identical to SEQ ID NO: 206539

SEQ ID NO: 505619 - RNA, 64 nt, Human; identical to SEQ ID NO: 206540

SEQ ID NO: 505620 - RNA, 64 nt, Human; identical to SEQ ID NO: 206541

SEQ ID NO: 505621 - RNA, 64 nt, Human; identical to SEQ ID NO: 206542

SEQ ID NO: 505622 - RNA, 64 nt, Human; identical to SEQ ID NO: 206543

SEQ ID NO: 505623 - RNA, 64 nt, Human; identical to SEQ ID NO: 206544

SEQ ID NO: 505624 - RNA, 64 nt, Human; identical to SEQ ID NO: 206545

SEQ ID NO: 505625 - RNA, 64 nt, Human; identical to SEQ ID NO: 206546

SEQ ID NO: 505626 - RNA, 64 nt, Human; identical to SEQ ID NO: 206547

SEQ ID NO: 505627 - RNA, 64 nt, Human; identical to SEQ ID NO: 206548

SEQ ID NO: 505628 - RNA, 64 nt, Human; identical to SEQ ID NO: 206549

SEQ ID NO: 505629 - RNA, 64 nt, Human; identical to SEQ ID NO: 206550

SEQ ID NO: 505630 - RNA, 64 nt, Human; identical to SEQ ID NO: 206551

SEQ ID NO: 505631 - RNA, 64 nt, Human; identical to SEQ ID NO: 206552

SEQ ID NO: 505632 - RNA, 64 nt, Human; identical to SEQ ID NO: 206553

SEQ ID NO: 505633 - RNA, 64 nt, Human; identical to SEQ ID NO: 206554

SEQ ID NO: 505634 - RNA, 64 nt, Human; identical to SEQ ID NO: 206555

SEQ ID NO: 505635 - RNA, 64 nt, Human; identical to SEQ ID NO: 206556

SEQ ID NO: 505636 - RNA, 64 nt, Human; identical to SEQ ID NO: 206557

SEQ ID NO: 505637 - RNA, 64 nt, Human; identical to SEQ ID NO: 206558

SEQ ID NO: 505638 - RNA, 64 nt, Human; identical to SEQ ID NO: 206559

SEQ ID NO: 505639 - RNA, 64 nt, Human; identical to SEQ ID NO: 206560

SEQ ID NO: 505640 - RNA, 64 nt, Human; identical to SEQ ID NO: 206561

SEQ ID NO: 505641 - RNA, 64 nt, Human; identical to SEQ ID NO: 206562

SEQ ID NO: 505642 - RNA, 64 nt, Human; identical to SEQ ID NO: 241911

SEQ ID NO: 505643 - RNA, 64 nt, Human; identical to SEQ ID NO: 240457

SEQ ID NO: 505644 - RNA, 64 nt, Human; identical to SEQ ID NO: 240353

SEQ ID NO: 505645 - RNA, 64 nt, Human; identical to SEQ ID NO: 206563

SEQ ID NO: 505646 - RNA, 64 nt, Human; identical to SEQ ID NO: 206545

SEQ ID NO: 505647 - RNA, 64 nt, Human; identical to SEQ ID NO: 206565

SEQ ID NO: 505648 - RNA, 64 nt, Human; identical to SEQ ID NO: 206566

SEQ ID NO: 505649 - RNA, 64 nt, Human; identical to SEQ ID NO: 206567

SEQ ID NO: 505650 - RNA, 64 nt, Human; identical to SEQ ID NO: 206568

SEQ ID NO: 505651 - RNA, 64 nt, Human; identical to SEQ ID NO: 206569

SEQ ID NO: 505652 - RNA, 64 nt, Human; identical to SEQ ID NO: 206570

SEQ ID NO: 505653 - RNA, 64 nt, Human; identical to SEQ ID NO: 206571

SEQ ID NO: 505654 - RNA, 64 nt, Human; identical to SEQ ID NO: 206572

SEQ ID NO: 505655 - RNA, 64 nt, Human; identical to SEQ ID NO: 206573

SEQ ID NO: 505656 - RNA, 64 nt, Human; identical to SEQ ID NO: 206574

SEQ ID NO: 505657 - RNA, 64 nt, Human; identical to SEQ ID NO: 206575

SEQ ID NO: 505658 - RNA, 64 nt, Human; identical to SEQ ID NO: 206576

SEQ ID NO: 505659 - RNA, 64 nt, Human; identical to SEQ ID NO: 206577

SEQ ID NO: 505660 - RNA, 64 nt, Human; identical to SEQ ID NO: 504655

SEQ ID NO: 505661 - RNA, 64 nt, Human; identical to SEQ ID NO: 359187

SEQ ID NO: 505662 - RNA, 64 nt, Human; identical to SEQ ID NO: 359188

SEQ ID NO: 505663 - RNA, 64 nt, Human; identical to SEQ ID NO: 359189

SEQ ID NO: 505664 - RNA, 64 nt, Human; identical to SEQ ID NO: 206578

SEQ ID NO: 505665 - RNA, 64 nt, Human; identical to SEQ ID NO: 206579

SEQ ID NO: 505666 - RNA, 64 nt, Human; identical to SEQ ID NO: 206580

SEQ ID NO: 505667 - RNA, 64 nt, Human; identical to SEQ ID NO: 206581

SEQ ID NO: 505668 - RNA, 64 nt, Human; identical to SEQ ID NO: 206582

SEQ ID NO: 505669 - RNA, 64 nt, Human; identical to SEQ ID NO: 206583

SEQ ID NO: 505670 - RNA, 64 nt, Human; identical to SEQ ID NO: 206584

SEQ ID NO: 505671 - RNA, 64 nt, Human; identical to SEQ ID NO: 206585

SEQ ID NO: 505672 - RNA, 64 nt, Human; identical to SEQ ID NO: 206586

SEQ ID NO: 505673 - RNA, 64 nt, Human; identical to SEQ ID NO: 206587

SEQ ID NO: 505674 - RNA, 64 nt, Human; identical to SEQ ID NO: 206588

SEQ ID NO: 505675 - RNA, 64 nt, Human; identical to SEQ ID NO: 206589

SEQ ID NO: 505676 - RNA, 64 nt, Human; identical to SEQ ID NO: 206590

SEQ ID NO: 505677 - RNA, 64 nt, Human; identical to SEQ ID NO: 206591

SEQ ID NO: 505678 - RNA, 64 nt, Human; identical to SEQ ID NO: 206592

SEQ ID NO: 505679 - RNA, 64 nt, Human; identical to SEQ ID NO: 359203

SEQ ID NO: 505680 - RNA, 64 nt, Human; identical to SEQ ID NO: 359204

SEQ ID NO: 505681 - RNA, 64 nt, Human; identical to SEQ ID NO: 359205

SEQ ID NO: 505682 - RNA, 64 nt, Human
caggcugcgucugcaccugaaaagugacccgcggaaacucuauggcggauuuuuuuuuuaacuu

SEQ ID NO: 505683 - RNA, 64 nt, Human; identical to SEQ ID NO: 206593

SEQ ID NO: 505684 - RNA, 64 nt, Human; identical to SEQ ID NO: 206594

SEQ ID NO: 505685 - RNA, 64 nt, Human; identical to SEQ ID NO: 206595

SEQ ID NO: 505686 - RNA, 64 nt, Human; identical to SEQ ID NO: 206596

SEQ ID NO: 505687 - RNA, 64 nt, Human; identical to SEQ ID NO: 206597

SEQ ID NO: 505688 - RNA, 64 nt, Human; identical to SEQ ID NO: 206598

SEQ ID NO: 505689 - RNA, 64 nt, Human; identical to SEQ ID NO: 206599

SEQ ID NO: 505690 - RNA, 64 nt, Human; identical to SEQ ID NO: 206600

SEQ ID NO: 505691 - RNA, 64 nt, Human; identical to SEQ ID NO: 206601

SEQ ID NO: 505692 - RNA, 64 nt, Human; identical to SEQ ID NO: 206602

SEQ ID NO: 505693 - RNA, 64 nt, Human; identical to SEQ ID NO: 206603

SEQ ID NO: 505694 - RNA, 64 nt, Human; identical to SEQ ID NO: 206604

SEQ ID NO: 505695 - RNA, 64 nt, Human; identical to SEQ ID NO: 206605

SEQ ID NO: 505696 - RNA, 64 nt, Human; identical to SEQ ID NO: 206606

SEQ ID NO: 505697 - RNA, 64 nt, Human; identical to SEQ ID NO: 206607

SEQ ID NO: 505698 - RNA, 64 nt, Human; identical to SEQ ID NO: 240799

SEQ ID NO: 505699 - RNA, 57 nt, Human; identical to SEQ ID NO: 240800

SEQ ID NO: 505700 - RNA, 64 nt, Human; identical to SEQ ID NO: 240494

SEQ ID NO: 505701 - RNA, 64 nt, Human; identical to SEQ ID NO: 357248

SEQ ID NO: 505702 - RNA, 64 nt, Human; identical to SEQ ID NO: 206608

SEQ ID NO: 505703 - RNA, 64 nt, Human; identical to SEQ ID NO: 206609

SEQ ID NO: 505704 - RNA, 64 nt, Human; identical to SEQ ID NO: 206610

SEQ ID NO: 505705 - RNA, 64 nt, Human; identical to SEQ ID NO: 206611

SEQ ID NO: 505706 - RNA, 64 nt, Human; identical to SEQ ID NO: 206612

SEQ ID NO: 505707 - RNA, 64 nt, Human; identical to SEQ ID NO: 206613

SEQ ID NO: 505708 - RNA, 64 nt, Human; identical to SEQ ID NO: 206614

SEQ ID NO: 505709 - RNA, 64 nt, Human; identical to SEQ ID NO: 206615

SEQ ID NO: 505710 - RNA, 64 nt, Human; identical to SEQ ID NO: 206616

SEQ ID NO: 505711 - RNA, 64 nt, Human; identical to SEQ ID NO: 206617

SEQ ID NO: 505712 - RNA, 64 nt, Human; identical to SEQ ID NO: 206618

SEQ ID NO: 505713 - RNA, 64 nt, Human; identical to SEQ ID NO: 206619

SEQ ID NO: 505714 - RNA, 64 nt, Human; identical to SEQ ID NO: 206620

SEQ ID NO: 505715 - RNA, 64 nt, Human; identical to SEQ ID NO: 206621

SEQ ID NO: 505716 - RNA, 64 nt, Human; identical to SEQ ID NO: 206622

SEQ ID NO: 505717 - RNA, 64 nt, Human; identical to SEQ ID NO: 359161

SEQ ID NO: 505718 - RNA, 64 nt, Human; identical to SEQ ID NO: 359162

SEQ ID NO: 505719 - RNA, 64 nt, Human; identical to SEQ ID NO: 359163

SEQ ID NO: 505720 - RNA, 64 nt, Human; identical to SEQ ID NO: 359164

SEQ ID NO: 505721 - RNA, 64 nt, Human; identical to SEQ ID NO: 206623

SEQ ID NO: 505722 - RNA, 64 nt, Human; identical to SEQ ID NO: 206624

SEQ ID NO: 505723 - RNA, 64 nt, Human; identical to SEQ ID NO: 206625

SEQ ID NO: 505724 - RNA, 64 nt, Human; identical to SEQ ID NO: 206626

SEQ ID NO: 505725 - RNA, 64 nt, Human; identical to SEQ ID NO: 206627

SEQ ID NO: 505726 - RNA, 64 nt, Human; identical to SEQ ID NO: 206628

SEQ ID NO: 505727 - RNA, 64 nt, Human; identical to SEQ ID NO: 206629

SEQ ID NO: 505728 - RNA, 62 nt, Human; identical to SEQ ID NO: 206630

SEQ ID NO: 505729 - RNA, 64 nt, Human; identical to SEQ ID NO: 206631

SEQ ID NO: 505730 - RNA, 64 nt, Human; identical to SEQ ID NO: 206632

SEQ ID NO: 505731 - RNA, 64 nt, Human; identical to SEQ ID NO: 206633

SEQ ID NO: 505732 - RNA, 64 nt, Human; identical to SEQ ID NO: 206634

SEQ ID NO: 505733 - RNA, 64 nt, Human; identical to SEQ ID NO: 206635

SEQ ID NO: 505734 - RNA, 64 nt, Human; identical to SEQ ID NO: 206636

SEQ ID NO: 505735 - RNA, 64 nt, Human; identical to SEQ ID NO: 206637

SEQ ID NO: 505736 - RNA, 64 nt, Human; identical to SEQ ID NO: 359165

SEQ ID NO: 505737 - RNA, 64 nt, Human; identical to SEQ ID NO: 359166

SEQ ID NO: 505738 - RNA, 64 nt, Human; identical to SEQ ID NO: 359167

SEQ ID NO: 505739 - RNA, 64 nt, Human; identical to SEQ ID NO: 206638

SEQ ID NO: 505740 - RNA, 64 nt, Human; identical to SEQ ID NO: 206639

SEQ ID NO: 505741 - RNA, 64 nt, Human; identical to SEQ ID NO: 206640

SEQ ID NO: 505742 - RNA, 64 nt, Human; identical to SEQ ID NO: 206641

SEQ ID NO: 505743 - RNA, 64 nt, Human; identical to SEQ ID NO: 206642

SEQ ID NO: 505744 - RNA, 64 nt, Human; identical to SEQ ID NO: 206643

SEQ ID NO: 505745 - RNA, 64 nt, Human; identical to SEQ ID NO: 206644

SEQ ID NO: 505746 - RNA, 64 nt, Human; identical to SEQ ID NO: 206645

SEQ ID NO: 505747 - RNA, 64 nt, Human; identical to SEQ ID NO: 206646

SEQ ID NO: 505748 - RNA, 64 nt, Human; identical to SEQ ID NO: 206647

SEQ ID NO: 505749 - RNA, 64 nt, Human; identical to SEQ ID NO: 206648

SEQ ID NO: 505750 - RNA, 64 nt, Human; identical to SEQ ID NO: 206649

SEQ ID NO: 505751 - RNA, 64 nt, Human; identical to SEQ ID NO: 206650

SEQ ID NO: 505752 - RNA, 64 nt, Human; identical to SEQ ID NO: 206651

SEQ ID NO: 505753 - RNA, 64 nt, Human; identical to SEQ ID NO: 206652

SEQ ID NO: 505754 - RNA, 51 nt, Human; identical to SEQ ID NO: 241951

SEQ ID NO: 505755 - RNA, 64 nt, Human; identical to SEQ ID NO: 240762

SEQ ID NO: 505756 - RNA, 64 nt, Human; identical to SEQ ID NO: 240264

SEQ ID NO: 505757 - RNA, 64 nt, Human; identical to SEQ ID NO: 241992

SEQ ID NO: 505758 - RNA, 64 nt, Human; identical to SEQ ID NO: 206653

SEQ ID NO: 505759 - RNA, 64 nt, Human; identical to SEQ ID NO: 206654

SEQ ID NO: 505760 - RNA, 64 nt, Human; identical to SEQ ID NO: 206655

SEQ ID NO: 505761 - RNA, 64 nt, Human; identical to SEQ ID NO: 206656

SEQ ID NO: 505762 - RNA, 64 nt, Human; identical to SEQ ID NO: 206657

SEQ ID NO: 505763 - RNA, 61 nt, Human; identical to SEQ ID NO: 206658

SEQ ID NO: 505764 - RNA, 64 nt, Human; identical to SEQ ID NO: 206659

SEQ ID NO: 505765 - RNA, 64 nt, Human; identical to SEQ ID NO: 206660

SEQ ID NO: 505766 - RNA, 52 nt, Human; identical to SEQ ID NO: 206661

SEQ ID NO: 505767 - RNA, 64 nt, Human; identical to SEQ ID NO: 206662

SEQ ID NO: 505768 - RNA, 64 nt, Human; identical to SEQ ID NO: 206663

SEQ ID NO: 505769 - RNA, 64 nt, Human; identical to SEQ ID NO: 206664

SEQ ID NO: 505770 - RNA, 64 nt, Human; identical to SEQ ID NO: 206665

SEQ ID NO: 505771 - RNA, 64 nt, Human; identical to SEQ ID NO: 206666

SEQ ID NO: 505772 - RNA, 64 nt, Human; identical to SEQ ID NO: 206667

SEQ ID NO: 505773 - RNA, 64 nt, Human; identical to SEQ ID NO: 241931

SEQ ID NO: 505774 - RNA, 64 nt, Human; identical to SEQ ID NO: 241949

SEQ ID NO: 505775 - RNA, 64 nt, Human; identical to SEQ ID NO: 240263

SEQ ID NO: 505776 - RNA, 64 nt, Human; identical to SEQ ID NO: 241993

SEQ ID NO: 505777 - RNA, 64 nt, Human; identical to SEQ ID NO: 206668

SEQ ID NO: 505778 - RNA, 64 nt, Human; identical to SEQ ID NO: 206669

SEQ ID NO: 505779 - RNA, 64 nt, Human; identical to SEQ ID NO: 206670

SEQ ID NO: 505780 - RNA, 64 nt, Human; identical to SEQ ID NO: 206671

SEQ ID NO: 505781 - RNA, 64 nt, Human; identical to SEQ ID NO: 206672

SEQ ID NO: 505782 - RNA, 64 nt, Human; identical to SEQ ID NO: 206673

SEQ ID NO: 505783 - RNA, 53 nt, Human; identical to SEQ ID NO: 206674

SEQ ID NO: 505784 - RNA, 64 nt, Human; identical to SEQ ID NO: 206675

SEQ ID NO: 505785 - RNA, 64 nt, Human; identical to SEQ ID NO: 206676

SEQ ID NO: 505786 - RNA, 64 nt, Human; identical to SEQ ID NO: 206677

SEQ ID NO: 505787 - RNA, 64 nt, Human; identical to SEQ ID NO: 206678

SEQ ID NO: 505788 - RNA, 64 nt, Human; identical to SEQ ID NO: 206679

SEQ ID NO: 505789 - RNA, 64 nt, Human; identical to SEQ ID NO: 206680

SEQ ID NO: 505790 - RNA, 64 nt, Human; identical to SEQ ID NO: 206681

SEQ ID NO: 505791 - RNA, 64 nt, Human; identical to SEQ ID NO: 206682

SEQ ID NO: 505792 - RNA, 64 nt, Human; identical to SEQ ID NO: 240638

SEQ ID NO: 505793 - RNA, 64 nt, Human; identical to SEQ ID NO: 240798

SEQ ID NO: 505794 - RNA, 64 nt, Human; identical to SEQ ID NO: 240316

SEQ ID NO: 505795 - RNA, 64 nt, Human; identical to SEQ ID NO: 359169

SEQ ID NO: 505796 - RNA, 64 nt, Human; identical to SEQ ID NO: 206683

SEQ ID NO: 505797 - RNA, 64 nt, Human; identical to SEQ ID NO: 206684

SEQ ID NO: 505798 - RNA, 64 nt, Human; identical to SEQ ID NO: 206685

SEQ ID NO: 505799 - RNA, 64 nt, Human; identical to SEQ ID NO: 206686

SEQ ID NO: 505800 - RNA, 64 nt, Human; identical to SEQ ID NO: 206687

SEQ ID NO: 505801 - RNA, 64 nt, Human; identical to SEQ ID NO: 206688

SEQ ID NO: 505802 - RNA, 64 nt, Human; identical to SEQ ID NO: 206689

SEQ ID NO: 505803 - RNA, 64 nt, Human; identical to SEQ ID NO: 206690

SEQ ID NO: 505804 - RNA, 64 nt, Human; identical to SEQ ID NO: 206691

SEQ ID NO: 505805 - RNA, 64 nt, Human; identical to SEQ ID NO: 206692

SEQ ID NO: 505806 - RNA, 62 nt, Human; identical to SEQ ID NO: 206693

SEQ ID NO: 505807 - RNA, 64 nt, Human; identical to SEQ ID NO: 206694

SEQ ID NO: 505808 - RNA, 64 nt, Human; identical to SEQ ID NO: 206695

SEQ ID NO: 505809 - RNA, 64 nt, Human; identical to SEQ ID NO: 206696

SEQ ID NO: 505810 - RNA, 64 nt, Human; identical to SEQ ID NO: 206697

SEQ ID NO: 505811 - RNA, 64 nt, Human; identical to SEQ ID NO: 240280

SEQ ID NO: 505812 - RNA, 64 nt, Human; identical to SEQ ID NO: 242089

SEQ ID NO: 505813 - RNA, 50 nt, Human; identical to SEQ ID NO: 240636

SEQ ID NO: 505814 - RNA, 64 nt, Human; identical to SEQ ID NO: 240281

SEQ ID NO: 505815 - RNA, 64 nt, Human; identical to SEQ ID NO: 206698

SEQ ID NO: 505816 - RNA, 52 nt, Human; identical to SEQ ID NO: 206699

SEQ ID NO: 505817 - RNA, 64 nt, Human; identical to SEQ ID NO: 206700

SEQ ID NO: 505818 - RNA, 64 nt, Human; identical to SEQ ID NO: 206701

SEQ ID NO: 505819 - RNA, 64 nt, Human; identical to SEQ ID NO: 206702

SEQ ID NO: 505820 - RNA, 64 nt, Human; identical to SEQ ID NO: 206703

SEQ ID NO: 505821 - RNA, 64 nt, Human; identical to SEQ ID NO: 206704

SEQ ID NO: 505822 - RNA, 64 nt, Human; identical to SEQ ID NO: 206705

SEQ ID NO: 505823 - RNA, 64 nt, Human; identical to SEQ ID NO: 206706

SEQ ID NO: 505824 - RNA, 64 nt, Human; identical to SEQ ID NO: 206707

SEQ ID NO: 505825 - RNA, 64 nt, Human; identical to SEQ ID NO: 206708

SEQ ID NO: 505826 - RNA, 64 nt, Human; identical to SEQ ID NO: 206709

SEQ ID NO: 505827 - RNA, 64 nt, Human; identical to SEQ ID NO: 206710

SEQ ID NO: 505828 - RNA, 64 nt, Human; identical to SEQ ID NO: 206711

SEQ ID NO: 505829 - RNA, 64 nt, Human; identical to SEQ ID NO: 206712

SEQ ID NO: 505830 - RNA, 64 nt, Human; identical to SEQ ID NO: 242164

SEQ ID NO: 505831 - RNA, 64 nt, Human; identical to SEQ ID NO: 242165

SEQ ID NO: 505832 - RNA, 64 nt, Human; identical to SEQ ID NO: 240618

SEQ ID NO: 505833 - RNA, 64 nt, Human; identical to SEQ ID NO: 240564

SEQ ID NO: 505834 - RNA, 64 nt, Human; identical to SEQ ID NO: 206713

SEQ ID NO: 505835 - RNA, 64 nt, Human; identical to SEQ ID NO: 206714

SEQ ID NO: 505836 - RNA, 64 nt, Human; identical to SEQ ID NO: 206715

SEQ ID NO: 505837 - RNA, 64 nt, Human; identical to SEQ ID NO: 206716

SEQ ID NO: 505838 - RNA, 64 nt, Human; identical to SEQ ID NO: 206717

SEQ ID NO: 505839 - RNA, 61 nt, Human; identical to SEQ ID NO: 206718

SEQ ID NO: 505840 - RNA, 50 nt, Human; identical to SEQ ID NO: 206719

SEQ ID NO: 505841 - RNA, 64 nt, Human; identical to SEQ ID NO: 206720

SEQ ID NO: 505842 - RNA, 64 nt, Human; identical to SEQ ID NO: 206721

SEQ ID NO: 505843 - RNA, 64 nt, Human; identical to SEQ ID NO: 206722

SEQ ID NO: 505844 - RNA, 64 nt, Human; identical to SEQ ID NO: 206723

SEQ ID NO: 505845 - RNA, 64 nt, Human; identical to SEQ ID NO: 206724

SEQ ID NO: 505846 - RNA, 64 nt, Human; identical to SEQ ID NO: 206725

SEQ ID NO: 505847 - RNA, 64 nt, Human; identical to SEQ ID NO: 206726

SEQ ID NO: 505848 - RNA, 64 nt, Human; identical to SEQ ID NO: 206727

SEQ ID NO: 505849 - RNA, 58 nt, Human; identical to SEQ ID NO: 240600

SEQ ID NO: 505850 - RNA, 64 nt, Human; identical to SEQ ID NO: 240601

SEQ ID NO: 505851 - RNA, 64 nt, Human; identical to SEQ ID NO: 240602

SEQ ID NO: 505852 - RNA, 64 nt, Human; identical to SEQ ID NO: 240654

SEQ ID NO: 505853 - RNA, 64 nt, Human; identical to SEQ ID NO: 206728

SEQ ID NO: 505854 - RNA, 64 nt, Human; identical to SEQ ID NO: 206729

SEQ ID NO: 505855 - RNA, 64 nt, Human; identical to SEQ ID NO: 206730

SEQ ID NO: 505856 - RNA, 64 nt, Human; identical to SEQ ID NO: 206731

SEQ ID NO: 505857 - RNA, 54 nt, Human; identical to SEQ ID NO: 206732

SEQ ID NO: 505858 - RNA, 64 nt, Human; identical to SEQ ID NO: 206733

SEQ ID NO: 505859 - RNA, 64 nt, Human; identical to SEQ ID NO: 206734

SEQ ID NO: 505860 - RNA, 64 nt, Human; identical to SEQ ID NO: 206735

SEQ ID NO: 505861 - RNA, 56 nt, Human; identical to SEQ ID NO: 206736

SEQ ID NO: 505862 - RNA, 64 nt, Human; identical to SEQ ID NO: 206737

SEQ ID NO: 505863 - RNA, 64 nt, Human; identical to SEQ ID NO: 206738

SEQ ID NO: 505864 - RNA, 64 nt, Human; identical to SEQ ID NO: 206739

SEQ ID NO: 505865 - RNA, 64 nt, Human; identical to SEQ ID NO: 206740

SEQ ID NO: 505866 - RNA, 64 nt, Human; identical to SEQ ID NO: 206741

SEQ ID NO: 505867 - RNA, 64 nt, Human; identical to SEQ ID NO: 206742

SEQ ID NO: 505868 - RNA, 64 nt, Human; identical to SEQ ID NO: 240764

SEQ ID NO: 505869 - RNA, 64 nt, Human; identical to SEQ ID NO: 241889

SEQ ID NO: 505870 - RNA, 64 nt, Human; identical to SEQ ID NO: 240335

SEQ ID NO: 505871 - RNA, 64 nt, Human; identical to SEQ ID NO: 359170

SEQ ID NO: 505872 - RNA, 64 nt, Human; identical to SEQ ID NO: 206743

SEQ ID NO: 505873 - RNA, 64 nt, Human; identical to SEQ ID NO: 206744

SEQ ID NO: 505874 - RNA, 64 nt, Human; identical to SEQ ID NO: 206745

SEQ ID NO: 505875 - RNA, 64 nt, Human; identical to SEQ ID NO: 206746

SEQ ID NO: 505876 - RNA, 64 nt, Human; identical to SEQ ID NO: 206747

SEQ ID NO: 505877 - RNA, 64 nt, Human; identical to SEQ ID NO: 206748

SEQ ID NO: 505878 - RNA, 64 nt, Human; identical to SEQ ID NO: 206749

SEQ ID NO: 505879 - RNA, 64 nt, Human; identical to SEQ ID NO: 206750

SEQ ID NO: 505880 - RNA, 64 nt, Human; identical to SEQ ID NO: 206751

SEQ ID NO: 505881 - RNA, 64 nt, Human; identical to SEQ ID NO: 206752

SEQ ID NO: 505882 - RNA, 64 nt, Human; identical to SEQ ID NO: 206753

SEQ ID NO: 505883 - RNA, 64 nt, Human; identical to SEQ ID NO: 206754

SEQ ID NO: 505884 - RNA, 64 nt, Human; identical to SEQ ID NO: 206755

SEQ ID NO: 505885 - RNA, 64 nt, Human; identical to SEQ ID NO: 206756

SEQ ID NO: 505886 - RNA, 64 nt, Human; identical to SEQ ID NO: 206757

SEQ ID NO: 505887 - RNA, 64 nt, Human; identical to SEQ ID NO: 240835

SEQ ID NO: 505888 - RNA, 64 nt, Human; identical to SEQ ID NO: 240836

SEQ ID NO: 505889 - RNA, 64 nt, Human; identical to SEQ ID NO: 240780

SEQ ID NO: 505890 - RNA, 64 nt, Human; identical to SEQ ID NO: 240637

SEQ ID NO: 505891 - RNA, 64 nt, Human; identical to SEQ ID NO: 206758

SEQ ID NO: 505892 - RNA, 64 nt, Human; identical to SEQ ID NO: 206759

SEQ ID NO: 505893 - RNA, 64 nt, Human; identical to SEQ ID NO: 206760

SEQ ID NO: 505894 - RNA, 64 nt, Human; identical to SEQ ID NO: 206761

SEQ ID NO: 505895 - RNA, 64 nt, Human; identical to SEQ ID NO: 206762

SEQ ID NO: 505896 - RNA, 64 nt, Human; identical to SEQ ID NO: 206763

SEQ ID NO: 505897 - RNA, 64 nt, Human; identical to SEQ ID NO: 206764

SEQ ID NO: 505898 - RNA, 64 nt, Human; identical to SEQ ID NO: 206765

SEQ ID NO: 505899 - RNA, 64 nt, Human; identical to SEQ ID NO: 206766

SEQ ID NO: 505900 - RNA, 64 nt, Human; identical to SEQ ID NO: 206767

SEQ ID NO: 505901 - RNA, 64 nt, Human; identical to SEQ ID NO: 206768

SEQ ID NO: 505902 - RNA, 64 nt, Human; identical to SEQ ID NO: 206769

SEQ ID NO: 505903 - RNA, 64 nt, Human; identical to SEQ ID NO: 206770

SEQ ID NO: 505904 - RNA, 64 nt, Human; identical to SEQ ID NO: 206771

SEQ ID NO: 505905 - RNA, 64 nt, Human; identical to SEQ ID NO: 206772

SEQ ID NO: 505906 - RNA, 64 nt, Human; identical to SEQ ID NO: 240565

SEQ ID NO: 505907 - RNA, 64 nt, Human; identical to SEQ ID NO: 240566

SEQ ID NO: 505908 - RNA, 64 nt, Human; identical to SEQ ID NO: 240619

SEQ ID NO: 505909 - RNA, 64 nt, Human; identical to SEQ ID NO: 240674

SEQ ID NO: 505910 - RNA, 64 nt, Human; identical to SEQ ID NO: 206773

SEQ ID NO: 505911 - RNA, 64 nt, Human; identical to SEQ ID NO: 206774

SEQ ID NO: 505912 - RNA, 64 nt, Human; identical to SEQ ID NO: 206775

SEQ ID NO: 505913 - RNA, 64 nt, Human; identical to SEQ ID NO: 206776

SEQ ID NO: 505914 - RNA, 64 nt, Human; identical to SEQ ID NO: 206777

SEQ ID NO: 505915 - RNA, 64 nt, Human; identical to SEQ ID NO: 206778

SEQ ID NO: 505916 - RNA, 64 nt, Human; identical to SEQ ID NO: 206779

SEQ ID NO: 505917 - RNA, 64 nt, Human; identical to SEQ ID NO: 206780

SEQ ID NO: 505918 - RNA, 64 nt, Human; identical to SEQ ID NO: 206781

SEQ ID NO: 505919 - RNA, 64 nt, Human; identical to SEQ ID NO: 206782

SEQ ID NO: 505920 - RNA, 64 nt, Human; identical to SEQ ID NO: 206783

SEQ ID NO: 505921 - RNA, 64 nt, Human; identical to SEQ ID NO: 206784

SEQ ID NO: 505922 - RNA, 64 nt, Human; identical to SEQ ID NO: 206785

SEQ ID NO: 505923 - RNA, 64 nt, Human; identical to SEQ ID NO: 206786

SEQ ID NO: 505924 - RNA, 64 nt, Human; identical to SEQ ID NO: 206787

SEQ ID NO: 505925 - RNA, 64 nt, Human; identical to SEQ ID NO: 240318

SEQ ID NO: 505926 - RNA, 64 nt, Human; identical to SEQ ID NO: 240728

SEQ ID NO: 505927 - RNA, 64 nt, Human; identical to SEQ ID NO: 240493

SEQ ID NO: 505928 - RNA, 52 nt, Human; identical to SEQ ID NO: 240334

SEQ ID NO: 505929 - RNA, 64 nt, Human; identical to SEQ ID NO: 206788

SEQ ID NO: 505930 - RNA, 64 nt, Human; identical to SEQ ID NO: 206789

SEQ ID NO: 505931 - RNA, 58 nt, Human; identical to SEQ ID NO: 206790

SEQ ID NO: 505932 - RNA, 64 nt, Human; identical to SEQ ID NO: 206791

SEQ ID NO: 505933 - RNA, 64 nt, Human; identical to SEQ ID NO: 206792

SEQ ID NO: 505934 - RNA, 64 nt, Human; identical to SEQ ID NO: 206793

SEQ ID NO: 505935 - RNA, 64 nt, Human; identical to SEQ ID NO: 206794

SEQ ID NO: 505936 - RNA, 64 nt, Human; identical to SEQ ID NO: 206795

SEQ ID NO: 505937 - RNA, 64 nt, Human; identical to SEQ ID NO: 206796

SEQ ID NO: 505938 - RNA, 64 nt, Human; identical to SEQ ID NO: 206797

SEQ ID NO: 505939 - RNA, 64 nt, Human; identical to SEQ ID NO: 206798

SEQ ID NO: 505940 - RNA, 64 nt, Human; identical to SEQ ID NO: 206799

SEQ ID NO: 505941 - RNA, 64 nt, Human; identical to SEQ ID NO: 206800

SEQ ID NO: 505942 - RNA, 64 nt, Human; identical to SEQ ID NO: 206801

SEQ ID NO: 505943 - RNA, 64 nt, Human; identical to SEQ ID NO: 206802

SEQ ID NO: 505944 - RNA, 64 nt, Human; identical to SEQ ID NO: 240385

SEQ ID NO: 505945 - RNA, 64 nt, Human; identical to SEQ ID NO: 357249

SEQ ID NO: 505946 - RNA, 64 nt, Human; identical to SEQ ID NO: 357250

SEQ ID NO: 505947 - RNA, 64 nt, Human; identical to SEQ ID NO: 357251

SEQ ID NO: 505948 - RNA, 64 nt, Human; identical to SEQ ID NO: 206803

SEQ ID NO: 505949 - RNA, 64 nt, Human; identical to SEQ ID NO: 206804

SEQ ID NO: 505950 - RNA, 64 nt, Human; identical to SEQ ID NO: 206805

SEQ ID NO: 505951 - RNA, 64 nt, Human; identical to SEQ ID NO: 206806

SEQ ID NO: 505952 - RNA, 64 nt, Human; identical to SEQ ID NO: 206807

SEQ ID NO: 505953 - RNA, 64 nt, Human; identical to SEQ ID NO: 206808

SEQ ID NO: 505954 - RNA, 64 nt, Human; identical to SEQ ID NO: 206809

SEQ ID NO: 505955 - RNA, 64 nt, Human; identical to SEQ ID NO: 206810

SEQ ID NO: 505956 - RNA, 64 nt, Human; identical to SEQ ID NO: 206811

SEQ ID NO: 505957 - RNA, 64 nt, Human; identical to SEQ ID NO: 206812

SEQ ID NO: 505958 - RNA, 64 nt, Human; identical to SEQ ID NO: 206813

SEQ ID NO: 505959 - RNA, 64 nt, Human; identical to SEQ ID NO: 206814

SEQ ID NO: 505960 - RNA, 62 nt, Human; identical to SEQ ID NO: 206815

SEQ ID NO: 505961 - RNA, 64 nt, Human; identical to SEQ ID NO: 206816

SEQ ID NO: 505962 - RNA, 64 nt, Human; identical to SEQ ID NO: 206817

SEQ ID NO: 505963 - RNA, 64 nt, Human; identical to SEQ ID NO: 241994

SEQ ID NO: 505964 - RNA, 64 nt, Human; identical to SEQ ID NO: 240782

SEQ ID NO: 505965 - RNA, 64 nt, Human; identical to SEQ ID NO: 240582

SEQ ID NO: 505966 - RNA, 64 nt, Human; identical to SEQ ID NO: 240336

SEQ ID NO: 505967 - RNA, 64 nt, Human; identical to SEQ ID NO: 206818

SEQ ID NO: 505968 - RNA, 61 nt, Human; identical to SEQ ID NO: 206819

SEQ ID NO: 505969 - RNA, 64 nt, Human; identical to SEQ ID NO: 206820

SEQ ID NO: 505970 - RNA, 64 nt, Human; identical to SEQ ID NO: 206821

SEQ ID NO: 505971 - RNA, 64 nt, Human; identical to SEQ ID NO: 206822

SEQ ID NO: 505972 - RNA, 64 nt, Human; identical to SEQ ID NO: 206823

SEQ ID NO: 505973 - RNA, 64 nt, Human; identical to SEQ ID NO: 206824

SEQ ID NO: 505974 - RNA, 64 nt, Human; identical to SEQ ID NO: 206825

SEQ ID NO: 505975 - RNA, 64 nt, Human; identical to SEQ ID NO: 206826

SEQ ID NO: 505976 - RNA, 64 nt, Human; identical to SEQ ID NO: 206827

SEQ ID NO: 505977 - RNA, 64 nt, Human; identical to SEQ ID NO: 206828

SEQ ID NO: 505978 - RNA, 64 nt, Human; identical to SEQ ID NO: 206829

SEQ ID NO: 505979 - RNA, 64 nt, Human; identical to SEQ ID NO: 206830

SEQ ID NO: 505980 - RNA, 64 nt, Human; identical to SEQ ID NO: 206831

SEQ ID NO: 505981 - RNA, 53 nt, Human; identical to SEQ ID NO: 206832

SEQ ID NO: 505982 - RNA, 64 nt, Human; identical to SEQ ID NO: 242031

SEQ ID NO: 505983 - RNA, 64 nt, Human; identical to SEQ ID NO: 242032

SEQ ID NO: 505984 - RNA, 64 nt, Human; identical to SEQ ID NO: 242125

SEQ ID NO: 505985 - RNA, 64 nt, Human; identical to SEQ ID NO: 240174

SEQ ID NO: 505986 - RNA, 64 nt, Human; identical to SEQ ID NO: 206833

SEQ ID NO: 505987 - RNA, 64 nt, Human; identical to SEQ ID NO: 206834

SEQ ID NO: 505988 - RNA, 64 nt, Human; identical to SEQ ID NO: 206835

SEQ ID NO: 505989 - RNA, 64 nt, Human; identical to SEQ ID NO: 206836

SEQ ID NO: 505990 - RNA, 64 nt, Human; identical to SEQ ID NO: 206837

SEQ ID NO: 505991 - RNA, 64 nt, Human; identical to SEQ ID NO: 206838

SEQ ID NO: 505992 - RNA, 64 nt, Human; identical to SEQ ID NO: 206839

SEQ ID NO: 505993 - RNA, 64 nt, Human; identical to SEQ ID NO: 206840

SEQ ID NO: 505994 - RNA, 64 nt, Human; identical to SEQ ID NO: 206841

SEQ ID NO: 505995 - RNA, 64 nt, Human; identical to SEQ ID NO: 206842

SEQ ID NO: 505996 - RNA, 51 nt, Human; identical to SEQ ID NO: 206843

SEQ ID NO: 505997 - RNA, 64 nt, Human; identical to SEQ ID NO: 206844

SEQ ID NO: 505998 - RNA, 64 nt, Human; identical to SEQ ID NO: 206845

SEQ ID NO: 505999 - RNA, 64 nt, Human; identical to SEQ ID NO: 206846

SEQ ID NO: 506000 - RNA, 64 nt, Human; identical to SEQ ID NO: 206847

SEQ ID NO: 506001 - RNA, 64 nt, Human; identical to SEQ ID NO: 242050

SEQ ID NO: 506002 - RNA, 64 nt, Human; identical to SEQ ID NO: 242051

SEQ ID NO: 506003 - RNA, 64 nt, Human; identical to SEQ ID NO: 241281

SEQ ID NO: 506004 - RNA, 64 nt, Human; identical to SEQ ID NO: 241910

SEQ ID NO: 506005 - RNA, 64 nt, Human; identical to SEQ ID NO: 206848

SEQ ID NO: 506006 - RNA, 64 nt, Human; identical to SEQ ID NO: 206849

SEQ ID NO: 506007 - RNA, 64 nt, Human; identical to SEQ ID NO: 206850

SEQ ID NO: 506008 - RNA, 64 nt, Human; identical to SEQ ID NO: 206851

SEQ ID NO: 506009 - RNA, 64 nt, Human; identical to SEQ ID NO: 206852

SEQ ID NO: 506010 - RNA, 64 nt, Human; identical to SEQ ID NO: 206853

SEQ ID NO: 506011 - RNA, 64 nt, Human; identical to SEQ ID NO: 206854

SEQ ID NO: 506012 - RNA, 64 nt, Human; identical to SEQ ID NO: 206855

SEQ ID NO: 506013 - RNA, 64 nt, Human; identical to SEQ ID NO: 206856

SEQ ID NO: 506014 - RNA, 64 nt, Human; identical to SEQ ID NO: 206857

SEQ ID NO: 506015 - RNA, 64 nt, Human; identical to SEQ ID NO: 206858

SEQ ID NO: 506016 - RNA, 64 nt, Human; identical to SEQ ID NO: 206859

SEQ ID NO: 506017 - RNA, 64 nt, Human; identical to SEQ ID NO: 206860

SEQ ID NO: 506018 - RNA, 64 nt, Human; identical to SEQ ID NO: 206861

SEQ ID NO: 506019 - RNA, 64 nt, Human; identical to SEQ ID NO: 206862

SEQ ID NO: 506020 - RNA, 64 nt, Human; identical to SEQ ID NO: 242106

SEQ ID NO: 506021 - RNA, 64 nt, Human; identical to SEQ ID NO: 242107

SEQ ID NO: 506022 - RNA, 64 nt, Human; identical to SEQ ID NO: 242108

SEQ ID NO: 506023 - RNA, 64 nt, Human; identical to SEQ ID NO: 242126

SEQ ID NO: 506024 - RNA, 64 nt, Human; identical to SEQ ID NO: 206863

SEQ ID NO: 506025 - RNA, 64 nt, Human; identical to SEQ ID NO: 206864

SEQ ID NO: 506026 - RNA, 64 nt, Human; identical to SEQ ID NO: 206865

SEQ ID NO: 506027 - RNA, 64 nt, Human; identical to SEQ ID NO: 206866

SEQ ID NO: 506028 - RNA, 64 nt, Human; identical to SEQ ID NO: 206867

SEQ ID NO: 506029 - RNA, 64 nt, Human; identical to SEQ ID NO: 206868

SEQ ID NO: 506030 - RNA, 64 nt, Human; identical to SEQ ID NO: 206869

SEQ ID NO: 506031 - RNA, 64 nt, Human; identical to SEQ ID NO: 206870

SEQ ID NO: 506032 - RNA, 64 nt, Human; identical to SEQ ID NO: 206871

SEQ ID NO: 506033 - RNA, 64 nt, Human; identical to SEQ ID NO: 206872

SEQ ID NO: 506034 - RNA, 64 nt, Human; identical to SEQ ID NO: 206873

SEQ ID NO: 506035 - RNA, 64 nt, Human; identical to SEQ ID NO: 206874

SEQ ID NO: 506036 - RNA, 64 nt, Human; identical to SEQ ID NO: 206875

SEQ ID NO: 506037 - RNA, 64 nt, Human; identical to SEQ ID NO: 206876

SEQ ID NO: 506038 - RNA, 64 nt, Human; identical to SEQ ID NO: 206877

SEQ ID NO: 506039 - RNA, 64 nt, Human; identical to SEQ ID NO: 240191

SEQ ID NO: 506040 - RNA, 64 nt, Human; identical to SEQ ID NO: 242127

SEQ ID NO: 506041 - RNA, 64 nt, Human; identical to SEQ ID NO: 241908

SEQ ID NO: 506042 - RNA, 64 nt, Human; identical to SEQ ID NO: 242145

SEQ ID NO: 506043 - RNA, 64 nt, Human; identical to SEQ ID NO: 206878

SEQ ID NO: 506044 - RNA, 64 nt, Human; identical to SEQ ID NO: 206879

SEQ ID NO: 506045 - RNA, 64 nt, Human; identical to SEQ ID NO: 206880

SEQ ID NO: 506046 - RNA, 64 nt, Human; identical to SEQ ID NO: 206881

SEQ ID NO: 506047 - RNA, 64 nt, Human; identical to SEQ ID NO: 206882

SEQ ID NO: 506048 - RNA, 64 nt, Human; identical to SEQ ID NO: 206883

SEQ ID NO: 506049 - RNA, 64 nt, Human; identical to SEQ ID NO: 206884

SEQ ID NO: 506050 - RNA, 64 nt, Human; identical to SEQ ID NO: 206885

SEQ ID NO: 506051 - RNA, 64 nt, Human; identical to SEQ ID NO: 206886

SEQ ID NO: 506052 - RNA, 64 nt, Human; identical to SEQ ID NO: 206887

SEQ ID NO: 506053 - RNA, 64 nt, Human; identical to SEQ ID NO: 206888

SEQ ID NO: 506054 - RNA, 64 nt, Human; identical to SEQ ID NO: 206889

SEQ ID NO: 506055 - RNA, 64 nt, Human; identical to SEQ ID NO: 206890

SEQ ID NO: 506056 - RNA, 64 nt, Human; identical to SEQ ID NO: 206891

SEQ ID NO: 506057 - RNA, 64 nt, Human; identical to SEQ ID NO: 206892

SEQ ID NO: 506058 - RNA, 64 nt, Human; identical to SEQ ID NO: 242323

SEQ ID NO: 506059 - RNA, 64 nt, Human; identical to SEQ ID NO: 240209

SEQ ID NO: 506060 - RNA, 64 nt, Human; identical to SEQ ID NO: 242324

SEQ ID NO: 506061 - RNA, 57 nt, Human; identical to SEQ ID NO: 242325

SEQ ID NO: 506062 - RNA, 64 nt, Human; identical to SEQ ID NO: 206893

SEQ ID NO: 506063 - RNA, 64 nt, Human; identical to SEQ ID NO: 206894

SEQ ID NO: 506064 - RNA, 64 nt, Human; identical to SEQ ID NO: 206895

SEQ ID NO: 506065 - RNA, 64 nt, Human; identical to SEQ ID NO: 206896

SEQ ID NO: 506066 - RNA, 64 nt, Human; identical to SEQ ID NO: 206897

SEQ ID NO: 506067 - RNA, 64 nt, Human; identical to SEQ ID NO: 206898

SEQ ID NO: 506068 - RNA, 64 nt, Human; identical to SEQ ID NO: 206899

SEQ ID NO: 506069 - RNA, 64 nt, Human; identical to SEQ ID NO: 206900

SEQ ID NO: 506070 - RNA, 64 nt, Human; identical to SEQ ID NO: 206901

SEQ ID NO: 506071 - RNA, 64 nt, Human; identical to SEQ ID NO: 206902

SEQ ID NO: 506072 - RNA, 64 nt, Human; identical to SEQ ID NO: 206903

SEQ ID NO: 506073 - RNA, 64 nt, Human; identical to SEQ ID NO: 206904

SEQ ID NO: 506074 - RNA, 64 nt, Human; identical to SEQ ID NO: 206905

SEQ ID NO: 506075 - RNA, 64 nt, Human; identical to SEQ ID NO: 206906

SEQ ID NO: 506076 - RNA, 64 nt, Human; identical to SEQ ID NO: 206907

SEQ ID NO: 506077 - RNA, 64 nt, Human; identical to SEQ ID NO: 240299

SEQ ID NO: 506078 - RNA, 64 nt, Human; identical to SEQ ID NO: 240620

SEQ ID NO: 506079 - RNA, 64 nt, Human; identical to SEQ ID NO: 240727

SEQ ID NO: 506080 - RNA, 64 nt, Human; identical to SEQ ID NO: 242070

SEQ ID NO: 506081 - RNA, 64 nt, Human; identical to SEQ ID NO: 206908

SEQ ID NO: 506082 - RNA, 64 nt, Human; identical to SEQ ID NO: 206909

SEQ ID NO: 506083 - RNA, 64 nt, Human; identical to SEQ ID NO: 206910

SEQ ID NO: 506084 - RNA, 64 nt, Human; identical to SEQ ID NO: 206911

SEQ ID NO: 506085 - RNA, 64 nt, Human; identical to SEQ ID NO: 206912

SEQ ID NO: 506086 - RNA, 64 nt, Human; identical to SEQ ID NO: 206913

SEQ ID NO: 506087 - RNA, 64 nt, Human; identical to SEQ ID NO: 206914

SEQ ID NO: 506088 - RNA, 64 nt, Human; identical to SEQ ID NO: 206915

SEQ ID NO: 506089 - RNA, 64 nt, Human; identical to SEQ ID NO: 206916

SEQ ID NO: 506090 - RNA, 64 nt, Human; identical to SEQ ID NO: 206917

SEQ ID NO: 506091 - RNA, 51 nt, Human; identical to SEQ ID NO: 206918

SEQ ID NO: 506092 - RNA, 64 nt, Human; identical to SEQ ID NO: 206919

SEQ ID NO: 506093 - RNA, 64 nt, Human; identical to SEQ ID NO: 206920

SEQ ID NO: 506094 - RNA, 64 nt, Human; identical to SEQ ID NO: 206921

SEQ ID NO: 506095 - RNA, 64 nt, Human; identical to SEQ ID NO: 206922

SEQ ID NO: 506096 - RNA, 64 nt, Human; identical to SEQ ID NO: 242146

SEQ ID NO: 506097 - RNA, 64 nt, Human; identical to SEQ ID NO: 240869

SEQ ID NO: 506098 - RNA, 64 nt, Human; identical to SEQ ID NO: 240208

SEQ ID NO: 506099 - RNA, 64 nt, Human; identical to SEQ ID NO: 240226

SEQ ID NO: 506100 - RNA, 64 nt, Human; identical to SEQ ID NO: 206923

SEQ ID NO: 506101 - RNA, 64 nt, Human; identical to SEQ ID NO: 206924

SEQ ID NO: 506102 - RNA, 64 nt, Human; identical to SEQ ID NO: 206925

SEQ ID NO: 506103 - RNA, 64 nt, Human; identical to SEQ ID NO: 206926

SEQ ID NO: 506104 - RNA, 64 nt, Human; identical to SEQ ID NO: 206927

SEQ ID NO: 506105 - RNA, 64 nt, Human; identical to SEQ ID NO: 206928

SEQ ID NO: 506106 - RNA, 64 nt, Human; identical to SEQ ID NO: 206929

SEQ ID NO: 506107 - RNA, 64 nt, Human; identical to SEQ ID NO: 206930

SEQ ID NO: 506108 - RNA, 64 nt, Human; identical to SEQ ID NO: 206931

SEQ ID NO: 506109 - RNA, 64 nt, Human; identical to SEQ ID NO: 206932

SEQ ID NO: 506110 - RNA, 64 nt, Human; identical to SEQ ID NO: 206933

SEQ ID NO: 506111 - RNA, 64 nt, Human; identical to SEQ ID NO: 206934

SEQ ID NO: 506112 - RNA, 53 nt, Human; identical to SEQ ID NO: 206935

SEQ ID NO: 506113 - RNA, 64 nt, Human; identical to SEQ ID NO: 206936

SEQ ID NO: 506114 - RNA, 53 nt, Human; identical to SEQ ID NO: 206935

SEQ ID NO: 506115 - RNA, 64 nt, Human; identical to SEQ ID NO: 240817

SEQ ID NO: 506116 - RNA, 64 nt, Human; identical to SEQ ID NO: 240818

SEQ ID NO: 506117 - RNA, 64 nt, Human; identical to SEQ ID NO: 242088

SEQ ID NO: 506118 - RNA, 64 nt, Human; identical to SEQ ID NO: 240834

SEQ ID NO: 506119 - RNA, 64 nt, Human; identical to SEQ ID NO: 206938

SEQ ID NO: 506120 - RNA, 64 nt, Human; identical to SEQ ID NO: 206939

SEQ ID NO: 506121 - RNA, 64 nt, Human; identical to SEQ ID NO: 206940

SEQ ID NO: 506122 - RNA, 64 nt, Human; identical to SEQ ID NO: 206941

SEQ ID NO: 506123 - RNA, 64 nt, Human; identical to SEQ ID NO: 206942

SEQ ID NO: 506124 - RNA, 64 nt, Human; identical to SEQ ID NO: 206943

SEQ ID NO: 506125 - RNA, 64 nt, Human; identical to SEQ ID NO: 206944

SEQ ID NO: 506126 - RNA, 64 nt, Human; identical to SEQ ID NO: 206945

SEQ ID NO: 506127 - RNA, 64 nt, Human; identical to SEQ ID NO: 206946

SEQ ID NO: 506128 - RNA, 64 nt, Human; identical to SEQ ID NO: 206947

SEQ ID NO: 506129 - RNA, 64 nt, Human; identical to SEQ ID NO: 206948

SEQ ID NO: 506130 - RNA, 64 nt, Human; identical to SEQ ID NO: 206949

SEQ ID NO: 506131 - RNA, 64 nt, Human; identical to SEQ ID NO: 206950

SEQ ID NO: 506132 - RNA, 64 nt, Human; identical to SEQ ID NO: 206951

SEQ ID NO: 506133 - RNA, 64 nt, Human; identical to SEQ ID NO: 206952

SEQ ID NO: 506134 - RNA, 64 nt, Human; identical to SEQ ID NO: 240852

SEQ ID NO: 506135 - RNA, 64 nt, Human; identical to SEQ ID NO: 240853

SEQ ID NO: 506136 - RNA, 64 nt, Human; identical to SEQ ID NO: 240870

SEQ ID NO: 506137 - RNA, 64 nt, Human; identical to SEQ ID NO: 240244

SEQ ID NO: 506138 - RNA, 64 nt, Human; identical to SEQ ID NO: 206953

SEQ ID NO: 506139 - RNA, 64 nt, Human; identical to SEQ ID NO: 206954

SEQ ID NO: 506140 - RNA, 64 nt, Human; identical to SEQ ID NO: 206955

SEQ ID NO: 506141 - RNA, 64 nt, Human; identical to SEQ ID NO: 206956

SEQ ID NO: 506142 - RNA, 64 nt, Human; identical to SEQ ID NO: 206957

SEQ ID NO: 506143 - RNA, 64 nt, Human; identical to SEQ ID NO: 206958

SEQ ID NO: 506144 - RNA, 64 nt, Human; identical to SEQ ID NO: 206959

SEQ ID NO: 506145 - RNA, 64 nt, Human; identical to SEQ ID NO: 206960

SEQ ID NO: 506146 - RNA, 64 nt, Human; identical to SEQ ID NO: 206961

SEQ ID NO: 506147 - RNA, 64 nt, Human; identical to SEQ ID NO: 206962

SEQ ID NO: 506148 - RNA, 64 nt, Human; identical to SEQ ID NO: 206963

SEQ ID NO: 506149 - RNA, 64 nt, Human; identical to SEQ ID NO: 206964

SEQ ID NO: 506150 - RNA, 64 nt, Human; identical to SEQ ID NO: 206965

SEQ ID NO: 506151 - RNA, 64 nt, Human; identical to SEQ ID NO: 206966

SEQ ID NO: 506152 - RNA, 64 nt, Human; identical to SEQ ID NO: 206967

SEQ ID NO: 506153 - RNA, 64 nt, Human; identical to SEQ ID NO: 240529

SEQ ID NO: 506154 - RNA, 64 nt, Human; identical to SEQ ID NO: 240317

SEQ ID NO: 506155 - RNA, 64 nt, Human; identical to SEQ ID NO: 240710

SEQ ID NO: 506156 - RNA, 64 nt, Human; identical to SEQ ID NO: 359173

SEQ ID NO: 506157 - RNA, 64 nt, Human; identical to SEQ ID NO: 206968

SEQ ID NO: 506158 - RNA, 64 nt, Human; identical to SEQ ID NO: 206969

SEQ ID NO: 506159 - RNA, 64 nt, Human; identical to SEQ ID NO: 206970

SEQ ID NO: 506160 - RNA, 64 nt, Human; identical to SEQ ID NO: 206971

SEQ ID NO: 506161 - RNA, 64 nt, Human; identical to SEQ ID NO: 206972

SEQ ID NO: 506162 - RNA, 64 nt, Human; identical to SEQ ID NO: 206973

SEQ ID NO: 506163 - RNA, 56 nt, Human; identical to SEQ ID NO: 206974

SEQ ID NO: 506164 - RNA, 64 nt, Human; identical to SEQ ID NO: 206975

SEQ ID NO: 506165 - RNA, 64 nt, Human; identical to SEQ ID NO: 206976

SEQ ID NO: 506166 - RNA, 61 nt, Human; identical to SEQ ID NO: 206977

SEQ ID NO: 506167 - RNA, 64 nt, Human; identical to SEQ ID NO: 206978

SEQ ID NO: 506168 - RNA, 64 nt, Human; identical to SEQ ID NO: 206979

SEQ ID NO: 506169 - RNA, 64 nt, Human; identical to SEQ ID NO: 242087

SEQ ID NO: 506170 - RNA, 64 nt, Human; identical to SEQ ID NO: 240210

SEQ ID NO: 506171 - RNA, 64 nt, Human; identical to SEQ ID NO: 242404

SEQ ID NO: 506172 - RNA, 64 nt, Human
cagggagcccagccuauucccguuggcuggcugggccccucagcugcugggccccaccucccca

SEQ ID NO: 506173 - RNA, 64 nt, Human
uuuccagggggcucugcuccaaguucccuagcgggccccucagggagaaauagccucacgugca

SEQ ID NO: 506174 - RNA, 64 nt, Human
ccugagaugugggaggugcagcauguuccccugggccccucagaaagucgagcuuggaggccag

SEQ ID NO: 506175 - RNA, 64 nt, Human
cccagaugucugcagcccucagcagcugcagaccgccccucaccaacccagagaaccugcuuua

SEQ ID NO: 506176 - RNA, 64 nt, Human
ggcauuggugccaaguccaguggaugagaauccagccccucacaagcugugggauggggcuugg

SEQ ID NO: 506177 - RNA, 64 nt, Human
gaggcaccgugggccuggcacuugcaaaaguguggccccucacucuaguguguggucccucuca

SEQ ID NO: 506178 - RNA, 64 nt, Human
uucuaacugggccuaaggugagcugagggcuugagccccucagcccagcgggggucccuuuuca

SEQ ID NO: 506179 - RNA, 64 nt, Human
gacugcgggagccagcgcuccugccgccccucuugccccucagaccuugcauccacagaagcac

SEQ ID NO: 506180 - RNA, 64 nt, Human
aagugauucucccagaagcacaaagcauacucuugccccucagguguugcuuguguacaucgua

SEQ ID NO: 506181 - RNA, 64 nt, Human
gaggcaacaauagagacacaggcuggguuggucugccccucagucaggcccccuuacccaccca

SEQ ID NO: 506182 - RNA, 64 nt, Human
gccauggagugggaauccccagccgaggcccuaggccccucagcagggaagggauccccgggga

SEQ ID NO: 506183 - RNA, 64 nt, Human
ucugcaucuuggaggcagggaggugagggcaggugccccucagacacuucaggaagguaguuug

SEQ ID NO: 506184 - RNA, 64 nt, Human
ccaaucaugugaaggacagaagcuuuugccaugggccccucacaucagggaaaaugaccuucac

SEQ ID NO: 506185 - RNA, 64 nt, Human; identical to SEQ ID NO: 240887

SEQ ID NO: 506186 - RNA, 64 nt, Human; identical to SEQ ID NO: 240888

SEQ ID NO: 506187 - RNA, 64 nt, Human; identical to SEQ ID NO: 240889

SEQ ID NO: 506188 - RNA, 64 nt, Human
gugcccaccccucaaguguaaggaacugcguuccgccccucaggcccccaugggggcagggauc

SEQ ID NO: 506189 - RNA, 64 nt, Human
auugauaaaucagaggugcuacugaggaguuggugccccucauuccagaaucuccuacccccag

SEQ ID NO: 506190 - RNA, 64 nt, Human
auacuuauuucuggccaaaugaaucugcuucucugccccucaaacuuuuaguucacaauucauc

SEQ ID NO: 506191 - RNA, 64 nt, Human
uaaagcacucuuauuuuuugaucuggccuauuuugccccucauuguguagccucaauuaacaca

SEQ ID NO: 506192 - RNA, 64 nt, Human
ugccucugggaggagagggacuccuggggggccugccccucauacgccaucaccaaaaggaaag

SEQ ID NO: 506193 - RNA, 64 nt, Human
ccuuccugcccuguguuaggagauagggauauuggccccucacugcagcugccagcacuugguc

SEQ ID NO: 506194 - RNA, 64 nt, Human
gccccuagccccuucccuccuccuggggccuccagccccucacacugcuguucccagugauauu

SEQ ID NO: 506195 - RNA, 64 nt, Human
caugccgggaagccagagaccugcaggggccucggccccucacaucguguaugucucuccuuga

SEQ ID NO: 506196 - RNA, 64 nt, Human
ucucugcucccuucuucaguaagcaaggagccccgccccucaggcccagccucuggcaagaggu

SEQ ID NO: 506197 - RNA, 59 nt, Human; identical to SEQ ID NO: 424460

SEQ ID NO: 506198 - RNA, 64 nt, Human
gggccugaacugccucugcuucccccccugaggggccccucacucuuacccaagacucuggauu

SEQ ID NO: 506199 - RNA, 64 nt, Human
guagcccagcccaucuaaauggaagcugggaauugccccucaccuccccuguguccuguccagc

SEQ ID NO: 506200 - RNA, 64 nt, Human
agcacacacugcaugccuuaacaagugugugcaagccccucagaacucaagacauccaaauuuu

SEQ ID NO: 506201 - RNA, 64 nt, Human
gaaagauuucugaacagugauugucccguuaauagccccucagaagauguucccugcugauaac

SEQ ID NO: 506202 - RNA, 64 nt, Human
ugucauaaaaaacaguggagcucuguauuagaaagccccucagaacugggaaggccagguaacu

SEQ ID NO: 506203 - RNA, 64 nt, Human; identical to SEQ ID NO: 240245

SEQ ID NO: 506204 - RNA, 64 nt, Human; identical to SEQ ID NO: 240959

SEQ ID NO: 506205 - RNA, 64 nt, Human; identical to SEQ ID NO: 240960

SEQ ID NO: 506206 - RNA, 64 nt, Human
aucgguauauuaaguccaaaagaugguccgggcugccccucacaaaagcuucugcauccacgug

SEQ ID NO: 506207 - RNA, 64 nt, Human
gagccugggacccuguuuacaguugcacaucugggccccucacuguggggauugaucauucuca

SEQ ID NO: 506208 - RNA, 64 nt, Human
gacuccugggcuucagccucucccacccagcccugccccucaccugccugcccuccccuccccc

SEQ ID NO: 506209 - RNA, 64 nt, Human
agcuggaagaagccuuagagcucaacuucuucaagccccucacuuuacagaugaggaaauggag

SEQ ID NO: 506210 - RNA, 64 nt, Human
uggccagaagcaccagccugcugccagcggggcagccccucauaggaggcccaggagggagccc

SEQ ID NO: 506211 - RNA, 64 nt, Human
cccacagcccugagaugggccggcccccuuccuggccccucauggcgggacuggagaaaugguc

SEQ ID NO: 506212 - RNA, 64 nt, Human
cccggcccauaucccugguugccucauggccagcgccccucagccucugccacugugaaccggc

SEQ ID NO: 506213 - RNA, 64 nt, Human
gucugagcagccguguugggggcgcucccucucugccccucagcgagagccucggaccucccaa

SEQ ID NO: 506214 - RNA, 64 nt, Human
gcgaccugcugacccacggucacugcuguguucagccccucagcucggccccagccuauuuccc

SEQ ID NO: 506215 - RNA, 64 nt, Human
agagagggcccagcuguagccauggcucaggcaagccccucagcccuugcccccaucccucgga

SEQ ID NO: 506216 - RNA, 57 nt, Human; identical to SEQ ID NO: 424476

SEQ ID NO: 506217 - RNA, 64 nt, Human
gcuuuucgaacugugcucccacggggaccacugggccccucaggggaagcugcuaggggaagga

SEQ ID NO: 506218 - RNA, 64 nt, Human
gggaggggaggcggaucugaggggcugggugcaggccccucaguuggggcucccaccuucccca

SEQ ID NO: 506219 - RNA, 64 nt, Human
cuggggucccagggcccuuccuuguuucucagaggccccucagccacuggaaccccaucuucag

SEQ ID NO: 506220 - RNA, 64 nt, Human
acagccucuuuccgucccucucuuucugauccaggccccucaguccaagcuuuggaaaaccuuc

SEQ ID NO: 506221 - RNA, 64 nt, Human; identical to SEQ ID NO: 242257

SEQ ID NO: 506222 - RNA, 64 nt, Human; identical to SEQ ID NO: 242258

SEQ ID NO: 506223 - RNA, 64 nt, Human; identical to SEQ ID NO: 242259

SEQ ID NO: 506224 - RNA, 64 nt, Human
ggaagcacaugccucucucaggccaaacucaccugccccucaacucuccuccagagucagaagu

SEQ ID NO: 506225 - RNA, 64 nt, Human
gcccagcugcagccacccuucucaucuggaucgggccccucagaagcaggaaacccucaaaccc

SEQ ID NO: 506226 - RNA, 64 nt, Human
uuguccuacaucucccugaaccagagugugcccugccccucaugcucagaccucucccacccca

SEQ ID NO: 506227 - RNA, 64 nt, Human
cuuuuuguauuucuggggcugaggcucagcaacagccccucaggcuuccagugaguccccaucu

SEQ ID NO: 506228 - RNA, 64 nt, Human
ugugagaaagcuaaaaugguggucuucuccaccagccccucacaggcuuggggguuuucaaugu

SEQ ID NO: 506229 - RNA, 64 nt, Human
aaaccagugcauucuacuucucgaguguucacuugccccucaguuugugaccaaguugugggua

SEQ ID NO: 506230 - RNA, 64 nt, Human
acaacuauagacuugcucauuguucagacugauugccccucaccugaauccacucucuguauuc

SEQ ID NO: 506231 - RNA, 64 nt, Human
acucuaucuuuagauuucaaaccuuaggcuuacagccccucaauaucucucugcuaacaccagu

SEQ ID NO: 506232 - RNA, 64 nt, Human
ggaccccucccuugcucagugccuccuggccggggccccucaccccaaggggucuguauauaca

SEQ ID NO: 506233 - RNA, 64 nt, Human
aacauuaaucaccaaaguauuaauguacagaguggccccucaccugggccuuuccugugccaac

SEQ ID NO: 506234 - RNA, 64 nt, Human
gguccauccuggagacccugaggucuaagcuacagccccucagccaaccacagacccuucucug

SEQ ID NO: 506235 - RNA, 64 nt, Human
cuuccuggcucgucucaaaggccaggacccuggggccccucaacugcagucagagagcaagccc

SEQ ID NO: 506236 - RNA, 64 nt, Human
cuaccugaccaacaguuccuucagcuuccauuucgccccucauuuaucccucaacccccagccc

SEQ ID NO: 506237 - RNA, 64 nt, Human
guaugcuacuuucucucagcauccaauaaucauggccccucaauuuauuuguggucacccaggg

SEQ ID NO: 506238 - RNA, 64 nt, Human
caaaaagugcggaggaaguagcuggacaggcccugccccucaccagcaagaggcaugauuggau

SEQ ID NO: 506239 - RNA, 64 nt, Human; identical to SEQ ID NO: 240133

SEQ ID NO: 506240 - RNA, 64 nt, Human; identical to SEQ ID NO: 242241

SEQ ID NO: 506241 - RNA, 64 nt, Human; identical to SEQ ID NO: 242305

SEQ ID NO: 506242 - RNA, 64 nt, Human
uccuuccugcucacauccacagucagggcacggcgccccucaagaacuccagagucaccugucu

SEQ ID NO: 506243 - RNA, 64 nt, Human
gcaaaacccaaguagaugccucuaggggcacauggccccucacaucacaagccagaaccuaagc

SEQ ID NO: 506244 - RNA, 64 nt, Human
cuuagccauccccuccucagcaaggcaucuaccggccccucacagagacaguacuuugaaacuc

SEQ ID NO: 506245 - RNA, 64 nt, Human
aagagaaaaacccuccucugguaguucugugugugccccucaccccugugugcuagugucuggg

SEQ ID NO: 506246 - RNA, 64 nt, Human
uuugcccuugcaaaggcuuccuaggucuccaguggccccucaggacccagggucccagcugcug

SEQ ID NO: 506247 - RNA, 64 nt, Human
gagugacccuggcaguguuugccugcucagaguggccccucagaacaacagggcuggccuugga

SEQ ID NO: 506248 - RNA, 64 nt, Human
acccagucauccagcagcgucaacaucgugaugggccccucagccagggcugccagccaggcca

SEQ ID NO: 506249 - RNA, 64 nt, Human
gcgcgaagugaaggaugcgucacuuuucugagcggccccucagaccucuccugcuggucccugg

SEQ ID NO: 506250 - RNA, 57 nt, Human; identical to SEQ ID NO: 424504

SEQ ID NO: 506251 - RNA, 64 nt, Human
cucaaaauauauucagcaaaggguucacuuaguugccccucaugcuucacagguugacuaguau

SEQ ID NO: 506252 - RNA, 64 nt, Human
cugugaaugugccucguucaucccuggugcuugagccccucaagcuccagucaaugauccaguc

SEQ ID NO: 506253 - RNA, 64 nt, Human
gccacucucugcccacuaccuaugcuucuagaaagccccucaccucaggaccccagagggacca

SEQ ID NO: 506254 - RNA, 64 nt, Human
uguguugcgcccggagcccgcccuucgccucccagccccucaagacaccgcuggcugcuggaca

SEQ ID NO: 506255 - RNA, 64 nt, Human
cgcccggccccgccgcggcccggacccccagccagccccucacagcucuuccccagcuccgccu

SEQ ID NO: 506256 - RNA, 64 nt, Human
ucacucuggccaaggagcucugaauugugagucugccccucaggggaauucggagcuagaggac

SEQ ID NO: 506257 - RNA, 64 nt, Human; identical to SEQ ID NO: 242260

SEQ ID NO: 506258 - RNA, 64 nt, Human; identical to SEQ ID NO: 242402

SEQ ID NO: 506259 - RNA, 64 nt, Human; identical to SEQ ID NO: 240135

SEQ ID NO: 506260 - RNA, 64 nt, Human
cccuucccccauccaugguugggaaagaagcucagccccucacaguggccucaagugugaugcc

SEQ ID NO: 506261 - RNA, 64 nt, Human
agcgccccggcugggcggaggaggagacgcccaugccccucaggggaaaguggagaccgggaca

SEQ ID NO: 506262 - RNA, 64 nt, Human
agcugcacaugccagugugacccuugaagacagugccccucagagaccccaagaccuuagggau

SEQ ID NO: 506263 - RNA, 64 nt, Human
ccuaaugacacccacuccuagcccugaggcucgugccccucagacuggggaagaguccaaggaa

SEQ ID NO: 506264 - RNA, 64 nt, Human
ccuggggagggcccucuggccccaggcaaccuuagccccucagaacagggagucccaggaccca

SEQ ID NO: 506265 - RNA, 64 nt, Human
ggcuccguaagaacucagaugccugggaagcccagccccucaggugcccccacacacagccuuc

SEQ ID NO: 506266 - RNA, 64 nt, Human
uuuuauucacucuucagacacgcuacucaagagugccccucagcugcugaacaagcauuuguag

SEQ ID NO: 506267 - RNA, 64 nt, Human
cagaccucuuauugcccauucuccuuucuucucagccccucaccccucuuuagcaauuccuaga

SEQ ID NO: 506268 - RNA, 64 nt, Human
gggcccacugagcugcacugggauucuucacucugccccucacuuccuuuagggcaaauaacac

SEQ ID NO: 506269 - RNA, 64 nt, Human
acuuuuuauacuuuguaaagacaauuguuggagagccccucacacagcccuggccucugcucaa

SEQ ID NO: 506270 - RNA, 64 nt, Human
guuccugugcugcccugcaccuaggagagacucagccccucacagcuugggauguuaccuugcc

SEQ ID NO: 506271 - RNA, 64 nt, Human
aacuugccacaggagcgauguguuuucucugagugccccucacuuacauguuuaucuuuguuug

SEQ ID NO: 506272 - RNA, 64 nt, Human
cucccacgccugcccacuuugcuagcccggcugugccccucacuaucagagacugggcgaagca

SEQ ID NO: 506273 - RNA, 64 nt, Human
ccuuccagccccuccaggacccggucccccugcugccccucacuucaggaggggccuggagcag

SEQ ID NO: 506274 - RNA, 64 nt, Human
auagguuuuuauuguugaauguacaucuaccccagccccucaaaagaaaaacuguuuacauaga

SEQ ID NO: 506275 - RNA, 64 nt, Human; identical to SEQ ID NO: 240961

SEQ ID NO: 506276 - RNA, 64 nt, Human; identical to SEQ ID NO: 242163

SEQ ID NO: 506277 - RNA, 64 nt, Human; identical to SEQ ID NO: 240246

SEQ ID NO: 506278 - RNA, 64 nt, Human
ugcuauuuuuauagcugauauaguuacaccucaagccccucagggguaacaacuaacaaacacc

SEQ ID NO: 506279 - RNA, 64 nt, Human
aguuuucuagaagguugggauugucaggguccuggccccucagaacuggcuugaucaagggccu

SEQ ID NO: 506280 - RNA, 64 nt, Human
agaugcagccgucugaugaggccacaaccccuaggccccucaggagcuuugcagagaggaggac

SEQ ID NO: 506281 - RNA, 64 nt, Human
uugcuacucuuugagaaugaaguugucauucagggccccucauguagccaaaagaccaagaaaa

SEQ ID NO: 506282 - RNA, 64 nt, Human
aauaugagcuacugaggaggggguuggacauccugccccucaccccccacccacacugcaggua

SEQ ID NO: 506283 - RNA, 64 nt, Human
uguuuacauguguagccuauguugugguccaucagccccucacauuccuagggguuugagaugc

SEQ ID NO: 506284 - RNA, 64 nt, Human
gcaggguagggcugucgccuuagaucccgcccaagccccucauucccuccuugcacagaugcau

SEQ ID NO: 506285 - RNA, 64 nt, Human
accuaggaaccgccgcugccugcuggggggccacgccccucaugcccuugucccaggcccgggg

SEQ ID NO: 506286 - RNA, 64 nt, Human
agccacaccagccuggauuucaaucccagaaucugccccucacgaggaugugaccuugggcaga

SEQ ID NO: 506287 - RNA, 64 nt, Human
cccgugcuucucccuugggcagccucucucuugagccccucacccuguuucuuucugugaagcg

SEQ ID NO: 506288 - RNA, 64 nt, Human
uaauucuuucucauguugggagugagaaugccgggccccucagggcugucggugugcugucagc

SEQ ID NO: 506289 - RNA, 64 nt, Human
auucuagaacacuuggagccugaacucugaccaggccccucacuugagccuuugcuuucugcuc

SEQ ID NO: 506290 - RNA, 64 nt, Human
caugacccacuaacguggcaacuuuaacccaaaggccccucagacauguuacagcaaaucugga

SEQ ID NO: 506291 - RNA, 64 nt, Human
agccuccgaggagaccaggaacccugcuucagcagccccucagggcuucccaaggauguccagc

SEQ ID NO: 506292 - RNA, 64 nt, Human
cuguggccacagcucuggagugggaggguugguugccccucaccucagagcucccccaaaggcc

SEQ ID NO: 506293 - RNA, 64 nt, Human; identical to SEQ ID NO: 242278

SEQ ID NO: 506294 - RNA, 64 nt, Human; identical to SEQ ID NO: 242144

SEQ ID NO: 506295 - RNA, 64 nt, Human; identical to SEQ ID NO: 240136

SEQ ID NO: 506296 - RNA, 64 nt, Human
uggauuaggagagggggugaugaccccuccccaagccccucagggcccagaccuuccugcucuc

SEQ ID NO: 506297 - RNA, 64 nt, Human
agcucgaccuugcucuuauuagucccucaccccugccccucaugaucucccacuuucucuagcu

SEQ ID NO: 506298 - RNA, 64 nt, Human
ugucuccagaagucguggccuuccagaacagucugccccucaaggaaggguggggcaggcagua

SEQ ID NO: 506299 - RNA, 64 nt, Human
gggcuaagaaguucaccagcccugagccauggcggccccucagccugccugaagagaggaaacu

SEQ ID NO: 506300 - RNA, 64 nt, Human
ggcuagguuaggcccugcacuccaccuggggacggccccucaucaccugaaguccucugcugug

SEQ ID NO: 506301 - RNA, 64 nt, Human
gcugcuccaaaaucaucaacucagccccugggcugccccucagaggcggugucuggggaggacu

SEQ ID NO: 506302 - RNA, 64 nt, Human
ugcucgaguuccuggaugugcagaagcacuuguggccccucaaggaccucacgcugacgagcaa

SEQ ID NO: 506303 - RNA, 64 nt, Human
ccaucagggaccuccaggugcauggauuggugcugccccucaugcugcccagcuucuacucaga

SEQ ID NO: 506304 - RNA, 64 nt, Human
cugcaccucuggaggugcagggcacccuugagaagccccucaccccuaggccgccuccaggugc

SEQ ID NO: 506305 - RNA, 64 nt, Human
ccgcuaaggaagauaucuaguguuggggauccuggccccucaaccuccuguggaacccagcagu

SEQ ID NO: 506306 - RNA, 64 nt, Human
gucuaauccuucucauuacccacccgaccuggcugccccucaccuugggcugggggacuggggg

SEQ ID NO: 506307 - RNA, 64 nt, Human
ccuggcgcuugaggcucagaagagccucuguccagccccucaguauuaccaugucucccucuca

SEQ ID NO: 506308 - RNA, 64 nt, Human
aucaaaccauucuaauggaaaaggacaacaaacugccccucacuacuggcuugguuuggucuac

SEQ ID NO: 506309 - RNA, 64 nt, Human
guccuccauugaggaugcccacugaggcagccaggccccucaccagcccuggggggaauccuaa

SEQ ID NO: 506310 - RNA, 64 nt, Human
ucuuuagagcauugccauucccugccuggggcgggccccucaucgcguccuccuaccgaaaccu

SEQ ID NO: 506311 - RNA, 64 nt, Human; identical to SEQ ID NO: 242368

SEQ ID NO: 506312 - RNA, 64 nt, Human; identical to SEQ ID NO: 242369

SEQ ID NO: 506313 - RNA, 64 nt, Human; identical to SEQ ID NO: 242370

SEQ ID NO: 506314 - RNA, 64 nt, Human
uugcuuauuuguguaauggaugugguccucuaaagccccucauuguuuuugauugccuucuaua

SEQ ID NO: 506315 - RNA, 64 nt, Human
cuccccaccuccaggcuuucccacuucccacccugccccucagagacugaaauuacggguaccu

SEQ ID NO: 506316 - RNA, 64 nt, Human
ggccuuucccaccuggagagaaacuuccagaccagccccucauaccacagccaagaggggccuu

SEQ ID NO: 506317 - RNA, 64 nt, Human
ggccuuucccaccgguagagaaacuuccagaccagccccucacaccacagccaagagaagccuu

SEQ ID NO: 506318 - RNA, 64 nt, Human
ggccuuuaccaccuggagagaagcuuccagaccagccccucacaccacagccaggagaggccuu

SEQ ID NO: 506319 - RNA, 64 nt, Human; identical to SEQ ID NO: 506316

SEQ ID NO: 506320 - RNA, 64 nt, Human
ggccuuucucaccuggagagaaacuuccagaccagccccucacaccaccgccaggagaggccuu

SEQ ID NO: 506321 - RNA, 64 nt, Human
ggccuuucccaccgggagagaaacuuccagaccagccccucacaccacagccaggagaggccuu

SEQ ID NO: 506322 - RNA, 64 nt, Human
ggccuuucccaccgggagaggaacuuccagaccagccccucacaccacagccaggagaggccuu

SEQ ID NO: 506323 - RNA, 64 nt, Human
cagaaccaccagcaaagccggcggcuggacuggcgccccucagagaccugcggaaagcccccuc

SEQ ID NO: 506324 - RNA, 64 nt, Human
auuuuccagaaauuucucaaaaugucugcugauagccccucacucauauuuuucauguggguuu

SEQ ID NO: 506325 - RNA, 64 nt, Human
cucuguguuuccagaaggccccacacacccaagugccccucacaccucgugccucccccucaca

SEQ ID NO: 506326 - RNA, 64 nt, Human
cugaccagcagaauccacccggugaccagugguggccccucagcccacccucccggcagcucag

SEQ ID NO: 506327 - RNA, 64 nt, Human
gacuccagugcucuggcccgggacuccccuauccgccccucacuuacccuuaaacaggugaucc

SEQ ID NO: 506328 - RNA, 64 nt, Human
cauccacugaaggcuguguuuauucuuuuccugugccccucauaauggaagaaaguaaacugcu

SEQ ID NO: 506329 - RNA, 64 nt, Human; identical to SEQ ID NO: 240137

SEQ ID NO: 506330 - RNA, 64 nt, Human; identical to SEQ ID NO: 242336

SEQ ID NO: 506331 - RNA, 64 nt, Human; identical to SEQ ID NO: 242403

SEQ ID NO: 506332 - RNA, 64 nt, Human
gcgucgagugagcgucccgaggccacgugcggaggccccucacugugcugucaaaggccugugg

SEQ ID NO: 506333 - RNA, 64 nt, Human
ugcuagaaaaucgaguuggcaaaaugggguuugggccccucagagcccugcccugcacccuugu

SEQ ID NO: 506334 - RNA, 64 nt, Human
ucucgucacccaucacucccugcuuccgcagggcgccccucaguauucgcugccauaugucccu

SEQ ID NO: 506335 - RNA, 64 nt, Human
gggagauacugggggcagagcagacuuugccagugccccucaggucaaaccaagccaagagcac

SEQ ID NO: 506336 - RNA, 64 nt, Human
ggcccacacacccugccuaggccaccccgccgcggccccucaggucgcccuggccacacucaca

SEQ ID NO: 506337 - RNA, 64 nt, Human
cccuaagacccaccgacucugugcuagaacaagcgccccucagagauucugaugccacugaagu

SEQ ID NO: 506338 - RNA, 64 nt, Human
ggaggacagucuuuccccagcaggggucaggggggccccucaggaagccuaaggucgugcuagu

SEQ ID NO: 506339 - RNA, 64 nt, Human
ucacucccuuuggcuacccuggccgugccuggcagccccucaggccccacagguggguccuggu

SEQ ID NO: 506340 - RNA, 64 nt, Human
acggaaaucucugggacaauggcuccuccagagggccccucagagccaggugcuggccagaugc

SEQ ID NO: 506341 - RNA, 64 nt, Human
uuguagcccucugagcccucauccugcaggcagagccccucagugcucugagaaaccugcccug

SEQ ID NO: 506342 - RNA, 64 nt, Human
gugaggccuggcccugggcagggucuguggcugcgccccucaggccagcaguugagguccaucg

SEQ ID NO: 506343 - RNA, 64 nt, Human
augguccgcugagggcuggggggcggucuccgaggccccucaacagagaagccuccaccugagg

SEQ ID NO: 506344 - RNA, 64 nt, Human
gagaaaagccgaaaaagcaugcaucuuagaaauagccccucaauuccaggagucaacaugccaa

SEQ ID NO: 506345 - RNA, 64 nt, Human
gggagaguaagaacuaagggaaugaguuugggcggccccucauaaaggaccuuagaggcaggga

SEQ ID NO: 506346 - RNA, 64 nt, Human
ucuuguaauuguggauuaaugucaauguuaaucagccccucaaagggagagaaaagcuggaccu

SEQ ID NO: 506347 - RNA, 64 nt, Human; identical to SEQ ID NO: 240138

SEQ ID NO: 506348 - RNA, 64 nt, Human; identical to SEQ ID NO: 242386

SEQ ID NO: 506349 - RNA, 64 nt, Human; identical to SEQ ID NO: 242387

SEQ ID NO: 506350 - RNA, 64 nt, Human
agccaugggcuaaauggguacuagaacaacaacugccccucauguacgccaaggaugagcucua

SEQ ID NO: 506351 - RNA, 64 nt, Human
ugaaccuugcauauccuucacauauuucccauaagccccucagaaaggcuaacugugaugauga

SEQ ID NO: 506352 - RNA, 64 nt, Human
guggauauggugcagagaagcuggacuucugugggccccucaacagccaagugugaccccacug

SEQ ID NO: 506353 - RNA, 64 nt, Human
cagcaguccccuuggauacuaaagucugagccaggccccucaggcccggcaugggcagugcgag

SEQ ID NO: 506354 - RNA, 64 nt, Human
uuuuuuuaagcguuugcacuauuuagaguccuaagccccucauguucagcugugcuguguuucu

SEQ ID NO: 506355 - RNA, 64 nt, Human
agaaggaugugagaggugggcgcuuuggagguuugccccucacccaccagcugccccaucccug

SEQ ID NO: 506356 - RNA, 64 nt, Human
ccgaggugcugauggagaugcucaaggccagcaagccccucaggccagcacuucgcuugcagaa

SEQ ID NO: 506357 - RNA, 64 nt, Human
aucacgccucgcucccuccuggcccucugguccagccccucacgccuccucucagucuacucaa

SEQ ID NO: 506358 - RNA, 64 nt, Human
uuuuguguacuuuuaaaauuguaucuuuccaggagccccucagauuguaccuugcuuucucacc

SEQ ID NO: 506359 - RNA, 64 nt, Human
ugggggaguagaucuuucuaggagggagacacuggccccucaaaucguccagcgaccuuccuca

SEQ ID NO: 506360 - RNA, 64 nt, Human
cgggacagugcugcagcucccuggcuucuguggggccccucaccuacuuacccagguggguccc

SEQ ID NO: 506361 - RNA, 64 nt, Human
uccccaaaaccuuuccccagacacauucuccugugccccucagagaggcaugugaugugcaagg

SEQ ID NO: 506362 - RNA, 64 nt, Human
agugaccucaaauguugccuuggaguccccuacagccccucagcagagggcagcacuugaaugc

SEQ ID NO: 506363 - RNA, 64 nt, Human
agggcccuccucccccaccagcucuccccacagggccccucagcaucauggagacccgcaggcg

SEQ ID NO: 506364 - RNA, 64 nt, Human
uuuccaagagcaaggaugaaaaauugaagucacagccccucagcaccaagcagaaggugaggac

SEQ ID NO: 506365 - RNA, 64 nt, Human; identical to SEQ ID NO: 240154

SEQ ID NO: 506366 - RNA, 64 nt, Human; identical to SEQ ID NO: 242419

SEQ ID NO: 506367 - RNA, 64 nt, Human; identical to SEQ ID NO: 242420

SEQ ID NO: 506368 - RNA, 64 nt, Human
cugucacaggcugggucaaaagagcccuggcucugccccucagggggccagcuggggagauggg

SEQ ID NO: 506369 - RNA, 64 nt, Human
cacuggcugccaacuccugccgcccucugggacugccccucagucccaggagagcuaugaggcc

SEQ ID NO: 506370 - RNA, 64 nt, Human
ccccaaagcaguuagacuauggagagccgacccagccccucaggaacccucauccuucaaagac

SEQ ID NO: 506371 - RNA, 64 nt, Human
cuccccuagacucaggcuuccuuuggagauuaaggccccucagagaucaacagaccaacauuuu

SEQ ID NO: 506372 - RNA, 64 nt, Human
cugaggcuggcaaguggggcaacguguggaggaagccccucauaauuuggagaaaacuugauac

SEQ ID NO: 506373 - RNA, 64 nt, Human
uauugccauacaauuuuaauuuauacaaguauuggccccucaagugguuggaaauuuuuuuuuu

SEQ ID NO: 506374 - RNA, 64 nt, Human
ucaugaauaggcguacuuucuguauuuaaaaauggccccucaagcaccguuaauuuacauucca

SEQ ID NO: 506375 - RNA, 64 nt, Human
ccaaagguugggacucugucuuacauaucugggugccccucauagugcaguaauaaguaaguug

SEQ ID NO: 506376 - RNA, 62 nt, Human
gaagucuguccaaccccaaaaggcucuuuucagagccccucaauugucaccaaaaggaagcu

SEQ ID NO: 506377 - RNA, 64 nt, Human
ucucauugcccacggacccaaccucuguccaggugccccucaucaucacaguuuaacacaagcu

SEQ ID NO: 506378 - RNA, 64 nt, Human
ucuccuacuguuuaaauucccauuccaccacagugccccucagccagaucaccaccccuuacaa

SEQ ID NO: 506379 - RNA, 54 nt, Human; identical to SEQ ID NO: 424612

SEQ ID NO: 506380 - RNA, 58 nt, Human; identical to SEQ ID NO: 424613

SEQ ID NO: 506381 - RNA, 64 nt, Human
augccagcaagaaugaagcacagaugaaggcagcgccccucacuugcucuggcuucagaaguga

SEQ ID NO: 506382 - RNA, 64 nt, Human
ggccugguggagauucccugucuucugagcccgagccccucauuaccagugaaggacaugcuug

SEQ ID NO: 506383 - RNA, 64 nt, Human; identical to SEQ ID NO: 242421

SEQ ID NO: 506384 - RNA, 64 nt, Human; identical to SEQ ID NO: 242289

SEQ ID NO: 506385 - RNA, 64 nt, Human; identical to SEQ ID NO: 240155

SEQ ID NO: 506386 - RNA, 64 nt, Human
ugacuuucaacuugcugacuccuccucuuuuccagccccucaaccaucggucuuguuuacuaga

SEQ ID NO: 506387 - RNA, 64 nt, Human
gagaugacccaaaucuuucacuaugugcaccccagccccucaaaaauggggaagggcugaaaga

SEQ ID NO: 506388 - RNA, 64 nt, Human
gccagucauugacagacggacuuguugaccacacgccccucaccaaacaaugcagcagcuacug

SEQ ID NO: 506389 - RNA, 64 nt, Human
uaguggcugaguucuuucuuagcugcuuuaaggagccccucacuccccagagucaaaaggaaau

SEQ ID NO: 506390 - RNA, 64 nt, Human
cccaagcagacuagaugggaggaggcgccgcucagccccucacccugcaucacugaagagcggc

SEQ ID NO: 506391 - RNA, 64 nt, Human
ccuguccugccacggccucccagccggugcgggagccccucacugcccugaccgacuccgcagu

SEQ ID NO: 506392 - RNA, 64 nt, Human
ccuccacgugagaacaagggugaaggugagggaagccccucaccuugggucuuuugcugugccu

SEQ ID NO: 506393 - RNA, 64 nt, Human
gaggaggugaaagaaagggacccaccugcuagucgccccucagagcaugaugggaggugugcca

SEQ ID NO: 506394 - RNA, 64 nt, Human
gcccaugaugguaccacaccagggccucagccuggccccucaccacauacccuuugccuuuuag

SEQ ID NO: 506395 - RNA, 64 nt, Human
ggugaggggccaggccauggccaaggggccagcugccccucauuuaucacucugaccuucacag

SEQ ID NO: 506396 - RNA, 64 nt, Human
ccaugaccagaggcuggaguggggguguguuagagccccucaccgggacuugcugugcggaugg

SEQ ID NO: 506397 - RNA, 64 nt, Human
aucaauguuucaucuccaacccucugccaguuuggccccucagagcuugguggcucaagacugu

SEQ ID NO: 506398 - RNA, 64 nt, Human
cuccuggugccgccucggccccagccuguccccagccccucaaucuggugcagcagcaucuugu

SEQ ID NO: 506399 - RNA, 64 nt, Human
ucucccuccuccagaucccugccuccuagugccagccccucacacgccuucauccugaaacagg

SEQ ID NO: 506400 - RNA, 64 nt, Human
ggugccacauggguuccugugccacccuuuccccgccccucaaaucguccuuuaagucuuccuu

SEQ ID NO: 506401 - RNA, 64 nt, Human; identical to SEQ ID NO: 241030

SEQ ID NO: 506402 - RNA, 64 nt, Human; identical to SEQ ID NO: 240871

SEQ ID NO: 506403 - RNA, 64 nt, Human; identical to SEQ ID NO: 240262

SEQ ID NO: 506404 - RNA, 64 nt, Human
cuccccuguaaaaugggaccuccgaaccaacccugccccucagaaaugcccugccuauuaaaug

SEQ ID NO: 506405 - RNA, 64 nt, Human
cucgcccacccugugcccuggcgccgcugcaacagccccucauggccaggagccccccauggcc

SEQ ID NO: 506406 - RNA, 64 nt, Human
aagaaccugggccuaucagcguguaagggggccugccccucaucugcgaaagaagagcccagac

SEQ ID NO: 506407 - RNA, 64 nt, Human
uccuggcccugccucuggcccuucccgggccgcugccccucagccauguggcacuucugagcuc

SEQ ID NO: 506408 - RNA, 64 nt, Human
ggcagagaggaggggagguccugaggggacugcugccccucacucggcauccccugcagaguca

SEQ ID NO: 506409 - RNA, 64 nt, Human
aucuguuacuuccccuuuuuccauggguuucauggccccucaugauauuugccuucugcuccua

SEQ ID NO: 506410 - RNA, 64 nt, Human
auugcugcaauacugcucccccagccucuccccugccccucaaccugccuuagcugcacucucu

SEQ ID NO: 506411 - RNA, 64 nt, Human
gcccgccuggcuucgaguuggaacccggacacuugccccucacugguguggauggaaaucugcc

SEQ ID NO: 506412 - RNA, 64 nt, Human
aaugcaacagggguguugcgggggcaacaugagagccccucacccccaacucuccacuuucagg

SEQ ID NO: 506413 - RNA, 64 nt, Human
uggcacacagaguucauguuugcgcccucucccugccccucaccccagagggugaggaggaaug

SEQ ID NO: 506414 - RNA, 64 nt, Human
aagcaccagccaucguguggagcacuaccaaggggccccucagggccuuccugggaggaguccc

SEQ ID NO: 506415 - RNA, 64 nt, Human
ucucccucuaauuacagaucccacuuccagccgggccccucauguauccacuggccgaccgcag

SEQ ID NO: 506416 - RNA, 64 nt, Human
ccgaccuagaugaugauucuuccuguagcaucuggccccucacaaugucagaggauuuaauugu

SEQ ID NO: 506417 - RNA, 64 nt, Human
ccgacgcggugcugcugccgccgcuucggguuuggccccucagaaccccuccuuuucugagcgc

SEQ ID NO: 506418 - RNA, 64 nt, Human
auuaaucaaccauauuaaauuuauaauaaaaaaugccccucagaaguuugccucugaagccuuu

SEQ ID NO: 506419 - RNA, 64 nt, Human; identical to SEQ ID NO: 241970

SEQ ID NO: 506420 - RNA, 64 nt, Human; identical to SEQ ID NO: 241971

SEQ ID NO: 506421 - RNA, 64 nt, Human; identical to SEQ ID NO: 242290

SEQ ID NO: 506422 - RNA, 64 nt, Human
cagcagagcagaccugaugucccggugcuuccuggccccucagcuccagugauucacgcccgcc

SEQ ID NO: 506423 - RNA, 64 nt, Human
uagcccccagccugugaccuuccccccagggaaggccccucaugccuuuccuucccuuucucug

SEQ ID NO: 506424 - RNA, 64 nt, Human
caaagggaggggagcaaguggggaccuggccauggccccucagcaaaaaccuauucacagcggg

SEQ ID NO: 506425 - RNA, 64 nt, Human
ucugcuaggcagcccaggccuggucugggagacagccccucacccugccugggcucuuggccaa

SEQ ID NO: 506426 - RNA, 64 nt, Human
guucuuauuuauugcaugcgucgcuuccacaggggccccucaagagcugugacucgggagagcu

SEQ ID NO: 506427 - RNA, 64 nt, Human
cugucccuucagccggcagagcgagcccagcguggccccucaauuugaaaauggacgucuuuuc

SEQ ID NO: 506428 - RNA, 64 nt, Human
uuuaaugaacaagguggaccaaagggcugaaccagccccucaaccaggacccuggggggccugc

SEQ ID NO: 506429 - RNA, 64 nt, Human
ggguggcaggagagcggacuuagagcccccgagggccccucagcagaggaaggggaguccccuc

SEQ ID NO: 506430 - RNA, 64 nt, Human
acucgugacugcccagcgccccaggcuggacugagccccucacgccgcccugcagcccccaugc

SEQ ID NO: 506431 - RNA, 64 nt, Human
cugaccagaccacgggcagggccugccuccgugugccccucagcucagccccagcaagugugug

SEQ ID NO: 506432 - RNA, 64 nt, Human
gcugagguuuggguggugugaucuguccuaauuggccccucaccaaugcaucuaucugucugcc

SEQ ID NO: 506433 - RNA, 64 nt, Human
ugggaagccuggcaaagcugcccaaccggguagugccccucacccaucggaucacugccuucuu

SEQ ID NO: 506434 - RNA, 64 nt, Human
ugaauugucaucuuugguguuuuuuuaacccccagccccucaaaaaaauaaggccuccagguau

SEQ ID NO: 506435 - RNA, 64 nt, Human
gaaggcuguggcugcuagugaccucuuugcuguggccccucauuugaccuuucaccucugucug

SEQ ID NO: 506436 - RNA, 64 nt, Human
cacuuccgcaucugcccgugggcgccccacagcugccccucagccgcugagauccaguguccaa

SEQ ID NO: 506437 - RNA, 64 nt, Human; identical to SEQ ID NO: 240156

SEQ ID NO: 506438 - RNA, 64 nt, Human; identical to SEQ ID NO: 241979

SEQ ID NO: 506439 - RNA, 64 nt, Human; identical to SEQ ID NO: 241980

SEQ ID NO: 506440 - RNA, 64 nt, Human
uuucugucccuccuacuuuccuucacaccagacagccccucaugucuccaggacaggacaggac

SEQ ID NO: 506441 - RNA, 64 nt, Human
caugugcuugugccuaccuggccgcaaguccccagccccucaacccuccguuccuccucagccu

SEQ ID NO: 506442 - RNA, 64 nt, Human
aggaaacgggacaaaaccuuaagcuguuuucuuagccccucagccagcugccauuagcuuggcu

SEQ ID NO: 506443 - RNA, 64 nt, Human
uuugcacaugcucacccccagcacagucccacuggccccucaccuccccuucccugagcuccuu

SEQ ID NO: 506444 - RNA, 64 nt, Human
gcacuggaugggauguacuucucagccccgcugagccccucauuugugcccagcauuuugugug

SEQ ID NO: 506445 - RNA, 64 nt, Human
acuucuccuugaggcagcuggagagcuaucccccgccccucaagcaccugugccguguggccau

SEQ ID NO: 506446 - RNA, 64 nt, Human
cuggcgccccuucucuccaagcucaauucucuaagccccucagggucuccuccucaccccaccc

SEQ ID NO: 506447 - RNA, 64 nt, Human
cccgaagcaggcguccaucuguguccuccuggcagccccucaaacacacaccaccccaugucac

SEQ ID NO: 506448 - RNA, 64 nt, Human
ucccgaugucacaggcagucugugugguuacagcgccccucaguguucaucuccagcagagaca

SEQ ID NO: 506449 - RNA, 64 nt, Human
ccgccccguggucggaagagcacucccuucccuggccccucauccagccuccggugcuguaaaa

SEQ ID NO: 506450 - RNA, 64 nt, Human
uccuuucuggcauccuggccucucgugguccucagccccucacccccaguacugcagaucucac

SEQ ID NO: 506451 - RNA, 64 nt, Human
ucuccuuguggggucccagguccugcugccaagagccccucaagagaagggcugaaccugggga

SEQ ID NO: 506452 - RNA, 63 nt, Human
augggggcacguuguccgugauaaaaguacaagugccccucaccgcccguggagauugcuuuc

SEQ ID NO: 506453 - RNA, 64 nt, Human
agacucccagcagcagagcccaagcacuggcuucgccccucagugcccuggggcauguucaggg

SEQ ID NO: 506454 - RNA, 64 nt, Human
gccuggucccccuuugcccugcaguggaaugagggccccucagccccgcauugaucuaaauaaa

SEQ ID NO: 506455 - RNA, 64 nt, Human; identical to SEQ ID NO: 242438

SEQ ID NO: 506456 - RNA, 64 nt, Human; identical to SEQ ID NO: 242470

SEQ ID NO: 506457 - RNA, 64 nt, Human; identical to SEQ ID NO: 240124

SEQ ID NO: 506458 - RNA, 64 nt, Human
cugggcucagauacugugacaucccagaagcccagccccucaaccccucuggaugcuacauggg

SEQ ID NO: 506459 - RNA, 64 nt, Human
cuguuggacuuuacagaagagccucauccugucugccccucacucugcccuggaaucaacaucu

SEQ ID NO: 506460 - RNA, 64 nt, Human
gcucucgauuucucuaucugucccucugaggucggccccucagacccuccuccuuaauuuccca

SEQ ID NO: 506461 - RNA, 64 nt, Human
acacguggaugauggggucagagaucacugagcugccccucaagggggccuggaacccgggugc

SEQ ID NO: 506462 - RNA, 64 nt, Human
gagcccugcccgaggcugaggcugggccggcgcugccccucaucuuagcauugggcagacacca

SEQ ID NO: 506463 - RNA, 64 nt, Human
cccuuguuaaugaugcuccugccucugccucccagccccucacccagcacagcucugccuggac

SEQ ID NO: 506464 - RNA, 64 nt, Human
aggcagacccccaccaccauacaugcugucuguggccccucagacauucuguuucaucucccau

SEQ ID NO: 506465 - RNA, 64 nt, Human
ccugucaccucccucucaccaacccggggucugagccccucauuccugaccguccguguucuca

SEQ ID NO: 506466 - RNA, 64 nt, Human
ugauuuauaaguacugagcaugaaguacuugucugccccucauuucaaggccagaguuauuuuc

SEQ ID NO: 506467 - RNA, 64 nt, Human
ccugguuagguggggacagaggauuucugcuuaggccccucaggacccagggaaugccagggac

SEQ ID NO: 506468 - RNA, 64 nt, Human
agguaucuuuggcaaggcuaccaguuggacguaagccccucaugcugacucagggugggcccug

SEQ ID NO: 506469 - RNA, 64 nt, Human
cacagaccccagagccaggaaccucucagccgaugccccucagcaagagcaccccaucuucagg

SEQ ID NO: 506470 - RNA, 64 nt, Human
ccccgacgccggcggggaggcagggaugucgagggccccucacagcugugcccgcccugccccg

SEQ ID NO: 506471 - RNA, 64 nt, Human
ggccaggcagcggggcagggacagggagccgagugccccucagagucccccaaacacaagcaca

SEQ ID NO: 506472 - RNA, 64 nt, Human
cccugcaugcuguguauccuaacucccuacaacagccccucaaauaaaucacaucuagugacug

SEQ ID NO: 506473 - RNA, 54 nt, Human; identical to SEQ ID NO: 242453

SEQ ID NO: 506474 - RNA, 64 nt, Human; identical to SEQ ID NO: 242454

SEQ ID NO: 506475 - RNA, 64 nt, Human; identical to SEQ ID NO: 242455

SEQ ID NO: 506476 - RNA, 64 nt, Human
cucgucuuccuccugcagacaggcggacccacaggccccucagggucugcccagccaggcuccu

SEQ ID NO: 506477 - RNA, 64 nt, Human
gcuucuugccuaccacuuggccagugcccacccagccccucagguggcacaucuggagggcagg

SEQ ID NO: 506478 - RNA, 64 nt, Human
ugaugaaccugcuuauaccuaagggcaggagcaagccccucacaaugcagcugcauggguuuuu

SEQ ID NO: 506479 - RNA, 64 nt, Human
ccaucagugccagccccugcuggcuggugccugagccccucagacagcccccugccccgcaggc

SEQ ID NO: 506480 - RNA, 64 nt, Human
acaccagaauuuugaaaaucccgaauuuuugacagccccucaggccuggagaguuaucuacaga

SEQ ID NO: 506481 - RNA, 64 nt, Human
gugcccuucccuggaggucucucccucccccagagccccucaugccacagugguacucuguguc

SEQ ID NO: 506482 - RNA, 64 nt, Human
ggcccucaauccaccuucaggccccgccccaugggccccucaccgcugguuggaaagaguguug

SEQ ID NO: 506483 - RNA, 64 nt, Human
guggguugcugccugaugacaagggguuguuucagccccucagucaugcugccuucugcugcuc

SEQ ID NO: 506484 - RNA, 64 nt, Human
ugagcugggccccagcccagugacuggcucauuugccccucaagcacgaguuugcauguuuagu

SEQ ID NO: 506485 - RNA, 64 nt, Human
ggugguggggcugggccauggagcuggcccagaggccccucagcccuuuguaaagucugaugaa

SEQ ID NO: 506486 - RNA, 64 nt, Human
agaaccuaacaauuuaaagacacugggaacacuugccccucaguauaguacugucaagggaagc

SEQ ID NO: 506487 - RNA, 64 nt, Human
aaagggccccugaccugccuggcuuccuuagcuugccccucagcuuugcaaagagccacccuag

SEQ ID NO: 506488 - RNA, 64 nt, Human
uccccaucuuuaaaaugcugccagagcgauugcggccccucaccuuguccacguaucaggaaug

SEQ ID NO: 506489 - RNA, 64 nt, Human
caaucucgacucacugcagcuaucucucgccucagccccucaaguagcugggacuacaggugca

SEQ ID NO: 506490 - RNA, 64 nt, Human
gcuugaccagcgugcugacuggccuagggccccugccccucaccuucuccuucuugauuccaaa

SEQ ID NO: 506491 - RNA, 64 nt, Human; identical to SEQ ID NO: 240125

SEQ ID NO: 506492 - RNA, 64 nt, Human; identical to SEQ ID NO: 242471

SEQ ID NO: 506493 - RNA, 64 nt, Human; identical to SEQ ID NO: 242472

SEQ ID NO: 506494 - RNA, 64 nt, Human
cgguucccacccuccuccaccuccucuccuccgggccccucaguuuccucuccucaucucuggc

SEQ ID NO: 506495 - RNA, 64 nt, Human
acuacuguguuucacugaccauacauuuuucuuagccccucaaguaauauagcacagaguuaug

SEQ ID NO: 506496 - RNA, 64 nt, Human
gauggaggaggugugggcugacuaccucccagaagccccucaugccaagccugucccacugggg

SEQ ID NO: 506497 - RNA, 64 nt, Human
aguagaggccucguuucugccacacaucacgccugccccucaccgcccucuccucaaacuccuc

SEQ ID NO: 506498 - RNA, 64 nt, Human
aauuuggguucugccugccagcugcacugaugcugccccucaucucucugcccaacccuucccu

SEQ ID NO: 506499 - RNA, 51 nt, Human; identical to SEQ ID NO: 424711

SEQ ID NO: 506500 - RNA, 64 nt, Human
ggggaaguuccccaacacauaaucccaagacugugccccucaucugcaucuucagauccaguac

SEQ ID NO: 506501 - RNA, 64 nt, Human
caugcuuucugccucugguaacaggagugagugagccccucagaccugcacucugggugucucc

SEQ ID NO: 506502 - RNA, 64 nt, Human
aucagggccugcauuuauggagugcuugcuaugugccccucauggcaggcccacagcacucuga

SEQ ID NO: 506503 - RNA, 64 nt, Human
aagggcagccccagcagcuggauucucaggcugggccccucaccuggcagaguccauaguggag

SEQ ID NO: 506504 - RNA, 64 nt, Human
ucgcugugcccugguuucccuccucgggcuucucgccccucagugguuuccucggcccuccugg

SEQ ID NO: 506505 - RNA, 64 nt, Human
accaggaugaccccacagccagagucccuuggcagccccucaccccagaccccccuucuaagga

SEQ ID NO: 506506 - RNA, 64 nt, Human
aguuguuccucuguuaucaugccugaauucccccgccccucaguuaccuggggaagaguaaagg

SEQ ID NO: 506507 - RNA, 64 nt, Human
guuucccauugucacggaaaacauuggcugcaaagccccucaaagcccucaagugccuucugug

SEQ ID NO: 506508 - RNA, 64 nt, Human
ugcacucggcccaguccugccgccguguccaggcgccccucacccccacaccugcugcauggcu

SEQ ID NO: 506509 - RNA, 64 nt, Human; identical to SEQ ID NO: 242276

SEQ ID NO: 506510 - RNA, 64 nt, Human; identical to SEQ ID NO: 240126

SEQ ID NO: 506511 - RNA, 64 nt, Human; identical to SEQ ID NO: 242487

SEQ ID NO: 506512 - RNA, 64 nt, Human
ucgguuuuguuuuuguuucucauucuucuuccucgccccucagccccccaacccccaacccccu

SEQ ID NO: 506513 - RNA, 64 nt, Human
gggcugagugggagggcggcccuuuccagccucugccccucaggggaacccuguagcuuugugu

SEQ ID NO: 506514 - RNA, 64 nt, Human
uaucucuccaaaccccauacccuucaaugcuguggccccucagugacuuccuugggugauccug

SEQ ID NO: 506515 - RNA, 64 nt, Human
gauggcaggcuacaguugggaagucucagccugggccccucagccacccuuggucucaugcccc

SEQ ID NO: 506516 - RNA, 64 nt, Human
ucccugccccauucuggugucuuuccacuccucagccccucaucuugccuccacccagcugcuc

SEQ ID NO: 506517 - RNA, 64 nt, Human
cuccuucagccaccuggccauaccccuuaaauaagccccucaccuugcugccucaggaccuuca

SEQ ID NO: 506518 - RNA, 64 nt, Human
gcuggcugcaagcuguggguucuuucuccucugugccccucaugcugaucuucuagaugccacu

SEQ ID NO: 506519 - RNA, 64 nt, Human
cccacacggccccuucccagccagcccgccgcccgccccucaguuugguagugccccaccuccc

SEQ ID NO: 506520 - RNA, 64 nt, Human
ccgcccauccugcacacggggccgcugggcaggugccccucacacccccaggaugucagugcuc

SEQ ID NO: 506521 - RNA, 64 nt, Human
auacugaaaacugaccaaggccugugcacagguagccccucaugcugggcucuggaccaugagc

SEQ ID NO: 506522 - RNA, 64 nt, Human
acccaguaacuggggccacggggagagaggaguagccccucagacucuucuuacuaagucucag

SEQ ID NO: 506523 - RNA, 64 nt, Human
gcugccuccuggugguggccauugucccccaucggccccucagccuugcaccccagcacugaga

SEQ ID NO: 506524 - RNA, 64 nt, Human
gaaugcuccagcgauuccaaacugcagccccucugccccucaccaaaaccugcggggcugcuug

SEQ ID NO: 506525 - RNA, 64 nt, Human
gugugugucuguuuugguuugugagaaaguagcugccccucauucuggccaguucuuuccagua

SEQ ID NO: 506526 - RNA, 64 nt, Human
caguagugccgaugugccacacugcccaguugaggccccucacgcucugugccccuagauccuu

SEQ ID NO: 506527 - RNA, 64 nt, Human; identical to SEQ ID NO: 242307

SEQ ID NO: 506528 - RNA, 64 nt, Human; identical to SEQ ID NO: 240172

SEQ ID NO: 506529 - RNA, 64 nt, Human; identical to SEQ ID NO: 242011

SEQ ID NO: 506530 - RNA, 64 nt, Human
ccauggcaacucaaagugccuuccaaaccaaacugccccucaugagguuagggucccccacccu

SEQ ID NO: 506531 - RNA, 64 nt, Human
aacuucccgagaacaaacaggccugcucacaacugccccucaaguucaaccccgggaccgccca

SEQ ID NO: 506532 - RNA, 64 nt, Human
auucgugacugaggccccucuuggggcacucacugccccucauccccagaaauuauuuuucuac

SEQ ID NO: 506533 - RNA, 64 nt, Human
caguccacuccuagccccggcauccugcucuagggccccucaugccccaggcuggagcagcucu

SEQ ID NO: 506534 - RNA, 64 nt, Human
uggagccaagaagcacagagacacagaggcgccugccccucagcuccgcuggucugucugugca

SEQ ID NO: 506535 - RNA, 64 nt, Human
gcuccacugagcuccucugucacaccccauucuugccccucacugggcaggccauggccuacag

SEQ ID NO: 506536 - RNA, 64 nt, Human
accagcuuucugguuaagguuaacaccagauggugccccucauugguguccuuuuaaaaaauau

SEQ ID NO: 506537 - RNA, 64 nt, Human
cgggaguccgggcauggugggcacaguucucccugccccucagccugggggaagaagagggccu

SEQ ID NO: 506538 - RNA, 64 nt, Human
augacccaggcugccugagcaccucccagccccugccccucaugccaaccccgcccuaggccug

SEQ ID NO: 506539 - RNA, 64 nt, Human
gacgucugagcccagcuuucugcgugcccuccuggccccucacucccggcagcgggccggccuc

SEQ ID NO: 506540 - RNA, 64 nt, Human
ggaagggcccggugggacguggguagugugugaagccccucagccugggucccgccuagccuaa

SEQ ID NO: 506541 - RNA, 64 nt, Human
ggcccggaggucccaaggucccugggaggacugggccccucaugccucgagcuuggcaaccgaa

SEQ ID NO: 506542 - RNA, 64 nt, Human
gaggagaaggaugccugggugccaggcaagacaagccccucagcaggagagaggcccagaggcu

SEQ ID NO: 506543 - RNA, 64 nt, Human
uuagguucaccugcaaaacaaaaaucuuacuccagccccucaaugccauccugacacacuuuau

SEQ ID NO: 506544 - RNA, 64 nt, Human
cgccccuuuuguguuuugguucaaguuucucagagccccucagagcuucuacaucugugcauca

SEQ ID NO: 506545 - RNA, 64 nt, Human; identical to SEQ ID NO: 242489

SEQ ID NO: 506546 - RNA, 64 nt, Human; identical to SEQ ID NO: 242504

SEQ ID NO: 506547 - RNA, 64 nt, Human; identical to SEQ ID NO: 240127

SEQ ID NO: 506548 - RNA, 64 nt, Human
ccugggaucuccuucucccuccuguccuguccuugccccucaggacugcuggaaaauaaauccu

SEQ ID NO: 506549 - RNA, 64 nt, Human
agcaugccuggauggggcugcaccggcuggccuggccccucagggucccugguggcagcucacc

SEQ ID NO: 506550 - RNA, 64 nt, Human
uucgucauggaccgagguucccacucugggcaaagccccucacacugcaagggauuguagauaa

SEQ ID NO: 506551 - RNA, 64 nt, Human
cucagguucugccugagcccagccuaccaggcuugccccucagcucagcacuguugaccacgcu

SEQ ID NO: 506552 - RNA, 64 nt, Human
ccacuggcccuggguggcucugucagggugcacagccccucaugccuggagcaaugagggucua

SEQ ID NO: 506553 - RNA, 64 nt, Human
acuaccccucaacagagaugacuuugaugacucugccccucagcagggcuuacuaagcacuacc

SEQ ID NO: 506554 - RNA, 64 nt, Human
aagcacuaccccuuaacagggaugacuccgcacugccccucaacagggaugacucagcagagau

SEQ ID NO: 506555 - RNA, 64 nt, Human
agcagggaugacacagcaaggaugacucagcacugccccucagcaaggaugacucagcacugcc

SEQ ID NO: 506556 - RNA, 64 nt, Human
cucaacagacaugacucagggauggcuuaguacugccccucagcagggaugacucagcaccgcc

SEQ ID NO: 506557 - RNA, 64 nt, Human
aacagggaugacucagcagggaugacucagcaccgccccucaacaggcaugacucugcagagau

SEQ ID NO: 506558 - RNA, 64 nt, Human; identical to SEQ ID NO: 506555

SEQ ID NO: 506559 - RNA, 64 nt, Human
cucaacagggaugacucagggauggcuuaguacugccccucaacagggaugacucagcagggau

SEQ ID NO: 506560 - RNA, 64 nt, Human; identical to SEQ ID NO: 506557

SEQ ID NO: 506561 - RNA, 64 nt, Human
aacaggcaugacucugcagagaugacuuaguacugccccucagcagggaugacucaguacugcc

SEQ ID NO: 506562 - RNA, 64 nt, Human
uaguacugccccucagcagggaugacucaguacugccccucagcagggaugacucagcacugcc

SEQ ID NO: 506563 - RNA, 64 nt, Human; identical to SEQ ID NO: 242505

SEQ ID NO: 506564 - RNA, 64 nt, Human; identical to SEQ ID NO: 242506

SEQ ID NO: 506565 - RNA, 64 nt, Human; identical to SEQ ID NO: 242385

SEQ ID NO: 506566 - RNA, 64 nt, Human
caguacugccccucagcagggaugacucagcacugccccucaacagggaugacucagcagggau

SEQ ID NO: 506567 - RNA, 64 nt, Human
agcagugaugacacagcaaggaugacucagcacugccccucagcaaggaugacucagcacugcc

SEQ ID NO: 506568 - RNA, 64 nt, Human; identical to SEQ ID NO: 506556

SEQ ID NO: 506569 - RNA, 64 nt, Human
uaguacugccccucagcagggaugacucagcaccgccccucaacagggaugacucagcacugcc

SEQ ID NO: 506570 - RNA, 64 nt, Human
cagcaccgccccucaacagggaugacucagcacugccccucaacagggaugacucagcagggau

SEQ ID NO: 506571 - RNA, 64 nt, Human
agcagcgaugacacagcaaggaugacucagcacugccccucaccaaggaugacucagcacugcc

SEQ ID NO: 506572 - RNA, 64 nt, Human
cucaacagacaugacucagggauggcuuaguacugccccucagcagggaugacucagcagggau

SEQ ID NO: 506573 - RNA, 64 nt, Human
aacagggaugacucagcagggaugacucagcacugccccucaacagggaugacugcagggauga

SEQ ID NO: 506574 - RNA, 64 nt, Human
ucaacagggaugacugcagggaugacucagcacugccccucagcagggaugacucagcacugcc

SEQ ID NO: 506575 - RNA, 64 nt, Human
cagcacugccccucagcagggaugacucagcacugccccucagcagggaugacucagcagggau

SEQ ID NO: 506576 - RNA, 64 nt, Human
agcagggaugacucagcagggaugacucagcaccgccccucaacaggcaugacucugcagagau

SEQ ID NO: 506577 - RNA, 64 nt, Human
aacaggcaugacucugcagagaugacucagcacugccccucagcagggauggcucagcagggau

SEQ ID NO: 506578 - RNA, 64 nt, Human
agcagggauggcucagcagggaugacucagcauugccccucaacagggaugacucagcagacuc

SEQ ID NO: 506579 - RNA, 64 nt, Human
gacucagcagacucagcagggaugacucagcacugccccucaacagacaugacucagcagggau

SEQ ID NO: 506580 - RNA, 64 nt, Human
aacagacaugacucagcagggaugacucagcaccgccccucagcaaggaugacucagcagggau

SEQ ID NO: 506581 - RNA, 64 nt, Human; identical to SEQ ID NO: 242521

SEQ ID NO: 506582 - RNA, 64 nt, Human; identical to SEQ ID NO: 242522

SEQ ID NO: 506583 - RNA, 64 nt, Human; identical to SEQ ID NO: 242523

SEQ ID NO: 506584 - RNA, 64 nt, Human
ggccugggagacccaucuggucccugcguccucugccccucacugcucugugcagauccugucg

SEQ ID NO: 506585 - RNA, 64 nt, Human
uggccuggcugggcugggucuggggccgccacaggccccucacggggcggcagaggcaacuuca

SEQ ID NO: 506586 - RNA, 64 nt, Human
gggcagccaaguuccugauagcacuugugccucagccccucaccuggccaccugccagggcacc

SEQ ID NO: 506587 - RNA, 59 nt, Human; identical to SEQ ID NO: 424784

SEQ ID NO: 506588 - RNA, 64 nt, Human
guuuuacugccuguagcaauggccagagccucuggccccucacccaccauggaccagcccauug

SEQ ID NO: 506589 - RNA, 64 nt, Human
ggacacaaggugggcugcccucaagccccagagagccccucauccuuccucugggaccagaugu

SEQ ID NO: 506590 - RNA, 64 nt, Human
ggaagggagacuggcccugcccagccggucucuagccccucagcccccgcugggcacucucugu

SEQ ID NO: 506591 - RNA, 64 nt, Human
ggugcagacaaauucagcaauaguaugcagaucagccccucaccaccucauuguucucaucugg

SEQ ID NO: 506592 - RNA, 64 nt, Human
gccccaacccucagacccucgccuuccaaggcaggccccucagccuggccugcucucaccaccu

SEQ ID NO: 506593 - RNA, 64 nt, Human
gcuccuuccuggucuggcccagcuggcuuccccagccccucagccauccagggcuacccacugc

SEQ ID NO: 506594 - RNA, 64 nt, Human
ccagccuuaacucgaugguccgucccugccaggugccccucacucuuccugaccccaaagccag

SEQ ID NO: 506595 - RNA, 64 nt, Human
ggugcuccaggauaacaaagaagggcagguugaagccccucauggaaggagcuggcuuuguggg

SEQ ID NO: 506596 - RNA, 64 nt, Human
aggcacucaaugcagccagaccuauuccuccugggccccucaucugcucagcagcuauuugaau

SEQ ID NO: 506597 - RNA, 64 nt, Human
gacauccugcaguccccaccaguccugaccgugggccccucaggggucugggagugugacguug

SEQ ID NO: 506598 - RNA, 64 nt, Human
caaccugugaugaggggaggaaacucaccugcuggccccucaccugggcaccuggggaguggga

SEQ ID NO: 506599 - RNA, 64 nt, Human; identical to SEQ ID NO: 242352

SEQ ID NO: 506600 - RNA, 64 nt, Human; identical to SEQ ID NO: 240129

SEQ ID NO: 506601 - RNA, 64 nt, Human; identical to SEQ ID NO: 242538

SEQ ID NO: 506602 - RNA, 64 nt, Human
acggacugccgccucuggguccccccaccguggugccccucaccauccuccugggggagcaggg

SEQ ID NO: 506603 - RNA, 64 nt, Human
agaucuguagccagucagaggaggaggagaaggagccccucagcagaguggugcaguuucgcuc

SEQ ID NO: 506604 - RNA, 64 nt, Human
acugugaaaaggcuuccugugaccuccgauggcggccccucauuggccaagggcacuguggaug

SEQ ID NO: 506605 - RNA, 64 nt, Human
gcugaagagcaagguuucguggcagcacggcccggccccucacccucuguccccacgaggggac

SEQ ID NO: 506606 - RNA, 64 nt, Human
ccccuccuugcccgccuacccucccuccagaauagccccucacccuucuuccccuucuaguuga

SEQ ID NO: 506607 - RNA, 64 nt, Human
acucacaucccuuuccuagucccccacauccaaagccccucagccugccuugcagaccaauggg

SEQ ID NO: 506608 - RNA, 64 nt, Human
aacauaggacuaaccagccacugcccucucuuaggccccucauuuaaaaacgguuauacuauaa

SEQ ID NO: 506609 - RNA, 64 nt, Human
ggggagguugguggaccauggagucccuggugcugccccucaggugggacccaggcguucucag

SEQ ID NO: 506610 - RNA, 64 nt, Human
cugcaccugggaccauaggaugggaggauagggagccccucaugacugagggcagaagaaauug

SEQ ID NO: 506611 - RNA, 64 nt, Human
agccacugggugagcagagucacccacagggccagccccucagccaggagccaguggcaggagc

SEQ ID NO: 506612 - RNA, 52 nt, Human; identical to SEQ ID NO: 424806

SEQ ID NO: 506613 - RNA, 64 nt, Human
cggcagggaguugugagcgccuucccaacaaugugccccucaccccuugaugcccaugcuaaug

SEQ ID NO: 506614 - RNA, 64 nt, Human
cagccugggucagaaggggugggcgagccccucggccccucacccuccaggcugcugugagagu

SEQ ID NO: 506615 - RNA, 64 nt, Human
gccuuuccuuggcccucacugccagugccaaaccgccccucagcagggcagggccaguccuggc

SEQ ID NO: 506616 - RNA, 64 nt, Human
cuaguaugcccuguaauuuuucugggaaguccuagccccucacuuccagcuugccuguuucuuc

SEQ ID NO: 506617 - RNA, 64 nt, Human; identical to SEQ ID NO: 242540

SEQ ID NO: 506618 - RNA, 64 nt, Human; identical to SEQ ID NO: 242334

SEQ ID NO: 506619 - RNA, 64 nt, Human; identical to SEQ ID NO: 240130

SEQ ID NO: 506620 - RNA, 64 nt, Human
cguuuuugagggggucaugccgggggagccaccagccccucacuggguucggaggagagucagg

SEQ ID NO: 506621 - RNA, 64 nt, Human
uuggccugggggaggucagaacauucgaaucucugccccucacuugaggaggagcuggccugcg

SEQ ID NO: 506622 - RNA, 64 nt, Human
cacagugaggccaccuugagucaagccgacuaaggccccucaacccugucacuaagcagcacgu

SEQ ID NO: 506623 - RNA, 64 nt, Human
ccaggugcugcacugaccgcugggccacacggcugccccucagcccugcuggaacagggucugc

SEQ ID NO: 506624 - RNA, 64 nt, Human
ugaauggugcacugguuuaauuguguuggugucggccccucacaaaugcagccaagucauguaa

SEQ ID NO: 506625 - RNA, 64 nt, Human
aggugggauccugaaggcacuagcugacagacgggccccucaauccuguccucugaaggauugu

SEQ ID NO: 506626 - RNA, 64 nt, Human
cuggcucugaggucacaucagcuagguuugggaggccccucagcuugguuugggagugcccgug

SEQ ID NO: 506627 - RNA, 64 nt, Human
ccucaugacaaaggaagggacucaaagcagcaaugccccucauaguguaggcuaaggugaguuu

SEQ ID NO: 506628 - RNA, 64 nt, Human
gcgcugagauuacaggugugagccaccgugcccagccccucaguagguuuuaaggagcccccag

SEQ ID NO: 506629 - RNA, 64 nt, Human
cccgggcccccgcgccucugccggacacggaccggccccucagcccccaccgaggacgcagcca

SEQ ID NO: 506630 - RNA, 64 nt, Human
uauuugugcguuccagaaaagggcccagcucugagccccucacccuuccacacucacgaacucu

SEQ ID NO: 506631 - RNA, 64 nt, Human
uuucuuucaguucucccaugcagccgaggcccgggccccucaggacuccaaggagacggugcag

SEQ ID NO: 506632 - RNA, 64 nt, Human
uccaugaaugaaaugacucagggaaguguuuguugccccucaugccuccuuucucacuuuagaa

SEQ ID NO: 506633 - RNA, 64 nt, Human
gcucuggcagugaugaugguacuuccuguugucagccccucaagcccagcugcaaccagucugg

SEQ ID NO: 506634 - RNA, 64 nt, Human
gugcccucgcuccgccccaucaguuccugccccugccccucaugcagacugcccugcuggggcc

SEQ ID NO: 506635 - RNA, 64 nt, Human; identical to SEQ ID NO: 242182

SEQ ID NO: 506636 - RNA, 64 nt, Human; identical to SEQ ID NO: 242183

SEQ ID NO: 506637 - RNA, 64 nt, Human; identical to SEQ ID NO: 242184

SEQ ID NO: 506638 - RNA, 64 nt, Human
gcccuaggccaccucgcggaagccuucagccuccgccccucacugcagccccuugggacuugag

SEQ ID NO: 506639 - RNA, 64 nt, Human
ggguguugggaaccaugccugccagccaguaugugccccucacccaggccuggcugggcccugg

SEQ ID NO: 506640 - RNA, 64 nt, Human
uccugcucugagcgcucaccccugcugaggcucagccccucaacccgguggcauucugggggag

SEQ ID NO: 506641 - RNA, 64 nt, Human
caccgcuguugagcagccuggugguacuggccacgccccucaaggcaaggcuccuccccuuagg

SEQ ID NO: 506642 - RNA, 64 nt, Human
gcucagcccagcugacugugccuguucugagugagccccucacucagccggggcccucccaccu

SEQ ID NO: 506643 - RNA, 64 nt, Human
uuggggggucuugguuuaugcucccugcccuugagccccucagccguuugcccugcccccaccu

SEQ ID NO: 506644 - RNA, 64 nt, Human
uacagcggugggaucucugcugccagcucucccagccccucagcuucgcagccuggcgcagcau

SEQ ID NO: 506645 - RNA, 64 nt, Human
guguccccaccccagggccacuuagcugacaccagccccucagaggaccagugcgccccauccc

SEQ ID NO: 506646 - RNA, 64 nt, Human
cuccuugucucauccccgaagauccgucccccuggccccucaguguccaugucuugagcuuaau

SEQ ID NO: 506647 - RNA, 64 nt, Human
auccccuccuguucacucucccaacccugcuccagccccucagcuucccagacccucaugcagu

SEQ ID NO: 506648 - RNA, 64 nt, Human
cccagccuaggacgccaacuucucccaccccuuggccccucacauccucuccaggaagggagug

SEQ ID NO: 506649 - RNA, 64 nt, Human
gcucuuucuccuucuucccugagucucucuccaugccccucaucucuuccuuuugcccucgccu

SEQ ID NO: 506650 - RNA, 64 nt, Human
ccuucuggaccugcccccacuguggccugcaugcgccccucacgccccuggagcgcaucgccca

SEQ ID NO: 506651 - RNA, 64 nt, Human
cccagagcugaccccacuccaggaccuaggcccagccccucagccucaucuggagccccugaag

SEQ ID NO: 506652 - RNA, 64 nt, Human
acacauguuuucggcaacguguucccguguccuggccccucacgggcccccacacucuccugac

SEQ ID NO: 506653 - RNA, 64 nt, Human; identical to SEQ ID NO: 242012

SEQ ID NO: 506654 - RNA, 64 nt, Human; identical to SEQ ID NO: 242013

SEQ ID NO: 506655 - RNA, 64 nt, Human; identical to SEQ ID NO: 242030

SEQ ID NO: 506656 - RNA, 64 nt, Human
cugcccccucucugagagcccuggccagcucuucgccccucaccucuuugaaacucuggacgua

SEQ ID NO: 506657 - RNA, 64 nt, Human
uugcaaacuucucccggguccagcgccuggggcugccccucaagauggucauguacucagcugu

SEQ ID NO: 506658 - RNA, 64 nt, Human
guuccuuggaccguaucacugguccaccuccugagccccucaauccuaucacagucuacugacu

SEQ ID NO: 506659 - RNA, 64 nt, Human
caaggccaccugacuccuaucacgacgcacccaagccccucaguccagcuucccaaugccuggc

SEQ ID NO: 506660 - RNA, 64 nt, Human
uucuucuuccgacugguacugaacauauauacuugccccucaggugagguuccaaguugcaacu

SEQ ID NO: 506661 - RNA, 64 nt, Human
acaucucaaaagaaguccaaagcgggaaucaugugccccucagcggagccccgggaguguccaa

SEQ ID NO: 506662 - RNA, 64 nt, Human
ccugaguugggggagcgacccuucccccagccccgccccucaggacacccagaaccccaccccu

SEQ ID NO: 506663 - RNA, 64 nt, Human
cacuuuucccuuccucuuuccccacagccccccagccccucagcccucccagcccacuucugcc

SEQ ID NO: 506664 - RNA, 64 nt, Human
ggaggcaguggcuggugggccacucucuccaggugccccucagccaugggcccuacaguccccu

SEQ ID NO: 506665 - RNA, 62 nt, Human
ccacccuauggaccagucaaauaaaagccuucaggccccucaaccagaguccccucuuacug

SEQ ID NO: 506666 - RNA, 64 nt, Human
ggaggcugagguggcugcaggagcucguuucacagccccucagguggagcugguugggccgcgg

SEQ ID NO: 506667 - RNA, 64 nt, Human
caaccucuccccuaacccugcucccuggggcugcgccccucaacacccucucaacaccccccuc

SEQ ID NO: 506668 - RNA, 64 nt, Human
gagcagagcgggacucuguccaacaagccccacagccccucaaagacuuuuuuuuguuuguuuu

SEQ ID NO: 506669 - RNA, 64 nt, Human
cugugcccugccuucagcuuuggugaaagggagggccccucaugugugcugugcugugucugca

SEQ ID NO: 506670 - RNA, 64 nt, Human
agccaaacagauggggaggcccaaagcaaggcuugccccucagaggagcucacgcagggcagga

SEQ ID NO: 506671 - RNA, 64 nt, Human; identical to SEQ ID NO: 240131

SEQ ID NO: 506672 - RNA, 64 nt, Human; identical to SEQ ID NO: 242201

SEQ ID NO: 506673 - RNA, 64 nt, Human; identical to SEQ ID NO: 242202

SEQ ID NO: 506674 - RNA, 64 nt, Human
caguuuggcagcuugacuucugcagcuggaggaggccccucaggccggggaucuggggagggcu

SEQ ID NO: 506675 - RNA, 64 nt, Human
gaacagccgacuuugagcauuguuucuucuaacugccccucaacuaccauuaucuucaagucaa

SEQ ID NO: 506676 - RNA, 64 nt, Human
ggacagcaggccuggcacugggaggugggggugagccccucacagccuugccccuccccaaggc

SEQ ID NO: 506677 - RNA, 64 nt, Human
uggccacuggggccaccacccugaccaccacugugccccucauuguuacugccuugugagauaa

SEQ ID NO: 506678 - RNA, 64 nt, Human
ucuuuuuuuuaggccccugccugucugcccaucugccccucacccacccgaggcucugcccacc

SEQ ID NO: 506679 - RNA, 64 nt, Human
accuuuacuaaaacacuuucucugaaccccccuugccccucacugaucuugcuuuucccugguc

SEQ ID NO: 506680 - RNA, 64 nt, Human
ccauguauauagguccugaugccuucccaaccccgccccucacccuguugccaccuuguuucau

SEQ ID NO: 506681 - RNA, 64 nt, Human
auccucucggugggaugggcaccacagacaggaggccccucaggcccgugcgggccacugucug

SEQ ID NO: 506682 - RNA, 64 nt, Human
caguuaccgagccgaagggagaugaugggccuucgccccucagugggauggcagcugagggggc

SEQ ID NO: 506683 - RNA, 64 nt, Human
ucaggagugggcucagagucuagcaaaugcuaaggccccucaggcugggcucugaacgaggacc

SEQ ID NO: 506684 - RNA, 64 nt, Human
uggguugguguggauagcaaaggaggaagucugagccccucauuggucuuccucccaccugucc

SEQ ID NO: 506685 - RNA, 64 nt, Human
guaaagguccaugaacccugccccacuccugucagccccucaucagccuuuucagcagguucca

SEQ ID NO: 506686 - RNA, 64 nt, Human
gugucuguucucuggggauugcugggucacaggugccccucaccuuccacagucaggcagggaa

SEQ ID NO: 506687 - RNA, 64 nt, Human
caacugugaagguccccgugggguggagcauggugccccucacaagccgcagcggcuggugccc

SEQ ID NO: 506688 - RNA, 64 nt, Human
ugccauggaggcgccuuccuggguuggccagagggccccucacuggcuggacuggaggcugggu

SEQ ID NO: 506689 - RNA, 64 nt, Human; identical to SEQ ID NO: 242555

SEQ ID NO: 506690 - RNA, 64 nt, Human; identical to SEQ ID NO: 242556

SEQ ID NO: 506691 - RNA, 64 nt, Human; identical to SEQ ID NO: 242557

SEQ ID NO: 506692 - RNA, 64 nt, Human
caggugcccaacaccccccaccggaggacacgcugccccucagcgaugccccuaccuuuugggg

SEQ ID NO: 506693 - RNA, 64 nt, Human
cuucaccuuugucgcugggucagugcuggaaagcgccccucacuccugcgcugacaagggcccu

SEQ ID NO: 506694 - RNA, 64 nt, Human
cggaguguggggauaggagccgggccaagcgcuggccccucagcggugagcccugcccacucuu

SEQ ID NO: 506695 - RNA, 64 nt, Human
cagucucugucuccugggcccugcucugggaccugccccucacguucucuuggggacacccgag

SEQ ID NO: 506696 - RNA, 64 nt, Human
aacucauccuguucaagaaacaaccuuucauguagccccucaacagaaugcauugcaucaucac

SEQ ID NO: 506697 - RNA, 64 nt, Human
gguuuuuaaucaguuaucuugggaacuuaaccuggccccucaccucuucugcaccccccgcccc

SEQ ID NO: 506698 - RNA, 64 nt, Human
uucucuuaauuuucaggaagaaagggaaauugcagccccucagcccccaggauugaccucuggg

SEQ ID NO: 506699 - RNA, 64 nt, Human
ggcccugcacaugaugggguuugguggacccagugccccucacggcugccgcaagucugcugca

SEQ ID NO: 506700 - RNA, 64 nt, Human
cggugagcuuccugcagccuguggauguccugcagccccucagcccuacccccaaguuucuccu

SEQ ID NO: 506701 - RNA, 64 nt, Human
accggugcuccucucuaggcagcgggugggcacagccccucaccacggacacggacagaggacc

SEQ ID NO: 506702 - RNA, 64 nt, Human
gugggguguggauggggcugcagcaccaggcagagccccucagggcgccgaugucgagggcacc

SEQ ID NO: 506703 - RNA, 64 nt, Human
aauuagggauauuaucaaaauauguaaccaugaggccccucagguccugaucagucagaaugga

SEQ ID NO: 506704 - RNA, 64 nt, Human
accugacucugucacucaagccuuucuccaccaggccccucaucugaauaccaagcacagaaau

SEQ ID NO: 506705 - RNA, 64 nt, Human
uggcccccggccacugucucggggcccaccucucgccccucaucuugguaauuagccagccuca

SEQ ID NO: 506706 - RNA, 64 nt, Human
uuccuuugcagaacuucagggacugggagcagaggccccucacucaacgacguuugugcgacau

SEQ ID NO: 506707 - RNA, 64 nt, Human; identical to SEQ ID NO: 240726

SEQ ID NO: 506708 - RNA, 64 nt, Human; identical to SEQ ID NO: 240123

SEQ ID NO: 506709 - RNA, 64 nt, Human; identical to SEQ ID NO: 242436

SEQ ID NO: 506710 - RNA, 64 nt, Human
cugcucaucacgggaggauaccugugugccggcagccccucagggacucucagcccuggcacug

SEQ ID NO: 506711 - RNA, 64 nt, Human
cauggggggcuggaccaccauggccacugacccagccccucagaaucccacacuccaauccuuu

SEQ ID NO: 506712 - RNA, 64 nt, Human
cacggucccagggccccaccuaggugcagagccggccccucaccuaacagcugguuccuaccag

SEQ ID NO: 506713 - RNA, 64 nt, Human
cucccccuucccuggggcuucuagagcucucucugccccucagguccuggcccuuggguccuug

SEQ ID NO: 506714 - RNA, 64 nt, Human
aggguccagggaggggcgccugcugagcacuuccgccccucacccugcccagccccugccauga

SEQ ID NO: 506715 - RNA, 64 nt, Human
accuugaaaugagaccacgucagagacauguacugccccucacauuuucucaccuaaaccagca

SEQ ID NO: 506716 - RNA, 64 nt, Human
gcccuuccuugaguggucuagaaggcacugcguggccccucagaugcugggacacaacagaccc

SEQ ID NO: 506717 - RNA, 64 nt, Human
gcagcagagcucaggacauucccccacagagcuugccccucaguuccuaccuccaagggggagg

SEQ ID NO: 506718 - RNA, 64 nt, Human
ccaccccuucccuucccuggcgccccgggcccaggccccucagcugucagcugguuuugauggc

SEQ ID NO: 506719 - RNA, 64 nt, Human
gggaugcugcugggaguccauggcacaggccacagccccucaccuugccgcgguggcuggcagc

SEQ ID NO: 506720 - RNA, 64 nt, Human
aaugugguagugaaaaucgaggaagcaccucucagccccucagagaaugaucacccugaauuca

SEQ ID NO: 506721 - RNA, 59 nt, Human; identical to SEQ ID NO: 424897

SEQ ID NO: 506722 - RNA, 64 nt, Human
aaggcaggagagagagcagcuccccugcccaccugccccucaacccuguagcugcagggggagg

SEQ ID NO: 506723 - RNA, 64 nt, Human
ggugcagacaagagguggcgagagcccccaucaugccccucaaccuaucccguuccuucugccu

SEQ ID NO: 506724 - RNA, 64 nt, Human
cucagacacugaugucuguccccaggugcucucugccccucaugccccucucaccggcccagug

SEQ ID NO: 506725 - RNA, 64 nt, Human; identical to SEQ ID NO: 242203

SEQ ID NO: 506726 - RNA, 64 nt, Human; identical to SEQ ID NO: 242353

SEQ ID NO: 506727 - RNA, 64 nt, Human; identical to SEQ ID NO: 240132

SEQ ID NO: 506728 - RNA, 64 nt, Human
aggaacgugcaaauuugcaggugcugcaucccaagccccucaugcuccugccuuccugagggcc

SEQ ID NO: 506729 - RNA, 64 nt, Human
augcccguuggacuuugccccucacacuggcccagccccucacacugccccaccccgagaaccc

SEQ ID NO: 506730 - RNA, 64 nt, Human
ccaggccgcaggagugggaugcccguuggacuuugccccucacacuggcccagccccucacacu

SEQ ID NO: 506731 - RNA, 64 nt, Human
caggcccuuccucccuuggcccaaccagcaaagcgccccucagucuucaagggcuuuccuggau

SEQ ID NO: 506732 - RNA, 64 nt, Human
acacagccaggaacccggccagguccccccacaugccccucagggcccaggccugagugagugc

SEQ ID NO: 506733 - RNA, 64 nt, Human
cucuuuagucuuugucccuuccuuuucacuaagugccccucauccuuuucaaucucauugucac

SEQ ID NO: 506734 - RNA, 64 nt, Human
cccuuuccuuccucuccucccaccuccucccucagccccucauucuccuugggaaucugcagag

SEQ ID NO: 506735 - RNA, 64 nt, Human
accgccagagucccagacaccgguuuuccuagaagccccucacccccacuggcccacugguggc

SEQ ID NO: 506736 - RNA, 64 nt, Human
ccugccaagcgagaaugcaggccccgcccccucggccccucaccaccucuuucuacagccuaau

SEQ ID NO: 506737 - RNA, 64 nt, Human
uaugaggagagcuucaggccccaggacugugggggccccucaggucagcucacugagcugggug

SEQ ID NO: 506738 - RNA, 64 nt, Human
auauuggcaaggggaguggaaaugacaccaagaagccccucaugcucaugguuggacagagagc

SEQ ID NO: 506739 - RNA, 64 nt, Human
cauuugccucccuccagcucugcuuaggcauuuugccccucaccccaauguuccacaccaucga

SEQ ID NO: 506740 - RNA, 64 nt, Human
ccauucuccagucagaguagaugaugaggcccaugccccucacccccacgccccgccccuacaa

SEQ ID NO: 506741 - RNA, 64 nt, Human
guggcaccugccacucugccccuugcccuccccugccccucacaacagucaccucacaaaccug

SEQ ID NO: 506742 - RNA, 64 nt, Human
gaugacugcagcagaccuccuuggguguaccaaugccccucaucucccacuuucacaccuaacc

SEQ ID NO: 506743 - RNA, 64 nt, Human; identical to SEQ ID NO: 242221

SEQ ID NO: 506744 - RNA, 64 nt, Human; identical to SEQ ID NO: 242222

SEQ ID NO: 506745 - RNA, 64 nt, Human; identical to SEQ ID NO: 242240

SEQ ID NO: 506746 - RNA, 64 nt, Human
aaauaaaguauaaaacauuuccaaucacuuaguagccccucaaaguaguuagaaaauaaacaga

SEQ ID NO: 506747 - RNA, 64 nt, Human
gcucaccguggcaaacacaggaaccccaugacucgccccucaccuggcguggagcugccugguu

SEQ ID NO: 506748 - RNA, 64 nt, Human
gugcacacagggaugcccgcuccacauccugccugccccucagcccuggcccaggccccuuuug

SEQ ID NO: 506749 - RNA, 64 nt, Human
cccaucuugaguccuggaacggcccugggugccugccccucacugugcaacucugggagcagcc

SEQ ID NO: 506750 - RNA, 64 nt, Human
cccucuaaauaccuacccuagaugauuucauccugccccucacuucuuaacauauuccuguguc

SEQ ID NO: 506751 - RNA, 64 nt, Human; identical to SEQ ID NO: 242542

SEQ ID NO: 506752 - RNA, 64 nt, Human; identical to SEQ ID NO: 242543

SEQ ID NO: 506753 - RNA, 64 nt, Human; identical to SEQ ID NO: 242544

SEQ ID NO: 506754 - RNA, 64 nt, Human; identical to SEQ ID NO: 242545

SEQ ID NO: 506755 - RNA, 64 nt, Human; identical to SEQ ID NO: 242546

SEQ ID NO: 506756 - RNA, 64 nt, Human; identical to SEQ ID NO: 242547

SEQ ID NO: 506757 - RNA, 64 nt, Human; identical to SEQ ID NO: 242548

SEQ ID NO: 506758 - RNA, 64 nt, Human; identical to SEQ ID NO: 242549

SEQ ID NO: 506759 - RNA, 64 nt, Human; identical to SEQ ID NO: 242550

SEQ ID NO: 506760 - RNA, 64 nt, Human
ggaccugcaggagcggggagcugcagugccaccugcuggguaccacgggccgggccuggggucc

SEQ ID NO: 506761 - RNA, 64 nt, Human
agacucugccucagaaaaaaaaaaaaauaauaaugcuggguagugaccuugugauuguuacagc

SEQ ID NO: 506762 - RNA, 64 nt, Human
ucaugcuggcaauacuugaaacggguuuauuaaugcuggguauuuugcacaauuuuauagaccu

SEQ ID NO: 506763 - RNA, 64 nt, Human
uauuucuauaggaugaaucccuagaaguggaauugcuggguaucucgggggagcuuugugccuu

SEQ ID NO: 506764 - RNA, 64 nt, Human
ggguggcgggcccagggaaaugggguggggaugggcuggguaagaccuggcccuccccugcugc

SEQ ID NO: 506765 - RNA, 64 nt, Human
caaggaaaguuuugcccugagauucaugguuauggcuggguaccaccaaauagaagaauggcuu

SEQ ID NO: 506766 - RNA, 64 nt, Human
uguauauggaauaugcuugccauuaugaagaacagcuggguauaccauuauuucaaguaauaaa

SEQ ID NO: 506767 - RNA, 64 nt, Human
auauaaggaaccauucuccauccuuccuuaucaugcuggguacaaugcuucuaugaauauuucc

SEQ ID NO: 506768 - RNA, 64 nt, Human
uucugugucuguauuuauaauuuauuugaaaugugcuggguaguguucucauuugggggcugaa

SEQ ID NO: 506769 - RNA, 64 nt, Human
cccaagaaaagugcaucugggaauugccaguccagcuggguagucccaggcuccugucuugggg

SEQ ID NO: 506770 - RNA, 64 nt, Human
ugcagugagccaugaucaugccacugcacucugggcuggguaacagagugagauccugucucaa

SEQ ID NO: 506771 - RNA, 64 nt, Human
accacaacaaauauugauugagggcgcugcaugugcuggguacauuucuuggcacuugggaauc

SEQ ID NO: 506772 - RNA, 64 nt, Human
uucccuugacuucccuuuugagagcacacguucugcuggguagcucaauugccagccucuguca

SEQ ID NO: 506773 - RNA, 64 nt, Human
ucugauuuuguggcaaaaauacuuccuagguggugcuggguacuucuuguugcauccugucagg

SEQ ID NO: 506774 - RNA, 64 nt, Human
aacagacaugagaccuccuccaggacccugcggggcuggguacuguguacccccaggcuggcua

SEQ ID NO: 506775 - RNA, 64 nt, Human
uaggaguuucucaucuaugagaaagaccuaccaugcuggguagggcuuaugggcugaguuucug

SEQ ID NO: 506776 - RNA, 64 nt, Human; identical to SEQ ID NO: 359174

SEQ ID NO: 506777 - RNA, 64 nt, Human; identical to SEQ ID NO: 359175

SEQ ID NO: 506778 - RNA, 64 nt, Human; identical to SEQ ID NO: 359176

SEQ ID NO: 506779 - RNA, 64 nt, Human; identical to SEQ ID NO: 359178

SEQ ID NO: 506780 - RNA, 64 nt, Human
gucaucugaguugagcacuggucacauugaaggugcuggguaagugguagcucuuguugcuucc

SEQ ID NO: 506781 - RNA, 64 nt, Human
agcagagaccucuccacuuucccuuagccccucugcuggguagagaggcacuuucagggacuuc

SEQ ID NO: 506782 - RNA, 64 nt, Human
auccgggagagcuaggucccuuggggcucuggaugcuggguaacccagagguaauguggguacc

SEQ ID NO: 506783 - RNA, 64 nt, Human
caggaguuuggacccucuaggucuugggggaagagcuggguaauaccuggugucugagugauuc

SEQ ID NO: 506784 - RNA, 64 nt, Human
gggcugcagagcucuguugagggaacugcccagggcuggguagaggcagcaaggggacagggcu

SEQ ID NO: 506785 - RNA, 64 nt, Human
ggcuuagaucaauguauagggcuauauuuuggcagcuggguagcucuuugaagguggauaagac

SEQ ID NO: 506786 - RNA, 64 nt, Human
cugcucauauuacacuccauccucucuguaguuugcuggguaguggaggggguaagcuaaauca

SEQ ID NO: 506787 - RNA, 64 nt, Human
agacucugaaggcccucccggcaccucugccaaggcuggguaagacuccucuauguugccugcu

SEQ ID NO: 506788 - RNA, 64 nt, Human
acacaaauaguuuuauaaucaggauugcauuugugcuggguaaaagaggagagcugugcuuucu

SEQ ID NO: 506789 - RNA, 64 nt, Human
ggaaccgugcaaaggaaacuggaaacuuuuccccgcuggguagagcauguugcugauacucuuc

SEQ ID NO: 506790 - RNA, 64 nt, Human
cugucucagaaaaaaaaaacaaaaaccaguuuaggcuggguaugguggcucaccagcacuuugg

SEQ ID NO: 506791 - RNA, 64 nt, Human
ccaggauccccugcuacuccacugaccuggaagagcuggguaccaggccacccacuguggggca

SEQ ID NO: 506792 - RNA, 64 nt, Human
cuguacagcaugcguucucuuuuugugguugcuggcuggguacuguauuuaaugaaguagagaa

SEQ ID NO: 506793 - RNA, 64 nt, Human
aaaauaaaaauguuuaguucaagaagagacccaagcuggguaugguggugugagagccugugag

SEQ ID NO: 506794 - RNA, 64 nt, Human
ugggcuccugcagcccuguccuggcaggugaugugcuggguauagcauggaccucccagagaag

SEQ ID NO: 506795 - RNA, 64 nt, Human
ggauuaauccucuugcaccagcucucagagaaaugcuggguaucccuguccuugucccuaucug

SEQ ID NO: 506796 - RNA, 64 nt, Human; identical to SEQ ID NO: 359183

SEQ ID NO: 506797 - RNA, 64 nt, Human; identical to SEQ ID NO: 359184

SEQ ID NO: 506798 - RNA, 64 nt, Human; identical to SEQ ID NO: 359185

SEQ ID NO: 506799 - RNA, 64 nt, Human; identical to SEQ ID NO: 359186

SEQ ID NO: 506800 - RNA, 64 nt, Human
cgguucagccaagacagauguagacggaguuggagcuggguauuguuaaaaacugcauuaugca

SEQ ID NO: 506801 - RNA, 64 nt, Human
uagugcuaaagaaaagauuuaagcaccuugucaagcuggguaaauaggaaaaauacauaaucau

SEQ ID NO: 506802 - RNA, 64 nt, Human
ucuggggggaagggaggggggaaugggugugucagcuggguagauacaaacccugaaaagagaa

SEQ ID NO: 506803 - RNA, 64 nt, Human
uggaguuaccaguuacugaaauagggaaggaugggcuggguaaguauggaauuuggugcaaagc

SEQ ID NO: 506804 - RNA, 64 nt, Human
uucacuccauaaaauacagagagugcugcaaugagcuggguagaagagguuaguuuuauagaca

SEQ ID NO: 506805 - RNA, 64 nt, Human
uccacaguggggcaccaaggauucuguccucauugcuggguaagcagggagaagagaaguuuuc

SEQ ID NO: 506806 - RNA, 64 nt, Human
ugauggggccuggguuuguuccuggggcuggaaugcuggguaugcucugugacaaggcuacgcu

SEQ ID NO: 506807 - RNA, 64 nt, Human
uuugugaaaaaugcuaugucacuauucagaauaugcuggguaaauugacuugccuagugaaaag

SEQ ID NO: 506808 - RNA, 64 nt, Human
uuuaguuuugauuguuuuaacaguuaguaauggugcuggguaauaagcauaagaccaaucucuu

SEQ ID NO: 506809 - RNA, 64 nt, Human
guaaccauccuggucaacuuagcagaaaugcugcgcuggguauaauaaagcuuuucuacuucua

SEQ ID NO: 506810 - RNA, 64 nt, Human
gugcacagacuagccuuagucaucuccaguugaggcuggguaugagggguacagacuuggcccu

SEQ ID NO: 506811 - RNA, 64 nt, Human
ggccuggcugaguucacagcccagucuggggacagcuggguaugaggugcuuacggcacagugu

SEQ ID NO: 506812 - RNA, 64 nt, Human
acagcaugagcaugaagcccaguggcaccaaauggcuggguacaaucaagugauauuuuguagc

SEQ ID NO: 506813 - RNA, 64 nt, Human
uuuaagggugauagucaaauuauguauugguggggcuggguaccaaugcugcaggucaacagcu

SEQ ID NO: 506814 - RNA, 64 nt, Human
uacagaaccuucccuagagggaauaccagaguuagcuggguauagagguggcucaaaggaagug

SEQ ID NO: 506815 - RNA, 64 nt, Human
gaacugccauuuguguuucagcucacaguucuuugcuggguaaaagaaauacuuucugacaguc

SEQ ID NO: 506816 - RNA, 64 nt, Human; identical to SEQ ID NO: 359245

SEQ ID NO: 506817 - RNA, 64 nt, Human; identical to SEQ ID NO: 359246

SEQ ID NO: 506818 - RNA, 64 nt, Human; identical to SEQ ID NO: 359247

SEQ ID NO: 506819 - RNA, 64 nt, Human; identical to SEQ ID NO: 357253

SEQ ID NO: 506820 - RNA, 64 nt, Human
guccccuugagaggucagaggggccucugugggugcuggguacuccagaggugccacuggugga

SEQ ID NO: 506821 - RNA, 64 nt, Human
gcuugcuguguugcugagaucaucguaugcaacagcuggguaauaagacuagcauagcucaaac

SEQ ID NO: 506822 - RNA, 64 nt, Human
cugagcuggaccuuaugcaaacauuucugugccugcuggguaggggcacgucugaggggcccug

SEQ ID NO: 506823 - RNA, 64 nt, Human
gcgcaaggagaggagggauccaguggggccgugggcuggguagggugccuuggcaggagccagg

SEQ ID NO: 506824 - RNA, 64 nt, Human
agcauggagcaggcagaggaagccuaucuguggggcuggguacauuucucugagacucacggaa

SEQ ID NO: 506825 - RNA, 64 nt, Human
ccauuuggggaggcaggcugggccaaaggguagagcuggguaauaaaugucuauucuccugggg

SEQ ID NO: 506826 - RNA, 64 nt, Human
ccuaacugguauagagcaccuaguccagugaccugcuggguaaacuguggaugaugguugcaaa

SEQ ID NO: 506827 - RNA, 64 nt, Human
cagcugaguuaugaagcuggaauugguucuagacgcuggguagaugcaaagcagccuaacucuu

SEQ ID NO: 506828 - RNA, 64 nt, Human
gggguggaugaaagaacuagaauagaagacugaagcuggguaggccgcucaguguccacuggca

SEQ ID NO: 506829 - RNA, 64 nt, Human
uccacuggacacugugaaauacacuaacaggauggcuggguagagcaaucugggcacuuuggcc

SEQ ID NO: 506830 - RNA, 64 nt, Human
uacugaauaaauaacauuaacuugggagccaagagcuggguaagccuuaccuuuagacuacucu

SEQ ID NO: 506831 - RNA, 64 nt, Human
uuagcugaaggaggaauacgagggcuuugggcaggcuggguacccaauauacaaagagcagcac

SEQ ID NO: 506832 - RNA, 64 nt, Human
uuuggauaucuugaguugaugguuuugugauuuagcuggguaaacuaucuuuguaacagauaag

SEQ ID NO: 506833 - RNA, 64 nt, Human
uucaggagagccugccauuccugggaugaucccugcuggguauuugcacgagagugguuugguu

SEQ ID NO: 506834 - RNA, 64 nt, Human
aaggcaucuuguugccuugccacguccugucacagcuggguauccuuaccauguuccacgcccu

SEQ ID NO: 506835 - RNA, 64 nt, Human
ucaaagcacuaccacaccuagacuggaaaugugggcuggguaauuucuugcuguuagcagccga

SEQ ID NO: 506836 - RNA, 64 nt, Human; identical to SEQ ID NO: 359171

SEQ ID NO: 506837 - RNA, 64 nt, Human; identical to SEQ ID NO: 357254

SEQ ID NO: 506838 - RNA, 64 nt, Human; identical to SEQ ID NO: 357255

SEQ ID NO: 506839 - RNA, 64 nt, Human; identical to SEQ ID NO: 357256

SEQ ID NO: 506840 - RNA, 64 nt, Human
ugaaacacugucucugcaaaaaauacaaaaauuagcuggguauggugguaagugccuguagucc

SEQ ID NO: 506841 - RNA, 64 nt, Human
gcuuauugcacccucaccaugugccuggugcccugcuggguagagaacacagaggacagggcau

SEQ ID NO: 506842 - RNA, 64 nt, Human
guuuccuccucgcccuucaguuuuugccugaggugcuggguagcccauccuuuccucuguccca

SEQ ID NO: 506843 - RNA, 64 nt, Human
ugcaggagccauaggaaacuacugaaaugauugugcuggguaaauuaaggaucuggcaucauac

SEQ ID NO: 506844 - RNA, 64 nt, Human
cacagugagacuccaucucuuaaaaaaaaaauuagcuggguauagugguaugugccuguagucc

SEQ ID NO: 506845 - RNA, 64 nt, Human
guucauucauuuaacacacauugauugagugccugcuggguacaagggauucaauuuaugccua

SEQ ID NO: 506846 - RNA, 64 nt, Human
ccugcccaaggacgacgaggauugcuccagggcugcuggguaguuuaccgucccuucuauaggc

SEQ ID NO: 506847 - RNA, 64 nt, Human
ccuuuggcuuccgugcucgagccguuuuuacccagcuggguacggugccacguucaggcacgug

SEQ ID NO: 506848 - RNA, 62 nt, Human
gcaaaugguuugauaguugaugauggcagcaggcuggguaagaagcuggguuguguacuuuc

SEQ ID NO: 506849 - RNA, 64 nt, Human
ugccauggagccaggucagcucucugucuguucugcuggguaacaagguuuggcaguuccuguu

SEQ ID NO: 506850 - RNA, 64 nt, Human
agcuuguacaugucucuccccuggcaaaacaagagcuggguaguuuagccaaacggcacccccu

SEQ ID NO: 506851 - RNA, 64 nt, Human
cuacauauuuuuaggauaugaauuuuuuuuuccugcuggguagauuguccagugacuuauggca

SEQ ID NO: 506852 - RNA, 64 nt, Human
aaaaacacagccucuccuuuuagcaaguuaaaaggcuggguaggacugcgggagacugccugcc

SEQ ID NO: 506853 - RNA, 64 nt, Human
acagggaguguaaacugcccccagauguuccugggcuggguaaaagcagcuggagugaagcacu

SEQ ID NO: 506854 - RNA, 64 nt, Human
uagaugcaaauuuuacugcaucacacccugaucagcuggguauuugcuuaguguauucaucaaa

SEQ ID NO: 506855 - RNA, 64 nt, Human
caaguuuagaagguguggaacuugugccuggcuggcuggguagucagcugagccuguugcugag

SEQ ID NO: 506856 - RNA, 64 nt, Human; identical to SEQ ID NO: 359191

SEQ ID NO: 506857 - RNA, 64 nt, Human; identical to SEQ ID NO: 359192

SEQ ID NO: 506858 - RNA, 64 nt, Human; identical to SEQ ID NO: 359193

SEQ ID NO: 506859 - RNA, 64 nt, Human; identical to SEQ ID NO: 359194

SEQ ID NO: 506860 - RNA, 64 nt, Human
augugcugugaccaugugacucagcaauccugcugcuggguauauacccgaaagaaaggaaaag

SEQ ID NO: 506861 - RNA, 64 nt, Human
uaauuacaaauaaugcacacacacaaauguauaugcuggguaguaugaacuccaaggcaauuuu

SEQ ID NO: 506862 - RNA, 64 nt, Human
uacucauaaccuauuaugaaaauaaaugaaacuggcuggguaugguggcucaugccuauaaucc

SEQ ID NO: 506863 - RNA, 64 nt, Human
ugcauucaaaggguuggagauugcugcuuugagugcuggguaccuguggggaaccuacuacucc

SEQ ID NO: 506864 - RNA, 64 nt, Human
augcagaauagacucagccuauguccugauuccagcuggguaguucuagaacuucagaagcucc

SEQ ID NO: 506865 - RNA, 64 nt, Human
ucacccgugcgcccugccuggagguccaggccuugcuggguacuucugagcccuugggauucaa

SEQ ID NO: 506866 - RNA, 64 nt, Human
ggcugaccuaucaaagccucccggaggccaccgugcuggguaccaggacucaccucugacaagc

SEQ ID NO: 506867 - RNA, 64 nt, Human
guuuucuucucuuaaauaacucgaucuguacccagcuggguagcagccagcaaaggccaucaga

SEQ ID NO: 506868 - RNA, 64 nt, Human
aucaugucggugagaugguguggugaugaagccugcuggguauacagcucagggaaagucaucg

SEQ ID NO: 506869 - RNA, 64 nt, Human
ucguguauggugcaaucagaccacaaaaucagaagcuggguauaauauuucaaguuacaaaccc

SEQ ID NO: 506870 - RNA, 64 nt, Human
gcuugaaguggacccugaaaacccugaauccagcgcuggguaugcgaucucugccuaucgccug

SEQ ID NO: 506871 - RNA, 64 nt, Human
guuucucucuuucagcaccagcucuugccccuaugcuggguaccaagggaguucuccuagcugu

SEQ ID NO: 506872 - RNA, 64 nt, Human
gugcugggauuacagggaugagccaccgugccuggcuggguauuuauauuaucauucuaguuuc

SEQ ID NO: 506873 - RNA, 64 nt, Human
cuggaacugaaucuuacaugguauacuuagugcugcuggguaauuuguugguauauuaucuggu

SEQ ID NO: 506874 - RNA, 64 nt, Human
cugguguaugaauacuuugucauaaugcugcuuugcuggguagugagcucuuauuuuucacugg

SEQ ID NO: 506875 - RNA, 64 nt, Human
uuggggguuaccccucagcccaccucacuauggugcuggguagaggggauaccuggguucuaac

SEQ ID NO: 506876 - RNA, 64 nt, Human; identical to SEQ ID NO: 359195

SEQ ID NO: 506877 - RNA, 64 nt, Human; identical to SEQ ID NO: 359196

SEQ ID NO: 506878 - RNA, 64 nt, Human; identical to SEQ ID NO: 359197

SEQ ID NO: 506879 - RNA, 64 nt, Human; identical to SEQ ID NO: 359202

SEQ ID NO: 506880 - RNA, 62 nt, Human
caaaacccugucucugcuaaaaauacaaaauuuagcuggguaugguggcacgugccuguaau

SEQ ID NO: 506881 - RNA, 64 nt, Human
uaaggacuccaccuuuaggggacccuccauguuugcuggguauuagccaagcugguccugggag

SEQ ID NO: 506882 - RNA, 64 nt, Human
gacgucccuuuuuucucugaguaucuccucgcaagcuggguaaucgaugggggagucugaagca

SEQ ID NO: 506883 - RNA, 64 nt, Human
cagaguacagucuuggagggacagaauuguuugugcuggguauuggagcucucaguggggagca

SEQ ID NO: 506884 - RNA, 64 nt, Human
auuuucuuggcuguucuggaaaugcuuucccacagcuggguaacuguucuaaauggcuuugaua

SEQ ID NO: 506885 - RNA, 64 nt, Human
ugccaaggccugugacuuucuaaccuggccucacgcuggguaagcuuaagguagaggugcagga

SEQ ID NO: 506886 - RNA, 64 nt, Human
ugacagccugagaucugucccuucaacgggcugggcuggguaugugccuaccgaugacaaugug

SEQ ID NO: 506887 - RNA, 64 nt, Human
agcaagcuggagaggcugggcaggggcugauggggcuggguacacuggggaauguuagcaagac

SEQ ID NO: 506888 - RNA, 64 nt, Human
uggcuguaaauaccuggcuccugccagcagcugagcuggguagccucucugagcugguuuccug

SEQ ID NO: 506889 - RNA, 64 nt, Human
aggcucagacaccucugagagcaggugggcacuggcuggguacggugcccuccacaggacucuc

SEQ ID NO: 506890 - RNA, 64 nt, Human
augcaaaucuacacaagcuuuuauaaauguugcugcuggguagcuccacaguguuucauaaggc

SEQ ID NO: 506891 - RNA, 64 nt, Human
gaccagggugacucuucaaucccuauccccaugggcuggguacaggauauccuccuaccccaug

SEQ ID NO: 506892 - RNA, 64 nt, Human
gcccuuugcauagcucuccuucccccucacugaagcuggguagccuauugggguugagagggaa

SEQ ID NO: 506893 - RNA, 64 nt, Human
auaauccagacuaccaggucugguagauauuaaagcuggguacuaagaaauguuauuugcaucc

SEQ ID NO: 506894 - RNA, 64 nt, Human
ggcagagcucucugacuuggguguaugcugccaggcuggguacuuucauacuuuguuuucuugu

SEQ ID NO: 506895 - RNA, 64 nt, Human
caucugcuuaauaaacaauuucucagcaauguuugcuggguaugggaguuuaagcccggcagau

SEQ ID NO: 506896 - RNA, 64 nt, Human; identical to SEQ ID NO: 359179

SEQ ID NO: 506897 - RNA, 64 nt, Human; identical to SEQ ID NO: 359180

SEQ ID NO: 506898 - RNA, 64 nt, Human; identical to SEQ ID NO: 359181

SEQ ID NO: 506899 - RNA, 64 nt, Human; identical to SEQ ID NO: 359207

SEQ ID NO: 506900 - RNA, 64 nt, Human
aggacccauccucuuggguggguuuuggguguuggcuggguaaggggagccggggacuucugaa

SEQ ID NO: 506901 - RNA, 64 nt, Human
cacuggaacaaagaacuaggaucucacaggaaaagcuggguaacucaagcagcuauucuuucug

SEQ ID NO: 506902 - RNA, 64 nt, Human
ucuacgcccacccuccccccggcaaaaaaaaaaagcuggguaugguggcuuaugccuguagucg

SEQ ID NO: 506903 - RNA, 64 nt, Human
cuggccucuagucuucccugcucuccgagguagagcuggguauggaugcuuagugcccucacuu

SEQ ID NO: 506904 - RNA, 64 nt, Human
cuggccuccagucuccccugcugucccagguagagcuggguauggaugcuuagugcccucacuu

SEQ ID NO: 506905 - RNA, 64 nt, Human
cucucugagggugauggggcugagcaggaggggggcuggguaagagcacagguuagggcaugga

SEQ ID NO: 506906 - RNA, 64 nt, Human
cagacacaguauuuaauugcacauacagauguuugcuggguauauucacuguaaauuuuauuua

SEQ ID NO: 506907 - RNA, 64 nt, Human
ccuucuguuuugaguuuuguagcaguguacccacgcuggguauuaccauguaaauaaucuguga

SEQ ID NO: 506908 - RNA, 64 nt, Human
auaaaacccgucucuacuaauacaaaaaaaauuagcuggguauguuggugcaggcuugcaaucc

SEQ ID NO: 506909 - RNA, 64 nt, Human
ccuacaaauagcucauuagaugacauucacgcaugcuggguauaggcaaggaaaguaauuuuca

SEQ ID NO: 506910 - RNA, 64 nt, Human
cuuauguuuuuuccaguaucugagauaauauaaagcuggguaauuuuuuauguaauuuuuuggu

SEQ ID NO: 506911 - RNA, 64 nt, Human
gcuugaaagggugugugauuacaccauuguuaaugcuggguaaaaacuaucuucuugcagccuu

SEQ ID NO: 506912 - RNA, 64 nt, Human
agucuaucagacgugggcugaauuuugcugaucagcuggguaguuuuggccgagaacugcacuu

SEQ ID NO: 506913 - RNA, 64 nt, Human
cugccucucccugggucuggggacaggcccgcuugcuggguaccugguccccacugcugagcug

SEQ ID NO: 506914 - RNA, 64 nt, Human
cuucagaccuggacagugucugugaacgagggccgcuggguacgggguugcucugccggaggcu

SEQ ID NO: 506915 - RNA, 64 nt, Human
gaaauugagauuuugauacaccuaaggucacgcagcuggguagauauacagcugucacaagagu

SEQ ID NO: 506916 - RNA, 64 nt, Human; identical to SEQ ID NO: 357258

SEQ ID NO: 506917 - RNA, 64 nt, Human; identical to SEQ ID NO: 357259

SEQ ID NO: 506918 - RNA, 64 nt, Human; identical to SEQ ID NO: 357260

SEQ ID NO: 506919 - RNA, 64 nt, Human; identical to SEQ ID NO: 359258

SEQ ID NO: 506920 - RNA, 64 nt, Human
aaauaacucagcagaauucugaaaaugaggucacgcuggguaagaaugccuuuuuuuuuuuuuc

SEQ ID NO: 506921 - RNA, 64 nt, Human
uacccuggaguagugucugcccugagcugccagugcuggguaucccccagccccaggaaaugug

SEQ ID NO: 506922 - RNA, 64 nt, Human
aauugcguuagucuguuuugcaggaauaccugaggcuggguaauuuauagagaaaagaguuuua

SEQ ID NO: 506923 - RNA, 64 nt, Human
uaacagauaacgauuagaguggggaaccgucaaagcuggguacacauuuccuaucuuccuccag

SEQ ID NO: 506924 - RNA, 64 nt, Human
uugaggaucaguuuuaauuucuccauuuguaauagcuggguauuuaaacuggaagcaaauaguu

SEQ ID NO: 506925 - RNA, 64 nt, Human
gccaggcaggucacugcacaacuaaagcaaaccagcuggguacaguuucuuggcacucuguaag

SEQ ID NO: 506926 - RNA, 64 nt, Human
cucaccccuugggauuauggcuuagaagaagggggcuggguaggcaagcacuccuuggcugugu

SEQ ID NO: 506927 - RNA, 64 nt, Human
uuuuuaaaccccccagcccugcucgugagauugggcuggguagggacagaggaggccgaaaucc

SEQ ID NO: 506928 - RNA, 64 nt, Human
gcaauugcagauaauuccaagaaugcauauuugggcuggguauggagguucacugguaauccca

SEQ ID NO: 506929 - RNA, 64 nt, Human
ggaagggcagguguauucuaauuugcacaaaggugcuggguagacuaguggcagcucucaugug

SEQ ID NO: 506930 - RNA, 64 nt, Human
aaguuuaauuuaauuuuuuacaccuauugauucugcuggguaugagcuaaaguauuacagaaag

SEQ ID NO: 506931 - RNA, 64 nt, Human
agcaccuuacagauauuuuucuccagaagauggugcuggguaauaaaaucaucacaauuaggga

SEQ ID NO: 506932 - RNA, 64 nt, Human
ugaagccagagggaauuucaagacuuaugggaaugcuggguagaagcuguuuuaauuccccugu

SEQ ID NO: 506933 - RNA, 64 nt, Human
uuauuucguuucuggggacugcauuggacugagggcuggguaggcaggugucuuggacccaccu

SEQ ID NO: 506934 - RNA, 64 nt, Human
gcuggccucagacucauacagaagguggggguuggcuggguacgagggauguggagcacaaaag

SEQ ID NO: 506935 - RNA, 64 nt, Human
acuguggggaugugggauguggcgggacaggguugcuggguacagaagccagacuucuuuuaca

SEQ ID NO: 506936 - RNA, 64 nt, Human
augagccagagauagaacauuuuaagccaucuucaaacucuagcaggcuguacauuacagugua

SEQ ID NO: 506937 - RNA, 64 nt, Human
cagugcugaaauucauccuacggaaguaaccgcaaaacucuagagggggaguugagcaggcgcc

SEQ ID NO: 506938 - RNA, 64 nt, Human
uacaugagaacuuagacacaagggaccaucccccaaacucuacucuuauacccagaaaagaaca

SEQ ID NO: 506939 - RNA, 64 nt, Human
gggcugagcuaguuagcccucacuagccaaacugaaacucuaugcaacauuaaaagaagagauc

SEQ ID NO: 506940 - RNA, 64 nt, Human
uuuugaaaguguuauggcuauguuuuaugaugaugcuggguaaguagaguaaguuaaacuuggu

SEQ ID NO: 506941 - RNA, 64 nt, Human
agccacacccguucccacgucagaggagggcaaggcuggguacucagcagccacucugagccgg

SEQ ID NO: 506942 - RNA, 64 nt, Human
aagugucaccccgcuguaagcuccuuuguggagugcuggguaagcaguuuccaauaaacgcaag

SEQ ID NO: 506943 - RNA, 64 nt, Human
uaaaauaaaacugacaaaguguuucuaggguguagcuggguacauauuaaguggcuuguugagc

SEQ ID NO: 506944 - RNA, 64 nt, Human
cggagguugaagaaaggaaccugggaugaggggugcuggguauaagcagagagggauggguucc

SEQ ID NO: 506945 - RNA, 64 nt, Human
agggcggggggagguugauuuucaugauucaugagcuggguacugacugagauaagaaaagccu

SEQ ID NO: 506946 - RNA, 64 nt, Human
gguucuccguguggugggaggaggagguucgggugcuggguaagugccaugucaguguggacag

SEQ ID NO: 506947 - RNA, 64 nt, Human
acugcguacaugauggaccauuuuuuuuuuuuuggcuggguagagaaaucauauaaaacgcagg

SEQ ID NO: 506948 - RNA, 64 nt, Human
uguucugugaccacccguguagcuacugaaaauggcuggguaagcaagucaaggguguuggagg

SEQ ID NO: 506949 - RNA, 64 nt, Human
ucccuucccaggggggugcccuuaguuuggacaugcuggguagcaggacuccagggcgugcacg

SEQ ID NO: 506950 - RNA, 64 nt, Human
ccaaaacucaagucaccucaguaccauccaggaggcuggguauuguccugccucugccuuuucu

SEQ ID NO: 506951 - RNA, 64 nt, Human
ggcaaauccagucccaaugguccugacuuugggcgcuggguauuggaaauggaugcaaaguaca

SEQ ID NO: 506952 - RNA, 64 nt, Human
aaccgugaagacguguggccgcgucccaccugcggcuggguacccugcacccggcacuguagga

SEQ ID NO: 506953 - RNA, 64 nt, Human
uuacuuuuugugcuguggaagagcauuugggaaagcuggguauuauagaggccaaugaaagaug

SEQ ID NO: 506954 - RNA, 64 nt, Human
cccaucucuacaaaaaccaaaaaguuaaaaaucagcuggguacgguggcacgugccugugaucc

SEQ ID NO: 506955 - RNA, 64 nt, Human
ugcagggaccucugauugcaccacugcacuccaggcuggguaacagaaugagaccuuaucucaa

SEQ ID NO: 506956 - RNA, 64 nt, Human
aaaacaaaacagugacacucacuuguguguauauaaacucuagagacaucuuaggcccucccuu

SEQ ID NO: 506957 - RNA, 64 nt, Human
accccgcaacccuguccucugcugggcccccagcaaacucuagcaauagcagcugcugccgugu

SEQ ID NO: 506958 - RNA, 64 nt, Human
gcuaaucuugugaaaauaauugacaggcgaaagaaaacucuauuuagaugcauauuacuguaca

SEQ ID NO: 506959 - RNA, 64 nt, Human
aaaccuauacuguggaguccuguggggauacugcaaacucuauugccaaagggaugcuuuauac

SEQ ID NO: 506960 - RNA, 64 nt, Human
augggggcagguguuccugaauaccgacaggccugcuggguaaaugacuaggugguaagguucu

SEQ ID NO: 506961 - RNA, 64 nt, Human
aguuucuuuccaguacagucaucccuugauaccugcuggguauugguuccagcacuccgugagc

SEQ ID NO: 506962 - RNA, 64 nt, Human
uuucuuaaaaaaaaaaaaaaaaaauuuaaacuuagcuggguaugguggcacaugccuauagucu

SEQ ID NO: 506963 - RNA, 64 nt, Human
accuggaauggaggcugggagauguggcuuauuugcuggguacgugacuaucccuaauaacaaa

SEQ ID NO: 506964 - RNA, 64 nt, Human
auuuguugagcaccuauuauauaucaggcacugagcuggguaggcucuaaacuucacaauaacc

SEQ ID NO: 506965 - RNA, 64 nt, Human
ugccacgucugcaugugaagcgugcucauuucaugcuggguaugacgccgagcgcacaccacug

SEQ ID NO: 506966 - RNA, 64 nt, Human
augaaaaaggacccuaauaaacaccugcucacuggcuggguauucuuuguaaccaguguuucug

SEQ ID NO: 506967 - RNA, 64 nt, Human
caccugucacuguugguacuugcaggaggcuucugcuggguauguuuuggaagugagugucacu

SEQ ID NO: 506968 - RNA, 64 nt, Human
cuugugccucuaagcaguggaccauggucaccuugcuggguagagccuagguuguccuugggcc

SEQ ID NO: 506969 - RNA, 64 nt, Human
gucacacagccccugaccucccucaccaguggaggcuggguagugcuggccaucccaaaagggc

SEQ ID NO: 506970 - RNA, 64 nt, Human
ccuccacaccaguggccucgugguuauuagcaaggcuggguaaugugaaggcccaagagcagag

SEQ ID NO: 506971 - RNA, 64 nt, Human
aagaaccuguaagcagggugugaggagcacccaggcuggguagggacugcaugccccaugccac

SEQ ID NO: 506972 - RNA, 64 nt, Human
gaagcugugaugcaggcugacugccagccgaggggcuggguagugccgugcgggagcugauggu

SEQ ID NO: 506973 - RNA, 64 nt, Human
gcgggucuucuccuugugcccgggauugggcuaugcuggguaccaccauguacucaggcauggu

SEQ ID NO: 506974 - RNA, 64 nt, Human
gucacuuggaagaagacagugacucuuuuucccugcuggguagcauuuuguauggaacgguugg

SEQ ID NO: 506975 - RNA, 64 nt, Human
aaagugagacaucgucucaaaaaaaaaaaaaaaagcuggguaugguggcgcaugccuuuaaucc

SEQ ID NO: 506976 - RNA, 64 nt, Human; identical to SEQ ID NO: 359121

SEQ ID NO: 506977 - RNA, 64 nt, Human; identical to SEQ ID NO: 359122

SEQ ID NO: 506978 - RNA, 64 nt, Human; identical to SEQ ID NO: 359123

SEQ ID NO: 506979 - RNA, 64 nt, Human; identical to SEQ ID NO: 359124

SEQ ID NO: 506980 - RNA, 64 nt, Human
cgcaucccucuuuuccuucccuggguucaguguggcuggguaaggaccgucuguuuguagggcu

SEQ ID NO: 506981 - RNA, 64 nt, Human
aggaagaaccuguagaagaugaccucguuccggagcuggguaucucaaaucugcuuucauccag

SEQ ID NO: 506982 - RNA, 64 nt, Human
gccuccugccacaaagacugggccgagagauggggcuggguaagcgggugcgccuccuguuugg

SEQ ID NO: 506983 - RNA, 64 nt, Human
acagaagcagguggcccugugggcugaggguaaggcuggguaggguccuaacagugcuccuugu

SEQ ID NO: 506984 - RNA, 64 nt, Human
gucucaaauggcucgguguugacccagggauggggcuggguaguuggggucccagaaagccggg

SEQ ID NO: 506985 - RNA, 64 nt, Human
cuaagcaaugaaugaauuucuaaauacaguaugugcuggguaaacagaaagugguuuagacauu

SEQ ID NO: 506986 - RNA, 64 nt, Human
cgggcugaggcugguuucugcucgugcuuacagugcuggguaguguuggcccuaagagcuguag

SEQ ID NO: 506987 - RNA, 64 nt, Human
gggcuauauuucgcaaagcaauuguaacugcagugcuggguagauaauuuuuuuuuuuuuaaga

SEQ ID NO: 506988 - RNA, 64 nt, Human
uaccccuuuaugcaaaauaggauccaaagcuaaggcuggguaagaauaguugugcagggaggga

SEQ ID NO: 506989 - RNA, 64 nt, Human
uguuaguuucccugagguauuugcaaccaccauggcuggguaaccaccgaucagcacagcuguc

SEQ ID NO: 506990 - RNA, 64 nt, Human
aucuguaguaauauagccacaaacuggacaagaagcuggguauuuggguuuaaaauagauuuuc

SEQ ID NO: 506991 - RNA, 64 nt, Human
uaaagccugcccuccuuugccuucaacuguauaugcuggguauuucauuugucuuuuuauuuug

SEQ ID NO: 506992 - RNA, 64 nt, Human
cgcggggcagggcuccacugaagccacccccaccccucgccagcuagcuccauagggaagccug

SEQ ID NO: 506993 - RNA, 64 nt, Human
gugacaggaaagccuuucgagaggcccaagguggccucgccagcccugcaguauugaugugcag

SEQ ID NO: 506994 - RNA, 64 nt, Human
cuuacccaccugucacccccucuacgcucuccuuccucgccagcacgccuuagcuuugcaagcc

SEQ ID NO: 506995 - RNA, 64 nt, Human
ugggcucagcacauaggguucccacgaagcuccgaaacucuaaguguuugcugcaauuuuauaa

SEQ ID NO: 506996 - RNA, 64 nt, Human
ccagaauuucauaugggcagaauaauauugugucaaacucuacuucagauugucuccuuauccc

SEQ ID NO: 506997 - RNA, 64 nt, Human; identical to SEQ ID NO: 359119

SEQ ID NO: 506998 - RNA, 64 nt, Human
ugcucugucccuuccucucugcuucccucccaggccucgccagggcucccuucuccucugccug

SEQ ID NO: 506999 - RNA, 64 nt, Human
cagcguugcccccacaaccacgccggacgugcccccucgccaccuuuuccagacgacuucuuag

SEQ ID NO: 507000 - RNA, 51 nt, Human
ccccauacucagaggugugacccucgccaggccccagccccagugcuggga

SEQ ID NO: 507001 - RNA, 64 nt, Human
acuuuccccgcagcugcagggccucgcgcucggcccucgccaggccagccccacuccuuguacc

SEQ ID NO: 507002 - RNA, 64 nt, Human
ugacaagccagcagccugcgucaggagaagggcuccucgccaacccacccacacgcucgucuca

SEQ ID NO: 507003 - RNA, 64 nt, Human
agauggcuguuaguaggucugugccuggugucugccucgccauccugggguaaggggcagagag

SEQ ID NO: 507004 - RNA, 64 nt, Human
ugcucuuuuguguuucgcuccaaaggguugucuuccucgccaaaaggagggagggacuuugaau

SEQ ID NO: 507005 - RNA, 64 nt, Human
uuccgacaucccagaccagccaaggguccucaccccucgccaccuuucacccucaugaaaacac

SEQ ID NO: 507006 - RNA, 64 nt, Human
ugacgcuccggguccccgugccuggcucuucuugccucgccaccgcgugcuccugggcgcgccc

SEQ ID NO: 507007 - RNA, 64 nt, Human
cugcugcccgcacagcuucccucccgggcacucaccucgccaucccugccgucccaaggcucuc

SEQ ID NO: 507008 - RNA, 64 nt, Human
ggcagggauggggguggcugggacuccuggugccccucgccagcuucuccugcgccccgcccac

SEQ ID NO: 507009 - RNA, 64 nt, Human
agggaaccuacccucggcucccgggucuccccucccucgccaccccaaccagcggcuucugcgc

SEQ ID NO: 507010 - RNA, 64 nt, Human
aagggaaggcgguucagagauguuggaggacaccccucgccaucucgcccuugcugggggcacg

SEQ ID NO: 507011 - RNA, 64 nt, Human
aggaggauccuugaggucaggaguucgagaccagccucgccaacauggugaaaccccauuucua

SEQ ID NO: 507012 - RNA, 64 nt, Human; identical to SEQ ID NO: 359125

SEQ ID NO: 507013 - RNA, 64 nt, Human; identical to SEQ ID NO: 359126

SEQ ID NO: 507014 - RNA, 64 nt, Human; identical to SEQ ID NO: 359127

SEQ ID NO: 507015 - RNA, 64 nt, Human
ugggcggaucacaaggucaagagaucaagaccauccucgccaacaaggugaaaccccaccucua

SEQ ID NO: 507016 - RNA, 64 nt, Human
agccaggaccugcugugugaaaucgaagacucgcccucgccagugguguuacacauugaggcug

SEQ ID NO: 507017 - RNA, 64 nt, Human
uccagccagagggucuggaccauccagugccuguccucgccacagggccuccagggagcauucg

SEQ ID NO: 507018 - RNA, 64 nt, Human
gaaccuaccucauccuccuggaggguguggcuacccucgccaccccaaauuccaugucaauaaa

SEQ ID NO: 507019 - RNA, 64 nt, Human
cagccacugcuacuacaucuugccagaagguuucccucgccaacaaacaguugaaauuuaaggg

SEQ ID NO: 507020 - RNA, 64 nt, Human
ggcagaucacuugaggucaggaguuugagaccagccucgccaacauggugagacccugucucua

SEQ ID NO: 507021 - RNA, 64 nt, Human
cacccaccgcugggucugcggccuaagggaccucccucgccagcagagguccauuccguuccca

SEQ ID NO: 507022 - RNA, 64 nt, Human
gcagggugaacugcagcgaguacuucccgcuguuccucgccacgcucugggucgccggcaucuu

SEQ ID NO: 507023 - RNA, 64 nt, Human
caaaaugcugagauuacaggugugagccacugcaccucgccagauguccaaugucugacuccug

SEQ ID NO: 507024 - RNA, 64 nt, Human
ugccgccccuccccucccacucucgucuccuuccccucgccauagaguuccagacauauuuucc

SEQ ID NO: 507025 - RNA, 64 nt, Human
guugcuggaggggcuguccuccuuccugggacccccucgccagcuuggcucgauguuugccaug

SEQ ID NO: 507026 - RNA, 64 nt, Human
cagaacccucggacggugccagggccgcccgcguccucgccagccucccagcagcaggcgcgcc

SEQ ID NO: 507027 - RNA, 64 nt, Human
cagacucgcccgacggccacggccccccuccugcccucgccagccggcagcccgggccuuucuc

SEQ ID NO: 507028 - RNA, 64 nt, Human
ucggugccguguuccuaacuacuccaucccaugaccucgccacaccuacuggggcaucuggcug

SEQ ID NO: 507029 - RNA, 64 nt, Human; identical to SEQ ID NO: 359212

SEQ ID NO: 507030 - RNA, 64 nt, Human; identical to SEQ ID NO: 359213

SEQ ID NO: 507031 - RNA, 64 nt, Human; identical to SEQ ID NO: 359214

SEQ ID NO: 507032 - RNA, 64 nt, Human
ggggcggccggcagcaggagccugggaaagaggcccucgccaggugauggcagggccagggugg

SEQ ID NO: 507033 - RNA, 64 nt, Human
uacucaccgccgcggacaaucccccaccccgaucccucgccagaccaggacgcuuccucaagcc

SEQ ID NO: 507034 - RNA, 64 nt, Human
agucacguggcucuuuaguaacacggacaaggcuccucgccaaggaacucguggcagaagaggg

SEQ ID NO: 507035 - RNA, 64 nt, Human
gguggaucaccugaggucaggaguucgagaccagccucgccaacauggcgaaaccccaucucua

SEQ ID NO: 507036 - RNA, 64 nt, Human
acagcagagccuuuccagcuguacauaaccacguccucgccacugcaccucggcauaugccacc

SEQ ID NO: 507037 - RNA, 64 nt, Human
uggcccaaaguggcccaaagcgucccaaaguaggccucgccaggcccaccuccugcccggcgua

SEQ ID NO: 507038 - RNA, 64 nt, Human
aaagcaggcgagguaaauggacaguggacagccgccucgccaaacuguuagucuuuaccucuga

SEQ ID NO: 507039 - RNA, 64 nt, Human
uucccaaguauacgcuguucuuucgcucuuugugccucgccagugcuuuccaugugccucguag

SEQ ID NO: 507040 - RNA, 64 nt, Human
caucaacacacaaauucguaaaaaacacacauggccucgccaucguggguaaaaucggccccac

SEQ ID NO: 507041 - RNA, 64 nt, Human
cgaccuucugguguggccgcccugggggccaggcccucgccauccuccccauccuuguuccuca

SEQ ID NO: 507042 - RNA, 64 nt, Human
ggagggcagcagcugagaggccagggacagggugccucgccaagcugucugaggucugucccag

SEQ ID NO: 507043 - RNA, 64 nt, Human
agaggccuugccugggcaacccuaagccccugucccucgccauacacugaugccuggcagcuag

SEQ ID NO: 507044 - RNA, 64 nt, Human
cacaguugccaagaggggucuuugccgugggcccccucgccagccacucaccagcugcaugcac

SEQ ID NO: 507045 - RNA, 64 nt, Human
agacccuccuucccucucaccccuccucucccggccucgccaggagucuuggcuguuggcagcu

SEQ ID NO: 507046 - RNA, 64 nt, Human; identical to SEQ ID NO: 359129

SEQ ID NO: 507047 - RNA, 64 nt, Human; identical to SEQ ID NO: 359132

SEQ ID NO: 507048 - RNA, 64 nt, Human; identical to SEQ ID NO: 359133

SEQ ID NO: 507049 - RNA, 64 nt, Human
uuguaugacuccuggcagcaggcgugggcuuccuccucgccacuccugcucuuucuccacugca

SEQ ID NO: 507050 - RNA, 64 nt, Human
uucugccugugucaccuuggugcccgucuuggggccucgccacacaugcccuuuguugggcuga

SEQ ID NO: 507051 - RNA, 64 nt, Human
ccuuccguuucugaaaucucuuacucagguaaggccucgccaagccucuaugcaccccacaaag

SEQ ID NO: 507052 - RNA, 64 nt, Human
agccgagacuggcagcccuccaucugguccguacccucgccagaggccccccuacaucaaccuc

SEQ ID NO: 507053 - RNA, 64 nt, Human
cagugccacccggccucccgucuuuccugaaaccccucgccagauuuugcacucugagguuucu

SEQ ID NO: 507054 - RNA, 64 nt, Human
gaagagaaacuaccaagacuccuccugccccaaaccucgccagagaagcucuucaaccagaggg

SEQ ID NO: 507055 - RNA, 64 nt, Human
ucuguguucauccccuuccugaucuaaccggcucccucgccagucccgggggccugcccugcuc

SEQ ID NO: 507056 - RNA, 64 nt, Human
ucacuugugaaucaggcagugucauggcagccacccucgccaacggugggaucugccccaucac

SEQ ID NO: 507057 - RNA, 64 nt, Human
cacaggagggagcgggagcaggauguggcccuggccucgccagagcaccugaagaagcaggccg

SEQ ID NO: 507058 - RNA, 63 nt, Human
acgucuucugcagggagugagcuccccagacccccucgccacuccagcgcccaguccuucucc

SEQ ID NO: 507059 - RNA, 64 nt, Human
gucgagacaguugucaaagaagaaaguuauccuaccucgccaagugguaugaaauuaagugacc

SEQ ID NO: 507060 - RNA, 64 nt, Human
uuugcuuuucuucuaacuuuucccucuagccucuccucgccacaauuugcugcuuacugcuggu

SEQ ID NO: 507061 - RNA, 64 nt, Human
gcggcccugcccaggaggcggcagccgggcgcacccucgccagcccugcuggaguuugcugugg

SEQ ID NO: 507062 - RNA, 64 nt, Human
cacaccgcacugcaccgcaccgcaccgcaccguaccucgccacaucucaccacaccacaccaca

SEQ ID NO: 507063 - RNA, 64 nt, Human; identical to SEQ ID NO: 359134

SEQ ID NO: 507064 - RNA, 64 nt, Human; identical to SEQ ID NO: 359135

SEQ ID NO: 507065 - RNA, 64 nt, Human; identical to SEQ ID NO: 359136

SEQ ID NO: 507066 - RNA, 64 nt, Human
uuugcacagcaugccagcuccucaguguuacauuccucgccagggucucucagugggucuucga

SEQ ID NO: 507067 - RNA, 64 nt, Human
ucuuccuacagcccccucuccagcccagcuaccuccucgccaagugggaaugccuacuccaguc

SEQ ID NO: 507068 - RNA, 64 nt, Human
cucacucgccugcuucccaugcucccuuguacccccucgccacaucccugucuuggggcccagc

SEQ ID NO: 507069 - RNA, 64 nt, Human
ugcuggcucgcucccacaccgccccgguguuggcccucgccauggagcagaggcggggacagcu

SEQ ID NO: 507070 - RNA, 64 nt, Human
aggucacugccuuccggagcugcgccuauuccucccucgccaaacgcguuccagaauuugucca

SEQ ID NO: 507071 - RNA, 64 nt, Human
cccuugcuggggaaaguggcuugguuccccaucuccucgccagcugcugaucccuacacgggca

SEQ ID NO: 507072 - RNA, 64 nt, Human
gcuccagcauugacugucucugugccaugaucaaccucgccaccacagagcuggagucugacuu

SEQ ID NO: 507073 - RNA, 56 nt, Human
accguuucucucccaccuagagcgccccucgccagcccgcucugucgcugcugcgc

SEQ ID NO: 507074 - RNA, 64 nt, Human
gcacuucaguccuauucaacauaguacuggaaguccucgccacagcaaucaggcaagagaaaga

SEQ ID NO: 507075 - RNA, 64 nt, Human
ccuuggucuggacacauucuggaacacuggacacccucgccagggccacuucugcacuagggcu

SEQ ID NO: 507076 - RNA, 64 nt, Human
cuuccugggguagcugagccgcugcuacgccuauccucgccacuaccucauccuggucacucag

SEQ ID NO: 507077 - RNA, 64 nt, Human
cuuuccuaggaguuugaaugccccauauuuguguccucgccagcucuuuggccaccuuucaagc

SEQ ID NO: 507078 - RNA, 62 nt, Human
gugugauaaggaagacauaggcuuuuguccugccucgccaucggagcucucaugggccccag

SEQ ID NO: 507079 - RNA, 64 nt, Human
ccucaaaugaggacagggcucccgccuucacagcccucgccaggggucugccccaauccuggcc

SEQ ID NO: 507080 - RNA, 63 nt, Human; identical to SEQ ID NO: 359138

SEQ ID NO: 507081 - RNA, 64 nt, Human; identical to SEQ ID NO: 359139

SEQ ID NO: 507082 - RNA, 64 nt, Human; identical to SEQ ID NO: 359140

SEQ ID NO: 507083 - RNA, 64 nt, Human
ccuuuguggcugccucccaagccugcuucuuuguccucgccacauagucgucagcguaggcacc

SEQ ID NO: 507084 - RNA, 64 nt, Human
uccuggggcuguacugagcgccaucuggguccgcccucgccagcgcugcugcaagaaggacccc

SEQ ID NO: 507085 - RNA, 64 nt, Human
cugugggggcgcagccugccuccugcucucaguuccucgccagaggcugcugcccuuccuggcu

SEQ ID NO: 507086 - RNA, 64 nt, Human
agggcuucccgcugccuccagacagcaccuggguccucgccacccuaagccccgggacaccugu

SEQ ID NO: 507087 - RNA, 64 nt, Human
gcuaggcaucgggcggcagcgccgacagcccuucccucgccagugccccucggccacuccuggg

SEQ ID NO: 507088 - RNA, 64 nt, Human
cugcagguggcaucugccacgaaggaagcgccagccucgccaggccagcaggggcgucguuuug

SEQ ID NO: 507089 - RNA, 64 nt, Human
cgccuccccagcccggggacggccgugcuccgucccucgccaacggccgagcuugugauucuga

SEQ ID NO: 507090 - RNA, 64 nt, Human
agcagucaccugggguuucuggggguggacaguuccucgccacccagcagcacccugggacugc

SEQ ID NO: 507091 - RNA, 64 nt, Human
acgcccccacuagcuacuccacgaagcccccgagccucgccagacccccagggggccucugacg

SEQ ID NO: 507092 - RNA, 64 nt, Human
ccucugcccuuucucuguccuuaugcugucccggccucgccagcccucuggggcauugugggag

SEQ ID NO: 507093 - RNA, 64 nt, Human
aacuuuccaaaaccuuccucuuccagcaacugaaccucgccauaaggcacuuaucccugguucc

SEQ ID NO: 507094 - RNA, 64 nt, Human
gguggcaccggugcugggacacacgggacuguguccucgccaccccccgcccugcccccugcca

SEQ ID NO: 507095 - RNA, 64 nt, Human
ucacuuccugagcuggugacugccaggguucccaccucgccaaggcuagagggcuccgggugug

SEQ ID NO: 507096 - RNA, 64 nt, Human
caagggggcggggcgggggcccgaaagcugagacccucgccacggggagggggacgcgcacaca

SEQ ID NO: 507097 - RNA, 64 nt, Human; identical to SEQ ID NO: 359141

SEQ ID NO: 507098 - RNA, 64 nt, Human; identical to SEQ ID NO: 359142

SEQ ID NO: 507099 - RNA, 64 nt, Human; identical to SEQ ID NO: 359143

SEQ ID NO: 507100 - RNA, 64 nt, Human
caagaugcugggauuacagacaugagccaccgugccucgccacagccaggauuugaacaaacuu

SEQ ID NO: 507101 - RNA, 64 nt, Human
agugccgcgcaggaaugugggguccccuguguucccucgccagaggagcacuuggcaaggucag

SEQ ID NO: 507102 - RNA, 64 nt, Human
ucggcuugucgccugcuccccguaucccauggcuccucgccaaagacugaaauuguggagcugg

SEQ ID NO: 507103 - RNA, 64 nt, Human
cccuuccuuacuuguuggggggaggucuggagcaccucgccaaugcccuucccccauccggcug

SEQ ID NO: 507104 - RNA, 64 nt, Human
cuccccuuccccagccucgaagccaugggggcccccucgccacccccagccccuugggcuaucg

SEQ ID NO: 507105 - RNA, 60 nt, Human
gccggaccacccccguauaaagaccgcgggccucgccagaagaccgcgggaggagggcgc

SEQ ID NO: 507106 - RNA, 59 nt, Human
guuucugugucaaucgcugugaaauaaagucugaaaacuuuaaaagcauugcuuuuguc

SEQ ID NO: 507107 - RNA, 59 nt, Human
uucagucugcaguccucugcucacagacaucugaaaagugaauggccaagcuggucuag

SEQ ID NO: 507108 - RNA, 59 nt, Human
cuggcucaauggucuacauucugaaguugucugaaaaugucuucaugauuaaauucagc

SEQ ID NO: 507109 - RNA, 59 nt, Human
ggagcuuaacagaggaaccucaagaagauucugaaaauccuacccccaccccccaccag

SEQ ID NO: 507110 - RNA, 59 nt, Human
aaacugaggaaugaauuccacgagccuguucugaaaauguggacguaagacaaacacgu

SEQ ID NO: 507111 - RNA, 59 nt, Human
gggcuauaauucuguccuggaaaaagaacucugaaaaccugggucaggggaaugauucc

SEQ ID NO: 507112 - RNA, 64 nt, Human; identical to SEQ ID NO: 359145

SEQ ID NO: 507113 - RNA, 64 nt, Human; identical to SEQ ID NO: 359146

SEQ ID NO: 507114 - RNA, 64 nt, Human; identical to SEQ ID NO: 359147

SEQ ID NO: 507115 - RNA, 59 nt, Human
auuagcaauuuucaaauaauuauuuuuucucugaaaauuuugugugugauugcacaaua

SEQ ID NO: 507116 - RNA, 59 nt, Human
cauggccccuucaggagcagaaucauagcucugaaaagagaagcuccguuguguacuga

SEQ ID NO: 507117 - RNA, 59 nt, Human
uuuuguuaauuggacaccaagaggaagaaucugaaaaaaaaaugcauguugguaaguaa

SEQ ID NO: 507118 - RNA, 59 nt, Human
acaauugggggaaggggaaggaagaaaacucugaaaacaaaaucuuguucuaugcaaaa

SEQ ID NO: 507119 - RNA, 59 nt, Human
aaggaagagagauuguucugaaguuacccucugaaaaauauuuugucucucugacuuga

SEQ ID NO: 507120 - RNA, 59 nt, Human
ucauuaaccacauuccugcacaacucauuucugaaaaccuaccauguuucuuuacagag

SEQ ID NO: 507121 - RNA, 59 nt, Human
ccucccagcuuucuucuucuuuuuuuuuuucugaaaaaaggaaaaagcacacagcacac

SEQ ID NO: 507122 - RNA, 59 nt, Human
gagugggagcugagugggggaucacagccucugaaaaccaauguucucucuucuccacc

SEQ ID NO: 507123 - RNA, 59 nt, Human
cucacuucugcuuccucaucucagcccacucugaaaaugugcagcacccucacugguuc

SEQ ID NO: 507124 - RNA, 59 nt, Human
aacgcaaggaggaugcccaauuguugcccucugaaaaugcacaguucuccuggcccuag

SEQ ID NO: 507125 - RNA, 59 nt, Human
aggguaagagauggguagaagaguaugccucugaaaauuuuauuaguuuauucuugugg

SEQ ID NO: 507126 - RNA, 59 nt, Human
uuggucaugguaagguuuuuccaucagccucugaaaaaauaguugugcacaacaucugc

SEQ ID NO: 507127 - RNA, 59 nt, Human
agcauugcuucucacaacuauuaccugcaucugaaaaaaaaucuauagacuccagcugc

SEQ ID NO: 507128 - RNA, 59 nt, Human
aaucgagguuuuuuuguuuuguuuuguuuucugaaaaaaucauacaacuuugugcuucu

SEQ ID NO: 507129 - RNA, 59 nt, Human
ugguguuuggguuuuguuuuuuugaaaggucugaaaaggugaagcccccuacccaaugg

SEQ ID NO: 507130 - RNA, 64 nt, Human; identical to SEQ ID NO: 359150

SEQ ID NO: 507131 - RNA, 64 nt, Human; identical to SEQ ID NO: 359151

SEQ ID NO: 507132 - RNA, 64 nt, Human; identical to SEQ ID NO: 359152

SEQ ID NO: 507133 - RNA, 59 nt, Human
uaaggaaugaaguuggaaccacaggcagaucugaaaaagaaccaaauagagcuccuaaa

SEQ ID NO: 507134 - RNA, 59 nt, Human
gaauagguggucugaacguggugucucacucugaaaagcaggaauguaagaugaugaaa

SEQ ID NO: 507135 - RNA, 59 nt, Human
aggcaccaaagaaaacauuugcuuaauugucugaaaagaaacaagagaaaaacacuggu

SEQ ID NO: 507136 - RNA, 59 nt, Human
guuuacaggaaagagacugagauugguaaucugaaaaggaccacaagcauagcugguag

SEQ ID NO: 507137 - RNA, 59 nt, Human
gcccugaagucgggagaggugaccacaggucugaaaaucagccagugccaacauugcuu

SEQ ID NO: 507138 - RNA, 59 nt, Human
gacccaaggccuaugcugaggucuaaaccucugaaaaaaguauaguaucgaguacccgu

SEQ ID NO: 507139 - RNA, 59 nt, Human
uauacucacauaacuugauuauucacuccucugaaaagaugcuggauaggcuaccaaag

SEQ ID NO: 507140 - RNA, 59 nt, Human
ggaacugcaguaggcuuccucuguagagcucugaaaagguugacuauauagaggucuug

SEQ ID NO: 507141 - RNA, 59 nt, Human
ugugucucuuguuucuacugcuaagaaggucugaaaauuuaaugaaaccacuucauaca

SEQ ID NO: 507142 - RNA, 59 nt, Human
uuuguuauaagugaccuuugucuggaaugucugaaaaguaguuaaugcuuuuugguauu

SEQ ID NO: 507143 - RNA, 59 nt, Human
guaaaaugaagcaaagauuggaaacacuuucugaaaaagaaagcaaugauaauagcggu

SEQ ID NO: 507144 - RNA, 59 nt, Human
acaagaauggaauagaaauguaaaaguacucugaaaagcaauugcccuguaacuuaucu

SEQ ID NO: 507145 - RNA, 59 nt, Human
ucucaaaucccaaaguugggaggcauguuucugaaaagcaacugaggugugacuguuug

SEQ ID NO: 507146 - RNA, 59 nt, Human
uuuuuuuaacaucucuuucucauuagagaucugaaaacucauuagagauguugagucuu

SEQ ID NO: 507147 - RNA, 59 nt, Human
cguccccaaggaauaaguuuguucagaacucugaaaaugucccuguccuccccuuuacc

SEQ ID NO: 507148 - RNA, 64 nt, Human; identical to SEQ ID NO: 359278

SEQ ID NO: 507149 - RNA, 64 nt, Human; identical to SEQ ID NO: 359279

SEQ ID NO: 507150 - RNA, 64 nt, Human; identical to SEQ ID NO: 359280

SEQ ID NO: 507151 - RNA, 59 nt, Human
uuucucagcaucauggaugcaggggcuugucugaaaagccacucuggaccuagccuguc

SEQ ID NO: 507152 - RNA, 59 nt, Human
uaaaguauauaauuuuuuuauguuuuguuucugaaaauuccagaaaggauauuuaagaa

SEQ ID NO: 507153 - RNA, 59 nt, Human
aaggcaaguugccacuugucauuuuuguuucugaaaaauaaaaguauaacuuauucaca

SEQ ID NO: 507154 - RNA, 59 nt, Human
aagauuuacuguauuaaauggccuucgggucugaaaagcuuuuuuaacuucuugcuuaa

SEQ ID NO: 507155 - RNA, 59 nt, Human
aagucauuucuuucaaaagagacaucaugucugaaaauaauuacugguagucuaauaug

SEQ ID NO: 507156 - RNA, 59 nt, Human
uugcaagugucuuuaaacuagggaucuaaucugaaaauucaguaacuaauauuaggcag

SEQ ID NO: 507157 - RNA, 59 nt, Human
uccugcaaaucucugcccugaauccgaaaucugaaaauguacuggcuugaacaaaauuu

SEQ ID NO: 507158 - RNA, 59 nt, Human
guaaauugagcaguucaugacccaggauaucugaaaauauucuacuggccuguaaucua

SEQ ID NO: 507159 - RNA, 59 nt, Human
ugaagagaaacauuuagcuaguaacgugaucugaaaacugaauguccuaugugaguauu

SEQ ID NO: 507160 - RNA, 59 nt, Human
aacacaccucugccaccccagguuuuucaucugaaaagcaguucaugucugaaacagag

SEQ ID NO: 507161 - RNA, 59 nt, Human
cuggcucaaugaucuacauucugaaguugucugaaaaugucuucaugauuaaauucagc

SEQ ID NO: 507162 - RNA, 59 nt, Human
ggaaugaaucuccaaggcuuuuaggacugucugaaaauuugaggcugggugaaguuaaa

SEQ ID NO: 507163 - RNA, 59 nt, Human
agcuuggccagcuuugugaaccuuugacaucugaaaacaaccaaggauccaucugggcu

SEQ ID NO: 507164 - RNA, 59 nt, Human
cuugagcguugacagagaaaaggcuuaguucugaaaaccgauauguuguuggaagauga

SEQ ID NO: 507165 - RNA, 59 nt, Human
guguuucaaggggaaagugaggcagagguucugaaaagggucucuguuuuuguguucau

SEQ ID NO: 507166 - RNA, 64 nt, Human
ugggauauauauuuaauuuucuuaaauucccguuaaacucuauuuuaugguuuugauuucagau

SEQ ID NO: 507167 - RNA, 64 nt, Human
ggggagaugucaggggaaagauagauaguuguaaaaacucuaaagcuuuaauauauucgguuug

SEQ ID NO: 507168 - RNA, 64 nt, Human
cuggcaauaucgaagguuccuuuuuuguuuguguaaacucuaauuucuaucaaggugucaugga

SEQ ID NO: 507169 - RNA, 59 nt, Human
cuauucucaguuacaccucccagugcccuucugaaaagugccagcuauuucauuaggca

SEQ ID NO: 507170 - RNA, 59 nt, Human
gaguccaguacccaggccccauggaaaggucugaaaauaauauuccagauuacacugua

SEQ ID NO: 507171 - RNA, 59 nt, Human
aagagaaaaguugaauaugagucauugugucugaaaacugcaaagugaacuuaacugag

SEQ ID NO: 507172 - RNA, 59 nt, Human
acuacugaguuugccagagugaaaauccaucugaaaaacucagcuaccuuuaguuuuua

SEQ ID NO: 507173 - RNA, 59 nt, Human
uauucuagaaguucaggacagccuuagcaucugaaaaagaagcccauuccucuuuauag

SEQ ID NO: 507174 - RNA, 59 nt, Human
augggaauaaaacaguaccuuagguucuuucugaaaaggagguaucuagcaauggauaa

SEQ ID NO: 507175 - RNA, 59 nt, Human
ugaaagggacaauuuggcugaagucuuucucugaaaaaagccaaaggguuauaggggua

SEQ ID NO: 507176 - RNA, 59 nt, Human
ccuuuuugugugcaaccacuuacccuuucucugaaaaaccuguucucaggaaggaucug

SEQ ID NO: 507177 - RNA, 59 nt, Human
ucauuucuaaucuaaauuaugugugccuaucugaaaacuuugggcucuuucuuguuucu

SEQ ID NO: 507178 - RNA, 59 nt, Human
uagauguguacauuugguguuugaaauucucugaaaaucccauuaggaaaccaggugug

SEQ ID NO: 507179 - RNA, 59 nt, Human
uggacgcagcaccaucaaagcccagaauuucugaaaacggugacaagguuaacauaagg

SEQ ID NO: 507180 - RNA, 59 nt, Human
aaaauccaauuuugucaguauuuucuuagucugaaaaaaacagcaguaguaaucuggug

SEQ ID NO: 507181 - RNA, 59 nt, Human
cauuuuaaugggaaauuuucaacccuuaaucugaaaacagaagacagucuuaauauaaa

SEQ ID NO: 507182 - RNA, 59 nt, Human
uguggaaaaaggauuaaauauuucuguuuucugaaaagaguuauuuuguauuuuguuuu

SEQ ID NO: 507183 - RNA, 59 nt, Human
caguggugaaauggggagugggugcccauucugaaaaacgaggcauuccugcucauucc

SEQ ID NO: 507184 - RNA, 64 nt, Human
aacacaaucuuccagcauacguuugcuuuuucagaaacucuagcauucucuuuaaauacugacg

SEQ ID NO: 507185 - RNA, 64 nt, Human
auacagaauuauuaacuauauuuuacuaacuaaaaaacucuaguauucuuuaccuaaagucaau

SEQ ID NO: 507186 - RNA, 64 nt, Human
gagaacguagaaguagcccuagggauccuuuuugaaacucuacaguuaucgcagauauucuagc

SEQ ID NO: 507187 - RNA, 59 nt, Human
uaauuuuuccauuuguucugcauuuugauucugaaaagaaagcuggcuuugcccauuuc

SEQ ID NO: 507188 - RNA, 59 nt, Human
gaaagauuuuaaguuggaaacaguuccugucugaaaacucuucugagaaccacaaaccu

SEQ ID NO: 507189 - RNA, 59 nt, Human
cucuuaaauuugucgagugauuuuuagccucugaaaacucuaugcuggccacugauucc

SEQ ID NO: 507190 - RNA, 59 nt, Human
uaauaauuuacuuuaagauauugaaaccaucugaaaagaaagcuaaauaccaguauggu

SEQ ID NO: 507191 - RNA, 59 nt, Human
auuaaaagaaaaaacaccauuuaauauguucugaaaacauuacucaccuguaugaccag

SEQ ID NO: 507192 - RNA, 59 nt, Human
gacggaagaagagagugagccgcaauuguucugaaaaugucaaacgaggcuucuguuuu

SEQ ID NO: 507193 - RNA, 59 nt, Human
ccuuaaaaaccuucuaaaaugcuuuugauucugaaaauugggggaaaaaacuuuuaauc

SEQ ID NO: 507194 - RNA, 59 nt, Human
aggugcaugggaaauauaguuagcuauacucugaaaauacauuauguuuuuuuucuuua

SEQ ID NO: 507195 - RNA, 59 nt, Human
ugugcauuaaauaugcuuccacaguaaaaucugaaaaacugauuugugauugaaagcug

SEQ ID NO: 507196 - RNA, 59 nt, Human
gaaaucuauauuccagguauuguuuuuagucugaaaaacaaacucccccaugugguauu

SEQ ID NO: 507197 - RNA, 59 nt, Human
gugacuggggaaaaucucacaucuccuugucugaaaacauuuccccugcuguucucuuu

SEQ ID NO: 507198 - RNA, 59 nt, Human
uuuaugaauccugucgguauuccuugguaucugaaaaaaauaccaaauaguaccauaca

SEQ ID NO: 507199 - RNA, 59 nt, Human
ucagguuucagaaaagcuacaguaugaaaucugaaaagcaacagaaauugaaagugacc

SEQ ID NO: 507200 - RNA, 59 nt, Human
auauuuucauuuguauaacucauuugcagucugaaaauuuuuuuuagugccagucccug

SEQ ID NO: 507201 - RNA, 59 nt, Human
cagcuuuuugugcuggacuuggcacacgcucugaaaacugagauuuugucauugaacug

SEQ ID NO: 507202 - RNA, 64 nt, Human; identical to SEQ ID NO: 359154

SEQ ID NO: 507203 - RNA, 64 nt, Human; identical to SEQ ID NO: 359155

SEQ ID NO: 507204 - RNA, 64 nt, Human; identical to SEQ ID NO: 359156

SEQ ID NO: 507205 - RNA, 59 nt, Human
acaaagaaaagcagaugccaaaauacucuucugaaaacagcaacccagguaagacuugu

SEQ ID NO: 507206 - RNA, 59 nt, Human
auauuuguaagugcugcuuuauucuucauucugaaaagaagagauuauaguaaacaagu

SEQ ID NO: 507207 - RNA, 59 nt, Human
uugguaggagugaaaaccaguauaauucuucugaaaaacauuuaucagaaacuuaaaau

SEQ ID NO: 507208 - RNA, 59 nt, Human
aauguaucuuauuuauauaugaaguaaguucugaaaacuguuuaugguauuuucgugca

SEQ ID NO: 507209 - RNA, 59 nt, Human
gguguuuuagaaguagauacaggcacugcucugaaaaccuggcuagccaaggauauucu

SEQ ID NO: 507210 - RNA, 59 nt, Human
ccccacugauaagguaacauuugagcaagucugaaaaaggcaaggggaucuuuggggcu

SEQ ID NO: 507211 - RNA, 59 nt, Human
cccucucuuguguaaaugucccccauguuucugaaaagugcuguaguuuaguccccuca

SEQ ID NO: 507212 - RNA, 59 nt, Human
aacaguuuuaccaccuaguaacagucauuucugaaaauauguuggauagaaagucacuc

SEQ ID NO: 507213 - RNA, 59 nt, Human
agguguuauuucuuuaauuuaugcuugaaucugaaaaauuauuucugacuuacuccaug

SEQ ID NO: 507214 - RNA, 59 nt, Human
cuguucccaagcaaagacuggugacuuuaucugaaaaugauuccucuucccaugaccua

SEQ ID NO: 507215 - RNA, 59 nt, Human
uauguauaucaugaauuuuuuuuuuaaguucugaaaaagaacuuguucucuccuuaaag

SEQ ID NO: 507216 - RNA, 59 nt, Human
cagguggcagaauggggugcaugaagguuucugaaaauuaacacugcuuguguuuuuaa

SEQ ID NO: 507217 - RNA, 59 nt, Human
uucccuuuccuucaaggccuagaguauauucugaaaauuuaggaaugaggaagaaaucu

SEQ ID NO: 507218 - RNA, 59 nt, Human
acacuacaaaaacaaauuuugucuguacuucugaaaagaauuuuguuguuucucagcug

SEQ ID NO: 507219 - RNA, 59 nt, Human
acaacauuuauuacccagaagaccuuuugucugaaaaccagccaagcuuuauucaggac

SEQ ID NO: 507220 - RNA, 64 nt, Human
ugauugccuuuucauagccguaaaugagaauuauaaacucuauuccaguuuugguauacuaaau

SEQ ID NO: 507221 - RNA, 64 nt, Human
cauuuucaacaaugcuaacuuggaccugucaguuaaacucuaagguggacaggguucucaguac

SEQ ID NO: 507222 - RNA, 64 nt, Human
uauccuaaaacaaauaguuuauaaaugugaacuuaaacucuaauuaauuccaacuguacuuuua

SEQ ID NO: 507223 - RNA, 59 nt, Human
ccacaccuggccacucgcaagaccuuuuaucugaaaaccagccaagcuuuauucacgac

SEQ ID NO: 507224 - RNA, 59 nt, Human
uuaaugaugcuaacuagagacccagaacgucugaaaacguccugauauuuaaagaacaa

SEQ ID NO: 507225 - RNA, 59 nt, Human
gauucugggauggcaaguuguuugccuuuucugaaaagagaacauacagaaccugucca

SEQ ID NO: 507226 - RNA, 59 nt, Human
uaucuuguuucauagcugccaaauaugaaucugaaaacaggguggguagcuaaggucau

SEQ ID NO: 507227 - RNA, 59 nt, Human
ccuuaaacagaaaccccuaagaaagguucucugaaaauuauuugguggguuaaaugccu

SEQ ID NO: 507228 - RNA, 59 nt, Human
uaguaaguuggcaugaaauuuugguaaaaucugaaaaucacauuucagaauaaaacaau

SEQ ID NO: 507229 - RNA, 59 nt, Human
uugauggaauacuguaucauaugcucaacucugaaaaccuugaacacggccaaaaucca

SEQ ID NO: 507230 - RNA, 56 nt, Human
augaacgacacacauguuagagcccuucugaaaaaguauccugcuucugauaugca

SEQ ID NO: 507231 - RNA, 59 nt, Human
auuuuguugaauguauuaacaucauauggucugaaaauguggguuuuuauuuggcacau

SEQ ID NO: 507232 - RNA, 59 nt, Human
uuaagauucacuuauuagucugcuguuucucugaaaaauuuuagagcuagguauaguga

SEQ ID NO: 507233 - RNA, 59 nt, Human
ccugggcauugaggcauuuccauacaucuucugaaaacuaggcggagguuuccaaaucu

SEQ ID NO: 507234 - RNA, 59 nt, Human
uaagcugcaauuuuguacagauaccaacuucugaaaagcugguguuuuuacaacuagca

SEQ ID NO: 507235 - RNA, 59 nt, Human
gaaacuacuuaacacagcuaauuuuuuucucugaaaaaucaucgagacaaaagagccac

SEQ ID NO: 507236 - RNA, 59 nt, Human
cuguauucuuuacaacuauuuuuugacccucugaaaauuauuauacuucaccuaaaugg

SEQ ID NO: 507237 - RNA, 59 nt, Human
ugcaaaagaaauucaguuuauaagauaaaucugaaaaauccauaaugaaauaggaguua

SEQ ID NO: 507238 - RNA, 64 nt, Human
ccuuucgauaucuaaaaggacucacaguggagaaaaacucuaugaguguaagcaaugugggaaa

SEQ ID NO: 507239 - RNA, 64 nt, Human
acuucaaaugcauggaagcacucacacuuggcagaaacucuaugaauguaagcaguaugggaaa

SEQ ID NO: 507240 - RNA, 64 nt, Human
aagcccaucagacucacagcugaccucuuggcagaaacucuauaagccagaagagagugggggc

SEQ ID NO: 507241 - RNA, 59 nt, Human
gcuguuacaaauuggaccuuuauacauuuucugaaaacaaugaaaagaguauauuuaac

SEQ ID NO: 507242 - RNA, 59 nt, Human
uccaagucaguccuuuggaaaccagcaggucugaaaaagaggcugcaucaaugcaagcc

SEQ ID NO: 507243 - RNA, 59 nt, Human
acuccuuaugugaggaaaugcuacuaauaucugaaaagugaaagauuucuauguauuaa

SEQ ID NO: 507244 - RNA, 59 nt, Human
gagggugcuaaucucauuaugcugugcuaucugaaaagaacuuaaggccacaauucacg

SEQ ID NO: 507245 - RNA, 59 nt, Human
gaaagaaauccaucugcucaugaagcacuucugaaaauauaggugauugccugaauguc

SEQ ID NO: 507246 - RNA, 59 nt, Human
auaaggcuaguguacuacaaaagagacuaucugaaaaagaagaaauaaaaucgcaguua

SEQ ID NO: 507247 - RNA, 59 nt, Human
uauuuacuaaaauguguuuaauuuuccuuucugaaaacucucauuuuaaaaacguucau

SEQ ID NO: 507248 - RNA, 59 nt, Human
uuuuguagaaaaaauguuucagugccuagucugaaaaauaacaguuugaguucuuugaa

SEQ ID NO: 507249 - RNA, 59 nt, Human
aacaauaauguuuggaaauaaagaagugcucugaaaaaauaucagccaccaaaauaguu

SEQ ID NO: 507250 - RNA, 59 nt, Human
caaucacgucacaggucucuuggccucaaucugaaaacugcugccgccgcgccgaggag

SEQ ID NO: 507251 - RNA, 59 nt, Human
cugggacuuagacuggggcucggccucgcucugaaaagugcuuaagaaaaucuucucag

SEQ ID NO: 507252 - RNA, 59 nt, Human
uuucuacuaaauccauuucaagcuaguucucugaaaauuuugccauuuaucuacagaaa

SEQ ID NO: 507253 - RNA, 59 nt, Human
aaagauuaaucaaacauaaauauucauugucugaaaaugucuuuaagauacaauucaga

SEQ ID NO: 507254 - RNA, 59 nt, Human
aacgaugcagaugcaagccuguaucagaaucugaaaaccuuauauaaaccccucagaca

SEQ ID NO: 507255 - RNA, 59 nt, Human
uaccaccucuuuucauauuucuucacauaucugaaaaauguugaaagccuaagccagga

SEQ ID NO: 507256 - RNA, 64 nt, Human
ucuuaacagacauaagauaauuuauacuggagagaaacucuacaaaucagaaagaugugacuac

SEQ ID NO: 507257 - RNA, 64 nt, Human
ucuuaacacacauacgauaauucuuacugcagagaaacucuacaaaccaguaagaugugacagu

SEQ ID NO: 507258 - RNA, 64 nt, Human
uauccugcacaucaagcugcaugccuuaaagcggaaacucuaggacuguguucaugggagagca

SEQ ID NO: 507259 - RNA, 59 nt, Human
aggcaucugauuuuuaaaaaauuaaaauuucugaaaaccaaugcgacaaauaaaguugg

SEQ ID NO: 507260 - RNA, 59 nt, Human
ugcuaccaagaaaccaacccaaagaaaauucugaaaaauacauuucuauuuauagaaua

SEQ ID NO: 507261 - RNA, 59 nt, Human
auaaugaaaaaaaucuuugcuuguuuauuucugaaaaagaacuguauuuagugauuauu

SEQ ID NO: 507262 - RNA, 59 nt, Human
aaggaguucaauugugaaaaaguuuacuaucugaaaauauuugaauguugaauauaaaa

SEQ ID NO: 507263 - RNA, 59 nt, Human
aaggcacguacugcagugugaagaaauguucugaaaaaggguuauagaaaucuggaaau

SEQ ID NO: 507264 - RNA, 59 nt, Human
aaauuuauuuaccugcuuguggcuucaaaucugaaaauuaauaagccugcucguuuaaa

SEQ ID NO: 507265 - RNA, 59 nt, Human
uuauucuauuuauuccuuuucucuccuaaucugaaaauggguguucuguauuuugggug

SEQ ID NO: 507266 - RNA, 59 nt, Human
uuugucucuacugauaugucuuauuaacaucugaaaaaauauauauuuuuuauuggaaa

SEQ ID NO: 507267 - RNA, 59 nt, Human
ucuucgcagccuagauaugaagaaucugcucugaaaacaaaaaaaaauuacccuuuugu

SEQ ID NO: 507268 - RNA, 59 nt, Human
uggcagcugguuauauuuaauucagccccucugaaaagcacauacagucuauacuuugu

SEQ ID NO: 507269 - RNA, 59 nt, Human
guaccuaaugauuauucagugcguauauaucugaaaagucauguugcaaaucuuucugu

SEQ ID NO: 507270 - RNA, 59 nt, Human
acucaucuagaugaggugcuuugagcaguucugaaaaaugcaguuccaggaaagcaacu

SEQ ID NO: 507271 - RNA, 59 nt, Human
uguuuuaccuuauuuucucuuggaacauaucugaaaaccuuccccacaaauaacuuguc

SEQ ID NO: 507272 - RNA, 59 nt, Human
ccugggaagagagucauaguaugaagaagucugaaaauggggaagggauuuucagaaua

SEQ ID NO: 507273 - RNA, 59 nt, Human
gcguuucacauaaaaagcauagcagcagcucugaaaagacacuucacaguaaauauguc

SEQ ID NO: 507274 - RNA, 64 nt, Human
ucuaauuauauguuauugaauucaugcuucagaaaaacucuagggaugcacugcaugugugaac

SEQ ID NO: 507275 - RNA, 64 nt, Human
ugaccuuucaaaaaugcaaauuaaguuacucuuaaaacucuaguuaaaauacuugauguacaua

SEQ ID NO: 507276 - RNA, 64 nt, Human
aaagaauauccugaacucuuuaucuuguaaaaugaaacucuauaaccaccauuaaaaaaacaac

SEQ ID NO: 507277 - RNA, 59 nt, Human
uuacucaggaaucaaaagagaaaaaaguuucugaaaacaaugaaaccauaaaagauaau

SEQ ID NO: 507278 - RNA, 59 nt, Human
aagcuauaguguaaaaacaaaguuugggcucugaaaauuuaacugaaaaagauuuccuu

SEQ ID NO: 507279 - RNA, 59 nt, Human
cagccugggcaacaagagcgaaacucuugucugaaaaaauaaaguucaucccaacuuuc

SEQ ID NO: 507280 - RNA, 59 nt, Human
ucaguaagcagcuugccaaucacuccaggucugaaaagcaagucccccagccccacccc

SEQ ID NO: 507281 - RNA, 59 nt, Human
acccuguuucuuucugugaagcgagaaugucugaaaauaaauaggaccaugccaugggu

SEQ ID NO: 507282 - RNA, 59 nt, Human
aaauagauguguguuuaauggaauugaagucugaaaaggaaguaguuauuuuagcagaa

SEQ ID NO: 507283 - RNA, 59 nt, Human
ucuccagauaccuuuuuuauaaaaagaagucugaaaaucauuaugguauauaaucuacc

SEQ ID NO: 507284 - RNA, 59 nt, Human
accaaaagaugccugacauagagccaaauucugaaaauaauuguaguaguagugauaua

SEQ ID NO: 507285 - RNA, 59 nt, Human
uuuaaaugcguacauauugaccaauggccucugaaaaagcacauuuuagauacugaaau

SEQ ID NO: 507286 - RNA, 59 nt, Human
gguacucccaaacugacaauuuuaccuauucugaaaaagacauaaaacagaauuuggua

SEQ ID NO: 507287 - RNA, 59 nt, Human
auagaaugauuucgguucaccugcuggugucugaaaaaaaccgugauucaucuggaagu

SEQ ID NO: 507288 - RNA, 59 nt, Human
augaauuuauagaggaaaauguaugcuacucugaaaacaaagcuuauguuagagaauau

SEQ ID NO: 507289 - RNA, 59 nt, Human
uaaugacuuaagggucaagauuuuuuucuucugaaaauuauguucugaguuaggcagaa

SEQ ID NO: 507290 - RNA, 59 nt, Human
guguuuaggaaacaaaguaugcgcuacugucugaaaacaaauaaagcagaugccuuugu

SEQ ID NO: 507291 - RNA, 59 nt, Human
gauagagaaacagagcacccccugugcuuucugaaaauagacuugcucuugucuugagu

SEQ ID NO: 507292 - RNA, 64 nt, Human
aaaugaaaaaaaaaggggggugggaggggaagaaaaacucuauuuuuguaaaaagggaaaaaga

SEQ ID NO: 507293 - RNA, 64 nt, Human
ggaggaauggacuuugcuggauccuucacagaaaaaacucuacagagacgugaugugggaaacc

SEQ ID NO: 507294 - RNA, 64 nt, Human
aucucaaaaaaaauaaaaaaaaagaaaaagaaauaaacucuaugaauguaaaccauguggugaa

SEQ ID NO: 507295 - RNA, 59 nt, Human
agagugccauucggguuauccaugccuugucugaaaaugagguauugaugaauacacuu

SEQ ID NO: 507296 - RNA, 59 nt, Human
cacccaacuggaugccaagacacccggguucugaaaaugugcuguguuccuaccucggc

SEQ ID NO: 507297 - RNA, 59 nt, Human
aggaacacuuuagauagagggcaaauauaucugaaaaccuaauuucuuucuuuuuuuga

SEQ ID NO: 507298 - RNA, 59 nt, Human
uguagcuauaacauauuuuaaaaauaaaaucugaaaaccucagaaaauuugcauuagaa

SEQ ID NO: 507299 - RNA, 59 nt, Human
ggugucugcugucgcuaccacugugcacaucugaaaacucacaaccaagaaaauccauu

SEQ ID NO: 507300 - RNA, 59 nt, Human
agauauguacuucaugguuaaauucuaaaucugaaaaugcuagugggagauaucaagaa

SEQ ID NO: 507301 - RNA, 59 nt, Human
acacuuaaaacacaugccaguugggaaggucugaaaacucagugcauaauaggaacacu

SEQ ID NO: 507302 - RNA, 59 nt, Human
uauuugagugauguuuuaaauauccuaugucugaaaauaauuccuccuaauuguguggu

SEQ ID NO: 507303 - RNA, 59 nt, Human
gggcugugagcucuuaauuuguuuuugauucugaaaaacucugcuuccuggcauccagg

SEQ ID NO: 507304 - RNA, 59 nt, Human
gccugccccugggguccuuuuuuuuauuuucugaaaaucacucucgggacugccguccu

SEQ ID NO: 507305 - RNA, 59 nt, Human
uuggaguugagauaucagucucggaaacuucugaaaaaugcuaauaauuacccaaggau

SEQ ID NO: 507306 - RNA, 59 nt, Human
uagaauaaacacugguuuccuagccauccucugaaaacaguaugaaacaugaccaagua

SEQ ID NO: 507307 - RNA, 59 nt, Human
guagagaguuaguggaauauagacaggacucugaaaacacaacuuccagccauuuuuuu

SEQ ID NO: 507308 - RNA, 59 nt, Human
uggcucuaaaagguaauguguggauugccucugaaaaguguguauauauuuugugugaa

SEQ ID NO: 507309 - RNA, 59 nt, Human
uuuuaaguuuuguaauaaacaagaugaugucugaaaauguguaacugggcaccuugccu

SEQ ID NO: 507310 - RNA, 64 nt, Human
uaccugagaaaauuaaacaaaucacauuggaaauaaacucuauggcuugggcacgguggcucau

SEQ ID NO: 507311 - RNA, 64 nt, Human
gcaaagucaugaaagaacucacacuggagagaagaaacucuaugaaugcaagcagugugggaaa

SEQ ID NO: 507312 - RNA, 64 nt, Human
acccccaguggauaccuaaaacccagauaggaccaaacucuaugucuauguuuuuuucuuauau

SEQ ID NO: 507313 - RNA, 59 nt, Human
aaaauguuuucuucaucugugacuccuggucugaaaauguuguuaugcuauuaaaguga

SEQ ID NO: 507314 - RNA, 59 nt, Human
gcuagcauuacuaaccaacuguuggaagcucugaaaauaaaagaucuugaacccaugcu

SEQ ID NO: 507315 - RNA, 59 nt, Human
auaaguguuauucuccauuauuaauguguucugaaaauauauuaugaauaaauacauca

SEQ ID NO: 507316 - RNA, 59 nt, Human
cagcaaggcauugacuucugaaaaaaugaucugaaaaaaguuucaccguuugucuucuu

SEQ ID NO: 507317 - RNA, 59 nt, Human
uugcgcuuugcaucagcaaggcauugacuucugaaaaaaugaucugaaaaaaguuucac

SEQ ID NO: 507318 - RNA, 59 nt, Human
auagggagacccuaucccuacaaaaaauuucugaaaaauuaccugggcauuguggggca

SEQ ID NO: 507319 - RNA, 59 nt, Human
aucugauggcuccugcagcacuuuuuccuucugaaaauauuuacauuuugcuaaccuag

SEQ ID NO: 507320 - RNA, 59 nt, Human
gccccaucuaaagaaucccuuucuguaugucugaaaacccauuaaaauaaagucacugc

SEQ ID NO: 507321 - RNA, 59 nt, Human
uuuguuuaaauugggcuuggagaaucuauucugaaaacauugacucuagacuuguagaa

SEQ ID NO: 507322 - RNA, 59 nt, Human
acuuaaauugacacuuuuugaaaugccagucugaaaauaauuaagauaucucugcuuug

SEQ ID NO: 507323 - RNA, 59 nt, Human
agaucacaccacaauguuuucaagaaacaucugaaaagauaaaacaaagaacaaauaac

SEQ ID NO: 507324 - RNA, 59 nt, Human
caacuuaagcugggauaaucacauuaucaucugaaaaucuggaguugaacagcaaaaga

SEQ ID NO: 507325 - RNA, 59 nt, Human
gggcucaccgagggagcacuggugggugcucugaaaacccacaggaucccaccuccagg

SEQ ID NO: 507326 - RNA, 59 nt, Human
gguuuauagacuggggugccauguguacuucugaaaauauuuuaaccagcccacccagc

SEQ ID NO: 507327 - RNA, 59 nt, Human
aaaucaaacauugguugaacacaucagccucugaaaagguagcucugacucuugucuuu

SEQ ID NO: 507328 - RNA, 64 nt, Human; identical to SEQ ID NO: 359157

SEQ ID NO: 507329 - RNA, 59 nt, Human; identical to SEQ ID NO: 359158

SEQ ID NO: 507330 - RNA, 64 nt, Human; identical to SEQ ID NO: 359159

SEQ ID NO: 507331 - RNA, 59 nt, Human
cugcuuguaucuguaucccuuguugaaacucugaaaacacugaauaacuaaaaucucuu

SEQ ID NO: 507332 - RNA, 59 nt, Human
cuguugauagaccuggaauuuagaguauaucugaaaagcaguuggacuucaagaaauuu

SEQ ID NO: 507333 - RNA, 59 nt, Human
gagcauagaagaagcggcaccugccaucuucugaaaacuccaaagggaaauuucaguag

SEQ ID NO: 507334 - RNA, 59 nt, Human
uauuacagcugacagcuuuucagggguggucugaaaagccaguuugacagccauucuuc

SEQ ID NO: 507335 - RNA, 59 nt, Human
ccccuuagaaagucuucugcaaacccauuucugaaaaugguacauuauaggguggguau

SEQ ID NO: 507336 - RNA, 59 nt, Human
uugugaguuauuugcuuauccuguuuuauucugaaaaaugaaagugcucaauagaauuu

SEQ ID NO: 507337 - RNA, 59 nt, Human
guuugcugaacaccuuguggaagcaaaaaucugaaaaugugaauaaaauuauuuuggau

SEQ ID NO: 507338 - RNA, 59 nt, Human
auuuuguaacacgucaaccauuugaugcuucugaaaaguacuuucaacuugcgaaggaa

SEQ ID NO: 507339 - RNA, 59 nt, Human
cauauccacaauuccaaaaucuccaaaccucugaaaacugaaauauuuuucauaaauua

SEQ ID NO: 507340 - RNA, 59 nt, Human
cucaaaauacuucaugaaaggcaguguauucugaaaaagccuucaaauaaagguauugc

SEQ ID NO: 507341 - RNA, 59 nt, Human
cccaagagauuguuguuugccauacuuugucugaaaaauuccuuuguguuucuauugac

SEQ ID NO: 507342 - RNA, 59 nt, Human
ugcuuuaaugucaaguuugcagaauugucucugaaaauaaaaacccugacuuuaguugu

SEQ ID NO: 507343 - RNA, 59 nt, Human
gauggggagucaaguucuagaaaguuuugucugaaaaccuuugaauagaauggcaugaa

SEQ ID NO: 507344 - RNA, 59 nt, Human
caaccugccaacccacacacuggaguaauucugaaaaaaauuauuccuaaacucucuaa

SEQ ID NO: 507345 - RNA, 59 nt, Human
gaaaucacugaggccauaucuuuuuacaaucugaaaaaaaaguaguaaaaagguaguua

SEQ ID NO: 507346 - RNA, 64 nt, Human
cacuguuuugcaucaagcuggaguacuggauggaaaacucuacaauaacauuuugugcauaauu

SEQ ID NO: 507347 - RNA, 64 nt, Human
cccuuacucaaaaucagauaauuaacaaugaaggaaacucuaaacuccccuuauggucuaccag

SEQ ID NO: 507348 - RNA, 64 nt, Human
ugaguuucuggcaaguagcuuggggaagcugaauaaacucuaggcccagggcuacuaaagacuu

SEQ ID NO: 507349 - RNA, 59 nt, Human
agaucacuguuucucucaacacuauuuaaucugaaaaauguuucaguacaaaccacugu

SEQ ID NO: 507350 - RNA, 59 nt, Human
ggggauuucagugugcuuaaguaaaauccucugaaaaccacgggagccucugccuccuc

SEQ ID NO: 507351 - RNA, 59 nt, Human
cuuugguacaugccuguuaauauucauguucugaaaauauuuuguuaaaaguguaaauc

SEQ ID NO: 507352 - RNA, 59 nt, Human
uacauuccuuggauaucugacaacguguuucugaaaaacagauuuucauaaguaauaau

SEQ ID NO: 507353 - RNA, 59 nt, Human
gauguguguccucaagaacuugucuugggucugaaaaagcugagaagaauaaaggaaac

SEQ ID NO: 507354 - RNA, 59 nt, Human
uugacucuacuaaaauaacaauguuucagucugaaaauuugaauugaaaaaaauguaua

SEQ ID NO: 507355 - RNA, 59 nt, Human
uuuugcccaaaauaacucauuuuguauuaucugaaaauauauaauuucuggucaugugu

SEQ ID NO: 507356 - RNA, 59 nt, Human
cuguuaaauuuauuaugcccaaaucaaccucugaaaaaagguuuuuccaggaagauuua

SEQ ID NO: 507357 - RNA, 59 nt, Human
cucuauaguacccucucuauucacuagcuucugaaaagggaggaguauuuuuaguuuga

SEQ ID NO: 507358 - RNA, 59 nt, Human
gcuuuguuucucucuugcucugaaacauuucugaaaaggcaaggaagggagggguagug

SEQ ID NO: 507359 - RNA, 59 nt, Human
auacaaaauguacugacauuuuguuuucuucugaaaaaaauccuugcuaaauguacucu

SEQ ID NO: 507360 - RNA, 59 nt, Human
uguuuauaaguuuugagauuuuuuuuuuuucugaaaaggauaccaaagugcgauaacug

SEQ ID NO: 507361 - RNA, 59 nt, Human
ugaacauggaaacaacuucuaguauuggaucugaaaauaaagugucauccaagccauaa

SEQ ID NO: 507362 - RNA, 59 nt, Human
cuagaagaaugcuaaguuuguguccuugcucugaaaauugguaaaucaagcauguuugu

SEQ ID NO: 507363 - RNA, 59 nt, Human
uuccaaacacauacaggaagguagaaauaucugaaaauguauguguaaguauucuuauu

SEQ ID NO: 507364 - RNA, 64 nt, Human
uacuugugguucaagaagcacuagauuuaguaagaaacucuaccuauauacuuaguuugaaguu

SEQ ID NO: 507365 - RNA, 64 nt, Human
uuuggauguuuuguccccuccuuaauuuauguugaaacucuacauaaacuguuuacuguugaaa

SEQ ID NO: 507366 - RNA, 64 nt, Human
ucauuuaacuugcuauaaaaugagucauauaaagaaacucuauaugggugagguauaucccacu

SEQ ID NO: 507367 - RNA, 59 nt, Human
caaaacauaugaaguccuggaaaagagcaucugaaaaaccuagaacaaguuuaacugug

SEQ ID NO: 507368 - RNA, 59 nt, Human
uugguuuaaaucacauuugauacuauccuucugaaaagucugagacagaucuacaaacu

SEQ ID NO: 507369 - RNA, 59 nt, Human
ugcagauuacaugacucuaaugugggcagucugaaaauaucuuuaacugucuucuuuga

SEQ ID NO: 507370 - RNA, 59 nt, Human
aaaaugaaagcgcaauaagcaccuaguuuucugaaaacugauuuaccagguuuagguug

SEQ ID NO: 507371 - RNA, 59 nt, Human
auaaggccaggaaaacugccauuucaaguucugaaaaauguuuugaguauuugaauuua

SEQ ID NO: 507372 - RNA, 59 nt, Human
auaucaguuacggguuacaacugguucauucugaaaacaacaacaacaaaaguccauuc

SEQ ID NO: 507373 - RNA, 59 nt, Human
cuuucaagagauuaaaaauaaaucaacagucugaaaaccuaagcagacacggagcauua

SEQ ID NO: 507374 - RNA, 59 nt, Human
auaauccauuuauaucacagcucacaguuucugaaaauguauaaaagaaucuauaaucu

SEQ ID NO: 507375 - RNA, 59 nt, Human
aauuaugaucuuugaaguuauaacugugaucugaaaauguguguggugguaugacagca

SEQ ID NO: 507376 - RNA, 59 nt, Human
augucuauacugugaaaaguguuuucaauucugaaaaaaagcauacaucaugauuaugg

SEQ ID NO: 507377 - RNA, 59 nt, Human
auuuuauugacugggguuugaucucagcuucugaaaauguuuaaaaauuggaaggaaau

SEQ ID NO: 507378 - RNA, 59 nt, Human
uuauaauuuuaacaucuuauauugaagauucugaaaaccuaucuuuauuagaggaaaau

SEQ ID NO: 507379 - RNA, 59 nt, Human
aacauaggaauguauuucguuggaaacauucugaaaaaucucagagaacugaacccuua

SEQ ID NO: 507380 - RNA, 59 nt, Human
acagcguuuccguaaaauugacuuuguacucugaaaacgucaauuuauauugaacuugg

SEQ ID NO: 507381 - RNA, 59 nt, Human
uauuguuccuaguaaucuuaggggaguggucugaaaaaacaucaagcauaguaauuguc

SEQ ID NO: 507382 - RNA, 64 nt, Human
uuuaaaagacuggcaaccaggucuaaggauuagaaaacucuaaaguucugacuucaaucaacgg

SEQ ID NO: 507383 - RNA, 64 nt, Human
uuggaauaucuacuaugugcaaggaauuuuucuuaaacucuaagguuaugaaucacugggcaaa

SEQ ID NO: 507384 - RNA, 64 nt, Human
cugcagauauuucaucaaauaaggaugaugaagaaaacucuaugcacacuacgguuguguuguu

SEQ ID NO: 507385 - RNA, 59 nt, Human
uacucauuuuaggaaaaaaaaaagcaugaucugaaaaauacuuuuggugguauguuggu

SEQ ID NO: 507386 - RNA, 59 nt, Human
gcuaaucuuguagcuaagcuaccuaauccucugaaaacuguuuucucugauuuguauuu

SEQ ID NO: 507387 - RNA, 59 nt, Human
gcugaugaugucucuuguagaagauggacucugaaaaacauuccaggaaaccauggcag

SEQ ID NO: 507388 - RNA, 59 nt, Human
ugucuucgagauguagaaauaaggaauauucugaaaauaaaaauuauacaguaguaaag

SEQ ID NO: 507389 - RNA, 59 nt, Human
agugcuuuuuacucauugcuguaucuuuuucugaaaacacuguuguuaacaucuaauuc

SEQ ID NO: 507390 - RNA, 59 nt, Human
gaaccaucuuucaaugcacugaaaagucaucugaaaaaauagcuucuuccauaucagcu

SEQ ID NO: 507391 - RNA, 59 nt, Human
auuugggguuuugauuaauucuuuauuuuucugaaaaaaaguuuaaauaaugucuguaa

SEQ ID NO: 507392 - RNA, 59 nt, Human
uuauuuuuaggugcuuuuaaucucaaaauucugaaaagcgaauagcaguguuuucagaa

SEQ ID NO: 507393 - RNA, 59 nt, Human
cucugguggaugauuaucugcuaaguaagucugaaaauguaauauuuugauaauacugu

SEQ ID NO: 507394 - RNA, 59 nt, Human
gugucauucuguccugagaaaugaagucaucugaaaaauaaaaugaaagaaacugaauu

SEQ ID NO: 507395 - RNA, 59 nt, Human
aguaccaaguaaccuacaagccuccuaguucugaaaaguuggaagggcaucaugaccuc

SEQ ID NO: 507396 - RNA, 59 nt, Human
cuucgacaaaaaaauaauaaaacguuucuucugaaaagcugaacguuucuguauaagcg

SEQ ID NO: 507397 - RNA, 59 nt, Human
uuuaaaagcacaucuauguucacugccacucugaaaaagggaauuauuucucagucuuu

SEQ ID NO: 507398 - RNA, 59 nt, Human
cccaagguuggagggugggaugaguacccucugaaaaagggaauuugcuggugaaaaga

SEQ ID NO: 507399 - RNA, 59 nt, Human
ccaugagcugaagaccagccauucaagaaucugaaaaguagacaagaggacuccaguug

SEQ ID NO: 507400 - RNA, 64 nt, Human
ucccaucagcgugcauucaccagcccaucgccacaaacucuaucggagaacaugaaucaaaagu

SEQ ID NO: 507401 - RNA, 64 nt, Human
aacuugcucucagucaauauaauaaaugauaguuaaacucuaaggaagaccugggaaaugaaaa

SEQ ID NO: 507402 - RNA, 64 nt, Human
cuucuuacguuugggaaguuuuauguaguguaacaaacucuagacgaguuaccagaagaugugg

SEQ ID NO: 507403 - RNA, 59 nt, Human
caccagcauccugagaagaaaugauuacuucugaaaaacauccuuuuuuccagccucug

SEQ ID NO: 507404 - RNA, 59 nt, Human
aacaguaccaguguaaauucagucuuuucucugaaaagcaaaggauguguuuucagucu

SEQ ID NO: 507405 - RNA, 59 nt, Human
uugaaggcugcugugugcauguuugggggucugaaaagacaguugugugcauggaugug

SEQ ID NO: 507406 - RNA, 52 nt, Human
acauauuuaaugauguuuaaagucugaaaaaguuugugggaccacuaaccaa

SEQ ID NO: 507407 - RNA, 59 nt, Human
uaagguacaaguguguuaaaauugaaaacucugaaaauaacucuuuaaaaagcccucuu

SEQ ID NO: 507408 - RNA, 59 nt, Human
auuaagaugaagauacagucaugaaauuaucugaaaaugggucaucacauuaaguauuu

SEQ ID NO: 507409 - RNA, 59 nt, Human
aaaaucaaacguuuaagaagaauuacaacucugaaaagcauuuauauguggaacuucuc

SEQ ID NO: 507410 - RNA, 59 nt, Human
ucugugaauuuucuguaaauaaaauuauuucugaaaaucucuagcuauuagugaugugg

SEQ ID NO: 507411 - RNA, 59 nt, Human
aaccuugaacaucaaauaucggguacuacucugaaaaccauuaauauauugaucacuua

SEQ ID NO: 507412 - RNA, 59 nt, Human
uuaguuucuuaagugaguuuucaggugucucugaaaaauuuauaacaaucauguauuau

SEQ ID NO: 507413 - RNA, 59 nt, Human
gacagaagagaccuugucucgaaaaggaaucugaaaacaauggaaccaugccuucauaa

SEQ ID NO: 507414 - RNA, 59 nt, Human
guuuucuaguuuaaguuguucccccucccucugaaaaaaguauguauuuuuacauuaga

SEQ ID NO: 507415 - RNA, 59 nt, Human
aauguuaggaagauccagcaauuuugguuucugaaaaauuacaaaacuuuucuacccua

SEQ ID NO: 507416 - RNA, 59 nt, Human
uaauuuugcuucuacaguauuuuggaaggucugaaaacuugcacagggucaucuuugua

SEQ ID NO: 507417 - RNA, 59 nt, Human
augaaauggauuuucacggaagagacagcucugaaaaguuuugaugcuuguggcaagag

SEQ ID NO: 507418 - RNA, 64 nt, Human; identical to SEQ ID NO: 503626

SEQ ID NO: 507419 - RNA, 64 nt, Human; identical to SEQ ID NO: 503627

SEQ ID NO: 507420 - RNA, 64 nt, Human; identical to SEQ ID NO: 503711

SEQ ID NO: 507421 - RNA, 59 nt, Human
ccuaauacaggaauacagcgacagaccuaucugaaaagucuguuugggggcauacuuuu

SEQ ID NO: 507422 - RNA, 59 nt, Human
uguagcaugacagggauuucaaucaccuuucugaaaagagugggcugauaaacuuguaa

SEQ ID NO: 507423 - RNA, 59 nt, Human
gggugggcugguuggcccuauguaccuaaucugaaaaacuaaauaucguucugucaggg

SEQ ID NO: 507424 - RNA, 59 nt, Human
uugaauaucucuuucccuaucaugcugcuucugaaaauucaguuuuggagcaaguccug

SEQ ID NO: 507425 - RNA, 59 nt, Human
ggaguaaaucucuccaccuccucuaacucucugaaaacucuagaguuggagcaagucuu

SEQ ID NO: 507426 - RNA, 59 nt, Human
agagagggacuaugcccugaccccuccuuucugaaaaucagugcccucccuguugcucu

SEQ ID NO: 507427 - RNA, 59 nt, Human
guuaggaauccuagcacuugucucaggacucugaaaaggaacggcuuccucauuccuug

SEQ ID NO: 507428 - RNA, 59 nt, Human
auuuagugaucaagauauggaagcugauuucugaaaaugcucaguguguacucuaauua

SEQ ID NO: 507429 - RNA, 59 nt, Human
aguggguuuuaaauaguuuuucugacccuucugaaaaauaacuacauaagugcuucuug

SEQ ID NO: 507430 - RNA, 59 nt, Human
guuugggggcuuccaaguuguuugugagaucugaaaacuuaacuuugcccaauauccug

SEQ ID NO: 507431 - RNA, 59 nt, Human
aaaagucugaaugagaagauggcaggacgucugaaaaaaaaaguuauaauuaauaaaau

SEQ ID NO: 507432 - RNA, 59 nt, Human
uacaugccucaugugaaguguccacccucucugaaaaucuuucuuguucaaaacagcaa

SEQ ID NO: 507433 - RNA, 59 nt, Human
uaacacccucagcauccugcacugcccucucugaaaacacccacauucuuuggucacug

SEQ ID NO: 507434 - RNA, 59 nt, Human
aucugaagaaccugcuguguuuagaugucucugaaaacagguuggaaagacuuccugaa

SEQ ID NO: 507435 - RNA, 59 nt, Human
gaguucacacccacucuaaaaccauguccucugaaaagaaacaaaaauacagugaucau

SEQ ID NO: 507436 - RNA, 64 nt, Human; identical to SEQ ID NO: 503712

SEQ ID NO: 507437 - RNA, 64 nt, Human; identical to SEQ ID NO: 503713

SEQ ID NO: 507438 - RNA, 64 nt, Human; identical to SEQ ID NO: 503729

SEQ ID NO: 507439 - RNA, 59 nt, Human
uuaaaaugaucaaggcacuaauguuuuggucugaaaagcuguguacuuuauagacauuu

SEQ ID NO: 507440 - RNA, 59 nt, Human
auguucacuuucuauuuuuaaaagacuacucugaaaaacacucuuggauaauaaaugua

SEQ ID NO: 507441 - RNA, 59 nt, Human
aaggagaauaaauuccagaaaacacauauucugaaaauggaguguuuguucccugccau

SEQ ID NO: 507442 - RNA, 59 nt, Human
augacauucugaaacuugccuguauauuaucugaaaaauggauuucuugagcaaaagau

SEQ ID NO: 507443 - RNA, 59 nt, Human
aagguucaaaauacacaaguaacauacacucugaaaaacaugcagauaauuugcugaug

SEQ ID NO: 507444 - RNA, 59 nt, Human
uaagauuaaaaaauuuuuaaaccucuaugucugaaaaaaaaaaugacacuccuggaaga

SEQ ID NO: 507445 - RNA, 59 nt, Human
guuacuccaagcaacuugcccaauuuuaaucugaaaauuuaucauguuuuauaauuuga

SEQ ID NO: 507446 - RNA, 59 nt, Human
gaaggcaguguucugacuucuuuaggugaucugaaaaaaacacccuuaucauccagugu

SEQ ID NO: 507447 - RNA, 59 nt, Human
uuugcugcaucuagguugguguuugaucaucugaaaaaacauuucagugggaagaaaug

SEQ ID NO: 507448 - RNA, 59 nt, Human
auaaguuuacacacugugcaaucucacaaucugaaaauaaaguugaguuggcuguguuu

SEQ ID NO: 507449 - RNA, 59 nt, Human
acaaaaguuacaacacguaucucuuuucaucugaaaacuaauaccuggaaaaggauaaa

SEQ ID NO: 507450 - RNA, 59 nt, Human
auucucuucuuuugaaaauuuuauuuuuaucugaaaauaacaguugaucugaaauaaaa

SEQ ID NO: 507451 - RNA, 59 nt, Human
gagguuuccuuuugagaugaggaaaauguucugaaaauauggugaugguugcacaccau

SEQ ID NO: 507452 - RNA, 59 nt, Human
ggcccacccaacucccucauaccgucgcaucugaaaauuuucagagaggaauucucuuu

SEQ ID NO: 507453 - RNA, 59 nt, Human
ggaaggagagggugagugggggauggcuuucugaaaaggguggucuaaaggaugccuau

SEQ ID NO: 507454 - RNA, 64 nt, Human; identical to SEQ ID NO: 504305

SEQ ID NO: 507455 - RNA, 64 nt, Human; identical to SEQ ID NO: 504306

SEQ ID NO: 507456 - RNA, 64 nt, Human; identical to SEQ ID NO: 504307

SEQ ID NO: 507457 - RNA, 59 nt, Human
acuuguucauucugugacccuaguuauuuucugaaaaauugguucuucucuuuucccag

SEQ ID NO: 507458 - RNA, 59 nt, Human
accauggugucaauacauaucauguagcuucugaaaaacuccacuguacacuuauagaa

SEQ ID NO: 507459 - RNA, 59 nt, Human
guaguaagaggauuuucuuccauaaugcaucugaaaaacuguaaacaaagacaaccauu

SEQ ID NO: 507460 - RNA, 59 nt, Human
accauuuuuaauuuaugucaguugaugcaucugaaaauaagugcuuggaguguucguac

SEQ ID NO: 507461 - RNA, 59 nt, Human
aagugucacuuggugcauaagcacagaaaucugaaaaauggccauguugucuuuuuuuu

SEQ ID NO: 507462 - RNA, 59 nt, Human
gagaagaucaauuucagcuacaauacucaucugaaaaucauuaaugccaacuugcucug

SEQ ID NO: 507463 - RNA, 59 nt, Human
gagaaucaauugcugaaaguguuaaaauuucugaaaauaaaugcuuaauuacauauaca

SEQ ID NO: 507464 - RNA, 59 nt, Human
cauuacuuuuaucugugagcucugacacaucugaaaaaguaaucugaugugcaaauuau

SEQ ID NO: 507465 - RNA, 59 nt, Human
caguuuugauuggguaauguuucuguucuucugaaaacagacccuuggcuucacacauu

SEQ ID NO: 507466 - RNA, 59 nt, Human
uuauaaacaagucacuuaaaugccaguugucugaaaaaucuuauaagguuuuacccuug

SEQ ID NO: 507467 - RNA, 59 nt, Human
uuaguuggaagccauguaagaaaauaacaucugaaaauucuugaacuuaaaaucaugcu

SEQ ID NO: 507468 - RNA, 59 nt, Human
gaugaguuuuuucuagagcucugucacuaucugaaaagaaagaggcuaugggaaacaua

SEQ ID NO: 507469 - RNA, 59 nt, Human
auguguugguuugugguccaacuucuuuaucugaaaaagccagugagaaaacauuuuug

SEQ ID NO: 507470 - RNA, 59 nt, Human
aaaaaaaauaaagaaaaaaugugcugcguucugaaaaauaacuccuuagcuuggucuga

SEQ ID NO: 507471 - RNA, 59 nt, Human
uuauuuuuuaugucuaaagcaacagcuguucugaaaaaucaccaaaagaaaugcacuuu

SEQ ID NO: 507472 - RNA, 64 nt, Human; identical to SEQ ID NO: 503731

SEQ ID NO: 507473 - RNA, 64 nt, Human; identical to SEQ ID NO: 503765

SEQ ID NO: 507474 - RNA, 64 nt, Human; identical to SEQ ID NO: 503766

SEQ ID NO: 507475 - RNA, 59 nt, Human
cuccucccugcccuucuuccugcccuuccucugaaaagaggcauuucgggaaggcuugc

SEQ ID NO: 507476 - RNA, 59 nt, Human
uguuguugucguuguuuuaaacuuuagaaucugaaaaccagaaagaagucuugucauug

SEQ ID NO: 507477 - RNA, 59 nt, Human
gcucggauucaacuaccuuagauaauauuucugaaaaccuaccagccagaggguagggc

SEQ ID NO: 507478 - RNA, 59 nt, Human
cuaucuuucaggaaacagcaucaaggaacucugaaaaauauagaaaaaguucauuuuca

SEQ ID NO: 507479 - RNA, 59 nt, Human
gggaggaaggugguaucaaauuguuggacucugaaaaacaaguggauggauuacuaaua

SEQ ID NO: 507480 - RNA, 59 nt, Human
aauuuucugacacgucuagaugugaaauuucugaaaauguugaagcagagaaacauuca

SEQ ID NO: 507481 - RNA, 59 nt, Human
gaacuuuggaaugacccccuuauauauuuucugaaaaugaaaacaguuacaugaaaaaa

SEQ ID NO: 507482 - RNA, 59 nt, Human
aauucucuagcuccuggucaggaagccaaucugaaaacaggcauguggaaacacaaaaa

SEQ ID NO: 507483 - RNA, 59 nt, Human
aaugauuuaaaguguuuuccuuaauguucucugaaaacaaguuucuuuuguaguuuuaa

SEQ ID NO: 507484 - RNA, 59 nt, Human
gagaaaaacaacccagcgaaggcgccuucucugaaaacaaugcugagaaugagagcggc

SEQ ID NO: 507485 - RNA, 59 nt, Human
ucaauuauauuccuuuuauggaaaaggacucugaaaaacccuaaaguauucuagggaga

SEQ ID NO: 507486 - RNA, 59 nt, Human
guaggaaucaaaaauugaagagagauauaucugaaaacuggaauaagaagcaaauaaau

SEQ ID NO: 507487 - RNA, 59 nt, Human
aaaugcaaauauacugaaaauugacauccucugaaaauuccacuugcuauuuacccaag

SEQ ID NO: 507488 - RNA, 59 nt, Human
ggcccucugcccagaaaccuuuguuugcaucugaaaauugaugggauuuggucaacacu

SEQ ID NO: 507489 - RNA, 59 nt, Human
ggggcgaccggaaaagggcucucucaaguucugaaaagagaaucugccaccagaucgaa

SEQ ID NO: 507490 - RNA, 64 nt, Human; identical to SEQ ID NO: 503767

SEQ ID NO: 507491 - RNA, 64 nt, Human; identical to SEQ ID NO: 503783

SEQ ID NO: 507492 - RNA, 64 nt, Human; identical to SEQ ID NO: 503784

SEQ ID NO: 507493 - RNA, 59 nt, Human
uugcaacaagaggauaauuccgaccuaccucugaaaaauguguagauuaaaugaguuuu

SEQ ID NO: 507494 - RNA, 59 nt, Human
cugaaacaauugggagauuaucuuucaauucugaaaaauucuguggguggccugucuuu

SEQ ID NO: 507495 - RNA, 59 nt, Human
aauugugcucuuugucauggcaaccagcuucugaaaagcccacugaaaauugccugucc

SEQ ID NO: 507496 - RNA, 59 nt, Human
aaacuccauuaaucaucugauuuuccgaaucugaaaauugagacuauuaagauauuagg

SEQ ID NO: 507497 - RNA, 59 nt, Human
acuuggguugugggaacaguugacagcguucugaaaagaugccauuuguuuccuucuga

SEQ ID NO: 507498 - RNA, 59 nt, Human
ggagauucacacuaugcacugggaaaguaucugaaaagucuuauaauaaagaaacaggc

SEQ ID NO: 507499 - RNA, 59 nt, Human
uuaucaaaaaccuagagaccaaucauauaucugaaaagaaauacccauuaaaaauucug

SEQ ID NO: 507500 - RNA, 59 nt, Human
gcaauauauacauaaaaucaaccaacauaucugaaaaggaucaugaaaccugagaaaug

SEQ ID NO: 507501 - RNA, 59 nt, Human
uuuuggcauuuaugucauuugugacauagucugaaaauagagacauuguuggccuuuaa

SEQ ID NO: 507502 - RNA, 59 nt, Human
ucaauuacuaaugcuaagauguguuggacucugaaaaacaaaauucuguggcuacacug

SEQ ID NO: 507503 - RNA, 59 nt, Human
ccuuuuuaaacccccaugaacacgaauacucugaaaaaaauaaaaagcuuucuggaaga

SEQ ID NO: 507504 - RNA, 59 nt, Human
acaucucaugaccacugacugcugaaaguucugaaaagaauuuuuguuuuguuacacug

SEQ ID NO: 507505 - RNA, 59 nt, Human
aagcaguucuacucgaucaccaagaugcuucugaaaauugcauuuuauuaccauuucaa

SEQ ID NO: 507506 - RNA, 59 nt, Human
cuuagcuucucuagacaucaguuuccacaucugaaaaauaagaagaugagaguacacgg

SEQ ID NO: 507507 - RNA, 59 nt, Human
uauaaagaaaacuguauguucacuugaacucugaaaauguacauguauggcuggacgcg

SEQ ID NO: 507508 - RNA, 64 nt, Human; identical to SEQ ID NO: 504071

SEQ ID NO: 507509 - RNA, 64 nt, Human; identical to SEQ ID NO: 504072

SEQ ID NO: 507510 - RNA, 64 nt, Human; identical to SEQ ID NO: 504073

SEQ ID NO: 507511 - RNA, 59 nt, Human
aaaauucucuuacuuaaauacguuugauuucugaaaagccuacaaauggaggggaaaug

SEQ ID NO: 507512 - RNA, 59 nt, Human
uaguuucaaaugaguuuaaaaaaauaacaucugaaaagaaaugcuaauguaaucauuua

SEQ ID NO: 507513 - RNA, 59 nt, Human
guucauuuccaccaaggguaucugcugccucugaaaauauuuuuuucuagcuauaacaa

SEQ ID NO: 507514 - RNA, 59 nt, Human
agacacagauguucgguuuuuuuccuguuucugaaaagaaauaauaauauccaggucaa

SEQ ID NO: 507515 - RNA, 59 nt, Human
uuuaaacuaauauuuguuucaguauuuugucugaaaagaaaacaccacuaauuguguac

SEQ ID NO: 507516 - RNA, 59 nt, Human
aguuuuaguauuuguuuucuagguggaccucugaaaaccaaaccaguaccuggggaggu

SEQ ID NO: 507517 - RNA, 59 nt, Human
uuuugcugagggggaaaaaauguaaauguucugaaaauucacugcugccuuuguggaaa

SEQ ID NO: 507518 - RNA, 59 nt, Human
ugaagcugcagauuuagagaacauuggcuucugaaaaaaaaaaagagugaagauaguac

SEQ ID NO: 507519 - RNA, 59 nt, Human
uaacagaaucuuuaugaaauaugaccuuuucugaaaauacauacuuuuacauuucuacu

SEQ ID NO: 507520 - RNA, 59 nt, Human
aaaauaaaagcagaauguauaucaucccaucugaaaaacacuaauuauugacaugugca

SEQ ID NO: 507521 - RNA, 59 nt, Human
cuuucacaucuuguggaaggaccaaauuuucugaaaaaauuggaacaaucuuuuaugug

SEQ ID NO: 507522 - RNA, 59 nt, Human
uuaugcguugaauauugccaaaugcucuuucugaaaaugcugaauugccuuuuuuguuu

SEQ ID NO: 507523 - RNA, 59 nt, Human
uuuuuucaagcaauauaauaggucuuagaucugaaaacucuucauuaggauuuaucaag

SEQ ID NO: 507524 - RNA, 59 nt, Human
auagcuuuguuauuauucauauuaacaaaucugaaaauaugucaaauuacguguuuuua

SEQ ID NO: 507525 - RNA, 59 nt, Human
cagcagaggaggguuugcagagaccucccucugaaaaacacaaagaauggacucucucc

SEQ ID NO: 507526 - RNA, 64 nt, Human; identical to SEQ ID NO: 504089

SEQ ID NO: 507527 - RNA, 64 nt, Human; identical to SEQ ID NO: 504090

SEQ ID NO: 507528 - RNA, 64 nt, Human; identical to SEQ ID NO: 504091

SEQ ID NO: 507529 - RNA, 59 nt, Human
aaugaaaucccauuggauuguacuucucuucugaaaagugugcuuuuugacccuacugg

SEQ ID NO: 507530 - RNA, 59 nt, Human
uuugcauuacagaacugcagcuuuucuacucugaaaaggccugggagcagaauggcugg

SEQ ID NO: 507531 - RNA, 59 nt, Human
gugucuguauuuuggguaaggaggggaggucugaaaaagacuuuggggcuuuuucuucu

SEQ ID NO: 507532 - RNA, 59 nt, Human
gccauuuuauucaaaugcuugcuauacaaucugaaaacacacuggcaggugcuccucuc

SEQ ID NO: 507533 - RNA, 59 nt, Human
gaaggagaaggccccccuuucuucauuaaucugaaaaaaaggaaagugagaauaggcug

SEQ ID NO: 507534 - RNA, 59 nt, Human
ggcagguuucugugccuuuauuucccucuucugaaaaaaagucuguguuuucauaguuu

SEQ ID NO: 507535 - RNA, 59 nt, Human
ggccccacguccuuagaggccagagcacaucugaaaacugcaaucacagccguccgcug

SEQ ID NO: 507536 - RNA, 59 nt, Human
ugcuaaacuugaauggagcaacacuccuuucugaaaagccagaagaaggggguuuuaaa

SEQ ID NO: 507537 - RNA, 59 nt, Human
gguagaaacuggugucugcucuggugugaucugaaaaggcgucuucacugcuuuaucuc

SEQ ID NO: 507538 - RNA, 59 nt, Human
uauguuuaucaaguggcuaacaaaugcauucugaaaauguauuuaacauagcuguuuua

SEQ ID NO: 507539 - RNA, 59 nt, Human
uguaaauacacauucuuauucuugaaccuucugaaaauaaguugcagacaucaugaaaa

SEQ ID NO: 507540 - RNA, 59 nt, Human
ugagcugugaagucuucuuggaccuguugucugaaaauaaaguuaauuuguuugaggca

SEQ ID NO: 507541 - RNA, 59 nt, Human
cauagagcacaaggucaaggaagcuagagucugaaaaacgaacaauucacuuccagguc

SEQ ID NO: 507542 - RNA, 59 nt, Human; identical to SEQ ID NO: 507524

SEQ ID NO: 507543 - RNA, 59 nt, Human
ucccugacaaggguaccagguccaccccuucugaaaagcagcuguuaguuuacucuugg

SEQ ID NO: 507544 - RNA, 64 nt, Human
agucacuuggacauuggucacuuguaggaaauuuaaacucuaauuaugacagcuacacugaaaa

SEQ ID NO: 507545 - RNA, 64 nt, Human
ucaagaugcuucacuuacauggaagaaacuucuaaaacucuaccgagugguuuuuguauauacu

SEQ ID NO: 507546 - RNA, 64 nt, Human
cuguccaagugccacaugccuacgauugaaaugaaaacucuauuguuaccucugaguuguguuc

SEQ ID NO: 507547 - RNA, 58 nt, Human
ccauuaaugaauuagucuaaucauguuuucugaaaauauaaccagccauuggcuauuu

SEQ ID NO: 507548 - RNA, 59 nt, Human
gcugccucucagucaccaagucaccucccucugaaaauccagucccuucuuuggauguc

SEQ ID NO: 507549 - RNA, 59 nt, Human
ggcuuccuugacgcgagaggcucugagggucugaaaagggcaucucaauggcaugggug

SEQ ID NO: 507550 - RNA, 59 nt, Human
ucuccuuuccaggagccccaggauuagcaucugaaaaggguagcacuuccuuuuuuguu

SEQ ID NO: 507551 - RNA, 59 nt, Human
gcuugagcugagagacagacacaacaguaucugaaaagaauacauacucuuuccaugca

SEQ ID NO: 507552 - RNA, 59 nt, Human
ugccaacauuuauauccaauucuaagauuucugaaaaaaaauucuuaucccuugcugcu

SEQ ID NO: 507553 - RNA, 59 nt, Human
agacauuugccaaauguauuaccgaugccucugaaaagggggucacugggucucauaga

SEQ ID NO: 507554 - RNA, 59 nt, Human
uaacaauggaauaugccuucucugcuaugucugaaaauagaagcuauuuauuaugagcu

SEQ ID NO: 507555 - RNA, 59 nt, Human
acaaagaauuuuauagaaauuuuuaaacaucugaaaaagaagcuuaaguuuuaucaucc

SEQ ID NO: 507556 - RNA, 59 nt, Human
ucuaauuuggaguucaaaggaacaccagcucugaaaacaugaccguggggccaggaugu

SEQ ID NO: 507557 - RNA, 59 nt, Human
aguucagggacucuccagccuacuccuuuucugaaaaacccuuaaucaugugaacauuu

SEQ ID NO: 507558 - RNA, 59 nt, Human
gaguuggccaccaccucuucuacuugcugucugaaaaaacaccugacuaguacagcuga

SEQ ID NO: 507559 - RNA, 59 nt, Human
ccagguccucauuuccaaagucccaaugcucugaaaaccaaaaguauuuucauaaccca

SEQ ID NO: 507560 - RNA, 59 nt, Human
cgcauaccugcuuccaagaauaaaacaguucugaaaagcaaccgcaaagccgggcgcgg

SEQ ID NO: 507561 - RNA, 59 nt, Human
agugcuggcaggcuaguguagauaaguggucugaaaaggugucucugagccgagggcau

SEQ ID NO: 507562 - RNA, 64 nt, Human; identical to SEQ ID NO: 503801

SEQ ID NO: 507563 - RNA, 64 nt, Human; identical to SEQ ID NO: 503802

SEQ ID NO: 507564 - RNA, 64 nt, Human; identical to SEQ ID NO: 503803

SEQ ID NO: 507565 - RNA, 59 nt, Human
cugauggaaaugggaaugaaguuaaguggucugaaaaacuugaaucguucacauuucuc

SEQ ID NO: 507566 - RNA, 59 nt, Human
cuacuguucaaacuaagagauuuuuaaauucugaaaaacugcuuacaauucauguuuuc

SEQ ID NO: 507567 - RNA, 59 nt, Human
gaauacaggaagauaaguguucguucuuuucugaaaaagaguauguguaccacaagagc

SEQ ID NO: 507568 - RNA, 59 nt, Human
uggccguaaguucucucagcuuuuguuugucugaaaauaaauuuaguucgccuuuauuc

SEQ ID NO: 507569 - RNA, 59 nt, Human
aggaacaguuugauacacuuuuaaaagguucugaaaacaaagcuguauagggauccucu

SEQ ID NO: 507570 - RNA, 59 nt, Human
gugguuuauuaauuacauuuaaaaaguuuucugaaaaaacuuuugcaauaaaaaaaaau

SEQ ID NO: 507571 - RNA, 59 nt, Human
aaugguaagacuagugcaaaacaguuauuucugaaaauuaaagaccauuauugcuacca

SEQ ID NO: 507572 - RNA, 59 nt, Human
caaauugaaaaugcacagaauguuuuucaucugaaaauugcauggagacuuuuguuucu

SEQ ID NO: 507573 - RNA, 59 nt, Human
cuaaaugcuuauuguuaagugaaaaccaaucugaaaaggcuuucuauguuguaugauug

SEQ ID NO: 507574 - RNA, 59 nt, Human
uaaaaguuauaaaucaaaauaacagauuaucugaaaaaaaaucuauccuguacguguga

SEQ ID NO: 507575 - RNA, 59 nt, Human
auaugcuugcauuguuuaaguuuuuaaauucugaaaauuaauaauuaggguuuuuuuca

SEQ ID NO: 507576 - RNA, 59 nt, Human
gagaaaaagaaugagaaccaccuuauucuucugaaaaagacuuucuucucauccaguaa

SEQ ID NO: 507577 - RNA, 59 nt, Human
acuagcucuuguugagccgugggcaauugucugaaaagugaagacagaaccacagggcu

SEQ ID NO: 507578 - RNA, 59 nt, Human
uuugucuuguuuuucuguuuuaguugucuucugaaaaaagagucguucccucuguuucu

SEQ ID NO: 507579 - RNA, 59 nt, Human
uguaauuguaauuccaaaauccaaaaagcucugaaaacaagguuuccauaagcuuggug

SEQ ID NO: 507580 - RNA, 64 nt, Human; identical to SEQ ID NO: 503819

SEQ ID NO: 507581 - RNA, 64 nt, Human; identical to SEQ ID NO: 503820

SEQ ID NO: 507582 - RNA, 64 nt, Human; identical to SEQ ID NO: 503821

SEQ ID NO: 507583 - RNA, 59 nt, Human
uuagaacccuguagugacuuaucauggccucugaaaaaucuagacuuucauuaugcaua

SEQ ID NO: 507584 - RNA, 59 nt, Human
gggagggagggggcuccaugaaagguacgucugaaaaguuucugaagauuuuauuauca

SEQ ID NO: 507585 - RNA, 59 nt, Human
auucagaagagaggagggaaguugugcacucugaaaaugcaugaaaaacaaaggcaaaa

SEQ ID NO: 507586 - RNA, 59 nt, Human
acuagcaaagcaaauauuauaaaguuauaucugaaaauaauugugggaaguaugugauu

SEQ ID NO: 507587 - RNA, 59 nt, Human
gacaguccuauuuuugauguccuuuccuuucugaaaauaaaguuuugugcuuuggagaa

SEQ ID NO: 507588 - RNA, 59 nt, Human
caucaccuaagacgauuggcgaaaacuuuucugaaaaccuuugugaauuacuucguuuc

SEQ ID NO: 507589 - RNA, 59 nt, Human
gaagguuguuuuuuuuuuuuuuucuccauucugaaaauagcaggacauuuaccucuuaa

SEQ ID NO: 507590 - RNA, 59 nt, Human
auauaaagguauaagagaccaugacaaugucugaaaauggaauagauaaugaugccuuu

SEQ ID NO: 507591 - RNA, 59 nt, Human
ccauuauaguauuuauuguauuuuuauguucugaaaauuacccauggaacaauaugcuu

SEQ ID NO: 507592 - RNA, 59 nt, Human
cuccaguauagucaguuuaguucauauguucugaaaacuguuuuggagaaagauagaca

SEQ ID NO: 507593 - RNA, 59 nt, Human
ugaucacuuaaaguaguuuccuucuuuauucugaaaaaaugaggaaaaaauaacaacag

SEQ ID NO: 507594 - RNA, 59 nt, Human
gucuugguauagguuuaagugugggacagucugaaaauugauagcauuuagcauuucuu

SEQ ID NO: 507595 - RNA, 59 nt, Human
ccacagacacacagcacaggcgugacaguucugaaaagaagcugaguugucuccaggcu

SEQ ID NO: 507596 - RNA, 59 nt, Human
aaaaaaaaaaaaagauaaaaagucagaaaucugaaaaguggaggaagaguacaaauaga

SEQ ID NO: 507597 - RNA, 59 nt, Human
ggggugaggaagagggagggauggacaagucugaaaaccucacaacuccuuaccaaggc

SEQ ID NO: 507598 - RNA, 64 nt, Human
auaaacuggaaagugguuugauuauugugagucaaaacucuaagugguuaaaaauuaguaugaa

SEQ ID NO: 507599 - RNA, 64 nt, Human
uaaaugcuuucuagugaaaaauuauaaucuacuuaaacucuaaucagaaaaaaaauucucaaaa

SEQ ID NO: 507600 - RNA, 64 nt, Human
aauaaucaugcuuuuuuccuaugguuacagcauuaaacucuauuuuaaguuguuuuugaacuuu

SEQ ID NO: 507601 - RNA, 59 nt, Human
ggacugcugcuucucuuagcuccucugccucugaaaagcugcucgggguuuuuuauuua

SEQ ID NO: 507602 - RNA, 59 nt, Human
cugaccaguauuuaaaaccaaaaggauauucugaaaaauggccaacaauuuuuuuagaa

SEQ ID NO: 507603 - RNA, 59 nt, Human
acuacccuugaagcacauccccuucuggaucugaaaagagcccuuggcucagggcgucu

SEQ ID NO: 507604 - RNA, 59 nt, Human
acgauaaucacaccuuuucccccgucuuuucugaaaaauuguaaaucugaucauaucaa

SEQ ID NO: 507605 - RNA, 59 nt, Human
uagucugcuuugguacuaauaaucuuguuucugaaaagaugguaucauauauuuaaucu

SEQ ID NO: 507606 - RNA, 59 nt, Human
gugccaaaguccauuuaucccaaauccugucugaaaaggagggguacauugguaaacau

SEQ ID NO: 507607 - RNA, 59 nt, Human
caucucagcccugccuuucucuggagcauucugaaaacagauauucuggcccagggaau

SEQ ID NO: 507608 - RNA, 59 nt, Human
ucaaacaaagccccaagaugaagucuaauucugaaaauaucucacaauuuuugaauguu

SEQ ID NO: 507609 - RNA, 59 nt, Human
ccuucuacacuagugccaugggaaccaggucugaaaaaguagagagaagugaaaguaga

SEQ ID NO: 507610 - RNA, 59 nt, Human
aagucuccagagcacacaagaguauuucuucugaaaaaaauguuacaauuauacuagau

SEQ ID NO: 507611 - RNA, 59 nt, Human
uaauucagauuaccuaauuuuaaaauguuucugaaaagugaacagaguuaccuuacaga

SEQ ID NO: 507612 - RNA, 59 nt, Human
aauaaacugguuaauguuuaaguuaaaccucugaaaagucuccauuuaccagauuugag

SEQ ID NO: 507613 - RNA, 59 nt, Human
guacacagacugauuuggagaacacauucucugaaaauacuguaaauacguuggggauu

SEQ ID NO: 507614 - RNA, 59 nt, Human
uuaugauuguaaagcauuuuaucacauuuucugaaaacaauuguucuugguuugcuuau

SEQ ID NO: 507615 - RNA, 59 nt, Human
gacaaaccgagugcaaugaaugaugcuuuucugaaaaugaaauauaacaagugggugaa

SEQ ID NO: 507616 - RNA, 64 nt, Human
cccaaaucugauuccuccuauugucuuguaaaucaaacucuaagugaaaacuucccauuugucc

SEQ ID NO: 507617 - RNA, 64 nt, Human
cuuucuuuuuaauaggacaagcaugaguuaggacaaacucuaaaaauucauauucuucacuauu

SEQ ID NO: 507618 - RNA, 64 nt, Human
ucaguuuauaaagcaguuccacaccaugcaaacaaaacucuaacagcaaagguuaucuugaccu

SEQ ID NO: 507619 - RNA, 59 nt, Human
aaagcauuagaaauaacuucuaaccauccucugaaaaaacagaaaaaauaucgaauccc

SEQ ID NO: 507620 - RNA, 59 nt, Human
agugaauguuaggccuugggggcugagucucugaaaagucuaagaagcucugccuagac

SEQ ID NO: 507621 - RNA, 59 nt, Human
ucggcccuccccggccuuugcccuugcuuucugaaaaucagguaguguggcuacuccuu

SEQ ID NO: 507622 - RNA, 59 nt, Human
auaacuaaggagcagcauuugaguagauuucugaaaaacaauguuauuuguugauuuaa

SEQ ID NO: 507623 - RNA, 59 nt, Human
aaagucacuuuuggcuaaucaugcagucuucugaaaagguuuaauagagaaaugcuguu

SEQ ID NO: 507624 - RNA, 59 nt, Human
ccccguuuuauaaaagaggaaacugaaguucugaaaaucuccuuccagggccccagcua

SEQ ID NO: 507625 - RNA, 59 nt, Human
cacgucuucugagaaugacuuucagucucucugaaaaugaaaagcuuaggaccagaaga

SEQ ID NO: 507626 - RNA, 59 nt, Human
aguuucuuguuuaaaaaaaaauaaaaucaucugaaaagcauuuguacaguaaaauguau

SEQ ID NO: 507627 - RNA, 59 nt, Human
aguguuagcaauaguucaaaaaauuaaguucugaaaauugaaaaaauuaaaauguaaaa

SEQ ID NO: 507628 - RNA, 59 nt, Human
aaucaugagucuucuauuuuugucccauuucugaaaauuaucaagauaacuaguaaaau

SEQ ID NO: 507629 - RNA, 59 nt, Human
aacacauacauggaguauggaggaaauuuucugaaaaauacauuuagauuaguuuaguu

SEQ ID NO: 507630 - RNA, 59 nt, Human
auuuucaugcacaguagauucaaguugugucugaaaauaucucuugugcuuuuuugauu

SEQ ID NO: 507631 - RNA, 59 nt, Human
aggcacugcgcccgguggauaacuuuguuucugaaaagacugacauugaacuugucuau

SEQ ID NO: 507632 - RNA, 59 nt, Human
uacugauggauuaaaaacagcuaacauugucugaaaauuauguuaccuauaagaaguug

SEQ ID NO: 507633 - RNA, 59 nt, Human
gucaucuuucugcugguugugagggggaaucugaaaauggaguuuuagaggaaaaguca

SEQ ID NO: 507634 - RNA, 64 nt, Human
uuugggggaugccugggccuuuaaaacacuagccaaacucuaauuaauucucaaaucacugcca

SEQ ID NO: 507635 - RNA, 64 nt, Human
uggcaucgugcuggcucucugcauccaggggugcaaacucuacagcggcucugcagacugcacc

SEQ ID NO: 507636 - RNA, 64 nt, Human
ggcagagggagaugguuagacucuugcagggcuaaaacucuaauuuggaauugaauauugugga

SEQ ID NO: 507637 - RNA, 59 nt, Human
gaguagcuucuuuaugauaaagacaauuuucugaaaagugaacaauucuguuaaaagaa

SEQ ID NO: 507638 - RNA, 59 nt, Human
acuauuuuggcuuuuuaaacauaauuuucucugaaaauuaauuguggcucuuauuugca

SEQ ID NO: 507639 - RNA, 59 nt, Human
auuacaggauauguugcaguccccaucuuucugaaaauaacccuuaacguauccaacag

SEQ ID NO: 507640 - RNA, 59 nt, Human
guguuuuaaaagaugaguuuuuccuacauucugaaaagcaaacaugaaaaacugaacac

SEQ ID NO: 507641 - RNA, 59 nt, Human
auauggccguauagccucaggccuucauuucugaaaagaaaaaagcucaaaaagcugcu

SEQ ID NO: 507642 - RNA, 59 nt, Human
agugacaauagagucucaggauagcagagucugaaaauaccuuggucucccccauuaug

SEQ ID NO: 507643 - RNA, 59 nt, Human
aucuuuaaauguauugaagcauugugcugucugaaaauaaggaauugcuuauaaaccag

SEQ ID NO: 507644 - RNA, 59 nt, Human
ugucuacaguuuauccauauaacuucucuucugaaaacugaggaguguccucuguucuu

SEQ ID NO: 507645 - RNA, 59 nt, Human
ucucccuuccggggcugcccucaagagcuucugaaaaacuaaugacucugcugccuucu

SEQ ID NO: 507646 - RNA, 59 nt, Human
uauuuaacauuaaaaucuaagaaugaaccucugaaaagacuaaauagguuuaccaugug

SEQ ID NO: 507647 - RNA, 59 nt, Human
uaaguuccauguauuuuuguuacaaaucuucugaaaaaaaacaaaacaaugugaaacau

SEQ ID NO: 507648 - RNA, 59 nt, Human
auuacaaguuguacuaacauauuaaagguucugaaaaguccugcagcaaagacaacuau

SEQ ID NO: 507649 - RNA, 59 nt, Human
caagaaaaaugauccuugcgugcugaauaucugaaaagagaaauuuuuccuacaaaauc

SEQ ID NO: 507650 - RNA, 59 nt, Human
guugggcucugccccagccccacacuugcucugaaaaccaagugucagagccccuuccc

SEQ ID NO: 507651 - RNA, 59 nt, Human
agagcucaaaagcagaaauggccaggccuucugaaaacuuaaguccagaauugucacag

SEQ ID NO: 507652 - RNA, 64 nt, Human
uggcugcugucaugagaugauaaaauguaaaacaaaacucuagucaacguagaaagaguuaacu

SEQ ID NO: 507653 - RNA, 64 nt, Human
gcaaauaaacugcuauaagacauuuugguuaguaaaacucuagccuuuggcguguugguaucuu

SEQ ID NO: 507654 - RNA, 64 nt, Human
gcccacaccuugacuucaguauuucugaccuccuaaacucuaauaaagucaugcuuacagccac

SEQ ID NO: 507655 - RNA, 59 nt, Human
uccacagccucacuucauuccaccuauucucugaaaauauucccugagagagaacagag

SEQ ID NO: 507656 - RNA, 59 nt, Human
guacugugauggggucaucaaauuauuaaucugaaaauagcaacccagaauguaaaaaa

SEQ ID NO: 507657 - RNA, 59 nt, Human
auuugugucccuuaaaccagacucacuuuucugaaaaaucuccauuguugaggagaggc

SEQ ID NO: 507658 - RNA, 59 nt, Human
uuuaacgaaaaucacaacuucaggagacaucugaaaagaaugaugucucugaaagcugu

SEQ ID NO: 507659 - RNA, 59 nt, Human
uaauaaguguagcaaaaucuccuuagauaucugaaaagucauacuggauggaaucugua

SEQ ID NO: 507660 - RNA, 59 nt, Human
cuugcugauuuuuucccacagcaugugauucugaaaauguaacuacaauauugacauaa

SEQ ID NO: 507661 - RNA, 59 nt, Human
ugaccucuguagagacucuugaagacaacucugaaaagugggcugugacucccgaugca

SEQ ID NO: 507662 - RNA, 59 nt, Human
uuaaaauagaaauauuaugauugcauaaaucugaaaaugaauuauguuauuugcucuga

SEQ ID NO: 507663 - RNA, 59 nt, Human
uuuccuucaaagucaguuacugccaauuuucugaaaaaagcauguuccauauacuaagu

SEQ ID NO: 507664 - RNA, 59 nt, Human
uucuaccagcucauacaaaauaaaugguuucugaaaauguuuaaguauuaacuuacaag

SEQ ID NO: 507665 - RNA, 59 nt, Human
gaacacacucgauuaaaaauguuaagcuaucugaaaaauaaaaugugcaagucuucagg

SEQ ID NO: 507666 - RNA, 59 nt, Human
gaagcuauaacauguuauguacaguacacucugaaaagaaaucugaaacaaguuauugu

SEQ ID NO: 507667 - RNA, 59 nt, Human
ucaaugugaauccaaagcuugucugguucucugaaaauaauuuuuuccccuuuagguuc

SEQ ID NO: 507668 - RNA, 59 nt, Human
aagcucauugccaacccacaagauauguuucugaaaaccuguaguuucuuaauuuaagu

SEQ ID NO: 507669 - RNA, 59 nt, Human
cgugcccaguggcugcuccuuccuucaccucugaaaacggcccucuugaagggggauau

SEQ ID NO: 507670 - RNA, 64 nt, Human
auucgucacagagagaguacaucugugaacaaguaaacucuacuuggaaaacuacguuuacuuu

SEQ ID NO: 507671 - RNA, 64 nt, Human
ugccuuaccaggugaguggucuuucgaagauaaaaaacucuagucccuuuaaacguuugccccu

SEQ ID NO: 507672 - RNA, 64 nt, Human
cuucguccauuaguuggaaaaaguaacagaccuaaaacucuaccaagcuacuaaaaacauugca

SEQ ID NO: 507673 - RNA, 59 nt, Human
uaaaaauguaaaauugguuaaaaauaaaaucugaaaaguauguaucucacauugaacua

SEQ ID NO: 507674 - RNA, 59 nt, Human
gucccuucucuugagacuccccucugagaucugaaaaaugaaguggcuuaggaacauca

SEQ ID NO: 507675 - RNA, 59 nt, Human
gccaaauaagucuuaaccaaaaaaaggaaucugaaaaacauacaugacuuauaaauuca

SEQ ID NO: 507676 - RNA, 59 nt, Human
ggguauucaaacuguaguuaguugguaccucugaaaaaugagaauggugagcgcacggg

SEQ ID NO: 507677 - RNA, 59 nt, Human
uuggguuaugacauuuuucuugguucuuaucugaaaauuucaucuguaaccuuucaugu

SEQ ID NO: 507678 - RNA, 59 nt, Human
gugccuuugcuaugaauuaauaugcacuuucugaaaacucuaaagccugggaaacauuu

SEQ ID NO: 507679 - RNA, 59 nt, Human
auaaaacuauuacauuuaaaauauggacgucugaaaaauaaaauauucaucauuuuuau

SEQ ID NO: 507680 - RNA, 59 nt, Human
uuacuuaaugagcuuuaagugccugucguucugaaaauuguguauuuauaauucagcuu

SEQ ID NO: 507681 - RNA, 59 nt, Human
aaaagcaccuaccucugccaugugauguuucugaaaagccucuguauguccccauuugc

SEQ ID NO: 507682 - RNA, 59 nt, Human
cucuuuuuuuccucucagggaacuaaugcucugaaaagggaucugggcacaacaguuuc

SEQ ID NO: 507683 - RNA, 59 nt, Human
aaguuugggucuguacaaaggaaugaaguucugaaaauggugaauauguggguaaauau

SEQ ID NO: 507684 - RNA, 59 nt, Human
aaaaauugauuuucaaguacauguguauuucugaaaauucaaacagugauugccuagaa

SEQ ID NO: 507685 - RNA, 59 nt, Human
uuuugucauuguuuuucgcaauugagcuaucugaaaacuguuauuccuaaguaauguuc

SEQ ID NO: 507686 - RNA, 59 nt, Human
aaaccuaaggaugacaaacacuauccacaucugaaaacuaccacaccauaucagggauc

SEQ ID NO: 507687 - RNA, 59 nt, Human
cuugaaagcccauuaaguggaauagacuuucugaaaauaagaguucuuuaccucagucc

SEQ ID NO: 507688 - RNA, 62 nt, Human
uuuuuauuguaaaacaauaauaauaauaaaaagcaaacucuauugguguguuguguguggcu

SEQ ID NO: 507689 - RNA, 64 nt, Human
accauuuuugaggaccauguaccuagugcuuugaaaacucuaagucacuauaugaauaugacaa

SEQ ID NO: 507690 - RNA, 64 nt, Human
aucuucuugguucccugugagguuucaggcacuaaaacucuauguggggaagggagggguuacu

SEQ ID NO: 507691 - RNA, 59 nt, Human
cuaaagacauuuaaguugcuccagggauuucugaaaaaagacacaggcuucuuccuaga

SEQ ID NO: 507692 - RNA, 59 nt, Human
aauauuuuaaauuugggaucaucgccuguucugaaaacuagaugcaccaaccguaucau

SEQ ID NO: 507693 - RNA, 59 nt, Human
uuaaugaagccugguaaaauuaacaccugucugaaaaucaaaaacauggcuucccagca

SEQ ID NO: 507694 - RNA, 59 nt, Human
aaguggacucucugacaaaguggguacuuucugaaaauuuauauaacuguuguugauaa

SEQ ID NO: 507695 - RNA, 59 nt, Human
acacaacguaaucaaauaugugguccaucucugaaaacaagagacugcuugacaaagga

SEQ ID NO: 507696 - RNA, 59 nt, Human
gugguuauucucugacuugguaacuauguucugaaaacacugcauuuaagaauuuuuaa

SEQ ID NO: 507697 - RNA, 59 nt, Human
uuucugauuucauuguucgcuucuguaauucugaaaaacuuuaaacugguagaacuugg

SEQ ID NO: 507698 - RNA, 59 nt, Human
aaggaaaaauauuuggcuccuuuaauuccucugaaaacaugaguauuuugaguucugca

SEQ ID NO: 507699 - RNA, 59 nt, Human
agcuuuuauguuuuacaaguucacuaaaaucugaaaacuguuucuauaaggaaauaaua

SEQ ID NO: 507700 - RNA, 59 nt, Human
auuugaaauaagacaggaauaaagaguauucugaaaaaaagaagauauggaugaaguga

SEQ ID NO: 507701 - RNA, 59 nt, Human
ugacaagccaaggcugcaugagacaucuuucugaaaaugguaacuucugaaacagcaaa

SEQ ID NO: 507702 - RNA, 50 nt, Human
aauuucaguugccaauaugaucugaaaacccaguggauggcugaaggugu

SEQ ID NO: 507703 - RNA, 59 nt, Human
aacaacccaaugaaauaacauuuugcauaucugaaaagaagcauugaauauaagccaaa

SEQ ID NO: 507704 - RNA, 59 nt, Human
uuuucuaauggaaugaaccauuuuccucuucugaaaauucuguaucugagcacaucaag

SEQ ID NO: 507705 - RNA, 59 nt, Human
uuuggguucuuuguaauuuaaugaauaggucugaaaacuuaugaccaauacuuguuaua

SEQ ID NO: 507706 - RNA, 64 nt, Human
cuucaagggcugcuucaaacucaaacacagagagaaacucuauggguaucaaacagcucaggcu

SEQ ID NO: 507707 - RNA, 64 nt, Human
uauauauuuuuuguugcaaagugucucucuagagaaacucuauauauuauucgaauuuuuaaau

SEQ ID NO: 507708 - RNA, 64 nt, Human
aguggcacgggggcgugaggaagagggaaaggggaaacucuaaggguccuggcgcggggaaggg

SEQ ID NO: 507709 - RNA, 59 nt, Human
agacuacccuuguuuuauguuuucaguauucugaaaauaccaguguguggcaguucucg

SEQ ID NO: 507710 - RNA, 59 nt, Human
acuuguacguuuuuuauauacuucaacuuucugaaaaaguaaacuucgacaaguuccca

SEQ ID NO: 507711 - RNA, 59 nt, Human
acauuuggaagcuaaaauguacaucguugucugaaaaaacccaaccccaaaaccuucau

SEQ ID NO: 507712 - RNA, 59 nt, Human
uuuuuguuuucauuuucucuagacauucaucugaaaaucauuuuaugguucucaauccc

SEQ ID NO: 507713 - RNA, 59 nt, Human
auguucuuuaccaaauuguugcaucugguucugaaaaaguauagcauguagcagcuucc

SEQ ID NO: 507714 - RNA, 59 nt, Human
cugcaaaucaugucaguguaguacaaaauucugaaaacacauaagggcugguuauuuac

SEQ ID NO: 507715 - RNA, 59 nt, Human
uuauucuuuguuaacaugagagucccaugucugaaaaccaaaguccaauuucugucugg

SEQ ID NO: 507716 - RNA, 59 nt, Human
accagucaugagucuuacugugucaaaaaucugaaaacacuugcugagaaccaaauuua

SEQ ID NO: 507717 - RNA, 59 nt, Human
aauuuuuuuacaaguauuuacauacuguaucugaaaacagacuuuaaagucacaagauu

SEQ ID NO: 507718 - RNA, 59 nt, Human
auuauaaauguacauauauauucucacauucugaaaaauaacauucucagaauccacag

SEQ ID NO: 507719 - RNA, 59 nt, Human
ugucaaauauauucuauaaugaaauaaaaucugaaaaguggauuucuuauugaccuaua

SEQ ID NO: 507720 - RNA, 59 nt, Human
acaaagaaaaacagauacuaaaagucucuucugaaaacagcaauccagguaagacuuau

SEQ ID NO: 507721 - RNA, 59 nt, Human
ugcuguggcucagucagcaaccucagaacucugaaaaaacaaaacaaaaaaaaaaaaaa

SEQ ID NO: 507722 - RNA, 59 nt, Human
uauguagugaguaaaguugcucucuagucucugaaaagcaaaaaaagugagaaaauaau

SEQ ID NO: 507723 - RNA, 59 nt, Human
agcuucucuuucagaauuuuuauaccaauucugaaaaagaaaauuugcguggcauuuuu

SEQ ID NO: 507724 - RNA, 64 nt, Human
cuguauuucuuuguagaauaaaugguuucucauuaaacucuaaagauuagggaaaauggauaua

SEQ ID NO: 507725 - RNA, 64 nt, Human
aucguuguuuuugaauguagcacaagcgaugagcaaacucuauaagaguguuuuaaaaauuaac

SEQ ID NO: 507726 - RNA, 64 nt, Human
gacuggaccucagcucacacgaaucuccaaggaaaaacucuacagagcaucuuuuagagcaaga

SEQ ID NO: 507727 - RNA, 59 nt, Human
aaagaggcacuuuacuuuagacuugccacucugaaaaccuucccugcguuuugguucuu

SEQ ID NO: 507728 - RNA, 59 nt, Human
ucuuagccagaaaugucuugccucuggucucugaaaagcuggggugagugguuaccuca

SEQ ID NO: 507729 - RNA, 59 nt, Human
ccuagaggggagugugggcaugggaggggucugaaaaucaggacccaacccagccacug

SEQ ID NO: 507730 - RNA, 59 nt, Human
agcuuuauacugccugaccaaagaacaaaucugaaaaucaccauuuuaaaguuauuuuu

SEQ ID NO: 507731 - RNA, 59 nt, Human
ccaguugcaaguuuaaacguguucgaaagucugaaaauagaacuugccuuuuaaguuaa

SEQ ID NO: 507732 - RNA, 59 nt, Human
guaaaagaaagugaggaaaaggaagugcuucugaaaacaaaccuuucuggacggcagag

SEQ ID NO: 507733 - RNA, 59 nt, Human
gggauuuugaacaaguuauauaauuguggucugaaaagacccuaaacugaaguucuguu

SEQ ID NO: 507734 - RNA, 59 nt, Human
gcucgcuguuaccugcuuccccagucuuuucugaaaaacuacaaauuagggugggaaaa

SEQ ID NO: 507735 - RNA, 59 nt, Human
cagagcuguugaucccacacauucauuuuucugaaaauucaugaacuauucucucauau

SEQ ID NO: 507736 - RNA, 59 nt, Human
uguccauggguucuucaugugcuaugaucucugaaaagacguuaucaccuuaaagcuca

SEQ ID NO: 507737 - RNA, 59 nt, Human
aggagggggaauucauccuccgggucuucucugaaaagaggaaccucucugagugagug

SEQ ID NO: 507738 - RNA, 59 nt, Human
ucuuuagaggaagcacaacugugccuuuuucugaaaaucccuuuuucugguggaauuga

SEQ ID NO: 507739 - RNA, 59 nt, Human
aggacuacauuaacucuuauuguuguguuucugaaaagugaaauuuaaaaagcagccug

SEQ ID NO: 507740 - RNA, 59 nt, Human
gacugagaauggcccugcauaaaaugaacucugaaaacuuuaccaucuagagugcucau

SEQ ID NO: 507741 - RNA, 59 nt, Human
acuuacugacuccacuccugacuucugcuucugaaaaaaugaaguagguguuuucccua

SEQ ID NO: 507742 - RNA, 64 nt, Human
auugcuuuuauuauuauugcuuuuauuaucauuaaaacucuaguucuuguuuugucucuccgaa

SEQ ID NO: 507743 - RNA, 64 nt, Human
uuuguguaaauauguuugcccuaguugaauuaagaaacucuaaagguuauaaaaugaaaacaaa

SEQ ID NO: 507744 - RNA, 64 nt, Human
guagacuccuuccaaugaaaucucaggaauaauuaaacucuagggggacuuucuuaaaaauaac

SEQ ID NO: 507745 - RNA, 59 nt, Human
agaaccaccuagaaauaacucagcagaauucugaaaaugaggucacgcuggguaagaau

SEQ ID NO: 507746 - RNA, 59 nt, Human
gaagugaauuugaauaucaucagaaugugucugaaaaaacauuguccucaaauaauguu

SEQ ID NO: 507747 - RNA, 59 nt, Human
ugcaggccuuaacuuacugaacugaacuuucugaaaacguaauguagcaguaucaauau

SEQ ID NO: 507748 - RNA, 59 nt, Human
uguccucugaucuaaaguugcaugguuggucugaaaauagaguugggcuuaauguugac

SEQ ID NO: 507749 - RNA, 59 nt, Human
agauucuuauugaauucauaauacuuaucucugaaaaugucuuugacuguaaauuuagg

SEQ ID NO: 507750 - RNA, 59 nt, Human
uuuguacagcuuuaaguugugucagauucucugaaaacauuuuuuagaaagcaaaauuu

SEQ ID NO: 507751 - RNA, 59 nt, Human
acagucaagugaccaucauagcuuuuuauucugaaaacauuccuucauaguucaguuag

SEQ ID NO: 507752 - RNA, 59 nt, Human
gccauuuaaggguggaccuccgcgacgauucugaaaaugagcucucugccaagguuuua

SEQ ID NO: 507753 - RNA, 59 nt, Human
aaaaagaagagaaaagaucgucugagaaaucugaaaaaaaagaaagcaaggauacuaag

SEQ ID NO: 507754 - RNA, 59 nt, Human
aaaaagccuaaucccucuauuuuaagauuucugaaaaaacacuccauguuauauucugg

SEQ ID NO: 507755 - RNA, 59 nt, Human
uuucuacaguuuaacauagcacagggccuucugaaaaucgcacuugucaaagacgacuc

SEQ ID NO: 507756 - RNA, 59 nt, Human
ucuuaauaugauaaacugugcuuuaucauucugaaaacucaggauacagcuuauucaua

SEQ ID NO: 507757 - RNA, 59 nt, Human
ggucucaacugugcuugaaaaacacugucucugaaaacaacuuugugauucucccugcu

SEQ ID NO: 507758 - RNA, 59 nt, Human
uuacuggcuucagaaagcuaauuaagugcucugaaaaagacaccguuucuugaaacaaa

SEQ ID NO: 507759 - RNA, 59 nt, Human
aacaagcaacaccuuaaaagaguuuuauuucugaaaauaaauuaauuuuuuguaaauaa

SEQ ID NO: 507760 - RNA, 64 nt, Human; identical to SEQ ID NO: 504179

SEQ ID NO: 507761 - RNA, 64 nt, Human; identical to SEQ ID NO: 504180

SEQ ID NO: 507762 - RNA, 64 nt, Human; identical to SEQ ID NO: 504181

SEQ ID NO: 507763 - RNA, 59 nt, Human
cccaaccuggugcuaggucauuucacuuuucugaaaaccucacaucaggcugcauccuc

SEQ ID NO: 507764 - RNA, 59 nt, Human
gaggaugauugaggugggucuaccucaucucugaaaauucuggaaggaauggaggaguc

SEQ ID NO: 507765 - RNA, 59 nt, Human
ccccuaaaggucaauguuaaguacaacauucugaaaauacaauuuggcuacgaagagua

SEQ ID NO: 507766 - RNA, 59 nt, Human
agcccucuguggagucauugugcuggaccucugaaaagaucugcaggggccaagauguu

SEQ ID NO: 507767 - RNA, 59 nt, Human
uugugacugugagaguuuccgguuuaaaaucugaaaagccagauaugccuguuuccuuu

SEQ ID NO: 507768 - RNA, 59 nt, Human
aacaaacuccucaugauaacugcacacaaucugaaaaccacugaaggacaagccaacca

SEQ ID NO: 507769 - RNA, 59 nt, Human
gacgugugugugacucuuaacaauugcugucugaaaaugagagagaagacuucggaagc

SEQ ID NO: 507770 - RNA, 59 nt, Human
uucaacacuguugcucuugaaaaucugggucugaaaaaacgcacaagagccccugcccu

SEQ ID NO: 507771 - RNA, 59 nt, Human
accauuuuaggcauagaacuacagacauuucugaaaagguuggugaugaagaacuucag

SEQ ID NO: 507772 - RNA, 59 nt, Human
gauuuuugugaugaagagcuuccauuacuucugaaaacuauauuuaucugagugagucc

SEQ ID NO: 507773 - RNA, 59 nt, Human
cauaggaggcaaaaggucuauggcucaugucugaaaaaugccugcugcugccaaguuag

SEQ ID NO: 507774 - RNA, 59 nt, Human
gagcguuuugcggucaucagacuuccucaucugaaaacacagaacauacugacccuuuc

SEQ ID NO: 507775 - RNA, 59 nt, Human
uagaacaaacccuuuuugaucuuaaugcuucugaaaacuaggucugacucuggggauuu

SEQ ID NO: 507776 - RNA, 59 nt, Human
caauucaugaagugaauuaaugaugaggaucugaaaacuuggcuggggcuauauauacu

SEQ ID NO: 507777 - RNA, 59 nt, Human
aacgggaaaaaagaaagguuccaguuuugucugaaaauucugauuaagccucugggccc

SEQ ID NO: 507778 - RNA, 64 nt, Human; identical to SEQ ID NO: 504323

SEQ ID NO: 507779 - RNA, 64 nt, Human; identical to SEQ ID NO: 504324

SEQ ID NO: 507780 - RNA, 64 nt, Human; identical to SEQ ID NO: 504325

SEQ ID NO: 507781 - RNA, 59 nt, Human
auagccugauccugcccuuccaguucaguucugaaaaguaagguugggaccuggguacg

SEQ ID NO: 507782 - RNA, 59 nt, Human
cuuccaugaggcagaaggggucgucguucucugaaaacagugacucugaaauguuggga

SEQ ID NO: 507783 - RNA, 59 nt, Human
cacccugauauugcuucuccucugaaugcucugaaaagugcaggugcccaaggcaugac

SEQ ID NO: 507784 - RNA, 59 nt, Human
acuuuugggugucuguauccuaagaaguuucugaaaagaucuaaagccuuuuuauccca

SEQ ID NO: 507785 - RNA, 59 nt, Human
ucccagagguucaggcaguuccugucaucucugaaaagacugggggauaugaaaucuuc

SEQ ID NO: 507786 - RNA, 59 nt, Human
ggcugccucuaagacuaggaauaggaauaucugaaaacagcauuucuaagggugguaac

SEQ ID NO: 507787 - RNA, 59 nt, Human
aguuauucugcuaaaaauggucuuaguugucugaaaagccagcucuugaaccucuucac

SEQ ID NO: 507788 - RNA, 59 nt, Human
uggauauauuccuuuugucuucaucacuuucugaaaauaaacauaaaacuguugaaugu

SEQ ID NO: 507789 - RNA, 59 nt, Human
ugaacguaugugcucuuauaaaguggacuucugaaaaaugaauguaaaagacacuggug

SEQ ID NO: 507790 - RNA, 59 nt, Human
agauccuuguucuuugacaauuugugaugucugaaaaaacagaacccgaaaagcuaugg

SEQ ID NO: 507791 - RNA, 59 nt, Human
aaagagggagggaaaucuuucaacuuauuucugaaaaagagaaaaaaauauaaaauuuc

SEQ ID NO: 507792 - RNA, 59 nt, Human
acuuacugacuuguuaccacugcugacuuucugaaaaguuuuccaguuuuuguuuuuug

SEQ ID NO: 507793 - RNA, 59 nt, Human
uucaaaagaaagagacuucauuuggcaguucugaaaacaucaccaugacaucucucucc

SEQ ID NO: 507794 - RNA, 59 nt, Human
auucuguuuucagucuugggugguaucuuucugaaaauuaaggaaguucuucaugauua

SEQ ID NO: 507795 - RNA, 59 nt, Human
aauuauuuguaauaaaagauuugcugcagucugaaaacugcccaggggugcacuguugg

SEQ ID NO: 507796 - RNA, 64 nt, Human; identical to SEQ ID NO: 504287

SEQ ID NO: 507797 - RNA, 64 nt, Human; identical to SEQ ID NO: 504288

SEQ ID NO: 507798 - RNA, 64 nt, Human; identical to SEQ ID NO: 504289

SEQ ID NO: 507799 - RNA, 59 nt, Human
uaaccccauggacuccuuucccuuucuucucugaaaaaaacuaauuuaaauuugcuuuu

SEQ ID NO: 507800 - RNA, 59 nt, Human
cuguggagcucuggggggcaaccuggaggucugaaaagaggagccagagaaggugguac

SEQ ID NO: 507801 - RNA, 59 nt, Human
aguuuaaucucucugcuucauauuucacaucugaaaaguggcguuggaaauaauaccuc

SEQ ID NO: 507802 - RNA, 59 nt, Human
acauucaaccauuuguuuucagucagauuucugaaaagugagagguaguuuugauagua

SEQ ID NO: 507803 - RNA, 59 nt, Human
uuauagagaaaggguuuugucaaauguuuucugaaaaucugaguaauucaaagcaugcc

SEQ ID NO: 507804 - RNA, 59 nt, Human
auuauccucaauuuccauauguuacugaaucugaaaaacaucuuuaaaauucaaacagu

SEQ ID NO: 507805 - RNA, 59 nt, Human
aaaaguucuagcugcuuucuuaaaaauaaucugaaaaucuuauugauacuaaagaggag

SEQ ID NO: 507806 - RNA, 59 nt, Human
acaugacuuuacauaaugacuuucuagacucugaaaaaaaugcuuuuaucauuuuugca

SEQ ID NO: 507807 - RNA, 59 nt, Human
guagcauuaaaauggagaaaagaaaguuuucugaaaaaaugcaguaaauauaagccaca

SEQ ID NO: 507808 - RNA, 59 nt, Human
gcuuuagaaugaagucguauaauaaagucucugaaaaggccuuauucagaauaagcaag

SEQ ID NO: 507809 - RNA, 59 nt, Human
gacauaaauaagcauauucagcaaaaaggucugaaaagcaagggaauaccauuauuuuc

SEQ ID NO: 507810 - RNA, 59 nt, Human
gcuaggaacauguggugggacuuucauauucugaaaaauguucuauauucucauuuuuc

SEQ ID NO: 507811 - RNA, 59 nt, Human
aauuucuaaccacgguuauuuaagcauaaucugaaaacaucuagcccaaagguaaguug

SEQ ID NO: 507812 - RNA, 59 nt, Human
uuuuuuaugguacucgaaaaaucaaaccuucugaaaauuaugauauuuguacuucauuu

SEQ ID NO: 507813 - RNA, 59 nt, Human
uuuguccaguuaucuucauaugacuguucucugaaaaaaggucuuacuaccugauauca

SEQ ID NO: 507814 - RNA, 64 nt, Human; identical to SEQ ID NO: 504341

SEQ ID NO: 507815 - RNA, 64 nt, Human; identical to SEQ ID NO: 504342

SEQ ID NO: 507816 - RNA, 64 nt, Human; identical to SEQ ID NO: 504343

SEQ ID NO: 507817 - RNA, 59 nt, Human
uauauuaaaaggcaacaggaauuacaaagucugaaaaccauuuuaaaccaucuuuuaaa

SEQ ID NO: 507818 - RNA, 59 nt, Human
ucacggaaacaaacucguucugcugucaaucugaaaaugccagugcugugccuuggaaa

SEQ ID NO: 507819 - RNA, 59 nt, Human
gggagaucuuaauaccuaauuucaucauuucugaaaauguacuguuuuagaauguauua

SEQ ID NO: 507820 - RNA, 59 nt, Human
gggccguggaacagaauauauguuggaccucugaaaaguuguaaggggccaauucuaag

SEQ ID NO: 507821 - RNA, 59 nt, Human
uuuaugucaucaccucccuugccuuuguuucugaaaauuuugucugcuaaaaaguuucu

SEQ ID NO: 507822 - RNA, 59 nt, Human
caaacgcccaggauuaaaauaaaauauaaucugaaaaccucauguucucucuuucccca

SEQ ID NO: 507823 - RNA, 59 nt, Human
gaggggggugcaaugaggaauguuucuggucugaaaagaauaaaguggguuugaaagcg

SEQ ID NO: 507824 - RNA, 59 nt, Human
aagauccucuuggcagguggagccaggugucugaaaaguucauucucgucuggcugaac

SEQ ID NO: 507825 - RNA, 59 nt, Human
cucaguauuucuuuauaaaaaucuguuguucugaaaaucaacaaccuuagaaggauuuu

SEQ ID NO: 507826 - RNA, 59 nt, Human
gaaaaacccaguauuauaaaaaccucaauucugaaaaucuauagacugaaugcaguucc

SEQ ID NO: 507827 - RNA, 59 nt, Human
aacuuccauuuauaaagucagaaccuaucucugaaaauuaaugugagaaagaaaucucu

SEQ ID NO: 507828 - RNA, 59 nt, Human
cauuauauuuauugguugagcaucccuaaucugaaaauccaagauuaaaugcuccaauu

SEQ ID NO: 507829 - RNA, 59 nt, Human
uaaggaacaaagagaaacuuguaauggucucugaaaaggaauugagaaguaauuccucu

SEQ ID NO: 507830 - RNA, 59 nt, Human
uuuagucauuaaaagugagauuaauaaaaucugaaaauguuauauaauaacuuuaaaaa

SEQ ID NO: 507831 - RNA, 59 nt, Human
uucccugugugccaacgccagccuucgcuucugaaaaccaaacuccagccgcugccagu

SEQ ID NO: 507832 - RNA, 64 nt, Human; identical to SEQ ID NO: 504433

SEQ ID NO: 507833 - RNA, 64 nt, Human; identical to SEQ ID NO: 504434

SEQ ID NO: 507834 - RNA, 64 nt, Human; identical to SEQ ID NO: 504435

SEQ ID NO: 507835 - RNA, 59 nt, Human
ccacagcucagcuucaggcuucuuauguuucugaaaacagcuuggauauuuuaaugcac

SEQ ID NO: 507836 - RNA, 59 nt, Human
caaaauguuuuuauauuaaaaauguuuggucugaaaauuaaaagcacuucauuuagaau

SEQ ID NO: 507837 - RNA, 59 nt, Human
cugggcaacauagcaagacccccaccaucucugaaaaaaaaaauuagccaggcauggug

SEQ ID NO: 507838 - RNA, 59 nt, Human
caaaagaacaccugaaaaaugauauuuugucugaaaagacuugacauuguaaaaauaua

SEQ ID NO: 507839 - RNA, 59 nt, Human
aguagaaaacuaugaaugugggauagccuucugaaaaagccacaaauuuaugaaacauu

SEQ ID NO: 507840 - RNA, 59 nt, Human
acacgaagguugcuagggaaccacuucauucugaaaauguguaaaugaaaggaaaguca

SEQ ID NO: 507841 - RNA, 59 nt, Human
uuggagaugguucugcccacucugguuucucugaaaaaacgagguaauucccugagccc

SEQ ID NO: 507842 - RNA, 59 nt, Human
auaaaaaaugaaauauucacagaaucagaucugaaaacacaugucccagacugcauacu

SEQ ID NO: 507843 - RNA, 59 nt, Human
uguuuugagcaauaauuucugcucauaugucugaaaaguauacagagauaaauucugug

SEQ ID NO: 507844 - RNA, 59 nt, Human
guuuguuuuguuuuuuugagauggagucuucugaaaauuuucucaucuucucuaacccg

SEQ ID NO: 507845 - RNA, 59 nt, Human
uucauucagagguaagccuuuauccuaagucugaaaauucauaucaaagaaaauuuuau

SEQ ID NO: 507846 - RNA, 59 nt, Human
aaaagauaguuauauacaaaauucuguuuucugaaaacaaaauugugauucaccuucag

SEQ ID NO: 507847 - RNA, 59 nt, Human
agugcuauuacuuugaaaacccugcugauucugaaaagugucagaaguuaccauuugau

SEQ ID NO: 507848 - RNA, 59 nt, Human
acacacacacacacagucaaauacuguucucugaaaaaugaugucccaaaaguauuaua

SEQ ID NO: 507849 - RNA, 59 nt, Human
uaaaacugaucaaaagcauaauugaaaguucugaaaaaagaaaaauaauaauauguaga

SEQ ID NO: 507850 - RNA, 64 nt, Human; identical to SEQ ID NO: 504581

SEQ ID NO: 507851 - RNA, 64 nt, Human; identical to SEQ ID NO: 504582

SEQ ID NO: 507852 - RNA, 54 nt, Human; identical to SEQ ID NO: 504583

SEQ ID NO: 507853 - RNA, 59 nt, Human
cccugaagguggccacuuuaagagagaaaucugaaaaccccauuugcuuucuuuucucc

SEQ ID NO: 507854 - RNA, 59 nt, Human
cuugcccccacugucaaggccuggucucaucugaaaagcccuccuggaccucaaagaau

SEQ ID NO: 507855 - RNA, 59 nt, Human
agcugcauuguaagaguucugucaugcagucugaaaagggaagaaacaggauggcuuuc

SEQ ID NO: 507856 - RNA, 59 nt, Human
uuguauuauuagauuacugauuuuucuuuucugaaaauacauuugaguuuuaaucacau

SEQ ID NO: 507857 - RNA, 59 nt, Human
cacauuaguuccagaagaaagauggaaauucugaaaacugaaugucaagaaaaggaguc

SEQ ID NO: 507858 - RNA, 59 nt, Human
agagcaauaaugcuuuuuaaaaauaaacuucugaaaacccaaggccagguacugcauuc

SEQ ID NO: 507859 - RNA, 59 nt, Human
gcaccuguuucccgggcaauuuaacaaugucugaaaagggacugugaguaauggcuguc

SEQ ID NO: 507860 - RNA, 59 nt, Human
gggauuaagguggacaagaucuccuaagaucugaaaagaaaccuuaauacgcucauaug

SEQ ID NO: 507861 - RNA, 59 nt, Human
gcugcuccuuccauuccgucaggacgugaucugaaaacauguagagaagaugaguugag

SEQ ID NO: 507862 - RNA, 59 nt, Human
auuuugcucaacaucuccaguuucucugcucugaaaaauggggaaaacugcuaaacauc

SEQ ID NO: 507863 - RNA, 59 nt, Human
uaacaaccaaccauugagugguacuuauaucugaaaauucagauugcaugaauucaggu

SEQ ID NO: 507864 - RNA, 59 nt, Human
ggcuccauggggcccaggugcaaaggguuucugaaaaacagcaggauuaaguacugaaa

SEQ ID NO: 507865 - RNA, 59 nt, Human
uaguuaugguuacuuucccuagucaaugcucugaaaaugugucacauuauaaacaauac

SEQ ID NO: 507866 - RNA, 59 nt, Human
agaacacagaaagucuuaggaucaugaacucugaaaaaaagagaaaccuuaucuuugcu

SEQ ID NO: 507867 - RNA, 59 nt, Human
aaccaccuuuugaagcagcaacuaucaagucugaaaagcaauugauguuuccauuaauc

SEQ ID NO: 507868 - RNA, 64 nt, Human; identical to SEQ ID NO: 503855

SEQ ID NO: 507869 - RNA, 64 nt, Human; identical to SEQ ID NO: 503856

SEQ ID NO: 507870 - RNA, 64 nt, Human; identical to SEQ ID NO: 503857

SEQ ID NO: 507871 - RNA, 59 nt, Human
ucaguaaucauuaguggcaaugaugacauucugaaaagcugcaauacuuauacaauaaa

SEQ ID NO: 507872 - RNA, 59 nt, Human
ccaccaugcugggucccaggcagcuuuccucugaaaagcaaccucuccugccacccaga

SEQ ID NO: 507873 - RNA, 59 nt, Human
auccuuaccguccuagagagcagacgcuuucugaaaacuacuugcuccaaaagacccuc

SEQ ID NO: 507874 - RNA, 59 nt, Human
cucugcccucucccagucccccuguggcuucugaaaaucucagggacagaugaggcuga

SEQ ID NO: 507875 - RNA, 59 nt, Human
cacuaaaguuaguaaagaaaaguuuaccaucugaaaaagcuggauuuucuuuaagaggu

SEQ ID NO: 507876 - RNA, 59 nt, Human
uguagcccuaccaaaaauagccaguaguaucugaaaaugaaaaauaaaugaaguaucuc

SEQ ID NO: 507877 - RNA, 59 nt, Human
uuggggauauuaggaucuuccuuggagacucugaaaauggcacacaaagaauggcaguu

SEQ ID NO: 507878 - RNA, 59 nt, Human
aacauucuaccagauuauggauggacugaucugaaaaucgaccucaacucaaggguggu

SEQ ID NO: 507879 - RNA, 59 nt, Human
gcauagcuagaccaucuuauuaauaauacucugaaaaaaaugauuucaaggcauggaag

SEQ ID NO: 507880 - RNA, 59 nt, Human
aauaacaaaguggucacagaaauuugugaucugaaaacccggcucccuuccccacaagg

SEQ ID NO: 507881 - RNA, 59 nt, Human
uaauugugaagccagauaugcaauguguaucugaaaagcaaggaauuugcagccguuuu

SEQ ID NO: 507882 - RNA, 59 nt, Human
gauucuaauguggaaauuguuguauuuaaucugaaaaugacuuuaccuacaacaguucc

SEQ ID NO: 507883 - RNA, 59 nt, Human
uuaagacuuuaaaauguaagcauuguaauucugaaaauacacauuuuaagaagaaacua

SEQ ID NO: 507884 - RNA, 59 nt, Human
ggagucuguagguugccagaacucaaaagucugaaaaacaucccaaaagaccauucuua

SEQ ID NO: 507885 - RNA, 59 nt, Human
uugucuacccacagugucauggaaucuucucugaaaacuaauccauaaaguucccugga

SEQ ID NO: 507886 - RNA, 64 nt, Human; identical to SEQ ID NO: 503873

SEQ ID NO: 507887 - RNA, 64 nt, Human; identical to SEQ ID NO: 503874

SEQ ID NO: 507888 - RNA, 64 nt, Human; identical to SEQ ID NO: 503875

SEQ ID NO: 507889 - RNA, 59 nt, Human
cauauuucaguucuuucuuuuucucacuaucugaaaauacauuucccucccucucuucc

SEQ ID NO: 507890 - RNA, 59 nt, Human
aaaaugucagcaaauguaaaaauuuaauuucugaaaagcaccauuagcccauuuccccc

SEQ ID NO: 507891 - RNA, 59 nt, Human
ucugcaauuuuaacuucucaaaggaugucucugaaaagaaucacuuuaaaccaaugccu

SEQ ID NO: 507892 - RNA, 59 nt, Human
cuaaacugaagcugcuguaacuaaaggaaucugaaaagaacaacccugaagcagaggcc

SEQ ID NO: 507893 - RNA, 59 nt, Human
gcuucagaugcacugccugcgggugccagucugaaaaccagaccgcacagaggccuggg

SEQ ID NO: 507894 - RNA, 59 nt, Human
cgcuuuugacuauugugcuccuuuauaauucugaaaacuaaucagcacuuuuuaacaau

SEQ ID NO: 507895 - RNA, 59 nt, Human
cucuuuuuaaaaauaaaaccagacucuguucugaaaauaaaaaacuugagacuugugac

SEQ ID NO: 507896 - RNA, 59 nt, Human
gaucuguccucuucguguacacaguuguuucugaaaauuuucaaugagcuuuuucuaac

SEQ ID NO: 507897 - RNA, 59 nt, Human
ugugcuggcauaaaauaaccugaaaagauucugaaaagccaggauguggaauugaaaga

SEQ ID NO: 507898 - RNA, 57 nt, Human
aggaaagagauuaauguauuaaaacaaccucugaaaaaucuaggagucguaugucau

SEQ ID NO: 507899 - RNA, 59 nt, Human
uggggaaggcaccauuaagccaaaaugaaucugaaaaaagaccaagugggaggaugccu

SEQ ID NO: 507900 - RNA, 59 nt, Human
gcagaugccuaugggagaggaaaagcguaucugaaaaugguccaggacaggaggaugaa

SEQ ID NO: 507901 - RNA, 59 nt, Human
gucuaacauauucaaugcaaguaagacuuucugaaaacacuugaugauguggaaaugcu

SEQ ID NO: 507902 - RNA, 59 nt, Human
ugguagucacuugcgugaaugcuggucagucugaaaaggugaagcuggcugugcacuua

SEQ ID NO: 507903 - RNA, 59 nt, Human
auuuaguguucucacagcuuggauauuuuucugaaaaguuauuugccaaaacugaaauc

SEQ ID NO: 507904 - RNA, 64 nt, Human; identical to SEQ ID NO: 503909

SEQ ID NO: 507905 - RNA, 64 nt, Human; identical to SEQ ID NO: 503910

SEQ ID NO: 507906 - RNA, 64 nt, Human; identical to SEQ ID NO: 503911

SEQ ID NO: 507907 - RNA, 59 nt, Human
ggguuccuuugcuuuuugcuuucuccuuuucugaaaauguauguguuuugccucucuuu

SEQ ID NO: 507908 - RNA, 59 nt, Human
cucuguauaaucuauggcuauccgaauucucugaaaaaauaauaaaaguccccucuauu

SEQ ID NO: 507909 - RNA, 59 nt, Human
uuugauuugucucauauauuuggaguuuuucugaaaaauggagcaguaaugcagcauca

SEQ ID NO: 507910 - RNA, 59 nt, Human
aguaucugaaauuucacaguccuauccgaucugaaaacacacauacacaaaugcacaca

SEQ ID NO: 507911 - RNA, 59 nt, Human
aagauggauaaaugaauaucacuacuuguucugaaaacauguuuguugcuuuuuaucuc

SEQ ID NO: 507912 - RNA, 59 nt, Human
uucccucaccagucuaggcaugacuggcuucugaaaaauuccagcacaccuccucgaac

SEQ ID NO: 507913 - RNA, 59 nt, Human
uccaaccugggugacagagugagauuccaucugaaaaacaaaaacaaaaacagaaaaca

SEQ ID NO: 507914 - RNA, 59 nt, Human
guuggucuuaacuaauguaaauauugcugucugaaaaaguguuuuuacauauagcuuug

SEQ ID NO: 507915 - RNA, 59 nt, Human
uaguuuccaagguauuauguuacucuaacucugaaaagugauguaaucugguagcaaug

SEQ ID NO: 507916 - RNA, 59 nt, Human
gaucauguuguugaugguuagcauauguuucugaaaauuaaauauguauuauuaaaagu

SEQ ID NO: 507917 - RNA, 59 nt, Human
ugccuuuuuaacuugcuuugcaagccuacucugaaaauaaguuauuuagucaaguuauu

SEQ ID NO: 507918 - RNA, 59 nt, Human
uaagaaagagguucugugauuuuucagacucugaaaauucauuuugauucuacauauuc

SEQ ID NO: 507919 - RNA, 59 nt, Human
cccaggcaaggccagagacuucaagucuaucugaaaagucuccagaagucuaaccccag

SEQ ID NO: 507920 - RNA, 59 nt, Human
cccgggcaaggccagagacuucaagucuaucugaaaagucuccagaggucuaaccccag

SEQ ID NO: 507921 - RNA, 59 nt, Human
uaucauuuaugggaucaaacauaugauugucugaaaacaucacuuuuuguggauuugug

SEQ ID NO: 507922 - RNA, 64 nt, Human; identical to SEQ ID NO: 503927

SEQ ID NO: 507923 - RNA, 64 nt, Human; identical to SEQ ID NO: 503928

SEQ ID NO: 507924 - RNA, 64 nt, Human; identical to SEQ ID NO: 503929

SEQ ID NO: 507925 - RNA, 59 nt, Human
auagcuuuuggugcacuuuuguuucaccaucugaaaauucacaaaacuucuugcuucaa

SEQ ID NO: 507926 - RNA, 59 nt, Human
uugugaaccuaccauguugccucccaucuucugaaaaaacaaaaaaauugagaggcugg

SEQ ID NO: 507927 - RNA, 59 nt, Human
ccuaagaauaaaaauugaaaugguguuaaucugaaaauuaaugauucucuguaagcacu

SEQ ID NO: 507928 - RNA, 59 nt, Human
guagagaaauuaugugugucauguggucuucugaaaauggaacaccauucuucagagca

SEQ ID NO: 507929 - RNA, 59 nt, Human
aaauauuuuuaaaaaauacaauuuagaucucugaaaauuggaaccacucaagaguauca

SEQ ID NO: 507930 - RNA, 59 nt, Human
agggaugggguuagguaggggagaacauuucugaaaaagaacuuauaaugaagcuacaa

SEQ ID NO: 507931 - RNA, 59 nt, Human
aaaaaaaacaaagaccaaaaauagcacauucugaaaaaaagauucuuaauaagauuuua

SEQ ID NO: 507932 - RNA, 59 nt, Human
aaccuagguaacagagagacaccucugucucugaaaaaacaaaacuugaaguuugaaac

SEQ ID NO: 507933 - RNA, 59 nt, Human
ggcauuguaacaacuccguguaaagauuaucugaaaaguaaaaaaaaaaaaaaaaaaaa

SEQ ID NO: 507934 - RNA, 59 nt, Human
cacgugacagugacaacacagugacugccucugaaaagagcccugaggcaaacacucuc

SEQ ID NO: 507935 - RNA, 59 nt, Human
ugacaucgcguugcauuuauuuuuauauuucugaaaacuguugcuuuuucuuuuucccu

SEQ ID NO: 507936 - RNA, 59 nt, Human
ugucauuuauaggauaaaacauaugcuugucugaaaauaucaccuuuuguggauuuauc

SEQ ID NO: 507937 - RNA, 59 nt, Human
uucccaauguuugaguuuaaaaaagacuuucugaaaaaauccacuuuuuguucauuuuc

SEQ ID NO: 507938 - RNA, 59 nt, Human
aaaaguccuucuguuacucaagaaaaugcucugaaaaauuccuuuucucuuuuuuuuuu

SEQ ID NO: 507939 - RNA, 59 nt, Human
cauaauccuuagaaguuagcuuguccgcaucugaaaauucacuuuuaccuugaaguuca

SEQ ID NO: 507940 - RNA, 64 nt, Human; identical to SEQ ID NO: 503945

SEQ ID NO: 507941 - RNA, 64 nt, Human; identical to SEQ ID NO: 503946

SEQ ID NO: 507942 - RNA, 64 nt, Human; identical to SEQ ID NO: 503947

SEQ ID NO: 507943 - RNA, 64 nt, Human
ugggguuuucugugcccaugacuugggggcugcacccccacagcacccccacaauguaggaaaa

SEQ ID NO: 507944 - RNA, 64 nt, Human
gugcccaugacuugggggcugcacccccacagcacccccacaauguaggaaaagaccucaggga

SEQ ID NO: 507945 - RNA, 64 nt, Human
cucugcagcuuccuccucagccucccuccuugcacccccacagguuuggcuugugguuuuuguc

SEQ ID NO: 507946 - RNA, 64 nt, Human
cugggagacggcagaagagauagaaucagggcugcccccacagagugggacccaaggggcuaau

SEQ ID NO: 507947 - RNA, 64 nt, Human
ccaugggggcgggggagaggcucaccccuacguccccccacaccuggaggcuggagccaggggc

SEQ ID NO: 507948 - RNA, 64 nt, Human
uuggcuucauggguuuuucugcuuccugcccccacccccacaugugcaauccucaagauuuguc

SEQ ID NO: 507949 - RNA, 64 nt, Human
ggaggcaggucccaggagcagacccugcccccagcccccacagacacaccccaaucugaaagcc

SEQ ID NO: 507950 - RNA, 64 nt, Human
accugcgagaucagcagauaagaucaacaggucccccccacaugaggccacccaggaaaaaagg

SEQ ID NO: 507951 - RNA, 64 nt, Human
cucucgagacuucucugugaacuucccuacccuacccccacaacacaagcaccccagaccucac

SEQ ID NO: 507952 - RNA, 64 nt, Human
gcagguucugcagcauccugccuugcugcucugucccccacaucuuccuggccacagccccuug

SEQ ID NO: 507953 - RNA, 64 nt, Human; identical to SEQ ID NO: 503963

SEQ ID NO: 507954 - RNA, 64 nt, Human; identical to SEQ ID NO: 503964

SEQ ID NO: 507955 - RNA, 64 nt, Human; identical to SEQ ID NO: 503965

SEQ ID NO: 507956 - RNA, 64 nt, Human
augagaaagaaucuuacuuaaauuuggagauuuucccccacaucucuuuuccggauacauuaua

SEQ ID NO: 507957 - RNA, 64 nt, Human
uugugcuccuccuggcucaccauuucccccugcucccccacagccgguucugcacuuaucaccg

SEQ ID NO: 507958 - RNA, 52 nt, Human
accccaacagaacaucaugauccccccacagaugaggccccggggcauggcu

SEQ ID NO: 507959 - RNA, 64 nt, Human
uuauucagccuucucuacaggaaucucuuauguucccccacaugcaggugguuuuucaguaggc

SEQ ID NO: 507960 - RNA, 64 nt, Human
auggacgagugagcuaccaggaagaggggcgcugcccccacagauccauccuuuugcuucaucu

SEQ ID NO: 507961 - RNA, 64 nt, Human
uucagcuucagaccccuuccccaccaggcuaggccccccacaccugggggacccccuggccccu

SEQ ID NO: 507962 - RNA, 64 nt, Human
accccucaaccuccggaguccaggagaacccguacccccacagagccuuaagcaacuacuucug

SEQ ID NO: 507963 - RNA, 64 nt, Human
gcauaaggcggcgacuuccaaggucaaugcuuuucccccacaucucuauguacauagggaacuu

SEQ ID NO: 507964 - RNA, 64 nt, Human
aaugacccaccccucuccccccgccugccaccuccccccacaagugcccuccaggcuuuucuug

SEQ ID NO: 507965 - RNA, 64 nt, Human
aaaagaaagcaaugauaauagcgguggauacccacccccacaaaugcacccaagagacaagcca

SEQ ID NO: 507966 - RNA, 64 nt, Human
caucauaauucaaguguucuuccacacagcguugcccccacaaccacgccggacgugcccccuc

SEQ ID NO: 507967 - RNA, 64 nt, Human
aggaccuuugcacaggacugauggguauaacugacccccacagggaggcaggaaaacagccaga

SEQ ID NO: 507968 - RNA, 61 nt, Human
ugcaacuuuugcaagacuagcuccuugcuggcccccacaugccccaugcuaggccccaaug

SEQ ID NO: 507969 - RNA, 64 nt, Human
ccuaggguugccugagagccaaccucuccugccacccccacaccaagaacuauaugguuccuac

SEQ ID NO: 507970 - RNA, 64 nt, Human
gcauuuagggccacuuucucuguccucgggaaggcccccacaagcuuaagccccuguauacgug

SEQ ID NO: 507971 - RNA, 64 nt, Human
uaaaucaugugcuuaaugcaacaugcccuuucgacccccacauucucaccaccuguuucuuugu

SEQ ID NO: 507972 - RNA, 64 nt, Human; identical to SEQ ID NO: 503981

SEQ ID NO: 507973 - RNA, 64 nt, Human; identical to SEQ ID NO: 503982

SEQ ID NO: 507974 - RNA, 64 nt, Human; identical to SEQ ID NO: 503983

SEQ ID NO: 507975 - RNA, 55 nt, Human
ccaucuacacagacaccugaaggagcccccacaugcgccugcccauccagcacug

SEQ ID NO: 507976 - RNA, 64 nt, Human
accucccaggcucaagcaguccuuucaccucaaccccccacauagcugggacuacaggugcuua

SEQ ID NO: 507977 - RNA, 64 nt, Human
aucuccccaccccuagaaacagggcuggaaaucucccccacagcagugugacuggugaaaaugc

SEQ ID NO: 507978 - RNA, 64 nt, Human
cgaguagcugggauuacagguucccccccaccuucccccacacccagcuaauuuuuguguuuuu

SEQ ID NO: 507979 - RNA, 64 nt, Human
agggaggggcaggaugggccauggaggugccccacccccacaccugacaaucacccacacuccu

SEQ ID NO: 507980 - RNA, 64 nt, Human
ugugguugcuguucugaguacugcucucaucacacccccacagagggggucuuaccacacaaag

SEQ ID NO: 507981 - RNA, 64 nt, Human
ugggaggaccagagacgaagggcuuggaaggagacccccacaugcaucauuuccuccucuucac

SEQ ID NO: 507982 - RNA, 64 nt, Human
ccaauauauauccaugugccuggauuaucuuuaacccccacaccucuuaccuuggacagguaag

SEQ ID NO: 507983 - RNA, 64 nt, Human
guaggucaugaacagucacccgugcuggcuguagcccccacagaggcaaucaugcccaauagau

SEQ ID NO: 507984 - RNA, 64 nt, Human
agcuggccuaggugggagccaccacuccugccugcccccacacccacuccacaccaguaauaaa

SEQ ID NO: 507985 - RNA, 64 nt, Human
uauuuuugcaacuauuuccaccuccucccacaaccccccacacuccacuccacacucuugaguc

SEQ ID NO: 507986 - RNA, 64 nt, Human
cuggaggagagucaccuccagacaacaucugcuccccccacaggggugcagguggcuggcagca

SEQ ID NO: 507987 - RNA, 64 nt, Human
uuagaggagcuagcccaucaagccggcagagaaucccccacacgcucugaaggacccacuuuca

SEQ ID NO: 507988 - RNA, 64 nt, Human
gugacgggcgugcggccgggcggggaggcuggcucccccacaccucccaccugcauugcucucc

SEQ ID NO: 507989 - RNA, 64 nt, Human
uggcugaccuggcugaaagccgcugucucggagccccccacagcauuuuguuccccucccgcug

SEQ ID NO: 507990 - RNA, 64 nt, Human
uggcuaggugucucucacggcugcuccauccuagcccccacaagcuggggcuuccuccuguaga

SEQ ID NO: 507991 - RNA, 64 nt, Human; identical to SEQ ID NO: 503999

SEQ ID NO: 507992 - RNA, 64 nt, Human; identical to SEQ ID NO: 504000

SEQ ID NO: 507993 - RNA, 64 nt, Human; identical to SEQ ID NO: 504001

SEQ ID NO: 507994 - RNA, 64 nt, Human
gaagguuuuacaagaagacugauagucuuucaagcccccacaucacaggcuuagggacggcacu

SEQ ID NO: 507995 - RNA, 64 nt, Human
cugugguggguucgauuuaucccugcccaccccacccccacaacuucccuuuugcuacuucccc

SEQ ID NO: 507996 - RNA, 64 nt, Human
aacaguagauaaaucucucccuaaaagauggauucccccacauacccaugcuacuaguuucucu

SEQ ID NO: 507997 - RNA, 64 nt, Human
caccaccuccaucggcacccaagcgggcaucauccccccacacugcucaggggaggggagggau

SEQ ID NO: 507998 - RNA, 64 nt, Human
cuccaagcucccuccacaaguuucccucccaggccccccacaccccaguguggacuugggauuu

SEQ ID NO: 507999 - RNA, 64 nt, Human
uugccccaaaucucaacuucucagacguuccauacccccacaugccaauuucagcacccaacug

SEQ ID NO: 508000 - RNA, 64 nt, Human
ugggccuccucaccaacggcagugccaaaaucagcccccacaucaaggugguguucucugugcu

SEQ ID NO: 508001 - RNA, 64 nt, Human
uuucacuguucuucagagcuuucuggcucucuuucccccacaaaauucgacauauuuaaaaauc

SEQ ID NO: 508002 - RNA, 64 nt, Human
aggcgaggaaaaugcccgaggcgcugucuucugucccccacacguaccagaaagugaaaaaugc

SEQ ID NO: 508003 - RNA, 64 nt, Human
acucagaugccugggaagcccagccccucaggugcccccacacacagccuucccuugacgccua

SEQ ID NO: 508004 - RNA, 64 nt, Human
ggcagggugggggcacgaagugggcccugggugacccccacagcucccuuccgaggcugcaggg

SEQ ID NO: 508005 - RNA, 64 nt, Human
gcccccauucuacuacccaccacugcccaccccacccccacaucacacacucuucgaugcuuuc

SEQ ID NO: 508006 - RNA, 64 nt, Human
cccccaagcaccuccagcggugaugagcuccacacccccacacccauugcagcuguggcgccac

SEQ ID NO: 508007 - RNA, 64 nt, Human
gcccccacuaccucucuguguacugccgcugugucccccacagaccugcacauuguugucaccc

SEQ ID NO: 508008 - RNA, 64 nt, Human
uggcagggcugcuaccuccucagaguuucagaagcccccacaugggggcucuaggaaugccggc

SEQ ID NO: 508009 - RNA, 64 nt, Human
ucuccccaccaccaccucuguggccuccaugguacccccacagggcuggccuccccuagagggu

SEQ ID NO: 508010 - RNA, 64 nt, Human; identical to SEQ ID NO: 504035

SEQ ID NO: 508011 - RNA, 64 nt, Human; identical to SEQ ID NO: 504036

SEQ ID NO: 508012 - RNA, 64 nt, Human; identical to SEQ ID NO: 504037

SEQ ID NO: 508013 - RNA, 64 nt, Human
ccugagaaaagacugagccaggaacuacaagcuccccccacauuccucccagccuggaccuaau

SEQ ID NO: 508014 - RNA, 64 nt, Human
acggggugcuauuccaucgcagggugcucacacacccccacacccacccacccacacacaacac

SEQ ID NO: 508015 - RNA, 64 nt, Human
gcaaaccuuuaacuaauuauguaucugaaagucacccccacauaccaacucaacuuuuuuccug

SEQ ID NO: 508016 - RNA, 64 nt, Human
cacaggaagaucauucagaaacuaggaaaggaggcccccacagcugauccugccacagcacacc

SEQ ID NO: 508017 - RNA, 64 nt, Human
agcagcuguaucgggcuuccucauccugccuguucccccacaccugccaggauauggacaucuu

SEQ ID NO: 508018 - RNA, 64 nt, Human
aucuuggaggguuuggggagaaguuggcgugccacccccacaaccccugaggagguguagaccc

SEQ ID NO: 508019 - RNA, 64 nt, Human
gagcgugccaggcugcagggcaggcaguaaaaggcccccacauacccugcaguuuucucugucc

SEQ ID NO: 508020 - RNA, 64 nt, Human
gguccaaaguccaagcuagcucuggccuguguggcccccacauaaauaaauuaguggggagggg

SEQ ID NO: 508021 - RNA, 64 nt, Human
ccugaauucugccucccuguuauagucccugucucccccacagagaccugugggugcucccagc

SEQ ID NO: 508022 - RNA, 64 nt, Human
guugugaauagagcuugcuaugguaugaaugugucccccacagcucaugcguuggaaacuuaau

SEQ ID NO: 508023 - RNA, 64 nt, Human
uuaauuggucauucagccaaccaucaguauuuuccccccacaacauguguaacacuuuucaguc

SEQ ID NO: 508024 - RNA, 64 nt, Human
aacauuacugaaagaacccugcgaaucaaaacaacccccacacagaccccgcaauccuuuuuua

SEQ ID NO: 508025 - RNA, 64 nt, Human
cagcagccccucagggcuucccaaggauguccagcccccacacccacacguuaacauaaugagu

SEQ ID NO: 508026 - RNA, 64 nt, Human
aaggacucgccuugcaaccgacaggccauucccacccccacacacaaccuccccuguuuucaca

SEQ ID NO: 508027 - RNA, 64 nt, Human
agcaaaugcaagcugggcugggucuagucccucccccccacaggugacaugaguacagacccuc

SEQ ID NO: 508028 - RNA, 64 nt, Human
agagaccuucagugccauccugacucuagaaggccccccacagcagggcguagggggcaucacc

SEQ ID NO: 508029 - RNA, 64 nt, Human; identical to SEQ ID NO: 504053

SEQ ID NO: 508030 - RNA, 64 nt, Human; identical to SEQ ID NO: 504054

SEQ ID NO: 508031 - RNA, 64 nt, Human; identical to SEQ ID NO: 504055

SEQ ID NO: 508032 - RNA, 64 nt, Human
uuauucuggaaagacaucuccaaggugagguccacccccacagcagaccucaaguagaaauugc

SEQ ID NO: 508033 - RNA, 64 nt, Human
agagagagagaaauuauauacuaugaaaagugcacccccacacucugcuagaggaaugaauuua

SEQ ID NO: 508034 - RNA, 64 nt, Human
ggggggagggggcuuccccuuucagcugcccggccccccacacccacagcuugcucuucuaucu

SEQ ID NO: 508035 - RNA, 64 nt, Human
agagucacuggcaugaugcccucgcucccccaugcccccacaucccaguggggcauaacuaggg

SEQ ID NO: 508036 - RNA, 64 nt, Human
augucuguuugccucuuagagacaggugucucugcccccacaccgcuacuggggucuaauggag

SEQ ID NO: 508037 - RNA, 64 nt, Human
ccuggccagugagcuggaccucaugcccuacacacccccacagucuaccccaaagucugccaaa

SEQ ID NO: 508038 - RNA, 64 nt, Human
uccucuccccugcugucucuggggcugccacccucccccacaguccaggcccuucagccaaggg

SEQ ID NO: 508039 - RNA, 64 nt, Human
cuauauauuauaguaaaacccucgaaagggaucacccccacacuccuuucccuuccccucucca

SEQ ID NO: 508040 - RNA, 64 nt, Human
ggauuuuaguauccucaggaguccuggaaccaaccccccacagauacggggacaacuuuaugac

SEQ ID NO: 508041 - RNA, 64 nt, Human
ucaucuccugcuaguacugugccgcuucccccuccccccacacaaaauaaaaacaguaucugcc

SEQ ID NO: 508042 - RNA, 64 nt, Human
cuuuuaaguuuggguuggagacaacuuccuguggcccccacaagcugagucuggccuucuccag

SEQ ID NO: 508043 - RNA, 64 nt, Human
uuucugcuuuagcguaauugcucagaguagagagcccccacaaaguuauuuaaaagaugcccua

SEQ ID NO: 508044 - RNA, 64 nt, Human
cuaguauuguccauaucagaccucugaucccucgcccccacaccccaucucucuucccuaaucc

SEQ ID NO: 508045 - RNA, 64 nt, Human
accugggaccugccccccaugagccaggacgguccccccacagucagccugugcaaaggccccg

SEQ ID NO: 508046 - RNA, 64 nt, Human
ucucuuuuuuccuuccagccuggauguucggggacccccacaucaccaccuuggauggugucag

SEQ ID NO: 508047 - RNA, 64 nt, Human
gaggcggccccacgugggcugugcuacauacaggcccccacagcccggugagcgacagggccca

SEQ ID NO: 508048 - RNA, 64 nt, Human; identical to SEQ ID NO: 503518

SEQ ID NO: 508049 - RNA, 64 nt, Human; identical to SEQ ID NO: 504509

SEQ ID NO: 508050 - RNA, 64 nt, Human; identical to SEQ ID NO: 504510

SEQ ID NO: 508051 - RNA, 64 nt, Human
aacaaaaauuacauuacaagauccagguucuucccccccacacucaaucaagccagcccucucc

SEQ ID NO: 508052 - RNA, 64 nt, Human
ccucauucaaauauuuacccgggacacacacccccccccacacacacacacagacacacucaca

SEQ ID NO: 508053 - RNA, 64 nt, Human
ugauguauagauuaguuagcaaauucucagaaaucccccacauaaaagccuuacuuuguucaaa

SEQ ID NO: 508054 - RNA, 64 nt, Human
gcugggauuacaggugugagccacugugccuggccccccacaacauguuuaaacuuagcuaggc

SEQ ID NO: 508055 - RNA, 64 nt, Human
aguuguguucuguuuuccuuucugugucuuacuccccccacacucucccucccccaucaccauc

SEQ ID NO: 508056 - RNA, 64 nt, Human
ccaaggccgcccuuucccucgcacacaggccccacccccacaguuccacgccccccccccaagg

SEQ ID NO: 508057 - RNA, 64 nt, Human
gguaguacugggugcuuuuuauacaacuuuccaucccccacacaguuggagaauaauuuguaga

SEQ ID NO: 508058 - RNA, 64 nt, Human
cuacuuuuugcaccuuauuuucucuguuccugagcccccacauucucuaggagaaacuuagagg

SEQ ID NO: 508059 - RNA, 64 nt, Human
ucucuccacugcucucagccucccaaccccagggcccccacaggccccccgcagcacccugcag

SEQ ID NO: 508060 - RNA, 64 nt, Human
cacccccuucccugucccaggcccugcccugguccccccacaaggccucagcccagucacaacu

SEQ ID NO: 508061 - RNA, 64 nt, Human
acugguacuugguaaagaaaucuguccguaaguacccccacaaucagucaaacuauauuuaaag

SEQ ID NO: 508062 - RNA, 64 nt, Human
agaaggggaagaagauugaucaaacugaaugaaacccccacacacacacacaugcauacacaca

SEQ ID NO: 508063 - RNA, 64 nt, Human
caggagcguguacuaccccaggaugcaugcagggcccccacaggagcguguacuaccccaggac

SEQ ID NO: 508064 - RNA, 64 nt, Human
caggagcguguacuaccccaggacgcaugcagggcccccacaggagcguguacuaccccaggau

SEQ ID NO: 508065 - RNA, 64 nt, Human
gcguguccuauccccggaccggacgcaugcagggcccccacaggagcguguacuaccccaggac

SEQ ID NO: 508066 - RNA, 64 nt, Human
cuggagcguguacuaccccaggacgcaugcagggcccccacaggagcguguccuauccccggac

SEQ ID NO: 508067 - RNA, 64 nt, Human; identical to SEQ ID NO: 504511

SEQ ID NO: 508068 - RNA, 64 nt, Human; identical to SEQ ID NO: 504527

SEQ ID NO: 508069 - RNA, 64 nt, Human; identical to SEQ ID NO: 504528

SEQ ID NO: 508070 - RNA, 64 nt, Human
caggagcguguacuaccccagaacgcaugcagggcccccacaggagcguguacuaccccaggac

SEQ ID NO: 508071 - RNA, 64 nt, Human
caggagcauguccuaucccuggacgcaugcagggcccccacaggagcguguacuaccccagaac

SEQ ID NO: 508072 - RNA, 64 nt, Human
caggagcguguccuauccccggacgcaugcagggcccccacaggagcauguccuaucccuggac

SEQ ID NO: 508073 - RNA, 64 nt, Human
gaggagcguguccuauccccggacgcaugcagggcccccacaggagcguguccuauccccggac

SEQ ID NO: 508074 - RNA, 64 nt, Human
auucucauuccucuccucccuacacuuaguauuucccccacagagugccuagaaucuuaauaau

SEQ ID NO: 508075 - RNA, 64 nt, Human
accacacaccccgccccugaaaggagaucaucagcccccacaauuugucagagcugaagccagc

SEQ ID NO: 508076 - RNA, 64 nt, Human
gaccugugucaaaacuuacauccacauuccuacacccccacaacccaucacuucugguguuaac

SEQ ID NO: 508077 - RNA, 64 nt, Human
augagccaaaagcacauaccuaccccaucccccacccccacacacacacacacacacacaugca

SEQ ID NO: 508078 - RNA, 64 nt, Human
gcggggacucaccuucauucucuuccuucacuuucccccacacccuacaacaggucggacccac

SEQ ID NO: 508079 - RNA, 64 nt, Human
aauuugacuuuaugcaguguucugcagcaugccucccccacaucucauagcaccagguuguguc

SEQ ID NO: 508080 - RNA, 64 nt, Human
cggcggccugagaacuuuagggugacugaugcuacccccacagaggaggcaagagccccaggac

SEQ ID NO: 508081 - RNA, 64 nt, Human
acagguggcagagccgaggcuuagggucuggcaccccccacagcuggagacggaggcucuccug

SEQ ID NO: 508082 - RNA, 64 nt, Human
cccccgcccgccgggccgcggaggaggcaggcggcccccacacugugccugaggcccggaaccg

SEQ ID NO: 508083 - RNA, 64 nt, Human
ugaggagcugaaacugaccaguguccaguguuagcccccacauggggcugcucuugcuucuacu

SEQ ID NO: 508084 - RNA, 64 nt, Human
ugccgacccuguggccugcugcccgccccccccccccccacaguggccauacgggcacaggaga

SEQ ID NO: 508085 - RNA, 64 nt, Human
uggagcuaauuaagguuugcccugccugcagccucccccacaaauaaugaacagcagaaagacu

SEQ ID NO: 508086 - RNA, 64 nt, Human; identical to SEQ ID NO: 503519

SEQ ID NO: 508087 - RNA, 64 nt, Human; identical to SEQ ID NO: 504545

SEQ ID NO: 508088 - RNA, 64 nt, Human; identical to SEQ ID NO: 504546

SEQ ID NO: 508089 - RNA, 64 nt, Human
uacugagaagacuccuuggauauuucccaagaaccccccacauacaccccucacaagccacccc

SEQ ID NO: 508090 - RNA, 64 nt, Human
ucaacccggcccccaggucugcuggguccccccacccccacagcccucacagcauuccccauug

SEQ ID NO: 508091 - RNA, 64 nt, Human
gaggcacccugcagggcaaugcaugucaucccaacccccacacuccccauccuccaacccacug

SEQ ID NO: 508092 - RNA, 64 nt, Human
augaggucucguguugagauauugugugccacaacccccacagucuucaccuccgugugugaug

SEQ ID NO: 508093 - RNA, 64 nt, Human
auggguccuggcgauuauuuuaaugcuggcuacacccccacaggugacuuggauucagaaauac

SEQ ID NO: 508094 - RNA, 64 nt, Human
uccggcaaaaggaccgagcccugggguaguaaggcccccacacuccuguuuuuugcaaguacau

SEQ ID NO: 508095 - RNA, 64 nt, Human
cccaccuugccaagcuuucuucuacaaccagagccccccacaaugaugauuaaacaccugacac

SEQ ID NO: 508096 - RNA, 64 nt, Human
ucaggccccaaggggcaucucuguuuccauucuccccccacagaccugucaagagaagcaugac

SEQ ID NO: 508097 - RNA, 64 nt, Human
cagaguggccugccuaucacaaccacaucccuuccccccacaaggcaauaaaucucauuucuuu

SEQ ID NO: 508098 - RNA, 64 nt, Human
acuuggggaaggggccugggcugugaggacagggcccccacaggggaugguuucacgaguguag

SEQ ID NO: 508099 - RNA, 64 nt, Human
ucccgucuggggugugaagugcccucugcuuuuucccccacauuguuugggguucccagcaccu

SEQ ID NO: 508100 - RNA, 64 nt, Human
uuagaagaaauauaaagaaauggccacuccccaucccccacaguccuggaguaaaucaaaauca

SEQ ID NO: 508101 - RNA, 64 nt, Human
agacugaaugugggcguaagaaagcgggaagggucccccacagcaagagagagacccucccagu

SEQ ID NO: 508102 - RNA, 64 nt, Human
gggagggcccugaggacucccacccucacccccacccccacagggucagcaacugcuuccgguu

SEQ ID NO: 508103 - RNA, 64 nt, Human
cucagccaccaaaugucccugacacccuccccagcccccacagauaacaucagcugagguuuuu

SEQ ID NO: 508104 - RNA, 64 nt, Human
agugcuccccagcaggcauccacuaccccagggccccccacaugucauggcaagguugguagug

SEQ ID NO: 508105 - RNA, 64 nt, Human; identical to SEQ ID NO: 504547

SEQ ID NO: 508106 - RNA, 64 nt, Human; identical to SEQ ID NO: 504563

SEQ ID NO: 508107 - RNA, 64 nt, Human; identical to SEQ ID NO: 504564

SEQ ID NO: 508108 - RNA, 64 nt, Human
gaggggagguaagucugggggcuacgaagccgggcccccacacccuggcugaagucagcuugac

SEQ ID NO: 508109 - RNA, 64 nt, Human
accguauuuuaucuucaguggcugccugauuuuacccccacaauuaaaguugaaggaauccuga

SEQ ID NO: 508110 - RNA, 64 nt, Human
guggggcccugacaccacguuaucaaacaugcagcccccacaccccucgucugcccgcccccag

SEQ ID NO: 508111 - RNA, 64 nt, Human
uggcaacaaaagccagaguguugugggccaaguccccccacagggccucugcagggcauggccc

SEQ ID NO: 508112 - RNA, 64 nt, Human
gcagcaucuugucacugcacaacaguggccuggucccccacaggcaguuagggccccaggucag

SEQ ID NO: 508113 - RNA, 64 nt, Human
ccacugucccugacaaccccuucguccggacccucccccacacaacuaugucuggucaccagcu

SEQ ID NO: 508114 - RNA, 64 nt, Human
agaauagccauuuccagagggaaguacacacauacccccacacaccagucuuuuuggggguuuc

SEQ ID NO: 508115 - RNA, 64 nt, Human
agggauggaaaacuccuggauuuaagcucagcaucccccacaugggcuuuucgaucaucuucag

SEQ ID NO: 508116 - RNA, 64 nt, Human
ggagagagcggcagagaagcucugagagccccuucccccacaacaaaucuagcucuaguuguua

SEQ ID NO: 508117 - RNA, 64 nt, Human
agcaagaauuugagguucugacaacaguacccaucccccacaguaccccuucagcucaguuucu

SEQ ID NO: 508118 - RNA, 62 nt, Human
cugacgguggaugcucguaaccacggugacagcccccacagcccagacaugagcuacgagau

SEQ ID NO: 508119 - RNA, 64 nt, Human
agaggaccaacauccaguccugcugacuauuugacccccacaacaauggguauccuuaauagag

SEQ ID NO: 508120 - RNA, 64 nt, Human
ggugggcuuagccucuuugaaaaguucugccuugcccccacaggugggcacauccugugucuca

SEQ ID NO: 508121 - RNA, 64 nt, Human
guaauccuguggccaacaccaaugccccaaccuucccccacagcuaucuucacucucugccuuc

SEQ ID NO: 508122 - RNA, 64 nt, Human
acucugagccaucuucuuccuccaucucuuucaacccccacaggggcugccugcucuucacagc

SEQ ID NO: 508123 - RNA, 64 nt, Human
cugucucuccuucucucucuccccccaccacccacccccacacacgucaucugcauuguuauug

SEQ ID NO: 508124 - RNA, 64 nt, Human; identical to SEQ ID NO: 503535

SEQ ID NO: 508125 - RNA, 64 nt, Human; identical to SEQ ID NO: 504636

SEQ ID NO: 508126 - RNA, 64 nt, Human; identical to SEQ ID NO: 504637

SEQ ID NO: 508127 - RNA, 64 nt, Human
uuguuucucagcucuguacaaacacaaauacacacccccacaaaacuaaaaucaaaguuucacu

SEQ ID NO: 508128 - RNA, 64 nt, Human
agggcacagucuccaugugugugccaagcccuggcccccacagcgcucgauggaccucagcaag

SEQ ID NO: 508129 - RNA, 64 nt, Human
ccuggcuaccagcucucaccuacacccacgcacccccccacacacuaugcucucucaagaaugu

SEQ ID NO: 508130 - RNA, 64 nt, Human
cagccuccaaaguagcuggcacuacaaguguacacccccacacaaggcuaaguuuuguauuuuu

SEQ ID NO: 508131 - RNA, 64 nt, Human
aauagaaguccuuauguauguguuacaagaauuucccccacaacauccuuuaugacugaaguuc

SEQ ID NO: 508132 - RNA, 64 nt, Human
uucugagguugucgugugaguucuguacaaaaagcccccacaagucguccaguagaaaugcauc

SEQ ID NO: 508133 - RNA, 64 nt, Human
acucuuccguccuuaaugucuuccauggcuauugcccccacaauggucucuuuucucccugcuc

SEQ ID NO: 508134 - RNA, 64 nt, Human
cugccccaaauccagccaguccugccccagcccacccccacauuggagcccuccugcugcuuug

SEQ ID NO: 508135 - RNA, 64 nt, Human
caggcagagaugauacccaccacacaccugggggcccccacacccaguccucacccuuaacuuc

SEQ ID NO: 508136 - RNA, 64 nt, Human
cugcacaauggggaccuguguagccccaagagaucccccacauccuccgccaucccuuugcagu

SEQ ID NO: 508137 - RNA, 64 nt, Human
aagcacuaggagcucuuuuggggguguaguggugcccccacaugaacaugauggacacccuugg

SEQ ID NO: 508138 - RNA, 64 nt, Human
ucuugcacacaugccucucucccacuuuucccaacccccacauuugcaacuagaagagguugcc

SEQ ID NO: 508139 - RNA, 64 nt, Human
cuccuccaggcccccggacgcucagcccccacagcccccacagccuggcgccagggcucacagc

SEQ ID NO: 508140 - RNA, 64 nt, Human
acggcugcccuccuccaggcccccggacgcucagcccccacagcccccacagccuggcgccagg

SEQ ID NO: 508141 - RNA, 64 nt, Human
cacagugcugucugaucugugcuuuccagcucaccccccacacucacuccugagaccccuggcc

SEQ ID NO: 508142 - RNA, 64 nt, Human
cuuccccaugggaagacgaggcccucgggcccagcccccacagugcugucugaucugugcuuuc

SEQ ID NO: 508143 - RNA, 64 nt, Human; identical to SEQ ID NO: 504767

SEQ ID NO: 508144 - RNA, 64 nt, Human; identical to SEQ ID NO: 504768

SEQ ID NO: 508145 - RNA, 64 nt, Human; identical to SEQ ID NO: 504769

SEQ ID NO: 508146 - RNA, 64 nt, Human
ccagugggagguaauuaaaucaugggggugguuacccccacacugcuguucucaugauacugag

SEQ ID NO: 508147 - RNA, 64 nt, Human
gggcccccagaggaagcccucagccucugcccuccccccacacagggcgggagcccaggccugu

SEQ ID NO: 508148 - RNA, 64 nt, Human
aacuuuaguaguaaaaccucauuguguauccauucccccacagaugaacuaagaaagucaccaa

SEQ ID NO: 508149 - RNA, 64 nt, Human
aauaaaagcgaagcagacaaaaagaaccuuaccucccccacaauacaacauugggcugcugaac

SEQ ID NO: 508150 - RNA, 64 nt, Human
aaaugugaagggucuuggccucaucccucagguccccccacagcacuucccacuacugcuucug

SEQ ID NO: 508151 - RNA, 64 nt, Human
cccugagggcaucuccuggcaccucuguccccuucccccacagacuguuagagccucugcucgu

SEQ ID NO: 508152 - RNA, 64 nt, Human
gcagugccucugccagucacugucaucguugugucccccacaacuguccucuugcuagcucggc

SEQ ID NO: 508153 - RNA, 64 nt, Human
cugccagugggggauguuucuggaggcagcuggucccccacaccgcguccugcugagccugccc

SEQ ID NO: 508154 - RNA, 64 nt, Human
gggcguggguggggaaggggcucugggaccagaccccccacacuacugcgucuuuguuucuauc

SEQ ID NO: 508155 - RNA, 53 nt, Human
cgugccugacaggugacugaccacccccacacuccucccacggcuuguggcug

SEQ ID NO: 508156 - RNA, 64 nt, Human
cucuguggcccugagacaccagggaaaaucuccccccccacaggacauacuaguucccuggcag

SEQ ID NO: 508157 - RNA, 64 nt, Human
ggugauguagacaauaauuaacacagaggacuuucccccacacccagaucacaaacagccuaca

SEQ ID NO: 508158 - RNA, 64 nt, Human
aacguaagugugccuuaauugcacagagguacugcccccacaccuccugacaccuccauauacc

SEQ ID NO: 508159 - RNA, 64 nt, Human
uacacuacuuuaauccaguuccuucaaagugauacccccacagguaagcccucagcauccugaa

SEQ ID NO: 508160 - RNA, 64 nt, Human
cccacacguguccccagccugccuguggcuguuccccccacaagaagcaccucccuugcuuggc

SEQ ID NO: 508161 - RNA, 64 nt, Human
gcucagcuuccccaacacgcaggagcacacccagcccccacauccugugccuccaucagcuaaa

SEQ ID NO: 508162 - RNA, 64 nt, Human; identical to SEQ ID NO: 504107

SEQ ID NO: 508163 - RNA, 64 nt, Human; identical to SEQ ID NO: 504108

SEQ ID NO: 508164 - RNA, 64 nt, Human; identical to SEQ ID NO: 504109

SEQ ID NO: 508165 - RNA, 64 nt, Human
gaugccaacggccuucucauuuacagguuuuuuucccccacauuggccuuuauuuacuacuucc

SEQ ID NO: 508166 - RNA, 64 nt, Human
cugaaacgagaagugcccuuaaggaucaccccagcccccacagcccuggaauaaauuucgcaau

SEQ ID NO: 508167 - RNA, 64 nt, Human
ccuuuuggcaccuaaucaaauuucaaaaucccuccccccacauuuucauacuuuuccccauucu

SEQ ID NO: 508168 - RNA, 64 nt, Human
aacuugugaagaaugcccagaagaaccucagacacccccacaacuuuguacaaaugguuacugu

SEQ ID NO: 508169 - RNA, 64 nt, Human
cccaggaagggcuagggacaucggaggggaccugcccccacacccucugcucagccccuggacu

SEQ ID NO: 508170 - RNA, 64 nt, Human
cugguugcaggacuagugggaaggcggaggugggcccccacagagcccacaggcagcugcgucc

SEQ ID NO: 508171 - RNA, 64 nt, Human
gauuccacaucaugaguacuugccuuuuaacuuucccccacauuacuguugagucauggaauaa

SEQ ID NO: 508172 - RNA, 64 nt, Human
ucucggcacacccuagaguauuguacaaccaacacccccacauaacuuuguccccucuucccca

SEQ ID NO: 508173 - RNA, 64 nt, Human
gaggggaacacugcccucgcacggccccgaagggcccccacauuugugccgacacuguucuccc

SEQ ID NO: 508174 - RNA, 64 nt, Human
aguggcaugccuccucugcugcagggcucccccacccccacacggccucuaaagauguuuauuu

SEQ ID NO: 508175 - RNA, 64 nt, Human
cagauaaguggcucuuacccagcucucagugacucccccacaaaacagcaacagccuccaccgc

SEQ ID NO: 508176 - RNA, 64 nt, Human
gagaccuccgguccgagacccugccuggguucaccccccacaacccagacccagaaccgcucuc

SEQ ID NO: 508177 - RNA, 64 nt, Human
gccucuuuccagaucgcuggccccagaacccugucccccacacccaggggcacaugcacuguug

SEQ ID NO: 508178 - RNA, 64 nt, Human
auuccaaucucuucuucuuuaugcaaacacuuuucccccacaacaagccuuguuuguuccgaua

SEQ ID NO: 508179 - RNA, 64 nt, Human
cuguuucaucugacauccggauagaugccagccacccccacauuccaaggugagauuucugacu

SEQ ID NO: 508180 - RNA, 64 nt, Human
gauugcagggguccagccuugccuguuuccgaagcccccacacugccuuucgcccuacugagac

SEQ ID NO: 508181 - RNA, 64 nt, Human; identical to SEQ ID NO: 504125

SEQ ID NO: 508182 - RNA, 64 nt, Human; identical to SEQ ID NO: 504126

SEQ ID NO: 508183 - RNA, 64 nt, Human; identical to SEQ ID NO: 504127

SEQ ID NO: 508184 - RNA, 64 nt, Human
ggaauauuuuccagagucucuaaacucucaucuucccccacagauacacauccaagcucacaaa

SEQ ID NO: 508185 - RNA, 64 nt, Human
agcuaccaagacugucccuagacaaagguggagucccccacacugcccaagaccaaaucccuca

SEQ ID NO: 508186 - RNA, 64 nt, Human
acuguaaaccaugguuccagcagccuguuccacacccccacaccaucaggauagcacagggaaa

SEQ ID NO: 508187 - RNA, 64 nt, Human
ugccuuuccugcccuuccccaccaccugcacugccccccacauucucccagccccccccaagga

SEQ ID NO: 508188 - RNA, 64 nt, Human
aguccucugggagggagguucgccuaggaggugccccccacauugguguccccaugggcagcag

SEQ ID NO: 508189 - RNA, 64 nt, Human
ccccuucaggugcacuauaauggggcuggaggggcccccacaucucucagccccacuaaugcag

SEQ ID NO: 508190 - RNA, 64 nt, Human
cacacccugcccugaggggcuguccaggccuucucccccacacccucaggccgagauccgugag

SEQ ID NO: 508191 - RNA, 64 nt, Human
accagggccgcucgugggacuccacauccuccagcccccacaauccugucaggggcucccugac

SEQ ID NO: 508192 - RNA, 64 nt, Human
ucucaggucugaguuguuaccccaagcgcccuggcccccacauggugauguugacaucacuggc

SEQ ID NO: 508193 - RNA, 64 nt, Human
ucccacccacaccugccucccucuuaccccugcucccccacacugcaggaggauuugucucuaa

SEQ ID NO: 508194 - RNA, 64 nt, Human
cccuccucuucuccucaccgcauuccaccugcaucccccacaucacccugaagaugacuuccug

SEQ ID NO: 508195 - RNA, 64 nt, Human
cucucauaugcccaacacgaccacugccucccugcccccacaccugcacccaaacagacacauc

SEQ ID NO: 508196 - RNA, 64 nt, Human
ucuggugcuuguugauccaaguccccugccuggucccccacaaggacucccauccaggcccccu

SEQ ID NO: 508197 - RNA, 64 nt, Human
caacccucugcuugacuccgcacugccacuuguccccccacacccguccaccugcccagagcuc

SEQ ID NO: 508198 - RNA, 64 nt, Human
aagugcagaugaguguguguucuuccccaagguccccccacagcuccaggacaccgcuguccug

SEQ ID NO: 508199 - RNA, 61 nt, Human
uugauggaccagacaaauaggaugauggcugcccccacacaauaaaugguaacauaggaga

SEQ ID NO: 508200 - RNA, 64 nt, Human; identical to SEQ ID NO: 504143

SEQ ID NO: 508201 - RNA, 64 nt, Human; identical to SEQ ID NO: 504144

SEQ ID NO: 508202 - RNA, 64 nt, Human; identical to SEQ ID NO: 504145

SEQ ID NO: 508203 - RNA, 64 nt, Human
gagccccacagaggcagguccuggaaccaccccacccccacaccuggacgcucgcucugguggg

SEQ ID NO: 508204 - RNA, 64 nt, Human
cagguuuggaggagccccgaguggcccaggaguccccccacacacagaugcauaggccugccuu

SEQ ID NO: 508205 - RNA, 64 nt, Human
gccugggacccucugggcugcuguggcuccucugcccccacagauccuauccuccaagccagcc

SEQ ID NO: 508206 - RNA, 64 nt, Human
cagauucccuguccugagccauggucucucgggccccccacacgcguguguacacacggaccau

SEQ ID NO: 508207 - RNA, 64 nt, Human
ccacgagccaccacugccucccgcugcugcccaccccccacaaaaaggaaaaaaugaaugaggu

SEQ ID NO: 508208 - RNA, 64 nt, Human
gucccccacuccugccugcuucccggugagcugccccccacacgugcagcccgggcugccucca

SEQ ID NO: 508209 - RNA, 64 nt, Human
ccuccguguguuagacucuuguccuucuguccugcccccacagcugcugcucacuuauccugcc

SEQ ID NO: 508210 - RNA, 64 nt, Human
cacauuuaugcacuuuguaucacccuccgaacuccccccacaccuucccuucccuggauuucau

SEQ ID NO: 508211 - RNA, 64 nt, Human
uaccgaauccugacugcaaggcccaccugccccucccccacagagccuccagagcuagcugagg

SEQ ID NO: 508212 - RNA, 64 nt, Human
gacauucccagaacuaccgccagguggcgccaggcccccacagucuguggccguggucuuagcc

SEQ ID NO: 508213 - RNA, 64 nt, Human
acugggccccguuucuaggaaguaccagccccaucccccacaguccagcuccggggaaggggcu

SEQ ID NO: 508214 - RNA, 64 nt, Human
acaggaagccuucacacuggaagggggaccugcgcccccacaucugaaaccuguaggucccccc

SEQ ID NO: 508215 - RNA, 64 nt, Human
agccucaccaaaguguugggauuacuggugugagcccccacaccuggccgagccagcgcuucuc

SEQ ID NO: 508216 - RNA, 64 nt, Human
gaacugcucacccugccuuuuucugggggcugagcccccacaaccugucuuuuccaaguggaua

SEQ ID NO: 508217 - RNA, 64 nt, Human
agagcugugcagggaggaaggggugagaggggggcccccacaccuagacucaguaaggaagucg

SEQ ID NO: 508218 - RNA, 64 nt, Human
gaguggcccuccagguggcagcacuaaggacacccccccacaacaagaguuagcagcgaggucc

SEQ ID NO: 508219 - RNA, 64 nt, Human; identical to SEQ ID NO: 504161

SEQ ID NO: 508220 - RNA, 64 nt, Human; identical to SEQ ID NO: 504162

SEQ ID NO: 508221 - RNA, 64 nt, Human; identical to SEQ ID NO: 504163

SEQ ID NO: 508222 - RNA, 64 nt, Human
guugcuacugugcaaugcauaccuccucaacacccccccacacucaguaaagaauuuuccaacc

SEQ ID NO: 508223 - RNA, 64 nt, Human
ugagagacugccucugcuucauaggauaccagaucccccacagucuuccaaguaggaaacuucc

SEQ ID NO: 508224 - RNA, 64 nt, Human
gccugcgcucuccagauaugaccccugcacccaccccccacagccugcccuaccccaccuaccc

SEQ ID NO: 508225 - RNA, 64 nt, Human
agacuacuagaaagaaacgacacccuuccccaagcccccacagcuacuccaacccaaacaacaa

SEQ ID NO: 508226 - RNA, 64 nt, Human
cuacucacucuuaaucaaaguguggaggagguggcccccacagcaggguuuggaaccuacagac

SEQ ID NO: 508227 - RNA, 64 nt, Human
uuacaguguauuaccuuccuucccuccucuucuccccccacacccaacaaaauacaguuuggaa

SEQ ID NO: 508228 - RNA, 64 nt, Human
uuguucuuauauaagaucacugaagaaagaggaacccccacaacccccuccacaaagagaccag

SEQ ID NO: 508229 - RNA, 64 nt, Human
acugcuuucugcuuuucucccaccccuccuagcacccccacaucccccaucuaguaacaucuca

SEQ ID NO: 508230 - RNA, 64 nt, Human
gauuugcauaugaaaggagagcaucggccuagggcccccacaguugcucuaugcuuuccaaacc

SEQ ID NO: 508231 - RNA, 64 nt, Human
uggcugcucuuaaggugggggauagaggaugccucccccacagacccuaccccaagaccccuag

SEQ ID NO: 508232 - RNA, 64 nt, Human
cagcagaagccucuuucuccucucugcccccugccccccacaccacaccuguaggggaccuguc

SEQ ID NO: 508233 - RNA, 64 nt, Human
gguggggaagggagggucucuugauuccuaaccgcccccacauacugcuccaccgcugaacuuc

SEQ ID NO: 508234 - RNA, 64 nt, Human
gauugcucuuaaaauguauucaguuauuuaguggcccccacaggaguggagucuugaaaucuaa

SEQ ID NO: 508235 - RNA, 64 nt, Human
ugccuggcauuuaggcagcagagccccugaccgucccccacagggcucugccucacguccucau

SEQ ID NO: 508236 - RNA, 64 nt, Human
augcuaaucgugguuucggggugagaauaaaacacccccacauaacaugcauuugcaugggccc

SEQ ID NO: 508237 - RNA, 64 nt, Human
ucccaccucugaagacuccagugacugcugccuccccccacaagaacucccuucuccccucagc

SEQ ID NO: 508238 - RNA, 64 nt, Human; identical to SEQ ID NO: 504197

SEQ ID NO: 508239 - RNA, 64 nt, Human; identical to SEQ ID NO: 504198

SEQ ID NO: 508240 - RNA, 64 nt, Human; identical to SEQ ID NO: 504199

SEQ ID NO: 508241 - RNA, 64 nt, Human
guccccaguggggcagcccuccccacagacgagccccccacauggugccgcggcacgucccccc

SEQ ID NO: 508242 - RNA, 64 nt, Human
acagcccuaccccgccccaguaucaugcgauggucccccacaccgguucccugaaccccucuug

SEQ ID NO: 508243 - RNA, 64 nt, Human
ucuaaccugcugugucacccgcuuucccucccagcccccacauccuuaccauuuucccucccug

SEQ ID NO: 508244 - RNA, 64 nt, Human
aaaagcaucuuuuuuguuauuuguuugcaucccucccccacacccugguguuuuaaaaugaaga

SEQ ID NO: 508245 - RNA, 62 nt, Human
uggugagauuuaacauuuagaggugacagcaucccccacacuggcagugaauuuuuugugcu

SEQ ID NO: 508246 - RNA, 64 nt, Human
ucugggagauacucugcaaguugaccuggccucucccccacaggaacaaaacacugccuccaga

SEQ ID NO: 508247 - RNA, 64 nt, Human
ugcaacuucuguauccuuccuuccccuccacccucccccacaaaauucaagggaaaguaaaggg

SEQ ID NO: 508248 - RNA, 64 nt, Human
agaggacccugagaggagacgggcugggcggcgacccccacagggcucucgagaacagauucuc

SEQ ID NO: 508249 - RNA, 64 nt, Human
cugcccauaaccugcuaaggucagggcccagggccccccacagcauggcugagggaccccuucc

SEQ ID NO: 508250 - RNA, 64 nt, Human
ccaguggaaacacagccucacacugcccuuccgccccccacacuuugccugcaggugcaccgaa

SEQ ID NO: 508251 - RNA, 64 nt, Human
cuuugucuaggacccagaucauccccagagagagcccccacaagcuccucaggaaacaggauug

SEQ ID NO: 508252 - RNA, 64 nt, Human
ccccuccuuggcauucaugggggagcccaggaaccccccacaccuaugggguuagagcuccucc

SEQ ID NO: 508253 - RNA, 64 nt, Human
gaaggacaaacaaccaagaguggcccaguccccacccccacaucuagcucagucucaaaucuga

SEQ ID NO: 508254 - RNA, 64 nt, Human
ccccauuuccaaggccccccucccucuccagguccccccacagcaauaaaagcuucccccugau

SEQ ID NO: 508255 - RNA, 64 nt, Human
ggagggagaacccaaagagacagcucuucuacuacccccacagaccugcucuggacacuugcuc

SEQ ID NO: 508256 - RNA, 64 nt, Human
agauccaguacucuguguaccugcuccagccccacccccacagagagaacuuguggcucugggg

SEQ ID NO: 508257 - RNA, 64 nt, Human; identical to SEQ ID NO: 504215

SEQ ID NO: 508258 - RNA, 64 nt, Human; identical to SEQ ID NO: 504216

SEQ ID NO: 508259 - RNA, 64 nt, Human; identical to SEQ ID NO: 504217

SEQ ID NO: 508260 - RNA, 64 nt, Human
cuuaagcacuucugaacuuggguuucaugccugccccccacaaauuauguuuagaagcagcacu

SEQ ID NO: 508261 - RNA, 64 nt, Human
uuauauuaacuacaggauaauauuagccuuauuacccccacaagauuuuuuaaaacuugaggua

SEQ ID NO: 508262 - RNA, 64 nt, Human
ccagccgcauuucagcagugccuucugggguguccccccacacccugcuuuggccccagaggcg

SEQ ID NO: 508263 - RNA, 64 nt, Human
gaccccaggggaaagcaaagggcgucucagggaacccccacauucucucacugaaguuucccac

SEQ ID NO: 508264 - RNA, 64 nt, Human
ccugaggguucagguacagcaaggagagcuccaucccccacaguccaucuccauucggggucac

SEQ ID NO: 508265 - RNA, 64 nt, Human
aacacgcacggcacugaccccaccuccgcccggacccccacagaccucgggaaggcgcugggcc

SEQ ID NO: 508266 - RNA, 64 nt, Human
ggcuaaagauuuuccaaaucuggugaaaacaauacccccacauauucaagaagcucaaaugacc

SEQ ID NO: 508267 - RNA, 64 nt, Human
gcccaguccugccgccguguccaggcgccccucacccccacaccugcugcauggcuggccacac

SEQ ID NO: 508268 - RNA, 64 nt, Human
auaauaauacaauauuuaaacaucaucucacccacccccacaaggggagaaaaaguaggggaag

SEQ ID NO: 508269 - RNA, 64 nt, Human
aauuuauuuuucuacacuucaauaugaacugccccccccacauuaauauaaaaacuacuaaugc

SEQ ID NO: 508270 - RNA, 64 nt, Human
ugcuugugaccuugacuugccaugaaggcaccugcccccacagcuccuugcaaacuaugaguuc

SEQ ID NO: 508271 - RNA, 64 nt, Human
ucacacguagcuccucaggccauuccccaugagucccccacacccaccccauccucggucuuug

SEQ ID NO: 508272 - RNA, 64 nt, Human
cgccugccuggccgcaggugguucucccugaagacccccacaugugccauaucccugugggcgg

SEQ ID NO: 508273 - RNA, 64 nt, Human
ccaccuccaaggagaggcuccucagugugcaccucccccacauccguccucucugccggccccg

SEQ ID NO: 508274 - RNA, 64 nt, Human
ucuacugcagaggguuagaggcacuugagcaaggcccccacaucccaacucugggaguuguggu

SEQ ID NO: 508275 - RNA, 64 nt, Human
gagaucuuguuguuucaaaguauguggcacucgccccccacacucucuugcuccugccuucgcc

SEQ ID NO: 508276 - RNA, 64 nt, Human; identical to SEQ ID NO: 504233

SEQ ID NO: 508277 - RNA, 64 nt, Human; identical to SEQ ID NO: 504234

SEQ ID NO: 508278 - RNA, 64 nt, Human; identical to SEQ ID NO: 504235

SEQ ID NO: 508279 - RNA, 64 nt, Human
acugucuucuggaaggugcuguuugccugugugccccccacagaguacugccacggcugggccu

SEQ ID NO: 508280 - RNA, 64 nt, Human
caacuggcagggccugaucagaggcagaaaaugacccccacaguggucuuuucccugcuagaga

SEQ ID NO: 508281 - RNA, 64 nt, Human
uggcacuacaccuucguaacugcuguucccacugcccccacaacacuccaaucuccaccuuccu

SEQ ID NO: 508282 - RNA, 64 nt, Human
uggcaggggagcagguuccccaagggcccuggcacccccacaagcugucccugcagggccaucu

SEQ ID NO: 508283 - RNA, 64 nt, Human
uggaagauguggggugcugggugagaggcaucagcccccacaaguauguuuuugugucuuaaga

SEQ ID NO: 508284 - RNA, 64 nt, Human
cuccuccccagcccuguaggccugaggggagggucccccacaccacgguguccacccggccccg

SEQ ID NO: 508285 - RNA, 64 nt, Human
cccccuuggcugggacgucugggguccuguggggcccccacaauggucccaaacagcugccucu

SEQ ID NO: 508286 - RNA, 64 nt, Human
uccaucccugcacccugguccucucccagccucucccccacauugucccugacucuaggggcac

SEQ ID NO: 508287 - RNA, 64 nt, Human
agucagaagccaaguggaucaucuguguccccuucccccacaaucccuccuuuuucuaguaaaa

SEQ ID NO: 508288 - RNA, 64 nt, Human
acucuaugggaaacucuucagcaccuaccugcgccccccacacaccucucgaggcaccucccag

SEQ ID NO: 508289 - RNA, 64 nt, Human
uuuuccuuuuggccagauagcuagguuucugguucccccacaguagguguuuucacauaagauu

SEQ ID NO: 508290 - RNA, 64 nt, Human
gggaagucauuaguugaacuauuuucacauuggccccccacacaggccacucucuucccuuucu

SEQ ID NO: 508291 - RNA, 64 nt, Human
ucauaucugcuaaagcgaauccugggcucacugccccccacaggcacuguggccacugccagca

SEQ ID NO: 508292 - RNA, 64 nt, Human
cuuacuuugucccaugcuacugauuggcacguggcccccacaauggcacaauaaagccccuuug

SEQ ID NO: 508293 - RNA, 64 nt, Human
ugacuuugggcaaaucauuucacuccucaaagcccccccacacaagcuggauucccacuucuua

SEQ ID NO: 508294 - RNA, 64 nt, Human
cuggggcaggggcugugcacagacggaccccccacccccacacgcacuuuaugagggagacccc

SEQ ID NO: 508295 - RNA, 64 nt, Human; identical to SEQ ID NO: 504806

SEQ ID NO: 508296 - RNA, 64 nt, Human; identical to SEQ ID NO: 504807

SEQ ID NO: 508297 - RNA, 53 nt, Human; identical to SEQ ID NO: 503482

SEQ ID NO: 508298 - RNA, 64 nt, Human
aaggucaguuuucccccagagcccgggucccugucccccacagggcaggcggggucccuggagc

SEQ ID NO: 508299 - RNA, 64 nt, Human
aaacaccacugcuuccuacccagguggcgacugccccccacaccuucccugccccguccugagu

SEQ ID NO: 508300 - RNA, 64 nt, Human
ggaccuacucucccuccuccccaccauuccucuucccccacauguguggcacgcugcagcccuc

SEQ ID NO: 508301 - RNA, 64 nt, Human
gccugucaguugugugugucccuuauagucccuucccccacagcucuugcugaaagaguuugcc

SEQ ID NO: 508302 - RNA, 64 nt, Human
gagaggucacaggucagcaaaaacagucaaaaaacccccacagauuuugaauaaaggaucuacu

SEQ ID NO: 508303 - RNA, 64 nt, Human
agccucccaaguagcugagacuacagguucacaccccccacaccuggcuuauuuuguauguuuu

SEQ ID NO: 508304 - RNA, 64 nt, Human
accccagcccccugaacccccuucauggacagaucccccacagccuggggcagaagaggcgucg

SEQ ID NO: 508305 - RNA, 64 nt, Human
ucaggcagagcuguggcacagacccccguccugucccccacacccgugucaugugucuguuuau

SEQ ID NO: 508306 - RNA, 64 nt, Human
cccucucccaggacccaucacgccugugcaguggcccccacagaaagacugagcucaagguggg

SEQ ID NO: 508307 - RNA, 64 nt, Human
cugaggucauggaaccugggaacagaagccucaacccccacaagaccaagcaucacauggagug

SEQ ID NO: 508308 - RNA, 64 nt, Human
gcagggaggguaagggcuggcuccagauaccccucccccacagauuccuagcaaugaaaaucua

SEQ ID NO: 508309 - RNA, 64 nt, Human
aguccgacugcccuccccaccccacccccgccaccccccacaugugaccacugcaacgaagaca

SEQ ID NO: 508310 - RNA, 64 nt, Human
uguccccacagucagccuccugucccugcuggugcccccacacccaccuacccugugcuuuuug

SEQ ID NO: 508311 - RNA, 64 nt, Human
ggcacauggcccaggcagcugucaauucucaugucccccacauggcccaaggugggcaucuuga

SEQ ID NO: 508312 - RNA, 64 nt, Human
cuugggcagugggggugcuccugucuguccuuuucccccacacccuggacugugcuuggcuguu

SEQ ID NO: 508313 - RNA, 64 nt, Human; identical to SEQ ID NO: 508299

SEQ ID NO: 508314 - RNA, 64 nt, Human; identical to SEQ ID NO: 504824

SEQ ID NO: 508315 - RNA, 64 nt, Human; identical to SEQ ID NO: 504825

SEQ ID NO: 508316 - RNA, 64 nt, Human; identical to SEQ ID NO: 504826

SEQ ID NO: 508317 - RNA, 64 nt, Human
aaucgccaccugugccuuuccucuggcccugcugcccccacacccaacuccgagggcccacgcu

SEQ ID NO: 508318 - RNA, 64 nt, Human
gugacuugugucuauugaaaguauauccguuuuccccccacauggggauucauacuugagaaau

SEQ ID NO: 508319 - RNA, 64 nt, Human
gccugguccacagagagacacugucacccccuuucccccacaagacuggcagaggcugggcagc

SEQ ID NO: 508320 - RNA, 64 nt, Human
uugcaccagggugaggccugacucacgcugcuuccccccacaggcccugcuuugcuugccugcu

SEQ ID NO: 508321 - RNA, 64 nt, Human
gcaguaucaccagaagacauuagggggcaguaggcccccacacaaaaccuucaggcuugaauuu

SEQ ID NO: 508322 - RNA, 64 nt, Human
cugcacagggagagcaguugaggcccgggcagggcccccacaccagaccccaacauagcuuccc

SEQ ID NO: 508323 - RNA, 64 nt, Human
ggugcaugugugugcacacacacacacacacacacccccacaccccuuugccgguuccucgacu

SEQ ID NO: 508324 - RNA, 54 nt, Human
ccccuguuauccuggucuaauaaccccccacacauacaccucuggugaccuauu

SEQ ID NO: 508325 - RNA, 64 nt, Human
gcagcagcgucaguggacccagugcugagaaaagcccccacaucccggaaaacccacuuuccuu

SEQ ID NO: 508326 - RNA, 64 nt, Human
ucuuucuuucuuuuuuucuuuuuuaaaguaauuucccccacaguaaaauacacugacuccugag

SEQ ID NO: 508327 - RNA, 64 nt, Human
uccucacagggugccugugagaaaggacauuuuacccccacaucauagucacaucacugacucc

SEQ ID NO: 508328 - RNA, 64 nt, Human
agagaaggggcagagcugggggcugagggagacccccccacaccccuucucuccuuccucucgu

SEQ ID NO: 508329 - RNA, 64 nt, Human
cucugccccuggauggugcggggugcuuucuccacccccacacucccugcucagcuccucgugc

SEQ ID NO: 508330 - RNA, 64 nt, Human
ccuccagugaauucagaacagaagccauguaucucccccacaccagggcccaccauggagcuug

SEQ ID NO: 508331 - RNA, 64 nt, Human
uuugcucgcuuuccuccccugccggcccccuccgcccccacacacacucgggacgucuucauug

SEQ ID NO: 508332 - RNA, 64 nt, Human
gccacuacucaccaguguuguucaccaacacccacccccacacacaccaacauuuugcugccua

SEQ ID NO: 508333 - RNA, 64 nt, Human; identical to SEQ ID NO: 504844

SEQ ID NO: 508334 - RNA, 64 nt, Human; identical to SEQ ID NO: 504845

SEQ ID NO: 508335 - RNA, 64 nt, Human; identical to SEQ ID NO: 503483

SEQ ID NO: 508336 - RNA, 64 nt, Human
acggacauuccaaagaccuccagagaccaccccacccccacauuccuuugaccagccuugugag

SEQ ID NO: 508337 - RNA, 64 nt, Human
uggcauuugcugaccgaaugcucauagagguugacccccacagggucacgcaggacucggacac

SEQ ID NO: 508338 - RNA, 64 nt, Human
auauguaaaucaagacucacaucccuuuccuagucccccacauccaaagccccucagccugccu

SEQ ID NO: 508339 - RNA, 64 nt, Human
augcaggcugcuguacccgcucugccucaagcaucccccacacagggcucugguuuucacucgc

SEQ ID NO: 508340 - RNA, 64 nt, Human
accugccacgggagggggcccccaaacuuucuuccccccacacuucugguuuucuguguggagg

SEQ ID NO: 508341 - RNA, 64 nt, Human
guccugagcccgugucauucuuccaaccucccugcccccacacacuuaucccagacacaacacc

SEQ ID NO: 508342 - RNA, 64 nt, Human
aaggauggggaggugggggggcaggagcuucugucccccacauuccaugcaccuccccucugua

SEQ ID NO: 508343 - RNA, 64 nt, Human
gacccucguacccaaaggccccugccccacuucucccccacaaagcggggucucaagccacacu

SEQ ID NO: 508344 - RNA, 64 nt, Human
acuugugcaccugucuuacauucucuguugcucccccccacacucuugcucagucugucaccug

SEQ ID NO: 508345 - RNA, 64 nt, Human
cuuccccuccuccccuauuuaaaccacucugucucccccacaacccuccccuggcccucugauu

SEQ ID NO: 508346 - RNA, 60 nt, Human
gcaggaccuccuccugcugagaccccaaugcccccacagagcaauacacugaagccuaaa

SEQ ID NO: 508347 - RNA, 64 nt, Human
ucuuagauugaaucuggccuccaaauauaugcuccccccacauuuuaccucucuaccaaaugaa

SEQ ID NO: 508348 - RNA, 64 nt, Human
gggggcugggcuggggguuagggcugggacugugcccccacacugcgccucagcuucccaucuc

SEQ ID NO: 508349 - RNA, 64 nt, Human
aggaauucagcucagcuucuuccuagguccaagccccccacaccuuuuccccaaccacagagaa

SEQ ID NO: 508350 - RNA, 64 nt, Human
uggggccugggccccggaaaaaucuaucugcccucccccacacuuuauauacgaauaaacgcag

SEQ ID NO: 508351 - RNA, 64 nt, Human
uccaaggaagagagcccaaggguaggggagaaaccccccacaacugaccccugccucccugugc

SEQ ID NO: 508352 - RNA, 64 nt, Human; identical to SEQ ID NO: 504938

SEQ ID NO: 508353 - RNA, 64 nt, Human; identical to SEQ ID NO: 504939

SEQ ID NO: 508354 - RNA, 64 nt, Human; identical to SEQ ID NO: 504940

SEQ ID NO: 508355 - RNA, 64 nt, Human
ccggugcccaccaugagcucccagcaccugacuccccccacauccaagggcagccuggaaccag

SEQ ID NO: 508356 - RNA, 64 nt, Human
agcaccaggacgcccucgagguugcucugggauccccccacagccccuggucagucugcccuug

SEQ ID NO: 508357 - RNA, 64 nt, Human
gugggcccagaggcccacagggacgcccaccugccccccacagaggcuggugguugagaugccc

SEQ ID NO: 508358 - RNA, 64 nt, Human
aaacuuccacccccgacggcuccugcugacagggcccccacaggugggaaagacgggcuccuau

SEQ ID NO: 508359 - RNA, 64 nt, Human
acuuuggggguagacccugaagccccuccuccuucccccacagauggggacaggaggugauggg

SEQ ID NO: 508360 - RNA, 64 nt, Human
ucuagucugaucugauccacugacagauucaccucccccacaucccuagacagggauggaaugu

SEQ ID NO: 508361 - RNA, 64 nt, Human
uagccucccagguagcugggacuacaagcgugugcccccacagccagcuaauuuuuguauuuuu

SEQ ID NO: 508362 - RNA, 64 nt, Human
cuggaaauguagcacuuacguaaaacauuuguuucccccacaguuuuaauaagaacagaucagg

SEQ ID NO: 508363 - RNA, 64 nt, Human
cgaaaaugaucuuuacaauguaucccagcuuucacccccacauggcaaugcagaguuguauuua

SEQ ID NO: 508364 - RNA, 64 nt, Human
agugcccccaccguggccccccacgccccauuaacccccacacccccauuccgcgcaauaaacg

SEQ ID NO: 508365 - RNA, 64 nt, Human
uccacagugggguucacacccagggcuccuuggucccccacaaccugccccggccaggccugca

SEQ ID NO: 508366 - RNA, 58 nt, Human
ugaaggccaagacacagugacacagccacccccacagccggagcccccgccgcuccac

SEQ ID NO: 508367 - RNA, 64 nt, Human
gagagggcauggaggcuccauacaaccucuuccacccccacaucuuucuuuguccuauacaugu

SEQ ID NO: 508368 - RNA, 64 nt, Human
agaugcugcuaagucggcuccagcacacaggagccccccacaacgaagaguuagugcccccaaa

SEQ ID NO: 508369 - RNA, 64 nt, Human
aucuuccugccccgcuuuccucucccauccucaucccccacacugggauagaugcuuguuugua

SEQ ID NO: 508370 - RNA, 64 nt, Human
accacucccccacccugaccgugcugaacagacccccccacacgagagaaaauaaaggagcaau

SEQ ID NO: 508371 - RNA, 64 nt, Human; identical to SEQ ID NO: 505072

SEQ ID NO: 508372 - RNA, 64 nt, Human; identical to SEQ ID NO: 505073

SEQ ID NO: 508373 - RNA, 64 nt, Human; identical to SEQ ID NO: 503499

SEQ ID NO: 508374 - RNA, 64 nt, Human
ugacauaugccaacacggggucugggugggggcucccccacauccuuuccuugccuaugagcug

SEQ ID NO: 508375 - RNA, 64 nt, Human
uccaaaccccgaagugaaacccgccaccggguuacccccacaagggggccgcugcgagaaguuc

SEQ ID NO: 508376 - RNA, 64 nt, Human
gccauggccucugcuagcuccaccuugaaggagccccccacauccuccccuacaucccagagau

SEQ ID NO: 508377 - RNA, 64 nt, Human
uguuauuuauugcuacuuccugccuggucuccugcccccacaccuggcccuggggccuguacaa

SEQ ID NO: 508378 - RNA, 64 nt, Human
uuuuauuuaagagguggggucccaggugggaacccccccacaauaaagucugucaauguuugga

SEQ ID NO: 508379 - RNA, 62 nt, Human
agauguacgaacgacagugauguucccagguccccccacaccaguaaacaucccccagcucc

SEQ ID NO: 508380 - RNA, 64 nt, Human
gcuccccagaguaucuucccacugagacacgccgcccccacagaggcacaguccccagccaccu

SEQ ID NO: 508381 - RNA, 64 nt, Human
uuccuucuagggagcacccucccaccccccaccccccccacacacaccaucuuuccaucccagg

SEQ ID NO: 508382 - RNA, 64 nt, Human
ccacagggauccccaggaugcccacuucccuccacccccacaccccagccgugucccuaacccc

SEQ ID NO: 508383 - RNA, 64 nt, Human
ugcagcacauguguuacaugucaggcagugaaaccccccacagcagccuucccucucagaggau

SEQ ID NO: 508384 - RNA, 64 nt, Human
agacugagcccugcuggcggacuucaaggagaagcccccacaggggauuuugcuccuagaguaa

SEQ ID NO: 508385 - RNA, 64 nt, Human
ggcaacguguucccguguccuggccccucacgggcccccacacucuccugaccgugagggcacu

SEQ ID NO: 508386 - RNA, 64 nt, Human
gagcaaacacuggccucugguguccacccuccaacccccacaagucccucuuuggggagacacu

SEQ ID NO: 508387 - RNA, 64 nt, Human
ccuggugcuauugggguggggagcucccuccccucccccacaccagaaagggguauguuggggg

SEQ ID NO: 508388 - RNA, 64 nt, Human
gcaggacaaacgccccugcccugccagaauccggcccccacagcucucacggcugcugcuccuc

SEQ ID NO: 508389 - RNA, 64 nt, Human
gugguaccaaaaugcauccccaugacccacagcccccccacacccguccuuggguaggguacgg

SEQ ID NO: 508390 - RNA, 64 nt, Human; identical to SEQ ID NO: 504359

SEQ ID NO: 508391 - RNA, 64 nt, Human; identical to SEQ ID NO: 504360

SEQ ID NO: 508392 - RNA, 64 nt, Human; identical to SEQ ID NO: 504361

SEQ ID NO: 508393 - RNA, 62 nt, Human
cccagccagagagcaccuagccuucuuuggggcccccacaggcccuuugugcagugaacagc

SEQ ID NO: 508394 - RNA, 64 nt, Human
gagggacccggagcccguccccccaaucccucaccccccacaccucagccacuggagacugaug

SEQ ID NO: 508395 - RNA, 64 nt, Human
caccuuugaccuugccucaccuuucaccccccaccccccacagcgucagcuccuaccucugacc

SEQ ID NO: 508396 - RNA, 64 nt, Human
gagagggcauggaggcuccacgcaaccccuuccacccccacaucuuccuuugucuuauacaugg

SEQ ID NO: 508397 - RNA, 64 nt, Human
cacagugccaagaggccccagggcccagggacuccccccacagcagggugggacccgggacccg

SEQ ID NO: 508398 - RNA, 64 nt, Human
agacagcaagaagcugcaaugugcaaucccccugcccccacagccaaggucaggaagaggcccu

SEQ ID NO: 508399 - RNA, 64 nt, Human
uguuauuacgcaccaguugggguucacccuucaucccccacauuuaauugucugauauagaaua

SEQ ID NO: 508400 - RNA, 64 nt, Human
ccuuggcgucacggugggcuggaggcagcccccccccccacaacacuugaggccaaaggacacc

SEQ ID NO: 508401 - RNA, 64 nt, Human
auauguugaaaccuuacccccgugcccccccucucccccacaaugugaugguauuuggaggccc

SEQ ID NO: 508402 - RNA, 64 nt, Human
cacugacuuugccuugaacagaccccccgacccucccccacaagccuuuaauugagagccgcuc

SEQ ID NO: 508403 - RNA, 64 nt, Human
gacaggaccagacuguuggugacuccuuccccggcccccacagcaguaucagaaacuucugaca

SEQ ID NO: 508404 - RNA, 64 nt, Human
cuccccgcugccccccacgacccuaccuugaaggcccccacaaauaaaggcgcugccacucagc

SEQ ID NO: 508405 - RNA, 64 nt, Human
caggggugcuuuugcuacuuugguuguggucacucccccacaccugccugccuccuucacggac

SEQ ID NO: 508406 - RNA, 64 nt, Human
uguacagucucgcccuuggaagacugagcugggacccccacagccauccgcuggcuuggccagc

SEQ ID NO: 508407 - RNA, 64 nt, Human
caacagggccccgggagggaacccugcccccaaccccccacagcaaggcuguacagucucgccc

SEQ ID NO: 508408 - RNA, 64 nt, Human
aaccccuucacaaaccccaacaccccugacuuggcccccacagagagagguccuacagcuguca

SEQ ID NO: 508409 - RNA, 64 nt, Human; identical to SEQ ID NO: 504251

SEQ ID NO: 508410 - RNA, 64 nt, Human; identical to SEQ ID NO: 504252

SEQ ID NO: 508411 - RNA, 64 nt, Human; identical to SEQ ID NO: 504253

SEQ ID NO: 508412 - RNA, 64 nt, Human
ucccgcugagagccacuuucaucggcaauaaaaucccccacauuuaccaucuucaauucguuca

SEQ ID NO: 508413 - RNA, 64 nt, Human
caugauccagaacugaggucacuggguucuagaacccccacauuuaccucgaggcucuuccauc

SEQ ID NO: 508414 - RNA, 64 nt, Human
uagccuaucuccugugccccugacugagcagaagcccccacagcuggccagcagccccgccuga

SEQ ID NO: 508415 - RNA, 64 nt, Human
cugaccccaugucuccuggacucagggucugcuucccccacauugggcugaccgugucucucua

SEQ ID NO: 508416 - RNA, 64 nt, Human
cacgauggcccccauugcccucaucacccugacacccccacauucucuccucuggacccccagg

SEQ ID NO: 508417 - RNA, 64 nt, Human
ccccuccuaaagcuuuagacucagagcccagggucccccacaagccucaagguagccucagguu

SEQ ID NO: 508418 - RNA, 64 nt, Human
cauuauuauuuuaccaaguaaacucacuccuuuucccccacagggguuacacccaucugguugu

SEQ ID NO: 508419 - RNA, 64 nt, Human
ucuccagcacuuccugggcagccacggcccccuccccccacauugccacauaccuggaggcuga

SEQ ID NO: 508420 - RNA, 64 nt, Human
uccaaguaauauaauggaagagaaaucucauacucccccacaguuugaugucauuaauguguug

SEQ ID NO: 508421 - RNA, 64 nt, Human
gugcgcaugugguagaaggugugcgcucgugccucccccacagaaaggcuuuguugguuucuac

SEQ ID NO: 508422 - RNA, 64 nt, Human
gaugacgucaucaucacauucagggcuauuuuuucccccacaaacccaagggcaggggccacuc

SEQ ID NO: 508423 - RNA, 64 nt, Human
ccguaguagcaaaaacauaaaacaaauaaaacuucccccacaucacagaugauuuuggacaaga

SEQ ID NO: 508424 - RNA, 64 nt, Human
gugugugucuuuaacuugcgucccauucucagggcccccacaucagugucucguuuacaucuca

SEQ ID NO: 508425 - RNA, 64 nt, Human
ccacucaggggaccccacuccccucacacacacccccccacaaggaacccucaggccacccucc

SEQ ID NO: 508426 - RNA, 64 nt, Human
auccccacguugagcugucuagcaugagcacccacccccacagcgcccugcacccggccgcugc

SEQ ID NO: 508427 - RNA, 64 nt, Human
caggccuauucgcugcacuuccugccaaacuuugcccccacaagccuggucaucagccaggcag

SEQ ID NO: 508428 - RNA, 64 nt, Human; identical to SEQ ID NO: 504378

SEQ ID NO: 508429 - RNA, 64 nt, Human; identical to SEQ ID NO: 504379

SEQ ID NO: 508430 - RNA, 64 nt, Human; identical to SEQ ID NO: 503500

SEQ ID NO: 508431 - RNA, 64 nt, Human
cagggaaacagggccagcacagaggggccuuccucccccacagagcccccaugacauagucugc

SEQ ID NO: 508432 - RNA, 64 nt, Human
aggccuuaggucuggccauucacacacacacacacccccacaccccacucccacacacaguucc

SEQ ID NO: 508433 - RNA, 64 nt, Human
auggagcccaggccacauggaugaugaugauucucccccacagguucgaaccucugacaugggu

SEQ ID NO: 508434 - RNA, 64 nt, Human
cccaugacuggugacuguuuaaugagcugugcaucccccacaaaaacaugagugccccucugug

SEQ ID NO: 508435 - RNA, 64 nt, Human
ccauguccaaggucugacagcuccccacuggcugcccccacaggggcuuuaggcuggucugggu

SEQ ID NO: 508436 - RNA, 64 nt, Human
cuaguuuucuagaauuuaucacacuucugugagacccccacaccucaguucccuuggccucaga

SEQ ID NO: 508437 - RNA, 50 nt, Human
uccaucaagcauuccaguagcccccacagaggcccucagcucaguuuuug

SEQ ID NO: 508438 - RNA, 64 nt, Human
caccggucucugcugaggcucccagccucaguuucccccacagcagcacgggccccacugugcu

SEQ ID NO: 508439 - RNA, 64 nt, Human
cccaggggcacauugaacaggaggacggggcucucccccacaguggggaagcagaacggggaga

SEQ ID NO: 508440 - RNA, 64 nt, Human
gacuguggugaggucacuagauucuacugcucuucccccacauuaauaccuuuuccuuccucag

SEQ ID NO: 508441 - RNA, 64 nt, Human
cuggcuggacuggaggcuggguggccggcccugccccccacauucuggcuccaccgggagggac

SEQ ID NO: 508442 - RNA, 64 nt, Human
aguguccucugauccuguccggugccucccccaacccccacacccaugcagaacucccagguca

SEQ ID NO: 508443 - RNA, 64 nt, Human
agagaaggggaggaggacuccagcugggcucggucccccacagucagggacccccauaaaggac

SEQ ID NO: 508444 - RNA, 64 nt, Human
gcccaccgcugcccugucuguugcgacacccucccccccacauacacacgcagcguuuugauaa

SEQ ID NO: 508445 - RNA, 64 nt, Human
cagcucgcgaggcaccucuccucguccccacccacccccacauuugcacaccuuccacaggguc

SEQ ID NO: 508446 - RNA, 64 nt, Human
ccuccccaccuggcccucccaggacagcucucgccccccacaaaggggcaugggccuccagccu

SEQ ID NO: 508447 - RNA, 64 nt, Human; identical to SEQ ID NO: 504395

SEQ ID NO: 508448 - RNA, 64 nt, Human; identical to SEQ ID NO: 504396

SEQ ID NO: 508449 - RNA, 64 nt, Human; identical to SEQ ID NO: 504397

SEQ ID NO: 508450 - RNA, 64 nt, Human
gaggcuccuuucugccuccauggcuauccauccacccccacagaccccguuccuccagccugcg

SEQ ID NO: 508451 - RNA, 64 nt, Human
gaucuggggcuuccuggccuggccagagcuggagcccccacaggguaaggaagagagaguggga

SEQ ID NO: 508452 - RNA, 64 nt, Human
caacucuagaggccgcagcagagcucaggacauucccccacagagcuugccccucaguuccuac

SEQ ID NO: 508453 - RNA, 64 nt, Human
gugucagagccugggggacgagucacccagcucacccccacaugcucaaaacagucaccaaguc

SEQ ID NO: 508454 - RNA, 64 nt, Human
cuugacuuugucacaacgguugcacugaagauggcccccacaagcccaguugugaauaucaagg

SEQ ID NO: 508455 - RNA, 64 nt, Human
caugcagagcccuggccgcuggagacucuuaaagcccccacagcccuccagguccuccagcucu

SEQ ID NO: 508456 - RNA, 64 nt, Human
ugaucguccacuagcccagaguguguguguucaacccccacaccagguggugguaggcggugug

SEQ ID NO: 508457 - RNA, 64 nt, Human
gagcagugggcaguucaugguguuagggcacucacccccacagacuggcaaacccugcaggacu

SEQ ID NO: 508458 - RNA, 64 nt, Human
cuugcucacagcugauugggcaccugaccacacgcccccacaggcucugaccagcagccuauga

SEQ ID NO: 508459 - RNA, 64 nt, Human
cuuuaaugcuggggcccaaguaagggcacagauccccccacaaaguggaugccugcugcaucuu

SEQ ID NO: 508460 - RNA, 64 nt, Human
caggguaucggggugcgaggucugucugcaccggcccccacaucuaaccaggcccugauguagg

SEQ ID NO: 508461 - RNA, 64 nt, Human
caucugggagugggugaacagcaccccgccgcuucccccacacgcuugcucggcgcucugacuu

SEQ ID NO: 508462 - RNA, 64 nt, Human
agccccaucccuguccucaugaccccucguccaccccccacacacacuauaaggcugagggcug

SEQ ID NO: 508463 - RNA, 64 nt, Human
ccagacaagacacagccaggaacccggccagguccccccacaugccccucagggcccaggccug

SEQ ID NO: 508464 - RNA, 64 nt, Human
ccaggcuuugccucagggccuuuagccuaugucccccccacauaaagagagcuucucagagccu

SEQ ID NO: 508465 - RNA, 64 nt, Human
uuuguaauagggauuuuuuuuuugguugaccacucccccacacuuccaaaauuaaacaguguuu

SEQ ID NO: 508466 - RNA, 64 nt, Human; identical to SEQ ID NO: 504414

SEQ ID NO: 508467 - RNA, 64 nt, Human; identical to SEQ ID NO: 504415

SEQ ID NO: 508468 - RNA, 64 nt, Human; identical to SEQ ID NO: 503501

SEQ ID NO: 508469 - RNA, 64 nt, Human
cgcugucaccacauccugagcacucggccccauccccccacaggagggaagcuguggucugacg

SEQ ID NO: 508470 - RNA, 64 nt, Human
ggggcaggaugauuuuggccucauuacuuuaccacccccacaccuggaaagcauauacuauauu

SEQ ID NO: 508471 - RNA, 64 nt, Human
gggacagucggccuggaccggaccucuccuuucgcccccacacccccuccccuugccagcugug

SEQ ID NO: 508472 - RNA, 64 nt, Human
uuuaaaugauuauuaugauuuuggugguaacgaucccccacacacaaccacuaugaagaaauaa

SEQ ID NO: 508473 - RNA, 64 nt, Human
cuguucccacccagccagggcaugaaacaucaaccccccacaugugaacccaucauuccuaaac

SEQ ID NO: 508474 - RNA, 64 nt, Human
cacagucacacagagcgccucaccugcauccucucccccacaagagccccaaagaucccacggg

SEQ ID NO: 508475 - RNA, 64 nt, Human
gcuuauaaugagaagcagcaguucccugcuugcacccccacauccaaaggauguggagcucuuu

SEQ ID NO: 508476 - RNA, 64 nt, Human
ugcuccugcgaggcuaugagugggaugagugaugcccccacagcaccuccauguggacuuagga

SEQ ID NO: 508477 - RNA, 64 nt, Human
ggaaauucagaaaauuuccuuagagucuuuaauucccccacaaagauuauuaaucacauauaua

SEQ ID NO: 508478 - RNA, 64 nt, Human
cugaguuuugguuuguaaucuuuugucccucccacccccacagaagauuucuaaguagggugac

SEQ ID NO: 508479 - RNA, 64 nt, Human
cccucccagcacccccagccauccccccugucuucccccacaucuuugccagaggugugacaug

SEQ ID NO: 508480 - RNA, 64 nt, Human
ccuuagugugccucccaauacucccuucuuccugcccccacaccccauccccagcuagcccaag

SEQ ID NO: 508481 - RNA, 64 nt, Human
uccaguuucuuaaggaaaccacuggaaucugcagcccccacaugcaucugucuaacgcaugccu

SEQ ID NO: 508482 - RNA, 64 nt, Human
ugaggccucugggucaagcuuucaucagccccagcccccacacuccaccaaaguucucaugcac

SEQ ID NO: 508483 - RNA, 64 nt, Human
ccgacagucgugaggauggcagagcugcugcauucccccacacggggauuucugugucugcuug

SEQ ID NO: 508484 - RNA, 64 nt, Human
cuccugcaagucagcuacucuccgugcccacuuccccccacacacacaccccacccuguugcug

SEQ ID NO: 508485 - RNA, 64 nt, Human; identical to SEQ ID NO: 504416

SEQ ID NO: 508486 - RNA, 64 nt, Human; identical to SEQ ID NO: 504490

SEQ ID NO: 508487 - RNA, 64 nt, Human; identical to SEQ ID NO: 504491

SEQ ID NO: 508488 - RNA, 64 nt, Human; identical to SEQ ID NO: 64085

SEQ ID NO: 508489 - RNA, 64 nt, Human; identical to SEQ ID NO: 64086

SEQ ID NO: 508490 - RNA, 64 nt, Human; identical to SEQ ID NO: 64087

SEQ ID NO: 508491 - RNA, 64 nt, Human; identical to SEQ ID NO: 64088

SEQ ID NO: 508492 - RNA, 64 nt, Human; identical to SEQ ID NO: 64089

SEQ ID NO: 508493 - RNA, 64 nt, Human; identical to SEQ ID NO: 64090

SEQ ID NO: 508494 - RNA, 64 nt, Human; identical to SEQ ID NO: 64091

SEQ ID NO: 508495 - RNA, 64 nt, Human; identical to SEQ ID NO: 64092

SEQ ID NO: 508496 - RNA, 64 nt, Human; identical to SEQ ID NO: 64093

SEQ ID NO: 508497 - RNA, 64 nt, Human; identical to SEQ ID NO: 64094

SEQ ID NO: 508498 - RNA, 64 nt, Human; identical to SEQ ID NO: 503517

SEQ ID NO: 508499 - RNA, 64 nt, Human; identical to SEQ ID NO: 504452

SEQ ID NO: 508500 - RNA, 64 nt, Human; identical to SEQ ID NO: 504453

SEQ ID NO: 508501 - RNA, 64 nt, Human; identical to SEQ ID NO: 64095

SEQ ID NO: 508502 - RNA, 64 nt, Human; identical to SEQ ID NO: 64096

SEQ ID NO: 508503 - RNA, 64 nt, Human; identical to SEQ ID NO: 64097

SEQ ID NO: 508504 - RNA, 64 nt, Human; identical to SEQ ID NO: 64098

SEQ ID NO: 508505 - RNA, 64 nt, Human; identical to SEQ ID NO: 64099

SEQ ID NO: 508506 - RNA, 64 nt, Human; identical to SEQ ID NO: 64100

SEQ ID NO: 508507 - RNA, 64 nt, Human; identical to SEQ ID NO: 64101

SEQ ID NO: 508508 - RNA, 51 nt, Human; identical to SEQ ID NO: 64102

SEQ ID NO: 508509 - RNA, 64 nt, Human; identical to SEQ ID NO: 64103

SEQ ID NO: 508510 - RNA, 64 nt, Human; identical to SEQ ID NO: 64104

SEQ ID NO: 508511 - RNA, 57 nt, Human; identical to SEQ ID NO: 64105

SEQ ID NO: 508512 - RNA, 64 nt, Human; identical to SEQ ID NO: 64106

SEQ ID NO: 508513 - RNA, 64 nt, Human; identical to SEQ ID NO: 64107

SEQ ID NO: 508514 - RNA, 64 nt, Human; identical to SEQ ID NO: 64108

SEQ ID NO: 508515 - RNA, 59 nt, Human; identical to SEQ ID NO: 64109

SEQ ID NO: 508516 - RNA, 64 nt, Human; identical to SEQ ID NO: 64110

SEQ ID NO: 508517 - RNA, 64 nt, Human; identical to SEQ ID NO: 504454

SEQ ID NO: 508518 - RNA, 64 nt, Human; identical to SEQ ID NO: 504471

SEQ ID NO: 508519 - RNA, 64 nt, Human; identical to SEQ ID NO: 504472

SEQ ID NO: 508520 - RNA, 64 nt, Human; identical to SEQ ID NO: 64111

SEQ ID NO: 508521 - RNA, 64 nt, Human; identical to SEQ ID NO: 64112

SEQ ID NO: 508522 - RNA, 64 nt, Human; identical to SEQ ID NO: 64113

SEQ ID NO: 508523 - RNA, 64 nt, Human; identical to SEQ ID NO: 64114

SEQ ID NO: 508524 - RNA, 61 nt, Human; identical to SEQ ID NO: 64115

SEQ ID NO: 508525 - RNA, 64 nt, Human; identical to SEQ ID NO: 64116

SEQ ID NO: 508526 - RNA, 64 nt, Human; identical to SEQ ID NO: 64117

SEQ ID NO: 508527 - RNA, 64 nt, Human; identical to SEQ ID NO: 64118

SEQ ID NO: 508528 - RNA, 64 nt, Human; identical to SEQ ID NO: 64119

SEQ ID NO: 508529 - RNA, 64 nt, Human; identical to SEQ ID NO: 64120

SEQ ID NO: 508530 - RNA, 64 nt, Human; identical to SEQ ID NO: 64121

SEQ ID NO: 508531 - RNA, 64 nt, Human; identical to SEQ ID NO: 64122

SEQ ID NO: 508532 - RNA, 64 nt, Human; identical to SEQ ID NO: 64123

SEQ ID NO: 508533 - RNA, 64 nt, Human; identical to SEQ ID NO: 64124

SEQ ID NO: 508534 - RNA, 64 nt, Human; identical to SEQ ID NO: 64125

SEQ ID NO: 508535 - RNA, 53 nt, Human; identical to SEQ ID NO: 64126

SEQ ID NO: 508536 - RNA, 64 nt, Human; identical to SEQ ID NO: 504269

SEQ ID NO: 508537 - RNA, 64 nt, Human; identical to SEQ ID NO: 504270

SEQ ID NO: 508538 - RNA, 64 nt, Human; identical to SEQ ID NO: 504271

SEQ ID NO: 508539 - RNA, 64 nt, Human; identical to SEQ ID NO: 64127

SEQ ID NO: 508540 - RNA, 64 nt, Human; identical to SEQ ID NO: 64128

SEQ ID NO: 508541 - RNA, 64 nt, Human; identical to SEQ ID NO: 64129

SEQ ID NO: 508542 - RNA, 64 nt, Human; identical to SEQ ID NO: 64130

SEQ ID NO: 508543 - RNA, 64 nt, Human; identical to SEQ ID NO: 64131

SEQ ID NO: 508544 - RNA, 64 nt, Human; identical to SEQ ID NO: 64132

SEQ ID NO: 508545 - RNA, 64 nt, Human; identical to SEQ ID NO: 64133

SEQ ID NO: 508546 - RNA, 64 nt, Human; identical to SEQ ID NO: 64134

SEQ ID NO: 508547 - RNA, 64 nt, Human; identical to SEQ ID NO: 64135

SEQ ID NO: 508548 - RNA, 64 nt, Human; identical to SEQ ID NO: 64136

SEQ ID NO: 508549 - RNA, 64 nt, Human; identical to SEQ ID NO: 64137

SEQ ID NO: 508550 - RNA, 64 nt, Human; identical to SEQ ID NO: 64138

SEQ ID NO: 508551 - RNA, 64 nt, Human; identical to SEQ ID NO: 64139

SEQ ID NO: 508552 - RNA, 64 nt, Human; identical to SEQ ID NO: 64140

SEQ ID NO: 508553 - RNA, 64 nt, Human; identical to SEQ ID NO: 64141

SEQ ID NO: 508554 - RNA, 64 nt, Human; identical to SEQ ID NO: 64142

SEQ ID NO: 508555 - RNA, 64 nt, Human; identical to SEQ ID NO: 504673

SEQ ID NO: 508556 - RNA, 64 nt, Human; identical to SEQ ID NO: 504674

SEQ ID NO: 508557 - RNA, 64 nt, Human; identical to SEQ ID NO: 503464

SEQ ID NO: 508558 - RNA, 64 nt, Human; identical to SEQ ID NO: 64143

SEQ ID NO: 508559 - RNA, 64 nt, Human; identical to SEQ ID NO: 64144

SEQ ID NO: 508560 - RNA, 64 nt, Human; identical to SEQ ID NO: 64145

SEQ ID NO: 508561 - RNA, 64 nt, Human; identical to SEQ ID NO: 64146

SEQ ID NO: 508562 - RNA, 64 nt, Human; identical to SEQ ID NO: 64147

SEQ ID NO: 508563 - RNA, 64 nt, Human; identical to SEQ ID NO: 64148

SEQ ID NO: 508564 - RNA, 64 nt, Human; identical to SEQ ID NO: 64149

SEQ ID NO: 508565 - RNA, 64 nt, Human; identical to SEQ ID NO: 64150

SEQ ID NO: 508566 - RNA, 64 nt, Human; identical to SEQ ID NO: 64151

SEQ ID NO: 508567 - RNA, 64 nt, Human; identical to SEQ ID NO: 64152

SEQ ID NO: 508568 - RNA, 64 nt, Human; identical to SEQ ID NO: 64153

SEQ ID NO: 508569 - RNA, 64 nt, Human; identical to SEQ ID NO: 64154

SEQ ID NO: 508570 - RNA, 64 nt, Human; identical to SEQ ID NO: 64155

SEQ ID NO: 508571 - RNA, 64 nt, Human; identical to SEQ ID NO: 64156

SEQ ID NO: 508572 - RNA, 64 nt, Human; identical to SEQ ID NO: 64157

SEQ ID NO: 508573 - RNA, 64 nt, Human; identical to SEQ ID NO: 64158

SEQ ID NO: 508574 - RNA, 64 nt, Human; identical to SEQ ID NO: 504691

SEQ ID NO: 508575 - RNA, 64 nt, Human; identical to SEQ ID NO: 504692

SEQ ID NO: 508576 - RNA, 64 nt, Human; identical to SEQ ID NO: 504693

SEQ ID NO: 508577 - RNA, 64 nt, Human; identical to SEQ ID NO: 64159

SEQ ID NO: 508578 - RNA, 64 nt, Human; identical to SEQ ID NO: 64160

SEQ ID NO: 508579 - RNA, 64 nt, Human; identical to SEQ ID NO: 64161

SEQ ID NO: 508580 - RNA, 64 nt, Human; identical to SEQ ID NO: 64162

SEQ ID NO: 508581 - RNA, 64 nt, Human; identical to SEQ ID NO: 64163

SEQ ID NO: 508582 - RNA, 64 nt, Human; identical to SEQ ID NO: 64164

SEQ ID NO: 508583 - RNA, 64 nt, Human; identical to SEQ ID NO: 64165

SEQ ID NO: 508584 - RNA, 64 nt, Human; identical to SEQ ID NO: 64166

SEQ ID NO: 508585 - RNA, 62 nt, Human; identical to SEQ ID NO: 64167

SEQ ID NO: 508586 - RNA, 64 nt, Human; identical to SEQ ID NO: 64168

SEQ ID NO: 508587 - RNA, 64 nt, Human; identical to SEQ ID NO: 64169

SEQ ID NO: 508588 - RNA, 64 nt, Human; identical to SEQ ID NO: 64170

SEQ ID NO: 508589 - RNA, 58 nt, Human; identical to SEQ ID NO: 64171

SEQ ID NO: 508590 - RNA, 64 nt, Human; identical to SEQ ID NO: 64172

SEQ ID NO: 508591 - RNA, 64 nt, Human; identical to SEQ ID NO: 64173

SEQ ID NO: 508592 - RNA, 64 nt, Human; identical to SEQ ID NO: 64174

SEQ ID NO: 508593 - RNA, 64 nt, Human; identical to SEQ ID NO: 504711

SEQ ID NO: 508594 - RNA, 64 nt, Human; identical to SEQ ID NO: 504712

SEQ ID NO: 508595 - RNA, 64 nt, Human; identical to SEQ ID NO: 503465

SEQ ID NO: 508596 - RNA, 64 nt, Human; identical to SEQ ID NO: 64175

SEQ ID NO: 508597 - RNA, 64 nt, Human; identical to SEQ ID NO: 64176

SEQ ID NO: 508598 - RNA, 64 nt, Human; identical to SEQ ID NO: 64177

SEQ ID NO: 508599 - RNA, 64 nt, Human; identical to SEQ ID NO: 64178

SEQ ID NO: 508600 - RNA, 52 nt, Human; identical to SEQ ID NO: 64179

SEQ ID NO: 508601 - RNA, 64 nt, Human; identical to SEQ ID NO: 64180

SEQ ID NO: 508602 - RNA, 64 nt, Human; identical to SEQ ID NO: 64181

SEQ ID NO: 508603 - RNA, 64 nt, Human; identical to SEQ ID NO: 64182

SEQ ID NO: 508604 - RNA, 64 nt, Human; identical to SEQ ID NO: 64183

SEQ ID NO: 508605 - RNA, 64 nt, Human; identical to SEQ ID NO: 64184

SEQ ID NO: 508606 - RNA, 59 nt, Human; identical to SEQ ID NO: 64185

SEQ ID NO: 508607 - RNA, 64 nt, Human; identical to SEQ ID NO: 64186

SEQ ID NO: 508608 - RNA, 64 nt, Human; identical to SEQ ID NO: 64187

SEQ ID NO: 508609 - RNA, 64 nt, Human; identical to SEQ ID NO: 64188

SEQ ID NO: 508610 - RNA, 64 nt, Human; identical to SEQ ID NO: 64189

SEQ ID NO: 508611 - RNA, 59 nt, Human; identical to SEQ ID NO: 64190

SEQ ID NO: 508612 - RNA, 64 nt, Human; identical to SEQ ID NO: 504729

SEQ ID NO: 508613 - RNA, 64 nt, Human; identical to SEQ ID NO: 504730

SEQ ID NO: 508614 - RNA, 64 nt, Human; identical to SEQ ID NO: 504731

SEQ ID NO: 508615 - RNA, 64 nt, Human; identical to SEQ ID NO: 64191

SEQ ID NO: 508616 - RNA, 64 nt, Human; identical to SEQ ID NO: 64192

SEQ ID NO: 508617 - RNA, 64 nt, Human; identical to SEQ ID NO: 64193

SEQ ID NO: 508618 - RNA, 64 nt, Human; identical to SEQ ID NO: 64194

SEQ ID NO: 508619 - RNA, 64 nt, Human; identical to SEQ ID NO: 64195

SEQ ID NO: 508620 - RNA, 64 nt, Human; identical to SEQ ID NO: 64196

SEQ ID NO: 508621 - RNA, 64 nt, Human; identical to SEQ ID NO: 64197

SEQ ID NO: 508622 - RNA, 64 nt, Human; identical to SEQ ID NO: 64198

SEQ ID NO: 508623 - RNA, 64 nt, Human; identical to SEQ ID NO: 64199

SEQ ID NO: 508624 - RNA, 64 nt, Human; identical to SEQ ID NO: 64200

SEQ ID NO: 508625 - RNA, 64 nt, Human; identical to SEQ ID NO: 64201

SEQ ID NO: 508626 - RNA, 64 nt, Human; identical to SEQ ID NO: 64202

SEQ ID NO: 508627 - RNA, 64 nt, Human; identical to SEQ ID NO: 64203

SEQ ID NO: 508628 - RNA, 64 nt, Human; identical to SEQ ID NO: 64204

SEQ ID NO: 508629 - RNA, 64 nt, Human; identical to SEQ ID NO: 64205

SEQ ID NO: 508630 - RNA, 64 nt, Human; identical to SEQ ID NO: 64206

SEQ ID NO: 508631 - RNA, 64 nt, Human; identical to SEQ ID NO: 504749

SEQ ID NO: 508632 - RNA, 64 nt, Human; identical to SEQ ID NO: 504750

SEQ ID NO: 508633 - RNA, 64 nt, Human; identical to SEQ ID NO: 503481

SEQ ID NO: 508634 - RNA, 64 nt, Human; identical to SEQ ID NO: 64207

SEQ ID NO: 508635 - RNA, 64 nt, Human; identical to SEQ ID NO: 64208

SEQ ID NO: 508636 - RNA, 64 nt, Human; identical to SEQ ID NO: 64209

SEQ ID NO: 508637 - RNA, 64 nt, Human; identical to SEQ ID NO: 64210

SEQ ID NO: 508638 - RNA, 64 nt, Human; identical to SEQ ID NO: 64211

SEQ ID NO: 508639 - RNA, 64 nt, Human; identical to SEQ ID NO: 64212

SEQ ID NO: 508640 - RNA, 64 nt, Human; identical to SEQ ID NO: 64213

SEQ ID NO: 508641 - RNA, 64 nt, Human; identical to SEQ ID NO: 64214

SEQ ID NO: 508642 - RNA, 64 nt, Human; identical to SEQ ID NO: 64215

SEQ ID NO: 508643 - RNA, 64 nt, Human; identical to SEQ ID NO: 504786

SEQ ID NO: 508644 - RNA, 64 nt, Human; identical to SEQ ID NO: 504787

SEQ ID NO: 508645 - RNA, 64 nt, Human; identical to SEQ ID NO: 504788

SEQ ID NO: 508646 - RNA, 64 nt, Human; identical to SEQ ID NO: 505466

SEQ ID NO: 508647 - RNA, 64 nt, Human; identical to SEQ ID NO: 505682

SEQ ID NO: 508648 - RNA, 64 nt, Human; identical to SEQ ID NO: 504635

SEQ ID NO: 508649 - RNA, 64 nt, Human; identical to SEQ ID NO: 503447

SEQ ID NO: 508650 - RNA, 64 nt, Human; identical to SEQ ID NO: 504599

SEQ ID NO: 508651 - RNA, 64 nt, Human; identical to SEQ ID NO: 504600

SEQ ID NO: 508652 - RNA, 64 nt, Human; identical to SEQ ID NO: 504601

SEQ ID NO: 508653 - RNA, 64 nt, Human; identical to SEQ ID NO: 504617

SEQ ID NO: 508654 - RNA, 64 nt, Human; identical to SEQ ID NO: 504618

SEQ ID NO: 508655 - RNA, 64 nt, Human; identical to SEQ ID NO: 504619

SEQ ID NO: 508656 - RNA, 64 nt, Human; identical to SEQ ID NO: 503463

SEQ ID NO: 508657 - RNA, 64 nt, Human; identical to SEQ ID NO: 504653

SEQ ID NO: 508658 - RNA, 64 nt, Human; identical to SEQ ID NO: 504654

SEQ ID NO: 508659 - RNA, 64 nt, Human; identical to SEQ ID NO: 503158

SEQ ID NO: 508660 - RNA, 64 nt, Human; identical to SEQ ID NO: 507598

SEQ ID NO: 508661 - RNA, 64 nt, Human; identical to SEQ ID NO: 507599

SEQ ID NO: 508662 - RNA, 64 nt, Human; identical to SEQ ID NO: 507600

SEQ ID NO: 508663 - RNA, 64 nt, Human; identical to SEQ ID NO: 507616

SEQ ID NO: 508664 - RNA, 64 nt, Human; identical to SEQ ID NO: 507617

SEQ ID NO: 508665 - RNA, 64 nt, Human; identical to SEQ ID NO: 507618

SEQ ID NO: 508666 - RNA, 64 nt, Human; identical to SEQ ID NO: 503159

SEQ ID NO: 508667 - RNA, 64 nt, Human; identical to SEQ ID NO: 507634

SEQ ID NO: 508668 - RNA, 64 nt, Human; identical to SEQ ID NO: 507635

SEQ ID NO: 508669 - RNA, 64 nt, Human; identical to SEQ ID NO: 507636

SEQ ID NO: 508670 - RNA, 64 nt, Human; identical to SEQ ID NO: 507652

SEQ ID NO: 508671 - RNA, 64 nt, Human; identical to SEQ ID NO: 507653

SEQ ID NO: 508672 - RNA, 64 nt, Human; identical to SEQ ID NO: 507654

SEQ ID NO: 508673 - RNA, 64 nt, Human; identical to SEQ ID NO: 503175

SEQ ID NO: 508674 - RNA, 62 nt, Human; identical to SEQ ID NO: 507688

SEQ ID NO: 508675 - RNA, 64 nt, Human; identical to SEQ ID NO: 507689

SEQ ID NO: 508676 - RNA, 64 nt, Human; identical to SEQ ID NO: 507690

SEQ ID NO: 508677 - RNA, 64 nt, Human; identical to SEQ ID NO: 507706

SEQ ID NO: 508678 - RNA, 64 nt, Human; identical to SEQ ID NO: 507707

SEQ ID NO: 508679 - RNA, 64 nt, Human; identical to SEQ ID NO: 507708

SEQ ID NO: 508680 - RNA, 64 nt, Human; identical to SEQ ID NO: 503176

SEQ ID NO: 508681 - RNA, 64 nt, Human; identical to SEQ ID NO: 507724

SEQ ID NO: 508682 - RNA, 64 nt, Human; identical to SEQ ID NO: 507725

SEQ ID NO: 508683 - RNA, 64 nt, Human; identical to SEQ ID NO: 507726

SEQ ID NO: 508684 - RNA, 64 nt, Human; identical to SEQ ID NO: 507742

SEQ ID NO: 508685 - RNA, 64 nt, Human; identical to SEQ ID NO: 507743

SEQ ID NO: 508686 - RNA, 64 nt, Human; identical to SEQ ID NO: 507744

SEQ ID NO: 508687 - RNA, 64 nt, Human; identical to SEQ ID NO: 503177

SEQ ID NO: 508688 - RNA, 64 nt, Human; identical to SEQ ID NO: 507166

SEQ ID NO: 508689 - RNA, 64 nt, Human; identical to SEQ ID NO: 507167

SEQ ID NO: 508690 - RNA, 64 nt, Human; identical to SEQ ID NO: 507168

SEQ ID NO: 508691 - RNA, 64 nt, Human; identical to SEQ ID NO: 507184

SEQ ID NO: 508692 - RNA, 64 nt, Human; identical to SEQ ID NO: 507185

SEQ ID NO: 508693 - RNA, 64 nt, Human; identical to SEQ ID NO: 507186

SEQ ID NO: 508694 - RNA, 64 nt, Human; identical to SEQ ID NO: 503193

SEQ ID NO: 508695 - RNA, 64 nt, Human; identical to SEQ ID NO: 507220

SEQ ID NO: 508696 - RNA, 64 nt, Human; identical to SEQ ID NO: 507221

SEQ ID NO: 508697 - RNA, 64 nt, Human; identical to SEQ ID NO: 507222

SEQ ID NO: 508698 - RNA, 64 nt, Human; identical to SEQ ID NO: 507238

SEQ ID NO: 508699 - RNA, 64 nt, Human; identical to SEQ ID NO: 507239

SEQ ID NO: 508700 - RNA, 64 nt, Human; identical to SEQ ID NO: 507240

SEQ ID NO: 508701 - RNA, 64 nt, Human; identical to SEQ ID NO: 503194

SEQ ID NO: 508702 - RNA, 64 nt, Human; identical to SEQ ID NO: 507256

SEQ ID NO: 508703 - RNA, 64 nt, Human; identical to SEQ ID NO: 507257

SEQ ID NO: 508704 - RNA, 64 nt, Human; identical to SEQ ID NO: 507258

SEQ ID NO: 508705 - RNA, 64 nt, Human; identical to SEQ ID NO: 507274

SEQ ID NO: 508706 - RNA, 64 nt, Human; identical to SEQ ID NO: 507275

SEQ ID NO: 508707 - RNA, 64 nt, Human; identical to SEQ ID NO: 507276

SEQ ID NO: 508708 - RNA, 64 nt, Human; identical to SEQ ID NO: 503195

SEQ ID NO: 508709 - RNA, 64 nt, Human; identical to SEQ ID NO: 507292

SEQ ID NO: 508710 - RNA, 64 nt, Human; identical to SEQ ID NO: 507293

SEQ ID NO: 508711 - RNA, 64 nt, Human; identical to SEQ ID NO: 507294

SEQ ID NO: 508712 - RNA, 64 nt, Human; identical to SEQ ID NO: 507310

SEQ ID NO: 508713 - RNA, 64 nt, Human; identical to SEQ ID NO: 507311

SEQ ID NO: 508714 - RNA, 64 nt, Human; identical to SEQ ID NO: 507312

SEQ ID NO: 508715 - RNA, 64 nt, Human; identical to SEQ ID NO: 503211

SEQ ID NO: 508716 - RNA, 64 nt, Human; identical to SEQ ID NO: 507346

SEQ ID NO: 508717 - RNA, 64 nt, Human; identical to SEQ ID NO: 507347

SEQ ID NO: 508718 - RNA, 64 nt, Human; identical to SEQ ID NO: 507348

SEQ ID NO: 508719 - RNA, 64 nt, Human; identical to SEQ ID NO: 507364

SEQ ID NO: 508720 - RNA, 64 nt, Human; identical to SEQ ID NO: 507365

SEQ ID NO: 508721 - RNA, 64 nt, Human; identical to SEQ ID NO: 507366

SEQ ID NO: 508722 - RNA, 64 nt, Human; identical to SEQ ID NO: 503212

SEQ ID NO: 508723 - RNA, 64 nt, Human; identical to SEQ ID NO: 507382

SEQ ID NO: 508724 - RNA, 64 nt, Human; identical to SEQ ID NO: 507383

SEQ ID NO: 508725 - RNA, 64 nt, Human; identical to SEQ ID NO: 507384

SEQ ID NO: 508726 - RNA, 64 nt, Human; identical to SEQ ID NO: 507400

SEQ ID NO: 508727 - RNA, 64 nt, Human; identical to SEQ ID NO: 507401

SEQ ID NO: 508728 - RNA, 64 nt, Human; identical to SEQ ID NO: 507402

SEQ ID NO: 508729 - RNA, 64 nt, Human; identical to SEQ ID NO: 503213

SEQ ID NO: 508730 - RNA, 64 nt, Human; identical to SEQ ID NO: 507544

SEQ ID NO: 508731 - RNA, 64 nt, Human; identical to SEQ ID NO: 507545

SEQ ID NO: 508732 - RNA, 64 nt, Human; identical to SEQ ID NO: 507546

SEQ ID NO: 508733 - RNA, 64 nt, Human; identical to SEQ ID NO: 507670

SEQ ID NO: 508734 - RNA, 64 nt, Human; identical to SEQ ID NO: 507671

SEQ ID NO: 508735 - RNA, 64 nt, Human; identical to SEQ ID NO: 507672

SEQ ID NO: 508736 - RNA, 64 nt, Human; identical to SEQ ID NO: 503229

SEQ ID NO: 508737 - RNA, 64 nt, Human; identical to SEQ ID NO: 506936

SEQ ID NO: 508738 - RNA, 64 nt, Human; identical to SEQ ID NO: 506937

SEQ ID NO: 508739 - RNA, 64 nt, Human; identical to SEQ ID NO: 506938

SEQ ID NO: 508740 - RNA, 64 nt, Human; identical to SEQ ID NO: 506939

SEQ ID NO: 508741 - RNA, 64 nt, Human; identical to SEQ ID NO: 506956

SEQ ID NO: 508742 - RNA, 64 nt, Human; identical to SEQ ID NO: 506957

SEQ ID NO: 508743 - RNA, 64 nt, Human; identical to SEQ ID NO: 506958

SEQ ID NO: 508744 - RNA, 64 nt, Human; identical to SEQ ID NO: 503230

SEQ ID NO: 508745 - RNA, 64 nt, Human; identical to SEQ ID NO: 506959

SEQ ID NO: 508746 - RNA, 64 nt, Human; identical to SEQ ID NO: 506995

SEQ ID NO: 508747 - RNA, 64 nt, Human; identical to SEQ ID NO: 506996

SEQ ID NO: 508748 - RNA, 64 nt, Human; identical to SEQ ID NO: 359119

SEQ ID NO: 508749 - RNA, 64 nt, Human; identical to SEQ ID NO: 359120

SEQ ID NO: 508750 - RNA, 64 nt, Human; identical to SEQ ID NO: 359121

SEQ ID NO: 508751 - RNA, 64 nt, Human; identical to SEQ ID NO: 359122

SEQ ID NO: 508752 - RNA, 64 nt, Human; identical to SEQ ID NO: 359123

SEQ ID NO: 508753 - RNA, 64 nt, Human; identical to SEQ ID NO: 359124

SEQ ID NO: 508754 - RNA, 64 nt, Human; identical to SEQ ID NO: 359125

SEQ ID NO: 508755 - RNA, 64 nt, Human; identical to SEQ ID NO: 359126

SEQ ID NO: 508756 - RNA, 64 nt, Human; identical to SEQ ID NO: 359127

SEQ ID NO: 508757 - RNA, 64 nt, Human; identical to SEQ ID NO: 359128

SEQ ID NO: 508758 - RNA, 64 nt, Human; identical to SEQ ID NO: 359129

SEQ ID NO: 508759 - RNA, 64 nt, Human; identical to SEQ ID NO: 359132

SEQ ID NO: 508760 - RNA, 64 nt, Human; identical to SEQ ID NO: 359133

SEQ ID NO: 508761 - RNA, 64 nt, Human; identical to SEQ ID NO: 359134

SEQ ID NO: 508762 - RNA, 64 nt, Human; identical to SEQ ID NO: 359135

SEQ ID NO: 508763 - RNA, 64 nt, Human; identical to SEQ ID NO: 359136

SEQ ID NO: 508764 - RNA, 64 nt, Human; identical to SEQ ID NO: 359137

SEQ ID NO: 508765 - RNA, 63 nt, Human; identical to SEQ ID NO: 359138

SEQ ID NO: 508766 - RNA, 64 nt, Human; identical to SEQ ID NO: 359139

SEQ ID NO: 508767 - RNA, 64 nt, Human; identical to SEQ ID NO: 359140

SEQ ID NO: 508768 - RNA, 64 nt, Human; identical to SEQ ID NO: 359141

SEQ ID NO: 508769 - RNA, 64 nt, Human; identical to SEQ ID NO: 359142

SEQ ID NO: 508770 - RNA, 64 nt, Human; identical to SEQ ID NO: 359143

SEQ ID NO: 508771 - RNA, 64 nt, Human; identical to SEQ ID NO: 359144

SEQ ID NO: 508772 - RNA, 64 nt, Human; identical to SEQ ID NO: 359145

SEQ ID NO: 508773 - RNA, 64 nt, Human; identical to SEQ ID NO: 359146

SEQ ID NO: 508774 - RNA, 64 nt, Human; identical to SEQ ID NO: 359147

SEQ ID NO: 508775 - RNA, 64 nt, Human; identical to SEQ ID NO: 359150

SEQ ID NO: 508776 - RNA, 64 nt, Human; identical to SEQ ID NO: 359151

SEQ ID NO: 508777 - RNA, 64 nt, Human; identical to SEQ ID NO: 359152

SEQ ID NO: 508778 - RNA, 64 nt, Human; identical to SEQ ID NO: 359153

SEQ ID NO: 508779 - RNA, 64 nt, Human; identical to SEQ ID NO: 359154

SEQ ID NO: 508780 - RNA, 64 nt, Human; identical to SEQ ID NO: 359155

SEQ ID NO: 508781 - RNA, 64 nt, Human; identical to SEQ ID NO: 359156

SEQ ID NO: 508782 - RNA, 64 nt, Human; identical to SEQ ID NO: 359157

SEQ ID NO: 508783 - RNA, 59 nt, Human; identical to SEQ ID NO: 359158

SEQ ID NO: 508784 - RNA, 64 nt, Human; identical to SEQ ID NO: 359159

SEQ ID NO: 508785 - RNA, 64 nt, Human; identical to SEQ ID NO: 359160

SEQ ID NO: 508786 - RNA, 64 nt, Human; identical to SEQ ID NO: 359161

SEQ ID NO: 508787 - RNA, 64 nt, Human; identical to SEQ ID NO: 359162

SEQ ID NO: 508788 - RNA, 64 nt, Human; identical to SEQ ID NO: 359163

SEQ ID NO: 508789 - RNA, 64 nt, Human; identical to SEQ ID NO: 359164

SEQ ID NO: 508790 - RNA, 64 nt, Human; identical to SEQ ID NO: 359165

SEQ ID NO: 508791 - RNA, 64 nt, Human; identical to SEQ ID NO: 359166

SEQ ID NO: 508792 - RNA, 64 nt, Human; identical to SEQ ID NO: 359167

SEQ ID NO: 508793 - RNA, 64 nt, Human; identical to SEQ ID NO: 359168

SEQ ID NO: 508794 - RNA, 64 nt, Human; identical to SEQ ID NO: 359169

SEQ ID NO: 508795 - RNA, 64 nt, Human; identical to SEQ ID NO: 359170

SEQ ID NO: 508796 - RNA, 64 nt, Human; identical to SEQ ID NO: 359171

SEQ ID NO: 508797 - RNA, 64 nt, Human; identical to SEQ ID NO: 359172

SEQ ID NO: 508798 - RNA, 64 nt, Human; identical to SEQ ID NO: 359173

SEQ ID NO: 508799 - RNA, 64 nt, Human; identical to SEQ ID NO: 359174

SEQ ID NO: 508800 - RNA, 64 nt, Human; identical to SEQ ID NO: 359175

SEQ ID NO: 508801 - RNA, 64 nt, Human; identical to SEQ ID NO: 359176

SEQ ID NO: 508802 - RNA, 64 nt, Human; identical to SEQ ID NO: 359177

SEQ ID NO: 508803 - RNA, 64 nt, Human; identical to SEQ ID NO: 359178

SEQ ID NO: 508804 - RNA, 64 nt, Human; identical to SEQ ID NO: 359179

SEQ ID NO: 508805 - RNA, 64 nt, Human; identical to SEQ ID NO: 359180

SEQ ID NO: 508806 - RNA, 64 nt, Human; identical to SEQ ID NO: 359181

SEQ ID NO: 508807 - RNA, 64 nt, Human; identical to SEQ ID NO: 359182

SEQ ID NO: 508808 - RNA, 64 nt, Human; identical to SEQ ID NO: 359183

SEQ ID NO: 508809 - RNA, 64 nt, Human; identical to SEQ ID NO: 359184

SEQ ID NO: 508810 - RNA, 64 nt, Human; identical to SEQ ID NO: 359185

SEQ ID NO: 508811 - RNA, 64 nt, Human; identical to SEQ ID NO: 359186

SEQ ID NO: 508812 - RNA, 64 nt, Human; identical to SEQ ID NO: 359187

SEQ ID NO: 508813 - RNA, 64 nt, Human; identical to SEQ ID NO: 359188

SEQ ID NO: 508814 - RNA, 64 nt, Human; identical to SEQ ID NO: 359189

SEQ ID NO: 508815 - RNA, 64 nt, Human; identical to SEQ ID NO: 359190

SEQ ID NO: 508816 - RNA, 64 nt, Human; identical to SEQ ID NO: 359191

SEQ ID NO: 508817 - RNA, 64 nt, Human; identical to SEQ ID NO: 359192

SEQ ID NO: 508818 - RNA, 64 nt, Human; identical to SEQ ID NO: 359193

SEQ ID NO: 508819 - RNA, 64 nt, Human; identical to SEQ ID NO: 359194

SEQ ID NO: 508820 - RNA, 64 nt, Human; identical to SEQ ID NO: 359195

SEQ ID NO: 508821 - RNA, 64 nt, Human; identical to SEQ ID NO: 359196

SEQ ID NO: 508822 - RNA, 64 nt, Human; identical to SEQ ID NO: 359197

SEQ ID NO: 508823 - RNA, 64 nt, Human; identical to SEQ ID NO: 359201

SEQ ID NO: 508824 - RNA, 64 nt, Human; identical to SEQ ID NO: 359202

SEQ ID NO: 508825 - RNA, 64 nt, Human; identical to SEQ ID NO: 359203

SEQ ID NO: 508826 - RNA, 64 nt, Human; identical to SEQ ID NO: 359204

SEQ ID NO: 508827 - RNA, 64 nt, Human; identical to SEQ ID NO: 359205

SEQ ID NO: 508828 - RNA, 64 nt, Human; identical to SEQ ID NO: 359206

SEQ ID NO: 508829 - RNA, 64 nt, Human; identical to SEQ ID NO: 359207

SEQ ID NO: 508830 - RNA, 64 nt, Human; identical to SEQ ID NO: 359208

SEQ ID NO: 508831 - RNA, 64 nt, Human; identical to SEQ ID NO: 359209

SEQ ID NO: 508832 - RNA, 64 nt, Human; identical to SEQ ID NO: 359210

SEQ ID NO: 508833 - RNA, 64 nt, Human; identical to SEQ ID NO: 359211

SEQ ID NO: 508834 - RNA, 64 nt, Human; identical to SEQ ID NO: 359212

SEQ ID NO: 508835 - RNA, 64 nt, Human; identical to SEQ ID NO: 359213

SEQ ID NO: 508836 - RNA, 64 nt, Human; identical to SEQ ID NO: 359214

SEQ ID NO: 508837 - RNA, 64 nt, Human; identical to SEQ ID NO: 359215

SEQ ID NO: 508838 - RNA, 64 nt, Human; identical to SEQ ID NO: 359216

SEQ ID NO: 508839 - RNA, 64 nt, Human; identical to SEQ ID NO: 359220

SEQ ID NO: 508840 - RNA, 64 nt, Human; identical to SEQ ID NO: 359221

SEQ ID NO: 508841 - RNA, 64 nt, Human; identical to SEQ ID NO: 359222

SEQ ID NO: 508842 - RNA, 64 nt, Human; identical to SEQ ID NO: 359223

SEQ ID NO: 508843 - RNA, 64 nt, Human; identical to SEQ ID NO: 359224

SEQ ID NO: 508844 - RNA, 64 nt, Human; identical to SEQ ID NO: 359225

SEQ ID NO: 508845 - RNA, 64 nt, Human; identical to SEQ ID NO: 359226

SEQ ID NO: 508846 - RNA, 64 nt, Human; identical to SEQ ID NO: 359227

SEQ ID NO: 508847 - RNA, 64 nt, Human; identical to SEQ ID NO: 359228

SEQ ID NO: 508848 - RNA, 64 nt, Human; identical to SEQ ID NO: 359229

SEQ ID NO: 508849 - RNA, 64 nt, Human; identical to SEQ ID NO: 359230

SEQ ID NO: 508850 - RNA, 64 nt, Human; identical to SEQ ID NO: 359231

SEQ ID NO: 508851 - RNA, 64 nt, Human; identical to SEQ ID NO: 359232

SEQ ID NO: 508852 - RNA, 64 nt, Human; identical to SEQ ID NO: 359233

SEQ ID NO: 508853 - RNA, 64 nt, Human; identical to SEQ ID NO: 359234

SEQ ID NO: 508854 - RNA, 64 nt, Human; identical to SEQ ID NO: 359235

SEQ ID NO: 508855 - RNA, 64 nt, Human; identical to SEQ ID NO: 359239

SEQ ID NO: 508856 - RNA, 64 nt, Human; identical to SEQ ID NO: 359240

SEQ ID NO: 508857 - RNA, 64 nt, Human; identical to SEQ ID NO: 359241

SEQ ID NO: 508858 - RNA, 64 nt, Human; identical to SEQ ID NO: 359232

SEQ ID NO: 508859 - RNA, 64 nt, Human; identical to SEQ ID NO: 359243

SEQ ID NO: 508860 - RNA, 64 nt, Human; identical to SEQ ID NO: 359244

SEQ ID NO: 508861 - RNA, 64 nt, Human; identical to SEQ ID NO: 359245

SEQ ID NO: 508862 - RNA, 64 nt, Human; identical to SEQ ID NO: 359246

SEQ ID NO: 508863 - RNA, 64 nt, Human; identical to SEQ ID NO: 359247

SEQ ID NO: 508864 - RNA, 64 nt, Human; identical to SEQ ID NO: 359248

SEQ ID NO: 508865 - RNA, 64 nt, Human; identical to SEQ ID NO: 359249

SEQ ID NO: 508866 - RNA, 64 nt, Human; identical to SEQ ID NO: 359250

SEQ ID NO: 508867 - RNA, 64 nt, Human; identical to SEQ ID NO: 359251

SEQ ID NO: 508868 - RNA, 64 nt, Human; identical to SEQ ID NO: 359252

SEQ ID NO: 508869 - RNA, 64 nt, Human; identical to SEQ ID NO: 359253

SEQ ID NO: 508870 - RNA, 64 nt, Human; identical to SEQ ID NO: 359254

SEQ ID NO: 508871 - RNA, 64 nt, Human; identical to SEQ ID NO: 357246

SEQ ID NO: 508872 - RNA, 64 nt, Human; identical to SEQ ID NO: 357247

SEQ ID NO: 508873 - RNA, 64 nt, Human; identical to SEQ ID NO: 357248

SEQ ID NO: 508874 - RNA, 64 nt, Human; identical to SEQ ID NO: 357249

SEQ ID NO: 508875 - RNA, 64 nt, Human; identical to SEQ ID NO: 357250

SEQ ID NO: 508876 - RNA, 64 nt, Human; identical to SEQ ID NO: 357251

SEQ ID NO: 508877 - RNA, 64 nt, Human; identical to SEQ ID NO: 357252

SEQ ID NO: 508878 - RNA, 64 nt, Human; identical to SEQ ID NO: 357253

SEQ ID NO: 508879 - RNA, 64 nt, Human; identical to SEQ ID NO: 357254

SEQ ID NO: 508880 - RNA, 64 nt, Human; identical to SEQ ID NO: 357255

SEQ ID NO: 508881 - RNA, 64 nt, Human; identical to SEQ ID NO: 357256

SEQ ID NO: 508882 - RNA, 64 nt, Human; identical to SEQ ID NO: 357257

SEQ ID NO: 508883 - RNA, 64 nt, Human; identical to SEQ ID NO: 357258

SEQ ID NO: 508884 - RNA, 64 nt, Human; identical to SEQ ID NO: 357259

SEQ ID NO: 508885 - RNA, 64 nt, Human; identical to SEQ ID NO: 357260

SEQ ID NO: 508886 - RNA, 64 nt, Human; identical to SEQ ID NO: 359258

SEQ ID NO: 508887 - RNA, 64 nt, Human; identical to SEQ ID NO: 359278

SEQ ID NO: 508888 - RNA, 64 nt, Human; identical to SEQ ID NO: 359279

SEQ ID NO: 508889 - RNA, 64 nt, Human; identical to SEQ ID NO: 359280

SEQ ID NO: 508890 - RNA, 64 nt, Human; identical to SEQ ID NO: 359281

SEQ ID NO: 508891 - RNA, 64 nt, Human; identical to SEQ ID NO: 359282

SEQ ID NO: 508892 - RNA, 64 nt, Human; identical to SEQ ID NO: 359283

SEQ ID NO: 508893 - RNA, 64 nt, Human; identical to SEQ ID NO: 359284

SEQ ID NO: 508894 - RNA, 64 nt, Human; identical to SEQ ID NO: 359285

SEQ ID NO: 508895 - RNA, 64 nt, Human; identical to SEQ ID NO: 359286

SEQ ID NO: 508896 - RNA, 64 nt, Human; identical to SEQ ID NO: 359287

SEQ ID NO: 508897 - RNA, 64 nt, Human; identical to SEQ ID NO: 359288

SEQ ID NO: 508898 - RNA, 64 nt, Human; identical to SEQ ID NO: 359289

SEQ ID NO: 508899 - RNA, 64 nt, Human; identical to SEQ ID NO: 359290

SEQ ID NO: 508900 - RNA, 64 nt, Human; identical to SEQ ID NO: 359291

SEQ ID NO: 508901 - RNA, 64 nt, Human; identical to SEQ ID NO: 359292

SEQ ID NO: 508902 - RNA, 64 nt, Human; identical to SEQ ID NO: 359293

SEQ ID NO: 508903 - RNA, 64 nt, Human; identical to SEQ ID NO: 359297

SEQ ID NO: 508904 - RNA, 64 nt, Human; identical to SEQ ID NO: 359298

SEQ ID NO: 508905 - RNA, 64 nt, Human; identical to SEQ ID NO: 359299

SEQ ID NO: 508906 - RNA, 64 nt, Human; identical to SEQ ID NO: 359300

SEQ ID NO: 508907 - RNA, 64 nt, Human; identical to SEQ ID NO: 359301

SEQ ID NO: 508908 - RNA, 64 nt, Human; identical to SEQ ID NO: 359302

SEQ ID NO: 508909 - RNA, 64 nt, Human; identical to SEQ ID NO: 359303

SEQ ID NO: 508910 - RNA, 64 nt, Human; identical to SEQ ID NO: 359304

SEQ ID NO: 508911 - RNA, 64 nt, Human; identical to SEQ ID NO: 359305

SEQ ID NO: 508912 - RNA, 64 nt, Human; identical to SEQ ID NO: 359306

SEQ ID NO: 508913 - RNA, 64 nt, Human; identical to SEQ ID NO: 359307

SEQ ID NO: 508914 - RNA, 64 nt, Human; identical to SEQ ID NO: 359308

SEQ ID NO: 508915 - RNA, 64 nt, Human; identical to SEQ ID NO: 359309

SEQ ID NO: 508916 - RNA, 64 nt, Human; identical to SEQ ID NO: 359310

SEQ ID NO: 508917 - RNA, 64 nt, Human; identical to SEQ ID NO: 359311

SEQ ID NO: 508918 - RNA, 64 nt, Human; identical to SEQ ID NO: 359312

SEQ ID NO: 508919 - RNA, 64 nt, Human; identical to SEQ ID NO: 359316

SEQ ID NO: 508920 - RNA, 64 nt, Human; identical to SEQ ID NO: 359317

SEQ ID NO: 508921 - RNA, 64 nt, Human; identical to SEQ ID NO: 359318

SEQ ID NO: 508922 - RNA, 64 nt, Human; identical to SEQ ID NO: 359319

SEQ ID NO: 508923 - RNA, 64 nt, Human; identical to SEQ ID NO: 359320

SEQ ID NO: 508924 - RNA, 64 nt, Human; identical to SEQ ID NO: 359321

SEQ ID NO: 508925 - RNA, 64 nt, Human; identical to SEQ ID NO: 359322

SEQ ID NO: 508926 - RNA, 64 nt, Human; identical to SEQ ID NO: 359323

SEQ ID NO: 508927 - RNA, 64 nt, Human; identical to SEQ ID NO: 359324

SEQ ID NO: 508928 - RNA, 64 nt, Human; identical to SEQ ID NO: 359325

SEQ ID NO: 508929 - RNA, 64 nt, Human; identical to SEQ ID NO: 359326

SEQ ID NO: 508930 - RNA, 64 nt, Human; identical to SEQ ID NO: 359327

SEQ ID NO: 508931 - RNA, 64 nt, Human; identical to SEQ ID NO: 359328

SEQ ID NO: 508932 - RNA, 64 nt, Human; identical to SEQ ID NO: 359329

SEQ ID NO: 508933 - RNA, 64 nt, Human; identical to SEQ ID NO: 359330

SEQ ID NO: 508934 - RNA, 64 nt, Human; identical to SEQ ID NO: 359331

SEQ ID NO: 508935 - RNA, 64 nt, Human; identical to SEQ ID NO: 359335

SEQ ID NO: 508936 - RNA, 64 nt, Human; identical to SEQ ID NO: 359336

SEQ ID NO: 508937 - RNA, 64 nt, Human; identical to SEQ ID NO: 359337

SEQ ID NO: 508938 - RNA, 64 nt, Human; identical to SEQ ID NO: 359338

SEQ ID NO: 508939 - RNA, 64 nt, Human; identical to SEQ ID NO: 359339

SEQ ID NO: 508940 - RNA, 64 nt, Human; identical to SEQ ID NO: 359340

SEQ ID NO: 508941 - RNA, 64 nt, Human; identical to SEQ ID NO: 359341

SEQ ID NO: 508942 - RNA, 64 nt, Human; identical to SEQ ID NO: 359342

SEQ ID NO: 508943 - RNA, 64 nt, Human; identical to SEQ ID NO: 359343

SEQ ID NO: 508944 - RNA, 64 nt, Human; identical to SEQ ID NO: 359344

SEQ ID NO: 508945 - RNA, 64 nt, Human; identical to SEQ ID NO: 359345

SEQ ID NO: 508946 - RNA, 64 nt, Human; identical to SEQ ID NO: 359346

SEQ ID NO: 508947 - RNA, 64 nt, Human; identical to SEQ ID NO: 359347

SEQ ID NO: 508948 - RNA, 64 nt, Human; identical to SEQ ID NO: 359348

SEQ ID NO: 508949 - RNA, 64 nt, Human; identical to SEQ ID NO: 359349

SEQ ID NO: 508950 - RNA, 64 nt, Human; identical to SEQ ID NO: 359350

SEQ ID NO: 508951 - RNA, 64 nt, Human; identical to SEQ ID NO: 359354

SEQ ID NO: 508952 - RNA, 64 nt, Human; identical to SEQ ID NO: 359355

SEQ ID NO: 508953 - RNA, 64 nt, Human; identical to SEQ ID NO: 359356

SEQ ID NO: 508954 - RNA, 64 nt, Human; identical to SEQ ID NO: 359357

SEQ ID NO: 508955 - RNA, 64 nt, Human; identical to SEQ ID NO: 359358

SEQ ID NO: 508956 - RNA, 64 nt, Human; identical to SEQ ID NO: 359359

SEQ ID NO: 508957 - RNA, 64 nt, Human; identical to SEQ ID NO: 359360

SEQ ID NO: 508958 - RNA, 64 nt, Human; identical to SEQ ID NO: 359361

SEQ ID NO: 508959 - RNA, 64 nt, Human; identical to SEQ ID NO: 359362

SEQ ID NO: 508960 - RNA, 59 nt, Human; identical to SEQ ID NO: 359363

SEQ ID NO: 508961 - RNA, 64 nt, Human; identical to SEQ ID NO: 359364

SEQ ID NO: 508962 - RNA, 64 nt, Human; identical to SEQ ID NO: 359365

SEQ ID NO: 508963 - RNA, 64 nt, Human; identical to SEQ ID NO: 359366

SEQ ID NO: 508964 - RNA, 64 nt, Human; identical to SEQ ID NO: 359367

SEQ ID NO: 508965 - RNA, 64 nt, Human; identical to SEQ ID NO: 359368

SEQ ID NO: 508966 - RNA, 64 nt, Human; identical to SEQ ID NO: 359369

SEQ ID NO: 508967 - RNA, 64 nt, Human; identical to SEQ ID NO: 359373

SEQ ID NO: 508968 - RNA, 64 nt, Human; identical to SEQ ID NO: 359374

SEQ ID NO: 508969 - RNA, 64 nt, Human; identical to SEQ ID NO: 359375

SEQ ID NO: 508970 - RNA, 64 nt, Human; identical to SEQ ID NO: 359376

SEQ ID NO: 508971 - RNA, 64 nt, Human; identical to SEQ ID NO: 359377

SEQ ID NO: 508972 - RNA, 64 nt, Human; identical to SEQ ID NO: 359378

SEQ ID NO: 508973 - RNA, 64 nt, Human; identical to SEQ ID NO: 359379

SEQ ID NO: 508974 - RNA, 64 nt, Human; identical to SEQ ID NO: 359380

SEQ ID NO: 508975 - RNA, 64 nt, Human; identical to SEQ ID NO: 359381

SEQ ID NO: 508976 - RNA, 64 nt, Human; identical to SEQ ID NO: 359382

SEQ ID NO: 508977 - RNA, 64 nt, Human; identical to SEQ ID NO: 359383

SEQ ID NO: 508978 - RNA, 64 nt, Human; identical to SEQ ID NO: 359384

SEQ ID NO: 508979 - RNA, 64 nt, Human; identical to SEQ ID NO: 359385

SEQ ID NO: 508980 - RNA, 64 nt, Human; identical to SEQ ID NO: 359386

SEQ ID NO: 508981 - RNA, 64 nt, Human; identical to SEQ ID NO: 359387

SEQ ID NO: 508982 - RNA, 64 nt, Human; identical to SEQ ID NO: 359388

SEQ ID NO: 508983 - RNA, 64 nt, Human
uuucacacauaggcucugaaagugggaaaggaaagcugaucaagcaggggccggacuuggggga

SEQ ID NO: 508984 - RNA, 64 nt, Human
aggacaagccagcuucagagaauagugaggagaagcugaucaguaaguuugacaagcuuccagu

SEQ ID NO: 508985 - RNA, 64 nt, Human
cagguucccacagccuugggcccuagguaccccagcugaucagugccaggagagaccagagccu

SEQ ID NO: 508986 - RNA, 64 nt, Human
ccaucaaccuuggugacagcagcgcagugccaaugcugaucacacugcaugggagauuuuguua

SEQ ID NO: 508987 - RNA, 64 nt, Human
gcacuggacugaauuuuuaccucaaugugcaaaggcugaucagccugaacuuucuaaaggacuu

SEQ ID NO: 508988 - RNA, 64 nt, Human
uagagucuugcuguguuacccaggguggauugcagcugaucauagcucacugcagcuucaaacu

SEQ ID NO: 508989 - RNA, 64 nt, Human
uagcugaucucuaauuuaacugagcucuaauuuagcugaucagauuuugcuuggguaaaguucc

SEQ ID NO: 508990 - RNA, 64 nt, Human
gucaaucuugguuaaugagcuacaguuuuacaaagcugaucacuuccuauaaggacaaugguag

SEQ ID NO: 508991 - RNA, 64 nt, Human
acuauugccucauauuguccucugcaagcuucuugcugaucagaguuccuccuacuuacaaccc

SEQ ID NO: 508992 - RNA, 64 nt, Human
acuuuccuaaaguguuuuugccauuggaauuuuugcugaucacagucuuaugucauuuuuuucu

SEQ ID NO: 508993 - RNA, 64 nt, Human
aaagacgggcaacacagcggguuacauccacacugcugaucacaccaacgacaggagcugauaa

SEQ ID NO: 508994 - RNA, 64 nt, Human
uccugcuucucugcaggugaaaacucugggggaugcugaucaauagagcuuggucccaagcucu

SEQ ID NO: 508995 - RNA, 64 nt, Human
ggucuggggcgaggccaggggccaucaaaaacaggcugaucaccaaagucagugucacccugga

SEQ ID NO: 508996 - RNA, 64 nt, Human
cuuggggcauauaagcuacugaguggaacauggagcugaucaagaggccguaauggucauggcu

SEQ ID NO: 508997 - RNA, 64 nt, Human
ugguuauuguuuuuuucccuuuucuuagcuaugagcugaucauugcuccuucucaccuccugcc

SEQ ID NO: 508998 - RNA, 64 nt, Human
cuugauccaugugaacauccgcaccugcacccaugcugaucaauaaaugccgacaacacauuuu

SEQ ID NO: 508999 - RNA, 64 nt, Human
uuuacauuuuggcuaucuuuacuuuguucugggagcugaucaugauaaccugcagaccugauca

SEQ ID NO: 509000 - RNA, 64 nt, Human
agcaauuggaaaagggaaagacaaaguagugggagcugaucaaacguugaguuccuuggguugg

SEQ ID NO: 509001 - RNA, 64 nt, Human
ugcuguuuugcagguucaaaccuuguacuacucagcugaucacaagcugcuugaugggaaccua

SEQ ID NO: 509002 - RNA, 64 nt, Human
aacaaucagguccccugagauagcuggucauugggcugaucauugccagaaucuucuucuccug

SEQ ID NO: 509003 - RNA, 64 nt, Human
uuucccuccauuuguuacgugagagaaugcgucugcugaucacugaagugucccuuuuagcuuc

SEQ ID NO: 509004 - RNA, 64 nt, Human
ccuuugccuaggaggccuucucgcauuuucucuagcugaucagaauuuuaccaaaauucagaac

SEQ ID NO: 509005 - RNA, 64 nt, Human
uguaaagaaaaacaaaugguaacuggugcuuaaagcugaucaagaaaguuaacaacaacauaga

SEQ ID NO: 509006 - RNA, 64 nt, Human
agucauuuacuaaacauaugauuucacuagaaaagcugaucauaagugaauuuauaccuaccug

SEQ ID NO: 509007 - RNA, 64 nt, Human
cauauuuuaguuaguacuaaauucuuaguaaaaugcugaucaguaaaccaaucccuugaguuau

SEQ ID NO: 509008 - RNA, 64 nt, Human
uaaaauguagagggauaccugucugcauaauaaagcugaucauguuuugcuacaguuugcaggu

SEQ ID NO: 509009 - RNA, 64 nt, Human
cugaaccuggauggauuauagaggagcccucacggcugaucaauaauguugcaaagggagacua

SEQ ID NO: 509010 - RNA, 64 nt, Human
acauuuggggguauaucuauuucugaagagguaagcugaucaaaauaaauagaguguaaauucu

SEQ ID NO: 509011 - RNA, 64 nt, Human
cuagauuuucugaagaaaauggauuguguaaaaugcugaucauuuguuuauuaaaauguguccu

SEQ ID NO: 509012 - RNA, 64 nt, Human
ccugucuuacuagaucugggcagcauuugacauggcugaucaccccuugcuucuuggauggcac

SEQ ID NO: 509013 - RNA, 64 nt, Human
uugagggacagcccuuggcaaugcuuuccuaucugcugaucauggugaccuuccuuaggacuuc

SEQ ID NO: 509014 - RNA, 64 nt, Human
augguuacauaucaaaacaucccaauucuuuagugcugaucaucgaggagcuagaacauuccau

SEQ ID NO: 509015 - RNA, 64 nt, Human
acuugggcagcugaagcccugccauucugcaugagcugaucagccugugccacacuucgcucuu

SEQ ID NO: 509016 - RNA, 64 nt, Human
uugggccugaguagggcagagagggccuuuccuggcugaucagagcuuaccagccccaccccac

SEQ ID NO: 509017 - RNA, 64 nt, Human
cucugcuguauuccauguaucccaauccgguccugcugaucaauuccaaucccagacauuucuc

SEQ ID NO: 509018 - RNA, 64 nt, Human
uugucccuaggcuacaaugcuacacuuggcucaggcugaucaccaugcuagucacaggagggag

SEQ ID NO: 509019 - RNA, 64 nt, Human
uggacacccagaauugguaucucauggcuggagagcugaucagccaggcacagaaucuccagaa

SEQ ID NO: 509020 - RNA, 64 nt, Human
gagggcacuuggauaacucaaguugauauuuauagcugaucaaucuauaugugucacagaacua

SEQ ID NO: 509021 - RNA, 64 nt, Human
agggauugacacccuucuguuuuauggaauugcugcugaucauuuuuucuuuaaaacuuggaua

SEQ ID NO: 509022 - RNA, 64 nt, Human
aguggaaucagccugugcaggcuggggaucucaggcugaucaguaggggccagcuuuggagcca

SEQ ID NO: 509023 - RNA, 64 nt, Human
acauggggaauagaugaaauaagauuggccaugagcugaucauuguugaagcuaggugauggac

SEQ ID NO: 509024 - RNA, 64 nt, Human
cccgcacgucagccgggcucgcggcacgcccgccgcugaucacucugcauguuucuucgugugg

SEQ ID NO: 509025 - RNA, 64 nt, Human
auacuuggggcccuaagaguguucaguauugaaugcugaucagcugccaggugaggagucagaa

SEQ ID NO: 509026 - RNA, 64 nt, Human
agcuauuuuaaaggggguccauuuacaucaaacagcugaucagaggacucuaucuaaauuguga

SEQ ID NO: 509027 - RNA, 64 nt, Human
cuggaaguucccuuuagauuucacauuuuauauggcugaucaauuuucauacauugagaaacca

SEQ ID NO: 509028 - RNA, 64 nt, Human
aagaagaagagaguuccuccaauucugaccgagugcugaucauucccuagagacaccaguaacc

SEQ ID NO: 509029 - RNA, 64 nt, Human
ugcgcgacguucggcgcuaccagaacuccgagcugcugaucagcaagcugccgcuccugcgaga

SEQ ID NO: 509030 - RNA, 64 nt, Human
aaacaaaugugacuuaugcuggugcccucgcccugcugaucagauucugguucaaauucugcca

SEQ ID NO: 509031 - RNA, 64 nt, Human
ccuguaaucccagcacuuugggaagccaaggugggcugaucacuugaucccaggaguuugagac

SEQ ID NO: 509032 - RNA, 64 nt, Human
auccgaguguccuaaccccacgccaugugauggagcugaucaaggucauguuucucacuguucc

SEQ ID NO: 509033 - RNA, 64 nt, Human
uccucaagucucagugcuauccuauuacaacauggcugaucauuaauuagaagguuauccuugg

SEQ ID NO: 509034 - RNA, 64 nt, Human
uauguauaaagucaugcucgauuucaggagagcagcugaucacaauuugcuucaugaaucaagg

SEQ ID NO: 509035 - RNA, 64 nt, Human
cucuuguugugcucuuugugcccaagaugcgcaggcugaucacccgaggggaauggcagucgga

SEQ ID NO: 509036 - RNA, 64 nt, Human
auggccuuuauuaaaaacugagugacucuauauagcugaucaguuuuuucaccuggaagcauuu

SEQ ID NO: 509037 - RNA, 64 nt, Human
uuauaauuucuaauaaccaacuccagaacuaggagcugaucaacucuuuguuuuccucuccauc

SEQ ID NO: 509038 - RNA, 64 nt, Human
cacaggaucccagcacuuugggaggccgaggcaggcugaucacgaggucagaagaucaagacca

SEQ ID NO: 509039 - RNA, 64 nt, Human
uguacggccucgugggggcaggggucgugcugaugcugaucauccugguagcucuccugaugcu

SEQ ID NO: 509040 - RNA, 64 nt, Human
aguucuaaauuauuccuaucucaauagccaagaggcugaucaagcgucauuuauugaggaagca

SEQ ID NO: 509041 - RNA, 64 nt, Human
gagguauagagggcauauaagcuaugggacauaugcugaucacaggcuauauucaugaaguuac

SEQ ID NO: 509042 - RNA, 64 nt, Human
ugguuuaguggcucaacauuguguucccauuucagcugaucagugggccuccaaggaggggcug

SEQ ID NO: 509043 - RNA, 64 nt, Human
gcccugagggacagcccagcucugagucucagucgcugaucacugccagggaggcucaggcugc

SEQ ID NO: 509044 - RNA, 64 nt, Human
ccaucucaaaggucacacguaauagccucccugggcugaucauucccucuccuuguaauugcag

SEQ ID NO: 509045 - RNA, 64 nt, Human
ggucagggagguggcucagaguccaccucucauugcugaucaauuucucauuaccccuacacau

SEQ ID NO: 509046 - RNA, 64 nt, Human
ccacuuaaaagagcaagcuaacacauugucuuaagcugaucagggauuuuuuguauauaagucu

SEQ ID NO: 509047 - RNA, 64 nt, Human
ugugucuucuagggaagucuguuagaacugcugugcugaucaacgggacgcuccgucuuugaag

SEQ ID NO: 509048 - RNA, 64 nt, Human
uuaaaagacugucgccaaauagcugagccaaaaggcugaucagaauucacuuuuuggaaugugg

SEQ ID NO: 509049 - RNA, 64 nt, Human
gccaggcugagccgaucuggucucguguucgcuggcugaucauugcaguaucagaggguggaga

SEQ ID NO: 509050 - RNA, 64 nt, Human
auacaacugagucucgaggggcguguguuccccagcugaucaugucagccucaugccccaggcc

SEQ ID NO: 509051 - RNA, 64 nt, Human
ucuugcugguaacaaaagaauuggugcaccuucagcugaucaaacauuaacaaacaugaacagg

SEQ ID NO: 509052 - RNA, 64 nt, Human
ccugacuuaagaguuuucaagaugucaacuucaggcugaucagcagaugggaugugaaaaauac

SEQ ID NO: 509053 - RNA, 64 nt, Human
caaggaaacgcuaccucucugucccuugcuguaugcugaucaucgccagaggugcuucacccug

SEQ ID NO: 509054 - RNA, 64 nt, Human
ggugugucuggacuuaacucacguaguaaauacugcugaucaauaccuaaucauuccacauuua

SEQ ID NO: 509055 - RNA, 64 nt, Human
caugcaggaagaugucaaagucagccccaucuuggcugaucaggguguucagccuuaaccccac

SEQ ID NO: 509056 - RNA, 64 nt, Human
gugaagcucccaugugcuggaauggcauggacuugcugaucaacagaaggaaauggucugaagu

SEQ ID NO: 509057 - RNA, 64 nt, Human
ggaaguugagcuuugcuaaauaaaagauauuucugcugaucaaagaugaucaagcuuucugugu

SEQ ID NO: 509058 - RNA, 64 nt, Human
uuggcucugacuuucagcuguguugggaccacuggcugaucacaucaccucucugccucaguuu

SEQ ID NO: 509059 - RNA, 64 nt, Human
acaucgcguaaccuugggaaagcuguuuaaagucgcugaucauccucuuccucaucuguaaaug

SEQ ID NO: 509060 - RNA, 64 nt, Human
uuucaaugucugucucuguugcuucggggcauaagcugaucaccgucuaguugggaaaguaacc

SEQ ID NO: 509061 - RNA, 64 nt, Human
caauaaauuauggcucuucaccugggcgccaacugcugaucaaugaaaugcuuguugaaucagg

SEQ ID NO: 509062 - RNA, 64 nt, Human
auguuaccaaucccguucgcucugacccuugcuggcugaucaccuugagcaacuuacuuaacau

SEQ ID NO: 509063 - RNA, 64 nt, Human
uccauugugacuuuggaauuuagggaagugaguagcugaucaacaccuuaaaauucauuuaaua

SEQ ID NO: 509064 - RNA, 64 nt, Human
aaagacggguucagcacccaccuuucuuuagccagcugaucagagaugcugcaaagagaaccuu

SEQ ID NO: 509065 - RNA, 64 nt, Human
uuuaaggaaaacccccaaaggcuacaggcgaccugcugaucaggaaagaauuucgcucuuguca

SEQ ID NO: 509066 - RNA, 64 nt, Human
cugaaauccugaguuuaaguggcuugauuaaauggcugaucaaaacuuaaaaacacacuagguc

SEQ ID NO: 509067 - RNA, 64 nt, Human
gccaccgcagcagcagaguacaaccugcagagaagcugaucaccgggcagagauagagcgagca

SEQ ID NO: 509068 - RNA, 64 nt, Human
auugcuugagcccaggaguuugagguugcagugagcugaucaugccacugcacucuagccuagg

SEQ ID NO: 509069 - RNA, 64 nt, Human
gucaucagagcuccucuguccugcuucugaaugugcugaucauuugaggaauaaaauuauuuuu

SEQ ID NO: 509070 - RNA, 64 nt, Human
uugguguggauuuucuacuguaagaagagccauagcugaucaugucccccugacccuucccuuc

SEQ ID NO: 509071 - RNA, 64 nt, Human
gaguuguggaaugacaacagcccaugccauugaugcugaucagagaaaaacuauucaauucugc

SEQ ID NO: 509072 - RNA, 64 nt, Human
ggacugaagaggggcccccagcucgggaccuggugcugaucagaguggcugcugccccagccug

SEQ ID NO: 509073 - RNA, 64 nt, Human
auggacuaugguucaaggacacuggaauugaggagcugaucaaggcucucuucagccuugcucu

SEQ ID NO: 509074 - RNA, 64 nt, Human
gcugacacaggccucacugcaauuugauaugccugcugaucagagucucuugggcauuuuauau

SEQ ID NO: 509075 - RNA, 64 nt, Human
ggaggaaugagugucugagagucuuccacgaccggcugaucagugaaacagacaagcagcuggu

SEQ ID NO: 509076 - RNA, 64 nt, Human
aaaacgcucacggaccuugaacgaggagagcacugcugaucagacuaggccccacucagccugg

SEQ ID NO: 509077 - RNA, 64 nt, Human
ucuaccaaggcuguggaacucuccuacgaguucugcugaucaggaaauuuaagaauuuaucuua

SEQ ID NO: 509078 - RNA, 64 nt, Human
acgcucaccacccugacccuccuuccagagcagugcugaucacuggauccuguaugugaggaaa

SEQ ID NO: 509079 - RNA, 64 nt, Human
caucucaagcaaguuuaaucaaugaucaucucacgcugaucauuggauccuacucaacaaaagg

SEQ ID NO: 509080 - RNA, 64 nt, Human
ugggguauccgggaggauggccgcaccccuuccugcugaucacccaaacguggucucccgucca

SEQ ID NO: 509081 - RNA, 64 nt, Human
uaugcuugcuuggggaauguuguuuucugacuaggcugaucauuaucuaaagaaucuaauucug

SEQ ID NO: 509082 - RNA, 64 nt, Human
gcuuuuccaagugugagcgccccaccgacugugugcugaucagagacuggagagguggagugag

SEQ ID NO: 509083 - RNA, 64 nt, Human
agcuguggagucuaucagacgugggcugaauuuugcugaucagcuggguaguuuuggccgagaa

SEQ ID NO: 509084 - RNA, 64 nt, Human
agaacagggagauaaacaucaucaucuucuaagagcugaucaagaaauuuaaaacaacaacaac

SEQ ID NO: 509085 - RNA, 64 nt, Human
gucugucuguuguauacagugggugccauauaaagcugaucaaugguggugcuuccugccugcu

SEQ ID NO: 509086 - RNA, 64 nt, Human
aaaccuuccccugugacagaagaugagguuggcagcugaucagaccucaauaauuuuauacugu

SEQ ID NO: 509087 - RNA, 64 nt, Human
cagcuagucuaggagguuaacgucggguaggaaugcugaucaugauagguuugguuuucuacag

SEQ ID NO: 509088 - RNA, 64 nt, Human
ggauacuuguucaggguugccaugcugcugcugagcugaucaaggaagucucucuagguagaga

SEQ ID NO: 509089 - RNA, 64 nt, Human
auugugcugagcgcugagcuugcgcucagggcuggcugaucaaacucaagcucacaccuguacc

SEQ ID NO: 509090 - RNA, 64 nt, Human
ccugcaaaaggagguaaguuucucaccacguagcgcugaucaucccguguugcccgugcguugc

SEQ ID NO: 509091 - RNA, 64 nt, Human
gaacccagcugugccccucccccaggggcgugaggcugaucagcgaagacgggaggaaagauuu

SEQ ID NO: 509092 - RNA, 64 nt, Human
gcaccagcuauaggucacagccacaucacucacagcugaucacugguugguggaaaauaaacua

SEQ ID NO: 509093 - RNA, 64 nt, Human
gagucagagagggggaugucugaagaugguccuggcugaucacuucuuucuuuccacacucaca

SEQ ID NO: 509094 - RNA, 64 nt, Human
cugccuggccggguuucuaccucucgucaccggagcugaucacugucaguuuuguaccgauuua

SEQ ID NO: 509095 - RNA, 64 nt, Human
ccuguccucguucccugcagguaacaugagaagggcugaucaggagaugcucuuuaagaaguuc

SEQ ID NO: 509096 - RNA, 64 nt, Human
ucccuuccucccccaugugauaaauggguccagggcugaucaaagaacucugacugcagaacug

SEQ ID NO: 509097 - RNA, 64 nt, Human
cuugcuugaaagcguugugcccucugagugucuggcugaucacaucagagaggucugcguggca

SEQ ID NO: 509098 - RNA, 64 nt, Human
ugccgccaccacggcauuaugaucccuucccccugcugaucaaucugcaguuugugaacuucac

SEQ ID NO: 509099 - RNA, 64 nt, Human
cucggguuccuaccggcuucucugcauuuggucugcugaucauguugccauaauguguauggaa

SEQ ID NO: 509100 - RNA, 64 nt, Human
ucacuggggacacagaaaugcuacaaagccaccugcugaucaucaauuugcuugggauauacua

SEQ ID NO: 509101 - RNA, 64 nt, Human
gccggauuuggcaacucaaaaccaccuugccucagcugaucagaguuucuguggaauucuguuu

SEQ ID NO: 509102 - RNA, 64 nt, Human
uuuuagagaguuggcaccuuugaugugguagugagcugaucauccacuuucuucuaaaauaaag

SEQ ID NO: 509103 - RNA, 64 nt, Human
ucgggugcugauauugccuguuuccuaguaaugggcugaucaaaugaucaguggaauucuuggu

SEQ ID NO: 509104 - RNA, 64 nt, Human
uugauaaccagcuuaucuuaucaguaguuuuauugcugaucaggcaaaaauaguuuuccaaagu

SEQ ID NO: 509105 - RNA, 64 nt, Human
ccuauaauccuagcacuuugagaggccaaggugggcugaucacaaggucaagaguucgugacca

SEQ ID NO: 509106 - RNA, 64 nt, Human
gggagcucaggaaugugggguuguggaggggcuggcugaucacacaugcccccuccuuacugag

SEQ ID NO: 509107 - RNA, 64 nt, Human
gaccugcgcccaccccuccacucucccaggagucgcugaucacugggaccugguuccagccguu

SEQ ID NO: 509108 - RNA, 64 nt, Human
ccaaaggauagucuuuaucaguucauuauuuauugcugaucauuuuucuguucauauauacaug

SEQ ID NO: 509109 - RNA, 62 nt, Human
augcaaugcuagauaauaaaauugcucccuauuggcugaucagagaggagucuguguaguuu

SEQ ID NO: 509110 - RNA, 64 nt, Human
ccugcucacauauaaauuguguauuuagugaaaggcugaucaaagauucaaagaauguuauuug

SEQ ID NO: 509111 - RNA, 64 nt, Human
aagguuuuaugaaaugugaaccauuuugggaaaagcugaucaauuuuucuuccuagcuucccau

SEQ ID NO: 509112 - RNA, 64 nt, Human
cacaguggccugcaugggccagcauggacccugggcugaucaugugcauuccugcuucucuggg

SEQ ID NO: 509113 - RNA, 64 nt, Human
auuugaaauuacuucuguuuggcuaguuugcuuagcugaucaccaccaacaucauaggucuaua

SEQ ID NO: 509114 - RNA, 64 nt, Human
aguaaacaaauggugccaucauucaagauaacaugcugaucacccuccucccaaaaagcaagag

SEQ ID NO: 509115 - RNA, 64 nt, Human
uugguuugucagugucccccaucgacucucuggggcugaucacuuaguuuuuggccucugcugc

SEQ ID NO: 509116 - RNA, 64 nt, Human
uuccaugccauacuguaacauuccaacaucuuuagcugaucagaucucuccauauccucucuug

SEQ ID NO: 509117 - RNA, 64 nt, Human
cugaagcucugucccuauucccccagcccagcuagcugaucacaccaacagauccucaucagca

SEQ ID NO: 509118 - RNA, 64 nt, Human
auuagacuuuaauucgagcgcgugugaacugaacgcugaucaguauuuuuuaucaacaccugag

SEQ ID NO: 509119 - RNA, 50 nt, Human
gaguugcagcuuuguguuaagcugaucacagacaccggcugcaccaucag

SEQ ID NO: 509120 - RNA, 64 nt, Human
cucccguguccguccaccgagcacucagauggaugcugaucaccagggccgagggggcucccag

SEQ ID NO: 509121 - RNA, 64 nt, Human
gaauuuuguuuuuagccaggucaguauugaugaggcugaucauuuggcucuuuuuuuccuucca

SEQ ID NO: 509122 - RNA, 64 nt, Human
agacucagucucaaaaagaaaaaagaaauuuauugcugaucacaaggacagacaguuuuuuccc

SEQ ID NO: 509123 - RNA, 64 nt, Human
cugggcagguagcagucccuggccucucccccuggcugaucacucucccucaggcaguggagau

SEQ ID NO: 509124 - RNA, 64 nt, Human
cauccaccccaccacaacugcccagguagcuggagcugaucauaaacaagaaggcucugggcag

SEQ ID NO: 509125 - RNA, 64 nt, Human
agaaaugcaaacaggcuguucaccaccaucuccagcugaucacagacaccagcaaagcaaugca

SEQ ID NO: 509126 - RNA, 64 nt, Human
ggugccucacaggguuccugcugccuggugucuugcugaucaucacccuggucacuucaugcug

SEQ ID NO: 509127 - RNA, 64 nt, Human
gccucucacauggagauuguguauucagugaaaggcugaucaaagacccaaaggaaugcaacag

SEQ ID NO: 509128 - RNA, 64 nt, Human
acaugaacucaucaugguaacacuggguauuucagcugaucagaagcucagcauggccauuaug

SEQ ID NO: 509129 - RNA, 64 nt, Human
gggacaacaaaguuaauaugauuaaccaccugccgcugaucagccuuauguucccaaagagccc

SEQ ID NO: 509130 - RNA, 64 nt, Human
uaaguacuuaucuuuauuuguaauaauuuagucugcugaucaaaagcauugucuuaauuuuuga

SEQ ID NO: 509131 - RNA, 64 nt, Human
cuucuguuuucuuuuagcgaccccccaccgccaggcugaucagaagcugaugacucguggacaa

SEQ ID NO: 509132 - RNA, 64 nt, Human
ucuccccuguagggcauguugaggaaggaggagggcugaucaaggccaagcuggucuagccuga

SEQ ID NO: 509133 - RNA, 64 nt, Human
ugcugcaggaccuaaagggagccccaucuuuauggcugaucaacuacaacccuauaugccugaa

SEQ ID NO: 509134 - RNA, 64 nt, Human
gauggggaaggucacuggaaauugaggccaaagggcugaucagaauugccuuuauaauauauuu

SEQ ID NO: 509135 - RNA, 64 nt, Human
ggaugauaauccaaaaguauuucacagcacuaaugcugaucaaaauuugcucucccaccaagaa

SEQ ID NO: 509136 - RNA, 64 nt, Human
cuggggaaagcccucuucugcagcuuuguggaaggcugaucaguggcugcuggguggcggguac

SEQ ID NO: 509137 - RNA, 64 nt, Human
ccuaauauugacuuucaggaauaaaguucagugugcugaucauucacaauacaguggauagcuu

SEQ ID NO: 509138 - RNA, 64 nt, Human
ggagucucgcucugucgcccaggcuggagugcaguggcgcaaucucagcucacugcaagcucug

SEQ ID NO: 509139 - RNA, 64 nt, Human
ggagucucgcucuuucgcccaggcuggagugcaguggcgcaaucucggcucacuguaaucuccg

SEQ ID NO: 509140 - RNA, 64 nt, Human
ggagucucucacugucgcccaggcuggagugcaguggcgcaaucucggcucacugcaaccuccg

SEQ ID NO: 509141 - RNA, 64 nt, Human
aguuucacucuuguugcccaggcugggggugcaauggcgcaaucuuugcucacugcaaccccug

SEQ ID NO: 509142 - RNA, 64 nt, Human
gaguuucgcucuuguugcccaggcuggagugcaauggcgcaaucucgacucaccacaaccuccg

SEQ ID NO: 509143 - RNA, 64 nt, Human
aacauucucauaaaauugggcacagaguucgcauuggcgcaauauuuaugggagugggagggau

SEQ ID NO: 509144 - RNA, 64 nt, Human
gaguuuggcucuugucacccaggcuggagugcaauggcgcaaucucagcucacugcaaccucug

SEQ ID NO: 509145 - RNA, 64 nt, Human
agggucucccucuguugccaaggcuggagugcaguggcgcaaucuuaacucauugcaaccucca

SEQ ID NO: 509146 - RNA, 64 nt, Human
ccucccaccaugcgcugcucaaccucucuccuucuggcgcaagagaacauuucuagaaaaaacu

SEQ ID NO: 509147 - RNA, 64 nt, Human
guuuuuuuguuuguuuguuuguuuguuuugagacuggcgcaaucuuggcucaccgcaaccuccg

SEQ ID NO: 509148 - RNA, 64 nt, Human
uuaauuuuuuuguagagauggggucucgcuuuguuggcgcaauccucccaccucagacucccaa

SEQ ID NO: 509149 - RNA, 64 nt, Human
aggaucucauucuguugccuaggcuggagugcaguggcgcaaucucggcucacugcaaccucug

SEQ ID NO: 509150 - RNA, 64 nt, Human
agagucuugcucugucacccaggcuggagugcaguggcgcaaucucgggucacugcaagcucug

SEQ ID NO: 509151 - RNA, 64 nt, Human
ggagucuugcucugucacccaggcuggagugcgguggcgcaaucucggcucacugcauccucug

SEQ ID NO: 509152 - RNA, 64 nt, Human
ggagucucacucuguggcccaggcuggagugcaguggcgcaaucuuggcucacugcaaccucca

SEQ ID NO: 509153 - RNA, 64 nt, Human
uugccauugccuuucuuguuuacagauagugcaauggcgcaauccuggcucacugcagccucua

SEQ ID NO: 509154 - RNA, 64 nt, Human
agagucucauucugucacccaggcuggagugcaguggcgcaaucuuggcucacugcaaccuccg

SEQ ID NO: 509155 - RNA, 64 nt, Human
ucuuuuuagugaguucaugaauguuuaacgguucuggcgcaaagcuuucuugcauucugagcau

SEQ ID NO: 509156 - RNA, 64 nt, Human
uuggcacaacuugcgaguguagugacuuuaggacuggcgcaaaaccuccagggugcucaacuua

SEQ ID NO: 509157 - RNA, 64 nt, Human
cccaugcccacacuacaggccagggcugcggggcuggcgcaaucccagcccccuuccccgggcc

SEQ ID NO: 509158 - RNA, 64 nt, Human
uuugaaaauuguuagagaaaacaacauuagaaaauggcgcaaaaucguuaggucccaggagaga

SEQ ID NO: 509159 - RNA, 64 nt, Human
uuuuaaucuagcaguguugaagcugggaauuuuuuggcgcaauccauguagcagugacccaggc

SEQ ID NO: 509160 - RNA, 64 nt, Human
aaagucucgcugugucacccaggcuggagugcaguggcgcaaucucacugcauccuccgccucc

SEQ ID NO: 509161 - RNA, 64 nt, Human
agaguuucucucuguugcccaggcuggagugcaguggcgcaauuucagcucacugcaaccucug

SEQ ID NO: 509162 - RNA, 64 nt, Human
ugcuccggugcacaaaugcuuucucuucaaggcauggcgcaaaaaagccacuacuuccagaagc

SEQ ID NO: 509163 - RNA, 64 nt, Human
cucuacuaaaauacaaaaaauuagcugggugugguggcgcaaaccuguagucguagcuacuugg

SEQ ID NO: 509164 - RNA, 64 nt, Human
agagucucgcucugucaccuaggcuggagugcaguggcgcaaucucaccucacugcaagcucug

SEQ ID NO: 509165 - RNA, 64 nt, Human
aauccccacuguccucaucucuaccgccaccuucuggcgcaacaagaaguugcgcucugacagg

SEQ ID NO: 509166 - RNA, 64 nt, Human
aaaagguuuccgcagaggugguaugcugugcuuuuggcgcaagugguggggggauggggugggg

SEQ ID NO: 509167 - RNA, 64 nt, Human
uggucagaugcagguuggaaggggccuugcugaguggcgcaaggccgagcguucccagcagggg

SEQ ID NO: 509168 - RNA, 64 nt, Human
ggaaucucgcucugucgcccaggcuggagugcacuggcgcaaucucggcucacugcaaccucug

SEQ ID NO: 509169 - RNA, 64 nt, Human
gagggcuccucaggcagccacaaggcaggaaaacuggcgcaaauuuccugggccucccucugac

SEQ ID NO: 509170 - RNA, 64 nt, Human
ugagucuugcucugucacugaggcuggagugcaguggcgcaauuucagcucacugcaaccucug

SEQ ID NO: 509171 - RNA, 64 nt, Human
gacagucuugcucugucaucaggcuggagugcaguggcgcaauuucggcucacugcaaccucca

SEQ ID NO: 509172 - RNA, 64 nt, Human
acagucucgcucugucgcccaggcuggagugcaguggcgcaaucucggcucacugcaaccucca

SEQ ID NO: 509173 - RNA, 64 nt, Human
caaaaaaaaaaaaaaaaaaaauagccgggcaugguggcgcaagccuguaaucccagcuacucag

SEQ ID NO: 509174 - RNA, 64 nt, Human
auacggggaagacccacccagggagcgguuucaguggcgcaacaaagcaccacuuuuacuguug

SEQ ID NO: 509175 - RNA, 64 nt, Human
agagucucucucuguugcccaggcuggagugcaguggcgcaaucucagcucacugcaaccuccg

SEQ ID NO: 509176 - RNA, 64 nt, Human
ucaucuuaauacuagucuauacauuuuugccaaauggcgcaaauauaccuccauuuauauuuug

SEQ ID NO: 509177 - RNA, 64 nt, Human
agucucgcuguugucagcccaggcuggagugcaauggcgcaaucucgguucacugcaaccucug

SEQ ID NO: 509178 - RNA, 64 nt, Human
ggagucuugcucugucgcccaggcuguagugcaauggcgcaaucucagcucacugcaagcuccg

SEQ ID NO: 509179 - RNA, 64 nt, Human
ccuuucugacucugucguccaggcuggagugcaguggcgcaaucucacugcaagcuccacuucc

SEQ ID NO: 509180 - RNA, 64 nt, Human
cccccaccacaaacacagcccuggaaacauacaguggcgcaagguccucuugaaauguuaaugg

SEQ ID NO: 509181 - RNA, 64 nt, Human
gaguuucauucuuguugccgaggcuggagugcaauggcgcaaccuuggcucacugcaaccucug

SEQ ID NO: 509182 - RNA, 64 nt, Human
gucucgcucuguugcccaggcugcuggagugccguggcgcaaucucggcucacugcaaccuccg

SEQ ID NO: 509183 - RNA, 64 nt, Human
ggagucucacucuguuacccaggcuggaaugcaguggcgcaaucuuggcucacuuuaaccucca

SEQ ID NO: 509184 - RNA, 64 nt, Human
cuuuguaaggaauucuugcucuucuaggggugccuggcgcaaccgugggcaaguuacugcuccu

SEQ ID NO: 509185 - RNA, 64 nt, Human
gagucuugcucuugucgcccaggcuggagugcaguggcgcaaucucagcucacugcaaccuccg

SEQ ID NO: 509186 - RNA, 64 nt, Human
cugacggguccccugggucugcauaggucucccauggcgcaaugagucaguggcccccagccag

SEQ ID NO: 509187 - RNA, 64 nt, Human
ggagucucgcucugucgcccaggcuggagugcaguggcgcaaucucagcucacugcaagcucca

SEQ ID NO: 509188 - RNA, 64 nt, Human
ggagucucgcucugucgcccagguuggagugcaguggcgcaaucucggcucacugcaagcuccg

SEQ ID NO: 509189 - RNA, 64 nt, Human
gagucuuacucuguugccuaggcuggagugaaaguggcgcaaccucugccucccaggucaaagc

SEQ ID NO: 509190 - RNA, 64 nt, Human
gcggcagccccggagggcggcugggagcugagcguggcgcaagcgggccagggcgcgggcgcgg

SEQ ID NO: 509191 - RNA, 64 nt, Human
uggagucuugcucugucaccaggcuggaaugcaguggcgcaaucugggcucacugcaaccuccg

SEQ ID NO: 509192 - RNA, 64 nt, Human
cccacuuuuacguugugucccuccgccucccccauggcgcaacaggagucagucucuuucugua

SEQ ID NO: 509193 - RNA, 64 nt, Human
acagagucucgcuguuacccaggcuggagugcaauggcgcaaacuuggcucacugcaaccucug

SEQ ID NO: 509194 - RNA, 64 nt, Human
cccugcaggcgccucccguaaauccugagcucucuggcgcaaucugaaacuucucuucuguuuu

SEQ ID NO: 509195 - RNA, 64 nt, Human
ggugucucgcugcaucacccaggcuggagugcaguggcgcaaucucgccuuccugcagucuccg

SEQ ID NO: 509196 - RNA, 64 nt, Human
guguccgccucucucucucucucucugcgcguccuggcgcaaggccugggguggagccacggcu

SEQ ID NO: 509197 - RNA, 64 nt, Human
gagccaguguugucagcagccauugccacgaagauggcgcaauuucauggcauggagaugccuu

SEQ ID NO: 509198 - RNA, 64 nt, Human
gcaggagcagccagcuguggcagcgcauuaguuuuggcgcaagcgagccuaugcugcaggguca

SEQ ID NO: 509199 - RNA, 64 nt, Human
cagagucucacucuguugccaggcuggagugcaguggcgcaaucuuggcucacugcaaccuccg

SEQ ID NO: 509200 - RNA, 64 nt, Human
agagacuugcuuugucgcccaggcuggagugcaguggcgcaaugucagcucacugccaccuccg

SEQ ID NO: 509201 - RNA, 64 nt, Human
aauccugcugcucugguccuugugauaagccucucuucggcaucugaggagcagcugcagcaaa

SEQ ID NO: 509202 - RNA, 64 nt, Human
uuuagaagagucuauacuaaguucuuggugcccucuucggcagccaagggugaaggccccauag

SEQ ID NO: 509203 - RNA, 64 nt, Human
aagguucagaaagucccccuggggacuccuccaucuucggcagcucuggcucaaagaggccgag

SEQ ID NO: 509204 - RNA, 60 nt, Human; identical to SEQ ID NO: 394706

SEQ ID NO: 509205 - RNA, 60 nt, Human; identical to SEQ ID NO: 394707

SEQ ID NO: 509206 - RNA, 60 nt, Human; identical to SEQ ID NO: 394708

SEQ ID NO: 509207 - RNA, 60 nt, Human; identical to SEQ ID NO: 394725

SEQ ID NO: 509208 - RNA, 64 nt, Human
ggauuguuuuuaaaccuccauacucaagcugucucuucggcagggaggugaauacucuugaaag

SEQ ID NO: 509209 - RNA, 64 nt, Human
uaccucaguauuccaucauggucugaaagucaaacuucggcaaggcacggacgacugugcagac

SEQ ID NO: 509210 - RNA, 64 nt, Human
agcccgccaguggugagacuguguccucaaggagcuucggcaccaugucugguuuggauucauc

SEQ ID NO: 509211 - RNA, 64 nt, Human
aacaaaaaauuuccuaaugcaucugagagauaagcuucggcaguaucacaagaagauuaaagug

SEQ ID NO: 509212 - RNA, 64 nt, Human
ugggcuccuccaccagcuccacccugagcuuccucuucggcaagaggagcuuuuccagcgcgcu

SEQ ID NO: 509213 - RNA, 64 nt, Human
agcucuguucuuuccuaaucuaagccucugucuucuucggcaaaccuugcuuugaacucugcca

SEQ ID NO: 509214 - RNA, 64 nt, Human
uuaucaguggcuuugccacuaguaaaugugugaucuucggcaaguaaccuaaccuagggacauc

SEQ ID NO: 509215 - RNA, 64 nt, Human
uuggucaggggacugucugucaugccuggaggcucuucggcacacuuccccaucuuucccuucu

SEQ ID NO: 509216 - RNA, 64 nt, Human
ccauccucccaucucagugguuccauggcgcucccuucggcacgugcgguuuccgccccucccu

SEQ ID NO: 509217 - RNA, 64 nt, Human
acugugagcaccugagcaugaaacucgacgcguucuucggcaucuucuuuggggcccugggcgg

SEQ ID NO: 509218 - RNA, 64 nt, Human
ccaggacgaccuccagcgcgaucuccagcagcuccuucggcauuucugcaaggaggacuugaag

SEQ ID NO: 509219 - RNA, 64 nt, Human
aagagcuuccuuggccugacucggugugcggccacuucggcacugcuuaauccagauauucuug

SEQ ID NO: 509220 - RNA, 64 nt, Human
cuccaagauaccaucuccucauccuaacccaggucuucggcaccaccacaauuaauucccuucc

SEQ ID NO: 509221 - RNA, 64 nt, Human
augggcacugcagggacagucagucaggaugacacuucggcaucaucucuucccucucccaucg

SEQ ID NO: 509222 - RNA, 64 nt, Human
gcaccacagugccaaugcuugucagacacaugcccuucggcagcauuccagaacaggagggaag

SEQ ID NO: 509223 - RNA, 63 nt, Human
cggggcucagcccccuccaggaugcagcccccucccccgcaccccggaaccggcgucgcuggc

SEQ ID NO: 509224 - RNA, 63 nt, Human
cuauuaauacaugccuuuuccucccauccaccucccccgcacacacacaaagaugaccuggga

SEQ ID NO: 509225 - RNA, 64 nt, Human
ucaauggccagggaaacaguuggcuauucaucaucuucggcacuuaugacaacauuaacacaga

SEQ ID NO: 509226 - RNA, 64 nt, Human
aagauucauuuuucuuuuuuccauucuucaggaccuucggcaaggugagucaaggcucucuacc

SEQ ID NO: 509227 - RNA, 64 nt, Human
uaggagcuccaaaccuguagaggacccaggagggcuucggcagauuccaccuauaauucugucu

SEQ ID NO: 509228 - RNA, 64 nt, Human
cucagagaacucugccuugcccucgucccucguccuucggcagccggagaggcugugggugggc

SEQ ID NO: 509229 - RNA, 64 nt, Human
acuucuaccgggacugggccacguacaagcagggcuucggcagucggcugggggaguucuggcu

SEQ ID NO: 509230 - RNA, 64 nt, Human
uucugcacgccucgcuguccgaguaugugcugcucuucggcaccgccuugggcucccgcggcca

SEQ ID NO: 509231 - RNA, 64 nt, Human
ucacuuuucuuaggggacagaaucccaucuuuuccuucggcagauugcagccccauuccccaca

SEQ ID NO: 509232 - RNA, 64 nt, Human
cgccuacagccccaacacaagcuccagucuuccucuucggcaugcccuggaagcuucuuccagu

SEQ ID NO: 509233 - RNA, 64 nt, Human
uuuuggagguauucaauauccuuugccucaaggacuucggcagauacugucucuuucaugaguu

SEQ ID NO: 509234 - RNA, 64 nt, Human
gcggccccuuugugaacgugagcaaccuaggaggcuucggcagcggcggcagcgcacagccguu

SEQ ID NO: 509235 - RNA, 64 nt, Human
aguggagcggcgaauucccuguggccugccaugccuucggcaucagaggauggaguggucgagg

SEQ ID NO: 509236 - RNA, 52 nt, Human
ccuaugagauuucggugugagccuucggcaccuccccuccccaacgccucug

SEQ ID NO: 509237 - RNA, 64 nt, Human
ccccagagccaagaacacuaagcacucgccggcccuucggcacccucgcccucccucccgacuc

SEQ ID NO: 509238 - RNA, 64 nt, Human
gcgacuugaauaaagugggaggucaaacaugggccuucggcauuggguuucuagggaauauggc

SEQ ID NO: 509239 - RNA, 64 nt, Human
augacgcaggcgccacccugcugccggagccgggcuucggcagucuucuccacugagggacugg

SEQ ID NO: 509240 - RNA, 63 nt, Human
guugcccuacaggcccacagggccaccagcacacccccgcacgcugggcaccaacagagccac

SEQ ID NO: 509241 - RNA, 63 nt, Human
ugagccuggcugcccgccugcacgcccccacugcccccgcacgaaucaccuccugcuggcuac

SEQ ID NO: 509242 - RNA, 63 nt, Human
gaagggccagggccuggcacccaccuggagaagcccccgcacccgagggaacccaugguggac

SEQ ID NO: 509243 - RNA, 63 nt, Human
acuaacugaggagcuaguguuaauccagagaaccccccgcaaugugcuuccgagauucagacu

SEQ ID NO: 509244 - RNA, 64 nt, Human
auacacugcauccuguaaggucuguaaaucagggcuucggcaaugccauuuugcuauagacuca

SEQ ID NO: 509245 - RNA, 64 nt, Human
ucgggccaggcucccagauucuugaggacagggacuucggcauuuacuaaugggggacuacugu

SEQ ID NO: 509246 - RNA, 64 nt, Human
aucaagcccuguucuuuuuccuccagccugaagucuucggcaaauagcucagagggacacgguc

SEQ ID NO: 509247 - RNA, 64 nt, Human
acugcaucuuagcacaugcugccuuauuucuuuccuucggcagguguucaugggaaguaggugg

SEQ ID NO: 509248 - RNA, 64 nt, Human
ccgauguucagaggcauccaaaaaaagucucccacuucggcagccaugaagcccacucaugcaa

SEQ ID NO: 509249 - RNA, 64 nt, Human
gccugugaauucgcaggaucauuucagacccgcacuucggcagccaacucgaaagcaggcgguu

SEQ ID NO: 509250 - RNA, 64 nt, Human
uuacucaugcuaggcuugaggaagaagaaaaacgcuucggcauucuccuuaggacuuaucugcu

SEQ ID NO: 509251 - RNA, 64 nt, Human
aaaaaucuuuuuugaagaguuuuucuugugcuugcuucggcagcauauauacugaaauuagaaa

SEQ ID NO: 509252 - RNA, 64 nt, Human
cuucccagaaauuucaaugcauugcauauuuagccuucggcauauuuuucaugaauagaucaug

SEQ ID NO: 509253 - RNA, 64 nt, Human
cccagggucugggagcugggcuaacaggcugacacuucggcagggucaccaggaggcacagcua

SEQ ID NO: 509254 - RNA, 64 nt, Human
aaagcauuagacuuuuauccccuucaugucacuucuucggcauuaugguuugcaucugaaagca

SEQ ID NO: 509255 - RNA, 64 nt, Human
gggucggcccaggggugggcgacacaggcagcuucuucggcagccucacggcagcaaccccagc

SEQ ID NO: 509256 - RNA, 64 nt, Human
aauauauacggccuguguacacagaauuuaaucacuucggcagguugaacaacuccauguagau

SEQ ID NO: 509257 - RNA, 64 nt, Human
cuccagccccaagaugccuacagcccccaggccccuucggcagcacugccucugcccaccugcc

SEQ ID NO: 509258 - RNA, 64 nt, Human
gaggcacaaacuggacaucucucucucucauauccuucggcauuggguuaucuaugggugcaag

SEQ ID NO: 509259 - RNA, 63 nt, Human
uggaccagccaugcacccgcccagccaccacgucccccgcaugaauguacuguacacuuucaa

SEQ ID NO: 509260 - RNA, 63 nt, Human
ggcccugcugcgaaaguucuuggugguggaugacccccgcaaguuugcacucuuugagcgcgc

SEQ ID NO: 509261 - RNA, 63 nt, Human
uccaggcggggaaccugcuuccugccuucacugcccccgcagcacucacagacaucucccugg

SEQ ID NO: 509262 - RNA, 63 nt, Human
aacuguuggcugcuccccacccgccucccgccucccccgcagguuaugucagcagcucugaga

SEQ ID NO: 509263 - RNA, 64 nt, Human
aaggucuuugaaaauguuuauuggcucaggauagcuucggcauccaaucugcgaaggccccuga

SEQ ID NO: 509264 - RNA, 64 nt, Human
cuguccacccccgccucccuccccugcccucggucuucggcauugguucccuuugcuccacccc

SEQ ID NO: 509265 - RNA, 64 nt, Human
uguucucggggacccugcgcaugaaccuggaccccuucggcagcuacucagaggaggacauuug

SEQ ID NO: 509266 - RNA, 64 nt, Human
cuccugcucacacagucacccuccgcucuugcuacuucggcaagacaucuuaagaaugugacac

SEQ ID NO: 509267 - RNA, 64 nt, Human
agcaggggcugccccuccaccuggccaggacccccuucggcacccaguugcccuuggccaccac

SEQ ID NO: 509268 - RNA, 64 nt, Human
cccucaguccagcuucccaaugccuggcaccccccuucggcaauagcucaccguuuacacccuc

SEQ ID NO: 509269 - RNA, 64 nt, Human
ccuguaggggcaccaccacaguggacggcgcuggcuucggcauugaccggccggcggagcucuc

SEQ ID NO: 509270 - RNA, 64 nt, Human
guagcgagagacggcacccagaaucagaucccagcuucggcauuugaucagaccaaacagugcu

SEQ ID NO: 509271 - RNA, 64 nt, Human
cuaccacuugggcacuucacagccagccuagggucuucggcaccuccaagagcugaaucucccu

SEQ ID NO: 509272 - RNA, 64 nt, Human
cccguuuccacccgggcauguucgucucuccugacuucggcagaggccccugguggccuucagu

SEQ ID NO: 509273 - RNA, 64 nt, Human
ugccuggagccugggcagcaccuccgggacugaccuucggcaguggcugggggacugcuuucag

SEQ ID NO: 509274 - RNA, 64 nt, Human
cagugcuuucuaacagcuucugggugcagauuuucuucggcauccuuuugcacucagcuuauua

SEQ ID NO: 509275 - RNA, 64 nt, Human
ggaagugcggggaggagguuaugaucccugggcgcuucggcagaauggagagcugagguguccc

SEQ ID NO: 509276 - RNA, 64 nt, Human
accuaaaaaguagcaagaagcuacaucccucaaacuucggcaaugaaaauaaaguuugagaagc

SEQ ID NO: 509277 - RNA, 64 nt, Human
uaccgugaaugugaaaaggugaaacuggugcugacuucggcagcagguauacuaaaauuggaau

SEQ ID NO: 509278 - RNA, 63 nt, Human
cuggggggcccuugaugccacuaaucccccgaccccccgcaucugccaaacugcacagacaca

SEQ ID NO: 509279 - RNA, 63 nt, Human
uuauuggaaggcagcucccgcauaccaggauaacccccgcaaaccacauagcagacccccgcc

SEQ ID NO: 509280 - RNA, 63 nt, Human
agguuucuagaguuguuuucuuccucccccccccccccgcaccauugguuguguaucacuuuc

SEQ ID NO: 509281 - RNA, 63 nt, Human
agcacuucagaaaauacacaacagccccuucugcccccgcacagaaaugcugcagaguauaua

SEQ ID NO: 509282 - RNA, 64 nt, Human
ucaucaaaaauuacaagcgcugcuuuccugugaucuucggcaaagccuccgaguccuugcagcu

SEQ ID NO: 509283 - RNA, 64 nt, Human
uacugugaaugugaaaaggugaaacuguugcugacuucggcagcagguauacuaaaauuggaau

SEQ ID NO: 509284 - RNA, 64 nt, Human; identical to SEQ ID NO: 509201

SEQ ID NO: 509285 - RNA, 64 nt, Human; identical to SEQ ID NO: 509202

SEQ ID NO: 509286 - RNA, 64 nt, Human; identical to SEQ ID NO: 509203

SEQ ID NO: 509287 - RNA, 64 nt, Human; identical to SEQ ID NO: 509208

SEQ ID NO: 509288 - RNA, 64 nt, Human; identical to SEQ ID NO: 509209

SEQ ID NO: 509289 - RNA, 64 nt, Human; identical to SEQ ID NO: 509210

SEQ ID NO: 509290 - RNA, 64 nt, Human; identical to SEQ ID NO: 509211

SEQ ID NO: 509291 - RNA, 64 nt, Human; identical to SEQ ID NO: 509212

SEQ ID NO: 509292 - RNA, 64 nt, Human; identical to SEQ ID NO: 509213

SEQ ID NO: 509293 - RNA, 64 nt, Human; identical to SEQ ID NO: 509214

SEQ ID NO: 509294 - RNA, 64 nt, Human; identical to SEQ ID NO: 509215

SEQ ID NO: 509295 - RNA, 64 nt, Human; identical to SEQ ID NO: 509216

SEQ ID NO: 509296 - RNA, 64 nt, Human; identical to SEQ ID NO: 509217

SEQ ID NO: 509297 - RNA, 63 nt, Human
ucucagccucccaaccccagggcccccacaggccccccgcagcacccugcagagcacacaggu

SEQ ID NO: 509298 - RNA, 59 nt, Human; identical to SEQ ID NO: 302837

SEQ ID NO: 509299 - RNA, 63 nt, Human
ggugccaggggagucaggguuguagccaagacgcccccgcacggggaggguugggaagggggu

SEQ ID NO: 509300 - RNA, 63 nt, Human
caggcuguacugccaggcugcgaugcgugcuggcccccgcacaggcuccugugugcagggacu

SEQ ID NO: 509301 - RNA, 64 nt, Human; identical to SEQ ID NO: 509218

SEQ ID NO: 509302 - RNA, 64 nt, Human; identical to SEQ ID NO: 509219

SEQ ID NO: 509303 - RNA, 64 nt, Human; identical to SEQ ID NO: 509220

SEQ ID NO: 509304 - RNA, 64 nt, Human; identical to SEQ ID NO: 509221

SEQ ID NO: 509305 - RNA, 64 nt, Human; identical to SEQ ID NO: 509222

SEQ ID NO: 509306 - RNA, 64 nt, Human; identical to SEQ ID NO: 509225

SEQ ID NO: 509307 - RNA, 64 nt, Human; identical to SEQ ID NO: 509226

SEQ ID NO: 509308 - RNA, 64 nt, Human; identical to SEQ ID NO: 509227

SEQ ID NO: 509309 - RNA, 64 nt, Human; identical to SEQ ID NO: 509228

SEQ ID NO: 509310 - RNA, 64 nt, Human; identical to SEQ ID NO: 509229

SEQ ID NO: 509311 - RNA, 64 nt, Human; identical to SEQ ID NO: 509230

SEQ ID NO: 509312 - RNA, 64 nt, Human; identical to SEQ ID NO: 509231

SEQ ID NO: 509313 - RNA, 64 nt, Human; identical to SEQ ID NO: 509232

SEQ ID NO: 509314 - RNA, 64 nt, Human; identical to SEQ ID NO: 509233

SEQ ID NO: 509315 - RNA, 64 nt, Human; identical to SEQ ID NO: 509234

SEQ ID NO: 509316 - RNA, 63 nt, Human
cucucagcugugguacugcccuguaagaaccugcccccgcaaaacucuggagucccugggaca

SEQ ID NO: 509317 - RNA, 63 nt, Human
aggccuggugcagcccacucugugccuggacaucccccgcaggccgccgcgucuguguugggg

SEQ ID NO: 509318 - RNA, 63 nt, Human
cagcagccugugcaaauucugaugauggccccacccccgcacacgcacacgcacaucaugcuu

SEQ ID NO: 509319 - RNA, 63 nt, Human
ccagaagggaaaggcggcuguuuggcucuuucucccccgcaaggacccgcugacccgcuggau

SEQ ID NO: 509320 - RNA, 64 nt, Human; identical to SEQ ID NO: 509235

SEQ ID NO: 509321 - RNA, 52 nt, Human; identical to SEQ ID NO: 509236

SEQ ID NO: 509322 - RNA, 64 nt, Human; identical to SEQ ID NO: 509237

SEQ ID NO: 509323 - RNA, 64 nt, Human; identical to SEQ ID NO: 509238

SEQ ID NO: 509324 - RNA, 64 nt, Human; identical to SEQ ID NO: 509239

SEQ ID NO: 509325 - RNA, 64 nt, Human; identical to SEQ ID NO: 509244

SEQ ID NO: 509326 - RNA, 64 nt, Human; identical to SEQ ID NO: 509245

SEQ ID NO: 509327 - RNA, 64 nt, Human; identical to SEQ ID NO: 509246

SEQ ID NO: 509328 - RNA, 64 nt, Human; identical to SEQ ID NO: 509247

SEQ ID NO: 509329 - RNA, 64 nt, Human; identical to SEQ ID NO: 509248

SEQ ID NO: 509330 - RNA, 64 nt, Human; identical to SEQ ID NO: 509249

SEQ ID NO: 509331 - RNA, 64 nt, Human; identical to SEQ ID NO: 509250

SEQ ID NO: 509332 - RNA, 64 nt, Human; identical to SEQ ID NO: 509251

SEQ ID NO: 509333 - RNA, 64 nt, Human; identical to SEQ ID NO: 509252

SEQ ID NO: 509334 - RNA, 64 nt, Human; identical to SEQ ID NO: 509253

SEQ ID NO: 509335 - RNA, 63 nt, Human
ccuccagcugagccugucucugaauuguucccucccccgcaaugugggcacuuaccauguucc

SEQ ID NO: 509336 - RNA, 63 nt, Human
ggaugggagaagaaggaaggggguggcccgucacccccgcaagacuugcauccagguagccua

SEQ ID NO: 509337 - RNA, 63 nt, Human
caacugugcuuaucaaaauugugaacacccccacccccgcauuuuuguguguugaaauucuug

SEQ ID NO: 509338 - RNA, 63 nt, Human
cagcagccugugcaaauucugaugaugaccccacccccgcacacgcacacgcacaucaugcuu

SEQ ID NO: 509339 - RNA, 64 nt, Human; identical to SEQ ID NO: 509254

SEQ ID NO: 509340 - RNA, 64 nt, Human; identical to SEQ ID NO: 115781

SEQ ID NO: 509341 - RNA, 64 nt, Human; identical to SEQ ID NO: 115782

SEQ ID NO: 509342 - RNA, 64 nt, Human; identical to SEQ ID NO: 115783

SEQ ID NO: 509343 - RNA, 64 nt, Human; identical to SEQ ID NO: 115784

SEQ ID NO: 509344 - RNA, 64 nt, Human; identical to SEQ ID NO: 115785

SEQ ID NO: 509345 - RNA, 64 nt, Human; identical to SEQ ID NO: 115786

SEQ ID NO: 509346 - RNA, 64 nt, Human; identical to SEQ ID NO: 115787

SEQ ID NO: 509347 - RNA, 64 nt, Human; identical to SEQ ID NO: 115788

SEQ ID NO: 509348 - RNA, 64 nt, Human; identical to SEQ ID NO: 115789

SEQ ID NO: 509349 - RNA, 64 nt, Human; identical to SEQ ID NO: 115790

SEQ ID NO: 509350 - RNA, 64 nt, Human; identical to SEQ ID NO: 115791

SEQ ID NO: 509351 - RNA, 64 nt, Human; identical to SEQ ID NO: 115792

SEQ ID NO: 509352 - RNA, 64 nt, Human; identical to SEQ ID NO: 115793

SEQ ID NO: 509353 - RNA, 64 nt, Human; identical to SEQ ID NO: 115794

SEQ ID NO: 509354 - RNA, 64 nt, Human; identical to SEQ ID NO: 115795

SEQ ID NO: 509355 - RNA, 60 nt, Human; identical to SEQ ID NO: 394954

SEQ ID NO: 509356 - RNA, 60 nt, Human; identical to SEQ ID NO: 394955

SEQ ID NO: 509357 - RNA, 60 nt, Human; identical to SEQ ID NO: 395885

SEQ ID NO: 509358 - RNA, 64 nt, Human; identical to SEQ ID NO: 58982

SEQ ID NO: 509359 - RNA, 64 nt, Human; identical to SEQ ID NO: 509255

SEQ ID NO: 509360 - RNA, 64 nt, Human; identical to SEQ ID NO: 509256

SEQ ID NO: 509361 - RNA, 64 nt, Human; identical to SEQ ID NO: 509257

SEQ ID NO: 509362 - RNA, 64 nt, Human; identical to SEQ ID NO: 509258

SEQ ID NO: 509363 - RNA, 64 nt, Human; identical to SEQ ID NO: 509263

SEQ ID NO: 509364 - RNA, 64 nt, Human; identical to SEQ ID NO: 509264

SEQ ID NO: 509365 - RNA, 64 nt, Human; identical to SEQ ID NO: 509265

SEQ ID NO: 509366 - RNA, 64 nt, Human; identical to SEQ ID NO: 509266

SEQ ID NO: 509367 - RNA, 64 nt, Human; identical to SEQ ID NO: 509267

SEQ ID NO: 509368 - RNA, 64 nt, Human; identical to SEQ ID NO: 509268

SEQ ID NO: 509369 - RNA, 64 nt, Human; identical to SEQ ID NO: 509269

SEQ ID NO: 509370 - RNA, 64 nt, Human; identical to SEQ ID NO: 509270

SEQ ID NO: 509371 - RNA, 64 nt, Human; identical to SEQ ID NO: 509271

SEQ ID NO: 509372 - RNA, 64 nt, Human; identical to SEQ ID NO: 509272

SEQ ID NO: 509373 - RNA, 64 nt, Human; identical to SEQ ID NO: 509273

SEQ ID NO: 509374 - RNA, 64 nt, Human; identical to SEQ ID NO: 58985

SEQ ID NO: 509375 - RNA, 64 nt, Human; identical to SEQ ID NO: 58986

SEQ ID NO: 509376 - RNA, 59 nt, Human; identical to SEQ ID NO: 58987

SEQ ID NO: 509377 - RNA, 64 nt, Human; identical to SEQ ID NO: 58988

SEQ ID NO: 509378 - RNA, 64 nt, Human; identical to SEQ ID NO: 509274

SEQ ID NO: 509379 - RNA, 64 nt, Human; identical to SEQ ID NO: 509275

SEQ ID NO: 509380 - RNA, 64 nt, Human; identical to SEQ ID NO: 509276

SEQ ID NO: 509381 - RNA, 64 nt, Human; identical to SEQ ID NO: 509277

SEQ ID NO: 509382 - RNA, 64 nt, Human; identical to SEQ ID NO: 509282

SEQ ID NO: 509383 - RNA, 64 nt, Human; identical to SEQ ID NO: 509283

SEQ ID NO: 509384 - RNA, 64 nt, Human
uggcagcagcuuuuguguccggucaccaguucugccgugcgauggggccuccuguggauaccag

SEQ ID NO: 509385 - RNA, 64 nt, Human
cauuccagcugaguggccuugcucugugugagccccgugcgagggcccugcuuguagcuggacc

SEQ ID NO: 509386 - RNA, 64 nt, Human
ugcguguuuacacccgucccucugcuggccgcccccgugcgagcggcaccccugcccugcccuc

SEQ ID NO: 509387 - RNA, 64 nt, Human
agcgaaaccaaaugcgccccuucaccucgcgugcccgugcgaggccgggggcuucuuucagagc

SEQ ID NO: 509388 - RNA, 64 nt, Human
aucaacauggcaauugcacucauguggacugggaccgugcgagcugccguguggguuagucggg

SEQ ID NO: 509389 - RNA, 64 nt, Human
aggacaucuguccagucucaaucaggacagaccaccgugcgacacccaggaggcucucggaugg

SEQ ID NO: 509390 - RNA, 64 nt, Human
gcuucaacagcuuuggaaaugggucccgagugggccgugcgaggaaggcugucgaccucuacuc

SEQ ID NO: 509391 - RNA, 64 nt, Human
guuuggggacuggagggcuggcagcagccugucaccgugcgaccgugaccaccuggcaugggcu

SEQ ID NO: 509392 - RNA, 64 nt, Human
ggacugaaucacauagauucuccuccgucaguaaccgugcgauuauacaaauuaugucuuccaa

SEQ ID NO: 509393 - RNA, 64 nt, Human
ccuaucuucccggagaccacgcuucuccuccgugccgugcgacccccaccccaugacuauugug

SEQ ID NO: 509394 - RNA, 64 nt, Human
caccaccccagggggcaggcaggcaggcccccucccgugcgaaacuguuaacuuauucagcucg

SEQ ID NO: 509395 - RNA, 64 nt, Human
guuuggggucgccggaucucgaggcuugcccgagccgugcgagccaggacuaggagauuccggu

SEQ ID NO: 509396 - RNA, 64 nt, Human
gcagacgcugguuuugguggccacaggggguggcccgugcgacagaggcacaugcugaggccug

SEQ ID NO: 509397 - RNA, 61 nt, Human; identical to SEQ ID NO: 302794

SEQ ID NO: 509398 - RNA, 63 nt, Human
ccaggcccugggacucugagcguccgugucucucccccgcaacccauccucagccggggccgu

SEQ ID NO: 509399 - RNA, 63 nt, Human
gagccuggggggcgccggguggcaaaggacucacccccgcacaggcccgccuggcuucgaguu

SEQ ID NO: 509400 - RNA, 63 nt, Human
cccaggaccugagcucccagcaucugcagacgacccccgcagccuuucccucggaccccccuc

SEQ ID NO: 509401 - RNA, 63 nt, Human
ucuaugacuugagccaggucugguccguggugucccccgcacccagcaggggacaggcacuca

SEQ ID NO: 509402 - RNA, 63 nt, Human
uggaucaaagaaauucagaacagccugccuguccccccgcacuuuuuacauauauuuguuuca

SEQ ID NO: 509403 - RNA, 63 nt, Human
gguucuagucaauucugaaccaccaccccccgccccccgcaaaaaaguaaaagucaaaccaaa

SEQ ID NO: 509404 - RNA, 63 nt, Human
ggaguuggacacuccgagagugcagcuguucuccccccgcaccauccguguccugcauucugc

SEQ ID NO: 509405 - RNA, 63 nt, Human
aggccccugucgagcuggggucccagccaggugcccccgcaugcccuccugcaguugcuggau

SEQ ID NO: 509406 - RNA, 63 nt, Human
cgcccggcccgcgcucccgcccgcacugcccuccccccgcagcaggggcgccuugggacuccg

SEQ ID NO: 509407 - RNA, 63 nt, Human
cugagacuccccgcccgcccuccucugcccccucccccgcagacagacagacagacggacggg

SEQ ID NO: 509408 - RNA, 63 nt, Human
ugcagccugcccagcagcacauuccagucacugcccccgcacucccacagggcucaggcuggg

SEQ ID NO: 509409 - RNA, 63 nt, Human
uggaacugcucagcuaggcaggugcccccaucccccccgcauucuggccuaggcaggagagga

SEQ ID NO: 509410 - RNA, 63 nt, Human
ccgagucuggagaagggaggcgccuggcuguaucccccgcaggcccucuuccgagagccuucc

SEQ ID NO: 509411 - RNA, 63 nt, Human
agaaugcacugcugaggagcaugcccacccccacccccgcagugugcagauuaaagcaaguca

SEQ ID NO: 509412 - RNA, 63 nt, Human
uucauccuaggcaacagagcgagacucugucuccccccgcaaaaaaaaaaaagaaagaaagaa

SEQ ID NO: 509413 - RNA, 63 nt, Human
cggccaccgccccagccucaccccaucccacgacccccgcaacccuucacaucaccccccucg

SEQ ID NO: 509414 - RNA, 63 nt, Human
cuccuggggacauuuccucaaagcaguuuugcgcccccgcaagggaauggucagccuaagggu

SEQ ID NO: 509415 - RNA, 63 nt, Human
uacccauuaaacaguaauucccacuccucccagcccccgcagccaccauucugcuuucugucu

SEQ ID NO: 509416 - RNA, 63 nt, Human
cuggaggcgucuacacuggcuccacauccacuucccccgcagcucgugugggcgcucguccac

SEQ ID NO: 509417 - RNA, 63 nt, Human
acacugugugugucaccauauaacugcaccucacccccgcacgugugcaugacucgcagagaa

SEQ ID NO: 509418 - RNA, 63 nt, Human
caguccagugaauccacgacccgcagaccuguccccccgcaacagcuuauaccauggaaugag

SEQ ID NO: 509419 - RNA, 63 nt, Human
auggcaugccccccagcuacuguaugcccccgacccccgcagaggcagaaugaacccauaggg

SEQ ID NO: 509420 - RNA, 63 nt, Human
ggcaugggaaacagugcagugacucacccccugcccccgcaccaaccacccauauucaggaga

SEQ ID NO: 509421 - RNA, 63 nt, Human
ccggcccugccuccccaggcggugccccugagccccccgcagcggcccgagcuggcggaagcc

SEQ ID NO: 509422 - RNA, 63 nt, Human
ccgcccccagcgagccggggacccacccaccaccccccgcaccgccgacgccgccucguucgu

SEQ ID NO: 509423 - RNA, 63 nt, Human
guuucucauauagcccucagucacugagggagucccccgcaggauuggagaggcacauucccu

SEQ ID NO: 509424 - RNA, 63 nt, Human
gaaagugcuguacaaauuccacccgccccaggacccccgcaccugcccucuggcaccagaugc

SEQ ID NO: 509425 - RNA, 50 nt, Human; identical to SEQ ID NO: 301172

SEQ ID NO: 509426 - RNA, 63 nt, Human
guuucugcucagucugucccccuucccccucgacccccgcaaugagugggcaccaggggacgc

SEQ ID NO: 509427 - RNA, 63 nt, Human
gcguggaaaguugcugggcccccgcccccggcucccccgcacgcaugcauccacugcggccgg

SEQ ID NO: 509428 - RNA, 63 nt, Human
agagugaggugagcaccaugguuucucagccugcccccgcauggcaguuccuagguugcaguu

SEQ ID NO: 509429 - RNA, 63 nt, Human
ggccgcccuggcuuggcagcccugcccacgcugcccccgcaaacaauggugugugcguuuuua

SEQ ID NO: 509430 - RNA, 59 nt, Human; identical to SEQ ID NO: 302995

SEQ ID NO: 509431 - RNA, 63 nt, Human
gacgauuuagcuguggcucccuccuccuguccucccccgcacccccucccuucugggaaacaa

SEQ ID NO: 509432 - RNA, 63 nt, Human
cuggaagggccggcuucugccuggggugcauuucccccgcagugcauaccggacuugucacac

SEQ ID NO: 509433 - RNA, 63 nt, Human
gcugacagaagagguacccuugggacagaguaucccccgcaggcggaaguagcugagggcaag

SEQ ID NO: 509434 - RNA, 63 nt, Human
cauuguaacuaaaaucuuccucaggacuauuaacccccgcaaaguuucuauagggaacugccu

SEQ ID NO: 509435 - RNA, 63 nt, Human
uggggagaaaaacucucaucccugacccuuccccccccgcaaauguuagaccagagcuguuga

SEQ ID NO: 509436 - RNA, 63 nt, Human
uguggagaccagacucugcaaguggggagaccacccccgcaagccagugacaagggagcccug

SEQ ID NO: 509437 - RNA, 63 nt, Human
ccgcccugcccgcccccccccccaccaguccugcccccgcauggagcccccgugauuaguagc

SEQ ID NO: 509438 - RNA, 63 nt, Human
ggaaagacguuuuugugcugugggcagcacccucccccgcagcgggguagggaagaaaacuau

SEQ ID NO: 509439 - RNA, 63 nt, Human
uaaugauggcccauucuacuugcucuggaccugcccccgcauccccugccuccauccuaguaa

SEQ ID NO: 509440 - RNA, 63 nt, Human
uagcacaagggcagugccuggacggacccggagcccccgcauaucagcaguucacccaguacu

SEQ ID NO: 509441 - RNA, 63 nt, Human
uaucauuuuuggcuccgagaagagggcaaggggcccccgcaggguacuucugugcuugcccuc

SEQ ID NO: 509442 - RNA, 63 nt, Human
uuaccucccacagaacgugguggacuccuucuucccccgcagcaugacccgguuuuaugccaa

SEQ ID NO: 509443 - RNA, 63 nt, Human
agcagcgagaacaucccaccccucccccccccccccccgcagccagugcuccuugucaagcuc

SEQ ID NO: 509444 - RNA, 63 nt, Human
cauuccugugccuacuuugccugaguucuucuacccccgcaguugccagccacauugggaguc

SEQ ID NO: 509445 - RNA, 63 nt, Human
guccaauuccaaagccagaccagaagauucuaucccccgcagcgcucuccuuugagcaagccg

SEQ ID NO: 509446 - RNA, 50 nt, Human; identical to SEQ ID NO: 301202

SEQ ID NO: 509447 - RNA, 63 nt, Human
ugccgccaucucucccuuccugccucauuucaucccccgcagcagccgggauugauugugcuu

SEQ ID NO: 509448 - RNA, 63 nt, Human
ccugucugggaggcccuuaugagggcagcccagcccccgcacccacccccaaccagagaagca

SEQ ID NO: 509449 - RNA, 63 nt, Human
cuucauuagucauggguggaagaaaaaccacaccccccgcaccccuccguucuuucugcauag

SEQ ID NO: 509450 - RNA, 63 nt, Human
uugcuggcagcuggcaucgugucgcuuuaucugcccccgcacaguuugcuuuguacgucugcc

SEQ ID NO: 509451 - RNA, 63 nt, Human
aacccgccugagacggugcugugcaggggaaagcccccgcacccacacaggaauucugcugag

SEQ ID NO: 509452 - RNA, 63 nt, Human
agaggaucuuuaggccugaguugugaagcgcaacccccgcaaaacgcauuugccaucacaguu

SEQ ID NO: 509453 - RNA, 63 nt, Human
uguuaaaggaguuccugucaccugcuccccccacccccgcaugcgucuguccacuuggcuaac

SEQ ID NO: 509454 - RNA, 63 nt, Human
cccggcuucccuuacccuaucacuggccucaggcccccgcaggcugccucuucccaaccuccu

SEQ ID NO: 509455 - RNA, 63 nt, Human
auggccgcuucuagagccucgacacccccccaacccccgcaccaagcagacaaagucaauaaa

SEQ ID NO: 509456 - RNA, 63 nt, Human
ugaccuuggggggagaacagaagggggacgacgcccccgcaccuccugcgaucuggcuggcuu

SEQ ID NO: 509457 - RNA, 63 nt, Human
ccuccagaauccugaugguaucaauggauuuaucccccgcaaagacaucaaaccugaguauca

SEQ ID NO: 509458 - RNA, 63 nt, Human
ugggguccagaguaaggaugugcggcccccaggcccccgcacaccucccucagcaccaagacc

SEQ ID NO: 509459 - RNA, 63 nt, Human
cccgaguuggggggaggggguguggcaacgugccccccgcagaggccacgcauguuugaccaa

SEQ ID NO: 509460 - RNA, 63 nt, Human
gagccuggccuguaacuuauaaagugcaccucgcccccgcaagccccagccccgaggaccguc

SEQ ID NO: 509461 - RNA, 63 nt, Human
uugguuagcgggagugugcugcccccacccccacccccgcacccccauucuacacaaggcaga

SEQ ID NO: 509462 - RNA, 63 nt, Human
ucuugcacaggguggggcgcgcaguaggaaccucccccgcaggagcuggcgcccucucgcucc

SEQ ID NO: 509463 - RNA, 63 nt, Human
gccuccagaggcccaccccucaugcaacagccgcccccgcaggcagggggcuggggacugcag

SEQ ID NO: 509464 - RNA, 63 nt, Human
aagagacagacaugagagacaagcaucuucuuucccccgcaaguccauuuuauuuccuucuug

SEQ ID NO: 509465 - RNA, 63 nt, Human
gaaccugugccaacuaagggcccccacuguaagcccccgcacccccacccccugcccagagca

SEQ ID NO: 509466 - RNA, 63 nt, Human
ucuuagagcuguuaggacccgauggggaggcagcccccgcaguggacaacccccgcuuggaca

SEQ ID NO: 509467 - RNA, 52 nt, Human; identical to SEQ ID NO: 302726

SEQ ID NO: 509468 - RNA, 63 nt, Human
uuucugugcuguccacacucucuugccucccgacccccgcacucccuucuagcacccccaaag

SEQ ID NO: 509469 - RNA, 63 nt, Human
ccuaugcgcucaauggcccggaggggcagcaaccccccgcacacgucagccaacagcagugcc

SEQ ID NO: 509470 - RNA, 63 nt, Human
acaggcacacagggcccggccacacccagcggccccccgcacagccacccguggggugcugcc

SEQ ID NO: 509471 - RNA, 63 nt, Human
acugucccuuucugugugaagaucacguuccuucccccgcaaugugcccccagacgcacgugg

SEQ ID NO: 509472 - RNA, 63 nt, Human
ggaagcugccuuguggggacuuaccuggggugucccccgcaugccuguaccccagaugggugg

SEQ ID NO: 509473 - RNA, 63 nt, Human
gguacgggggcgcggcagggguccccggccccucccccgcagaggucaaugccaacgaacaaa

SEQ ID NO: 509474 - RNA, 63 nt, Human
ccccaccccacccacccucggggcgccccccuccccccgcaagccagccugggccagccccgc

SEQ ID NO: 509475 - RNA, 63 nt, Human
cgcacugaccacacccaccccguucggccccgccccccgcacugaacacacccgcccucaacc

SEQ ID NO: 509476 - RNA, 63 nt, Human
cuggacacguggccacaaaucugggacaaggggcccccgcacagcaugaaauaaaaagugccu

SEQ ID NO: 509477 - RNA, 63 nt, Human
cgccuccauugcugcuuguucuggagacccccgcccccgcaccuuccagacuuagcagaagaa

SEQ ID NO: 509478 - RNA, 63 nt, Human
accgcccccuccgccgccccuuccccagcccugcccccgcagacucccccugccgccaagacu

SEQ ID NO: 509479 - RNA, 63 nt, Human
gccugggucaagccagcauccccuugguaaagacccccgcaggccaccaggcauucuggacac

SEQ ID NO: 509480 - RNA, 63 nt, Human
uugcuccuagaguaaggcucaucugggccucggcccccgcaccugguggccuuguccuugagg

SEQ ID NO: 509481 - RNA, 63 nt, Human
cgggcugggccccuccaggagucacagaugaggcccccgcagagacuggugaguggugacccu

SEQ ID NO: 509482 - RNA, 63 nt, Human
gugacaccggccccucccucuacccacccccuucccccgcaugcugaucccccugcccaggug

SEQ ID NO: 509483 - RNA, 63 nt, Human
acugaguugggugacuugguaccugcucaggaccccccgcacugucccaaucccacucaggcc

SEQ ID NO: 509484 - RNA, 63 nt, Human
augcuugcugugacuccgccccugcccccucuccccccgcaugugggugcccccacuccccca

SEQ ID NO: 509485 - RNA, 63 nt, Human
acccccgacucugaaucccgggcgggaggaggacccccgcaccgcccccuccccagcguguaa

SEQ ID NO: 509486 - RNA, 63 nt, Human
ggcuguugcgggugcgcggcagcuggagacacucccccgcagggccaaccccugcccuguugc

SEQ ID NO: 509487 - RNA, 63 nt, Human
uccccugugauccguaaggccggcggcucggggcccccgcagcagcagcagcagcagcagcag

SEQ ID NO: 509488 - RNA, 63 nt, Human
gggguuuguugaugaaccuccacccccaccccacccccgcacgccuguaaucccagcacuugg

SEQ ID NO: 509489 - RNA, 63 nt, Human
cggugucucugcccgcaggacgccugcccccagcccccgcagcccucuggcccccuccaucuc

SEQ ID NO: 509490 - RNA, 50 nt, Human; identical to SEQ ID NO: 302493

SEQ ID NO: 509491 - RNA, 63 nt, Human
ugcccauccccccucagauccagacaugccccucccccgcagacacaccccaaggcagcccaa

SEQ ID NO: 509492 - RNA, 63 nt, Human
caaacccagaugccugaggccuggcuggggcugcccccgcaggacacuguggccaugccacgg

SEQ ID NO: 509493 - RNA, 63 nt, Human
uuuuuaaccccaauuauccuucucucucuccugcccccgcaucccacucccagggugucacga

SEQ ID NO: 509494 - RNA, 63 nt, Human
ggggacagcccuccugggaaucuacauuguguucccccgcauuccaggcucagggucugagga

SEQ ID NO: 509495 - RNA, 63 nt, Human
uucacaugcagaagagaaaaggccccccuccaccccccgcauucccugccgagugagagccag

SEQ ID NO: 509496 - RNA, 63 nt, Human
uuuuccuguggacgccggggaagcacagcaccacccccgcaccugcccucggccuuugugagc

SEQ ID NO: 509497 - RNA, 63 nt, Human
guugagugcagaagggugcgccucuucccucuacccccgcaccaccugcugugugccagccug

SEQ ID NO: 509498 - RNA, 63 nt, Human
gggggugcugcggcuacaccaccacccgcgcggcccccgcagccuagaccucccaggccugug

SEQ ID NO: 509499 - RNA, 63 nt, Human
cuuuccccagcaccccagagccagucgggacaccccccgcagcccguccugguggcuguggaa

SEQ ID NO: 509500 - RNA, 63 nt, Human
cucccugaggaacagccaggaccccaucugccacccccgcagcagugacccccacccagggcc

SEQ ID NO: 509501 - RNA, 63 nt, Human
uuucuucagacugaggccuuuugguagucggagcccccgcagucgucagccucccugacgucu

SEQ ID NO: 509502 - RNA, 63 nt, Human
ggcccaguagagcaaggcagacagugaccuccacccccgcagcccucuuaaaaggccaguacu

SEQ ID NO: 509503 - RNA, 63 nt, Human
aaagggggcuaguccccuucuuuuggcccuccgcccccgcaggcuucugugugcugcuaacug

SEQ ID NO: 509504 - RNA, 63 nt, Human
agccacagagauagagcugaggaguccuguguucccccgcaaggagcaccccgggaucauuuu

SEQ ID NO: 509505 - RNA, 63 nt, Human
auaccuuggcucuuccuuuuuuucuccugcuuccccccgcaccuuguggggaagcuucagggg

SEQ ID NO: 509506 - RNA, 63 nt, Human
ggccgagugacagccagcccuggaaccccccgacccccgcagcugcugcagccagugugccag

SEQ ID NO: 509507 - RNA, 64 nt, Human
uugagccguggucaccgagaggguugaggacgcagcacccgaggucccagccuuugcaggagcc

SEQ ID NO: 509508 - RNA, 64 nt, Human
ccuuggggaccuggcuucauucugcucucucuuggcacccgacccuuggcagcauguaccacac

SEQ ID NO: 509509 - RNA, 64 nt, Human
gaaggacaauguuaucugggauucaccgugcccagcacccgaagugccaaauuccaggaggaca

SEQ ID NO: 509510 - RNA, 64 nt, Human
ccuggcccucugggcccaacgcaggaggcccucagcacccgaacacaucuuccuccuccccacc

SEQ ID NO: 509511 - RNA, 64 nt, Human
ggccagggccuggcacccaccuggagaagcccccgcacccgagggaacccaugguggacuccac

SEQ ID NO: 509512 - RNA, 64 nt, Human
ucauucauuuugcacaauucuugaacugaugucagcacccgaguggcuccugaauuuaagucug

SEQ ID NO: 509513 - RNA, 64 nt, Human
uuccuuuuuacuugugugguuauguguggggcuggcacccgaaaugugugacauucagcuucua

SEQ ID NO: 509514 - RNA, 64 nt, Human
auuuacaagaaaaugaaaagcguccucuuaauuggcacccgaauguugcuguggcucagucaca

SEQ ID NO: 509515 - RNA, 64 nt, Human
guucggugagccuggcacugcuccuugccuaccagcacccgacuuuuaauuauauggaucucuu

SEQ ID NO: 509516 - RNA, 64 nt, Human
gaaauuaaaggaaagggaaagaaauagaucuggugcacccgaacauuaggagaaaaugaaaaau

SEQ ID NO: 509517 - RNA, 64 nt, Human
cuucgcccguccgcaugggcgcuucuguccagcugcacccgaggccggggguuucccucaccuc

SEQ ID NO: 509518 - RNA, 64 nt, Human
ucgggcccagccccaggcugcagcccauucgcaggcacccgaaagaacuuccccaguauggugg

SEQ ID NO: 509519 - RNA, 64 nt, Human
cugcuuucagggccgacugccugugaaguggauggcacccgaggcauuauuugaccggaucuac

SEQ ID NO: 509520 - RNA, 64 nt, Human
ggaaggagccgugaggagaggagugaggcaacaggcacccgaagucccucguccuucccucugu

SEQ ID NO: 509521 - RNA, 64 nt, Human
ccuuccuggagcucccagccagagcugagcuuaggcacccgaguggagccugcagcugagucug

SEQ ID NO: 509522 - RNA, 64 nt, Human
gauccagaaauaaacaauuccuacauuuuaaacugcacccgauucugaguagugggaugaaguc

SEQ ID NO: 509523 - RNA, 64 nt, Human
gucagugccccugggagggaagggcaucccugaggcacccgaauggucccucagggugcaggga

SEQ ID NO: 509524 - RNA, 64 nt, Human
acguccuccgcauccacuuuccagcucagcagccgcacccgaggcucagccugagggguaugug

SEQ ID NO: 509525 - RNA, 64 nt, Human
acagcuccaugagauagagaccugccucccccuugcacccgaggcccucgcagcagggagcuca

SEQ ID NO: 509526 - RNA, 64 nt, Human
uuccgcugggguuuccgagccgcccccgaaccgcgcacccgacuugcaggcguccgccugggcc

SEQ ID NO: 509527 - RNA, 64 nt, Human
ucccaaagugcugggauuacaggcaugagccaccgcacccgacggucuuuucaaagcuauuuau

SEQ ID NO: 509528 - RNA, 64 nt, Human
uaaaaaaugacaauuaaaugugcagauuccccacgcacccgaugaccuauuuuuucagccgugg

SEQ ID NO: 509529 - RNA, 64 nt, Human
auguggaagaauagcuaucauuccugucucuguggcacccgaucaauggcuuaaaucugucguu

SEQ ID NO: 509530 - RNA, 64 nt, Human
uucuagugcuccauccaccccucucuccacagacgcacccgaauuucuguccguucccaaagau

SEQ ID NO: 509531 - RNA, 64 nt, Human
ccugccugccccugcuccccagcuccuccugccugcacccgacucggcccccuccugacuugcc

SEQ ID NO: 509532 - RNA, 64 nt, Human
ucaguuuccaaaauggaaccaccucaccuccgcagcacccgacuuaccaggacgcaugccccuc

SEQ ID NO: 509533 - RNA, 64 nt, Human
ucugccccacccccaccuccccacugugguuagucagaggcauccugcuccaagcucugcuuuu

SEQ ID NO: 509534 - RNA, 64 nt, Human
ccaaagcaaguaagcgguuagcaccccccaaucccagaggcaacaauagagacacaggcugggu

SEQ ID NO: 509535 - RNA, 64 nt, Human
gcugacuauagcaaccagcuggacccggccucuggcacccgaaacuuccacccccgacggcucc

SEQ ID NO: 509536 - RNA, 64 nt, Human
ugugggccugcugugugccaaaccugagcuaccugcacccgagcccuggggcucagccccacca

SEQ ID NO: 509537 - RNA, 64 nt, Human
aguccaucagaaacaggagcugacaaccugcugggcacccgaagaccaagcccccugccagcuc

SEQ ID NO: 509538 - RNA, 64 nt, Human
acuucugacuuucuaaggaaaugaugcuucccaagcacccgagguugguuggucccaaaucuau

SEQ ID NO: 509539 - RNA, 64 nt, Human
ccuccccaggcuggccccagaggagcgagcaccagcacccgacgccuggccugccagggauggg

SEQ ID NO: 509540 - RNA, 64 nt, Human
ccaaugugggggguccugaagacacccccuuggggcacccgagugccccuucucagggcucagu

SEQ ID NO: 509541 - RNA, 64 nt, Human
ugaccacacuguggaaaauaccuuugcagacguggcacccgagugcacacaccgaccgccacau

SEQ ID NO: 509542 - RNA, 64 nt, Human
gcccaggggucccugcuggaucagagaaauagaagcacccgaagacgguuaguggcaauuccuu

SEQ ID NO: 509543 - RNA, 64 nt, Human
gacagagguugugguggggcaagaucgcaccauugcacccgagccuaggcaacaagagugaaau

SEQ ID NO: 509544 - RNA, 64 nt, Human
auuuguguggcccauggauuugaaagaagcugcugcacccgaaacugccagugugcggugacaa

SEQ ID NO: 509545 - RNA, 64 nt, Human
ggaagauucuggaaugccgugcggaugaacuucagcacccgagucagucccagcucauccuccc

SEQ ID NO: 509546 - RNA, 64 nt, Human
ucccaaagugcugggauuacaggugugagccacugcacccgaccgauacucacauuuuuaaacu

SEQ ID NO: 509547 - RNA, 64 nt, Human
gguacaucccguucacacaugggaagagaagguacagaggcaaggaggaugccggcaaggccuu

SEQ ID NO: 509548 - RNA, 64 nt, Human
cgcccagcagcugcugugugaugagcaggccccacagaggcagaggcugcuggcugaccuccug

SEQ ID NO: 509549 - RNA, 64 nt, Human
uggagaacagaaagaagaaaggaaagaaaggaaccagaggcagagagacgaggauacccagcga

SEQ ID NO: 509550 - RNA, 64 nt, Human
agcaccaaggggcuugaaccguaauuuggcuaaucagaggcauuuuuuuuguccuaguaucuuu

SEQ ID NO: 509551 - RNA, 64 nt, Human
uaagggaccacacccuuccuccuuccccugcccacagaggcagagggcacaggaaagaagccgg

SEQ ID NO: 509552 - RNA, 64 nt, Human
agccgcagccucccucugaccugcaggccaagagcagaggcagcgaguuguggaaagccucugc

SEQ ID NO: 509553 - RNA, 64 nt, Human
ccuuccuuccaggcacaucucacauugccauguacagaggcaggagucacguuuggucaccaug

SEQ ID NO: 509554 - RNA, 64 nt, Human
acacccagguucaagcaaaagacccaccucucugcagaggcaaagucuacuuucugguaccuca

SEQ ID NO: 509555 - RNA, 64 nt, Human
cugcagccacccuucucaucuggaucgggcccugcagaggcagaaaacccuuaaaugcugucac

SEQ ID NO: 509556 - RNA, 59 nt, Human
ucagcaccaacauggacugagggacuucucagaggcagggcagcacacggccagccccg

SEQ ID NO: 509557 - RNA, 64 nt, Human
cuuggguuacacuaccauuuauuggaacaagccccagaggcaguauuugauuuccucaggcccc

SEQ ID NO: 509558 - RNA, 64 nt, Human
uccacagcccuagcugccagcaaugcuguccucacagaggcauagucgcccccagcuggguugu

SEQ ID NO: 509559 - RNA, 64 nt, Human
gcaggaucaugccuucugugucuggaagaggcggcagaggcaacaguguuuaggauuuggguua

SEQ ID NO: 509560 - RNA, 64 nt, Human
auaagagucaugaagcuaaauccuugggcuaugucagaggcacaaagucuagaauguguguauu

SEQ ID NO: 509561 - RNA, 64 nt, Human
cggcucacgccuguaaucccagcacuuucggaggcagaggcaggcggaucacaaggucaagaga

SEQ ID NO: 509562 - RNA, 64 nt, Human
ggcaccucaaucuacaccagagcccagggagucccagaggcaaguuucacagaauugucaaaug

SEQ ID NO: 509563 - RNA, 64 nt, Human
aaugugaaugaugauccuaggcauuugcugaauacagaggcaacugcauuggcuuuggguugca

SEQ ID NO: 509564 - RNA, 64 nt, Human
agaagagcaguagacagcccuggacacucugaagcagaggcaagacaaacacaggcgcuuugca

SEQ ID NO: 509565 - RNA, 64 nt, Human
agcagaacaaacucagaucucaucaggguagcagcagaggcaggaccagaaggcaaucaagagc

SEQ ID NO: 509566 - RNA, 64 nt, Human
gcaacaguuguagcagcagcagacgaagccauugcagaggcagaauaugcugagugucuggagu

SEQ ID NO: 509567 - RNA, 64 nt, Human
uaacugugggaacaagccccucccuccacugccucagaggcaguaagaaagagaggccgaccca

SEQ ID NO: 509568 - RNA, 64 nt, Human
uuaugauaacaccagugggaauugcuggaggaaccagaggcacuuccaccuuggcugggaagac

SEQ ID NO: 509569 - RNA, 64 nt, Human
aaaggaaauuguaucaggacccaugggauauauccagaggcaaacuuuaugaggcuuugaaauc

SEQ ID NO: 509570 - RNA, 64 nt, Human
uucaguccaguuuguuugaagucaaucuuuucaucagaggcagcuuaaagaugcuuucaguuag

SEQ ID NO: 509571 - RNA, 64 nt, Human
uuaguuuuuagcugggugaccuugggcaaguuaacagaggcaaccucucugagccucaguuguc

SEQ ID NO: 509572 - RNA, 64 nt, Human
aaucacauauuaaucaggacauuaaaaacuuuaacagaggcaugauggcucacacguauaaucc

SEQ ID NO: 509573 - RNA, 64 nt, Human
ggaugcacuggccuguucuguaggagagacuggccagaggcagcuaaggggcaggaaucaagga

SEQ ID NO: 509574 - RNA, 64 nt, Human
ccaagcuuaguccugggagaggacagggacuucgcagaggcaagcgaccgaggcccucccaaag

SEQ ID NO: 509575 - RNA, 64 nt, Human
uugucauggguuuggaagacccagccaucugcagcagaggcagccuaucccauugcaaggagag

SEQ ID NO: 509576 - RNA, 64 nt, Human
gguguccucgagguugagcuucacuccacugcggcagaggcagcgugcacacucggauuugcua

SEQ ID NO: 509577 - RNA, 64 nt, Human
uccaggagccauuuugcaccaaggacuugguaggcagaggcagccccacuguaaagaaggguca

SEQ ID NO: 509578 - RNA, 64 nt, Human
ccucuggcugcaucugugcagccacauccuuguacagaggcauagguuaccacccccaccccgg

SEQ ID NO: 509579 - RNA, 64 nt, Human
cauuuauccauucaguguuuccugggccucugcucagaggcaggucaccacugggcccugugga

SEQ ID NO: 509580 - RNA, 64 nt, Human
ggauggggaauagccaagaauggcagccucagcgcagaggcaaggucagaaagagacggcgcuu

SEQ ID NO: 509581 - RNA, 64 nt, Human
ggcguccauuuccagcagacacaauggaggcugacagaggcaggagccuaccccuggccacacc

SEQ ID NO: 509582 - RNA, 64 nt, Human
cccugccugccuuauuugcuuacugagcacaggacagaggcaauauacaacucuggguucacac

SEQ ID NO: 509583 - RNA, 64 nt, Human
ggaaaggcagccaacuugcgccucuuagaaggaucagaggcaagaugagauggcagccugcaga

SEQ ID NO: 509584 - RNA, 64 nt, Human
uuaauuuuauuuuguggcagcuaaguuaguaugacagaggcagugcuccuguggacaggagcau

SEQ ID NO: 509585 - RNA, 64 nt, Human
aucagagcugcugucuggggcaguguuaacuacacagaggcacauccugacaggguuugcccca

SEQ ID NO: 509586 - RNA, 64 nt, Human
auaguuuuauaaucucggaagaugauaccaagagcagaggcaacaaauagaggccuggccucca

SEQ ID NO: 509587 - RNA, 64 nt, Human
aaaccagcagaucaaaaagcacaaagagcuggggcagaggcaggaagcaggggcccuccuggca

SEQ ID NO: 509588 - RNA, 64 nt, Human
gaucccaccaguucugccuggcuuccuccauccccagaggcacuaaaagcaguauuuuaagguu

SEQ ID NO: 509589 - RNA, 64 nt, Human
ugcugagcacccucuccgguuuggguugggauaacagaggcaggaguggcagcuguccccucuc

SEQ ID NO: 509590 - RNA, 64 nt, Human
gagaacugcaaaccgcugcggcgguaucugaccucagaggcagaggaacaccaccagcucuucg

SEQ ID NO: 509591 - RNA, 50 nt, Human
agaaguuuuugcggaagugacagaggcaaagggugcuacccaagccccuc

SEQ ID NO: 509592 - RNA, 64 nt, Human
cacgcuguggaaugaugugaauuggcccuguuuacagaggcaguacaacugaauguuauuuuac

SEQ ID NO: 509593 - RNA, 64 nt, Human
caugaacagucacccgugcuggcuguagcccccacagaggcaaucaugcccaauagauucaaga

SEQ ID NO: 509594 - RNA, 64 nt, Human
aaaucucuggaagagggaacauguggggacuacucagaggcaaagaggagcugcuccugccucc

SEQ ID NO: 509595 - RNA, 64 nt, Human
cccaggcucuagaucacauggcaucaggcuggggcagaggcauagcuauugucucgggcauccu

SEQ ID NO: 509596 - RNA, 64 nt, Human
cgugcuuuuccuuaucugacuucucauuuuguaucagaggcauaucauaaauugauaauuuugc

SEQ ID NO: 509597 - RNA, 64 nt, Human
uguucucuaaugccacugcucuguuuuaaaaacucagaggcaauuuuuacauaucaguaauugu

SEQ ID NO: 509598 - RNA, 64 nt, Human
ucuuaaaggcccaauccuaacagacuccccguaccagaggcagaucuggaacucgucaacaaca

SEQ ID NO: 509599 - RNA, 64 nt, Human
guaaucuugauaauaagcacagacagccuaacagcagaggcaacuuaaauaacuccugagcagu

SEQ ID NO: 509600 - RNA, 64 nt, Human
caguggaaggaagccacacacuggucagucauuucagaggcagcagaugcccagggagacccaa

SEQ ID NO: 509601 - RNA, 64 nt, Human
cuaagccccuggaagcagcauugugugauauucucagaggcaggggaaaauagagggaaaaaua

SEQ ID NO: 509602 - RNA, 64 nt, Human
ucccuucccauuauauugaaguugagaaaugugacagaggcauuuagaguauggacuuuucuuu

SEQ ID NO: 509603 - RNA, 64 nt, Human
ugcgugagugugguggugugaccuucaggcugcacagaggcaaggacccagauguggcagcaug

SEQ ID NO: 509604 - RNA, 64 nt, Human
gccauccgugcggccuuggccacaucccuauuaacagaggcagcuccacuucagacagggacaa

SEQ ID NO: 509605 - RNA, 64 nt, Human
aguaguuggguauaagaucugaacuuuucaucugcagaggcaagaaaaauauuugacauuguga

SEQ ID NO: 509606 - RNA, 64 nt, Human
cccucuucuaagccuuggccugaaucugguugaucagaggcaaguguggauccuuuggguggca

SEQ ID NO: 509607 - RNA, 64 nt, Human
cuggcgccgacauggcgaaggcaaggucuucccccagaggcacauuccucuccaucuuuccacc

SEQ ID NO: 509608 - RNA, 64 nt, Human
ggcuuuuuaguuucuuggcucucuuugucauguccagaggcaggcuguucuguaaaauagacug

SEQ ID NO: 509609 - RNA, 64 nt, Human
acuauuuauuauugcuuaugugcccuguucaaaacagaggcacuuaauuugaucuuuuauuuuu

SEQ ID NO: 509610 - RNA, 64 nt, Human
auucauuuucugauaaaauauuugucuaauaaaacagaggcaagauaauuuaaucaaaagaaau

SEQ ID NO: 509611 - RNA, 64 nt, Human
gucuuuuaaguaaguuccaagauccaugaauuaacagaggcauauauuuaaaaugaaauuuaau

SEQ ID NO: 509612 - RNA, 64 nt, Human
aggggacgaagggaccccugccccugucugccagcagaggcaguagggcacagagggaagagga

SEQ ID NO: 509613 - RNA, 64 nt, Human
agaacagcugagucaagcuuggaggucccugaaccagaggcacuaggauuaccccagggccauc

SEQ ID NO: 509614 - RNA, 64 nt, Human
acacuaaccuuaauaagaauucuacagcuuuggacagaggcauuuucaccuuaauggugaagua

SEQ ID NO: 509615 - RNA, 64 nt, Human
uuguccauuacacaccgaauguuaauuuaagaaccagaggcagaaguucuggcuuccugcuuga

SEQ ID NO: 509616 - RNA, 64 nt, Human
ggcuacaugcaggacacggcaugggccugcuccccagaggcaccuguuuggggucuucuugagg

SEQ ID NO: 509617 - RNA, 64 nt, Human
gcaagccugcucacccacugcuucugcuuuaagccagaggcaccuggaacccuggacuucacug

SEQ ID NO: 509618 - RNA, 64 nt, Human
agugaggcucacaacucagccucgcaagagguggcagaggcacaggaggccacaguccuuccug

SEQ ID NO: 509619 - RNA, 64 nt, Human
auauguccaauaaaaacuaugacuuuuccccuugcagaggcagaauuaaagcuaaucuagggac

SEQ ID NO: 509620 - RNA, 64 nt, Human
auuuccuugucauuccuaucucuugaguucuccccagaggcaaucacugcuacugguuguguau

SEQ ID NO: 509621 - RNA, 64 nt, Human
ucugucauuuucccuuccuaccccaacccugagccagaggcaucugacagcccuuucccagagg

SEQ ID NO: 509622 - RNA, 64 nt, Human
gggcagagcugggcggcauccacagccagagaggcagaggcaagagcagagccaggcugugccc

SEQ ID NO: 509623 - RNA, 64 nt, Human
ccagcagagggauauuugccuccuaaaucuuuggcagaggcaggaguaaggaagccauuucugg

SEQ ID NO: 509624 - RNA, 64 nt, Human
aagcucugucugggucauucauuuaaacuagaagcagaggcacuuaaaacauguaccaggaacc

SEQ ID NO: 509625 - RNA, 64 nt, Human
acuaugcagagugcuugugaggguuucacuaaaacagaggcaaaacuguccauugaauucagua

SEQ ID NO: 509626 - RNA, 64 nt, Human
agauaacacauguaauacauaguagaauacauuucagaggcagaguuccucggauuauuuuuua

SEQ ID NO: 509627 - RNA, 64 nt, Human
agagugacugaacucacucuaaggccuuugacugcagaggcaccuguuagggaaaaucagaugu

SEQ ID NO: 509628 - RNA, 64 nt, Human
aacucucuggggcaggguuauuccuuuguggaaccagaggcacagagagagucaacugaggcca

SEQ ID NO: 509629 - RNA, 64 nt, Human
ccacuuaaaggagaaaaauauuugggacuagcagcagaggcaguaagagaugugaaccuuggug

SEQ ID NO: 509630 - RNA, 64 nt, Human
caacgagaugagaagacugugauccucauguacucagaggcacuucccuccuaagucaaagacc

SEQ ID NO: 509631 - RNA, 64 nt, Human
cuuucccauucacuucucuagaaagcugccaagacagaggcagaaagaaauggaugauaguucu

SEQ ID NO: 509632 - RNA, 64 nt, Human
agccagcaggcaccacuuuucugcucccuuucuccagaggcagaacacauguuuucagagaagc

SEQ ID NO: 509633 - RNA, 64 nt, Human
ggaagacugacugaggccacuuccaggugggcagcagaggcaggccccagugugaccaccacug

SEQ ID NO: 509634 - RNA, 64 nt, Human
uggguaaagacauguagcuguggcuuuggucccccagaggcauagauccuauccugggagaguu

SEQ ID NO: 509635 - RNA, 64 nt, Human
uuugauaacuuaagaaccaaaguaacagaguaaacagaggcaugauggaucccugggccccacu

SEQ ID NO: 509636 - RNA, 64 nt, Human
guggcccuccaccuuguuccugcccuuuaacuuucagaggcaauagguaaauggggcccauuag

SEQ ID NO: 509637 - RNA, 64 nt, Human
ggccuggcuuccgcaacacauuuccgggugugcccagaggcaagaggguugggugguucuuucc

SEQ ID NO: 509638 - RNA, 64 nt, Human
acaaaccuuccuucaggagcaggcauugguagugcagaggcacagauuccguccuuuaccagcu

SEQ ID NO: 509639 - RNA, 64 nt, Human
gagaggguacagggaaaggaaaaauuuucaccaacagaggcagucucucauagaguauaaagca

SEQ ID NO: 509640 - RNA, 64 nt, Human
gaagucuauacucuacccagggcaucccucuggucagaggcagugaguacugggaacuggaggc

SEQ ID NO: 509641 - RNA, 64 nt, Human
gcuguuggccaauggugccaggcagccuggccuccagaggcauggaagcagcuucucugugugc

SEQ ID NO: 509642 - RNA, 64 nt, Human
gggcuuauucauuuaacacauaccaaccauuauccagaggcaccauggagaguuagucauggaa

SEQ ID NO: 509643 - RNA, 64 nt, Human
aggcuucacucagguguggcugugacugagggggcagaggcaguggcucuuuagaaggaaaagg

SEQ ID NO: 509644 - RNA, 64 nt, Human
aaacuagugaauacaguuugucuuucaagagaaucagaggcaucguaacuccuaccaaguuagu

SEQ ID NO: 509645 - RNA, 64 nt, Human
gcaaggaacuaaggaaggaauccccuucuuagagcagaggcacaaguuagagcaggcccagcau

SEQ ID NO: 509646 - RNA, 52 nt, Human
gcgggaaagacuacgugugacacagaggcaaaaggagaaaaucauguugaaa

SEQ ID NO: 509647 - RNA, 64 nt, Human
aggagugccgccucuacccacuugugaugggguacagaggcacuugcucuucugcaugguguuc

SEQ ID NO: 509648 - RNA, 64 nt, Human
uggcaccauuacccaggucugacugaccaccagucagaggcacuuuauuuguaucaugaaauga

SEQ ID NO: 509649 - RNA, 64 nt, Human
gggaugcagcagccgcucgcauggaagugccgcccagaggcaugcaggcugcugggcaccaccc

SEQ ID NO: 509650 - RNA, 58 nt, Human
caccucugaagccaacgugagcaaagggcagaggcaguuggccuaugagugggcugau

SEQ ID NO: 509651 - RNA, 64 nt, Human
ugcugguucuccuugcugugugugacacagcagacagaggcacuauuccuggugcaguauuuca

SEQ ID NO: 509652 - RNA, 64 nt, Human
gggagcuacuggacagucaccuuggugggaaugccagaggcaugggcauuagguccccccggcc

SEQ ID NO: 509653 - RNA, 64 nt, Human
ugcuccccacuucccagauggugcggcggcuggccagaggcacucuucacuucccagacagagg

SEQ ID NO: 509654 - RNA, 64 nt, Human
aaaaacaaaugaaaauugaugggguuuaaagcuacagaggcacugaccuuuuucuaguuauugu

SEQ ID NO: 509655 - RNA, 64 nt, Human
ugugaaauacacagguggaaacagaggugcaagccagaggcaauguaauaugcuguaaggcuag

SEQ ID NO: 509656 - RNA, 64 nt, Human
acacugugguguggcugccacggccuccuggcuccagaggcagcugggcugggccaaggcagga

SEQ ID NO: 509657 - RNA, 64 nt, Human
cagcccaaccaaaccuugagaaugcgaaacauuccagaggcaguagccuccaaagcacacagag

SEQ ID NO: 509658 - RNA, 64 nt, Human
ucugcccugagggggcgccuuuuucuaauuugaacagaggcacccuauggccuaggggcccuga

SEQ ID NO: 509659 - RNA, 64 nt, Human
ugugcuuauguagacacaaucuucugucucaguacagaggcacugacuucaauaaagucuauuu

SEQ ID NO: 509660 - RNA, 64 nt, Human
cacaggugcgaaaggaaaggccuucacacccucacagaggcaucaugcaaaggacagcggcuuu

SEQ ID NO: 509661 - RNA, 64 nt, Human
cuuuuguguaaguacaaccauauuucagucaguccagaggcaguuaacccuguagcacuuacua

SEQ ID NO: 509662 - RNA, 64 nt, Human
gcuccucuggcugugggaccacagaugagucuuucagaggcaggauccauuuuugcagauagcu

SEQ ID NO: 509663 - RNA, 64 nt, Human
uauugucugaacggcugaauaugaauagauacagcagaggcacuccugauauaugauuuuuauc

SEQ ID NO: 509664 - RNA, 64 nt, Human
ggggaauccaugagcuuccuuuauuucuggcucacagaggcagccacgaggcacuacaccaagu

SEQ ID NO: 509665 - RNA, 64 nt, Human
uguucuuuaaggcaccuccugccacuuucucccucagaggcacaaacacuuuguguuccacguc

SEQ ID NO: 509666 - RNA, 64 nt, Human
ugugacauucccuugguacauaggacauaaaacacagaggcauugcuauuugguaaguuaagcu

SEQ ID NO: 509667 - RNA, 64 nt, Human
gauggcuggaugugaaagagacaugcucuagcugcagaggcaaauuugaagugccacggaacgu

SEQ ID NO: 509668 - RNA, 64 nt, Human
gagcauuagaagcugccaccagcccaggacccuccagaggcagccuggccuguggcaucagucc

SEQ ID NO: 509669 - RNA, 64 nt, Human
auaaaucugcuucaaccuuaggauguuuucagaccagaggcaacuuauucaugaauuuuuauga

SEQ ID NO: 509670 - RNA, 64 nt, Human
ucucacccuuuccccacagcgacuacuucccacucagaggcaacaaguauuacaguugcuugua

SEQ ID NO: 509671 - RNA, 64 nt, Human
gacccagcaccuagacaagaucuuggcuuucccacagaggcaggaguccuaccucgggccaaca

SEQ ID NO: 509672 - RNA, 64 nt, Human
ucuuaguagacaaaaagagucaauaccagagaaccagaggcauccucuguauuuuaaugaacuc

SEQ ID NO: 509673 - RNA, 64 nt, Human
gcguucaguugacacauugcacacacagucuguucagaggcauuggaggauggggguccuggua

SEQ ID NO: 509674 - RNA, 64 nt, Human
uguucuccaguucacgucugccagcuggugagggcagaggcagaccuggucagacccagcgccc

SEQ ID NO: 509675 - RNA, 64 nt, Human
aaaauuaaguugcauagcugcuuugcagugguuucagaggcagaucugagaagauuaaaaaaaa

SEQ ID NO: 509676 - RNA, 64 nt, Human
caagagagacugucggucucuguuagaaaaucagcagaggcagcaaugaugugaugggauagug

SEQ ID NO: 509677 - RNA, 64 nt, Human
ugaguuucauccuauccgagggaugagauuaaggcagaggcaaaaguuucacacaaaguuucug

SEQ ID NO: 509678 - RNA, 64 nt, Human
aucaaguagguaaaaugagccuuuuguguacacacagaggcacaugugcaugcacacacaacuu

SEQ ID NO: 509679 - RNA, 64 nt, Human
ugaaaagcauaguuggucuuggugucauauggaucagaggcacaagugcagaggcuguggucau

SEQ ID NO: 509680 - RNA, 64 nt, Human
aaaaaauaaaaauuaaaaaaaaauuauuaggcugcagaggcaagaggauccccugagcccagaa

SEQ ID NO: 509681 - RNA, 64 nt, Human
cagaaacagggacaaagaaauccccccuucagaacagaggcauuuaaaauggaaaagagagauu

SEQ ID NO: 509682 - RNA, 64 nt, Human
gaauuuugaaguaacgaaugcaaauuccacucagcagaggcaauguuauuuauguacauaggga

SEQ ID NO: 509683 - RNA, 64 nt, Human
cugcuaauaaaugucauccaagaggaacuaaaaccagaggcauuauuacugcauuguuugucac

SEQ ID NO: 509684 - RNA, 64 nt, Human
cugauuuguuuuuuacagccaaaccucugucagucagaggcauucauuaguuuuauacauguaa

SEQ ID NO: 509685 - RNA, 64 nt, Human
gccaccaguaugacaguauuauacgcuggcaacacagaggcagcccgcacaccugcgccugggu

SEQ ID NO: 509686 - RNA, 64 nt, Human
uguagucaacaucuguaacucuuacaugaguguccagaggcacucaugggaaaauugguuuugc

SEQ ID NO: 509687 - RNA, 64 nt, Human
uaggagaaaugaagcaacaguugugucuagaugucagaggcauggcugggccuccaucucugcc

SEQ ID NO: 509688 - RNA, 64 nt, Human
ucuauaccaauaagucagucaccuugcuccucuccagaggcaaaguggaagagauccugcaaga

SEQ ID NO: 509689 - RNA, 64 nt, Human
gacagacacagcaggaaggggccugagaggcugacagaggcaggaugggugcaaggcaggggug

SEQ ID NO: 509690 - RNA, 64 nt, Human
cuccuagcugaguaaauccgggucucuaggaugccagaggcagcgcacacaagcugggaaaucc

SEQ ID NO: 509691 - RNA, 64 nt, Human
gagcccuuggcugugguaauccaggguaauugcgcagaggcaucugauguguaggaaaguaauu

SEQ ID NO: 509692 - RNA, 64 nt, Human
aacgccagguaucuccccuccucucucuccccugcagaggcauguagggaacagcaggagauua

SEQ ID NO: 509693 - RNA, 64 nt, Human
ccaaaugucgggguuggggugggagggcgucaggcagaggcaacugacuucauuugugccacac

SEQ ID NO: 509694 - RNA, 64 nt, Human
cugugucaaaagaagggcucagaagcccucuuuucagaggcaaugauuccugucaguaugaggu

SEQ ID NO: 509695 - RNA, 64 nt, Human
aaaaagaauaaaagcggagauauauuuuuugacacagaggcacccaaagaaauacaaacauugc

SEQ ID NO: 509696 - RNA, 64 nt, Human
aacgaaugagaaaaaugaaaggaaguucugcugucagaggcaaaacaucuguuuaucauagaca

SEQ ID NO: 509697 - RNA, 64 nt, Human
uuuuaucugccaucaguguuugaccuguuuagggcagaggcaauaagucagaagucuugaaguu

SEQ ID NO: 509698 - RNA, 64 nt, Human
gcagcccacaggaguccagggaaggcggggaccacagaggcacagaguccagcacuuggccgcu

SEQ ID NO: 509699 - RNA, 64 nt, Human
accuucugucguccucccaggggugucauauuuacagaggcaaacucuuacagcuuggaugauu

SEQ ID NO: 509700 - RNA, 64 nt, Human
ccugcgcagcccuggcugaggucacuaggcuggccagaggcaggacaggcagucuugaauuucc

SEQ ID NO: 509701 - RNA, 64 nt, Human
cuacaaaccauuagaaaauaacucaaaaagauggcagaggcaaauccacagaaggggggcugcc

SEQ ID NO: 509702 - RNA, 64 nt, Human
cacccaggagccccccaggcugccugccugcgugcagaggcaggagaggaccguggagcguuuc

SEQ ID NO: 509703 - RNA, 64 nt, Human
ccuuuuugauucauguuuguagucauguugucaacagaggcaaaguuaagcuugaugaugguua

SEQ ID NO: 509704 - RNA, 64 nt, Human
guucccggucagccugucccaggacagcccacuccagaggcacaggagggucaccaggccugcg

SEQ ID NO: 509705 - RNA, 64 nt, Human
agguuagggaagaaagaaucgggcucacgaaugccagaggcagugaugucccauccuggaggag

SEQ ID NO: 509706 - RNA, 64 nt, Human
ugcagcauuucucugccauugcuuucaaugaggccagaggcauccuggauauuagaccuauuau

SEQ ID NO: 509707 - RNA, 64 nt, Human
ucugguucaccgcccugauuccacagaugugggucagaggcagagauggaaguuggaauggaca

SEQ ID NO: 509708 - RNA, 64 nt, Human
cccuggcuucagggucagagugcccagcguuuaucagaggcagcauccaagcccagagccagug

SEQ ID NO: 509709 - RNA, 64 nt, Human
caccagaaaaugcucucccacugcuagauaaaugcagaggcaaaguguagacaucuguaggaac

SEQ ID NO: 509710 - RNA, 64 nt, Human
ucaauuggaaguaguucuaugaauauggaaaggccagaggcagagugaaauaaaaugcuaucuc

SEQ ID NO: 509711 - RNA, 64 nt, Human
aggaagugucaccuucaggauacaaauacaugagcagaggcagaguuaggcaaaauucccccaa

SEQ ID NO: 509712 - RNA, 64 nt, Human
ucaccauaauccaggagggucuccuuccccacugcagaggcagaacguccaagaauggaguaag

SEQ ID NO: 509713 - RNA, 64 nt, Human
uguggcacuuaggggagaugacauuugcuuugggcagaggcagcuagccaggacacauuuccac

SEQ ID NO: 509714 - RNA, 64 nt, Human
gggagacacaggccccacccagcagacugaggggcagaggcacaggugggagggcagcggagau

SEQ ID NO: 509715 - RNA, 64 nt, Human
gagcaagcucuucccuugcucaugagcuccugaucagaggcauuugagcagcugaauaaccugc

SEQ ID NO: 509716 - RNA, 64 nt, Human
ucaacccagcccaccaugccuuggcugaugauaccagaggcagagagugcuggucugucuggga

SEQ ID NO: 509717 - RNA, 64 nt, Human
uggguguucacagaucuugugucucaaagguaggcagaggcaggaaaagcaaggagccagaauu

SEQ ID NO: 509718 - RNA, 64 nt, Human
ugcuggcuuucaagcgugguuuuuugcuaagagccagaggcaggucuucuggaguucucagggg

SEQ ID NO: 509719 - RNA, 64 nt, Human
cgcacaggugggugauguccuuggcugcugccgucagaggcagcccccugcacagggaggggcu

SEQ ID NO: 509720 - RNA, 64 nt, Human
uuguugguauucagcugugauggauauagagaaucagaggcaccuuguuuucacaacuaggaua

SEQ ID NO: 509721 - RNA, 64 nt, Human
ugaccuugggcaaacccuggcucggagcccagggcagaggcagcucagaguggaggcucuaggc

SEQ ID NO: 509722 - RNA, 64 nt, Human
guuugggagccugaggggccaucucccugacacucagaggcacugccuugcagacaccauccgu

SEQ ID NO: 509723 - RNA, 64 nt, Human
auagaaugguuccauuauggcugcguuggauugacagaggcaccaaaaggcaaaugguacuguc

SEQ ID NO: 509724 - RNA, 64 nt, Human
aaacaagcauccuuuacuaacaagagcaggaauucagaggcacaagaaaaagcauuggcaugag

SEQ ID NO: 509725 - RNA, 64 nt, Human
uuggggacgagggccugggccgcggugaggccaccagaggcaggaguggcccugggggucccgg

SEQ ID NO: 509726 - RNA, 64 nt, Human
gagcacccacccugguucuccaggccccucuguccagaggcagggccugaaccucgggcuccug

SEQ ID NO: 509727 - RNA, 64 nt, Human
auugcucaggguggggggcugggaccauggcccgcagaggcacugccacagcugugagggccaa

SEQ ID NO: 509728 - RNA, 64 nt, Human
agcacucagcuccccagccaaucuguacaucccucagaggcagcgaucugaugaauugguuuuu

SEQ ID NO: 509729 - RNA, 64 nt, Human
agacggaaguaaaggcucaggaaacagcccaccacagaggcagaugccaaaccaaagacagauu

SEQ ID NO: 509730 - RNA, 64 nt, Human
caaccaguugcaucgugcggggcaaaaugaggagcagaggcauggaggagggaggcgugggaug

SEQ ID NO: 509731 - RNA, 64 nt, Human
ggacagagagacagggagagucagccuccacauucagaggcaucacaaguaauggcacaauucu

SEQ ID NO: 509732 - RNA, 64 nt, Human
ugcauguaugggaacuguuuuauagagaauggggcagaggcacaacuccaggaauucucuagcu

SEQ ID NO: 509733 - RNA, 64 nt, Human
ucaggaggcugagacaggagaaucaccugaaccccagaggcagagguugcagugagcugagauc

SEQ ID NO: 509734 - RNA, 64 nt, Human
cugucuccaugacuucauuugcacuuugacagagcagaggcagaguauuugucuuauauuucuc

SEQ ID NO: 509735 - RNA, 64 nt, Human
gauauaggcauuugggauuugcugcaaaaugacccagaggcaggggucagggggagagguagag

SEQ ID NO: 509736 - RNA, 64 nt, Human
gcccccagugccggagcagaaaggacccuggacccagaggcagauacugcggggugguagaaaa

SEQ ID NO: 509737 - RNA, 64 nt, Human
cuugcugguuaucuuacucugagugugaugcagucagaggcaccugcggguuagcccaggggcc

SEQ ID NO: 509738 - RNA, 64 nt, Human
uucauugaccaagaugaucacauggaaggcggcacagaggcagcugugugggcugcagauuucc

SEQ ID NO: 509739 - RNA, 64 nt, Human
uggagucagcaggagcugguguuuuucagccagacagaggcauaauaaagugacugauguuuac

SEQ ID NO: 509740 - RNA, 64 nt, Human
uuaagcccuugugagugggcuucaccagcuacugcagaggcauuuugcauuugucugugucaag

SEQ ID NO: 509741 - RNA, 64 nt, Human
cugugcccuuuucucagacccggaauccagugggcagaggcagcuucgcaggggguccccggac

SEQ ID NO: 509742 - RNA, 64 nt, Human
ggcuuguggggggcagaguuugucccucugucaucagaggcagccuuccaggcacagcucuggu

SEQ ID NO: 509743 - RNA, 64 nt, Human
aaccuuugcggguggggcguuacugccaaaacuccagaggcaaaguggaccuggcaaccacaag

SEQ ID NO: 509744 - RNA, 64 nt, Human
cccuggaacauugggccugaguggagaugggagacagaggcaggccagaagguucucucugcac

SEQ ID NO: 509745 - RNA, 64 nt, Human
cagcuucccgacucccaggagcucaagccaagcccagaggcaguggcuggggucccugcagguc

SEQ ID NO: 509746 - RNA, 64 nt, Human
ucguaguugugaaacacuugcagagcaaacaaagcagaggcaagaacugaggagaaguaucaga

SEQ ID NO: 509747 - RNA, 64 nt, Human
uggugcuaggauagcuauuucuuacuguaauugccagaggcagaaauggucuggguauaagcua

SEQ ID NO: 509748 - RNA, 64 nt, Human
aggaaaugcagcccaaguuuuacaaauggguaaacagaggcacugagagauagaugguaguuug

SEQ ID NO: 509749 - RNA, 64 nt, Human
agccgauacuggcagccauugcagcuccaaacugcagaggcaaggccaauuuuaacuuuucaau

SEQ ID NO: 509750 - RNA, 64 nt, Human
gugcugcgccugcaggcagagcuggagcccccagcagaggcaggcugggacggaccagcaucug

SEQ ID NO: 509751 - RNA, 50 nt, Human
uaaagaaaggcccaaagugacagaggcagcagagggaugguccaccgccc

SEQ ID NO: 509752 - RNA, 64 nt, Human
gcacccauagcccccaucuauggacaggcugggacagaggcagauggguuagaucacacauaac

SEQ ID NO: 509753 - RNA, 64 nt, Human
acucccuucccuucuacucugcgcuggcuuuugacagaggcaguaaauuaggccuaauccucac

SEQ ID NO: 509754 - RNA, 64 nt, Human
cagaguggcuggcaggcacaaccuccuggcacaccagaggcaggucuucaauacccacugguuu

SEQ ID NO: 509755 - RNA, 64 nt, Human
caugacgugguacagacauuacagguguuguagacagaggcacuugucucgugcagagggauua

SEQ ID NO: 509756 - RNA, 64 nt, Human
auccuacaggcacugguguggggcacaguccaugcagaggcaaaggagacaaagcaagaccaga

SEQ ID NO: 509757 - RNA, 64 nt, Human
agaggcuggaucuuggagaaugugagaagccagccagaggcaucugagggggagccgguaacug

SEQ ID NO: 509758 - RNA, 64 nt, Human
gagccaaauagcaucuuuacagaggaagugggaucagaggcaggaaguguggaaaguugcuaag

SEQ ID NO: 509759 - RNA, 64 nt, Human
uuuucuagucuauacauucugauuaauuugcagucagaggcaaugcaaaaagcauuccuuuuca

SEQ ID NO: 509760 - RNA, 64 nt, Human
uguuauauaucucuuuuggucccauccucuaaagcagaggcaacacuggaacauggcuagccuu

SEQ ID NO: 509761 - RNA, 64 nt, Human
ggccuguggcagcgccgcuggacccuaggaggcucagaggcaguggugugggagcccugucugc

SEQ ID NO: 509762 - RNA, 64 nt, Human
guugaagaggcugacuuggcccacugcuaagcggcagaggcagggccagccauccugucgcaag

SEQ ID NO: 509763 - RNA, 64 nt, Human
uguuuuguggaaagacuaauucucuuugauacugcagaggcaguggccauggaucuguuccucu

SEQ ID NO: 509764 - RNA, 64 nt, Human
gaacugggcugacuccaggaccuccaggaugaggcagaggcaugaugcuuccugcucaccuggg

SEQ ID NO: 509765 - RNA, 64 nt, Human
ugagaaguacacacuauuuauuuuuugguuuugucagaggcaggcaggauuuuggagcuggaag

SEQ ID NO: 509766 - RNA, 64 nt, Human
ugaugguugcugacuaauccgggauuucaugagucagaggcaccaccccucaccccagcugccu

SEQ ID NO: 509767 - RNA, 64 nt, Human
guggauggcugcugguguggggacuucgggugggcagaggcaccuugcugggucuguggcauuu

SEQ ID NO: 509768 - RNA, 64 nt, Human
ugagucggcugggcagggccgcagggcgcuccggcagaggcagggcccuggggucucugagcag

SEQ ID NO: 509769 - RNA, 64 nt, Human
aauauaauauuuuccccacaaaagaaacacuuaacagaggcaagugcaauuuauaaauuuauau

SEQ ID NO: 509770 - RNA, 64 nt, Human
uauguggugugaaacagccaaggcauuuauucuucagaggcaggauaauauuucaggauacaaa

SEQ ID NO: 509771 - RNA, 64 nt, Human
ucgcacgguaccugcgcgcggcugcggggggcaccagaggcaguaaccaugcccgcauagaugc

SEQ ID NO: 509772 - RNA, 64 nt, Human
ccuaguccgcugaagauggagggggcuggggucacagaggcauagaauacacauuuuuugccac

SEQ ID NO: 509773 - RNA, 64 nt, Human
ggggaugugguaagcggaaacagaagacaggcagcagaggcauuaaaaaugcauaccaugcuuu

SEQ ID NO: 509774 - RNA, 64 nt, Human
uaaccagcauaaauacugccugaggaucaaaacucagaggcaaagagggaguuccugacugcua

SEQ ID NO: 509775 - RNA, 64 nt, Human
auaacuuccaugcugccugcuguguuccagaucacagaggcagccaaggcucaggaaaaacugg

SEQ ID NO: 509776 - RNA, 64 nt, Human
ggggcuccugccucuucugacuucacugggggcccagaggcagaugggugggugggugggcagg

SEQ ID NO: 509777 - RNA, 64 nt, Human
uccaaggaaagcucuagaaaacaguauaaacuuucagaggcaaaauccuucaccaauuuuucca

SEQ ID NO: 509778 - RNA, 64 nt, Human
ugaaacccagucacugugagcucccaggugcagccagaggcaccucaagaagaagaggggcaua

SEQ ID NO: 509779 - RNA, 64 nt, Human
acugacucauucugaacccccuaagcacccaggccagaggcaagaaccugggcuguaacugcca

SEQ ID NO: 509780 - RNA, 64 nt, Human
gccugccccgcugcccagaggaccccacgccucucagaggcagaggucccaugacagccuuuga

SEQ ID NO: 509781 - RNA, 64 nt, Human
ccaggugcugaucggugagguggccuggggagggcagaggcaagguuaccagggcaccaugcaa

SEQ ID NO: 509782 - RNA, 64 nt, Human
uaacugaacaggagcuggugugacuguuaccagacagaggcaacugaugaaaaagcccugugaa

SEQ ID NO: 509783 - RNA, 64 nt, Human
gcaguccugcccugcugcugcugccgccccgcuacagaggcaaugugaccagucacagggacag

SEQ ID NO: 509784 - RNA, 64 nt, Human
gcccccccugucgucugcucuucacccagcaccacagaggcaccugcugcacacacaagcaucu

SEQ ID NO: 509785 - RNA, 64 nt, Human
uggggguuggaaggaugggggcucauuuaacccucagaggcagcgccuuugucugucuaucugg

SEQ ID NO: 509786 - RNA, 64 nt, Human
ccagcaucaccugccuguuaggagaagcugcauccagaggcaaacggaggcaaagcuggcucac

SEQ ID NO: 509787 - RNA, 64 nt, Human
aucauaacaaaauucuaguguuuauacgaacacccagaggcaaaagaauuuggcuuaauucuca

SEQ ID NO: 509788 - RNA, 64 nt, Human
cucuguuuuugaaaucuacucgucaaagaguuuucagaggcaaugaaaggggaacagauuuuuc

SEQ ID NO: 509789 - RNA, 64 nt, Human
ucccggaaaugcuucaucugguggacugugggagcagaggcauugccaggacuugggaaacagu

SEQ ID NO: 509790 - RNA, 64 nt, Human
gcuucuccaggcccgggguuguuggggagagaggcagaggcagcuggagcgccguucucuccug

SEQ ID NO: 509791 - RNA, 64 nt, Human
uucaaugacugaaauauagcuucugacaacuaugcagaggcauuuuagagacauuggcauugcc

SEQ ID NO: 509792 - RNA, 64 nt, Human
gcucugggagccaggccagggugugagggaggugcagaggcauccggggcgggagcaagcccca

SEQ ID NO: 509793 - RNA, 64 nt, Human
gguagcuugccacaugccccaucucccauugcugcagaggcauaagacagaagagaugggaagu

SEQ ID NO: 509794 - RNA, 64 nt, Human
uggcauuugcaaaaggaagcaucaauaguggacccagaggcagugcauaaaaccuuaggauaga

SEQ ID NO: 509795 - RNA, 53 nt, Human
ccuucuuuucauggugguagcuccagaggcaggcagaggaaauauugucagag

SEQ ID NO: 509796 - RNA, 64 nt, Human
ucucugcuggccuacagcuugucuguuucucaagcagaggcaggaagagcuagucuuagcauuu

SEQ ID NO: 509797 - RNA, 64 nt, Human
auucaaaccgcaaguaugggagauuuaggcccugcagaggcagaccauuccuuaguaucucaca

SEQ ID NO: 509798 - RNA, 64 nt, Human
uuucccuggacaggcagccuccuuuguguguauucagaggcagugaugacuugcuguccaggca

SEQ ID NO: 509799 - RNA, 64 nt, Human
ccaaucccaacucccuuucccaaacaaaaagccacagaggcagagcaagcauuccccuuuaaga

SEQ ID NO: 509800 - RNA, 64 nt, Human
uuuggggagagggggguaucaggcagggagggggcagaggcaaaucaccgggcagagggagggg

SEQ ID NO: 509801 - RNA, 51 nt, Human
ccgaagaaauugacccauaggcagaggcaugagcuggacuucauguuuccc

SEQ ID NO: 509802 - RNA, 64 nt, Human
ugaucuuccauugcucaagccagggaaugcauugcagaggcaccugcacaacgacaaacuugag

SEQ ID NO: 509803 - RNA, 64 nt, Human
ccuggccugaccccagacgcagugccuggcaguccagaggcagugggaucccugagugcugaau

SEQ ID NO: 509804 - RNA, 64 nt, Human
cauuuaacaaaaucuauaacugugaagcuuaauucagaggcauuauagaauaauguguaauuau

SEQ ID NO: 509805 - RNA, 64 nt, Human
acuuacauguguuuuaaaaugucaguguguuucccagaggcagaaauaaaaauacugaauaucu

SEQ ID NO: 509806 - RNA, 64 nt, Human
acccugagauguaaacagcaagugggggcugaggcagaggcagggauagcuggguggugaccuc

SEQ ID NO: 509807 - RNA, 64 nt, Human
aggcauauuuucuuuucuuacagucauugccagacagaggcauacaagucuguuugcugcauac

SEQ ID NO: 509808 - RNA, 64 nt, Human
ccucacucaaccugcugagguguggauggggaaacagaggcaaaacugaggcaccugaugcauu

SEQ ID NO: 509809 - RNA, 64 nt, Human
acuggcuucucuggcucacccaagcucucccuuacagaggcaacacagaauuauaaggaaucag

SEQ ID NO: 509810 - RNA, 64 nt, Human
acacagccucuauagcaggccuuccuguggaaggcagaggcagugagggagguggacggugcca

SEQ ID NO: 509811 - RNA, 64 nt, Human
caggggaggguguucaaggaagaguggcucuuagcagaggcacuuuggaaggugugaggcauaa

SEQ ID NO: 509812 - RNA, 64 nt, Human
cuucaggcugaugagugugugggguauggggcagcagaggcagccagccagcaaagaggggcca

SEQ ID NO: 509813 - RNA, 64 nt, Human
gugccaucaccauaaccucuggggaccccaaccucagaggcagcuucaagugccuuuugcugcg

SEQ ID NO: 509814 - RNA, 64 nt, Human
gcgcauuugauuucuccagguuugcugugucucacagaggcaguaggaacccagcucucagggc

SEQ ID NO: 509815 - RNA, 64 nt, Human
cuuugaucaguauaauuuuuuaaaguuacuuugucagaggcacaaaaggguuuaaacugauuca

SEQ ID NO: 509816 - RNA, 64 nt, Human
ccaaagggggagucccucgucucuugugacucagcagaggcaguggccacguucagggaggggc

SEQ ID NO: 509817 - RNA, 64 nt, Human
augccccccagcuacuguaugcccccgacccccgcagaggcagaaugaacccauagggagcuga

SEQ ID NO: 509818 - RNA, 64 nt, Human
gcuccaucugccuucagggccuggacugcacucacagaggcaaguguuguagacuaacaaagau

SEQ ID NO: 509819 - RNA, 64 nt, Human
ucuucagggacuuguguacugguuaugggggugccagaggcacuaggcuugggguggggagguc

SEQ ID NO: 509820 - RNA, 64 nt, Human
agggaaaaacaggcaggggucagagccagccugccagaggcaaaugcaaaagagguccccagaa

SEQ ID NO: 509821 - RNA, 64 nt, Human
uggcgugguauuuauugugcagcagauccagagacagaggcagccugucuuuucaguugguuuc

SEQ ID NO: 509822 - RNA, 64 nt, Human
ugccuugggccucgccucuguccucagguccucucagaggcagauaccuaggggagcugcugcu

SEQ ID NO: 509823 - RNA, 64 nt, Human
cgccagcgcucaccaugggugccaggaugcuucgcagaggcacugugcucacgguuggacuugg

SEQ ID NO: 509824 - RNA, 64 nt, Human
aguuaugugaaacacuuugccgcaggccgccuggcagaggcaggaaaugcuccagcaguggcuc

SEQ ID NO: 509825 - RNA, 64 nt, Human
ccagccacacccggugggggcacagcacagaccccagaggcaggaaccucucagccgaugcccc

SEQ ID NO: 509826 - RNA, 64 nt, Human
uauuccacgcugugcuguuuggaugggagccccacagaggcagguccuggaaccaccccacccc

SEQ ID NO: 509827 - RNA, 64 nt, Human
uuuccccaugaacucugaaccaccuuugucucugcagaggcauccggaucccagcaagcgagcu

SEQ ID NO: 509828 - RNA, 64 nt, Human
gcagcaugcaauaauuacaucauaaguucucaagcagaggcagucuauugcaaggaccuucuuu

SEQ ID NO: 509829 - RNA, 64 nt, Human
gcacugacucugagacgugauacuucauggaugccagaggcauucggauucaugacucgugcuu

SEQ ID NO: 509830 - RNA, 64 nt, Human
ugaugcuggccagggaagcagaggaugugagaggcagaggcaggcuccuggggcugagcuccuu

SEQ ID NO: 509831 - RNA, 64 nt, Human
ccggcccggacacagggaggacgcucccggggcccagaggcaggacuguggcgggccgggccuc

SEQ ID NO: 509832 - RNA, 64 nt, Human
caggaaauuaaacucauggaacuuauaagacauacagaggcacaccuuucugaaauccaagaaa

SEQ ID NO: 509833 - RNA, 64 nt, Human
uaucuuuguuacuuucacuuuuuuacaaccuggccagaggcauuuuuuaaaucaggcccaauau

SEQ ID NO: 509834 - RNA, 64 nt, Human
acagggagacgggggccuggagccagcccugagccagaggcagaauggauggacagacaggcca

SEQ ID NO: 509835 - RNA, 64 nt, Human
caccuaaagauuuucuguagcguagauauuuccccagaggcacgcgaacugucagucuuuccua

SEQ ID NO: 509836 - RNA, 64 nt, Human
agcucuuuugucucuguccuuacgaggcgucauacagaggcaguggggugggcacagaugagca

SEQ ID NO: 509837 - RNA, 64 nt, Human
aaggccuugucagcuuugucugugccucgcaaaucagaggcaagggagagguuguuaccagggg

SEQ ID NO: 509838 - RNA, 64 nt, Human
ggagggcagaggaaguacuuagggagguuggugucagaggcaggagugggggaucagggaaggu

SEQ ID NO: 509839 - RNA, 64 nt, Human
acugaggggaacccugggacaggcacaggcugggcagaggcacagggcagugcaggggacucug

SEQ ID NO: 509840 - RNA, 64 nt, Human
gcugaggccauggcaggacagcugcuguggggugcagaggcagaagaugaaggacaaaaggaag

SEQ ID NO: 509841 - RNA, 64 nt, Human
gcauagucaccuaggggaggaggccguaugaagacagaggcagagauuggagugacgcaucucc

SEQ ID NO: 509842 - RNA, 64 nt, Human
uauaucuauauauuucucucacccuauuuugagacagaggcacaaagacucagcaauuuuuuuc

SEQ ID NO: 509843 - RNA, 64 nt, Human
uugcuucucugccuacguccccuuagaugggcagcagaggcaacucccgcauccuuugcucugc

SEQ ID NO: 509844 - RNA, 64 nt, Human
ggcccgucagagucuuuuguggugcugugcuucucagaggcaggauccaagcagaucagcccag

SEQ ID NO: 509845 - RNA, 64 nt, Human
acucuggcuuaggaaaacaugaacacaggggcaacagaggcaaacuguuguucgaguuaaauau

SEQ ID NO: 509846 - RNA, 64 nt, Human
cauuuacguucuuccccuucuggccaagauuugccagaggcaacaucaaaaaccagcaaauuuu

SEQ ID NO: 509847 - RNA, 64 nt, Human
ggauugaaucugguuggucauuuccaccaggaaucagaggcagcuguuaccagguuucggccuu

SEQ ID NO: 509848 - RNA, 64 nt, Human
cucaggaccagagaagggaaaugacuucuccaggcagaggcagaucugagucuagaacccaggc

SEQ ID NO: 509849 - RNA, 64 nt, Human
gucagagaacagagaucacacacaccaaaccagacagaggcagggcagcauggagacagguaga

SEQ ID NO: 509850 - RNA, 64 nt, Human
uugggacgcugaggugggaggaucgccugaaccucagaggcagagguugcaaugaagcggaggu

SEQ ID NO: 509851 - RNA, 64 nt, Human
guucuuuugccuuguucucugccugauguguaugcagaggcagcccucaauaugcagugguuga

SEQ ID NO: 509852 - RNA, 64 nt, Human
gaaaacaucugggaauuugaaucacuccugaauacagaggcauauucuuuuuaaacuauaaaua

SEQ ID NO: 509853 - RNA, 64 nt, Human
ccugacuagcauguguucuugauugcaaaauuggcagaggcagggugucaacuugauuaggugu

SEQ ID NO: 509854 - RNA, 64 nt, Human
gugugaguggccccuucugaaucucuccagcagccagaggcacgugagaagcagaaagagcugg

SEQ ID NO: 509855 - RNA, 64 nt, Human
cagggcuccugggcugccagggaccuucagcucccagaggcagugugguccugggaaugugacc

SEQ ID NO: 509856 - RNA, 64 nt, Human
gcuucuacucucagcuuuaggacaaaagcucugucagaggcacaagcugaaggucaaaaaugau

SEQ ID NO: 509857 - RNA, 64 nt, Human
uggcuccggggggaguggggcccugcgcuagaggcagaggcaguucuuuguucaagcguuccuc

SEQ ID NO: 509858 - RNA, 64 nt, Human
uucuuuguucaagcguuccucuggggaccggcagcagaggcaccguguucucucagcccuggau

SEQ ID NO: 509859 - RNA, 64 nt, Human
cugccauggcuggcgugaggcccagaggaccacgcagaggcaaugguaguacagaugucacagc

SEQ ID NO: 509860 - RNA, 64 nt, Human
guuccguuaggggauccuuccuuaggcuuaacgacagaggcaagccuuugcaugccgucagucu

SEQ ID NO: 509861 - RNA, 64 nt, Human
uaagacaaaaaaaaaaaaaaaaaacaaacagaggcagaggcaggcaguagcaagaaagcagagc

SEQ ID NO: 509862 - RNA, 64 nt, Human
aaaauguaagacaaaaaaaaaaaaaaaaaacaaacagaggcagaggcaggcaguagcaagaaag

SEQ ID NO: 509863 - RNA, 64 nt, Human
agucuugcaccaaagucucuggucuguuuacuaacagaggcaaaaggcaugucuuaggaacugu

SEQ ID NO: 509864 - RNA, 64 nt, Human
uuuauugucuuccuguaagaccuucgggucaaggcagaggcaggaaacuaacuggugugaguca

SEQ ID NO: 509865 - RNA, 64 nt, Human
ggggagacaacccccuacuuccucccuuggggugcagaggcacggggagagggaggaugagaca

SEQ ID NO: 509866 - RNA, 64 nt, Human
aucuccuccucuuggcucucaaugcugaggcuugcagaggcaucccagcggcaccagccuccca

SEQ ID NO: 509867 - RNA, 64 nt, Human
gaugcauccuaguuguccuccuggcagcuguuuucagaggcauucccagcccuucacuuaacuc

SEQ ID NO: 509868 - RNA, 64 nt, Human
cguugguuuaccugaguuuucucuggggucugcacagaggcagcagcauggacaucauggccuc

SEQ ID NO: 509869 - RNA, 64 nt, Human
agccaguggacuguggcagagaaaguccuccacucagaggcagagacugaguuaagucauaggu

SEQ ID NO: 509870 - RNA, 64 nt, Human
gcagccccugccugguaagaaggugcccauuguucagaggcaaagagaagccugcgguuggcau

SEQ ID NO: 509871 - RNA, 64 nt, Human
ggaaaggacacgugagagugagcucaaguggcagcagaggcaguuuggaauaagcugcggcaag

SEQ ID NO: 509872 - RNA, 64 nt, Human
gauucuuucccccucccugcugaagcaugugguacagaggcaagagcagagccugagaagcguc

SEQ ID NO: 509873 - RNA, 64 nt, Human
ccuuccgccccuccaaagcccucaccaugccuaacagaggcaugcauuuuuauaucagauuauu

SEQ ID NO: 509874 - RNA, 64 nt, Human
uggaggggguugaaggauccugacagaccauggacagaggcaggaaguaaggaaacugauguua

SEQ ID NO: 509875 - RNA, 64 nt, Human
aggagcauagaauaguuuggguaccaggaacccacagaggcacacaugaaaagccaaauuaugg

SEQ ID NO: 509876 - RNA, 64 nt, Human
cuauaucauacucuugugagguuggauuuaaccacagaggcagaaaguuggucuacuuugcucg

SEQ ID NO: 509877 - RNA, 64 nt, Human
agagacacagagauggaauagaaaagaugagaggcagaggcagacaggcgcuggacagaggggc

SEQ ID NO: 509878 - RNA, 64 nt, Human
accugugggaaaccugccaggggcagccgauguucagaggcauccaaaaaaagucucccacuuc

SEQ ID NO: 509879 - RNA, 64 nt, Human
uuauucagauaauuaacacugcaugaaucugauucagaggcaugcauuuacauauguugcccua

SEQ ID NO: 509880 - RNA, 64 nt, Human
guauucagacauaguauuacaagcuauuggaacucagaggcaucuuagagaacaucuguuccca

SEQ ID NO: 509881 - RNA, 64 nt, Human
uugcagccagccaccaacggcccccuugcccuugcagaggcagaagccugcgucugcaccugca

SEQ ID NO: 509882 - RNA, 64 nt, Human
cucuaccaguugcgcaagaaagaagucacuguuacagaggcaagcggugaacuagguaagaguu

SEQ ID NO: 509883 - RNA, 64 nt, Human
uucugugagagucccucugcugcucacucugauccagaggcacccugaguuggugcuuuggauc

SEQ ID NO: 509884 - RNA, 64 nt, Human
guccugccuggggccccacuugaaggaggcaggacagaggcaccgaggccagggagacgcccaa

SEQ ID NO: 509885 - RNA, 52 nt, Human
cugaucacccagccauauagcacagaggcauauuuuccuguuacuugagugg

SEQ ID NO: 509886 - RNA, 64 nt, Human
gauagggaugaagaccccacugggguuggaagugcagaggcagacagguguauggagucaccug

SEQ ID NO: 509887 - RNA, 64 nt, Human
cuuuucuagaaccuuuuguaaaaguugguggcagcagaggcagccccaggccgggcugcaucuc

SEQ ID NO: 509888 - RNA, 64 nt, Human
acugaguagggaaggcagggcugcccagaagucucagaggcaccucacgccagccaucgcggag

SEQ ID NO: 509889 - RNA, 64 nt, Human
cccaggggaucuuuccucccuccccugcaugaggcagaggcaagcugccugccaacccccuccc

SEQ ID NO: 509890 - RNA, 64 nt, Human
acuaaccuuccucugggccugaccaucucugggacagaggcaagaauccccaaggggugggcag

SEQ ID NO: 509891 - RNA, 64 nt, Human
ccucuguguguacuucauagaagguggaaucggacagaggcagguuagugacaguuauuccuga

SEQ ID NO: 509892 - RNA, 64 nt, Human
uggcugcccgccugccucuuuggggaacugagcucagaggcaggugcuucagagaaggaaacaa

SEQ ID NO: 509893 - RNA, 64 nt, Human
uggcucacgccuguaaucccagcgcuuugggaggcagaggcagguggaucaccugaggucggga

SEQ ID NO: 509894 - RNA, 64 nt, Human
ggaaggcagggaggugcaacuggcagggccugaucagaggcagaaaaugacccccacagugguc

SEQ ID NO: 509895 - RNA, 64 nt, Human
aagguucugauguccugguugugauugcuggacccagaggcaagaucugcagagaugccuguga

SEQ ID NO: 509896 - RNA, 64 nt, Human
aacaguuggcaggacaggugugacacagccacagcagaggcaaggggugccaggaguccccagc

SEQ ID NO: 509897 - RNA, 64 nt, Human
cucauuaauucuuuguaacagcaaauccuaggcucagaggcacagugcuuuguauuugauauac

SEQ ID NO: 509898 - RNA, 64 nt, Human
gggcugcuuggaguggaaagcagggagcaguguucagaggcaaagcagccuucccagccgcucc

SEQ ID NO: 509899 - RNA, 64 nt, Human
ggaaagacaaagagguuaucacaaaaauuccucccagaggcacucuauaucugcuaugccuaaa

SEQ ID NO: 509900 - RNA, 55 nt, Human
ugaagaaaacucugacuuaggcacucagaggcauacacuuuuuacagauggacaa

SEQ ID NO: 509901 - RNA, 62 nt, Human
acaggagaagugcacccuagggccuucugggccagaggcaccaucccuucuggccauccauc

SEQ ID NO: 509902 - RNA, 64 nt, Human
aaccuuguggucacaucagaggucaacagcagaacagaggcaggucaggguuguccgcucugau

SEQ ID NO: 509903 - RNA, 64 nt, Human
aaugaguuccuuuaagugccaccgccagcaagcccagaggcacacaguccgagugcacccgcuu

SEQ ID NO: 509904 - RNA, 64 nt, Human
aucucuuaaaacuuuguagucuuggaauucaugacagaggcaaaugacuccugcuuaacuuaug

SEQ ID NO: 509905 - RNA, 64 nt, Human
cugucuuacccgguggccuuggcccagaaggagccagaggcagcagccucagccccagggacug

SEQ ID NO: 509906 - RNA, 64 nt, Human
cauagggcuggggacuggggaaggggaggguguucagaggcagcaccaccacacagucaccccu

SEQ ID NO: 509907 - RNA, 64 nt, Human
ggacuccaccaccaagucacuuccccugcucgugcagaggcacgggaugagucugggugaccuc

SEQ ID NO: 509908 - RNA, 64 nt, Human
agauaagcccagcagccccagaagauggucugaacagaggcaucuccgcacccaagacugugca

SEQ ID NO: 509909 - RNA, 64 nt, Human
gacgggagagacacaggauaaaagguuaaaagugcagaggcagagucuggggcucagguugggu

SEQ ID NO: 509910 - RNA, 64 nt, Human
cuucagguaaugggggcucauugugagggaggugcagaggcagcagaggauuggcauaaaacug

SEQ ID NO: 509911 - RNA, 56 nt, Human
cuguaccacggaaauugugaccgcuucagaggcaaggcuugccacuugggucuggg

SEQ ID NO: 509912 - RNA, 64 nt, Human
uugcggacagccacggccaggccagagggagugacagaggcagccccauucugccugcccaggc

SEQ ID NO: 509913 - RNA, 64 nt, Human
cucagcgccagcucuaccaguucucguuuugggccagaggcagccucugcacucccacgccugu

SEQ ID NO: 509914 - RNA, 64 nt, Human
accccugacuuccucccuccccacaucaugaaggcagaggcaugcacauuccucacugaaaaag

SEQ ID NO: 509915 - RNA, 64 nt, Human
uggcgcaugcuuguaaucccagcuacucaggaggcagaggcaggagaaucacuugaacccggga

SEQ ID NO: 509916 - RNA, 64 nt, Human
ucccuggugggccuggcaaugacagcauuucucacagaggcauucugguaaaugaagcugaaag

SEQ ID NO: 509917 - RNA, 64 nt, Human
ucguggugacugccuuugggagcccgcagguggccagaggcagggguagcugaguuccuggaga

SEQ ID NO: 509918 - RNA, 64 nt, Human
cucaccaacuacagaaagagcgucauguccuuggcagaggcagggaagcucuaccgcaaggacc

SEQ ID NO: 509919 - RNA, 64 nt, Human
auaagagaagguguaagguuuuuaucuuauaugccagaggcaccaggccagaugugccgcacag

SEQ ID NO: 509920 - RNA, 64 nt, Human
cuuuggccuuccuuuccccagcgccccugagggccagaggcagaugugggcugcaggcugcaca

SEQ ID NO: 509921 - RNA, 64 nt, Human
ccacuccccggccucguggcagugauggccccugcagaggcagccugaggucaccgggcccgac

SEQ ID NO: 509922 - RNA, 64 nt, Human
aggugaugccaagggauacugcucaucuguggagcagaggcacagacaacccuucccaucuggc

SEQ ID NO: 509923 - RNA, 64 nt, Human
ugccucugcucucccuuuguggggacucaggcagcagaggcaucugggaagucucugaguaggc

SEQ ID NO: 509924 - RNA, 64 nt, Human
ggucuggggccgccacaggccccucacggggcggcagaggcaacuucagugucccuguuagagc

SEQ ID NO: 509925 - RNA, 64 nt, Human
cucugaaauggaguucucacaccguaucuagggacagaggcaucuggaugcaaacgcgggguuu

SEQ ID NO: 509926 - RNA, 64 nt, Human
guccacagcggcgacccaggccuccaagcuugcacagaggcaaggccagacuuuuccgucguuu

SEQ ID NO: 509927 - RNA, 64 nt, Human
gcacagcggagccaugggggcugggaguccccaucagaggcagugaggugggccccggcccugg

SEQ ID NO: 509928 - RNA, 64 nt, Human
ucccgccacggggccgugcuguguuuauggcuggcagaggcagccagcgggugggggauucugc

SEQ ID NO: 509929 - RNA, 64 nt, Human
uguuucucagaaaagaacauguagugacacagggcagaggcauccauggcuggcgucuggaaua

SEQ ID NO: 509930 - RNA, 64 nt, Human
ugcacuggaacccacagaccucacaccugggggacagaggcagauaagaaggugcgagggccac

SEQ ID NO: 509931 - RNA, 64 nt, Human
uagaugguaaacaguguuaacccauccuuuacuacagaggcauauggguuugaauguuaccugg

SEQ ID NO: 509932 - RNA, 64 nt, Human
cugggccccuuccagaaucagugcgagcguccugcagaggcauggccuuccugccacugcagag

SEQ ID NO: 509933 - RNA, 64 nt, Human
ugguaccugauggucuguucugacgggugagggacagaggcaucuggaugaaaaucucgacgcu

SEQ ID NO: 509934 - RNA, 64 nt, Human
acggcgaccuucgggcccuuuucuccagcaacugcagaggcauuucaggaguuggagaacggag

SEQ ID NO: 509935 - RNA, 64 nt, Human
accuugacaacaaaacccugcgcugcccccuuuacagaggcacccuggugccccgccuggcaga

SEQ ID NO: 509936 - RNA, 64 nt, Human
augcugcugcugccugggucucugcucuagcacccagaggcaugacaggcccugcucagagguc

SEQ ID NO: 509937 - RNA, 64 nt, Human
gggaucuggggacuugggugugacaccugcuugacagaggcagggcuguggccaggaccaaccu

SEQ ID NO: 509938 - RNA, 64 nt, Human
gaagaagcugggagggagggggaggugaaaagggcagaggcaaggaugguggggcccccagcac

SEQ ID NO: 509939 - RNA, 64 nt, Human
ccuggcuccgcuguguggauggggagaucggggccagaggcagaacccuggugaggaagcucca

SEQ ID NO: 509940 - RNA, 64 nt, Human
acucgcuucucugugacugauguuaggcugggcccagaggcacagccggggccugccuagcacu

SEQ ID NO: 509941 - RNA, 64 nt, Human
ccucccgguucccacaggcuaugaugcugcauggcagaggcagguauaacacagcacuacauau

SEQ ID NO: 509942 - RNA, 64 nt, Human
gccaaccaccucuggcccuguugugggggugucacagaggcaguggcagcaacaaaggauuuga

SEQ ID NO: 509943 - RNA, 64 nt, Human
gugcucagagggcggggagaaucucagcgugggccagaggcagcucgugugccuggcccgagcc

SEQ ID NO: 509944 - RNA, 64 nt, Human
acgcaaaccaaccuuucugacaucagcacuuuaccagaggcauaaacacaacugacucccauuu

SEQ ID NO: 509945 - RNA, 64 nt, Human
gaugugucaaaggcuuuuggagugaccaaaagcacagaggcagcggguggggcgccuggguggu

SEQ ID NO: 509946 - RNA, 64 nt, Human
ugguccccaaggucgcugccacccuugcccggggcagaggcagaagcccacauaugcugugacg

SEQ ID NO: 509947 - RNA, 64 nt, Human
auuaucuuguuuguacagaaauauacuggccuagcagaggcaaaaaaaaaaaaaaugaauuuua

SEQ ID NO: 509948 - RNA, 64 nt, Human
cacccggcugguuggcauggccuggggcaggaggcagaggcaggagaccaagauggcaggugga

SEQ ID NO: 509949 - RNA, 64 nt, Human
ggcugucaacccuuucuccuguuggacuacaguucagaggcagccugcaguccucccaugauag

SEQ ID NO: 509950 - RNA, 64 nt, Human
cauacccuguccuuucucccugaccccaagggcacagaggcaaggccuccugucuacagcagcu

SEQ ID NO: 509951 - RNA, 64 nt, Human
gggcuucccuccugggggcagcuacacucguccccagaggcacauucgugcacauucucacaga

SEQ ID NO: 509952 - RNA, 64 nt, Human
gcuaggaugcuucaggcccauguacaauugaaagcagaggcauccuugagcuuuaaagcauuga

SEQ ID NO: 509953 - RNA, 64 nt, Human
gaccccugggcugacguccagaccaaucucaccccagaggcaacuggauggugccuuuaguugg

SEQ ID NO: 509954 - RNA, 64 nt, Human
uuaaccucacacaagcacagaucccagacuuugccagaggcaaacagccuuccaauugccccuc

SEQ ID NO: 509955 - RNA, 64 nt, Human
caccuagcacgugcuggaugggcugccucugacucagaggcauggccggauuuggcaacucaaa

SEQ ID NO: 509956 - RNA, 64 nt, Human
agagggcacaaaacugucucaaugagaggggagacagaggcagcuagggcuuggucucccagga

SEQ ID NO: 509957 - RNA, 64 nt, Human
aaggaggcucuagguuuugucuaucaucucaguucagaggcaacgaaacuggacucauuacucc

SEQ ID NO: 509958 - RNA, 64 nt, Human
ucccgguuugucaguucuuggugcucuguguucccagaggcaggcggagguugaagaaaggaac

SEQ ID NO: 509959 - RNA, 64 nt, Human
cccagccuuggagcuggaugccugugcagcagaacagaggcaacgguggcaggcagguggaggc

SEQ ID NO: 509960 - RNA, 64 nt, Human
auccugaaauucuccuggccgcaagaacuccccacagaggcagaagagggucuccaccuauggc

SEQ ID NO: 509961 - RNA, 64 nt, Human
uucgggugcuggguaagugccaugucaguguggacagaggcauuugacuaagccaaccuccucu

SEQ ID NO: 509962 - RNA, 64 nt, Human
uuucagagagaccaggagcacuacagagaauuuccagaggcaaauuuugaauugagugccacug

SEQ ID NO: 509963 - RNA, 64 nt, Human
ccaguucuggccacguacagccagcgggucagcccagaggcagccucagcuccagggcuaagga

SEQ ID NO: 509964 - RNA, 64 nt, Human
cuguaugggauaucccucgguaaggguaaaggagcagaggcaaaggagaaaagcagaaguugca

SEQ ID NO: 509965 - RNA, 64 nt, Human
gacuuagaccuccuucaguguggcucugcugggccagaggcauccugcugucccggguggcugc

SEQ ID NO: 509966 - RNA, 64 nt, Human
ggucgggagaguagaguacauaaucagugccacacagaggcagggcgugucugagagacuaaug

SEQ ID NO: 509967 - RNA, 64 nt, Human
ggugaaagcugugaaaggauccacauuaauucuucagaggcagggcuaagacuuucaagacuga

SEQ ID NO: 509968 - RNA, 64 nt, Human
auuaauaacucuuugcaaaaugucuccuuugagacagaggcauuucagauagauacccaccaug

SEQ ID NO: 509969 - RNA, 64 nt, Human
caggggcagaacccgcucgugccaucugucgauucagaggcacgcacacaugcucugcaggaug

SEQ ID NO: 509970 - RNA, 64 nt, Human
ucaagacaagcagacucguaaaaucuuguagaggcagaggcaaaguuaucaucauacaaaaauc

SEQ ID NO: 509971 - RNA, 64 nt, Human
ugucucuccugccccuuggacacgcucaguggggcagaggcaguaccugggcaagcuggcggcu

SEQ ID NO: 509972 - RNA, 64 nt, Human
cuuacccgcuaggugguuaauuuauccaugcuggcagaggcacucagguacuugguaagcaaau

SEQ ID NO: 509973 - RNA, 64 nt, Human
ucugcaaaaguugaaagcaaaugggagaugaugucagaggcaucuguuuccuuuaccaucugca

SEQ ID NO: 509974 - RNA, 64 nt, Human
cccgccggccugccgggcucccaccccuggacggcagaggcaaggacggacgggagcuccacug

SEQ ID NO: 509975 - RNA, 64 nt, Human
ccggggggauucagcccuucucccacugugcuggcagaggcacuccugugacgcugaauacagu

SEQ ID NO: 509976 - RNA, 64 nt, Human
agaccaaacucauucaccaaaugaugccacuucccagaggcagagccugagucacuggucaccc

SEQ ID NO: 509977 - RNA, 64 nt, Human
acagcugcugggggaaauccugggguccuugagacagaggcaggacccucguguucccagcugc

SEQ ID NO: 509978 - RNA, 64 nt, Human
acagagacacacagagaagaaagccauguggcggcagaggcagagaugggagugaugcggacgg

SEQ ID NO: 509979 - RNA, 64 nt, Human
gugcccgccccaagagcaagcaccggccaugcugcagaggcaagaccucaauucuuggcugcaa

SEQ ID NO: 509980 - RNA, 64 nt, Human
ggguguuacacgcagucaucagaccucacccucacagaggcacaaacccacauaguuguggacg

SEQ ID NO: 509981 - RNA, 64 nt, Human
ugauccucaaacauugacacuggaugggcugcagcagaggcacugggggcagcgggggccaggg

SEQ ID NO: 509982 - RNA, 64 nt, Human
cuaccaaugcuuaaaaccacacccagggagcccacagaggcacucagugggugguggggugaug

SEQ ID NO: 509983 - RNA, 64 nt, Human
ccccaucccuccaaucugugccccgucugcagggcagaggcagauguggcaugucuuuuuguac

SEQ ID NO: 509984 - RNA, 64 nt, Human
cagaguaucuucccacugagacacgccgcccccacagaggcacaguccccagccaccucugcaa

SEQ ID NO: 509985 - RNA, 64 nt, Human
auuuggccuugaacaaaaccaaguccacuggggacagaggcaggggcaaguggcucuccccauu

SEQ ID NO: 509986 - RNA, 64 nt, Human
cauuaguugagauucugugagucuagguugaccacagaggcaagcacuggugagucuaggacag

SEQ ID NO: 509987 - RNA, 64 nt, Human
cccuugaggguacccuggguccccucaucaggggcagaggcaugaaagagucggggcuggaugg

SEQ ID NO: 509988 - RNA, 64 nt, Human
acuccccacuggcagccgcuggugucucuucacacagaggcacaaccuggacccaggcagccuc

SEQ ID NO: 509989 - RNA, 64 nt, Human
gacagggagguugggaggggggacagaggggagacagaggcacggagagaaaggaauguuuagc

SEQ ID NO: 509990 - RNA, 64 nt, Human
ggagccagguagccccggccugggucaucaggcacagaggcaccgcaacaccaccugcggcaac

SEQ ID NO: 509991 - RNA, 64 nt, Human
cguuuuuaaaaucuuccaaaugccuuuuuuuccucagaggcagagaaugacuaaguacggggag

SEQ ID NO: 509992 - RNA, 64 nt, Human
gugcguucucucugugacucucuucccuuacuuucagaggcauaggaucuggagccagacugcu

SEQ ID NO: 509993 - RNA, 64 nt, Human
uggugcacaccugucgucucagcuacucgggaggcagaggcaggagaauggcuugaaccuggga

SEQ ID NO: 509994 - RNA, 64 nt, Human
ccccaggucucagcccccaaggcugcccccucagcagaggcagcugguggcuuugcccuccacc

SEQ ID NO: 509995 - RNA, 64 nt, Human
gaagcuccauagaaguggcauuugaaggguguggcagaggcagugcuguguuuaucacacuggu

SEQ ID NO: 509996 - RNA, 64 nt, Human
uggcucacaccugucauccuagcacuuugggaggcagaggcaggaggaucgcuugagcucagga

SEQ ID NO: 509997 - RNA, 64 nt, Human
aucaggcaaggucuggagacauuuuugguuggggcagaggcaugcuccuggcaucgagugggug

SEQ ID NO: 509998 - RNA, 64 nt, Human
gacuguguccuuagaaaaaugggaaauuuggucacagaggcagauguacagagggaagacgaug

SEQ ID NO: 509999 - RNA, 64 nt, Human
gacuaagguugcaggccuuagccucgucucgucccagaggcauuggaucaggagaaugggaauu

SEQ ID NO: 510000 - RNA, 64 nt, Human
aaagagucuagcaaaacaauauaguauuuuuuugcagaggcaugaaaaauuaagacgcuuuaga

SEQ ID NO: 510001 - RNA, 64 nt, Human
ggcuccucacacaugaucguguuucguaaggagccagaggcagcauagugaaaaguuaggagcg

SEQ ID NO: 510002 - RNA, 64 nt, Human
cugcuacccucauuucucaucuuuuuacuaaacucagaggcagugacagcagucagggacagac

SEQ ID NO: 510003 - RNA, 54 nt, Human
uuuuggugcugagcgcaugagugacagaggcagagaugcugcugcaacuggaag

SEQ ID NO: 510004 - RNA, 64 nt, Human
cauagcucauguaucagggacuuuugccacauuucagaggcauagcaugaacaaguaauauuaa

SEQ ID NO: 510005 - RNA, 63 nt, Human
ggagcccauccagucucccaacuuguauuaaagacagaggcagaaguuugguggugguggugu

SEQ ID NO: 510006 - RNA, 64 nt, Human
ucaguuccaucaucuggaggucagacacacuguccagaggcagaacugaagcccucucggcccc

SEQ ID NO: 510007 - RNA, 64 nt, Human
aagaaucacauccgguuguguccugugggagggucagaggcagaaucuacuuacagugguguaa

SEQ ID NO: 510008 - RNA, 64 nt, Human
caaaugaguucccuugauucaaauaacccugaaucagaggcagagaccuccugaugucuugguu

SEQ ID NO: 510009 - RNA, 64 nt, Human
guugaggcugcauaacuuguucgugaagauauaacagaggcagacagaauccagagggcuacag

SEQ ID NO: 510010 - RNA, 64 nt, Human
ucggagggccccugugugggggccagucaggcugcagaggcaccucaacauuccauggugcuag

SEQ ID NO: 510011 - RNA, 64 nt, Human
caccuagaaccccaauucagccuccugggcaccccagaggcaaggcugugcacucagggaggga

SEQ ID NO: 510012 - RNA, 64 nt, Human
ugaacugacccuucaggcugagugugaagcgucucagaggcauuucagaaccugagcuuuuggg

SEQ ID NO: 510013 - RNA, 64 nt, Human
agaggccucugaaccccaggcugggaccccagcacagaggcaauaaaggcaguggucccuucca

SEQ ID NO: 510014 - RNA, 64 nt, Human
ugguuugucacaaagaaggaacuaagaagcaggacagaggcaacguggagaggcugaaaacagu

SEQ ID NO: 510015 - RNA, 64 nt, Human
gacaauucuucucgacuucaggagcugacagagccagaggcaccuaaacuuggguacaucuugu

SEQ ID NO: 510016 - RNA, 64 nt, Human
uacacaugaccuuggagccucuuggccuucagagcagaggcaaacccaccacagggcagcugcg

SEQ ID NO: 510017 - RNA, 64 nt, Human
ucuuuaacacuugaaauucauuucuaucuggauacagaggcagauuuuucuucauugcuuaguu

SEQ ID NO: 510018 - RNA, 64 nt, Human
caugaggugugucccuagggcuucaguccuggggcagaggcauaaacagaaccagucacuaugg

SEQ ID NO: 510019 - RNA, 58 nt, Human
aagauuguccgccugucugaggggagcccagaggcacauccggacaaguuucagauaa

SEQ ID NO: 510020 - RNA, 64 nt, Human
ccuggaaacccauuuagagccaagucugaagaaucagaggcaacuucaugguucuccaaagaag

SEQ ID NO: 510021 - RNA, 64 nt, Human
gacacagaugcauagggaggacaccaugccgugacagaggcagagggugcagugacacagccac

SEQ ID NO: 510022 - RNA, 64 nt, Human
gcuacuucggcuucuuaaacccugcaguguuaaacagaggcauugagaaaggggaaaggcgggu

SEQ ID NO: 510023 - RNA, 64 nt, Human
ucuacucccgcucucuauuccccaguuucuugcccagaggcaacccuugccagucuguuuaucc

SEQ ID NO: 510024 - RNA, 64 nt, Human
aaugguccccuuacggacaggucccagagauggacagaggcacccagggcccccaccguccuuc

SEQ ID NO: 510025 - RNA, 61 nt, Human
ccaggacacgugucccuugaacugaagacagcagaggcacgcauccccuuggagagacugu

SEQ ID NO: 510026 - RNA, 64 nt, Human
agcauggccacccucaagaggcgagaugagcccacagaggcauauccugcggggaugcugggcu

SEQ ID NO: 510027 - RNA, 64 nt, Human
uuggucacccugucaccacugaaccuugauuuaacagaggcaaaaugcaagucuucccugaaga

SEQ ID NO: 510028 - RNA, 64 nt, Human
gcagggaguguggagaagguggaagagcugagcucagaggcagagaagcuccuugcagggagca

SEQ ID NO: 510029 - RNA, 64 nt, Human
uuguugaacuucggccacgagacaugcacacuuccagaggcagugggaacugcucagaggcccg

SEQ ID NO: 510030 - RNA, 64 nt, Human
aaccagaaccagagggguaguuuucuuuucccuccagaggcagccuuugguacuuaaaauaucu

SEQ ID NO: 510031 - RNA, 64 nt, Human
uuaggaacuaaccucauuagcuauaaggaucaugcagaggcagcaaagccgggugcgaugagcu

SEQ ID NO: 510032 - RNA, 64 nt, Human
aagagagccaggggagggccccggguucggcggccagaggcaggucagggguccccucucccuc

SEQ ID NO: 510033 - RNA, 64 nt, Human
acuugguuagggcuaccuucucauugguugcagccagaggcacuucugcccgggcugccucucc

SEQ ID NO: 510034 - RNA, 64 nt, Human
auggcacugagaugcauccacucagcaggagugacagaggcagaaguuccuuuaaagcacaucu

SEQ ID NO: 510035 - RNA, 64 nt, Human
aacccuuaaaguacaguguuauuuaagaaucuuccagaggcagucaacagacuuauacacuaag

SEQ ID NO: 510036 - RNA, 64 nt, Human
gccugcagggguggagggcagucccucagaaucccagaggcagucccagccucagaacccagga

SEQ ID NO: 510037 - RNA, 64 nt, Human
ggaaagacucuuaauuaagaggcucaggcaagcacagaggcagcccgugggucucugucucagu

SEQ ID NO: 510038 - RNA, 64 nt, Human
ccauucucaagacucaucugccuagggagggucacagaggcaggauguaagacacacuguguug

SEQ ID NO: 510039 - RNA, 64 nt, Human
agggcugaggccagccccuagcagcuggauguggcagaggcaggccagaggaccuaagugugau

SEQ ID NO: 510040 - RNA, 64 nt, Human
gcugcuucuaagaggcuaaccuggaaacuaagcucagaggcaagguaauaaagcacuucagggc

SEQ ID NO: 510041 - RNA, 64 nt, Human
agagaaggaucugcuccgccuuuggccacaggagcagaggcagaccugggaugccccaguuucu

SEQ ID NO: 510042 - RNA, 64 nt, Human
ccuuucccagcccacagggcuugaagugaaggaacagaggcagggggugggccagccccagggc

SEQ ID NO: 510043 - RNA, 64 nt, Human
aggucugggggacagacaaggaugauggaccccucagaggcaagacuaggaucagggacagauc

SEQ ID NO: 510044 - RNA, 64 nt, Human
gcagcuaugcaaaucccuaccuacccagcugggccagaggcacgaggcagccaggcaggguggg

SEQ ID NO: 510045 - RNA, 64 nt, Human
ugaucguaguugcauuuuauucgucauuaccuggcagaggcaaagaaaggugagacccucuccc

SEQ ID NO: 510046 - RNA, 64 nt, Human
uccuaaaauccuaaaaagauacaccuugcaguagcagaggcaaugacaugaguuuguuuucuca

SEQ ID NO: 510047 - RNA, 64 nt, Human
agccagauagcuugacucaugagggaccuucagccagaggcaucuuuugagccauacgaauucc

SEQ ID NO: 510048 - RNA, 64 nt, Human
ugguuuugguggccacaggggguggcccgugcgacagaggcacaugcugaggccugcuggugga

SEQ ID NO: 510049 - RNA, 64 nt, Human
uagguucugcuuucugauacaucugucagugagucagaggcagaaccuagucuuguuguucaua

SEQ ID NO: 510050 - RNA, 64 nt, Human
uugcaauaauaucuuaacagaagggggugucaaacagaggcaucagccugcuguugaucacaga

SEQ ID NO: 510051 - RNA, 64 nt, Human
ucagagcugccccugcucucccaccacagccacccagaggcaccccaugaagcuuuuuucucgu

SEQ ID NO: 510052 - RNA, 64 nt, Human
ucaguguuggccaugaugacaacuacagaaaaaccagaggcagcuucuuugccaagaccuuuca

SEQ ID NO: 510053 - RNA, 64 nt, Human
ucucccuguccaagcgggaccgcuuugcagagaccagaggcauaucgcggcuugagcugaaaau

SEQ ID NO: 510054 - RNA, 64 nt, Human
acuguuccuaugaagaagccacuuguguuuuaagcagaggcaaccucucucuucuccucuguuu

SEQ ID NO: 510055 - RNA, 64 nt, Human
cagaugcccccugcucuguaacccuggggaaugucagaggcagguaauaaagguuguuuaaaca

SEQ ID NO: 510056 - RNA, 64 nt, Human
ucaaauccucccaagcugcugcacgugcugaguccagaggcagucacagagaccucuggccagg

SEQ ID NO: 510057 - RNA, 64 nt, Human
gaaagcacauuuuaccauugcuguugggaggaagcagaggcagaugggaaagcagagagaggag

SEQ ID NO: 510058 - RNA, 64 nt, Human
cuuccacacccucagaagaggagagccggcacagcagaggcaccggcgaugaaguggcacagcc

SEQ ID NO: 510059 - RNA, 64 nt, Human
agacacagacacagagcaggaggacacguggagacagaggcagacuggagugaugcggccacaa

SEQ ID NO: 510060 - RNA, 64 nt, Human
agacacagacacaaagcaggaggccacauaaagacagaggcagagacugaagugaugcugcccc

SEQ ID NO: 510061 - RNA, 64 nt, Human
aagggucuccaggcuuuauuccucccaggcacugcagaggcaccggugaggaagggucuccagg

SEQ ID NO: 510062 - RNA, 64 nt, Human; identical to SEQ ID NO: 117307

SEQ ID NO: 510063 - RNA, 64 nt, Human; identical to SEQ ID NO: 117308

SEQ ID NO: 510064 - RNA, 64 nt, Human; identical to SEQ ID NO: 117309

SEQ ID NO: 510065 - RNA, 64 nt, Human; identical to SEQ ID NO: 117310

SEQ ID NO: 510066 - RNA, 64 nt, Human; identical to SEQ ID NO: 117311

SEQ ID NO: 510067 - RNA, 64 nt, Human; identical to SEQ ID NO: 58989

SEQ ID NO: 510068 - RNA, 64 nt, Human; identical to SEQ ID NO: 58990

SEQ ID NO: 510069 - RNA, 64 nt, Human; identical to SEQ ID NO: 58991

SEQ ID NO: 510070 - RNA, 64 nt, Human; identical to SEQ ID NO: 117312

SEQ ID NO: 510071 - RNA, 64 nt, Human; identical to SEQ ID NO: 117313

SEQ ID NO: 510072 - RNA, 64 nt, Human; identical to SEQ ID NO: 117314

SEQ ID NO: 510073 - RNA, 64 nt, Human; identical to SEQ ID NO: 117315

SEQ ID NO: 510074 - RNA, 64 nt, Human; identical to SEQ ID NO: 117316

SEQ ID NO: 510075 - RNA, 64 nt, Human; identical to SEQ ID NO: 117317

SEQ ID NO: 510076 - RNA, 53 nt, Human; identical to SEQ ID NO: 117318

SEQ ID NO: 510077 - RNA, 54 nt, Human; identical to SEQ ID NO: 117319

SEQ ID NO: 510078 - RNA, 64 nt, Human; identical to SEQ ID NO: 117320

SEQ ID NO: 510079 - RNA, 64 nt, Human; identical to SEQ ID NO: 117321

SEQ ID NO: 510080 - RNA, 62 nt, Human; identical to SEQ ID NO: 117322

SEQ ID NO: 510081 - RNA, 64 nt, Human; identical to SEQ ID NO: 117323

SEQ ID NO: 510082 - RNA, 64 nt, Human; identical to SEQ ID NO: 117324

SEQ ID NO: 510083 - RNA, 64 nt, Human; identical to SEQ ID NO: 117325

SEQ ID NO: 510084 - RNA, 64 nt, Human; identical to SEQ ID NO: 117326

SEQ ID NO: 510085 - RNA, 64 nt, Human; identical to SEQ ID NO: 58992

SEQ ID NO: 510086 - RNA, 54 nt, Human; identical to SEQ ID NO: 435462

SEQ ID NO: 510087 - RNA, 56 nt, Human; identical to SEQ ID NO: 435470

SEQ ID NO: 510088 - RNA, 64 nt, Human; identical to SEQ ID NO: 117327

SEQ ID NO: 510089 - RNA, 64 nt, Human; identical to SEQ ID NO: 117328

SEQ ID NO: 510090 - RNA, 64 nt, Human; identical to SEQ ID NO: 117329

SEQ ID NO: 510091 - RNA, 64 nt, Human; identical to SEQ ID NO: 117330

SEQ ID NO: 510092 - RNA, 64 nt, Human; identical to SEQ ID NO: 117331

SEQ ID NO: 510093 - RNA, 64 nt, Human; identical to SEQ ID NO: 117332

SEQ ID NO: 510094 - RNA, 64 nt, Human; identical to SEQ ID NO: 117333

SEQ ID NO: 510095 - RNA, 64 nt, Human
gacacacuccaccuccagcacgcgacuucucaggacgacgaaucuucucaaugggggggcggcu

SEQ ID NO: 510096 - RNA, 64 nt, Human
cccaaagcuuucccaaacauuauucaaugguuacacgacgaaguagcuuuugaauaaugucugc

SEQ ID NO: 510097 - RNA, 64 nt, Human
uuauaacaugaaaggaaaauuaguuguguauuucacgacgaaagcgacggaccaaaagaaauuu

SEQ ID NO: 510098 - RNA, 64 nt, Human
caggcucggagggaagguuucccuuuauaugaagacgacgaaggaagagcaaggccaucugagu

SEQ ID NO: 510099 - RNA, 64 nt, Human
caauaauguugcaaagggagacuacagggaucucacgacgaauauucugauacaauacucaacc

SEQ ID NO: 510100 - RNA, 64 nt, Human
ugggcuguggcccugcugugaucauaccuugagcacgacgaagcaaccuuguuucugaggaagc

SEQ ID NO: 510101 - RNA, 60 nt, Human; identical to SEQ ID NO: 395917

SEQ ID NO: 510102 - RNA, 60 nt, Human; identical to SEQ ID NO: 395918

SEQ ID NO: 510103 - RNA, 60 nt, Human; identical to SEQ ID NO: 395919

SEQ ID NO: 510104 - RNA, 64 nt, Human; identical to SEQ ID NO: 435481

SEQ ID NO: 510105 - RNA, 64 nt, Human
augcuuucauucagucagucucuguugacuaaauacgacgaaaauucauacuuuaugcaggaga

SEQ ID NO: 510106 - RNA, 64 nt, Human
cgcuccgcugaaggggcaggggcuaggcugggagacgacgaaggaacaggcguuucugacgagc

SEQ ID NO: 510107 - RNA, 64 nt, Human
cccucccucccccuccuccccucuuuuacucuagacgacgaauaaagcccuguuagaggaugcg

SEQ ID NO: 510108 - RNA, 64 nt, Human
aguugauuauuucaacaguauugguuaagucacaacgacgaagugcugagaagguuauggguac

SEQ ID NO: 510109 - RNA, 64 nt, Human
auuuugugagguguacguguuaaugucccauuucacgacgaaaagacaagacucuggggauggg

SEQ ID NO: 510110 - RNA, 63 nt, Human
cugauuuucuugacuguagguuuaagacgcuaaacgacgaaaacuccagucaccuccucuacu

SEQ ID NO: 510111 - RNA, 64 nt, Human
uuuuugucacacaggauggcaugugauccucaagacgacgaacaaugaacuaaagccaaaugca

SEQ ID NO: 510112 - RNA, 64 nt, Human; identical to SEQ ID NO: 115711

SEQ ID NO: 510113 - RNA, 64 nt, Human; identical to SEQ ID NO: 115712

SEQ ID NO: 510114 - RNA, 64 nt, Human; identical to SEQ ID NO: 115713

SEQ ID NO: 510115 - RNA, 64 nt, Human; identical to SEQ ID NO: 115714

SEQ ID NO: 510116 - RNA, 64 nt, Human; identical to SEQ ID NO: 115715

SEQ ID NO: 510117 - RNA, 64 nt, Human; identical to SEQ ID NO: 115716

SEQ ID NO: 510118 - RNA, 60 nt, Human; identical to SEQ ID NO: 395752

SEQ ID NO: 510119 - RNA, 60 nt, Human; identical to SEQ ID NO: 395883

SEQ ID NO: 510120 - RNA, 60 nt, Human; identical to SEQ ID NO: 395884

SEQ ID NO: 510121 - RNA, 64 nt, Human; identical to SEQ ID NO: 59001

SEQ ID NO: 510122 - RNA, 64 nt, Human; identical to SEQ ID NO: 115717

SEQ ID NO: 510123 - RNA, 63 nt, Human; identical to SEQ ID NO: 115718

SEQ ID NO: 510124 - RNA, 64 nt, Human; identical to SEQ ID NO: 115719

SEQ ID NO: 510125 - RNA, 64 nt, Human; identical to SEQ ID NO: 115720

SEQ ID NO: 510126 - RNA, 64 nt, Human; identical to SEQ ID NO: 115721

SEQ ID NO: 510127 - RNA, 64 nt, Human; identical to SEQ ID NO: 115722

SEQ ID NO: 510128 - RNA, 64 nt, Human; identical to SEQ ID NO: 115723

SEQ ID NO: 510129 - RNA, 64 nt, Human; identical to SEQ ID NO: 115724

SEQ ID NO: 510130 - RNA, 64 nt, Human; identical to SEQ ID NO: 115725

SEQ ID NO: 510131 - RNA, 64 nt, Human; identical to SEQ ID NO: 115726

SEQ ID NO: 510132 - RNA, 64 nt, Human; identical to SEQ ID NO: 115727

SEQ ID NO: 510133 - RNA, 64 nt, Human; identical to SEQ ID NO: 115728

SEQ ID NO: 510134 - RNA, 64 nt, Human; identical to SEQ ID NO: 115729

SEQ ID NO: 510135 - RNA, 64 nt, Human; identical to SEQ ID NO: 115730

SEQ ID NO: 510136 - RNA, 64 nt, Human; identical to SEQ ID NO: 115731

SEQ ID NO: 510137 - RNA, 64 nt, Human; identical to SEQ ID NO: 115732

SEQ ID NO: 510138 - RNA, 64 nt, Human; identical to SEQ ID NO: 59002

SEQ ID NO: 510139 - RNA, 64 nt, Human; identical to SEQ ID NO: 59003

SEQ ID NO: 510140 - RNA, 64 nt, Human; identical to SEQ ID NO: 59004

SEQ ID NO: 510141 - RNA, 64 nt, Human; identical to SEQ ID NO: 115733

SEQ ID NO: 510142 - RNA, 64 nt, Human; identical to SEQ ID NO: 115734

SEQ ID NO: 510143 - RNA, 64 nt, Human; identical to SEQ ID NO: 115735

SEQ ID NO: 510144 - RNA, 64 nt, Human; identical to SEQ ID NO: 115736

SEQ ID NO: 510145 - RNA, 64 nt, Human; identical to SEQ ID NO: 115737

SEQ ID NO: 510146 - RNA, 64 nt, Human; identical to SEQ ID NO: 115738

SEQ ID NO: 510147 - RNA, 64 nt, Human; identical to SEQ ID NO: 115739

SEQ ID NO: 510148 - RNA, 64 nt, Human; identical to SEQ ID NO: 115740

SEQ ID NO: 510149 - RNA, 64 nt, Human; identical to SEQ ID NO: 115741

SEQ ID NO: 510150 - RNA, 64 nt, Human; identical to SEQ ID NO: 115742

SEQ ID NO: 510151 - RNA, 64 nt, Human; identical to SEQ ID NO: 115743

SEQ ID NO: 510152 - RNA, 64 nt, Human; identical to SEQ ID NO: 115744

SEQ ID NO: 510153 - RNA, 64 nt, Human; identical to SEQ ID NO: 115745

SEQ ID NO: 510154 - RNA, 64 nt, Human; identical to SEQ ID NO: 115746

SEQ ID NO: 510155 - RNA, 64 nt, Human; identical to SEQ ID NO: 115747

SEQ ID NO: 510156 - RNA, 64 nt, Human; identical to SEQ ID NO: 115748

SEQ ID NO: 510157 - RNA, 60 nt, Human; identical to SEQ ID NO: 395087

SEQ ID NO: 510158 - RNA, 60 nt, Human; identical to SEQ ID NO: 395088

SEQ ID NO: 510159 - RNA, 60 nt, Human; identical to SEQ ID NO: 395202

SEQ ID NO: 510160 - RNA, 60 nt, Human; identical to SEQ ID NO: 394378

SEQ ID NO: 510161 - RNA, 64 nt, Human; identical to SEQ ID NO: 115749

SEQ ID NO: 510162 - RNA, 64 nt, Human; identical to SEQ ID NO: 115750

SEQ ID NO: 510163 - RNA, 64 nt, Human; identical to SEQ ID NO: 115751

SEQ ID NO: 510164 - RNA, 64 nt, Human; identical to SEQ ID NO: 115752

SEQ ID NO: 510165 - RNA, 64 nt, Human; identical to SEQ ID NO: 115753

SEQ ID NO: 510166 - RNA, 64 nt, Human; identical to SEQ ID NO: 115754

SEQ ID NO: 510167 - RNA, 64 nt, Human; identical to SEQ ID NO: 115755

SEQ ID NO: 510168 - RNA, 64 nt, Human; identical to SEQ ID NO: 115756

SEQ ID NO: 510169 - RNA, 64 nt, Human; identical to SEQ ID NO: 115757

SEQ ID NO: 510170 - RNA, 64 nt, Human; identical to SEQ ID NO: 115758

SEQ ID NO: 510171 - RNA, 64 nt, Human; identical to SEQ ID NO: 115759

SEQ ID NO: 510172 - RNA, 64 nt, Human; identical to SEQ ID NO: 115760

SEQ ID NO: 510173 - RNA, 64 nt, Human; identical to SEQ ID NO: 115761

SEQ ID NO: 510174 - RNA, 64 nt, Human; identical to SEQ ID NO: 115762

SEQ ID NO: 510175 - RNA, 64 nt, Human; identical to SEQ ID NO: 115763

SEQ ID NO: 510176 - RNA, 64 nt, Human; identical to SEQ ID NO: 115764

SEQ ID NO: 510177 - RNA, 60 nt, Human; identical to SEQ ID NO: 394376

SEQ ID NO: 510178 - RNA, 60 nt, Human; identical to SEQ ID NO: 395069

SEQ ID NO: 510179 - RNA, 60 nt, Human; identical to SEQ ID NO: 394896

SEQ ID NO: 510180 - RNA, 60 nt, Human; identical to SEQ ID NO: 394377

SEQ ID NO: 510181 - RNA, 64 nt, Human; identical to SEQ ID NO: 115765

SEQ ID NO: 510182 - RNA, 64 nt, Human; identical to SEQ ID NO: 115766

SEQ ID NO: 510183 - RNA, 64 nt, Human; identical to SEQ ID NO: 115767

SEQ ID NO: 510184 - RNA, 64 nt, Human; identical to SEQ ID NO: 115768

SEQ ID NO: 510185 - RNA, 64 nt, Human; identical to SEQ ID NO: 115769

SEQ ID NO: 510186 - RNA, 64 nt, Human; identical to SEQ ID NO: 115770

SEQ ID NO: 510187 - RNA, 64 nt, Human; identical to SEQ ID NO: 115771

SEQ ID NO: 510188 - RNA, 64 nt, Human; identical to SEQ ID NO: 115772

SEQ ID NO: 510189 - RNA, 64 nt, Human; identical to SEQ ID NO: 115773

SEQ ID NO: 510190 - RNA, 64 nt, Human; identical to SEQ ID NO: 115774

SEQ ID NO: 510191 - RNA, 64 nt, Human; identical to SEQ ID NO: 115775

SEQ ID NO: 510192 - RNA, 64 nt, Human; identical to SEQ ID NO: 115776

SEQ ID NO: 510193 - RNA, 64 nt, Human; identical to SEQ ID NO: 115777

SEQ ID NO: 510194 - RNA, 64 nt, Human; identical to SEQ ID NO: 115778

SEQ ID NO: 510195 - RNA, 64 nt, Human; identical to SEQ ID NO: 115779

SEQ ID NO: 510196 - RNA, 64 nt, Human; identical to SEQ ID NO: 115780

SEQ ID NO: 510197 - RNA, 60 nt, Human; identical to SEQ ID NO: 395030

SEQ ID NO: 510198 - RNA, 60 nt, Human; identical to SEQ ID NO: 394375

SEQ ID NO: 510199 - RNA, 60 nt, Human; identical to SEQ ID NO: 395050

SEQ ID NO: 510200 - RNA, 60 nt, Human; identical to SEQ ID NO: 395086

SEQ ID NO: 510201 - RNA, 64 nt, Human; identical to SEQ ID NO: 115796

SEQ ID NO: 510202 - RNA, 64 nt, Human; identical to SEQ ID NO: 314438

SEQ ID NO: 510203 - RNA, 64 nt, Human; identical to SEQ ID NO: 314439

SEQ ID NO: 510204 - RNA, 64 nt, Human; identical to SEQ ID NO: 314440

SEQ ID NO: 510205 - RNA, 64 nt, Human; identical to SEQ ID NO: 314441

SEQ ID NO: 510206 - RNA, 64 nt, Human; identical to SEQ ID NO: 314442

SEQ ID NO: 510207 - RNA, 64 nt, Human; identical to SEQ ID NO: 314443

SEQ ID NO: 510208 - RNA, 64 nt, Human; identical to SEQ ID NO: 314444

SEQ ID NO: 510209 - RNA, 64 nt, Human; identical to SEQ ID NO: 314445

SEQ ID NO: 510210 - RNA, 64 nt, Human; identical to SEQ ID NO: 314446

SEQ ID NO: 510211 - RNA, 64 nt, Human; identical to SEQ ID NO: 314447

SEQ ID NO: 510212 - RNA, 64 nt, Human; identical to SEQ ID NO: 314448

SEQ ID NO: 510213 - RNA, 64 nt, Human; identical to SEQ ID NO: 314449

SEQ ID NO: 510214 - RNA, 64 nt, Human; identical to SEQ ID NO: 314450

SEQ ID NO: 510215 - RNA, 64 nt, Human; identical to SEQ ID NO: 314451

SEQ ID NO: 510216 - RNA, 64 nt, Human; identical to SEQ ID NO: 314452

SEQ ID NO: 510217 - RNA, 64 nt, Human; identical to SEQ ID NO: 58993

SEQ ID NO: 510218 - RNA, 64 nt, Human; identical to SEQ ID NO: 58994

SEQ ID NO: 510219 - RNA, 64 nt, Human; identical to SEQ ID NO: 58995

SEQ ID NO: 510220 - RNA, 64 nt, Human; identical to SEQ ID NO: 58996

SEQ ID NO: 510221 - RNA, 64 nt, Human; identical to SEQ ID NO: 115797

SEQ ID NO: 510222 - RNA, 64 nt, Human; identical to SEQ ID NO: 115798

SEQ ID NO: 510223 - RNA, 64 nt, Human; identical to SEQ ID NO: 115799

SEQ ID NO: 510224 - RNA, 64 nt, Human; identical to SEQ ID NO: 115800

SEQ ID NO: 510225 - RNA, 64 nt, Human; identical to SEQ ID NO: 115801

SEQ ID NO: 510226 - RNA, 64 nt, Human; identical to SEQ ID NO: 115802

SEQ ID NO: 510227 - RNA, 64 nt, Human; identical to SEQ ID NO: 115803

SEQ ID NO: 510228 - RNA, 64 nt, Human; identical to SEQ ID NO: 115804

SEQ ID NO: 510229 - RNA, 64 nt, Human; identical to SEQ ID NO: 115805

SEQ ID NO: 510230 - RNA, 64 nt, Human; identical to SEQ ID NO: 115806

SEQ ID NO: 510231 - RNA, 64 nt, Human; identical to SEQ ID NO: 115807

SEQ ID NO: 510232 - RNA, 64 nt, Human; identical to SEQ ID NO: 115808

SEQ ID NO: 510233 - RNA, 64 nt, Human; identical to SEQ ID NO: 115809

SEQ ID NO: 510234 - RNA, 64 nt, Human; identical to SEQ ID NO: 115810

SEQ ID NO: 510235 - RNA, 64 nt, Human; identical to SEQ ID NO: 115811

SEQ ID NO: 510236 - RNA, 64 nt, Human; identical to SEQ ID NO: 115812

SEQ ID NO: 510237 - RNA, 60 nt, Human; identical to SEQ ID NO: 394992

SEQ ID NO: 510238 - RNA, 60 nt, Human; identical to SEQ ID NO: 394339

SEQ ID NO: 510239 - RNA, 60 nt, Human; identical to SEQ ID NO: 395750

SEQ ID NO: 510240 - RNA, 60 nt, Human; identical to SEQ ID NO: 395751

SEQ ID NO: 510241 - RNA, 64 nt, Human; identical to SEQ ID NO: 115813

SEQ ID NO: 510242 - RNA, 64 nt, Human; identical to SEQ ID NO: 115814

SEQ ID NO: 510243 - RNA, 64 nt, Human; identical to SEQ ID NO: 115815

SEQ ID NO: 510244 - RNA, 64 nt, Human; identical to SEQ ID NO: 115816

SEQ ID NO: 510245 - RNA, 64 nt, Human; identical to SEQ ID NO: 115817

SEQ ID NO: 510246 - RNA, 50 nt, Human; identical to SEQ ID NO: 115818

SEQ ID NO: 510247 - RNA, 64 nt, Human; identical to SEQ ID NO: 115819

SEQ ID NO: 510248 - RNA, 64 nt, Human; identical to SEQ ID NO: 115820

SEQ ID NO: 510249 - RNA, 64 nt, Human; identical to SEQ ID NO: 115821

SEQ ID NO: 510250 - RNA, 64 nt, Human; identical to SEQ ID NO: 115822

SEQ ID NO: 510251 - RNA, 64 nt, Human; identical to SEQ ID NO: 115823

SEQ ID NO: 510252 - RNA, 64 nt, Human; identical to SEQ ID NO: 115824

SEQ ID NO: 510253 - RNA, 64 nt, Human; identical to SEQ ID NO: 115825

SEQ ID NO: 510254 - RNA, 64 nt, Human; identical to SEQ ID NO: 115826

SEQ ID NO: 510255 - RNA, 64 nt, Human; identical to SEQ ID NO: 115827

SEQ ID NO: 510256 - RNA, 64 nt, Human; identical to SEQ ID NO: 115828

SEQ ID NO: 510257 - RNA, 60 nt, Human; identical to SEQ ID NO: 395503

SEQ ID NO: 510258 - RNA, 60 nt, Human; identical to SEQ ID NO: 395504

SEQ ID NO: 510259 - RNA, 60 nt, Human; identical to SEQ ID NO: 395505

SEQ ID NO: 510260 - RNA, 60 nt, Human; identical to SEQ ID NO: 394953

SEQ ID NO: 510261 - RNA, 64 nt, Human; identical to SEQ ID NO: 115829

SEQ ID NO: 510262 - RNA, 64 nt, Human; identical to SEQ ID NO: 115830

SEQ ID NO: 510263 - RNA, 64 nt, Human; identical to SEQ ID NO: 115831

SEQ ID NO: 510264 - RNA, 64 nt, Human; identical to SEQ ID NO: 115832

SEQ ID NO: 510265 - RNA, 64 nt, Human; identical to SEQ ID NO: 115833

SEQ ID NO: 510266 - RNA, 64 nt, Human; identical to SEQ ID NO: 115834

SEQ ID NO: 510267 - RNA, 64 nt, Human; identical to SEQ ID NO: 115835

SEQ ID NO: 510268 - RNA, 64 nt, Human; identical to SEQ ID NO: 115836

SEQ ID NO: 510269 - RNA, 64 nt, Human; identical to SEQ ID NO: 115837

SEQ ID NO: 510270 - RNA, 64 nt, Human; identical to SEQ ID NO: 115838

SEQ ID NO: 510271 - RNA, 64 nt, Human; identical to SEQ ID NO: 115839

SEQ ID NO: 510272 - RNA, 64 nt, Human; identical to SEQ ID NO: 115840

SEQ ID NO: 510273 - RNA, 64 nt, Human; identical to SEQ ID NO: 115841

SEQ ID NO: 510274 - RNA, 64 nt, Human; identical to SEQ ID NO: 115842

SEQ ID NO: 510275 - RNA, 64 nt, Human; identical to SEQ ID NO: 115843

SEQ ID NO: 510276 - RNA, 64 nt, Human; identical to SEQ ID NO: 115844

SEQ ID NO: 510277 - RNA, 60 nt, Human; identical to SEQ ID NO: 395467

SEQ ID NO: 510278 - RNA, 60 nt, Human; identical to SEQ ID NO: 395048

SEQ ID NO: 510279 - RNA, 60 nt, Human; identical to SEQ ID NO: 395049

SEQ ID NO: 510280 - RNA, 60 nt, Human; identical to SEQ ID NO: 394338

SEQ ID NO: 510281 - RNA, 64 nt, Human; identical to SEQ ID NO: 115845

SEQ ID NO: 510282 - RNA, 64 nt, Human; identical to SEQ ID NO: 115846

SEQ ID NO: 510283 - RNA, 64 nt, Human; identical to SEQ ID NO: 115847

SEQ ID NO: 510284 - RNA, 64 nt, Human; identical to SEQ ID NO: 115848

SEQ ID NO: 510285 - RNA, 64 nt, Human; identical to SEQ ID NO: 115849

SEQ ID NO: 510286 - RNA, 64 nt, Human; identical to SEQ ID NO: 115850

SEQ ID NO: 510287 - RNA, 64 nt, Human; identical to SEQ ID NO: 115851

SEQ ID NO: 510288 - RNA, 64 nt, Human; identical to SEQ ID NO: 115852

SEQ ID NO: 510289 - RNA, 64 nt, Human; identical to SEQ ID NO: 115853

SEQ ID NO: 510290 - RNA, 64 nt, Human; identical to SEQ ID NO: 115854

SEQ ID NO: 510291 - RNA, 64 nt, Human; identical to SEQ ID NO: 115855

SEQ ID NO: 510292 - RNA, 64 nt, Human; identical to SEQ ID NO: 115856

SEQ ID NO: 510293 - RNA, 64 nt, Human; identical to SEQ ID NO: 115857

SEQ ID NO: 510294 - RNA, 64 nt, Human; identical to SEQ ID NO: 115858

SEQ ID NO: 510295 - RNA, 64 nt, Human; identical to SEQ ID NO: 115859

SEQ ID NO: 510296 - RNA, 64 nt, Human; identical to SEQ ID NO: 115860

SEQ ID NO: 510297 - RNA, 60 nt, Human; identical to SEQ ID NO: 395105

SEQ ID NO: 510298 - RNA, 60 nt, Human; identical to SEQ ID NO: 395106

SEQ ID NO: 510299 - RNA, 60 nt, Human; identical to SEQ ID NO: 395107

SEQ ID NO: 510300 - RNA, 60 nt, Human; identical to SEQ ID NO: 395126

SEQ ID NO: 510301 - RNA, 64 nt, Human; identical to SEQ ID NO: 115861

SEQ ID NO: 510302 - RNA, 64 nt, Human; identical to SEQ ID NO: 115862

SEQ ID NO: 510303 - RNA, 64 nt, Human; identical to SEQ ID NO: 115863

SEQ ID NO: 510304 - RNA, 64 nt, Human; identical to SEQ ID NO: 115864

SEQ ID NO: 510305 - RNA, 64 nt, Human; identical to SEQ ID NO: 115865

SEQ ID NO: 510306 - RNA, 64 nt, Human; identical to SEQ ID NO: 115866

SEQ ID NO: 510307 - RNA, 64 nt, Human; identical to SEQ ID NO: 115867

SEQ ID NO: 510308 - RNA, 64 nt, Human; identical to SEQ ID NO: 115868

SEQ ID NO: 510309 - RNA, 64 nt, Human; identical to SEQ ID NO: 115869

SEQ ID NO: 510310 - RNA, 64 nt, Human; identical to SEQ ID NO: 115870

SEQ ID NO: 510311 - RNA, 64 nt, Human; identical to SEQ ID NO: 115871

SEQ ID NO: 510312 - RNA, 64 nt, Human; identical to SEQ ID NO: 115872

SEQ ID NO: 510313 - RNA, 64 nt, Human; identical to SEQ ID NO: 115873

SEQ ID NO: 510314 - RNA, 64 nt, Human; identical to SEQ ID NO: 115874

SEQ ID NO: 510315 - RNA, 64 nt, Human; identical to SEQ ID NO: 115875

SEQ ID NO: 510316 - RNA, 64 nt, Human; identical to SEQ ID NO: 115876

SEQ ID NO: 510317 - RNA, 60 nt, Human; identical to SEQ ID NO: 394972

SEQ ID NO: 510318 - RNA, 60 nt, Human; identical to SEQ ID NO: 394973

SEQ ID NO: 510319 - RNA, 60 nt, Human; identical to SEQ ID NO: 394974

SEQ ID NO: 510320 - RNA, 60 nt, Human; identical to SEQ ID NO: 394993

SEQ ID NO: 510321 - RNA, 64 nt, Human; identical to SEQ ID NO: 115877

SEQ ID NO: 510322 - RNA, 64 nt, Human; identical to SEQ ID NO: 115878

SEQ ID NO: 510323 - RNA, 64 nt, Human; identical to SEQ ID NO: 115879

SEQ ID NO: 510324 - RNA, 64 nt, Human; identical to SEQ ID NO: 115880

SEQ ID NO: 510325 - RNA, 64 nt, Human; identical to SEQ ID NO: 115881

SEQ ID NO: 510326 - RNA, 64 nt, Human; identical to SEQ ID NO: 115882

SEQ ID NO: 510327 - RNA, 64 nt, Human; identical to SEQ ID NO: 115883

SEQ ID NO: 510328 - RNA, 64 nt, Human; identical to SEQ ID NO: 115884

SEQ ID NO: 510329 - RNA, 64 nt, Human; identical to SEQ ID NO: 115885

SEQ ID NO: 510330 - RNA, 64 nt, Human; identical to SEQ ID NO: 115886

SEQ ID NO: 510331 - RNA, 64 nt, Human; identical to SEQ ID NO: 115887

SEQ ID NO: 510332 - RNA, 64 nt, Human; identical to SEQ ID NO: 115888

SEQ ID NO: 510333 - RNA, 64 nt, Human; identical to SEQ ID NO: 115889

SEQ ID NO: 510334 - RNA, 64 nt, Human; identical to SEQ ID NO: 115890

SEQ ID NO: 510335 - RNA, 64 nt, Human; identical to SEQ ID NO: 115891

SEQ ID NO: 510336 - RNA, 64 nt, Human; identical to SEQ ID NO: 115892

SEQ ID NO: 510337 - RNA, 60 nt, Human; identical to SEQ ID NO: 394358

SEQ ID NO: 510338 - RNA, 59 nt, Human; identical to SEQ ID NO: 395010

SEQ ID NO: 510339 - RNA, 60 nt, Human; identical to SEQ ID NO: 395011

SEQ ID NO: 510340 - RNA, 60 nt, Human; identical to SEQ ID NO: 395029

SEQ ID NO: 510341 - RNA, 64 nt, Human; identical to SEQ ID NO: 115893

SEQ ID NO: 510342 - RNA, 64 nt, Human; identical to SEQ ID NO: 115894

SEQ ID NO: 510343 - RNA, 64 nt, Human; identical to SEQ ID NO: 115895

SEQ ID NO: 510344 - RNA, 64 nt, Human; identical to SEQ ID NO: 115896

SEQ ID NO: 510345 - RNA, 64 nt, Human; identical to SEQ ID NO: 115897

SEQ ID NO: 510346 - RNA, 64 nt, Human; identical to SEQ ID NO: 115898

SEQ ID NO: 510347 - RNA, 64 nt, Human; identical to SEQ ID NO: 115899

SEQ ID NO: 510348 - RNA, 64 nt, Human; identical to SEQ ID NO: 115900

SEQ ID NO: 510349 - RNA, 64 nt, Human; identical to SEQ ID NO: 115901

SEQ ID NO: 510350 - RNA, 64 nt, Human; identical to SEQ ID NO: 115902

SEQ ID NO: 510351 - RNA, 64 nt, Human; identical to SEQ ID NO: 115903

SEQ ID NO: 510352 - RNA, 64 nt, Human; identical to SEQ ID NO: 115904

SEQ ID NO: 510353 - RNA, 64 nt, Human; identical to SEQ ID NO: 115905

SEQ ID NO: 510354 - RNA, 64 nt, Human; identical to SEQ ID NO: 115906

SEQ ID NO: 510355 - RNA, 64 nt, Human; identical to SEQ ID NO: 115907

SEQ ID NO: 510356 - RNA, 64 nt, Human; identical to SEQ ID NO: 115908

SEQ ID NO: 510357 - RNA, 60 nt, Human; identical to SEQ ID NO: 395334

SEQ ID NO: 510358 - RNA, 60 nt, Human; identical to SEQ ID NO: 395124

SEQ ID NO: 510359 - RNA, 60 nt, Human; identical to SEQ ID NO: 395125

SEQ ID NO: 510360 - RNA, 60 nt, Human; identical to SEQ ID NO: 395144

SEQ ID NO: 510361 - RNA, 64 nt, Human; identical to SEQ ID NO: 115909

SEQ ID NO: 510362 - RNA, 64 nt, Human; identical to SEQ ID NO: 115910

SEQ ID NO: 510363 - RNA, 64 nt, Human; identical to SEQ ID NO: 115911

SEQ ID NO: 510364 - RNA, 64 nt, Human; identical to SEQ ID NO: 115912

SEQ ID NO: 510365 - RNA, 64 nt, Human; identical to SEQ ID NO: 115913

SEQ ID NO: 510366 - RNA, 64 nt, Human; identical to SEQ ID NO: 115914

SEQ ID NO: 510367 - RNA, 64 nt, Human; identical to SEQ ID NO: 115915

SEQ ID NO: 510368 - RNA, 60 nt, Human; identical to SEQ ID NO: 395909

SEQ ID NO: 510369 - RNA, 60 nt, Human; identical to SEQ ID NO: 395910

SEQ ID NO: 510370 - RNA, 60 nt, Human; identical to SEQ ID NO: 395911

SEQ ID NO: 510371 - RNA, 60 nt, Human; identical to SEQ ID NO: 395912

SEQ ID NO: 510372 - RNA, 60 nt, Human; identical to SEQ ID NO: 395913

SEQ ID NO: 510373 - RNA, 60 nt, Human; identical to SEQ ID NO: 395914

SEQ ID NO: 510374 - RNA, 60 nt, Human; identical to SEQ ID NO: 395915

SEQ ID NO: 510375 - RNA, 60 nt, Human; identical to SEQ ID NO: 395916

SEQ ID NO: 510376 - RNA, 60 nt, Human; identical to SEQ ID NO: 394726

SEQ ID NO: 510377 - RNA, 60 nt, Human; identical to SEQ ID NO: 394397

SEQ ID NO: 510378 - RNA, 60 nt, Human; identical to SEQ ID NO: 394727

SEQ ID NO: 510379 - RNA, 60 nt, Human; identical to SEQ ID NO: 394744

SEQ ID NO: 510380 - RNA, 60 nt, Human; identical to SEQ ID NO: 394745

SEQ ID NO: 510381 - RNA, 60 nt, Human; identical to SEQ ID NO: 394414

SEQ ID NO: 510382 - RNA, 60 nt, Human; identical to SEQ ID NO: 394763

SEQ ID NO: 510383 - RNA, 60 nt, Human; identical to SEQ ID NO: 394764

SEQ ID NO: 510384 - RNA, 60 nt, Human; identical to SEQ ID NO: 394765

SEQ ID NO: 510385 - RNA, 60 nt, Human; identical to SEQ ID NO: 394801

SEQ ID NO: 510386 - RNA, 60 nt, Human; identical to SEQ ID NO: 394802

SEQ ID NO: 510387 - RNA, 60 nt, Human; identical to SEQ ID NO: 394415

SEQ ID NO: 510388 - RNA, 60 nt, Human; identical to SEQ ID NO: 394782

SEQ ID NO: 510389 - RNA, 60 nt, Human; identical to SEQ ID NO: 394783

SEQ ID NO: 510390 - RNA, 60 nt, Human; identical to SEQ ID NO: 394784

SEQ ID NO: 510391 - RNA, 60 nt, Human; identical to SEQ ID NO: 394877

SEQ ID NO: 510392 - RNA, 60 nt, Human; identical to SEQ ID NO: 394878

SEQ ID NO: 510393 - RNA, 60 nt, Human; identical to SEQ ID NO: 394416

SEQ ID NO: 510394 - RNA, 60 nt, Human; identical to SEQ ID NO: 394803

SEQ ID NO: 510395 - RNA, 58 nt, Human; identical to SEQ ID NO: 395145

SEQ ID NO: 510396 - RNA, 60 nt, Human; identical to SEQ ID NO: 394418

SEQ ID NO: 510397 - RNA, 60 nt, Human; identical to SEQ ID NO: 394839

SEQ ID NO: 510398 - RNA, 60 nt, Human; identical to SEQ ID NO: 394840

SEQ ID NO: 510399 - RNA, 60 nt, Human; identical to SEQ ID NO: 394841

SEQ ID NO: 510400 - RNA, 60 nt, Human; identical to SEQ ID NO: 394858

SEQ ID NO: 510401 - RNA, 60 nt, Human; identical to SEQ ID NO: 394859

SEQ ID NO: 510402 - RNA, 60 nt, Human; identical to SEQ ID NO: 394419

SEQ ID NO: 510403 - RNA, 60 nt, Human; identical to SEQ ID NO: 394860

SEQ ID NO: 510404 - RNA, 60 nt, Human; identical to SEQ ID NO: 394625

SEQ ID NO: 510405 - RNA, 60 nt, Human; identical to SEQ ID NO: 394626

SEQ ID NO: 510406 - RNA, 60 nt, Human; identical to SEQ ID NO: 394420

SEQ ID NO: 510407 - RNA, 60 nt, Human; identical to SEQ ID NO: 394879

SEQ ID NO: 510408 - RNA, 60 nt, Human; identical to SEQ ID NO: 395031

SEQ ID NO: 510409 - RNA, 60 nt, Human; identical to SEQ ID NO: 394421

SEQ ID NO: 510410 - RNA, 60 nt, Human; identical to SEQ ID NO: 394898

SEQ ID NO: 510411 - RNA, 60 nt, Human; identical to SEQ ID NO: 394915

SEQ ID NO: 510412 - RNA, 60 nt, Human; identical to SEQ ID NO: 394916

SEQ ID NO: 510413 - RNA, 60 nt, Human; identical to SEQ ID NO: 394422

SEQ ID NO: 510414 - RNA, 60 nt, Human; identical to SEQ ID NO: 394917

SEQ ID NO: 510415 - RNA, 60 nt, Human; identical to SEQ ID NO: 394746

SEQ ID NO: 510416 - RNA, 60 nt, Human; identical to SEQ ID NO: 394423

SEQ ID NO: 510417 - RNA, 60 nt, Human; identical to SEQ ID NO: 394450

SEQ ID NO: 510418 - RNA, 60 nt, Human; identical to SEQ ID NO: 394451

SEQ ID NO: 510419 - RNA, 60 nt, Human; identical to SEQ ID NO: 394452

SEQ ID NO: 510420 - RNA, 60 nt, Human; identical to SEQ ID NO: 394469

SEQ ID NO: 510421 - RNA, 60 nt, Human; identical to SEQ ID NO: 394470

SEQ ID NO: 510422 - RNA, 60 nt, Human; identical to SEQ ID NO: 394471

SEQ ID NO: 510423 - RNA, 60 nt, Human; identical to SEQ ID NO: 394934

SEQ ID NO: 510424 - RNA, 60 nt, Human; identical to SEQ ID NO: 394935

SEQ ID NO: 510425 - RNA, 60 nt, Human; identical to SEQ ID NO: 394936

SEQ ID NO: 510426 - RNA, 60 nt, Human; identical to SEQ ID NO: 394488

SEQ ID NO: 510427 - RNA, 60 nt, Human; identical to SEQ ID NO: 394489

SEQ ID NO: 510428 - RNA, 60 nt, Human; identical to SEQ ID NO: 394490

SEQ ID NO: 510429 - RNA, 60 nt, Human; identical to SEQ ID NO: 394491

SEQ ID NO: 510430 - RNA, 60 nt, Human; identical to SEQ ID NO: 394508

SEQ ID NO: 510431 - RNA, 60 nt, Human; identical to SEQ ID NO: 394509

SEQ ID NO: 510432 - RNA, 60 nt, Human; identical to SEQ ID NO: 394510

SEQ ID NO: 510433 - RNA, 60 nt, Human; identical to SEQ ID NO: 394527

SEQ ID NO: 510434 - RNA, 60 nt, Human; identical to SEQ ID NO: 394528

SEQ ID NO: 510435 - RNA, 60 nt, Human; identical to SEQ ID NO: 394529

SEQ ID NO: 510436 - RNA, 60 nt, Human; identical to SEQ ID NO: 394546

SEQ ID NO: 510437 - RNA, 60 nt, Human; identical to SEQ ID NO: 394547

SEQ ID NO: 510438 - RNA, 60 nt, Human; identical to SEQ ID NO: 394548

SEQ ID NO: 510439 - RNA, 55 nt, Human; identical to SEQ ID NO: 394549

SEQ ID NO: 510440 - RNA, 60 nt, Human; identical to SEQ ID NO: 394566

SEQ ID NO: 510441 - RNA, 60 nt, Human; identical to SEQ ID NO: 394567

SEQ ID NO: 510442 - RNA, 60 nt, Human; identical to SEQ ID NO: 394568

SEQ ID NO: 510443 - RNA, 57 nt, Human; identical to SEQ ID NO: 395920

SEQ ID NO: 510444 - RNA, 60 nt, Human; identical to SEQ ID NO: 395921

SEQ ID NO: 510445 - RNA, 60 nt, Human; identical to SEQ ID NO: 395922

SEQ ID NO: 510446 - RNA, 60 nt, Human; identical to SEQ ID NO: 395923

SEQ ID NO: 510447 - RNA, 60 nt, Human; identical to SEQ ID NO: 395924

SEQ ID NO: 510448 - RNA, 60 nt, Human; identical to SEQ ID NO: 395925

SEQ ID NO: 510449 - RNA, 60 nt, Human; identical to SEQ ID NO: 395926

SEQ ID NO: 510450 - RNA, 60 nt, Human; identical to SEQ ID NO: 395927

SEQ ID NO: 510451 - RNA, 60 nt, Human; identical to SEQ ID NO: 395928

SEQ ID NO: 510452 - RNA, 60 nt, Human; identical to SEQ ID NO: 395929

SEQ ID NO: 510453 - RNA, 60 nt, Human; identical to SEQ ID NO: 395930

SEQ ID NO: 510454 - RNA, 60 nt, Human; identical to SEQ ID NO: 395931

SEQ ID NO: 510455 - RNA, 60 nt, Human; identical to SEQ ID NO: 395932

SEQ ID NO: 510456 - RNA, 60 nt, Human; identical to SEQ ID NO: 395933

SEQ ID NO: 510457 - RNA, 60 nt, Human; identical to SEQ ID NO: 395934

SEQ ID NO: 510458 - RNA, 60 nt, Human; identical to SEQ ID NO: 395935

SEQ ID NO: 510459 - RNA, 60 nt, Human; identical to SEQ ID NO: 395936

SEQ ID NO: 510460 - RNA, 60 nt, Human; identical to SEQ ID NO: 395937

SEQ ID NO: 510461 - RNA, 60 nt, Human; identical to SEQ ID NO: 395938

SEQ ID NO: 510462 - RNA, 60 nt, Human; identical to SEQ ID NO: 395939

SEQ ID NO: 510463 - RNA, 60 nt, Human; identical to SEQ ID NO: 395940

SEQ ID NO: 510464 - RNA, 60 nt, Human; identical to SEQ ID NO: 395941

SEQ ID NO: 510465 - RNA, 60 nt, Human; identical to SEQ ID NO: 395942

SEQ ID NO: 510466 - RNA, 60 nt, Human; identical to SEQ ID NO: 395943

SEQ ID NO: 510467 - RNA, 60 nt, Human; identical to SEQ ID NO: 395944

SEQ ID NO: 510468 - RNA, 60 nt, Human; identical to SEQ ID NO: 395945

SEQ ID NO: 510469 - RNA, 60 nt, Human; identical to SEQ ID NO: 395946

SEQ ID NO: 510470 - RNA, 60 nt, Human; identical to SEQ ID NO: 395947

SEQ ID NO: 510471 - RNA, 60 nt, Human; identical to SEQ ID NO: 395948

SEQ ID NO: 510472 - RNA, 60 nt, Human; identical to SEQ ID NO: 395949

SEQ ID NO: 510473 - RNA, 60 nt, Human; identical to SEQ ID NO: 395950

SEQ ID NO: 510474 - RNA, 60 nt, Human; identical to SEQ ID NO: 395951

SEQ ID NO: 510475 - RNA, 60 nt, Human; identical to SEQ ID NO: 395952

SEQ ID NO: 510476 - RNA, 60 nt, Human; identical to SEQ ID NO: 395953

SEQ ID NO: 510477 - RNA, 60 nt, Human; identical to SEQ ID NO: 395954

SEQ ID NO: 510478 - RNA, 60 nt, Human; identical to SEQ ID NO: 395955

SEQ ID NO: 510479 - RNA, 60 nt, Human; identical to SEQ ID NO: 395956

SEQ ID NO: 510480 - RNA, 60 nt, Human; identical to SEQ ID NO: 395957

SEQ ID NO: 510481 - RNA, 60 nt, Human; identical to SEQ ID NO: 395958

SEQ ID NO: 510482 - RNA, 60 nt, Human; identical to SEQ ID NO: 395959

SEQ ID NO: 510483 - RNA, 60 nt, Human; identical to SEQ ID NO: 395960

SEQ ID NO: 510484 - RNA, 60 nt, Human; identical to SEQ ID NO: 395961

SEQ ID NO: 510485 - RNA, 60 nt, Human; identical to SEQ ID NO: 395962

SEQ ID NO: 510486 - RNA, 60 nt, Human; identical to SEQ ID NO: 395963

SEQ ID NO: 510487 - RNA, 60 nt, Human; identical to SEQ ID NO: 395964

SEQ ID NO: 510488 - RNA, 60 nt, Human; identical to SEQ ID NO: 395965

SEQ ID NO: 510489 - RNA, 60 nt, Human; identical to SEQ ID NO: 395966

SEQ ID NO: 510490 - RNA, 60 nt, Human; identical to SEQ ID NO: 395967

SEQ ID NO: 510491 - RNA, 60 nt, Human; identical to SEQ ID NO: 395968

SEQ ID NO: 510492 - RNA, 60 nt, Human; identical to SEQ ID NO: 395969

SEQ ID NO: 510493 - RNA, 60 nt, Human; identical to SEQ ID NO: 395970

SEQ ID NO: 510494 - RNA, 60 nt, Human; identical to SEQ ID NO: 395971

SEQ ID NO: 510495 - RNA, 60 nt, Human; identical to SEQ ID NO: 395972

SEQ ID NO: 510496 - RNA, 60 nt, Human; identical to SEQ ID NO: 395973

SEQ ID NO: 510497 - RNA, 60 nt, Human; identical to SEQ ID NO: 395974

SEQ ID NO: 510498 - RNA, 60 nt, Human; identical to SEQ ID NO: 395975

SEQ ID NO: 510499 - RNA, 60 nt, Human; identical to SEQ ID NO: 395976

SEQ ID NO: 510500 - RNA, 60 nt, Human; identical to SEQ ID NO: 395977

SEQ ID NO: 510501 - RNA, 60 nt, Human; identical to SEQ ID NO: 395978

SEQ ID NO: 510502 - RNA, 60 nt, Human; identical to SEQ ID NO: 395979

SEQ ID NO: 510503 - RNA, 60 nt, Human; identical to SEQ ID NO: 395980

SEQ ID NO: 510504 - RNA, 60 nt, Human; identical to SEQ ID NO: 395981

SEQ ID NO: 510505 - RNA, 60 nt, Human; identical to SEQ ID NO: 395982

SEQ ID NO: 510506 - RNA, 60 nt, Human; identical to SEQ ID NO: 395983

SEQ ID NO: 510507 - RNA, 60 nt, Human; identical to SEQ ID NO: 395984

SEQ ID NO: 510508 - RNA, 60 nt, Human; identical to SEQ ID NO: 395985

SEQ ID NO: 510509 - RNA, 60 nt, Human; identical to SEQ ID NO: 395986

SEQ ID NO: 510510 - RNA, 60 nt, Human; identical to SEQ ID NO: 395987

SEQ ID NO: 510511 - RNA, 60 nt, Human; identical to SEQ ID NO: 395988

SEQ ID NO: 510512 - RNA, 60 nt, Human; identical to SEQ ID NO: 395989

SEQ ID NO: 510513 - RNA, 60 nt, Human; identical to SEQ ID NO: 395990

SEQ ID NO: 510514 - RNA, 60 nt, Human; identical to SEQ ID NO: 395991

SEQ ID NO: 510515 - RNA, 60 nt, Human; identical to SEQ ID NO: 395992

SEQ ID NO: 510516 - RNA, 60 nt, Human; identical to SEQ ID NO: 395993

SEQ ID NO: 510517 - RNA, 60 nt, Human; identical to SEQ ID NO: 395994

SEQ ID NO: 510518 - RNA, 60 nt, Human; identical to SEQ ID NO: 395995

SEQ ID NO: 510519 - RNA, 60 nt, Human; identical to SEQ ID NO: 395996

SEQ ID NO: 510520 - RNA, 60 nt, Human; identical to SEQ ID NO: 395997

SEQ ID NO: 510521 - RNA, 60 nt, Human; identical to SEQ ID NO: 395998

SEQ ID NO: 510522 - RNA, 60 nt, Human; identical to SEQ ID NO: 395999

SEQ ID NO: 510523 - RNA, 60 nt, Human; identical to SEQ ID NO: 396000

SEQ ID NO: 510524 - RNA, 60 nt, Human; identical to SEQ ID NO: 396001

SEQ ID NO: 510525 - RNA, 60 nt, Human; identical to SEQ ID NO: 396002

SEQ ID NO: 510526 - RNA, 60 nt, Human; identical to SEQ ID NO: 396003

SEQ ID NO: 510527 - RNA, 60 nt, Human; identical to SEQ ID NO: 396004

SEQ ID NO: 510528 - RNA, 60 nt, Human; identical to SEQ ID NO: 396005

SEQ ID NO: 510529 - RNA, 60 nt, Human; identical to SEQ ID NO: 396006

SEQ ID NO: 510530 - RNA, 60 nt, Human; identical to SEQ ID NO: 396007

SEQ ID NO: 510531 - RNA, 60 nt, Human; identical to SEQ ID NO: 396008

SEQ ID NO: 510532 - RNA, 60 nt, Human; identical to SEQ ID NO: 396009

SEQ ID NO: 510533 - RNA, 60 nt, Human; identical to SEQ ID NO: 396010

SEQ ID NO: 510534 - RNA, 60 nt, Human; identical to SEQ ID NO: 396011

SEQ ID NO: 510535 - RNA, 60 nt, Human; identical to SEQ ID NO: 396012

SEQ ID NO: 510536 - RNA, 60 nt, Human; identical to SEQ ID NO: 396013

SEQ ID NO: 510537 - RNA, 60 nt, Human; identical to SEQ ID NO: 396014

SEQ ID NO: 510538 - RNA, 60 nt, Human; identical to SEQ ID NO: 396015

SEQ ID NO: 510539 - RNA, 60 nt, Human; identical to SEQ ID NO: 396016

SEQ ID NO: 510540 - RNA, 60 nt, Human; identical to SEQ ID NO: 396017

SEQ ID NO: 510541 - RNA, 60 nt, Human; identical to SEQ ID NO: 396018

SEQ ID NO: 510542 - RNA, 60 nt, Human; identical to SEQ ID NO: 396019

SEQ ID NO: 510543 - RNA, 60 nt, Human; identical to SEQ ID NO: 396020

SEQ ID NO: 510544 - RNA, 60 nt, Human; identical to SEQ ID NO: 396021

SEQ ID NO: 510545 - RNA, 60 nt, Human; identical to SEQ ID NO: 396022

SEQ ID NO: 510546 - RNA, 60 nt, Human; identical to SEQ ID NO: 396023

SEQ ID NO: 510547 - RNA, 60 nt, Human; identical to SEQ ID NO: 396024

SEQ ID NO: 510548 - RNA, 60 nt, Human; identical to SEQ ID NO: 396025

SEQ ID NO: 510549 - RNA, 60 nt, Human; identical to SEQ ID NO: 396026

SEQ ID NO: 510550 - RNA, 60 nt, Human; identical to SEQ ID NO: 396027

SEQ ID NO: 510551 - RNA, 60 nt, Human; identical to SEQ ID NO: 396028

SEQ ID NO: 510552 - RNA, 60 nt, Human; identical to SEQ ID NO: 396029

SEQ ID NO: 510553 - RNA, 60 nt, Human; identical to SEQ ID NO: 396030

SEQ ID NO: 510554 - RNA, 60 nt, Human; identical to SEQ ID NO: 396031

SEQ ID NO: 510555 - RNA, 60 nt, Human; identical to SEQ ID NO: 396032

SEQ ID NO: 510556 - RNA, 60 nt, Human; identical to SEQ ID NO: 396033

SEQ ID NO: 510557 - RNA, 60 nt, Human; identical to SEQ ID NO: 396034

SEQ ID NO: 510558 - RNA, 60 nt, Human; identical to SEQ ID NO: 396035

SEQ ID NO: 510559 - RNA, 60 nt, Human; identical to SEQ ID NO: 396036

SEQ ID NO: 510560 - RNA, 60 nt, Human; identical to SEQ ID NO: 396037

SEQ ID NO: 510561 - RNA, 60 nt, Human; identical to SEQ ID NO: 396038

SEQ ID NO: 510562 - RNA, 60 nt, Human; identical to SEQ ID NO: 396039

SEQ ID NO: 510563 - RNA, 60 nt, Human; identical to SEQ ID NO: 396040

SEQ ID NO: 510564 - RNA, 60 nt, Human; identical to SEQ ID NO: 396041

SEQ ID NO: 510565 - RNA, 60 nt, Human; identical to SEQ ID NO: 396042

SEQ ID NO: 510566 - RNA, 60 nt, Human; identical to SEQ ID NO: 396043

SEQ ID NO: 510567 - RNA, 60 nt, Human; identical to SEQ ID NO: 396044

SEQ ID NO: 510568 - RNA, 60 nt, Human; identical to SEQ ID NO: 396045

SEQ ID NO: 510569 - RNA, 60 nt, Human; identical to SEQ ID NO: 396046

SEQ ID NO: 510570 - RNA, 60 nt, Human; identical to SEQ ID NO: 396047

SEQ ID NO: 510571 - RNA, 60 nt, Human; identical to SEQ ID NO: 396048

SEQ ID NO: 510572 - RNA, 60 nt, Human; identical to SEQ ID NO: 396049

SEQ ID NO: 510573 - RNA, 60 nt, Human; identical to SEQ ID NO: 396050

SEQ ID NO: 510574 - RNA, 60 nt, Human; identical to SEQ ID NO: 396051

SEQ ID NO: 510575 - RNA, 60 nt, Human; identical to SEQ ID NO: 396052

SEQ ID NO: 510576 - RNA, 60 nt, Human; identical to SEQ ID NO: 396053

SEQ ID NO: 510577 - RNA, 60 nt, Human; identical to SEQ ID NO: 396054

SEQ ID NO: 510578 - RNA, 60 nt, Human; identical to SEQ ID NO: 396055

SEQ ID NO: 510579 - RNA, 60 nt, Human; identical to SEQ ID NO: 396056

SEQ ID NO: 510580 - RNA, 60 nt, Human; identical to SEQ ID NO: 396057

SEQ ID NO: 510581 - RNA, 60 nt, Human; identical to SEQ ID NO: 396058

SEQ ID NO: 510582 - RNA, 60 nt, Human; identical to SEQ ID NO: 396059

SEQ ID NO: 510583 - RNA, 60 nt, Human; identical to SEQ ID NO: 396060

SEQ ID NO: 510584 - RNA, 60 nt, Human; identical to SEQ ID NO: 396061

SEQ ID NO: 510585 - RNA, 60 nt, Human; identical to SEQ ID NO: 396062

SEQ ID NO: 510586 - RNA, 60 nt, Human; identical to SEQ ID NO: 396063

SEQ ID NO: 510587 - RNA, 60 nt, Human; identical to SEQ ID NO: 396064

SEQ ID NO: 510588 - RNA, 60 nt, Human; identical to SEQ ID NO: 396065

SEQ ID NO: 510589 - RNA, 60 nt, Human; identical to SEQ ID NO: 396066

SEQ ID NO: 510590 - RNA, 60 nt, Human; identical to SEQ ID NO: 396067

SEQ ID NO: 510591 - RNA, 60 nt, Human; identical to SEQ ID NO: 396068

SEQ ID NO: 510592 - RNA, 60 nt, Human; identical to SEQ ID NO: 396069

SEQ ID NO: 510593 - RNA, 60 nt, Human; identical to SEQ ID NO: 396070

SEQ ID NO: 510594 - RNA, 60 nt, Human; identical to SEQ ID NO: 396071

SEQ ID NO: 510595 - RNA, 60 nt, Human; identical to SEQ ID NO: 396072

SEQ ID NO: 510596 - RNA, 60 nt, Human; identical to SEQ ID NO: 396073

SEQ ID NO: 510597 - RNA, 60 nt, Human; identical to SEQ ID NO: 396074

SEQ ID NO: 510598 - RNA, 60 nt, Human; identical to SEQ ID NO: 396075

SEQ ID NO: 510599 - RNA, 60 nt, Human; identical to SEQ ID NO: 396076

SEQ ID NO: 510600 - RNA, 60 nt, Human; identical to SEQ ID NO: 396077

SEQ ID NO: 510601 - RNA, 60 nt, Human; identical to SEQ ID NO: 396078

SEQ ID NO: 510602 - RNA, 60 nt, Human; identical to SEQ ID NO: 396079

SEQ ID NO: 510603 - RNA, 60 nt, Human; identical to SEQ ID NO: 396080

SEQ ID NO: 510604 - RNA, 60 nt, Human; identical to SEQ ID NO: 396081

SEQ ID NO: 510605 - RNA, 60 nt, Human; identical to SEQ ID NO: 396082

SEQ ID NO: 510606 - RNA, 60 nt, Human; identical to SEQ ID NO: 396083

SEQ ID NO: 510607 - RNA, 60 nt, Human; identical to SEQ ID NO: 396084

SEQ ID NO: 510608 - RNA, 60 nt, Human; identical to SEQ ID NO: 396085

SEQ ID NO: 510609 - RNA, 60 nt, Human; identical to SEQ ID NO: 396086

SEQ ID NO: 510610 - RNA, 60 nt, Human; identical to SEQ ID NO: 396087

SEQ ID NO: 510611 - RNA, 60 nt, Human; identical to SEQ ID NO: 396088

SEQ ID NO: 510612 - RNA, 60 nt, Human; identical to SEQ ID NO: 396089

SEQ ID NO: 510613 - RNA, 60 nt, Human; identical to SEQ ID NO: 396090

SEQ ID NO: 510614 - RNA, 60 nt, Human; identical to SEQ ID NO: 396091

SEQ ID NO: 510615 - RNA, 60 nt, Human; identical to SEQ ID NO: 396092

SEQ ID NO: 510616 - RNA, 60 nt, Human; identical to SEQ ID NO: 396093

SEQ ID NO: 510617 - RNA, 60 nt, Human; identical to SEQ ID NO: 396094

SEQ ID NO: 510618 - RNA, 60 nt, Human; identical to SEQ ID NO: 396095

SEQ ID NO: 510619 - RNA, 60 nt, Human; identical to SEQ ID NO: 396096

SEQ ID NO: 510620 - RNA, 60 nt, Human; identical to SEQ ID NO: 396097

SEQ ID NO: 510621 - RNA, 60 nt, Human; identical to SEQ ID NO: 396098

SEQ ID NO: 510622 - RNA, 60 nt, Human; identical to SEQ ID NO: 396099

SEQ ID NO: 510623 - RNA, 60 nt, Human; identical to SEQ ID NO: 396100

SEQ ID NO: 510624 - RNA, 60 nt, Human; identical to SEQ ID NO: 396101

SEQ ID NO: 510625 - RNA, 60 nt, Human; identical to SEQ ID NO: 396102

SEQ ID NO: 510626 - RNA, 60 nt, Human; identical to SEQ ID NO: 396103

SEQ ID NO: 510627 - RNA, 60 nt, Human; identical to SEQ ID NO: 396104

SEQ ID NO: 510628 - RNA, 60 nt, Human; identical to SEQ ID NO: 396105

SEQ ID NO: 510629 - RNA, 51 nt, Human; identical to SEQ ID NO: 396106

SEQ ID NO: 510630 - RNA, 60 nt, Human; identical to SEQ ID NO: 396107

SEQ ID NO: 510631 - RNA, 60 nt, Human; identical to SEQ ID NO: 396108

SEQ ID NO: 510632 - RNA, 60 nt, Human; identical to SEQ ID NO: 396109

SEQ ID NO: 510633 - RNA, 60 nt, Human; identical to SEQ ID NO: 396110

SEQ ID NO: 510634 - RNA, 60 nt, Human; identical to SEQ ID NO: 396111

SEQ ID NO: 510635 - RNA, 60 nt, Human; identical to SEQ ID NO: 396112

SEQ ID NO: 510636 - RNA, 60 nt, Human; identical to SEQ ID NO: 396113

SEQ ID NO: 510637 - RNA, 60 nt, Human; identical to SEQ ID NO: 396114

SEQ ID NO: 510638 - RNA, 60 nt, Human; identical to SEQ ID NO: 396115

SEQ ID NO: 510639 - RNA, 60 nt, Human; identical to SEQ ID NO: 396116

SEQ ID NO: 510640 - RNA, 60 nt, Human; identical to SEQ ID NO: 396117

SEQ ID NO: 510641 - RNA, 60 nt, Human; identical to SEQ ID NO: 396118

SEQ ID NO: 510642 - RNA, 60 nt, Human; identical to SEQ ID NO: 396119

SEQ ID NO: 510643 - RNA, 60 nt, Human; identical to SEQ ID NO: 396120

SEQ ID NO: 510644 - RNA, 60 nt, Human; identical to SEQ ID NO: 396121

SEQ ID NO: 510645 - RNA, 60 nt, Human; identical to SEQ ID NO: 396122

SEQ ID NO: 510646 - RNA, 60 nt, Human; identical to SEQ ID NO: 396123

SEQ ID NO: 510647 - RNA, 60 nt, Human; identical to SEQ ID NO: 396124

SEQ ID NO: 510648 - RNA, 60 nt, Human; identical to SEQ ID NO: 396125

SEQ ID NO: 510649 - RNA, 60 nt, Human; identical to SEQ ID NO: 396126

SEQ ID NO: 510650 - RNA, 60 nt, Human; identical to SEQ ID NO: 396127

SEQ ID NO: 510651 - RNA, 60 nt, Human; identical to SEQ ID NO: 396128

SEQ ID NO: 510652 - RNA, 60 nt, Human; identical to SEQ ID NO: 396129

SEQ ID NO: 510653 - RNA, 60 nt, Human; identical to SEQ ID NO: 396130

SEQ ID NO: 510654 - RNA, 60 nt, Human; identical to SEQ ID NO: 396131

SEQ ID NO: 510655 - RNA, 60 nt, Human; identical to SEQ ID NO: 396132

SEQ ID NO: 510656 - RNA, 60 nt, Human; identical to SEQ ID NO: 396133

SEQ ID NO: 510657 - RNA, 60 nt, Human; identical to SEQ ID NO: 396134

SEQ ID NO: 510658 - RNA, 60 nt, Human; identical to SEQ ID NO: 396135

SEQ ID NO: 510659 - RNA, 60 nt, Human; identical to SEQ ID NO: 396136

SEQ ID NO: 510660 - RNA, 60 nt, Human; identical to SEQ ID NO: 396137

SEQ ID NO: 510661 - RNA, 60 nt, Human; identical to SEQ ID NO: 396138

SEQ ID NO: 510662 - RNA, 60 nt, Human; identical to SEQ ID NO: 396139

SEQ ID NO: 510663 - RNA, 60 nt, Human; identical to SEQ ID NO: 396140

SEQ ID NO: 510664 - RNA, 60 nt, Human; identical to SEQ ID NO: 396141

SEQ ID NO: 510665 - RNA, 60 nt, Human; identical to SEQ ID NO: 396142

SEQ ID NO: 510666 - RNA, 60 nt, Human; identical to SEQ ID NO: 396143

SEQ ID NO: 510667 - RNA, 60 nt, Human; identical to SEQ ID NO: 396144

SEQ ID NO: 510668 - RNA, 60 nt, Human; identical to SEQ ID NO: 396145

SEQ ID NO: 510669 - RNA, 60 nt, Human; identical to SEQ ID NO: 396146

SEQ ID NO: 510670 - RNA, 60 nt, Human; identical to SEQ ID NO: 396147

SEQ ID NO: 510671 - RNA, 60 nt, Human; identical to SEQ ID NO: 396148

SEQ ID NO: 510672 - RNA, 60 nt, Human; identical to SEQ ID NO: 396149

SEQ ID NO: 510673 - RNA, 60 nt, Human; identical to SEQ ID NO: 396150

SEQ ID NO: 510674 - RNA, 60 nt, Human; identical to SEQ ID NO: 396151

SEQ ID NO: 510675 - RNA, 60 nt, Human; identical to SEQ ID NO: 396152

SEQ ID NO: 510676 - RNA, 60 nt, Human; identical to SEQ ID NO: 396153

SEQ ID NO: 510677 - RNA, 60 nt, Human; identical to SEQ ID NO: 396154

SEQ ID NO: 510678 - RNA, 60 nt, Human; identical to SEQ ID NO: 396155

SEQ ID NO: 510679 - RNA, 60 nt, Human; identical to SEQ ID NO: 396156

SEQ ID NO: 510680 - RNA, 60 nt, Human; identical to SEQ ID NO: 396157

SEQ ID NO: 510681 - RNA, 60 nt, Human; identical to SEQ ID NO: 396158

SEQ ID NO: 510682 - RNA, 60 nt, Human; identical to SEQ ID NO: 396159

SEQ ID NO: 510683 - RNA, 60 nt, Human; identical to SEQ ID NO: 396160

SEQ ID NO: 510684 - RNA, 60 nt, Human; identical to SEQ ID NO: 396161

SEQ ID NO: 510685 - RNA, 60 nt, Human; identical to SEQ ID NO: 396162

SEQ ID NO: 510686 - RNA, 60 nt, Human; identical to SEQ ID NO: 396163

SEQ ID NO: 510687 - RNA, 60 nt, Human; identical to SEQ ID NO: 396164

SEQ ID NO: 510688 - RNA, 60 nt, Human; identical to SEQ ID NO: 396165

SEQ ID NO: 510689 - RNA, 60 nt, Human; identical to SEQ ID NO: 396166

SEQ ID NO: 510690 - RNA, 60 nt, Human; identical to SEQ ID NO: 396167

SEQ ID NO: 510691 - RNA, 60 nt, Human; identical to SEQ ID NO: 396168

SEQ ID NO: 510692 - RNA, 60 nt, Human; identical to SEQ ID NO: 396169

SEQ ID NO: 510693 - RNA, 60 nt, Human; identical to SEQ ID NO: 396170

SEQ ID NO: 510694 - RNA, 60 nt, Human; identical to SEQ ID NO: 396171

SEQ ID NO: 510695 - RNA, 60 nt, Human; identical to SEQ ID NO: 396172

SEQ ID NO: 510696 - RNA, 60 nt, Human; identical to SEQ ID NO: 396173

SEQ ID NO: 510697 - RNA, 60 nt, Human; identical to SEQ ID NO: 396174

SEQ ID NO: 510698 - RNA, 60 nt, Human; identical to SEQ ID NO: 396175

SEQ ID NO: 510699 - RNA, 60 nt, Human; identical to SEQ ID NO: 396176

SEQ ID NO: 510700 - RNA, 60 nt, Human; identical to SEQ ID NO: 396177

SEQ ID NO: 510701 - RNA, 60 nt, Human; identical to SEQ ID NO: 396178

SEQ ID NO: 510702 - RNA, 60 nt, Human; identical to SEQ ID NO: 396179

SEQ ID NO: 510703 - RNA, 60 nt, Human; identical to SEQ ID NO: 396180

SEQ ID NO: 510704 - RNA, 60 nt, Human; identical to SEQ ID NO: 396181

SEQ ID NO: 510705 - RNA, 60 nt, Human; identical to SEQ ID NO: 396182

SEQ ID NO: 510706 - RNA, 60 nt, Human; identical to SEQ ID NO: 396183

SEQ ID NO: 510707 - RNA, 60 nt, Human; identical to SEQ ID NO: 396184

SEQ ID NO: 510708 - RNA, 60 nt, Human; identical to SEQ ID NO: 396185

SEQ ID NO: 510709 - RNA, 60 nt, Human; identical to SEQ ID NO: 396186

SEQ ID NO: 510710 - RNA, 60 nt, Human; identical to SEQ ID NO: 396187

SEQ ID NO: 510711 - RNA, 60 nt, Human; identical to SEQ ID NO: 396188

SEQ ID NO: 510712 - RNA, 60 nt, Human; identical to SEQ ID NO: 396189

SEQ ID NO: 510713 - RNA, 60 nt, Human; identical to SEQ ID NO: 396190

SEQ ID NO: 510714 - RNA, 60 nt, Human; identical to SEQ ID NO: 396191

SEQ ID NO: 510715 - RNA, 60 nt, Human; identical to SEQ ID NO: 396192

SEQ ID NO: 510716 - RNA, 60 nt, Human; identical to SEQ ID NO: 396193

SEQ ID NO: 510717 - RNA, 60 nt, Human; identical to SEQ ID NO: 396194

SEQ ID NO: 510718 - RNA, 60 nt, Human; identical to SEQ ID NO: 396195

SEQ ID NO: 510719 - RNA, 60 nt, Human; identical to SEQ ID NO: 396196

SEQ ID NO: 510720 - RNA, 60 nt, Human; identical to SEQ ID NO: 396197

SEQ ID NO: 510721 - RNA, 60 nt, Human; identical to SEQ ID NO: 396198

SEQ ID NO: 510722 - RNA, 60 nt, Human; identical to SEQ ID NO: 396199

SEQ ID NO: 510723 - RNA, 60 nt, Human; identical to SEQ ID NO: 396200

SEQ ID NO: 510724 - RNA, 60 nt, Human; identical to SEQ ID NO: 396201

SEQ ID NO: 510725 - RNA, 60 nt, Human; identical to SEQ ID NO: 396202

SEQ ID NO: 510726 - RNA, 60 nt, Human; identical to SEQ ID NO: 396203

SEQ ID NO: 510727 - RNA, 60 nt, Human; identical to SEQ ID NO: 396204

SEQ ID NO: 510728 - RNA, 60 nt, Human; identical to SEQ ID NO: 396205

SEQ ID NO: 510729 - RNA, 60 nt, Human; identical to SEQ ID NO: 396206

SEQ ID NO: 510730 - RNA, 60 nt, Human; identical to SEQ ID NO: 396207

SEQ ID NO: 510731 - RNA, 60 nt, Human; identical to SEQ ID NO: 396208

SEQ ID NO: 510732 - RNA, 60 nt, Human; identical to SEQ ID NO: 396209

SEQ ID NO: 510733 - RNA, 60 nt, Human; identical to SEQ ID NO: 396210

SEQ ID NO: 510734 - RNA, 60 nt, Human; identical to SEQ ID NO: 396211

SEQ ID NO: 510735 - RNA, 60 nt, Human; identical to SEQ ID NO: 396212

SEQ ID NO: 510736 - RNA, 60 nt, Human; identical to SEQ ID NO: 396213

SEQ ID NO: 510737 - RNA, 60 nt, Human; identical to SEQ ID NO: 396214

SEQ ID NO: 510738 - RNA, 60 nt, Human; identical to SEQ ID NO: 396215

SEQ ID NO: 510739 - RNA, 60 nt, Human; identical to SEQ ID NO: 396216

SEQ ID NO: 510740 - RNA, 60 nt, Human; identical to SEQ ID NO: 396217

SEQ ID NO: 510741 - RNA, 60 nt, Human; identical to SEQ ID NO: 396218

SEQ ID NO: 510742 - RNA, 60 nt, Human; identical to SEQ ID NO: 396219

SEQ ID NO: 510743 - RNA, 60 nt, Human; identical to SEQ ID NO: 396220

SEQ ID NO: 510744 - RNA, 60 nt, Human; identical to SEQ ID NO: 396221

SEQ ID NO: 510745 - RNA, 60 nt, Human; identical to SEQ ID NO: 396222

SEQ ID NO: 510746 - RNA, 60 nt, Human; identical to SEQ ID NO: 396223

SEQ ID NO: 510747 - RNA, 60 nt, Human; identical to SEQ ID NO: 396224

SEQ ID NO: 510748 - RNA, 60 nt, Human; identical to SEQ ID NO: 396225

SEQ ID NO: 510749 - RNA, 60 nt, Human; identical to SEQ ID NO: 396226

SEQ ID NO: 510750 - RNA, 60 nt, Human; identical to SEQ ID NO: 396227

SEQ ID NO: 510751 - RNA, 59 nt, Human; identical to SEQ ID NO: 396228

SEQ ID NO: 510752 - RNA, 60 nt, Human; identical to SEQ ID NO: 396229

SEQ ID NO: 510753 - RNA, 60 nt, Human; identical to SEQ ID NO: 396230

SEQ ID NO: 510754 - RNA, 60 nt, Human; identical to SEQ ID NO: 396231

SEQ ID NO: 510755 - RNA, 60 nt, Human; identical to SEQ ID NO: 396232

SEQ ID NO: 510756 - RNA, 60 nt, Human; identical to SEQ ID NO: 396233

SEQ ID NO: 510757 - RNA, 60 nt, Human; identical to SEQ ID NO: 396234

SEQ ID NO: 510758 - RNA, 60 nt, Human; identical to SEQ ID NO: 396235

SEQ ID NO: 510759 - RNA, 60 nt, Human; identical to SEQ ID NO: 396236

SEQ ID NO: 510760 - RNA, 60 nt, Human; identical to SEQ ID NO: 396237

SEQ ID NO: 510761 - RNA, 60 nt, Human; identical to SEQ ID NO: 396238

SEQ ID NO: 510762 - RNA, 60 nt, Human; identical to SEQ ID NO: 396239

SEQ ID NO: 510763 - RNA, 60 nt, Human; identical to SEQ ID NO: 396240

SEQ ID NO: 510764 - RNA, 60 nt, Human; identical to SEQ ID NO: 396241

SEQ ID NO: 510765 - RNA, 60 nt, Human; identical to SEQ ID NO: 396242

SEQ ID NO: 510766 - RNA, 60 nt, Human; identical to SEQ ID NO: 396243

SEQ ID NO: 510767 - RNA, 60 nt, Human; identical to SEQ ID NO: 396244

SEQ ID NO: 510768 - RNA, 60 nt, Human; identical to SEQ ID NO: 396245

SEQ ID NO: 510769 - RNA, 60 nt, Human; identical to SEQ ID NO: 396246

SEQ ID NO: 510770 - RNA, 60 nt, Human; identical to SEQ ID NO: 396247

SEQ ID NO: 510771 - RNA, 60 nt, Human; identical to SEQ ID NO: 396248

SEQ ID NO: 510772 - RNA, 60 nt, Human; identical to SEQ ID NO: 396249

SEQ ID NO: 510773 - RNA, 60 nt, Human; identical to SEQ ID NO: 396250

SEQ ID NO: 510774 - RNA, 60 nt, Human; identical to SEQ ID NO: 396251

SEQ ID NO: 510775 - RNA, 60 nt, Human; identical to SEQ ID NO: 396252

SEQ ID NO: 510776 - RNA, 60 nt, Human; identical to SEQ ID NO: 396253

SEQ ID NO: 510777 - RNA, 60 nt, Human; identical to SEQ ID NO: 396254

SEQ ID NO: 510778 - RNA, 60 nt, Human; identical to SEQ ID NO: 396255

SEQ ID NO: 510779 - RNA, 60 nt, Human; identical to SEQ ID NO: 396256

SEQ ID NO: 510780 - RNA, 60 nt, Human; identical to SEQ ID NO: 396257

SEQ ID NO: 510781 - RNA, 60 nt, Human; identical to SEQ ID NO: 396258

SEQ ID NO: 510782 - RNA, 60 nt, Human; identical to SEQ ID NO: 396259

SEQ ID NO: 510783 - RNA, 60 nt, Human; identical to SEQ ID NO: 396260

SEQ ID NO: 510784 - RNA, 60 nt, Human; identical to SEQ ID NO: 396261

SEQ ID NO: 510785 - RNA, 60 nt, Human; identical to SEQ ID NO: 396262

SEQ ID NO: 510786 - RNA, 60 nt, Human; identical to SEQ ID NO: 396263

SEQ ID NO: 510787 - RNA, 60 nt, Human; identical to SEQ ID NO: 396264

SEQ ID NO: 510788 - RNA, 60 nt, Human; identical to SEQ ID NO: 396265

SEQ ID NO: 510789 - RNA, 60 nt, Human; identical to SEQ ID NO: 396266

SEQ ID NO: 510790 - RNA, 60 nt, Human; identical to SEQ ID NO: 396267

SEQ ID NO: 510791 - RNA, 60 nt, Human; identical to SEQ ID NO: 396268

SEQ ID NO: 510792 - RNA, 60 nt, Human; identical to SEQ ID NO: 396269

SEQ ID NO: 510793 - RNA, 60 nt, Human; identical to SEQ ID NO: 396270

SEQ ID NO: 510794 - RNA, 60 nt, Human; identical to SEQ ID NO: 396271

SEQ ID NO: 510795 - RNA, 60 nt, Human; identical to SEQ ID NO: 396272

SEQ ID NO: 510796 - RNA, 60 nt, Human; identical to SEQ ID NO: 396273

SEQ ID NO: 510797 - RNA, 60 nt, Human; identical to SEQ ID NO: 396274

SEQ ID NO: 510798 - RNA, 60 nt, Human; identical to SEQ ID NO: 395909

SEQ ID NO: 510799 - RNA, 60 nt, Human; identical to SEQ ID NO: 395910

SEQ ID NO: 510800 - RNA, 60 nt, Human; identical to SEQ ID NO: 395911

SEQ ID NO: 510801 - RNA, 60 nt, Human; identical to SEQ ID NO: 395912

SEQ ID NO: 510802 - RNA, 60 nt, Human; identical to SEQ ID NO: 395913

SEQ ID NO: 510803 - RNA, 60 nt, Human; identical to SEQ ID NO: 395914

SEQ ID NO: 510804 - RNA, 60 nt, Human; identical to SEQ ID NO: 395915

SEQ ID NO: 510805 - RNA, 60 nt, Human; identical to SEQ ID NO: 395916

SEQ ID NO: 510806 - RNA, 60 nt, Human; identical to SEQ ID NO: 395917

SEQ ID NO: 510807 - RNA, 60 nt, Human; identical to SEQ ID NO: 395918

SEQ ID NO: 510808 - RNA, 60 nt, Human; identical to SEQ ID NO: 395919

SEQ ID NO: 510809 - RNA, 60 nt, Human; identical to SEQ ID NO: 395465

SEQ ID NO: 510810 - RNA, 60 nt, Human; identical to SEQ ID NO: 395466

SEQ ID NO: 510811 - RNA, 60 nt, Human; identical to SEQ ID NO: 394320

SEQ ID NO: 510812 - RNA, 60 nt, Human; identical to SEQ ID NO: 395334

SEQ ID NO: 510813 - RNA, 60 nt, Human; identical to SEQ ID NO: 395124

SEQ ID NO: 510814 - RNA, 60 nt, Human; identical to SEQ ID NO: 395125

SEQ ID NO: 510815 - RNA, 60 nt, Human; identical to SEQ ID NO: 394337

SEQ ID NO: 510816 - RNA, 60 nt, Human; identical to SEQ ID NO: 395467

SEQ ID NO: 510817 - RNA, 60 nt, Human; identical to SEQ ID NO: 395048

SEQ ID NO: 510818 - RNA, 60 nt, Human; identical to SEQ ID NO: 395049

SEQ ID NO: 510819 - RNA, 60 nt, Human; identical to SEQ ID NO: 394338

SEQ ID NO: 510820 - RNA, 60 nt, Human; identical to SEQ ID NO: 395503

SEQ ID NO: 510821 - RNA, 60 nt, Human; identical to SEQ ID NO: 395504

SEQ ID NO: 510822 - RNA, 60 nt, Human; identical to SEQ ID NO: 395505

SEQ ID NO: 510823 - RNA, 60 nt, Human; identical to SEQ ID NO: 394991

SEQ ID NO: 510824 - RNA, 60 nt, Human; identical to SEQ ID NO: 394992

SEQ ID NO: 510825 - RNA, 60 nt, Human; identical to SEQ ID NO: 394339

SEQ ID NO: 510826 - RNA, 60 nt, Human; identical to SEQ ID NO: 395750

SEQ ID NO: 510827 - RNA, 60 nt, Human; identical to SEQ ID NO: 395751

SEQ ID NO: 510828 - RNA, 60 nt, Human; identical to SEQ ID NO: 395752

SEQ ID NO: 510829 - RNA, 60 nt, Human; identical to SEQ ID NO: 395883

SEQ ID NO: 510830 - RNA, 60 nt, Human; identical to SEQ ID NO: 395884

SEQ ID NO: 510831 - RNA, 60 nt, Human; identical to SEQ ID NO: 394356

SEQ ID NO: 510832 - RNA, 60 nt, Human; identical to SEQ ID NO: 394953

SEQ ID NO: 510833 - RNA, 60 nt, Human; identical to SEQ ID NO: 394954

SEQ ID NO: 510834 - RNA, 60 nt, Human; identical to SEQ ID NO: 394955

SEQ ID NO: 510835 - RNA, 60 nt, Human; identical to SEQ ID NO: 395885

SEQ ID NO: 510836 - RNA, 60 nt, Human; identical to SEQ ID NO: 394357

SEQ ID NO: 510837 - RNA, 60 nt, Human; identical to SEQ ID NO: 394972

SEQ ID NO: 510838 - RNA, 60 nt, Human; identical to SEQ ID NO: 394973

SEQ ID NO: 510839 - RNA, 60 nt, Human; identical to SEQ ID NO: 394974

SEQ ID NO: 510840 - RNA, 60 nt, Human; identical to SEQ ID NO: 394993

SEQ ID NO: 510841 - RNA, 60 nt, Human; identical to SEQ ID NO: 394358

SEQ ID NO: 510842 - RNA, 59 nt, Human; identical to SEQ ID NO: 395010

SEQ ID NO: 510843 - RNA, 60 nt, Human; identical to SEQ ID NO: 395011

SEQ ID NO: 510844 - RNA, 60 nt, Human; identical to SEQ ID NO: 395012

SEQ ID NO: 510845 - RNA, 60 nt, Human; identical to SEQ ID NO: 395029

SEQ ID NO: 510846 - RNA, 60 nt, Human; identical to SEQ ID NO: 395030

SEQ ID NO: 510847 - RNA, 60 nt, Human; identical to SEQ ID NO: 394375

SEQ ID NO: 510848 - RNA, 60 nt, Human; identical to SEQ ID NO: 395050

SEQ ID NO: 510849 - RNA, 60 nt, Human; identical to SEQ ID NO: 395143

SEQ ID NO: 510850 - RNA, 60 nt, Human; identical to SEQ ID NO: 395144

SEQ ID NO: 510851 - RNA, 60 nt, Human; identical to SEQ ID NO: 394376

SEQ ID NO: 510852 - RNA, 60 nt, Human; identical to SEQ ID NO: 395069

SEQ ID NO: 510853 - RNA, 60 nt, Human; identical to SEQ ID NO: 394896

SEQ ID NO: 510854 - RNA, 60 nt, Human; identical to SEQ ID NO: 394897

SEQ ID NO: 510855 - RNA, 60 nt, Human; identical to SEQ ID NO: 394377

SEQ ID NO: 510856 - RNA, 60 nt, Human; identical to SEQ ID NO: 395086

SEQ ID NO: 510857 - RNA, 60 nt, Human; identical to SEQ ID NO: 395087

SEQ ID NO: 510858 - RNA, 60 nt, Human; identical to SEQ ID NO: 395088

SEQ ID NO: 510859 - RNA, 60 nt, Human; identical to SEQ ID NO: 395202

SEQ ID NO: 510860 - RNA, 60 nt, Human; identical to SEQ ID NO: 394378

SEQ ID NO: 510861 - RNA, 60 nt, Human; identical to SEQ ID NO: 395105

SEQ ID NO: 510862 - RNA, 60 nt, Human; identical to SEQ ID NO: 395106

SEQ ID NO: 510863 - RNA, 60 nt, Human; identical to SEQ ID NO: 395107

SEQ ID NO: 510864 - RNA, 60 nt, Human; identical to SEQ ID NO: 395126

SEQ ID NO: 510865 - RNA, 60 nt, Human; identical to SEQ ID NO: 394395

SEQ ID NO: 510866 - RNA, 60 nt, Human; identical to SEQ ID NO: 395259

SEQ ID NO: 510867 - RNA, 60 nt, Human; identical to SEQ ID NO: 395391

SEQ ID NO: 510868 - RNA, 60 nt, Human; identical to SEQ ID NO: 394396

SEQ ID NO: 510869 - RNA, 60 nt, Human; identical to SEQ ID NO: 394705

SEQ ID NO: 510870 - RNA, 60 nt, Human; identical to SEQ ID NO: 394706

SEQ ID NO: 510871 - RNA, 60 nt, Human; identical to SEQ ID NO: 394707

SEQ ID NO: 510872 - RNA, 60 nt, Human; identical to SEQ ID NO: 394708

SEQ ID NO: 510873 - RNA, 60 nt, Human; identical to SEQ ID NO: 394725

SEQ ID NO: 510874 - RNA, 60 nt, Human; identical to SEQ ID NO: 394726

SEQ ID NO: 510875 - RNA, 60 nt, Human; identical to SEQ ID NO: 394397

SEQ ID NO: 510876 - RNA, 60 nt, Human; identical to SEQ ID NO: 394727

SEQ ID NO: 510877 - RNA, 60 nt, Human; identical to SEQ ID NO: 394744

SEQ ID NO: 510878 - RNA, 60 nt, Human; identical to SEQ ID NO: 394745

SEQ ID NO: 510879 - RNA, 60 nt, Human; identical to SEQ ID NO: 394414

SEQ ID NO: 510880 - RNA, 60 nt, Human; identical to SEQ ID NO: 394763

SEQ ID NO: 510881 - RNA, 60 nt, Human; identical to SEQ ID NO: 394764

SEQ ID NO: 510882 - RNA, 60 nt, Human; identical to SEQ ID NO: 394765

SEQ ID NO: 510883 - RNA, 60 nt, Human; identical to SEQ ID NO: 394801

SEQ ID NO: 510884 - RNA, 60 nt, Human; identical to SEQ ID NO: 394802

SEQ ID NO: 510885 - RNA, 60 nt, Human; identical to SEQ ID NO: 394415

SEQ ID NO: 510886 - RNA, 60 nt, Human; identical to SEQ ID NO: 394782

SEQ ID NO: 510887 - RNA, 60 nt, Human; identical to SEQ ID NO: 394783

SEQ ID NO: 510888 - RNA, 60 nt, Human; identical to SEQ ID NO: 394784

SEQ ID NO: 510889 - RNA, 60 nt, Human; identical to SEQ ID NO: 394877

SEQ ID NO: 510890 - RNA, 60 nt, Human; identical to SEQ ID NO: 394878

SEQ ID NO: 510891 - RNA, 60 nt, Human; identical to SEQ ID NO: 394416

SEQ ID NO: 510892 - RNA, 60 nt, Human; identical to SEQ ID NO: 394803

SEQ ID NO: 510893 - RNA, 58 nt, Human; identical to SEQ ID NO: 395145

SEQ ID NO: 510894 - RNA, 60 nt, Human; identical to SEQ ID NO: 394418

SEQ ID NO: 510895 - RNA, 60 nt, Human; identical to SEQ ID NO: 394839

SEQ ID NO: 510896 - RNA, 60 nt, Human; identical to SEQ ID NO: 394840

SEQ ID NO: 510897 - RNA, 60 nt, Human; identical to SEQ ID NO: 394841

SEQ ID NO: 510898 - RNA, 60 nt, Human; identical to SEQ ID NO: 394858

SEQ ID NO: 510899 - RNA, 60 nt, Human; identical to SEQ ID NO: 394859

SEQ ID NO: 510900 - RNA, 60 nt, Human; identical to SEQ ID NO: 394419

SEQ ID NO: 510901 - RNA, 60 nt, Human; identical to SEQ ID NO: 394860

SEQ ID NO: 510902 - RNA, 60 nt, Human; identical to SEQ ID NO: 394625

SEQ ID NO: 510903 - RNA, 60 nt, Human; identical to SEQ ID NO: 394626

SEQ ID NO: 510904 - RNA, 60 nt, Human; identical to SEQ ID NO: 394420

SEQ ID NO: 510905 - RNA, 60 nt, Human; identical to SEQ ID NO: 394879

SEQ ID NO: 510906 - RNA, 60 nt, Human; identical to SEQ ID NO: 395031

SEQ ID NO: 510907 - RNA, 60 nt, Human; identical to SEQ ID NO: 394421

SEQ ID NO: 510908 - RNA, 60 nt, Human; identical to SEQ ID NO: 394898

SEQ ID NO: 510909 - RNA, 60 nt, Human; identical to SEQ ID NO: 394915

SEQ ID NO: 510910 - RNA, 60 nt, Human; identical to SEQ ID NO: 394916

SEQ ID NO: 510911 - RNA, 60 nt, Human; identical to SEQ ID NO: 394422

SEQ ID NO: 510912 - RNA, 60 nt, Human; identical to SEQ ID NO: 394917

SEQ ID NO: 510913 - RNA, 60 nt, Human; identical to SEQ ID NO: 394746

SEQ ID NO: 510914 - RNA, 60 nt, Human; identical to SEQ ID NO: 394423

SEQ ID NO: 510915 - RNA, 60 nt, Human; identical to SEQ ID NO: 394450

SEQ ID NO: 510916 - RNA, 60 nt, Human; identical to SEQ ID NO: 394451

SEQ ID NO: 510917 - RNA, 60 nt, Human; identical to SEQ ID NO: 394452

SEQ ID NO: 510918 - RNA, 60 nt, Human; identical to SEQ ID NO: 394469

SEQ ID NO: 510919 - RNA, 60 nt, Human; identical to SEQ ID NO: 394470

SEQ ID NO: 510920 - RNA, 60 nt, Human; identical to SEQ ID NO: 394471

SEQ ID NO: 510921 - RNA, 60 nt, Human; identical to SEQ ID NO: 394934

SEQ ID NO: 510922 - RNA, 60 nt, Human; identical to SEQ ID NO: 394935

SEQ ID NO: 510923 - RNA, 60 nt, Human; identical to SEQ ID NO: 394936

SEQ ID NO: 510924 - RNA, 60 nt, Human; identical to SEQ ID NO: 394488

SEQ ID NO: 510925 - RNA, 60 nt, Human; identical to SEQ ID NO: 394489

SEQ ID NO: 510926 - RNA, 60 nt, Human; identical to SEQ ID NO: 394490

SEQ ID NO: 510927 - RNA, 60 nt, Human; identical to SEQ ID NO: 394491

SEQ ID NO: 510928 - RNA, 60 nt, Human; identical to SEQ ID NO: 394508

SEQ ID NO: 510929 - RNA, 60 nt, Human; identical to SEQ ID NO: 394509

SEQ ID NO: 510930 - RNA, 60 nt, Human; identical to SEQ ID NO: 394510

SEQ ID NO: 510931 - RNA, 60 nt, Human; identical to SEQ ID NO: 394527

SEQ ID NO: 510932 - RNA, 60 nt, Human; identical to SEQ ID NO: 394528

SEQ ID NO: 510933 - RNA, 60 nt, Human; identical to SEQ ID NO: 394529

SEQ ID NO: 510934 - RNA, 60 nt, Human; identical to SEQ ID NO: 394546

SEQ ID NO: 510935 - RNA, 60 nt, Human; identical to SEQ ID NO: 394547

SEQ ID NO: 510936 - RNA, 60 nt, Human; identical to SEQ ID NO: 394548

SEQ ID NO: 510937 - RNA, 55 nt, Human; identical to SEQ ID NO: 394549

SEQ ID NO: 510938 - RNA, 60 nt, Human; identical to SEQ ID NO: 394566

SEQ ID NO: 510939 - RNA, 60 nt, Human; identical to SEQ ID NO: 394567

SEQ ID NO: 510940 - RNA, 60 nt, Human; identical to SEQ ID NO: 394568

SEQ ID NO: 510941 - RNA, 57 nt, Human; identical to SEQ ID NO: 395920

SEQ ID NO: 510942 - RNA, 60 nt, Human; identical to SEQ ID NO: 395921

SEQ ID NO: 510943 - RNA, 60 nt, Human; identical to SEQ ID NO: 395922

SEQ ID NO: 510944 - RNA, 60 nt, Human; identical to SEQ ID NO: 395923

SEQ ID NO: 510945 - RNA, 60 nt, Human; identical to SEQ ID NO: 395924

SEQ ID NO: 510946 - RNA, 60 nt, Human; identical to SEQ ID NO: 395925

SEQ ID NO: 510947 - RNA, 60 nt, Human; identical to SEQ ID NO: 395926

SEQ ID NO: 510948 - RNA, 60 nt, Human; identical to SEQ ID NO: 395927

SEQ ID NO: 510949 - RNA, 60 nt, Human; identical to SEQ ID NO: 395928

SEQ ID NO: 510950 - RNA, 60 nt, Human; identical to SEQ ID NO: 395929

SEQ ID NO: 510951 - RNA, 60 nt, Human; identical to SEQ ID NO: 395930

SEQ ID NO: 510952 - RNA, 60 nt, Human; identical to SEQ ID NO: 395931

SEQ ID NO: 510953 - RNA, 60 nt, Human; identical to SEQ ID NO: 395932

SEQ ID NO: 510954 - RNA, 60 nt, Human; identical to SEQ ID NO: 395933

SEQ ID NO: 510955 - RNA, 60 nt, Human; identical to SEQ ID NO: 395934

SEQ ID NO: 510956 - RNA, 60 nt, Human; identical to SEQ ID NO: 395935

SEQ ID NO: 510957 - RNA, 60 nt, Human; identical to SEQ ID NO: 395936

SEQ ID NO: 510958 - RNA, 60 nt, Human; identical to SEQ ID NO: 395937

SEQ ID NO: 510959 - RNA, 60 nt, Human; identical to SEQ ID NO: 395938

SEQ ID NO: 510960 - RNA, 60 nt, Human; identical to SEQ ID NO: 395939

SEQ ID NO: 510961 - RNA, 60 nt, Human; identical to SEQ ID NO: 395940

SEQ ID NO: 510962 - RNA, 60 nt, Human; identical to SEQ ID NO: 395941

SEQ ID NO: 510963 - RNA, 60 nt, Human; identical to SEQ ID NO: 395942

SEQ ID NO: 510964 - RNA, 60 nt, Human; identical to SEQ ID NO: 395943

SEQ ID NO: 510965 - RNA, 60 nt, Human; identical to SEQ ID NO: 395944

SEQ ID NO: 510966 - RNA, 60 nt, Human; identical to SEQ ID NO: 395945

SEQ ID NO: 510967 - RNA, 60 nt, Human; identical to SEQ ID NO: 395946

SEQ ID NO: 510968 - RNA, 60 nt, Human; identical to SEQ ID NO: 395947

SEQ ID NO: 510969 - RNA, 60 nt, Human; identical to SEQ ID NO: 395948

SEQ ID NO: 510970 - RNA, 60 nt, Human; identical to SEQ ID NO: 395949

SEQ ID NO: 510971 - RNA, 60 nt, Human; identical to SEQ ID NO: 395950

SEQ ID NO: 510972 - RNA, 60 nt, Human; identical to SEQ ID NO: 395951

SEQ ID NO: 510973 - RNA, 60 nt, Human; identical to SEQ ID NO: 395952

SEQ ID NO: 510974 - RNA, 60 nt, Human; identical to SEQ ID NO: 395953

SEQ ID NO: 510975 - RNA, 60 nt, Human; identical to SEQ ID NO: 395954

SEQ ID NO: 510976 - RNA, 60 nt, Human; identical to SEQ ID NO: 395955

SEQ ID NO: 510977 - RNA, 60 nt, Human; identical to SEQ ID NO: 395956

SEQ ID NO: 510978 - RNA, 60 nt, Human; identical to SEQ ID NO: 395957

SEQ ID NO: 510979 - RNA, 60 nt, Human; identical to SEQ ID NO: 395958

SEQ ID NO: 510980 - RNA, 60 nt, Human; identical to SEQ ID NO: 395959

SEQ ID NO: 510981 - RNA, 60 nt, Human; identical to SEQ ID NO: 395960

SEQ ID NO: 510982 - RNA, 60 nt, Human; identical to SEQ ID NO: 395961

SEQ ID NO: 510983 - RNA, 60 nt, Human; identical to SEQ ID NO: 395962

SEQ ID NO: 510984 - RNA, 60 nt, Human; identical to SEQ ID NO: 395963

SEQ ID NO: 510985 - RNA, 60 nt, Human; identical to SEQ ID NO: 395964

SEQ ID NO: 510986 - RNA, 60 nt, Human; identical to SEQ ID NO: 395965

SEQ ID NO: 510987 - RNA, 60 nt, Human; identical to SEQ ID NO: 395966

SEQ ID NO: 510988 - RNA, 60 nt, Human; identical to SEQ ID NO: 395967

SEQ ID NO: 510989 - RNA, 60 nt, Human; identical to SEQ ID NO: 395968

SEQ ID NO: 510990 - RNA, 60 nt, Human; identical to SEQ ID NO: 395969

SEQ ID NO: 510991 - RNA, 60 nt, Human; identical to SEQ ID NO: 395970

SEQ ID NO: 510992 - RNA, 60 nt, Human; identical to SEQ ID NO: 395971

SEQ ID NO: 510993 - RNA, 60 nt, Human; identical to SEQ ID NO: 395972

SEQ ID NO: 510994 - RNA, 60 nt, Human; identical to SEQ ID NO: 395973

SEQ ID NO: 510995 - RNA, 60 nt, Human; identical to SEQ ID NO: 395974

SEQ ID NO: 510996 - RNA, 60 nt, Human; identical to SEQ ID NO: 395975

SEQ ID NO: 510997 - RNA, 60 nt, Human; identical to SEQ ID NO: 395976

SEQ ID NO: 510998 - RNA, 60 nt, Human; identical to SEQ ID NO: 395977

SEQ ID NO: 510999 - RNA, 60 nt, Human; identical to SEQ ID NO: 395978

SEQ ID NO: 511000 - RNA, 60 nt, Human; identical to SEQ ID NO: 395979

SEQ ID NO: 511001 - RNA, 60 nt, Human; identical to SEQ ID NO: 395980

SEQ ID NO: 511002 - RNA, 60 nt, Human; identical to SEQ ID NO: 395981

SEQ ID NO: 511003 - RNA, 60 nt, Human; identical to SEQ ID NO: 395982

SEQ ID NO: 511004 - RNA, 60 nt, Human; identical to SEQ ID NO: 395983

SEQ ID NO: 511005 - RNA, 60 nt, Human; identical to SEQ ID NO: 395984

SEQ ID NO: 511006 - RNA, 60 nt, Human; identical to SEQ ID NO: 395985

SEQ ID NO: 511007 - RNA, 60 nt, Human; identical to SEQ ID NO: 395986

SEQ ID NO: 511008 - RNA, 60 nt, Human; identical to SEQ ID NO: 395987

SEQ ID NO: 511009 - RNA, 60 nt, Human; identical to SEQ ID NO: 395988

SEQ ID NO: 511010 - RNA, 60 nt, Human; identical to SEQ ID NO: 395989

SEQ ID NO: 511011 - RNA, 60 nt, Human; identical to SEQ ID NO: 395990

SEQ ID NO: 511012 - RNA, 60 nt, Human; identical to SEQ ID NO: 395991

SEQ ID NO: 511013 - RNA, 60 nt, Human; identical to SEQ ID NO: 395992

SEQ ID NO: 511014 - RNA, 60 nt, Human; identical to SEQ ID NO: 395993

SEQ ID NO: 511015 - RNA, 60 nt, Human; identical to SEQ ID NO: 395994

SEQ ID NO: 511016 - RNA, 60 nt, Human; identical to SEQ ID NO: 395995

SEQ ID NO: 511017 - RNA, 60 nt, Human; identical to SEQ ID NO: 395996

SEQ ID NO: 511018 - RNA, 60 nt, Human; identical to SEQ ID NO: 395997

SEQ ID NO: 511019 - RNA, 60 nt, Human; identical to SEQ ID NO: 395998

SEQ ID NO: 511020 - RNA, 60 nt, Human; identical to SEQ ID NO: 395999

SEQ ID NO: 511021 - RNA, 60 nt, Human; identical to SEQ ID NO: 396000

SEQ ID NO: 511022 - RNA, 60 nt, Human; identical to SEQ ID NO: 396001

SEQ ID NO: 511023 - RNA, 60 nt, Human; identical to SEQ ID NO: 396002

SEQ ID NO: 511024 - RNA, 60 nt, Human; identical to SEQ ID NO: 396003

SEQ ID NO: 511025 - RNA, 60 nt, Human; identical to SEQ ID NO: 396004

SEQ ID NO: 511026 - RNA, 60 nt, Human; identical to SEQ ID NO: 396005

SEQ ID NO: 511027 - RNA, 60 nt, Human; identical to SEQ ID NO: 396006

SEQ ID NO: 511028 - RNA, 60 nt, Human; identical to SEQ ID NO: 396007

SEQ ID NO: 511029 - RNA, 60 nt, Human; identical to SEQ ID NO: 396008

SEQ ID NO: 511030 - RNA, 60 nt, Human; identical to SEQ ID NO: 396009

SEQ ID NO: 511031 - RNA, 60 nt, Human; identical to SEQ ID NO: 396010

SEQ ID NO: 511032 - RNA, 60 nt, Human; identical to SEQ ID NO: 396011

SEQ ID NO: 511033 - RNA, 60 nt, Human; identical to SEQ ID NO: 396012

SEQ ID NO: 511034 - RNA, 60 nt, Human; identical to SEQ ID NO: 396013

SEQ ID NO: 511035 - RNA, 60 nt, Human; identical to SEQ ID NO: 396014

SEQ ID NO: 511036 - RNA, 60 nt, Human; identical to SEQ ID NO: 396015

SEQ ID NO: 511037 - RNA, 60 nt, Human; identical to SEQ ID NO: 396016

SEQ ID NO: 511038 - RNA, 60 nt, Human; identical to SEQ ID NO: 396017

SEQ ID NO: 511039 - RNA, 60 nt, Human; identical to SEQ ID NO: 396018

SEQ ID NO: 511040 - RNA, 60 nt, Human; identical to SEQ ID NO: 396019

SEQ ID NO: 511041 - RNA, 60 nt, Human; identical to SEQ ID NO: 396020

SEQ ID NO: 511042 - RNA, 60 nt, Human; identical to SEQ ID NO: 396021

SEQ ID NO: 511043 - RNA, 60 nt, Human; identical to SEQ ID NO: 396022

SEQ ID NO: 511044 - RNA, 60 nt, Human; identical to SEQ ID NO: 396023

SEQ ID NO: 511045 - RNA, 60 nt, Human; identical to SEQ ID NO: 396024

SEQ ID NO: 511046 - RNA, 60 nt, Human; identical to SEQ ID NO: 396025

SEQ ID NO: 511047 - RNA, 60 nt, Human; identical to SEQ ID NO: 396026

SEQ ID NO: 511048 - RNA, 60 nt, Human; identical to SEQ ID NO: 396027

SEQ ID NO: 511049 - RNA, 60 nt, Human; identical to SEQ ID NO: 396028

SEQ ID NO: 511050 - RNA, 60 nt, Human; identical to SEQ ID NO: 396029

SEQ ID NO: 511051 - RNA, 60 nt, Human; identical to SEQ ID NO: 396030

SEQ ID NO: 511052 - RNA, 60 nt, Human; identical to SEQ ID NO: 396031

SEQ ID NO: 511053 - RNA, 60 nt, Human; identical to SEQ ID NO: 396032

SEQ ID NO: 511054 - RNA, 60 nt, Human; identical to SEQ ID NO: 396033

SEQ ID NO: 511055 - RNA, 60 nt, Human; identical to SEQ ID NO: 396034

SEQ ID NO: 511056 - RNA, 60 nt, Human; identical to SEQ ID NO: 396035

SEQ ID NO: 511057 - RNA, 60 nt, Human; identical to SEQ ID NO: 396036

SEQ ID NO: 511058 - RNA, 60 nt, Human; identical to SEQ ID NO: 396037

SEQ ID NO: 511059 - RNA, 60 nt, Human; identical to SEQ ID NO: 396038

SEQ ID NO: 511060 - RNA, 60 nt, Human; identical to SEQ ID NO: 396039

SEQ ID NO: 511061 - RNA, 60 nt, Human; identical to SEQ ID NO: 396040

SEQ ID NO: 511062 - RNA, 60 nt, Human; identical to SEQ ID NO: 396041

SEQ ID NO: 511063 - RNA, 60 nt, Human; identical to SEQ ID NO: 396042

SEQ ID NO: 511064 - RNA, 60 nt, Human; identical to SEQ ID NO: 396043

SEQ ID NO: 511065 - RNA, 60 nt, Human; identical to SEQ ID NO: 396044

SEQ ID NO: 511066 - RNA, 60 nt, Human; identical to SEQ ID NO: 396045

SEQ ID NO: 511067 - RNA, 60 nt, Human; identical to SEQ ID NO: 396046

SEQ ID NO: 511068 - RNA, 60 nt, Human; identical to SEQ ID NO: 396047

SEQ ID NO: 511069 - RNA, 60 nt, Human; identical to SEQ ID NO: 396048

SEQ ID NO: 511070 - RNA, 60 nt, Human; identical to SEQ ID NO: 396049

SEQ ID NO: 511071 - RNA, 60 nt, Human; identical to SEQ ID NO: 396050

SEQ ID NO: 511072 - RNA, 60 nt, Human; identical to SEQ ID NO: 396051

SEQ ID NO: 511073 - RNA, 60 nt, Human; identical to SEQ ID NO: 396052

SEQ ID NO: 511074 - RNA, 60 nt, Human; identical to SEQ ID NO: 396053

SEQ ID NO: 511075 - RNA, 60 nt, Human; identical to SEQ ID NO: 396054

SEQ ID NO: 511076 - RNA, 60 nt, Human; identical to SEQ ID NO: 396055

SEQ ID NO: 511077 - RNA, 60 nt, Human; identical to SEQ ID NO: 396056

SEQ ID NO: 511078 - RNA, 60 nt, Human; identical to SEQ ID NO: 396057

SEQ ID NO: 511079 - RNA, 60 nt, Human; identical to SEQ ID NO: 396058

SEQ ID NO: 511080 - RNA, 60 nt, Human; identical to SEQ ID NO: 396059

SEQ ID NO: 511081 - RNA, 60 nt, Human; identical to SEQ ID NO: 396060

SEQ ID NO: 511082 - RNA, 60 nt, Human; identical to SEQ ID NO: 396061

SEQ ID NO: 511083 - RNA, 60 nt, Human; identical to SEQ ID NO: 396062

SEQ ID NO: 511084 - RNA, 60 nt, Human; identical to SEQ ID NO: 396063

SEQ ID NO: 511085 - RNA, 60 nt, Human; identical to SEQ ID NO: 396064

SEQ ID NO: 511086 - RNA, 60 nt, Human; identical to SEQ ID NO: 396065

SEQ ID NO: 511087 - RNA, 60 nt, Human; identical to SEQ ID NO: 396066

SEQ ID NO: 511088 - RNA, 60 nt, Human; identical to SEQ ID NO: 396067

SEQ ID NO: 511089 - RNA, 60 nt, Human; identical to SEQ ID NO: 396068

SEQ ID NO: 511090 - RNA, 60 nt, Human; identical to SEQ ID NO: 396069

SEQ ID NO: 511091 - RNA, 60 nt, Human; identical to SEQ ID NO: 396070

SEQ ID NO: 511092 - RNA, 60 nt, Human; identical to SEQ ID NO: 396071

SEQ ID NO: 511093 - RNA, 60 nt, Human; identical to SEQ ID NO: 396072

SEQ ID NO: 511094 - RNA, 60 nt, Human; identical to SEQ ID NO: 396073

SEQ ID NO: 511095 - RNA, 60 nt, Human; identical to SEQ ID NO: 396074

SEQ ID NO: 511096 - RNA, 60 nt, Human; identical to SEQ ID NO: 396075

SEQ ID NO: 511097 - RNA, 60 nt, Human; identical to SEQ ID NO: 396076

SEQ ID NO: 511098 - RNA, 60 nt, Human; identical to SEQ ID NO: 396077

SEQ ID NO: 511099 - RNA, 60 nt, Human; identical to SEQ ID NO: 396078

SEQ ID NO: 511100 - RNA, 60 nt, Human; identical to SEQ ID NO: 396079

SEQ ID NO: 511101 - RNA, 60 nt, Human; identical to SEQ ID NO: 396080

SEQ ID NO: 511102 - RNA, 60 nt, Human; identical to SEQ ID NO: 396081

SEQ ID NO: 511103 - RNA, 60 nt, Human; identical to SEQ ID NO: 396082

SEQ ID NO: 511104 - RNA, 60 nt, Human; identical to SEQ ID NO: 396083

SEQ ID NO: 511105 - RNA, 60 nt, Human; identical to SEQ ID NO: 396084

SEQ ID NO: 511106 - RNA, 60 nt, Human; identical to SEQ ID NO: 396085

SEQ ID NO: 511107 - RNA, 60 nt, Human; identical to SEQ ID NO: 396086

SEQ ID NO: 511108 - RNA, 60 nt, Human; identical to SEQ ID NO: 396087

SEQ ID NO: 511109 - RNA, 60 nt, Human; identical to SEQ ID NO: 396088

SEQ ID NO: 511110 - RNA, 60 nt, Human; identical to SEQ ID NO: 396089

SEQ ID NO: 511111 - RNA, 60 nt, Human; identical to SEQ ID NO: 396090

SEQ ID NO: 511112 - RNA, 60 nt, Human; identical to SEQ ID NO: 396091

SEQ ID NO: 511113 - RNA, 60 nt, Human; identical to SEQ ID NO: 396092

SEQ ID NO: 511114 - RNA, 60 nt, Human; identical to SEQ ID NO: 396093

SEQ ID NO: 511115 - RNA, 60 nt, Human; identical to SEQ ID NO: 396094

SEQ ID NO: 511116 - RNA, 60 nt, Human; identical to SEQ ID NO: 396095

SEQ ID NO: 511117 - RNA, 60 nt, Human; identical to SEQ ID NO: 396096

SEQ ID NO: 511118 - RNA, 60 nt, Human; identical to SEQ ID NO: 396097

SEQ ID NO: 511119 - RNA, 60 nt, Human; identical to SEQ ID NO: 396098

SEQ ID NO: 511120 - RNA, 60 nt, Human; identical to SEQ ID NO: 396099

SEQ ID NO: 511121 - RNA, 60 nt, Human; identical to SEQ ID NO: 396100

SEQ ID NO: 511122 - RNA, 60 nt, Human; identical to SEQ ID NO: 396101

SEQ ID NO: 511123 - RNA, 60 nt, Human; identical to SEQ ID NO: 396102

SEQ ID NO: 511124 - RNA, 60 nt, Human; identical to SEQ ID NO: 396103

SEQ ID NO: 511125 - RNA, 60 nt, Human; identical to SEQ ID NO: 396104

SEQ ID NO: 511126 - RNA, 60 nt, Human; identical to SEQ ID NO: 396105

SEQ ID NO: 511127 - RNA, 51 nt, Human; identical to SEQ ID NO: 396106

SEQ ID NO: 511128 - RNA, 60 nt, Human; identical to SEQ ID NO: 396107

SEQ ID NO: 511129 - RNA, 60 nt, Human; identical to SEQ ID NO: 396108

SEQ ID NO: 511130 - RNA, 60 nt, Human; identical to SEQ ID NO: 396109

SEQ ID NO: 511131 - RNA, 60 nt, Human; identical to SEQ ID NO: 396110

SEQ ID NO: 511132 - RNA, 60 nt, Human; identical to SEQ ID NO: 396111

SEQ ID NO: 511133 - RNA, 60 nt, Human; identical to SEQ ID NO: 396112

SEQ ID NO: 511134 - RNA, 60 nt, Human; identical to SEQ ID NO: 396113

SEQ ID NO: 511135 - RNA, 60 nt, Human; identical to SEQ ID NO: 396114

SEQ ID NO: 511136 - RNA, 60 nt, Human; identical to SEQ ID NO: 396115

SEQ ID NO: 511137 - RNA, 60 nt, Human; identical to SEQ ID NO: 396116

SEQ ID NO: 511138 - RNA, 60 nt, Human; identical to SEQ ID NO: 396117

SEQ ID NO: 511139 - RNA, 60 nt, Human; identical to SEQ ID NO: 396118

SEQ ID NO: 511140 - RNA, 60 nt, Human; identical to SEQ ID NO: 396119

SEQ ID NO: 511141 - RNA, 60 nt, Human; identical to SEQ ID NO: 396120

SEQ ID NO: 511142 - RNA, 60 nt, Human; identical to SEQ ID NO: 396121

SEQ ID NO: 511143 - RNA, 60 nt, Human; identical to SEQ ID NO: 396122

SEQ ID NO: 511144 - RNA, 60 nt, Human; identical to SEQ ID NO: 396123

SEQ ID NO: 511145 - RNA, 60 nt, Human; identical to SEQ ID NO: 396124

SEQ ID NO: 511146 - RNA, 60 nt, Human; identical to SEQ ID NO: 396125

SEQ ID NO: 511147 - RNA, 60 nt, Human; identical to SEQ ID NO: 396126

SEQ ID NO: 511148 - RNA, 60 nt, Human; identical to SEQ ID NO: 396127

SEQ ID NO: 511149 - RNA, 60 nt, Human; identical to SEQ ID NO: 396128

SEQ ID NO: 511150 - RNA, 60 nt, Human; identical to SEQ ID NO: 396129

SEQ ID NO: 511151 - RNA, 60 nt, Human; identical to SEQ ID NO: 396130

SEQ ID NO: 511152 - RNA, 60 nt, Human; identical to SEQ ID NO: 396131

SEQ ID NO: 511153 - RNA, 60 nt, Human; identical to SEQ ID NO: 396132

SEQ ID NO: 511154 - RNA, 60 nt, Human; identical to SEQ ID NO: 396133

SEQ ID NO: 511155 - RNA, 60 nt, Human; identical to SEQ ID NO: 396134

SEQ ID NO: 511156 - RNA, 60 nt, Human; identical to SEQ ID NO: 396135

SEQ ID NO: 511157 - RNA, 60 nt, Human; identical to SEQ ID NO: 396136

SEQ ID NO: 511158 - RNA, 60 nt, Human; identical to SEQ ID NO: 396137

SEQ ID NO: 511159 - RNA, 60 nt, Human; identical to SEQ ID NO: 396138

SEQ ID NO: 511160 - RNA, 60 nt, Human; identical to SEQ ID NO: 396139

SEQ ID NO: 511161 - RNA, 60 nt, Human; identical to SEQ ID NO: 396140

SEQ ID NO: 511162 - RNA, 60 nt, Human; identical to SEQ ID NO: 396141

SEQ ID NO: 511163 - RNA, 60 nt, Human; identical to SEQ ID NO: 396142

SEQ ID NO: 511164 - RNA, 60 nt, Human; identical to SEQ ID NO: 396143

SEQ ID NO: 511165 - RNA, 60 nt, Human; identical to SEQ ID NO: 396144

SEQ ID NO: 511166 - RNA, 60 nt, Human; identical to SEQ ID NO: 396145

SEQ ID NO: 511167 - RNA, 60 nt, Human; identical to SEQ ID NO: 396146

SEQ ID NO: 511168 - RNA, 60 nt, Human; identical to SEQ ID NO: 396147

SEQ ID NO: 511169 - RNA, 60 nt, Human; identical to SEQ ID NO: 396148

SEQ ID NO: 511170 - RNA, 60 nt, Human; identical to SEQ ID NO: 396149

SEQ ID NO: 511171 - RNA, 60 nt, Human; identical to SEQ ID NO: 396150

SEQ ID NO: 511172 - RNA, 60 nt, Human; identical to SEQ ID NO: 396151

SEQ ID NO: 511173 - RNA, 60 nt, Human; identical to SEQ ID NO: 396152

SEQ ID NO: 511174 - RNA, 60 nt, Human; identical to SEQ ID NO: 396153

SEQ ID NO: 511175 - RNA, 60 nt, Human; identical to SEQ ID NO: 396154

SEQ ID NO: 511176 - RNA, 60 nt, Human; identical to SEQ ID NO: 396155

SEQ ID NO: 511177 - RNA, 60 nt, Human; identical to SEQ ID NO: 396156

SEQ ID NO: 511178 - RNA, 60 nt, Human; identical to SEQ ID NO: 396157

SEQ ID NO: 511179 - RNA, 60 nt, Human; identical to SEQ ID NO: 396158

SEQ ID NO: 511180 - RNA, 60 nt, Human; identical to SEQ ID NO: 396159

SEQ ID NO: 511181 - RNA, 60 nt, Human; identical to SEQ ID NO: 396160

SEQ ID NO: 511182 - RNA, 60 nt, Human; identical to SEQ ID NO: 396161

SEQ ID NO: 511183 - RNA, 60 nt, Human; identical to SEQ ID NO: 396162

SEQ ID NO: 511184 - RNA, 60 nt, Human; identical to SEQ ID NO: 396163

SEQ ID NO: 511185 - RNA, 60 nt, Human; identical to SEQ ID NO: 396164

SEQ ID NO: 511186 - RNA, 60 nt, Human; identical to SEQ ID NO: 396165

SEQ ID NO: 511187 - RNA, 60 nt, Human; identical to SEQ ID NO: 396166

SEQ ID NO: 511188 - RNA, 60 nt, Human; identical to SEQ ID NO: 396167

SEQ ID NO: 511189 - RNA, 60 nt, Human; identical to SEQ ID NO: 396168

SEQ ID NO: 511190 - RNA, 60 nt, Human; identical to SEQ ID NO: 396169

SEQ ID NO: 511191 - RNA, 60 nt, Human; identical to SEQ ID NO: 396170

SEQ ID NO: 511192 - RNA, 60 nt, Human; identical to SEQ ID NO: 396171

SEQ ID NO: 511193 - RNA, 60 nt, Human; identical to SEQ ID NO: 396172

SEQ ID NO: 511194 - RNA, 60 nt, Human; identical to SEQ ID NO: 396173

SEQ ID NO: 511195 - RNA, 60 nt, Human; identical to SEQ ID NO: 396174

SEQ ID NO: 511196 - RNA, 60 nt, Human; identical to SEQ ID NO: 396175

SEQ ID NO: 511197 - RNA, 60 nt, Human; identical to SEQ ID NO: 396176

SEQ ID NO: 511198 - RNA, 60 nt, Human; identical to SEQ ID NO: 396177

SEQ ID NO: 511199 - RNA, 60 nt, Human; identical to SEQ ID NO: 396178

SEQ ID NO: 511200 - RNA, 60 nt, Human; identical to SEQ ID NO: 396179

SEQ ID NO: 511201 - RNA, 60 nt, Human; identical to SEQ ID NO: 396180

SEQ ID NO: 511202 - RNA, 60 nt, Human; identical to SEQ ID NO: 396181

SEQ ID NO: 511203 - RNA, 60 nt, Human; identical to SEQ ID NO: 396182

SEQ ID NO: 511204 - RNA, 60 nt, Human; identical to SEQ ID NO: 396183

SEQ ID NO: 511205 - RNA, 60 nt, Human; identical to SEQ ID NO: 396184

SEQ ID NO: 511206 - RNA, 60 nt, Human; identical to SEQ ID NO: 396185

SEQ ID NO: 511207 - RNA, 60 nt, Human; identical to SEQ ID NO: 396186

SEQ ID NO: 511208 - RNA, 60 nt, Human; identical to SEQ ID NO: 396187

SEQ ID NO: 511209 - RNA, 60 nt, Human; identical to SEQ ID NO: 396188

SEQ ID NO: 511210 - RNA, 60 nt, Human; identical to SEQ ID NO: 396189

SEQ ID NO: 511211 - RNA, 60 nt, Human; identical to SEQ ID NO: 396190

SEQ ID NO: 511212 - RNA, 60 nt, Human; identical to SEQ ID NO: 396191

SEQ ID NO: 511213 - RNA, 60 nt, Human; identical to SEQ ID NO: 396192

SEQ ID NO: 511214 - RNA, 60 nt, Human; identical to SEQ ID NO: 396193

SEQ ID NO: 511215 - RNA, 60 nt, Human; identical to SEQ ID NO: 396194

SEQ ID NO: 511216 - RNA, 60 nt, Human; identical to SEQ ID NO: 396195

SEQ ID NO: 511217 - RNA, 60 nt, Human; identical to SEQ ID NO: 396196

SEQ ID NO: 511218 - RNA, 60 nt, Human; identical to SEQ ID NO: 396197

SEQ ID NO: 511219 - RNA, 60 nt, Human; identical to SEQ ID NO: 396198

SEQ ID NO: 511220 - RNA, 60 nt, Human; identical to SEQ ID NO: 396199

SEQ ID NO: 511221 - RNA, 60 nt, Human; identical to SEQ ID NO: 396200

SEQ ID NO: 511222 - RNA, 60 nt, Human; identical to SEQ ID NO: 396201

SEQ ID NO: 511223 - RNA, 60 nt, Human; identical to SEQ ID NO: 396202

SEQ ID NO: 511224 - RNA, 60 nt, Human; identical to SEQ ID NO: 396203

SEQ ID NO: 511225 - RNA, 60 nt, Human; identical to SEQ ID NO: 396204

SEQ ID NO: 511226 - RNA, 60 nt, Human; identical to SEQ ID NO: 396205

SEQ ID NO: 511227 - RNA, 60 nt, Human; identical to SEQ ID NO: 396206

SEQ ID NO: 511228 - RNA, 60 nt, Human; identical to SEQ ID NO: 396207

SEQ ID NO: 511229 - RNA, 60 nt, Human; identical to SEQ ID NO: 396208

SEQ ID NO: 511230 - RNA, 60 nt, Human; identical to SEQ ID NO: 396209

SEQ ID NO: 511231 - RNA, 60 nt, Human; identical to SEQ ID NO: 396210

SEQ ID NO: 511232 - RNA, 60 nt, Human; identical to SEQ ID NO: 396211

SEQ ID NO: 511233 - RNA, 60 nt, Human; identical to SEQ ID NO: 396212

SEQ ID NO: 511234 - RNA, 60 nt, Human; identical to SEQ ID NO: 396213

SEQ ID NO: 511235 - RNA, 60 nt, Human; identical to SEQ ID NO: 396214

SEQ ID NO: 511236 - RNA, 60 nt, Human; identical to SEQ ID NO: 396215

SEQ ID NO: 511237 - RNA, 60 nt, Human; identical to SEQ ID NO: 396216

SEQ ID NO: 511238 - RNA, 60 nt, Human; identical to SEQ ID NO: 396217

SEQ ID NO: 511239 - RNA, 60 nt, Human; identical to SEQ ID NO: 396218

SEQ ID NO: 511240 - RNA, 60 nt, Human; identical to SEQ ID NO: 396219

SEQ ID NO: 511241 - RNA, 60 nt, Human; identical to SEQ ID NO: 396220

SEQ ID NO: 511242 - RNA, 60 nt, Human; identical to SEQ ID NO: 396221

SEQ ID NO: 511243 - RNA, 60 nt, Human; identical to SEQ ID NO: 396222

SEQ ID NO: 511244 - RNA, 60 nt, Human; identical to SEQ ID NO: 396223

SEQ ID NO: 511245 - RNA, 60 nt, Human; identical to SEQ ID NO: 396224

SEQ ID NO: 511246 - RNA, 60 nt, Human; identical to SEQ ID NO: 396225

SEQ ID NO: 511247 - RNA, 60 nt, Human; identical to SEQ ID NO: 396226

SEQ ID NO: 511248 - RNA, 60 nt, Human; identical to SEQ ID NO: 396227

SEQ ID NO: 511249 - RNA, 59 nt, Human; identical to SEQ ID NO: 396228

SEQ ID NO: 511250 - RNA, 60 nt, Human; identical to SEQ ID NO: 396229

SEQ ID NO: 511251 - RNA, 60 nt, Human; identical to SEQ ID NO: 396230

SEQ ID NO: 511252 - RNA, 60 nt, Human; identical to SEQ ID NO: 396231

SEQ ID NO: 511253 - RNA, 60 nt, Human; identical to SEQ ID NO: 396232

SEQ ID NO: 511254 - RNA, 60 nt, Human; identical to SEQ ID NO: 396233

SEQ ID NO: 511255 - RNA, 60 nt, Human; identical to SEQ ID NO: 396234

SEQ ID NO: 511256 - RNA, 60 nt, Human; identical to SEQ ID NO: 396235

SEQ ID NO: 511257 - RNA, 60 nt, Human; identical to SEQ ID NO: 396236

SEQ ID NO: 511258 - RNA, 60 nt, Human; identical to SEQ ID NO: 396237

SEQ ID NO: 511259 - RNA, 60 nt, Human; identical to SEQ ID NO: 396238

SEQ ID NO: 511260 - RNA, 60 nt, Human; identical to SEQ ID NO: 396239

SEQ ID NO: 511261 - RNA, 60 nt, Human; identical to SEQ ID NO: 396240

SEQ ID NO: 511262 - RNA, 60 nt, Human; identical to SEQ ID NO: 396241

SEQ ID NO: 511263 - RNA, 60 nt, Human; identical to SEQ ID NO: 396242

SEQ ID NO: 511264 - RNA, 60 nt, Human; identical to SEQ ID NO: 396243

SEQ ID NO: 511265 - RNA, 60 nt, Human; identical to SEQ ID NO: 396244

SEQ ID NO: 511266 - RNA, 60 nt, Human; identical to SEQ ID NO: 396245

SEQ ID NO: 511267 - RNA, 60 nt, Human; identical to SEQ ID NO: 396246

SEQ ID NO: 511268 - RNA, 60 nt, Human; identical to SEQ ID NO: 396247

SEQ ID NO: 511269 - RNA, 60 nt, Human; identical to SEQ ID NO: 396248

SEQ ID NO: 511270 - RNA, 60 nt, Human; identical to SEQ ID NO: 396249

SEQ ID NO: 511271 - RNA, 60 nt, Human; identical to SEQ ID NO: 396250

SEQ ID NO: 511272 - RNA, 60 nt, Human; identical to SEQ ID NO: 396251

SEQ ID NO: 511273 - RNA, 60 nt, Human; identical to SEQ ID NO: 396252

SEQ ID NO: 511274 - RNA, 60 nt, Human; identical to SEQ ID NO: 396253

SEQ ID NO: 511275 - RNA, 60 nt, Human; identical to SEQ ID NO: 396254

SEQ ID NO: 511276 - RNA, 60 nt, Human; identical to SEQ ID NO: 396255

SEQ ID NO: 511277 - RNA, 60 nt, Human; identical to SEQ ID NO: 396256

SEQ ID NO: 511278 - RNA, 60 nt, Human; identical to SEQ ID NO: 396257

SEQ ID NO: 511279 - RNA, 60 nt, Human; identical to SEQ ID NO: 396258

SEQ ID NO: 511280 - RNA, 60 nt, Human; identical to SEQ ID NO: 396259

SEQ ID NO: 511281 - RNA, 60 nt, Human; identical to SEQ ID NO: 396260

SEQ ID NO: 511282 - RNA, 60 nt, Human; identical to SEQ ID NO: 396261

SEQ ID NO: 511283 - RNA, 60 nt, Human; identical to SEQ ID NO: 396262

SEQ ID NO: 511284 - RNA, 60 nt, Human; identical to SEQ ID NO: 396263

SEQ ID NO: 511285 - RNA, 60 nt, Human; identical to SEQ ID NO: 396264

SEQ ID NO: 511286 - RNA, 60 nt, Human; identical to SEQ ID NO: 396265

SEQ ID NO: 511287 - RNA, 60 nt, Human; identical to SEQ ID NO: 396266

SEQ ID NO: 511288 - RNA, 60 nt, Human; identical to SEQ ID NO: 396267

SEQ ID NO: 511289 - RNA, 60 nt, Human; identical to SEQ ID NO: 396268

SEQ ID NO: 511290 - RNA, 60 nt, Human; identical to SEQ ID NO: 396269

SEQ ID NO: 511291 - RNA, 60 nt, Human; identical to SEQ ID NO: 396270

SEQ ID NO: 511292 - RNA, 60 nt, Human; identical to SEQ ID NO: 396271

SEQ ID NO: 511293 - RNA, 60 nt, Human; identical to SEQ ID NO: 396272

SEQ ID NO: 511294 - RNA, 60 nt, Human; identical to SEQ ID NO: 396273

SEQ ID NO: 511295 - RNA, 60 nt, Human; identical to SEQ ID NO: 396274

SEQ ID NO: 511296 - RNA, 64 nt, Human; identical to SEQ ID NO: 314187

SEQ ID NO: 511297 - RNA, 64 nt, Human; identical to SEQ ID NO: 314188

SEQ ID NO: 511298 - RNA, 64 nt, Human; identical to SEQ ID NO: 314237

SEQ ID NO: 511299 - RNA, 64 nt, Human; identical to SEQ ID NO: 314238

SEQ ID NO: 511300 - RNA, 64 nt, Human; identical to SEQ ID NO: 313194

SEQ ID NO: 511301 - RNA, 64 nt, Human; identical to SEQ ID NO: 314220

SEQ ID NO: 511302 - RNA, 56 nt, Human; identical to SEQ ID NO: 313978

SEQ ID NO: 511303 - RNA, 53 nt, Human; identical to SEQ ID NO: 314343

SEQ ID NO: 511304 - RNA, 53 nt, Human; identical to SEQ ID NO: 314400

SEQ ID NO: 511305 - RNA, 64 nt, Human; identical to SEQ ID NO: 314221

SEQ ID NO: 511306 - RNA, 64 nt, Human; identical to SEQ ID NO: 314222

SEQ ID NO: 511307 - RNA, 64 nt, Human; identical to SEQ ID NO: 313997

SEQ ID NO: 511308 - RNA, 64 nt, Human; identical to SEQ ID NO: 313195

SEQ ID NO: 511309 - RNA, 64 nt, Human; identical to SEQ ID NO: 314256

SEQ ID NO: 511310 - RNA, 64 nt, Human; identical to SEQ ID NO: 314271

SEQ ID NO: 511311 - RNA, 64 nt, Human; identical to SEQ ID NO: 314272

SEQ ID NO: 511312 - RNA, 64 nt, Human; identical to SEQ ID NO: 313196

SEQ ID NO: 511313 - RNA, 64 nt, Human; identical to SEQ ID NO: 314273

SEQ ID NO: 511314 - RNA, 64 nt, Human; identical to SEQ ID NO: 314118

SEQ ID NO: 511315 - RNA, 64 nt, Human; identical to SEQ ID NO: 314119

SEQ ID NO: 511316 - RNA, 64 nt, Human; identical to SEQ ID NO: 313212

SEQ ID NO: 511317 - RNA, 64 nt, Human; identical to SEQ ID NO: 314319

SEQ ID NO: 511318 - RNA, 64 nt, Human; identical to SEQ ID NO: 314320

SEQ ID NO: 511319 - RNA, 64 nt, Human; identical to SEQ ID NO: 314321

SEQ ID NO: 511320 - RNA, 64 nt, Human; identical to SEQ ID NO: 314029

SEQ ID NO: 511321 - RNA, 64 nt, Human; identical to SEQ ID NO: 58979

SEQ ID NO: 511322 - RNA, 64 nt, Human; identical to SEQ ID NO: 58980

SEQ ID NO: 511323 - RNA, 64 nt, Human; identical to SEQ ID NO: 58981

SEQ ID NO: 511324 - RNA, 64 nt, Human; identical to SEQ ID NO: 58983

SEQ ID NO: 511325 - RNA, 64 nt, Human; identical to SEQ ID NO: 314030

SEQ ID NO: 511326 - RNA, 64 nt, Human; identical to SEQ ID NO: 313213

SEQ ID NO: 511327 - RNA, 64 nt, Human; identical to SEQ ID NO: 313214

SEQ ID NO: 511328 - RNA, 64 nt, Human; identical to SEQ ID NO: 314031

SEQ ID NO: 511329 - RNA, 64 nt, Human; identical to SEQ ID NO: 313945

SEQ ID NO: 511330 - RNA, 64 nt, Human; identical to SEQ ID NO: 313960

SEQ ID NO: 511331 - RNA, 64 nt, Human; identical to SEQ ID NO: 313961

SEQ ID NO: 511332 - RNA, 64 nt, Human; identical to SEQ ID NO: 313962

SEQ ID NO: 511333 - RNA, 64 nt, Human; identical to SEQ ID NO: 313963

SEQ ID NO: 511334 - RNA, 64 nt, Human; identical to SEQ ID NO: 313979

SEQ ID NO: 511335 - RNA, 64 nt, Human; identical to SEQ ID NO: 313980

SEQ ID NO: 511336 - RNA, 64 nt, Human; identical to SEQ ID NO: 314012

SEQ ID NO: 511337 - RNA, 64 nt, Human; identical to SEQ ID NO: 314013

SEQ ID NO: 511338 - RNA, 64 nt, Human; identical to SEQ ID NO: 314014

SEQ ID NO: 511339 - RNA, 64 nt, Human; identical to SEQ ID NO: 314120

SEQ ID NO: 511340 - RNA, 64 nt, Human; identical to SEQ ID NO: 314203

SEQ ID NO: 511341 - RNA, 64 nt, Human; identical to SEQ ID NO: 58984

SEQ ID NO: 511342 - RNA, 64 nt, Human; identical to SEQ ID NO: 59005

SEQ ID NO: 511343 - RNA, 64 nt, Human; identical to SEQ ID NO: 59006

SEQ ID NO: 511344 - RNA, 64 nt, Human; identical to SEQ ID NO: 59007

SEQ ID NO: 511345 - RNA, 64 nt, Human; identical to SEQ ID NO: 314204

SEQ ID NO: 511346 - RNA, 64 nt, Human; identical to SEQ ID NO: 314205

SEQ ID NO: 511347 - RNA, 64 nt, Human; identical to SEQ ID NO: 314342

SEQ ID NO: 511348 - RNA, 64 nt, Human; identical to SEQ ID NO: 314344

SEQ ID NO: 511349 - RNA, 64 nt, Human; identical to SEQ ID NO: 314345

SEQ ID NO: 511350 - RNA, 64 nt, Human; identical to SEQ ID NO: 314346

SEQ ID NO: 511351 - RNA, 64 nt, Human; identical to SEQ ID NO: 314347

SEQ ID NO: 511352 - RNA, 64 nt, Human; identical to SEQ ID NO: 314348

SEQ ID NO: 511353 - RNA, 64 nt, Human; identical to SEQ ID NO: 314349

SEQ ID NO: 511354 - RNA, 64 nt, Human; identical to SEQ ID NO: 314350

SEQ ID NO: 511355 - RNA, 64 nt, Human; identical to SEQ ID NO: 314351

SEQ ID NO: 511356 - RNA, 64 nt, Human; identical to SEQ ID NO: 314352

SEQ ID NO: 511357 - RNA, 64 nt, Human; identical to SEQ ID NO: 314353

SEQ ID NO: 511358 - RNA, 64 nt, Human; identical to SEQ ID NO: 314354

SEQ ID NO: 511359 - RNA, 64 nt, Human; identical to SEQ ID NO: 314355

SEQ ID NO: 511360 - RNA, 64 nt, Human; identical to SEQ ID NO: 314356

SEQ ID NO: 511361 - RNA, 64 nt, Human; identical to SEQ ID NO: 59008

SEQ ID NO: 511362 - RNA, 64 nt, Human; identical to SEQ ID NO: 59009

SEQ ID NO: 511363 - RNA, 64 nt, Human; identical to SEQ ID NO: 59010

SEQ ID NO: 511364 - RNA, 64 nt, Human; identical to SEQ ID NO: 59011

SEQ ID NO: 511365 - RNA, 64 nt, Human; identical to SEQ ID NO: 314357

SEQ ID NO: 511366 - RNA, 64 nt, Human; identical to SEQ ID NO: 314358

SEQ ID NO: 511367 - RNA, 64 nt, Human; identical to SEQ ID NO: 314359

SEQ ID NO: 511368 - RNA, 64 nt, Human; identical to SEQ ID NO: 314360

SEQ ID NO: 511369 - RNA, 64 nt, Human; identical to SEQ ID NO: 314361

SEQ ID NO: 511370 - RNA, 64 nt, Human; identical to SEQ ID NO: 314362

SEQ ID NO: 511371 - RNA, 64 nt, Human; identical to SEQ ID NO: 314363

SEQ ID NO: 511372 - RNA, 64 nt, Human; identical to SEQ ID NO: 314364

SEQ ID NO: 511373 - RNA, 64 nt, Human; identical to SEQ ID NO: 314365

SEQ ID NO: 511374 - RNA, 64 nt, Human; identical to SEQ ID NO: 314366

SEQ ID NO: 511375 - RNA, 64 nt, Human; identical to SEQ ID NO: 314367

SEQ ID NO: 511376 - RNA, 64 nt, Human; identical to SEQ ID NO: 314368

SEQ ID NO: 511377 - RNA, 64 nt, Human; identical to SEQ ID NO: 314369

SEQ ID NO: 511378 - RNA, 64 nt, Human; identical to SEQ ID NO: 314370

SEQ ID NO: 511379 - RNA, 64 nt, Human; identical to SEQ ID NO: 314371

SEQ ID NO: 511380 - RNA, 64 nt, Human; identical to SEQ ID NO: 314372

SEQ ID NO: 511381 - RNA, 64 nt, Human; identical to SEQ ID NO: 59012

SEQ ID NO: 511382 - RNA, 64 nt, Human; identical to SEQ ID NO: 59013

SEQ ID NO: 511383 - RNA, 64 nt, Human; identical to SEQ ID NO: 59014

SEQ ID NO: 511384 - RNA, 64 nt, Human; identical to SEQ ID NO: 59015

SEQ ID NO: 511385 - RNA, 64 nt, Human; identical to SEQ ID NO: 314373

SEQ ID NO: 511386 - RNA, 64 nt, Human; identical to SEQ ID NO: 314374

SEQ ID NO: 511387 - RNA, 64 nt, Human; identical to SEQ ID NO: 314375

SEQ ID NO: 511388 - RNA, 64 nt, Human; identical to SEQ ID NO: 314376

SEQ ID NO: 511389 - RNA, 58 nt, Human; identical to SEQ ID NO: 314377

SEQ ID NO: 511390 - RNA, 64 nt, Human; identical to SEQ ID NO: 314378

SEQ ID NO: 511391 - RNA, 64 nt, Human; identical to SEQ ID NO: 314379

SEQ ID NO: 511392 - RNA, 64 nt, Human; identical to SEQ ID NO: 314380

SEQ ID NO: 511393 - RNA, 64 nt, Human; identical to SEQ ID NO: 314381

SEQ ID NO: 511394 - RNA, 64 nt, Human; identical to SEQ ID NO: 314382

SEQ ID NO: 511395 - RNA, 64 nt, Human; identical to SEQ ID NO: 314383

SEQ ID NO: 511396 - RNA, 64 nt, Human; identical to SEQ ID NO: 314384

SEQ ID NO: 511397 - RNA, 64 nt, Human; identical to SEQ ID NO: 314385

SEQ ID NO: 511398 - RNA, 64 nt, Human; identical to SEQ ID NO: 314386

SEQ ID NO: 511399 - RNA, 64 nt, Human; identical to SEQ ID NO: 314387

SEQ ID NO: 511400 - RNA, 64 nt, Human; identical to SEQ ID NO: 314388

SEQ ID NO: 511401 - RNA, 64 nt, Human; identical to SEQ ID NO: 59016

SEQ ID NO: 511402 - RNA, 64 nt, Human; identical to SEQ ID NO: 59017

SEQ ID NO: 511403 - RNA, 64 nt, Human; identical to SEQ ID NO: 59018

SEQ ID NO: 511404 - RNA, 64 nt, Human; identical to SEQ ID NO: 59019

SEQ ID NO: 511405 - RNA, 64 nt, Human; identical to SEQ ID NO: 314389

SEQ ID NO: 511406 - RNA, 64 nt, Human; identical to SEQ ID NO: 314390

SEQ ID NO: 511407 - RNA, 64 nt, Human; identical to SEQ ID NO: 314391

SEQ ID NO: 511408 - RNA, 64 nt, Human; identical to SEQ ID NO: 314392

SEQ ID NO: 511409 - RNA, 64 nt, Human; identical to SEQ ID NO: 314393

SEQ ID NO: 511410 - RNA, 64 nt, Human; identical to SEQ ID NO: 314394

SEQ ID NO: 511411 - RNA, 64 nt, Human; identical to SEQ ID NO: 314395

SEQ ID NO: 511412 - RNA, 64 nt, Human; identical to SEQ ID NO: 314396

SEQ ID NO: 511413 - RNA, 64 nt, Human; identical to SEQ ID NO: 314397

SEQ ID NO: 511414 - RNA, 64 nt, Human; identical to SEQ ID NO: 314398

SEQ ID NO: 511415 - RNA, 64 nt, Human; identical to SEQ ID NO: 314399

SEQ ID NO: 511416 - RNA, 64 nt, Human; identical to SEQ ID NO: 314401

SEQ ID NO: 511417 - RNA, 64 nt, Human; identical to SEQ ID NO: 314402

SEQ ID NO: 511418 - RNA, 64 nt, Human; identical to SEQ ID NO: 314403

SEQ ID NO: 511419 - RNA, 64 nt, Human; identical to SEQ ID NO: 314404

SEQ ID NO: 511420 - RNA, 64 nt, Human; identical to SEQ ID NO: 314405

SEQ ID NO: 511421 - RNA, 64 nt, Human
cccagacccugcaguuugagaucugaugcuuccugagggccaaggcauugcuguaagaaaaggu

SEQ ID NO: 511422 - RNA, 64 nt, Human
gguggucucauaauuccauuuguggagagaacaggagggccagauagauagguccuagcagaag

SEQ ID NO: 511423 - RNA, 64 nt, Human
aaauaaaugcgaacaugcauacauaaauguggcugagggccacuuuugccaucacugugcucca

SEQ ID NO: 511424 - RNA, 64 nt, Human; identical to SEQ ID NO: 314406

SEQ ID NO: 511425 - RNA, 64 nt, Human; identical to SEQ ID NO: 314407

SEQ ID NO: 511426 - RNA, 64 nt, Human; identical to SEQ ID NO: 314408

SEQ ID NO: 511427 - RNA, 64 nt, Human; identical to SEQ ID NO: 314409

SEQ ID NO: 511428 - RNA, 64 nt, Human; identical to SEQ ID NO: 314410

SEQ ID NO: 511429 - RNA, 64 nt, Human; identical to SEQ ID NO: 314411

SEQ ID NO: 511430 - RNA, 64 nt, Human; identical to SEQ ID NO: 314412

SEQ ID NO: 511431 - RNA, 64 nt, Human; identical to SEQ ID NO: 314413

SEQ ID NO: 511432 - RNA, 64 nt, Human; identical to SEQ ID NO: 314414

SEQ ID NO: 511433 - RNA, 64 nt, Human; identical to SEQ ID NO: 314415

SEQ ID NO: 511434 - RNA, 64 nt, Human; identical to SEQ ID NO: 314416

SEQ ID NO: 511435 - RNA, 64 nt, Human; identical to SEQ ID NO: 314417

SEQ ID NO: 511436 - RNA, 64 nt, Human; identical to SEQ ID NO: 314418

SEQ ID NO: 511437 - RNA, 64 nt, Human; identical to SEQ ID NO: 314419

SEQ ID NO: 511438 - RNA, 64 nt, Human; identical to SEQ ID NO: 314420

SEQ ID NO: 511439 - RNA, 64 nt, Human; identical to SEQ ID NO: 314421

SEQ ID NO: 511440 - RNA, 64 nt, Human; identical to SEQ ID NO: 58997

SEQ ID NO: 511441 - RNA, 64 nt, Human; identical to SEQ ID NO: 58998

SEQ ID NO: 511442 - RNA, 64 nt, Human; identical to SEQ ID NO: 58999

SEQ ID NO: 511443 - RNA, 64 nt, Human; identical to SEQ ID NO: 59000

SEQ ID NO: 511444 - RNA, 64 nt, Human; identical to SEQ ID NO: 314422

SEQ ID NO: 511445 - RNA, 64 nt, Human; identical to SEQ ID NO: 314423

SEQ ID NO: 511446 - RNA, 64 nt, Human; identical to SEQ ID NO: 314424

SEQ ID NO: 511447 - RNA, 64 nt, Human; identical to SEQ ID NO: 314425

SEQ ID NO: 511448 - RNA, 64 nt, Human; identical to SEQ ID NO: 314426

SEQ ID NO: 511449 - RNA, 64 nt, Human; identical to SEQ ID NO: 314427

SEQ ID NO: 511450 - RNA, 64 nt, Human; identical to SEQ ID NO: 314428

SEQ ID NO: 511451 - RNA, 64 nt, Human; identical to SEQ ID NO: 314429

SEQ ID NO: 511452 - RNA, 64 nt, Human; identical to SEQ ID NO: 314430

SEQ ID NO: 511453 - RNA, 64 nt, Human; identical to SEQ ID NO: 314431

SEQ ID NO: 511454 - RNA, 64 nt, Human; identical to SEQ ID NO: 314432

SEQ ID NO: 511455 - RNA, 64 nt, Human; identical to SEQ ID NO: 314433

SEQ ID NO: 511456 - RNA, 64 nt, Human; identical to SEQ ID NO: 314434

SEQ ID NO: 511457 - RNA, 64 nt, Human; identical to SEQ ID NO: 314435

SEQ ID NO: 511458 - RNA, 64 nt, Human; identical to SEQ ID NO: 314436

SEQ ID NO: 511459 - RNA, 64 nt, Human; identical to SEQ ID NO: 314437

SEQ ID NO: 511460 - RNA, 64 nt, Human
gguugaauuuguggauguggaacccauggauacagagggccaacuguauuuaggauaauuucau

SEQ ID NO: 511461 - RNA, 64 nt, Human
cggcaccaucugcccagcuccaaggacccuuggugagggccagccugccuucugcaugagagga

SEQ ID NO: 511462 - RNA, 64 nt, Human
cugugauaaugugaaaugagaaguauuuacauuggagggccaauggcugguccuucaagugcug

SEQ ID NO: 511463 - RNA, 64 nt, Human; identical to SEQ ID NO: 314453

SEQ ID NO: 511464 - RNA, 64 nt, Human; identical to SEQ ID NO: 141407

SEQ ID NO: 511465 - RNA, 64 nt, Human; identical to SEQ ID NO: 141408

SEQ ID NO: 511466 - RNA, 64 nt, Human; identical to SEQ ID NO: 141409

SEQ ID NO: 511467 - RNA, 64 nt, Human; identical to SEQ ID NO: 141410

SEQ ID NO: 511468 - RNA, 64 nt, Human; identical to SEQ ID NO: 141411

SEQ ID NO: 511469 - RNA, 64 nt, Human; identical to SEQ ID NO: 141412

SEQ ID NO: 511470 - RNA, 64 nt, Human; identical to SEQ ID NO: 141413

SEQ ID NO: 511471 - RNA, 64 nt, Human; identical to SEQ ID NO: 141414

SEQ ID NO: 511472 - RNA, 64 nt, Human; identical to SEQ ID NO: 141415

SEQ ID NO: 511473 - RNA, 64 nt, Human; identical to SEQ ID NO: 141416

SEQ ID NO: 511474 - RNA, 64 nt, Human; identical to SEQ ID NO: 141417

SEQ ID NO: 511475 - RNA, 64 nt, Human; identical to SEQ ID NO: 141418

SEQ ID NO: 511476 - RNA, 64 nt, Human; identical to SEQ ID NO: 141419

SEQ ID NO: 511477 - RNA, 64 nt, Human; identical to SEQ ID NO: 141420

SEQ ID NO: 511478 - RNA, 64 nt, Human; identical to SEQ ID NO: 141421

SEQ ID NO: 511479 - RNA, 64 nt, Human
ccagcuccugcaccacggacacagaaugucuggagagggccagcaggcccucugaggguucugg

SEQ ID NO: 511480 - RNA, 64 nt, Human
uccccuguccccgcaucuccccugggaccagcuggagggccacaugcacacacagccuagcugc

SEQ ID NO: 511481 - RNA, 64 nt, Human
agagaaaugagaaagagucugugggugggccucugagggccacagaaaaccagacaccccacau

SEQ ID NO: 511482 - RNA, 64 nt, Human; identical to SEQ ID NO: 314454

SEQ ID NO: 511483 - RNA, 64 nt, Human; identical to SEQ ID NO: 314455

SEQ ID NO: 511484 - RNA, 64 nt, Human; identical to SEQ ID NO: 314456

SEQ ID NO: 511485 - RNA, 64 nt, Human; identical to SEQ ID NO: 314457

SEQ ID NO: 511486 - RNA, 64 nt, Human; identical to SEQ ID NO: 314458

SEQ ID NO: 511487 - RNA, 64 nt, Human; identical to SEQ ID NO: 314459

SEQ ID NO: 511488 - RNA, 64 nt, Human; identical to SEQ ID NO: 314460

SEQ ID NO: 511489 - RNA, 64 nt, Human; identical to SEQ ID NO: 314461

SEQ ID NO: 511490 - RNA, 64 nt, Human; identical to SEQ ID NO: 314462

SEQ ID NO: 511491 - RNA, 64 nt, Human; identical to SEQ ID NO: 314463

SEQ ID NO: 511492 - RNA, 64 nt, Human; identical to SEQ ID NO: 314464

SEQ ID NO: 511493 - RNA, 64 nt, Human; identical to SEQ ID NO: 314465

SEQ ID NO: 511494 - RNA, 64 nt, Human; identical to SEQ ID NO: 314466

SEQ ID NO: 511495 - RNA, 64 nt, Human; identical to SEQ ID NO: 314467

SEQ ID NO: 511496 - RNA, 64 nt, Human; identical to SEQ ID NO: 314468

SEQ ID NO: 511497 - RNA, 64 nt, Human; identical to SEQ ID NO: 314469

SEQ ID NO: 511498 - RNA, 64 nt, Human
agacugcugcccccagaacaggcagggggugugggagggccaguuucccgccacuggguccaag

SEQ ID NO: 511499 - RNA, 64 nt, Human
aacaaaagugauuaugucacgagaggagaggcuggagggccaugggaguucccagcuggcucac

SEQ ID NO: 511500 - RNA, 64 nt, Human
ggcacgacagcagaaggauguugcuuuuuuaagggagggccagaaagaaaguuaguggauugca

SEQ ID NO: 511501 - RNA, 64 nt, Human; identical to SEQ ID NO: 314470

SEQ ID NO: 511502 - RNA, 64 nt, Human; identical to SEQ ID NO: 314471

SEQ ID NO: 511503 - RNA, 64 nt, Human; identical to SEQ ID NO: 314472

SEQ ID NO: 511504 - RNA, 64 nt, Human; identical to SEQ ID NO: 314473

SEQ ID NO: 511505 - RNA, 64 nt, Human; identical to SEQ ID NO: 314474

SEQ ID NO: 511506 - RNA, 64 nt, Human; identical to SEQ ID NO: 314475

SEQ ID NO: 511507 - RNA, 64 nt, Human; identical to SEQ ID NO: 314476

SEQ ID NO: 511508 - RNA, 64 nt, Human; identical to SEQ ID NO: 314477

SEQ ID NO: 511509 - RNA, 64 nt, Human; identical to SEQ ID NO: 314478

SEQ ID NO: 511510 - RNA, 64 nt, Human; identical to SEQ ID NO: 314479

SEQ ID NO: 511511 - RNA, 64 nt, Human; identical to SEQ ID NO: 314480

SEQ ID NO: 511512 - RNA, 64 nt, Human; identical to SEQ ID NO: 314481

SEQ ID NO: 511513 - RNA, 64 nt, Human; identical to SEQ ID NO: 314482

SEQ ID NO: 511514 - RNA, 64 nt, Human; identical to SEQ ID NO: 314483

SEQ ID NO: 511515 - RNA, 64 nt, Human; identical to SEQ ID NO: 314484

SEQ ID NO: 511516 - RNA, 64 nt, Human; identical to SEQ ID NO: 314485

SEQ ID NO: 511517 - RNA, 64 nt, Human
gagggaguggggacagugcaggcaguauuggcaggagggccagugcagaagggcugguagcuca

SEQ ID NO: 511518 - RNA, 64 nt, Human
ccggcucuaagagaaaggcccaucuacucaggaagagggccagggccuuggguucuggggauug

SEQ ID NO: 511519 - RNA, 64 nt, Human
aggaggagcauuguccaggcauggccuguggcccgagggccaaccaccgagcaggcacagcaca

SEQ ID NO: 511520 - RNA, 64 nt, Human; identical to SEQ ID NO: 314486

SEQ ID NO: 511521 - RNA, 64 nt, Human; identical to SEQ ID NO: 314487

SEQ ID NO: 511522 - RNA, 64 nt, Human; identical to SEQ ID NO: 314488

SEQ ID NO: 511523 - RNA, 64 nt, Human; identical to SEQ ID NO: 314489

SEQ ID NO: 511524 - RNA, 64 nt, Human; identical to SEQ ID NO: 313213

SEQ ID NO: 511525 - RNA, 64 nt, Human; identical to SEQ ID NO: 314491

SEQ ID NO: 511526 - RNA, 64 nt, Human; identical to SEQ ID NO: 314492

SEQ ID NO: 511527 - RNA, 64 nt, Human; identical to SEQ ID NO: 314493

SEQ ID NO: 511528 - RNA, 64 nt, Human; identical to SEQ ID NO: 314494

SEQ ID NO: 511529 - RNA, 64 nt, Human; identical to SEQ ID NO: 314495

SEQ ID NO: 511530 - RNA, 64 nt, Human; identical to SEQ ID NO: 314496

SEQ ID NO: 511531 - RNA, 64 nt, Human; identical to SEQ ID NO: 314497

SEQ ID NO: 511532 - RNA, 64 nt, Human
acuuagauccccucaacugucuacuuguugcagugagggccaauaauuaugaaauugucaggcu

SEQ ID NO: 511533 - RNA, 64 nt, Human
cugaagagccucaccugggggcauuuuguggguggagggccagaguguguauacccaggcuugu

SEQ ID NO: 511534 - RNA, 64 nt, Human
ugcgaaaagacuccugguuccccuguugauuugugagggccaaguuugcuaguagaaaucgaca

SEQ ID NO: 511535 - RNA, 50 nt, Human; identical to SEQ ID NO: 58964

SEQ ID NO: 511536 - RNA, 64 nt, Human; identical to SEQ ID NO: 58965

SEQ ID NO: 511537 - RNA, 64 nt, Human; identical to SEQ ID NO: 58966

SEQ ID NO: 511538 - RNA, 64 nt, Human; identical to SEQ ID NO: 58967

SEQ ID NO: 511539 - RNA, 64 nt, Human; identical to SEQ ID NO: 58968

SEQ ID NO: 511540 - RNA, 64 nt, Human; identical to SEQ ID NO: 58969

SEQ ID NO: 511541 - RNA, 64 nt, Human; identical to SEQ ID NO: 58970

SEQ ID NO: 511542 - RNA, 64 nt, Human; identical to SEQ ID NO: 58971

SEQ ID NO: 511543 - RNA, 64 nt, Human; identical to SEQ ID NO: 58972

SEQ ID NO: 511544 - RNA, 64 nt, Human; identical to SEQ ID NO: 58973

SEQ ID NO: 511545 - RNA, 64 nt, Human; identical to SEQ ID NO: 58974

SEQ ID NO: 511546 - RNA, 64 nt, Human; identical to SEQ ID NO: 58975

SEQ ID NO: 511547 - RNA, 64 nt, Human; identical to SEQ ID NO: 58976

SEQ ID NO: 511548 - RNA, 64 nt, Human; identical to SEQ ID NO: 58977

SEQ ID NO: 511549 - RNA, 64 nt, Human; identical to SEQ ID NO: 58978

SEQ ID NO: 511550 - RNA, 64 nt, Human; identical to SEQ ID NO: 59020

SEQ ID NO: 511551 - RNA, 64 nt, Human; identical to SEQ ID NO: 59021

SEQ ID NO: 511552 - RNA, 64 nt, Human; identical to SEQ ID NO: 59022

SEQ ID NO: 511553 - RNA, 64 nt, Human; identical to SEQ ID NO: 59023

SEQ ID NO: 511554 - RNA, 64 nt, Human; identical to SEQ ID NO: 59024

SEQ ID NO: 511555 - RNA, 64 nt, Human; identical to SEQ ID NO: 59025

SEQ ID NO: 511556 - RNA, 64 nt, Human; identical to SEQ ID NO: 59026

SEQ ID NO: 511557 - RNA, 64 nt, Human; identical to SEQ ID NO: 59027

SEQ ID NO: 511558 - RNA, 64 nt, Human; identical to SEQ ID NO: 59028

SEQ ID NO: 511559 - RNA, 64 nt, Human; identical to SEQ ID NO: 59029

SEQ ID NO: 511560 - RNA, 64 nt, Human
ugaauugucuucuaaagagauuggauggccucuaaagagguauguguaucuuuauuucagaugu

SEQ ID NO: 511561 - RNA, 64 nt, Human
agcagggcuggucauacccucuggaguucagaggaagagguaggaccagugcuuuuuuguuucu

SEQ ID NO: 511562 - RNA, 64 nt, Human
cacuccccgaaguagugauguuaauuaacaacugaagagguaacuaaaucucacaugcaggucu

SEQ ID NO: 511563 - RNA, 64 nt, Human
ucacugcuaaugcucagagaucuuuuuucacuguaagagguaaccuuuaacaauauggguauua

SEQ ID NO: 511564 - RNA, 64 nt, Human
uugugaacaugcaaucaucuuauguggguacagaaagagguaaagagucugaaucaaaaaggac

SEQ ID NO: 511565 - RNA, 64 nt, Human
uuuggauuuuggggagaaccaagcccugguagggaagagguaagggggaugauucaccuccaua

SEQ ID NO: 511566 - RNA, 64 nt, Human
uggggccucaauccagucuugauaacagcgaggaaagagguauugaagaaacagggguggguuu

SEQ ID NO: 511567 - RNA, 64 nt, Human
auauaauugcuuuccuccacacccagccacuguaaagagguaacuuggguccucuuccauugca

SEQ ID NO: 511568 - RNA, 64 nt, Human
ucaaagugauagaaaaguguggcuugggcauugaaagagguaaaauucucuagauuuauuaguc

SEQ ID NO: 511569 - RNA, 64 nt, Human
auggggcuguauagauuaucugaaucauuugucuaagagguacauucuuccagauggaaucaau

SEQ ID NO: 511570 - RNA, 64 nt, Human
guuuugcuuuguugaauaauacguguguaccuaaaagagguaagagcaaaaaguguaauuccac

SEQ ID NO: 511571 - RNA, 64 nt, Human
auuaaugguaaaggaaacccggcauuucaguguaaagagguaacauaaacggauacugccucau

SEQ ID NO: 511572 - RNA, 64 nt, Human
ccaguaucuugggcaugggggagccuuuggccagaagagguauaaagcucagaaguuuuucagu

SEQ ID NO: 511573 - RNA, 64 nt, Human
accccuagcacugagacuugugccuggaaggaaaaagagguagcaaaggggcaccugagguuca

SEQ ID NO: 511574 - RNA, 64 nt, Human
ggaaccuuguuucccaccgaauaagaguuaagguaagagguagcucuucaccugaugacauucc

SEQ ID NO: 511575 - RNA, 64 nt, Human
ccacucuggaauuuacccauagaagacgggaagaaagagguaugaagaugggcucaauuaugag

SEQ ID NO: 511576 - RNA, 64 nt, Human
uagcuuuaauuuguguuauuucuuuauugacgggaagagguacaucuuuuuuuccuuacugaaa

SEQ ID NO: 511577 - RNA, 64 nt, Human
uuuuaaaugcuauuauugcagaggaucaucaaaaaagagguaaucuacguuauuuccuauucua

SEQ ID NO: 511578 - RNA, 64 nt, Human
agauuuccaauguguauauucuaauggagaaagcaagagguagaguuuguauguuugacuuacc

SEQ ID NO: 511579 - RNA, 64 nt, Human
ccacuuucccuucacguuuuuuggcugaccugaaaagagguaacuuaguuuuuggucacuuguu

SEQ ID NO: 511580 - RNA, 64 nt, Human
ggagagcuugagguuucacacaagccauuuacuaaagagguagaaauguuuucuauugguuuua

SEQ ID NO: 511581 - RNA, 64 nt, Human
uugauuaaaacuuuuuaaaaagcuuugguauuaaaagagguaaacaucaguuuccucaaacauu

SEQ ID NO: 511582 - RNA, 64 nt, Human
acuguguuacaguuugucucuaacaugaaacagcaagagguagcccccucucccguccucaugc

SEQ ID NO: 511583 - RNA, 64 nt, Human
gauguaugcacauuuggggguauaucuauuucugaagagguaagcugaucaaaauaaauagagu

SEQ ID NO: 511584 - RNA, 64 nt, Human
aagaaaaagaauuuugauauuggaauagccugcuaagagguacauguggguauuuuggaguuac

SEQ ID NO: 511585 - RNA, 64 nt, Human
gcccacccccaggguuucugaguucauagguuauaagagguaaguugaacaauuccccagauga

SEQ ID NO: 511586 - RNA, 64 nt, Human
cuuacaagauugauuacucgacaggcuuguauuuaagagguaacugugagguuaccauuaugug

SEQ ID NO: 511587 - RNA, 64 nt, Human
cauauuugucuauuuuuucuauaaguuuuauugcaagagguaaagaagaaaacuauauauauau

SEQ ID NO: 511588 - RNA, 64 nt, Human
ugugagacuuucccuuuuugcuuaaccuggagugaagagguagaacugugguauuauggaugag

SEQ ID NO: 511589 - RNA, 64 nt, Human
ucaucuugaacuuggccugagaacauuuucugggaagagguaagggugacaaauggaacaucag

SEQ ID NO: 511590 - RNA, 64 nt, Human
guaaauuaaauuuacauuugaguuguuuguugcuaagagguaguaaauguaagagaguacuggu

SEQ ID NO: 511591 - RNA, 64 nt, Human
ucggaagcaagguuaggcugagugagggugaguaaagagguagaggagguuugaggagagagaa

SEQ ID NO: 511592 - RNA, 64 nt, Human
cuggguguguccuuucccagugcuuuucuuuuacaagagguaguagacuaguggaaauccccaa

SEQ ID NO: 511593 - RNA, 64 nt, Human
cacuggcaagauuucaagaccacucucugcacugaagagguaaaauuugcacugcaagucacau

SEQ ID NO: 511594 - RNA, 64 nt, Human
cauaagaacagcuaccuucuccacuugguggcacaagagguagggaggggaguauggguucauu

SEQ ID NO: 511595 - RNA, 64 nt, Human
aaguuaaaggaaacaaaauuuguaccauugucccaagagguauuuuacuguauauauuguggua

SEQ ID NO: 511596 - RNA, 64 nt, Human
auuaaacaacacauuccuaaauaaccagugguuaaagagguaaucacagucugagcaacauggc

SEQ ID NO: 511597 - RNA, 64 nt, Human
aaacccuguauccaauuuuaaugauaaaauagccaagagguauaucgaugauggaaauuagcca

SEQ ID NO: 511598 - RNA, 64 nt, Human
ggcacuucaaaguuuccuuagacccuauaguguuaagagguauuuuaaacacuaaaaggacaaa

SEQ ID NO: 511599 - RNA, 64 nt, Human
gauuauauagcacauauuuuauuaguuguuuaauaagagguaauacccaucuaggaaagaaauu

SEQ ID NO: 511600 - RNA, 64 nt, Human
aagacugaguauugaugggggaguggaccagacaaagagguaagaugaaacaguaguguguuua

SEQ ID NO: 511601 - RNA, 64 nt, Human
aucaaccauuuauccugaacaacaccauuugagaaagagguaaccaucuuugguucuacauggu

SEQ ID NO: 511602 - RNA, 64 nt, Human
uuccauccacuuauggaggaggaggagaauguggaagagguaaaaagcugggcacaaguucaua

SEQ ID NO: 511603 - RNA, 64 nt, Human
ggcgacgaaucaggacacagugaacuugggaaugaagagguagcaggaggguggagugucggcu

SEQ ID NO: 511604 - RNA, 64 nt, Human
uacuuacauauuauaaaauaaacuauaccucuucaagagguauccuguucuguaagaucagaug

SEQ ID NO: 511605 - RNA, 64 nt, Human
acgucuucuaaaaggggcauauuuuauauuagugaagagguauuacugacacaauuucuucuau

SEQ ID NO: 511606 - RNA, 64 nt, Human
uuuuaaaaaugcgcuaagaaggcaaagcagaaagaagagguauacuuauuuaaaaaacuaagau

SEQ ID NO: 511607 - RNA, 64 nt, Human
aaaauucuuuaaaauauuuuaaugcauucuuuugaagagguagauguuugguacauuuuauggc

SEQ ID NO: 511608 - RNA, 64 nt, Human
ugccaaauugagauaaugauacuuaaccaguuagaagagguagugugaauauuaauuaguuuau

SEQ ID NO: 511609 - RNA, 64 nt, Human
gaagagagauaugcaaagaagcuauuaccuacauaagagguauauuuaaagauuuuuuuuuuca

SEQ ID NO: 511610 - RNA, 64 nt, Human
gagauaaaauaaacuaaaacaacaaacauccuuaaagagguagggugugggcugcugagggggc

SEQ ID NO: 511611 - RNA, 64 nt, Human
aacugcauggaggcauaacagucagggggaguggaagagguaccaggagucacucaguuugaca

SEQ ID NO: 511612 - RNA, 64 nt, Human
uacuuaauuuugguagauauugaauggcuuggaaaagagguacccauucauauauuuauaaauu

SEQ ID NO: 511613 - RNA, 64 nt, Human
uuuuugcaccauuaauuuagcaaaggccaucuacaagagguauaccacuguauuuugcaaauua

SEQ ID NO: 511614 - RNA, 64 nt, Human
caaguauucuuucaagguuggaagagggauuuugaagagguaucucuccaagcaagaaugacuu

SEQ ID NO: 511615 - RNA, 64 nt, Human
aacaauguaauuacauuaaaauggaccuaucuguaagagguacuaaaaacacuggauucauuuc

SEQ ID NO: 511616 - RNA, 64 nt, Human
guagaugugugauugucugagugagugaaacuacaagagguaaaaaauaaugggugguugaaaa

SEQ ID NO: 511617 - RNA, 64 nt, Human
uauuucuaauaaauauuuauauuuuuaugaaauaaagagguauguggaaauuaauauuugguga

SEQ ID NO: 511618 - RNA, 64 nt, Human
gcugcuuuucugucagucugaagcguaguaguggaagagguaguaagcaccagcugccucuuug

SEQ ID NO: 511619 - RNA, 64 nt, Human
guaucaaaaucuuccaauuaucaugcucaccugaaagagguaugcucucuuaggaauacaguuu

SEQ ID NO: 511620 - RNA, 64 nt, Human
uauuaauagccauuugaagaaggaggaauuuuagaagagguagagaaaauggaacauuaacccu

SEQ ID NO: 511621 - RNA, 64 nt, Human
cugacugaaauagacaaaguaagagggaaaggaaaagagguaucaaguaaauacugaaacccaa

SEQ ID NO: 511622 - RNA, 64 nt, Human
ucucaaacugguggaauauauggagagaucuugaaagagguaaaauaaaccuucacugcuccac

SEQ ID NO: 511623 - RNA, 64 nt, Human
uuugaaauuguuugacggcaagguuuaaguuauuaagagguaagacuuaguacuaucugugcgu

SEQ ID NO: 511624 - RNA, 64 nt, Human
uuuaaacugcuuuuucggaagaacaacaacaaaaaagagguaaagacgaaucuauaaaguaccg

SEQ ID NO: 511625 - RNA, 64 nt, Human
cagaggcaaauuugaagugccacggaacguugucaagagguagugagauuguugcugugagcaa

SEQ ID NO: 511626 - RNA, 64 nt, Human
auuaauuauauuaucuauuuaggcauuaauauaaaagagguaggagucuguuauuuaaaaaaag

SEQ ID NO: 511627 - RNA, 64 nt, Human
cccuuaaaugccagaucugguggagggaagagagaagagguaggaagaaaggugaugaaaacuc

SEQ ID NO: 511628 - RNA, 64 nt, Human
uuuuuuuguuguuugcaaauuguuacuaauauugaagagguaagggaggcaaugcaaaugauuu

SEQ ID NO: 511629 - RNA, 64 nt, Human
aguaaauggacuugccuuaauuuauaaaggagggaagagguagaagggaaccauggguccucca

SEQ ID NO: 511630 - RNA, 64 nt, Human
guuuuucagauaauaugugaccaauauacugggaaagagguagucacagagaaaggguaaguga

SEQ ID NO: 511631 - RNA, 64 nt, Human
acaguauucugugaugucuuuuuaacuuuuuggaaagagguaucauuuguagaaaaaauuugau

SEQ ID NO: 511632 - RNA, 64 nt, Human
agguaccauucaaagcagggggaaagguaggaagaagagguaauuuuuacugaaaauuagggca

SEQ ID NO: 511633 - RNA, 64 nt, Human
uuauggcacauauuagcauauaagccuuuauuccaagagguauuuauuuuuucacuuguaaaaa

SEQ ID NO: 511634 - RNA, 64 nt, Human
auauuugauaggaggcuacgggagaguugucuagaagagguaagaccugaaacuguuuguucuc

SEQ ID NO: 511635 - RNA, 64 nt, Human
uuaaggagaauuguauuucuccagaagcugcagcaagagguacagcucaacaaaggaaaaccac

SEQ ID NO: 511636 - RNA, 64 nt, Human
aaagagccuuaauguauuugauguauucugugauaagagguacuaauaguauccagcacagauu

SEQ ID NO: 511637 - RNA, 64 nt, Human
uccagaguucucgaagaaaauaaaugacuuuaggaagagguauacauuuuuuaagucgcucugc

SEQ ID NO: 511638 - RNA, 64 nt, Human
ugguacuauguacuauuguaacuucuaguucccuaagagguaccuguuuucaguaaaaaggggu

SEQ ID NO: 511639 - RNA, 64 nt, Human
aaaccaaucagguuauugcauugacuucacucccaagagguagaugcaaacugcccuucaguga

SEQ ID NO: 511640 - RNA, 64 nt, Human
aguuuucaccugguauccauuauaaacaaucaggaagagguaauuuuucaccuugcuuuucagu

SEQ ID NO: 511641 - RNA, 64 nt, Human
cagaaugugacuguauuuggagacagggucuuuaaagagguaaaauaaggucauuaggauagac

SEQ ID NO: 511642 - RNA, 64 nt, Human
uuggcaguggaaggcucgaguugauuaagugacaaagagguaaagcagacaugcccaagcuugg

SEQ ID NO: 511643 - RNA, 64 nt, Human
gacuuaacaauuuuccaacuuuaccauggugugaaagagguaugauuccuaagcccuaaggagc

SEQ ID NO: 511644 - RNA, 64 nt, Human
caaaaagagcaaacacuggggaucaaauuauuuuaagagguauuucaguuuuaaaugcaaaaua

SEQ ID NO: 511645 - RNA, 64 nt, Human
aauauugucccuuugagcagaaauuuaucuuucaaagagguauauuugaaaaaaaaaaaaagua

SEQ ID NO: 511646 - RNA, 64 nt, Human
acucccauaugcaagucaauucauuuaaugugccaagagguagauuuuaaacauagucuaucgu

SEQ ID NO: 511647 - RNA, 64 nt, Human
uucaaaguuaaaagcaaacacuuacagaauuaugaagagguaucuguuuaacauuuccucaguc

SEQ ID NO: 511648 - RNA, 64 nt, Human
aggcaggggucagggggagagguagagaugagacaagagguagaggggagagguagagguagcc

SEQ ID NO: 511649 - RNA, 64 nt, Human
caaauaaacaugcaauguuuauguuguacuguauaagagguaagcuaauuaaugcagugaaugg

SEQ ID NO: 511650 - RNA, 64 nt, Human
gaguccaaauccacuuaaauucuguuuuccugaaaagagguacagcauaagaaauagcucuuua

SEQ ID NO: 511651 - RNA, 64 nt, Human
gcucucugauaauucagagagcauugggucugggaagagguaagaggaacacuagaagcucagc

SEQ ID NO: 511652 - RNA, 64 nt, Human
uuguguguggaucauuccaauugaaguugcuaugaagagguagcagaugaaucucauugaauua

SEQ ID NO: 511653 - RNA, 64 nt, Human
cauuauagcaggugcuuuguaaucuggaauggagaagagguaggggcauuuggggauuccuguu

SEQ ID NO: 511654 - RNA, 64 nt, Human
cacuuuuaccucugacgucauucuuuuuuucugaaagagguaauaauucuaguuuugauagacu

SEQ ID NO: 511655 - RNA, 64 nt, Human
gaacaauagaauaaucuauuauuuggagccugccaagagguacuguaauggguaauucugacgu

SEQ ID NO: 511656 - RNA, 64 nt, Human
cugcaggacugaccccaaggaggaacgugggcacaagagguauaucagcacacgugugaucacc

SEQ ID NO: 511657 - RNA, 64 nt, Human
acaauccuugagaaucuuugcaugcagaggagguaagagguauuggauuuucacagaggaagaa

SEQ ID NO: 511658 - RNA, 64 nt, Human
agaccaauuaaauuucaacuguuuaggguggagaaagagguacuggaaaacaugcagaugagga

SEQ ID NO: 511659 - RNA, 64 nt, Human
gaugugagcagagugccauaguagggguucugggaagagguauuucugauuugugggccucugc

SEQ ID NO: 511660 - RNA, 64 nt, Human
agaagucugccccuauuuauuuuuaguaaguaucaagagguagccugagccuaguuagaguuag

SEQ ID NO: 511661 - RNA, 64 nt, Human
augcaaguuauuuuaauguacaaacuaaauggguaagagguaaaaucuucauuuaaauauacua

SEQ ID NO: 511662 - RNA, 64 nt, Human
uagaaagccaaaguagaguucuguuuaagcuugaaagagguaugaaguaaucuguaguguuuuu

SEQ ID NO: 511663 - RNA, 64 nt, Human
gcauuaguguaauguggugugguuuugcacuuaaaagagguauucauaugcucuaguuguaaau

SEQ ID NO: 511664 - RNA, 64 nt, Human
uaacaguauuaggguggaagaggaaucaagaguaaagagguagggguuuacucauuuuucuucc

SEQ ID NO: 511665 - RNA, 64 nt, Human
acccgaaagaaaggaaaaggaagccaguauauugaagagguaucugcacccccauguuuauugc

SEQ ID NO: 511666 - RNA, 64 nt, Human
ugauccccuaccuucuagggaacuaggaccuaggaagagguaaagauuaucagguaugcaaagc

SEQ ID NO: 511667 - RNA, 64 nt, Human
gaguuacaggaauucucuguaaugagugauucugaagagguacuuuccuggaauaauugucuac

SEQ ID NO: 511668 - RNA, 64 nt, Human
acuucuuaaauaucuuuuauguuugaauauggacaagagguacaggguuuuuaccugucacauu

SEQ ID NO: 511669 - RNA, 64 nt, Human
caggagucucuucuguucugcaaguuugauggguaagagguagccuuuuuucaaaguaggauuu

SEQ ID NO: 511670 - RNA, 64 nt, Human
cuuucauuaaaaagaauagaaggauucagucauaaagagguaaaaaacugucacgguacgaaau

SEQ ID NO: 511671 - RNA, 64 nt, Human
uuuagagucuauuuucuaaaguuuuaaguauuuuaagagguauugagacuaaugaauauaauag

SEQ ID NO: 511672 - RNA, 64 nt, Human
agggauuaaugaaaaucaaguuccauccucagacaagagguaaagaaggaaaauucagccaguu

SEQ ID NO: 511673 - RNA, 64 nt, Human
uuuaucaggcauagcucugaaacauugaugaucuaagagguauugauuucugaauauucauaau

SEQ ID NO: 511674 - RNA, 64 nt, Human
gcaaccacauuugacuaauuuccguuaguugaauaagagguauuaugaucauggaggggacauu

SEQ ID NO: 511675 - RNA, 64 nt, Human
aaaauacauguacaaaguuuggaaagaugaaaaaaagagguagcuuuuagauugcaaacuggaa

SEQ ID NO: 511676 - RNA, 64 nt, Human
uucuuguaauuuucaaauuuuugccugucucuugaagagguauuuuuucacccuuagaaaaggg

SEQ ID NO: 511677 - RNA, 64 nt, Human
aauuaauccuucaaaacaaucagauaauucacacaagagguacaccuuaugaaucgcaucaaua

SEQ ID NO: 511678 - RNA, 64 nt, Human
ugcaguucaauucauuuuaauuagaaaaguaugaaagagguauaacacucuuauucuagcacag

SEQ ID NO: 511679 - RNA, 64 nt, Human
aucugcauaugaagcauuuucugauauauuuaauaagagguauagaagcucuucaagcauuaaa

SEQ ID NO: 511680 - RNA, 64 nt, Human
caauauguuuuuugaaccagcuauaaaagaaauuaagagguacaugugaggguagaaacaaaua

SEQ ID NO: 511681 - RNA, 64 nt, Human
uugcucuggcccuugcuuuuuacccuccagagcuaagagguagcagagucucuugggaugagug

SEQ ID NO: 511682 - RNA, 64 nt, Human
agagaaugauaggcuuuuguucuuaugaacgaaaaagagguagcacuacaaacacaauauucaa

SEQ ID NO: 511683 - RNA, 64 nt, Human
uccuguucuuuuaauugaaaguuuauaugcuucuaagagguagauaccagaauguugcuuucug

SEQ ID NO: 511684 - RNA, 64 nt, Human
aggauguuguaucagaaucaugugagaacucaggaagagguagagcagaaauaaaaaggaagaa

SEQ ID NO: 511685 - RNA, 64 nt, Human
uuuauuuuaaaagguaguauaagaaaugaggaaaaagagguaauaucagggcuucugcuguuuu

SEQ ID NO: 511686 - RNA, 64 nt, Human
ccuuaaaaaaaaaaaaauugcucuuggcugugaaaagagguacuaaaugcgauucaguucaccg

SEQ ID NO: 511687 - RNA, 64 nt, Human
ccagcacucaaaacucagggucaaguuuuaacaaaagagguauguagucacaguaaauacuaag

SEQ ID NO: 511688 - RNA, 64 nt, Human
cuaucuuggcacacuaaaugcuaagcacugucuuaagagguagagcuggugugagugaaauuaa

SEQ ID NO: 511689 - RNA, 64 nt, Human
gcugaagcuaaucuaauuuaaauuuaacagcuugaagagguagcuagguguuuaaaguuccucc

SEQ ID NO: 511690 - RNA, 64 nt, Human
uauuuagaaucacuuuuuuccuccuguaucaaggaagagguaugugcugauuuguuuggauauu

SEQ ID NO: 511691 - RNA, 64 nt, Human
uauccaugccuuuuuguccuguuuacagucuuaaaagagguaaaacagcaaauauuuuuuuaag

SEQ ID NO: 511692 - RNA, 64 nt, Human
augcuuuguuagcauuucaacuugcauuauuauaaagagguauuaaugccucaguuauguguuu

SEQ ID NO: 511693 - RNA, 64 nt, Human
cucuugcuucagagcagauuucgauuuuuuuuggaagagguaacacauccacaugguucaaaaa

SEQ ID NO: 511694 - RNA, 64 nt, Human
gcucuccuuuuuguagugaugaggaacaaugaaaaagagguaguguaaggaauugugaggcugg

SEQ ID NO: 511695 - RNA, 64 nt, Human
uucuguccuaccaugcaaauacacagauuaugccaagagguaccacauuuucaugacagauaca

SEQ ID NO: 511696 - RNA, 64 nt, Human
augaucaauucaggagacugcccaaggcuugcagaagagguaagggagugaggcacuccuaucc

SEQ ID NO: 511697 - RNA, 64 nt, Human
ucaucagguauuuauagugaaucauacuguaaaaaagagguagcaugauaugcuggaaagcaua

SEQ ID NO: 511698 - RNA, 64 nt, Human
cucuagcuucuucuaucagugguuggucugauagaagagguaaaaauugcucuugaaaaugucc

SEQ ID NO: 511699 - RNA, 64 nt, Human
uaaccuuucuuugcaguuaagacugaagcugucaaagagguaagcacauuuuauauagacguaa

SEQ ID NO: 511700 - RNA, 64 nt, Human
uugggaggcugaggcaggagaaucgcuugagcccaagagguagagguugcagugagccaagauc

SEQ ID NO: 511701 - RNA, 64 nt, Human
uggcagcauccuccuugauaaaagcagaaaagcaaagagguaauuggaguugaaucaaguuaau

SEQ ID NO: 511702 - RNA, 64 nt, Human
ucauaccagccuuugaaaaguuacugugccaauaaagagguacaacuguguucuucuauuguuu

SEQ ID NO: 511703 - RNA, 64 nt, Human
guauguaaccaaaagaauugaaauccggaucucaaagagguaugugcacucccauguucacugc

SEQ ID NO: 511704 - RNA, 64 nt, Human
ucugaggcugggccugcagcuguguagucuuuggaagagguagccccugaacgcagagccuaag

SEQ ID NO: 511705 - RNA, 64 nt, Human
gcuuaccaggcccgcuuguuacagaagcugacagaagagguacccuugggacagaguauccccc

SEQ ID NO: 511706 - RNA, 64 nt, Human
uuuauuuugacacuaaaacauggacacaacuagaaagagguacaaugcaauauaaagucacaau

SEQ ID NO: 511707 - RNA, 64 nt, Human
aguuuuauuauaaaccaagaauuuuggacuugcaaagagguauuauugcaauaaugcacuuuuc

SEQ ID NO: 511708 - RNA, 64 nt, Human
aaugggaaugauuucuguauguucccuugguaccaagagguacuaugcaaaguaaccuauuaca

SEQ ID NO: 511709 - RNA, 64 nt, Human
gucagauauggggucccgcaccuauaucuggaugaagagguagaaacucuggaccucauuaaug

SEQ ID NO: 511710 - RNA, 64 nt, Human
caaggguccucauaagaaagaggccagaaggucaaagagguagagacaaagugaugauggaagu

SEQ ID NO: 511711 - RNA, 64 nt, Human
cggagggggcgggggugggguggaggggagggggaagagguacaggcgguguccgccucguuuc

SEQ ID NO: 511712 - RNA, 64 nt, Human
agucauaauauuauacaaauucagaguguuauuaaagagguauugaaauauuuuaccagucuca

SEQ ID NO: 511713 - RNA, 64 nt, Human
aaugccagcuguuuaaucacaccuaccccuggaaaagagguaaaccuuuugaacaguugaauuu

SEQ ID NO: 511714 - RNA, 64 nt, Human
uccagucuugccagcuuaaggagaucaagauauuaagagguauccuugauuuauuuuccaguau

SEQ ID NO: 511715 - RNA, 64 nt, Human
agaacauacuuuuuuuuucuuuaagccaaaugaaaagagguaacuuugcuuuuuuccuuuuucu

SEQ ID NO: 511716 - RNA, 64 nt, Human
caaacagggauauagaagugguggaagcagacagaagagguaagggaggcuaaguggguaacag

SEQ ID NO: 511717 - RNA, 64 nt, Human
auuucuaaauguuucccaggcuaauacaggaaacaagagguaccaaaaaagaaaguuuauuuuu

SEQ ID NO: 511718 - RNA, 64 nt, Human
uuagucacagguuuuuacaguccagcaagggccaaagagguauaguauacaaguuaauaguauu

SEQ ID NO: 511719 - RNA, 64 nt, Human
cuagcauguaaagagugguggacuuuaaaaccguaagagguaucauuacaagucaccuggaaca

SEQ ID NO: 511720 - RNA, 64 nt, Human
cuuuuauaggcucuguuacuguugcguagucuugaagagguacccaucauaaugacagcaucuc

SEQ ID NO: 511721 - RNA, 64 nt, Human
aucaaauuguaaguaauacagacaugccauuuaaaagagguaaauucuuguuuucuauauuuug

SEQ ID NO: 511722 - RNA, 64 nt, Human
agcugauggcuguauucugacuuugaagccuguuaagagguagcaagggggcuagaggagggag

SEQ ID NO: 511723 - RNA, 64 nt, Human
uuugcuugccucucuguuuguaaccuugucgacaaagagguagaaaagauugggucuaggauau

SEQ ID NO: 511724 - RNA, 64 nt, Human
gguaucacucuuucagauugaagcugacaucuccaagagguacagcgggcgcccugugaaccug

SEQ ID NO: 511725 - RNA, 64 nt, Human
gccuuguuacacucaaugcaauucucaagucuauaagagguaugugcuuaauauuuccuacugu

SEQ ID NO: 511726 - RNA, 53 nt, Human
uacauaacuuuucagcauagaaaaagagguacuuagaaguauugaaggaaaaa

SEQ ID NO: 511727 - RNA, 64 nt, Human
cuccugccuuugcuuguucacugcagucuuaagaaagagguaaaaggcaagcaaaggagaugaa

SEQ ID NO: 511728 - RNA, 64 nt, Human
caaauccagugagcuccagauucuuccaaggcaaaagagguaagcagaucacaccucuuucugc

SEQ ID NO: 511729 - RNA, 64 nt, Human
gguaaccccuuacgaugaugacaucccacacacuaagagguacaagcaggaccaaaguuuugga

SEQ ID NO: 511730 - RNA, 64 nt, Human
cuuuguuucuucggcuaaagguacaguuccuuucaagagguaacagcacugggauccaagcagg

SEQ ID NO: 511731 - RNA, 64 nt, Human
gauccucugauccucacuccacugucauguuugaaagagguauugguguucuggaguggggguc

SEQ ID NO: 511732 - RNA, 64 nt, Human
ucaggaugggaaaggaagaaggggauaggaaaagaagagguaauuuuacauuuccccuuuaaag

SEQ ID NO: 511733 - RNA, 64 nt, Human
uuagauugcuaaucccacucauucaggaaaugccaagagguauuccuuggggaaauggugccuc

SEQ ID NO: 511734 - RNA, 64 nt, Human
uaugguauaccagugaaagaacuguaguauaaaaaagagguauuaauguuuuaugaaaucucau

SEQ ID NO: 511735 - RNA, 64 nt, Human
gccaguucacccacagaucacaccuccauccccaaagagguagcacugcagcaacaucaggggg

SEQ ID NO: 511736 - RNA, 64 nt, Human
accuaaaguugcaggaaacauuuuuuauuucguaaagagguaccaacugucgcugaugugauau

SEQ ID NO: 511737 - RNA, 64 nt, Human
ugauguugcuggacugucauagaaauuacacccaaagagguauuuaucuuuacuuuuaaacagu

SEQ ID NO: 511738 - RNA, 64 nt, Human
ucuucccuuuacuuucagggacccuaaccuccaaaagagguacccauuggcgcucaaccgaauu

SEQ ID NO: 511739 - RNA, 64 nt, Human
aaggugggaacuuguccaagacgucacagguagcaagagguacuuuuaccuggcuccaaaucug

SEQ ID NO: 511740 - RNA, 64 nt, Human
cuauuauaaaacucugcuuuguccgacauuugcaaagagguacacgaggaaauggaauugguau

SEQ ID NO: 511741 - RNA, 64 nt, Human
uauaucuaauuaugucuaugugguaauaccuaaaaagagguagagagacucuauguucacaaaa

SEQ ID NO: 511742 - RNA, 64 nt, Human
agaauaccccugcuauuuaaauaaagcucauaccaagagguaacauuuugccccgggccaaauu

SEQ ID NO: 511743 - RNA, 64 nt, Human
aaguggccugcaggggccacucucuacugguaggaagagguaccacaggaagccgccuagugca

SEQ ID NO: 511744 - RNA, 64 nt, Human
gaaauuagaacgacuucacguuggagaaagcaugaagagguauucaucuguuacggcccucacg

SEQ ID NO: 511745 - RNA, 64 nt, Human
uucugucaccuagauuugaucagggucuauuuggaagagguaacccuuuucagggcuaagggcc

SEQ ID NO: 511746 - RNA, 64 nt, Human
uuguauugaauaauuugcuacauuuguaaaauguaagagguauauaauauauguauauuucuaa

SEQ ID NO: 511747 - RNA, 64 nt, Human
auguauauagaauuaguacuuuauuuuuauuuuuaagagguaaagcauuauguuggggaaagua

SEQ ID NO: 511748 - RNA, 64 nt, Human
cccuuuucagugugacuuugccacuucacccaucaagagguagaaucuauuucuucaaccccug

SEQ ID NO: 511749 - RNA, 64 nt, Human
acuggugauauggcuguaggaucccccuugaugcaagagguaggcuccccgaaagacccuggaa

SEQ ID NO: 511750 - RNA, 64 nt, Human
aaucaguuagggaaagugauuuaaacuuuauuuaaagagguauuuucuaauuaugcacagauau

SEQ ID NO: 511751 - RNA, 64 nt, Human
gcaauaauacaagaaaaaaaauccuuugcuugccaagagguagagugaugugcauuuaucuguu

SEQ ID NO: 511752 - RNA, 64 nt, Human
uuguuuuggggaagugaaauaugugguugguaggaagagguaccaaugacuuccaaacauguga

SEQ ID NO: 511753 - RNA, 64 nt, Human
gagagggugggaaaggggaggagggagcccugaaaagagguacuaaggauuaggccauuuguca

SEQ ID NO: 511754 - RNA, 64 nt, Human
aacuucguguuuugucaucagcaucuuuucuauuaagagguaaaauguaguccuuguuugacuc

SEQ ID NO: 511755 - RNA, 64 nt, Human
auuugaggauauuuaacauuuuccaauucugcuuaagagguaauucacaauaaaaaaaacaaag

SEQ ID NO: 511756 - RNA, 64 nt, Human; identical to SEQ ID NO: 141284

SEQ ID NO: 511757 - RNA, 64 nt, Human; identical to SEQ ID NO: 141285

SEQ ID NO: 511758 - RNA, 64 nt, Human; identical to SEQ ID NO: 141286

SEQ ID NO: 511759 - RNA, 64 nt, Human; identical to SEQ ID NO: 141287

SEQ ID NO: 511760 - RNA, 64 nt, Human; identical to SEQ ID NO: 141288

SEQ ID NO: 511761 - RNA, 64 nt, Human; identical to SEQ ID NO: 141289

SEQ ID NO: 511762 - RNA, 64 nt, Human; identical to SEQ ID NO: 141290

SEQ ID NO: 511763 - RNA, 64 nt, Human; identical to SEQ ID NO: 141291

SEQ ID NO: 511764 - RNA, 64 nt, Human; identical to SEQ ID NO: 141292

SEQ ID NO: 511765 - RNA, 64 nt, Human; identical to SEQ ID NO: 141293

SEQ ID NO: 511766 - RNA, 64 nt, Human; identical to SEQ ID NO: 141294

SEQ ID NO: 511767 - RNA, 64 nt, Human
accuaacuguaucuugaggugguaguaaaacacagagggccaguaacgggucguaaugacuuau

SEQ ID NO: 511768 - RNA, 64 nt, Human
aggagguccaggccugggcucucgggcccuccuagagggccauuggagcuugcagcucagaccc

SEQ ID NO: 511769 - RNA, 64 nt, Human
agcccggcaggcguccugggacagcucaguguuggagggccaccugaaccacgagccagggcug

SEQ ID NO: 511770 - RNA, 64 nt, Human; identical to SEQ ID NO: 141295

SEQ ID NO: 511771 - RNA, 64 nt, Human; identical to SEQ ID NO: 141296

SEQ ID NO: 511772 - RNA, 64 nt, Human; identical to SEQ ID NO: 141297

SEQ ID NO: 511773 - RNA, 64 nt, Human; identical to SEQ ID NO: 141298

SEQ ID NO: 511774 - RNA, 64 nt, Human; identical to SEQ ID NO: 141299

SEQ ID NO: 511775 - RNA, 64 nt, Human; identical to SEQ ID NO: 141300

SEQ ID NO: 511776 - RNA, 64 nt, Human; identical to SEQ ID NO: 141301

SEQ ID NO: 511777 - RNA, 59 nt, Human; identical to SEQ ID NO: 141302

SEQ ID NO: 511778 - RNA, 64 nt, Human; identical to SEQ ID NO: 141303

SEQ ID NO: 511779 - RNA, 64 nt, Human; identical to SEQ ID NO: 141304

SEQ ID NO: 511780 - RNA, 64 nt, Human; identical to SEQ ID NO: 141305

SEQ ID NO: 511781 - RNA, 64 nt, Human; identical to SEQ ID NO: 141306

SEQ ID NO: 511782 - RNA, 64 nt, Human; identical to SEQ ID NO: 141307

SEQ ID NO: 511783 - RNA, 64 nt, Human; identical to SEQ ID NO: 141308

SEQ ID NO: 511784 - RNA, 64 nt, Human; identical to SEQ ID NO: 141309

SEQ ID NO: 511785 - RNA, 64 nt, Human; identical to SEQ ID NO: 141310

SEQ ID NO: 511786 - RNA, 64 nt, Human; identical to SEQ ID NO: 435459

SEQ ID NO: 511787 - RNA, 64 nt, Human; identical to SEQ ID NO: 435460

SEQ ID NO: 511788 - RNA, 64 nt, Human; identical to SEQ ID NO: 435461

SEQ ID NO: 511789 - RNA, 64 nt, Human; identical to SEQ ID NO: 141311

SEQ ID NO: 511790 - RNA, 64 nt, Human; identical to SEQ ID NO: 141312

SEQ ID NO: 511791 - RNA, 64 nt, Human; identical to SEQ ID NO: 141313

SEQ ID NO: 511792 - RNA, 64 nt, Human; identical to SEQ ID NO: 141314

SEQ ID NO: 511793 - RNA, 64 nt, Human; identical to SEQ ID NO: 141315

SEQ ID NO: 511794 - RNA, 64 nt, Human; identical to SEQ ID NO: 141316

SEQ ID NO: 511795 - RNA, 64 nt, Human; identical to SEQ ID NO: 141317

SEQ ID NO: 511796 - RNA, 64 nt, Human; identical to SEQ ID NO: 141318

SEQ ID NO: 511797 - RNA, 64 nt, Human; identical to SEQ ID NO: 141319

SEQ ID NO: 511798 - RNA, 64 nt, Human; identical to SEQ ID NO: 141320

SEQ ID NO: 511799 - RNA, 64 nt, Human; identical to SEQ ID NO: 141321

SEQ ID NO: 511800 - RNA, 64 nt, Human; identical to SEQ ID NO: 141322

SEQ ID NO: 511801 - RNA, 64 nt, Human; identical to SEQ ID NO: 141323

SEQ ID NO: 511802 - RNA, 64 nt, Human; identical to SEQ ID NO: 141324

SEQ ID NO: 511803 - RNA, 64 nt, Human; identical to SEQ ID NO: 141325

SEQ ID NO: 511804 - RNA, 64 nt, Human; identical to SEQ ID NO: 141326

SEQ ID NO: 511805 - RNA, 64 nt, Human
ggucugccauuccugcuuggggacugguggggaagagggccaggacaucuucugagccaggacg

SEQ ID NO: 511806 - RNA, 64 nt, Human
uugcugggguccccucauccacuugagggcgccugagggccaggagcagcaggcaaggagccug

SEQ ID NO: 511807 - RNA, 64 nt, Human
uauaaugugaaauauuuuuuuguggugauaaaaagagggccaaggagguaugagccaucagacu

SEQ ID NO: 511808 - RNA, 64 nt, Human; identical to SEQ ID NO: 141327

SEQ ID NO: 511809 - RNA, 64 nt, Human; identical to SEQ ID NO: 141328

SEQ ID NO: 511810 - RNA, 64 nt, Human; identical to SEQ ID NO: 141329

SEQ ID NO: 511811 - RNA, 64 nt, Human; identical to SEQ ID NO: 141330

SEQ ID NO: 511812 - RNA, 64 nt, Human; identical to SEQ ID NO: 141331

SEQ ID NO: 511813 - RNA, 64 nt, Human; identical to SEQ ID NO: 141332

SEQ ID NO: 511814 - RNA, 64 nt, Human; identical to SEQ ID NO: 141333

SEQ ID NO: 511815 - RNA, 64 nt, Human; identical to SEQ ID NO: 141334

SEQ ID NO: 511816 - RNA, 64 nt, Human; identical to SEQ ID NO: 141335

SEQ ID NO: 511817 - RNA, 64 nt, Human; identical to SEQ ID NO: 141336

SEQ ID NO: 511818 - RNA, 64 nt, Human; identical to SEQ ID NO: 141337

SEQ ID NO: 511819 - RNA, 64 nt, Human; identical to SEQ ID NO: 141338

SEQ ID NO: 511820 - RNA, 64 nt, Human; identical to SEQ ID NO: 141339

SEQ ID NO: 511821 - RNA, 64 nt, Human; identical to SEQ ID NO: 141340

SEQ ID NO: 511822 - RNA, 64 nt, Human; identical to SEQ ID NO: 141341

SEQ ID NO: 511823 - RNA, 64 nt, Human; identical to SEQ ID NO: 141342

SEQ ID NO: 511824 - RNA, 64 nt, Human
guggagccugagggugccugcccugcucuggagggagggccaggagcugccacacccccaaguc

SEQ ID NO: 511825 - RNA, 64 nt, Human
ucacaguaaauacuaagauggcauuucuaucucagagggccaaagugaaucacaccaguuucug

SEQ ID NO: 511826 - RNA, 64 nt, Human
gaauucuccuuguaagccuugaagaaguaugugagagggccacauuggcuaaaaccuaaaggug

SEQ ID NO: 511827 - RNA, 64 nt, Human; identical to SEQ ID NO: 141343

SEQ ID NO: 511828 - RNA, 64 nt, Human; identical to SEQ ID NO: 141344

SEQ ID NO: 511829 - RNA, 64 nt, Human; identical to SEQ ID NO: 141345

SEQ ID NO: 511830 - RNA, 64 nt, Human; identical to SEQ ID NO: 141346

SEQ ID NO: 511831 - RNA, 64 nt, Human; identical to SEQ ID NO: 141347

SEQ ID NO: 511832 - RNA, 64 nt, Human; identical to SEQ ID NO: 141348

SEQ ID NO: 511833 - RNA, 64 nt, Human; identical to SEQ ID NO: 141349

SEQ ID NO: 511834 - RNA, 64 nt, Human; identical to SEQ ID NO: 141350

SEQ ID NO: 511835 - RNA, 64 nt, Human; identical to SEQ ID NO: 141351

SEQ ID NO: 511836 - RNA, 64 nt, Human; identical to SEQ ID NO: 141352

SEQ ID NO: 511837 - RNA, 64 nt, Human; identical to SEQ ID NO: 141353

SEQ ID NO: 511838 - RNA, 64 nt, Human; identical to SEQ ID NO: 141354

SEQ ID NO: 511839 - RNA, 64 nt, Human; identical to SEQ ID NO: 141355

SEQ ID NO: 511840 - RNA, 64 nt, Human; identical to SEQ ID NO: 141356

SEQ ID NO: 511841 - RNA, 64 nt, Human; identical to SEQ ID NO: 141357

SEQ ID NO: 511842 - RNA, 64 nt, Human; identical to SEQ ID NO: 141358

SEQ ID NO: 511843 - RNA, 64 nt, Human
gagucuguuucaggccaggaggaggggauuugcugagggccaaggggguucugggacagagucu

SEQ ID NO: 511844 - RNA, 64 nt, Human
ugauuguuguggucaaugaaauacccaguuucuggagggccaggugggaaaugcuuucacugga

SEQ ID NO: 511845 - RNA, 64 nt, Human
aauaauccgaaaaguucgcuuugauauauuccuggagggccaagcccaucuauuuacaaaaggu

SEQ ID NO: 511846 - RNA, 64 nt, Human; identical to SEQ ID NO: 141359

SEQ ID NO: 511847 - RNA, 64 nt, Human; identical to SEQ ID NO: 141360

SEQ ID NO: 511848 - RNA, 64 nt, Human; identical to SEQ ID NO: 141361

SEQ ID NO: 511849 - RNA, 64 nt, Human; identical to SEQ ID NO: 141362

SEQ ID NO: 511850 - RNA, 64 nt, Human; identical to SEQ ID NO: 141363

SEQ ID NO: 511851 - RNA, 64 nt, Human; identical to SEQ ID NO: 141364

SEQ ID NO: 511852 - RNA, 64 nt, Human; identical to SEQ ID NO: 141365

SEQ ID NO: 511853 - RNA, 64 nt, Human; identical to SEQ ID NO: 141366

SEQ ID NO: 511854 - RNA, 64 nt, Human; identical to SEQ ID NO: 141367

SEQ ID NO: 511855 - RNA, 64 nt, Human; identical to SEQ ID NO: 141368

SEQ ID NO: 511856 - RNA, 64 nt, Human; identical to SEQ ID NO: 141369

SEQ ID NO: 511857 - RNA, 64 nt, Human; identical to SEQ ID NO: 141370

SEQ ID NO: 511858 - RNA, 64 nt, Human; identical to SEQ ID NO: 141371

SEQ ID NO: 511859 - RNA, 64 nt, Human; identical to SEQ ID NO: 141372

SEQ ID NO: 511860 - RNA, 64 nt, Human; identical to SEQ ID NO: 141373

SEQ ID NO: 511861 - RNA, 64 nt, Human; identical to SEQ ID NO: 141374

SEQ ID NO: 511862 - RNA, 64 nt, Human
uauuuugaugcaaaggaacggcccugggaccucagagggccacagaugggcuuccugggccuag

SEQ ID NO: 511863 - RNA, 64 nt, Human
uucccagccaaaugucugugcucucugugucacugagggccacagguuccucuaacaucuguca

SEQ ID NO: 511864 - RNA, 64 nt, Human
cagccugggcacccgcggggccgucccgccugcagagggccacucggggggguuuccaggcuua

SEQ ID NO: 511865 - RNA, 64 nt, Human; identical to SEQ ID NO: 141375

SEQ ID NO: 511866 - RNA, 64 nt, Human; identical to SEQ ID NO: 141376

SEQ ID NO: 511867 - RNA, 64 nt, Human; identical to SEQ ID NO: 141377

SEQ ID NO: 511868 - RNA, 64 nt, Human; identical to SEQ ID NO: 141378

SEQ ID NO: 511869 - RNA, 64 nt, Human; identical to SEQ ID NO: 141379

SEQ ID NO: 511870 - RNA, 64 nt, Human; identical to SEQ ID NO: 141380

SEQ ID NO: 511871 - RNA, 64 nt, Human; identical to SEQ ID NO: 141381

SEQ ID NO: 511872 - RNA, 64 nt, Human; identical to SEQ ID NO: 141382

SEQ ID NO: 511873 - RNA, 64 nt, Human; identical to SEQ ID NO: 141383

SEQ ID NO: 511874 - RNA, 64 nt, Human; identical to SEQ ID NO: 141384

SEQ ID NO: 511875 - RNA, 64 nt, Human; identical to SEQ ID NO: 141385

SEQ ID NO: 511876 - RNA, 64 nt, Human; identical to SEQ ID NO: 141386

SEQ ID NO: 511877 - RNA, 64 nt, Human; identical to SEQ ID NO: 141387

SEQ ID NO: 511878 - RNA, 64 nt, Human; identical to SEQ ID NO: 141388

SEQ ID NO: 511879 - RNA, 64 nt, Human; identical to SEQ ID NO: 141389

SEQ ID NO: 511880 - RNA, 64 nt, Human; identical to SEQ ID NO: 141390

SEQ ID NO: 511881 - RNA, 64 nt, Human
ucuaggcagagaggaggagagguguugccggcuggagggccaaccagugaacaccagcugugaa

SEQ ID NO: 511882 - RNA, 64 nt, Human
ccgcucaguauuacuuucugccgcugucaaggccgagggccaggcagaauggcugcacguaggu

SEQ ID NO: 511883 - RNA, 64 nt, Human
cacaccugggggacagaggcagauaagaaggugcgagggccacagcccugggaggggguccuga

SEQ ID NO: 511884 - RNA, 64 nt, Human; identical to SEQ ID NO: 141391

SEQ ID NO: 511885 - RNA, 64 nt, Human; identical to SEQ ID NO: 141392

SEQ ID NO: 511886 - RNA, 64 nt, Human; identical to SEQ ID NO: 141393

SEQ ID NO: 511887 - RNA, 64 nt, Human; identical to SEQ ID NO: 141394

SEQ ID NO: 511888 - RNA, 64 nt, Human; identical to SEQ ID NO: 141395

SEQ ID NO: 511889 - RNA, 64 nt, Human; identical to SEQ ID NO: 141396

SEQ ID NO: 511890 - RNA, 64 nt, Human; identical to SEQ ID NO: 141397

SEQ ID NO: 511891 - RNA, 64 nt, Human; identical to SEQ ID NO: 141398

SEQ ID NO: 511892 - RNA, 64 nt, Human; identical to SEQ ID NO: 141399

SEQ ID NO: 511893 - RNA, 64 nt, Human; identical to SEQ ID NO: 141400

SEQ ID NO: 511894 - RNA, 64 nt, Human; identical to SEQ ID NO: 141401

SEQ ID NO: 511895 - RNA, 64 nt, Human; identical to SEQ ID NO: 141402

SEQ ID NO: 511896 - RNA, 64 nt, Human; identical to SEQ ID NO: 141403

SEQ ID NO: 511897 - RNA, 64 nt, Human; identical to SEQ ID NO: 141404

SEQ ID NO: 511898 - RNA, 64 nt, Human; identical to SEQ ID NO: 141405

SEQ ID NO: 511899 - RNA, 64 nt, Human; identical to SEQ ID NO: 141406

SEQ ID NO: 511900 - RNA, 64 nt, Human
uuaggcucugaaaucuugggcaaaaugacaaggggagggccaggauuccucucucaggucacuc

SEQ ID NO: 511901 - RNA, 64 nt, Human
uuagcgggcuggguggaccccucgccuccuccccgagggccaaugccgcggacacguuuucacu

SEQ ID NO: 511902 - RNA, 64 nt, Human
cgggcagaguggcccagcccccccugggcagggagagggccaaggacaauugggagggcagcag

SEQ ID NO: 511903 - RNA, 64 nt, Human; identical to SEQ ID NO: 141422

SEQ ID NO: 511904 - RNA, 64 nt, Human
uuucguugugcagccuggccccccagggaccccagagggccagggcgcuagaugcaaggugcua

SEQ ID NO: 511905 - RNA, 64 nt, Human
ccacgcaggaaccgacacucagacacaaggcaaagagggccacaggacccgggaaauacacaca

SEQ ID NO: 511906 - RNA, 64 nt, Human
cucuggcgccuccaauccagacccaccacagcuggagggccaggccuccucuuccccaggcugc

SEQ ID NO: 511907 - RNA, 64 nt, Human
ccaggggggcccgaggcaggguccaaaccugagugagggccagccaugccuccccucccauucc

SEQ ID NO: 511908 - RNA, 64 nt, Human
ccacacccuucacccucuguguccugguccuucugagggccacugcagaugacucuccuuugaa

SEQ ID NO: 511909 - RNA, 64 nt, Human
uaaaggaagggcagacccgugucuuuccaugcccgagggccacgacgucacuaugcagggcaca

SEQ ID NO: 511910 - RNA, 64 nt, Human
gcugucacaggacccaccuccaugccaggcaacagagggccacagaaccacccccacggcucac

SEQ ID NO: 511911 - RNA, 64 nt, Human
uccccugggaaaaccgaagccagcaagaccaggagagggccaccucacugggccugccuccccc

SEQ ID NO: 511912 - RNA, 64 nt, Human
gguucuuuggguaaauugaggaacauggaaaauggagggccaccacuuagguuccauggagaau

SEQ ID NO: 511913 - RNA, 64 nt, Human
cuucucacucaccauccuguugggauuaacaguugagggccaucgcugccuaaacauuuagcgu

SEQ ID NO: 511914 - RNA, 64 nt, Human; identical to SEQ ID NO: 412535

SEQ ID NO: 511915 - RNA, 64 nt, Human; identical to SEQ ID NO: 412575

SEQ ID NO: 511916 - RNA, 64 nt, Human; identical to SEQ ID NO: 412686

SEQ ID NO: 511917 - RNA, 64 nt, Human; identical to SEQ ID NO: 410577

SEQ ID NO: 511918 - RNA, 64 nt, Human; identical to SEQ ID NO: 412705

SEQ ID NO: 511919 - RNA, 64 nt, Human; identical to SEQ ID NO: 409055

SEQ ID NO: 511920 - RNA, 64 nt, Human; identical to SEQ ID NO: 412329

SEQ ID NO: 511921 - RNA, 64 nt, Human; identical to SEQ ID NO: 412385

SEQ ID NO: 511922 - RNA, 64 nt, Human; identical to SEQ ID NO: 412442

SEQ ID NO: 511923 - RNA, 64 nt, Human; identical to SEQ ID NO: 412403

SEQ ID NO: 511924 - RNA, 64 nt, Human; identical to SEQ ID NO: 141423

SEQ ID NO: 511925 - RNA, 64 nt, Human; identical to SEQ ID NO: 141424

SEQ ID NO: 511926 - RNA, 64 nt, Human; identical to SEQ ID NO: 141425

SEQ ID NO: 511927 - RNA, 64 nt, Human; identical to SEQ ID NO: 141426

SEQ ID NO: 511928 - RNA, 64 nt, Human; identical to SEQ ID NO: 141427

SEQ ID NO: 511929 - RNA, 64 nt, Human; identical to SEQ ID NO: 141428

SEQ ID NO: 511930 - RNA, 64 nt, Human; identical to SEQ ID NO: 141429

SEQ ID NO: 511931 - RNA, 64 nt, Human; identical to SEQ ID NO: 141430

SEQ ID NO: 511932 - RNA, 64 nt, Human; identical to SEQ ID NO: 141431

SEQ ID NO: 511933 - RNA, 64 nt, Human; identical to SEQ ID NO: 141432

SEQ ID NO: 511934 - RNA, 64 nt, Human; identical to SEQ ID NO: 141433

SEQ ID NO: 511935 - RNA, 64 nt, Human; identical to SEQ ID NO: 141434

SEQ ID NO: 511936 - RNA, 64 nt, Human; identical to SEQ ID NO: 141435

SEQ ID NO: 511937 - RNA, 64 nt, Human; identical to SEQ ID NO: 141436

SEQ ID NO: 511938 - RNA, 64 nt, Human; identical to SEQ ID NO: 141437

SEQ ID NO: 511939 - RNA, 64 nt, Human; identical to SEQ ID NO: 141438

SEQ ID NO: 511940 - RNA, 62 nt, Human; identical to SEQ ID NO: 466929

SEQ ID NO: 511941 - RNA, 62 nt, Human; identical to SEQ ID NO: 467009

SEQ ID NO: 511942 - RNA, 62 nt, Human; identical to SEQ ID NO: 463037

SEQ ID NO: 511943 - RNA, 64 nt, Human; identical to SEQ ID NO: 141439

SEQ ID NO: 511944 - RNA, 64 nt, Human; identical to SEQ ID NO: 141440

SEQ ID NO: 511945 - RNA, 64 nt, Human; identical to SEQ ID NO: 141441

SEQ ID NO: 511946 - RNA, 64 nt, Human; identical to SEQ ID NO: 141442

SEQ ID NO: 511947 - RNA, 64 nt, Human; identical to SEQ ID NO: 141443

SEQ ID NO: 511948 - RNA, 64 nt, Human; identical to SEQ ID NO: 141444

SEQ ID NO: 511949 - RNA, 64 nt, Human; identical to SEQ ID NO: 141445

SEQ ID NO: 511950 - RNA, 64 nt, Human; identical to SEQ ID NO: 141446

SEQ ID NO: 511951 - RNA, 64 nt, Human; identical to SEQ ID NO: 141447

SEQ ID NO: 511952 - RNA, 64 nt, Human; identical to SEQ ID NO: 141448

SEQ ID NO: 511953 - RNA, 64 nt, Human; identical to SEQ ID NO: 141449

SEQ ID NO: 511954 - RNA, 64 nt, Human; identical to SEQ ID NO: 141450

SEQ ID NO: 511955 - RNA, 64 nt, Human; identical to SEQ ID NO: 141451

SEQ ID NO: 511956 - RNA, 64 nt, Human; identical to SEQ ID NO: 141452

SEQ ID NO: 511957 - RNA, 64 nt, Human; identical to SEQ ID NO: 141453

SEQ ID NO: 511958 - RNA, 64 nt, Human; identical to SEQ ID NO: 141454

SEQ ID NO: 511959 - RNA, 62 nt, Human; identical to SEQ ID NO: 463038

SEQ ID NO: 511960 - RNA, 62 nt, Human; identical to SEQ ID NO: 463039

SEQ ID NO: 511961 - RNA, 62 nt, Human; identical to SEQ ID NO: 463040

SEQ ID NO: 511962 - RNA, 64 nt, Human; identical to SEQ ID NO: 141455

SEQ ID NO: 511963 - RNA, 64 nt, Human; identical to SEQ ID NO: 141456

SEQ ID NO: 511964 - RNA, 64 nt, Human; identical to SEQ ID NO: 141457

SEQ ID NO: 511965 - RNA, 64 nt, Human; identical to SEQ ID NO: 141458

SEQ ID NO: 511966 - RNA, 64 nt, Human; identical to SEQ ID NO: 141459

SEQ ID NO: 511967 - RNA, 64 nt, Human; identical to SEQ ID NO: 141460

SEQ ID NO: 511968 - RNA, 64 nt, Human; identical to SEQ ID NO: 141461

SEQ ID NO: 511969 - RNA, 64 nt, Human; identical to SEQ ID NO: 141462

SEQ ID NO: 511970 - RNA, 64 nt, Human; identical to SEQ ID NO: 141463

SEQ ID NO: 511971 - RNA, 64 nt, Human; identical to SEQ ID NO: 141464

SEQ ID NO: 511972 - RNA, 64 nt, Human; identical to SEQ ID NO: 141465

SEQ ID NO: 511973 - RNA, 64 nt, Human; identical to SEQ ID NO: 141466

SEQ ID NO: 511974 - RNA, 64 nt, Human; identical to SEQ ID NO: 141467

SEQ ID NO: 511975 - RNA, 64 nt, Human; identical to SEQ ID NO: 141468

SEQ ID NO: 511976 - RNA, 64 nt, Human; identical to SEQ ID NO: 141469

SEQ ID NO: 511977 - RNA, 64 nt, Human; identical to SEQ ID NO: 141470

SEQ ID NO: 511978 - RNA, 62 nt, Human; identical to SEQ ID NO: 466760

SEQ ID NO: 511979 - RNA, 62 nt, Human; identical to SEQ ID NO: 463084

SEQ ID NO: 511980 - RNA, 62 nt, Human; identical to SEQ ID NO: 466703

SEQ ID NO: 511981 - RNA, 64 nt, Human; identical to SEQ ID NO: 141471

SEQ ID NO: 511982 - RNA, 64 nt, Human; identical to SEQ ID NO: 141472

SEQ ID NO: 511983 - RNA, 64 nt, Human; identical to SEQ ID NO: 141473

SEQ ID NO: 511984 - RNA, 64 nt, Human; identical to SEQ ID NO: 141474

SEQ ID NO: 511985 - RNA, 64 nt, Human; identical to SEQ ID NO: 141475

SEQ ID NO: 511986 - RNA, 64 nt, Human; identical to SEQ ID NO: 141476

SEQ ID NO: 511987 - RNA, 64 nt, Human; identical to SEQ ID NO: 141477

SEQ ID NO: 511988 - RNA, 64 nt, Human; identical to SEQ ID NO: 141478

SEQ ID NO: 511989 - RNA, 64 nt, Human; identical to SEQ ID NO: 141479

SEQ ID NO: 511990 - RNA, 64 nt, Human; identical to SEQ ID NO: 141480

SEQ ID NO: 511991 - RNA, 64 nt, Human; identical to SEQ ID NO: 141481

SEQ ID NO: 511992 - RNA, 64 nt, Human; identical to SEQ ID NO: 141482

SEQ ID NO: 511993 - RNA, 64 nt, Human; identical to SEQ ID NO: 141483

SEQ ID NO: 511994 - RNA, 64 nt, Human; identical to SEQ ID NO: 141484

SEQ ID NO: 511995 - RNA, 64 nt, Human; identical to SEQ ID NO: 141485

SEQ ID NO: 511996 - RNA, 64 nt, Human; identical to SEQ ID NO: 141486

SEQ ID NO: 511997 - RNA, 62 nt, Human; identical to SEQ ID NO: 466725

SEQ ID NO: 511998 - RNA, 62 nt, Human; identical to SEQ ID NO: 466684

SEQ ID NO: 511999 - RNA, 64 nt, Human; identical to SEQ ID NO: 141487

SEQ ID NO: 512000 - RNA, 64 nt, Human; identical to SEQ ID NO: 141488

SEQ ID NO: 512001 - RNA, 64 nt, Human; identical to SEQ ID NO: 141489

SEQ ID NO: 512002 - RNA, 64 nt, Human; identical to SEQ ID NO: 141490

SEQ ID NO: 512003 - RNA, 64 nt, Human; identical to SEQ ID NO: 141491

SEQ ID NO: 512004 - RNA, 64 nt, Human; identical to SEQ ID NO: 141492

SEQ ID NO: 512005 - RNA, 64 nt, Human; identical to SEQ ID NO: 141493

SEQ ID NO: 512006 - RNA, 64 nt, Human; identical to SEQ ID NO: 141494

SEQ ID NO: 512007 - RNA, 64 nt, Human; identical to SEQ ID NO: 141495

SEQ ID NO: 512008 - RNA, 56 nt, Human; identical to SEQ ID NO: 141496

SEQ ID NO: 512009 - RNA, 64 nt, Human; identical to SEQ ID NO: 141497

SEQ ID NO: 512010 - RNA, 64 nt, Human; identical to SEQ ID NO: 141498

SEQ ID NO: 512011 - RNA, 64 nt, Human; identical to SEQ ID NO: 141499

SEQ ID NO: 512012 - RNA, 64 nt, Human; identical to SEQ ID NO: 141500

SEQ ID NO: 512013 - RNA, 64 nt, Human; identical to SEQ ID NO: 141501

SEQ ID NO: 512014 - RNA, 64 nt, Human; identical to SEQ ID NO: 141502

SEQ ID NO: 512015 - RNA, 64 nt, Human; identical to SEQ ID NO: 412893

SEQ ID NO: 512016 - RNA, 64 nt, Human; identical to SEQ ID NO: 412912

SEQ ID NO: 512017 - RNA, 64 nt, Human; identical to SEQ ID NO: 412931

SEQ ID NO: 512018 - RNA, 64 nt, Human; identical to SEQ ID NO: 141503

SEQ ID NO: 512019 - RNA, 64 nt, Human; identical to SEQ ID NO: 141504

SEQ ID NO: 512020 - RNA, 64 nt, Human; identical to SEQ ID NO: 141505

SEQ ID NO: 512021 - RNA, 64 nt, Human; identical to SEQ ID NO: 141506

SEQ ID NO: 512022 - RNA, 64 nt, Human; identical to SEQ ID NO: 141507

SEQ ID NO: 512023 - RNA, 64 nt, Human; identical to SEQ ID NO: 141508

SEQ ID NO: 512024 - RNA, 64 nt, Human; identical to SEQ ID NO: 141509

SEQ ID NO: 512025 - RNA, 64 nt, Human; identical to SEQ ID NO: 141510

SEQ ID NO: 512026 - RNA, 64 nt, Human; identical to SEQ ID NO: 141511

SEQ ID NO: 512027 - RNA, 64 nt, Human; identical to SEQ ID NO: 141512

SEQ ID NO: 512028 - RNA, 64 nt, Human; identical to SEQ ID NO: 141513

SEQ ID NO: 512029 - RNA, 64 nt, Human; identical to SEQ ID NO: 141514

SEQ ID NO: 512030 - RNA, 64 nt, Human; identical to SEQ ID NO: 141515

SEQ ID NO: 512031 - RNA, 62 nt, Human; identical to SEQ ID NO: 141516

SEQ ID NO: 512032 - RNA, 64 nt, Human; identical to SEQ ID NO: 141517

SEQ ID NO: 512033 - RNA, 64 nt, Human; identical to SEQ ID NO: 141518

SEQ ID NO: 512034 - RNA, 64 nt, Human; identical to SEQ ID NO: 409093

SEQ ID NO: 512035 - RNA, 64 nt, Human; identical to SEQ ID NO: 412950

SEQ ID NO: 512036 - RNA, 64 nt, Human; identical to SEQ ID NO: 412967

SEQ ID NO: 512037 - RNA, 64 nt, Human; identical to SEQ ID NO: 141519

SEQ ID NO: 512038 - RNA, 64 nt, Human; identical to SEQ ID NO: 141520

SEQ ID NO: 512039 - RNA, 64 nt, Human; identical to SEQ ID NO: 141521

SEQ ID NO: 512040 - RNA, 64 nt, Human; identical to SEQ ID NO: 141522

SEQ ID NO: 512041 - RNA, 64 nt, Human; identical to SEQ ID NO: 141523

SEQ ID NO: 512042 - RNA, 64 nt, Human; identical to SEQ ID NO: 141524

SEQ ID NO: 512043 - RNA, 64 nt, Human; identical to SEQ ID NO: 141525

SEQ ID NO: 512044 - RNA, 64 nt, Human; identical to SEQ ID NO: 141526

SEQ ID NO: 512045 - RNA, 64 nt, Human; identical to SEQ ID NO: 141527

SEQ ID NO: 512046 - RNA, 64 nt, Human; identical to SEQ ID NO: 141528

SEQ ID NO: 512047 - RNA, 64 nt, Human; identical to SEQ ID NO: 141529

SEQ ID NO: 512048 - RNA, 64 nt, Human; identical to SEQ ID NO: 141530

SEQ ID NO: 512049 - RNA, 64 nt, Human; identical to SEQ ID NO: 141531

SEQ ID NO: 512050 - RNA, 64 nt, Human; identical to SEQ ID NO: 141532

SEQ ID NO: 512051 - RNA, 64 nt, Human; identical to SEQ ID NO: 141533

SEQ ID NO: 512052 - RNA, 64 nt, Human; identical to SEQ ID NO: 141534

SEQ ID NO: 512053 - RNA, 64 nt, Human
acuauuggcccuaaauagcagaaagaagagaagugaccgagagaaccucagauucuucauugag

SEQ ID NO: 512054 - RNA, 64 nt, Human
ucacaccuucuggcaaauucaagaggcaugaguggaccgagagcacauccagcauuugcaucac

SEQ ID NO: 512055 - RNA, 64 nt, Human
ccugacagccucccagccagggcuggcgauaaaggaccgagauagauggagggggcgaguaggg

SEQ ID NO: 512056 - RNA, 64 nt, Human; identical to SEQ ID NO: 141535

SEQ ID NO: 512057 - RNA, 64 nt, Human; identical to SEQ ID NO: 141536

SEQ ID NO: 512058 - RNA, 64 nt, Human; identical to SEQ ID NO: 141537

SEQ ID NO: 512059 - RNA, 64 nt, Human; identical to SEQ ID NO: 141538

SEQ ID NO: 512060 - RNA, 64 nt, Human; identical to SEQ ID NO: 141539

SEQ ID NO: 512061 - RNA, 64 nt, Human; identical to SEQ ID NO: 141540

SEQ ID NO: 512062 - RNA, 64 nt, Human; identical to SEQ ID NO: 141541

SEQ ID NO: 512063 - RNA, 64 nt, Human; identical to SEQ ID NO: 141542

SEQ ID NO: 512064 - RNA, 64 nt, Human; identical to SEQ ID NO: 141543

SEQ ID NO: 512065 - RNA, 64 nt, Human; identical to SEQ ID NO: 141544

SEQ ID NO: 512066 - RNA, 64 nt, Human; identical to SEQ ID NO: 141545

SEQ ID NO: 512067 - RNA, 64 nt, Human; identical to SEQ ID NO: 141546

SEQ ID NO: 512068 - RNA, 64 nt, Human; identical to SEQ ID NO: 141547

SEQ ID NO: 512069 - RNA, 64 nt, Human; identical to SEQ ID NO: 141548

SEQ ID NO: 512070 - RNA, 64 nt, Human; identical to SEQ ID NO: 141549

SEQ ID NO: 512071 - RNA, 64 nt, Human; identical to SEQ ID NO: 141550

SEQ ID NO: 512072 - RNA, 64 nt, Human; identical to SEQ ID NO: 412761

SEQ ID NO: 512073 - RNA, 64 nt, Human; identical to SEQ ID NO: 410540

SEQ ID NO: 512074 - RNA, 64 nt, Human; identical to SEQ ID NO: 413228

SEQ ID NO: 512075 - RNA, 64 nt, Human; identical to SEQ ID NO: 141551

SEQ ID NO: 512076 - RNA, 64 nt, Human; identical to SEQ ID NO: 141552

SEQ ID NO: 512077 - RNA, 64 nt, Human; identical to SEQ ID NO: 141553

SEQ ID NO: 512078 - RNA, 64 nt, Human; identical to SEQ ID NO: 141554

SEQ ID NO: 512079 - RNA, 64 nt, Human; identical to SEQ ID NO: 141555

SEQ ID NO: 512080 - RNA, 64 nt, Human; identical to SEQ ID NO: 141556

SEQ ID NO: 512081 - RNA, 64 nt, Human; identical to SEQ ID NO: 141557

SEQ ID NO: 512082 - RNA, 64 nt, Human; identical to SEQ ID NO: 141558

SEQ ID NO: 512083 - RNA, 64 nt, Human; identical to SEQ ID NO: 141559

SEQ ID NO: 512084 - RNA, 64 nt, Human; identical to SEQ ID NO: 141560

SEQ ID NO: 512085 - RNA, 64 nt, Human; identical to SEQ ID NO: 141561

SEQ ID NO: 512086 - RNA, 64 nt, Human; identical to SEQ ID NO: 141562

SEQ ID NO: 512087 - RNA, 64 nt, Human; identical to SEQ ID NO: 141563

SEQ ID NO: 512088 - RNA, 64 nt, Human; identical to SEQ ID NO: 141564

SEQ ID NO: 512089 - RNA, 64 nt, Human; identical to SEQ ID NO: 141565

SEQ ID NO: 512090 - RNA, 64 nt, Human; identical to SEQ ID NO: 141566

SEQ ID NO: 512091 - RNA, 64 nt, Human; identical to SEQ ID NO: 412741

SEQ ID NO: 512092 - RNA, 64 nt, Human; identical to SEQ ID NO: 412742

SEQ ID NO: 512093 - RNA, 64 nt, Human; identical to SEQ ID NO: 410541

SEQ ID NO: 512094 - RNA, 64 nt, Human; identical to SEQ ID NO: 141567

SEQ ID NO: 512095 - RNA, 64 nt, Human; identical to SEQ ID NO: 141568

SEQ ID NO: 512096 - RNA, 64 nt, Human; identical to SEQ ID NO: 141569

SEQ ID NO: 512097 - RNA, 64 nt, Human; identical to SEQ ID NO: 141570

SEQ ID NO: 512098 - RNA, 64 nt, Human; identical to SEQ ID NO: 141571

SEQ ID NO: 512099 - RNA, 64 nt, Human; identical to SEQ ID NO: 141572

SEQ ID NO: 512100 - RNA, 64 nt, Human; identical to SEQ ID NO: 141573

SEQ ID NO: 512101 - RNA, 64 nt, Human; identical to SEQ ID NO: 141574

SEQ ID NO: 512102 - RNA, 64 nt, Human; identical to SEQ ID NO: 141575

SEQ ID NO: 512103 - RNA, 64 nt, Human; identical to SEQ ID NO: 141576

SEQ ID NO: 512104 - RNA, 64 nt, Human; identical to SEQ ID NO: 141577

SEQ ID NO: 512105 - RNA, 64 nt, Human; identical to SEQ ID NO: 141578

SEQ ID NO: 512106 - RNA, 64 nt, Human; identical to SEQ ID NO: 141579

SEQ ID NO: 512107 - RNA, 64 nt, Human; identical to SEQ ID NO: 141580

SEQ ID NO: 512108 - RNA, 64 nt, Human; identical to SEQ ID NO: 141581

SEQ ID NO: 512109 - RNA, 64 nt, Human; identical to SEQ ID NO: 141582

SEQ ID NO: 512110 - RNA, 64 nt, Human; identical to SEQ ID NO: 412535

SEQ ID NO: 512111 - RNA, 64 nt, Human; identical to SEQ ID NO: 408903

SEQ ID NO: 512112 - RNA, 64 nt, Human; identical to SEQ ID NO: 412537

SEQ ID NO: 512113 - RNA, 64 nt, Human; identical to SEQ ID NO: 141583

SEQ ID NO: 512114 - RNA, 64 nt, Human; identical to SEQ ID NO: 141584

SEQ ID NO: 512115 - RNA, 64 nt, Human; identical to SEQ ID NO: 141585

SEQ ID NO: 512116 - RNA, 64 nt, Human; identical to SEQ ID NO: 141586

SEQ ID NO: 512117 - RNA, 64 nt, Human; identical to SEQ ID NO: 141587

SEQ ID NO: 512118 - RNA, 64 nt, Human; identical to SEQ ID NO: 141588

SEQ ID NO: 512119 - RNA, 64 nt, Human; identical to SEQ ID NO: 141589

SEQ ID NO: 512120 - RNA, 64 nt, Human; identical to SEQ ID NO: 141590

SEQ ID NO: 512121 - RNA, 64 nt, Human; identical to SEQ ID NO: 141591

SEQ ID NO: 512122 - RNA, 64 nt, Human; identical to SEQ ID NO: 141592

SEQ ID NO: 512123 - RNA, 64 nt, Human; identical to SEQ ID NO: 141593

SEQ ID NO: 512124 - RNA, 64 nt, Human; identical to SEQ ID NO: 141594

SEQ ID NO: 512125 - RNA, 64 nt, Human; identical to SEQ ID NO: 141595

SEQ ID NO: 512126 - RNA, 56 nt, Human; identical to SEQ ID NO: 141596

SEQ ID NO: 512127 - RNA, 64 nt, Human; identical to SEQ ID NO: 141597

SEQ ID NO: 512128 - RNA, 64 nt, Human; identical to SEQ ID NO: 141598

SEQ ID NO: 512129 - RNA, 64 nt, Human; identical to SEQ ID NO: 412743

SEQ ID NO: 512130 - RNA, 64 nt, Human; identical to SEQ ID NO: 410559

SEQ ID NO: 512131 - RNA, 64 nt, Human; identical to SEQ ID NO: 409034

SEQ ID NO: 512132 - RNA, 64 nt, Human; identical to SEQ ID NO: 141599

SEQ ID NO: 512133 - RNA, 64 nt, Human; identical to SEQ ID NO: 141600

SEQ ID NO: 512134 - RNA, 64 nt, Human; identical to SEQ ID NO: 141601

SEQ ID NO: 512135 - RNA, 64 nt, Human; identical to SEQ ID NO: 141602

SEQ ID NO: 512136 - RNA, 64 nt, Human; identical to SEQ ID NO: 141603

SEQ ID NO: 512137 - RNA, 64 nt, Human; identical to SEQ ID NO: 141604

SEQ ID NO: 512138 - RNA, 64 nt, Human; identical to SEQ ID NO: 141605

SEQ ID NO: 512139 - RNA, 64 nt, Human; identical to SEQ ID NO: 141606

SEQ ID NO: 512140 - RNA, 64 nt, Human; identical to SEQ ID NO: 141607

SEQ ID NO: 512141 - RNA, 64 nt, Human; identical to SEQ ID NO: 141608

SEQ ID NO: 512142 - RNA, 64 nt, Human; identical to SEQ ID NO: 141609

SEQ ID NO: 512143 - RNA, 64 nt, Human; identical to SEQ ID NO: 141610

SEQ ID NO: 512144 - RNA, 64 nt, Human; identical to SEQ ID NO: 141611

SEQ ID NO: 512145 - RNA, 64 nt, Human; identical to SEQ ID NO: 141612

SEQ ID NO: 512146 - RNA, 64 nt, Human; identical to SEQ ID NO: 141613

SEQ ID NO: 512147 - RNA, 64 nt, Human; identical to SEQ ID NO: 141614

SEQ ID NO: 512148 - RNA, 64 nt, Human; identical to SEQ ID NO: 412574

SEQ ID NO: 512149 - RNA, 64 nt, Human; identical to SEQ ID NO: 412575

SEQ ID NO: 512150 - RNA, 64 nt, Human; identical to SEQ ID NO: 412592

SEQ ID NO: 512151 - RNA, 64 nt, Human; identical to SEQ ID NO: 141615

SEQ ID NO: 512152 - RNA, 64 nt, Human; identical to SEQ ID NO: 141616

SEQ ID NO: 512153 - RNA, 64 nt, Human; identical to SEQ ID NO: 141617

SEQ ID NO: 512154 - RNA, 64 nt, Human; identical to SEQ ID NO: 141618

SEQ ID NO: 512155 - RNA, 64 nt, Human; identical to SEQ ID NO: 141619

SEQ ID NO: 512156 - RNA, 50 nt, Human; identical to SEQ ID NO: 141620

SEQ ID NO: 512157 - RNA, 64 nt, Human; identical to SEQ ID NO: 141621

SEQ ID NO: 512158 - RNA, 64 nt, Human; identical to SEQ ID NO: 141622

SEQ ID NO: 512159 - RNA, 64 nt, Human; identical to SEQ ID NO: 141623

SEQ ID NO: 512160 - RNA, 64 nt, Human; identical to SEQ ID NO: 141624

SEQ ID NO: 512161 - RNA, 64 nt, Human; identical to SEQ ID NO: 141625

SEQ ID NO: 512162 - RNA, 64 nt, Human; identical to SEQ ID NO: 141626

SEQ ID NO: 512163 - RNA, 64 nt, Human; identical to SEQ ID NO: 141627

SEQ ID NO: 512164 - RNA, 64 nt, Human; identical to SEQ ID NO: 141628

SEQ ID NO: 512165 - RNA, 64 nt, Human; identical to SEQ ID NO: 141629

SEQ ID NO: 512166 - RNA, 64 nt, Human; identical to SEQ ID NO: 141630

SEQ ID NO: 512167 - RNA, 64 nt, Human
gggaggccgaggcgagcagaucacgaggucaggagaccgagaccauccuggcuaacauggugaa

SEQ ID NO: 512168 - RNA, 64 nt, Human
ugcaaaugcagaagacuuaccuuaguucaaggggaggggacaaagaccccacagcccaacagca

SEQ ID NO: 512169 - RNA, 64 nt, Human; identical to SEQ ID NO: 141631

SEQ ID NO: 512170 - RNA, 64 nt, Human; identical to SEQ ID NO: 141632

SEQ ID NO: 512171 - RNA, 64 nt, Human; identical to SEQ ID NO: 141633

SEQ ID NO: 512172 - RNA, 64 nt, Human; identical to SEQ ID NO: 141634

SEQ ID NO: 512173 - RNA, 64 nt, Human; identical to SEQ ID NO: 141635

SEQ ID NO: 512174 - RNA, 64 nt, Human; identical to SEQ ID NO: 141636

SEQ ID NO: 512175 - RNA, 64 nt, Human; identical to SEQ ID NO: 141637

SEQ ID NO: 512176 - RNA, 64 nt, Human; identical to SEQ ID NO: 141638

SEQ ID NO: 512177 - RNA, 64 nt, Human; identical to SEQ ID NO: 141639

SEQ ID NO: 512178 - RNA, 64 nt, Human; identical to SEQ ID NO: 141640

SEQ ID NO: 512179 - RNA, 64 nt, Human; identical to SEQ ID NO: 141641

SEQ ID NO: 512180 - RNA, 64 nt, Human; identical to SEQ ID NO: 141642

SEQ ID NO: 512181 - RNA, 64 nt, Human; identical to SEQ ID NO: 141643

SEQ ID NO: 512182 - RNA, 64 nt, Human; identical to SEQ ID NO: 141644

SEQ ID NO: 512183 - RNA, 64 nt, Human; identical to SEQ ID NO: 141645

SEQ ID NO: 512184 - RNA, 64 nt, Human; identical to SEQ ID NO: 141646

SEQ ID NO: 512185 - RNA, 64 nt, Human
aggccaggguucgggaaguacacugccaucggucaggggacagcugccucccaccuugccuggg

SEQ ID NO: 512186 - RNA, 64 nt, Human
agcagccccacaaguaacuggaaaucugaagaccaggggacaaaugcuggugaaugcuuaggcc

SEQ ID NO: 512187 - RNA, 64 nt, Human
cuuauuggucuuuuuguuuaauaccuuccccaagaggggacagucuggccaacuugcuccagua

SEQ ID NO: 512188 - RNA, 64 nt, Human; identical to SEQ ID NO: 141647

SEQ ID NO: 512189 - RNA, 64 nt, Human; identical to SEQ ID NO: 141648

SEQ ID NO: 512190 - RNA, 64 nt, Human; identical to SEQ ID NO: 141649

SEQ ID NO: 512191 - RNA, 64 nt, Human; identical to SEQ ID NO: 141650

SEQ ID NO: 512192 - RNA, 64 nt, Human; identical to SEQ ID NO: 141651

SEQ ID NO: 512193 - RNA, 64 nt, Human; identical to SEQ ID NO: 141652

SEQ ID NO: 512194 - RNA, 64 nt, Human; identical to SEQ ID NO: 141653

SEQ ID NO: 512195 - RNA, 64 nt, Human; identical to SEQ ID NO: 141654

SEQ ID NO: 512196 - RNA, 64 nt, Human; identical to SEQ ID NO: 141655

SEQ ID NO: 512197 - RNA, 64 nt, Human; identical to SEQ ID NO: 141656

SEQ ID NO: 512198 - RNA, 64 nt, Human; identical to SEQ ID NO: 141657

SEQ ID NO: 512199 - RNA, 64 nt, Human; identical to SEQ ID NO: 141658

SEQ ID NO: 512200 - RNA, 64 nt, Human; identical to SEQ ID NO: 141659

SEQ ID NO: 512201 - RNA, 64 nt, Human; identical to SEQ ID NO: 141660

SEQ ID NO: 512202 - RNA, 64 nt, Human; identical to SEQ ID NO: 141661

SEQ ID NO: 512203 - RNA, 64 nt, Human; identical to SEQ ID NO: 141662

SEQ ID NO: 512204 - RNA, 64 nt, Human; identical to SEQ ID NO: 412874

SEQ ID NO: 512205 - RNA, 64 nt, Human; identical to SEQ ID NO: 141663

SEQ ID NO: 512206 - RNA, 64 nt, Human
cugucccugcguguggccacuccucagcauccuccccacccaccaugguucauuccgacuuuuc

SEQ ID NO: 512207 - RNA, 64 nt, Human
accgccacguggccuucagaggaauccacagguccccacccaagaucccucaauuauaugggga

SEQ ID NO: 512208 - RNA, 64 nt, Human
ggaaggcacugguuaggaaggauguucaaacggucccacccaagccugucaccucugcucaucc

SEQ ID NO: 512209 - RNA, 64 nt, Human
gccaugccuaccaagcucgagcuggcccuugacccccacccacccccacccuugcuggcagggg

SEQ ID NO: 512210 - RNA, 64 nt, Human
uguuggaggccaaauguggcaaaccaaccccaggcccacccagagcgagcaaacgcugagaccu

SEQ ID NO: 512211 - RNA, 64 nt, Human
acaguuggugcgugauaugguuaagcuuuguguccccacccacaucucaucuugaaugguaauc

SEQ ID NO: 512212 - RNA, 64 nt, Human
cuggagguggguccuuauuucaagccauauucaacccacccaacaaaaccuaacauugaggugg

SEQ ID NO: 512213 - RNA, 64 nt, Human
cucguucugcgaggggcucaugggucugagagcccccacccacuaggcuugauugcaucccugu

SEQ ID NO: 512214 - RNA, 64 nt, Human
cccugccuggaguccuugaccgcucucugugggccccacccacucuguccugggaaaugaagaa

SEQ ID NO: 512215 - RNA, 64 nt, Human
acucugggauccacacccuuggacagggugggagaggggacacauggguguccagggagaaggc

SEQ ID NO: 512216 - RNA, 64 nt, Human
agguggcucuucugcuggggcugacuuguccagaaggggacaaagugcaauacagagccuuccc

SEQ ID NO: 512217 - RNA, 64 nt, Human
guggucauuggccgacaucacaguuuuccuguuucccacccagcuaaaaaccguuguuugcuuu

SEQ ID NO: 512218 - RNA, 64 nt, Human
auuugggauuucaaaacacaaaugaaaacucacacccacccacccccaagugcaugucuccauc

SEQ ID NO: 512219 - RNA, 64 nt, Human
gggacaggggaggacccuucuuuuggacagcccccccacccagagcccggucccuugggggccu

SEQ ID NO: 512220 - RNA, 64 nt, Human
agaagaaugcaccucauucuucccuggccucuuucccacccacagcccccagaggcucuagauc

SEQ ID NO: 512221 - RNA, 57 nt, Human; identical to SEQ ID NO: 53788

SEQ ID NO: 512222 - RNA, 64 nt, Human
uaaaaucacaccuacucugugguaagaauaaaaucccacccaccugggacuugguaauuucucc

SEQ ID NO: 512223 - RNA, 64 nt, Human
ucccaucugccugagccagggaaggacccccucccccacccaccucucuggcuuccaugcuccg

SEQ ID NO: 512224 - RNA, 64 nt, Human
gggcccuggcagaggguggggcacugcaccuuaccccacccauccaugccagcacuucugcacu

SEQ ID NO: 512225 - RNA, 64 nt, Human
uucggaaguuaccagccugugagauccaagcccccccacccaggcccccuaaaaaucagggccu

SEQ ID NO: 512226 - RNA, 64 nt, Human
aagauuuccuccaagccacaugaggacucuggcacccacccacaaagcaagaccuguauuuaua

SEQ ID NO: 512227 - RNA, 64 nt, Human
gaugguuuaggucuggcaauuguccuugaaaaaucccacccauguuguaccaccuuggugaguc

SEQ ID NO: 512228 - RNA, 64 nt, Human
auggccuaugcacauauggacucugcacaugaaucccacccacaugugacacauaugcaccuug

SEQ ID NO: 512229 - RNA, 64 nt, Human
ggauggccuccuugcugucuuuauugaagagcugcccacccagagucuugacucuagggcaggc

SEQ ID NO: 512230 - RNA, 64 nt, Human
cuggguuggucugccccucagucaggcccccuuacccacccaccagccccaaggcccgaccccu

SEQ ID NO: 512231 - RNA, 62 nt, Human; identical to SEQ ID NO: 466667

SEQ ID NO: 512232 - RNA, 64 nt, Human
caagcacauauuuugaaauggacugugaaggaaaaggggacaggaacaaaggaccaaaaauaag

SEQ ID NO: 512233 - RNA, 64 nt, Human
ucagaaacccuacuguuuguuagacaggugguugaggggacaugucagacccuauccucauggc

SEQ ID NO: 512234 - RNA, 64 nt, Human
agccuucagucaggguuugucagaggaacaaaccaggggacacuuuguuagaaagugcuuagag

SEQ ID NO: 512235 - RNA, 64 nt, Human
guugccaucuauaaggauugugccaguuuacagucccacccacaaugcaugagagugccuauua

SEQ ID NO: 512236 - RNA, 64 nt, Human
guccucccugugucccgcugugauucuauuuccucccacccacuccucaaauccugucauuauu

SEQ ID NO: 512237 - RNA, 64 nt, Human
guguggcaaauagaaguauaucaagcaauaaucucccacccaaggcuucuguaaacugggacca

SEQ ID NO: 512238 - RNA, 64 nt, Human
gagggccaacaacugucccuccuugagcaccagccccacccaagcaagcagacauuuaucuuuu

SEQ ID NO: 512239 - RNA, 64 nt, Human
uucuuuguuaggcugugucucccuaagcccuugccccacccagaguuucccguccccuucacug

SEQ ID NO: 512240 - RNA, 64 nt, Human
acuggucccugccucuggggcuuuucugaagaaacccacccacugugaucaauagggagagaaa

SEQ ID NO: 512241 - RNA, 64 nt, Human
ccuagagggucagauggggggaaccccacccugccccacccaucugaacacucauuacacuaaa

SEQ ID NO: 512242 - RNA, 64 nt, Human
ccccuagccccacucccugccuccugaaaugguucccacccagaacuaauuuauuuuuuauuaa

SEQ ID NO: 512243 - RNA, 64 nt, Human
aaccgcagggccgccccucccgcuugcuccccagcccacccaccccccuguacagaaugucugc

SEQ ID NO: 512244 - RNA, 64 nt, Human
aucaaaccccauggagcagccagcguuagaugcccccacccaccuguacucuggagagacugug

SEQ ID NO: 512245 - RNA, 64 nt, Human
cuguaaggcaaaauaaucuaaaaagacuaaccugcccacccacuccuuauauugcugugagauu

SEQ ID NO: 512246 - RNA, 64 nt, Human
uuaauguacuccaggcuucuucagauagguucagcccacccacccccaugauuguaugaaguuu

SEQ ID NO: 512247 - RNA, 64 nt, Human
ugcucuccgcuccacccccugccaacuacucagucccacccaacuuguaaaccaauaccaaaau

SEQ ID NO: 512248 - RNA, 64 nt, Human
ucaugaaaaauuaauccucaguuccacgagacugcccacccacagacaaaaaaauauauauauu

SEQ ID NO: 512249 - RNA, 62 nt, Human; identical to SEQ ID NO: 466819

SEQ ID NO: 512250 - RNA, 62 nt, Human; identical to SEQ ID NO: 463082

SEQ ID NO: 512251 - RNA, 62 nt, Human; identical to SEQ ID NO: 467111

SEQ ID NO: 512252 - RNA, 62 nt, Human; identical to SEQ ID NO: 467112

SEQ ID NO: 512253 - RNA, 64 nt, Human
aagagguugagaagacuccugggcuucagccucucccacccagcccugccccucaccugccugc

SEQ ID NO: 512254 - RNA, 55 nt, Human; identical to SEQ ID NO: 53813

SEQ ID NO: 512255 - RNA, 64 nt, Human
uucccugccacagccaaacccccacugcacccuacccacccaccccuagcccaggucagcuuuc

SEQ ID NO: 512256 - RNA, 64 nt, Human
ugcccauacugagccugccaaagugccugggaagcccacccagauucugaaacaggcccucugu

SEQ ID NO: 512257 - RNA, 64 nt, Human
agcacaaagcagauccucaauaaacauuucauuucccacccacacucgccagcucaccccauca

SEQ ID NO: 512258 - RNA, 64 nt, Human
uauaaauagguuuauguguacugguuugcauguacccacccaaaaugauuauuuuuguagaauc

SEQ ID NO: 512259 - RNA, 64 nt, Human
aagaggggcaggugggccucucuaggaucagugucccacccagaggccaguggccccuucacau

SEQ ID NO: 512260 - RNA, 64 nt, Human
caaaaccaucuucccacauguggguuguuggaaucccacccacucccccggacccugccccucc

SEQ ID NO: 512261 - RNA, 64 nt, Human
guagcucucgcuuaacuuccuaggggcugcugagcccacccagagguuguuggaguucagcggg

SEQ ID NO: 512262 - RNA, 64 nt, Human
ggcgcggggggccccaagcugcgccggccuccagcccacccacagcuguugcugaagucaggcc

SEQ ID NO: 512263 - RNA, 64 nt, Human
agugacuaauuuucccuuacaguuccugcuuggucccacccacugaaguagcucaucguagugc

SEQ ID NO: 512264 - RNA, 64 nt, Human
ucccacucuucauccuggaagugggaacuggagucccacccacagugcauucagaaagcaugcu

SEQ ID NO: 512265 - RNA, 64 nt, Human
gggacauaaaccacgagagugacagucaucuuugcccacccaguguaaugucacugcucaaauu

SEQ ID NO: 512266 - RNA, 64 nt, Human
gaaugcagggaagagggcaguaccugggaaaggacccacccaucuuccugcugcuguaacugcu

SEQ ID NO: 512267 - RNA, 62 nt, Human; identical to SEQ ID NO: 463065

SEQ ID NO: 512268 - RNA, 62 nt, Human; identical to SEQ ID NO: 467052

SEQ ID NO: 512269 - RNA, 62 nt, Human; identical to SEQ ID NO: 466817

SEQ ID NO: 512270 - RNA, 62 nt, Human; identical to SEQ ID NO: 466758

SEQ ID NO: 512271 - RNA, 64 nt, Human
cccauccuagaggccaggcaggagcccuucuauacccacccagaaugagacauccagcagauuu

SEQ ID NO: 512272 - RNA, 64 nt, Human
ugggcugcccccugccuccccacccuccccauggcccacccaucugggcugucucugcagggca

SEQ ID NO: 512273 - RNA, 64 nt, Human
gguccccauccccaccagcucguuuuucagcacccccacccaccuccacccagccccuggcacc

SEQ ID NO: 512274 - RNA, 64 nt, Human
uugagguagauugaccggcuuuagacgcccaccccccacccaccgcaagcuuugagugggacac

SEQ ID NO: 512275 - RNA, 64 nt, Human
ccacauugucccuucagcucagcugcucuucucccccacccacccugggaugugggugcucugg

SEQ ID NO: 512276 - RNA, 64 nt, Human
ccagucaggagagugagcucucagaagccagagccccacccaaggggacccuggucucuccgcc

SEQ ID NO: 512277 - RNA, 64 nt, Human
gcucuucauugguugucucugugagagcacuguccccacccaaccugucacaacggccagaacc

SEQ ID NO: 512278 - RNA, 64 nt, Human
uuucuaaccaaagagucucuggcucagcuguggucccacccaggaagggagggagcugaggccu

SEQ ID NO: 512279 - RNA, 64 nt, Human
gccccuacaugccuguagccuuucucacuccauccccacccaaagugcucagaccuugucuagu

SEQ ID NO: 512280 - RNA, 64 nt, Human
aggagguaggcaccuuucugagcuuauucuauuccccacccacacccccaggcaggguuggaaa

SEQ ID NO: 512281 - RNA, 64 nt, Human
cgcugucucaugauuaguuauguuugccugucuccccacccaucagugaaaucccugagggcag

SEQ ID NO: 512282 - RNA, 64 nt, Human
cauacuuuaaggaccagaucaugcuccauccagccccacccaauggccuuuugugcuuguuucc

SEQ ID NO: 512283 - RNA, 64 nt, Human
ccaggaggagggacacuccagccccccucucuggcccacccaguccucugcccaagcccuuccu

SEQ ID NO: 512284 - RNA, 64 nt, Human
gcccugaggucucgccugcccccgcccgguuucccccacccacugcccuccuucccucccgugc

SEQ ID NO: 512285 - RNA, 64 nt, Human
aaauaaugaugggcagaagggggggaauagccacaggggacaaaccuuaaggcauuauaaguga

SEQ ID NO: 512286 - RNA, 64 nt, Human
gcagaaagcagccggagccucggcggcggcagaaaggggacaaccagggccuccuccgaggagc

SEQ ID NO: 512287 - RNA, 64 nt, Human
cccaugccucauuguguuugguguccccuugccuaggggacaguccuccuggguaagaucagca

SEQ ID NO: 512288 - RNA, 64 nt, Human
uucaccuucgacccauccauugucccagcugggaaggggacauucccacuaguucucauucauu

SEQ ID NO: 512289 - RNA, 64 nt, Human
agcagccugcgucaggagaagggcuccucgccaacccacccacacgcucgucucacucaauuca

SEQ ID NO: 512290 - RNA, 64 nt, Human
aguaaggggaagguuggaucuuggguuuggucuacccacccaagagaaaagacuguuaacugga

SEQ ID NO: 512291 - RNA, 64 nt, Human
ccaggccaugacccaggggagccagcgcugccaccccacccagcgcugccagggagccgccauc

SEQ ID NO: 512292 - RNA, 64 nt, Human
auccucucagagucauugaaggguguucacccaucccacccaaggcuuggcacacugccagugu

SEQ ID NO: 512293 - RNA, 64 nt, Human
agccauauauggauugauaugguuuggauguauccccacccaagucucaucuugaauuuuaauc

SEQ ID NO: 512294 - RNA, 64 nt, Human
aaacauuuagaaaaaaaaauuuuuucuaucucugcccacccacaccugugauguuguguguguu

SEQ ID NO: 512295 - RNA, 64 nt, Human
caagagacaaguuaacucgugcaagagccaguuacccacccacaggucccccuacuuccugcca

SEQ ID NO: 512296 - RNA, 64 nt, Human
aaccagggcucugggauaguaagagaggugacaacccacccagacugcaguucccuccccaccc

SEQ ID NO: 512297 - RNA, 64 nt, Human
uuuccuuccagccuuucugucaucaucuccacagcccacccauccccugagcacacuaaccacc

SEQ ID NO: 512298 - RNA, 64 nt, Human
ggugcucuccccaggcucccuccucagccuccugcccacccagggcccuuuacucucuucuccc

SEQ ID NO: 512299 - RNA, 64 nt, Human
gcugagaaggaagcgcugaucuucuauuuaauuccccacccaugacccccagaaagcaggaggg

SEQ ID NO: 512300 - RNA, 64 nt, Human
guacacagagauauagagauacacaugcuuuuuucccacccaaaauugugacaacauuauguga

SEQ ID NO: 512301 - RNA, 64 nt, Human
ucuccuugagaugaucguagacacagggaugauucccacccaaacccacguauucauucaguga

SEQ ID NO: 512302 - RNA, 64 nt, Human
ccgcuuagacuuagcugucagugugacuuccuuucccacccacccccagaaaaacagaaagagc

SEQ ID NO: 512303 - RNA, 62 nt, Human; identical to SEQ ID NO: 463041

SEQ ID NO: 512304 - RNA, 62 nt, Human; identical to SEQ ID NO: 467129

SEQ ID NO: 512305 - RNA, 62 nt, Human; identical to SEQ ID NO: 467185

SEQ ID NO: 512306 - RNA, 62 nt, Human; identical to SEQ ID NO: 467186

SEQ ID NO: 512307 - RNA, 64 nt, Human
uugucuaugaugucccccuucucugaggccuggacccacccaucuuugucccuggggccugcuc

SEQ ID NO: 512308 - RNA, 64 nt, Human
gggggucuccugcugcuuagguccuuuugggacccccacccauccaggcccuuucuuugcacac

SEQ ID NO: 512309 - RNA, 64 nt, Human
aauugacuuuaauuuaaaacaaaggccugugccucccacccaggaggugggagggugaauuuua

SEQ ID NO: 512310 - RNA, 64 nt, Human
uggccgcaauggacaagccuccugcucacuccaccccacccaccucugcccuguccuuggcagc

SEQ ID NO: 512311 - RNA, 64 nt, Human
ugguggccucuccagggcugcucaggcaaggccccccacccaucugguauggaaaccugccggc

SEQ ID NO: 512312 - RNA, 64 nt, Human
gugcugcccccucaccuugguacugaucagcgcccccacccaggacauaccuuccccaggauag

SEQ ID NO: 512313 - RNA, 64 nt, Human
uucucaccuccuccuccacucccugccucuucuccccacccauccuggcgggcgggcugcgcgg

SEQ ID NO: 512314 - RNA, 64 nt, Human
gagggauggaaaugaccuccuggcaccaggcucacccacccaaggcccccugccccagcacuga

SEQ ID NO: 512315 - RNA, 64 nt, Human
cugcuguuucguauccuccucacaccguguauuucccacccacucagggucacagccuacuaau

SEQ ID NO: 512316 - RNA, 64 nt, Human
cuggaugcuguucgugccugucccugcucugccucccacccaguugccugaaucaucccagcuc

SEQ ID NO: 512317 - RNA, 64 nt, Human
cuccugggaaugcuggaccagggggauuacuucccccacccacacccccauuuggacaucuggg

SEQ ID NO: 512318 - RNA, 57 nt, Human; identical to SEQ ID NO: 53865

SEQ ID NO: 512319 - RNA, 64 nt, Human
cugguuccugggaugagccauacccuggaacuggcccacccacugugucuuccacguaagggag

SEQ ID NO: 512320 - RNA, 64 nt, Human
guauauugugaaaaugggggauuuucccucugcucccacccaccuaaacacagcagccauuugu

SEQ ID NO: 512321 - RNA, 62 nt, Human; identical to SEQ ID NO: 466722

SEQ ID NO: 512322 - RNA, 62 nt, Human; identical to SEQ ID NO: 463042

SEQ ID NO: 512323 - RNA, 62 nt, Human; identical to SEQ ID NO: 466724

SEQ ID NO: 512324 - RNA, 62 nt, Human; identical to SEQ ID NO: 467148

SEQ ID NO: 512325 - RNA, 64 nt, Human
cucucuaggccauccccucuucuaccuccugcaacccacccauccuauuagccucccacauuca

SEQ ID NO: 512326 - RNA, 64 nt, Human
uuccuugggcuucuccugagguaaugauuacccccccacccacagcugagucugugaggcccca

SEQ ID NO: 512327 - RNA, 64 nt, Human
gcacauagcagaacccagugcacguccuccccuucccacccaccucuggcugaaggugcucaag

SEQ ID NO: 512328 - RNA, 64 nt, Human
cauuaaccauaggauguugacucuagaaccuggacccacccagcgcguccuuucuuauccccga

SEQ ID NO: 512329 - RNA, 64 nt, Human
agagagacuagaugcuuucacuagggaaugucuucccacccagccaucacaaauguggacaauc

SEQ ID NO: 512330 - RNA, 64 nt, Human
cugagacucugcccucuucccacagccucccugccccacccaucccugcaaagccauuuuucag

SEQ ID NO: 512331 - RNA, 64 nt, Human
uggaaauggugaggcgaggggcuugagaggaacgcccacccacgaaggcccagggcgccagacg

SEQ ID NO: 512332 - RNA, 64 nt, Human
accugaagaagagaagcuuccggcaacccugcaacccacccaaggaggcuacuggaucggggau

SEQ ID NO: 512333 - RNA, 64 nt, Human
ccccucccucuuccugguggccaccucccucccgcccacccacucucaccccaaacaaaaucac

SEQ ID NO: 512334 - RNA, 64 nt, Human
ccugccgcugccccucggggcuggaauaaaacuccccacccagagucaguccuaguggggcccu

SEQ ID NO: 512335 - RNA, 64 nt, Human
ggccucauguaacaucugggaggggcuucauccccccacccaggaccuagugcaugccagcagc

SEQ ID NO: 512336 - RNA, 64 nt, Human
auuuucaccaucugauaugguuuggcuuuguguccccacccaaauugcaucucaaauuguaauc

SEQ ID NO: 512337 - RNA, 64 nt, Human
gccuccugaguagcuggauuacaggcaugugccacccacccaacuaauuuuuguguuuuuaaua

SEQ ID NO: 512338 - RNA, 64 nt, Human
guuacgcaacucuuuggcugcucugauuggauaucccacccacaagaucguauacccauaauau

SEQ ID NO: 512339 - RNA, 62 nt, Human; identical to SEQ ID NO: 463043

SEQ ID NO: 512340 - RNA, 62 nt, Human; identical to SEQ ID NO: 463101

SEQ ID NO: 512341 - RNA, 62 nt, Human; identical to SEQ ID NO: 466644

SEQ ID NO: 512342 - RNA, 62 nt, Human; identical to SEQ ID NO: 466645

SEQ ID NO: 512343 - RNA, 64 nt, Human
uuggguccuaagacccagggacccagcgacuaugcccacccagaccccagagcguucccauaac

SEQ ID NO: 512344 - RNA, 64 nt, Human
cugagaaaggagaaaaagaugggauugccacucacccacccacacugguaagggaggagaauuu

SEQ ID NO: 512345 - RNA, 64 nt, Human
ccccacccuugagaaggugcuuuguaauauucuccccacccaccccacgcccgcacccccgcac

SEQ ID NO: 512346 - RNA, 64 nt, Human
gcuugugguguuuucguuucuuuuucaucucccccccacccacaaagagcacggagccagccuu

SEQ ID NO: 512347 - RNA, 64 nt, Human
cuuugggucaggaggccaaagcugauguucaggccccacccacucccuacaguccucagaccaa

SEQ ID NO: 512348 - RNA, 64 nt, Human
auggcguuuuauaguccucuaaaaucuaggugcucccacccaccaaaggcauauccugcaaagg

SEQ ID NO: 512349 - RNA, 52 nt, Human; identical to SEQ ID NO: 53888

SEQ ID NO: 512350 - RNA, 64 nt, Human
uccaucgcagggugcucacacacccccacacccacccacccacacacaacacugggacaauuca

SEQ ID NO: 512351 - RNA, 64 nt, Human
cuauuccaucgcagggugcucacacacccccacacccacccacccacacacaacacugggacaa

SEQ ID NO: 512352 - RNA, 64 nt, Human
auuuuguagagcugccagcgcucucccagguucacccacccaggcuucaccagcccugugcggg

SEQ ID NO: 512353 - RNA, 64 nt, Human
uguuucauccaccggcugcacaggcacaaacucccccacccaggacggcugugaugagguggcc

SEQ ID NO: 512354 - RNA, 64 nt, Human
auguccagaggccuagggagguuuuagggcccuccccacccacacccacaggucgauuuggucu

SEQ ID NO: 512355 - RNA, 64 nt, Human
uugggggggauuguagcagacgucugggcuuuuccccacccagagaauagcccccuucgauaca

SEQ ID NO: 512356 - RNA, 57 nt, Human; identical to SEQ ID NO: 53895

SEQ ID NO: 512357 - RNA, 64 nt, Human; identical to SEQ ID NO: 412968

SEQ ID NO: 512358 - RNA, 64 nt, Human; identical to SEQ ID NO: 410539

SEQ ID NO: 512359 - RNA, 64 nt, Human; identical to SEQ ID NO: 413114

SEQ ID NO: 512360 - RNA, 64 nt, Human; identical to SEQ ID NO: 412760

SEQ ID NO: 512361 - RNA, 64 nt, Human
cagauaaucgcggccaccaccuguaggaccuccucccacccacgcugcccccagagcuugggcu

SEQ ID NO: 512362 - RNA, 64 nt, Human
acuauaccuuucaaauccccagggcagacacacccccacccagccccuauuuggaccuaaacug

SEQ ID NO: 512363 - RNA, 64 nt, Human
aagaaucccugcaucagguucuccuuugaggguacccacccaggacaguccccuaccacuucug

SEQ ID NO: 512364 - RNA, 64 nt, Human
ccacaugucuacuauggcaaaaaacauuaccauccccacccauaccacagcauccccuagagag

SEQ ID NO: 512365 - RNA, 64 nt, Human
ccuccccaaacucacuuggcauaauucacaaccucccacccaaacaaugggccugguggacgug

SEQ ID NO: 512366 - RNA, 64 nt, Human
gcaggcaggggcuggaccccagggacuugccuuccccacccacucugcugccagcaggcccagg

SEQ ID NO: 512367 - RNA, 64 nt, Human
cugaggaggggguuggacauccugccccucaccccccacccacacugcagguagaggaggccau

SEQ ID NO: 512368 - RNA, 64 nt, Human
ggugccaccgucccucugcagauacacugcucuccccacccagaccugccugucucccacccuu

SEQ ID NO: 512369 - RNA, 64 nt, Human
cuguacugaggaugauguuauucacagccccuggcccacccacuaauacuacugcacagaguca

SEQ ID NO: 512370 - RNA, 64 nt, Human
uuaacacccuugccuuucugggacuuggccucaccccacccauggaauaccugccucaucccaa

SEQ ID NO: 512371 - RNA, 64 nt, Human
uguguccuuggacagcagauccacacaccacuuccccacccacacacaguacccugggcugguu

SEQ ID NO: 512372 - RNA, 64 nt, Human
ugagaaaacuuacuuacuucaggcauccagugcccccacccaggguucaggcccugucuaaggu

SEQ ID NO: 512373 - RNA, 64 nt, Human
ggagucugcuucucccauguaccagggcaccaggcccacccaacugaaggcauggcggcggggu

SEQ ID NO: 512374 - RNA, 64 nt, Human
acaagccugccacgauggcugcugcuccuuguagcccacccaugagaagcaagagaccuuaaag

SEQ ID NO: 512375 - RNA, 62 nt, Human; identical to SEQ ID NO: 463044

SEQ ID NO: 512376 - RNA, 62 nt, Human; identical to SEQ ID NO: 463102

SEQ ID NO: 512377 - RNA, 62 nt, Human; identical to SEQ ID NO: 466664

SEQ ID NO: 512378 - RNA, 62 nt, Human; identical to SEQ ID NO: 466665

SEQ ID NO: 512379 - RNA, 64 nt, Human
uccuguccugcucacgucugugagucuguccuuucccacccacuagcccucuuucucucugugu

SEQ ID NO: 512380 - RNA, 64 nt, Human
uaucugggcuguugcuaauauugaggaggcuugccccacccaacaagccauaguggagagaacu

SEQ ID NO: 512381 - RNA, 64 nt, Human
ucacccacaucuaaugucucuuccucuguucuaucccacccaacagcucagagaugaaacuaug

SEQ ID NO: 512382 - RNA, 64 nt, Human
gccaggagggucucuccuccagccccugcacacucccacccaggacagcccccagcccaacuag

SEQ ID NO: 512383 - RNA, 64 nt, Human
cccuugcccgugauggcuccuuggggucugccugcccacccacaugagcccgcgaguauggcag

SEQ ID NO: 512384 - RNA, 64 nt, Human
uauucuuagguuagcggagcuuuuuccucuuuuccccacccaucuccccaauauugcccauuau

SEQ ID NO: 512385 - RNA, 64 nt, Human
caauggcaguguccuguuugagcacccugcagcccccacccaagauggccuggugagaugaugc

SEQ ID NO: 512386 - RNA, 64 nt, Human
ugagcgguuuucccaaaacaagcccuuccuggcucccacccagacauggaccagccaugcaccc

SEQ ID NO: 512387 - RNA, 64 nt, Human
cagagagcccucccaugucugcugguuucaguuccccacccaacugacugaagucuugaccuug

SEQ ID NO: 512388 - RNA, 64 nt, Human
aacugaggaauaaagggaaaaacccaaguucauucccacccaaagucagaaucccucauuggcc

SEQ ID NO: 512389 - RNA, 64 nt, Human
aggcagccuguucugggaggagcucccucacuggcccacccacuuguguugaagcaaaaagcaa

SEQ ID NO: 512390 - RNA, 64 nt, Human
ggcggugcugucagcgcacagacccaugcgcauccccacccacaacccuuuacccugaugaucu

SEQ ID NO: 512391 - RNA, 64 nt, Human
gguugcuccuagccaagauguuggccuuucugugcccacccagacuugguuugggccaccagag

SEQ ID NO: 512392 - RNA, 64 nt, Human
gggucccaugacaaccuagacugcccagggcucccccacccaggcccccacccucuugcugcuc

SEQ ID NO: 512393 - RNA, 62 nt, Human; identical to SEQ ID NO: 467149

SEQ ID NO: 512394 - RNA, 62 nt, Human; identical to SEQ ID NO: 467261

SEQ ID NO: 512395 - RNA, 62 nt, Human; identical to SEQ ID NO: 466702

SEQ ID NO: 512396 - RNA, 62 nt, Human; identical to SEQ ID NO: 466666

SEQ ID NO: 512397 - RNA, 64 nt, Human
uccucaccccaagugaaggcucgagacuuccugccccacccaguggguaggccaaguguguugc

SEQ ID NO: 512398 - RNA, 64 nt, Human
ggggacccugccucagcugacccggccucucugccccacccaagcccaaacuugguuucuguga

SEQ ID NO: 512399 - RNA, 64 nt, Human
uggggggcccacuagcagcccccagcaucucccacccacccagcuagggcagaggggucaggau

SEQ ID NO: 512400 - RNA, 64 nt, Human
gggcuggggggcccacuagcagcccccagcaucucccacccacccagcuagggcagagggguca

SEQ ID NO: 512401 - RNA, 64 nt, Human
aguucacucauuacugugaccuuccagcucaguccccacccaugggagccuguguugcuccucu

SEQ ID NO: 512402 - RNA, 64 nt, Human
ucacagaauggccacugauaggcaugccucuuuucccacccacuggaaggcucacaggcaaggu

SEQ ID NO: 512403 - RNA, 64 nt, Human
gcucccccaucugcccagcacggccugcacugugcccacccacuugcuccacaacguccaguug

SEQ ID NO: 512404 - RNA, 64 nt, Human
gugccauguguacuucugaaaauauuuuaaccagcccacccagcagucaguacacaugccuggg

SEQ ID NO: 512405 - RNA, 64 nt, Human
aaaauaguuaccuugccuuuuaggauguucuuaucccacccauaaugagaguugaaaggggaug

SEQ ID NO: 512406 - RNA, 64 nt, Human
uguuuucuguuucccccuuucccaccuccuuccccccacccaauccuuuuuuuuuucuuuuuug

SEQ ID NO: 512407 - RNA, 64 nt, Human
ggaggcgaggaagaguaauauuuagcauucaggacccacccacccuaugccggcuucugugcca

SEQ ID NO: 512408 - RNA, 64 nt, Human
agaucccuugcagaacgagaaaguuaaaaacaagcccacccaguacucacaccaucaagucugu

SEQ ID NO: 512409 - RNA, 64 nt, Human
agccagcagggcugugaugggcgagucccggagccccacccagaccugaaugcuucugagagca

SEQ ID NO: 512410 - RNA, 64 nt, Human
gcugcucaacaggacugcacucgucucugcccugcccacccagagccccucuuugugcccugau

SEQ ID NO: 512411 - RNA, 62 nt, Human; identical to SEQ ID NO: 466685

SEQ ID NO: 512412 - RNA, 64 nt, Human
gguuccucuugaguuugauuugacaagaugccuucccacccagguaaccccgugggaacgugcc

SEQ ID NO: 512413 - RNA, 64 nt, Human
acaccuuugcagggauucuuguccugcuggccaccccacccacaccugucccuggccagcaggc

SEQ ID NO: 512414 - RNA, 64 nt, Human
cucugggggguugccucgaguccccccaccccuccccacccaccaccgcucccgcgggaagcca

SEQ ID NO: 512415 - RNA, 64 nt, Human
aguacaccuuguuaccaaauagguuguucucuuccccacccaccuuugagcuuuugcucuaaaa

SEQ ID NO: 512416 - RNA, 64 nt, Human
aguaagagauguuauauucuuuucucauuucuuccccacccaaaaauaagcuaccauauagcuu

SEQ ID NO: 512417 - RNA, 64 nt, Human
uuuuuuuuuuuuuugagauggagucuugcucugucccacccagucuggagugcaauggugcgau

SEQ ID NO: 512418 - RNA, 64 nt, Human
gagugguuaaaaaagauaccuuauccuauuccuccccacccacccauguuuuuaaacuaauuua

SEQ ID NO: 512419 - RNA, 64 nt, Human
gguuaaaaaagauaccuuauccuauuccuccccacccacccauguuuuuaaacuaauuuauaua

SEQ ID NO: 512420 - RNA, 64 nt, Human
cgccugggacgccccuuucucuugcuguuuaccgcccacccagcagcgcccgaggccagggccg

SEQ ID NO: 512421 - RNA, 64 nt, Human
gccuggaucccccucuagcuccugcucacccacgcccacccaguaguccugccugucugcacag

SEQ ID NO: 512422 - RNA, 64 nt, Human
uuaagucucugcaggcguggcacgcacgcacgcacccacccacgcgcacuuacacgagaagaca

SEQ ID NO: 512423 - RNA, 64 nt, Human
cugucauuuucccaccugccuccccuacccaccccccacccaccaccuggggcuuccucugggg

SEQ ID NO: 512424 - RNA, 64 nt, Human
cugauauaugauuuuuauccaugcgucaguuuuucccacccaguguagcauccuaaagauaaag

SEQ ID NO: 512425 - RNA, 64 nt, Human
uauaaaagugaauaaccugaggauucuauuaguccccacccaaacuuuauugauucaccuccua

SEQ ID NO: 512426 - RNA, 64 nt, Human
ugggugggagggaggagggccgagacaggagcagcccacccagcagaaauacaauccgagcuac

SEQ ID NO: 512427 - RNA, 64 nt, Human
uaguggcagaugugaacugacaaggagugaagcgcccacccagcggauggacagcacccaccug

SEQ ID NO: 512428 - RNA, 64 nt, Human
ccuccaccgcuguuccgcugcagccccgcccugccccacccacccagugccuugcugaagccca

SEQ ID NO: 512429 - RNA, 64 nt, Human
caccgcuguuccgcugcagccccgcccugccccacccacccagugccuugcugaagcccauagc

SEQ ID NO: 512430 - RNA, 64 nt, Human
gggcugggcuaggagagcuggggucaaaagcugccccacccacucucccucacauggugcuagg

SEQ ID NO: 512431 - RNA, 64 nt, Human
uucuguguuucgccaaagcucauaagggcugugacccacccauauggccccaguuuuuucuguc

SEQ ID NO: 512432 - RNA, 64 nt, Human
ccaccagcgcgcaccgucgccacggaucgccgcccccacccagccgggcgccccggacccccca

SEQ ID NO: 512433 - RNA, 64 nt, Human
agcagaacucucugacuggggccccuggcccggccccacccagccgacauguuuucuuuggccu

SEQ ID NO: 512434 - RNA, 64 nt, Human
gugcacauuugccucucacaugcugcccucuccacccacccagggacaccccacggcuccuccc

SEQ ID NO: 512435 - RNA, 64 nt, Human
aaggccuugagggugcaggcaggcagcccuguaccccacccacauagacuauacuguacauaca

SEQ ID NO: 512436 - RNA, 64 nt, Human
uccaccuugguauaccagcucggcagaacaguuccccacccagcgauuagggagcugggcuggc

SEQ ID NO: 512437 - RNA, 64 nt, Human
gugccuuuucuuuuauuucagugcugccuucccacccacccaguccauucacccucaccucucc

SEQ ID NO: 512438 - RNA, 64 nt, Human
ucuggugccuuuucuuuuauuucagugcugccuucccacccacccaguccauucacccucaccu

SEQ ID NO: 512439 - RNA, 64 nt, Human
ucugugugaugucaaguaacauguggggaguguccccacccaaugcuuuggaaaaugcaagauc

SEQ ID NO: 512440 - RNA, 64 nt, Human
ccccuucccccaguggggacugaguuaugggagaaggggacauauuuguggccaaaaugauacu

SEQ ID NO: 512441 - RNA, 64 nt, Human
gaagacuuuuguuaugaggagcugcagauuagcuaggggacagcuggaauuaugcuggcuucug

SEQ ID NO: 512442 - RNA, 64 nt, Human
ugucaagggccauguccccaagcagagguggagaaggggacacugaggugagcaaaagcaggaa

SEQ ID NO: 512443 - RNA, 64 nt, Human
auaaugguuuguucucuuucagacauaauuuaguaggggacaagaagucuguucuucagugagu

SEQ ID NO: 512444 - RNA, 64 nt, Human
gcgcccuccuccuggccuucugacgggcggcguucccacccacaccuucgacgcgacgccuacg

SEQ ID NO: 512445 - RNA, 64 nt, Human
cggucccccgucucccggccgccccucuucccuucccacccagcugcgcccucggcucggucuc

SEQ ID NO: 512446 - RNA, 64 nt, Human
gacuguacaucuaaagaaugauuccguccuaacacccacccagccuguuugaacacauucuaau

SEQ ID NO: 512447 - RNA, 64 nt, Human
gagaagguuggagguggggaaggcuuuguauaaucccacccaccucaccaaaacgaugaaguua

SEQ ID NO: 512448 - RNA, 64 nt, Human
gcagugcuguccaguggaggggagggcuuucacgcccacccacccccuggcccugccagcuggu

SEQ ID NO: 512449 - RNA, 64 nt, Human
aucucaccauaucugugugccgcccccagcaccccccacccaccucuggggggcccgugagcgu

SEQ ID NO: 512450 - RNA, 64 nt, Human
gccucuguggccuuuggugaccucaccacucccucccacccagucccucccucugguccacugc

SEQ ID NO: 512451 - RNA, 64 nt, Human
cuggaggaggccgcuguagggucuggcugagcuucccacccacuuucccuggucccaauccuuu

SEQ ID NO: 512452 - RNA, 64 nt, Human
uccuggcccgagccuggggcucccugggcccugccccacccaccuuauccucccaccccacucc

SEQ ID NO: 512453 - RNA, 64 nt, Human
ugggcuggcagcaggacgacuggcuguccuccugcccacccacacugacggcaucuucccaguu

SEQ ID NO: 512454 - RNA, 64 nt, Human
cccagcuggccugagcagggggccugccaccagacccacccacgcucugacgagaggcuuuucc

SEQ ID NO: 512455 - RNA, 64 nt, Human
cacucagagucugggucucacuggccccaagucucccacccagaacucuggccaaaaauggcuc

SEQ ID NO: 512456 - RNA, 64 nt, Human
cgcuaccuguggccuuuuaacauucaagaguaugcccacccagccccaaagccaccggcaugug

SEQ ID NO: 512457 - RNA, 64 nt, Human
cugguagcugggauuacaggugugagccacugcacccacccaagacaagugauuuucauuguaa

SEQ ID NO: 512458 - RNA, 62 nt, Human; identical to SEQ ID NO: 466647

SEQ ID NO: 512459 - RNA, 64 nt, Human
uuuagcccacugaugcuuacuuaggccggagagcaggggacacggugcuagguucccucgugca

SEQ ID NO: 512460 - RNA, 64 nt, Human
ccucugcugccucccguacccggccugcggagggaggggacagcuggacccgcaggggaggucc

SEQ ID NO: 512461 - RNA, 64 nt, Human
ugguaauagacacaaaugcagugggaagaagaccaggggacaagaggcaaguuggagugaugca

SEQ ID NO: 512462 - RNA, 64 nt, Human
gaagucucaucugccugaaaaugacuguguggaucccacccaaauccaacucauccugguuugc

SEQ ID NO: 512463 - RNA, 64 nt, Human
ccacacuugauaaaucauggggcacagauauguucccacccaacaaaugugauaagugauugug

SEQ ID NO: 512464 - RNA, 64 nt, Human
ucugcccccgugauucaauuaccucccacuuggucccacccacgacacgugggaauugugggag

SEQ ID NO: 512465 - RNA, 64 nt, Human
cuaauagaggcagugagacugcaggugggcugggcccacccagggagcugaugccccuucuccc

SEQ ID NO: 512466 - RNA, 64 nt, Human
ccuuccuguucuuccuuccuagaagccccugucgcccacccagcugguccuguggaugggaucc

SEQ ID NO: 512467 - RNA, 50 nt, Human; identical to SEQ ID NO: 53985

SEQ ID NO: 512468 - RNA, 64 nt, Human
cuucuccuucuaccacucuuaaauuuacucccuccccacccagaacccagaugggguggagggg

SEQ ID NO: 512469 - RNA, 64 nt, Human
uggcccccuccccccccgccccucugcuucccuccccacccaccaccucaaggguagggaguug

SEQ ID NO: 512470 - RNA, 64 nt, Human
uugcauaguaggaccauaccucuuccuuucccaucccacccacauaugauagacagccccucug

SEQ ID NO: 512471 - RNA, 64 nt, Human
agccuccacucccacucugccagacacccugacacccacccaggcuuugaagagcauggagggg

SEQ ID NO: 512472 - RNA, 64 nt, Human
guuuuccccuggccucaguucccagcuccccccgcccacccacgcauacacacaugcccuccug

SEQ ID NO: 512473 - RNA, 64 nt, Human
ccugcagacuccaauggggccagcacuggaggggcccacccacaugacuuuuccauugaccagc

SEQ ID NO: 512474 - RNA, 64 nt, Human
guucuccuggcaggccugcugugugccaaaaacucccacccaaggucccucaggggauauuuca

SEQ ID NO: 512475 - RNA, 64 nt, Human
acaaccuaugacccccucccccaggacaccaccucccacccacagaccuucccuuuagcuguug

SEQ ID NO: 512476 - RNA, 64 nt, Human
cagggaaaugacccacagggaucgcagcugcagggagggccagggagguugggggugggaguga

SEQ ID NO: 512477 - RNA, 64 nt, Human
gccucagccaggaccaucgcccuuucucagagcagagggccagguauagaaaccgcagugggcc

SEQ ID NO: 512478 - RNA, 64 nt, Human
auccccagggccuuuguggacuagccaaggcugugagggccagaauaaacaacugcucaacaaa

SEQ ID NO: 512479 - RNA, 64 nt, Human
gugaugccaaagccccauggauucaggugcagaagagggccaggacuaggucuucugcccuuuc

SEQ ID NO: 512480 - RNA, 64 nt, Human
aacaggggagggcuccacaagcgugucuggcauucccacccaccauggaagacuggauacgcac

SEQ ID NO: 512481 - RNA, 64 nt, Human
gggcgcugggcaugugcccucacuguggacagggcccacccaccuccgguuccccugugccucc

SEQ ID NO: 512482 - RNA, 64 nt, Human
gcuugagaagcccccucucccugguccucuccuacccacccauguccucucagaaccccagccu

SEQ ID NO: 512483 - RNA, 64 nt, Human
caggcuuagaggacagaaaaaugugaagagacgccccacccacccucagccagcccucuccagu

SEQ ID NO: 512484 - RNA, 64 nt, Human
ccucucacacacagccccccugaugagcucugagcccacccagcauccucuguccugagacccc

SEQ ID NO: 512485 - RNA, 64 nt, Human
uucacuccaccaucacucacucacuccccacucccccacccauggggaggagaccuuugaugaa

SEQ ID NO: 512486 - RNA, 64 nt, Human
cccggucccggaacccucccuucgccacccuccacccacccaccucgcgguccccaggaccacu

SEQ ID NO: 512487 - RNA, 64 nt, Human
uaaaaaauaauaacaaaucaaccccagcaccaaacccacccaggcaggaagaagccgccccucc

SEQ ID NO: 512488 - RNA, 64 nt, Human
uucaggucaccgggacuucucucagagucagcggcccacccaacucccucauaccgucgcaucu

SEQ ID NO: 512489 - RNA, 64 nt, Human
ggaaauccgguaccaagugagcaagguggcaggacccacccaagccugauacgcaucugggccc

SEQ ID NO: 512490 - RNA, 64 nt, Human
uccuucugagcguggggccagcuccccccgcgcgcccacccacacucacuccaugcucccggaa

SEQ ID NO: 512491 - RNA, 64 nt, Human
uguccccauaguacaguucuucaguggacaugaccccacccagcccccugcagcccugcugcac

SEQ ID NO: 512492 - RNA, 64 nt, Human
cucccaucuguccccaucuuccuccccacaccuacccacccagugggcccugaagcagggccaa

SEQ ID NO: 512493 - RNA, 64 nt, Human
auucuggagcucuguguucugagaucaugcaucucccacccaucugcccuucucccuucuacgu

SEQ ID NO: 512494 - RNA, 64 nt, Human
cauuguuuccuccuuaaaucguuuagcauggcaugagggccacauuccauggacgggaagaccc

SEQ ID NO: 512495 - RNA, 64 nt, Human
gagcgaugcugaguuucacacguaccugaaccacgagggccagcucucccgacccgaggaguug

SEQ ID NO: 512496 - RNA, 64 nt, Human
ccuugccucacccauccucgcugucauggaccaugagggccaugccuuuguuugcuuuuguggc

SEQ ID NO: 512497 - RNA, 64 nt, Human
ccaucggccccaccagaucuccauucuuugccaugagggccaacacaugagaccccaccucccu

SEQ ID NO: 512498 - RNA, 64 nt, Human
accuucagccuccagcauguguggccacuguacccccacccacccuugggggagcaugaugggc

SEQ ID NO: 512499 - RNA, 55 nt, Human; identical to SEQ ID NO: 54009

SEQ ID NO: 512500 - RNA, 64 nt, Human
gaaagguggggaagaaggggaucucccucccgggcccacccagcugcccagccuuugcccacuc

SEQ ID NO: 512501 - RNA, 64 nt, Human
caucgggcuuagcaccugcccuucucacccauggcccacccaggccuggagcugggaugcaaug

SEQ ID NO: 512502 - RNA, 64 nt, Human
uggccagggacccaaugucccgaggaaucugccucccacccacugacucagggcucagacucag

SEQ ID NO: 512503 - RNA, 64 nt, Human
uauuuaaggauaugguuaaaaaaaaaucccaggacccacccauguuuucacuaucccuucugca

SEQ ID NO: 512504 - RNA, 64 nt, Human
uuucucuccacccuaacucagaccucaccuuccucccacccaccccugccuugcuuuucuuccu

SEQ ID NO: 512505 - RNA, 64 nt, Human
gcagaggguuuacuacaggccaggccauggacaccccacccagguacugcagugagggccuuga

SEQ ID NO: 512506 - RNA, 64 nt, Human
uuuaaaucuguuuuucuaacugggggaaaagauucccacccaauucaaaacauugugccauguc

SEQ ID NO: 512507 - RNA, 63 nt, Human
cacuccagccugggcaacaggaguaaaacucccccccacccaaaaaaaaaaacaacaacaaca

SEQ ID NO: 512508 - RNA, 64 nt, Human
cuuaugcaagugacggugcugcucuuguuccacccccacccagauggucucugagugcgccguc

SEQ ID NO: 512509 - RNA, 64 nt, Human
ucaguccagcuggaggcuggagggagacacaggccccacccagcagacugaggggcagaggcac

SEQ ID NO: 512510 - RNA, 64 nt, Human
aacugugaauuggagaaauggagcucuguggcuucccacccaaaccuucucaguccagcuggag

SEQ ID NO: 512511 - RNA, 56 nt, Human; identical to SEQ ID NO: 54021

SEQ ID NO: 512512 - RNA, 64 nt, Human
cugcaucccaagccccucaugcuccugccuuccugagggccagaggggagccccaggacccauu

SEQ ID NO: 512513 - RNA, 64 nt, Human
acaugaacaggcagauugaaaucaccagugacaugagggccauucuuguggacugguuggugga

SEQ ID NO: 512514 - RNA, 64 nt, Human
ggcugggucugugaaaaacaguggacagcaccccgagggccacaggugagggacacuaccacug

SEQ ID NO: 512515 - RNA, 64 nt, Human; identical to SEQ ID NO: 511913

SEQ ID NO: 512516 - RNA, 64 nt, Human
agagcgaccugccgggaccuugacaacaccuggccccacccacacguccugcaauauucacuga

SEQ ID NO: 512517 - RNA, 64 nt, Human
gccccgcccacucucccaccccugaagcugcacucccacccaccuagcuccccccagggccccc

SEQ ID NO: 512518 - RNA, 64 nt, Human
cucucugcagugcccuccucgccugugcagcccgcccacccacaggcucaccccuccugccggc

SEQ ID NO: 512519 - RNA, 64 nt, Human
ugcuggccgccuucuuggugccaaacccccuucccccacccagagacugggcagcugugucugg

SEQ ID NO: 512520 - RNA, 64 nt, Human
augggccugguugggagcagccccuggcccauugcccacccacccaucucacuaugcaauucga

SEQ ID NO: 512521 - RNA, 64 nt, Human
gccugguugggagcagccccuggcccauugcccacccacccaucucacuaugcaauucgaguuc

SEQ ID NO: 512522 - RNA, 64 nt, Human
agccagcacucugcagggucacacgcaccguguccccacccaggacagcagacacccgccagag

SEQ ID NO: 512523 - RNA, 57 nt, Human; identical to SEQ ID NO: 54029

SEQ ID NO: 512524 - RNA, 64 nt, Human
cucaggcccugugagauagagggcccagcccagccccacccacagauccccugcuccuguugug

SEQ ID NO: 512525 - RNA, 64 nt, Human
aggguuccaggcuguguguggggcccaagcaugccccacccaccccuccugggcccaggcagca

SEQ ID NO: 512526 - RNA, 64 nt, Human
agccucacaccuuguccuuccaccccugccugcccccacccagccugcuucuuguccagcauug

SEQ ID NO: 512527 - RNA, 64 nt, Human
ccaaucucauccaaauaacauuguucccauccuccccacccaccacaucaaaacauaacacauc

SEQ ID NO: 512528 - RNA, 64 nt, Human
gaaacccgcgcccaggaguauggcugaggccuugcccacccaccugccugggaagugcagagug

SEQ ID NO: 512529 - RNA, 64 nt, Human
caggcccgugggaccaugacuuagggaggugggacccacccacccccauccaggaaccgugacg

SEQ ID NO: 512530 - RNA, 64 nt, Human
uuuucaacucuucccugaacuuccugcuuccucagagggccauugaacucugagagauuugggg

SEQ ID NO: 512531 - RNA, 64 nt, Human
ggguugcagauguccuugaagagagugaggcauugagggccaauaggagcaauggggucccugg

SEQ ID NO: 512532 - RNA, 64 nt, Human
ggagugguugguaaaaucaauagauuucaggcaagagggccagauaccuaacagguuuuucucc

SEQ ID NO: 512533 - RNA, 64 nt, Human
uguuugaacagggcaguuuagguucuagguaguggagggccagguggggcucgaggaacguagu

SEQ ID NO: 512534 - RNA, 62 nt, Human
cccuggacguguggagcuaggggccugccugccccacccaccccacagacuccggccuguaa

SEQ ID NO: 512535 - RNA, 64 nt, Human
gauggcugcaggaaagcacuggucccaucgccuucccacccauucgccaacgcgggaaaggcaa

SEQ ID NO: 512536 - RNA, 64 nt, Human
acuuuaaugucacccucuacaucaucuuaccuagcccacccaaccuuauaaacaugauaauuga

SEQ ID NO: 512537 - RNA, 64 nt, Human
uccacaaagccucucuccccucccucgucccacccccacccaggcaggaagcccaggaggagug

SEQ ID NO: 512538 - RNA, 64 nt, Human
uuccccgggccacggggccuugggucccugcccucccacccagguuugguuccucccggggccc

SEQ ID NO: 512539 - RNA, 64 nt, Human
aguaauguggugugggcagcgugacauuuuaugucccacccaaaaauuggauuccuuuuggaga

SEQ ID NO: 512540 - RNA, 64 nt, Human
ggaguggcccgccaccuccugaagcagggccuggcccacccaaggugccuggggcaggcgggca

SEQ ID NO: 512541 - RNA, 64 nt, Human
ccagucuuccaugaaaauaaaugcugccuggacccccacccagaccacacacugacggccggcu

SEQ ID NO: 512542 - RNA, 64 nt, Human
uuuggugcaugcauucccauagauuuuuacaucucccacccaacucuuccccaauuuccuuuua

SEQ ID NO: 512543 - RNA, 64 nt, Human
uuuggcauucucugaauuuauuuccucuccuucccccacccagcuuucuuuuuauggccccagg

SEQ ID NO: 512544 - RNA, 64 nt, Human
gugggcuuggggcuacgcgccaggagagucuccccccacccaccuuuuuucuuugguugcuuuu

SEQ ID NO: 512545 - RNA, 64 nt, Human
cuugcauaggcacuauggacccuguuuugcuuaacccacccaacagccaauuuuagcagacauc

SEQ ID NO: 512546 - RNA, 64 nt, Human
cucaugccucgcgguggccucuccgggcccagcucccacccagccugacggcgccucccggccc

SEQ ID NO: 512547 - RNA, 64 nt, Human
ugauggaucuggccagagggguguuggagcccagcccacccacauaccagucaagcucuuaggg

SEQ ID NO: 512548 - RNA, 64 nt, Human
acgagagcgacccugagcucuucagccagauccugagggccagcuaugaguuugacucuccuuu

SEQ ID NO: 512549 - RNA, 64 nt, Human
agccagcuccgcccucccaaggcugugcguuccugagggccaggucgggggcaggcauggaggg

SEQ ID NO: 512550 - RNA, 64 nt, Human
gccacuugguccccagccauggacucuauacagugagggccacucaccgaccugagucaguguc

SEQ ID NO: 512551 - RNA, 62 nt, Human; identical to SEQ ID NO: 466646

SEQ ID NO: 512552 - RNA, 64 nt, Human
ccuccaaguggggucuggggccuggagagacccucccacccagcagaccaggagauagcugggg

SEQ ID NO: 512553 - RNA, 64 nt, Human
cuccaucuccgccuccacacugaccaagugcuggcccacccaguccaugcuccagggucaggcg

SEQ ID NO: 512554 - RNA, 64 nt, Human
ucccacccauauaucccuccuuuaccauaguacucccacccacuuccaucacccauccaauaaa

SEQ ID NO: 512555 - RNA, 64 nt, Human
gggggagggggaugggggacuuuuguugguggcucccacccauauaucccuccuuuaccauagu

SEQ ID NO: 512556 - RNA, 64 nt, Human
ccuccgcgguuggccccccagaccauaccucugacccacccagccccugugguagccccagcag

SEQ ID NO: 512557 - RNA, 64 nt, Human
gcaucaccugauuggaggggcugguaaagcaacacccacccacuucucacacuagccuuaagag

SEQ ID NO: 512558 - RNA, 64 nt, Human
aggaugugugucacuuugcuucagugacagcccucccacccagccuggcucugcuggcccugaa

SEQ ID NO: 512559 - RNA, 64 nt, Human
ugguuuguccaucuacugcuuugauuccuuggaucccacccauucuuucacuuuaagaaaaaac

SEQ ID NO: 512560 - RNA, 64 nt, Human
uguaaauaaacaggaacugauuuucugccuccaucccacccaugagggcugcaggcacuacaaa

SEQ ID NO: 512561 - RNA, 64 nt, Human
cugggaaccgcugagcugaaguucuuggaaggcucccacccaggugccccguuggaaagcagau

SEQ ID NO: 512562 - RNA, 64 nt, Human
cuuggggcgcccacccggcccggcugagcccugccccacccaacuccacagggcuguuuugccu

SEQ ID NO: 512563 - RNA, 64 nt, Human
ggccaggcagaaagagcuccaggcucuugugucgcccacccagcccucccauacucacuccuga

SEQ ID NO: 512564 - RNA, 64 nt, Human
ccccaacaagaacugcaucuggcagcugguggcccccacccaguaccgcaucucccugcaguuu

SEQ ID NO: 512565 - RNA, 64 nt, Human
ccucggaccccccucgaagcccccuggacugauucccacccacgacucacaggcauuccuccca

SEQ ID NO: 512566 - RNA, 64 nt, Human
caagguaggccaacugcaccccugucgccuggaggagggccagcucgcugcccgagcucuggcc

SEQ ID NO: 512567 - RNA, 64 nt, Human
uggggugggguacaaccaccaugacaacugccgggagggccacgcaggucguggucaccugcca

SEQ ID NO: 512568 - RNA, 64 nt, Human
ugcuggcacugaagauggcugaggagucagagaggagggccaaagaggcagaucagcugaagca

SEQ ID NO: 512569 - RNA, 64 nt, Human
caugaacugacauuccacauccugcccacccucugagggccaagcugccuggccacugggcugg

SEQ ID NO: 512570 - RNA, 64 nt, Human
ucuggaagggguguggaaaaggugauccuuuacccccacccaggaaaaccugcauugugcuagc

SEQ ID NO: 512571 - RNA, 64 nt, Human
guacuguuuugaagcugggcucuuuuguguagcucccacccaccuguagggcuagcucggcuua

SEQ ID NO: 512572 - RNA, 64 nt, Human
ggaucuggugccccucuucuccuggauucacauccccacccagggcccgcuuuuacuaaguguu

SEQ ID NO: 512573 - RNA, 64 nt, Human
gcauucugucuaagagaagaaagauaaggaggcucccacccaccucucccaagagcagacauua

SEQ ID NO: 512574 - RNA, 64 nt, Human
acuucucccagucuccccgagucacagugccgaucccacccacccaccguagggugcacagcaa

SEQ ID NO: 512575 - RNA, 64 nt, Human
cucccagucuccccgagucacagugccgaucccacccacccaccguagggugcacagcaaggca

SEQ ID NO: 512576 - RNA, 64 nt, Human
acggggacgacaggccgaggauucacgcuggaagcccacccaagccggcggggcccuagcgcag

SEQ ID NO: 512577 - RNA, 64 nt, Human
augauuuugcagguccaaugcaaacaucacagaccccacccaugcauaggagagacucuaacau

SEQ ID NO: 512578 - RNA, 64 nt, Human
cugagagugugacccucuccuguaaaguauuuaucccacccauuaauauaauuucuguauaaua

SEQ ID NO: 512579 - RNA, 64 nt, Human
gccuuuccuccccacuggagggcaagcccccccacccacccaggauguccuggcucacuccgca

SEQ ID NO: 512580 - RNA, 64 nt, Human
cagugccuuuccuccccacuggagggcaagcccccccacccacccaggauguccuggcucacuc

SEQ ID NO: 512581 - RNA, 64 nt, Human
ccaccagcagugccaccgccaccacaccccagaucccacccaccuugcaguggccuuuccuugu

SEQ ID NO: 512582 - RNA, 64 nt, Human
auucccugccacaaggaaaggaaagcaaaggcuucccacccaagucccccaucugcuaaaacug

SEQ ID NO: 512583 - RNA, 64 nt, Human
uugguguggcuuacuauuucauugugugcacccacccacccaccacacuggacuuuucuagaga

SEQ ID NO: 512584 - RNA, 64 nt, Human
auagaaaauuagauuuugcuaugagccauuuccugagggccaauuuaauacucgugugacucuu

SEQ ID NO: 512585 - RNA, 64 nt, Human
gucucugggcccuugugcuuccuguggguggggugagggccaaaggcuaugguuuccugccucc

SEQ ID NO: 512586 - RNA, 64 nt, Human
gucucaugcccaggugggugcucugggcuggagcgagggccagguuuugggccgaggcuucccc

SEQ ID NO: 512587 - RNA, 64 nt, Human; identical to SEQ ID NO: 410613

SEQ ID NO: 512588 - RNA, 64 nt, Human
gccuuugguguggcuuacuauuucauugugugcacccacccacccaccacacuggacuuuucua

SEQ ID NO: 512589 - RNA, 64 nt, Human
gacacggaggugcauuagcccaggcuggagguagcccacccaaaugcccuuucugauucuaauu

SEQ ID NO: 512590 - RNA, 64 nt, Human
uggcugcaucaaaugcaugcgugugcgugguggccccacccaggcaggggcuucccacagccuc

SEQ ID NO: 512591 - RNA, 64 nt, Human
auuggcaacaguggcccugcagcccccagcccuccccacccagguuuucggcccagugaagagg

SEQ ID NO: 512592 - RNA, 64 nt, Human
gcagagucccuccuugauaagguuuggcgguguccccacccaaaucucauguugaauuguaguu

SEQ ID NO: 512593 - RNA, 64 nt, Human
cuuggacacuucccugagaagccccuuccacucucccacccacccucuucaaauguuuacuaua

SEQ ID NO: 512594 - RNA, 64 nt, Human
uagguagcaaggacaagaacuaaacaaucccagccccacccagcaacacagaacacaggaguuu

SEQ ID NO: 512595 - RNA, 64 nt, Human
uguguguccucagauguguggggaggauccaucccccacccacugcagccucacaccgagucca

SEQ ID NO: 512596 - RNA, 64 nt, Human
aaaaaaagguagcugugauacaaaccccaggacacccacccacccaaagagccaaagaauaguu

SEQ ID NO: 512597 - RNA, 64 nt, Human
aaagguagcugugauacaaaccccaggacacccacccacccaaagagccaaagaauaguuccug

SEQ ID NO: 512598 - RNA, 64 nt, Human
cucacagagugaauucagcucuucugaaucaagacccacccagucucuuucauucagaccuguu

SEQ ID NO: 512599 - RNA, 62 nt, Human
uggcugagcuggcugccugaggaggggcagggcccacccaugucaccggucagugccuuuug

SEQ ID NO: 512600 - RNA, 64 nt, Human
cccaccccuuccugucucacucuucugucuuguccccacccaugcgccuucgugccugagacca

SEQ ID NO: 512601 - RNA, 64 nt, Human
ucccggcgugguggaagaggggacaggucccucacccacccacaauccuauucucgggcugaga

SEQ ID NO: 512602 - RNA, 64 nt, Human; identical to SEQ ID NO: 409074

SEQ ID NO: 512603 - RNA, 64 nt, Human; identical to SEQ ID NO: 412366

SEQ ID NO: 512604 - RNA, 64 nt, Human; identical to SEQ ID NO: 412367

SEQ ID NO: 512605 - RNA, 64 nt, Human; identical to SEQ ID NO: 410629

SEQ ID NO: 512606 - RNA, 64 nt, Human
ucaccgacagcggccuugaagacagagcaaagcgcccacccaggucccccgacugccugucucc

SEQ ID NO: 512607 - RNA, 64 nt, Human
cccaggcggggcaggaaggggccaagggggcuugcccacccaccccgaccccagcccccagccu

SEQ ID NO: 512608 - RNA, 64 nt, Human
caacgccaacaccuggugccuucugcagccagcgcccacccauccgugcccggacccuugggaa

SEQ ID NO: 512609 - RNA, 64 nt, Human
uggaccuacccuccagccaugacccuucccugcucccacccaccugacuccaaauaaagagcuu

SEQ ID NO: 512610 - RNA, 64 nt, Human
cugagcuccacccuccccucuucuugcggcaccgcccacccacaccccgucugccccuugaccc

SEQ ID NO: 512611 - RNA, 64 nt, Human
acaacgacuuuauuuucuuacccaauuucccacccccacccaccuaauucgaugaaggcugcca

SEQ ID NO: 512612 - RNA, 64 nt, Human
agaaagggauaaagguaauagagcccuucugccccccacccaccaaauuuacacaacaaaauga

SEQ ID NO: 512613 - RNA, 64 nt, Human
gguuuucacaggugcucccaccccaguugaggcucccacccacagggcugucugucacaaaccc

SEQ ID NO: 512614 - RNA, 64 nt, Human
auuuuuacacaucaugucaaagauaacagcuguucccacccaccaguuccucuaagcacauacu

SEQ ID NO: 512615 - RNA, 64 nt, Human
aggcccauacuggcccccaucugaacccaccucucccacccagaucaacauccccccaaccccu

SEQ ID NO: 512616 - RNA, 64 nt, Human
uuccucccucaggggaggugggccaugcagcuaacccacccaccaaagacccccucacccuggc

SEQ ID NO: 512617 - RNA, 63 nt, Human
uuauaccuaacugaauaaaaagcuguucugucuucccacccaaguaccuguucccauguguuu

SEQ ID NO: 512618 - RNA, 64 nt, Human
ccauuucuggugugugcagacaugguggccauugcccacccagguaccagcagcagaagacuau

SEQ ID NO: 512619 - RNA, 64 nt, Human
uaugugauguccuuagucacuaagguuaaacuuucccacccagaaaaggcaacuuagauaaaau

SEQ ID NO: 512620 - RNA, 64 nt, Human
aucauuaagaguagugaugggaagauuacagucugagggccaaacgugccugcuuccuguuuuu

SEQ ID NO: 512621 - RNA, 64 nt, Human
guucuccaguuguauggagccucuucugccaagagagggccaugcaauucaucccagaggaacc

SEQ ID NO: 512622 - RNA, 64 nt, Human
cuuugcccauccucuuugcccccucaggagugcugagggccaguguugacccacacuacccucc

SEQ ID NO: 512623 - RNA, 64 nt, Human; identical to SEQ ID NO: 412403

SEQ ID NO: 512624 - RNA, 64 nt, Human
cagaauauucuguggugccagugcacacuaccuucccacccauacacauccauguucacuguaa

SEQ ID NO: 512625 - RNA, 64 nt, Human
aaggaguuuucccuggcuccaaaggccauuggcacccacccaaguauuaugggaaaccuccaga

SEQ ID NO: 512626 - RNA, 64 nt, Human
uugcaacacuuucagcuccccaugcuccagaauacccacccaagaaaauaauaggcuuuaaaac

SEQ ID NO: 512627 - RNA, 64 nt, Human
aacugccuuuggaagauuuugccccuuagccauccccacccacuuguaccagcuaagaaugcug

SEQ ID NO: 512628 - RNA, 64 nt, Human
gccuuuuaagggggaccucaccuccugugcacagcccacccacuuuccucugcuucccuggcac

SEQ ID NO: 512629 - RNA, 64 nt, Human
cugagcuucccaaucaauacuuccuggagccagccccacccaccccugagaacagaggucagac

SEQ ID NO: 512630 - RNA, 64 nt, Human
caaggagaacguuugguacaaucgacauccuagccccacccagagguggcccucccaggcuggu

SEQ ID NO: 512631 - RNA, 64 nt, Human
aaaaacuuugcuccaggcaucacugauucccucucccacccaaggagaacguuugguacaaucg

SEQ ID NO: 512632 - RNA, 64 nt, Human
gagcguccuuuucuaaugucuuccauuccuaccccccacccaaaaacaaaagaaauauuuguag

SEQ ID NO: 512633 - RNA, 64 nt, Human
uggcggccucuuccugggagccaugaccucagaccccacccacacuccagaucgagaccccugc

SEQ ID NO: 512634 - RNA, 64 nt, Human
ucuggcuuucacaucaucuuugagaggcucuguucccacccaggcugcacggaagacgagagcc

SEQ ID NO: 512635 - RNA, 64 nt, Human
cugcucucugucucaaaugaggcccaacccaucccccacccagcucccggccguccuccuaccu

SEQ ID NO: 512636 - RNA, 64 nt, Human
cggcauguguguucagggacugagccuggggacgcccacccacacccacugcuuccucucggcg

SEQ ID NO: 512637 - RNA, 64 nt, Human
ggcaguagcccccacgcuggccccagccucagaccccacccagcaccuucccagacacgcagga

SEQ ID NO: 512638 - RNA, 64 nt, Human
cacuccugaugcccauuggucaccagauaucucugagggccaagcuaugcccaggaauguguca

SEQ ID NO: 512639 - RNA, 64 nt, Human
acacacucucccucaucuuucgugcccauucacugagggccagaaugacugcucacccacuucc

SEQ ID NO: 512640 - RNA, 64 nt, Human
gggaggggaagcuuuauuuauagaaaugacaauagagggccacggggaggcccccccagaagca

SEQ ID NO: 512641 - RNA, 64 nt, Human; identical to SEQ ID NO: 412384

SEQ ID NO: 512642 - RNA, 64 nt, Human
uggaccuacccuccagccaugacccuucccugcucccacccaccugacuccaaauaaaguccuu

SEQ ID NO: 512643 - RNA, 64 nt, Human
uaugcuauuguacauagaggaaaccugggcuagccccacccagagcgcagaggagggggcaccg

SEQ ID NO: 512644 - RNA, 64 nt, Human
ccuggggcguccaggccgcgcccuuuccccgacgcccacccaaccccaagccagcccggccgcu

SEQ ID NO: 512645 - RNA, 64 nt, Human
cagaccccccccaacccccagcugccaucgcucucccacccagcuuggcccccugcccgcccac

SEQ ID NO: 512646 - RNA, 64 nt, Human
gcucuggguggggccugcuccccauccccccaagcccacccagcacucucauugcugcuguuga

SEQ ID NO: 512647 - RNA, 64 nt, Human
agagcaagcauguugaauuuaaaauaugaauaaccccacccaacaauuuucaguuuauuuuuug

SEQ ID NO: 512648 - RNA, 64 nt, Human
accgccuggucccaagugucccucuguacccacacccacccacucacuuguaagcuccuugaug

SEQ ID NO: 512649 - RNA, 64 nt, Human
acacccgcagcuagcauccccacuccuccuccagcccacccaaccgccuugggucaagggggcu

SEQ ID NO: 512650 - RNA, 64 nt, Human
uuccauucccaucacuagcacuguccucuaaugccccacccaguggggaagucuccaauagguc

SEQ ID NO: 512651 - RNA, 64 nt, Human
aggacuugcuguagggggccuuacucccuguccccccacccacagggccccacgcaggccuggg

SEQ ID NO: 512652 - RNA, 64 nt, Human
aaggaguaagaaccuugccugaacauccuuccuucccacccaucgcuguguguuaguucccaac

SEQ ID NO: 512653 - RNA, 64 nt, Human
gaggagcacuggcaguugguggcagugagaccagcccacccaccaccacccaccacagaaaagc

SEQ ID NO: 512654 - RNA, 64 nt, Human
ugcugcugcaccaaccucacugcccucccucggccccacccacccucugguccuucugacccca

SEQ ID NO: 512655 - RNA, 64 nt, Human
gugcggggucucugugcacuugagagcugggggacccacccaccgucucccacuccaaguucau

SEQ ID NO: 512656 - RNA, 64 nt, Human; identical to SEQ ID NO: 412741

SEQ ID NO: 512657 - RNA, 64 nt, Human; identical to SEQ ID NO: 412742

SEQ ID NO: 512658 - RNA, 64 nt, Human; identical to SEQ ID NO: 410541

SEQ ID NO: 512659 - RNA, 64 nt, Human; identical to SEQ ID NO: 409075

SEQ ID NO: 512660 - RNA, 64 nt, Human
cagaggcucuguggcgggggucccugagagugcccccacccaucucaugccccagggaccgcca

SEQ ID NO: 512661 - RNA, 64 nt, Human
aggaggaaagggagccugcucucccuccccacaccccacccaaagcauacaccgcugagcucaa

SEQ ID NO: 512662 - RNA, 64 nt, Human
aagagccccccuaccuuaggccacccuccucaugcccacccagcaaggggcagaggccacaggc

SEQ ID NO: 512663 - RNA, 64 nt, Human
gucuugggcaaucugaggccaggacagauguugccccacccacuggagauggugcugagggagg

SEQ ID NO: 512664 - RNA, 64 nt, Human
gugcauuucuuuuguuuguuuguugcuguuuucccccacccauccaguucuccucagcaaagca

SEQ ID NO: 512665 - RNA, 64 nt, Human
ggugggacacuccccuucuccccacuuucaccuccccacccaaacuuuauaaaaguugaaaaaa

SEQ ID NO: 512666 - RNA, 64 nt, Human
cagccagugcccugagccagggucuccagaaagccccacccaggccaggcauguggcagggguu

SEQ ID NO: 512667 - RNA, 64 nt, Human
cucuuccccagacgccuggcugcugaucgccuuccccacccaccaacccucagggcaaagccag

SEQ ID NO: 512668 - RNA, 64 nt, Human
aucugacugcgccgccugcccuccugcccacccucccacccacccgaccagcagagcuuuuuaa

SEQ ID NO: 512669 - RNA, 64 nt, Human
uuuugacucucauuuucuacaaggcugcagugggcccacccaugggcuggcccauaacuguaug

SEQ ID NO: 512670 - RNA, 64 nt, Human
gagcuucauuuguauauaacacuuucagagccuucccacccauagguaguucuuaaaccaggug

SEQ ID NO: 512671 - RNA, 64 nt, Human
ugaauauaccucugauaugguuuggcucuguguccccacccaaaucucaucuugaauguguacu

SEQ ID NO: 512672 - RNA, 64 nt, Human
agccccaucucugcuguucccugcguggaggaagcccacccagcaagcucucuccuaccccagg

SEQ ID NO: 512673 - RNA, 64 nt, Human
cuugcagacaagucacuacagaaacauaccccaucccacccaccccugccucugccccagccag

SEQ ID NO: 512674 - RNA, 64 nt, Human
cagcccagccuguggcugcccccgacaccaggaggagggccaggagaguuccagggggcugagg

SEQ ID NO: 512675 - RNA, 64 nt, Human
gaugggcuggaaggagggcgaggggcugggcucagagggccagggcaucaagaacccagugaac

SEQ ID NO: 512676 - RNA, 64 nt, Human
ccugaagguguccacagccgggcagguggucacugagggccaugacgcggggcugaggaugccu

SEQ ID NO: 512677 - RNA, 64 nt, Human; identical to SEQ ID NO: 409073

SEQ ID NO: 512678 - RNA, 64 nt, Human
uauagaggaggaaaggcccucccucacccugcuccccacccaggcagggcagcaugggacccag

SEQ ID NO: 512679 - RNA, 64 nt, Human
auuccccuaggcugacuggauuugagaacaaauacccacccauuuccaccaugguaugguaacu

SEQ ID NO: 512680 - RNA, 64 nt, Human
ggagggccaugggccgaggccuggcauucacguucccacccagccuggcuggcggugcccacag

SEQ ID NO: 512681 - RNA, 64 nt, Human
cagguccugcagcaccuuaguccauacuaccagccccacccaccuuccuuccucuucccucuuc

SEQ ID NO: 512682 - RNA, 64 nt, Human
ccaccucccaccuagaggagaccaugggcccugccccacccacuccaggauguuaggguccccu

SEQ ID NO: 512683 - RNA, 64 nt, Human
cagcugccuugggcuggggccugcggaggggaagcccacccacaaugcauggaguauuauuuuu

SEQ ID NO: 512684 - RNA, 64 nt, Human
ugggggguccuggccccugugaugcucccccauccccacccacuucuacauccauccacacccc

SEQ ID NO: 512685 - RNA, 64 nt, Human
gcccuuccacucucugaccaccgcccccgcccuccccacccagcuccgcuucuuguuacuuggg

SEQ ID NO: 512686 - RNA, 64 nt, Human
guagguuauaaggcagucacuuuuucucucuacucccacccacaccugccucccucuuaccccu

SEQ ID NO: 512687 - RNA, 63 nt, Human
ugcgucguccaagcucuugaauauucuucuguucccacccacuucugauaaguacccugaggc

SEQ ID NO: 512688 - RNA, 64 nt, Human
ggccucuacccaguaguaccacuagcaccuauuccccacccagcgugucuccagauauugucaa

SEQ ID NO: 512689 - RNA, 64 nt, Human
aacuccgaccagaacccuucuuccuguggcacuccccacccauagaccuucagaucaucuccca

SEQ ID NO: 512690 - RNA, 64 nt, Human
aguagaggguauggccugaagccugaagacucgccccacccaccacugcccagcacccaguguc

SEQ ID NO: 512691 - RNA, 64 nt, Human
caaaggguccugcccacagcgcccuguaccugcucccacccagcccuuggugugcccacccagc

SEQ ID NO: 512692 - RNA, 62 nt, Human; identical to SEQ ID NO: 174733

SEQ ID NO: 512693 - RNA, 64 nt, Human; identical to SEQ ID NO: 412423

SEQ ID NO: 512694 - RNA, 64 nt, Human; identical to SEQ ID NO: 410630

SEQ ID NO: 512695 - RNA, 64 nt, Human
gcccuguaccugcucccacccagcccuuggugugcccacccagccuccucuccagcaccuugcu

SEQ ID NO: 512696 - RNA, 64 nt, Human
gcucucaaguaccuuuucuccuggacuguguggacccacccagcuuucuuccucccuguugugu

SEQ ID NO: 512697 - RNA, 64 nt, Human
ugccagccaugggcucgggauggacucccugggccccacccauugccaagccaggaaggcagcu

SEQ ID NO: 512698 - RNA, 64 nt, Human
aggggccuggaguacgaggggcacccugggggcucccacccagaagcagaggggcugggcuguu

SEQ ID NO: 512699 - RNA, 64 nt, Human
cacugcugggcucccagguagcugaaggccucagcccacccacucccuucuucccugugugggg

SEQ ID NO: 512700 - RNA, 64 nt, Human
acuucccuaggcugggcugagggcaaccuugccccccacccaagaagcccugcccuccagccac

SEQ ID NO: 512701 - RNA, 64 nt, Human
auuugcugugggcucuccuccagccugcccagggcccacccagaugccucugggguuaccccug

SEQ ID NO: 512702 - RNA, 64 nt, Human
ccccaaagccaagaagaucaagucucagcaccggcccacccaaagauucuggcccaacuccauc

SEQ ID NO: 512703 - RNA, 64 nt, Human
accaaaucccugaggauagauggcacccauggcccccacccacggaaggacuugaguuguuuac

SEQ ID NO: 512704 - RNA, 64 nt, Human
cccaagagccugcggggaugcccaucccacacaccccacccagcuguucuaacccugcuaucca

SEQ ID NO: 512705 - RNA, 64 nt, Human
gaggcucuccacuguccacccuaacacauacccucccacccaccuuccagacccccuugguugg

SEQ ID NO: 512706 - RNA, 61 nt, Human; identical to SEQ ID NO: 54173

SEQ ID NO: 512707 - RNA, 64 nt, Human
ccagagcacagaucuguuucgugcauuggaagaccccacccaagcuuggcagccgagcucgugu

SEQ ID NO: 512708 - RNA, 64 nt, Human
accggcccgcgcuccgcccccagcgagccggggacccacccaccaccccccgcaccgccgacgc

SEQ ID NO: 512709 - RNA, 64 nt, Human
uuagaguaguugaaaucuuuaggaaugaacuucugagggccaaaaaaugugacugacgggaaca

SEQ ID NO: 512710 - RNA, 64 nt, Human
gaugcuagggacgcuugagugagggagguggugugagggccagguuuccugaaaggcgggaguc

SEQ ID NO: 512711 - RNA, 64 nt, Human
cucuccgcagaaggcuugccggagacgccguggggagggccauuugaacauuacauccaaucaa

SEQ ID NO: 512712 - RNA, 64 nt, Human
uugggacauaagccuuugccccacaagcuguggagagggccaaaaccaagcugcuugagcccac

SEQ ID NO: 512713 - RNA, 64 nt, Human
uggccuugcaucugaauaggccuacccucacccacccacccaguuuaauugugcuuagagccca

SEQ ID NO: 512714 - RNA, 64 nt, Human
uugcuggccuugcaucugaauaggccuacccucacccacccacccaguuuaauugugcuuagag

SEQ ID NO: 512715 - RNA, 64 nt, Human
cugcugcaagacugcuccucucgucucaaaaugacccacccagcuagagcacuguacaccccca

SEQ ID NO: 512716 - RNA, 64 nt, Human
uccguauguaaaucagaucuccccucucaccccucccacccauuaaccuccucccaaaaaacaa

SEQ ID NO: 512717 - RNA, 64 nt, Human
cucuuugcgcuugccuucucacaccccccgacuccccacccauauuuugguaccaguuucuccu

SEQ ID NO: 512718 - RNA, 64 nt, Human
uagacacacuccuggcccucggccccucccuagucccacccacgcucaaccuuuggcccagcca

SEQ ID NO: 512719 - RNA, 64 nt, Human
accccauccccaccuccacuucagaacauggcaccccacccaacuggccaaguguuaagugaug

SEQ ID NO: 512720 - RNA, 64 nt, Human
gcaucuccuggcaggggucucuucccaaccagaccccacccaggcacauuagcgaccaggcuug

SEQ ID NO: 512721 - RNA, 64 nt, Human
uggggccugggugggcaggcaggaccugggcccucccacccaucagagcccacucaggaccagc

SEQ ID NO: 512722 - RNA, 64 nt, Human
agccugcugagaaauccuuuuagcgccagcaagccccacccagggcccuguccugugucugcca

SEQ ID NO: 512723 - RNA, 64 nt, Human
aggguggcagcuccccaaggcccugccccccagccccacccacucaugacucuaaguguguugu

SEQ ID NO: 512724 - RNA, 64 nt, Human
ggccuccugcuucuugccuaccacuuggccagugcccacccagccccucagguggcacaucugg

SEQ ID NO: 512725 - RNA, 64 nt, Human
cacaacaagaguuagcagcgagguccccaugagucccacccaugaccugccgacaguguugccc

SEQ ID NO: 512726 - RNA, 64 nt, Human
cagcaaacagacccuguggccccugcccggcucccccacccauucugcuccccuagagaccucu

SEQ ID NO: 512727 - RNA, 64 nt, Human
ggaggacuuguauggagaaauuuaagucuucacugagggccacuuuacaaaggaaauuugaaua

SEQ ID NO: 512728 - RNA, 64 nt, Human
ccccuucggugugaccggcagccuggcugaccgugagggccagagagagccuucacggacggcg

SEQ ID NO: 512729 - RNA, 64 nt, Human
gugaaaacucugguacgaaucucaucccucaacugagggccagggacccaggugugccugugcu

SEQ ID NO: 512730 - RNA, 64 nt, Human
ugcugcuguguugguugaggaaaaccucgggccugagggccaggccggagcccaggucucugcu

SEQ ID NO: 512731 - RNA, 64 nt, Human
auggcaccuguggccagagcaccucaggacccuccccacccaccaaaugccucugccuugaugg

SEQ ID NO: 512732 - RNA, 64 nt, Human
cagcgggccgagugcccucuccguccccucuccucccacccacgccacaggccagccuacucuu

SEQ ID NO: 512733 - RNA, 64 nt, Human
cagggcucagggccauguaccagaucugucugugcccacccaggcacagccacugccucccccu

SEQ ID NO: 512734 - RNA, 64 nt, Human
gccaggcuagucuugaacuccugaccucaaaugacccacccaccucagccucccaaagugcuga

SEQ ID NO: 512735 - RNA, 64 nt, Human
uauccugugcucuuccuagggagcuguguuguuucccacccaccacccuucccucugaacaaau

SEQ ID NO: 512736 - RNA, 64 nt, Human
gacugggucccuuggccauaucaaggcagcacggcccacccaggccucccauugccgcaacccc

SEQ ID NO: 512737 - RNA, 64 nt, Human
ggccagcugcucucuccaagcagguggcccagaucccacccacguggacuuucucaucaggugc

SEQ ID NO: 512738 - RNA, 64 nt, Human
auggaaguggcuguccccuccucuccagccccugcccacccacugguggaggugcuaacuagca

SEQ ID NO: 512739 - RNA, 64 nt, Human
uuggguccacagucacucuuugugccucaguuuacccacccauuaaaugggaacauuacugucu

SEQ ID NO: 512740 - RNA, 64 nt, Human
uacugccugagcaaaccugaggccucccggcagacccacccacccccuggggcugcucagccuc

SEQ ID NO: 512741 - RNA, 64 nt, Human
ggauccagccugggcucacccuguguggcucauucccacccaggaaacugaagauaaaagauuu

SEQ ID NO: 512742 - RNA, 64 nt, Human
agcuauagggaccucagggagccccagcuucuuacccacccaggaaacccuugguccagagagg

SEQ ID NO: 512743 - RNA, 64 nt, Human
cauccccagggaagggguugcuguagagauagcccccacccaggggauggaggucuacccugga

SEQ ID NO: 512744 - RNA, 64 nt, Human
cuuacuccauuuguuacucucuguucuuugacugcccacccacagaaaagcaaaauaaccaacu

SEQ ID NO: 512745 - RNA, 64 nt, Human
cuuugcacugaggacacagaucccggggagcugugagggccaccggugggcaguggguggaucc

SEQ ID NO: 512746 - RNA, 64 nt, Human
uuagaugacugaguuuuccuuuaggaaaacucccgagggccaaacuggaaacauaagagugacu

SEQ ID NO: 512747 - RNA, 64 nt, Human
ggcaaagaaguggccuccuggggggccaggccacgagggccagggcuucugccugaagauggag

SEQ ID NO: 512748 - RNA, 64 nt, Human
auaccuguacuaugaugggcuucuguucucugcugagggccaauacccuacuguggggagagau

SEQ ID NO: 512749 - RNA, 64 nt, Human
auuaguugucugccuuuuccuuuccaucccuugccccacccaucccaucuccaacccuagucuu

SEQ ID NO: 512750 - RNA, 64 nt, Human
gaugggcagcugcgccugccugcucggcccccagcccacccagccaaaaauacagcugggcuga

SEQ ID NO: 512751 - RNA, 64 nt, Human
gguuguuucugugggugagagauguguugcugugcccacccaguacagcuuccuccucugaccc

SEQ ID NO: 512752 - RNA, 64 nt, Human
ccaucucuuccccaacccuggauaccaguagcuucccacccaguccaaaccugcaccauccauc

SEQ ID NO: 512753 - RNA, 64 nt, Human
auucccucaucuguaggauuugggcugccccaggcccacccagggggcucugaauguauuuugu

SEQ ID NO: 512754 - RNA, 64 nt, Human
acaguccuucagaguuucagcugcauccuggugucccacccaggucgagcccccaggcuucugg

SEQ ID NO: 512755 - RNA, 64 nt, Human
gauggccucugagaggagcccacgacacugcagccccacccagaugccccuuucuggauuauuc

SEQ ID NO: 512756 - RNA, 64 nt, Human
ccaugacucuauccucauaccaccacugcugcuucccacccagcugagaaugcccccuccuccc

SEQ ID NO: 512757 - RNA, 64 nt, Human
cccacgugcugccaacucaaacauagccuccuuccccacccagcuggccacccuggccucagcu

SEQ ID NO: 512758 - RNA, 64 nt, Human
gcccuggaugccacccagugcagccuggcaccuacccacccacccuucagcuuaagccacuccc

SEQ ID NO: 512759 - RNA, 64 nt, Human
uucccuggcgcagucgcuccucgagccgcugccccccacccacccugcaccccucgcccucccc

SEQ ID NO: 512760 - RNA, 64 nt, Human
ggggcccaccccucucugugccggcgccaccaaccccacccacacugcugccuggugcucccgc

SEQ ID NO: 512761 - RNA, 64 nt, Human
cccccagucuccaggagccucucccuccgagauacccacccagcuuugucaaucacccaagcac

SEQ ID NO: 512762 - RNA, 64 nt, Human
ugucugcuccuccucuugaacuugggugggaaaccccacccaaaagcccccuuuguuacuuagg

SEQ ID NO: 512763 - RNA, 62 nt, Human; identical to SEQ ID NO: 466895

SEQ ID NO: 512764 - RNA, 62 nt, Human; identical to SEQ ID NO: 466896

SEQ ID NO: 512765 - RNA, 64 nt, Human; identical to SEQ ID NO: 409092

SEQ ID NO: 512766 - RNA, 64 nt, Human
accccuugguacugccucugaacacucugguuuccccacccaacugcggcuaagucucuuuuuc

SEQ ID NO: 512767 - RNA, 64 nt, Human
ccucugcccucuguuugcucucucaacacacuuccccacccaccguccuccauuccagcccagg

SEQ ID NO: 512768 - RNA, 64 nt, Human
uugcaugugcuaccaacacaugauacggggaagacccacccagggagcgguuucaguggcgcaa

SEQ ID NO: 512769 - RNA, 64 nt, Human
aagaagugaaagccagacagcccuaacaaagcaccccacccaccccugacauaccuacugucac

SEQ ID NO: 512770 - RNA, 64 nt, Human
ucucaaacucucuaacuuauaaguguugugaacccccacccaggcaguauccaugaaagcacaa

SEQ ID NO: 512771 - RNA, 64 nt, Human
agguguauuggggauucucugccagccugugucacccacccaccuccuucauuaucagcaauag

SEQ ID NO: 512772 - RNA, 64 nt, Human
cccaugccugcaaccuugcauccaucugggcuaccccacccaaguauacaauaaagucuuaccu

SEQ ID NO: 512773 - RNA, 64 nt, Human
cucuuucugcuugacaauguagcaacccaggccccccacccacgguccuccccuuuuuccucuc

SEQ ID NO: 512774 - RNA, 64 nt, Human
ggggcacagaccucucccacccacaagaacuccucccacccaacuuccccuuagagugcuguga

SEQ ID NO: 512775 - RNA, 64 nt, Human
ggcaggaucggcuuccucaggggcacagaccucucccacccacaagaacuccucccacccaacu

SEQ ID NO: 512776 - RNA, 64 nt, Human
gaccaucaaucucuuggggugauuaaucaaauuacccacccaaggcuucuagaaggagcuuccu

SEQ ID NO: 512777 - RNA, 64 nt, Human
augcucugaauuuuucgaaagggauucuccuaaacccacccacuucucuugcccaggcugcuuu

SEQ ID NO: 512778 - RNA, 64 nt, Human
uugggagggaaacuaagaaaugguugacagcguucccacccaucuacaauguuauuuuaggugc

SEQ ID NO: 512779 - RNA, 64 nt, Human
ccauccaauggauugugcaaauccccuccccaaacccacccauaccagcuagaaucacuugacu

SEQ ID NO: 512780 - RNA, 64 nt, Human
cuaacaaugcccagugacugucgcacuugaguuugagggccagugggccugaugaacgcucaga

SEQ ID NO: 512781 - RNA, 64 nt, Human
ggacugggaagaucuagccuaaagaggcuucucugagggccagggcccuacagcaugccccuac

SEQ ID NO: 512782 - RNA, 64 nt, Human
cacaugcugucuggcccuggggaucuucccacaggagggccagcgcuguggaccuuacaacgcc

SEQ ID NO: 512783 - RNA, 64 nt, Human
ucccucuguugccaucagcuugauuggcuuccccgagggccagcagggcugggggcuccggaga

SEQ ID NO: 512784 - RNA, 64 nt, Human
gaacaguggccuggcuggcguggcagggccaaggcccacccacugccaucccccuucugugugu

SEQ ID NO: 512785 - RNA, 64 nt, Human
gccaaaggaaggagccuucugagacccuccccaacccacccagguucccaaggcccugccguac

SEQ ID NO: 512786 - RNA, 64 nt, Human
guuuuagaaaaauugggauuuccccccaccccgccccacccagauaaacuauaucuacacuguc

SEQ ID NO: 512787 - RNA, 64 nt, Human
aauuuaauggcuaaaucuuuaaaagccaaugcaacccacccaauugaaucugcauuuucuuuua

SEQ ID NO: 512788 - RNA, 64 nt, Human
aaaaagccuuucuucuaaaaacgaaaaaagaccccccacccaaaauguuucgagucaacaaauu

SEQ ID NO: 512789 - RNA, 64 nt, Human
ucgcggccuggaaggagaagguguccacggagcccccacccauccucggcgguucccaucacca

SEQ ID NO: 512790 - RNA, 64 nt, Human
caggcuuuugcuuuugcuuuuguuuguuucuucccccacccagugcagaaaucaggaucaggga

SEQ ID NO: 512791 - RNA, 64 nt, Human
cucugcuagacuccucaggagagaccccuccccucccacccacagccauagaccuacagaccug

SEQ ID NO: 512792 - RNA, 64 nt, Human
ugguggggggcacguggacaugccccauaggggccccacccagacuuaacaggcaagguccugg

SEQ ID NO: 512793 - RNA, 64 nt, Human
caacaucugcugaaaacgguaaaacuaauuagugcccacccacccuccccgccccagcaacugc

SEQ ID NO: 512794 - RNA, 64 nt, Human
cgggacacauauagcagcauauuuugcucuuaaccccacccaccuuuuuaaucacacuagauuu

SEQ ID NO: 512795 - RNA, 64 nt, Human
agccugucucaccaguggccugcccucucgcucccccacccagcccacccauugaagucuccuu

SEQ ID NO: 512796 - RNA, 64 nt, Human
caccaguggccugcccucucgcucccccacccagcccacccauugaagucuccuugggccacca

SEQ ID NO: 512797 - RNA, 64 nt, Human
gucccgcgcuucgaacuccaggcuuucuggaguucccacccaagcccuccuuuggagcaaagaa

SEQ ID NO: 512798 - RNA, 64 nt, Human
ccuuuggggagggacccauguccauggcuucguugagggccauccauaugccagcugggggcca

SEQ ID NO: 512799 - RNA, 64 nt, Human
cagggugguucuggagccauugugggugagggucgagggccaccgaggucccgcgcaccgcugc

SEQ ID NO: 512800 - RNA, 64 nt, Human
cuaacuaaugggauccagcagggccauuucuccagagggccaguauccuauuaggagacucuug

SEQ ID NO: 512801 - RNA, 64 nt, Human
gcuuccagaaaggccaggcggaagccaaggucaagagggccaucccuaagccuccgcgccaggc

SEQ ID NO: 512802 - RNA, 64 nt, Human
uguggcacaggggggcauuuggcacagcaaaaagcccacccaggacuuagccucaguugacgau

SEQ ID NO: 512803 - RNA, 64 nt, Human
guuaucuucuggaauacauuagcucuuucaaaaacccacccaguguuuagccucaacggcagcc

SEQ ID NO: 512804 - RNA, 64 nt, Human
acacugugcaggcccaggcaggcccagccucugccccacccaucaguggaguccagauggcagg

SEQ ID NO: 512805 - RNA, 64 nt, Human
gccaggcucccgaccccauccaccuauccaccaccccacccaccuuugcagggaauaccucguu

SEQ ID NO: 512806 - RNA, 64 nt, Human
gcuggagaggggcgugcugcggggcccugaugcccccacccaccucgguccagcgcggcccugc

SEQ ID NO: 512807 - RNA, 64 nt, Human
ggucugcgugugauuugucucugagcccccugugcccacccagggcccggcacagagucgaugc

SEQ ID NO: 512808 - RNA, 64 nt, Human
gucugcucacauagccgguccccacgcccagcggcccacccaccagcagcugcuggaggucgua

SEQ ID NO: 512809 - RNA, 64 nt, Human
ccccguggcgcuguccgcucucccucuccugcugcccacccaccugccaguguuauuuaugcuc

SEQ ID NO: 512810 - RNA, 64 nt, Human
acuccagggugucaggaaggcaggggugccgggucccacccaguggaguaacaaacugugggug

SEQ ID NO: 512811 - RNA, 64 nt, Human
ggcgcggcgggcguaggagggugggcuggcgguacccacccagcccaagggagucacagugccu

SEQ ID NO: 512812 - RNA, 64 nt, Human
auuucaggaccugcagacaguacaggcuagauaacccacccaauuuccccacuguccucugauc

SEQ ID NO: 512813 - RNA, 57 nt, Human; identical to SEQ ID NO: 54257

SEQ ID NO: 512814 - RNA, 64 nt, Human
cccccgugauuaguagcccguaugaucacguagacccacccaacacacuccugcacacuggccc

SEQ ID NO: 512815 - RNA, 64 nt, Human
uccuggaggugcccuaccugcauccugcugcacccccacccacgacacucgagugcaagaucgc

SEQ ID NO: 512816 - RNA, 64 nt, Human
uccugcccaccgggcuccacuuggagaucagcaggagggccagugugggaccccugcugccacc

SEQ ID NO: 512817 - RNA, 64 nt, Human
uuaaaguagaaggaucaggacuggcaggggauaugagggccaguguagagauuaaacagaauaa

SEQ ID NO: 512818 - RNA, 64 nt, Human
ugcacauauguuuggagaaauagaggagagaaaagagggccacguaacugagagcuuacagugc

SEQ ID NO: 512819 - RNA, 64 nt, Human
gaugaaaacauucaagcagaacuagguagaaacagagggccaaaauugaaugcuaugcuuagau

SEQ ID NO: 512820 - RNA, 62 nt, Human
ccagccagcccgugaggugaccugagcaugcgcccacccacucaucugucccugaccucuaa

SEQ ID NO: 512821 - RNA, 64 nt, Human
gugggcagagagggauggggucccugagccaggccccacccaucacagcauucccagguccugg

SEQ ID NO: 512822 - RNA, 51 nt, Human; identical to SEQ ID NO: 54262

SEQ ID NO: 512823 - RNA, 64 nt, Human
uucucagggguuuggucacaaaggauggacucuucccacccagaggaugcagggaaagcacacu

SEQ ID NO: 512824 - RNA, 64 nt, Human
cauaaccgcugauucucagggucucugcugccgccccacccagaugggggaaagcacagguggg

SEQ ID NO: 512825 - RNA, 64 nt, Human
gcugagcccaggagccugccaggcugacgugcaucccacccagacgguguccucuucuugucgc

SEQ ID NO: 512826 - RNA, 64 nt, Human
ugcacuuauacaaaccuagaugggacaccuaugacccacccaggccagaugguacagccuguug

SEQ ID NO: 512827 - RNA, 64 nt, Human
aauccucugacaaguugacucuucgacccccacccccacccaagacauuuuaauaguaaauaga

SEQ ID NO: 512828 - RNA, 64 nt, Human
cuucccuaacaggaagguguccaguucaagagaacccacccagagacugggagugguggcucac

SEQ ID NO: 512829 - RNA, 64 nt, Human
cacucagugcuucugcuugcccugccccaggcagcccacccacgcccagugcggguguggagaa

SEQ ID NO: 512830 - RNA, 64 nt, Human
ggacagcccagagccuggcugcccaucauguggccccacccaaucaagggaagaaggaggaaug

SEQ ID NO: 512831 - RNA, 64 nt, Human
gaggugguccccugcaaucacuguuuguccccuacccacccaaccugucccugccugcucccag

SEQ ID NO: 512832 - RNA, 64 nt, Human
gaucacucaggaaaacaggaaaggagguuccagccccacccaccugcccaccccgccccaggca

SEQ ID NO: 512833 - RNA, 64 nt, Human
cggaauaugaauuucugcaccguuucagacuucgcccacccaucccuccccucgucuccugcag

SEQ ID NO: 512834 - RNA, 64 nt, Human
cccuccucgugaccucggccagcuggacccacaugagggccaccucuggaaccuucuucgaggc

SEQ ID NO: 512835 - RNA, 64 nt, Human
cacauguaccaccuacaagugucagaagacacuggagggccaugauggcaucgugcuggcucuc

SEQ ID NO: 512836 - RNA, 64 nt, Human
ucagcauagcuacaggaaaagucagcccuugacugagggccagaucaucccuggagugcaccuc

SEQ ID NO: 512837 - RNA, 64 nt, Human
ccagggagccuuccuggucccaggaccucugguggagggccauggcguggaccuucacccuucu

SEQ ID NO: 512838 - RNA, 64 nt, Human
auggggcagacacaacagcguggcuuagauugugcccacccagggaaggugcugaaugggaccc

SEQ ID NO: 512839 - RNA, 64 nt, Human
gauccugccagcagcccuacagcuccacacccuacccacccaucggcagccccucugcuguucc

SEQ ID NO: 512840 - RNA, 64 nt, Human
aagggucgcucaaagcucagacucaggucugaaacccacccacccgcaagccuaccagccuugu

SEQ ID NO: 512841 - RNA, 64 nt, Human
gagccugagcuucguagccaaagcagccugaugacccacccaccaaggaagaaagcagaauaaa

SEQ ID NO: 512842 - RNA, 64 nt, Human
cgccgccugcuccccacacggacuccaggcgguccccacccacagaagcagaccuucagcucag

SEQ ID NO: 512843 - RNA, 64 nt, Human
accccgggguggcccuggaggccccugaccccaccccacccacagagcacgagggccccgucag

SEQ ID NO: 512844 - RNA, 64 nt, Human
gccgggcagggacagggcagaggacucugagcgccccacccaugccugccuggccugguagaga

SEQ ID NO: 512845 - RNA, 64 nt, Human
uggcccagaggaaugccucgcacaaaaggucuuccccacccacccccagcccccuagucuaaua

SEQ ID NO: 512846 - RNA, 64 nt, Human
gauugucuguuuggcugacacagcagcagcccuucccacccagccaccuuccucacagggacua

SEQ ID NO: 512847 - RNA, 64 nt, Human
ucucagggccgacguuccaccuggggcuucccuccccacccaccccgacuccaggcuuucccuu

SEQ ID NO: 512848 - RNA, 64 nt, Human
uucugggaaagaaccacauuuuaggaauuugcuucccacccagugcccugcauuuaaucagcac

SEQ ID NO: 512849 - RNA, 64 nt, Human
caugcacauuccucacugaaaaagaaaacacacacccacccacacacacacacacagaagaaaa

SEQ ID NO: 512850 - RNA, 64 nt, Human
ggggugggggguuccugcucugccccugcccguccccacccagucuugcccucccauccucuca

SEQ ID NO: 512851 - RNA, 64 nt, Human
cccugggauuccugagugucagugacuugggauucccacccagggacucaagccagccaccccc

SEQ ID NO: 512852 - RNA, 64 nt, Human; identical to SEQ ID NO: 412327

SEQ ID NO: 512853 - RNA, 64 nt, Human; identical to SEQ ID NO: 409072

SEQ ID NO: 512854 - RNA, 64 nt, Human; identical to SEQ ID NO: 410611

SEQ ID NO: 512855 - RNA, 62 nt, Human; identical to SEQ ID NO: 466930

SEQ ID NO: 512856 - RNA, 64 nt, Human
cagaccccgaggccuugcucucagagcgggaggccccacccacuggagagccccgccccuaagg

SEQ ID NO: 512857 - RNA, 64 nt, Human
uuggggaaggccaagugggaggcugggaggcugccccacccaccgacucuaccaagucucucuu

SEQ ID NO: 512858 - RNA, 64 nt, Human
cagcugccugggaucccucauccucauacccacccccacccaagggccuggccugagcugggau

SEQ ID NO: 512859 - RNA, 64 nt, Human
uggggguuuguuuuggggggugggaguugauccucccacccagucugccccuggucucugccca

SEQ ID NO: 512860 - RNA, 64 nt, Human
guuacacaaagaaaauauuggggucacuggcgagcccacccacacucaccagaaucuccacugu

SEQ ID NO: 512861 - RNA, 64 nt, Human
ccuggcuauagcuuauacaguaucuccccuuguccccacccagucaccaaagccaccuacauga

SEQ ID NO: 512862 - RNA, 64 nt, Human
uccgucgggcuauugucacagagaaaagaagagacccacccacucgggcugcaaaaggugaaaa

SEQ ID NO: 512863 - RNA, 64 nt, Human
cacgcccaucgugcacaccugcccaucgugcacacccacccauggugcacaccuguaguccucc

SEQ ID NO: 512864 - RNA, 64 nt, Human
uuccuugccccaugggaaccuccaccuccuacuccccacccaccucugcgaaucugcucccaaa

SEQ ID NO: 512865 - RNA, 64 nt, Human
uuaacaugcauaugaaaaacaucacuuacguucucccacccauagacauaaaaaagggugaccu

SEQ ID NO: 512866 - RNA, 64 nt, Human
ugcucucucgucugucugucugucugcccacucccccacccaccacugugcguuucugauuucc

SEQ ID NO: 512867 - RNA, 64 nt, Human
gcuucaacucucucggcgguagggcggugccauccccacccauagggcuggcucacauccaguc

SEQ ID NO: 512868 - RNA, 64 nt, Human
aggccacugaagcucucgccccuguaacuuauaccccacccagcucaguuuugucacuuuucua

SEQ ID NO: 512869 - RNA, 64 nt, Human
aagaugccuaaaaaagcuaaaggccaccccaccccccacccaccaccuccugccuccucuccuc

SEQ ID NO: 512870 - RNA, 64 nt, Human
ccuggcugagggcguuaggggcugugccucuugugagggccauuugggaccucccuggggcacu

SEQ ID NO: 512871 - RNA, 64 nt, Human
ugucugacugcuugguggcaggcacccugccugugagggccacuuuccucuucuaguagcuguu

SEQ ID NO: 512872 - RNA, 64 nt, Human
cuucuuuagccgggcagcuguuugggggacaagagagggccagggucugugcuucugcucccgg

SEQ ID NO: 512873 - RNA, 64 nt, Human
ugcgccauuuuugugcuuuuauguuuaauuuuaugagggccacgggucuguguucgacucagcc

SEQ ID NO: 512874 - RNA, 64 nt, Human
gcuuguccuuccuucaggaagauguccacucaugcccacccaugagagggcuugccguaugccc

SEQ ID NO: 512875 - RNA, 64 nt, Human
cugaguccguagccccgccccggcgcuggucccgcccacccagacaccgcccacuucccggccc

SEQ ID NO: 512876 - RNA, 64 nt, Human
ggaauguggcccagccggcuggaaccucaagggccccacccaccgagauugcagcggcucuggc

SEQ ID NO: 512877 - RNA, 64 nt, Human
gccuagcuccucacagcugccuugcaccaagggccccacccagcucgguguucugagaccucgg

SEQ ID NO: 512878 - RNA, 64 nt, Human
cgcacaccucccucagcaccaagaccgggacccccccacccacgugucucauuguggcugccua

SEQ ID NO: 512879 - RNA, 64 nt, Human
gcagggcccccacaccagaccccaacauagcuuccccacccaggcacccccucccggggcagca

SEQ ID NO: 512880 - RNA, 64 nt, Human
cagcugcacccuggcauucucacagagcuggcugcccacccaguggggggcuauagccucagag

SEQ ID NO: 512881 - RNA, 64 nt, Human
gccccuggccugccggacacagcaccgugccaaccccacccagcuccaggcccaccggaugcug

SEQ ID NO: 512882 - RNA, 64 nt, Human
caagggucagcccucuugacugucacaugcugcccccacccagccuaaaauaaagagcucacug

SEQ ID NO: 512883 - RNA, 64 nt, Human
cauggcagagggagauuucaagggccuuuucuagcccacccaaaggacaaauggggagcucuag

SEQ ID NO: 512884 - RNA, 64 nt, Human
gaacucacuggcccagugguguucucacuccuaccccacccacccccugccuguccccaaauug

SEQ ID NO: 512885 - RNA, 64 nt, Human
auauccccugagaguuauaggaagugcccacugacccacccacccaccuacaccccccgccaca

SEQ ID NO: 512886 - RNA, 64 nt, Human
ccccugagaguuauaggaagugcccacugacccacccacccaccuacaccccccgccacacaca

SEQ ID NO: 512887 - RNA, 64 nt, Human
ucugaccaugacccaggcauccuugucccccucacccacccagagcuaggggcgggaacagccc

SEQ ID NO: 512888 - RNA, 64 nt, Human
cagggaaugagccaggcacgggggcaugggcagagagggccacggggcagggcccacugaggga

SEQ ID NO: 512889 - RNA, 64 nt, Human
ccuccacacagccggagcugcccuagggagccuggagggccagcuuguaaagaugaugggguuu

SEQ ID NO: 512890 - RNA, 64 nt, Human
gggacucccacaacaacaaaagcuugaagcuguggagggccacgguggcguggcucuccucgca

SEQ ID NO: 512891 - RNA, 64 nt, Human
ggaauuuggguaaaggcagagggaagggguggaggagggccagcucaguugccgaaacucugga

SEQ ID NO: 512892 - RNA, 64 nt, Human
ccccaaaucaggucaaugugugcccuccugagcucccacccaggcaucuccagugcucaugauc

SEQ ID NO: 512893 - RNA, 64 nt, Human
cucagccucgacccucuucugugcuggacuuccacccacccacccuuuucaaguuuagauagug

SEQ ID NO: 512894 - RNA, 64 nt, Human
caacccuuuccuucucuagugccugggccugggacccacccagagcaccugugcuggaggaugc

SEQ ID NO: 512895 - RNA, 64 nt, Human
acauuuaugucgcaugucaauccgaagagugaugcccacccaagaaguucaggagcugccgauu

SEQ ID NO: 512896 - RNA, 64 nt, Human
ccucgugcacacacacaaauuauucagauguacacccacccacauaucuuacagccagaggaac

SEQ ID NO: 512897 - RNA, 64 nt, Human
uaucuuaauagaauaguacaauaaaacacaaccccccacccagcauuaaaaaauaguuuuacug

SEQ ID NO: 512898 - RNA, 64 nt, Human
gggcugugagggcuguaccuggugcccuguggcccccacccaccuggauucccuguucuuugaa

SEQ ID NO: 512899 - RNA, 64 nt, Human
caacucacccccuacacacacaugagagagagcccccacccaguuccuuggccuaggucucccc

SEQ ID NO: 512900 - RNA, 64 nt, Human
caccuccccugccaagagucaaccacuaagcaaucccacccaagccuggaugcuucuagagggg

SEQ ID NO: 512901 - RNA, 64 nt, Human
uaacaaaccaauugcauuuuaguugggcagugcucccacccacccuccagaucccuuccagcua

SEQ ID NO: 512902 - RNA, 64 nt, Human
uuucaaucucaucugauaugcagaguauuucugccccacccaccuaccccccaaaaaaagcuga

SEQ ID NO: 512903 - RNA, 64 nt, Human
aagacugcaguauccauaacccccugcccacguccccacccacgggggagacggagagauauaa

SEQ ID NO: 512904 - RNA, 64 nt, Human
ggaccaggccuggagggcacuuccuccacagucccccacccaccuccugcggcucagccuugca

SEQ ID NO: 512905 - RNA, 59 nt, Human; identical to SEQ ID NO: 54329

SEQ ID NO: 512906 - RNA, 64 nt, Human
guccccagaccaacccugggaccuauacagaacagagggccagagcuagggcugcugcuucugc

SEQ ID NO: 512907 - RNA, 64 nt, Human
gaggcuggagaagacaccagggcugacuuugaccgagggccauggacgcgacaggccuguggcc

SEQ ID NO: 512908 - RNA, 64 nt, Human
aagaucauggcuuuuggagggaggugaguuuagggagggccaggaccauccuccuaccccucau

SEQ ID NO: 512909 - RNA, 64 nt, Human
uuccaacucucgggacgccaaggccgcaggacuggagggccaggccccgccacccccacgggag

SEQ ID NO: 512910 - RNA, 64 nt, Human
aacuucaaaagagcuaaccccuucccacacuccacccacccaccuacauuuccucugugaaauc

SEQ ID NO: 512911 - RNA, 64 nt, Human
ccagugaggaacccugaucucucagccccaaacacccacccaauuggcccaacacugucugccc

SEQ ID NO: 512912 - RNA, 64 nt, Human
ugugagcaaaagcagaaguggaccaccaucagcucccacccacccagcgauuuuuccuuggagg

SEQ ID NO: 512913 - RNA, 64 nt, Human
agcaaaagcagaaguggaccaccaucagcucccacccacccagcgauuuuuccuuggaggucag

SEQ ID NO: 512914 - RNA, 64 nt, Human
agacauucuucaccuccuuggcgcugccaccugccccacccaguuucuggaaaaaguugaugcu

SEQ ID NO: 512915 - RNA, 64 nt, Human
aaccuugcugagccuccuugucuauccuuccucccccacccaccauuguaaaguuuaugucacc

SEQ ID NO: 512916 - RNA, 64 nt, Human
aggccucugcccugccccacccccaccaccuguccccacccagugucccaggccacaggagcuu

SEQ ID NO: 512917 - RNA, 64 nt, Human
cucugccaguguuugggugggugucauggguguccccacccacuccucaguguuuguggagucg

SEQ ID NO: 512918 - RNA, 64 nt, Human
ugccucagcgggucaggccuucagaacacugccacccacccaguuuuauaaucccgcucccucu

SEQ ID NO: 512919 - RNA, 64 nt, Human
ccaguuuuauaaucccgcucccucuccaggcaaccccacccaccagccuaggccugcuccucca

SEQ ID NO: 512920 - RNA, 64 nt, Human
cggccgccccuccucggacagccagcugcacccgcccacccagcggcgacauuguacagacucc

SEQ ID NO: 512921 - RNA, 64 nt, Human
auggaaguuggggcacugggcgucugacucccuccccacccaagagaggaaggaccccucacca

SEQ ID NO: 512922 - RNA, 64 nt, Human
ccugcugugggagacgucuggccacaggcagugccccacccagucuuggagagagaugaauguu

SEQ ID NO: 512923 - RNA, 64 nt, Human
uuuauaggaaacuauuuuuuaaaaaaagccauuucccacccaaggacacaguggauguguuuuc

SEQ ID NO: 512924 - RNA, 64 nt, Human
gaaggcagccgaacugaggauuuagacugguucugagggccagggcaaaugaaggcgcaugucu

SEQ ID NO: 512925 - RNA, 64 nt, Human
aaguaucucugagggagucccagacacaggcagagagggccacauaucgugugccagaggcuga

SEQ ID NO: 512926 - RNA, 64 nt, Human
ccccaccccaccccaccauguccccauuacaccagagggccaucgugacguagacaggaugcca

SEQ ID NO: 512927 - RNA, 64 nt, Human
agcacaccucacacgggaccacagccgcgcugccgagggccaagcacaaagguuccagugagcg

SEQ ID NO: 512928 - RNA, 64 nt, Human
ucuacuacccauggcaggaaccuaguacaggucucccacccagggccuuccacccucggcuccu

SEQ ID NO: 512929 - RNA, 64 nt, Human
cuccacacauuccagccaggcccaggccagcccccccacccacccccaggccuccuaggggaag

SEQ ID NO: 512930 - RNA, 64 nt, Human
ccuccccagcagcugcucugcucaccagccugaccccacccagagcaggagcuggcgggugucu

SEQ ID NO: 512931 - RNA, 64 nt, Human
caggcuggucucgaacuccugaccuggugaucugcccacccaggccucccaaagugcugggauu

SEQ ID NO: 512932 - RNA, 64 nt, Human
uguauccagccuuagcucgcaccgacuucaauuucccacccaucuccaguaggaaauugauuuu

SEQ ID NO: 512933 - RNA, 64 nt, Human
cucccugcucugugauuggauaaauauuucccaucccacccaccuccccccaaaaaauagcuca

SEQ ID NO: 512934 - RNA, 64 nt, Human
cauucuccaccuguugguggggggugcuccucgacccacccagauuugaccguucagggggccu

SEQ ID NO: 512935 - RNA, 64 nt, Human
ucagcccugggccugcaggagaggcugagaccagcccacccagccaguggucgagcacugcccc

SEQ ID NO: 512936 - RNA, 64 nt, Human
cugggcucuaucccacacccacccccaccccacccccacccagccuccagaagcuggaaccauu

SEQ ID NO: 512937 - RNA, 64 nt, Human
gggagcucuggggacagcuuccucacaccccugucccacccacacagcugcccuagcugacccc

SEQ ID NO: 512938 - RNA, 64 nt, Human
cgggcccuguccuggcccaggccucugcccucugcccacccagcgucagcccccagaaaaaagg

SEQ ID NO: 512939 - RNA, 64 nt, Human
ggggcugccuuccccucagccucuccccacaccacccacccagcugcugucauuccgcucacug

SEQ ID NO: 512940 - RNA, 64 nt, Human
ccccgcacccagcaacuccugacagaaagcuccucccacccaaaugggccaggccccagcauga

SEQ ID NO: 512941 - RNA, 64 nt, Human
cagacuaagccagcaccggaccagccuggcccaccccacccacuucugcacuugcgguuccggc

SEQ ID NO: 512942 - RNA, 64 nt, Human
caugucaggcuggccccgaaucauagcucccugagagggccaagcagagaguacuggaaaccuc

SEQ ID NO: 512943 - RNA, 57 nt, Human; identical to SEQ ID NO: 434957

SEQ ID NO: 512944 - RNA, 64 nt, Human
uugaguacuugcugaaguaguugccuuguauuuugagggccaugguggaugaaaaugaugucug

SEQ ID NO: 512945 - RNA, 64 nt, Human
ucacauuuccuuggguuggagcaacagucccagagagggccacggugggagcugcgcccuccuu

SEQ ID NO: 512946 - RNA, 64 nt, Human
uaggcuccgucaguaucaggccugccagacggcacccacccagcacccagcaacuccaacuaac

SEQ ID NO: 512947 - RNA, 64 nt, Human
cuggagucagguggugggaguaccagccccccagcccacccacuuggcccacucagcccauuca

SEQ ID NO: 512948 - RNA, 64 nt, Human
cacccuucccugggggcgauuagcugcugagucacccacccagccuuggagcuggaugccugug

SEQ ID NO: 512949 - RNA, 64 nt, Human
gugggcaggccacugcugggacagggucuaugggcccacccagugccuuuccuuggcccucacu

SEQ ID NO: 512950 - RNA, 64 nt, Human
ucccggcgggugcucugaggccucacuacucgagcccacccagcaucccgcgcgcccuuccuuc

SEQ ID NO: 512951 - RNA, 64 nt, Human
cccucacuuccagcuugccuguuucuucucuacacccacccaaaagucacccagggacacucca

SEQ ID NO: 512952 - RNA, 64 nt, Human
ccuguaaacucccuccaucccaaccuggcucccucccacccaaccaacuuuccccccaacccgg

SEQ ID NO: 512953 - RNA, 64 nt, Human
aaguauccucagaaauguauucugcacccccggccccacccaugcugagggaaggggagcaguu

SEQ ID NO: 512954 - RNA, 64 nt, Human
ggccagcugccccaagcgggguagcagccuugaacccacccagcugggacaccaccagaagguc

SEQ ID NO: 512955 - RNA, 64 nt, Human
uggccuuaccuguccucagaaaggaagaggugaccccacccagccaccucucccuuuuauggaa

SEQ ID NO: 512956 - RNA, 64 nt, Human
ccuggcccgcucaccuuccucaccccuccucugacccacccauggugccagggccgaagcugac

SEQ ID NO: 512957 - RNA, 64 nt, Human
accgagugccuccgaccccccuccucagcccucccccacccacaggcccagccuccucggucuc

SEQ ID NO: 512958 - RNA, 64 nt, Human
gcccccaccaccuggacagaggccacacugacugcccacccagcuguggcgggaggugcagagc

SEQ ID NO: 512959 - RNA, 64 nt, Human
ccccgaggcugcuagauguagguguuaggcaugucccacccacccgccgccucccacggcaccu

SEQ ID NO: 512960 - RNA, 64 nt, Human
ucuguggcaacuguaaucacagagccagaagccagagggccagggauaugagaggcugacaaac

SEQ ID NO: 512961 - RNA, 64 nt, Human
cccuuucuaacgagagucucaaacaagcggaggcgagggccaauucaaccccauucuuuccagc

SEQ ID NO: 512962 - RNA, 64 nt, Human
caguucuccuguggcaguggcgauguggcauccagagggccauuguuucuacuuuugugggacu

SEQ ID NO: 512963 - RNA, 64 nt, Human
gcuucauguggcuucccuuuucuuuguucaagaugagggccaggaggggaaacaucacaccugc

SEQ ID NO: 512964 - RNA, 64 nt, Human
ggcagcccggcagaggacgggaggagaccagucccccacccagccguaccagaaauaaaggcuu

SEQ ID NO: 512965 - RNA, 64 nt, Human
gccugggcacgcggcccucuccugucagugccggcccacccaccagcaggcccccaacccccag

SEQ ID NO: 512966 - RNA, 64 nt, Human
ucagcgguuagccugacucuucuuccccccagcccccacccacugcuguguugugugugcuaga

SEQ ID NO: 512967 - RNA, 64 nt, Human
caucaacacaucuucaaggcggcagagcugugcgcccacccagcuauugaaaaggacuuucugu

SEQ ID NO: 512968 - RNA, 64 nt, Human
auccaagcccauggaggaaaguuacugcugaggacccacccaauggaaggauucuucucagccu

SEQ ID NO: 512969 - RNA, 64 nt, Human
gugcuugagacugagccaacccccaguguguggccccacccauguuauuuuuguuuuuguuuuu

SEQ ID NO: 512970 - RNA, 64 nt, Human
uggugauuccagcaaguacagagauucuaugaagcccacccagaaaaaacuugcugguccuggc

SEQ ID NO: 512971 - RNA, 64 nt, Human
gagaguugcuuuacguggccuguuucaacacagacccacccagagcccuccugcccuccuuccg

SEQ ID NO: 512972 - RNA, 64 nt, Human
ucuauagcaccagggcucacgugggaaccccccucccacccaccgccacaauaaagaucgcccc

SEQ ID NO: 512973 - RNA, 64 nt, Human
gccacaugccccgccaaguacugcacagggaccccccacccaggggaccugcuccgugagauaa

SEQ ID NO: 512974 - RNA, 64 nt, Human
ccuuggggcgcgaccuugugcgaggcccucggggcccacccacagcggcccagggccagacccu

SEQ ID NO: 512975 - RNA, 64 nt, Human
acaaaggcagaagaagaagaagaagaaauaaaaacccacccaagcaagaagacaaaagguaaag

SEQ ID NO: 512976 - RNA, 64 nt, Human
guggagaggguggggcgggcugggguuggagggucccacccaccacccugcugugcuugggaac

SEQ ID NO: 512977 - RNA, 64 nt, Human
gaaauguuugaggcuagacggggaggggccaggacccacccacugcuccugggggaugaggucc

SEQ ID NO: 512978 - RNA, 64 nt, Human
uccugccucugccuccaggcaugcguuuccccgugagggccaaugcaccuccccccacccccca

SEQ ID NO: 512979 - RNA, 64 nt, Human
cacaaagcucaauaggagggauguuccaguggaugagggccaccaggaagcacagguccaaggc

SEQ ID NO: 512980 - RNA, 64 nt, Human
gccacucuauugaauggcauggcccagacccucggagggccaggcaacaggcuagcaaggccca

SEQ ID NO: 512981 - RNA, 64 nt, Human
gaggguguuuuggguggcauagagguuuuguauugagggccagugaugauguuuugauauuuau

SEQ ID NO: 512982 - RNA, 64 nt, Human
caggggaagcggagaccagggugcaggcuccgcccccacccaaggccgggcccagccagaggag

SEQ ID NO: 512983 - RNA, 61 nt, Human; identical to SEQ ID NO: 54387

SEQ ID NO: 512984 - RNA, 64 nt, Human
ccgggcagggacgaggccugguguccucgcuccacccacccacgcugcugucaccugaggggaa

SEQ ID NO: 512985 - RNA, 64 nt, Human
ucacuggcucaggaccccagggagaaacgcucuccccacccacgccaugcugaccagagaucuu

SEQ ID NO: 512986 - RNA, 64 nt, Human
gccaccuaggacugaggacagagaguggggggugcccacccaccccccccgccccgggccuacc

SEQ ID NO: 512987 - RNA, 64 nt, Human
aggcugaugaucugucuccagccccuuccuucugcccacccacccuucuucccucugggcaacu

SEQ ID NO: 512988 - RNA, 64 nt, Human
cccagcugcagcccaggcaggagcagucgccuuucccacccacagcgcuggccacagggcuccc

SEQ ID NO: 512989 - RNA, 64 nt, Human
uccccccaaaacugacaccuuuguuagccaccuccccacccacauacauuucugccaguguuca

SEQ ID NO: 512990 - RNA, 64 nt, Human
uuucuguuuucuuuuuuuccccuuucccccugcccccacccacggggccuuuuuuuggaggugg

SEQ ID NO: 512991 - RNA, 64 nt, Human
acagcucucuuuguaagagaggaaagaaacuaaacccacccaagggaugaugucagggggagag

SEQ ID NO: 512992 - RNA, 64 nt, Human
gguuagccuuugcccugucacccccgaaucaugacccacccagugucuuucgagguggguuugu

SEQ ID NO: 512993 - RNA, 64 nt, Human
gccagccgugaccaccugcugugaggcccgaccacccacccagaaucugcccaguccccacuuc

SEQ ID NO: 512994 - RNA, 64 nt, Human
uugaccugugaccucaauacaauaaaugugaucccccacccaaacuugucugugucugccucgc

SEQ ID NO: 512995 - RNA, 64 nt, Human
aaagacacucccaguugcagggaggguagauggccccacccagaccgagagacacagugaugac

SEQ ID NO: 512996 - RNA, 64 nt, Human
ugcggccucagaccuagaagcucaaccccccuaugagggccacguccugggguagcuccugacc

SEQ ID NO: 512997 - RNA, 64 nt, Human
cccccaaggucuacucccuccucaccccacccuggagggccaggggaguggagagagcuccuga

SEQ ID NO: 512998 - RNA, 64 nt, Human
gguugugagccgcuagugauggagagcagagggagagggccaggcuccagacucccacacgccc

SEQ ID NO: 512999 - RNA, 64 nt, Human
accagcuggacaaauugcagggaggggagggagcgagggccaacccggccccucuguccccuug

SEQ ID NO: 513000 - RNA, 64 nt, Human
ggggcaccccagccccgccucugcucccccccaccccacccacccucggggcgccccccucccc

SEQ ID NO: 513001 - RNA, 62 nt, Human
gaguagaaccccugggcugaggccugcagugacccacccaccuaccuuugcaucaccuaccu

SEQ ID NO: 513002 - RNA, 64 nt, Human
uuugcuauuuuuccuguaacaucugcugaacgggcccacccacacguuguauauucagagagag

SEQ ID NO: 513003 - RNA, 64 nt, Human
guugcuguuuguguuacccucacuguccccaugucccacccacguccuacggcacucaggaagc

SEQ ID NO: 513004 - RNA, 64 nt, Human
acagucccagccgccacccaaggagccccauccgcccacccacccugggacccacgcggccacu

SEQ ID NO: 513005 - RNA, 64 nt, Human
aggcgugguggugggcaccuguacuggggaggugcccacccagcuacuggggaggcugagucag

SEQ ID NO: 513006 - RNA, 64 nt, Human
gagucccaggaggccuccuggaagcccaggacugcccacccaccacgcuggugcccaccgccug

SEQ ID NO: 513007 - RNA, 64 nt, Human
ccgcgcgccgggagcgcuccccggaaugagccgccccacccaccccaaggcuggagccgcugca

SEQ ID NO: 513008 - RNA, 64 nt, Human
gcagagggcgccaccaccaccugacggcuggggacccacccagccccucuccccucucugcucc

SEQ ID NO: 513009 - RNA, 64 nt, Human
gcuccacaggucugagcagggagcaacucaggcccccacccaagccugcgucagcggaacuuga

SEQ ID NO: 513010 - RNA, 64 nt, Human
agccucaagugacucagccugguuggagaacugccccacccaguaucuucugugccaugguucc

SEQ ID NO: 513011 - RNA, 64 nt, Human
aaucuccaaauaaguacgauaacauagucauagucccacccaacaugaugcaguuaucuugcau

SEQ ID NO: 513012 - RNA, 64 nt, Human
cuccaaaagcaaguagccaaagccguugccaaaccccacccauaaaucaaugggcccuuuauuu

SEQ ID NO: 513013 - RNA, 64 nt, Human
aucacuucgauaagugagaccugcucagcccacccccacccauccucagcuaccccgagaggua

SEQ ID NO: 513014 - RNA, 64 nt, Human
guucucagcuccagcuucaaaccucgagucucgagagggccacggggugguuuuuaugaccgga

SEQ ID NO: 513015 - RNA, 64 nt, Human
gaggcuucugagcuucuccuguacugugcaucgugagggccagagacaggaauguaaggauugg

SEQ ID NO: 513016 - RNA, 64 nt, Human
aaaugugcuucugcuucuacagcaauggcugcaggagggccauugggcaugucaggguuuggcc

SEQ ID NO: 513017 - RNA, 64 nt, Human
ccagagacaauacaaaaccccucacuuccucugagagggccaaaugcugugagucugaaguaug

SEQ ID NO: 513018 - RNA, 64 nt, Human
gagaggaaugggggagaggacgugagggaccacccccacccacacagcugccgcagcaucucac

SEQ ID NO: 513019 - RNA, 64 nt, Human
gaacucgguuuaaccagggcucuguaagaccacucccacccagagacuuguguggccuggugug

SEQ ID NO: 513020 - RNA, 64 nt, Human
cccucagccucaucuggagccccugaagaccagucccacccaccuuucuggccucaucugacac

SEQ ID NO: 513021 - RNA, 64 nt, Human
augggagcugcccccccaguggacaccauuggaccccacccagccuggaucuaccccaggagac

SEQ ID NO: 513022 - RNA, 64 nt, Human
aaccuugcccggaccaacgucuugaagcuuuucucccacccauuuuuguauaugggauaagggu

SEQ ID NO: 513023 - RNA, 64 nt, Human
cguggcauuagaagggggagggguggcuggggcccccacccauucccccucccuccaaacuccc

SEQ ID NO: 513024 - RNA, 64 nt, Human
cccaggcagggagcugcugugaguccagcugaggcccacccagguggucccuccagcccugguu

SEQ ID NO: 513025 - RNA, 64 nt, Human
cccacgucggccgucgggaaagcacggggccuuucccacccacccucagccagcgccacacggc

SEQ ID NO: 513026 - RNA, 64 nt, Human
ugggggcacagccccuccccacuccggccacgcccccacccaccccgcguguuucugcccugug

SEQ ID NO: 513027 - RNA, 64 nt, Human
ggaggugucaggcaggcagguggcaggcagcucacccacccaccccaugggaucccccagcccu

SEQ ID NO: 513028 - RNA, 64 nt, Human
acgccaggggaaaagagaguuaaggacacucacccccacccacgcacacacacaaggcagcguc

SEQ ID NO: 513029 - RNA, 64 nt, Human
gcaggauccgagggcgccccggacagaggucugccccacccacuuccuccccaccaccugugcc

SEQ ID NO: 513030 - RNA, 64 nt, Human
ggcacugggcccugggaacuggcacccauggggccccacccaugagugaugguucuggcugauu

SEQ ID NO: 513031 - RNA, 64 nt, Human
cucucucuguccuuccaccccucccuccuugcuucccacccauuccucaucccucacucccacc

SEQ ID NO: 513032 - RNA, 64 nt, Human
acuggagcaagucucccagaugauucuaauacaggagggccagaggccaaacuugaagaacugc

SEQ ID NO: 513033 - RNA, 64 nt, Human
ugcugaagccucuguccacacaugcacaccagaugagggccaugugcgcacacgagguggcugu

SEQ ID NO: 513034 - RNA, 64 nt, Human
ucaguauacaagauuauacaaucucuuuauuacugagggccaccaaauagccuaggaagugccc

SEQ ID NO: 513035 - RNA, 64 nt, Human
gggccuggcccguggagcugccacgcaggugccugagggccaggugccacgcaggugucugagg

SEQ ID NO: 513036 - RNA, 64 nt, Human
gcauacugcagucuggcucuuucuccccucccuccccacccaagccucaccuccccaccccuug

SEQ ID NO: 513037 - RNA, 64 nt, Human
agcagcugcagcugcuagagauggcccccaaccccccacccaccccucuccugccucggcaggg

SEQ ID NO: 513038 - RNA, 64 nt, Human
uaugcccgggggaagggugaaauugggguucaggcccacccagggggccgcuucccacucuugg

SEQ ID NO: 513039 - RNA, 64 nt, Human
accuagaagcugaauagugacgcccucccccaagcccacccagccgcacacaggccuagaggua

SEQ ID NO: 513040 - RNA, 64 nt, Human
cacgcuuaacuccagcccccacccacacccccaucccacccaaccacaggccccacuugcuaag

SEQ ID NO: 513041 - RNA, 64 nt, Human
guauggaaagaggggcucacgcuuaacuccagcccccacccacacccccaucccacccaaccac

SEQ ID NO: 513042 - RNA, 62 nt, Human
ugggugcgaacucacagugacuguccuacccacccacccaccucuguagagucccagaaaca

SEQ ID NO: 513043 - RNA, 58 nt, Human; identical to SEQ ID NO: 54435

SEQ ID NO: 513044 - RNA, 64 nt, Human
aggaagaggcuccauguggcuccugcuucacuuucccacccauuuagggagacaaucaagcucu

SEQ ID NO: 513045 - RNA, 53 nt, Human; identical to SEQ ID NO: 54437

SEQ ID NO: 513046 - RNA, 64 nt, Human
cauucucacccaguuccucucuccuucccugacccccacccacauuucccuccuuagagaucca

SEQ ID NO: 513047 - RNA, 53 nt, Human; identical to SEQ ID NO: 54439

SEQ ID NO: 513048 - RNA, 64 nt, Human
uggguuuacuggaacgagggcgaggaacaccuggcccacccagggcggaaaaccgcuuaaaggg

SEQ ID NO: 513049 - RNA, 60 nt, Human; identical to SEQ ID NO: 54441

SEQ ID NO: 513050 - RNA, 64 nt, Human
uguagaaacagucugauaugguuuggcucuguuccccacccaaaucccaucucaauuuuaaucc

SEQ ID NO: 513051 - RNA, 64 nt, Human
gaaccaggacccagaagcaccuccuuuguagacagagggccacggcugcgugcgauccaggccc

SEQ ID NO: 513052 - RNA, 64 nt, Human
agugaaagagcaucaggagauacugacuguaccugagggccaaaacaggagcagguaacgaacc

SEQ ID NO: 513053 - RNA, 64 nt, Human
gcagcccucuggcccccuccaucucuuguccguucccacccaccccccuccucggcccgagccu

SEQ ID NO: 513054 - RNA, 52 nt, Human; identical to SEQ ID NO: 54444

SEQ ID NO: 513055 - RNA, 64 nt, Human
uccagaucugcacuggguguggccccgcagugcccccacccaguccgccaaacacuccaccccc

SEQ ID NO: 513056 - RNA, 56 nt, Human; identical to SEQ ID NO: 54446

SEQ ID NO: 513057 - RNA, 64 nt, Human
gcagguuguuuguuugauaugguuuggcuguguccccacccaaaucuuaucuagaauuguaauc

SEQ ID NO: 513058 - RNA, 64 nt, Human
uuuucccccacagggguuacacccaucugguugucccacccacucuucagaggcuaggccccac

SEQ ID NO: 513059 - RNA, 64 nt, Human
cuuguuugcccucuuucccccaggaggggcucgacccacccacccucccucucagaccaaggug

SEQ ID NO: 513060 - RNA, 64 nt, Human
accacgcccugccuacucuuuguuuucuuuccuccccacccauuuucccccguccuguccccuc

SEQ ID NO: 513061 - RNA, 64 nt, Human
acccauccucgcucccccaccuccuugggucaugcccacccacccuuuccugccuccuccgugu

SEQ ID NO: 513062 - RNA, 64 nt, Human
gggucguggccagcccugcagcuucagcaccugccccacccagagugggagucagguggagcca

SEQ ID NO: 513063 - RNA, 64 nt, Human
aggccgagcccacaccaucuggcccaggcuggcccccacccaccuuccuugcgaccaccaacac

SEQ ID NO: 513064 - RNA, 64 nt, Human
guauaguuaacaaacgcccaucugcucacccaugcccacccagcgccgccgccgcuggcucucg

SEQ ID NO: 513065 - RNA, 64 nt, Human
ccuucccuacacccugaccggccacugccgcacacccacccagagcacgccacccgccauggga

SEQ ID NO: 513066 - RNA, 54 nt, Human; identical to SEQ ID NO: 54456

SEQ ID NO: 513067 - RNA, 64 nt, Human
cgcaucucagugcaggagagacagugaggcugcacccacccaggaguguggccacgugggcaaa

SEQ ID NO: 513068 - RNA, 64 nt, Human
ucaguuccucccaaccaaccagucuucacuucaagagggccacacugcaaccucagcuuaacau

SEQ ID NO: 513069 - RNA, 64 nt, Human
agaauuaagagauaugauguauaaaauagacaucgagggccauuaagagaguaaauacuuaaaa

SEQ ID NO: 513070 - RNA, 64 nt, Human
gagggaaggggccuacacccgucuuggggcucgccccacccagggcucccuccuggagcauccc

SEQ ID NO: 513071 - RNA, 64 nt, Human
auagacaagaagugaauuugccuggggcagaacacccacccaaagaguccccacuuaacaauac

SEQ ID NO: 513072 - RNA, 64 nt, Human
cugggcgcuugcagugcguugcacacccucaccucccacccacugauuauuaauaaagucuuuu

SEQ ID NO: 513073 - RNA, 64 nt, Human
gucacccccuccgugccacgcacugaaggccacccccacccaccugggaaacuaagaacuggau

SEQ ID NO: 513074 - RNA, 64 nt, Human
gccugcagaagccuccuggccuggcugugucuuccccacccagcucuccccugcgccccugucu

SEQ ID NO: 513075 - RNA, 64 nt, Human
cccuggccuugcuggggccccuccugccuccacgcccacccagcgucgacccuugacccacgaa

SEQ ID NO: 513076 - RNA, 64 nt, Human
gguggggauggggagagccuuugccuccaccauucccacccacccuccccuuaaacccucugcc

SEQ ID NO: 513077 - RNA, 64 nt, Human
caugacuucacugaggcugucauugcugccuugccccacccauaggcccuguccauacccaugu

SEQ ID NO: 513078 - RNA, 64 nt, Human
agcuuggaaguuucuuccccgaguggagcuucgacccacccacuccaggaacccagagccacau

SEQ ID NO: 513079 - RNA, 64 nt, Human
ugacccucuuuccuugcaucccuauuccuugucccccacccacucuuccccccaucaagaaaag

SEQ ID NO: 513080 - RNA, 64 nt, Human
gguugccugcgucuccuuggaguggcagauuccacccacccagcucugcccaugccucuccuuc

SEQ ID NO: 513081 - RNA, 64 nt, Human
ugugccaggccagucacaccgaccaccacccacucccacccacuguagugcucccaccccugga

SEQ ID NO: 513082 - RNA, 64 nt, Human
aauguccuccagaagccucuggcuagaggccagccccacccaggagggagggggcuauagcuac

SEQ ID NO: 513083 - RNA, 64 nt, Human
accaaugggcaggagagaaggccuuuauuucucgcccacccauuccuccuguaccagcaccucc

SEQ ID NO: 513084 - RNA, 64 nt, Human
ugccuccuccccaccuccccacccuggaaccccugagggccaaacagcagaguggagcugagcu

SEQ ID NO: 513085 - RNA, 64 nt, Human
ugucaccucugugacggucaccacugcucccuuggagggccacuugaguuacuguugcuuccuc

SEQ ID NO: 513086 - RNA, 64 nt, Human
aguccccguuacucuuagagaaaggaguuggggugagggccagagcuggcaguggaaacuuguu

SEQ ID NO: 513087 - RNA, 64 nt, Human
agcaccugcuuggcccugccaccuuccuccaggggagggccagauggcauccuggcuuggggcg

SEQ ID NO: 513088 - RNA, 64 nt, Human
gcaugucauuugcauaucguuugcaugcccucaucccacccauucucagggcaguaugggaagc

SEQ ID NO: 513089 - RNA, 64 nt, Human
gagccccauucuacauccccaccauuaaccaggccccacccacaagguagaaacaaccccuaga

SEQ ID NO: 513090 - RNA, 63 nt, Human
cacauagucaagucuuccagggcaaagccagcagcccacccaggucagguagccagcagggcu

SEQ ID NO: 513091 - RNA, 64 nt, Human
ccuguguggcugugccgggcagccauccugcauucccacccagcgcgcagucuccaccucggcc

SEQ ID NO: 513092 - RNA, 64 nt, Human
auagcggggcccacaggcagggguaugagugcgucccacccaacgcagcaccagccccggccac

SEQ ID NO: 513093 - RNA, 64 nt, Human
augacccuacgggggucaggagagcccugcggcccccacccaccagcucagaaccugucacuaa

SEQ ID NO: 513094 - RNA, 64 nt, Human
ucccccaucgccugcugagucacuugucuguccacccacccagcccaguucuaggucguucccc

SEQ ID NO: 513095 - RNA, 64 nt, Human
cugaggccagccaugcccacgccccuccccagcccccacccaugccagcgcagcgccagggcuc

SEQ ID NO: 513096 - RNA, 64 nt, Human
gccccaccucccugccaguccuuggaccucccagcccacccagccucagcacagcucaacacag

SEQ ID NO: 513097 - RNA, 64 nt, Human
cuuuucggucagucuucugaagaaucucaaaaagcccacccaacuuucagcugacauuuccacc

SEQ ID NO: 513098 - RNA, 64 nt, Human
gggauacuauagugagcccaugcagcaccucucacccacccagagauggagcugcucugccuuc

SEQ ID NO: 513099 - RNA, 64 nt, Human
uuuccuguguucucuuaagcagauagcacauacccccacccaguaccaaauuucagaacacaag

SEQ ID NO: 513100 - RNA, 64 nt, Human
gggcauggccugggucgcacccccuccccacggccccacccacagggaccucaacuucugggcc

SEQ ID NO: 513101 - RNA, 64 nt, Human
gccccaccucccugccaguccuuggaccucccagcccacccagccucagcacagcucagcacag

SEQ ID NO: 513102 - RNA, 64 nt, Human
cagaguggguguuccuucgagccccuuccacucagagggccacacccagcgaugccagugaagg

SEQ ID NO: 513103 - RNA, 64 nt, Human
aggagaguaaauaaucuagaggcaagaguucagugagggccaagggggacccccagaaaaaggu

SEQ ID NO: 513104 - RNA, 64 nt, Human
uuuugcugauggagggcacucaagggcugggugagagggccacguguuugguauuacauuacug

SEQ ID NO: 513105 - RNA, 64 nt, Human
uucauucuuaccaccuggccugcaaaguuugcaggagggccagguauauucacuugugucuucu

SEQ ID NO: 513106 - RNA, 64 nt, Human
guucugcggagaccaagagaaggcgugugagcaacccacccacuggaagaucaccuacugagga

SEQ ID NO: 513107 - RNA, 64 nt, Human
uugguaccgggggucuccugaccugucuagcauucccacccacucuucugcacuucuugcaagg

SEQ ID NO: 513108 - RNA, 64 nt, Human
ucaccacccagaaguggggagagacuuugggccucccacccaguggggcuuggccuggcuucug

SEQ ID NO: 513109 - RNA, 64 nt, Human
gcugcaccagcgaaucugccugggcugcuccugucccacccacccucacugagauccauguaag

SEQ ID NO: 513110 - RNA, 64 nt, Human
gaagccaggggucccagcccgucuaccuccccaucccacccaggcccccagcuccccgcggggg

SEQ ID NO: 513111 - RNA, 64 nt, Human
uuaccguucaucaccacucgggggcaccgggccgcccacccacucccaaaauccgucaguauuc

SEQ ID NO: 513112 - RNA, 64 nt, Human
ccucaagcuguaggcccauguuccagucccuccacccacccaccgggcucagcuccagggcaca

SEQ ID NO: 513113 - RNA, 64 nt, Human
uguacuucagggccuggguauccagcgagcccuccccacccacccacgguccucaccuggagcu

SEQ ID NO: 513114 - RNA, 64 nt, Human
cuucagggccuggguauccagcgagcccuccccacccacccacgguccucaccuggagcugugg

SEQ ID NO: 513115 - RNA, 64 nt, Human
guccuggcaccucaacugugacaaucagcaaagccccacccaggcccccaucugggaugauggg

SEQ ID NO: 513116 - RNA, 64 nt, Human
ucccagauccucugcaaucuaccugcaccccugacccacccaggaguuggaccgggaguuggga

SEQ ID NO: 513117 - RNA, 64 nt, Human
aagcagcagcuccaacccugccucuguccccuuccccacccacugccugagccuucugagcaga

SEQ ID NO: 513118 - RNA, 64 nt, Human
aggaaccgcagcucgcgaggcaccucuccucguccccacccacccccacauuugcacaccuucc

SEQ ID NO: 513119 - RNA, 64 nt, Human
guguuuaguguggauuucagcaaaaccugaucaucccacccagaagaccuucucaucaauagau

SEQ ID NO: 513120 - RNA, 64 nt, Human
ccacuccagugguaucagucucuuuauuggaugugagggccaaaagggacuguaacuccugucu

SEQ ID NO: 513121 - RNA, 64 nt, Human
guaaguggggaggagggucagcuaagagaagugggagggccagagcuuuuugguucugauuuac

SEQ ID NO: 513122 - RNA, 64 nt, Human
cuugccuagaauaggcugcaugguguaugucagugagggccacgaggcgucggcuuuagacaca

SEQ ID NO: 513123 - RNA, 64 nt, Human
uucuucacccgcugcagccguuccgucccaaacagagggccacacagauaccccacguucuaua

SEQ ID NO: 513124 - RNA, 64 nt, Human
ccugcuccacucagcuccguccagucaaccugaacccacccaguccagcugucugugggaaugg

SEQ ID NO: 513125 - RNA, 64 nt, Human
guuccuaccuccaagggggaggguccuggaagcgcccacccaggcgccgccccugugcuugcuc

SEQ ID NO: 513126 - RNA, 64 nt, Human
guucggcggcagcguuuguuccagaacgccgccucccacccagaucgcgguauauagagauaug

SEQ ID NO: 513127 - RNA, 64 nt, Human
cccugcagaauguucauagguucccagccccgaccccacccaaaggggccuggagcugcaggau

SEQ ID NO: 513128 - RNA, 64 nt, Human
caggaccccaucugccacccccgcagcagugacccccacccagggccaggccuaagaggcuucu

SEQ ID NO: 513129 - RNA, 64 nt, Human
cuccaaagcaacgggcuggggcagccugcagcugcccacccaaccuggucuucacaccagauug

SEQ ID NO: 513130 - RNA, 64 nt, Human
ggcccaccuugcggcccuggcucugagucgcucucccacccagccuggacuuggccccauggga

SEQ ID NO: 513131 - RNA, 64 nt, Human
gcugugggcccuccugcuccacccccaucccacucccacccaugucugggcucccaggcaggga

SEQ ID NO: 513132 - RNA, 64 nt, Human
ugcucccaggagccagugacaugaggugcagaggcccacccagcccccuaccuacugcccccau

SEQ ID NO: 513133 - RNA, 64 nt, Human
gggcuuccagggcuaggccccugccgcucccacccccacccaucugggccccggguucaagaga

SEQ ID NO: 513134 - RNA, 64 nt, Human
ccaguugcagcuggacuucuccacccggauggcccccacccaguccugcacacuugguccaucc

SEQ ID NO: 513135 - RNA, 64 nt, Human
gcucccaccuagaugggucugauccuccaggauccccacccaaagccugauggcaccccggcug

SEQ ID NO: 513136 - RNA, 64 nt, Human
uuccgagccucagaauccaggagauacgcacagccccacccacucugagaugacaguggcugac

SEQ ID NO: 513137 - RNA, 64 nt, Human
gacgccagggccugcccggccuccuguuccugcccccacccaccaccugccuggagaggaacgg

SEQ ID NO: 513138 - RNA, 64 nt, Human
acuucgguuuguugaacuuuggcagccaguuggugagggccagauguuauucccuuucuuaaag

SEQ ID NO: 513139 - RNA, 64 nt, Human
cggugaguccugccccggcugugccagggugagggagggccaagcccaggaggauuugucugag

SEQ ID NO: 513140 - RNA, 53 nt, Human; identical to SEQ ID NO: 434942

SEQ ID NO: 513141 - RNA, 64 nt, Human
ggcaguggagaucaggagugacagaucacagggugagggccaccuccacacccacccccucugg

SEQ ID NO: 513142 - RNA, 64 nt, Human
gggcagugggaucucgauggagccuccccccccccccacccaugccucccucuuccuccucuuu

SEQ ID NO: 513143 - RNA, 64 nt, Human
gucuggugcccagucuggcaugcagcuacccaggcccacccaucacgugugauugacauguagg

SEQ ID NO: 513144 - RNA, 64 nt, Human
ucugcugaucuccgccugggcccugauggccguccccacccaccugccuuccggcccggcuccc

SEQ ID NO: 513145 - RNA, 64 nt, Human
cuucuagcccuccucccauccacacacacaggcacccacccacaccaggucggcuuguuucuca

SEQ ID NO: 513146 - RNA, 64 nt, Human
cccaaucaccagaaagcaccaaagccccuggcaccccacccacuccauccuacccagggacccc

SEQ ID NO: 513147 - RNA, 64 nt, Human
ggccccuccucuggcccaggacgccugcugcaagcccacccagauggggccagagucugugugg

SEQ ID NO: 513148 - RNA, 64 nt, Human
cgcugcuccgcccugugccccccgcccaucgccccccacccaucucuggagagcccucugcacc

SEQ ID NO: 513149 - RNA, 64 nt, Human
cccaucaccuccugcggcagaacagcacccgugacccacccagagagcaaggccaggggucuug

SEQ ID NO: 513150 - RNA, 64 nt, Human
agcauacaggaaacuucucguuuccucguuuagccccacccagaucaggugaaagggcagcuuu

SEQ ID NO: 513151 - RNA, 64 nt, Human
ggcaccugucugccaggaggccacguguguccugcccacccagggggagcuguauuuuggcagc

SEQ ID NO: 513152 - RNA, 64 nt, Human
ccccgcuccaccccucaccucaccucgcccccgccccacccaucgcgccccggcccgucccauc

SEQ ID NO: 513153 - RNA, 64 nt, Human
uccuugggcuucuccugagguaaugauuuacccccccacccacagcugagucugugaggcccca

SEQ ID NO: 513154 - RNA, 64 nt, Human
cucucuaggccauccccucuucuaccuccugcaacccacccauccuauuagccucccacauucu

SEQ ID NO: 513155 - RNA, 64 nt, Human
caguuuguugggguccaaaagacaccaucucuaccccacccaaauaaaaaugcacucaucucug

SEQ ID NO: 513156 - RNA, 64 nt, Human
ugguuauaaauucaaagagcuugaaaagauugaagagggccaaacacugaugauuuguggaaaa

SEQ ID NO: 513157 - RNA, 64 nt, Human
agauauuuuuauaaaaaaguaccacugagucagugagggccacagauugguauuaaugagauac

SEQ ID NO: 513158 - RNA, 64 nt, Human
aucuggaaaugguagacuguguugggauuggggggagggccaugggagggguacaucgucaaca

SEQ ID NO: 513159 - RNA, 64 nt, Human
uggguggaagucaguuggccucccugguucugcagagggccagaagaaugagagagaggaagac

SEQ ID NO: 513160 - RNA, 64 nt, Human
ucucccccuuaccccacaacgugcaacugacacucccacccagucucugcuccaccuuucagcc

SEQ ID NO: 513161 - RNA, 64 nt, Human
ugccugcccaaacaccccaccauuggccugucaacccacccauuggccugucugcugggugcua

SEQ ID NO: 513162 - RNA, 64 nt, Human
gcgcugcacgaccugcucaccaccuaugccguuacccacccacagguguccuacugccagggca

SEQ ID NO: 513163 - RNA, 64 nt, Human
augggcuccaggagggacccucugguccagcugccccacccagcugcccuuaucagcuccaagu

SEQ ID NO: 513164 - RNA, 64 nt, Human
ucccagccccaucuguggguugcacuuacaaacccccacccaccuucagaaauaguuuuucaac

SEQ ID NO: 513165 - RNA, 64 nt, Human
guuuuccccuuuuggggaucaccucucuguaucccccacccacuaucccauuugcccuccuccu

SEQ ID NO: 513166 - RNA, 64 nt, Human
auguagccaugggaccaaaccuagccccuuagcccccacccacuucccugggcaaaugaauggc

SEQ ID NO: 513167 - RNA, 64 nt, Human
cuccuuuucugggcccuagcacagguggguaacccccacccaacccagcuccugcugcuguccc

SEQ ID NO: 513168 - RNA, 64 nt, Human
auuucaugauggagugaaugcccugcccugcuuccccacccaagccagucuacauugcccaaac

SEQ ID NO: 513169 - RNA, 64 nt, Human
agaagauuguuauaauacagcucuccgucugugucccacccaugcagacucucugaauaaccua

SEQ ID NO: 513170 - RNA, 64 nt, Human
aauguugaaaaaagaagcaugccuccuucucccucccacccaccucaagcaguugaacacagcc

SEQ ID NO: 513171 - RNA, 64 nt, Human
cuaucaccaccuguugggcauagccagagcuguucccacccagccagggcaugaaacaucaacc

SEQ ID NO: 513172 - RNA, 64 nt, Human
ggcuuggggguaaauccugaggcuuuggugcucccccacccacccauucccgcccuuugcagca

SEQ ID NO: 513173 - RNA, 64 nt, Human
uggggguaaauccugaggcuuuggugcucccccacccacccauucccgcccuuugcagcagccc

SEQ ID NO: 513174 - RNA, 64 nt, Human
cuaguugcugagaggggcuggggagauggggcgggagggccagacucagugcugcuguggagcu

SEQ ID NO: 513175 - RNA, 64 nt, Human
gguggugagcuccugccugcuggagguugccauggagggccauuccugcccggcaacagcaccg

SEQ ID NO: 513176 - RNA, 64 nt, Human
auggcuuaaagccagaaagagcugagggaguuaagagggccaaccuuagggcacgugggcauua

SEQ ID NO: 513177 - RNA, 64 nt, Human
aaucuuuuauaagaacaguacagauuguucucaagagggccaucagaaggaagccaaagaguuc

SEQ ID NO: 513178 - RNA, 64 nt, Human
agguuaaaucugaauuuccacugcuuuggagagucccacccacuaagcacugugcauguaaaca

SEQ ID NO: 513179 - RNA, 64 nt, Human
aggccccuguagugacccacgcguccagcagacgcccacccaccgcuagccguuguuccugugc

SEQ ID NO: 513180 - RNA, 64 nt, Human
gccguuguuccugugcaaaguagugugcuaugcacccacccagguggccgccucugggcccaag

SEQ ID NO: 513181 - RNA, 64 nt, Human
gccccguggccggcaggccggccccugccccacccccacccacgggugucccugcccacucgug

SEQ ID NO: 513182 - RNA, 64 nt, Human
cgagcugguccuaggccccgccuagugccccacccccacccacagugcugcacuccuccugccc

SEQ ID NO: 513183 - RNA, 64 nt, Human
cccaagcucggaucacaugaaggagacagcagcacccacccaugcacgcaccccgccccugcau

SEQ ID NO: 513184 - RNA, 64 nt, Human
cagugggcucccugccugccaccuccccugccagcccacccaccuuccccccaccugagauugu

SEQ ID NO: 513185 - RNA, 64 nt, Human
uggccucuggcaccucacccuugccauggcugaccccacccauuccaaggcggggucacgguac

SEQ ID NO: 513186 - RNA, 64 nt, Human
gcuggguggccacaacugggaugccaccuggagccccacccaggagcuggccgcggcaccuuac

SEQ ID NO: 513187 - RNA, 64 nt, Human
uagacacuggacucccuguccccaccaccccugccccacccagggccaacaugacuaagcucuc

SEQ ID NO: 513188 - RNA, 64 nt, Human
auacugagaaucuaggccaccccaaccucuguuccccacccaguucuucauuuggaggaaucac

SEQ ID NO: 513189 - RNA, 64 nt, Human
uccugaucaggccucaccccuccccugggacuuucccacccaggaaaggaggaccagucaggau

SEQ ID NO: 513190 - RNA, 64 nt, Human
gaagaagcugcagugggagacaaagccucggucccccacccauccacacacaccuacacucaca

SEQ ID NO: 513191 - RNA, 64 nt, Human
agguuaaagaugaauuuccacugcuuuggagagucccacccacuaagcacugugcauguaaaca

SEQ ID NO: 513192 - RNA, 64 nt, Human
aggagcugaaggugggggugacacugggaggugggagggccaggccaacuggcugcggccauca

SEQ ID NO: 513193 - RNA, 64 nt, Human
ucugcccccaccucgaaacccacaguccccaguggagggccacuacucauccccauugguuucc

SEQ ID NO: 513194 - RNA, 64 nt, Human
acacugauauuuaauccuuaaaaccccuuuaaaugagggccaguauuaucucugcuuucagaag

SEQ ID NO: 513195 - RNA, 64 nt, Human
auggcacauuuaccuguugcuccguccagauguugagggccagucuaggcugacacauccuacc

SEQ ID NO: 513196 - RNA, 64 nt, Human
cuuugcaacaggcauuacucgccauugauuggugcccacccagggcacacugucggaguucuau

SEQ ID NO: 513197 - RNA, 64 nt, Human
gccccggagaacccugucccugcguguggccacuccucagcauccuccccacccaccaugguuc

SEQ ID NO: 513198 - RNA, 64 nt, Human
acagcaggcgccucgggucccagaugucugcagcccucagcagcugcagaccgccccucaccaa

SEQ ID NO: 513199 - RNA, 64 nt, Human
aguguugguuugaacccugugagccugagacagagagggccaggcaccaaccacaaggcgggaa

SEQ ID NO: 513200 - RNA, 64 nt, Human
ugagcuuaaaggcccuggguccugccaguuccaggagggccaugucugugccucuguguacccc

SEQ ID NO: 513201 - RNA, 64 nt, Human
agaaugggcccagugggggcugggcaggcccauugagggccaccgccgagguuucuccuagggc

SEQ ID NO: 513202 - RNA, 64 nt, Human
ccaguucuggggcccgccugccaccucucccagcccucagcauugucagccugaagaucagagc

SEQ ID NO: 513203 - RNA, 64 nt, Human
ccguccuuuccccgcagagacuggucuuggaaacccucagcaaacucagcauccaggacaacaa

SEQ ID NO: 513204 - RNA, 64 nt, Human
aagcccccccacccaggcccccuaaaaaucagggccucagcaagcagaggagacacagcaguga

SEQ ID NO: 513205 - RNA, 64 nt, Human
auggagugggaauccccagccgaggcccuaggccccucagcagggaagggauccccggggaggc

SEQ ID NO: 513206 - RNA, 64 nt, Human
ggccacacaaaaagugaugcucgcccugggcuagccucagcagaccuaaggcaucucuacuccc

SEQ ID NO: 513207 - RNA, 64 nt, Human
gcugccauauccugcuggcuccuugcuugauuucccucagcaaacccuugaacuugcuaggcca

SEQ ID NO: 513208 - RNA, 64 nt, Human
gaaggcaaguggugauggcgccacugcacuccuaccucagcaacagaguaagacucugucccaa

SEQ ID NO: 513209 - RNA, 64 nt, Human
guucuuuggcccacccccuaaucccuaacucuucccucagcaucacagggcuucacugcacaca

SEQ ID NO: 513210 - RNA, 64 nt, Human
gcuuuucugccguggauucucccccgucuucuccccucagcaauuccugcaaaggguuaaaaau

SEQ ID NO: 513211 - RNA, 64 nt, Human
uuauucugcucaugucugggguauucacuuggcuccucagcaaggaagcaaacgccuuggagga

SEQ ID NO: 513212 - RNA, 64 nt, Human
uauccagaaguaauugcggaggcuccuucagcugccucagcacuuugauuuuggacagggacaa

SEQ ID NO: 513213 - RNA, 64 nt, Human
gcugggagugguuagccggaauacuggggccugcccucagcaucccccauagcucccagcagcc

SEQ ID NO: 513214 - RNA, 64 nt, Human
cagccccagggugaucucaaaguaucuaauucacccucagcaugugggaagggacagguggggg

SEQ ID NO: 513215 - RNA, 64 nt, Human
uccuggucccaacgccagcccuucauccuuccucccucagcagccaggcagacauaacaacaaa

SEQ ID NO: 513216 - RNA, 64 nt, Human
acacgcacauccagcccugguaccugcggguggagagggccaucaccgaggccuccccagcgca

SEQ ID NO: 513217 - RNA, 64 nt, Human
gcugcaucaggcucucugggagaggaggggccuggagggccaggagucccagacucacgcaccc

SEQ ID NO: 513218 - RNA, 64 nt, Human
aauugcggagaacaggacagugcccgguccccuugagggccaucacacccagacccaacggguu

SEQ ID NO: 513219 - RNA, 64 nt, Human
auccgaaagaauuaagagaauaccuagaacauauccucagcaagaaacaaaaccaaacuggacu

SEQ ID NO: 513220 - RNA, 64 nt, Human
cccugcagcccuuuuggcuccccuuuucccugugccucagcacuccuuuccugguugcagauaa

SEQ ID NO: 513221 - RNA, 64 nt, Human
auuuggaugauuucuaaauuaucacaaagugggaccucagcaguagugaugugugugucucaug

SEQ ID NO: 513222 - RNA, 64 nt, Human
acaaacagaugcucagaugaaaaacagauguuauccucagcacaaauucaguaaagagacuaca

SEQ ID NO: 513223 - RNA, 64 nt, Human
uaaccauggauaccaccaugaauuuuauuuggauccucagcagguugauucuggaggccucaug

SEQ ID NO: 513224 - RNA, 64 nt, Human
ccagagaggggcagguagaccugcauagcagcagccucagcagcugucuugguaaaggagagag

SEQ ID NO: 513225 - RNA, 64 nt, Human
aaggaguguccuugaggccuaggacgcugcccggccucagcagcagcccugggagccuccugag

SEQ ID NO: 513226 - RNA, 64 nt, Human
cagcugcugguaggucuuuagcaggccucuggcaccucagcagucggaggcacagaagcugcaa

SEQ ID NO: 513227 - RNA, 64 nt, Human
ggcaugugucucccugcucacccucgucugggcaccucagcaucuguggacuugagcguccaaa

SEQ ID NO: 513228 - RNA, 64 nt, Human
agaccccagcugucugcgcgucugacucuuguggccucagcaggacaggccccgggcacugccu

SEQ ID NO: 513229 - RNA, 64 nt, Human
auaaccaggacucgcugggagagauggacucuguccucagcaacacuccacagcagaaaggggu

SEQ ID NO: 513230 - RNA, 64 nt, Human
aguuuauugucaauugcuucucaagucuaaccagccucagcagugugcauagaccauuuccagg

SEQ ID NO: 513231 - RNA, 64 nt, Human
cugggugcuagaagcccacacccucuacccuguuccucagcauggagcucuggcauccccaccu

SEQ ID NO: 513232 - RNA, 64 nt, Human
gcacacuuucuagauagauuuuauuuuuaaguguccucagcauugcagaaaauaacauuguaau

SEQ ID NO: 513233 - RNA, 64 nt, Human
uggguaggagcagcuuugugucacuaaagaaagugagggccacugucuccggcgggugaggcug

SEQ ID NO: 513234 - RNA, 64 nt, Human
ucccuggagccaccgcggguccuuccccggccccgagggccaaggggguccccgcccgccagug

SEQ ID NO: 513235 - RNA, 64 nt, Human
cacuguggguaccuggugaucagggcaagcuguggagggccagggguggggcugagacugggcu

SEQ ID NO: 513236 - RNA, 64 nt, Human
aggccugggcacuugugcacccauguaggagcaugagggccacacucuuuucaccucaaagccc

SEQ ID NO: 513237 - RNA, 64 nt, Human
guggucucgaucucuugaccucgugauccgcccgccucagcaucccaaagugcugggauuacag

SEQ ID NO: 513238 - RNA, 64 nt, Human
ggccagcucuggaagggcuguauuugggccuaauccucagcaaauguucuaccacucgcagggg

SEQ ID NO: 513239 - RNA, 64 nt, Human
guaaaacagauaugaaaaccuuuucagugcuugcccucagcagcuaagaagacagacaguagag

SEQ ID NO: 513240 - RNA, 53 nt, Human
ccccaaaaaacuguaagugaggcccucagcaagcccuggccccaacucggagu

SEQ ID NO: 513241 - RNA, 64 nt, Human
auggcacaggagccagggaccgugacaacggugcccucagcagccugguguccucuggccauuu

SEQ ID NO: 513242 - RNA, 64 nt, Human
uuggcaaauaagcauucugucucuuuggcugcugccucagcacagagagccagaacucuaucgg

SEQ ID NO: 513243 - RNA, 64 nt, Human
ggaaaaucuccaagagcccugaccucaucuuccaccucagcaaccaugaccugaaaccucagcg

SEQ ID NO: 513244 - RNA, 64 nt, Human
uggccaagauuuccuucuguaucacuccaagcagccucagcagaagaagcagccaugcccagua

SEQ ID NO: 513245 - RNA, 64 nt, Human
auuauuauauuuuucaaugccagugcugcucagcccucagcagaacuucaguuuccaugaaaua

SEQ ID NO: 513246 - RNA, 64 nt, Human
uggccagguucucacacuggcccagagaaaagagccucagcaagagaguuuugccaacaauucc

SEQ ID NO: 513247 - RNA, 64 nt, Human
ugacuucucauuuccuugucuuuuugggugcauuccucagcacacuuuuuuuuuaaaccuuuuu

SEQ ID NO: 513248 - RNA, 64 nt, Human
uauuacuuccccucugauaggacauuguagccagccucagcacucagugaguucaucagggcca

SEQ ID NO: 513249 - RNA, 64 nt, Human
ggggauggggcauggucaaacuuagccauccccuccucagcaaggcaucuaccggccccucaca

SEQ ID NO: 513250 - RNA, 64 nt, Human
ucucaacagaaaaccaguguuaaugaauaucaugccucagcacugucacuuuuaaaaccuguca

SEQ ID NO: 513251 - RNA, 64 nt, Human
aaaaaucgcgaguguuucgcggguaacugggguugagggccaaaauauuuggaaugaaggacuu

SEQ ID NO: 513252 - RNA, 64 nt, Human
uuccccaacaacccagagcagguguugcagacaggagggccacagcguguggaaguaaagacuu

SEQ ID NO: 513253 - RNA, 64 nt, Human
agguccccccuccauaaggacgucaaacuuccaggagggccaguguuccuagugugggccagga

SEQ ID NO: 513254 - RNA, 64 nt, Human
uagugaaggcuucucucugugggaugggaugguggagggccacaugggaggcucacccccuucu

SEQ ID NO: 513255 - RNA, 54 nt, Human
gcgggagcugggacccgugagcugccucagcacugggaccucucgcucuccgcu

SEQ ID NO: 513256 - RNA, 64 nt, Human
cuccgagcccacugucacgcugccugguguucccccucagcagcaagcacuucucuuagggcug

SEQ ID NO: 513257 - RNA, 64 nt, Human
uuuaauugcaguuuaaaagugaaucguaagagaaccucagcauugugcacgauaagagaaugug

SEQ ID NO: 513258 - RNA, 64 nt, Human
gccugcccuggcguucucacagccucccccuuccccucagcaggcggcucucuuugccuuaccc

SEQ ID NO: 513259 - RNA, 64 nt, Human
uuuaaguuguuauuucugauuagaacucuguaacccucagcaaguuucauuuuugucaugacaa

SEQ ID NO: 513260 - RNA, 64 nt, Human
agaagcacaggcuccuguccucagaucccgggaaccucagcaaccucugccggcuccucgcuuc

SEQ ID NO: 513261 - RNA, 64 nt, Human
cucuucggccggguguggugacucacaccuguaaccucagcacuuugggaggcagaggugggag

SEQ ID NO: 513262 - RNA, 64 nt, Human
ccagccucaggaagaguagaaauuggguggugcuccucagcaggggaagguggauguuuaggcu

SEQ ID NO: 513263 - RNA, 64 nt, Human
ggacagguguagagauaaggacuggcaaccagagccucagcauccaaagauggacugaaguggg

SEQ ID NO: 513264 - RNA, 64 nt, Human
caggaggagaacaugaaaauauuaagacaaaaauccucagcaguuguucuccaccccuucucca

SEQ ID NO: 513265 - RNA, 64 nt, Human
uuaugaacuccauuuuaccaagaacauuuaagugccucagcaucuguaugauauaguggagcag

SEQ ID NO: 513266 - RNA, 64 nt, Human
aauaacgauaucuaaagcuuaccagcaaaagaacccucagcagaauagcaaaaacuuugcucag

SEQ ID NO: 513267 - RNA, 64 nt, Human
agacugcucuccucaccacacagcacuaguccauccucagcaccugagccucccucacuuggac

SEQ ID NO: 513268 - RNA, 57 nt, Human
cacauuacaaugggcugugacucuccaccucagcauugcaucguaucaucauuuucg

SEQ ID NO: 513269 - RNA, 64 nt, Human
uccugugguggcauugggagaguucccccaugaugagggccaagauagaaucuguaccacucag

SEQ ID NO: 513270 - RNA, 64 nt, Human
gcaggcccgugccugguuuugcgucuguuccccugagggccaucgucauccuggagcuucaaug

SEQ ID NO: 513271 - RNA, 64 nt, Human
gccuuguuugggguucuguggguuugggugggaagagggccaucugccugaauguaaccugcua

SEQ ID NO: 513272 - RNA, 64 nt, Human
gaaccaggcagagugggaacuugaaacuguugcugagggccacccggggcuucuugguccacuc

SEQ ID NO: 513273 - RNA, 64 nt, Human
agguccucauccguccgcuguccucauucugcggccucagcaaaaagccacaaggucugagcgg

SEQ ID NO: 513274 - RNA, 64 nt, Human
ccccacagagcucaggguggcagaucuccgguauccucagcacuacccacccccgccagcuccc

SEQ ID NO: 513275 - RNA, 64 nt, Human
guuuguauuuucaauuuauuggauggcuuaagcaccucagcauuccuuacuaugugauaaaaua

SEQ ID NO: 513276 - RNA, 64 nt, Human
cgcagccuggcccucugggcccaacgcaggaggcccucagcacccgaacacaucuuccuccucc

SEQ ID NO: 513277 - RNA, 64 nt, Human
aagaauauuuccauauuucagugggcacucccaaccucagcacuuguccguagggucacacgcg

SEQ ID NO: 513278 - RNA, 64 nt, Human
cacucauccagaaggcccugaggaagaagaaaauccucagcaaagugaagaauugcuugaagua

SEQ ID NO: 513279 - RNA, 64 nt, Human
uuugccacaggcaggugagaaaggcagggccacuccucagcaaaguuggccucuucuacacuuc

SEQ ID NO: 513280 - RNA, 59 nt, Human
ccuggucugugagggucuaaagagagaguccucagcagagucuucuugugcugccuuug

SEQ ID NO: 513281 - RNA, 64 nt, Human
acgggagggaggaggagcagacggcagaggaaauccucagcaaaggccugagccagaugaccac

SEQ ID NO: 513282 - RNA, 64 nt, Human
uucucaagggaagagccuugcugugccccuguagccucagcacccagcacaggccugucagaca

SEQ ID NO: 513283 - RNA, 64 nt, Human
ggcucccugcugcccucaggauaaagucuggaccccucagcauggcuugugagacucauggugu

SEQ ID NO: 513284 - RNA, 64 nt, Human
ugccagaggccuggugcccuggcccagccuguggccucagcaucucauaacucauuugcuuugu

SEQ ID NO: 513285 - RNA, 64 nt, Human
ggaagggggcaggccccuuuggaccugcaguuggccucagcagaaggccuugccuuguguaugu

SEQ ID NO: 513286 - RNA, 64 nt, Human
aaaauaggcugggcgcgguggcucacgccuguaaccucagcacuuugggaggccgaggcggaca

SEQ ID NO: 513287 - RNA, 64 nt, Human
ucccccuguccccaccccaggagaguaaggggacgagggccagcucucuggcaucaggcugcuu

SEQ ID NO: 513288 - RNA, 64 nt, Human
cagaaguugggcagagagaggcagggaggccagugagggccagggagugaguguuagaagaagc

SEQ ID NO: 513289 - RNA, 64 nt, Human
gauacacuuuggccuuccuuuccccagcgccccugagggccagaggcagaugugggcugcaggc

SEQ ID NO: 513290 - RNA, 64 nt, Human
ugggggcucugcuuugcgucuaaccuuugugggggagggccagcaaggcaguccccccacgccc

SEQ ID NO: 513291 - RNA, 64 nt, Human
ucagcccugguuccucccucucuggccugugccgccucagcagcccuggcagaacugaagagcg

SEQ ID NO: 513292 - RNA, 64 nt, Human
cucacuuuauaucuuauauucuaaauagcuaucaccucagcagucuuuugccuauugguuaugu

SEQ ID NO: 513293 - RNA, 64 nt, Human
acccccaguugugaaaacugcaguuuagcagugaccucagcaaccccuccuuuuuauuuuuucc

SEQ ID NO: 513294 - RNA, 64 nt, Human
guuuuagggucuggcuuuugcaggcacccucugaccucagcagagcuccugggccugcugccug

SEQ ID NO: 513295 - RNA, 64 nt, Human
uaaaauucugaaacagaggcuuuaaaauuuaaaaccucagcaaaauaauccaugaauuuacuga

SEQ ID NO: 513296 - RNA, 64 nt, Human
uauucuaaguuuucauucuuugaauuauaaauggccucagcaguuuugcucaacuacugauaaa

SEQ ID NO: 513297 - RNA, 64 nt, Human
cccacuuuugcucuuccccaaggaacugcucccaccucagcacguggaggccucucacgguccu

SEQ ID NO: 513298 - RNA, 64 nt, Human
uuccuuuuucuuuucagaaugaagaccuaaaugaccucagcaaauccucuucuaacucaugggu

SEQ ID NO: 513299 - RNA, 64 nt, Human
auaaugaggagagucaaaaacaugcagccuuaagccucagcaaagagcauaauccaacucagua

SEQ ID NO: 513300 - RNA, 64 nt, Human
ggagugcaaucagccuccuccagcugccagagcgccucagcacaggugucagggugcaaggaag

SEQ ID NO: 513301 - RNA, 64 nt, Human
augugaugauaaucacccccagcagauuccauuaccucagcagcucuuguucccccgccacugg

SEQ ID NO: 513302 - RNA, 64 nt, Human
cauaucuucaccaggccagagauucaguuuuaaaccucagcagccaucaguuuggccaaguggu

SEQ ID NO: 513303 - RNA, 64 nt, Human
cuccuuggaguguccaggaccaucuuaaagccgcccucagcacaucugcaugaagauagauagg

SEQ ID NO: 513304 - RNA, 64 nt, Human
gccagagggguuggccaguuggagccugggucagccucagcagccuauccccauguccucuaug

SEQ ID NO: 513305 - RNA, 64 nt, Human
gcgggcaccagcgccacuuaugugccucugcuccgagggccagugggcugcagggccugcuugg

SEQ ID NO: 513306 - RNA, 64 nt, Human
aggagacccaaaugccuuuacuuuauucucuggggagggccagcggcucgcaucccccucaucu

SEQ ID NO: 513307 - RNA, 55 nt, Human; identical to SEQ ID NO: 434872

SEQ ID NO: 513308 - RNA, 64 nt, Human
acggaggagguucccuugcugggcaugcuucguagagggccaggagcagcaggucaugugcaca

SEQ ID NO: 513309 - RNA, 64 nt, Human
cggccagaccacaaggccagaagcaauaauggcaccucagcaguuccaguauggauagggguuc

SEQ ID NO: 513310 - RNA, 64 nt, Human
gacugugaagacaugaaaagauaauaguuggaaaccucagcaauuuucaauucaaggaaucuau

SEQ ID NO: 513311 - RNA, 64 nt, Human
gaagccuugaagauuacaacugugauuuccuuuuccucagcaagcuccuauguguauauuuucc

SEQ ID NO: 513312 - RNA, 64 nt, Human
agagggacuggaggccagcgguguccacccuugcccucagcaagagagaaugcauucuuaaaag

SEQ ID NO: 513313 - RNA, 64 nt, Human
guuacaaaucaggucacuaugcaaacuagaauauccucagcagguggccuggccacucuggaga

SEQ ID NO: 513314 - RNA, 64 nt, Human
cauuugcuccuccuguuccugugccacuccagaaccucagcagaucugagccaccgccugccag

SEQ ID NO: 513315 - RNA, 64 nt, Human
cuguguguguguuucggaaagccgcuguguccugccucagcacaaagacccagugucauuugcu

SEQ ID NO: 513316 - RNA, 64 nt, Human
cacuccguuucugaauuuucuauaggauccucggccucagcagauauaaacgcuuaccauuguu

SEQ ID NO: 513317 - RNA, 64 nt, Human
uugaacgccucuccuaggccacuacaaacugaccccucagcagggcuggcugccacagggcugc

SEQ ID NO: 513318 - RNA, 64 nt, Human
ccccauccccaccccuccuggucuguauccugggccucagcaagccaugccccuggggugaggg

SEQ ID NO: 513319 - RNA, 64 nt, Human
uguucauuaguauauacucauuccuucaugcuuuccucagcagaacacuuccacuucugaggug

SEQ ID NO: 513320 - RNA, 64 nt, Human
acucuagaaaacgaagggaggaggagcacaagauccucagcaacgaacaccugcacuuagaaaa

SEQ ID NO: 513321 - RNA, 64 nt, Human
agauagguuggucaucgugcagaaggccccaggaccucagcacacacagccuccucuuggucug

SEQ ID NO: 513322 - RNA, 64 nt, Human
gugaagaaaaucuuuuggccacaggaaauaucuuccucagcaucugagaauuuuuccaggaggg

SEQ ID NO: 513323 - RNA, 64 nt, Human
ccuugagcugcuuuggagacucggcugccagagggagggccaugggccgaggccuggcauucac

SEQ ID NO: 513324 - RNA, 64 nt, Human
acauggccuugccucgguggcccugacugucagggagggccagggaggcagagcgggagggagu

SEQ ID NO: 513325 - RNA, 64 nt, Human
ccugcgccuuccccccuaccgccucaccucacaggagggccaggcauguauuccucagaggcga

SEQ ID NO: 513326 - RNA, 64 nt, Human
uccaggacccgucccaauaaccacccacggccaggagggccaaggccccgugcuggauauuuaa

SEQ ID NO: 513327 - RNA, 64 nt, Human
caccuggaaagaacagagauuacccuuucaccuaccucagcaaaacaaacuuucaagucuugau

SEQ ID NO: 513328 - RNA, 64 nt, Human
ugugagcaaagugcuuuggcaaggcaagggucucccucagcagggcuaggugcacuacagccuc

SEQ ID NO: 513329 - RNA, 64 nt, Human
ccgucugugucagcccagcucugccucgcagcccccucagcaugggugcccccagaaguaagca

SEQ ID NO: 513330 - RNA, 64 nt, Human
guuaggugcucuugaagaagaugucauggcauugccucagcaccccagcaagagcauugcaucu

SEQ ID NO: 513331 - RNA, 64 nt, Human
guaugaaauaugugcaugcccuagaugugaaacuccucagcagcucggguuauaaugugugugu

SEQ ID NO: 513332 - RNA, 64 nt, Human
aaacacacagaagaagcuaccucagguguuuuuaccucagcaccuugcucuuguguuucccuua

SEQ ID NO: 513333 - RNA, 64 nt, Human
ucuucaagcacuggacguggauucucucucuagcccucagcaccccugcgguaggagugccgcc

SEQ ID NO: 513334 - RNA, 64 nt, Human
acccugcuuuuguaaccgcguuaaccugacaaaaccucagcagcagaagucccuauuuuucuag

SEQ ID NO: 513335 - RNA, 64 nt, Human
ggaggagagagggggagaccccuuugccuuccccccucagcaaggggcugcuucuggggcuccc

SEQ ID NO: 513336 - RNA, 64 nt, Human
aauugcuccuuugauggagguuagggacugucacccucagcacugugaacauaccgggcgagau

SEQ ID NO: 513337 - RNA, 64 nt, Human
ccccccgagaucaggacgaaggaccaccgucgguccucagcagggcggcagccuccuccuggcu

SEQ ID NO: 513338 - RNA, 64 nt, Human
ccagcuuccuucugucauuccccucuuuugucuuccucagcagguuggcuuuuuucccuggugc

SEQ ID NO: 513339 - RNA, 64 nt, Human
cuaccuguacgucugacaugaaaacuucucaccgccucagcagcugaacuaaaaaccugaauag

SEQ ID NO: 513340 - RNA, 64 nt, Human
gagcguuuucaagaaaauagcuauaauaccuaugccucagcaauacauagaacugaaaaaacag

SEQ ID NO: 513341 - RNA, 64 nt, Human
cucuccacccccccgggacuguuggggggauucugagggccagagggggauauauaugauuccc

SEQ ID NO: 513342 - RNA, 64 nt, Human
ccucgugcugggcucugcccugggcagacaggcagagggccagagcagaggacacauggccuug

SEQ ID NO: 513343 - RNA, 64 nt, Human
agacacagcugggucuggaccccacggggcuggggagggccaugugcaauauuuggaggguuuu

SEQ ID NO: 513344 - RNA, 64 nt, Human
ccaccgcaacaagcgggccgccccagccaccuccgagggccagagcaagcgcuguaaacccuga

SEQ ID NO: 513345 - RNA, 64 nt, Human
augccuaaaguuccaauuuuagcaaauaugggaaccucagcaaugcuaauuuucuagaaaaacc

SEQ ID NO: 513346 - RNA, 64 nt, Human
uagagcacacugggagguuucaucuuggaggauuccucagcaggauacuucagccauuuuagua

SEQ ID NO: 513347 - RNA, 64 nt, Human
gcaucuugagauuguuauggugagaguauuuacaccucagcaaaugcugcaaaauccuguuuuc

SEQ ID NO: 513348 - RNA, 64 nt, Human
uucuaugacugaucaaaagacuaauaguuaaaaaccucagcaggccuuguucacgauaugcaga

SEQ ID NO: 513349 - RNA, 64 nt, Human
gcuggggacaacaaaggggcggcucagucccgagccucagcauggcuggcagcgcggcugacac

SEQ ID NO: 513350 - RNA, 64 nt, Human
auucccuacuaaccuccaccagcaaccuggacugccucagcauuccaaauagauacuaccugca

SEQ ID NO: 513351 - RNA, 64 nt, Human
acaauacauaacagaguugccaagauauuuauacccucagcacucggggcaacacaguggaaag

SEQ ID NO: 513352 - RNA, 64 nt, Human
ucccagcaugaagugugcauggcuuugagaagugccucagcacccugaaauggacuaaggccag

SEQ ID NO: 513353 - RNA, 64 nt, Human
agcugagcccucagcccgggaggcaggcuccaggccucagcaggugcggagccgucacugcacc

SEQ ID NO: 513354 - RNA, 64 nt, Human
ggucccucaaagaggagaguggggugcagaaaugccucagcauggcucaugcacacagcauucu

SEQ ID NO: 513355 - RNA, 64 nt, Human
uuucauuuuguagcugcugagauguuaaggcaagccucagcaucugccccugcugggugcacaa

SEQ ID NO: 513356 - RNA, 64 nt, Human
gcccaccauuuccgagguccuguccacggcggggccucagcagaacucucugacuggggccccu

SEQ ID NO: 513357 - RNA, 64 nt, Human
agccucaaccuccuggguccaagugauccucccaccucagcacacaacaccaugcccaauuuua

SEQ ID NO: 513358 - RNA, 64 nt, Human
aggccuccugggccugucgggccuccgauuucauccucagcacguaaugcucaccaacagcacu

SEQ ID NO: 513359 - RNA, 64 nt, Human
acacaucccucgggaacucugccccucugacaaugagggccacagagaaggugguguuuccaug

SEQ ID NO: 513360 - RNA, 64 nt, Human
caugggcacugggcucgccuugcacgcccaccaggagggccaggggcauacgcaguccugacgu

SEQ ID NO: 513361 - RNA, 64 nt, Human
agccagcugccagugcagguggagggcuguaggggagggccagugcccagacagggucaugggg

SEQ ID NO: 513362 - RNA, 64 nt, Human
gcagaagggagaaggcugugcuagaggagccagugagggccagcauggggugggcuucacuaag

SEQ ID NO: 513363 - RNA, 64 nt, Human
guggaauuugcuuccugaguaaguggauauacaaccucagcaaugacaaggaagaaguguggaa

SEQ ID NO: 513364 - RNA, 64 nt, Human
uacgaacuucuccagcucugcucuguuuucucuuccucagcauccaccccgugacacguagugg

SEQ ID NO: 513365 - RNA, 64 nt, Human
ggaaguggaggugaaugucucugccuccuguaggccucagcagggacagcacagacccucuggc

SEQ ID NO: 513366 - RNA, 64 nt, Human
uccuugguucucccagcuugguuguguagcaaucccucagcauuguuuuucucagcuucuuggc

SEQ ID NO: 513367 - RNA, 64 nt, Human
cccaucagugaaaagggguggcuagaguaacuaaccucagcaggccguccaguccugauagucu

SEQ ID NO: 513368 - RNA, 64 nt, Human
gggucauauguuuauuuuucauuguguuuugugaccucagcagggugggggucuuccuccuuac

SEQ ID NO: 513369 - RNA, 64 nt, Human
cucccucuaauguguggugcuuuggugagcaaacccucagcaguccugaccuucgggugaccag

SEQ ID NO: 513370 - RNA, 64 nt, Human
cccccgcacaggcuccugugugcagggacugauuccucagcacacgaggcuuccacaacccagu

SEQ ID NO: 513371 - RNA, 63 nt, Human
agcucguggggauggagugacagccucagucccccucagcacagacaaaagccagcagagcaa

SEQ ID NO: 513372 - RNA, 64 nt, Human
ccuaucauuaccuugcacccaucucuuuagauggccucagcaccucacucguuauucuccaucu

SEQ ID NO: 513373 - RNA, 64 nt, Human
caagguaauggagggcuccuacuugggacagagcccucagcagagaauuagcagucuguuggug

SEQ ID NO: 513374 - RNA, 64 nt, Human
ugaauuccacagugcaaauaucuuucuguaacacccucagcauccugcacugcccucucugaaa

SEQ ID NO: 513375 - RNA, 64 nt, Human
agagccugcucuaugcggaucuggaccaucuagcccucagcaggccccgccggcuguccacagc

SEQ ID NO: 513376 - RNA, 64 nt, Human
cuuucagcaucggcucuucagcagauccaaacccccucagcaacuugcagaggaccuguccccu

SEQ ID NO: 513377 - RNA, 64 nt, Human
gcuauuuuuuaccucaccuggaaacuaccauugugagggccaucccccaggcacugcacagcac

SEQ ID NO: 513378 - RNA, 64 nt, Human
uuggaggagaaggacauuuuacugcagugagaaugagggccaagaaagagucaggccuuaauuu

SEQ ID NO: 513379 - RNA, 64 nt, Human
uuuuguuuuaaauacgcacuacaugugguuuauagagggccaagacuuggcaacagaagcaguu

SEQ ID NO: 513380 - RNA, 64 nt, Human
ugaacccagauggcaauccaucccgguucucucugagggccacgggcuuggguaguggaaaggg

SEQ ID NO: 513381 - RNA, 64 nt, Human
gaccucaaauguugccuuggaguccccuacagccccucagcagagggcagcacuugaaugcuua

SEQ ID NO: 513382 - RNA, 64 nt, Human
uccucuccagcacucugucguucucugagccccaccucagcaggucuccaggaucccucacauu

SEQ ID NO: 513383 - RNA, 64 nt, Human
gcccuccucccccaccagcucuccccacagggccccucagcaucauggagacccgcaggcgggg

SEQ ID NO: 513384 - RNA, 64 nt, Human
ccaagagcaaggaugaaaaauugaagucacagccccucagcaccaagcagaaggugaggacagg

SEQ ID NO: 513385 - RNA, 64 nt, Human
gugcccagagacaagugaaggugucugcccugggccucagcaaggauguguacaacagguagaa

SEQ ID NO: 513386 - RNA, 64 nt, Human
gagcccuuccucuguaaaagugucacaccaccucccucagcacuuccccaucacaacaaccuau

SEQ ID NO: 513387 - RNA, 64 nt, Human
gguccaggugcccccgccccacaaggccgcggagccucagcaggagggguggcgaguugcgggu

SEQ ID NO: 513388 - RNA, 64 nt, Human
gguggugagccgccugccaguggaggacagcaccccucagcaccacccacccucauucagagca

SEQ ID NO: 513389 - RNA, 64 nt, Human
uuuuguguaugucugacuuguuuuuaaauaacuuccucagcaaugcagaccuuaauuuuuauau

SEQ ID NO: 513390 - RNA, 64 nt, Human
cuccuuuucgcaaauguacagaagccauuugucaccucagcauucgcugccgaaaugagcaacu

SEQ ID NO: 513391 - RNA, 64 nt, Human
gauggaaaaguguagggacugagaagggcugcagccucagcaguguacagaguccccggcgcuc

SEQ ID NO: 513392 - RNA, 64 nt, Human
ugcaccuggacagguguacgucugcacccaucacccucagcaccaggccacccugcaguccacu

SEQ ID NO: 513393 - RNA, 64 nt, Human
uggcuugaagcugcucacugcucacacgcugccuccucagcagccucacugcaucuuucucuuc

SEQ ID NO: 513394 - RNA, 64 nt, Human
gaauucaauugagaaguucuguuguucauccuuaccucagcagguagaaaagagguggagauca

SEQ ID NO: 513395 - RNA, 64 nt, Human
gacaaugacccagaagacagccaugccuccgaaagagggccagguccuaagcugcugcuugugc

SEQ ID NO: 513396 - RNA, 64 nt, Human
gcuguuuuauaaaagugaaauauccaguauuucagagggccaggcaagagcacuucagaugagg

SEQ ID NO: 513397 - RNA, 64 nt, Human
cacauuucugggggugucgucacugccguccccggagggccagauacggccccgcccaaagggu

SEQ ID NO: 513398 - RNA, 64 nt, Human
cgaguggucgagugaagauugaaaauuaaccucugagggccagcacagcagcucaugccuguaa

SEQ ID NO: 513399 - RNA, 64 nt, Human
ccugaagcacucccaggcucaucaugggagcuuuccucagcaccuucaccuucccucccagugu

SEQ ID NO: 513400 - RNA, 64 nt, Human
uaggcaugugcuggucucuguguguuuguguguuccucagcaggaaugagugucuuuguguauc

SEQ ID NO: 513401 - RNA, 64 nt, Human
cagggaccaggauaccacucugucacugugugacccucagcaagucacuaacccuuggccucau

SEQ ID NO: 513402 - RNA, 64 nt, Human
agggaaccuccuagcacugugaaagucagaaucgccucagcauuuccaugacgcacauuaugca

SEQ ID NO: 513403 - RNA, 64 nt, Human
ucgcagaaauaauuaaugagauucgcuccugugaccucagcaaauggacaggaaauaaguccuu

SEQ ID NO: 513404 - RNA, 64 nt, Human
augacaugauuaaaugaugaauuuauuuugucagccucagcaacaaacauuuccuaaaugggau

SEQ ID NO: 513405 - RNA, 64 nt, Human
uccacauccgcaaaagccuccucgccuucagccuccucagcauucaguuugucaaugaagugau

SEQ ID NO: 513406 - RNA, 64 nt, Human
guguuaggagaagaacgaugauaccuacuuaacaccucagcaucugcgucgugucucuuugugc

SEQ ID NO: 513407 - RNA, 64 nt, Human
gggccucucuccguugccccagcuucacucucucccucagcaccugcccugcuggaggccccag

SEQ ID NO: 513408 - RNA, 64 nt, Human
ucaugugccuuucuauuuucaucuuagaaaauuuccucagcaaaccgaugagagauugugguug

SEQ ID NO: 513409 - RNA, 64 nt, Human
aaugaagcaacagagaggaaauuguacauaaguaccucagcauuuaauccaaacagggguucuu

SEQ ID NO: 513410 - RNA, 64 nt, Human
uccugggcuuuuccuacugugucuuguuacaaggccucagcaauccacagaacucucucuccuu

SEQ ID NO: 513411 - RNA, 64 nt, Human
aaaagaauuccuuagcaugaugucuguuuugguaccucagcaaugaaccuuuucuagaaauuau

SEQ ID NO: 513412 - RNA, 64 nt, Human
guaaggagccuucaauuuucuuuagcgacuacuaccucagcaacaggaggcagcaaggggcugu

SEQ ID NO: 513413 - RNA, 64 nt, Human
cagggacagccuggggcugacagggcuccccuccgagggccaguuucaggucuggaaggggagg

SEQ ID NO: 513414 - RNA, 64 nt, Human
gcuacugugagccccgggccagagaagagcccgggagggccaggggcgugcaugccaggccggg

SEQ ID NO: 513415 - RNA, 64 nt, Human
agauuguggucacauuggggcuuguuuaggauuggagggccaggucaccuccccagccacccuc

SEQ ID NO: 513416 - RNA, 64 nt, Human
uccuuuuguucuggguggaagcagcggugccgcggagggccagccagauccggacccuucccuu

SEQ ID NO: 513417 - RNA, 64 nt, Human
caaguaaccacuccauccagccuugggcaagaugccucagcaauauacaauggcauugcaacca

SEQ ID NO: 513418 - RNA, 64 nt, Human
cccuuaccccggggucugguguaugcugugcuuuccucagcaguauggcucugacaucucuuag

SEQ ID NO: 513419 - RNA, 64 nt, Human
gugcaucauuugcaucauuccccauugacugaauccucagcaguggccguuuuuccucuugucc

SEQ ID NO: 513420 - RNA, 64 nt, Human
aauucaucaaccagcugccucuuguuucauuucaccucagcacguaccaucuguccuuuuguug

SEQ ID NO: 513421 - RNA, 64 nt, Human
aucugcaguauuuguaccuccagaauggcagaucccucagcaggaacaaaggcauauugacggu

SEQ ID NO: 513422 - RNA, 64 nt, Human
uccgcgucccacuagcaggcggagccccccacccccucagcagggccggagaccuagguaagga

SEQ ID NO: 513423 - RNA, 64 nt, Human
augcuuuccuguucaugggguuuuugcccuggagccucagcagcaaaugccacucugggcaguc

SEQ ID NO: 513424 - RNA, 64 nt, Human
acagcccuuuguggccgccguccccauccccugcccucagcacacacaucugcacacacgcagc

SEQ ID NO: 513425 - RNA, 64 nt, Human
auagucuucucaaauuagaaaguuaaccccauguccucagcauuucuuuucuggccaaaagcag

SEQ ID NO: 513426 - RNA, 64 nt, Human
cugcggagaacacccuugguggcuuaugggucccccucagcaagcccuacagagcuguggagga

SEQ ID NO: 513427 - RNA, 52 nt, Human
cggagcugaauacagccugaggccucagcagccgccuuaagcugauccugcg

SEQ ID NO: 513428 - RNA, 64 nt, Human
cccuccccuccuuuagccaagucaggaucuuaggccucagcaggcagggacccuuccaggccac

SEQ ID NO: 513429 - RNA, 50 nt, Human
agucugucaaaaagaaguaaccucagcacuacuauucucucuuaaaagau

SEQ ID NO: 513430 - RNA, 64 nt, Human
aacacaugcuucgcuguuagugucuucuuccugcccucagcaccacagcucaagaaaaccuaaa

SEQ ID NO: 513431 - RNA, 64 nt, Human
auugaucucuggcacaagcagcuuccuggaguuaccucagcagaagacuagaauuagagaaaag

SEQ ID NO: 513432 - RNA, 64 nt, Human
uuggucuggguuuggcaggcacugccugcuacuugagggccaggaugcucccccagggaagaaa

SEQ ID NO: 513433 - RNA, 64 nt, Human
ugcacauccuuggaggcgagaugagcuccuugcagagggccagaguaagugcaagucauggagu

SEQ ID NO: 513434 - RNA, 64 nt, Human
gugccaagcccuggcccccacagcgcucgauggaccucagcaagcugcccagcccuggcccagg

SEQ ID NO: 513435 - RNA, 64 nt, Human
gaggggaccucuccacacagguguuccgugggacccucagcagcucuggcucugccucaggagg

SEQ ID NO: 513436 - RNA, 64 nt, Human
uuauugugcaugcugaaaagaguaugaaaaauccccucagcaggcauaggauagaaacguauug

SEQ ID NO: 513437 - RNA, 64 nt, Human
gaaggaucaccugagccuaggaguucaagaccagccucagcaacagcaggagccccaccccccg

SEQ ID NO: 513438 - RNA, 64 nt, Human
cagauuugcaguaccaaccuaugcagccaagcaaccucagcaguucccaucaaggucagaagaa

SEQ ID NO: 513439 - RNA, 64 nt, Human
aggggucucugguauccagauggagcucucgcuuccucagcagcugugacuuucacccaggacc

SEQ ID NO: 513440 - RNA, 64 nt, Human
ugcagugagccaagaucgcgccacugcacuccagccucagcaauagagugagacugucucaaaa

SEQ ID NO: 513441 - RNA, 64 nt, Human
auggauucuccacucaguugcaacuuggacuuguccucagcagcugguaaucuugcucugcuug

SEQ ID NO: 513442 - RNA, 64 nt, Human
cuuuugggaggauuugauguaaguuacugacaagccucagcaaacccaaagauguuaacaguau

SEQ ID NO: 513443 - RNA, 62 nt, Human
aggccucacauucguggggcucccugaauggcagccucagcacagcguaggcccuuaauaaa

SEQ ID NO: 513444 - RNA, 64 nt, Human
gauuggggugaagacaucccuggagugaaggacuccucagcauggggggcaguggggcacacgu

SEQ ID NO: 513445 - RNA, 64 nt, Human
gcagccacugacaagaggccagugugucaccagcccucagcagaaaccgaaagagaaagaacgg

SEQ ID NO: 513446 - RNA, 64 nt, Human
uuucccccugugccuuugcucggugcucugguuuccucagcaacacuccuuguaaggggcagag

SEQ ID NO: 513447 - RNA, 64 nt, Human
ggcugcacuugaacacugauuguccauuuacagcccucagcaaugugccuucuaaauggcauga

SEQ ID NO: 513448 - RNA, 64 nt, Human
uggguguagauuaccugccacuuccaggagcccagagggccaagagagacauugccuccaccuc

SEQ ID NO: 513449 - RNA, 64 nt, Human
cacuggcguuggggaguugguuccugagaggucugagggccagagcugcccucuacauuaacau

SEQ ID NO: 513450 - RNA, 64 nt, Human
cuugcucuucugucugucaucuugcaggaugcccgagggccagaugggcuuagcuaggccaaag

SEQ ID NO: 513451 - RNA, 64 nt, Human
aguggccuuggguccgggucucacugagcagcccgagggccacuccagcccggcuggggaagag

SEQ ID NO: 513452 - RNA, 64 nt, Human
uucuugugcaugucucuguaauguaacucacccuccucagcauuauuugauacacugauuguua

SEQ ID NO: 513453 - RNA, 64 nt, Human
uccuaucugccaaaauggcuuagacacaaaaacaccucagcagaaaugaauauaccuagcacuc

SEQ ID NO: 513454 - RNA, 64 nt, Human
aggcuuuguaaaaacuauccaugaagggaaagcuccucagcauaacugcucagggaaauagggc

SEQ ID NO: 513455 - RNA, 64 nt, Human
uugcuucaagauucaaacagagacucccagucccccucagcaucuucccugaaucacagcccca

SEQ ID NO: 513456 - RNA, 64 nt, Human
uccuacccaggcugccuggccggggccacugccuccucagcaugcaggaggcugcccuguaggg

SEQ ID NO: 513457 - RNA, 64 nt, Human
agggaggggagcaaguggggaccuggccauggccccucagcaaaaaccuauucacagcgggugg

SEQ ID NO: 513458 - RNA, 64 nt, Human
gagacacuuuucaucuggagcaggggggugagcuccucagcagccuccguaacagcugcccugc

SEQ ID NO: 513459 - RNA, 64 nt, Human
gagggcucuuccauccccagcacccccugcuacaccucagcagccucccccaugcaaaaaggaa

SEQ ID NO: 513460 - RNA, 64 nt, Human
caggcucuguacaaaaaaaaaaaaaaaaaaaaagccucagcauuuuaucauuccauggaaggag

SEQ ID NO: 513461 - RNA, 64 nt, Human
augcagcauucacucucccugucuuuuccccuucccucagcagaaacguguuuaucagcaaguc

SEQ ID NO: 513462 - RNA, 64 nt, Human
gagggccaucagaaggaagccaaagaguucacagccucagcaccaacaacucaacauggucauc

SEQ ID NO: 513463 - RNA, 64 nt, Human
gacugggcaugagguggucaccaggauugagcuuccucagcacccaguggguaauacuugcuuc

SEQ ID NO: 513464 - RNA, 64 nt, Human
agcugaggggccccucugcccccuucuaccuccaccucagcacccucccccagcuugauguuug

SEQ ID NO: 513465 - RNA, 64 nt, Human
uuuuagaggggacacuuugguccucgguucccacccucagcaagcaggccuccagcccgaggaa

SEQ ID NO: 513466 - RNA, 64 nt, Human
ucccauuucacccccucugcagacaccaauguccgagggccacccaggacaggacgggggucag

SEQ ID NO: 513467 - RNA, 64 nt, Human
agccagaggcaccuggaacccuggacuucacugggagggccaacuuggaggaucagugcuggcu

SEQ ID NO: 513468 - RNA, 64 nt, Human
aaagagggcaccaaagaaaaggguaagugcaucugagggccaaaagagauguauaagccuuuua

SEQ ID NO: 513469 - RNA, 64 nt, Human
agaugaaaauaaggaugauggggacgggguccaggagggccacugggaaggcacuauccagaaa

SEQ ID NO: 513470 - RNA, 64 nt, Human
uggcaggagagcggacuuagagcccccgagggccccucagcagaggaaggggaguccccuccuc

SEQ ID NO: 513471 - RNA, 64 nt, Human
acaaaaagccgagaacccagggccagcaguggagccucagcagaccagggccugguccuugcua

SEQ ID NO: 513472 - RNA, 64 nt, Human
cgccgagcccgggcucccgagagcaaccucgugaccucagcaugccauucguucgugagugucc

SEQ ID NO: 513473 - RNA, 64 nt, Human
ucccccccuuuccagggcaggggacaccuuggcuccucagcagcccaaggacggcaccauccag

SEQ ID NO: 513474 - RNA, 64 nt, Human
ucccuccagccucagccaagcaacauggggugaaccucagcacucccacaccucccuuccagca

SEQ ID NO: 513475 - RNA, 64 nt, Human
cuaugcaagugccccuguggcuuguccccaacccccucagcaacaaagcucagcuggggaacga

SEQ ID NO: 513476 - RNA, 64 nt, Human
cacuccuuagaucgcuauugauggcuugaucaucccucagcauuucucccaaccagaucgguga

SEQ ID NO: 513477 - RNA, 64 nt, Human
acuuccuggaagugucuuucggauccacuauaugccucagcacauggaaccuuaaugaccaaag

SEQ ID NO: 513478 - RNA, 64 nt, Human
ggggaaacccaagggaggaguccugguccugcucccucagcacccaaaaggggcagaaccugag

SEQ ID NO: 513479 - RNA, 64 nt, Human
caguuccuucaaagugauacccccacagguaagcccucagcauccugaauacaucauccgcagc

SEQ ID NO: 513480 - RNA, 64 nt, Human
cuguagacaaugagauuaagcuucaaucacugcuccucagcaaugugaagaaucaaagucaggg

SEQ ID NO: 513481 - RNA, 64 nt, Human
gacacucacuggacaauaucaaaccauggcuccuccucagcauggcuuugugucuuucccaguu

SEQ ID NO: 513482 - RNA, 64 nt, Human
uugguacuguccaugucugggugugugccuauuaccucagcauuucucacaaaguguaccaugu

SEQ ID NO: 513483 - RNA, 64 nt, Human
ggcuuucugaguccuguuggccaccaagugucagccucagcacucccgggacuauugccaagaa

SEQ ID NO: 513484 - RNA, 64 nt, Human
cgucugaggggcccugcuccaagccugcaggaccgagggccacagccggacaggggguagcccc

SEQ ID NO: 513485 - RNA, 64 nt, Human
ccuccugcuccccucgccugcacacccccuuucagagggccacuggguuaggaccugaggaccu

SEQ ID NO: 513486 - RNA, 64 nt, Human
cucccaccccauuaagacucaccaggagaggucugagggccauucagaacccacuccugagugg

SEQ ID NO: 513487 - RNA, 64 nt, Human
uuguuccugcaccacaucagauaagcaugugaaggagggccaacuggcagcugcgggacccuug

SEQ ID NO: 513488 - RNA, 64 nt, Human
gccagggcauuugcagaagcugggaaggaccaagccucagcaccccagggcugcggggcucuug

SEQ ID NO: 513489 - RNA, 64 nt, Human
ccagccagagcacaggaagagcagugugauggggccucagcagcgggugccccuggcucgggac

SEQ ID NO: 513490 - RNA, 64 nt, Human
ugccaaccuuaguguuucuccagccagacagaugccucagcaugaagggcuuggggacuugugg

SEQ ID NO: 513491 - RNA, 64 nt, Human
ccucugcaugcagcacagaagggugugaccaugcccucagcaccacucuuguccccacugaacg

SEQ ID NO: 513492 - RNA, 64 nt, Human
ccugcucuuaugacauuauaucuugugccuuucuccucagcagugagcagugagcuacuccugg

SEQ ID NO: 513493 - RNA, 64 nt, Human
uuuccuuuauaaugaggaugauuauuuucaaggcccucagcauauuuguauaguugcuugccug

SEQ ID NO: 513494 - RNA, 64 nt, Human
auccuuucggacgacuacuuggagccauaaguaaccucagcaaaaacgaggccucugcaagcca

SEQ ID NO: 513495 - RNA, 64 nt, Human
uuuggagcaauuaauuaaauuagguuaaguuuucccucagcaaccuguguguucaaagguuagg

SEQ ID NO: 513496 - RNA, 53 nt, Human
ucacugcuacugagaucuagggcccucagcaaccagcucuguagggagcucug

SEQ ID NO: 513497 - RNA, 64 nt, Human
cuguggcgauuggugaacagcauaaacagcuggaccucagcaagggucaggcaaacccagucac

SEQ ID NO: 513498 - RNA, 64 nt, Human
gggccaggcccucgccauccuccccauccuuguuccucagcaaauggcauuagcagcugucauc

SEQ ID NO: 513499 - RNA, 64 nt, Human
cccagacgcaccgucacccugcaccagcuuuggcccucagcacuuuuuuucuccugucuccgca

SEQ ID NO: 513500 - RNA, 64 nt, Human
acuuuuaugacuuuuaacuuucucugucucucuuccucagcagaccucuuggaauuaggguuuc

SEQ ID NO: 513501 - RNA, 64 nt, Human
gaaagcaaaauaauaacugcuauuuauaaaaaugccucagcagaaucuguuuuuauguugacug

SEQ ID NO: 513502 - RNA, 64 nt, Human
cuguaguguuggcccagagugugguuacugcccugagggccaugaaagccacagaggaugggcu

SEQ ID NO: 513503 - RNA, 64 nt, Human
gcaugucacggcaaggacugccgcauuggugauggagggccagcugaggggaaguugcugguga

SEQ ID NO: 513504 - RNA, 64 nt, Human
gccugggggagccuacuggggacugagcccccaggagggccagcauguggagagucgcugcggc

SEQ ID NO: 513505 - RNA, 64 nt, Human
ggaccauggcccgcagaggcacugccacagcugugagggccaagaugcuguccccccauccaaa

SEQ ID NO: 513506 - RNA, 64 nt, Human
guuuguugcuguuuucccccacccauccaguucuccucagcaaagcaaauuccuuaacaccuuu

SEQ ID NO: 513507 - RNA, 64 nt, Human
uuccccuccucgaagcugguuggcaaggugaaggccucagcauccuagggaacaaggaaccagc

SEQ ID NO: 513508 - RNA, 64 nt, Human
agcguauuuuacaggcauuuauauccauugcuuuccucagcaaggcauguuacuacuuuuauca

SEQ ID NO: 513509 - RNA, 64 nt, Human
agcccggccgacccggacucccggucaccugaccccucagcaagaacagccugccugguggccu

SEQ ID NO: 513510 - RNA, 64 nt, Human
aaccucugccuccuggguucaagcgaaccuccugccucagcaucccaaguagcugggauuacag

SEQ ID NO: 513511 - RNA, 64 nt, Human
auugcuucugccuccacguaaaugaaaccaaaggccucagcauauccugggaggacugggggcu

SEQ ID NO: 513512 - RNA, 64 nt, Human
agcaaagucggaaacacagagaagcacggcuuccccucagcacagacccuccagacugggucuc

SEQ ID NO: 513513 - RNA, 64 nt, Human
cucugucagcucugcugcccacaugcaccccuggccucagcaucccgguucccccagacaagag

SEQ ID NO: 513514 - RNA, 64 nt, Human
agggaacuccagagcugcccaccucccacugcccccucagcacacacacaguccccaggcggcc

SEQ ID NO: 513515 - RNA, 64 nt, Human
cauagcucuccaguggcuuuuaaagaaagcugguccucagcacuaacaaaaucacuacaauagc

SEQ ID NO: 513516 - RNA, 64 nt, Human
aacagucucaugggucaccacguggggagggcugccucagcagguuucucagaccacggagaag

SEQ ID NO: 513517 - RNA, 64 nt, Human
uaaguguucggcaguaaccuacuuuguuccuucgccucagcagcaaaucuugcuacuggcucua

SEQ ID NO: 513518 - RNA, 64 nt, Human
cccacgugguugucccgggaaagcugccccacagccucagcaucuucagcacuuaccgauccag

SEQ ID NO: 513519 - RNA, 64 nt, Human
cgugacaggcugcccuccccucacaguuccugcaccucagcagccagggaagcagggcccagag

SEQ ID NO: 513520 - RNA, 64 nt, Human
agcacaagccucagggaaggggaagcaggaugcggagggccaaagcccgggaccucuacuugaa

SEQ ID NO: 513521 - RNA, 64 nt, Human
cuugggauuuuauuuuuguggcgggcgggggugggagggccauuuugucacuuugccucaguug

SEQ ID NO: 513522 - RNA, 64 nt, Human
agcaucuguaaguugcacucaggaggguuuaggggagggccaugggcaggcuggauacccaguc

SEQ ID NO: 513523 - RNA, 64 nt, Human
aaccucacuggucccucucccggaggcccuuguagagggccacguccauaaauuuucuuaugga

SEQ ID NO: 513524 - RNA, 64 nt, Human
ccuauuugggugauggguucguuagaaguccaaaccucagcagcacacaauauacucauguaac

SEQ ID NO: 513525 - RNA, 64 nt, Human
aagaguccccuuggguacaccccucugcccacagccucagcauuucuuggagcagcaaagggcc

SEQ ID NO: 513526 - RNA, 64 nt, Human
aguguagaucauuccagaucagugggggagggcaccucagcaaccucugaguguggacaauagc

SEQ ID NO: 513527 - RNA, 64 nt, Human
agaccccagagccaggaaccucucagccgaugccccucagcaagagcaccccaucuucagguag

SEQ ID NO: 513528 - RNA, 64 nt, Human
gaaugcagugggacggaccuggggugggcacucaccucagcagagccucaaugccaccucccca

SEQ ID NO: 513529 - RNA, 64 nt, Human
uguuacaaggcacuugucacuaugcuauuucuggccucagcaggaaccuguacuggguuauuuu

SEQ ID NO: 513530 - RNA, 64 nt, Human
ugugugaaucuuuuuccaccugccacugcuccccccucagcaucuccaaauauauuuaugcaua

SEQ ID NO: 513531 - RNA, 64 nt, Human
cucuuaggaaccuggccugggccaggggccugacccucagcacuuucagccgccccaagucuga

SEQ ID NO: 513532 - RNA, 64 nt, Human
uuacuaaacuagaaguccucauaguuuaaaauggccucagcaggccuaguguauacaaacuggu

SEQ ID NO: 513533 - RNA, 64 nt, Human
aggagacagcaugaacaccugcuuguccaauuagccucagcacauuacuaaucucaguuuguuc

SEQ ID NO: 513534 - RNA, 64 nt, Human
aaagccuuucccuuaugaucaacaaguggacucuccucagcaggucuuuagagauuauccucuc

SEQ ID NO: 513535 - RNA, 64 nt, Human
agguacugcccauugggagauggggacauugggaccucagcaaugaagaacccuugugaaguaa

SEQ ID NO: 513536 - RNA, 64 nt, Human
gacugggugugccaaaauaugcccaggguccugcccucagcacuagauuuaauggggccaagag

SEQ ID NO: 513537 - RNA, 64 nt, Human
gccccccucugcucagaaucugaaguaguucccuccucagcaauuucaucucuugaacacugac

SEQ ID NO: 513538 - RNA, 64 nt, Human
gcgggcuaggaggaggggguaggugaugggggacgagggccaggcacccacauccccaauaaag

SEQ ID NO: 513539 - RNA, 64 nt, Human
auaccucgcagauuugcugagucugucuugugcagagggccagagaauggcuuaugggggccca

SEQ ID NO: 513540 - RNA, 64 nt, Human
ugugccagggaacaggggccggccugggggcugggagggccaggggcaccucccucccacccuu

SEQ ID NO: 513541 - RNA, 64 nt, Human
gcaaaacuagaauuguugcaucccucaauugaaugagggccauaucccugugguauuccuuucc

SEQ ID NO: 513542 - RNA, 64 nt, Human
ccuauauaaacuccaaagggaaacacaccgacugccucagcaaucaugcaaagaccuugccugg

SEQ ID NO: 513543 - RNA, 64 nt, Human
aacguccaccuccuggguucaagcgauucuccugccucagcauccuaauuaguugggauuacag

SEQ ID NO: 513544 - RNA, 64 nt, Human
gcccagccuggccccaaauguucuuuccuuucauccucagcaagugcugagucugugaauaaag

SEQ ID NO: 513545 - RNA, 64 nt, Human
uccgcgcccauuggugacccuuccaggcagacagccucagcaacgccccugguggacaggaugg

SEQ ID NO: 513546 - RNA, 64 nt, Human
aauaaugaugucuaaagcuuaccaacaaaagaacccucagcagaauaacaaaaacuuugcucag

SEQ ID NO: 513547 - RNA, 64 nt, Human
gcaaaagcagccccaagagcugcgcauuggcuucccucagcaaucuguccugucugugcuccca

SEQ ID NO: 513548 - RNA, 64 nt, Human
gccccacgcaggagcgaggacucugcucaaggacccucagcaacuggggccaggggccuggaga

SEQ ID NO: 513549 - RNA, 64 nt, Human
auagaagcucugucagucucgucuggaucuugguccucagcaacugucuggauccugacaggug

SEQ ID NO: 513550 - RNA, 64 nt, Human
agaaacucacagcuccuccgggauacauaugugcccucagcagcagcucccaggugaaguuacc

SEQ ID NO: 513551 - RNA, 64 nt, Human
uuuacucaucucucuagugcugccucacauugggccucagcagcuccccagcaccaauucacag

SEQ ID NO: 513552 - RNA, 64 nt, Human
uucugcccuuaauugacacuccuauuuauuucauccucagcaaauuucauccuggcucacagac

SEQ ID NO: 513553 - RNA, 64 nt, Human
aacuugcauaggacuuucugucuuuuuucauuucccucagcacuuggcaucuugucaucuacac

SEQ ID NO: 513554 - RNA, 64 nt, Human
agccaugggaaaugagccagcccaagggcaucauccucagcagcaucgaggaagggccgaggaa

SEQ ID NO: 513555 - RNA, 64 nt, Human
gagaucugcagacuuguggguaacugaucacagaccucagcaugggggugaccagggugacucu

SEQ ID NO: 513556 - RNA, 64 nt, Human
gugucucccacuuugcaaccuauguggcagccaugagggccaucaacaucgcagaugagcugcc

SEQ ID NO: 513557 - RNA, 64 nt, Human
uccucauaccugucacauuggugaucucacagaggagggccaugccgcugaaaagggaaggaga

SEQ ID NO: 513558 - RNA, 64 nt, Human
agaguuuugguaccagaggcuagaguggacaaaugagggccagggaggaaccggaaaaugggag

SEQ ID NO: 513559 - RNA, 64 nt, Human
aagaauauaguauagaguuugccucaacacaugugagggccaaauaaccugcuagcuaggcagu

SEQ ID NO: 513560 - RNA, 64 nt, Human
gagcccccccauggaacugcagcccccugucuccccucagcagucugagugcaaccccguuggu

SEQ ID NO: 513561 - RNA, 64 nt, Human
caaggagcaguccuaaacccuacccagccugcugccucagcacagccaagggaaaaacaaaaac

SEQ ID NO: 513562 - RNA, 64 nt, Human
gcacaagagcuaagaaauaaccuccaucccuaccccucagcacacaaccccuacgguaacagca

SEQ ID NO: 513563 - RNA, 64 nt, Human
aagaggacuagggggcgccaacguucgauuucuaccucagcagcaguuggaucuuuugaaggga

SEQ ID NO: 513564 - RNA, 64 nt, Human
caaaaggaaccacccagacccaccacccguacacccucagcagacccugaagacuugcuuuuaa

SEQ ID NO: 513565 - RNA, 64 nt, Human
aucccaggaaacuugggucuugcugcccauccuuccucagcacagggaacccggaagcccguug

SEQ ID NO: 513566 - RNA, 64 nt, Human
gguccuacuggaugaagagaagauggacaccagcccucagcaugaggaaauucaggguccccua

SEQ ID NO: 513567 - RNA, 64 nt, Human
gaaaaacggaaggguucagcugcugcucccaauaccucagcaugguaaggggacagagcccagc

SEQ ID NO: 513568 - RNA, 64 nt, Human
gcuguggauacggaaaugguuaaguacugugcuuccucagcagcugggcugucagggccauagu

SEQ ID NO: 513569 - RNA, 64 nt, Human
aaucuguuuucagcucuugcauugcauagaugaaccucagcauguaaagaacuauuuuuuuaaa

SEQ ID NO: 513570 - RNA, 64 nt, Human
agcaauauaggccagacuugguccuaagcaccugccucagcaauugucuacauucaguuguuuu

SEQ ID NO: 513571 - RNA, 64 nt, Human
gcgagugcacagacagcacccuccucuccgugcuccucagcaguccuccgcuacgcacagguag

SEQ ID NO: 513572 - RNA, 64 nt, Human
agggucgcuggaagggcacccucuuuaacccaucccucagcaaacgcagcucuucccaaggacc

SEQ ID NO: 513573 - RNA, 64 nt, Human
gccagcccgauggggaugaggaggagagcacagcccucagcaucaacgaggagaugcagcgcau

SEQ ID NO: 513574 - RNA, 64 nt, Human
gagcaguuguagcaggccugaccacagauucccagagggccagguguggauccacaggacuuga

SEQ ID NO: 513575 - RNA, 64 nt, Human
cuacaccuuuugcuaacaccccuacuaggucccagagggccagaaacaccugacuuaccucuga

SEQ ID NO: 513576 - RNA, 64 nt, Human
ggggaggagguggagcagcgggcguccccgaagugagggccaggcccuucccggcugcgaggac

SEQ ID NO: 513577 - RNA, 64 nt, Human
ugccuccucacuggugaaacccaggauguagauagagggccacacccacccuguccagaguaga

SEQ ID NO: 513578 - RNA, 64 nt, Human
auuaggcauuuguacauuuuuagcagcaaaauugccucagcagagcucccaguuuuauucccag

SEQ ID NO: 513579 - RNA, 64 nt, Human
ccaggaccuccugcuuuuccauacuuaacuguggccucagcaugggguagggcugggugacugg

SEQ ID NO: 513580 - RNA, 64 nt, Human
aggcagugccuagcuccagagcaggcacagccugccucagcaugcuucgaaaggcagcuucccu

SEQ ID NO: 513581 - RNA, 64 nt, Human
ggaaagccacccgcuagacccauggccucacccaccucagcacuuggaagaagaggugacuuug

SEQ ID NO: 513582 - RNA, 64 nt, Human
uagugcuuucuaugggagucaaaauaccccauucccucagcagacagaguacagagaagggccu

SEQ ID NO: 513583 - RNA, 64 nt, Human
gggagcacaaggggccucccaaaaaggagccccaccucagcaucacugccuuaaucguggccuc

SEQ ID NO: 513584 - RNA, 64 nt, Human
aucuucaagagacaaaaaaaauuaaaauaacuacccucagcaaacacuagcuguucugcucaua

SEQ ID NO: 513585 - RNA, 64 nt, Human
agaguauagaagaucuucauuugaaaaccaucuaccucagcauuuacugagcauuuuaaaacuc

SEQ ID NO: 513586 - RNA, 64 nt, Human
ggcgaaguugccggcuggacagggaagcgguuccccucagcagccccucuccuucucgugccuc

SEQ ID NO: 513587 - RNA, 64 nt, Human
cuguggagaagagaaggaaaagcacacgcaugcgccucagcaaauggcagcccaggagcuguuu

SEQ ID NO: 513588 - RNA, 64 nt, Human
gaaucugcaucuggcuuccagugguaagcacauuccucagcaggaucaagccaaacaguaaaaa

SEQ ID NO: 513589 - RNA, 64 nt, Human
ccacacaucuuuagaacuagucgucuccucuuggccucagcagcucuucccuguucuuacuggu

SEQ ID NO: 513590 - RNA, 64 nt, Human
aaacgugcccugagcccucuccuccaagagguccccucagcaucaagcagcccaaccaaggcgu

SEQ ID NO: 513591 - RNA, 64 nt, Human
guucuggacaaggccaagcuuuucuuuauuaaaaccucagcaugucucccugaucugaacuauu

SEQ ID NO: 513592 - RNA, 64 nt, Human
gcugcaaagcccuuggaacacccuggaugcuguugagggccaagagaucuguguggcuccuggg

SEQ ID NO: 513593 - RNA, 64 nt, Human
ucugggacacggcaccccccugggccuggagggagagggccaauccagacacacucacacucuc

SEQ ID NO: 513594 - RNA, 64 nt, Human
agcgagccugcgucugucucagcuguccagcgcugagggccagggucuugugcuguggggcugg

SEQ ID NO: 513595 - RNA, 64 nt, Human
gucugggcugccggguucuagucuccuuugcacugagggccacacuauuaccaugagaagaggg

SEQ ID NO: 513596 - RNA, 64 nt, Human
ccccucucucccuguccugcauuccaucccagcuccucagcauggccucagugggcgcacccau

SEQ ID NO: 513597 - RNA, 64 nt, Human
agauaggaaauaagccauaauugaagaggcacggccucagcagaaagugcuccuuagaauacua

SEQ ID NO: 513598 - RNA, 64 nt, Human
uugaaaaucauuacacuuucacuagaagcccaaaccucagcauucugcaauauguaaccaacau

SEQ ID NO: 513599 - RNA, 64 nt, Human
cuucuucuuuuccuuuuggcaaagcagauauaacccucagcaugcuaggagagugcacccguac

SEQ ID NO: 513600 - RNA, 64 nt, Human
auuuccgugguuucucaugagcuguguucacagaccucagcagggcaucgcauggaccgcagga

SEQ ID NO: 513601 - RNA, 64 nt, Human
ggucucuaggggaggggcauggguaaggguguuuccucagcacccuccugggguggggauuaug

SEQ ID NO: 513602 - RNA, 64 nt, Human
ucugccuagaugaaccacagcauuuugguaaaugccucagcauguuaggagcgcuggaacguuu

SEQ ID NO: 513603 - RNA, 64 nt, Human
cacagacggaggacuggaacugcaacuccagcguccucagcaccccacuccucaguaaaagucu

SEQ ID NO: 513604 - RNA, 64 nt, Human
ugugucucgucagaggaauagcuuaccacgaaccccucagcauacugggaaucucuuccugaac

SEQ ID NO: 513605 - RNA, 64 nt, Human
aaccucugccuccuggguucaagcgauucuccugccucagcaucucgaguagcugggauuacag

SEQ ID NO: 513606 - RNA, 64 nt, Human
uucagagcacacguauccuaauuacccuccucuuccucagcagaacccauuugagauucuaaau

SEQ ID NO: 513607 - RNA, 64 nt, Human
acagcagcaggacacaccaugugccaggaaaugaccucagcaagaaaccucaggccgugugaag

SEQ ID NO: 513608 - RNA, 64 nt, Human
gaagccacaguacucaucugcagagggcuuacagccucagcaaggaccuuguggcuuuguaaca

SEQ ID NO: 513609 - RNA, 64 nt, Human
aggaggagcgccuccggcagaagaaugaggugacccucagcauucccguggaccacccagucag

SEQ ID NO: 513610 - RNA, 62 nt, Human; identical to SEQ ID NO: 434796

SEQ ID NO: 513611 - RNA, 64 nt, Human
agcucaggaucucucccaaggcuaccuacugcaggagggccaacaggugagaugggaagaaugg

SEQ ID NO: 513612 - RNA, 64 nt, Human
uaccugcaggaacaauauuccuguagccauggaagagggccaaggcucagucacuccuuggaug

SEQ ID NO: 513613 - RNA, 64 nt, Human
guccccgggccuggccaacccugcugugcagggugagggccaugcaugcaguaugaggggucua

SEQ ID NO: 513614 - RNA, 64 nt, Human
aggaugcagcaugccuucaggagacacugcuggaccucagcauucccuugauaucaguccccuu

SEQ ID NO: 513615 - RNA, 64 nt, Human
uuuccaagcacuggaugcccuuggaugacagcauccucagcauuaaaacuggugaacugaugaa

SEQ ID NO: 513616 - RNA, 64 nt, Human
ccuccuggggccagccuccuugccucugcucugaccucagcagcuacaccuaaccccaccgcac

SEQ ID NO: 513617 - RNA, 64 nt, Human
gcccccagauggccgcccugaagcucucugggcuccucagcaauaaagcacuuuauuuucaaau

SEQ ID NO: 513618 - RNA, 64 nt, Human
cuucgggaaaauucaaagguggauuacaagguguccucagcaugcccuauggccuaugugcgaa

SEQ ID NO: 513619 - RNA, 64 nt, Human
gcccagaaaccaaaugugaacuuccugucucccaccucagcacuaguccaugccaggacaccag

SEQ ID NO: 513620 - RNA, 64 nt, Human
aggaguguaucagugauccauugcaccuuuauucccucagcauaugccugaggcgaucuuuuau

SEQ ID NO: 513621 - RNA, 64 nt, Human
uaugaacccaguguaagagaccacccacccagagccucagcacugucugacuuugggaaccagg

SEQ ID NO: 513622 - RNA, 64 nt, Human
cgagagggcauauggggcccugccaacaccacuuccucagcagaaacccgucaugacgcggcug

SEQ ID NO: 513623 - RNA, 64 nt, Human
caggaccccuaagaccaagugacaacugggagagccucagcauauacucuucuccuccgaucuc

SEQ ID NO: 513624 - RNA, 64 nt, Human
caggugauguccuggcagggggccucgcgggucuccucagcaucagacgggcuuccaggaccgc

SEQ ID NO: 513625 - RNA, 64 nt, Human
agaugcuagacgaaaacccacauuaccuguuaggccucagcauggcuuaugugcacguguaaau

SEQ ID NO: 513626 - RNA, 64 nt, Human
aggguccaggcugagggcugggagcucccuugcgccucagcaguuugcagugggguaaggaggc

SEQ ID NO: 513627 - RNA, 64 nt, Human
caccaacuaauuuuguuguuguucuaccagaaaaccucagcagauguuuugauuugcugcuuua

SEQ ID NO: 513628 - RNA, 64 nt, Human
uggagcaccuuccucuccagccagaggcugaccugagggccacuguccucagaugacaccaccc

SEQ ID NO: 513629 - RNA, 64 nt, Human
gggugcuguguuuucauagcauggagucggaggagagggccauuuagcagggggagcagaagag

SEQ ID NO: 513630 - RNA, 64 nt, Human
ucauaguuuucucucucuuuaaagagaauaaauagagggccaggugugguggcucacgccugug

SEQ ID NO: 513631 - RNA, 64 nt, Human
agaguggucucagugagaagguagaugccaacuggagggccagaccuguguccugcccaugucc

SEQ ID NO: 513632 - RNA, 64 nt, Human
ugcagugaucccucuuucgucccacccccucuucccucagcagccccggaagccugccucaccc

SEQ ID NO: 513633 - RNA, 64 nt, Human
caguacagaccagugguucucaaacuuuaaaaugccucagcaucacuugggagcuuauugaaau

SEQ ID NO: 513634 - RNA, 64 nt, Human
ucuccuaucccaaagcaccaauuacugcccucugccucagcaguaccaguauaagaugacauuc

SEQ ID NO: 513635 - RNA, 64 nt, Human
ccuuugccuuucaugcccaugcuugauucuugcaccucagcagcugaaggucucagagaccagu

SEQ ID NO: 513636 - RNA, 64 nt, Human
gaccagcuggggcguggggagggccguaccccacccucagcaccccuuccauguggagaaagga

SEQ ID NO: 513637 - RNA, 64 nt, Human
uauuuaaacaaacaaugguagcucacuaaaaugaccucagcacaugacgauuucuauuaacauu

SEQ ID NO: 513638 - RNA, 64 nt, Human
cagagagggcauaggaucugaggacaaggaaauuccucagcauggcguaucaggaaagcauggc

SEQ ID NO: 513639 - RNA, 64 nt, Human
cucagaaauaagccugagagaccaucuuuagcagccucagcacugccaggccugcccugaaacu

SEQ ID NO: 513640 - RNA, 64 nt, Human
cccguuugucaucugguuuggcaggacccaggacccucagcaaugagucugaguguucaaagcc

SEQ ID NO: 513641 - RNA, 64 nt, Human
uguuuucccacuguuaaggacucuguccaaagaaccucagcaucagcucccucaagcuuaauga

SEQ ID NO: 513642 - RNA, 64 nt, Human
acucauccuuaugugcuagggauaaaucaagaguccucagcacuccacauucccaaaaaauccc

SEQ ID NO: 513643 - RNA, 64 nt, Human
ugacgccgucucugugagcaccgaggcuuuuuggccucagcaccuucgaagugguuccuuggca

SEQ ID NO: 513644 - RNA, 64 nt, Human
gugucugggcugccccugccaaguucccccagucccucagcaccuggccccaggacugaggucc

SEQ ID NO: 513645 - RNA, 64 nt, Human
gagaaggaugccugggugccaggcaagacaagccccucagcaggagagaggcccagaggcucca

SEQ ID NO: 513646 - RNA, 64 nt, Human
uggucacaggaugcacugucagcaucaggucccagagggccaccguguccauuacagcagaguc

SEQ ID NO: 513647 - RNA, 64 nt, Human
gagggaaagagaagcccaaccucugugaucauaugagggccaaggcugagcaguguagacagag

SEQ ID NO: 513648 - RNA, 64 nt, Human
cuccugggagaggccugggggcggugcucacugggagggccaggacucaguuccugcucucauc

SEQ ID NO: 513649 - RNA, 64 nt, Human
auaggagaggaaccgcagguggugagcggcuggggagggccaggacagccggggcugggugcug

SEQ ID NO: 513650 - RNA, 64 nt, Human
gcggcugaacaugggcauccuaggcuccuacgacccucagcagaucuucaagugcaaagggacc

SEQ ID NO: 513651 - RNA, 64 nt, Human
ggaccgaacccuggcucaggccuggucauugccuccucagcacucccuccugggaggccuuagc

SEQ ID NO: 513652 - RNA, 64 nt, Human
cuaagugaucaggcacguugagaguauacgguguccucagcacauacaccugugggaaaacgga

SEQ ID NO: 513653 - RNA, 64 nt, Human
ggacacagcucuucuccaggcuguaucccaugagccucagcauccuggcacccggccccugcug

SEQ ID NO: 513654 - RNA, 64 nt, Human
cccagccucaucaccgugcucuucucagcgccacccucagcagccagauugcaacaccagggag

SEQ ID NO: 513655 - RNA, 64 nt, Human
ucauuucuccuuaaugaaggcucuggcccuaaccccucagcacugucuccagauaggaacaugc

SEQ ID NO: 513656 - RNA, 64 nt, Human
aggccuggaagagcugagaccuugcuuugagacuccucagcaccccuccaguuuugccugagaa

SEQ ID NO: 513657 - RNA, 64 nt, Human
ugcccacauccccucuccaauaaagcaccugugcccucagcaauggccugccaugugcuguugc

SEQ ID NO: 513658 - RNA, 64 nt, Human
accccucaacagagaugacuuugaugacucugccccucagcagggcuuacuaagcacuaccccu

SEQ ID NO: 513659 - RNA, 64 nt, Human
agggaugacacagcaaggaugacucagcacugccccucagcaaggaugacucagcacugccgcu

SEQ ID NO: 513660 - RNA, 64 nt, Human
aacagacaugacucagggauggcuuaguacugccccucagcagggaugacucagcaccgccucu

SEQ ID NO: 513661 - RNA, 64 nt, Human; identical to SEQ ID NO: 513659

SEQ ID NO: 513662 - RNA, 64 nt, Human
aggcaugacucugcagagaugacuuaguacugccccucagcagggaugacucaguacugccccu

SEQ ID NO: 513663 - RNA, 64 nt, Human
uacugccccucagcagggaugacucaguacugccccucagcagggaugacucagcacugccccu

SEQ ID NO: 513664 - RNA, 64 nt, Human
gacuugcuaaagcacuuugcacuuaauggcuguugagggccacuuuuuuuuuauacugcacagu

SEQ ID NO: 513665 - RNA, 64 nt, Human
auaauauuuuaagugucuucugugguauaugugggagggccauuaaggaguggguuucacuccc

SEQ ID NO: 513666 - RNA, 64 nt, Human
cugucuuuuagguuuguuugaagagacuguaccagagggccagggaggaggagaaaggaauuga

SEQ ID NO: 513667 - RNA, 64 nt, Human
uaaauccuccuccuucccuuuuuucuggagucuugagggccagaguuuuuguuuuuguuuuugu

SEQ ID NO: 513668 - RNA, 64 nt, Human
agugaugacacagcaaggaugacucagcacugccccucagcaaggaugacucagcacugccgcu

SEQ ID NO: 513669 - RNA, 64 nt, Human
aacagacaugacucagggauggcuuaguacugccccucagcagggaugacucagcaccgccccu

SEQ ID NO: 513670 - RNA, 64 nt, Human
aacagacaugacucagggauggcuuaguacugccccucagcagggaugacucagcagggaugac

SEQ ID NO: 513671 - RNA, 64 nt, Human
acagggaugacugcagggaugacucagcacugccccucagcagggaugacucagcacugccccu

SEQ ID NO: 513672 - RNA, 64 nt, Human
cacugccccucagcagggaugacucagcacugccccucagcagggaugacucagcagggaugac

SEQ ID NO: 513673 - RNA, 64 nt, Human
aggcaugacucugcagagaugacucagcacugccccucagcagggauggcucagcagggaugac

SEQ ID NO: 513674 - RNA, 64 nt, Human
agacaugacucagcagggaugacucagcaccgccccucagcaaggaugacucagcagggaugau

SEQ ID NO: 513675 - RNA, 64 nt, Human
aauucacagggaagaaaacauuucaagggcuauaccucagcaucuaggcuuuuuggacuaagga

SEQ ID NO: 513676 - RNA, 64 nt, Human
ugugacauuugggauuccccaucacuugucaugcccucagcacccagcuugugccauugggcau

SEQ ID NO: 513677 - RNA, 64 nt, Human
caaggugacuugccauuugaacuuucguaagagaccucagcaguuagacugagaaaaguuagag

SEQ ID NO: 513678 - RNA, 64 nt, Human
aaggaugugcggcccccaggcccccgcacaccucccucagcaccaagaccgggacccccccacc

SEQ ID NO: 513679 - RNA, 64 nt, Human
cggcucugugaguggcugugaggaugcugcacguccucagcagaguuugcaaguugcuuuaucu

SEQ ID NO: 513680 - RNA, 64 nt, Human
cggaaguucaacugagugcagugcagguggauucccucagcagccuguguguugugugaaauaa

SEQ ID NO: 513681 - RNA, 53 nt, Human
ugccgaagccagcugccugacugccucagcagggaccgcaugccgcuuggaga

SEQ ID NO: 513682 - RNA, 64 nt, Human
ggguccagaugagggccaggaaggggaggagagugagggccaagaacgagccuuaagggagcag

SEQ ID NO: 513683 - RNA, 64 nt, Human
ggaccacaaggcagcagaaagcgcggguccagaugagggccaggaaggggaggagagugagggc

SEQ ID NO: 513684 - RNA, 64 nt, Human
acugcagagugagagugacguuuucuuagggcuggagggccaguucccacucaaggcucccucg

SEQ ID NO: 513685 - RNA, 64 nt, Human
cgccccuccccagcgucccagggcucugguucuggagggccacuuugucaagguguuucaguuu

SEQ ID NO: 513686 - RNA, 64 nt, Human
gggcguuuucccggcaggcccccgggguccucagccucagcaacccagggagaggacagaaacg

SEQ ID NO: 513687 - RNA, 64 nt, Human
aucaggccccuggguggggaaggggcacagugucccucagcagcuuacgccccuggagucuugg

SEQ ID NO: 513688 - RNA, 64 nt, Human
gcaucuguguuggguggacaugaauacuuagcuaccucagcaggaauuccuuccagguccccuu

SEQ ID NO: 513689 - RNA, 64 nt, Human
cuacuggaaaaaaauacaaaaagcaaaacaaaacccucagcacuguuacaagaggccauuuaag

SEQ ID NO: 513690 - RNA, 64 nt, Human
uuuggauuuaaguuacuauccuggcuuugcccaaccucagcaaccuguaagacugauaaugaaa

SEQ ID NO: 513691 - RNA, 64 nt, Human
gcacgugacuguauuauacauggguagcuucugaccucagcauuaucuauauaguaccuuugcu

SEQ ID NO: 513692 - RNA, 64 nt, Human
gccuggcuuauucccaugugugacuccagccugcccucagcacagacucuuucagauggaggug

SEQ ID NO: 513693 - RNA, 64 nt, Human
uucacaucccugggcagaguaccaggcugcugacccucagcagggccagacaaggcucagugga

SEQ ID NO: 513694 - RNA, 64 nt, Human
cacccuaaagcccccuccaaauagccauacuuagccucagcaggagccuggccuguaacuuaua

SEQ ID NO: 513695 - RNA, 64 nt, Human
ugugcgaaguaaacuaccucaagguaugaaguuaccucagcaauuauuuuccuuuuuguucccc

SEQ ID NO: 513696 - RNA, 64 nt, Human
ggcugucacuuuucugccagggguacugggucccccucagcacccuccacagcacaggccuucc

SEQ ID NO: 513697 - RNA, 64 nt, Human
ggcugccuugaaaucaagagacaauaacuuugaaccucagcaagaccuugaaccgccgguucau

SEQ ID NO: 513698 - RNA, 64 nt, Human
aaaaguguggcauagcuaccugcccauccccaacccucagcaaaguagaaucucuuuucuggua

SEQ ID NO: 513699 - RNA, 64 nt, Human
ucuguagccagucagaggaggaggagaaggagccccucagcagaguggugcaguuucgcucaga

SEQ ID NO: 513700 - RNA, 64 nt, Human
cuggcggagaugcuucuaaggcauggucgggggagagggccaacaacugucccuccuugagcac

SEQ ID NO: 513701 - RNA, 64 nt, Human
ugcugagaggcuccuucuaccugccgcaggguaggagggccaggcaaaguucaccagcuugcuc

SEQ ID NO: 513702 - RNA, 58 nt, Human; identical to SEQ ID NO: 434784

SEQ ID NO: 513703 - RNA, 64 nt, Human
uugaauuuauccuaguauuuuucuuuaccugaaggagggccauuuauuuuuaauuucacuacau

SEQ ID NO: 513704 - RNA, 64 nt, Human
agguggcagcucacacccagacucacuggccacaccucagcagggggggagucgagugucaguc

SEQ ID NO: 513705 - RNA, 64 nt, Human
cacugucacuuccagcuagaccccguguccccggccucagcaccccugucucuagccacuuugg

SEQ ID NO: 513706 - RNA, 64 nt, Human
cagucggguuuccuggagcaaugggugugccagcccucagcaugacucugccaagcauccagac

SEQ ID NO: 513707 - RNA, 64 nt, Human
ggcaucacucccagccccucgccuucuagggcacccucagcaaaggggcagguggggacacucc

SEQ ID NO: 513708 - RNA, 64 nt, Human
augcaguuuggaaauaauggugaaggugcugaacccucagcaggagggcaguuuggugaguauu

SEQ ID NO: 513709 - RNA, 64 nt, Human
uuuccuuggcccucacugccagugccaaaccgccccucagcagggcagggccaguccuggcgac

SEQ ID NO: 513710 - RNA, 64 nt, Human
uaggggaggggguccugggcccggugaccgcaggccucagcaucuccacucugcguaacagguu

SEQ ID NO: 513711 - RNA, 64 nt, Human
ucacagggacauggaugaagcuggaaaccaucauccucagcaaacuaacacaggaacagaaaac

SEQ ID NO: 513712 - RNA, 64 nt, Human
gguaaugguggcugugcauucuggucagucuggaccucagcaacuucaucucaggacuaaagag

SEQ ID NO: 513713 - RNA, 64 nt, Human
auccauccucacucagcugcugccuacugggcauccucagcaagaugcuggagacuuuuuaccc

SEQ ID NO: 513714 - RNA, 64 nt, Human
guggggagcaggccccaggcuggaccugcccuguccucagcacgcgugugcaaaagugaacaau

SEQ ID NO: 513715 - RNA, 64 nt, Human
uauuuguuccuacagcauucucaguauuucuggcccucagcagugggcauuguaagcaugaacu

SEQ ID NO: 513716 - RNA, 64 nt, Human
ucagaaauaagcaauacuuguuccucuguuacaaccucagcacuuugcaccguaggagccauug

SEQ ID NO: 513717 - RNA, 64 nt, Human
aaaaaaacgaaaaaaauaaggauugacugggcuaccucagcauacauuucugccacauucuuaa

SEQ ID NO: 513718 - RNA, 64 nt, Human; identical to SEQ ID NO: 435478

SEQ ID NO: 513719 - RNA, 60 nt, Human; identical to SEQ ID NO: 435479

SEQ ID NO: 513720 - RNA, 64 nt, Human; identical to SEQ ID NO: 435480

SEQ ID NO: 513721 - RNA, 64 nt, Human
acagugaucaccccggacgggcguccaggacccugagggccauggccaaaaggcuccugagugu

SEQ ID NO: 513722 - RNA, 64 nt, Human
agucugggaagaguggagaagaggcagggucaggccucagcaucucacauccaccaccuccagg

SEQ ID NO: 513723 - RNA, 64 nt, Human
aaucagcccuucucccaggccugugcacacacccccucagcacucccuaugcacuuuccugaca

SEQ ID NO: 513724 - RNA, 64 nt, Human
uaggggucaggggguggggguuucauuuuccauuccucagcacagagcagaaaugauagauuuu

SEQ ID NO: 513725 - RNA, 64 nt, Human
aaacaaaauucuuugggucugacaguaacagaaaccucagcacugggaaaaguugcccacacug

SEQ ID NO: 513726 - RNA, 64 nt, Human
caguagccaguaucuauuagcagccauauugucaccucagcacuguggacaccucccugugaag

SEQ ID NO: 513727 - RNA, 64 nt, Human
gguuccuuugaugaugacuacugcuguuaacugaccucagcauuaaaaaaaaaaaaauucaggg

SEQ ID NO: 513728 - RNA, 64 nt, Human
auugauucccaggcccaggcagcggagguuacacccucagcaagggcucagcugggaucugcgc

SEQ ID NO: 513729 - RNA, 64 nt, Human
caccaguaucuggggugggcacguggucggggacccucagcagcaggggcucugucucccuucc

SEQ ID NO: 513730 - RNA, 64 nt, Human
ccccgcacugaccacacccaccgcaaccucauccccucagcacuaaccacauccacucucaacc

SEQ ID NO: 513731 - RNA, 64 nt, Human
ccauccuucagaguggaccucagugccaguccugccucagcaucugggucacgucggccaggag

SEQ ID NO: 513732 - RNA, 64 nt, Human
ccaaaauugaccacauaguuggaaguaaagcacuccucagcaaauguaaaggaacaaaaauuau

SEQ ID NO: 513733 - RNA, 64 nt, Human
aaccucugccuucugguuucaagcaacucuucugccucagcaucccaaguagcugggauaacag

SEQ ID NO: 513734 - RNA, 64 nt, Human
ggaccccugguguaggccugggcgauagacucuuccucagcagccuggcaggcaggaaacagac

SEQ ID NO: 513735 - RNA, 64 nt, Human
ggcugguacuccugacgaauauaggugccaaaauccucagcaaaauacuaguaaaccaaaucca

SEQ ID NO: 513736 - RNA, 64 nt, Human
agcauccccuagagagagugaggugcagggacccgagggccagguuagcacagcgcuggcccca

SEQ ID NO: 513737 - RNA, 64 nt, Human
uucaauaaagaggaagcaaacagccaggcucccugagggccaggcccccagaccaucuuggguu

SEQ ID NO: 513738 - RNA, 64 nt, Human
gcauccuggcuccccaggguggcaggagcugagggagggccacacacuggcaagauuucaagac

SEQ ID NO: 513739 - RNA, 64 nt, Human
ggaggaggccaccugaccaaaugccgccaaccccgagggccaguuucuugucgaauugguacgg

SEQ ID NO: 513740 - RNA, 64 nt, Human
aaccuccgccuccuggguucaagcgauuccucugccucagcacuuugggaggccaaggcaggca

SEQ ID NO: 513741 - RNA, 64 nt, Human
gucucccugggcaguugaccugcacagacaggaaccucagcagugacagaagagagauccaggg

SEQ ID NO: 513742 - RNA, 64 nt, Human
uuuuguuucauucaacagagggauuuuuuaguauccucagcacucauucuauucucauuucuuu

SEQ ID NO: 513743 - RNA, 64 nt, Human
cacuggaccaggagucuggagaugccuggguagcccucagcauuuggaggggaaccuguucccg

SEQ ID NO: 513744 - RNA, 64 nt, Human
uggcuaccaggaaacucggagacaaucuuuucagccucagcauuucuggcuggauuuccaccca

SEQ ID NO: 513745 - RNA, 64 nt, Human
cccuccaggugccugguggugcuagcuccucccaccucagcaccugcugcaucuggagcagccc

SEQ ID NO: 513746 - RNA, 64 nt, Human
cccaacagcacccucuccagaugcagccccaucuccucagcaccccaggaccugaguaucccca

SEQ ID NO: 513747 - RNA, 64 nt, Human
ugggaaauuugccauggaauuaaugaagaaaagcccucagcacaucauccuucuacucuaauca

SEQ ID NO: 513748 - RNA, 64 nt, Human
guuuucaccgguucggagcugaagaagaauuuugccucagcaugaauugagucucauccauauc

SEQ ID NO: 513749 - RNA, 64 nt, Human
cagccaccucucccuugauggucugggagccuggccucagcaaggggccuuccugaccucuggc

SEQ ID NO: 513750 - RNA, 64 nt, Human
aggauggaggguccaauccuaggacagccuuguuccucagcaccccuagcaugaacuuguggga

SEQ ID NO: 513751 - RNA, 64 nt, Human
ccucuguacccucacuucagggcaccugagccacccucagcaggagcugggguggccccugagc

SEQ ID NO: 513752 - RNA, 64 nt, Human
uuaucuaccaugacugucucucagccucacgggcccucagcacuuuguguuuugacccccagca

SEQ ID NO: 513753 - RNA, 64 nt, Human
ggugucccccaggucucagcccccaaggcugcccccucagcagaggcagcugguggcuuugccc

SEQ ID NO: 513754 - RNA, 64 nt, Human
aggccaaguguguugcuucagcaaaccggaccaggagggccagggccggauguggggacccucu

SEQ ID NO: 513755 - RNA, 64 nt, Human
gcuaggucuuaagagccaaaggaaggaagugguugagggccaggaaagagaaggaaugucaugc

SEQ ID NO: 513756 - RNA, 64 nt, Human
ggagggcuggcagcugaacgcacuugcagcguccgagggccaccgggcuggcauuuugugaccc

SEQ ID NO: 513757 - RNA, 64 nt, Human
ggaggaugaccagggaagcccccugauaagccaagagggccagcacagcccuugcucccaggcu

SEQ ID NO: 513758 - RNA, 64 nt, Human
gucugagugccccaggucugguuaugacuucaggccucagcaccugguugucucuucugcaaag

SEQ ID NO: 513759 - RNA, 64 nt, Human
aucaucguuauuuucaaagggggcuuauuaauacccucagcauguuuuucacccaaaugaugca

SEQ ID NO: 513760 - RNA, 64 nt, Human
ggccaugugaagagaauuauuacaucuuuauuaaccucagcauuuacuuuguuucuuuugcuua

SEQ ID NO: 513761 - RNA, 64 nt, Human
ccuuuuuuagccuuggcuuuuguugaacuagaacccucagcacauacuguguuguacuuuugua

SEQ ID NO: 513762 - RNA, 64 nt, Human
uugcacaagaauuagguuugaacucgagcuggaaccucagcaaacuagaguauauauuguucag

SEQ ID NO: 513763 - RNA, 64 nt, Human
caccccugaauagcuccuucggccccaucuccauccucagcagaugacacugauuggccucacg

SEQ ID NO: 513764 - RNA, 64 nt, Human
ccguguucccgcagggcgcacaugcuuggagaguccucagcaggguagccgaggccaggccacu

SEQ ID NO: 513765 - RNA, 64 nt, Human
augacacccugugcaccagcugcacuggcuucccccucagcaccaggguaccaggugagccaga

SEQ ID NO: 513766 - RNA, 64 nt, Human
uugcuucacccgcugcagagcacacgcaacccagccucagcaucacagccgcagcucuguucag

SEQ ID NO: 513767 - RNA, 64 nt, Human
uccauuuucugagacccccagaaaggaaacugacccucagcagcugccugauuguuacgcgaau

SEQ ID NO: 513768 - RNA, 64 nt, Human
gccugcugacccguggccccagcucacucauugcccucagcagccacccgaggcugugcagaag

SEQ ID NO: 513769 - RNA, 64 nt, Human
uuuauuuuccaucaaagcccucugagaagugagaccucagcaauuccgggagccacauagagac

SEQ ID NO: 513770 - RNA, 64 nt, Human
aucuauccugucuuuccuuuccuccucucaguguccucagcacccacaaggaauuuuccuauca

SEQ ID NO: 513771 - RNA, 64 nt, Human
gccuugagaggacccugcaggcagucagcaccagccucagcaacugugcagagaccuacaggcc

SEQ ID NO: 513772 - RNA, 64 nt, Human; identical to SEQ ID NO: 435463

SEQ ID NO: 513773 - RNA, 64 nt, Human; identical to SEQ ID NO: 435464

SEQ ID NO: 513774 - RNA, 64 nt, Human; identical to SEQ ID NO: 435465

SEQ ID NO: 513775 - RNA, 64 nt, Human; identical to SEQ ID NO: 435466

SEQ ID NO: 513776 - RNA, 64 nt, Human
aggcccagaaacaggaagugacucacacaagaccccucagcaagggugcaaagggggaagaacu

SEQ ID NO: 513777 - RNA, 64 nt, Human
ccuugguuuuggugcugcugcugcuucccaagauccucagcagggauuaagaaggaacccggug

SEQ ID NO: 513778 - RNA, 64 nt, Human
ugcuuacccaaaaucuaagugcucaaucccugagccucagcaaaacagcuccccuccgagggaa

SEQ ID NO: 513779 - RNA, 64 nt, Human
gcggcgcugggccaguggacccgcccgcggcccuccucagcacggugccuccgagguuuugagg

SEQ ID NO: 513780 - RNA, 64 nt, Human
auucuucagcaauaucaacguuuuaacaugcucaccucagcaaaaguuaagacagcuguaaaug

SEQ ID NO: 513781 - RNA, 64 nt, Human
ucugucacuaucaguguccaucucuacuguacucccucagcaucagagcaugcaucaggggucc

SEQ ID NO: 513782 - RNA, 64 nt, Human
cccugccaguccuuggaccucccagcccacccagccucagcacagcucaacacagaaggagcag

SEQ ID NO: 513783 - RNA, 64 nt, Human
uaguggagacccagaggaugagaaaacuucucugccucagcagaagaguggcagcugagagaga

SEQ ID NO: 513784 - RNA, 64 nt, Human
uguuucugaccugcuuugcagacgugccuccgcaccucagcaguuugggguguggccccagggc

SEQ ID NO: 513785 - RNA, 64 nt, Human
gugcauugaggaaggggccccagggccuucgcucccucagcacugggguggaggcggcaggaag

SEQ ID NO: 513786 - RNA, 64 nt, Human
caaagugagagguggcucccccggcccccaccacccucagcagccccaccccacucaacccuga

SEQ ID NO: 513787 - RNA, 64 nt, Human
ggguaucaccugguggccacagucccccuucucaccucagcaaugauccccaaagugagaggug

SEQ ID NO: 513788 - RNA, 64 nt, Human
cccugccaguccuuggaccucccagcccacccagccucagcacagcucagcacagaaggagcag

SEQ ID NO: 513789 - RNA, 64 nt, Human
ggaagcuugaauuauaaaugugguguuuggccugccucagcagcaccaguugacugcucgugug

SEQ ID NO: 513790 - RNA, 64 nt, Human; identical to SEQ ID NO: 435467

SEQ ID NO: 513791 - RNA, 64 nt, Human; identical to SEQ ID NO: 435468

SEQ ID NO: 513792 - RNA, 64 nt, Human; identical to SEQ ID NO: 435469

SEQ ID NO: 513793 - RNA, 64 nt, Human
ugccgagggcugcgccccgugcugccuccccccagagggccacccgcugugcucguggacugag

SEQ ID NO: 513794 - RNA, 64 nt, Human
cccccagccuccugccaccaucauucagcagcucccucagcagccacucauagcacagauuccu

SEQ ID NO: 513795 - RNA, 64 nt, Human
ucucauuguuuacauaagcuuuuacaguuucagaccucagcagcuguaaggccaguccagggaa

SEQ ID NO: 513796 - RNA, 64 nt, Human
cuccgagcugguuguggcacaguagcuggggagaccucagcagggcugcucagugccugccucu

SEQ ID NO: 513797 - RNA, 64 nt, Human
gaccaacugaguggcugguuucucccuaagcagcccucagcacccccucccuccccaccuggcc

SEQ ID NO: 513798 - RNA, 64 nt, Human
acucagggccaauuauuggcugagcccacgguccccucagcagggaugcgauggucucugaauc

SEQ ID NO: 513799 - RNA, 64 nt, Human
ccccuccaccucucucucgauuucucucucucccccucagcaucuucccgcugagagugguggg

SEQ ID NO: 513800 - RNA, 64 nt, Human
caccacuuccccgcaauggaccauguaacaaauaccucagcaggcccugcaaaaggccaugcua

SEQ ID NO: 513801 - RNA, 64 nt, Human
ugcccagcggccgcaugcacaccucccggccccuccucagcagcgcaggggcugggggcccuuc

SEQ ID NO: 513802 - RNA, 64 nt, Human
cuucacgcuuucagcuugaggggagcucccacugccucagcaggagcaauucugcaucccuaau

SEQ ID NO: 513803 - RNA, 64 nt, Human
caaauuucaucaugaaggucauccagagcugcuuccucagcaacaggugagugccccgcccccc

SEQ ID NO: 513804 - RNA, 64 nt, Human
acagccucacagggucugguaccagggguugugcccucagcagugacagcagcuuaggugucag

SEQ ID NO: 513805 - RNA, 64 nt, Human
ugccgagguuccuaccucauggacagaacaaacaccucagcaaugaaaccuguucaugucuaag

SEQ ID NO: 513806 - RNA, 64 nt, Human
uccggugagcugggaaaccucacccuugcaccguccucagcaguccacaaagcauuuucauuuc

SEQ ID NO: 513807 - RNA, 64 nt, Human
guaggaucacuacugcauugcaauacccuguuauccucagcaacaaaacccacauuucauacau

SEQ ID NO: 513808 - RNA, 64 nt, Human
ucuugguguuugacuguuguaauggaguaaagaagagggccagcuuaauuuaaaaauaaaguga

SEQ ID NO: 513809 - RNA, 64 nt, Human
aacuuuccaugggaaacuuucccuuuuguaaguugagggccagggguagggauauuuuuuaguu

SEQ ID NO: 513810 - RNA, 64 nt, Human
gagaaagaagccgaaggcucuuagggagcagccagagggccaagugaccaagaggauggggccu

SEQ ID NO: 513811 - RNA, 64 nt, Human
gagagagaugggcuugcucucucugugcacccaggagggccacgcacuuaaaacuguguuugug

SEQ ID NO: 513812 - RNA, 64 nt, Human
ggaccugggcccugcccuuggcucaccuuucucuccucagcagaacaugucucuccucgagucc

SEQ ID NO: 513813 - RNA, 64 nt, Human
cccaccuccaucaaacgcagacacuguagucagaccucagcaauauaggaggcaauaaucuuuu

SEQ ID NO: 513814 - RNA, 64 nt, Human
ucuguuucagcaaaucucagucccugacuaacagccucagcacauccgacaccucccagcgugg

SEQ ID NO: 513815 - RNA, 64 nt, Human
ggagaagggccacggaagccccaggcuuuagagcccucagcaggucuggggagcuagagcaaag

SEQ ID NO: 513816 - RNA, 64 nt, Human
accccuugcgaacaggaccagauuuuguuuggagccucagcaugccggggcccagaugauggag

SEQ ID NO: 513817 - RNA, 64 nt, Human
ugauuucuuugccaauggcaagaagaugagaugcccucagcacugaggauucuugcccccuugu

SEQ ID NO: 513818 - RNA, 64 nt, Human
ucacccagcuauccucgcacucaaagccauccaaccucagcaggccuucucgggcccugccacc

SEQ ID NO: 513819 - RNA, 64 nt, Human
aaucaagggaugacccuccucuggggcccccuguccucagcacauuccaggcagcugugcccug

SEQ ID NO: 513820 - RNA, 64 nt, Human
ggaagagggggcuggccauggggcccucccagaaccucagcauuuccuuccagcccauccaaac

SEQ ID NO: 513821 - RNA, 64 nt, Human
gcucccccggccguccugagggggaccaggcagcccucagcagccacaggccuuccaggagcug

SEQ ID NO: 513822 - RNA, 64 nt, Human
acggccgcagagcggcuggcaguuucuucgaggaccucagcaaggugggggaggggccggggcg

SEQ ID NO: 513823 - RNA, 64 nt, Human
gcugagcgcgccuggugugggucugcagcggaggccucagcaaccugcucuuccgcugcucgcu

SEQ ID NO: 513824 - RNA, 64 nt, Human
aaacagaaaggugcaggagguaccuuaacucaccccucagcaaauaccuaugucaacaguauaa

SEQ ID NO: 513825 - RNA, 64 nt, Human
accccugugcccugccuacacacucccguuuggcccucagcacuuugggccuggucacauaccc

SEQ ID NO: 513826 - RNA, 64 nt, Human; identical to SEQ ID NO: 435471

SEQ ID NO: 513827 - RNA, 64 nt, Human; identical to SEQ ID NO: 435472

SEQ ID NO: 513828 - RNA, 64 nt, Human; identical to SEQ ID NO: 435476

SEQ ID NO: 513829 - RNA, 64 nt, Human; identical to SEQ ID NO: 435477

SEQ ID NO: 513830 - RNA, 64 nt, Human
caugcugacuaguaaccaugaagauucagauguaccucagcaaugcgccagagcaaagucucua

SEQ ID NO: 513831 - RNA, 64 nt, Human
cuucugaaauaccaagggcagaugucaccuccuuccucagcaggacugacucugggcucuacaa

SEQ ID NO: 513832 - RNA, 64 nt, Human
auuacauugugguauuaauauuuagaaaaauggaccucagcaguguauuuacuguacaucucuu

SEQ ID NO: 513833 - RNA, 64 nt, Human
cggcagggacgcagccacaguucagacccuguccccucagcaccuggauggacucccacuguuu

SEQ ID NO: 513834 - RNA, 64 nt, Human
auggaagagauuguguauucauuuuuuacaucuuccucagcauuaacauaccacuuuuuaggga

SEQ ID NO: 513835 - RNA, 64 nt, Human
uagugcuuguggagaucacagccccacccuugucccucagcaacaucccaucuaagcauuccac

SEQ ID NO: 513836 - RNA, 64 nt, Human
accaucgacaaccaaggggugagguggggacaggccucagcagggaauggggcguauauguuag

SEQ ID NO: 513837 - RNA, 64 nt, Human
ugaucuugagucuggaacugacaaguugugugacccucagcaagucacuuaaccuaucugagcc

SEQ ID NO: 513838 - RNA, 64 nt, Human
uggggccucacccuguauuugagguucucaccacccucagcagggagaagggcugaaguucgcc

SEQ ID NO: 513839 - RNA, 64 nt, Human
ggguugggcucaggccuaauuuucucugucauucccucagcaacuugccuauacuuguguggcc

SEQ ID NO: 513840 - RNA, 64 nt, Human
aauggaacaccauucuucagagcacacgucuagcccucagcaagacaguuguuucuccuccucc

SEQ ID NO: 513841 - RNA, 64 nt, Human
ucucucucaaaauuacaguguucauugucauugaccucagcagcaaauuugacuugaauucacu

SEQ ID NO: 513842 - RNA, 64 nt, Human
uucucauggucagaaguucucauggugcacgaguccucagcacucugccggcaguggggguggg

SEQ ID NO: 513843 - RNA, 64 nt, Human
gcuagagauaggaaauggggcaaaucgcaggugaccucagcaguaccuggaugauucccaccaa

SEQ ID NO: 513844 - RNA, 64 nt, Human
cagaaagcuauggauucccuggaugaaauccaaggagggccaucuucagaauggaaaaaugcaa

SEQ ID NO: 513845 - RNA, 64 nt, Human
caccaagacucugcacaaccagauugcuugugcagagggccacaauaaguguauguuuuauauu

SEQ ID NO: 513846 - RNA, 64 nt, Human
ccagacaccagccuuuaggguggccuugggaggagagggccaggcuguccugggugugagagaa

SEQ ID NO: 513847 - RNA, 64 nt, Human
acagguuacaugaaacauugaaagacuuguuacagagggccaugauauuuuucaaagaaaugug

SEQ ID NO: 513848 - RNA, 64 nt, Human
augaggaccuccagggcauguugcucccuucuguccucagcaaggcucgguccuggacauucua

SEQ ID NO: 513849 - RNA, 64 nt, Human
ccucugcucagugccuguggggagcagccucuacccucagcauccuggccacaaguucuuccuu

SEQ ID NO: 513850 - RNA, 64 nt, Human
gggcgugguacgugugcgccaggacucgggcgcugagggccacucacacagcugcuaccacgac

SEQ ID NO: 513851 - RNA, 64 nt, Human
acucugccaugcacacaggaggagagcuggaccugagggccaccgcagcggugcacacauuccu

SEQ ID NO: 513852 - RNA, 64 nt, Human; identical to SEQ ID NO: 435434

SEQ ID NO: 513853 - RNA, 64 nt, Human; identical to SEQ ID NO: 435435

SEQ ID NO: 513854 - RNA, 64 nt, Human; identical to SEQ ID NO: 435436

SEQ ID NO: 513855 - RNA, 64 nt, Human; identical to SEQ ID NO: 435437

SEQ ID NO: 513856 - RNA, 64 nt, Human; identical to SEQ ID NO: 435442

SEQ ID NO: 513857 - RNA, 64 nt, Human; identical to SEQ ID NO: 435443

SEQ ID NO: 513858 - RNA, 64 nt, Human; identical to SEQ ID NO: 435444

SEQ ID NO: 513859 - RNA, 64 nt, Human; identical to SEQ ID NO: 435445

SEQ ID NO: 513860 - RNA, 64 nt, Human; identical to SEQ ID NO: 435446

SEQ ID NO: 513861 - RNA, 52 nt, Human; identical to SEQ ID NO: 435447

SEQ ID NO: 513862 - RNA, 64 nt, Human; identical to SEQ ID NO: 435448

SEQ ID NO: 513863 - RNA, 64 nt, Human; identical to SEQ ID NO: 435449

SEQ ID NO: 513864 - RNA, 64 nt, Human; identical to SEQ ID NO: 435450

SEQ ID NO: 513865 - RNA, 64 nt, Human; identical to SEQ ID NO: 435451

SEQ ID NO: 513866 - RNA, 64 nt, Human; identical to SEQ ID NO: 435452

SEQ ID NO: 513867 - RNA, 64 nt, Human; identical to SEQ ID NO: 435453

SEQ ID NO: 513868 - RNA, 64 nt, Human; identical to SEQ ID NO: 435454

SEQ ID NO: 513869 - RNA, 64 nt, Human; identical to SEQ ID NO: 435455

SEQ ID NO: 513870 - RNA, 64 nt, Human
cucagcugggauccuggaccugggaggccccugugagggccagcucuggaaaaaccugggaguu

SEQ ID NO: 513871 - RNA, 64 nt, Human
gccugcugggaauaggcugagcaugcaaugacaugagggccaaggcuugugggaaaaugacagc

SEQ ID NO: 513872 - RNA, 64 nt, Human
aagaccaccuagggcggggcugggugggagaugggagggccaacugcgagcugcuccacuucuc

SEQ ID NO: 513873 - RNA, 64 nt, Human
gcagcccaugcgagcccuucuccugcugcucugggagggccaguuccacauugagccagccugg

SEQ ID NO: 513874 - RNA, 64 nt, Human
ccuggccagcacucuagcuccugaccuuugacccgagggccaccucaaccccagcuucugacgu

SEQ ID NO: 513875 - RNA, 64 nt, Human
ucucagucaggcuucagagcagcccuggagacaggagggccauguuaaaagcuuuuucacaguu

SEQ ID NO: 513876 - RNA, 64 nt, Human
ggaggugggggauugagggagggacagaguguuggagggccagagacuaguccugagauggaaa

SEQ ID NO: 513877 - RNA, 64 nt, Human
cggaggccaguggagcugccugguguccacgggggagggccaaggccugcugagcugauucucc

SEQ ID NO: 513878 - RNA, 64 nt, Human
gcagcucgguuuccuuuucuagaauggaaauagugagggccaaugcccaggguuggagggagga

SEQ ID NO: 513879 - RNA, 64 nt, Human
acucagccucauucagcauggguccuugaugccagagggccagcaggcuccuggcugugcccag

SEQ ID NO: 513880 - RNA, 64 nt, Human
gacggcuaagggcacgaagacgauaucugguagagagggccagagaugcccgcgugguagggcu

SEQ ID NO: 513881 - RNA, 64 nt, Human
uugaagaagaguguggaggaagcuauuaccaggggagggccagggcucugaggagugggcgcug

SEQ ID NO: 513882 - RNA, 64 nt, Human
ucaagagggguagcucggcugccggaagagaggggugcccuaucccuggcaaccccuccacgua

SEQ ID NO: 513883 - RNA, 64 nt, Human
auccaaagcugcugaaguauguuugaacucuccagugcccuauagcugcaagaguugaauuagu

SEQ ID NO: 513884 - RNA, 64 nt, Human
cagccauggccugggggccaagccucacccugcggugcccuaaaggagggggggcacgagccaa

SEQ ID NO: 513885 - RNA, 64 nt, Human
uccuuuacuuuuuuccugcuggcuacagcauggggugcccuauaggcacaagcccagcugaaga

SEQ ID NO: 513886 - RNA, 64 nt, Human
cuuagaguguggucuccccaccaacuccaguuuugugcccuaagccucauuucucauguucaga

SEQ ID NO: 513887 - RNA, 64 nt, Human
guuccuccuuagugccaucacagcaggugaaugggugcccuacggggcccuccuucccccacca

SEQ ID NO: 513888 - RNA, 64 nt, Human
ggacucagcccagcuggggaggacauggcgcccggugcccuaggagcccucaguguccccuacc

SEQ ID NO: 513889 - RNA, 64 nt, Human
gaguguagagcguagguggcaauugagagagagugugcccuagaggaaagaggcgggugugggg

SEQ ID NO: 513890 - RNA, 64 nt, Human
uuccucuggaaagagaagucacacagacaaucaugugcccuauaaaagugaguguuuauaggac

SEQ ID NO: 513891 - RNA, 64 nt, Human
uccuuauccuccccaaauuuuaagcucuauuucugugcccuaguccuagacacacauuagacuc

SEQ ID NO: 513892 - RNA, 64 nt, Human
caaaucaauaaagucaaauguauggaaacauuuugugcccuacucuccauaccccguguacuca

SEQ ID NO: 513893 - RNA, 62 nt, Human; identical to SEQ ID NO: 467010

SEQ ID NO: 513894 - RNA, 62 nt, Human; identical to SEQ ID NO: 467011

SEQ ID NO: 513895 - RNA, 62 nt, Human; identical to SEQ ID NO: 463062

SEQ ID NO: 513896 - RNA, 64 nt, Human
aguaccuuucacugcauuggauggaugaacaucagugcccuaacuuuauccaucauguagguca

SEQ ID NO: 513897 - RNA, 64 nt, Human
gagugacuauuuggagaauagcacccauaucugugugcccuagggcucagaggggccucaucuu

SEQ ID NO: 513898 - RNA, 64 nt, Human
ccacauuuuauaguaguaguuugcaggauauuaugugcccuaauuagcagauauagacauuauc

SEQ ID NO: 513899 - RNA, 64 nt, Human
uaucugcuaugaaaauccacaaauuuuucagauagugcccuaaaaacaauuuuauaugccucac

SEQ ID NO: 513900 - RNA, 64 nt, Human
uuuuguuuuugcacaucauaauggauuuuucuuagugcccuaauugugaaggguuucucuagcu

SEQ ID NO: 513901 - RNA, 64 nt, Human
agcuacuguuggaaucugcugcaggggccuuugugugcccuaaaaacaaauccuguucauguuu

SEQ ID NO: 513902 - RNA, 64 nt, Human
acuguaguaaauaaugcuuugaaauugaaccuuugugcccuaucacccaacgcuccaaagucau

SEQ ID NO: 513903 - RNA, 64 nt, Human
uuuauuuuucuaaucacagcaguaugaguuaugagugcccuaauuugugguuaguuucuaauuu

SEQ ID NO: 513904 - RNA, 64 nt, Human
uucuccucaauccguugcaugaaauaauuacuaugugcccuaaugcacacaaauagcuaaggag

SEQ ID NO: 513905 - RNA, 64 nt, Human
ucuuucuuuaaauguuuuauaaguucacaaaauggugcccuauaugggguauuggacauagaua

SEQ ID NO: 513906 - RNA, 64 nt, Human
uucgggagaucaugucucacuucacagcccugcagugcccuagacuggcugaaaaaccuaaacu

SEQ ID NO: 513907 - RNA, 64 nt, Human
agcuggugaaaccgagcccucugcaucugcgaaugugcccuaggugcugcugcuggggacaugg

SEQ ID NO: 513908 - RNA, 64 nt, Human
uaacgaaagcaagcgagugaauuaggauuucaaagugcccuaauagugugagucuccaguuccu

SEQ ID NO: 513909 - RNA, 64 nt, Human
cuuuucuacuaaggccucuuacuuugggggggaugugcccuacagaagacauagaagaugggga

SEQ ID NO: 513910 - RNA, 64 nt, Human
acccucaagcauuucuauguauugagaauugucagugcccuaagguauccauugguucccuuga

SEQ ID NO: 513911 - RNA, 64 nt, Human
agaucuggcgucacauggcucccaggaaagugcugugcccuauccccacugauaccaucugauu

SEQ ID NO: 513912 - RNA, 62 nt, Human; identical to SEQ ID NO: 466969

SEQ ID NO: 513913 - RNA, 62 nt, Human; identical to SEQ ID NO: 466442

SEQ ID NO: 513914 - RNA, 62 nt, Human; identical to SEQ ID NO: 466553

SEQ ID NO: 513915 - RNA, 53 nt, Human
uacccaggacagaguccuagugugugcccuacccuggcucaggcuucugggcu

SEQ ID NO: 513916 - RNA, 64 nt, Human
augaagauuuaagugaccuuaauuaaccuguccugugcccuacccuuaaggaauacucucugua

SEQ ID NO: 513917 - RNA, 64 nt, Human
aguuguucagagcccugguggaucuuguaauccagugcccuacaaaggcuagaacacuacaggg

SEQ ID NO: 513918 - RNA, 64 nt, Human
uacaauaauucaguauucaugucaaaauugagaagugcccuaauugaauguguuugaauguuau

SEQ ID NO: 513919 - RNA, 64 nt, Human
gagagcaugggugagcguguaaaagcuuggcccugugcccuacaauggggccagcugggccgac

SEQ ID NO: 513920 - RNA, 64 nt, Human
gcaucccccugcccgacuccuuccccgcacccacgugcccuagauucauggcagaaaaugacca

SEQ ID NO: 513921 - RNA, 64 nt, Human
cagacacccagaauguagcaucugagaaggcccugugcccuaaaggacaccccucgcccccauc

SEQ ID NO: 513922 - RNA, 64 nt, Human
gcucuucugagagggacagagaaagaauagaaaugugcccuaaaagcauaaaugaguaucaccu

SEQ ID NO: 513923 - RNA, 64 nt, Human
uguccaaauuccuuacgcagugguauucaugauggugcccuaucuaaguccaggacuguuuucc

SEQ ID NO: 513924 - RNA, 64 nt, Human
augaaaagaaccuccucaguuguugcaaaaaucagugcccuaaagagguaagcuuuaguagaac

SEQ ID NO: 513925 - RNA, 64 nt, Human
guagcucacugucacucacugaauagagaaacgugugcccuauacuuccugugacaaucauuuu

SEQ ID NO: 513926 - RNA, 64 nt, Human
cucaacuguacauguguacauucuucaccuccuggugcccuaucccgcaaaaugggcuuccugc

SEQ ID NO: 513927 - RNA, 64 nt, Human
ccucuacccaucuucuuuucuuaaagcaggcuaugugcccuacauggcaaggcaccaugacugc

SEQ ID NO: 513928 - RNA, 64 nt, Human
cagggaucagaugggacaauaucaaauuuacuuugugcccuacaaguuaaaaacugcacccauu

SEQ ID NO: 513929 - RNA, 64 nt, Human
gugagccacuuuguguauuuacuguauauuuauugugcccuaaaugugcaacucuccuaaagac

SEQ ID NO: 513930 - RNA, 64 nt, Human
uuuugcugugaugucccugccaaggccauugccagugcccuacaugggcuuugugcccagguaa

SEQ ID NO: 513931 - RNA, 62 nt, Human; identical to SEQ ID NO: 467319

SEQ ID NO: 513932 - RNA, 62 nt, Human; identical to SEQ ID NO: 467320

SEQ ID NO: 513933 - RNA, 62 nt, Human; identical to SEQ ID NO: 463063

SEQ ID NO: 513934 - RNA, 64 nt, Human
cauccggaacagggccuucuacauggaggagggcgugcccuauugcgagcgagguacccacugg

SEQ ID NO: 513935 - RNA, 64 nt, Human
gcugcaguuugggcccaggcuaugugcucuucuggugcccuagggacugcuguggccagagccu

SEQ ID NO: 513936 - RNA, 64 nt, Human
gcauaauguagcugccuauaugcaguuuuauccugugcccuaaagccucacuguccagagcugu

SEQ ID NO: 513937 - RNA, 64 nt, Human
cccuagcacaaagcaagugccuggcacauagucagugcccuaaguauucguagagugaagaaug

SEQ ID NO: 513938 - RNA, 64 nt, Human
acaccucaaacuuuucuaaacauaaaccauauuggugcccuagaaaugugaggaauaugacaag

SEQ ID NO: 513939 - RNA, 64 nt, Human
ugaccccaggugucccucuggaaggggcuggcuggugcccuauuuccagccaccccagcagcua

SEQ ID NO: 513940 - RNA, 64 nt, Human
aguuagagcagagacuucacugacugacuuacaggugcccuauucugagguacaggagccgcgg

SEQ ID NO: 513941 - RNA, 60 nt, Human
cccugcuuggaccucgauaacgggggaggggugcccuagcaucagaaggguucauggccc

SEQ ID NO: 513942 - RNA, 64 nt, Human
aacuucaaaauguauucucuguucuuggaauacagugcccuaaaaugguguucuuaugaccugc

SEQ ID NO: 513943 - RNA, 64 nt, Human
ugguuuaacaacagugcccuguuuacaacagauugugcccuaucucaucugcagccgaggaaua

SEQ ID NO: 513944 - RNA, 64 nt, Human
caauccuguguucucagaggaaguugcacacauugugcccuaaagaaggcccucaggugaaaga

SEQ ID NO: 513945 - RNA, 64 nt, Human
cgaauaaacguggcugagucugccaaguggaacugugcccuauguguggggacuggcugccccc

SEQ ID NO: 513946 - RNA, 64 nt, Human
uuguccugaggaggaacuccaggccucccaucgugugcccuaaggccuccugcguccuggagcc

SEQ ID NO: 513947 - RNA, 64 nt, Human
cuggcaguagggucaugauguugggaaggguguagugcccuagguuggugacagaagggacaga

SEQ ID NO: 513948 - RNA, 64 nt, Human
gacauggauucauuacagaaauguauguguagcugugcccuagaugaccauuuuuauuuuagug

SEQ ID NO: 513949 - RNA, 64 nt, Human
uuaaagcaauaugauaaggguauucaauaauugggugcccuaaauuucuggaugagaaaauuuu

SEQ ID NO: 513950 - RNA, 62 nt, Human; identical to SEQ ID NO: 466989

SEQ ID NO: 513951 - RNA, 62 nt, Human; identical to SEQ ID NO: 466990

SEQ ID NO: 513952 - RNA, 62 nt, Human; identical to SEQ ID NO: 466991

SEQ ID NO: 513953 - RNA, 64 nt, Human
guuccguagcucagagccugccugccagggccaagugcccuagaguccacccgguguccugaag

SEQ ID NO: 513954 - RNA, 64 nt, Human
cgaggugggguccccucccagcccugcauccuccgugcccuagaccugcuccccagaggagggg

SEQ ID NO: 513955 - RNA, 64 nt, Human
ggagcuggaauugaguaccuaaauaaacaaaaaugugcccuauguaagcuucuacaucuugauu

SEQ ID NO: 513956 - RNA, 64 nt, Human
agccacuggcgcccaggagcggugggccgaagacgugcccuacccuaccacaagggcugugucu

SEQ ID NO: 513957 - RNA, 64 nt, Human
ggaacgaggagagguggccacguggcaggccacagugcccuaugggcuuuucuguuugaacccc

SEQ ID NO: 513958 - RNA, 64 nt, Human
uaauuuuaguuuucuuaguauauuauuauaaauugugcccuaagucagguacaaauguacacau

SEQ ID NO: 513959 - RNA, 64 nt, Human
gccuacucugguuaagauguucuuuuccucaaaggugcccuagugccaugauuuaaauauuuuu

SEQ ID NO: 513960 - RNA, 64 nt, Human
uucuaguccugacuucaccuuuuugauuuggugugugcccuaggguauguacccuuccccaucu

SEQ ID NO: 513961 - RNA, 64 nt, Human
aacuuauacuaaagguuguguugccugcugagcugugcccuauuguguggucgggggaugagga

SEQ ID NO: 513962 - RNA, 64 nt, Human
cuggaagguuaaggacccagagagaaaucgagaggugcccuacagcagccaggccuaucaggau

SEQ ID NO: 513963 - RNA, 64 nt, Human
aaugagggagccacagaauccugagaaggugaaugugcccuaaccugcuccucugugccuaggc

SEQ ID NO: 513964 - RNA, 64 nt, Human
gcccuuucaugggcuucgucugccaucuuugugggugcccuagacuuaguccuuaucuuguccu

SEQ ID NO: 513965 - RNA, 64 nt, Human
gauuaacagugcaggguuggggucugcauuggaggugcccuauaaaccagaagagaaaauacug

SEQ ID NO: 513966 - RNA, 64 nt, Human
ggauaacuguaugccuaaguaguauauaaaagcugugcccuagcguaaacaguauagcagaaac

SEQ ID NO: 513967 - RNA, 64 nt, Human
cacagcauccagggauugcccagcuauagugugggugcccuacugaacucugauuagggaaccu

SEQ ID NO: 513968 - RNA, 64 nt, Human
ugaccucuugcugucucugcucgcccuccuuucugugcccuacucauugggguuccgcacuuuc

SEQ ID NO: 513969 - RNA, 62 nt, Human; identical to SEQ ID NO: 466931

SEQ ID NO: 513970 - RNA, 62 nt, Human; identical to SEQ ID NO: 463045

SEQ ID NO: 513971 - RNA, 62 nt, Human; identical to SEQ ID NO: 466932

SEQ ID NO: 513972 - RNA, 64 nt, Human
ggagaaaaaaacaauauuaaaccgcccaagcagugugcccuagcagaggaaaaugcaacaucuc

SEQ ID NO: 513973 - RNA, 64 nt, Human
ccaagcagaaugaugaggaccuguaaaauaccuugugcccuauuaaaaaaaaaaaaaaaaaaaa

SEQ ID NO: 513974 - RNA, 64 nt, Human
gcccagccucuuaaccucuucuuacccugaaugugugcccuaucuuuucucccaccuccuuccu

SEQ ID NO: 513975 - RNA, 64 nt, Human
ugcagggggcuggggggguggggggcaguggauggugcccuaucuggguagagguagugugagu

SEQ ID NO: 513976 - RNA, 64 nt, Human
gcaauacaauuugaauagucucuuugagaaguaugugcccuaucucauggaugugauaguggaa

SEQ ID NO: 513977 - RNA, 64 nt, Human
auccucaggccuccccuuccuuagcuggccaggagugcccuaaggguaagagggaggccacuga

SEQ ID NO: 513978 - RNA, 64 nt, Human
agcaaggcccucugaagcaugggccgugccagcugugcccuagugauaaggguaagaggagaga

SEQ ID NO: 513979 - RNA, 64 nt, Human
caguguuuccuugggagacuuuauucagcugagagugcccuagacaguaacuucuaaggucacg

SEQ ID NO: 513980 - RNA, 64 nt, Human
augcagcuuuuuugaguugucacagaggcugugugugcccuacacugaccaggguuuguaaaac

SEQ ID NO: 513981 - RNA, 64 nt, Human
agcaucacuggagguggucacacagagguagcaugugcccuaguuacagaaucuauuaagggga

SEQ ID NO: 513982 - RNA, 64 nt, Human
auggaagguucucugugcuccuccuacccuuccagugcccuaggccuggcgacugccccugccu

SEQ ID NO: 513983 - RNA, 64 nt, Human
cuaguaugugcuucaaaagggcaaaugugcuuuagugcccuaaggcuaaauuuuggucauuuga

SEQ ID NO: 513984 - RNA, 64 nt, Human
cugcguuuuuauacacgucaaagcuguuaagaaugugcccuaagggagaggaucuugucguaga

SEQ ID NO: 513985 - RNA, 64 nt, Human
uggggaucagcugaaggaucaggaagugugggcugugcccuagccacaccacagccagccucag

SEQ ID NO: 513986 - RNA, 64 nt, Human
auuccuguucuuucuuacacaagagcuggagcccgugcccuaccacacaucuguggagaugccc

SEQ ID NO: 513987 - RNA, 64 nt, Human
acccuagauuuuaacacugcauucucacuauaacgugcccuauaauggcugcaucccuuuugag

SEQ ID NO: 513988 - RNA, 64 nt, Human; identical to SEQ ID NO: 408903

SEQ ID NO: 513989 - RNA, 64 nt, Human; identical to SEQ ID NO: 412537

SEQ ID NO: 513990 - RNA, 64 nt, Human; identical to SEQ ID NO: 412743

SEQ ID NO: 513991 - RNA, 64 nt, Human
auuuguuuaacuugauuuauuaaauucuaguuaugugcccuauaaugauguuucagucagugac

SEQ ID NO: 513992 - RNA, 64 nt, Human
cuuggagccuggguuuuuggagaaagagaucuccgugcccuacagaccuuuucucaacgaaugu

SEQ ID NO: 513993 - RNA, 64 nt, Human
auuugagaucagagagcaccacagggcuggcuuugugcccuaaccccugggaugcagccugccu

SEQ ID NO: 513994 - RNA, 64 nt, Human
cgguucccacggagcugacuucuccggggugccugugcccuacauuaaacccggcguuuguuuc

SEQ ID NO: 513995 - RNA, 64 nt, Human
cagagauguccuggaugggaacaugguccuggaggugcccuaccugcauccugcugcaccccca

SEQ ID NO: 513996 - RNA, 64 nt, Human
ucccuuuccaaaggccauggagagcuggagccuggugcccuaaccucugagucaccaucuuaag

SEQ ID NO: 513997 - RNA, 64 nt, Human
aaaguaucccuacuguaauuugugauacaaugcugugcccuaaaguguauuuuuuuacuaauag

SEQ ID NO: 513998 - RNA, 64 nt, Human
ugguucuuuguucugucccccaugcucugaugcagugcccuagaaggggaaagaauuaaugcuc

SEQ ID NO: 513999 - RNA, 64 nt, Human
gggaagccaugggcaguccagaucaagccaccacgugcccuacgauggccuaacaggagugccc

SEQ ID NO: 514000 - RNA, 64 nt, Human
uugguguuguacagcucacauguuuacacacucagugcccuaauuuccccugagggaaucgcuu

SEQ ID NO: 514001 - RNA, 64 nt, Human
ggcuucuagggaaagcaaggaccucacaugccaggugcccuaguacuugcuuagugagccaugu

SEQ ID NO: 514002 - RNA, 64 nt, Human
gugugugcgcauguguguuugcauguaggagaacgugcccuauucacacucugggaagacgcua

SEQ ID NO: 514003 - RNA, 64 nt, Human
acugccuauaaguuaauauugggagaaaugacuugugcccuaaacaaccuccugcacagucugc

SEQ ID NO: 514004 - RNA, 64 nt, Human; identical to SEQ ID NO: 514003

SEQ ID NO: 514005 - RNA, 64 nt, Human
uaugaaaagcuucuuggcaaugaauucuguaauagugcccuacauuaugguuuucugguggaau

SEQ ID NO: 514006 - RNA, 55 nt, Human
acaucaaagaugccuuuugaugagagugcccuaaccccagacaagcuccuuguuc

SEQ ID NO: 514007 - RNA, 64 nt, Human; identical to SEQ ID NO: 412592

SEQ ID NO: 514008 - RNA, 64 nt, Human; identical to SEQ ID NO: 412593

SEQ ID NO: 514009 - RNA, 64 nt, Human; identical to SEQ ID NO: 409035

SEQ ID NO: 514010 - RNA, 64 nt, Human
guggaccuuacaacgccgagugcacugcauuccugugcccuagaugcacguggggcccacugcu

SEQ ID NO: 514011 - RNA, 64 nt, Human
uuuccaacagcuaaacuacucuuaguugaacagugugcccuagcuuuucuugcaaccagaguau

SEQ ID NO: 514012 - RNA, 64 nt, Human
ggagcgcgcuucccgucucuccucuccccauucugugcccuacuauuuucaacaaaacaaaaca

SEQ ID NO: 514013 - RNA, 64 nt, Human
acucacacacaaaauguacccaguauucuagguagugcccuauuuuacaauuguaaaacugagg

SEQ ID NO: 514014 - RNA, 64 nt, Human
agcaaaaauuauccuugugaaauaucugcugauugugcccuacucuuugcaccugacuuuuccu

SEQ ID NO: 514015 - RNA, 64 nt, Human
aagacagacuguuuuagacagacuuuuuaaaauggugcccuaccauugacacaugcagaaauug

SEQ ID NO: 514016 - RNA, 64 nt, Human
augaugugacuuccauguagauauaaaaaugauugugcccuaaccaaacuuccucagauugugc

SEQ ID NO: 514017 - RNA, 64 nt, Human
aauucauuugacuuuggaggcaaaauguguugaagugcccuaugaaguagcaauuuucuauagg

SEQ ID NO: 514018 - RNA, 64 nt, Human
ccugugcuggguguccaccugugcccccaccugggugcccuaugcugacccaggaaaggccaga

SEQ ID NO: 514019 - RNA, 64 nt, Human
ucaggaucccuggggcuggggaacucccaacuucgugcccuagauccugcaccuccccacucga

SEQ ID NO: 514020 - RNA, 64 nt, Human
ugacacaugcaagggcgucugacacacagagggagugcccuagauaugaauugccaggauguuu

SEQ ID NO: 514021 - RNA, 64 nt, Human
cccacacacuuagccauugaaaugucaaauugaugugcccuagaucaacagaucaacaauaccu

SEQ ID NO: 514022 - RNA, 64 nt, Human
uuuucuauaaaauggguaggcaggagaaaagcaggugcccuaagauugcucuaaggcccagcau

SEQ ID NO: 514023 - RNA, 64 nt, Human
ccggggaggguagcagugggccauggggcuucuugugcccuaaaggggacuggcugcugugauc

SEQ ID NO: 514024 - RNA, 52 nt, Human
aagauguccacaagaaauagaugugcccuacagacccugggaccuucuugcc

SEQ ID NO: 514025 - RNA, 64 nt, Human
gucauugcuuugguuaucuauaaaauaggcuuuugugcccuacuuuucuucuuguagggcuugg

SEQ ID NO: 514026 - RNA, 64 nt, Human; identical to SEQ ID NO: 412611

SEQ ID NO: 514027 - RNA, 64 nt, Human; identical to SEQ ID NO: 412612

SEQ ID NO: 514028 - RNA, 64 nt, Human; identical to SEQ ID NO: 412613

SEQ ID NO: 514029 - RNA, 64 nt, Human
gcuggacugcaggcuuauuuugcuuaagucaacagugcccuaaaacuccaaacucaaaugcagu

SEQ ID NO: 514030 - RNA, 64 nt, Human
gcuggaacgggguccaggagacuguguguaacaggugcccuaggugacccuuauaaucagggaa

SEQ ID NO: 514031 - RNA, 64 nt, Human
uauccuucaaaacaaucugcauuaagaagauauugugcccuacuagacagcuuucauucacuuu

SEQ ID NO: 514032 - RNA, 64 nt, Human; identical to SEQ ID NO: 64437

SEQ ID NO: 514033 - RNA, 64 nt, Human; identical to SEQ ID NO: 64438

SEQ ID NO: 514034 - RNA, 64 nt, Human; identical to SEQ ID NO: 64439

SEQ ID NO: 514035 - RNA, 64 nt, Human; identical to SEQ ID NO: 64440

SEQ ID NO: 514036 - RNA, 64 nt, Human; identical to SEQ ID NO: 64441

SEQ ID NO: 514037 - RNA, 64 nt, Human; identical to SEQ ID NO: 64442

SEQ ID NO: 514038 - RNA, 64 nt, Human; identical to SEQ ID NO: 64443

SEQ ID NO: 514039 - RNA, 64 nt, Human; identical to SEQ ID NO: 64444

SEQ ID NO: 514040 - RNA, 64 nt, Human; identical to SEQ ID NO: 64445

SEQ ID NO: 514041 - RNA, 64 nt, Human; identical to SEQ ID NO: 64446

SEQ ID NO: 514042 - RNA, 64 nt, Human; identical to SEQ ID NO: 64447

SEQ ID NO: 514043 - RNA, 64 nt, Human; identical to SEQ ID NO: 64448

SEQ ID NO: 514044 - RNA, 64 nt, Human; identical to SEQ ID NO: 410576

SEQ ID NO: 514045 - RNA, 64 nt, Human; identical to SEQ ID NO: 409036

SEQ ID NO: 514046 - RNA, 64 nt, Human; identical to SEQ ID NO: 412631

SEQ ID NO: 514047 - RNA, 64 nt, Human; identical to SEQ ID NO: 64449

SEQ ID NO: 514048 - RNA, 52 nt, Human; identical to SEQ ID NO: 64450

SEQ ID NO: 514049 - RNA, 64 nt, Human; identical to SEQ ID NO: 64451

SEQ ID NO: 514050 - RNA, 64 nt, Human; identical to SEQ ID NO: 64452

SEQ ID NO: 514051 - RNA, 64 nt, Human; identical to SEQ ID NO: 64453

SEQ ID NO: 514052 - RNA, 64 nt, Human; identical to SEQ ID NO: 64454

SEQ ID NO: 514053 - RNA, 64 nt, Human; identical to SEQ ID NO: 64455

SEQ ID NO: 514054 - RNA, 64 nt, Human; identical to SEQ ID NO: 64456

SEQ ID NO: 514055 - RNA, 64 nt, Human; identical to SEQ ID NO: 64457

SEQ ID NO: 514056 - RNA, 64 nt, Human; identical to SEQ ID NO: 64458

SEQ ID NO: 514057 - RNA, 64 nt, Human; identical to SEQ ID NO: 64459

SEQ ID NO: 514058 - RNA, 52 nt, Human; identical to SEQ ID NO: 64460

SEQ ID NO: 514059 - RNA, 64 nt, Human; identical to SEQ ID NO: 64461

SEQ ID NO: 514060 - RNA, 64 nt, Human; identical to SEQ ID NO: 64462

SEQ ID NO: 514061 - RNA, 64 nt, Human; identical to SEQ ID NO: 64463

SEQ ID NO: 514062 - RNA, 64 nt, Human; identical to SEQ ID NO: 64464

SEQ ID NO: 514063 - RNA, 64 nt, Human; identical to SEQ ID NO: 412632

SEQ ID NO: 514064 - RNA, 64 nt, Human; identical to SEQ ID NO: 412649

SEQ ID NO: 514065 - RNA, 64 nt, Human; identical to SEQ ID NO: 409052

SEQ ID NO: 514066 - RNA, 64 nt, Human; identical to SEQ ID NO: 64465

SEQ ID NO: 514067 - RNA, 64 nt, Human; identical to SEQ ID NO: 64466

SEQ ID NO: 514068 - RNA, 64 nt, Human; identical to SEQ ID NO: 64467

SEQ ID NO: 514069 - RNA, 64 nt, Human; identical to SEQ ID NO: 64468

SEQ ID NO: 514070 - RNA, 64 nt, Human; identical to SEQ ID NO: 64469

SEQ ID NO: 514071 - RNA, 64 nt, Human; identical to SEQ ID NO: 64470

SEQ ID NO: 514072 - RNA, 64 nt, Human; identical to SEQ ID NO: 64471

SEQ ID NO: 514073 - RNA, 64 nt, Human; identical to SEQ ID NO: 64472

SEQ ID NO: 514074 - RNA, 64 nt, Human; identical to SEQ ID NO: 64473

SEQ ID NO: 514075 - RNA, 50 nt, Human; identical to SEQ ID NO: 64474

SEQ ID NO: 514076 - RNA, 64 nt, Human; identical to SEQ ID NO: 64475

SEQ ID NO: 514077 - RNA, 64 nt, Human; identical to SEQ ID NO: 64476

SEQ ID NO: 514078 - RNA, 64 nt, Human; identical to SEQ ID NO: 64477

SEQ ID NO: 514079 - RNA, 64 nt, Human; identical to SEQ ID NO: 64478

SEQ ID NO: 514080 - RNA, 64 nt, Human; identical to SEQ ID NO: 64479

SEQ ID NO: 514081 - RNA, 64 nt, Human; identical to SEQ ID NO: 64480

SEQ ID NO: 514082 - RNA, 64 nt, Human; identical to SEQ ID NO: 412651

SEQ ID NO: 514083 - RNA, 64 nt, Human; identical to SEQ ID NO: 412440

SEQ ID NO: 514084 - RNA, 64 nt, Human; identical to SEQ ID NO: 409053

SEQ ID NO: 514085 - RNA, 64 nt, Human; identical to SEQ ID NO: 64481

SEQ ID NO: 514086 - RNA, 64 nt, Human; identical to SEQ ID NO: 64482

SEQ ID NO: 514087 - RNA, 64 nt, Human; identical to SEQ ID NO: 64483

SEQ ID NO: 514088 - RNA, 64 nt, Human; identical to SEQ ID NO: 64484

SEQ ID NO: 514089 - RNA, 64 nt, Human; identical to SEQ ID NO: 64485

SEQ ID NO: 514090 - RNA, 64 nt, Human; identical to SEQ ID NO: 64486

SEQ ID NO: 514091 - RNA, 64 nt, Human; identical to SEQ ID NO: 64487

SEQ ID NO: 514092 - RNA, 64 nt, Human; identical to SEQ ID NO: 64488

SEQ ID NO: 514093 - RNA, 64 nt, Human; identical to SEQ ID NO: 64489

SEQ ID NO: 514094 - RNA, 64 nt, Human; identical to SEQ ID NO: 64490

SEQ ID NO: 514095 - RNA, 55 nt, Human; identical to SEQ ID NO: 64491

SEQ ID NO: 514096 - RNA, 64 nt, Human; identical to SEQ ID NO: 64492

SEQ ID NO: 514097 - RNA, 64 nt, Human; identical to SEQ ID NO: 64493

SEQ ID NO: 514098 - RNA, 64 nt, Human; identical to SEQ ID NO: 64494

SEQ ID NO: 514099 - RNA, 64 nt, Human; identical to SEQ ID NO: 64495

SEQ ID NO: 514100 - RNA, 64 nt, Human; identical to SEQ ID NO: 64496

SEQ ID NO: 514101 - RNA, 64 nt, Human; identical to SEQ ID NO: 410593

SEQ ID NO: 514102 - RNA, 64 nt, Human; identical to SEQ ID NO: 412703

SEQ ID NO: 514103 - RNA, 64 nt, Human; identical to SEQ ID NO: 412704

SEQ ID NO: 514104 - RNA, 64 nt, Human; identical to SEQ ID NO: 64497

SEQ ID NO: 514105 - RNA, 64 nt, Human; identical to SEQ ID NO: 64498

SEQ ID NO: 514106 - RNA, 51 nt, Human; identical to SEQ ID NO: 64499

SEQ ID NO: 514107 - RNA, 64 nt, Human; identical to SEQ ID NO: 64500

SEQ ID NO: 514108 - RNA, 64 nt, Human; identical to SEQ ID NO: 64501

SEQ ID NO: 514109 - RNA, 64 nt, Human; identical to SEQ ID NO: 64502

SEQ ID NO: 514110 - RNA, 64 nt, Human; identical to SEQ ID NO: 64503

SEQ ID NO: 514111 - RNA, 64 nt, Human; identical to SEQ ID NO: 64504

SEQ ID NO: 514112 - RNA, 64 nt, Human; identical to SEQ ID NO: 64505

SEQ ID NO: 514113 - RNA, 64 nt, Human; identical to SEQ ID NO: 64506

SEQ ID NO: 514114 - RNA, 64 nt, Human; identical to SEQ ID NO: 64507

SEQ ID NO: 514115 - RNA, 64 nt, Human; identical to SEQ ID NO: 64508

SEQ ID NO: 514116 - RNA, 64 nt, Human; identical to SEQ ID NO: 64509

SEQ ID NO: 514117 - RNA, 64 nt, Human; identical to SEQ ID NO: 64510

SEQ ID NO: 514118 - RNA, 64 nt, Human; identical to SEQ ID NO: 64511

SEQ ID NO: 514119 - RNA, 64 nt, Human; identical to SEQ ID NO: 64512

SEQ ID NO: 514120 - RNA, 64 nt, Human; identical to SEQ ID NO: 409054

SEQ ID NO: 514121 - RNA, 64 nt, Human; identical to SEQ ID NO: 410594

SEQ ID NO: 514122 - RNA, 64 nt, Human; identical to SEQ ID NO: 412722

SEQ ID NO: 514123 - RNA, 64 nt, Human; identical to SEQ ID NO: 64513

SEQ ID NO: 514124 - RNA, 64 nt, Human; identical to SEQ ID NO: 64514

SEQ ID NO: 514125 - RNA, 64 nt, Human; identical to SEQ ID NO: 64515

SEQ ID NO: 514126 - RNA, 64 nt, Human; identical to SEQ ID NO: 64516

SEQ ID NO: 514127 - RNA, 64 nt, Human; identical to SEQ ID NO: 412723

SEQ ID NO: 514128 - RNA, 64 nt, Human; identical to SEQ ID NO: 412724

SEQ ID NO: 514129 - RNA, 64 nt, Human; identical to SEQ ID NO: 412857

SEQ ID NO: 514130 - RNA, 64 nt, Human; identical to SEQ ID NO: 412969

SEQ ID NO: 514131 - RNA, 64 nt, Human
ccacugagggccucgccuggcugcagccugcgccaccgcccagagacccaagcugccuccccuc

SEQ ID NO: 514132 - RNA, 64 nt, Human
ggucuugcccugugguuugacucuccuuagaaccaccgcccaccagaaacauaaaggauuaaaa

SEQ ID NO: 514133 - RNA, 64 nt, Human
cacccccagauucuucgcacagugucuagauccgaccgcccaacguuugccucccagccugacu

SEQ ID NO: 514134 - RNA, 64 nt, Human
uuuccuuaaauuuuuagccauuucuccaugggccaccgcccagcucauguaggugagccugggc

SEQ ID NO: 514135 - RNA, 64 nt, Human
cacugguggccgccucccugucccguguguuuccaccgcccaaucuggcuuguccuggcagugc

SEQ ID NO: 514136 - RNA, 64 nt, Human
caggaguagcugaggguccuuucugugcccuuaaaccgcccagaggagcccuauuccacucugg

SEQ ID NO: 514137 - RNA, 64 nt, Human
ggacaccaacgccgcauaggacugcccacaugggaccgcccacauaggaccgcccacauaggac

SEQ ID NO: 514138 - RNA, 64 nt, Human
cauaggacugcccacaugggaccgcccacauaggaccgcccacauaggaccgcccacaugggac

SEQ ID NO: 514139 - RNA, 62 nt, Human; identical to SEQ ID NO: 466759

SEQ ID NO: 514140 - RNA, 64 nt, Human; identical to SEQ ID NO: 412910

SEQ ID NO: 514141 - RNA, 64 nt, Human; identical to SEQ ID NO: 412911

SEQ ID NO: 514142 - RNA, 64 nt, Human
caugggaccgcccacauaggaccgcccacauaggaccgcccacaugggaccgcccacaugggac

SEQ ID NO: 514143 - RNA, 64 nt, Human
cauaggaccgcccacauaggaccgcccacaugggaccgcccacaugggaccgcccacaugggac

SEQ ID NO: 514144 - RNA, 64 nt, Human
cauaggaccgcccacaugggaccgcccacaugggaccgcccacaugggaccgcccacauagaac

SEQ ID NO: 514145 - RNA, 64 nt, Human
caugggaccgcccacaugggaccgcccacaugggaccgcccacauagaaccguccuccaguggu

SEQ ID NO: 514146 - RNA, 64 nt, Human
ccagccucggccaggccugcucugcucagcgcccaccgcccaccaccccuccugcuuccccgag

SEQ ID NO: 514147 - RNA, 64 nt, Human
cauauuauuacaguuccacaucaaggccgagugcaccgcccaccacugccacggccuuugacca

SEQ ID NO: 514148 - RNA, 64 nt, Human
agugaugccuacugaugcuucagugccucugcacaccgcccauuccacuuccuccuuccccaca

SEQ ID NO: 514149 - RNA, 64 nt, Human
ccaagagcaaauccugccugcccuaucccuagccaccgcccagugcucucacuauccaccucaa

SEQ ID NO: 514150 - RNA, 64 nt, Human
ggaaccccucucccuuccauaauuccccucauccaccgcccacuccaggcacucacucaaacuu

SEQ ID NO: 514151 - RNA, 64 nt, Human
gacgaacggugaucugugacccgguggugugcccaccgcccagcugcccacacccggugcaggc

SEQ ID NO: 514152 - RNA, 64 nt, Human
agacgggaacuccuccuuccugcuucagggccgcaccgcccagacuggcucagcccaggccacc

SEQ ID NO: 514153 - RNA, 64 nt, Human
ccaucgccugggacgccccuuucucuugcuguuuaccgcccacccagcagcgcccgaggccagg

SEQ ID NO: 514154 - RNA, 64 nt, Human
cauucuggcuaucgucccccuucucacugaccugaccgcccaccaccuccuucccccucaucac

SEQ ID NO: 514155 - RNA, 64 nt, Human
cuggaaugggaacugagaaccgauucuuuccacaaccgcccacugagcagcaaggcugcagcca

SEQ ID NO: 514156 - RNA, 64 nt, Human
auauucacuaauaaauguaugauguauaccaacgaccgcccacgcugccuuuggcugcccgugu

SEQ ID NO: 514157 - RNA, 64 nt, Human
cuaaggacauacaagagccauuguuacgagcagcaccgcccagcccuuccuugccuacugucag

SEQ ID NO: 514158 - RNA, 64 nt, Human; identical to SEQ ID NO: 410559

SEQ ID NO: 514159 - RNA, 64 nt, Human; identical to SEQ ID NO: 409034

SEQ ID NO: 514160 - RNA, 64 nt, Human; identical to SEQ ID NO: 412574

SEQ ID NO: 514161 - RNA, 64 nt, Human
caggaaccacuccuguuguacaaagcucacacccaccgcccaggucuuaacuuucuggcaucca

SEQ ID NO: 514162 - RNA, 64 nt, Human
gggccucuggacuucuuggaugagcucacccugaaccgcccaggcggucugcucuugguguuca

SEQ ID NO: 514163 - RNA, 64 nt, Human
cccugccucaaguagcaggccggcccgggccgccaccgcccaucccagaccauggagcgcgcug

SEQ ID NO: 514164 - RNA, 64 nt, Human
ucaauuccguagccagcugcuccccagcagcggaaccgcccaggaucagauugcaugugacucu

SEQ ID NO: 514165 - RNA, 64 nt, Human
cagcugcugcccaggcuccgcagagcagguguccaccgcccauccagccauuguguuuagaggg

SEQ ID NO: 514166 - RNA, 64 nt, Human
gccuggacgcuguggcuuaagaguaacagcagccaccgcccaguuccaguggccccacgaagcc

SEQ ID NO: 514167 - RNA, 64 nt, Human
auaaaaagguucuccugaauaaugagaucagccaaccgcccaugcaacugaagacacugucguc

SEQ ID NO: 514168 - RNA, 64 nt, Human
acggugccgaacgcuggccacuggauccacgcugaccgcccacaggacuucauagcugccaucc

SEQ ID NO: 514169 - RNA, 64 nt, Human
gggguuguugggggggccucuguuuccggaauucaccgcccagucgccagggggcgcccgcggg

SEQ ID NO: 514170 - RNA, 64 nt, Human
agaaacagggccggccccccaacuucagggacccaccgcccauuccccgagagcugucggaacc

SEQ ID NO: 514171 - RNA, 64 nt, Human
aauuuauuuuuuuuugagacaggaucucacuuuuaccgcccaggcuggagugcagugccaugau

SEQ ID NO: 514172 - RNA, 64 nt, Human
guccgcugaccucuggccacaggaagccagguccaccgcccaccacccuuucaggccauguuuc

SEQ ID NO: 514173 - RNA, 64 nt, Human
cuggccuggaauggguaauggggugaguuaacccaccgcccagcuggcaagggaaaccuucuga

SEQ ID NO: 514174 - RNA, 64 nt, Human
guucuggcuggggaaugacaacauccacgcccugaccgcccaggguagggccgcugcuggggcu

SEQ ID NO: 514175 - RNA, 64 nt, Human
cagccugagcuccacccuccccucuucuugcggcaccgcccacccacaccccgucugccccuug

SEQ ID NO: 514176 - RNA, 64 nt, Human
gcucugccccuccguccccagggugcaggcgcgcaccgcccaacccccaccucccgguguaugc

SEQ ID NO: 514177 - RNA, 52 nt, Human; identical to SEQ ID NO: 467012

SEQ ID NO: 514178 - RNA, 62 nt, Human; identical to SEQ ID NO: 466778

SEQ ID NO: 514179 - RNA, 62 nt, Human; identical to SEQ ID NO: 463064

SEQ ID NO: 514180 - RNA, 64 nt, Human
aguggacucugcuacacuuaaaccuaugugacaaaccgcccauuauuuuauuguuuauuuaauu

SEQ ID NO: 514181 - RNA, 64 nt, Human
cugcccggccccucgccccugccuggcacugcucaccgcccaaggcgacgccggcuggaccagg

SEQ ID NO: 514182 - RNA, 64 nt, Human
cuccccaggaagcuccugcgcuacuacagcaagaaccgcccaaccgaggcugucaggugcuacg

SEQ ID NO: 514183 - RNA, 64 nt, Human
gccaaaaaggcagcugccuguggcuccuguaccaaccgcccagccacgcuccaucgccgcccaa

SEQ ID NO: 514184 - RNA, 64 nt, Human
cuugagcccuggcuguucugugguuccucugcucaccgcccaucaggguucucuuagcaacuca

SEQ ID NO: 514185 - RNA, 64 nt, Human
uauucaauauauuuuuucuaaaauccaacuucugaccgcccaguaggaagaaaaaugagacauu

SEQ ID NO: 514186 - RNA, 64 nt, Human
uacccgggccuccccucgucccucuucuagugguaccgcccaggccuuaaucacccccauuccg

SEQ ID NO: 514187 - RNA, 64 nt, Human
gccccgcccaggcacggccgaccccgccccgggcaccgcccaccgagccauccugccucgccuc

SEQ ID NO: 514188 - RNA, 64 nt, Human
ucccugagggcccaccagccugugcugcauacccaccgcccagcuucucccugagggcccacca

SEQ ID NO: 514189 - RNA, 64 nt, Human
ccucugagggcccaccagccugugcugcauacccaccgcccagcuucucccugagggcccacca

SEQ ID NO: 514190 - RNA, 64 nt, Human
ccuguccccccaccacccgccugccccgcggaagaccgcccagugagccagcccccaccuucca

SEQ ID NO: 514191 - RNA, 64 nt, Human
ccccacggccccacuguccacacacugccuccccaccgcccaccucggcugcuaggccccucgc

SEQ ID NO: 514192 - RNA, 64 nt, Human
caucaaauucuaagggagaaaaaaacaauauuaaaccgcccaagcagugugcccuagcagagga

SEQ ID NO: 514193 - RNA, 64 nt, Human
ugggcucuuggcaccugcguguccugugcuuaccaccgcccaaggcccccuuggaucucuugga

SEQ ID NO: 514194 - RNA, 64 nt, Human
cuaugguuguucgccaccaagccaggagugcugcaccgcccaguggucccccucgggcuccagg

SEQ ID NO: 514195 - RNA, 64 nt, Human
agccgggccauaugcccagugccagcuagggcccaccgcccauccugcacacggggccgcuggg

SEQ ID NO: 514196 - RNA, 62 nt, Human; identical to SEQ ID NO: 467029

SEQ ID NO: 514197 - RNA, 62 nt, Human; identical to SEQ ID NO: 467030

SEQ ID NO: 514198 - RNA, 62 nt, Human; identical to SEQ ID NO: 467031

SEQ ID NO: 514199 - RNA, 64 nt, Human
caguguuccugagaggcugggcacuuagcuggaaaccgcccaccucccucccgggugagccugg

SEQ ID NO: 514200 - RNA, 64 nt, Human
cugcucacaacugccccucaaguucaaccccgggaccgcccagccccgcaaagcaaagacccug

SEQ ID NO: 514201 - RNA, 64 nt, Human
uauccugguuugcaaaagagccucccaugccaguaccgcccagccuuggaggccggaaugcuca

SEQ ID NO: 514202 - RNA, 64 nt, Human
uauggagacacccuggcccccaggagcuggaggcaccgcccacuccccuggcauuccagcuuug

SEQ ID NO: 514203 - RNA, 64 nt, Human
uccguccucucggcuuccccaugugugggcugggaccgcccacggggugcagaucuccuggcgu

SEQ ID NO: 514204 - RNA, 64 nt, Human
uugucuacccacacaaauccucaggaaaccaaccaccgcccagguggcccugagggaggcauuc

SEQ ID NO: 514205 - RNA, 64 nt, Human
aacccaaagaagugaaggagaaagcagcugccucaccgcccagacauugauuuguucagauguu

SEQ ID NO: 514206 - RNA, 64 nt, Human
gggagcucaaagcaagugagcucaccuaccugccaccgcccaggaccagucugcccacugccua

SEQ ID NO: 514207 - RNA, 64 nt, Human
cgacucuuccugcgaggucucagagcgcuguguaaccgcccaagggguucaccuugccugcugc

SEQ ID NO: 514208 - RNA, 64 nt, Human
gcccuccugccacccaugcucaugugguguccccaccgcccacuuguuugaugucacugacugu

SEQ ID NO: 514209 - RNA, 64 nt, Human
gccccgccccggcgcuggucccgcccacccagacaccgcccacuucccggcccggggccugcac

SEQ ID NO: 514210 - RNA, 64 nt, Human
ccugggcuccggcagggagaggugcaggggagucaccgcccagaccuccccagccaccaaccga

SEQ ID NO: 514211 - RNA, 64 nt, Human
uacaguauucccacucuuaucuuacaacucccccaccgcccacucuccaccucacuagcucccc

SEQ ID NO: 514212 - RNA, 64 nt, Human
guguccaaggauucccguacagugacugugucucaccgcccacaacccuaucgcuggagcugug

SEQ ID NO: 514213 - RNA, 64 nt, Human
ggugcuaggcugagggauguuuuuccucccccuuaccgcccaugcccuugaaagaaaagucacu

SEQ ID NO: 514214 - RNA, 64 nt, Human
uguccuucugauacaguugaucagaccccugcccaccgcccaggccaggccuguggucaucaau

SEQ ID NO: 514215 - RNA, 64 nt, Human; identical to SEQ ID NO: 412346

SEQ ID NO: 514216 - RNA, 64 nt, Human; identical to SEQ ID NO: 412347

SEQ ID NO: 514217 - RNA, 64 nt, Human; identical to SEQ ID NO: 410612

SEQ ID NO: 514218 - RNA, 64 nt, Human
ggagagggugguguccugagucaaguccugccccaccgcccagcuccccccagaggccaccucg

SEQ ID NO: 514219 - RNA, 64 nt, Human
agugugaugggccaccggggcaagagggaaggugaccgcccagcucucccacaucccacuggau

SEQ ID NO: 514220 - RNA, 64 nt, Human
acgguaggagcucucccgguaccaguguccacagaccgcccaacacagaggcuuugaggcuucu

SEQ ID NO: 514221 - RNA, 64 nt, Human
uucuccgguucucccugugcccauccaccgguugaccgcccaucugccuuuaucagagggacug

SEQ ID NO: 514222 - RNA, 64 nt, Human
ccauccccugccgugggggccacagccacaccucaccgcccaguccagcugucuccagaagggg

SEQ ID NO: 514223 - RNA, 64 nt, Human
gccaguggccuuagagggagccugcccugcccccaccgcccaccaccuccuccccuucauuccu

SEQ ID NO: 514224 - RNA, 64 nt, Human
agaguccggccuggccucccccaggaccgagaucaccgcccaguaugggcuagagcaggucuuc

SEQ ID NO: 514225 - RNA, 64 nt, Human
acaaaacuuugacccagccacuguuagugucgccaccgcccauaaaggagcugagcccagcagg

SEQ ID NO: 514226 - RNA, 64 nt, Human
agaggcaccaugggcguggaggggcuucccggacaccgcccacccgggacccgccucuuccacc

SEQ ID NO: 514227 - RNA, 64 nt, Human
ggaaagacauuauacgugggcuuggcccagccccaccgcccacgccuggguaguagcagugccu

SEQ ID NO: 514228 - RNA, 64 nt, Human
gaugagaaacccaaagcugagagagguguggggaaccgcccaaggucacccagcugugaaugaa

SEQ ID NO: 514229 - RNA, 64 nt, Human
ccauccagcacugaccagcccugauuccccgaccaccgcccaggguggagaaggaggcccuugc

SEQ ID NO: 514230 - RNA, 64 nt, Human
aaugagguucccugcaacccccgcccuccagcccaccgcccaaccuuuuacaaauggcauuuuc

SEQ ID NO: 514231 - RNA, 59 nt, Human; identical to SEQ ID NO: 56626

SEQ ID NO: 514232 - RNA, 64 nt, Human
gaggggcccagugcaugagggcggcuccccagggaccgcccagaucccagcuuugagagaggag

SEQ ID NO: 514233 - RNA, 64 nt, Human
ugugugugugucuugcacuccagagcugaccuccaccgcccagccugggaagucauuguaggga

SEQ ID NO: 514234 - RNA, 62 nt, Human; identical to SEQ ID NO: 467049

SEQ ID NO: 514235 - RNA, 62 nt, Human; identical to SEQ ID NO: 467050

SEQ ID NO: 514236 - RNA, 62 nt, Human; identical to SEQ ID NO: 467051

SEQ ID NO: 514237 - RNA, 56 nt, Human; identical to SEQ ID NO: 56629

SEQ ID NO: 514238 - RNA, 64 nt, Human
gagccuaccucugacagcgcggggcucacuaguuaccgcccaaccuggauccggcgcguguggc

SEQ ID NO: 514239 - RNA, 64 nt, Human
gagucagaugaggcccugcaccuuccccaaaggaaccgcccagugcagguauuucagaaggaga

SEQ ID NO: 514240 - RNA, 64 nt, Human; identical to SEQ ID NO: 412874

SEQ ID NO: 514241 - RNA, 64 nt, Human; identical to SEQ ID NO: 412893

SEQ ID NO: 514242 - RNA, 64 nt, Human; identical to SEQ ID NO: 409092

SEQ ID NO: 514243 - RNA, 64 nt, Human; identical to SEQ ID NO: 412910

SEQ ID NO: 514244 - RNA, 64 nt, Human; identical to SEQ ID NO: 412911

SEQ ID NO: 514245 - RNA, 64 nt, Human; identical to SEQ ID NO: 412912

SEQ ID NO: 514246 - RNA, 64 nt, Human; identical to SEQ ID NO: 412931

SEQ ID NO: 514247 - RNA, 64 nt, Human; identical to SEQ ID NO: 409093

SEQ ID NO: 514248 - RNA, 64 nt, Human; identical to SEQ ID NO: 412950

SEQ ID NO: 514249 - RNA, 64 nt, Human; identical to SEQ ID NO: 412967

SEQ ID NO: 514250 - RNA, 64 nt, Human; identical to SEQ ID NO: 412968

SEQ ID NO: 514251 - RNA, 64 nt, Human; identical to SEQ ID NO: 410539

SEQ ID NO: 514252 - RNA, 64 nt, Human; identical to SEQ ID NO: 413114

SEQ ID NO: 514253 - RNA, 64 nt, Human; identical to SEQ ID NO: 412760

SEQ ID NO: 514254 - RNA, 64 nt, Human; identical to SEQ ID NO: 412761

SEQ ID NO: 514255 - RNA, 64 nt, Human; identical to SEQ ID NO: 410540

SEQ ID NO: 514256 - RNA, 64 nt, Human; identical to SEQ ID NO: 413228

SEQ ID NO: 514257 - RNA, 64 nt, Human; identical to SEQ ID NO: 412593

SEQ ID NO: 514258 - RNA, 64 nt, Human; identical to SEQ ID NO: 409035

SEQ ID NO: 514259 - RNA, 64 nt, Human; identical to SEQ ID NO: 412611

SEQ ID NO: 514260 - RNA, 64 nt, Human; identical to SEQ ID NO: 412612

SEQ ID NO: 514261 - RNA, 64 nt, Human; identical to SEQ ID NO: 412613

SEQ ID NO: 514262 - RNA, 64 nt, Human; identical to SEQ ID NO: 412686

SEQ ID NO: 514263 - RNA, 64 nt, Human; identical to SEQ ID NO: 410576

SEQ ID NO: 514264 - RNA, 64 nt, Human; identical to SEQ ID NO: 409036

SEQ ID NO: 514265 - RNA, 64 nt, Human; identical to SEQ ID NO: 412631

SEQ ID NO: 514266 - RNA, 64 nt, Human; identical to SEQ ID NO: 412632

SEQ ID NO: 514267 - RNA, 64 nt, Human; identical to SEQ ID NO: 412649

SEQ ID NO: 514268 - RNA, 64 nt, Human; identical to SEQ ID NO: 409052

SEQ ID NO: 514269 - RNA, 64 nt, Human; identical to SEQ ID NO: 410577

SEQ ID NO: 514270 - RNA, 64 nt, Human; identical to SEQ ID NO: 412651

SEQ ID NO: 514271 - RNA, 64 nt, Human; identical to SEQ ID NO: 412440

SEQ ID NO: 514272 - RNA, 64 nt, Human; identical to SEQ ID NO: 409053

SEQ ID NO: 514273 - RNA, 64 nt, Human; identical to SEQ ID NO: 410593

SEQ ID NO: 514274 - RNA, 64 nt, Human; identical to SEQ ID NO: 412703

SEQ ID NO: 514275 - RNA, 64 nt, Human; identical to SEQ ID NO: 412704

SEQ ID NO: 514276 - RNA, 64 nt, Human; identical to SEQ ID NO: 412705

SEQ ID NO: 514277 - RNA, 64 nt, Human; identical to SEQ ID NO: 409054

SEQ ID NO: 514278 - RNA, 64 nt, Human; identical to SEQ ID NO: 410594

SEQ ID NO: 514279 - RNA, 64 nt, Human; identical to SEQ ID NO: 412722

SEQ ID NO: 514280 - RNA, 64 nt, Human; identical to SEQ ID NO: 412723

SEQ ID NO: 514281 - RNA, 64 nt, Human; identical to SEQ ID NO: 412724

SEQ ID NO: 514282 - RNA, 64 nt, Human; identical to SEQ ID NO: 412857

SEQ ID NO: 514283 - RNA, 64 nt, Human; identical to SEQ ID NO: 409055

SEQ ID NO: 514284 - RNA, 64 nt, Human; identical to SEQ ID NO: 412969

SEQ ID NO: 514285 - RNA, 64 nt, Human; identical to SEQ ID NO: 412327

SEQ ID NO: 514286 - RNA, 64 nt, Human; identical to SEQ ID NO: 409072

SEQ ID NO: 514287 - RNA, 64 nt, Human; identical to SEQ ID NO: 410611

SEQ ID NO: 514288 - RNA, 64 nt, Human; identical to SEQ ID NO: 412329

SEQ ID NO: 514289 - RNA, 64 nt, Human; identical to SEQ ID NO: 412346

SEQ ID NO: 514290 - RNA, 64 nt, Human; identical to SEQ ID NO: 412347

SEQ ID NO: 514291 - RNA, 64 nt, Human; identical to SEQ ID NO: 410612

SEQ ID NO: 514292 - RNA, 64 nt, Human; identical to SEQ ID NO: 409073

SEQ ID NO: 514293 - RNA, 64 nt, Human; identical to SEQ ID NO: 412384

SEQ ID NO: 514294 - RNA, 64 nt, Human; identical to SEQ ID NO: 412385

SEQ ID NO: 514295 - RNA, 64 nt, Human; identical to SEQ ID NO: 410613

SEQ ID NO: 514296 - RNA, 64 nt, Human; identical to SEQ ID NO: 409074

SEQ ID NO: 514297 - RNA, 64 nt, Human; identical to SEQ ID NO: 412366

SEQ ID NO: 514298 - RNA, 64 nt, Human; identical to SEQ ID NO: 412367

SEQ ID NO: 514299 - RNA, 64 nt, Human; identical to SEQ ID NO: 412442

SEQ ID NO: 514300 - RNA, 64 nt, Human; identical to SEQ ID NO: 410629

SEQ ID NO: 514301 - RNA, 64 nt, Human; identical to SEQ ID NO: 412403

SEQ ID NO: 514302 - RNA, 64 nt, Human; identical to SEQ ID NO: 409075

SEQ ID NO: 514303 - RNA, 64 nt, Human; identical to SEQ ID NO: 412403

SEQ ID NO: 514304 - RNA, 62 nt, Human; identical to SEQ ID NO: 174733

SEQ ID NO: 514305 - RNA, 64 nt, Human; identical to SEQ ID NO: 412423

SEQ ID NO: 514306 - RNA, 64 nt, Human; identical to SEQ ID NO: 410630

SEQ ID NO: 514307 - RNA, 62 nt, Human; identical to SEQ ID NO: 466895

SEQ ID NO: 514308 - RNA, 62 nt, Human; identical to SEQ ID NO: 466896

SEQ ID NO: 514309 - RNA, 62 nt, Human; identical to SEQ ID NO: 466929

SEQ ID NO: 514310 - RNA, 62 nt, Human; identical to SEQ ID NO: 466930

SEQ ID NO: 514311 - RNA, 62 nt, Human; identical to SEQ ID NO: 466931

SEQ ID NO: 514312 - RNA, 62 nt, Human; identical to SEQ ID NO: 463045

SEQ ID NO: 514313 - RNA, 62 nt, Human; identical to SEQ ID NO: 466932

SEQ ID NO: 514314 - RNA, 62 nt, Human; identical to SEQ ID NO: 467009

SEQ ID NO: 514315 - RNA, 62 nt, Human; identical to SEQ ID NO: 467010

SEQ ID NO: 514316 - RNA, 62 nt, Human; identical to SEQ ID NO: 467011

SEQ ID NO: 514317 - RNA, 62 nt, Human; identical to SEQ ID NO: 463062

SEQ ID NO: 514318 - RNA, 62 nt, Human; identical to SEQ ID NO: 466969

SEQ ID NO: 514319 - RNA, 62 nt, Human; identical to SEQ ID NO: 466442

SEQ ID NO: 514320 - RNA, 62 nt, Human; identical to SEQ ID NO: 466553

SEQ ID NO: 514321 - RNA, 62 nt, Human; identical to SEQ ID NO: 463037

SEQ ID NO: 514322 - RNA, 62 nt, Human; identical to SEQ ID NO: 467319

SEQ ID NO: 514323 - RNA, 62 nt, Human; identical to SEQ ID NO: 467320

SEQ ID NO: 514324 - RNA, 62 nt, Human; identical to SEQ ID NO: 463063

SEQ ID NO: 514325 - RNA, 62 nt, Human; identical to SEQ ID NO: 466989

SEQ ID NO: 514326 - RNA, 62 nt, Human; identical to SEQ ID NO: 466990

SEQ ID NO: 514327 - RNA, 62 nt, Human; identical to SEQ ID NO: 466991

SEQ ID NO: 514328 - RNA, 62 nt, Human; identical to SEQ ID NO: 463038

SEQ ID NO: 514329 - RNA, 52 nt, Human; identical to SEQ ID NO: 467012

SEQ ID NO: 514330 - RNA, 62 nt, Human; identical to SEQ ID NO: 466778

SEQ ID NO: 514331 - RNA, 62 nt, Human; identical to SEQ ID NO: 463064

SEQ ID NO: 514332 - RNA, 62 nt, Human; identical to SEQ ID NO: 467029

SEQ ID NO: 514333 - RNA, 62 nt, Human; identical to SEQ ID NO: 467030

SEQ ID NO: 514334 - RNA, 62 nt, Human; identical to SEQ ID NO: 467031

SEQ ID NO: 514335 - RNA, 62 nt, Human; identical to SEQ ID NO: 463039

SEQ ID NO: 514336 - RNA, 62 nt, Human; identical to SEQ ID NO: 467049

SEQ ID NO: 514337 - RNA, 62 nt, Human; identical to SEQ ID NO: 467050

SEQ ID NO: 514338 - RNA, 62 nt, Human; identical to SEQ ID NO: 467051

SEQ ID NO: 514339 - RNA, 62 nt, Human; identical to SEQ ID NO: 463065

SEQ ID NO: 514340 - RNA, 62 nt, Human; identical to SEQ ID NO: 467052

SEQ ID NO: 514341 - RNA, 62 nt, Human; identical to SEQ ID NO: 466817

SEQ ID NO: 514342 - RNA, 62 nt, Human; identical to SEQ ID NO: 463040

SEQ ID NO: 514343 - RNA, 62 nt, Human; identical to SEQ ID NO: 466819

SEQ ID NO: 514344 - RNA, 62 nt, Human; identical to SEQ ID NO: 463082

SEQ ID NO: 514345 - RNA, 62 nt, Human; identical to SEQ ID NO: 467111

SEQ ID NO: 514346 - RNA, 62 nt, Human; identical to SEQ ID NO: 467112

SEQ ID NO: 514347 - RNA, 62 nt, Human; identical to SEQ ID NO: 466758

SEQ ID NO: 514348 - RNA, 62 nt, Human; identical to SEQ ID NO: 466759

SEQ ID NO: 514349 - RNA, 62 nt, Human; identical to SEQ ID NO: 466760

SEQ ID NO: 514350 - RNA, 62 nt, Human; identical to SEQ ID NO: 463041

SEQ ID NO: 514351 - RNA, 62 nt, Human; identical to SEQ ID NO: 467129

SEQ ID NO: 514352 - RNA, 62 nt, Human; identical to SEQ ID NO: 467185

SEQ ID NO: 514353 - RNA, 62 nt, Human; identical to SEQ ID NO: 467186

SEQ ID NO: 514354 - RNA, 62 nt, Human; identical to SEQ ID NO: 466722

SEQ ID NO: 514355 - RNA, 62 nt, Human; identical to SEQ ID NO: 463042

SEQ ID NO: 514356 - RNA, 62 nt, Human; identical to SEQ ID NO: 466724

SEQ ID NO: 514357 - RNA, 62 nt, Human; identical to SEQ ID NO: 463084

SEQ ID NO: 514358 - RNA, 62 nt, Human; identical to SEQ ID NO: 467148

SEQ ID NO: 514359 - RNA, 62 nt, Human; identical to SEQ ID NO: 467149

SEQ ID NO: 514360 - RNA, 62 nt, Human; identical to SEQ ID NO: 467261

SEQ ID NO: 514361 - RNA, 62 nt, Human; identical to SEQ ID NO: 466702

SEQ ID NO: 514362 - RNA, 62 nt, Human; identical to SEQ ID NO: 466703

SEQ ID NO: 514363 - RNA, 62 nt, Human; identical to SEQ ID NO: 463043

SEQ ID NO: 514364 - RNA, 62 nt, Human; identical to SEQ ID NO: 463101

SEQ ID NO: 514365 - RNA, 62 nt, Human; identical to SEQ ID NO: 466644

SEQ ID NO: 514366 - RNA, 62 nt, Human; identical to SEQ ID NO: 466645

SEQ ID NO: 514367 - RNA, 62 nt, Human; identical to SEQ ID NO: 466646

SEQ ID NO: 514368 - RNA, 62 nt, Human; identical to SEQ ID NO: 466647

SEQ ID NO: 514369 - RNA, 62 nt, Human; identical to SEQ ID NO: 466725

SEQ ID NO: 514370 - RNA, 62 nt, Human; identical to SEQ ID NO: 463044

SEQ ID NO: 514371 - RNA, 62 nt, Human; identical to SEQ ID NO: 463102

SEQ ID NO: 514372 - RNA, 62 nt, Human; identical to SEQ ID NO: 466664

SEQ ID NO: 514373 - RNA, 62 nt, Human; identical to SEQ ID NO: 466665

SEQ ID NO: 514374 - RNA, 62 nt, Human; identical to SEQ ID NO: 466666

SEQ ID NO: 514375 - RNA, 62 nt, Human; identical to SEQ ID NO: 466667

SEQ ID NO: 514376 - RNA, 62 nt, Human; identical to SEQ ID NO: 466684

SEQ ID NO: 514377 - RNA, 62 nt, Human; identical to SEQ ID NO: 466685

SEQ ID NO: 514378 - RNA, 62 nt, Human
acuccagccugguuacagagcaagacucugucucaaacaaaacaaaacaaaacaaaaacaca

SEQ ID NO: 514379 - RNA, 62 nt, Human
auuacauuuuuuuuccaggggagaaaaaaacaucaaacaaaaacaucuaaaucauccuuuuu

SEQ ID NO: 514380 - RNA, 62 nt, Human
uacuucuauauagaagggugcacccuuacagaucaaacaaugguaagcgcucauuuggacaa

SEQ ID NO: 514381 - RNA, 62 nt, Human
augaguuauaaucucuuuaggagagaagauuaucaaacaaaugaaacaaguaaaggaagaaa

SEQ ID NO: 514382 - RNA, 62 nt, Human; identical to SEQ ID NO: 344008

SEQ ID NO: 514383 - RNA, 62 nt, Human
aggaacuaucugccuguguccucaaucucccuucaaacaagaugcugauuuguaggguacuu

SEQ ID NO: 514384 - RNA, 62 nt, Human
uguaauuuuggaauuucugguccugggaagaaucaaacaaaaucuuaaguucuaugagaacu

SEQ ID NO: 514385 - RNA, 62 nt, Human
aaaaguuaagcuuuugcaaaguugucaaaaguucaaacaaaagucuaguugggauuuuuuac

SEQ ID NO: 514386 - RNA, 62 nt, Human
acuucucugccugguuuuguguguucuguuauucaaacaauaaaaagcugguggaacuuacu

SEQ ID NO: 514387 - RNA, 62 nt, Human
auccaucuugucaaacacuuguccuuuguguuucaaacaauccaauuauacuguuaguuauu

SEQ ID NO: 514388 - RNA, 62 nt, Human
uuccagccucaccacucacaagcugugugacuucaaacaaaugaaaucagugcccagaaccu

SEQ ID NO: 514389 - RNA, 62 nt, Human
aacccacuugucaguucaguaaaauaauuuggucaaacaacagucuauugcauugauuuaua

SEQ ID NO: 514390 - RNA, 62 nt, Human
ggguacacugagggagaaaggaaaaggaaacuucaaacaauauagaauuaaauguaaaagga

SEQ ID NO: 514391 - RNA, 62 nt, Human
aagaaacaacaugaaugagcaacuucagagugucaaacaacugccauuaaacuuaacucaaa

SEQ ID NO: 514392 - RNA, 62 nt, Human
cauuuuuacaaucuuauauuaaacugguauuuucaaacaauaggaaacuuuuuuuuuuuuuu

SEQ ID NO: 514393 - RNA, 62 nt, Human
gugcaugcuaaaaaccuguauuuucaugcuuuucaaacaacaugaauagucagcugacuaaa

SEQ ID NO: 514394 - RNA, 62 nt, Human
ggguguuucuguagcaaguuuucauauucuuuucaaacaaugguuucucugcguuaauuauu

SEQ ID NO: 514395 - RNA, 62 nt, Human
uuccucccucuucaucaacauaguaaaauaagucaaacaaaaugagaacaccaaauuuuggg

SEQ ID NO: 514396 - RNA, 62 nt, Human
gucugggaagugaaguucuacuccucuuggcaucaaacaagguuugggaguguaggaggugc

SEQ ID NO: 514397 - RNA, 62 nt, Human
guggcaaaaauaaugacauguagcaaagauuuucaaacaaaauauuuuuuccuuuuguaaaa

SEQ ID NO: 514398 - RNA, 62 nt, Human
cuccaaccugggcaacagaacaagaacccaucucaaacaaacaaacaaacaaaaaaaaaaaa

SEQ ID NO: 514399 - RNA, 62 nt, Human
gacuguaacacauuuguuucaagucuuuggauucaaacaaccggauuguauuaaaauugaca

SEQ ID NO: 514400 - RNA, 62 nt, Human
guauaguagauaaauaaaauccaaggcaauuuucaaacaauuuuuuuaaacuuuggaaugug

SEQ ID NO: 514401 - RNA, 62 nt, Human
auuuuaaaguacuuuugguuauuuuucugucaucaaacaaaaacagguaucagugcauuauu

SEQ ID NO: 514402 - RNA, 62 nt, Human
cuccagccugggcaacagagugagacccugucucaaacaaacaacaacaguaacaacaaaaa

SEQ ID NO: 514403 - RNA, 62 nt, Human
guagaaaauuugauaaucugaaucaccagcauucaaacaaauauuucggcaauaaaguuuac

SEQ ID NO: 514404 - RNA, 62 nt, Human
gugacugcuugcugacuuuaucauaauuuucuucaaacaaaaaaauguauagaaaaaucaug

SEQ ID NO: 514405 - RNA, 62 nt, Human
cuuuaaaaugugggcuuuugugaagaccacuuucaaacaagggagcacugaaaccugaauug

SEQ ID NO: 514406 - RNA, 62 nt, Human
uaaucagcuccuggauuuuuuuuuuuuuuuuuucaaacaaugguuugaaacaacuacuggaa

SEQ ID NO: 514407 - RNA, 62 nt, Human
auggaacuuuuuaaaaccuacauuauuuucccucaaacaauuuauuuucacaauucauauuu

SEQ ID NO: 514408 - RNA, 62 nt, Human
caaagggcuaauaaccagaaucuacaaugaacucaaacaaauuuacaagaaaaaaacaaaca

SEQ ID NO: 514409 - RNA, 62 nt, Human
uaggguacuaaauuuaaauuuaaagauauuguucaaacaauaucauaucaucacauugagcu

SEQ ID NO: 514410 - RNA, 62 nt, Human
cuccagccugggcgacagagugagacuccaucucaaacaacaacaacaacaacaacaacaac

SEQ ID NO: 514411 - RNA, 62 nt, Human
gaaaacaaaauaugaaaagaaucggcaauguuucaaacaaaaagucauaaaagucacuuuau

SEQ ID NO: 514412 - RNA, 62 nt, Human
uguacguucuaauugagagcauuccaguaguaucaaacaauaaugucuacuguuuauagucc

SEQ ID NO: 514413 - RNA, 62 nt, Human
cuacaucucuauacuguacacucacccauaauucaaacaauuacaccaugguauaaaguggg

SEQ ID NO: 514414 - RNA, 62 nt, Human
cguauguuuacaaaccacuucacuggaagacgucaaacaagcugaaugaaggggcgcuuaga

SEQ ID NO: 514415 - RNA, 62 nt, Human
aguaucaucagugaagaauuguauuucaagauucaaacaauaaccagcaauuaaacuuuuuu

SEQ ID NO: 514416 - RNA, 62 nt, Human
auuuaauugcucacuuauucugaaagcuuuguucaaacaagaugauauuaaauuuguuuuca

SEQ ID NO: 514417 - RNA, 62 nt, Human
uuauuuucucugcuuuguguuauuuuuucuuaucaaacaauuagauguuauguuucauauua

SEQ ID NO: 514418 - RNA, 62 nt, Human
uuaaguuacaaaagacuuuucaucagaaaauuucaaacaaaguaaacauggcguuuuauagu

SEQ ID NO: 514419 - RNA, 62 nt, Human
caaccccguuuuuaagcaauggaacucuuucuucaaacaaaagcuuaugcagaacaucucug

SEQ ID NO: 514420 - RNA, 62 nt, Human
cuccagccugggcgacagagcgagacuucgucucaaacaaacaaaaaaauuagccgggcaug

SEQ ID NO: 514421 - RNA, 62 nt, Human
gcuagcaaaugaguuuuagcggggacaaaaaaucaaacaaaaaagugaaugcuuagaaccuu

SEQ ID NO: 514422 - RNA, 62 nt, Human
acugaaaacuucauucuuggguuaacaguaucucaaacaauugaagucaauuacucuauaau

SEQ ID NO: 514423 - RNA, 62 nt, Human
auuagacgcaggaaugcuacuaggaauuggaaucaaacaaugccaccccaagcguaauuuua

SEQ ID NO: 514424 - RNA, 62 nt, Human
aauuauuacagggagcuauugaucuacuagcaucaaacaaaggcaagcucuaauuccacagg

SEQ ID NO: 514425 - RNA, 62 nt, Human
aauaaaaaauccagaaccacacagcccuauggucaaacaauccuacguuugugccucugcuu

SEQ ID NO: 514426 - RNA, 62 nt, Human
ugcccaauuggaggaaagcaaccgguggauccucaaacaacacuggugugaccugagggcag

SEQ ID NO: 514427 - RNA, 62 nt, Human
uuuauuugaggggggaagagugcuguacaaagucaaacaaacaaguuuacaguuguaagugc

SEQ ID NO: 514428 - RNA, 62 nt, Human
ugggcagaggagcaagccccucgaacaugauuucaaacaagcagguccucuucucucaucuc

SEQ ID NO: 514429 - RNA, 62 nt, Human
uguuaacuaugaggaugugcugguuuguugaaucaaacaaaaggaaauguuguggaauauuu

SEQ ID NO: 514430 - RNA, 62 nt, Human
ggaucaaauuucaacaugagauuuggaggaggucaaacaaacuaaacuguagcaguguuuca

SEQ ID NO: 514431 - RNA, 62 nt, Human
uuuuaaguucaguucucccuuauggcugccuuucaaacaaguaccuuuuaucugaugccugu

SEQ ID NO: 514432 - RNA, 62 nt, Human
ccuuugcucaugacuccuguagggaaguuucuucaaacaaaacccagcuccugagucuccag

SEQ ID NO: 514433 - RNA, 62 nt, Human
augcugcugaaagcaaaugaauguggaggguuucaaacaagacaaaaggcauuccucccugc

SEQ ID NO: 514434 - RNA, 62 nt, Human
uuagccugggcaacagugagugagacucggucucaaacaaaaaccaaauugggaaauucuuc

SEQ ID NO: 514435 - RNA, 62 nt, Human
gcuauucuaccuuaguauuucacauuuguaguucaaacaagcgauuguccaucuguugccua

SEQ ID NO: 514436 - RNA, 62 nt, Human
ucggcagaacugaugugagguaagugagcaugucaaacaaaauaggagcucacauggauaua

SEQ ID NO: 514437 - RNA, 62 nt, Human
uuuguuuuuuuuuuaguucuuauuccggagccucaaacaagcauuauaccuucugugauuau

SEQ ID NO: 514438 - RNA, 62 nt, Human
uuuuaucugcugcuuauuuguggaaugaaaccucaaacaaacccaaagggggaggguagggc

SEQ ID NO: 514439 - RNA, 62 nt, Human
acccacaggugccaugugcacacuccugguuuucaaacaauucucuggauuuauuuauuugu

SEQ ID NO: 514440 - RNA, 62 nt, Human
gcccuuaggaagaauuuuuauauccacuaaaaucaaacaauucagggagugggcuaagcacg

SEQ ID NO: 514441 - RNA, 62 nt, Human
uuucccaagugucuggauggauggagagguacucaaacaaguuacuuucaguuguccugcug

SEQ ID NO: 514442 - RNA, 62 nt, Human
accccaaaucagaccaucugagcccacuacuaucaaacaaacaaacaaaaacuguuaauaua

SEQ ID NO: 514443 - RNA, 62 nt, Human
cuauguuuuuuucagaaagcaaggaaguaaacucaaacaaaagugcguguaauuaaauacua

SEQ ID NO: 514444 - RNA, 62 nt, Human
cuuuaaagagcuucuuuggcucuagaaaaauuucaaacaauuaaaauaagaaaaaauuuuaa

SEQ ID NO: 514445 - RNA, 62 nt, Human
uucaaucuuaucaacgcuacauuuuguauuuuucaaacaaguauaaauucugcaauaaagag

SEQ ID NO: 514446 - RNA, 62 nt, Human
aaaguaaccguaaccucacacauuaacuuuauucaaacaaacagcacuuacaggaaauguaa

SEQ ID NO: 514447 - RNA, 62 nt, Human
uagaaaauaaguaagaacuauuuuuaaaauauucaaacaaaacuaaaacaaaaauccagugu

SEQ ID NO: 514448 - RNA, 62 nt, Human
aauauugaagacauuguauuaccacuugugauucaaacaauuuugugguuaaaacuggauuu

SEQ ID NO: 514449 - RNA, 62 nt, Human
aguauccuggucuuaaucagguauugcaguguucaaacaagguauggacacaucaacauauu

SEQ ID NO: 514450 - RNA, 62 nt, Human
guuuuaguuagaugauaaaccaggguuuuaaaucaaacaauguagcauaaagugguauugaa

SEQ ID NO: 514451 - RNA, 62 nt, Human
uuaauugaggacagccugguuuucacauacacucaaacaaucaugagucagacauuugguau

SEQ ID NO: 514452 - RNA, 62 nt, Human
aaauguuugcuaccuuaguuuaaaaaacaaucucaaacaaaagacuugcuucaagguguuuu

SEQ ID NO: 514453 - RNA, 62 nt, Human
uugccaaauauuuacuucaggagcaaagauuuucaaacaagcauacacgaugcaaaauacca

SEQ ID NO: 514454 - RNA, 62 nt, Human
auguugggaaauucccucagaguguggguccuucaaacaauguaaaccaccaucuucuauuc

SEQ ID NO: 514455 - RNA, 62 nt, Human
ucaguagcguccuauggaugucacauuguacaucaaacaaccuugugauuauaaaacgaucc

SEQ ID NO: 514456 - RNA, 62 nt, Human
aaauugggaaagaaaacucacuugagucuugaucaaacaagugucuuuuacuuaagaagaaa

SEQ ID NO: 514457 - RNA, 62 nt, Human
auaaauguguauagcucaguuuggauaauuggucaaacaauuuuuuauccaguaguaaaaua

SEQ ID NO: 514458 - RNA, 62 nt, Human
auuuaccuaguauuaugaaagaaugaaggaguucaaacaaauguguuucccaguuaacuagg

SEQ ID NO: 514459 - RNA, 62 nt, Human
cuccagccuggaugacagagugagaccuugucucaaacaaaacaaaacaaaaaugaaauguu

SEQ ID NO: 514460 - RNA, 62 nt, Human
gcaguacauuauauuauucuguacaaaggcuuucaaacaaaauuuuuaaaauaauaaaguau

SEQ ID NO: 514461 - RNA, 62 nt, Human
acuucuuauggugcuauuccauaaacuuuuuuucaaacaaguuuuugaccuuugagccaacc

SEQ ID NO: 514462 - RNA, 62 nt, Human
uccuuuauuucaaugauucucagaaggccaauucaaacaaacccacauuuaagguucuuuag

SEQ ID NO: 514463 - RNA, 62 nt, Human
uucaauaaucucaccuuaaaagugaccccuuuucaaacaaagcauaaacaauuuauuugugg

SEQ ID NO: 514464 - RNA, 62 nt, Human
gguuaauuuaaacuuaccuaagaagaugagaaucaaacaaaacagauaugcuuacucuaguu

SEQ ID NO: 514465 - RNA, 62 nt, Human
uuaaaaugcauugcugagaaacguugcuuucaucaaacaagaauaaauauuuuucagaaguu

SEQ ID NO: 514466 - RNA, 62 nt, Human
guacauuugaaauaaaaaccaaauuuuuagauucaaacaaucccuuuauccuuaauuuaauu

SEQ ID NO: 514467 - RNA, 62 nt, Human
ugacuuguacucugaaaguuuuggaaacguauucaaacaauuugaauauaaauuuaucauuu

SEQ ID NO: 514468 - RNA, 62 nt, Human
uuucacuuaaguauugucaccaggauuacuagucaaacaaaaaagaaaaguagaaaggaggu

SEQ ID NO: 514469 - RNA, 62 nt, Human
uggugacacuaauguucuacuauagcuuauuuucaaacaagggguaaaaaaaggaaagaaag

SEQ ID NO: 514470 - RNA, 62 nt, Human
uucaggggaggcuguuuacccaggcaauguccucaaacaagccugugccgggguguccugga

SEQ ID NO: 514471 - RNA, 62 nt, Human
uuauuaugcaaugccuuagucauaaacugggcucaaacaauucucagccuaaaacacuguug

SEQ ID NO: 514472 - RNA, 62 nt, Human
ccuaucaaagucccaucucuuaacccuggguaucaaacaaacugugaguuuuccagaaucug

SEQ ID NO: 514473 - RNA, 62 nt, Human
uuacaacuuaacuuuccaaguuuauauccuagucaaacaaaauuuacuugguugguccaaau

SEQ ID NO: 514474 - RNA, 62 nt, Human
gagaaauucccugaauuucuuuaguuuuguauucaaacaauuaugccacucgaugcaacaaa

SEQ ID NO: 514475 - RNA, 62 nt, Human
ucuuagcucacugcaaccucugcuuccuggguucaaacaauucucaugccucagccucccaa

SEQ ID NO: 514476 - RNA, 62 nt, Human
gaggaagucuggguuuuaugaauagcauagauucaaacaaucuuuuauucaaagauugaaau

SEQ ID NO: 514477 - RNA, 62 nt, Human
cauuagagaacauccuggcuuuugagcacuuuucaaacaaucaaguugacucacgugggucc

SEQ ID NO: 514478 - RNA, 62 nt, Human
acagaugaaaugauuugccugaggccguaucaucaaacaagaaauucauauucaccuuucug

SEQ ID NO: 514479 - RNA, 62 nt, Human
uuguucucagucccaaacugaaacuauaccauucaaacaacagcgcuccccauuucccccuc

SEQ ID NO: 514480 - RNA, 62 nt, Human
aaucccacuucagugcaccuguggccucucagucaaacaaguugugccuuucacagcuucuu

SEQ ID NO: 514481 - RNA, 62 nt, Human
augcuuucaaggguaaccagauuuaagaaucuucaaacaauacacuguuaccuuuugacugu

SEQ ID NO: 514482 - RNA, 62 nt, Human
cuguaauuucacuaacuuuuuauucaugcacuucaaacaaacuuuacuacuacauuauauga

SEQ ID NO: 514483 - RNA, 62 nt, Human
aguaaguuugugaauuugucaacuuucgagcaucaaacaaauauuuuacuuaaauuuuauuu

SEQ ID NO: 514484 - RNA, 62 nt, Human
gacacuucauggaccaagaaugagcugguuugucaaacaacaugugagcauggucacaagca

SEQ ID NO: 514485 - RNA, 62 nt, Human
aagcaugaaauguauauguguaauguuuuaugucaaacaauuaugcuuaauauacagucuau

SEQ ID NO: 514486 - RNA, 62 nt, Human
aagcaggaaaugugcauguguaaugguuuaugucaaacaauuaugcuuaauauaaagucuau

SEQ ID NO: 514487 - RNA, 62 nt, Human
cacugcaugccuugacuucccccaccuccuccucaaacaagagacuccacugcauguuccaa

SEQ ID NO: 514488 - RNA, 62 nt, Human
cuccagccugggugacagagcgagacuccgucucaaacaaacaaacaaaaaacuguuuucau

SEQ ID NO: 514489 - RNA, 62 nt, Human
uuaguuuuaucaguagucuuaaaguguugaucucaaacaaguacauuagaaaaaucauguuu

SEQ ID NO: 514490 - RNA, 62 nt, Human
ccuuuaauauaucagugcuccaguauauaaccucaaacaaauguaaauagaacgaauuauuu

SEQ ID NO: 514491 - RNA, 62 nt, Human
uuaauacuagugucauagauacuuuuuguacaucaaacaauugaucaugugcuguaaaggaa

SEQ ID NO: 514492 - RNA, 62 nt, Human
uugguugcaagaaugaauacugacuucagaacucaaacaauggaagaacuugcauuuuuaug

SEQ ID NO: 514493 - RNA, 62 nt, Human
caaagacucuuaacguaggauauauguucuguucaaacaagagaaaguaacucuacccaugc

SEQ ID NO: 514494 - RNA, 62 nt, Human
uucacucuaccuucuagguuccugaaguauuuucaaacaaaccaccaacaggagauauugag

SEQ ID NO: 514495 - RNA, 62 nt, Human
cuguggauucuuuaaaccugugugcuaauaauucaaacaauguugcauuaauuguauaaggg

SEQ ID NO: 514496 - RNA, 62 nt, Human
aauaauacauaguuucuguuaagggaauucucucaaacaaaaggaaagcgauuuuucucaau

SEQ ID NO: 514497 - RNA, 62 nt, Human
ucuuuugugaagaaagcggguccaaaugugauucaaacaacuguacggaguggcauauuaga

SEQ ID NO: 514498 - RNA, 62 nt, Human
auuacuuaauaaucucacauacugaauacuagucaaacaaguuuuuaaauguuucuuugggu

SEQ ID NO: 514499 - RNA, 62 nt, Human
aucuacauaucugucaucuaaauaaauggcuuucaaacaaagcaacugggucauuaaaacca

SEQ ID NO: 514500 - RNA, 52 nt, Human; identical to SEQ ID NO: 344160

SEQ ID NO: 514501 - RNA, 62 nt, Human
agaccgaacccccucaccugaaucccccucuaucaaacaaacaaaaaagcagcaguaaagag

SEQ ID NO: 514502 - RNA, 62 nt, Human
guagauauuaaccuuaaaaaggguuuucauucucaaacaagaugcuuuguucuccaacaaga

SEQ ID NO: 514503 - RNA, 62 nt, Human
acccaacaaugaauaucaaguauagauuugacucaaacaauuguaauuuuugaaauaaacua

SEQ ID NO: 514504 - RNA, 62 nt, Human
ucucagcucccugcaaccuccaccuccuggguucaaacaauucuccugccucagccucccga

SEQ ID NO: 514505 - RNA, 62 nt, Human
uuacuucuagaauuagaccaacaauuuauaaaucaaacaaacccaagagcauugaaauuuug

SEQ ID NO: 514506 - RNA, 62 nt, Human
auuguaaauauugguauuuugaauguuaaaugucaaacaaaugugacuuaugcuggugcccu

SEQ ID NO: 514507 - RNA, 62 nt, Human
ccauguucuuuugcucuuuuggggaugggacaucaaacaaaagucucuucguguauaucuca

SEQ ID NO: 514508 - RNA, 62 nt, Human
cuccagccugggcaacagagcgagacuccaucucaaacaaaaacaagaacaaaaacaaacau

SEQ ID NO: 514509 - RNA, 62 nt, Human
ggaaugacaugaaugcugcuaaaggacuggacucaaacaaaaacgaggucaaucaugccauu

SEQ ID NO: 514510 - RNA, 62 nt, Human
cauucuccucucccugacuggugucagauucaucaaacaaaaaauaaaucucgaagaaaaaa

SEQ ID NO: 514511 - RNA, 62 nt, Human
acuccagccuggcaacagagcuagaauccgucucaaacaaacaaacaaaaaaucccacagcu

SEQ ID NO: 514512 - RNA, 62 nt, Human
acauuugucaguauuuuugccggcuggugaauucaaacaaccugcccaaagauugauuugug

SEQ ID NO: 514513 - RNA, 62 nt, Human
gcaccuaucaagaaucaagagaauagauuguaucaaacaacggcagggaaauccuucagcaa

SEQ ID NO: 514514 - RNA, 62 nt, Human
aaguguuauuuguaaguuaauuuuuuuacaagucaaacaauguuggaagugguauuuagguu

SEQ ID NO: 514515 - RNA, 62 nt, Human
gguguuuuuagacucauauaauuuguuauuuuucaaacaauagugaauaauuaauauuuuug

SEQ ID NO: 514516 - RNA, 62 nt, Human
gauucccacccaauucaaaacauugugccaugucaaacaaauagucuaucaaccccagacac

SEQ ID NO: 514517 - RNA, 62 nt, Human
uggguguacucuggccucuugguucauuauuuucaaacaagcacacuuguacaauuauuuuc

SEQ ID NO: 514518 - RNA, 62 nt, Human
aaugagaaaaaguuuaaaauucucaauacaaaucaaacaauuuaaauauuuuaagaaaaaag

SEQ ID NO: 514519 - RNA, 62 nt, Human
ggcugagccauucaaagagcaucaucuguucuucaaacaaauguuggucacccacucucucc

SEQ ID NO: 514520 - RNA, 62 nt, Human
uagggcucacacauuuagaagaauuagauuuaucaaacaacagucugcaaaacuuugacuau

SEQ ID NO: 514521 - RNA, 62 nt, Human
uuuguuuugucauuuacgugaccauuugauucucaaacaaaaguuguuccaaacaaaaugau

SEQ ID NO: 514522 - RNA, 62 nt, Human
uaauaugugcauuguaaaauaaaugccauauuucaaacaaaacacguaauuuuuuuacagua

SEQ ID NO: 514523 - RNA, 62 nt, Human
ggagugucugagcugcauuaccucuagaaaccucaaacaaguagaaacuugccuagacaaua

SEQ ID NO: 514524 - RNA, 62 nt, Human
ccaaagugcaacauuuuccgaugcuuuagaaaucaaacaaaccagggacauuguucagaugu

SEQ ID NO: 514525 - RNA, 62 nt, Human
uccuggaacuugcucucauuuuccugggugcaucaaacaaaacaaaaaccaaacacccagag

SEQ ID NO: 514526 - RNA, 62 nt, Human
aguuuagcaguuaaaaguguauuuuuguuuaaucaaacaauaauaaagagagauuuguggaa

SEQ ID NO: 514527 - RNA, 62 nt, Human
gcagacuuucaauguuagcaauuaagcuguugucaaacaaucagucaugagcuuuguuaauu

SEQ ID NO: 514528 - RNA, 62 nt, Human
uuugcauuaguuaaaaaguuaguauauaggcaucaaacaaccuuggcuguaaccuauagaau

SEQ ID NO: 514529 - RNA, 62 nt, Human
gaacaacauuaauggagaugcacaaugauuauucaaacaagcuauauauauguacaaaggca

SEQ ID NO: 514530 - RNA, 62 nt, Human
cuccagccugggugacagggcaagacucugucucaaacaaauaaaaauccccucuccuaaac

SEQ ID NO: 514531 - RNA, 62 nt, Human
ccuaauccucacucuuuucuuccuaaucuucaucaaacaaaaaaugaaaagucugucuggac

SEQ ID NO: 514532 - RNA, 50 nt, Human; identical to SEQ ID NO: 344202

SEQ ID NO: 514533 - RNA, 62 nt, Human
auggaacuuuuuaaaaccuacguuauuuucccucaaacaauuuauuuucacaauucauauuu

SEQ ID NO: 514534 - RNA, 62 nt, Human
aaaaguccaaauguuuagcuuaggucugagagucaaacaauguuaaggauugucuuaaaguu

SEQ ID NO: 514535 - RNA, 62 nt, Human
ugaacaauaaauucuagaagaguugccuugauucaaacaaguauaauucucaaguuaucaca

SEQ ID NO: 514536 - RNA, 62 nt, Human
uaugcuguuuauauugucauuaaauuauacaaucaaacaaaugccaaaugaauugccuaauu

SEQ ID NO: 514537 - RNA, 62 nt, Human
guuaccccaaagcaaaaccauugugucaggagucaaacaaauguuuagaaagcaaacaugac

SEQ ID NO: 514538 - RNA, 62 nt, Human
cuugggcuuuguugcuuuuggcaaaagguacuucaaacaagggagggccuggacugaggggg

SEQ ID NO: 514539 - RNA, 62 nt, Human
aauuugugguaauacauggucacaaccguggaucaaacaaggucagucuaaaguggcagguc

SEQ ID NO: 514540 - RNA, 62 nt, Human
ccgguuuuccuccccgcccugucccucucuggucaaacaacauacuaaagaggcgaggcaau

SEQ ID NO: 514541 - RNA, 62 nt, Human
aaaugaugcaaccaaaagggaaaaaauaaaaaucaaacaaccuucagcuuuauuuuucuuua

SEQ ID NO: 514542 - RNA, 62 nt, Human
aucguguaacacaaauaaugauauuaaaagcaucaaacaagccagccucagcucccucccug

SEQ ID NO: 514543 - RNA, 62 nt, Human
ugcgggggacccuccccagcccauuccugcugucaaacaaacaaaaccuugcaaagcgcugg

SEQ ID NO: 514544 - RNA, 62 nt, Human
auuuagaacaugguaagccugguauuuuuuaaucaaacaaaauauuuaugaaauggguuuuc

SEQ ID NO: 514545 - RNA, 62 nt, Human
cauuuaagccaucagacgaacacaagagaggcucaaacaagaaauucacuguguacacucuc

SEQ ID NO: 514546 - RNA, 62 nt, Human
uauucuugcccuucccccaaccaguuuguuaaucaaacaauaaaaacauguuuuuuuuuuuu

SEQ ID NO: 514547 - RNA, 62 nt, Human
aagcucuggaagcccacacuauuuguuggugaucaaacaaagaaacaggugaugaggaugug

SEQ ID NO: 514548 - RNA, 62 nt, Human
aaauguaaguagauuguagauacuguuuuauaucaaacaauguuuauaauguguauauagaa

SEQ ID NO: 514549 - RNA, 62 nt, Human
augcacuuuuccccacauauggggcacuggcuucaaacaauucaguucaguaucauuacuuu

SEQ ID NO: 514550 - RNA, 62 nt, Human
aguggaggaaagcccauuccagcuguugccugucaaacaaauagaagauggaucucuagcuc

SEQ ID NO: 514551 - RNA, 62 nt, Human
aguguguggaggacacccugaaccccccgcuuucaaacaaguuuucaaauuguuugagguca

SEQ ID NO: 514552 - RNA, 62 nt, Human
acuggggcauauaaaaaagucaaaaaucaaaaucaaacaacaaguucugaguuacuuaggaa

SEQ ID NO: 514553 - RNA, 62 nt, Human
uuuuaagauaagagggggaaaaacacauaaagucaaacaaauguuuuaaaaauucauaacag

SEQ ID NO: 514554 - RNA, 62 nt, Human
ucccccaccguugucucaugccaguaacaggcucaaacaaugacaaagcagauucagaaaug

SEQ ID NO: 514555 - RNA, 62 nt, Human
aaucugcccuaaaacaguguacaguauuuuucucaaacaaaaacucagaauccagccuuaga

SEQ ID NO: 514556 - RNA, 62 nt, Human
gcauugaauaaauuuuugccauggaaagaacaucaaacaagccacucaucucuacagagaua

SEQ ID NO: 514557 - RNA, 62 nt, Human
guaauaacucacguacucugaagagagcuuggucaaacaauaaaauacauuguuacuaacuu

SEQ ID NO: 514558 - RNA, 62 nt, Human
aacacccugcucuacaauguugcaucaagaguucaaacaacaaaauaaaaaauauuaagagg

SEQ ID NO: 514559 - RNA, 62 nt, Human
uauauauguuuaaacuccaaaguuugggacauucaaacaauguacaugaaauuauaugugug

SEQ ID NO: 514560 - RNA, 62 nt, Human
ggugggagaucaggaaaauaacuuggccuagcucaaacaauauuggauaauccccuccuugg

SEQ ID NO: 514561 - RNA, 62 nt, Human
acuuacaaaaaaaugaagggcaugcugagcacucaaacaauuuguucuuacuuaaaauaaaa

SEQ ID NO: 514562 - RNA, 62 nt, Human
aguuuuauucuugaacuuggacacugaugccaucaaacaauuaacaaauauauuuaaguacu

SEQ ID NO: 514563 - RNA, 62 nt, Human
cauccccacuuuaaaccccaggagacugaaacucaaacaacccugggcaaguaaugugcaaa

SEQ ID NO: 514564 - RNA, 62 nt, Human
uuucgaaugugaagaaguaaauuuagaggaaaucaaacaagcaucacuuuccucaguggaaa

SEQ ID NO: 514565 - RNA, 62 nt, Human
aggacacuccguucccugaaaccguuaaaaaaucaaacaaaaggaccccaaauuaagaaucu

SEQ ID NO: 514566 - RNA, 62 nt, Human
cugccuccccauaggccauuuggacucugccuucaaacaaaggcaguucaguccacaggcau

SEQ ID NO: 514567 - RNA, 62 nt, Human
cacagcuuccccucucuccuccugcccaccugucaaacaaagccagaagcugagcaccaggg

SEQ ID NO: 514568 - RNA, 62 nt, Human
uaguacuuccaaauaaauucauaucuagauuuucaaacaaagccccaagaugaagucuaauu

SEQ ID NO: 514569 - RNA, 62 nt, Human
uaaaaaagcucaauagcaucuuaacgugaagaucaaacaagaacacaacaagccccuacuga

SEQ ID NO: 514570 - RNA, 62 nt, Human
cuagagggaaaugauucaaauuuuuucauaauucaaacaaaaguuauuacacuaaaaguauu

SEQ ID NO: 514571 - RNA, 62 nt, Human
uuguacccauuuuuccuuaaccaacacccaaaucaaacaauuaaaauauacaguguuuuucc

SEQ ID NO: 514572 - RNA, 62 nt, Human
auuuaggaaguuuaagguggugaucuucucuuucaaacaaagauaaaggaauuuauuuuuua

SEQ ID NO: 514573 - RNA, 62 nt, Human
auuccuccuggcuuccuuacaaaacaagccuuucaaacaaucauuguccucaggaaaguugu

SEQ ID NO: 514574 - RNA, 62 nt, Human
uauucacuuugagaaucgguuugacuuugcuuucaaacaaaacaaaaaccucuugcuuuuag

SEQ ID NO: 514575 - RNA, 62 nt, Human
aaucuuuucuagcuuaauauuuuaauucuaauucaaacaacucugagguuuugguuucauua

SEQ ID NO: 514576 - RNA, 62 nt, Human
aucucaguguuuguuaacaaaauacaaagaucucaaacaaaccccuuuuagcuucuccuagc

SEQ ID NO: 514577 - RNA, 62 nt, Human
aaaacuguaccuuagagauuuuccucuagugcucaaacaaauacaaaauaagauccccaagg

SEQ ID NO: 514578 - RNA, 62 nt, Human
cagugggggucuacaacaagaaguguauauuuucaaacaauuuuuuaaugauuuaacaauuu

SEQ ID NO: 514579 - RNA, 62 nt, Human
aagugaaaggucacacuaccauuauuuccccuucaaacaaauaauauuuuuacagaagcagg

SEQ ID NO: 514580 - RNA, 62 nt, Human
ugcaaacugucugaauuugccaugcaagguuuucaaacaauuugcauguuuuucagaugcuu

SEQ ID NO: 514581 - RNA, 62 nt, Human
aaauuaaacuuucuuugaucuguacaaguugaucaaacaaauggggucauucuugucauaug

SEQ ID NO: 514582 - RNA, 62 nt, Human
ugaucauuacacccuaacucuccuuccuuggcucaaacaauauuuucccuauaacaaaggca

SEQ ID NO: 514583 - RNA, 62 nt, Human
uuuauucuuuaauauaaguuacauucugcuccucaaacaaaugcaauuuuuuguguguguuu

SEQ ID NO: 514584 - RNA, 62 nt, Human
ugcaagcaaaccauuuuuccccuuucuuuuauucaaacaauaauuuuugaaacaaaaaagag

SEQ ID NO: 514585 - RNA, 62 nt, Human
aaaaaguaccaaacauuugcauucucagaacaucaaacaaaaaugcccugguggcaaagcua

SEQ ID NO: 514586 - RNA, 62 nt, Human
aauuuauaaauauuugcuuacaguuuuccuauucaaacaauuuguuaggccaauauuuugug

SEQ ID NO: 514587 - RNA, 62 nt, Human
accuauuaaauguguauuuauagucccuccuaucaaacaauuacagagcacaaugauuguca

SEQ ID NO: 514588 - RNA, 62 nt, Human
uuauuaacuucaguaggaaaguuacaucugcaucaaacaauauggcaacaucuauuuauuaa

SEQ ID NO: 514589 - RNA, 62 nt, Human
gaaauguccuaucaauuuuauuuugucaugcuucaaacaauaaagacauuucugcuuuaaaa

SEQ ID NO: 514590 - RNA, 62 nt, Human
auucuucuugcuguuguuuaguuuguuuuuuuucaaacaacccucuaaaaauguaaaaacca

SEQ ID NO: 514591 - RNA, 62 nt, Human
uccagccugggugacacagcaagacucuugucucaaacaaacaggaauuugaguaaauuuua

SEQ ID NO: 514592 - RNA, 62 nt, Human
gcauuuaugccugaaucaaagcugccuucugcucaaacaaaucagauuuauuucacauucuu

SEQ ID NO: 514593 - RNA, 62 nt, Human
uggcauguaguuaucuaaucaagacaccucauucaaacaaaaccugccuuaggaaaauuuaa

SEQ ID NO: 514594 - RNA, 62 nt, Human
gacguccuaguggaccugaugugaaauuccugucaaacaaacaccacuuuucaaugguuugc

SEQ ID NO: 514595 - RNA, 62 nt, Human
agcugauccuugagaaauuuacgcuuagucuaucaaacaagaaaugcuggcuuggcccggug

SEQ ID NO: 514596 - RNA, 62 nt, Human
uacagaauaacucuucuuaacuaaaaaccuagucaaacaaggaagcuguaggugaggagauc

SEQ ID NO: 514597 - RNA, 62 nt, Human
uugguuuuccuaagcccuuucuaacgagagucucaaacaagcggaggcgagggccaauucaa

SEQ ID NO: 514598 - RNA, 62 nt, Human
uacaaguauuuuuaauuaauugggccagcuuuucaaacaaagaugccacauucaaaauaggg

SEQ ID NO: 514599 - RNA, 62 nt, Human
acaguucaauuaagaccauggaaauuuuuauuucaaacaauuagagauggauauuacaacua

SEQ ID NO: 514600 - RNA, 62 nt, Human
auaaaaaacaauaguacugugccucuuucuucucaaacaauggaugacacaaaacuaugaga

SEQ ID NO: 514601 - RNA, 62 nt, Human
cuguguuaguagucugucuugacacacauuguucaaacaaucucaagcacuuguguuuaaaa

SEQ ID NO: 514602 - RNA, 62 nt, Human
uggucauaacgggaagcagaauuaugcuuuauucaaacaaaccugcuucugccucauuuucc

SEQ ID NO: 514603 - RNA, 62 nt, Human
uucaagauauguuuauucuauuauuguaaauuucaaacaauaaauaaauaagaauccaugac

SEQ ID NO: 514604 - RNA, 62 nt, Human
aguggagcugugguucucuugguacuuucuugucaaacaaaaccaauggcucuggguuugga

SEQ ID NO: 514605 - RNA, 62 nt, Human
acgugcguccgccucagcgcgagauuaggaguucaaacaauggugacuucccagagcccgcu

SEQ ID NO: 514606 - RNA, 62 nt, Human
ucuccugcuaacuuuuuuucuuaagcuuucugucaaacaaugagguuguagggggagguagg

SEQ ID NO: 514607 - RNA, 62 nt, Human
ccaugugcaaccaaacaccaccaaaaauaaaaucaaacaaaacuaaguugugaaggaaggga

SEQ ID NO: 514608 - RNA, 62 nt, Human
gcaauuaacugaaagggcaaagucuuaaucaaucaaacaauggaggaaucaccgacuuuaca

SEQ ID NO: 514609 - RNA, 62 nt, Human
augccagcuuccugcgucuaccacucugcagcucaaacaagaagcucagagcugccccuucc

SEQ ID NO: 514610 - RNA, 62 nt, Human
uggacaauguggguuuuugaaauuugcacccuucaaacaaugauuuaucagagaaagggguc

SEQ ID NO: 514611 - RNA, 62 nt, Human
uucuuugaaaguagacguuucagucauucuuuucaaacaaguguuuguguaccuuuugccaa

SEQ ID NO: 514612 - RNA, 62 nt, Human
uuccagccagggugacagagugagaccauguuucaaacaagaaacauuucagaggguaagua

SEQ ID NO: 514613 - RNA, 62 nt, Human
uucagaaaauggaaacuugggccauguguauuucaaacaaaaauaacuuuagauauaucuuu

SEQ ID NO: 514614 - RNA, 62 nt, Human
uggcaggugucauuugcuaguagaauuuguaaucaaacaauaggaggggaaucugugaacgc

SEQ ID NO: 514615 - RNA, 62 nt, Human
agcaggggugcaggauccuguucugagcugggucaaacaaagcagggccgggccuuccugcc

SEQ ID NO: 514616 - RNA, 62 nt, Human
ucucggcucacugcaaccuccgccuccuggauucaaacaauucuccugccucagccuccuga

SEQ ID NO: 514617 - RNA, 62 nt, Human
ucucggcuuauugcaaccuccgcuuccuggguucaaacaauucuccugccucagccuccuga

SEQ ID NO: 514618 - RNA, 62 nt, Human
cacuccggccugggcaacagaggaagacugccucaaacaaacaaaaaacaacaaaccaaacc

SEQ ID NO: 514619 - RNA, 62 nt, Human
cguucuuccagcaaaggcuuccaagguacaacucaaacaagccaugguuccuugaugacaaa

SEQ ID NO: 514620 - RNA, 62 nt, Human
acucccauucucacagguuuccagucagcuuuucaaacaagaauuuuguuuccaaauggaaa

SEQ ID NO: 514621 - RNA, 62 nt, Human
gccaagaaggaucuagucugcccacuacauucucaaacaagaggacuuggaagaaaagagcu

SEQ ID NO: 514622 - RNA, 62 nt, Human
gucuccucucagagugacagucauaaauacugucaaacaauaaagggagaauggugcuguuu

SEQ ID NO: 514623 - RNA, 62 nt, Human
auuuuggauugcaaacaggauaaauuaaauguucaaacaaucugauaaaauaaccauuugga

SEQ ID NO: 514624 - RNA, 62 nt, Human
aagcagguuucaucucaauauugggagagauuucaaacaaucacaccugccugagaaggagu

SEQ ID NO: 514625 - RNA, 62 nt, Human
uuuagaucacugaguguacagaagagagaaauucaaacaaaauauugcuguucuucaguuuu

SEQ ID NO: 514626 - RNA, 62 nt, Human
agccugaaggcuuuuuuuuggcuggcuuuuaaucaaacaaucuuuugaaacaauuguggucu

SEQ ID NO: 514627 - RNA, 62 nt, Human
cccccgcuugggguggugacgugacauugacaucaaacaaggauuacagugaaugugaaaaa

SEQ ID NO: 514628 - RNA, 62 nt, Human
guauuuaauuaguugauuuauuuaauguaauuucaaacaauuaaauuaugaauaaugcaaug

SEQ ID NO: 514629 - RNA, 62 nt, Human
uggcuuggugaggaaaagcggacaucagcuggucaaacaaacucucugaaccccucccucca

SEQ ID NO: 514630 - RNA, 62 nt, Human
caggccuggaaaggccacgauggcugcugaauucaaacaaggagucccuccagccugaauaa

SEQ ID NO: 514631 - RNA, 62 nt, Human
gcagggaaggaccugaaggauuuggaguugauucaaacaagaucucugggagucuccagccu

SEQ ID NO: 514632 - RNA, 62 nt, Human
uacugucuaauuaauaaauuuuccauuuuuuuucaaacaaguaugaaucuaguugguugaug

SEQ ID NO: 514633 - RNA, 62 nt, Human
ucgauuaucuugcauguuggcuagacuagaaaucaaacaacuuggaaaucgaucacaaccag

SEQ ID NO: 514634 - RNA, 62 nt, Human
gagccugguguauacugagaagcuggcaggggucaaacaagaagugauaaaggaauccaaag

SEQ ID NO: 514635 - RNA, 62 nt, Human
augcaaaaaggaaaacacacacaaccaauaacucaaacaaaaaagggacauuuaugugcagu

SEQ ID NO: 514636 - RNA, 62 nt, Human
agauggaagucuggggggcacagacaaccuuaucaaacaauauaaaagccaauauaaauucu

SEQ ID NO: 514637 - RNA, 62 nt, Human
auauaaagaaaaaagggagaugaacaaaauugucaaacaagacugauguaccacaaguguug

SEQ ID NO: 514638 - RNA, 62 nt, Human
auggcuuugcaagaagaugacauuucagaaaaucaaacaaaucuauauuuaauggauggacu

SEQ ID NO: 514639 - RNA, 62 nt, Human
guacaaugugaccuucucuaaaugcgguagauucaaacaaagaugcucuguagacaaguaga

SEQ ID NO: 514640 - RNA, 62 nt, Human
gucacagaauuaaggaagcaccucaauuuaguucaaacaagacgccaacauucucuccacag

SEQ ID NO: 514641 - RNA, 62 nt, Human
acaaauauaaugauaauuggcuuuuuaaauuuucaaacaacauagauuuacucaagaugaaa

SEQ ID NO: 514642 - RNA, 62 nt, Human
cugggaauuaacauguauuuaacacauuuugcucaaacaaucaaacaguaaaagcugaagag

SEQ ID NO: 514643 - RNA, 62 nt, Human
uugauuauaugugacuaauauguauuuuuuauucaaacaagacuucuguacauguuucuuca

SEQ ID NO: 514644 - RNA, 62 nt, Human
agcaucgcggaccgcaaaggccgcccgucccgucaaacaaguuucuucuuaggcuaagaaac

SEQ ID NO: 514645 - RNA, 62 nt, Human
ugugugcgugugugugugcagaaguuuugcuuucaaacaaaugaagauacaagaggcaguag

SEQ ID NO: 514646 - RNA, 62 nt, Human
caaagggcuaauauccagaaucuacaaugaacucaaacaaauuuacaggaacaaacaacccc

SEQ ID NO: 514647 - RNA, 62 nt, Human
cucagccucuccccgccgcccccaacaggcugucaaacaaaaccggagagggggugggggag

SEQ ID NO: 514648 - RNA, 62 nt, Human
guuccaaaauuuaaucacuaauuaaaaaucuaucaaacaaaacucuggaccagacagauuua

SEQ ID NO: 514649 - RNA, 62 nt, Human
gacaaagaucuaauccagaaucuauaaagaacucaaacaaaucaacaaugagaaaaacaacc

SEQ ID NO: 514650 - RNA, 62 nt, Human
gagccaccgcgcccggccccuaaguuaauauuucaaacaaucgaagguaaaacaacauauug

SEQ ID NO: 514651 - RNA, 62 nt, Human
gccuuccaccccccaaccaggccugagacugaucaaacaauaaacacguuucccacucugag

SEQ ID NO: 514652 - RNA, 62 nt, Human
uaguuuacagugaaauguuaucucagggacauucaaacaaaggaggaggagucauagggaag

SEQ ID NO: 514653 - RNA, 62 nt, Human
ugucucaggcagggcaucauucaguaauuagcucaaacaaaacaucucaaguccccaaaacc

SEQ ID NO: 514654 - RNA, 62 nt, Human
aaaaguuuuaaaaaaauuguugagucaaaaagucaaacaauaaagaaauuaagauuucuugg

SEQ ID NO: 514655 - RNA, 62 nt, Human
cgugccuggacuuuccauuauuuuuuguucuuucaaacaaucccauaauauuucccuugcac

SEQ ID NO: 514656 - RNA, 62 nt, Human
aaccaguauguguauuucuucuuccuuuaugcucaaacaaccuguacacagaaagcauuuuu

SEQ ID NO: 514657 - RNA, 62 nt, Human
uagagugacuccaagaacaauuguccauggucucaaacaaggggcuguuacauaacaagaaa

SEQ ID NO: 514658 - RNA, 62 nt, Human
acacaccuggugaagaguaguuuacuagcuuuucaaacaagaaugucccuuuuccuaaguca

SEQ ID NO: 514659 - RNA, 62 nt, Human
uugguucugauuuacaaauuaaugaaguaguuucaaacaacgcggucauguuuaccucucca

SEQ ID NO: 514660 - RNA, 62 nt, Human
aguguguuugacaagacagcuugauauuucuaucaaacaaaugacuuucauauugcaacaau

SEQ ID NO: 514661 - RNA, 62 nt, Human
ucucagcucacugcaaccuccaucuccuggauucaaacaauucuccugccucagccuccaga

SEQ ID NO: 514662 - RNA, 62 nt, Human
acaccucuauuuuuaaaaggacuuuaacgaagucaaacaacuuauaagacuagugauucacu

SEQ ID NO: 514663 - RNA, 62 nt, Human
agguuaaugugaguugaggaagacagucuuucucaaacaauacuacauaccuuuuauuauau

SEQ ID NO: 514664 - RNA, 62 nt, Human
guuuuucuagagagcuaagugggauguguagcucaaacaaacuguccuacccuuuuuuauuc

SEQ ID NO: 514665 - RNA, 62 nt, Human
aacagugccaagaauuuugcugaaugaaacaaucaaacaaagcauuuuaagguguaaguuau

SEQ ID NO: 514666 - RNA, 62 nt, Human
uuuuuuucacuggaagggaucccugaaguacaucaaacaaaggcauuggauuuggauccguc

SEQ ID NO: 514667 - RNA, 62 nt, Human
uauuguuuacauuaaacucccuuucauguuaaucaaacaagugaguagcucacgcagcaacg

SEQ ID NO: 514668 - RNA, 62 nt, Human
cagcaugacuggacagcgguuguaaauacaauucaaacaauucaaucaaagcuaccuuuuuu

SEQ ID NO: 514669 - RNA, 62 nt, Human
cugucaaggaaccguuucuauacauuuuuaccucaaacaacaggaccucgguucaugucccu

SEQ ID NO: 514670 - RNA, 62 nt, Human
uaucuuuccuaggcagaucacguugcaauggcucaaacaacauuccaccccagcaggacagu

SEQ ID NO: 514671 - RNA, 62 nt, Human
gggcugccuuuccuuuguguguauuaagcuuuucaaacaauggaggggauggagagcccugg

SEQ ID NO: 514672 - RNA, 62 nt, Human
gggugguuuggaugaagucugacuacuuuuuuucaaacaaacuauuauauuaaaacugucau

SEQ ID NO: 514673 - RNA, 62 nt, Human
cuaaaacuggcuuauccuugaguguuuacaacucaaacaacuuuuugaaugcaguaguuuuu

SEQ ID NO: 514674 - RNA, 62 nt, Human
augugauaauuguaaaggugaugaauuuaccaucaaacaaaucauuuugauguauuauuaua

SEQ ID NO: 514675 - RNA, 62 nt, Human
ccauguggcaagaaaggagacagugaauuuugucaaacaauaaaaaugugucaggaacacaa

SEQ ID NO: 514676 - RNA, 62 nt, Human
ugcaguucagccccacucccucuccaugcccaucaaacaacugcacaaucacuuguuacuga

SEQ ID NO: 514677 - RNA, 62 nt, Human
auucuuuuguuucuuuuaucugacugacucugucaaacaagugucaaaguuguguguuaaaa

SEQ ID NO: 514678 - RNA, 62 nt, Human
ucucuugcuuaccucaaaggccguugggaagaucaaacaauauuggaugugauugaacuuua

SEQ ID NO: 514679 - RNA, 62 nt, Human
uuuuuuugaucacuuacuuucaaagcacacagucaaacaagguuaugccaaauuuccaggcc

SEQ ID NO: 514680 - RNA, 62 nt, Human
gcaaggacuuacacuaaccuccuggcuguaaaucaaacaaggugacugaaaguggcauuuau

SEQ ID NO: 514681 - RNA, 62 nt, Human
uguaaaaaauaaaaauguauauagcugugagcucaaacaaaaacugcagacaaacaaaaaag

SEQ ID NO: 514682 - RNA, 64 nt, Human; identical to SEQ ID NO: 246608

SEQ ID NO: 514683 - RNA, 64 nt, Human; identical to SEQ ID NO: 246609

SEQ ID NO: 514684 - RNA, 64 nt, Human; identical to SEQ ID NO: 246613

SEQ ID NO: 514685 - RNA, 64 nt, Human; identical to SEQ ID NO: 246614

SEQ ID NO: 514686 - RNA, 64 nt, Human; identical to SEQ ID NO: 246615

SEQ ID NO: 514687 - RNA, 64 nt, Human; identical to SEQ ID NO: 246616

SEQ ID NO: 514688 - RNA, 64 nt, Human; identical to SEQ ID NO: 246617

SEQ ID NO: 514689 - RNA, 64 nt, Human; identical to SEQ ID NO: 246618

SEQ ID NO: 514690 - RNA, 64 nt, Human; identical to SEQ ID NO: 246619

SEQ ID NO: 514691 - RNA, 64 nt, Human; identical to SEQ ID NO: 246620

SEQ ID NO: 514692 - RNA, 64 nt, Human; identical to SEQ ID NO: 246621

SEQ ID NO: 514693 - RNA, 64 nt, Human; identical to SEQ ID NO: 246622

SEQ ID NO: 514694 - RNA, 62 nt, Human; identical to SEQ ID NO: 84439

SEQ ID NO: 514695 - RNA, 64 nt, Human; identical to SEQ ID NO: 246624

SEQ ID NO: 514696 - RNA, 64 nt, Human; identical to SEQ ID NO: 246625

SEQ ID NO: 514697 - RNA, 64 nt, Human; identical to SEQ ID NO: 246626

SEQ ID NO: 514698 - RNA, 64 nt, Human; identical to SEQ ID NO: 246627

SEQ ID NO: 514699 - RNA, 64 nt, Human; identical to SEQ ID NO: 246631

SEQ ID NO: 514700 - RNA, 64 nt, Human; identical to SEQ ID NO: 246632

SEQ ID NO: 514701 - RNA, 64 nt, Human; identical to SEQ ID NO: 246633

SEQ ID NO: 514702 - RNA, 64 nt, Human; identical to SEQ ID NO: 246634

SEQ ID NO: 514703 - RNA, 64 nt, Human; identical to SEQ ID NO: 246635

SEQ ID NO: 514704 - RNA, 64 nt, Human; identical to SEQ ID NO: 246636

SEQ ID NO: 514705 - RNA, 64 nt, Human; identical to SEQ ID NO: 246637

SEQ ID NO: 514706 - RNA, 64 nt, Human; identical to SEQ ID NO: 246638

SEQ ID NO: 514707 - RNA, 64 nt, Human; identical to SEQ ID NO: 246639

SEQ ID NO: 514708 - RNA, 64 nt, Human; identical to SEQ ID NO: 246640

SEQ ID NO: 514709 - RNA, 64 nt, Human; identical to SEQ ID NO: 246641

SEQ ID NO: 514710 - RNA, 64 nt, Human; identical to SEQ ID NO: 246642

SEQ ID NO: 514711 - RNA, 64 nt, Human
gccaggagccaggaguggggaagggagggaugaaaggggacacaagucccugucucugaaguuu

SEQ ID NO: 514712 - RNA, 64 nt, Human; identical to SEQ ID NO: 494001

SEQ ID NO: 514713 - RNA, 64 nt, Human; identical to SEQ ID NO: 494002

SEQ ID NO: 514714 - RNA, 64 nt, Human; identical to SEQ ID NO: 494003

SEQ ID NO: 514715 - RNA, 64 nt, Human; identical to SEQ ID NO: 494004

SEQ ID NO: 514716 - RNA, 64 nt, Human
aacuuuuaaaaauccccuucacacuuaauguacugaccgagacagaaguaccugaaaacagcug

SEQ ID NO: 514717 - RNA, 64 nt, Human
cagucaagaggaaccauuggccuagagcuccugugaccgagagcgccacggaagccuggggaug

SEQ ID NO: 514718 - RNA, 64 nt, Human
aaauguauaccguaucuaucuacccgacagcagcgaccgagacccggugggacacuccccuucu

SEQ ID NO: 514719 - RNA, 64 nt, Human; identical to SEQ ID NO: 494005

SEQ ID NO: 514720 - RNA, 64 nt, Human; identical to SEQ ID NO: 494009

SEQ ID NO: 514721 - RNA, 64 nt, Human; identical to SEQ ID NO: 494010

SEQ ID NO: 514722 - RNA, 64 nt, Human; identical to SEQ ID NO: 494011

SEQ ID NO: 514723 - RNA, 64 nt, Human; identical to SEQ ID NO: 494012

SEQ ID NO: 514724 - RNA, 64 nt, Human; identical to SEQ ID NO: 494013

SEQ ID NO: 514725 - RNA, 64 nt, Human; identical to SEQ ID NO: 494014

SEQ ID NO: 514726 - RNA, 54 nt, Human; identical to SEQ ID NO: 494015

SEQ ID NO: 514727 - RNA, 64 nt, Human; identical to SEQ ID NO: 494016

SEQ ID NO: 514728 - RNA, 64 nt, Human; identical to SEQ ID NO: 494017

SEQ ID NO: 514729 - RNA, 62 nt, Human; identical to SEQ ID NO: 494018

SEQ ID NO: 514730 - RNA, 64 nt, Human; identical to SEQ ID NO: 494019

SEQ ID NO: 514731 - RNA, 64 nt, Human; identical to SEQ ID NO: 494020

SEQ ID NO: 514732 - RNA, 64 nt, Human; identical to SEQ ID NO: 494021

SEQ ID NO: 514733 - RNA, 64 nt, Human; identical to SEQ ID NO: 494022

SEQ ID NO: 514734 - RNA, 64 nt, Human
gggacuccagcucguguguccucauggagaacccaggggacagcuggugcaaauucagaacuga

SEQ ID NO: 514735 - RNA, 64 nt, Human
acugccgacaucccucccccagcagaauggaggcaggggacaagggaggcaguggcuagugggg

SEQ ID NO: 514736 - RNA, 64 nt, Human
ugucuuugcugggcaucucguaaucacuuuucuuaggggacagaaucccaucuuuuccuucggc

SEQ ID NO: 514737 - RNA, 64 nt, Human; identical to SEQ ID NO: 494026

SEQ ID NO: 514738 - RNA, 64 nt, Human; identical to SEQ ID NO: 494027

SEQ ID NO: 514739 - RNA, 64 nt, Human; identical to SEQ ID NO: 494028

SEQ ID NO: 514740 - RNA, 64 nt, Human; identical to SEQ ID NO: 494029

SEQ ID NO: 514741 - RNA, 64 nt, Human; identical to SEQ ID NO: 494030

SEQ ID NO: 514742 - RNA, 64 nt, Human; identical to SEQ ID NO: 494031

SEQ ID NO: 514743 - RNA, 64 nt, Human; identical to SEQ ID NO: 494032

SEQ ID NO: 514744 - RNA, 64 nt, Human; identical to SEQ ID NO: 494033

SEQ ID NO: 514745 - RNA, 64 nt, Human; identical to SEQ ID NO: 494034

SEQ ID NO: 514746 - RNA, 64 nt, Human; identical to SEQ ID NO: 494035

SEQ ID NO: 514747 - RNA, 64 nt, Human; identical to SEQ ID NO: 494036

SEQ ID NO: 514748 - RNA, 64 nt, Human; identical to SEQ ID NO: 494037

SEQ ID NO: 514749 - RNA, 64 nt, Human; identical to SEQ ID NO: 494038

SEQ ID NO: 514750 - RNA, 64 nt, Human; identical to SEQ ID NO: 494039

SEQ ID NO: 514751 - RNA, 64 nt, Human; identical to SEQ ID NO: 494043

SEQ ID NO: 514752 - RNA, 64 nt, Human
ugcccucgggcgucuggcagccugagguggguggaggggacaguguucuggauagaucuauuau

SEQ ID NO: 514753 - RNA, 64 nt, Human
cgcugcuccaugcugaagaaaagugacagucuccaggggacauuucagccaugcugaaagggag

SEQ ID NO: 514754 - RNA, 64 nt, Human
uucugcuugagggagggaauagaaaggggcagggaggggacaucugagggcuucacagggcugc

SEQ ID NO: 514755 - RNA, 64 nt, Human; identical to SEQ ID NO: 494044

SEQ ID NO: 514756 - RNA, 64 nt, Human; identical to SEQ ID NO: 494045

SEQ ID NO: 514757 - RNA, 64 nt, Human; identical to SEQ ID NO: 494046

SEQ ID NO: 514758 - RNA, 64 nt, Human; identical to SEQ ID NO: 494047

SEQ ID NO: 514759 - RNA, 64 nt, Human; identical to SEQ ID NO: 494048

SEQ ID NO: 514760 - RNA, 64 nt, Human; identical to SEQ ID NO: 494049

SEQ ID NO: 514761 - RNA, 64 nt, Human; identical to SEQ ID NO: 494050

SEQ ID NO: 514762 - RNA, 64 nt, Human; identical to SEQ ID NO: 494051

SEQ ID NO: 514763 - RNA, 64 nt, Human; identical to SEQ ID NO: 494052

SEQ ID NO: 514764 - RNA, 64 nt, Human; identical to SEQ ID NO: 494053

SEQ ID NO: 514765 - RNA, 64 nt, Human; identical to SEQ ID NO: 494054

SEQ ID NO: 514766 - RNA, 64 nt, Human; identical to SEQ ID NO: 494055

SEQ ID NO: 514767 - RNA, 64 nt, Human; identical to SEQ ID NO: 494056

SEQ ID NO: 514768 - RNA, 64 nt, Human; identical to SEQ ID NO: 494060

SEQ ID NO: 514769 - RNA, 64 nt, Human; identical to SEQ ID NO: 494061

SEQ ID NO: 514770 - RNA, 64 nt, Human
aaaacaacaaaaaaagcuaaccuucuauuagaaaaggggacaggggaaugaguaaacuucuuuu

SEQ ID NO: 514771 - RNA, 64 nt, Human
gagugucgccgggaggccuucagggugggggggaaggggacaugggcaggaagcaccgagggag

SEQ ID NO: 514772 - RNA, 64 nt, Human
ccaacucugagcccauguucugcccccagcccaaaggggacaggccucaccucuacccaaaccc

SEQ ID NO: 514773 - RNA, 64 nt, Human; identical to SEQ ID NO: 494062

SEQ ID NO: 514774 - RNA, 64 nt, Human; identical to SEQ ID NO: 494063

SEQ ID NO: 514775 - RNA, 64 nt, Human; identical to SEQ ID NO: 494064

SEQ ID NO: 514776 - RNA, 64 nt, Human; identical to SEQ ID NO: 494065

SEQ ID NO: 514777 - RNA, 64 nt, Human; identical to SEQ ID NO: 494066

SEQ ID NO: 514778 - RNA, 64 nt, Human; identical to SEQ ID NO: 494067

SEQ ID NO: 514779 - RNA, 64 nt, Human; identical to SEQ ID NO: 494068

SEQ ID NO: 514780 - RNA, 64 nt, Human; identical to SEQ ID NO: 494069

SEQ ID NO: 514781 - RNA, 64 nt, Human; identical to SEQ ID NO: 494070

SEQ ID NO: 514782 - RNA, 64 nt, Human; identical to SEQ ID NO: 494071

SEQ ID NO: 514783 - RNA, 64 nt, Human; identical to SEQ ID NO: 494072

SEQ ID NO: 514784 - RNA, 64 nt, Human; identical to SEQ ID NO: 494073

SEQ ID NO: 514785 - RNA, 64 nt, Human; identical to SEQ ID NO: 494077

SEQ ID NO: 514786 - RNA, 64 nt, Human; identical to SEQ ID NO: 494078

SEQ ID NO: 514787 - RNA, 64 nt, Human; identical to SEQ ID NO: 494079

SEQ ID NO: 514788 - RNA, 64 nt, Human
ggaagggcagcauauaaaaacaucagucccgaggaggggacaacaauacuaccucacuacuaca

SEQ ID NO: 514789 - RNA, 64 nt, Human
uuccuuaaagaaguuaugaacuuuagaaaggaucaggggacaauaauaaucucauuuugauucu

SEQ ID NO: 514790 - RNA, 64 nt, Human
uuugaaaccauaugggcaaaacccggcaaccagaaggggacagauaaggaccguuccagaaauc

SEQ ID NO: 514791 - RNA, 64 nt, Human; identical to SEQ ID NO: 494080

SEQ ID NO: 514792 - RNA, 64 nt, Human; identical to SEQ ID NO: 494081

SEQ ID NO: 514793 - RNA, 64 nt, Human; identical to SEQ ID NO: 494082

SEQ ID NO: 514794 - RNA, 64 nt, Human; identical to SEQ ID NO: 494083

SEQ ID NO: 514795 - RNA, 64 nt, Human; identical to SEQ ID NO: 494084

SEQ ID NO: 514796 - RNA, 64 nt, Human; identical to SEQ ID NO: 494085

SEQ ID NO: 514797 - RNA, 64 nt, Human; identical to SEQ ID NO: 494086

SEQ ID NO: 514798 - RNA, 64 nt, Human; identical to SEQ ID NO: 494087

SEQ ID NO: 514799 - RNA, 64 nt, Human; identical to SEQ ID NO: 494088

SEQ ID NO: 514800 - RNA, 64 nt, Human; identical to SEQ ID NO: 494089

SEQ ID NO: 514801 - RNA, 60 nt, Human; identical to SEQ ID NO: 494090

SEQ ID NO: 514802 - RNA, 64 nt, Human; identical to SEQ ID NO: 494094

SEQ ID NO: 514803 - RNA, 64 nt, Human; identical to SEQ ID NO: 494095

SEQ ID NO: 514804 - RNA, 64 nt, Human
gugugccucugugucuccuuccucggggguaaggaggggacagugcuucccaaguuccagcugc

SEQ ID NO: 514805 - RNA, 64 nt, Human
cucugguuauuuguuuuuuccuuuguuguuuuaaaggggacaaaaaaaaaaaaaggacuugacu

SEQ ID NO: 514806 - RNA, 64 nt, Human
cuacggaggaagcggaaagcguuuucuuugcucgaggggacaaaaaagucaaaacgaggcgaga

SEQ ID NO: 514807 - RNA, 64 nt, Human
ccuccccuuagcugcccuuguaugacccggauuugcuaugcaaaacaaucuaucccagguucug

SEQ ID NO: 514808 - RNA, 64 nt, Human
ccucucaucucugcccagcccccucaguggcgcugcuaugcaaggcuugugaacccccagcaug

SEQ ID NO: 514809 - RNA, 64 nt, Human
ugccugaaacugagagagugaagaaccauaaaacgcuaugcagaaggaacauuauggagagaaa

SEQ ID NO: 514810 - RNA, 64 nt, Human
uucacccaugggcauggucagguagccucugguggcuaugcauuuauuacucaaaaguugggca

SEQ ID NO: 514811 - RNA, 64 nt, Human
gucaagccucugacaacuauugaauuuguaagcugcuaugcaaaugggcauuuauauaaacuug

SEQ ID NO: 514812 - RNA, 64 nt, Human
gaagggaaauagugccuuacuauauguggguugagcuaugcagaagauacgugcaugaaaaaac

SEQ ID NO: 514813 - RNA, 64 nt, Human
uuacuggauuuuguacaaacauaaucuauuauuugcuaugcaauauuuuaugcugguauuauau

SEQ ID NO: 514814 - RNA, 64 nt, Human
ugaggaguauuuccccucauucuaccucucuaaggcuaugcaacccuccccacgucuuccagcu

SEQ ID NO: 514815 - RNA, 64 nt, Human
uuucuuuacuguuugcaguuaauguucauguucugcuaugcaaucguuuauaugcacguuucuu

SEQ ID NO: 514816 - RNA, 64 nt, Human
acucuaaagccuagaccuuaaaccuguuccuagagcuaugcacaccccugccccaguuuaccgu

SEQ ID NO: 514817 - RNA, 64 nt, Human
uauccaggagugguggugugugccuguggucccugcuaugcagaugucuaagacaggaggauca

SEQ ID NO: 514818 - RNA, 64 nt, Human
auguuggccucugcaaccacacagggauauuucugcuaugcaccagccucacuccaccuuccuu

SEQ ID NO: 514819 - RNA, 64 nt, Human
acaaucuggaagaaaucauguacaggaauaauaugcuaugcacagggacuaugcuccuuggcuc

SEQ ID NO: 514820 - RNA, 64 nt, Human
uaugaguaauuagaagugguuauauaugaugaaugcuaugcagauguugucuuuaacucucaga

SEQ ID NO: 514821 - RNA, 64 nt, Human
uuguuuuuauaauuugugguuuucaugaaacauugcuaugcauuuauuaggaaaaacugaauuu

SEQ ID NO: 514822 - RNA, 64 nt, Human
cugcugcuuugcauucacuuccuuggccagagucaggggacagggagagagcuccacacuguaa

SEQ ID NO: 514823 - RNA, 64 nt, Human
acaaguucuuucacuaucugugugcagugcucugaggggacagacaaggcuuggguguauaugc

SEQ ID NO: 514824 - RNA, 64 nt, Human
gggauauguggauucggagaaagcugaggcccagaggggacacucgacccagucuaaagugggu

SEQ ID NO: 514825 - RNA, 64 nt, Human
uaaauaggggaaaaaaaauuuuuuucaagccagagcuaugcauauguuaggugauggguaguau

SEQ ID NO: 514826 - RNA, 64 nt, Human
uccagcugaugaguuacagccuguuaguaacaugaggggacauuuuggugagaaaugggacuua

SEQ ID NO: 514827 - RNA, 64 nt, Human
ccugggcagcagaggaaaccuacagcucugggugaggggacacuuggcuuugguguuugcacuu

SEQ ID NO: 514828 - RNA, 64 nt, Human
accauggcuggggaauugucuggugguggggggcaggggacagaggccaugaaggagcaaguuu

SEQ ID NO: 514829 - RNA, 64 nt, Human
aagacccaccccauucccacuccucugagcccggaggggacaccccaagcuccaagcuccaagc

SEQ ID NO: 514830 - RNA, 64 nt, Human
guaguggggggaguaauacagauucuucccuagaaggggacacugguaacaugucccacucuug

SEQ ID NO: 514831 - RNA, 64 nt, Human
ccccuuugucaguggggaaaccaaggcagagcugaggggacagggaggagcagaagccaucaag

SEQ ID NO: 514832 - RNA, 64 nt, Human
agguucuccagugacaguguccugugacugcaaaaggggacaagaaaaucccucuuccuccaug

SEQ ID NO: 514833 - RNA, 64 nt, Human
cccugggcacgggaggggguggggcugggcgugaaggggacaggggacgguagaaaccuaagga

SEQ ID NO: 514834 - RNA, 64 nt, Human
cacccucugggccuccuaccugugccuuucucugaggggacaccccgccagagagggccccggg

SEQ ID NO: 514835 - RNA, 64 nt, Human
cuucaccccugcuccucccggcuguuacauugucaggggacagcaucugcagcaguugcugagg

SEQ ID NO: 514836 - RNA, 64 nt, Human
gggcuuggagggaggagggccggcgaggcuagcgaggggacaggagacggcccugcugcggacg

SEQ ID NO: 514837 - RNA, 64 nt, Human
cugugugaugaccacuuauuacaacccucagaauaggggacaguggugugcccccugcaauaca

SEQ ID NO: 514838 - RNA, 64 nt, Human
caugucccugaggggccccuaagaaagaaaguggaggggacacuccagaggcugucgugggagg

SEQ ID NO: 514839 - RNA, 64 nt, Human
gccugggccccuccccucagagcccaugguaacgaaccccuagaaaggagagaacgggcgucag

SEQ ID NO: 514840 - RNA, 64 nt, Human
auuugucuagcaggcuuuccaguuuuuaccagaaaaccccuauaaauuaaaaauuuuuuacuua

SEQ ID NO: 514841 - RNA, 64 nt, Human
ugaauuaagaccagggcuagagucaacaguccagaaccccuauccguaugaacaggggcccguu

SEQ ID NO: 514842 - RNA, 64 nt, Human; identical to SEQ ID NO: 409093

SEQ ID NO: 514843 - RNA, 64 nt, Human; identical to SEQ ID NO: 412761

SEQ ID NO: 514844 - RNA, 64 nt, Human; identical to SEQ ID NO: 408903

SEQ ID NO: 514845 - RNA, 64 nt, Human
cuggguagcugugaucagggacaugauaaucugagcuaugcagaggagcacaucuguugucaac

SEQ ID NO: 514846 - RNA, 64 nt, Human
aagaaacugaaguguccaacuuccucuaaguauugcuaugcaaaagcugcuguaauuaaacuau

SEQ ID NO: 514847 - RNA, 64 nt, Human
aacacuagucucuuuauuaguagaaacuucuguggcuaugcagaaauagagaucgaaccaaaaa

SEQ ID NO: 514848 - RNA, 64 nt, Human
cccugcaacaaagacuugcuuuaaauagauuucagcuaugcagaaaaauuuagcuuaugcuucc

SEQ ID NO: 514849 - RNA, 64 nt, Human
gaaaguacuucaggcacgcugccuccugguaacagcuaugcagggagggaggacccacacugcu

SEQ ID NO: 514850 - RNA, 64 nt, Human
gccggagccauccuuucggugguaguuggggaaggcuaugcagauuugcucuguugugacgcgu

SEQ ID NO: 514851 - RNA, 64 nt, Human
ugcuccauacccagcgguucuucaugaguagugggcuaugcaggagcuucugggagauuuuuuu

SEQ ID NO: 514852 - RNA, 63 nt, Human
uuaagcugaguaacuuguagcaagacagcagcugcuaugcacacuggaguccaccauaccaaa

SEQ ID NO: 514853 - RNA, 64 nt, Human
uuggugacaacuaaaccaacuuuuuccaaagugcgcuaugcauauuuuuaaugaaagaugacau

SEQ ID NO: 514854 - RNA, 64 nt, Human
gauucuccucuguauauaauuucuuuugugcauugcuaugcaagcucacucuuuuuagcucugc

SEQ ID NO: 514855 - RNA, 64 nt, Human
ggaaagaguuuuuuuuuuuuuuuuuuuuuuuuuugcuaugcacaguuccucccagcaaccuucc

SEQ ID NO: 514856 - RNA, 64 nt, Human
auagugguaggaggggcucccugauuccccuaaagcuaugcacaccacaaggggcucugcucuu

SEQ ID NO: 514857 - RNA, 64 nt, Human
gguuaagauucccuuuuauugcaccuagaauagugcuaugcacagagcgggugcuugaguuguu

SEQ ID NO: 514858 - RNA, 64 nt, Human
caaagaaggaaacuguaucuuuagguuaaucaaagcuaugcauuucauauagcuuuuucauuua

SEQ ID NO: 514859 - RNA, 64 nt, Human
agcggcagaugggccugugugcacccaacgugaugcuaugcaugucugaccgacgaucccucga

SEQ ID NO: 514860 - RNA, 64 nt, Human
gacagacuaaagcugcccuccuggugcagggccgaggggacacaaggaccuaccuggaagcagc

SEQ ID NO: 514861 - RNA, 64 nt, Human
guagagccuagguuguccuugggccggcuuccuuaggggacagacuguuggguggugaugggga

SEQ ID NO: 514862 - RNA, 64 nt, Human
aaggccacaguaggccucucuuugugggaauggaaggggacaguuugcuuuuagugcuggcccu

SEQ ID NO: 514863 - RNA, 64 nt, Human
uacagauuucucacuauauauauuucuagaaggggcuaugcauauucaauguauugagaaccaa

SEQ ID NO: 514864 - RNA, 64 nt, Human
cccaagauggcacaucucaguaccuucuuacugugcuaugcauuuuauugagaguacagaaagg

SEQ ID NO: 514865 - RNA, 64 nt, Human
accaagccaaaaaaaguacggcccucagccagucgcuaugcagcacuuucggaccagggacuag

SEQ ID NO: 514866 - RNA, 64 nt, Human
gcccuuggcuguuguuacagagauguugggcagagcuaugcagguguuucauugugaacucuag

SEQ ID NO: 514867 - RNA, 64 nt, Human
uuuacccauuauugggaagcuuaaaugaauugaagcuaugcaagucuuuuauauuauuaaauau

SEQ ID NO: 514868 - RNA, 64 nt, Human
uauauacuauacaacaauguucuuuuuuguuacagcuaugcacuguaaaugcagccuucuuuuc

SEQ ID NO: 514869 - RNA, 64 nt, Human
gagcacuuuuuacuaaguaguagaugaauuuucagcuaugcaauaugacaaaacauggggaauu

SEQ ID NO: 514870 - RNA, 64 nt, Human
uccuguuaaaacuucauuuuuucaaacuuuuugagcuaugcaauauauaaauaaacaguaagaa

SEQ ID NO: 514871 - RNA, 64 nt, Human
uguugagauuaucuucugaucaggaaguuugagugcuaugcaaauaacauaguaguaauuucuc

SEQ ID NO: 514872 - RNA, 64 nt, Human
aauaucauggugccuacucgaaagaaauguagaugcuaugcauuuugaaaauaaucugcaucag

SEQ ID NO: 514873 - RNA, 64 nt, Human
uuacgaaagccaugucuaauaccaaccccgaaaagcuaugcauaucaagaaaaucaggggcugc

SEQ ID NO: 514874 - RNA, 64 nt, Human
aaauggcauauggaaaagcuuuguauuuugguuagcuaugcaaagucaugagaaagaugagauu

SEQ ID NO: 514875 - RNA, 64 nt, Human
cagacauagacugcaaaagaauaauuuggaaucagcuaugcaaaucagucucacaauagcguga

SEQ ID NO: 514876 - RNA, 64 nt, Human
ucuguuuuguuuugcugaaggcuaaauucacagcgcuaugcaauucuuaauuuucauuaaguug

SEQ ID NO: 514877 - RNA, 64 nt, Human
auagcacacuuuuccacauuccagugaugugugagcuaugcaaacaaaauccaagauucugcug

SEQ ID NO: 514878 - RNA, 64 nt, Human
gccgccuuguguugcuggagacgugggggcagggaggggacagugugggccuggccucuccuuu

SEQ ID NO: 514879 - RNA, 64 nt, Human
guuagauggggguucucagaaguggcugauuggaaggggacaagcuucguuucaggggucugcc

SEQ ID NO: 514880 - RNA, 64 nt, Human
gaggaaucgccaaaacaaaucacgagaagagagaaggggacagaacagcgagagcaaccuggaa

SEQ ID NO: 514881 - RNA, 64 nt, Human
caggaagggcagcuccagccagaggaccuuccuggcuaugcaggugcacagcucuuaggcauca

SEQ ID NO: 514882 - RNA, 64 nt, Human
uaccuauuuccucagauccccagcuuucuccucugcuaugcauuuucuucacagugcagcuugc

SEQ ID NO: 514883 - RNA, 64 nt, Human
uagguucuagucugaccccucucuccaccccugggcuaugcaggccagcccgugcagaccaccc

SEQ ID NO: 514884 - RNA, 64 nt, Human
caguauuaugcaaauaaaacugaccucauuuucugcuaugcaauaagaauacuuaauucuaguu

SEQ ID NO: 514885 - RNA, 64 nt, Human
agcccuuucuauaugagguuugaaaauguaaacugcuaugcauagcuugggcaauagcccuaaa

SEQ ID NO: 514886 - RNA, 64 nt, Human
acaagccagccaacucuuucucucugggcuucgggcuaugcaagagcguugucuaccuucuuuc

SEQ ID NO: 514887 - RNA, 64 nt, Human
uaauucacacaaugaauuucauaccuagcguggagcuaugcaagaagcagccaccagagggccc

SEQ ID NO: 514888 - RNA, 64 nt, Human
ggcgccaucuucugcccaccaugcuaugacgugcgcuaugcacccagcugugccaagugcaaga

SEQ ID NO: 514889 - RNA, 64 nt, Human
ccuugaaaaaacaauuauccuugaacuuccuccagcuaugcagggauucucauuaaagagcuga

SEQ ID NO: 514890 - RNA, 64 nt, Human
gcugggaucagugaaugccugauuaggacauggggcuaugcauagccuaagaguuauaggcuua

SEQ ID NO: 514891 - RNA, 64 nt, Human
cauaauguuucauguuuguccuaagugugcuguugcuaugcagugugaucuuuauuuauaguaa

SEQ ID NO: 514892 - RNA, 64 nt, Human
cccaaauuuuguugcaugcuuuuaaguagcauuagcuaugcacacuugacauuuuuaaauaucc

SEQ ID NO: 514893 - RNA, 64 nt, Human
acguucuuccuuuccgauucuucauccggucuacgcuaugcaauuccuccccaaauauagaucu

SEQ ID NO: 514894 - RNA, 64 nt, Human
aauugcucaucauucugggaguuuccauguaguggcuaugcaguguggaaagugagaaaaaccu

SEQ ID NO: 514895 - RNA, 64 nt, Human
uuggcccugccucaaaagccauaccucuucuccugcuaugcagaaucuguuucuccugaaucuc

SEQ ID NO: 514896 - RNA, 64 nt, Human
agggcuagugaaguggccucuuggauaccagcucaggggacacuggccccacaggaguugugag

SEQ ID NO: 514897 - RNA, 64 nt, Human
gguuuauaguagucuuguggacacagaaaugcacaggggacacuuacggacacagaaaugcaca

SEQ ID NO: 514898 - RNA, 64 nt, Human
agggaagggcuucagggccaucugcucccagggcaggggacaggccaccaaggaccuuuggcaa

SEQ ID NO: 514899 - RNA, 64 nt, Human
auguuuugguguguagucuuacuuuuuagaaauagcuaugcaucguucuacacagguuuaaaac

SEQ ID NO: 514900 - RNA, 64 nt, Human
uuauguauuaguuuugaaauaauaauggaaaguggcuaugcaguuugaauauccuuuguuucag

SEQ ID NO: 514901 - RNA, 64 nt, Human
uuaguauucagguugugaaaaauaaagauguuuggcuaugcacaaaauaguuuguaugcuuuga

SEQ ID NO: 514902 - RNA, 64 nt, Human
gcucaacaguuaaucagcagugaaucaucuugcagcuaugcaauuuaaaaaaaauacagauuac

SEQ ID NO: 514903 - RNA, 64 nt, Human
cuuuggaggaaaacucaagauacaaaaaugaauggcuaugcauaauaacaauaagaauguauuc

SEQ ID NO: 514904 - RNA, 64 nt, Human
accaccuuuuggagauuuaaccauagcugccaaagcuaugcacccaguuggccuuagaaaacca

SEQ ID NO: 514905 - RNA, 64 nt, Human
aauguuuauucuucccuguguacuucuacacauagcuaugcacuaugaaaauuaaauggaauga

SEQ ID NO: 514906 - RNA, 64 nt, Human
ugcuucccauuucuagaauaguuucuagaacagugcuaugcacauauuagaucuuaauaaacau

SEQ ID NO: 514907 - RNA, 64 nt, Human
gauauugggagaugaauuugcaacaauauaaaaagcuaugcaauuuucuuuuuauuaaggauga

SEQ ID NO: 514908 - RNA, 64 nt, Human
auuccgucucucauccucugccauguagcaaacugcuaugcauccuucagcugcaagggauuga

SEQ ID NO: 514909 - RNA, 64 nt, Human
caauucaucaacuggaaagcaauucuaugcuggugcuaugcaauuaugcucuguguuucauaug

SEQ ID NO: 514910 - RNA, 64 nt, Human
aaaaggcaauggcaguccuacauuuaagaauagagcuaugcaaacucuguuaaaaacuaugagg

SEQ ID NO: 514911 - RNA, 64 nt, Human
aaaauauauuuugcuguguauaaauugauauuuugcuaugcaacuccuguaauugaauuuguau

SEQ ID NO: 514912 - RNA, 64 nt, Human
uucuaagaugaauuuaccaggugagaaugaauaagcuaugcaagguauuuuguaauauacugug

SEQ ID NO: 514913 - RNA, 64 nt, Human
acaaaaggaugucagcaauugcuugggcugcuuggcuaugcaagccuccugccugcugauggcc

SEQ ID NO: 514914 - RNA, 64 nt, Human
gccucuccuccaucuucuggcaaggacagaggcgaggggacagcccagcgccauccugaggauc

SEQ ID NO: 514915 - RNA, 64 nt, Human
gugggcauaucuggguggcaauuucagagggcagaggggacaccuucauugccucuccucgcac

SEQ ID NO: 514916 - RNA, 64 nt, Human
cucccauuucacagaggauaccaccgagacucggaggggacacgaugagcaccaggccccaccu

SEQ ID NO: 514917 - RNA, 64 nt, Human
uauggaacauuaaauaauuauuuuugaaaugauugcuaugcagguuuaaacuuuuuuaaugauc

SEQ ID NO: 514918 - RNA, 64 nt, Human
cccccaucuaggugccaaauguucaucugcaaccgcuaugcagucuggugagagggagacagcc

SEQ ID NO: 514919 - RNA, 64 nt, Human
uuagaagggauuaccaaaggcuggagcgauuuaagcuaugcacuagccuugcccucuuagguug

SEQ ID NO: 514920 - RNA, 64 nt, Human
uccacugggccccuggccucgggagcggccccuggcuaugcacccccaccauuccuacacaucu

SEQ ID NO: 514921 - RNA, 64 nt, Human
cucaccauaugccuuauccccauucuacuccccugcuaugcaagugccccuguggcuugucccc

SEQ ID NO: 514922 - RNA, 64 nt, Human
aaggcacauccgggacgaucgauauagcacuuaggcuaugcaggggggucuuucuuucauaaag

SEQ ID NO: 514923 - RNA, 64 nt, Human
gugcuaaagucuacaccaauggaauuagaugagugcuaugcacuuaauuuuaaaauaaaacuag

SEQ ID NO: 514924 - RNA, 64 nt, Human
agaaagccauacauagaaugcuucaagcuaucuugcuaugcacauuauacuuguacuguuuugu

SEQ ID NO: 514925 - RNA, 64 nt, Human
cgaguggaacugcagccuggggacuugauuaggugcuaugcaucaguagcauuuugaaugcaag

SEQ ID NO: 514926 - RNA, 64 nt, Human
ugccuuuuuaaugaacaugugaaguuauacuguggcuaugcaacagcucucaccuacgcgaguc

SEQ ID NO: 514927 - RNA, 64 nt, Human
uaaagaacauguuugcacugugcugaagggcuuugcuaugcauacaaucugcuuucuugguuua

SEQ ID NO: 514928 - RNA, 64 nt, Human
uuaaacgugagugugugugugugugugugugugugcuaugcaugcucuaagucugcaugggaua

SEQ ID NO: 514929 - RNA, 64 nt, Human
agauaggaagagcauugggaaacuugcacagcuagcuaugcaucuacauuuugguuugggguua

SEQ ID NO: 514930 - RNA, 64 nt, Human
accuaaggaaucuaaauuguccuagccuuccauugcuaugcacugaaugaggacuacucucgug

SEQ ID NO: 514931 - RNA, 64 nt, Human
acaagaaccuagaaugaauauccaagcaccucgagcuaugcaaccucuguucuuguauuucuua

SEQ ID NO: 514932 - RNA, 64 nt, Human
gaugccaugagcugacggugucccuggagcagugaggggacaccagcaaaaaccuucagcucuc

SEQ ID NO: 514933 - RNA, 57 nt, Human
uggcacccaugacccgauaaacucuucaggggacagaagcuuuuugucuggagcugc

SEQ ID NO: 514934 - RNA, 64 nt, Human
aauggggacaccucccuauuacagaugagaacagaggggacaugaacuccuuggaggcagggcu

SEQ ID NO: 514935 - RNA, 64 nt, Human
gcgaugagucuaguagcacccaggacggcuuguagcuaugcaucauuuuccuacggcguuagca

SEQ ID NO: 514936 - RNA, 64 nt, Human
aacuguucacagaugccagccuugauccugaugagcuaugcacucuaauguggggccacucacc

SEQ ID NO: 514937 - RNA, 64 nt, Human
uacauucagugaguuauaguguuaauagucuugugcuaugcagcagguguaaaaauuaauaaau

SEQ ID NO: 514938 - RNA, 64 nt, Human
ccauacugacuuugaucuugagaaagaaaaacuggcuaugcauuaccuaaaaccaguccaaaau

SEQ ID NO: 514939 - RNA, 64 nt, Human
uccuuccaccaucugcagagauuugaaguuuggggcuaugcaugaaacccaacacuaaauuuug

SEQ ID NO: 514940 - RNA, 64 nt, Human
ccucauggggaaugucugggaagcuggggacauugcuaugcaaaugugugaaucuuagucaugg

SEQ ID NO: 514941 - RNA, 64 nt, Human
ggugagagggccacguguuugguauuacauuacugcuaugcaccacuugaaggagcucuaucac

SEQ ID NO: 514942 - RNA, 64 nt, Human
uauaacucagaaauggucagauggucaggagccagcuaugcagcaguauaccaucuguuuaauu

SEQ ID NO: 514943 - RNA, 64 nt, Human
uucucauuacaaaggaccaauucagaacugaaaagcuaugcauaggacaaggaagauacauaga

SEQ ID NO: 514944 - RNA, 64 nt, Human
aaacccugaaggaaaaccuuuuccauacacccaggcuaugcauugaagaguuuuccacuguaua

SEQ ID NO: 514945 - RNA, 64 nt, Human
acuaacacccaugcuauuuuuguagucagaaacagcuaugcaaacccuaccuaauuuacagucu

SEQ ID NO: 514946 - RNA, 64 nt, Human
cagauaacagcuaaugauaaaugacauaucauuagcuaugcaucgcaauaaaacagccaaaaug

SEQ ID NO: 514947 - RNA, 64 nt, Human
cuccugcgcugccccagagccugggaaggaggccgcuaugcaggguagcacugggaacaggaga

SEQ ID NO: 514948 - RNA, 64 nt, Human
auucuuuaggauaaccauuucaaaaaauaaaauugcuaugcaaucuugaauauuuucucuuuug

SEQ ID NO: 514949 - RNA, 64 nt, Human
cacaucuugcccacaugcuguaaccuaagaaacugcuaugcaaggcugggugcuguggcucaug

SEQ ID NO: 514950 - RNA, 64 nt, Human
aggacauuccuuucccagcuccagccuggagggaaggggacaaagaccccaggaggccaaaggg

SEQ ID NO: 514951 - RNA, 64 nt, Human
cagcuuccagcagaagucacgcuccccaucccccaggggacauaggaccuuuuuccugcuuccu

SEQ ID NO: 514952 - RNA, 64 nt, Human
ucuggcccguuggaggggcaggcugaggcuguggaggggacaagcacgccccccagaacgcagu

SEQ ID NO: 514953 - RNA, 64 nt, Human
uagccagcaugcuagugaaacgacuagcagcgaugcuaugcaaaaggcgcugauacuggaaggc

SEQ ID NO: 514954 - RNA, 64 nt, Human
uucaccaaagaugaucaacuagaaauguuaaguggcuaugcaagcaaaagcauagauagguuaa

SEQ ID NO: 514955 - RNA, 64 nt, Human
ucuauaaagauuccacaguuugacauuauggcuugcuaugcagaugugaaaauagguuaaauaa

SEQ ID NO: 514956 - RNA, 64 nt, Human
caagaagaguaaacaggaaaccuacuuuuuaugugcuaugcaaaauagacaucuuuaacauagu

SEQ ID NO: 514957 - RNA, 64 nt, Human
ggugacuccauucugaggugucacaagcaaugaagcuaugcaaacaauaggagggugugacagg

SEQ ID NO: 514958 - RNA, 64 nt, Human
aagagagcgaggagaaccauucuggaaacucuaggcuaugcauguuuaaagaucugguccccuu

SEQ ID NO: 514959 - RNA, 64 nt, Human
ucaacugagaagccaagccuggaguaggccuggggcuaugcauacgcauuaagggccugcugga

SEQ ID NO: 514960 - RNA, 64 nt, Human
augugucuucuuuguaaaaguuuagguauaaaaugcuaugcaacuuuuucuuuauaguaagagc

SEQ ID NO: 514961 - RNA, 64 nt, Human
uucugaaguuggaguguagucuuuucccccuuaggcuaugcauuaaucgaagcuuucuuuucac

SEQ ID NO: 514962 - RNA, 64 nt, Human
gaaguguuuuucccccuugagauaauggauauuugcuaugcagcaccaugaagaagagagacua

SEQ ID NO: 514963 - RNA, 64 nt, Human
guggggcugagccacgcucucguuuugucaggcagcuaugcaguugcucuuccuuguuuuuguu

SEQ ID NO: 514964 - RNA, 64 nt, Human
aucgauuaagugccuuaaaaccucuuuagacauagcuaugcaaguuuuuuauguuuguguucca

SEQ ID NO: 514965 - RNA, 64 nt, Human
gacaaggggcaguggugguuuucuguucuuucuggcuaugcauuugaaaauuuugauguuuuaa

SEQ ID NO: 514966 - RNA, 64 nt, Human
uuuaaaguagcuuuuggaagagaaaugaggauuugcuaugcagacagggaagggaauuucacuu

SEQ ID NO: 514967 - RNA, 64 nt, Human
cggaaaaaaaaaaaagaggucaggguuuuaacgagcuaugcaaucuuuuuccaaaacccaaggu

SEQ ID NO: 514968 - RNA, 64 nt, Human
acuugaaccacucccacgugcugccucccuuaggaggggacacugaugaugaggucucggagcc

SEQ ID NO: 514969 - RNA, 64 nt, Human
cucaguccuggaagccggccggcugggaucaagaaggggacagcgccaccucuugucagugcuc

SEQ ID NO: 514970 - RNA, 64 nt, Human
ugggcuuacaagaaacacugaugaauguaaaaucaggggacauuugaagauggcagaacugucu

SEQ ID NO: 514971 - RNA, 64 nt, Human
ggacagcuaauugccaccaugaaagaagcaugucgcuaugcacugcaagugaaaccucagcgcc

SEQ ID NO: 514972 - RNA, 64 nt, Human
aaaccaccacggugccaucucuuguguaugcagggcuaugcaccugcaggcacguguguaugca

SEQ ID NO: 514973 - RNA, 64 nt, Human
cgggcaaggcgguccccgccgacguccuggaggcgcuaugcaaggagcgggcgcgcuucgaaca

SEQ ID NO: 514974 - RNA, 64 nt, Human
ccagccccugcugcuugcuuucugccaaaccugugcuaugcaucagcugugcccucuguggacu

SEQ ID NO: 514975 - RNA, 64 nt, Human
uggcaaaguacuugucauagacuccuuugcuaaugcuaugcaaaaaauucuuuagagauuauaa

SEQ ID NO: 514976 - RNA, 64 nt, Human
cacaucacugcacccguccuguguccucaccauugcuaugcaaagugauucuuguuguacauaa

SEQ ID NO: 514977 - RNA, 64 nt, Human
auugagacgucaaugggacgcauuuuucuguugagcuaugcagucgucaaaacagcgauagaca

SEQ ID NO: 514978 - RNA, 64 nt, Human
uuuuucaaaguuucuuuccuuuuaauguuucccugcuaugcaaaaccuuucccagaccucaguu

SEQ ID NO: 514979 - RNA, 64 nt, Human
uccugacuagccccaagucccuucauuugcaucugcuaugcaauagucccucuccuuuccuucu

SEQ ID NO: 514980 - RNA, 64 nt, Human
cacuuuugcuuguagucauggccagggccaaauagcuaugcagagcagagaugccuucaccugg

SEQ ID NO: 514981 - RNA, 64 nt, Human
gcuuaggucccauggugggggaggaaccucaggggcuaugcagcccccgccagcugcccucgaa

SEQ ID NO: 514982 - RNA, 64 nt, Human
aacugauugaaacagauucaaagaaguaucgagugcuaugcauugaaacuuguuuuuaaauguu

SEQ ID NO: 514983 - RNA, 64 nt, Human
uggaggaacuuuaaacgcuguuuucucagagcaagcuaugcaccugggaguuccuucucaaaga

SEQ ID NO: 514984 - RNA, 64 nt, Human
cugagaauucacccaugagagagacccagugguugcuaugcacuuaggaaaacuuucagccaca

SEQ ID NO: 514985 - RNA, 64 nt, Human
cuagauuacuuaaaauaccucaugcauuauaaaagcuaugcaaauaguuguucuauuguauugu

SEQ ID NO: 514986 - RNA, 64 nt, Human; identical to SEQ ID NO: 412592

SEQ ID NO: 514987 - RNA, 64 nt, Human; identical to SEQ ID NO: 410576

SEQ ID NO: 514988 - RNA, 64 nt, Human; identical to SEQ ID NO: 412651

SEQ ID NO: 514989 - RNA, 64 nt, Human
cacagauaggcaggaggagcucaguugucggacagcuaugcagucccuguccgguggugcugga

SEQ ID NO: 514990 - RNA, 64 nt, Human
guuaucaguacaauucuuuguugcuuaaucuagagcuaugcacaccaaauugcugagauguuua

SEQ ID NO: 514991 - RNA, 64 nt, Human
cuaaaaaaaauacaaaaauuagcugggcaucccagcuaugcagaagcugaagcacaagaauugc

SEQ ID NO: 514992 - RNA, 64 nt, Human
guaaagacccuccaccaccccuauaaguuugauugcuaugcagguuugggagaggaggccuauu

SEQ ID NO: 514993 - RNA, 64 nt, Human
ugguuggcugggaaaucgagugccgcaucucacagcuaugcaaaaagcuagucaacaguacccu

SEQ ID NO: 514994 - RNA, 64 nt, Human
guaauuuuguguuuucuugagugucacuugauaggcuaugcauauuggaauucaaagaaaccca

SEQ ID NO: 514995 - RNA, 64 nt, Human
gaacacagcucagauuuuggcuggaauggcuauggcuaugcaguggcacuucuuguuguagucu

SEQ ID NO: 514996 - RNA, 64 nt, Human
uuuuaaaaucuggcuucacauacacagagucuuugcuaugcaccauguacuguucuaagcuucu

SEQ ID NO: 514997 - RNA, 64 nt, Human
ggcaugacuuaagaggaagggcagucuugggcccgcuaugcagguccuggcaaaccuggcugcc

SEQ ID NO: 514998 - RNA, 64 nt, Human
ucucugccccacaacccugcauucccagagguuagcuaugcagcccaccuagaugagucucuuc

SEQ ID NO: 514999 - RNA, 64 nt, Human
guggggagccgagguauggaggagcuggggagcagcuaugcaaaucccuaccuacccagcuggg

SEQ ID NO: 515000 - RNA, 64 nt, Human
ucacgugacucagcagugcccgccgccgucaccagcuaugcauucacuccguuuccagugagca

SEQ ID NO: 515001 - RNA, 64 nt, Human
uagaugugaaaaugcuuugaaaauguuuuuaagugcuaugcauauuuauagaguuauuauaguu

SEQ ID NO: 515002 - RNA, 64 nt, Human
gugacuuuuagguaagaaauaggcaugaugauaagcuaugcagauuauuaaaaagcuugauaca

SEQ ID NO: 515003 - RNA, 64 nt, Human
uagccauuuguuauguagugguagcgacuuuccugcuaugcaggaaucccucccaugacgugua

SEQ ID NO: 515004 - RNA, 64 nt, Human; identical to SEQ ID NO: 409054

SEQ ID NO: 515005 - RNA, 64 nt, Human; identical to SEQ ID NO: 412969

SEQ ID NO: 515006 - RNA, 64 nt, Human; identical to SEQ ID NO: 410612

SEQ ID NO: 515007 - RNA, 64 nt, Human
caccgcuagccguuguuccugugcaaaguagugugcuaugcacccacccagguggccgccucug

SEQ ID NO: 515008 - RNA, 64 nt, Human
caacuccccagugcugucugagcgcucccugcuggcuaugcaagaggacgcggccccggggggc

SEQ ID NO: 515009 - RNA, 64 nt, Human
uauacacucugauuccuauaauacagugcuauaagcuaugcacagaaaauaaaauguuugaaau

SEQ ID NO: 515010 - RNA, 64 nt, Human
gcuaaaauauccugucuggcagaguguuuugguagcuaugcaggccucccuucaguguaccucu

SEQ ID NO: 515011 - RNA, 64 nt, Human
gagcaguuagcagaccuaaagcaagccugaauuggcuaugcaguacauuguauucuguuugggg

SEQ ID NO: 515012 - RNA, 64 nt, Human
uuauguccugcuuugauaaaacugcuagaggauggcuaugcaaaagcauaacgauucaaggaaa

SEQ ID NO: 515013 - RNA, 64 nt, Human
cugccuuuguaacuuccacuuagccuacuacagggcuaugcacaucuuaguuuccaaaagucug

SEQ ID NO: 515014 - RNA, 64 nt, Human
aagccuagccaccucagcugcagggaggcagaaggcaaggcaggccccacggacacacuugggc

SEQ ID NO: 515015 - RNA, 64 nt, Human
caguguaaccuaccaguacaacugugaauccuaggcaaggcaaaaaugcacuuccacugaaacg

SEQ ID NO: 515016 - RNA, 64 nt, Human
guguuuuuuuuuuuuuuuuuuuuguuguuuaaaagcaaggcaugcuuguggaugacucuguaac

SEQ ID NO: 515017 - RNA, 64 nt, Human
agcccagaaccacagaugugucugggagagccuggcaaggcauuccucaucaccaucguguuug

SEQ ID NO: 515018 - RNA, 64 nt, Human
gcaagaaagaauuugaggcgaauccauagaguaagcaaggcaaguuacuucuauauagaagggu

SEQ ID NO: 515019 - RNA, 64 nt, Human
uggugugguggggugggcucucccuuaggcuugggcaaggcagccaccugcccuugcucucccu

SEQ ID NO: 515020 - RNA, 64 nt, Human; identical to SEQ ID NO: 412367

SEQ ID NO: 515021 - RNA, 64 nt, Human; identical to SEQ ID NO: 412423

SEQ ID NO: 515022 - RNA, 64 nt, Human
agguaguccugcuuuauaauaggaaaauguauuucuguauaagaguucuuugcuuucauuaacu

SEQ ID NO: 515023 - RNA, 64 nt, Human
uacccacagugaggcuguggauggaucaggggaccuguauaaaauguuugagccuguuccauuu

SEQ ID NO: 515024 - RNA, 64 nt, Human
caguauuccaucauggucugaaagucaaacuucggcaaggcacggacgacugugcagacacagc

SEQ ID NO: 515025 - RNA, 64 nt, Human
aggagggagggaaggaugucugggaugugaagaggcaaggcagaaauggaugaugaacaucaaa

SEQ ID NO: 515026 - RNA, 64 nt, Human
cugcagccuaacgugugguuuuaaugaccagcacgcaaggcaaaagcauuuugcacaguguuug

SEQ ID NO: 515027 - RNA, 64 nt, Human
cacacacagcugggcaaagccacaaggcuggccagcaaggcagguuggaugggagugggcaccu

SEQ ID NO: 515028 - RNA, 64 nt, Human
gcuuguguagacaagcgcgugcucgcugagcccugcaaggcagaaaugacagugcaaggaggaa

SEQ ID NO: 515029 - RNA, 64 nt, Human
agaccacgucacuacauuucuaugcaaggggacagcaaggcagcgugguggucauggcucuuag

SEQ ID NO: 515030 - RNA, 64 nt, Human
cccaccaggauuuccugugagggcccaggaaugagcaaggcauggucugccaccagcugacgga

SEQ ID NO: 515031 - RNA, 64 nt, Human
acuccauuuguuuggaccaaucccuuaaacaaaagcaaggcaaauuuuacauggauuuagagcc

SEQ ID NO: 515032 - RNA, 64 nt, Human
uggcucacgccuguaaucccagcacuuugggagggcaaggcaggcggauuaccuggggucagga

SEQ ID NO: 515033 - RNA, 64 nt, Human
cucccauccugcacuuuagccagcugcagggcgggcaaggcaaggaaagcugcuucccuggaag

SEQ ID NO: 515034 - RNA, 64 nt, Human
gggucuagauucugaggggguugguggauauugggcaaggcaggaaaccucuggagaccucauu

SEQ ID NO: 515035 - RNA, 64 nt, Human
aagcacuguguuauuuucacaguggagacacguggcaaggcaggagggcccucagcuccuaggg

SEQ ID NO: 515036 - RNA, 64 nt, Human
aauuuauuucaaaaagggaaacuauuguccccuagcaaggcaugauguuaaccagaauaaaguu

SEQ ID NO: 515037 - RNA, 64 nt, Human
uggggcauggucaaacuuagccauccccuccucagcaaggcaucuaccggccccucacagagac

SEQ ID NO: 515038 - RNA, 64 nt, Human
ugugagauuuauuuaauaggacuuccuuugaaagcuguauaauaguguuucucgggcuucuguc

SEQ ID NO: 515039 - RNA, 64 nt, Human
uauuuuugguuuuguguguauuuguauaaauuuucuguauaauuagcccaggcugauguaacua

SEQ ID NO: 515040 - RNA, 64 nt, Human
uucacuuucucuuugacuuuagaccuuuugaagucuguauaaacuuguuuugaaauauagucuc

SEQ ID NO: 515041 - RNA, 64 nt, Human
uaaauucacauguuuguaugaguacuuuugcgaagcaaggcaugaacugcuagguauuauuaag

SEQ ID NO: 515042 - RNA, 64 nt, Human
uggcagagggcacccgggcgguaguccgggacgcgcaaggcagagcccugacgcuccggguccc

SEQ ID NO: 515043 - RNA, 64 nt, Human
cuuaauuaggccacaguacagugauccaaggcaggcaaggcagccaggacaggggagcccgacc

SEQ ID NO: 515044 - RNA, 54 nt, Human
aggagugcggcugcgccugacagugcaaggcaggggcacggugguggggcacgg

SEQ ID NO: 515045 - RNA, 64 nt, Human
ccuggagccuggcccucugaggcuuacggucuuggcaaggcagcaucgccuuggcucuugggaa

SEQ ID NO: 515046 - RNA, 64 nt, Human
cucugggggcgguggggugcguggggguggcaaugcaaggcacugaggccacagaugugaguaa

SEQ ID NO: 515047 - RNA, 64 nt, Human
aauaggaaaauacuugaaaugcaugucucaagcugcaaggcaaacuccauuccucauauuaaac

SEQ ID NO: 515048 - RNA, 64 nt, Human
ucaauacuguccuugcuuguuuuauugcaggcaagcaaggcaaauggccuaaaaugcuguggcu

SEQ ID NO: 515049 - RNA, 64 nt, Human
uucacaaaacagguuuguauguagcaccuuucaugcaaggcaugcaaaaagccuauuuuaaaau

SEQ ID NO: 515050 - RNA, 64 nt, Human
uaauggaagagcucacucuauacaaaaccaauaugcaaggcauguguuuguccaagcaauugga

SEQ ID NO: 515051 - RNA, 64 nt, Human
agaccagcaaugugaacuguauuuacauaaacgugcaaggcacauacauaaugacuuucuuuuu

SEQ ID NO: 515052 - RNA, 64 nt, Human
uugaaagauuuaugucagucuuagauaauaccaugcaaggcaauuaaaucacugugacagcaca

SEQ ID NO: 515053 - RNA, 64 nt, Human
ggaagaagaugaagaaggaaaccaggugaacucagcaaggcagacuggcugcuuacuucagcac

SEQ ID NO: 515054 - RNA, 64 nt, Human
aacucccugauucuauacccucuuccuucuuucugcaaggcagaggaauaauauuuuuaaaggu

SEQ ID NO: 515055 - RNA, 64 nt, Human
acgcauaccuagaggaacucuaaccccgguguaccuguauaaacugaacugugaaacuguuucg

SEQ ID NO: 515056 - RNA, 64 nt, Human
aaguaaucccagauaauaaauuccuaaaaggaaacuguauaagcaauugcccuuaaaaauuaaa

SEQ ID NO: 515057 - RNA, 64 nt, Human
ccuuuacaauuacuuuuagcuguaacauccgauucuguauaagccacauagaaaaaaguugccu

SEQ ID NO: 515058 - RNA, 64 nt, Human
uuaaagaugccacccugggcugcccuggcaccuagcaaggcacaccaagaacagcuuuugaguc

SEQ ID NO: 515059 - RNA, 64 nt, Human
ugagcagugcuugaaugaaguuguagguaauauugcaaggcaaagacuauucccuucuaaccug

SEQ ID NO: 515060 - RNA, 64 nt, Human
aggccugcugugguucugacacacaggaucccaggcaaggcaccacuuccucacaugaaugagg

SEQ ID NO: 515061 - RNA, 64 nt, Human
uucucaagaguuggugacuuggaaggccgcuucugcaaggcaagucucaggaacccaugcaggu

SEQ ID NO: 515062 - RNA, 64 nt, Human
uggaugaagcuggggcugcaagacugccucuccugcaaggcagcucauacuuguacuguauguu

SEQ ID NO: 515063 - RNA, 64 nt, Human
acauauaucuggaguuacuauacuuuacugaagagcaaggcauaaauuuagacuaaaauccauc

SEQ ID NO: 515064 - RNA, 64 nt, Human
uagggugacaaguacauguuccuuuuggaaagaagcaaggcaauguauauuaauuauucuaaaa

SEQ ID NO: 515065 - RNA, 64 nt, Human
cuaagguguccagugcauugggaugguuuuccaggcaaggcacucggccaauccgcaucucagc

SEQ ID NO: 515066 - RNA, 64 nt, Human
cacccaggccacaaggccaugguuaauucuuaaggcaaggcaaauccauggaugagaagugcaa

SEQ ID NO: 515067 - RNA, 64 nt, Human
gaggcgcuacgcagacaguccugcugcucuagcagcaaggcaguaacaccacaaaagcaaaacc

SEQ ID NO: 515068 - RNA, 64 nt, Human
acaggagaguugagcacuuccagucaguuuuuaagcaaggcauggggaacagggaauagaaccu

SEQ ID NO: 515069 - RNA, 64 nt, Human
ccucuggcagcuggcccaggaagagccagcaagagcaaggcaugggagaggggaggugucacac

SEQ ID NO: 515070 - RNA, 64 nt, Human
agcucuuccugcuacuccaguuuccucagccucugcaaggcacucagggugggggacagcagga

SEQ ID NO: 515071 - RNA, 64 nt, Human
aagggaugacaaaagcauguugcgcuuugcaucagcaaggcauugacuucugaaaaaaugaucu

SEQ ID NO: 515072 - RNA, 64 nt, Human
guauaucacauuugugcuuccuggaaugaaaauucuguauaaccagguccuaacagugaucaga

SEQ ID NO: 515073 - RNA, 64 nt, Human
caacgauugugucuuuccuggucuguccuaggagcuguauaaagaagcccaggggcucuuuuua

SEQ ID NO: 515074 - RNA, 64 nt, Human
cuuggcagacuaaaacaaguacaucuguacaugacuguauaauuacgauuauaguaccacugca

SEQ ID NO: 515075 - RNA, 64 nt, Human
ucuuugaaacugccuuugugagcaaagugcuuuggcaaggcaagggucucccucagcagggcua

SEQ ID NO: 515076 - RNA, 64 nt, Human
uugcauccuugaggcucagggaugagagggcaccgcaaggcacccagccuuaccccacaagcag

SEQ ID NO: 515077 - RNA, 64 nt, Human
uuuuuccaccuggaaauuaggaauaauguagaaugcaaggcaguaauuuccuuuuggaaaggac

SEQ ID NO: 515078 - RNA, 64 nt, Human
cacaggcuguuugaaagcuucaccucaccuuucugcaaggcagaaaaaguaugaaaaaaaccaa

SEQ ID NO: 515079 - RNA, 64 nt, Human
agucuuggugcuaucaaucaccgucuguguuugagcaaggcauuuggcugcuguaagcuuauug

SEQ ID NO: 515080 - RNA, 64 nt, Human
gcaucacggcaaugucacgaugcccagacuuggagcaaggcaaccuuggagucaguccacucau

SEQ ID NO: 515081 - RNA, 64 nt, Human
cucauggaucugcuagguauuuauuucaaauaaagcaaggcauauguucacugauuuacgagua

SEQ ID NO: 515082 - RNA, 64 nt, Human
caucauuggauagcucagagggcccuugauucuggcaaggcaaauaaagccagaaugagaaauu

SEQ ID NO: 515083 - RNA, 64 nt, Human
uggagcugcuuuuaauuuuagcaaaauguuuuaugcaaggcacaauaggaagucaguucuccug

SEQ ID NO: 515084 - RNA, 64 nt, Human
auacccaucuugcuuucuuuuugguuuauuuguagcaaggcacauauagaagaagaaauuucug

SEQ ID NO: 515085 - RNA, 64 nt, Human
ucuaucucugggggucgcacguugcgggcagagcgcaaggcauacaccagaaaacgcuguccug

SEQ ID NO: 515086 - RNA, 64 nt, Human
aaaaugagcauugauguacccauuuuuuaaaaaagcaaggcacagccuuugcccaaaacuguca

SEQ ID NO: 515087 - RNA, 64 nt, Human
uuuccuauuugaugguuuguaaguagacaguaaggcaaggcagaugauuauuacccucagaaag

SEQ ID NO: 515088 - RNA, 64 nt, Human
gaugagaaccuucuuacugcaugauaacaaagcagcaaggcaagcaaaagcguaagaugaagag

SEQ ID NO: 515089 - RNA, 62 nt, Human
uacagccagcagggcccaggcagccaccaagcccaccccaggucaugccagcggcagaggac

SEQ ID NO: 515090 - RNA, 62 nt, Human
cuggaaagacucaauagugagaauauagccucccaccccauuaacuucgcucccaugggaga

SEQ ID NO: 515091 - RNA, 59 nt, Human; identical to SEQ ID NO: 271860

SEQ ID NO: 515092 - RNA, 64 nt, Human
uaugagaaaaaaacagcaggggcauuaguuucaggcaaggcagcucccagguuuagagauuaau

SEQ ID NO: 515093 - RNA, 64 nt, Human
cagcauucauucagcaaagacuuuugggguuugugcaaggcacaguuuuaagcacauaauguaa

SEQ ID NO: 515094 - RNA, 64 nt, Human
auuuuuggauuucauauacaugacugaacugugugcaaggcaauaguuagccuugauuuuagcc

SEQ ID NO: 515095 - RNA, 64 nt, Human
aaaaaugguagcauuuuaaacaaaauagaaaguugcaaggcaaauguuuauuuaaaagagcagg

SEQ ID NO: 515096 - RNA, 64 nt, Human
cuuugaacuucgauguuugcuguguuucaaaccugcaaggcaaaguaaaauuagagcaagaaca

SEQ ID NO: 515097 - RNA, 64 nt, Human
accucuuuaucaguucugaggcuggaggguuugggcaaggcaacauccccauuccaauuccauu

SEQ ID NO: 515098 - RNA, 64 nt, Human
uauuguucaaaugagcagggcccgagcuggaagcgcaaggcagccgccgccgugccgcuccucc

SEQ ID NO: 515099 - RNA, 64 nt, Human
uucuuuucuuaaagcaggcuaugugcccuacauggcaaggcaccaugacugcccaucgagaugc

SEQ ID NO: 515100 - RNA, 64 nt, Human
gcgugaagccacaaguuugagaccagccugguuagcaaggcaagauccccaacucuacaaaaaa

SEQ ID NO: 515101 - RNA, 64 nt, Human
uuugggggaccuggaagaaaugucuccaaaggaagcaaggcauguuuuaguugagugcucuggu

SEQ ID NO: 515102 - RNA, 64 nt, Human
acggaauucuauugcuaagaaagugggagcauaggcaaggcauugggaacacaggguagcugcu

SEQ ID NO: 515103 - RNA, 64 nt, Human
ugaggaggucauguucuagcuucccauucccagagcaaggcaggcgggaggccaaggacuggac

SEQ ID NO: 515104 - RNA, 64 nt, Human
cuguugugggggaggugaaccagggaggggcagggcaaggcagggcccccagagcugggccaca

SEQ ID NO: 515105 - RNA, 64 nt, Human
agagguugaauaauuaauguucaaaggcaagagggcaaggcauuuuuuaacacuuuuuaaaaua

SEQ ID NO: 515106 - RNA, 64 nt, Human
uggcugcacugagguggguguugaagagcccccuaggggacacacagcuuccaggaggagggaa

SEQ ID NO: 515107 - RNA, 56 nt, Human
agagagaccuaaaaaccugaagaggaaggggacaaguagccaccugaguuccugag

SEQ ID NO: 515108 - RNA, 64 nt, Human
cucugugcugcuggggucacgcgaggcuguuugcaggggacacggucacaggagcucuucugcc

SEQ ID NO: 515109 - RNA, 64 nt, Human
ggggcucucccgccugccuucucggggcccagacgcaaggcaccgauugggccaacaucagagc

SEQ ID NO: 515110 - RNA, 64 nt, Human
aggggccugagaggcugacagaggcaggaugggugcaaggcagggguggaggggagggaccagc

SEQ ID NO: 515111 - RNA, 64 nt, Human
aguuugaaauccaaguucuugccagaguguuggagcaaggcagcugauuugcugcagggaugga

SEQ ID NO: 515112 - RNA, 64 nt, Human
gggggcccuuacugugguagaaaccauugucacugcaaggcagcccugcuugggauucagguga

SEQ ID NO: 515113 - RNA, 64 nt, Human
aucaaggcagagcggcagagcggcaagcagagcggcaaggcaguucaacccaauggaaauggau

SEQ ID NO: 515114 - RNA, 64 nt, Human
gcacugugcaaagcaugcccuucugcacaggagagcaaggcacuugcaguagugaucuaugcca

SEQ ID NO: 515115 - RNA, 64 nt, Human
aggaaguaauuauuccucuaaagaaacauuuugagcaaggcaguuuagagaauccuaaugucua

SEQ ID NO: 515116 - RNA, 64 nt, Human
cugggccuugugugcuggcuuccgcugucacccagcaaggcacaggcuccuguauuugagacua

SEQ ID NO: 515117 - RNA, 64 nt, Human
gagagcacccugaggaccuuuaaaaggcaaagccgcaaggcagaaggaggcugggucccugaau

SEQ ID NO: 515118 - RNA, 64 nt, Human
cuauucuguuacgucauuaacagugccuuacugugcaaggcaccaaaggacauaaauacguacu

SEQ ID NO: 515119 - RNA, 64 nt, Human
uaccuuuccuuugucugccucagccccaggaagggcaaggcaagaugguggacagauagagaau

SEQ ID NO: 515120 - RNA, 64 nt, Human
accugggccucuccucggagccgaccccuggguagcaaggcagccgagagcaucucccuggagg

SEQ ID NO: 515121 - RNA, 64 nt, Human
caccagauuccugcaguugggcuuaacccacucugcaaggcaugugucuauucaggguuuccca

SEQ ID NO: 515122 - RNA, 64 nt, Human
uuugaccaaaugagauccauucagcgacuaacuggcaaggcacucaaaacaugucauucauuaa

SEQ ID NO: 515123 - RNA, 64 nt, Human
gccagggugggcaccaaagaccaggcccagagccaggggacagguuggggcugugggcuuggac

SEQ ID NO: 515124 - RNA, 64 nt, Human
ccucugggcagccccuuuccuccauguacacugcaggggacagaaggggggccccaucccuacc

SEQ ID NO: 515125 - RNA, 64 nt, Human
uuuuguaguaacauuaagacuuauauacaguuuuaggggacaauugagauggcugaacuacuga

SEQ ID NO: 515126 - RNA, 64 nt, Human
aguuauuaaaaagaaaacaaaacaaaaaaaaaaggcaaggcacaacaaaaaaauauccugggca

SEQ ID NO: 515127 - RNA, 64 nt, Human
cauucagucgucaugaguugagugcuuacuacaugcaaggcacucugcuaguuauauucuaaua

SEQ ID NO: 515128 - RNA, 64 nt, Human
gugccgaucccacccacccaccguagggugcacagcaaggcaucccaggugaggcuucccaccc

SEQ ID NO: 515129 - RNA, 64 nt, Human
agagacuuccucugguuuccucaggaggaaaugggcaaggcagaguaagcaggggagacagguu

SEQ ID NO: 515130 - RNA, 64 nt, Human
aacaaggcaaggagacuuucucucaucuuuccaagcaaggcaaggagacuuuuuaucauuagga

SEQ ID NO: 515131 - RNA, 64 nt, Human
cauuaucauaaugcagauacauuuucuguguucagcaaggcauugugugucauguggaucuuag

SEQ ID NO: 515132 - RNA, 64 nt, Human
ccugauaggacucuccuaguccaacuuggggugggcaaggcagucagcaucaccagcaauacca

SEQ ID NO: 515133 - RNA, 64 nt, Human
uuuuaaaauucugauuuuuauauauugaguuuaagcaaggcauucuuacacgaggaagugaagu

SEQ ID NO: 515134 - RNA, 64 nt, Human
gcacacaaucuggcucaauguauauauuggcccagcaaggcaaagaacugaaguuccaggaugg

SEQ ID NO: 515135 - RNA, 64 nt, Human
aggaguaaagguagccuugaggccagagcagguagcaaggcauuguggaaagaggggaccaggg

SEQ ID NO: 515136 - RNA, 64 nt, Human
auuaucugaugacauguugguaauuuuaaagacugcaaggcaguuuagagaaugaaguaaacca

SEQ ID NO: 515137 - RNA, 64 nt, Human
ucuggaugcugaguggagggagccacugagcacagcaaggcaccaaagccccuggagaaaccgc

SEQ ID NO: 515138 - RNA, 64 nt, Human
uacaaauguaaauuacuaauagugauguucuuuugcaaggcauagaacauuuguaugaaaagac

SEQ ID NO: 515139 - RNA, 64 nt, Human
aagggggcugaccuggagcagagcauggugagaggcaaggcaugagagggcaaguuuguugugg

SEQ ID NO: 515140 - RNA, 64 nt, Human
ccuacugaccuggcuggugacagaacaugcagcaaggggacaucuuaggcuggccagacuucag

SEQ ID NO: 515141 - RNA, 64 nt, Human
cauaacaaaggugguguugcuccagcucagccccaggggacacagaugcacuuugggggugagg

SEQ ID NO: 515142 - RNA, 64 nt, Human
ggcaggggccugggccggcgagggggccggggggaggggacagagcugaggauuuccuggagug

SEQ ID NO: 515143 - RNA, 64 nt, Human
uggaggaggugggacguuugggcuugggggcucggcaaggcaagcaagacacaccagagcucuu

SEQ ID NO: 515144 - RNA, 64 nt, Human
uuucaguugccaaaagcugcaucaggggaaugcggcaaggcacacagggcucuggcagccccug

SEQ ID NO: 515145 - RNA, 64 nt, Human
agaugccagugagccacguccaugcccauuccgugcaaggcagauauuccagucauauuaacag

SEQ ID NO: 515146 - RNA, 64 nt, Human
aagaggagugcuuguccccuaagaguguuuaauggcaaggcagcccugucugaaggacacuucc

SEQ ID NO: 515147 - RNA, 64 nt, Human
acuuaggaguuauuagugcuaaaaaggggaccgugcaaggcagcagaguuacaugguucuucaa

SEQ ID NO: 515148 - RNA, 64 nt, Human
gaaugccacacuauggaaugcagcuaccugccaagcaaggcaauagaaggcaaaaaauggaagu

SEQ ID NO: 515149 - RNA, 64 nt, Human
aacucucacuuuaguggauguaaauggaacuucugcaaggcaguaauuccccuuaggccuuguu

SEQ ID NO: 515150 - RNA, 64 nt, Human
guauaauuucucugccgacuccauuuaauccacugcaaggcaccuagagagacugcuccuauuu

SEQ ID NO: 515151 - RNA, 64 nt, Human
acagcaagccauuuugguuacauaucuacugguugcaaggcaggaaauauuggugaaaugcuag

SEQ ID NO: 515152 - RNA, 64 nt, Human
auuuuacaggcauuuauauccauugcuuuccucagcaaggcauguuacuacuuuuaucaucuaa

SEQ ID NO: 515153 - RNA, 64 nt, Human
guuaccuaaugguccucucugucccauuauaggugcaaggcaccccauccacacauuugcacca

SEQ ID NO: 515154 - RNA, 64 nt, Human
uguaaucuagauuuuccuauguugaaugcuuaaagcaaggcauaccuguccuagcaggaucugc

SEQ ID NO: 515155 - RNA, 64 nt, Human
ccccaacccccagcacccgggcucagggaccacagcaaggcaccugcagguugggccauacugg

SEQ ID NO: 515156 - RNA, 64 nt, Human
uauguagagaguuggggugucugguaggcaaacugcaaggcaguugagauaguuggauuaagag

SEQ ID NO: 515157 - RNA, 64 nt, Human
gcugaccuuucuccugcuucucuccaggcucugcaggggacagggcaggugcugcaggagcccc

SEQ ID NO: 515158 - RNA, 64 nt, Human
caguuauuuuuagaugagcagugucuucauucgaaggggacacuaacugugaugaucucauaua

SEQ ID NO: 515159 - RNA, 52 nt, Human
cagagccugaacucgcaugagaaggggacaccccacaccgcucaagcuuggg

SEQ ID NO: 515160 - RNA, 64 nt, Human
uuacuaacagcaacagcaagaaauaaaucagagagcaaggcaucgggggugaaucuugucuaac

SEQ ID NO: 515161 - RNA, 64 nt, Human
gcacccgcugggcgcgggcagcagggaagagggagcaaggcauuguccacagacugcugggguc

SEQ ID NO: 515162 - RNA, 64 nt, Human
ggguuuucuuuuuuaaaaacauaauacugugcaggcaaggcacuguaaaaguuuuaauuccuuc

SEQ ID NO: 515163 - RNA, 64 nt, Human
gcccuccccuggcacucugacugcaugcugaugagcaaggcaggcaggucugagaggcgaaacg

SEQ ID NO: 515164 - RNA, 64 nt, Human
uguucagggugccaguagugggcauggggugggggcaaggcaggacaaaacauacaagucugag

SEQ ID NO: 515165 - RNA, 64 nt, Human
guauaguucauuucaucucugugacaaauuuauagcaaggcacugaauuuuaucuuuugguaga

SEQ ID NO: 515166 - RNA, 64 nt, Human
accugaguguccuugcucuagagguucaaaggcagcaaggcagugagcuaugagcccagcaugg

SEQ ID NO: 515167 - RNA, 64 nt, Human
uccuucuguggccccggaggaaggagagacugaggcaaggcaaagugauaguacacggaagcag

SEQ ID NO: 515168 - RNA, 64 nt, Human
auuuagacuuggcauccagcaugggauaguuggggcaaggcaaaacuaacuuagaguuuccccc

SEQ ID NO: 515169 - RNA, 64 nt, Human
cuucccauaucuacucuucugugauugggagacugcaaggcacugaggaguaucaaagaagcaa

SEQ ID NO: 515170 - RNA, 64 nt, Human
ggccguaaagauggauuucuaaacccacuggguggcaaggcaggaccuuccuaauccuugcaac

SEQ ID NO: 515171 - RNA, 64 nt, Human
accccaagucagucaggaagcugcccauuuuuuugcaaggcauuuuaaugcccuuucccagacc

SEQ ID NO: 515172 - RNA, 64 nt, Human
auucaaauaaguauguauugagugccuacucugugcaaggcacuaugcuagaucuggugccuag

SEQ ID NO: 515173 - RNA, 64 nt, Human
uuucaagucugggagacagauaaggaggccaggugcaaggcagggaggcagagagaauguugug

SEQ ID NO: 515174 - RNA, 64 nt, Human
cucugcauuccuuccggggggagccuguccucagaggggacaaccugugacacccugaguccaa

SEQ ID NO: 515175 - RNA, 64 nt, Human
guagacucuugcuccugcuucuccugauccugcaaggggacauuccaguagaaguuuuuugcuu

SEQ ID NO: 515176 - RNA, 64 nt, Human
accucccuucuucuaacuaaauauaaaaagauccaggggacauaaauguggagauuaaauaaag

SEQ ID NO: 515177 - RNA, 64 nt, Human
uuuuaaaccaucaacauuacuuuucuuucuuaaggcaaggcaugcauaagagucauuugagacc

SEQ ID NO: 515178 - RNA, 64 nt, Human
uucucauucuguauagaccagcaaacuucccugugcaaggcaaguuuacaucacaaauccaaga

SEQ ID NO: 515179 - RNA, 64 nt, Human
gagucauaaauaugccauuuacaauaaggaggaggcaaggcaaaugcauagauguacaaauaua

SEQ ID NO: 515180 - RNA, 64 nt, Human
ugcugcuauaagaauguccagcuaccaugggaacgcaaggcagcaacucucuaauuaaccaggu

SEQ ID NO: 515181 - RNA, 64 nt, Human
acauuuucucuauggaagacguauguugcauaaagcaaggcacacuucugcuuuaugugugugu

SEQ ID NO: 515182 - RNA, 64 nt, Human
cauucaacagauaguucagaaacacuuuuuaucugcaaggcacuauucuagauccagaagaugc

SEQ ID NO: 515183 - RNA, 64 nt, Human
uauugagcagagggacugugcuucuaugcacugggcaaggcaguauuugcuuaggaaacuaauu

SEQ ID NO: 515184 - RNA, 64 nt, Human
caaguuucugccucuuuuaaauguacuugacuuugcaaggcaaguaguuuuacagccauuucug

SEQ ID NO: 515185 - RNA, 64 nt, Human
uguucagaaggaugggaaaaaggcuggaaggaaagcaaggcagaaggccaggaguaagcccaag

SEQ ID NO: 515186 - RNA, 64 nt, Human
uuucaauuugccagggaacaguggcaggcugcuagcaaggcagugagaagcucuuggcagccaa

SEQ ID NO: 515187 - RNA, 64 nt, Human
uugaaaaaaggaccaaaaauuauuuuuagcuauggcaaggcacaggccacauggccccugaugg

SEQ ID NO: 515188 - RNA, 64 nt, Human
cggucaccuuuguccuguuuucuacagguuagaagcaaggcacaagucauaccuacauucaagg

SEQ ID NO: 515189 - RNA, 64 nt, Human
ugacggugaccuguugacguaacuaagccuuacagcaaggcaugugccgcacgugcuccguggu

SEQ ID NO: 515190 - RNA, 64 nt, Human
ggaagaaaaugaagaaggagugauugaaugucgggcaaggcacuggcugagcugcuguggcucc

SEQ ID NO: 515191 - RNA, 64 nt, Human
cagagggcugccucuccagcggcuugggccggggaggggacacuccaguucucuagcauggccu

SEQ ID NO: 515192 - RNA, 64 nt, Human
auaaacgcagaguucacuguugcagccuuuuugaaggggacacagucuaggagggggauaaaug

SEQ ID NO: 515193 - RNA, 64 nt, Human
cuucaauuccucagcuuccccucugccuccaaacaggggacacuucgggaaugcugaacuaaug

SEQ ID NO: 515194 - RNA, 64 nt, Human
aagauguauuaaggggggaaaaccuggucuaagugcaaggcacacuuacagcgaguuuuacuuu

SEQ ID NO: 515195 - RNA, 64 nt, Human
cuuuccuggcuuuguucacuugcagaaaaggagcgcaaggcagaggcucugaagcacuuuccuu

SEQ ID NO: 515196 - RNA, 64 nt, Human
uaauguuaauagaggaaaugcagcaacgucaaaagcaaggcagguugguuaauuagaucugggg

SEQ ID NO: 515197 - RNA, 64 nt, Human
ggucucuccaagugcaucuagccuggccuggagggcaaggcagaugcauucuccuggcugcugg

SEQ ID NO: 515198 - RNA, 64 nt, Human
aagaagacaaaugaggucauaaacacugcauaaagcaaggcaaaaauguaugccacaucucagu

SEQ ID NO: 515199 - RNA, 64 nt, Human
uuggcggcagcagccaucauaggaagggaccaaggcaaggcaggugccuccaggugugcacgug

SEQ ID NO: 515200 - RNA, 64 nt, Human
ccugcuccaccacugacucaccgaaugaccuugggcaaggcacugcccucucugugccuugguu

SEQ ID NO: 515201 - RNA, 64 nt, Human
cuucuuucuugugucucccagcacacgugugcacgcaaggcagccuuucccuuuggcuagauaa

SEQ ID NO: 515202 - RNA, 64 nt, Human
ccugaaauagaguccuuaagacaagcaaagacaagcaaggcaagcacgucuggaaacagaaccc

SEQ ID NO: 515203 - RNA, 64 nt, Human
gggacuccucgagaggggacucgcggccgcgauggcaaggcauccugugaauucaugcgcugcg

SEQ ID NO: 515204 - RNA, 64 nt, Human
cagccacgccaggaggaggacacggccgccgagagcaaggcacaaccucgaguucuuggggcgc

SEQ ID NO: 515205 - RNA, 64 nt, Human
ugguaaugaaagagcgaaugacugaacagccauggcaaggcagaccuacaggcgaggccgcagc

SEQ ID NO: 515206 - RNA, 64 nt, Human
uguuuugcagaaugagccagaguucaccaagcaggcaaggcaaggaaggguguugcagagaggg

SEQ ID NO: 515207 - RNA, 64 nt, Human
cagacacgcacugcauucggcagagcuccagugagcaaggcacgacccucagaucucagucuag

SEQ ID NO: 515208 - RNA, 64 nt, Human
gccccuccaccaccaggggcacugccgucauggcaggggacacaguuguccuugugucugaacc

SEQ ID NO: 515209 - RNA, 64 nt, Human
ccucaucagcuccccaggcaaaaacaaaagugggaggggacacaugcucauuaucagggugccc

SEQ ID NO: 515210 - RNA, 64 nt, Human
aaccuguguuguccuagacccugucggggcagucaggggacacuagagauuugaucucaugcga

SEQ ID NO: 515211 - RNA, 64 nt, Human
cugcuuugcgucuaaccuuugugggggagggccagcaaggcaguccccccacgcccgagaaagc

SEQ ID NO: 515212 - RNA, 64 nt, Human
ccuggacccuggccagaagagcccuggcccuccagcaaggcagcaccugcucugaugcaccugu

SEQ ID NO: 515213 - RNA, 64 nt, Human
ccggcagggaaucggaacccucagacccacagccgcaaggcacuggauucuggcagcacccuga

SEQ ID NO: 515214 - RNA, 64 nt, Human
uauuuacuuuucuuggcccuggccagggcugggcgcaaggcacgcagugaugggcaaaccaauu

SEQ ID NO: 515215 - RNA, 64 nt, Human
augccaaugagaguuauuuuaugguaaccacagugcaaggcaacugucagcgcaaugggggaga

SEQ ID NO: 515216 - RNA, 64 nt, Human
uuuuggaauaaugugaaucaaccgaaaacugggggcaaggcagaggacagguuuucucagguua

SEQ ID NO: 515217 - RNA, 64 nt, Human
caagugccgugaacaucaugcacagcagccuccagcaaggcaaauuugacacaaaaggcaucga

SEQ ID NO: 515218 - RNA, 64 nt, Human
uuuguauuuuguauauucgccugaagaucaucccgcaaggcaggcuggaggugccggugggccu

SEQ ID NO: 515219 - RNA, 64 nt, Human
cgcaugauaccagaggaggcgagggacagagacagcaaggcagacaguggcuggcaggggggcc

SEQ ID NO: 515220 - RNA, 64 nt, Human
acugucugccccucggggugucagaaauucuagcgcaaggcacuuuuaaacguggauuguuuaa

SEQ ID NO: 515221 - RNA, 64 nt, Human
ugaaagugacuuccguaucucagcccaugacucagcaaggcagaauggccaccccugccaaagu

SEQ ID NO: 515222 - RNA, 64 nt, Human
cucagcguggagggguaggggcugggaacagugugcaaggcagccgugggccccacccucgggg

SEQ ID NO: 515223 - RNA, 64 nt, Human
aggccccgagacuuuucuucugugauuuccaaaagcaaggcagccgugcuguucuaguuccucu

SEQ ID NO: 515224 - RNA, 64 nt, Human
uaucaggauuucuguucugagagcagcgugggcagcaaggcagggcagcccagagguggcagcg

SEQ ID NO: 515225 - RNA, 64 nt, Human
ggaaaacuuauucugaauauuaacgguggugaaaaggggacaguuuuuacccuaaagugcaaaa

SEQ ID NO: 515226 - RNA, 60 nt, Human
ucaucuucaacagccgguagccgcgugcggaggggacagagcgugagcugagcaggccac

SEQ ID NO: 515227 - RNA, 64 nt, Human
acuguauauaaacauauuuuuauacuuuauugaaaggggacaccuguacauucuuccaucauca

SEQ ID NO: 515228 - RNA, 64 nt, Human
auagcaucuccccccuccuagugagcaggggccugcaaggcaucacucccagccccucgccuuc

SEQ ID NO: 515229 - RNA, 64 nt, Human
cucugguucuucauuuauugagcaccuacuacaugcaaggcacuguacuaggcgugagaagcau

SEQ ID NO: 515230 - RNA, 64 nt, Human
caucuucaguugaagaaacacccucuuaggcugugcaaggcauggguuaucaggggauugaggu

SEQ ID NO: 515231 - RNA, 56 nt, Human
cauaugccgcagacccauagccgccugcaaggcagagaggacacaggagagccagc

SEQ ID NO: 515232 - RNA, 64 nt, Human
ugcacccaaaucuccaucucaggcgcuacuucuggcaaggcauaucaugaggcuagugaagcac

SEQ ID NO: 515233 - RNA, 64 nt, Human
agcuucccugagggugcccgggcaagucuugccagcaaggcagcaagacuuccugcuauccaag

SEQ ID NO: 515234 - RNA, 64 nt, Human
augcucccaggcugcacagcaggcagggagggaggcaaggcaggggaguggggccugagcugag

SEQ ID NO: 515235 - RNA, 64 nt, Human
ggugguuccaggagcaacagcucccaaacccugagcaaggcaaccgaucgccaggaccaggaag

SEQ ID NO: 515236 - RNA, 64 nt, Human
gcaggauauuauccaggagaacuuccccaaucuagcaaggcaggccaacauucagauucaggaa

SEQ ID NO: 515237 - RNA, 64 nt, Human
ugacucacgucuguaaucccagcacuuugggagggcaaggcaagagcuugagcuugagccuaga

SEQ ID NO: 515238 - RNA, 64 nt, Human
gggggcaggaagaggagcagaaaagaagggcugggcaaggcauaguggcuuaugccuguaaucc

SEQ ID NO: 515239 - RNA, 64 nt, Human
ugccuauagucccagcacuuugggaggccaaggugcaaggcaggcagaucauuugaggucagaa

SEQ ID NO: 515240 - RNA, 64 nt, Human
caggcaccaauuucuuuaaagaaauucaaugugggcaaggcauauguguaaauuucacuuuuac

SEQ ID NO: 515241 - RNA, 64 nt, Human
acuugaaucugggaucucgccuuauucucaaguagcaaggcaucucgacaagcauggucuaggu

SEQ ID NO: 515242 - RNA, 64 nt, Human
ccacaccucaccgcccaguccagcugucuccagaaggggacaggcaguccgcggucucuggaca

SEQ ID NO: 515243 - RNA, 64 nt, Human
cucugcccuccagaaccugcagccuggaggggugaggggacaaccaccccucuuuccuccaggu

SEQ ID NO: 515244 - RNA, 64 nt, Human
acaccccggccucggggcuccugguggcagcaccaggggacacaccugccaaacccaccagaug

SEQ ID NO: 515245 - RNA, 64 nt, Human
cuagucuggaaucuuugugaagcauaggguuauugcaaggcaaaugggaacuaacacaucuugc

SEQ ID NO: 515246 - RNA, 64 nt, Human
aaauaaaaauacuucuacuugaaaugcuguuuaagcaaggcaagugaauuuuguuauucugaaa

SEQ ID NO: 515247 - RNA, 64 nt, Human
guuuaccaggagcuuaauaauuaauggcuacauagcaaggcaucgucuuggaaccggagaauuu

SEQ ID NO: 515248 - RNA, 64 nt, Human
uugagggagcuaggcuguuuugcuagagauaauugcaaggcacguggcacuaaaagucauuuuu

SEQ ID NO: 515249 - RNA, 64 nt, Human
acagagucaucauuuucauuaucagcagacauaagcaaggcagaugugucuuccuccccaacac

SEQ ID NO: 515250 - RNA, 64 nt, Human
caguuaagugguuuaagugguguuagcuuugagggcaaggcaaagugaggaagggcuggugcag

SEQ ID NO: 515251 - RNA, 64 nt, Human
ggaggcugccuguguguuuccuccugggaugcgugcaaggcagaccuggugcugcaaaggaaag

SEQ ID NO: 515252 - RNA, 64 nt, Human
cacuucaaccacaggccuuugacuuugccacauggcaaggcacccagcagaagaugaggaugac

SEQ ID NO: 515253 - RNA, 64 nt, Human
agggcuggagcucugcccaggugcccuggggccagcaaggcagucccaggccugccgucuccag

SEQ ID NO: 515254 - RNA, 64 nt, Human
caugugccuguuccagauggcagggcuccuuacugcaaggcaucucucagcgccuccagcagcc

SEQ ID NO: 515255 - RNA, 64 nt, Human
ucuccuccguccccuuccuccacugcugccuaaugcaaggcaguggcucagcagcaagaaugcu

SEQ ID NO: 515256 - RNA, 64 nt, Human
caggccuccuuccagcccagaguggcccaguagagcaaggcagacagugaccuccacccccgca

SEQ ID NO: 515257 - RNA, 64 nt, Human
cuggccagcauuuucauucauuuuaaggaaaguagcaaggcauaauguaauuuagcuaguuuuu

SEQ ID NO: 515258 - RNA, 64 nt, Human
cugaacuuuauuuacucauuagucaagguucuuugcaaggcaggugauuaacuuaaauaucuca

SEQ ID NO: 515259 - RNA, 64 nt, Human
ucuccuaagaccucauccugcuggggaccccacgaggggacauccacccucugggguguggcca

SEQ ID NO: 515260 - RNA, 64 nt, Human
gcacuucuaguggucucaccuggaggcaagagggaggggacagaggcccugccacgucccgcug

SEQ ID NO: 515261 - RNA, 64 nt, Human
uccccuggaccauccagggugcuagggggcagggaggggacacccccuccccgccuuuaccuca

SEQ ID NO: 515262 - RNA, 64 nt, Human
aaauucccaaauccuagacugcuccugggcauuagcaaggcagagccuuuuuaccuggccuaga

SEQ ID NO: 515263 - RNA, 64 nt, Human
ggcuucugguccauuccagggcagggagugaggagcaaggcaacuggcauuuguccaccuggag

SEQ ID NO: 515264 - RNA, 64 nt, Human
ccccagcccaggaaaaacuggaagccuucccccagcaaggcagaagcuuggaggaggguuguaa

SEQ ID NO: 515265 - RNA, 64 nt, Human
cuucuccaugcucauccccaaacuggggccuggagcaaggcacucucaaaucuugaacccugga

SEQ ID NO: 515266 - RNA, 64 nt, Human
gacugagcuugauucuaaaggggacagaucuugagcaaggcaagaagugggauucaggaauggg

SEQ ID NO: 515267 - RNA, 64 nt, Human
aucugagaggcauugguuugucuugcauucuuuugcaaggcauauauugcagcugauaugaauc

SEQ ID NO: 515268 - RNA, 64 nt, Human
gaucucaagaaugguggaggacccuggaaggacagcaaggcagcuccccagccucacucuucac

SEQ ID NO: 515269 - RNA, 64 nt, Human
uuuuacugagauauaaauuagaauggcaugugcugcaaggcagauguaugggagccaaucauuu

SEQ ID NO: 515270 - RNA, 64 nt, Human
cguccaggaagcguuagggcugaugggugacucagcaaggcagugucagagcugggacugggcg

SEQ ID NO: 515271 - RNA, 64 nt, Human
acaaauggaaaagcagauuggggccagggagucagcaaggcaccccagcucugugaugugacuu

SEQ ID NO: 515272 - RNA, 64 nt, Human
ccccaugcagccucaaaauguuucaaaugccuaccgccucuagaucgagccacguugacuucag

SEQ ID NO: 515273 - RNA, 64 nt, Human
gcuuggaagagccggccuugggugggcccuccaccgccucuacccucacugggugggacugcca

SEQ ID NO: 515274 - RNA, 64 nt, Human
ucaguagcaaaccacuacagucaguaccuggacucgccucuacccagcagacccugacuccagc

SEQ ID NO: 515275 - RNA, 64 nt, Human
gugccaagccucuauuauacaaaccaugcagacucgccucuagagauucugauucgguugaucu

SEQ ID NO: 515276 - RNA, 64 nt, Human
caccccugcccagcgagagcgcagacaccgugugaggggacagcagcccuuggugcaaagccag

SEQ ID NO: 515277 - RNA, 64 nt, Human
aaggagaucuaaaaaacacaaucagaaaugacaaaggggacauuaccaccaaccccacagaaau

SEQ ID NO: 515278 - RNA, 64 nt, Human
ugggaccuggauugggucagaugccuguccuuggaggggacaagguugacugcuuaggaggcgc

SEQ ID NO: 515279 - RNA, 64 nt, Human
cucccggccaggcugggaacgggcaccaagcagccgccucuaacaaacaccaugguccguggaa

SEQ ID NO: 515280 - RNA, 64 nt, Human
uuagagacaggcacaugggcagcccuguucccuucgccucuacugcgaggccuggggagauguu

SEQ ID NO: 515281 - RNA, 64 nt, Human
uguuugcuuuagguuuuugaaacagccccggcgacgccucuauuggcucucggccuuggcaacg

SEQ ID NO: 515282 - RNA, 64 nt, Human
ucucuagcccucagcaccccugcgguaggagugccgccucuacccacuugugaugggguacaga

SEQ ID NO: 515283 - RNA, 64 nt, Human
uuucgagaccagccuggccaacauggcgaaaccucgccucuacuaaaaauacaaaaaaauuagc

SEQ ID NO: 515284 - RNA, 64 nt, Human
uucacuguuccacaaacagcaggcugaauggccucgccucuagauugacgugggccagccuccu

SEQ ID NO: 515285 - RNA, 64 nt, Human
uuuggccuaagcuggacucuccuuauccgagugccgccucuauccccuuccccacguuccagcc

SEQ ID NO: 515286 - RNA, 64 nt, Human
auauauauacacaccuacacauggccaaccgccucgccucuagcgcugggaaucagucacugug

SEQ ID NO: 515287 - RNA, 64 nt, Human
uggcgcaucucuucccucuugucccgaagaucugcgccucuagugccuuuugagggguucccau

SEQ ID NO: 515288 - RNA, 64 nt, Human
guucgagaccagccuggccaacacggugaaaccccgccucuacuaaaaauacaaaaaauagccg

SEQ ID NO: 515289 - RNA, 64 nt, Human
cugccuuccuuauuuaaccucuucuuuugccacucgccucuaucuuugaaucauauuuuggccu

SEQ ID NO: 515290 - RNA, 64 nt, Human
gccucugcccaccagcauguuccuugaagcccaucgccucuagcggggacccuccuuuccuccc

SEQ ID NO: 515291 - RNA, 64 nt, Human
uugggcaguguaaguaggagguucaucugcugugcgccucuaaugucugucuggaugggaugug

SEQ ID NO: 515292 - RNA, 64 nt, Human
cccauuuccagaaggguagauaggagccugcagucgccucuaaaauccuaccuaaccaucccau

SEQ ID NO: 515293 - RNA, 64 nt, Human
gaacucaggcuucuggucugcaguggagccuguucgccucuaauagccaguuuacagcacuugc

SEQ ID NO: 515294 - RNA, 64 nt, Human
aggcacccagccugcaucucccaggaggaaguggaggggacaucgcuguuccccagaaacccac

SEQ ID NO: 515295 - RNA, 64 nt, Human
caauuuuaucucaggaauuauuuuuaaaaggaggaggggacauagaaaaaaugaaaugcaagca

SEQ ID NO: 515296 - RNA, 64 nt, Human
cugucacaacaauaagcagggaggggagauguggaggggacacaucugguugccuuggaggcag

SEQ ID NO: 515297 - RNA, 64 nt, Human
ucugguugccccuggcuggcuuccuggaggcguucgccucuaguuucucagggauggagcgaga

SEQ ID NO: 515298 - RNA, 64 nt, Human
uacgugacugcucggcuccccccgcccaccccgccgccucuaauuuauagcuugguaauaaauu

SEQ ID NO: 515299 - RNA, 64 nt, Human
gagccauuuuggguagcugaucuugcauuuucuacgccucuacuuggucaguuucuagaagaca

SEQ ID NO: 515300 - RNA, 64 nt, Human
cuccuccacagaucauucuccuugaugaagccaccgccucuauggacuccaagacugacacccu

SEQ ID NO: 515301 - RNA, 64 nt, Human
acauuccgccugucucccuaacccuccauugccucgccucuauuccagaaucaaugcugcagaa

SEQ ID NO: 515302 - RNA, 64 nt, Human
cagaaguuguggggagaguggggaaucagacagccgccucuaggggcuggguucugcuggggcc

SEQ ID NO: 515303 - RNA, 64 nt, Human
uaaaaauacaaaauuagccgggcaugguggugcacgccucuaaucccagcuacucgggaggcug

SEQ ID NO: 515304 - RNA, 64 nt, Human
uuucgagaccaaccugaccuacauggagaaacuccgccucuaguaaaaauacaaaauuagccgg

SEQ ID NO: 515305 - RNA, 64 nt, Human
acuacaguacuaagacaauguugaauauaucauucgccucuauaacaauuuaauguauucaguu

SEQ ID NO: 515306 - RNA, 64 nt, Human
cggugagcauuuccuuaguucucagacucuccuccgccucuaccaagagcuucgccagugucac

SEQ ID NO: 515307 - RNA, 64 nt, Human
uugacaagucccccgccguguuggaaagaccucucgccucuacguggcaccuggaauuggggcg

SEQ ID NO: 515308 - RNA, 64 nt, Human
aagaaaaucccucuuggccgggugugguagcccacgccucuaaucccagcacuuugggaggcug

SEQ ID NO: 515309 - RNA, 64 nt, Human
uggcugccacaggguccuccgaugcuggccuuugcgccucuagaggcagccacucauggauuca

SEQ ID NO: 515310 - RNA, 64 nt, Human
guuccagaccagccuggccaacauggugaaaccccgccucuacuaaaaaaaaaaauacaaaaaa

SEQ ID NO: 515311 - RNA, 64 nt, Human
guuaaauauuuuuaaagaucacauuuuccaugaacgccucuaguagcaaaccauucuuuugcac

SEQ ID NO: 515312 - RNA, 64 nt, Human
cugccaggacggcugcaagaccagcuggcccgggaggggacaacgggcuguugcgggugcgcgg

SEQ ID NO: 515313 - RNA, 64 nt, Human
auagugagacccccccuccagggugggucuggggaggggacagcuguucaccccagcacccuuu

SEQ ID NO: 515314 - RNA, 64 nt, Human
aagggggaggggcucuaggaaggaacuggggggaaggggacagguagguggcuggagggacccu

SEQ ID NO: 515315 - RNA, 62 nt, Human
ugauggagggcgugcaguaaggaguggacagucgccucuaccaagaucgcgugucccuaggg

SEQ ID NO: 515316 - RNA, 64 nt, Human
cccucgcagggucccaggcccagaagaggccccacgccucuagagcugggcuccguccucggcg

SEQ ID NO: 515317 - RNA, 64 nt, Human
gacagauagugccugggggugggggcggaggguucgccucuaggaaggggcuagaagggaugag

SEQ ID NO: 515318 - RNA, 64 nt, Human
aaggagcuguaguguccugcugccucugggcgcccgccucuagcgcgguucugggaagugugcu

SEQ ID NO: 515319 - RNA, 64 nt, Human; identical to SEQ ID NO: 470492

SEQ ID NO: 515320 - RNA, 64 nt, Human; identical to SEQ ID NO: 470493

SEQ ID NO: 515321 - RNA, 64 nt, Human; identical to SEQ ID NO: 470494

SEQ ID NO: 515322 - RNA, 64 nt, Human; identical to SEQ ID NO: 470495

SEQ ID NO: 515323 - RNA, 64 nt, Human; identical to SEQ ID NO: 470496

SEQ ID NO: 515324 - RNA, 64 nt, Human; identical to SEQ ID NO: 470497

SEQ ID NO: 515325 - RNA, 64 nt, Human; identical to SEQ ID NO: 470498

SEQ ID NO: 515326 - RNA, 64 nt, Human
gcuccuagagggggaagaggagagacccccaacaaggggacaggacggucacugugccaauccu

SEQ ID NO: 515327 - RNA, 64 nt, Human
gguggaggcacaggccaaccugcgcucuccccuuaggggacaaacagggacccuugcagagacc

SEQ ID NO: 515328 - RNA, 64 nt, Human
cuaccaaacugaaggggucuccagauuaucuuggaggggacaggaggauggcagagaaacaacu

SEQ ID NO: 515329 - RNA, 64 nt, Human; identical to SEQ ID NO: 470499

SEQ ID NO: 515330 - RNA, 64 nt, Human; identical to SEQ ID NO: 470500

SEQ ID NO: 515331 - RNA, 64 nt, Human; identical to SEQ ID NO: 470501

SEQ ID NO: 515332 - RNA, 64 nt, Human; identical to SEQ ID NO: 470502

SEQ ID NO: 515333 - RNA, 64 nt, Human; identical to SEQ ID NO: 470503

SEQ ID NO: 515334 - RNA, 64 nt, Human; identical to SEQ ID NO: 470504

SEQ ID NO: 515335 - RNA, 64 nt, Human; identical to SEQ ID NO: 470505

SEQ ID NO: 515336 - RNA, 64 nt, Human; identical to SEQ ID NO: 470506

SEQ ID NO: 515337 - RNA, 64 nt, Human; identical to SEQ ID NO: 470510

SEQ ID NO: 515338 - RNA, 64 nt, Human; identical to SEQ ID NO: 470511

SEQ ID NO: 515339 - RNA, 64 nt, Human; identical to SEQ ID NO: 470512

SEQ ID NO: 515340 - RNA, 64 nt, Human; identical to SEQ ID NO: 470513

SEQ ID NO: 515341 - RNA, 64 nt, Human; identical to SEQ ID NO: 470514

SEQ ID NO: 515342 - RNA, 64 nt, Human; identical to SEQ ID NO: 470515

SEQ ID NO: 515343 - RNA, 64 nt, Human; identical to SEQ ID NO: 470516

SEQ ID NO: 515344 - RNA, 64 nt, Human; identical to SEQ ID NO: 470517

SEQ ID NO: 515345 - RNA, 64 nt, Human
caacuguugcaaaucccguuucucucucccgguaaggggacaaauuauacuuuauucaggugau

SEQ ID NO: 515346 - RNA, 64 nt, Human
cccggggagggggacgggguggggaaacggaggcaggggacagaagaggggagauugggggaga

SEQ ID NO: 515347 - RNA, 64 nt, Human
acacauugaggaaaacccuauaaacauaaucaagaggggacauuuuucauuaagaguucaguaa

SEQ ID NO: 515348 - RNA, 64 nt, Human; identical to SEQ ID NO: 470518

SEQ ID NO: 515349 - RNA, 64 nt, Human; identical to SEQ ID NO: 470519

SEQ ID NO: 515350 - RNA, 64 nt, Human; identical to SEQ ID NO: 470520

SEQ ID NO: 515351 - RNA, 64 nt, Human; identical to SEQ ID NO: 470521

SEQ ID NO: 515352 - RNA, 64 nt, Human; identical to SEQ ID NO: 470522

SEQ ID NO: 515353 - RNA, 64 nt, Human; identical to SEQ ID NO: 470523

SEQ ID NO: 515354 - RNA, 64 nt, Human; identical to SEQ ID NO: 470524

SEQ ID NO: 515355 - RNA, 64 nt, Human; identical to SEQ ID NO: 470528

SEQ ID NO: 515356 - RNA, 64 nt, Human; identical to SEQ ID NO: 470529

SEQ ID NO: 515357 - RNA, 64 nt, Human; identical to SEQ ID NO: 470530

SEQ ID NO: 515358 - RNA, 64 nt, Human; identical to SEQ ID NO: 470531

SEQ ID NO: 515359 - RNA, 64 nt, Human; identical to SEQ ID NO: 470532

SEQ ID NO: 515360 - RNA, 64 nt, Human; identical to SEQ ID NO: 470533

SEQ ID NO: 515361 - RNA, 64 nt, Human; identical to SEQ ID NO: 470534

SEQ ID NO: 515362 - RNA, 64 nt, Human; identical to SEQ ID NO: 470535

SEQ ID NO: 515363 - RNA, 64 nt, Human
uuauuaggacacgaacuaaaaauaaaagugcacuaggggacaguugauuucaaucuaagaaaag

SEQ ID NO: 515364 - RNA, 64 nt, Human
gccugcuccaggccauggcugggggcagggagugaggggacaauuucugagugaaagagaaaga

SEQ ID NO: 515365 - RNA, 64 nt, Human
ucucaaaccaaaguuaacagggagaggaugggggaggggacaaauuagaauaggauagcaucug

SEQ ID NO: 515366 - RNA, 64 nt, Human
ugccucgcccgcccucccugggcacaugugcacacgugcccaggcacaaguaugucucuggguc

SEQ ID NO: 515367 - RNA, 64 nt, Human
cucccaaagugcugggauuacaggugugagccaccgugcccagccuauacuucccuuuuugaau

SEQ ID NO: 515368 - RNA, 64 nt, Human
cucccaaagugcugggauuacaggcgugagcaaucgugcccagccuuguucuuaauuuuguauc

SEQ ID NO: 515369 - RNA, 64 nt, Human
augacaaaagaaaaagaaaaauugagccuugggacgugcccauuuuuacuguaaauuaugauuc

SEQ ID NO: 515370 - RNA, 64 nt, Human
cuccuuugugugucuguauguuuguguacacacacgugcccaucugcugucccagaggggaggg

SEQ ID NO: 515371 - RNA, 64 nt, Human
gugcuccggagccuuccuucagacccuuccuccacgugcccacuugggaugcagaaugcagcgg

SEQ ID NO: 515372 - RNA, 64 nt, Human
ucgguuacugccuucucccuugaaauccuugcugcgugcccaccaggauuuccugugagggccc

SEQ ID NO: 515373 - RNA, 64 nt, Human
cagggccgagcugcuagcuucgacagugagagcucgugcccaucuccgaaaccaccuccaacac

SEQ ID NO: 515374 - RNA, 64 nt, Human
uggaaggcgaaggacaauguuaucugggauucaccgugcccagcacccgaagugccaaauucca

SEQ ID NO: 515375 - RNA, 64 nt, Human
cucccaaagugcugggauugcaggcaugagccaccgugcccagccucaaaaauauuuuuuaaaa

SEQ ID NO: 515376 - RNA, 64 nt, Human
ccucgagagcugaggcucuagccaccuaaaaccacgugcccaaacccaccaguuuaaaacggug

SEQ ID NO: 515377 - RNA, 63 nt, Human
ggugcugcuggcccuccugacaggccuucuggccgugcccaugccccuugggugccuggggca

SEQ ID NO: 515378 - RNA, 54 nt, Human
auggaggacccaucuccuagcacacgugcccacugaaguggcaccaacagaagu

SEQ ID NO: 515379 - RNA, 64 nt, Human
agauugaggcugugccacaucuucugccauccuaaggggacaugaugguucugugauucccaga

SEQ ID NO: 515380 - RNA, 64 nt, Human
uccucauuugucucuaaguugaaggcuuuguuggaggggacagagcacaggaacagccuugaca

SEQ ID NO: 515381 - RNA, 64 nt, Human
ccucgcggcuucccgccgugccgcagcgugcccacgugcccacgccccaccagcaggcggcugu

SEQ ID NO: 515382 - RNA, 64 nt, Human
ugcccugcccucgcggcuucccgccgugccgcagcgugcccacgugcccacgccccaccagcag

SEQ ID NO: 515383 - RNA, 64 nt, Human
cuccccaagugcugggauuauaggcaugagccaccgugcccagccuacuuucuaauuaauuaaa

SEQ ID NO: 515384 - RNA, 64 nt, Human
gugcccucccucacuugugggccccccuugccuccgugcccagguugcugugggugcagcuguc

SEQ ID NO: 515385 - RNA, 54 nt, Human
agcacaucauguccagcuaaaccucgugcccagggaaggcugugcagggacguc

SEQ ID NO: 515386 - RNA, 64 nt, Human
ugauuggcugccacauuucggccaugcuggcuggcgugcccauguugcagauauuuucccgagu

SEQ ID NO: 515387 - RNA, 64 nt, Human
ggggugcacccagccaaagacaaagcugccuccacgugcccaaggauucagauggugcacuggc

SEQ ID NO: 515388 - RNA, 64 nt, Human
cucccaaagugcugggauuacgggugugagccaccgugcccagccuuuuuuuuuuuaauagaaa

SEQ ID NO: 515389 - RNA, 64 nt, Human
cucccaaagugcugggauuacagguguaagccaccgugcccagcccuaaacaucauucuugaga

SEQ ID NO: 515390 - RNA, 64 nt, Human
gcucgcuuacucagaccaaggagugaaaaauugucgugcccacuuuaugccccagcauggagua

SEQ ID NO: 515391 - RNA, 64 nt, Human
aggcaagagaguugggaguggcucgaaucagagccgugcccaagauaucccugcuguugcaucg

SEQ ID NO: 515392 - RNA, 64 nt, Human
ugccuuccugcucacccuacucugaccuccuucacgugcccaggccuguggguaguggggaggg

SEQ ID NO: 515393 - RNA, 64 nt, Human
ccaggguggugacaguugaacaaaguguauaguacgugcccagugguagcgauggaaaaaagua

SEQ ID NO: 515394 - RNA, 64 nt, Human
cagacuugaacccagcugauaugcaaggucauggcgugcccaggguggugacaguugaacaaag

SEQ ID NO: 515395 - RNA, 64 nt, Human
cggugguugucccucccagggaugcagccagacccgugcccaaucuccucucccucuguuguuu

SEQ ID NO: 515396 - RNA, 64 nt, Human
ccaggugccguguuuacugcagcagugggaccuccgugcccacucccccagcucagaggcuuuc

SEQ ID NO: 515397 - RNA, 64 nt, Human
cguaagaugaaguggcccuccacaaaggcugguuaggggacaguucuuucucuaacauaguuuu

SEQ ID NO: 515398 - RNA, 64 nt, Human
ccaaguccccccuccaccuucgccaccucccgcucgugcccagcacaagugagccuggugugga

SEQ ID NO: 515399 - RNA, 64 nt, Human
ccaccuccccaacaugugaagacagugaugggcacgugcccacacccccacuucucuagccguu

SEQ ID NO: 515400 - RNA, 64 nt, Human
aguuaauggcuucuguuacauggagcucaauggacgugcccaggaaugcuuuuggcuguuauuu

SEQ ID NO: 515401 - RNA, 64 nt, Human
aucucugcccugaggucaccccguggucccuccacgugcccaucucucugcagugcccuccucg

SEQ ID NO: 515402 - RNA, 64 nt, Human
ucuuuuuuggagauaucuuccaucaagcaguacucgugcccauauacaaucucuuaguggcuag

SEQ ID NO: 515403 - RNA, 64 nt, Human
auuuuuauaggaauagaggaagaaaugucagaugcgugcccagcucuucaccccccaaucucuu

SEQ ID NO: 515404 - RNA, 64 nt, Human
cggcuguggcuccagagucugugcccuuuaccaccgugcccaacuguuucacaugcuguguuug

SEQ ID NO: 515405 - RNA, 64 nt, Human
cagcaggugggaaaugguaugagcugaggggggccgugcccaggggcccacagggaacccugcu

SEQ ID NO: 515406 - RNA, 64 nt, Human
accucggccucccaaagugcuaggauuacaggcccgugcccagcccuaaaguuuuaaacucuag

SEQ ID NO: 515407 - RNA, 64 nt, Human
ugucgaggagcuucggggcucagagaggugaugacgugcccaaggugacgcaacucgugaacag

SEQ ID NO: 515408 - RNA, 64 nt, Human
cugcagcccuagccggccgcgcccgccugcgccccgugcccaccucugcgcggacgaccccgac

SEQ ID NO: 515409 - RNA, 64 nt, Human
gccugcccagccagccagacucaccugcccuucccgugcccacagcuggagcagggccagagcc

SEQ ID NO: 515410 - RNA, 64 nt, Human
cucccaaagugcugggauuacaggcgugagccaccgugcccagccagaauggguaguuuuuauu

SEQ ID NO: 515411 - RNA, 64 nt, Human
cugugcagggauaggaagugccccagggugagaacgugcccagccacaucaucuuuaucuccug

SEQ ID NO: 515412 - RNA, 64 nt, Human
aggcaaaagaggcuacuugauugguggccaaccucgugcccacauggaagguaucuuuaauagg

SEQ ID NO: 515413 - RNA, 64 nt, Human
aaugccugccacccugcccgaggauguacagagccgugcccacacauuuccuugcaacuugauc

SEQ ID NO: 515414 - RNA, 64 nt, Human
ccguugcuucuggucagcccacuuguagacuuccaggggacacaucuuuauucuguuucaggaa

SEQ ID NO: 515415 - RNA, 64 nt, Human
acaguguucuccuguuuguggagcuaagguaaagaggggacacuucugucuguuuaacagacag

SEQ ID NO: 515416 - RNA, 64 nt, Human
uccacccugaggagugaugggcaaggggccaggaaggggacaggauugucugcugccuccaagu

SEQ ID NO: 515417 - RNA, 64 nt, Human
accguaaccgcgcagucccguuugacgguggugccgugcccagcaucgugccaaggacuccccu

SEQ ID NO: 515418 - RNA, 64 nt, Human
ccucaaacccugggguaggugggacggggggucucgugcccagaugaaaccauuuggaaacucg

SEQ ID NO: 515419 - RNA, 64 nt, Human
aggauggucucgaucucuuaaccuugugagccaccgugcccaacccuaacaauuauuuuuaaaa

SEQ ID NO: 515420 - RNA, 64 nt, Human
ucacauuuaaggugcgugugcguacggcggauuccgugcccaucucauguuuuuauucccuuua

SEQ ID NO: 515421 - RNA, 64 nt, Human
agcaggucggggagcugugcuucucucuccgguacgugcccagcucaggccggcugaccguggu

SEQ ID NO: 515422 - RNA, 64 nt, Human
uccagccucagccucccgaauagcugggauuacacgugcccaccaccaugcccagcuaauuuuu

SEQ ID NO: 515423 - RNA, 64 nt, Human
gggagcucgcauucucuuguguucguguugcccucgugcccaucaagugcagucgggaccuccc

SEQ ID NO: 515424 - RNA, 64 nt, Human
cucucagagagcugggauuacaggugugagccgccgugcccagccauugcauuuuuauucacau

SEQ ID NO: 515425 - RNA, 64 nt, Human
ggggcuucaggaagggaugugcuguuucccucuacgugcccaguccuagccucgcucuaggacc

SEQ ID NO: 515426 - RNA, 64 nt, Human
uguugcgucuaauacccuuugucucuccucuaugcgugcccauugcagagaaggggacugggac

SEQ ID NO: 515427 - RNA, 64 nt, Human
agguuccuggcagugcugggaguuuggaugggaucgugcccagcuuugcuuagcuuucuuuauu

SEQ ID NO: 515428 - RNA, 64 nt, Human
cuguugccaagacugcaaaccacuggcucguuuccgugcccaaauccaaggcgaaguuuucuag

SEQ ID NO: 515429 - RNA, 63 nt, Human
aucauaucauacugaaguaggagugcggcguuucgugcccaguggcugcuccuuccuucaccu

SEQ ID NO: 515430 - RNA, 64 nt, Human
ugaauuuuagaaaacaaacuaauucugauugugucgugcccaaguacccuuuuuuuuuuaauga

SEQ ID NO: 515431 - RNA, 64 nt, Human
cucccaaagugcugggauuacaggugugagccaccgugcccagccaaagacugcucuuaaagca

SEQ ID NO: 515432 - RNA, 64 nt, Human
uccacgcagcagagggacaugggccauuccaugacgugcccaggccaacgucgcaggacaguug

SEQ ID NO: 515433 - RNA, 64 nt, Human
cuggcccgggagcuccuugccugccacuucuuccaggggacagaauaacccaguggaggaugcc

SEQ ID NO: 515434 - RNA, 64 nt, Human
agcuccgggcuggcuuuuugcagggcgcagguggaggggacaggucugccgaugggggugggag

SEQ ID NO: 515435 - RNA, 64 nt, Human
ccuccaugaucacacccagggaccugcaugggugaggggacacccugggccucucucccgccca

SEQ ID NO: 515436 - RNA, 64 nt, Human
gaaaaaaaaaaaaagagaaacccuuugacuuccacgugcccaucucaagacauuccacucacag

SEQ ID NO: 515437 - RNA, 64 nt, Human
gggcuggggccucagacccccucagccuugggaccgugcccacgagggucuccccuccugcaca

SEQ ID NO: 515438 - RNA, 64 nt, Human
cucccaaguagcugggauuacagaaagccgccaccgugcccagcuaauuuuuguauuuuuguug

SEQ ID NO: 515439 - RNA, 64 nt, Human
cugccuguacugcugcugcugcugcucagggcuucgugcccauggggucaggaacagggagcga

SEQ ID NO: 515440 - RNA, 64 nt, Human
cucccaaagugcagggauuacaggcacaagccaccgugcccagccaagaauuuuuauuuuugcu

SEQ ID NO: 515441 - RNA, 64 nt, Human
cccccugacccuccagcuccuccuggcccucucacgugcccacuucugcugggccuuuagcccu

SEQ ID NO: 515442 - RNA, 64 nt, Human
cagggagcagcagugcaggccuggccuguguccccgugcccagcgggcucccggagcagcauuc

SEQ ID NO: 515443 - RNA, 64 nt, Human
cugcugucucaccccguguuucccugcgaguggacgugcccagcuguccccccaggccucuccu

SEQ ID NO: 515444 - RNA, 64 nt, Human
gcacaguuagaguaggagggggugcguacuagcacgugcccaguugcucagugcugcuaguaga

SEQ ID NO: 515445 - RNA, 64 nt, Human
gacauuccagugccacccaaauauauaucuguaacgugcccaagaaauccuagcugcgcucuug

SEQ ID NO: 515446 - RNA, 64 nt, Human
cccugacagucccagcccugcugccccauggccacgugcccacagaugugcuguugguccaggu

SEQ ID NO: 515447 - RNA, 64 nt, Human
gagcucccggccugcccagacuguggacacuggccgugcccaaugagacguucuaaaccaggac

SEQ ID NO: 515448 - RNA, 64 nt, Human
aacagugacggcuccagccuucgacccagagccccgugcccagugcgucagugggccugggguu

SEQ ID NO: 515449 - RNA, 64 nt, Human
ccuugcaccucgcugcccaucagaaagccugaggcgugcccagagcacaagacugggggcaacu

SEQ ID NO: 515450 - RNA, 64 nt, Human
ucacgguaacacacacacacucucccucaucuuucgugcccauucacugagggccagaaugacu

SEQ ID NO: 515451 - RNA, 64 nt, Human
ucccacggcugcagcagaguuugaagggcccagccgugcccagcuccaagcagacacacaggca

SEQ ID NO: 515452 - RNA, 56 nt, Human
agaagacaaggcggacuugaggaggaaggggacaguugcagucucacuugggacag

SEQ ID NO: 515453 - RNA, 64 nt, Human
uggagggcacugagcuggaggccccugcaaggguaggggacaagauguaggcuccagcuccccu

SEQ ID NO: 515454 - RNA, 64 nt, Human
ugcccuccuuuccgguguuuaagacauuuuuggaaggggacacgugacagccguuuguucccca

SEQ ID NO: 515455 - RNA, 64 nt, Human
ccucagucccucggccacccgggggucgcucccucgugcccaccgcaccugccgagccucuuug

SEQ ID NO: 515456 - RNA, 64 nt, Human
cccugggggucaugggaagcgagcacgcagcaggcgugcccaggagcgugugcaugugucagag

SEQ ID NO: 515457 - RNA, 64 nt, Human
cuaaggaggcgguggcucuuucuuaacauucccacgugcccagggcuguucaugcaagauuuua

SEQ ID NO: 515458 - RNA, 64 nt, Human
cuccccaagcgcugagauuacaggugugagccaccgugcccagccccucaguagguuuuaagga

SEQ ID NO: 515459 - RNA, 64 nt, Human
acaugaccacacgugggugcugaacucggggcgccgugcccaccggcaugguccucccgagcuc

SEQ ID NO: 515460 - RNA, 64 nt, Human
ggaggcugccgggcagaguggagcagcuuggggccgugcccagggcgguggcugugagucuagu

SEQ ID NO: 515461 - RNA, 64 nt, Human
gcugggccggcuucaugccagugcgagggcgucccgugcccacguacauacguaugucuccaug

SEQ ID NO: 515462 - RNA, 64 nt, Human
gggcacccgaagaccaagcccccugccagcucaccgugcccagccuccugcauccccucgaaga

SEQ ID NO: 515463 - RNA, 64 nt, Human
caaaaaauucaaaaauuagccaggugugguggugcgugcccagguucccagguacucggaggcu

SEQ ID NO: 515464 - RNA, 64 nt, Human
cucccaaagugcugggauuacaggcgugagucaccgugcccagccauguauauauauaauuuua

SEQ ID NO: 515465 - RNA, 64 nt, Human
ggggcgggcgguggcucgugcugggucacguggucgugcccaagcgcuccuccuguugccccac

SEQ ID NO: 515466 - RNA, 64 nt, Human
ccugcccaucccaccacccggccuuucccugcgccgugcccacccuccuccggaaucucccuuc

SEQ ID NO: 515467 - RNA, 64 nt, Human
cggccuugcccugcagggauggggcuccacaggccgugcccaacugggggugguucuaggggaa

SEQ ID NO: 515468 - RNA, 64 nt, Human
cagguggauaguaaaucaccaccacggggacagccgugcccagacugugcguuugcuuagcucg

SEQ ID NO: 515469 - RNA, 64 nt, Human
cucccaaagugcuaggauuccaggcgugagccaucgugcccagcuagacgucuuccuuuuuuuu

SEQ ID NO: 515470 - RNA, 64 nt, Human
ugcuauagcuuuuggggcggcccugcccaguccccgugcccacggggcucccucucccgguggu

SEQ ID NO: 515471 - RNA, 64 nt, Human
ccaugugggugucugaguccaugagccaagccugaggggacagugagucuccaggucugccaca

SEQ ID NO: 515472 - RNA, 64 nt, Human
uaguuucugauuauucggggaugggggggaugggaggggacagggauucacgauccaucgcguc

SEQ ID NO: 515473 - RNA, 64 nt, Human
cuauggggcauccagggcugugggggucuggaggaggggacaugaggugagagguauccuggcc

SEQ ID NO: 515474 - RNA, 64 nt, Human
cugacacaaaagacgugccuuaaggaacccgccgcgugcccaggugccccgcggggcauccagc

SEQ ID NO: 515475 - RNA, 64 nt, Human
agagcuguggacucaggacccaggacucuguuuacgugcccagucagcccuaccuggggaagcg

SEQ ID NO: 515476 - RNA, 64 nt, Human
uucccaaaguucugggauuacaggcaugagccaccgugcccagccaaauguuuauuuuauuuaa

SEQ ID NO: 515477 - RNA, 64 nt, Human
cugauggaaaauggcgguuucaaguccccgauuccgugcccacuucacaucuccccuaccagca

SEQ ID NO: 515478 - RNA, 64 nt, Human
gagcugguguuaggggucccaagguugccacccacgugcccagcugucccacgcugcagcgcag

SEQ ID NO: 515479 - RNA, 64 nt, Human
accccaucucccgcgcagccugcccccuccuggacgugcccauccccccucagauccagacaug

SEQ ID NO: 515480 - RNA, 64 nt, Human
ucuguggugcgaaccagcauuaacggauggggcacgugcccaacugaggaacaggagaagaaau

SEQ ID NO: 515481 - RNA, 64 nt, Human
acccacaggcuucacauucccaccaccuucgcaccgugcccagguacacuuucaagacacugua

SEQ ID NO: 515482 - RNA, 64 nt, Human
cugugccugggcccugggcugauggaagaugguccgugcccaggcccuuggcugcaggcaacac

SEQ ID NO: 515483 - RNA, 64 nt, Human
cuuccaaaguggugggauuaugggcaggagccuccgugcccaggcugcugccauuuucaaauuu

SEQ ID NO: 515484 - RNA, 64 nt, Human
agccaaaggcgccccuccccagagggaucccuaacgugcccagcauguagauucuggacuaaca

SEQ ID NO: 515485 - RNA, 64 nt, Human
gcucccgcaguguuuguuagagugcacaucccuacgugcccacuggcacacacacgugcucaca

SEQ ID NO: 515486 - RNA, 64 nt, Human
uccucuaccccaacugcccugucacgcgcuuccccgugcccaacgagaaggugcccugggaggu

SEQ ID NO: 515487 - RNA, 64 nt, Human
aaugccgggcguccccgagacgcggcugccuguccgugcccaugcaucuggaaaucuaauuuag

SEQ ID NO: 515488 - RNA, 64 nt, Human
uacuugggugaguccuuguggacaaccacacacacgugcccacaugguacuagcugccguucgu

SEQ ID NO: 515489 - RNA, 64 nt, Human
aucguucaacuccacucacugaagcccagaccuccgugcccaggcccaaucucgucaggcugcc

SEQ ID NO: 515490 - RNA, 64 nt, Human
ucauccuuuggcucaaagccagauguccguguggaggggacauagacacugcauggcccuaugu

SEQ ID NO: 515491 - RNA, 64 nt, Human
uucuucuguccaucuuuggccugcuggugccagcaggggacacagacugcaaagagaagcacaa

SEQ ID NO: 515492 - RNA, 64 nt, Human
accuuucugauccuugggucuggguuuuuugaggaggggacauaguggccucugggcugccaug

SEQ ID NO: 515493 - RNA, 64 nt, Human
ugugcggucaguguuuucaguaccaccucucucccgugcccacuuggcuauuuacuuauuuauu

SEQ ID NO: 515494 - RNA, 64 nt, Human
gggcugugcuggggccagacuggcacaaggcacucgugcccacaccacaccccagggccuugcc

SEQ ID NO: 515495 - RNA, 64 nt, Human
cugcgccugacauucacacagagaggcagagucccgugcccauuaggucuggcaugcccccucc

SEQ ID NO: 515496 - RNA, 64 nt, Human
ugcccccguggggaggagccccuuguaccugcuccgugcccaacacaugcccucucuguacauc

SEQ ID NO: 515497 - RNA, 64 nt, Human
caauuguguacuacguccuuguuuaguguguauccgugcccacguagaugaugucuguaacgua

SEQ ID NO: 515498 - RNA, 64 nt, Human
cucccaaaaugcugggauuacaggggugagccaccgugcccaaccucacuugcuucuuauccuu

SEQ ID NO: 515499 - RNA, 64 nt, Human
guauacaaguguuucuaguaacaguauuuccauacgugcccauuucacacaacuguggauaaau

SEQ ID NO: 515500 - RNA, 64 nt, Human
cucccaaaguacugggauuacaggcgugagccaccgugcccaaccaugaaauauuuuuacuuaa

SEQ ID NO: 515501 - RNA, 64 nt, Human
aagcuguuccgcagagaaaacugaagccucccaucgugcccacgauagcuggcaacggcgacac

SEQ ID NO: 515502 - RNA, 64 nt, Human
gagcgccuggggcuccugcaagucagcuacucuccgugcccacuuccccccacacacacacccc

SEQ ID NO: 515503 - RNA, 64 nt, Human; identical to SEQ ID NO: 352102

SEQ ID NO: 515504 - RNA, 64 nt, Human; identical to SEQ ID NO: 352103

SEQ ID NO: 515505 - RNA, 64 nt, Human
ccucucuccuuuagagaucugagcugucucuuaaaggggacaguugcccaaaauguuccuugcu

SEQ ID NO: 515506 - RNA, 64 nt, Human
ggcacucccuugguuggauuuucuaugacagcacaggggacagguggcacaccaugagaggucu

SEQ ID NO: 515507 - RNA, 64 nt, Human
ugccuguuuccuuuucccagcaccaugccuguggaggggacagucagacccagagguccuuuac

SEQ ID NO: 515508 - RNA, 64 nt, Human; identical to SEQ ID NO: 352104

SEQ ID NO: 515509 - RNA, 64 nt, Human; identical to SEQ ID NO: 352105

SEQ ID NO: 515510 - RNA, 64 nt, Human; identical to SEQ ID NO: 352106

SEQ ID NO: 515511 - RNA, 64 nt, Human; identical to SEQ ID NO: 352107

SEQ ID NO: 515512 - RNA, 64 nt, Human; identical to SEQ ID NO: 352108

SEQ ID NO: 515513 - RNA, 64 nt, Human; identical to SEQ ID NO: 352109

SEQ ID NO: 515514 - RNA, 64 nt, Human; identical to SEQ ID NO: 352110

SEQ ID NO: 515515 - RNA, 64 nt, Human; identical to SEQ ID NO: 352111

SEQ ID NO: 515516 - RNA, 64 nt, Human; identical to SEQ ID NO: 351748

SEQ ID NO: 515517 - RNA, 64 nt, Human; identical to SEQ ID NO: 351749

SEQ ID NO: 515518 - RNA, 64 nt, Human; identical to SEQ ID NO: 350481

SEQ ID NO: 515519 - RNA, 64 nt, Human; identical to SEQ ID NO: 350482

SEQ ID NO: 515520 - RNA, 64 nt, Human; identical to SEQ ID NO: 350483

SEQ ID NO: 515521 - RNA, 64 nt, Human; identical to SEQ ID NO: 350484

SEQ ID NO: 515522 - RNA, 64 nt, Human; identical to SEQ ID NO: 351995

SEQ ID NO: 515523 - RNA, 64 nt, Human; identical to SEQ ID NO: 351996

SEQ ID NO: 515524 - RNA, 64 nt, Human
uggaucacuggacuuucaguggacuaccuaaaacaggggacagcuuuuggaagaugacaucugc

SEQ ID NO: 515525 - RNA, 64 nt, Human
agagggccagggauaugagaggcugacaaacaucaggggacaucuggggaggagaucccuguca

SEQ ID NO: 515526 - RNA, 64 nt, Human
ccugcuaaaaucagcuacuagaaucugcugccagaggggacaaagacgugcacucaaccuucua

SEQ ID NO: 515527 - RNA, 64 nt, Human; identical to SEQ ID NO: 350501

SEQ ID NO: 515528 - RNA, 64 nt, Human; identical to SEQ ID NO: 351901

SEQ ID NO: 515529 - RNA, 64 nt, Human; identical to SEQ ID NO: 351902

SEQ ID NO: 515530 - RNA, 64 nt, Human; identical to SEQ ID NO: 351903

SEQ ID NO: 515531 - RNA, 64 nt, Human; identical to SEQ ID NO: 351904

SEQ ID NO: 515532 - RNA, 64 nt, Human; identical to SEQ ID NO: 352074

SEQ ID NO: 515533 - RNA, 64 nt, Human; identical to SEQ ID NO: 352075

SEQ ID NO: 515534 - RNA, 64 nt, Human; identical to SEQ ID NO: 350502

SEQ ID NO: 515535 - RNA, 64 nt, Human; identical to SEQ ID NO: 351921

SEQ ID NO: 515536 - RNA, 64 nt, Human; identical to SEQ ID NO: 351922

SEQ ID NO: 515537 - RNA, 64 nt, Human; identical to SEQ ID NO: 351923

SEQ ID NO: 515538 - RNA, 64 nt, Human; identical to SEQ ID NO: 351924

SEQ ID NO: 515539 - RNA, 64 nt, Human; identical to SEQ ID NO: 351843

SEQ ID NO: 515540 - RNA, 64 nt, Human; identical to SEQ ID NO: 351844

SEQ ID NO: 515541 - RNA, 64 nt, Human; identical to SEQ ID NO: 350503

SEQ ID NO: 515542 - RNA, 64 nt, Human; identical to SEQ ID NO: 351941

SEQ ID NO: 515543 - RNA, 63 nt, Human
gaauacguugugaccauccagaaaauaaaugcugaggggacacagucacagucugugggucac

SEQ ID NO: 515544 - RNA, 64 nt, Human
cccguuuccucccauggcccaguaugaggccagcaggggacauuugggaugcccaggccgcaga

SEQ ID NO: 515545 - RNA, 64 nt, Human
acacagcagcacccuuccccugaggccgguggggaggggacaagugucagcaggauuggcgugu

SEQ ID NO: 515546 - RNA, 64 nt, Human; identical to SEQ ID NO: 351942

SEQ ID NO: 515547 - RNA, 64 nt, Human; identical to SEQ ID NO: 351943

SEQ ID NO: 515548 - RNA, 64 nt, Human; identical to SEQ ID NO: 351944

SEQ ID NO: 515549 - RNA, 64 nt, Human; identical to SEQ ID NO: 352014

SEQ ID NO: 515550 - RNA, 64 nt, Human; identical to SEQ ID NO: 352015

SEQ ID NO: 515551 - RNA, 64 nt, Human; identical to SEQ ID NO: 350519

SEQ ID NO: 515552 - RNA, 64 nt, Human; identical to SEQ ID NO: 351981

SEQ ID NO: 515553 - RNA, 64 nt, Human; identical to SEQ ID NO: 351982

SEQ ID NO: 515554 - RNA, 64 nt, Human; identical to SEQ ID NO: 351983

SEQ ID NO: 515555 - RNA, 64 nt, Human; identical to SEQ ID NO: 351984

SEQ ID NO: 515556 - RNA, 64 nt, Human; identical to SEQ ID NO: 351805

SEQ ID NO: 515557 - RNA, 64 nt, Human; identical to SEQ ID NO: 351806

SEQ ID NO: 515558 - RNA, 64 nt, Human; identical to SEQ ID NO: 350520

SEQ ID NO: 515559 - RNA, 64 nt, Human; identical to SEQ ID NO: 351997

SEQ ID NO: 515560 - RNA, 64 nt, Human; identical to SEQ ID NO: 352076

SEQ ID NO: 515561 - RNA, 60 nt, Human; identical to SEQ ID NO: 352077

SEQ ID NO: 515562 - RNA, 64 nt, Human
agggcacucugauagggcaaaaacggaacaugggaggggacaaauaagggaauaaaaucuggcc

SEQ ID NO: 515563 - RNA, 56 nt, Human
agaagacaaggcggacgugaggaggaaggggacaguugcagucucacuugggacag

SEQ ID NO: 515564 - RNA, 64 nt, Human
uccuuccauaaugcuccuguacccaguuuauuuaaggggacaugcacuggaauaggaaaugucc

SEQ ID NO: 515565 - RNA, 64 nt, Human; identical to SEQ ID NO: 350521

SEQ ID NO: 515566 - RNA, 64 nt, Human; identical to SEQ ID NO: 352016

SEQ ID NO: 515567 - RNA, 64 nt, Human; identical to SEQ ID NO: 352017

SEQ ID NO: 515568 - RNA, 64 nt, Human; identical to SEQ ID NO: 352034

SEQ ID NO: 515569 - RNA, 64 nt, Human; identical to SEQ ID NO: 352035

SEQ ID NO: 515570 - RNA, 64 nt, Human; identical to SEQ ID NO: 350522

SEQ ID NO: 515571 - RNA, 64 nt, Human; identical to SEQ ID NO: 352036

SEQ ID NO: 515572 - RNA, 64 nt, Human; identical to SEQ ID NO: 352037

SEQ ID NO: 515573 - RNA, 64 nt, Human; identical to SEQ ID NO: 351845

SEQ ID NO: 515574 - RNA, 64 nt, Human; identical to SEQ ID NO: 351846

SEQ ID NO: 515575 - RNA, 64 nt, Human; identical to SEQ ID NO: 350538

SEQ ID NO: 515576 - RNA, 64 nt, Human; identical to SEQ ID NO: 350539

SEQ ID NO: 515577 - RNA, 64 nt, Human; identical to SEQ ID NO: 350540

SEQ ID NO: 515578 - RNA, 64 nt, Human; identical to SEQ ID NO: 350541

SEQ ID NO: 515579 - RNA, 64 nt, Human; identical to SEQ ID NO: 350559

SEQ ID NO: 515580 - RNA, 64 nt, Human; identical to SEQ ID NO: 350560

SEQ ID NO: 515581 - RNA, 64 nt, Human
ccccugggagagagcccagcacccaagauccagcaggggacaggacagaguagaagccccucca

SEQ ID NO: 515582 - RNA, 64 nt, Human
cauaugagaugacgaggaaaccccuuugcaggugaggggacagcuuucuagaaaagccacaccu

SEQ ID NO: 515583 - RNA, 64 nt, Human
aaacagagagaacgagccugaauacagcagauguaggggacagccgugggaccgcgugagaauu

SEQ ID NO: 515584 - RNA, 64 nt, Human; identical to SEQ ID NO: 351824

SEQ ID NO: 515585 - RNA, 64 nt, Human; identical to SEQ ID NO: 351825

SEQ ID NO: 515586 - RNA, 64 nt, Human; identical to SEQ ID NO: 351826

SEQ ID NO: 515587 - RNA, 64 nt, Human; identical to SEQ ID NO: 351827

SEQ ID NO: 515588 - RNA, 64 nt, Human; identical to SEQ ID NO: 351862

SEQ ID NO: 515589 - RNA, 64 nt, Human; identical to SEQ ID NO: 351863

SEQ ID NO: 515590 - RNA, 64 nt, Human; identical to SEQ ID NO: 351864

SEQ ID NO: 515591 - RNA, 64 nt, Human; identical to SEQ ID NO: 351865

SEQ ID NO: 515592 - RNA, 64 nt, Human; identical to SEQ ID NO: 351961

SEQ ID NO: 515593 - RNA, 53 nt, Human; identical to SEQ ID NO: 351962

SEQ ID NO: 515594 - RNA, 64 nt, Human; identical to SEQ ID NO: 351963

SEQ ID NO: 515595 - RNA, 64 nt, Human; identical to SEQ ID NO: 351964

SEQ ID NO: 515596 - RNA, 64 nt, Human; identical to SEQ ID NO: 352054

SEQ ID NO: 515597 - RNA, 64 nt, Human; identical to SEQ ID NO: 352055

SEQ ID NO: 515598 - RNA, 64 nt, Human; identical to SEQ ID NO: 352056

SEQ ID NO: 515599 - RNA, 64 nt, Human; identical to SEQ ID NO: 352057

SEQ ID NO: 515600 - RNA, 64 nt, Human
guggcaagcuguguucauaccuaaauuuucuggaaggggacagugaaaagaggagugacaggag

SEQ ID NO: 515601 - RNA, 64 nt, Human
agaccgucgucuucccuccagucuucugagggauaggggacauuccaucccaagcuucucccuu

SEQ ID NO: 515602 - RNA, 64 nt, Human
uuaaagaccagaaaagacuugcuuuuacccagggaggggacauucccccaauccugugucuggg

SEQ ID NO: 515603 - RNA, 64 nt, Human; identical to SEQ ID NO: 352094

SEQ ID NO: 515604 - RNA, 64 nt, Human; identical to SEQ ID NO: 352095

SEQ ID NO: 515605 - RNA, 64 nt, Human; identical to SEQ ID NO: 352096

SEQ ID NO: 515606 - RNA, 64 nt, Human; identical to SEQ ID NO: 352097

SEQ ID NO: 515607 - RNA, 64 nt, Human; identical to SEQ ID NO: 350577

SEQ ID NO: 515608 - RNA, 64 nt, Human; identical to SEQ ID NO: 350578

SEQ ID NO: 515609 - RNA, 64 nt, Human; identical to SEQ ID NO: 350579

SEQ ID NO: 515610 - RNA, 64 nt, Human; identical to SEQ ID NO: 352112

SEQ ID NO: 515611 - RNA, 64 nt, Human; identical to SEQ ID NO: 352113

SEQ ID NO: 515612 - RNA, 64 nt, Human; identical to SEQ ID NO: 352114

SEQ ID NO: 515613 - RNA, 64 nt, Human; identical to SEQ ID NO: 352115

SEQ ID NO: 515614 - RNA, 64 nt, Human; identical to SEQ ID NO: 352116

SEQ ID NO: 515615 - RNA, 64 nt, Human; identical to SEQ ID NO: 352117

SEQ ID NO: 515616 - RNA, 64 nt, Human; identical to SEQ ID NO: 352118

SEQ ID NO: 515617 - RNA, 64 nt, Human; identical to SEQ ID NO: 352119

SEQ ID NO: 515618 - RNA, 64 nt, Human; identical to SEQ ID NO: 352120

SEQ ID NO: 515619 - RNA, 64 nt, Human
cuggaggagguggagcugcagcugggacugugaggaccgagaagcaauggcccagcagacgaga

SEQ ID NO: 515620 - RNA, 64 nt, Human
guuguacauuggacaccugacaacccucugccaugaccgagacccccugauccuccguggacuc

SEQ ID NO: 515621 - RNA, 64 nt, Human
cauuacaaaaaggaauauuucccaaaccucuucagaccgagaaugcauggguaaaauuauuaaa

SEQ ID NO: 515622 - RNA, 64 nt, Human
agguuaagauugcugugagcuuuaucagauaagagaccgagagaaguaagcugggucuuguuau

SEQ ID NO: 515623 - RNA, 64 nt, Human; identical to SEQ ID NO: 352121

SEQ ID NO: 515624 - RNA, 64 nt, Human; identical to SEQ ID NO: 352122

SEQ ID NO: 515625 - RNA, 64 nt, Human; identical to SEQ ID NO: 352123

SEQ ID NO: 515626 - RNA, 64 nt, Human; identical to SEQ ID NO: 352124

SEQ ID NO: 515627 - RNA, 64 nt, Human; identical to SEQ ID NO: 352125

SEQ ID NO: 515628 - RNA, 64 nt, Human; identical to SEQ ID NO: 352126

SEQ ID NO: 515629 - RNA, 64 nt, Human; identical to SEQ ID NO: 352127

SEQ ID NO: 515630 - RNA, 64 nt, Human; identical to SEQ ID NO: 352128

SEQ ID NO: 515631 - RNA, 64 nt, Human; identical to SEQ ID NO: 352129

SEQ ID NO: 515632 - RNA, 64 nt, Human; identical to SEQ ID NO: 352130

SEQ ID NO: 515633 - RNA, 64 nt, Human; identical to SEQ ID NO: 352131

SEQ ID NO: 515634 - RNA, 64 nt, Human; identical to SEQ ID NO: 352132

SEQ ID NO: 515635 - RNA, 64 nt, Human; identical to SEQ ID NO: 352133

SEQ ID NO: 515636 - RNA, 64 nt, Human; identical to SEQ ID NO: 352134

SEQ ID NO: 515637 - RNA, 64 nt, Human; identical to SEQ ID NO: 352135

SEQ ID NO: 515638 - RNA, 64 nt, Human; identical to SEQ ID NO: 352136

SEQ ID NO: 515639 - RNA, 64 nt, Human
ugacaggccugggccucugcaacugcccugacaggaccgagaggccuugccccuccaccuggug

SEQ ID NO: 515640 - RNA, 64 nt, Human
cccgcguccaccugggaggcauuugggguugcaggaccgagacccacauccucucacucacuuc

SEQ ID NO: 515641 - RNA, 64 nt, Human
guaacacuccguaaacagcccagcuguaacgccagaccgagacgaacacucugccuaacuauca

SEQ ID NO: 515642 - RNA, 64 nt, Human
ggucaggcccuggaacucuaucugggccugggcuaggggacaucagagguucuuugagggacug

SEQ ID NO: 515643 - RNA, 64 nt, Human; identical to SEQ ID NO: 352137

SEQ ID NO: 515644 - RNA, 64 nt, Human; identical to SEQ ID NO: 352138

SEQ ID NO: 515645 - RNA, 64 nt, Human; identical to SEQ ID NO: 352139

SEQ ID NO: 515646 - RNA, 64 nt, Human; identical to SEQ ID NO: 352140

SEQ ID NO: 515647 - RNA, 64 nt, Human; identical to SEQ ID NO: 352141

SEQ ID NO: 515648 - RNA, 64 nt, Human; identical to SEQ ID NO: 352142

SEQ ID NO: 515649 - RNA, 64 nt, Human; identical to SEQ ID NO: 352143

SEQ ID NO: 515650 - RNA, 64 nt, Human; identical to SEQ ID NO: 352144

SEQ ID NO: 515651 - RNA, 64 nt, Human; identical to SEQ ID NO: 352145

SEQ ID NO: 515652 - RNA, 64 nt, Human; identical to SEQ ID NO: 352146

SEQ ID NO: 515653 - RNA, 64 nt, Human; identical to SEQ ID NO: 352147

SEQ ID NO: 515654 - RNA, 64 nt, Human; identical to SEQ ID NO: 352148

SEQ ID NO: 515655 - RNA, 64 nt, Human; identical to SEQ ID NO: 352149

SEQ ID NO: 515656 - RNA, 64 nt, Human; identical to SEQ ID NO: 352150

SEQ ID NO: 515657 - RNA, 64 nt, Human; identical to SEQ ID NO: 352151

SEQ ID NO: 515658 - RNA, 64 nt, Human; identical to SEQ ID NO: 352152

SEQ ID NO: 515659 - RNA, 64 nt, Human
aacugcugguuuuuaaaaaauguuuucuggggaaaggggacaaggaaggaaaagaaagaagaga

SEQ ID NO: 515660 - RNA, 64 nt, Human
augagccaagagcccucuucacgcugcuaacuccaggggacagacgaagggacaucuuuggaaa

SEQ ID NO: 515661 - RNA, 64 nt, Human
ugcgccgcuucccgccgcagcgcccgcgccuccgaggggacagcgcccucuggagcucgcuggg

SEQ ID NO: 515662 - RNA, 64 nt, Human; identical to SEQ ID NO: 352153

SEQ ID NO: 515663 - RNA, 64 nt, Human; identical to SEQ ID NO: 352154

SEQ ID NO: 515664 - RNA, 64 nt, Human; identical to SEQ ID NO: 352155

SEQ ID NO: 515665 - RNA, 64 nt, Human; identical to SEQ ID NO: 352156

SEQ ID NO: 515666 - RNA, 64 nt, Human; identical to SEQ ID NO: 352157

SEQ ID NO: 515667 - RNA, 64 nt, Human; identical to SEQ ID NO: 352158

SEQ ID NO: 515668 - RNA, 64 nt, Human; identical to SEQ ID NO: 352159

SEQ ID NO: 515669 - RNA, 64 nt, Human; identical to SEQ ID NO: 352160

SEQ ID NO: 515670 - RNA, 64 nt, Human; identical to SEQ ID NO: 352161

SEQ ID NO: 515671 - RNA, 64 nt, Human; identical to SEQ ID NO: 352162

SEQ ID NO: 515672 - RNA, 64 nt, Human; identical to SEQ ID NO: 352163

SEQ ID NO: 515673 - RNA, 64 nt, Human; identical to SEQ ID NO: 352164

SEQ ID NO: 515674 - RNA, 64 nt, Human; identical to SEQ ID NO: 352165

SEQ ID NO: 515675 - RNA, 58 nt, Human; identical to SEQ ID NO: 352166

SEQ ID NO: 515676 - RNA, 64 nt, Human; identical to SEQ ID NO: 352167

SEQ ID NO: 515677 - RNA, 64 nt, Human; identical to SEQ ID NO: 352168

SEQ ID NO: 515678 - RNA, 64 nt, Human
agcccaugugauguccaccaguggaugaaugcuggaccgagagcccuagcuucuggauccaggu

SEQ ID NO: 515679 - RNA, 64 nt, Human
acaggaguaggggggguguggguguguaaccagagaccgagagcaugaguggggugugccucgu

SEQ ID NO: 515680 - RNA, 64 nt, Human
gucaaaucuucuucagaggaucacccgggaaaacgaccgagaccgaagauuggcuacuguaaag

SEQ ID NO: 515681 - RNA, 64 nt, Human
cccagauggccaccauccucaaucuggagcgggugaccgagauccucgauuacuggggacccaa

SEQ ID NO: 515682 - RNA, 64 nt, Human; identical to SEQ ID NO: 352169

SEQ ID NO: 515683 - RNA, 64 nt, Human; identical to SEQ ID NO: 352170

SEQ ID NO: 515684 - RNA, 64 nt, Human; identical to SEQ ID NO: 352171

SEQ ID NO: 515685 - RNA, 64 nt, Human; identical to SEQ ID NO: 352172

SEQ ID NO: 515686 - RNA, 64 nt, Human; identical to SEQ ID NO: 352173

SEQ ID NO: 515687 - RNA, 64 nt, Human; identical to SEQ ID NO: 352174

SEQ ID NO: 515688 - RNA, 64 nt, Human; identical to SEQ ID NO: 352175

SEQ ID NO: 515689 - RNA, 64 nt, Human; identical to SEQ ID NO: 352176

SEQ ID NO: 515690 - RNA, 64 nt, Human; identical to SEQ ID NO: 352177

SEQ ID NO: 515691 - RNA, 64 nt, Human; identical to SEQ ID NO: 352178

SEQ ID NO: 515692 - RNA, 64 nt, Human; identical to SEQ ID NO: 352179

SEQ ID NO: 515693 - RNA, 64 nt, Human; identical to SEQ ID NO: 352180

SEQ ID NO: 515694 - RNA, 64 nt, Human; identical to SEQ ID NO: 352181

SEQ ID NO: 515695 - RNA, 64 nt, Human; identical to SEQ ID NO: 352182

SEQ ID NO: 515696 - RNA, 64 nt, Human; identical to SEQ ID NO: 352183

SEQ ID NO: 515697 - RNA, 64 nt, Human; identical to SEQ ID NO: 352184

SEQ ID NO: 515698 - RNA, 64 nt, Human
uuggauggacuuguauagugagagaggaggccuggaccgagaugugaguccuguugaagacuuc

SEQ ID NO: 515699 - RNA, 64 nt, Human
ucccaguugcagggaggguagauggccccacccagaccgagagacacagugaugaccucagccu

SEQ ID NO: 515700 - RNA, 64 nt, Human
aggccuuggaagaguccggccuggccucccccaggaccgagaucaccgcccaguaugggcuaga

SEQ ID NO: 515701 - RNA, 64 nt, Human
aaauauccccuucuuuuuaugggguuaaggaagggaccgagagaucagauaguugcuguuuugu

SEQ ID NO: 515702 - RNA, 64 nt, Human; identical to SEQ ID NO: 352185

SEQ ID NO: 515703 - RNA, 64 nt, Human; identical to SEQ ID NO: 352186

SEQ ID NO: 515704 - RNA, 64 nt, Human; identical to SEQ ID NO: 352187

SEQ ID NO: 515705 - RNA, 64 nt, Human; identical to SEQ ID NO: 352188

SEQ ID NO: 515706 - RNA, 64 nt, Human; identical to SEQ ID NO: 352189

SEQ ID NO: 515707 - RNA, 64 nt, Human; identical to SEQ ID NO: 352190

SEQ ID NO: 515708 - RNA, 64 nt, Human; identical to SEQ ID NO: 352191

SEQ ID NO: 515709 - RNA, 64 nt, Human; identical to SEQ ID NO: 352192

SEQ ID NO: 515710 - RNA, 64 nt, Human; identical to SEQ ID NO: 333042

SEQ ID NO: 515711 - RNA, 64 nt, Human; identical to SEQ ID NO: 330365

SEQ ID NO: 515712 - RNA, 64 nt, Human; identical to SEQ ID NO: 333043

SEQ ID NO: 515713 - RNA, 64 nt, Human; identical to SEQ ID NO: 332907

SEQ ID NO: 515714 - RNA, 64 nt, Human; identical to SEQ ID NO: 332908

SEQ ID NO: 515715 - RNA, 64 nt, Human
cugaccccacccgguggggcccuuggccccagaggaccgagagaguggagagugcggcgugggg

SEQ ID NO: 515716 - RNA, 64 nt, Human
ccaccaacccuccugcauccuugccuugcagcgugaccgagauaggucaucagcccagggcuuc

SEQ ID NO: 515717 - RNA, 64 nt, Human
cccuagggacucagccacuugcagaacaggaugggaccgagauuucagcgagcccuccuggcgc

SEQ ID NO: 515718 - RNA, 64 nt, Human; identical to SEQ ID NO: 330382

SEQ ID NO: 515719 - RNA, 64 nt, Human; identical to SEQ ID NO: 333470

SEQ ID NO: 515720 - RNA, 64 nt, Human; identical to SEQ ID NO: 333471

SEQ ID NO: 515721 - RNA, 64 nt, Human; identical to SEQ ID NO: 333472

SEQ ID NO: 515722 - RNA, 64 nt, Human; identical to SEQ ID NO: 332832

SEQ ID NO: 515723 - RNA, 64 nt, Human; identical to SEQ ID NO: 332833

SEQ ID NO: 515724 - RNA, 64 nt, Human; identical to SEQ ID NO: 330383

SEQ ID NO: 515725 - RNA, 64 nt, Human; identical to SEQ ID NO: 332627

SEQ ID NO: 515726 - RNA, 64 nt, Human; identical to SEQ ID NO: 332628

SEQ ID NO: 515727 - RNA, 64 nt, Human; identical to SEQ ID NO: 332629

SEQ ID NO: 515728 - RNA, 64 nt, Human; identical to SEQ ID NO: 332834

SEQ ID NO: 515729 - RNA, 64 nt, Human; identical to SEQ ID NO: 330384

SEQ ID NO: 515730 - RNA, 64 nt, Human; identical to SEQ ID NO: 332645

SEQ ID NO: 515731 - RNA, 64 nt, Human; identical to SEQ ID NO: 332646

SEQ ID NO: 515732 - RNA, 64 nt, Human; identical to SEQ ID NO: 332647

SEQ ID NO: 515733 - RNA, 64 nt, Human; identical to SEQ ID NO: 332664

SEQ ID NO: 515734 - RNA, 64 nt, Human
uacaguggcaaucgcauuucaacgugagcgugggaggggacaaacauucaaaccauagcagggu

SEQ ID NO: 515735 - RNA, 64 nt, Human
cucgcaaaucagaggcaagggagagguuguuaccaggggacacugagaauguacauuugaucug

SEQ ID NO: 515736 - RNA, 64 nt, Human
cccaccaggauaaagcagagccugcugccugcugaggggacacuuggggaaauagcagacucag

SEQ ID NO: 515737 - RNA, 64 nt, Human; identical to SEQ ID NO: 332665

SEQ ID NO: 515738 - RNA, 64 nt, Human; identical to SEQ ID NO: 330386

SEQ ID NO: 515739 - RNA, 64 nt, Human; identical to SEQ ID NO: 332683

SEQ ID NO: 515740 - RNA, 64 nt, Human; identical to SEQ ID NO: 332684

SEQ ID NO: 515741 - RNA, 64 nt, Human; identical to SEQ ID NO: 332685

SEQ ID NO: 515742 - RNA, 50 nt, Human; identical to SEQ ID NO: 332740

SEQ ID NO: 515743 - RNA, 64 nt, Human; identical to SEQ ID NO: 332741

SEQ ID NO: 515744 - RNA, 64 nt, Human; identical to SEQ ID NO: 330387

SEQ ID NO: 515745 - RNA, 64 nt, Human; identical to SEQ ID NO: 332702

SEQ ID NO: 515746 - RNA, 64 nt, Human; identical to SEQ ID NO: 332703

SEQ ID NO: 515747 - RNA, 64 nt, Human; identical to SEQ ID NO: 332704

SEQ ID NO: 515748 - RNA, 64 nt, Human; identical to SEQ ID NO: 332974

SEQ ID NO: 515749 - RNA, 64 nt, Human; identical to SEQ ID NO: 332975

SEQ ID NO: 515750 - RNA, 64 nt, Human; identical to SEQ ID NO: 330388

SEQ ID NO: 515751 - RNA, 64 nt, Human; identical to SEQ ID NO: 332721

SEQ ID NO: 515752 - RNA, 64 nt, Human; identical to SEQ ID NO: 332722

SEQ ID NO: 515753 - RNA, 64 nt, Human
agccggucagaacugugugacucacuugaggcaggaccgagagugacauccaguugcaccuuuc

SEQ ID NO: 515754 - RNA, 64 nt, Human
gcuguuccuaugacaggcccacucaaccugggcagaccgagaggcccgugcacuuuggaauggg

SEQ ID NO: 515755 - RNA, 64 nt, Human
aaccugucggaccuucacuucacaucaugguggggaccgagauagagagggagaccccauucca

SEQ ID NO: 515756 - RNA, 64 nt, Human; identical to SEQ ID NO: 332723

SEQ ID NO: 515757 - RNA, 64 nt, Human; identical to SEQ ID NO: 332589

SEQ ID NO: 515758 - RNA, 64 nt, Human; identical to SEQ ID NO: 332590

SEQ ID NO: 515759 - RNA, 64 nt, Human; identical to SEQ ID NO: 330389

SEQ ID NO: 515760 - RNA, 64 nt, Human; identical to SEQ ID NO: 332742

SEQ ID NO: 515761 - RNA, 64 nt, Human; identical to SEQ ID NO: 332909

SEQ ID NO: 515762 - RNA, 59 nt, Human; identical to SEQ ID NO: 330390

SEQ ID NO: 515763 - RNA, 64 nt, Human; identical to SEQ ID NO: 332759

SEQ ID NO: 515764 - RNA, 64 nt, Human; identical to SEQ ID NO: 332760

SEQ ID NO: 515765 - RNA, 64 nt, Human; identical to SEQ ID NO: 332761

SEQ ID NO: 515766 - RNA, 64 nt, Human; identical to SEQ ID NO: 332778

SEQ ID NO: 515767 - RNA, 64 nt, Human; identical to SEQ ID NO: 332779

SEQ ID NO: 515768 - RNA, 64 nt, Human; identical to SEQ ID NO: 330391

SEQ ID NO: 515769 - RNA, 64 nt, Human; identical to SEQ ID NO: 332780

SEQ ID NO: 515770 - RNA, 64 nt, Human; identical to SEQ ID NO: 332552

SEQ ID NO: 515771 - RNA, 64 nt, Human; identical to SEQ ID NO: 332553

SEQ ID NO: 515772 - RNA, 64 nt, Human
agaccuuccuagaguguuuggucggguucacagugaccgagagucagguccagcacacaccugg

SEQ ID NO: 515773 - RNA, 64 nt, Human
aaacaguucaauuaacuguauaggucuuucauuagaccgagacaucacuagaaauucugggcac

SEQ ID NO: 515774 - RNA, 64 nt, Human; identical to SEQ ID NO: 330392

SEQ ID NO: 515775 - RNA, 64 nt, Human; identical to SEQ ID NO: 332813

SEQ ID NO: 515776 - RNA, 64 nt, Human; identical to SEQ ID NO: 332814

SEQ ID NO: 515777 - RNA, 64 nt, Human; identical to SEQ ID NO: 332815

SEQ ID NO: 515778 - RNA, 64 nt, Human; identical to SEQ ID NO: 332480

SEQ ID NO: 515779 - RNA, 64 nt, Human; identical to SEQ ID NO: 332481

SEQ ID NO: 515780 - RNA, 64 nt, Human; identical to SEQ ID NO: 330393

SEQ ID NO: 515781 - RNA, 64 nt, Human; identical to SEQ ID NO: 332976

SEQ ID NO: 515782 - RNA, 64 nt, Human; identical to SEQ ID NO: 332426

SEQ ID NO: 515783 - RNA, 64 nt, Human; identical to SEQ ID NO: 332427

SEQ ID NO: 515784 - RNA, 64 nt, Human; identical to SEQ ID NO: 330394

SEQ ID NO: 515785 - RNA, 64 nt, Human; identical to SEQ ID NO: 333009

SEQ ID NO: 515786 - RNA, 64 nt, Human; identical to SEQ ID NO: 333204

SEQ ID NO: 515787 - RNA, 64 nt, Human; identical to SEQ ID NO: 333205

SEQ ID NO: 515788 - RNA, 64 nt, Human; identical to SEQ ID NO: 330395

SEQ ID NO: 515789 - RNA, 53 nt, Human; identical to SEQ ID NO: 333206

SEQ ID NO: 515790 - RNA, 64 nt, Human
gcuggaacuuacugacuguaagagguuagagguggaccgagaaggacuuuucccagucuucagu

SEQ ID NO: 515791 - RNA, 64 nt, Human
agcccaggcgguuucacgccccacacuuuguacagaccgagaggccaguugaucugcucuguuu

SEQ ID NO: 515792 - RNA, 64 nt, Human
cagggcccaacucuaaaguggaagaaccuuguuagaccgagagcuugccauccagccaagcugc

SEQ ID NO: 515793 - RNA, 64 nt, Human; identical to SEQ ID NO: 332666

SEQ ID NO: 515794 - RNA, 64 nt, Human
ccgagaccugcacagaugaaggagcagagguucugaccgagaggcugagccaggccggggucug

SEQ ID NO: 515795 - RNA, 64 nt, Human
uauuccaucaccauucaccccaggggacagccucgaccgagacaaggaggcccuuaaaugacag

SEQ ID NO: 515796 - RNA, 64 nt, Human
gugugugugugugugugcgcgcgcgccagugcaagaccgagauugagggaaagcaugucugcug

SEQ ID NO: 515797 - RNA, 64 nt, Human
agauauuuauuggccaggaaguuggugcugcuaagaccgagaaauuuaaagaaucggacagaug

SEQ ID NO: 515798 - RNA, 64 nt, Human
gcggagugggagggagacgcaguagacagagacagaccgagagaggaauggagagacagagggg

SEQ ID NO: 515799 - RNA, 64 nt, Human
uguuggagcuacugcaaaugcuauauugcacugugaccgagaacuuuuaagaggauagaauaca

SEQ ID NO: 515800 - RNA, 64 nt, Human
gcaggcucagaagagacugagcuugcacagaucagaccgagaagcagggugagagauucuaacg

SEQ ID NO: 515801 - RNA, 64 nt, Human
acgggagcaagacuucuaacggcugauugguauggaccgagauuaucuuucaauugaagugacu

SEQ ID NO: 515802 - RNA, 64 nt, Human
gauugugccacugcacacuccaaucugggugaaagaccgagacuccgccucaaaaaaaaaaaaa

SEQ ID NO: 515803 - RNA, 64 nt, Human
aaucuuacuguacuggaaacgucaccggaaucaggaccgagagcccuaaauaagucacacagca

SEQ ID NO: 515804 - RNA, 64 nt, Human
gggcugugcggagcuggugcugccugaaaccccagaccgagaaguugaugcucggcccacgccg

SEQ ID NO: 515805 - RNA, 64 nt, Human
uauuuaucugugugucugacagugugagauguuagaccgagagaaaagcaaacaaauaaaucac

SEQ ID NO: 515806 - RNA, 62 nt, Human
uccgcauccuagucucuaucauuaaaguucuagugaccgagacccgggcugcguucucuggg

SEQ ID NO: 515807 - RNA, 64 nt, Human
guaguuugaaacucauuguuuccuugugguaagugaccgagaugcugccacaggaccugagaca

SEQ ID NO: 515808 - RNA, 64 nt, Human
ucuuuccaaagcaaaagaggaagccagaccuugggaccgagaacugagaaucacaagggaguug

SEQ ID NO: 515809 - RNA, 64 nt, Human
caagaucgccccacugcacuccagccuggcaauagaccgagacuccgucuccaaaaaaaaaaaa

SEQ ID NO: 515810 - RNA, 64 nt, Human
agcugggcgagcugggcuggggagagccugugaggaccgagaggagaaaugagaagaaggaaca

SEQ ID NO: 515811 - RNA, 64 nt, Human
ccauccucagccggggccguccagacagcaacaagaccgagaaccggcguaucacacacaucuc

SEQ ID NO: 515812 - RNA, 64 nt, Human
gcagagcgugccgcuacacuccagccugaugacagaccgagacacugucucaaaaaaauaaaaa

SEQ ID NO: 515813 - RNA, 64 nt, Human
ccugacucaggacuuggacgccauaguggcccgggaccgagaccuucagcaguugaggcugggg

SEQ ID NO: 515814 - RNA, 64 nt, Human
gagaucgcaccacugcacuccagccugggcgacagaccgagacuccgucucaaaaaaaaaaaaa

SEQ ID NO: 515815 - RNA, 64 nt, Human; identical to SEQ ID NO: 99117

SEQ ID NO: 515816 - RNA, 64 nt, Human; identical to SEQ ID NO: 99118

SEQ ID NO: 515817 - RNA, 64 nt, Human; identical to SEQ ID NO: 99119

SEQ ID NO: 515818 - RNA, 64 nt, Human; identical to SEQ ID NO: 99120

SEQ ID NO: 515819 - RNA, 64 nt, Human; identical to SEQ ID NO: 99121

SEQ ID NO: 515820 - RNA, 64 nt, Human; identical to SEQ ID NO: 99122

SEQ ID NO: 515821 - RNA, 64 nt, Human; identical to SEQ ID NO: 99123

SEQ ID NO: 515822 - RNA, 64 nt, Human; identical to SEQ ID NO: 99124

SEQ ID NO: 515823 - RNA, 64 nt, Human; identical to SEQ ID NO: 99125

SEQ ID NO: 515824 - RNA, 64 nt, Human; identical to SEQ ID NO: 99126

SEQ ID NO: 515825 - RNA, 64 nt, Human; identical to SEQ ID NO: 99127

SEQ ID NO: 515826 - RNA, 64 nt, Human; identical to SEQ ID NO: 99128

SEQ ID NO: 515827 - RNA, 64 nt, Human; identical to SEQ ID NO: 99129

SEQ ID NO: 515828 - RNA, 64 nt, Human; identical to SEQ ID NO: 99130

SEQ ID NO: 515829 - RNA, 64 nt, Human; identical to SEQ ID NO: 99131

SEQ ID NO: 515830 - RNA, 64 nt, Human; identical to SEQ ID NO: 99132

SEQ ID NO: 515831 - RNA, 64 nt, Human
ugguaugauaucaaacuauuuugcaguuguaaauaggggacagauggaaaauauuuauaacuga

SEQ ID NO: 515832 - RNA, 64 nt, Human
ucccaagaugcagaaauguggaugcucuuuucccaggggacaugaguaaagcagugugguacac

SEQ ID NO: 515833 - RNA, 64 nt, Human
ucggauccauacucggggggccucagcccuugggaggggacaccugaggcagccagcgcccccu

SEQ ID NO: 515834 - RNA, 64 nt, Human
aggcuugaccuuuuguccugaccaggugggcuggaggggacaagcccuaucccuggcauuacgu

SEQ ID NO: 515835 - RNA, 64 nt, Human; identical to SEQ ID NO: 99133

SEQ ID NO: 515836 - RNA, 64 nt, Human; identical to SEQ ID NO: 99134

SEQ ID NO: 515837 - RNA, 64 nt, Human; identical to SEQ ID NO: 99135

SEQ ID NO: 515838 - RNA, 64 nt, Human; identical to SEQ ID NO: 99136

SEQ ID NO: 515839 - RNA, 64 nt, Human; identical to SEQ ID NO: 99137

SEQ ID NO: 515840 - RNA, 64 nt, Human; identical to SEQ ID NO: 99138

SEQ ID NO: 515841 - RNA, 64 nt, Human; identical to SEQ ID NO: 99139

SEQ ID NO: 515842 - RNA, 64 nt, Human; identical to SEQ ID NO: 99140

SEQ ID NO: 515843 - RNA, 64 nt, Human; identical to SEQ ID NO: 99141

SEQ ID NO: 515844 - RNA, 64 nt, Human; identical to SEQ ID NO: 99142

SEQ ID NO: 515845 - RNA, 64 nt, Human; identical to SEQ ID NO: 99143

SEQ ID NO: 515846 - RNA, 64 nt, Human; identical to SEQ ID NO: 99144

SEQ ID NO: 515847 - RNA, 64 nt, Human; identical to SEQ ID NO: 99145

SEQ ID NO: 515848 - RNA, 64 nt, Human; identical to SEQ ID NO: 99146

SEQ ID NO: 515849 - RNA, 64 nt, Human; identical to SEQ ID NO: 99147

SEQ ID NO: 515850 - RNA, 64 nt, Human; identical to SEQ ID NO: 99148

SEQ ID NO: 515851 - RNA, 64 nt, Human
ggcacuaagccuaagaaguucccugguuuuucccaggggacaggacccacugggagacaagcau

SEQ ID NO: 515852 - RNA, 64 nt, Human
uucuguccugucuuauacugcaacugugucuccuaggggacagauggccuucuuugucaucuuc

SEQ ID NO: 515853 - RNA, 64 nt, Human
agucccagguuuagugaaaaacugcuguaaacacaggggacacagcuuaacaaugcaacuuuua

SEQ ID NO: 515854 - RNA, 64 nt, Human
agacuaugugcacugaaguaaaugggguugggggaggggacauuucauauuuauaaugugcuga

SEQ ID NO: 515855 - RNA, 64 nt, Human; identical to SEQ ID NO: 99149

SEQ ID NO: 515856 - RNA, 64 nt, Human; identical to SEQ ID NO: 99150

SEQ ID NO: 515857 - RNA, 64 nt, Human; identical to SEQ ID NO: 99151

SEQ ID NO: 515858 - RNA, 64 nt, Human; identical to SEQ ID NO: 99152

SEQ ID NO: 515859 - RNA, 64 nt, Human; identical to SEQ ID NO: 99153

SEQ ID NO: 515860 - RNA, 64 nt, Human; identical to SEQ ID NO: 99154

SEQ ID NO: 515861 - RNA, 64 nt, Human; identical to SEQ ID NO: 99155

SEQ ID NO: 515862 - RNA, 64 nt, Human; identical to SEQ ID NO: 99156

SEQ ID NO: 515863 - RNA, 64 nt, Human; identical to SEQ ID NO: 99157

SEQ ID NO: 515864 - RNA, 64 nt, Human; identical to SEQ ID NO: 99158

SEQ ID NO: 515865 - RNA, 64 nt, Human; identical to SEQ ID NO: 99159

SEQ ID NO: 515866 - RNA, 64 nt, Human; identical to SEQ ID NO: 99160

SEQ ID NO: 515867 - RNA, 64 nt, Human; identical to SEQ ID NO: 99161

SEQ ID NO: 515868 - RNA, 64 nt, Human; identical to SEQ ID NO: 99162

SEQ ID NO: 515869 - RNA, 64 nt, Human; identical to SEQ ID NO: 99163

SEQ ID NO: 515870 - RNA, 64 nt, Human; identical to SEQ ID NO: 99164

SEQ ID NO: 515871 - RNA, 64 nt, Human
aggcuucccucuucucaggauccaccacaggguuaggggacaggaagccuguucuauucucaau

SEQ ID NO: 515872 - RNA, 64 nt, Human
uacacuggcaauuuaauuucaagaugaguuuuggaggggacauucaaaccauagcagugcuaua

SEQ ID NO: 515873 - RNA, 64 nt, Human
aaaggcaguucaguccacaggcauggaagcugugaggggacaggccugugcgugccauccagag

SEQ ID NO: 515874 - RNA, 64 nt, Human
gccaacagccggguggcuguccaagcaggauugcaggggacacagggaagcacugcccagcccc

SEQ ID NO: 515875 - RNA, 64 nt, Human; identical to SEQ ID NO: 99165

SEQ ID NO: 515876 - RNA, 58 nt, Human; identical to SEQ ID NO: 99166

SEQ ID NO: 515877 - RNA, 64 nt, Human; identical to SEQ ID NO: 99167

SEQ ID NO: 515878 - RNA, 64 nt, Human; identical to SEQ ID NO: 99168

SEQ ID NO: 515879 - RNA, 64 nt, Human; identical to SEQ ID NO: 99169

SEQ ID NO: 515880 - RNA, 64 nt, Human; identical to SEQ ID NO: 99170

SEQ ID NO: 515881 - RNA, 64 nt, Human; identical to SEQ ID NO: 99171

SEQ ID NO: 515882 - RNA, 64 nt, Human; identical to SEQ ID NO: 99172

SEQ ID NO: 515883 - RNA, 64 nt, Human; identical to SEQ ID NO: 99173

SEQ ID NO: 515884 - RNA, 64 nt, Human; identical to SEQ ID NO: 99174

SEQ ID NO: 515885 - RNA, 64 nt, Human; identical to SEQ ID NO: 99175

SEQ ID NO: 515886 - RNA, 64 nt, Human; identical to SEQ ID NO: 99176

SEQ ID NO: 515887 - RNA, 64 nt, Human; identical to SEQ ID NO: 99177

SEQ ID NO: 515888 - RNA, 64 nt, Human; identical to SEQ ID NO: 99178

SEQ ID NO: 515889 - RNA, 64 nt, Human; identical to SEQ ID NO: 99179

SEQ ID NO: 515890 - RNA, 64 nt, Human; identical to SEQ ID NO: 99180

SEQ ID NO: 515891 - RNA, 64 nt, Human
auccccuucuaaugaaugaaacuaggggaauuucaggggacagagaugggauuuguuguaugau

SEQ ID NO: 515892 - RNA, 64 nt, Human
cuacgguuuuuuuuuuuuuuuuuuuuuuuuuggcaggggacaaggagcaugguggucuuggcua

SEQ ID NO: 515893 - RNA, 64 nt, Human
aggucaggcauugacacuuuguaagaaaggggguaggggacacagcugggcagguggagugggu

SEQ ID NO: 515894 - RNA, 64 nt, Human
cucugagagcaaacaggaacacuagagaccaaaaaggggacaaaggagaagggcugagcccacc

SEQ ID NO: 515895 - RNA, 64 nt, Human; identical to SEQ ID NO: 99181

SEQ ID NO: 515896 - RNA, 64 nt, Human; identical to SEQ ID NO: 99182

SEQ ID NO: 515897 - RNA, 64 nt, Human; identical to SEQ ID NO: 99183

SEQ ID NO: 515898 - RNA, 64 nt, Human; identical to SEQ ID NO: 99184

SEQ ID NO: 515899 - RNA, 64 nt, Human; identical to SEQ ID NO: 99185

SEQ ID NO: 515900 - RNA, 64 nt, Human; identical to SEQ ID NO: 99186

SEQ ID NO: 515901 - RNA, 64 nt, Human; identical to SEQ ID NO: 99187

SEQ ID NO: 515902 - RNA, 64 nt, Human; identical to SEQ ID NO: 99188

SEQ ID NO: 515903 - RNA, 64 nt, Human; identical to SEQ ID NO: 99189

SEQ ID NO: 515904 - RNA, 64 nt, Human; identical to SEQ ID NO: 99190

SEQ ID NO: 515905 - RNA, 64 nt, Human; identical to SEQ ID NO: 99191

SEQ ID NO: 515906 - RNA, 64 nt, Human; identical to SEQ ID NO: 99192

SEQ ID NO: 515907 - RNA, 64 nt, Human; identical to SEQ ID NO: 99193

SEQ ID NO: 515908 - RNA, 64 nt, Human; identical to SEQ ID NO: 99194

SEQ ID NO: 515909 - RNA, 64 nt, Human; identical to SEQ ID NO: 99195

SEQ ID NO: 515910 - RNA, 64 nt, Human; identical to SEQ ID NO: 99196

SEQ ID NO: 515911 - RNA, 64 nt, Human
gucuguauaauaagggcaucucuauuagaucuuuaggggacagaggauuugucaagaugguuag

SEQ ID NO: 515912 - RNA, 64 nt, Human
uggggugagaggugaaagcauaacauggguacagaggggacaacaaugaaucagaacagaugcu

SEQ ID NO: 515913 - RNA, 64 nt, Human
ccccagagcagcccaggguccugccagagucugcaggggacagcccucguuuuuuaagucuuuu

SEQ ID NO: 515914 - RNA, 64 nt, Human
aguuggcugcauuuucuuaucugaucacaauggcaggggacagaaugugcauggaguggagcau

SEQ ID NO: 515915 - RNA, 64 nt, Human; identical to SEQ ID NO: 99197

SEQ ID NO: 515916 - RNA, 64 nt, Human; identical to SEQ ID NO: 99198

SEQ ID NO: 515917 - RNA, 64 nt, Human; identical to SEQ ID NO: 99199

SEQ ID NO: 515918 - RNA, 64 nt, Human; identical to SEQ ID NO: 99200

SEQ ID NO: 515919 - RNA, 64 nt, Human; identical to SEQ ID NO: 99201

SEQ ID NO: 515920 - RNA, 64 nt, Human; identical to SEQ ID NO: 99202

SEQ ID NO: 515921 - RNA, 64 nt, Human; identical to SEQ ID NO: 99203

SEQ ID NO: 515922 - RNA, 64 nt, Human; identical to SEQ ID NO: 99204

SEQ ID NO: 515923 - RNA, 64 nt, Human; identical to SEQ ID NO: 99205

SEQ ID NO: 515924 - RNA, 64 nt, Human; identical to SEQ ID NO: 99206

SEQ ID NO: 515925 - RNA, 64 nt, Human; identical to SEQ ID NO: 99207

SEQ ID NO: 515926 - RNA, 64 nt, Human; identical to SEQ ID NO: 99208

SEQ ID NO: 515927 - RNA, 60 nt, Human; identical to SEQ ID NO: 99209

SEQ ID NO: 515928 - RNA, 64 nt, Human; identical to SEQ ID NO: 99210

SEQ ID NO: 515929 - RNA, 64 nt, Human; identical to SEQ ID NO: 99211

SEQ ID NO: 515930 - RNA, 64 nt, Human; identical to SEQ ID NO: 99212

SEQ ID NO: 515931 - RNA, 64 nt, Human
cgugguggugcaggggacaagaggcugugggugcaggggacaccuguggagggcauuucccgug

SEQ ID NO: 515932 - RNA, 64 nt, Human
ggacacauuucacaccucaggcucgugguggugcaggggacaagaggcugugggugcaggggac

SEQ ID NO: 515933 - RNA, 64 nt, Human
cgacacacacuucaccugcaagggccgacaacgcaggggacaccgugccggcuucagacacucc

SEQ ID NO: 515934 - RNA, 64 nt, Human
ggguguucaaauuuauuuuaagagauagggagggaggggacauaaagggaaugcauacauugcu

SEQ ID NO: 515935 - RNA, 64 nt, Human; identical to SEQ ID NO: 99213

SEQ ID NO: 515936 - RNA, 64 nt, Human; identical to SEQ ID NO: 99214

SEQ ID NO: 515937 - RNA, 64 nt, Human; identical to SEQ ID NO: 99215

SEQ ID NO: 515938 - RNA, 55 nt, Human; identical to SEQ ID NO: 99216

SEQ ID NO: 515939 - RNA, 64 nt, Human; identical to SEQ ID NO: 99217

SEQ ID NO: 515940 - RNA, 64 nt, Human; identical to SEQ ID NO: 99218

SEQ ID NO: 515941 - RNA, 64 nt, Human; identical to SEQ ID NO: 99219

SEQ ID NO: 515942 - RNA, 64 nt, Human; identical to SEQ ID NO: 99220

SEQ ID NO: 515943 - RNA, 64 nt, Human; identical to SEQ ID NO: 99221

SEQ ID NO: 515944 - RNA, 64 nt, Human; identical to SEQ ID NO: 99222

SEQ ID NO: 515945 - RNA, 64 nt, Human; identical to SEQ ID NO: 99223

SEQ ID NO: 515946 - RNA, 64 nt, Human; identical to SEQ ID NO: 99224

SEQ ID NO: 515947 - RNA, 64 nt, Human; identical to SEQ ID NO: 99225

SEQ ID NO: 515948 - RNA, 64 nt, Human; identical to SEQ ID NO: 99226

SEQ ID NO: 515949 - RNA, 64 nt, Human; identical to SEQ ID NO: 99227

SEQ ID NO: 515950 - RNA, 64 nt, Human; identical to SEQ ID NO: 99228

SEQ ID NO: 515951 - RNA, 51 nt, Human; identical to SEQ ID NO: 99229

SEQ ID NO: 515952 - RNA, 64 nt, Human
guucagcugcugcucccaauaccucagcaugguaaggggacagagcccagcagaucccagcugu

SEQ ID NO: 515953 - RNA, 55 nt, Human
ggggaagcuccagaaggugagggagaggggacaacgacaugguucccguggaucu

SEQ ID NO: 515954 - RNA, 64 nt, Human
gaaguggcaucaaggacucagggggaaagaaaucaggggacauguuauagaaguuaugaaaaga

SEQ ID NO: 515955 - RNA, 64 nt, Human; identical to SEQ ID NO: 99230

SEQ ID NO: 515956 - RNA, 64 nt, Human; identical to SEQ ID NO: 99231

SEQ ID NO: 515957 - RNA, 64 nt, Human; identical to SEQ ID NO: 99232

SEQ ID NO: 515958 - RNA, 64 nt, Human; identical to SEQ ID NO: 99233

SEQ ID NO: 515959 - RNA, 64 nt, Human; identical to SEQ ID NO: 99234

SEQ ID NO: 515960 - RNA, 64 nt, Human; identical to SEQ ID NO: 99235

SEQ ID NO: 515961 - RNA, 64 nt, Human; identical to SEQ ID NO: 99236

SEQ ID NO: 515962 - RNA, 64 nt, Human; identical to SEQ ID NO: 99237

SEQ ID NO: 515963 - RNA, 64 nt, Human; identical to SEQ ID NO: 99238

SEQ ID NO: 515964 - RNA, 64 nt, Human; identical to SEQ ID NO: 99239

SEQ ID NO: 515965 - RNA, 64 nt, Human; identical to SEQ ID NO: 99240

SEQ ID NO: 515966 - RNA, 55 nt, Human; identical to SEQ ID NO: 99241

SEQ ID NO: 515967 - RNA, 64 nt, Human; identical to SEQ ID NO: 99242

SEQ ID NO: 515968 - RNA, 64 nt, Human; identical to SEQ ID NO: 99243

SEQ ID NO: 515969 - RNA, 64 nt, Human; identical to SEQ ID NO: 99244

SEQ ID NO: 515970 - RNA, 64 nt, Human; identical to SEQ ID NO: 99245

SEQ ID NO: 515971 - RNA, 64 nt, Human
ugagggcccagccaggagcagauggacagcgaugaggggacauuuucuggauucugggaggcaa

SEQ ID NO: 515972 - RNA, 64 nt, Human
aacuaugagaaauagcuguucugugaacgugaaaaggggacagcaguuuucccaguuuuggcca

SEQ ID NO: 515973 - RNA, 64 nt, Human
caguuggcaacacugcccauucaauugaaucagaaggggacaaaauuaacgauugccuucaguu

SEQ ID NO: 515974 - RNA, 64 nt, Human
ucagaggagggugacaggggcuggaaauaaagagaggggacauggugaugaaacauggcaggag

SEQ ID NO: 515975 - RNA, 64 nt, Human; identical to SEQ ID NO: 99246

SEQ ID NO: 515976 - RNA, 52 nt, Human; identical to SEQ ID NO: 99247

SEQ ID NO: 515977 - RNA, 64 nt, Human; identical to SEQ ID NO: 99248

SEQ ID NO: 515978 - RNA, 64 nt, Human; identical to SEQ ID NO: 99249

SEQ ID NO: 515979 - RNA, 64 nt, Human; identical to SEQ ID NO: 99250

SEQ ID NO: 515980 - RNA, 64 nt, Human; identical to SEQ ID NO: 99251

SEQ ID NO: 515981 - RNA, 64 nt, Human; identical to SEQ ID NO: 99252

SEQ ID NO: 515982 - RNA, 64 nt, Human; identical to SEQ ID NO: 99253

SEQ ID NO: 515983 - RNA, 64 nt, Human; identical to SEQ ID NO: 99254

SEQ ID NO: 515984 - RNA, 64 nt, Human; identical to SEQ ID NO: 99255

SEQ ID NO: 515985 - RNA, 64 nt, Human; identical to SEQ ID NO: 99256

SEQ ID NO: 515986 - RNA, 64 nt, Human; identical to SEQ ID NO: 99257

SEQ ID NO: 515987 - RNA, 64 nt, Human; identical to SEQ ID NO: 99258

SEQ ID NO: 515988 - RNA, 64 nt, Human; identical to SEQ ID NO: 99259

SEQ ID NO: 515989 - RNA, 64 nt, Human; identical to SEQ ID NO: 99260

SEQ ID NO: 515990 - RNA, 58 nt, Human; identical to SEQ ID NO: 99261

SEQ ID NO: 515991 - RNA, 64 nt, Human
aaugaaaaagaaugaaagggaaagugaaaaauuaaggggacaaaagaugggaugugaaaagaag

SEQ ID NO: 515992 - RNA, 64 nt, Human
uuaaaaaaguagauauuuaauaucuaagcaggggaggggacaggacagaaagccugcacugagg

SEQ ID NO: 515993 - RNA, 64 nt, Human
guugcacuuucguugcaugugcugugugaccccaaggggacagggagucacuuuggucaucucu

SEQ ID NO: 515994 - RNA, 64 nt, Human
auuuguuuugcuacauacuguuccagacuuuuaaaggggacaaugaaggugacuguggggagga

SEQ ID NO: 515995 - RNA, 64 nt, Human; identical to SEQ ID NO: 99262

SEQ ID NO: 515996 - RNA, 64 nt, Human; identical to SEQ ID NO: 99263

SEQ ID NO: 515997 - RNA, 64 nt, Human; identical to SEQ ID NO: 99264

SEQ ID NO: 515998 - RNA, 64 nt, Human; identical to SEQ ID NO: 99265

SEQ ID NO: 515999 - RNA, 64 nt, Human; identical to SEQ ID NO: 99266

SEQ ID NO: 516000 - RNA, 64 nt, Human; identical to SEQ ID NO: 99267

SEQ ID NO: 516001 - RNA, 64 nt, Human; identical to SEQ ID NO: 99268

SEQ ID NO: 516002 - RNA, 64 nt, Human; identical to SEQ ID NO: 99269

SEQ ID NO: 516003 - RNA, 64 nt, Human; identical to SEQ ID NO: 99270

SEQ ID NO: 516004 - RNA, 64 nt, Human; identical to SEQ ID NO: 99271

SEQ ID NO: 516005 - RNA, 64 nt, Human; identical to SEQ ID NO: 99272

SEQ ID NO: 516006 - RNA, 64 nt, Human; identical to SEQ ID NO: 99273

SEQ ID NO: 516007 - RNA, 64 nt, Human; identical to SEQ ID NO: 99274

SEQ ID NO: 516008 - RNA, 64 nt, Human; identical to SEQ ID NO: 99275

SEQ ID NO: 516009 - RNA, 64 nt, Human; identical to SEQ ID NO: 99276

SEQ ID NO: 516010 - RNA, 64 nt, Human; identical to SEQ ID NO: 99277

SEQ ID NO: 516011 - RNA, 50 nt, Human
gugccaccggcugcaaaugaaggggacaagagaacugucucauagucaug

SEQ ID NO: 516012 - RNA, 64 nt, Human
gugggagggcuuauauugguuuuuccagcuauuaaggggacauauugugucguugugcuuuuca

SEQ ID NO: 516013 - RNA, 64 nt, Human
gagccagggugcugggaaacucacagcuggacucaggggacacggccuguggccucaccauccc

SEQ ID NO: 516014 - RNA, 64 nt, Human
ugacuuuuucuaagagcucccggcgugguggaagaggggacaggucccucacccacccacaauc

SEQ ID NO: 516015 - RNA, 64 nt, Human; identical to SEQ ID NO: 99278

SEQ ID NO: 516016 - RNA, 64 nt, Human; identical to SEQ ID NO: 99279

SEQ ID NO: 516017 - RNA, 64 nt, Human; identical to SEQ ID NO: 99280

SEQ ID NO: 516018 - RNA, 64 nt, Human; identical to SEQ ID NO: 99281

SEQ ID NO: 516019 - RNA, 64 nt, Human; identical to SEQ ID NO: 99282

SEQ ID NO: 516020 - RNA, 64 nt, Human; identical to SEQ ID NO: 99283

SEQ ID NO: 516021 - RNA, 64 nt, Human; identical to SEQ ID NO: 99284

SEQ ID NO: 516022 - RNA, 64 nt, Human; identical to SEQ ID NO: 99285

SEQ ID NO: 516023 - RNA, 64 nt, Human; identical to SEQ ID NO: 99286

SEQ ID NO: 516024 - RNA, 64 nt, Human; identical to SEQ ID NO: 99287

SEQ ID NO: 516025 - RNA, 64 nt, Human; identical to SEQ ID NO: 99288

SEQ ID NO: 516026 - RNA, 64 nt, Human; identical to SEQ ID NO: 99289

SEQ ID NO: 516027 - RNA, 64 nt, Human; identical to SEQ ID NO: 99290

SEQ ID NO: 516028 - RNA, 64 nt, Human; identical to SEQ ID NO: 99291

SEQ ID NO: 516029 - RNA, 64 nt, Human; identical to SEQ ID NO: 99292

SEQ ID NO: 516030 - RNA, 64 nt, Human; identical to SEQ ID NO: 99293

SEQ ID NO: 516031 - RNA, 64 nt, Human
ccagccagcccgugacagcuucccccuaaucaggaggggacagcugggggcgcaagcuggugug

SEQ ID NO: 516032 - RNA, 54 nt, Human
gcucuccagggagcgauuaggggcaggggacaccuuggcuccucagcagcccaa

SEQ ID NO: 516033 - RNA, 64 nt, Human
ucaggcccagugugagccugcucugcaagaagggaggggacagcuggcuucagccaggcucggu

SEQ ID NO: 516034 - RNA, 64 nt, Human
uacccugccacgcuagguuaugacgaccugacccaggggacagcagcaggagacuacuccaaag

SEQ ID NO: 516035 - RNA, 64 nt, Human; identical to SEQ ID NO: 99294

SEQ ID NO: 516036 - RNA, 64 nt, Human; identical to SEQ ID NO: 99295

SEQ ID NO: 516037 - RNA, 64 nt, Human; identical to SEQ ID NO: 99296

SEQ ID NO: 516038 - RNA, 64 nt, Human; identical to SEQ ID NO: 99297

SEQ ID NO: 516039 - RNA, 64 nt, Human; identical to SEQ ID NO: 99298

SEQ ID NO: 516040 - RNA, 64 nt, Human; identical to SEQ ID NO: 99299

SEQ ID NO: 516041 - RNA, 64 nt, Human; identical to SEQ ID NO: 99300

SEQ ID NO: 516042 - RNA, 64 nt, Human; identical to SEQ ID NO: 99301

SEQ ID NO: 516043 - RNA, 64 nt, Human; identical to SEQ ID NO: 99302

SEQ ID NO: 516044 - RNA, 64 nt, Human; identical to SEQ ID NO: 99303

SEQ ID NO: 516045 - RNA, 64 nt, Human; identical to SEQ ID NO: 99304

SEQ ID NO: 516046 - RNA, 64 nt, Human; identical to SEQ ID NO: 99305

SEQ ID NO: 516047 - RNA, 64 nt, Human; identical to SEQ ID NO: 99306

SEQ ID NO: 516048 - RNA, 64 nt, Human; identical to SEQ ID NO: 99307

SEQ ID NO: 516049 - RNA, 64 nt, Human; identical to SEQ ID NO: 99308

SEQ ID NO: 516050 - RNA, 62 nt, Human; identical to SEQ ID NO: 99309

SEQ ID NO: 516051 - RNA, 58 nt, Human; identical to SEQ ID NO: 99310

SEQ ID NO: 516052 - RNA, 64 nt, Human
acucccgaaaggaacuauuuuacaggugccaaaaaggggacaguguugauaauaauaauaaaau

SEQ ID NO: 516053 - RNA, 64 nt, Human
ggauuccagaagaaaugauauuuauauucucuauaggggacagaaaaugagaagccaucacucu

SEQ ID NO: 516054 - RNA, 64 nt, Human
aauuucaagguccucaccacuccuucauuugcagaggggacaacagacuuucugaccugagaac

SEQ ID NO: 516055 - RNA, 64 nt, Human; identical to SEQ ID NO: 99311

SEQ ID NO: 516056 - RNA, 64 nt, Human; identical to SEQ ID NO: 99312

SEQ ID NO: 516057 - RNA, 64 nt, Human; identical to SEQ ID NO: 99313

SEQ ID NO: 516058 - RNA, 64 nt, Human; identical to SEQ ID NO: 99314

SEQ ID NO: 516059 - RNA, 64 nt, Human; identical to SEQ ID NO: 99315

SEQ ID NO: 516060 - RNA, 64 nt, Human; identical to SEQ ID NO: 99316

SEQ ID NO: 516061 - RNA, 64 nt, Human; identical to SEQ ID NO: 99317

SEQ ID NO: 516062 - RNA, 64 nt, Human; identical to SEQ ID NO: 99318

SEQ ID NO: 516063 - RNA, 64 nt, Human; identical to SEQ ID NO: 99319

SEQ ID NO: 516064 - RNA, 64 nt, Human; identical to SEQ ID NO: 99320

SEQ ID NO: 516065 - RNA, 64 nt, Human; identical to SEQ ID NO: 99321

SEQ ID NO: 516066 - RNA, 64 nt, Human; identical to SEQ ID NO: 99322

SEQ ID NO: 516067 - RNA, 64 nt, Human; identical to SEQ ID NO: 99323

SEQ ID NO: 516068 - RNA, 64 nt, Human; identical to SEQ ID NO: 99324

SEQ ID NO: 516069 - RNA, 64 nt, Human; identical to SEQ ID NO: 99325

SEQ ID NO: 516070 - RNA, 64 nt, Human; identical to SEQ ID NO: 99326

SEQ ID NO: 516071 - RNA, 64 nt, Human
ugcagagucaacagcccaucagcccauguuuuagaggggacacuuugguccucgguucccaccc

SEQ ID NO: 516072 - RNA, 64 nt, Human
agacacuccuugaaaugugugugugauggagggaaggggacagauuugaggacugaagcugggg

SEQ ID NO: 516073 - RNA, 64 nt, Human
acuggccgccucuccuugccaggccugccaacucaggggacagauggagcaggaguggagaaag

SEQ ID NO: 516074 - RNA, 64 nt, Human
ccucucgaggagccacauuuuccuccuuuguguuaggggacauaacaagcucugcugggcuuga

SEQ ID NO: 516075 - RNA, 64 nt, Human; identical to SEQ ID NO: 99327

SEQ ID NO: 516076 - RNA, 64 nt, Human; identical to SEQ ID NO: 99328

SEQ ID NO: 516077 - RNA, 64 nt, Human; identical to SEQ ID NO: 99329

SEQ ID NO: 516078 - RNA, 64 nt, Human; identical to SEQ ID NO: 99330

SEQ ID NO: 516079 - RNA, 64 nt, Human; identical to SEQ ID NO: 99331

SEQ ID NO: 516080 - RNA, 64 nt, Human; identical to SEQ ID NO: 99332

SEQ ID NO: 516081 - RNA, 64 nt, Human; identical to SEQ ID NO: 99333

SEQ ID NO: 516082 - RNA, 64 nt, Human; identical to SEQ ID NO: 99334

SEQ ID NO: 516083 - RNA, 64 nt, Human; identical to SEQ ID NO: 99335

SEQ ID NO: 516084 - RNA, 64 nt, Human; identical to SEQ ID NO: 99336

SEQ ID NO: 516085 - RNA, 64 nt, Human; identical to SEQ ID NO: 99337

SEQ ID NO: 516086 - RNA, 64 nt, Human; identical to SEQ ID NO: 99338

SEQ ID NO: 516087 - RNA, 50 nt, Human; identical to SEQ ID NO: 99339

SEQ ID NO: 516088 - RNA, 64 nt, Human; identical to SEQ ID NO: 99340

SEQ ID NO: 516089 - RNA, 64 nt, Human; identical to SEQ ID NO: 99341

SEQ ID NO: 516090 - RNA, 64 nt, Human; identical to SEQ ID NO: 99342

SEQ ID NO: 516091 - RNA, 64 nt, Human
agguggagaugcuuauagcaguuacgccuuaggaaggggacaaccaggccccgccacacgcuca

SEQ ID NO: 516092 - RNA, 64 nt, Human
cugccuacuuugcaagccagugaccugccuuuugaggggacauuggacgggggccgggggcggg

SEQ ID NO: 516093 - RNA, 64 nt, Human
ugcaugcaucucccccagaggaaacacugaggguaggggacaggaggcucaggacgcgcccucu

SEQ ID NO: 516094 - RNA, 64 nt, Human
gccaggagccuccugacccugugaugccugacacaggggacacugaaccuuguugaugccagcu

SEQ ID NO: 516095 - RNA, 64 nt, Human; identical to SEQ ID NO: 99343

SEQ ID NO: 516096 - RNA, 64 nt, Human; identical to SEQ ID NO: 99344

SEQ ID NO: 516097 - RNA, 64 nt, Human; identical to SEQ ID NO: 99345

SEQ ID NO: 516098 - RNA, 64 nt, Human; identical to SEQ ID NO: 99346

SEQ ID NO: 516099 - RNA, 64 nt, Human; identical to SEQ ID NO: 99347

SEQ ID NO: 516100 - RNA, 64 nt, Human; identical to SEQ ID NO: 99348

SEQ ID NO: 516101 - RNA, 64 nt, Human; identical to SEQ ID NO: 99349

SEQ ID NO: 516102 - RNA, 64 nt, Human; identical to SEQ ID NO: 99350

SEQ ID NO: 516103 - RNA, 64 nt, Human; identical to SEQ ID NO: 99351

SEQ ID NO: 516104 - RNA, 64 nt, Human; identical to SEQ ID NO: 99352

SEQ ID NO: 516105 - RNA, 64 nt, Human; identical to SEQ ID NO: 99353

SEQ ID NO: 516106 - RNA, 64 nt, Human; identical to SEQ ID NO: 99354

SEQ ID NO: 516107 - RNA, 64 nt, Human; identical to SEQ ID NO: 99355

SEQ ID NO: 516108 - RNA, 64 nt, Human; identical to SEQ ID NO: 99356

SEQ ID NO: 516109 - RNA, 64 nt, Human; identical to SEQ ID NO: 99357

SEQ ID NO: 516110 - RNA, 64 nt, Human; identical to SEQ ID NO: 99358

SEQ ID NO: 516111 - RNA, 52 nt, Human
cuccuucccuuucagacugagaaggggacaaaaagaccuuuccuuucauguc

SEQ ID NO: 516112 - RNA, 64 nt, Human
aaaugcgcagccggcuguggacgggggaggaggaaggggacagagggagcagguaggaaacacu

SEQ ID NO: 516113 - RNA, 64 nt, Human
uaugaaaugggacuguuuaacaagcaaggcucuuaggggacacuguugagccuggucccagaau

SEQ ID NO: 516114 - RNA, 64 nt, Human
acuagccagacacucugcucugcccuuguucccuaggggacacuucccucuguuucucuuuccu

SEQ ID NO: 516115 - RNA, 64 nt, Human; identical to SEQ ID NO: 99359

SEQ ID NO: 516116 - RNA, 64 nt, Human; identical to SEQ ID NO: 99360

SEQ ID NO: 516117 - RNA, 64 nt, Human; identical to SEQ ID NO: 99361

SEQ ID NO: 516118 - RNA, 64 nt, Human; identical to SEQ ID NO: 99362

SEQ ID NO: 516119 - RNA, 64 nt, Human; identical to SEQ ID NO: 99363

SEQ ID NO: 516120 - RNA, 64 nt, Human; identical to SEQ ID NO: 99364

SEQ ID NO: 516121 - RNA, 64 nt, Human; identical to SEQ ID NO: 99365

SEQ ID NO: 516122 - RNA, 64 nt, Human; identical to SEQ ID NO: 99366

SEQ ID NO: 516123 - RNA, 64 nt, Human; identical to SEQ ID NO: 99367

SEQ ID NO: 516124 - RNA, 64 nt, Human; identical to SEQ ID NO: 99368

SEQ ID NO: 516125 - RNA, 64 nt, Human; identical to SEQ ID NO: 99369

SEQ ID NO: 516126 - RNA, 64 nt, Human; identical to SEQ ID NO: 99370

SEQ ID NO: 516127 - RNA, 64 nt, Human; identical to SEQ ID NO: 99371

SEQ ID NO: 516128 - RNA, 64 nt, Human; identical to SEQ ID NO: 99372

SEQ ID NO: 516129 - RNA, 64 nt, Human; identical to SEQ ID NO: 99373

SEQ ID NO: 516130 - RNA, 64 nt, Human; identical to SEQ ID NO: 99374

SEQ ID NO: 516131 - RNA, 64 nt, Human
aaaugucauucuaagauucccauaucuuuugguuaggggacaauauuagagcuuuuaaaaagga

SEQ ID NO: 516132 - RNA, 64 nt, Human
ucacuucugccccgggcacugcguccagcagcagaggggacagggggcaggugugugacugggu

SEQ ID NO: 516133 - RNA, 64 nt, Human
acuaaaaagaaaaaaagaagccccuucacucuacaggggacaggagaccauggauuggacccca

SEQ ID NO: 516134 - RNA, 64 nt, Human
cccuggguccguaacauuuuuuccgaggaugaacaggggacaucuuuagguuucucaacucuug

SEQ ID NO: 516135 - RNA, 64 nt, Human; identical to SEQ ID NO: 99375

SEQ ID NO: 516136 - RNA, 64 nt, Human; identical to SEQ ID NO: 99376

SEQ ID NO: 516137 - RNA, 64 nt, Human; identical to SEQ ID NO: 99377

SEQ ID NO: 516138 - RNA, 64 nt, Human; identical to SEQ ID NO: 99378

SEQ ID NO: 516139 - RNA, 64 nt, Human; identical to SEQ ID NO: 99379

SEQ ID NO: 516140 - RNA, 64 nt, Human; identical to SEQ ID NO: 99380

SEQ ID NO: 516141 - RNA, 64 nt, Human; identical to SEQ ID NO: 99381

SEQ ID NO: 516142 - RNA, 64 nt, Human; identical to SEQ ID NO: 99382

SEQ ID NO: 516143 - RNA, 64 nt, Human; identical to SEQ ID NO: 99383

SEQ ID NO: 516144 - RNA, 56 nt, Human; identical to SEQ ID NO: 99384

SEQ ID NO: 516145 - RNA, 64 nt, Human; identical to SEQ ID NO: 99385

SEQ ID NO: 516146 - RNA, 64 nt, Human; identical to SEQ ID NO: 99386

SEQ ID NO: 516147 - RNA, 64 nt, Human; identical to SEQ ID NO: 99387

SEQ ID NO: 516148 - RNA, 64 nt, Human; identical to SEQ ID NO: 99388

SEQ ID NO: 516149 - RNA, 64 nt, Human; identical to SEQ ID NO: 99389

SEQ ID NO: 516150 - RNA, 64 nt, Human; identical to SEQ ID NO: 99390

SEQ ID NO: 516151 - RNA, 64 nt, Human
cccacaguuaugccggauguugccagaugccccuaggggacagagucaacccccaacugaggac

SEQ ID NO: 516152 - RNA, 64 nt, Human
aggaggacgugagugcugauaugcaggagagaagaggggacaaagaagcccuggcccggucagc

SEQ ID NO: 516153 - RNA, 64 nt, Human
acauguauuuuaguaaauccagaaaagaagacuaaggggacaggugaauaccugcuccucgccu

SEQ ID NO: 516154 - RNA, 64 nt, Human
ugcugugcuguggaugacugcagcuggccgccugaggggacaccagacucagcucuuuucuagc

SEQ ID NO: 516155 - RNA, 64 nt, Human; identical to SEQ ID NO: 99391

SEQ ID NO: 516156 - RNA, 64 nt, Human; identical to SEQ ID NO: 99392

SEQ ID NO: 516157 - RNA, 64 nt, Human; identical to SEQ ID NO: 99393

SEQ ID NO: 516158 - RNA, 64 nt, Human; identical to SEQ ID NO: 99394

SEQ ID NO: 516159 - RNA, 64 nt, Human; identical to SEQ ID NO: 99395

SEQ ID NO: 516160 - RNA, 64 nt, Human; identical to SEQ ID NO: 99377

SEQ ID NO: 516161 - RNA, 64 nt, Human; identical to SEQ ID NO: 99397

SEQ ID NO: 516162 - RNA, 64 nt, Human; identical to SEQ ID NO: 99398

SEQ ID NO: 516163 - RNA, 64 nt, Human; identical to SEQ ID NO: 99399

SEQ ID NO: 516164 - RNA, 64 nt, Human; identical to SEQ ID NO: 99400

SEQ ID NO: 516165 - RNA, 64 nt, Human; identical to SEQ ID NO: 99401

SEQ ID NO: 516166 - RNA, 64 nt, Human; identical to SEQ ID NO: 99402

SEQ ID NO: 516167 - RNA, 64 nt, Human; identical to SEQ ID NO: 99403

SEQ ID NO: 516168 - RNA, 64 nt, Human; identical to SEQ ID NO: 99404

SEQ ID NO: 516169 - RNA, 64 nt, Human; identical to SEQ ID NO: 99405

SEQ ID NO: 516170 - RNA, 64 nt, Human; identical to SEQ ID NO: 99406

SEQ ID NO: 516171 - RNA, 64 nt, Human
gcucuggaacacuuuggggcugauuugucucuuuaggggacauccccaacaugguuaauuccaa

SEQ ID NO: 516172 - RNA, 64 nt, Human
cagcgucuggaguaucuauaugagaagcucugugaggggacacucucaccucaugucguggcug

SEQ ID NO: 516173 - RNA, 64 nt, Human
ccuugguuuauugagugaaaugccucucagucuuaggggacauggcagagaugaaagaaagaaa

SEQ ID NO: 516174 - RNA, 64 nt, Human
cuuccgcagcacccagcaucaaaggacggacuucaggggacacguuuaguauauuaagacaugc

SEQ ID NO: 516175 - RNA, 64 nt, Human; identical to SEQ ID NO: 99407

SEQ ID NO: 516176 - RNA, 64 nt, Human; identical to SEQ ID NO: 99408

SEQ ID NO: 516177 - RNA, 64 nt, Human; identical to SEQ ID NO: 99409

SEQ ID NO: 516178 - RNA, 64 nt, Human; identical to SEQ ID NO: 99410

SEQ ID NO: 516179 - RNA, 64 nt, Human; identical to SEQ ID NO: 99411

SEQ ID NO: 516180 - RNA, 51 nt, Human; identical to SEQ ID NO: 99412

SEQ ID NO: 516181 - RNA, 64 nt, Human; identical to SEQ ID NO: 99413

SEQ ID NO: 516182 - RNA, 64 nt, Human; identical to SEQ ID NO: 99414

SEQ ID NO: 516183 - RNA, 64 nt, Human; identical to SEQ ID NO: 99415

SEQ ID NO: 516184 - RNA, 64 nt, Human; identical to SEQ ID NO: 99416

SEQ ID NO: 516185 - RNA, 64 nt, Human; identical to SEQ ID NO: 99417

SEQ ID NO: 516186 - RNA, 64 nt, Human; identical to SEQ ID NO: 99418

SEQ ID NO: 516187 - RNA, 64 nt, Human; identical to SEQ ID NO: 99419

SEQ ID NO: 516188 - RNA, 64 nt, Human; identical to SEQ ID NO: 99420

SEQ ID NO: 516189 - RNA, 64 nt, Human; identical to SEQ ID NO: 99421

SEQ ID NO: 516190 - RNA, 64 nt, Human; identical to SEQ ID NO: 99422

SEQ ID NO: 516191 - RNA, 64 nt, Human
uggagcacccuuuucuuuaucgcuacauuuauuuaggggacaaacuccauccagguugacucuc

SEQ ID NO: 516192 - RNA, 64 nt, Human
uccaggcacgucccggaccuguggggccccagagaggggacauuucccuccugggagagaagga

SEQ ID NO: 516193 - RNA, 64 nt, Human
gggugugggcagucaucagucaucaggugugcucaggggacaaucuccccucaaccgcacaugu

SEQ ID NO: 516194 - RNA, 56 nt, Human
uuggcucuagugaugcauagggaaacaggggacaugggcacuccugugaacaguuu

SEQ ID NO: 516195 - RNA, 64 nt, Human; identical to SEQ ID NO: 99423

SEQ ID NO: 516196 - RNA, 64 nt, Human; identical to SEQ ID NO: 99424

SEQ ID NO: 516197 - RNA, 64 nt, Human; identical to SEQ ID NO: 99425

SEQ ID NO: 516198 - RNA, 64 nt, Human; identical to SEQ ID NO: 99426

SEQ ID NO: 516199 - RNA, 64 nt, Human; identical to SEQ ID NO: 99427

SEQ ID NO: 516200 - RNA, 64 nt, Human; identical to SEQ ID NO: 99428

SEQ ID NO: 516201 - RNA, 64 nt, Human; identical to SEQ ID NO: 99429

SEQ ID NO: 516202 - RNA, 64 nt, Human; identical to SEQ ID NO: 99430

SEQ ID NO: 516203 - RNA, 64 nt, Human; identical to SEQ ID NO: 99431

SEQ ID NO: 516204 - RNA, 64 nt, Human; identical to SEQ ID NO: 99432

SEQ ID NO: 516205 - RNA, 64 nt, Human; identical to SEQ ID NO: 99433

SEQ ID NO: 516206 - RNA, 64 nt, Human; identical to SEQ ID NO: 99434

SEQ ID NO: 516207 - RNA, 64 nt, Human; identical to SEQ ID NO: 99435

SEQ ID NO: 516208 - RNA, 64 nt, Human; identical to SEQ ID NO: 99436

SEQ ID NO: 516209 - RNA, 64 nt, Human; identical to SEQ ID NO: 99437

SEQ ID NO: 516210 - RNA, 64 nt, Human; identical to SEQ ID NO: 99438

SEQ ID NO: 516211 - RNA, 64 nt, Human
aaaaaggagauauguacacuagagacaucaaaccaggggacaugaaauguauagggcaaaccuc

SEQ ID NO: 516212 - RNA, 64 nt, Human
cagcugagcccugagcccuugguuugucaauccuaggggacaggagccaggcuacugucuguac

SEQ ID NO: 516213 - RNA, 64 nt, Human
uuuugaaagggguguuuacgagcagcugugagugaggggacaaggggcaggucccaggagccac

SEQ ID NO: 516214 - RNA, 64 nt, Human
gugggagcaucccaguuaucccuggaaagcuagaaggggacagaggugucccugauuaagcagg

SEQ ID NO: 516215 - RNA, 64 nt, Human; identical to SEQ ID NO: 99439

SEQ ID NO: 516216 - RNA, 52 nt, Human; identical to SEQ ID NO: 99440

SEQ ID NO: 516217 - RNA, 64 nt, Human; identical to SEQ ID NO: 99441

SEQ ID NO: 516218 - RNA, 64 nt, Human; identical to SEQ ID NO: 99442

SEQ ID NO: 516219 - RNA, 64 nt, Human; identical to SEQ ID NO: 99443

SEQ ID NO: 516220 - RNA, 64 nt, Human; identical to SEQ ID NO: 99444

SEQ ID NO: 516221 - RNA, 64 nt, Human; identical to SEQ ID NO: 99445

SEQ ID NO: 516222 - RNA, 64 nt, Human; identical to SEQ ID NO: 99446

SEQ ID NO: 516223 - RNA, 64 nt, Human; identical to SEQ ID NO: 99447

SEQ ID NO: 516224 - RNA, 64 nt, Human; identical to SEQ ID NO: 99448

SEQ ID NO: 516225 - RNA, 64 nt, Human; identical to SEQ ID NO: 99449

SEQ ID NO: 516226 - RNA, 64 nt, Human; identical to SEQ ID NO: 99450

SEQ ID NO: 516227 - RNA, 64 nt, Human; identical to SEQ ID NO: 99451

SEQ ID NO: 516228 - RNA, 64 nt, Human; identical to SEQ ID NO: 99452

SEQ ID NO: 516229 - RNA, 64 nt, Human; identical to SEQ ID NO: 99453

SEQ ID NO: 516230 - RNA, 64 nt, Human; identical to SEQ ID NO: 99454

SEQ ID NO: 516231 - RNA, 64 nt, Human
aggugagggagugggaagggggauggagagcucgaggggacaguguguuugagcuggagugcug

SEQ ID NO: 516232 - RNA, 64 nt, Human
cagucagcacuuccuguccccugcagaggcucauaggggacagccccugccaaggagacccugg

SEQ ID NO: 516233 - RNA, 64 nt, Human
guugagagcguguguagugcugcaucuuaugacaaggggacagacaagcugggacgucagggaa

SEQ ID NO: 516234 - RNA, 64 nt, Human
ucugagauuccagcagguggcgcuggagggagucaggggacauaauggccuccuuguucacuuu

SEQ ID NO: 516235 - RNA, 64 nt, Human; identical to SEQ ID NO: 99455

SEQ ID NO: 516236 - RNA, 64 nt, Human; identical to SEQ ID NO: 99456

SEQ ID NO: 516237 - RNA, 64 nt, Human; identical to SEQ ID NO: 99457

SEQ ID NO: 516238 - RNA, 64 nt, Human; identical to SEQ ID NO: 99458

SEQ ID NO: 516239 - RNA, 64 nt, Human; identical to SEQ ID NO: 99459

SEQ ID NO: 516240 - RNA, 64 nt, Human; identical to SEQ ID NO: 99460

SEQ ID NO: 516241 - RNA, 64 nt, Human; identical to SEQ ID NO: 99461

SEQ ID NO: 516242 - RNA, 64 nt, Human; identical to SEQ ID NO: 99462

SEQ ID NO: 516243 - RNA, 64 nt, Human; identical to SEQ ID NO: 99463

SEQ ID NO: 516244 - RNA, 64 nt, Human; identical to SEQ ID NO: 99464

SEQ ID NO: 516245 - RNA, 64 nt, Human; identical to SEQ ID NO: 99465

SEQ ID NO: 516246 - RNA, 64 nt, Human; identical to SEQ ID NO: 99466

SEQ ID NO: 516247 - RNA, 64 nt, Human; identical to SEQ ID NO: 99467

SEQ ID NO: 516248 - RNA, 64 nt, Human; identical to SEQ ID NO: 99468

SEQ ID NO: 516249 - RNA, 64 nt, Human; identical to SEQ ID NO: 99469

SEQ ID NO: 516250 - RNA, 64 nt, Human; identical to SEQ ID NO: 99470

SEQ ID NO: 516251 - RNA, 64 nt, Human
gguaagaguccaugggggugcccagucccaggaaaggggacaaugaagggacaggccuggaguu

SEQ ID NO: 516252 - RNA, 64 nt, Human
ugggacugucuuuugcccacuucguuguguuaaaaggggacauuuguccaaacuccccaaccga

SEQ ID NO: 516253 - RNA, 64 nt, Human
aaaauauuagauauggagagauuauucaaagugaaggggacacaucauauuucugcauuuuacu

SEQ ID NO: 516254 - RNA, 64 nt, Human
uaauuggaaauuuagcaauaaggagaggaguccaaggggacaaauaaaggcagagagaagagac

SEQ ID NO: 516255 - RNA, 64 nt, Human; identical to SEQ ID NO: 99471

SEQ ID NO: 516256 - RNA, 64 nt, Human; identical to SEQ ID NO: 99472

SEQ ID NO: 516257 - RNA, 64 nt, Human; identical to SEQ ID NO: 99473

SEQ ID NO: 516258 - RNA, 64 nt, Human; identical to SEQ ID NO: 99474

SEQ ID NO: 516259 - RNA, 64 nt, Human; identical to SEQ ID NO: 99475

SEQ ID NO: 516260 - RNA, 64 nt, Human; identical to SEQ ID NO: 99476

SEQ ID NO: 516261 - RNA, 64 nt, Human; identical to SEQ ID NO: 99477

SEQ ID NO: 516262 - RNA, 64 nt, Human; identical to SEQ ID NO: 99478

SEQ ID NO: 516263 - RNA, 64 nt, Human; identical to SEQ ID NO: 99479

SEQ ID NO: 516264 - RNA, 64 nt, Human; identical to SEQ ID NO: 99480

SEQ ID NO: 516265 - RNA, 64 nt, Human; identical to SEQ ID NO: 99481

SEQ ID NO: 516266 - RNA, 64 nt, Human; identical to SEQ ID NO: 99482

SEQ ID NO: 516267 - RNA, 64 nt, Human; identical to SEQ ID NO: 99483

SEQ ID NO: 516268 - RNA, 64 nt, Human; identical to SEQ ID NO: 99484

SEQ ID NO: 516269 - RNA, 64 nt, Human; identical to SEQ ID NO: 99485

SEQ ID NO: 516270 - RNA, 64 nt, Human; identical to SEQ ID NO: 99486

SEQ ID NO: 516271 - RNA, 64 nt, Human
gaauuugaaacucaucugguggaaaccaaguuucaggggacaugaguuuuccagcuuuuauaca

SEQ ID NO: 516272 - RNA, 64 nt, Human
ccugcggugugaccuggggagaaaguugagugucaggggacaugaugagccaguuggcccugaa

SEQ ID NO: 516273 - RNA, 64 nt, Human
gcuagaggccugaggaugagcuggaaggagugagaggggacaaaacccaccuuguuggagccug

SEQ ID NO: 516274 - RNA, 64 nt, Human
accaugccaaucuacaggcacucauugcuacugaaggggacaccaaugcugcuauccgcaagcu

SEQ ID NO: 516275 - RNA, 64 nt, Human; identical to SEQ ID NO: 99487

SEQ ID NO: 516276 - RNA, 64 nt, Human; identical to SEQ ID NO: 99488

SEQ ID NO: 516277 - RNA, 64 nt, Human; identical to SEQ ID NO: 99489

SEQ ID NO: 516278 - RNA, 64 nt, Human; identical to SEQ ID NO: 99490

SEQ ID NO: 516279 - RNA, 64 nt, Human; identical to SEQ ID NO: 99491

SEQ ID NO: 516280 - RNA, 64 nt, Human; identical to SEQ ID NO: 99492

SEQ ID NO: 516281 - RNA, 64 nt, Human; identical to SEQ ID NO: 99493

SEQ ID NO: 516282 - RNA, 60 nt, Human; identical to SEQ ID NO: 99494

SEQ ID NO: 516283 - RNA, 64 nt, Human; identical to SEQ ID NO: 99495

SEQ ID NO: 516284 - RNA, 64 nt, Human; identical to SEQ ID NO: 99496

SEQ ID NO: 516285 - RNA, 64 nt, Human; identical to SEQ ID NO: 99497

SEQ ID NO: 516286 - RNA, 64 nt, Human; identical to SEQ ID NO: 99498

SEQ ID NO: 516287 - RNA, 64 nt, Human; identical to SEQ ID NO: 99499

SEQ ID NO: 516288 - RNA, 64 nt, Human; identical to SEQ ID NO: 99500

SEQ ID NO: 516289 - RNA, 51 nt, Human; identical to SEQ ID NO: 99501

SEQ ID NO: 516290 - RNA, 64 nt, Human; identical to SEQ ID NO: 99502

SEQ ID NO: 516291 - RNA, 64 nt, Human
gggggccugauguguguggguuguugaggggaacaggggacauagcugugcuaugagguuucuu

SEQ ID NO: 516292 - RNA, 64 nt, Human
ggaaugaggugauaagcaaggaggguguaaguuuaggggacaaagaagaaagaaugaauaauac

SEQ ID NO: 516293 - RNA, 57 nt, Human
ccaccaaggauccaaagugaccccaccaggggacagccagaggaaggggaccauggg

SEQ ID NO: 516294 - RNA, 64 nt, Human
acauaugauagacagccccucuguugagauauggaggggacagauacuggaaucggggguggga

SEQ ID NO: 516295 - RNA, 64 nt, Human; identical to SEQ ID NO: 99503

SEQ ID NO: 516296 - RNA, 64 nt, Human; identical to SEQ ID NO: 99504

SEQ ID NO: 516297 - RNA, 64 nt, Human; identical to SEQ ID NO: 99505

SEQ ID NO: 516298 - RNA, 64 nt, Human; identical to SEQ ID NO: 99506

SEQ ID NO: 516299 - RNA, 64 nt, Human; identical to SEQ ID NO: 99507

SEQ ID NO: 516300 - RNA, 64 nt, Human; identical to SEQ ID NO: 99508

SEQ ID NO: 516301 - RNA, 64 nt, Human; identical to SEQ ID NO: 99509

SEQ ID NO: 516302 - RNA, 64 nt, Human; identical to SEQ ID NO: 99510

SEQ ID NO: 516303 - RNA, 64 nt, Human; identical to SEQ ID NO: 99511

SEQ ID NO: 516304 - RNA, 64 nt, Human; identical to SEQ ID NO: 99512

SEQ ID NO: 516305 - RNA, 64 nt, Human; identical to SEQ ID NO: 99513

SEQ ID NO: 516306 - RNA, 64 nt, Human; identical to SEQ ID NO: 99514

SEQ ID NO: 516307 - RNA, 64 nt, Human; identical to SEQ ID NO: 99515

SEQ ID NO: 516308 - RNA, 64 nt, Human; identical to SEQ ID NO: 99516

SEQ ID NO: 516309 - RNA, 64 nt, Human; identical to SEQ ID NO: 99517

SEQ ID NO: 516310 - RNA, 64 nt, Human; identical to SEQ ID NO: 99518

SEQ ID NO: 516311 - RNA, 64 nt, Human
ggauuagaaaauauggguccauuccuuucuagaaaggggacaaccaagugucucaguuugccuu

SEQ ID NO: 516312 - RNA, 64 nt, Human
augaaccuaggccaccauggggaccugagagggaaggggacagauguuucucauugcauaaugu

SEQ ID NO: 516313 - RNA, 64 nt, Human
caaguguucacaaccuggaagugcuucgggaagaaggggacaauggcagaacagguguugguga

SEQ ID NO: 516314 - RNA, 64 nt, Human
gcaccaaacacugcuuuaggcacuggggacacaaaggggacagagccauccuccuuugacaccu

SEQ ID NO: 516315 - RNA, 64 nt, Human; identical to SEQ ID NO: 99519

SEQ ID NO: 516316 - RNA, 64 nt, Human; identical to SEQ ID NO: 99520

SEQ ID NO: 516317 - RNA, 64 nt, Human; identical to SEQ ID NO: 99521

SEQ ID NO: 516318 - RNA, 64 nt, Human; identical to SEQ ID NO: 99522

SEQ ID NO: 516319 - RNA, 64 nt, Human; identical to SEQ ID NO: 99523

SEQ ID NO: 516320 - RNA, 64 nt, Human; identical to SEQ ID NO: 99524

SEQ ID NO: 516321 - RNA, 64 nt, Human; identical to SEQ ID NO: 99525

SEQ ID NO: 516322 - RNA, 64 nt, Human; identical to SEQ ID NO: 99526

SEQ ID NO: 516323 - RNA, 64 nt, Human; identical to SEQ ID NO: 99527

SEQ ID NO: 516324 - RNA, 64 nt, Human; identical to SEQ ID NO: 99528

SEQ ID NO: 516325 - RNA, 64 nt, Human; identical to SEQ ID NO: 99529

SEQ ID NO: 516326 - RNA, 64 nt, Human; identical to SEQ ID NO: 99530

SEQ ID NO: 516327 - RNA, 64 nt, Human; identical to SEQ ID NO: 99531

SEQ ID NO: 516328 - RNA, 64 nt, Human; identical to SEQ ID NO: 99532

SEQ ID NO: 516329 - RNA, 64 nt, Human; identical to SEQ ID NO: 99533

SEQ ID NO: 516330 - RNA, 64 nt, Human; identical to SEQ ID NO: 99534

SEQ ID NO: 516331 - RNA, 64 nt, Human
ccacgauggccuggucccuccaacaugcauggacaggggacagugggacuaacuucaguacccu

SEQ ID NO: 516332 - RNA, 64 nt, Human
cugaggcauaaucacugcuucgguucugcucaucaggggacacgcucccuuacucauggcagcc

SEQ ID NO: 516333 - RNA, 64 nt, Human
gggcuugagucuuaauagggcugauaguccaaccaggggacaggguaucauaaagagauaauuc

SEQ ID NO: 516334 - RNA, 64 nt, Human
uuaggcugcaggggagggcagggcuggggaccgaaggggacaaguuccccuuucauccuuuggu

SEQ ID NO: 516335 - RNA, 64 nt, Human; identical to SEQ ID NO: 99535

SEQ ID NO: 516336 - RNA, 64 nt, Human; identical to SEQ ID NO: 99536

SEQ ID NO: 516337 - RNA, 64 nt, Human; identical to SEQ ID NO: 99537

SEQ ID NO: 516338 - RNA, 64 nt, Human; identical to SEQ ID NO: 99538

SEQ ID NO: 516339 - RNA, 64 nt, Human; identical to SEQ ID NO: 99539

SEQ ID NO: 516340 - RNA, 64 nt, Human; identical to SEQ ID NO: 99540

SEQ ID NO: 516341 - RNA, 64 nt, Human; identical to SEQ ID NO: 99541

SEQ ID NO: 516342 - RNA, 64 nt, Human; identical to SEQ ID NO: 99542

SEQ ID NO: 516343 - RNA, 64 nt, Human; identical to SEQ ID NO: 99543

SEQ ID NO: 516344 - RNA, 64 nt, Human; identical to SEQ ID NO: 99544

SEQ ID NO: 516345 - RNA, 64 nt, Human; identical to SEQ ID NO: 99545

SEQ ID NO: 516346 - RNA, 64 nt, Human; identical to SEQ ID NO: 99546

SEQ ID NO: 516347 - RNA, 64 nt, Human; identical to SEQ ID NO: 99547

SEQ ID NO: 516348 - RNA, 64 nt, Human; identical to SEQ ID NO: 99548

SEQ ID NO: 516349 - RNA, 64 nt, Human; identical to SEQ ID NO: 99549

SEQ ID NO: 516350 - RNA, 64 nt, Human; identical to SEQ ID NO: 99550

SEQ ID NO: 516351 - RNA, 64 nt, Human
gcccgagcccaagcauuuggcucugcugcccccaaggggacaggaagccucuugggccucuucc

SEQ ID NO: 516352 - RNA, 64 nt, Human
ccucgcugcagaaugcccaguaguacugcggccaaggggacaguuaggagacuucaucuaaagc

SEQ ID NO: 516353 - RNA, 64 nt, Human
ccccaaagcagaggggcugucugugucuccagaaaggggacaucgggggggaggggggcucaga

SEQ ID NO: 516354 - RNA, 64 nt, Human
cgaguucccauaggggcugcucccucaaaaagggaggggacagauggggagcuuuucuuaccua

SEQ ID NO: 516355 - RNA, 64 nt, Human; identical to SEQ ID NO: 99551

SEQ ID NO: 516356 - RNA, 64 nt, Human; identical to SEQ ID NO: 99552

SEQ ID NO: 516357 - RNA, 64 nt, Human; identical to SEQ ID NO: 99553

SEQ ID NO: 516358 - RNA, 64 nt, Human; identical to SEQ ID NO: 99554

SEQ ID NO: 516359 - RNA, 64 nt, Human; identical to SEQ ID NO: 99555

SEQ ID NO: 516360 - RNA, 64 nt, Human; identical to SEQ ID NO: 99556

SEQ ID NO: 516361 - RNA, 64 nt, Human; identical to SEQ ID NO: 99557

SEQ ID NO: 516362 - RNA, 64 nt, Human; identical to SEQ ID NO: 99558

SEQ ID NO: 516363 - RNA, 64 nt, Human
uguaaagcucucagauguuuucaagcauguguaaaggggacauguuauaguuucuuucuuucuu

SEQ ID NO: 516364 - RNA, 64 nt, Human
ugcaaggaaauaacagauacgggcagcuaggaacaggggacaaaauggaccgaggggaacccac

SEQ ID NO: 516365 - RNA, 64 nt, Human
ccuuaccugggaaagggcuguuauaaucuuucacaggggacaggaugguucccuugaugaagaa

SEQ ID NO: 516366 - RNA, 64 nt, Human
cacaccucuggccugcgucgcccaguucuuuguggcucugaagaauuggccgcuguggaaaaga

SEQ ID NO: 516367 - RNA, 64 nt, Human
ugaccagacuaaacucccaaccccagaccagggcaggggacaggucucaaguccuucccagcau

SEQ ID NO: 516368 - RNA, 64 nt, Human
ccuauuuuauacucauggaagagauaagcuaaagaggggacaauaaugagaaauguuggugugc

SEQ ID NO: 516369 - RNA, 64 nt, Human
acccagaccaugccaaaguccagucugaaaugaaaggggacagaagucuugcuguccauggugg

SEQ ID NO: 516370 - RNA, 64 nt, Human
aaggcaaggcaggccccacggacacacuugggcugcucugaaauaaagcuguugacuccaccug

SEQ ID NO: 516371 - RNA, 64 nt, Human
aaagggagcacagaacccaucauuucacacauaggcucugaaagugggaaaggaaagcugauca

SEQ ID NO: 516372 - RNA, 64 nt, Human
gggaagagccaccuggcagggcucacacuccugggcucugaacacacacgccagcuccucucug

SEQ ID NO: 516373 - RNA, 64 nt, Human
ugucauaucugagguccaaaaccacaaugaaagugcucugaagauuuaauguguuuauucaaau

SEQ ID NO: 516374 - RNA, 64 nt, Human
gcugccauccuacaagccacacccccuccucugagcucugaauaugggacccagugccaggagc

SEQ ID NO: 516375 - RNA, 64 nt, Human
uacaaaaucuucagcuucagccaggcaacgcuaagcucugaagaacucccuuuggcuacuuuug

SEQ ID NO: 516376 - RNA, 64 nt, Human
agcaggaacugagccagaaacgcagauugggcuggcucugaagccaagccucuucuuacuucac

SEQ ID NO: 516377 - RNA, 64 nt, Human
caugcaucauggccccuucaggagcagaaucauagcucugaaaagagaagcuccguuguguacu

SEQ ID NO: 516378 - RNA, 64 nt, Human
ugcaaucacagaagcacaugggauguaaucaugagcucugaagauuuucagcauuuaucuccca

SEQ ID NO: 516379 - RNA, 64 nt, Human
gaaccccuugcuccauaauuggucuuuuauccuggcucugaaugacccugcaggucaucauggu

SEQ ID NO: 516380 - RNA, 64 nt, Human
ucacaccgcaccgggcuggccugacacaaugguagcucugaagggaggggaagagagaggccug

SEQ ID NO: 516381 - RNA, 64 nt, Human
ggaugcgcagggaacaucaggaaaaggccacggggcucugaacagccccgguccagacagcagc

SEQ ID NO: 516382 - RNA, 64 nt, Human
uagacauuagucaguaauacaguguuauuucuaggcucugaaauagccacuuuaagaaucaugu

SEQ ID NO: 516383 - RNA, 64 nt, Human
cacauguauggucccuguagcgugaccuuuacuagcucugaaucagaagacagagcuauuucag

SEQ ID NO: 516384 - RNA, 64 nt, Human
ccuucaaagugauuuucuuuauaagaaaauuugggcucugaauacuccauucugccucacuucc

SEQ ID NO: 516385 - RNA, 64 nt, Human
cccagcugggcuguuggcugggggcaugggggaggcucugaagagauacccacagagugugguc

SEQ ID NO: 516386 - RNA, 60 nt, Human
acaacaaugaggauuuuugaaagacaauccaggggacauaauagcagugugcaugcaggc

SEQ ID NO: 516387 - RNA, 64 nt, Human
cucauuccuguaaucccagcacuuugggaggccaaggggacaggacugcuugaggccaagaggu

SEQ ID NO: 516388 - RNA, 64 nt, Human
gcccagccucgcgugaccucagagagguggggauaggggacaccuucagccuccagcaugugug

SEQ ID NO: 516389 - RNA, 64 nt, Human
uccguuaguugaauaagagguauuaugaucauggaggggacauuuauggugcuuuggauugugu

SEQ ID NO: 516390 - RNA, 64 nt, Human
auuuaaaggaacugcaguaggcuuccucuguagagcucugaaaagguugacuauauagaggucu

SEQ ID NO: 516391 - RNA, 64 nt, Human
guacaggguuucuuuugggggcgcuuaugaagaugcucugaaauugauugugaugguuguacaa

SEQ ID NO: 516392 - RNA, 64 nt, Human
cacagucuggccaugugacccucuccccaggcaagcucugaagucccugcagguggaggccaug

SEQ ID NO: 516393 - RNA, 64 nt, Human
aaaggauuguaucaaguagaugggacaacauucugcucugaacgaaaaguaauuuuagagacau

SEQ ID NO: 516394 - RNA, 64 nt, Human
caaaaccuccuccucccaggcacucauuuauauugcucugaaagagcuuuccaaaguauuuaaa

SEQ ID NO: 516395 - RNA, 64 nt, Human
cuccuggcacacaccugucuguaaccuguuuugugcucugaaagcaaauaguccugagcaaaaa

SEQ ID NO: 516396 - RNA, 64 nt, Human
aauauuacguacucaguagugcccugcuucuagggcucugaauacgggcuuaaagucaucuugu

SEQ ID NO: 516397 - RNA, 64 nt, Human
gacaagccucccuggaugaucgagguccccaguagcucugaacaagaguccagccaacccucuu

SEQ ID NO: 516398 - RNA, 64 nt, Human
ugggcuucagggcagguggggugagaauugggcggcucugaagcaaggcgguggacuugaacuu

SEQ ID NO: 516399 - RNA, 64 nt, Human
agccugggacaccuagguggagagaguggucuccgcucugaauuggauccaggggaccugggcu

SEQ ID NO: 516400 - RNA, 64 nt, Human
gcaguacacauuguccuuuuuuuaagacgugaaagcucugaaauuacuuuuagaggauauuaau

SEQ ID NO: 516401 - RNA, 64 nt, Human
gaaucaugcucuaauggcuuuuccauacacuaaagcucugaaaguagugaguuuccuagaauua

SEQ ID NO: 516402 - RNA, 64 nt, Human
ucccaauuuacucucaguuccagucaagcugguugcucugaaaguaacccagcuuguugcucua

SEQ ID NO: 516403 - RNA, 64 nt, Human
gucccaauuuuugguauuguggcagaaggugaaggcucugaaagcaaagaugcagcagcgguag

SEQ ID NO: 516404 - RNA, 64 nt, Human
ggccugccugagaggcucacagguccaagggaaagcucugaacuugccaagagcauaucuuuuc

SEQ ID NO: 516405 - RNA, 64 nt, Human
gcuucauuuggcuuuaucaaaaagaacagaccuagcucugaauuuguuuggcuugggaaauuau

SEQ ID NO: 516406 - RNA, 64 nt, Human
ccuaacuuggagcaugucacuggccaugggggugaggggacagacucugcucucacuggcuggc

SEQ ID NO: 516407 - RNA, 64 nt, Human
cagugggcugggggugccugccuagugcuggaguaggggacaaugggaauccuagaggggaugg

SEQ ID NO: 516408 - RNA, 64 nt, Human
cgccaccgagggacagccgagggaccgauggacgaggggacaggcuggugggaugggguucccc

SEQ ID NO: 516409 - RNA, 64 nt, Human
uacaaguccucuuuggguguaggagggggugggcaggggacaaguccaggaggggucccagggc

SEQ ID NO: 516410 - RNA, 64 nt, Human
ccaaccccuagcccaaccaaugcuagaauuucuugcucugaaggaggagcaggugaaacaggug

SEQ ID NO: 516411 - RNA, 64 nt, Human
ugugggacuagccuggcuugggacuaaaugcccugcucugaacacgaagcuuaguauaaacuga

SEQ ID NO: 516412 - RNA, 64 nt, Human
auugagaacuaaccguuguaaugcaggagugugugcucugaauggaaaguuauacaucguuggu

SEQ ID NO: 516413 - RNA, 64 nt, Human
ggagugugggaaugugauaaccuaaacaaccuuugcucugaaauuccauuuuucccucuuuccc

SEQ ID NO: 516414 - RNA, 64 nt, Human
uuacugacacccugucgccagccuagaacauccugcucugaaugaacagagcccagaugggggu

SEQ ID NO: 516415 - RNA, 64 nt, Human
agaagacaugaugaaaaaagagaaaaagucugaagcucugaauaucagagguaggauugacuuu

SEQ ID NO: 516416 - RNA, 64 nt, Human
cuagcccaucaagccggcagagaaucccccacacgcucugaaggacccacuuucagcuggacac

SEQ ID NO: 516417 - RNA, 64 nt, Human
ugcgagcuuccucuccugucccauguuggaaguugcucugaaggggugguagaugcuggaagcc

SEQ ID NO: 516418 - RNA, 64 nt, Human
gaacuggagugcaguaugagcugggugucacuuggcucugaacauacuggcuuugcuguaaugc

SEQ ID NO: 516419 - RNA, 64 nt, Human
aauuauguaauauauuguacaaauguaagcaaaggcucugaaauaaaaugccauaguuugugaa

SEQ ID NO: 516420 - RNA, 64 nt, Human
aggaaauuagcauuccuuaauguuuuguuuuggugcucugaauuucuucuuuauuauaguccua

SEQ ID NO: 516421 - RNA, 64 nt, Human
cagucagaguaugaugaucccugugacaguuuuugcucugaaauaguauuuaucauguguuugg

SEQ ID NO: 516422 - RNA, 64 nt, Human
gcacuuuuucuccucuguuaaaaaaaaugauaaggcucugaaauggaauauauugguuagaauu

SEQ ID NO: 516423 - RNA, 64 nt, Human
ccagugaacugcugcuucagaaguccauagcccagcucugaacuuucucgauaaaaugccauca

SEQ ID NO: 516424 - RNA, 64 nt, Human
augcaaugaggguauuuuugagugaauuuuaacugcucugaacuaaguauaagcucaugggccu

SEQ ID NO: 516425 - RNA, 64 nt, Human
aguucaguggcccagagguuauuuuuuuccuauugcucugaagacugcacugguugcugcaaag

SEQ ID NO: 516426 - RNA, 64 nt, Human
guccaggcuggcgaauugucucugguucagggaaaggggacagcccagcuugaagaugagggau

SEQ ID NO: 516427 - RNA, 64 nt, Human
ugguauucagggacaguguagcaaguagcuuacaaggggacaauucuggacuaaugagaaagac

SEQ ID NO: 516428 - RNA, 64 nt, Human
cuuuuauuuuuguauuuaauugacaugaauguaaaggggacagcucaggguuguuuuggagccu

SEQ ID NO: 516429 - RNA, 64 nt, Human
cugcuuaggggaccugcgugcaggugaggagagaaggggacacucgaguccaggcugguaucuc

SEQ ID NO: 516430 - RNA, 64 nt, Human
acugcaaaagugagaaggagauaauagauacuuugcucugaauuuggcauccagaguuaacauu

SEQ ID NO: 516431 - RNA, 64 nt, Human
agcuucaaacuagguauucugggaaugauguaaugcucugaauuuaguaugauauaaagaaaac

SEQ ID NO: 516432 - RNA, 64 nt, Human
gcaggucccuccaaccaccagcacugacuccugggcucugaagaaucacagaaacacuuuuuau

SEQ ID NO: 516433 - RNA, 64 nt, Human
ggggccuacaacaggcagguacugcugccagggggcucugaacuagugccugcuacccaggaca

SEQ ID NO: 516434 - RNA, 64 nt, Human
auugaguuaauuaucugggccuuucacuuuggaugcucugaaacauuuguugauuuugugugaa

SEQ ID NO: 516435 - RNA, 64 nt, Human
cuuuuaaaauacccuucccuucaacaacucuccagcucugaauggagaaacucucuaggccauc

SEQ ID NO: 516436 - RNA, 64 nt, Human
uuugcuacuuccccaaggcucuugcagagcuagggcucugaaggggagggaaggcaacggcucu

SEQ ID NO: 516437 - RNA, 64 nt, Human
ucgaugucagcuuuuugugcuggacuuggcacacgcucugaaaacugagauuuugucauugaac

SEQ ID NO: 516438 - RNA, 64 nt, Human
caaguccuguguggcaaaacugccuccuacggcggcucugaagcagagcccugggacggacccc

SEQ ID NO: 516439 - RNA, 64 nt, Human
aaucuguuuuguauaugaucuaauacaaagaugagcucugaacaaacacugaaucauguuaaua

SEQ ID NO: 516440 - RNA, 64 nt, Human
uagugaagacauaguucaccuaaaauggcauccugcucugaaucuagacuuuuuagaaauggca

SEQ ID NO: 516441 - RNA, 64 nt, Human
uaauguugguguuuuagaaguagauacaggcacugcucugaaaaccuggcuagccaaggauauu

SEQ ID NO: 516442 - RNA, 64 nt, Human
agagauacagccuuccguauccaucgaagcagaugcucugaacccugagcaggcacccacuucc

SEQ ID NO: 516443 - RNA, 64 nt, Human
ucugucugauaagagcucucacucuggccaaggagcucugaauugugagucugccccucagggg

SEQ ID NO: 516444 - RNA, 64 nt, Human
uugguuuaucagacucggaaucuauuuucucauugcucugaauaugucaucacucuagguuuua

SEQ ID NO: 516445 - RNA, 64 nt, Human
ugguccgcgcugccccugcccugccucuguccuggcucugaacuaguagaugauggugccagag

SEQ ID NO: 516446 - RNA, 64 nt, Human
ugauagaagacccuucuggggagccagggagcucaggggacagauaagggaaggacgcccccug

SEQ ID NO: 516447 - RNA, 64 nt, Human
gugagcugcccuggggguucacuggaguugaggcaggggacaguagucuccccugccagccuag

SEQ ID NO: 516448 - RNA, 64 nt, Human
ccaggucugguccguggugucccccgcacccagcaggggacaggcacucaggagggcccgguaa

SEQ ID NO: 516449 - RNA, 64 nt, Human
gcccagugaccuuucuccugcugcacuuggagggaggggacauacacacagucucccaucucuc

SEQ ID NO: 516450 - RNA, 64 nt, Human
aaagauagccagaguaaguaagcagccacugcaagcucugaaucaguuuuuuaaaaaaaagaaa

SEQ ID NO: 516451 - RNA, 51 nt, Human
gagcacucacgguccacugaagcucugaauccucagggaugccaccugcac

SEQ ID NO: 516452 - RNA, 64 nt, Human
aaaauggaagugaagcugccgacugugcaugacugcucugaacgucugaaaugagagugccaug

SEQ ID NO: 516453 - RNA, 64 nt, Human
uuuuaacaguguacuucuuaggcuuucauuaccagcucugaagaacuuuuuggaauaauuccau

SEQ ID NO: 516454 - RNA, 64 nt, Human
acuggaggccucugcaagauucugugggcagcuggcucugaauguagccagcccacauccauuc

SEQ ID NO: 516455 - RNA, 64 nt, Human
agaggaggggagccaagacacucaugccacucuggcucugaagggacaaaggcuucuggcuuuu

SEQ ID NO: 516456 - RNA, 64 nt, Human
cuugaucccaccugggaggccaggacacugaggagcucugaacccagcccacagggaagcagag

SEQ ID NO: 516457 - RNA, 64 nt, Human
ugacguucuaaaagggcaaacaguggagacgucugcucugaaaucccucaucccuuaguuggaa

SEQ ID NO: 516458 - RNA, 64 nt, Human
cuuugcuaacaauaauguuuggaaauaaagaagugcucugaaaaaauaucagccaccaaaauag

SEQ ID NO: 516459 - RNA, 64 nt, Human
ucaaugacugggacuuagacuggggcucggccucgcucugaaaagugcuuaagaaaaucuucuc

SEQ ID NO: 516460 - RNA, 64 nt, Human
uccagaacccauaaacauagcccagagaagagaggcucugaaagaaaggaggggagcagcagaa

SEQ ID NO: 516461 - RNA, 64 nt, Human
uuucuggucuucgcagccuagauaugaagaaucugcucugaaaacaaaaaaaaauuacccuuuu

SEQ ID NO: 516462 - RNA, 64 nt, Human
auggcaaaagaaaugcagauuucccaguuaucuugcucugaagacauuucuuuagcuagucuua

SEQ ID NO: 516463 - RNA, 64 nt, Human
uguuugacuuuccccucccugguggccacucuuugcucugaagcccagauuggcaagaggagcu

SEQ ID NO: 516464 - RNA, 64 nt, Human
ggguuguauuugcugacagccugcaagcuugcaugcucugaaagauuuuuuuuaguuuuuaauu

SEQ ID NO: 516465 - RNA, 64 nt, Human
gagaauaguuaugaugaauauguguuaagugccugcucugaaggaggcaauguucuucucauuu

SEQ ID NO: 516466 - RNA, 64 nt, Human
gaagggugaagguuagauagauggaaucucugucaggggacaaacagcuguagcauccccuuag

SEQ ID NO: 516467 - RNA, 64 nt, Human
cucccacagccaaaagaaugagugggagaaauggaggggacaaucuccugggagcuaugcgcag

SEQ ID NO: 516468 - RNA, 64 nt, Human
ccaaagagagucacuuuugacuccaucaacuucaaggggacagagccuaggcagcagauucucc

SEQ ID NO: 516469 - RNA, 64 nt, Human
gaagaauggguucaagaucaucauauucaucagaaggggacacuaaauagaacccuuaaccugu

SEQ ID NO: 516470 - RNA, 64 nt, Human
aaaaauagcguuucacauaaaaagcauagcagcagcucugaaaagacacuucacaguaaauaug

SEQ ID NO: 516471 - RNA, 64 nt, Human
uugucuuaagcuauaguguaaaaacaaaguuugggcucugaaaauuuaacugaaaaagauuucc

SEQ ID NO: 516472 - RNA, 64 nt, Human
cauagagaauucuucgcuucauuuuugauggcuggcucugaaagcaccauguggaguggaggug

SEQ ID NO: 516473 - RNA, 64 nt, Human
gauaccaaccgaaacugaagggaguuagaccaaggcucugaaauauaaagucuaaucuugcucu

SEQ ID NO: 516474 - RNA, 64 nt, Human
ucuuuagaguaaaugagaggagacauacaaagcugcucugaaggaccaucagguccggacucau

SEQ ID NO: 516475 - RNA, 54 nt, Human
auaaacaagacaaggacugaaagugcucugaacuugaaacucacuggagagcug

SEQ ID NO: 516476 - RNA, 64 nt, Human
aaugcauuauguggacugaaccgacuuuucuaaagcucugaacaaaagcuuuucuuuccuuuug

SEQ ID NO: 516477 - RNA, 63 nt, Human
accccaauuaugaucucuaagugaccaccaggggcucugaacugcagcugauguuaucagcag

SEQ ID NO: 516478 - RNA, 64 nt, Human
aauauaacacauuuuuuugcaugcaugcaaaugagcucugaaaucuucccaugcauucugguca

SEQ ID NO: 516479 - RNA, 64 nt, Human
aaaugauuuucucaaggaaugccccuggaacacagcucugaagagaguuuaguaaguaccaugu

SEQ ID NO: 516480 - RNA, 64 nt, Human
cggcacacucaauggcaaacacagcaccgagucugcucugaauccuggaggaucuggcccuccu

SEQ ID NO: 516481 - RNA, 64 nt, Human
cagcuuagcuagcauuacuaaccaacuguuggaagcucugaaaauaaaagaucuugaacccaug

SEQ ID NO: 516482 - RNA, 64 nt, Human
gaccuuaaaagggccaggacagaagcggcugccagcucugaaucuuuaacugaaaugcacaugg

SEQ ID NO: 516483 - RNA, 64 nt, Human
ugacaaacucuccaauuuucuaaaaugauauggagcucugaaaggcauguccauaaggucugac

SEQ ID NO: 516484 - RNA, 64 nt, Human
uuucauggaucauuuaaugcauucuucaaguuuugcucugaaauuugucuuuuaaaauuauucu

SEQ ID NO: 516485 - RNA, 64 nt, Human
uauuuuugaagcggcaaacucuguucucuggaaugcucugaaguuauggcugggaccuaucccc

SEQ ID NO: 516486 - RNA, 64 nt, Human
gacaugcuucaaugccuggugccauaggaagcccaggggacagucacaacuucuuggggccugg

SEQ ID NO: 516487 - RNA, 64 nt, Human
acacacacacacagccauucaucugggcuggcagaggggacagaguucagggaggggcugaguc

SEQ ID NO: 516488 - RNA, 64 nt, Human
gccuacaagcggcuccuauccagcuucuacugcaaggggacacacggcaucaugucaccacugg

SEQ ID NO: 516489 - RNA, 64 nt, Human
ccagggagcagggucgcuaagguccugcccacugaggggacagccuucugggcagggaccucgg

SEQ ID NO: 516490 - RNA, 64 nt, Human
ccaggauucuuauuugugcuguuauagaauaucagcucugaacgugugguaaagauuuuugugu

SEQ ID NO: 516491 - RNA, 64 nt, Human
uggugcugggcucaccgagggagcacuggugggugcucugaaaacccacaggaucccaccucca

SEQ ID NO: 516492 - RNA, 64 nt, Human
guagggaaguuaugaauuacuccuuccaguaguagcucugaagugucacauuuaauaucaguuu

SEQ ID NO: 516493 - RNA, 64 nt, Human
acuaacugggagaccuuaggcaaagcaugcaaucgcucugaauggcaguuuccucauuuuuaaa

SEQ ID NO: 516494 - RNA, 64 nt, Human
agcaccauaauuggucgguuacccugagcccagagcucugaaagcaucuguggaaugaucacgg

SEQ ID NO: 516495 - RNA, 64 nt, Human
cauauaccuuuuucacaucuaggaagaaaugcuugcucugaaauaguauagauuaaaaacacuc

SEQ ID NO: 516496 - RNA, 64 nt, Human
uuuuuaaauaaaagcaaaauuaacaaugaucugugcucugaaaguuuugaaaauauauuugaac

SEQ ID NO: 516497 - RNA, 64 nt, Human
uaaaaggcuaauuuaaauauaaauaauauaaagugcucugaauaaagcagaaauauauuacagu

SEQ ID NO: 516498 - RNA, 64 nt, Human
ugucagggaugagccuggcuuggggguugguggggcucugaagcgcauuugggguucuuuguag

SEQ ID NO: 516499 - RNA, 64 nt, Human
aaguaugugauuggaccccagaauguauuugaaggcucugaaauuguacaugcaaauugguaca

SEQ ID NO: 516500 - RNA, 64 nt, Human
uucagagaauauaaagugaaugccuuuagggguagcucugaaagagaaacccaacaacuucauu

SEQ ID NO: 516501 - RNA, 64 nt, Human
aaaaaucaacaaacaaaucaaagccaggcucagagcucugaaauuaaaaagcacugaaauaguu

SEQ ID NO: 516502 - RNA, 64 nt, Human
uugcaaauagggucugaggcuuuguuucucucuugcucugaaacauuucugaaaaggcaaggaa

SEQ ID NO: 516503 - RNA, 64 nt, Human
aaguauaaauuauaaaugcaauuaacuaagaacagcucugaauguauuugcaugggauuggucc

SEQ ID NO: 516504 - RNA, 64 nt, Human
uccauuccuagaagaaugcuaaguuuguguccuugcucugaaaauugguaaaucaagcauguuu

SEQ ID NO: 516505 - RNA, 64 nt, Human
auggcuggccauuaagcuuuauaaaaucaugugggcucugaaauuguucuuuuaugugucuagc

SEQ ID NO: 516506 - RNA, 64 nt, Human
aaaucaagcagguuagagaaaauagagaugaauuaggggacacugucuuauggauucauuuaua

SEQ ID NO: 516507 - RNA, 64 nt, Human
ccuuaaacucuaggccuuacuggaagccacugauaggggacacuucacuaccagaugugugcag

SEQ ID NO: 516508 - RNA, 64 nt, Human
aaagaaagacgcugggcccaauuuugacuuggccaggggacaccuugguguguuuguuaucuuu

SEQ ID NO: 516509 - RNA, 64 nt, Human
cuaaauuacguaugcaagucugugagugcgucugaggggacaucgccaaggacugacugagaca

SEQ ID NO: 516510 - RNA, 64 nt, Human
gacaguauaucucucuuuauccuaugugauuccugcucugaaugcauuauauuuuccaaacuau

SEQ ID NO: 516511 - RNA, 64 nt, Human
guuauaaucuaaaguauucuuaugaucuguguaagcucugaaugaacuucuuuacucaauaaaa

SEQ ID NO: 516512 - RNA, 64 nt, Human
ugugugggaaaagaggcagggaggaaugaagagagcucugaaucgagaauccuagaugaaccac

SEQ ID NO: 516513 - RNA, 64 nt, Human
uucagucuugaguuuucuucucuggacaccuuaugcucugaaaucaugagcgaggcugauucaa

SEQ ID NO: 516514 - RNA, 64 nt, Human
aaguguuuaggauuucaagacaacauuauacauggcucugaaauaucugacacaauguaaacau

SEQ ID NO: 516515 - RNA, 64 nt, Human
ugcaucgguuccaaguguggcaaguaaguuuucggcucugaagaacugacacuagcuagauuug

SEQ ID NO: 516516 - RNA, 64 nt, Human
uugauagauggcauuggaaugugguacaaaguuagcucugaagaauaugguaacgaagacaaua

SEQ ID NO: 516517 - RNA, 64 nt, Human
uauagaagcuggacuagagacggacugaccaucagcucugaacuguggcuuuuuuuguucaccu

SEQ ID NO: 516518 - RNA, 64 nt, Human
cugugguggaggccauaguggagaugaaggcucugcucugaagcucuuaauuguguauucacca

SEQ ID NO: 516519 - RNA, 64 nt, Human
ccuuccccaccccacccuuaggucccagguaguugcucugaagaguuucaguagaguggcccca

SEQ ID NO: 516520 - RNA, 64 nt, Human
gguuucauuaacaguacuggaaaguaguuguguggcucugaauguuuuguauuucaaucgagaa

SEQ ID NO: 516521 - RNA, 64 nt, Human
acuacagaauauuaaauauuauaaugugcccaaagcucugaauaguuaaaaauuaaauauuuau

SEQ ID NO: 516522 - RNA, 64 nt, Human
ucuuuucagugcacuggguggucaaugcccacucgcucugaaaucaucugacugugaugcccug

SEQ ID NO: 516523 - RNA, 64 nt, Human
auguuuuuauuuuagacccagaagagaggaguuugcucugaauuuguaaauaagucuuccccau

SEQ ID NO: 516524 - RNA, 64 nt, Human
ucuuucuaucaaauauuaucuuuguucuccuaaugcucugaaaggauguagaaacaauauuuaa

SEQ ID NO: 516525 - RNA, 64 nt, Human
cauccuaggaccugggcagacccacauggccugggcucugaaugcccacccugcgacggugggu

SEQ ID NO: 516526 - RNA, 64 nt, Human
gcuuaagggagaggcgagagaaugaucuggccucaggggacaggccaccuggucaggaggaaua

SEQ ID NO: 516527 - RNA, 64 nt, Human
cagcuggcacucaccaggccugggucagguggggaggggacaccaagggcccauuuccuccccu

SEQ ID NO: 516528 - RNA, 64 nt, Human
aacaagccccaggcaagcuggaacuuggguggggaggggacaugaggaggauaaacagcugacu

SEQ ID NO: 516529 - RNA, 64 nt, Human
acaaggacacagacauucccucaguguggggggcaggggacacagggagaggaugguugucccu

SEQ ID NO: 516530 - RNA, 64 nt, Human
agcaggcuagaggcacagcggccacauggugcuggcucugaacguugguugguggcuggaaaac

SEQ ID NO: 516531 - RNA, 64 nt, Human
guuucuuuuucuguccacaaguaaauuaauaucugcucugaaaugucauuuaucuacucacaca

SEQ ID NO: 516532 - RNA, 64 nt, Human
uaucaggaaggaauauccugccauaguaaaauuggcucugaagagcuuagaggcaaguuacaca

SEQ ID NO: 516533 - RNA, 64 nt, Human
cuccaccccaucccaucccaccuugaaaaucacugcucugaaccaguguucuccaccuuguccu

SEQ ID NO: 516534 - RNA, 64 nt, Human
uagguuauucaaaguuuucagcucuuuuaaaauugcucugaauaaguucuagugagugaguuau

SEQ ID NO: 516535 - RNA, 64 nt, Human
gggaaugagauggagcucacggcuuaaagcccaagcucugaagaagucaaggguggagccagag

SEQ ID NO: 516536 - RNA, 64 nt, Human
cuacuacaugaaauggauuuucacggaagagacagcucugaaaaguuuugaugcuuguggcaag

SEQ ID NO: 516537 - RNA, 64 nt, Human
ucuucuaguaugauggaaaguuucuuuuuucuuugcucugaauaaaacugaacuguggguucuc

SEQ ID NO: 516538 - RNA, 64 nt, Human
ugccuucggucauuucacucaacagcucggcccagcucugaaacuugggaaggugagggauuca

SEQ ID NO: 516539 - RNA, 64 nt, Human
ggcugccagucagggccugccaggagucuacacagcucugaaccuucuuuguuaaagaauucag

SEQ ID NO: 516540 - RNA, 64 nt, Human
uccagccuuucucccucacaucaggagguagauagcucugaaaugacagcgccacagccauagu

SEQ ID NO: 516541 - RNA, 64 nt, Human
aggcugguucagaggcccaugcugaggggugggugcucugaaguggagugaagccucaagccca

SEQ ID NO: 516542 - RNA, 64 nt, Human
agacagagcaccauccugggucagaaggucucaugcucugaaauggcgugcccucugcccaggu

SEQ ID NO: 516543 - RNA, 64 nt, Human
cucaaggguaaaauguuaggugucagcuuucagggcucugaaaccccauucccugcucugagga

SEQ ID NO: 516544 - RNA, 64 nt, Human
ugagggaucacagggccccagaaggcagggaaaggcucugaaagccagcugccgaccagagccc

SEQ ID NO: 516545 - RNA, 64 nt, Human
gucccuaguucgggaggcggaaaaagaugagcgcgcucugaagcaggagauucacgagcugcga

SEQ ID NO: 516546 - RNA, 64 nt, Human
cuucauacuuuguugggggacuuuggaggcgggcaggggacagggcuauugauaagguccccuu

SEQ ID NO: 516547 - RNA, 64 nt, Human
uuaguauuuauucacuuuuauuuagcaccagggaaggggacaaggacuaggguccuggggaacc

SEQ ID NO: 516548 - RNA, 64 nt, Human
ugagggaacugcccagggcuggguagaggcagcaaggggacagggcugggugcuguugugugcg

SEQ ID NO: 516549 - RNA, 64 nt, Human
ggagacgacagaaagccacuguuagaucugcagaaggggacacccuggaaggucaacaucucau

SEQ ID NO: 516550 - RNA, 64 nt, Human
caacuuccaaauuggauacugcugccaagaaguugcucugaagucaguuucuaucauucugcuc

SEQ ID NO: 516551 - RNA, 64 nt, Human
ucccacugccaccaccgccaucgccucaccugcagcucugaagacccaggccucaccuccgccu

SEQ ID NO: 516552 - RNA, 64 nt, Human
uguaaaugcucgugugauuuccuacagaaauacugcucugaauauuuuguaauaaaggucuuug

SEQ ID NO: 516553 - RNA, 64 nt, Human
ggucuggaggauucucucuagccgugacuccgcugcucugaaggucaacugagaagucuugugg

SEQ ID NO: 516554 - RNA, 64 nt, Human
uuuaaucuggcaauuaugaaaaagaaauauuuuagcucugaaggauuuaguagauucuguuaga

SEQ ID NO: 516555 - RNA, 64 nt, Human
auauauggcuucugcuucucuugugugugccucagcucugaagaaguuccugagaauggguuac

SEQ ID NO: 516556 - RNA, 64 nt, Human
caaggaugggggucaggcauuuuauaucaagggugcucugaacauauuuuauuuuuuaaaaaaa

SEQ ID NO: 516557 - RNA, 64 nt, Human
gcugaccacugacucagcucugaccuucacauuugcucugaagcaagugcguucagcugcuggg

SEQ ID NO: 516558 - RNA, 64 nt, Human
accgguauuacugagcucggcauuuggagagggagcucugaagugucuggggagguaccgcugu

SEQ ID NO: 516559 - RNA, 64 nt, Human
ugaaacaccguuguuuaaagacuucacacagaaggcucugaacugagccacuggggaagggaag

SEQ ID NO: 516560 - RNA, 64 nt, Human
ugucuuguuuuguacacacauuucucuguagugggcucugaauacauugaaaaugcacuauauu

SEQ ID NO: 516561 - RNA, 64 nt, Human
ucacauuacccuuguauuaugccauuuauaaacugcucugaaaccugaagcuggaaagauaaca

SEQ ID NO: 516562 - RNA, 64 nt, Human
cagguguuuacaggaaagaucucagaggcuaugagcucugaauaaaucuucauuguauaaaaug

SEQ ID NO: 516563 - RNA, 64 nt, Human
ggggcauagaucagaagacuacaaaaaugaagcugcucugaaaucuccuuuagccaucacccca

SEQ ID NO: 516564 - RNA, 64 nt, Human
uccugaucauccuaggcaaacauugacaaauacugcucugaauccuguucuauagauauugggg

SEQ ID NO: 516565 - RNA, 64 nt, Human
agguguccaaauuuaauguagacauuaucuuuuggcucugaagaagcaaacaugacuagagacg

SEQ ID NO: 516566 - RNA, 64 nt, Human
caaggcuccgugacugucaaacugggaguaggagaggggacaauuuaggacugggcuagauuuu

SEQ ID NO: 516567 - RNA, 64 nt, Human
gcaggcugcagggcauuccagccaagggcacagcaggggacagugcagggaggugugggguaag

SEQ ID NO: 516568 - RNA, 64 nt, Human
uagaucucuuuugugcuggguucaguggcucuucaggggacaggaaaugccugugucuggccag

SEQ ID NO: 516569 - RNA, 64 nt, Human
cugacuugcuuuucucuaggugguucauuuugaaaggggacagaaauauaacuaaaugcuucca

SEQ ID NO: 516570 - RNA, 64 nt, Human
uagaagaaauaauuuaaaugaacugcuuagcccugcucugaagaaccuuuuuuggaauuagauu

SEQ ID NO: 516571 - RNA, 64 nt, Human
augaugggaccucuuugcccuuccugucuggugugcucugaaaugggauaauggccagaguagc

SEQ ID NO: 516572 - RNA, 64 nt, Human
cuugauaugugucacuuuuuuaugcugaaaguaugcucugaacuuuagaguauaggaaauuaac

SEQ ID NO: 516573 - RNA, 64 nt, Human
acaacacaacuucacccaccgccuccuggcugcagcucugaagagccacagcgggaacauaucu

SEQ ID NO: 516574 - RNA, 64 nt, Human
gccugggccgccccgccggguuccauaggccgaugcucugaaagaagagacguggggcucgaga

SEQ ID NO: 516575 - RNA, 64 nt, Human
uguacaacaccagcaacauuauaauggcccuguagcucugaaugcuauuuguguaacugaaagg

SEQ ID NO: 516576 - RNA, 64 nt, Human
uuguaaccaaaauuuagguaagcaggcuuccuuugcucugaagguuuugaguaccuggcuguau

SEQ ID NO: 516577 - RNA, 64 nt, Human
uuuuaauuuuuuauacuuugguguuucacuucaugcucugaauacugaauaaccaugaaugacu

SEQ ID NO: 516578 - RNA, 64 nt, Human
gacacagaugcucacagccgaccuguggccucuugcucugaagccaucccccaucuucccuaga

SEQ ID NO: 516579 - RNA, 64 nt, Human
ucccacauuccuccccgcgggggaggaccucgccgcucugaagagcaccgugcacaugugggug

SEQ ID NO: 516580 - RNA, 64 nt, Human
uguggaugucuacaugguuaauggaaagcacugugcucugaaguggaucagucucaagugucug

SEQ ID NO: 516581 - RNA, 64 nt, Human
agauucucuauuggcucccuuuuuggguaaaccagcucugaacuuccaagcuccaaauccaagg

SEQ ID NO: 516582 - RNA, 64 nt, Human
ccagcugccuugaggacaugcccuagggaacagugcucugaaucguaccuggauucugugccua

SEQ ID NO: 516583 - RNA, 64 nt, Human
uccgcacguggcuggaggagguggucuuccauccgcucugaaaucauguuucuuagagaaaugc

SEQ ID NO: 516584 - RNA, 64 nt, Human
agagggacaucuggguggaggaguaaauuccugugcucugaaaugccacuugguagcucuggac

SEQ ID NO: 516585 - RNA, 64 nt, Human
ggccauagcuuuuaauauacugcugcccaggcuggcucugaauuucuauaaauuagcuguuaga

SEQ ID NO: 516586 - RNA, 64 nt, Human
gguccaaggucuuuguccuagaaucagaguggggaggggacagccuggggcugcccagagacug

SEQ ID NO: 516587 - RNA, 64 nt, Human
ccuccagcuggaugcuggggaucagcgauaggugaggggacacaguguaggagcuccccaugua

SEQ ID NO: 516588 - RNA, 64 nt, Human
gcauggucagaccacgucacuacauuucuaugcaaggggacagcaaggcagcgugguggucaug

SEQ ID NO: 516589 - RNA, 64 nt, Human
cauccuggugcuuagguggcagagggugggcagcaggggacagggaugggauggcaaaaccacc

SEQ ID NO: 516590 - RNA, 64 nt, Human
ccaguuacccaaaaucugauuagaaguauaaggugcucugaaguguccuaaauauuaauauccu

SEQ ID NO: 516591 - RNA, 64 nt, Human
auucuuauagaaacaaagcacaaauugcauucaagcucugaauugauuuuuugcuuggagcugu

SEQ ID NO: 516592 - RNA, 64 nt, Human
ggcagugcucaggagcugcaucccacuuuucccugcucugaaucgaaguccuaguuccuuccuu

SEQ ID NO: 516593 - RNA, 64 nt, Human
aguugcuuaauuauacccauagguaauacaaaaagcucugaagacccaaagaugacauuacuaa

SEQ ID NO: 516594 - RNA, 64 nt, Human
aggcacccgaagucccucguccuucccucugugugcucugaauauguccuuguccuuccugacc

SEQ ID NO: 516595 - RNA, 64 nt, Human
cgcaccucugcaucuccugggcgucaccaggaaggcucugaagucccgggcugcucucagcacu

SEQ ID NO: 516596 - RNA, 64 nt, Human
ccuccaaggucaacacuuggagaggguuucacuugcucugaagacccugguccaggauucgccc

SEQ ID NO: 516597 - RNA, 64 nt, Human
uguggcccuccugucuggagugacaucuucaucugcucugaauacuggugcccagccagcccgu

SEQ ID NO: 516598 - RNA, 64 nt, Human
cccacguagcaccggcaaccgccaaguggcccaggcucugaacuggcucugggcuccuccucgu

SEQ ID NO: 516599 - RNA, 64 nt, Human
ccaaucauuaucaaguuccauaauucauuauuaagcucugaaauucaggacacauacauuuaua

SEQ ID NO: 516600 - RNA, 64 nt, Human
cagggagcuauggugcacucuaguuuauacuugcgcucugaaauguguaaacauagggugccua

SEQ ID NO: 516601 - RNA, 64 nt, Human
gaggcagacaugcaccagugauguggugacaggugcucugaaggaggucaccaggaccugaccu

SEQ ID NO: 516602 - RNA, 64 nt, Human
caugucagcuuauaugugacacugcagcagaaaggcucugaagguccaaagaguuucugcaaag

SEQ ID NO: 516603 - RNA, 64 nt, Human
ugccacguucugcagccgugccuuugcggggcaggcucugaagccucagcccgacucagagugc

SEQ ID NO: 516604 - RNA, 64 nt, Human
auuauuauuuuucaaaugucauuuaucaggcauagcucugaaacauugaugaucuaagagguau

SEQ ID NO: 516605 - RNA, 64 nt, Human
acaugguucuaauuuggaguucaaaggaacaccagcucugaaaacaugaccguggggccaggau

SEQ ID NO: 516606 - RNA, 64 nt, Human
cuguggcuucaguucucaugcugccucuuccaaaaggggacacagaagcacuggcugcugcuac

SEQ ID NO: 516607 - RNA, 64 nt, Human
gccuagggaccuguugaacucucucagcugagucaggggacaccucaggcacugggacaguugg

SEQ ID NO: 516608 - RNA, 64 nt, Human
ugaaacaaggcuaggggaagaugggcagagaaaaaggggacaccuaguuugguugucauuuggc

SEQ ID NO: 516609 - RNA, 53 nt, Human
cucuggacaggacaugcugaggcaggggacaguguccccugcuaccgcccgcc

SEQ ID NO: 516610 - RNA, 64 nt, Human
cagcaagcucggcccagagcuucccuuccggcuggcucugaaccgugcguggugccuacagccu

SEQ ID NO: 516611 - RNA, 64 nt, Human
ggaugauccagguccucauuuccaaagucccaaugcucugaaaaccaaaaguauuuucauaacc

SEQ ID NO: 516612 - RNA, 64 nt, Human
ggagacauccguugugcuugccugcguuuuggaagcucugaagucacaucacaggacacggggc

SEQ ID NO: 516613 - RNA, 64 nt, Human
cgugugagaugccagccccuccgggcaggcaagggcucugaagauuuggcaacguggcuuaauu

SEQ ID NO: 516614 - RNA, 64 nt, Human
cagacgccugaggaacccuuacaguaggagcccagcucugaaaccaguguuagggaagggccug

SEQ ID NO: 516615 - RNA, 64 nt, Human
aaauuaacuuaccuaauaccugacaccucuuugggcucugaacugcuuucucucaucaagcaug

SEQ ID NO: 516616 - RNA, 64 nt, Human
ugccaaguugaaucaugugggcugaugcagggaagcucugaagcagugaauaaagguguuucgg

SEQ ID NO: 516617 - RNA, 64 nt, Human
gacucagcuuccuuagcaucucagcagaaaccuugcucugaagaccagagacagaagggacaga

SEQ ID NO: 516618 - RNA, 64 nt, Human
gccugggggagcuuuuagguguugagauggggcagcucugaauccuagacccuggaauagccug

SEQ ID NO: 516619 - RNA, 64 nt, Human
agaagcauacaacaugagcaaagcuuuuucucgugcucugaagggucuugagaggggaguggga

SEQ ID NO: 516620 - RNA, 64 nt, Human
gguaugaggaaugugugaaaaguauacacaaagggcucugaagcucaagucagaggagugggag

SEQ ID NO: 516621 - RNA, 64 nt, Human
ugaccggaggaaggcaugccucaauaaauggaaugcucugaaugggaagagcccauaacagaau

SEQ ID NO: 516622 - RNA, 64 nt, Human
cuuuaucuguaauuguaauuccaaaauccaaaaagcucugaaaacaagguuuccauaagcuugg

SEQ ID NO: 516623 - RNA, 64 nt, Human
aagagauucuugaccuuauuucuaaacgucuagagcucugaaaugucuugauggaagguauuaa

SEQ ID NO: 516624 - RNA, 64 nt, Human
uugaauuuaccuucauaugccacuaagaacaaaagcucugaaguucuuccugcuggcaccaaau

SEQ ID NO: 516625 - RNA, 64 nt, Human
guggccucccgccaacagcugcuguguaccuuuggcucugaauuaggaauaucuuuacuuucuc

SEQ ID NO: 516626 - RNA, 64 nt, Human
accaagcaucuuggggggguggccgcugaguggcaggggacaggaguccacuuuguuucguggg

SEQ ID NO: 516627 - RNA, 64 nt, Human
gugugugcguguuugugugcguguuuaccuccacaggggacacucuacacucaguguaagaucu

SEQ ID NO: 516628 - RNA, 64 nt, Human
gcacaccagcucagacaggggccugcgcagcugcaggggacagacgccaaucacugucacagca

SEQ ID NO: 516629 - RNA, 64 nt, Human
gugagcuguuguuuuucuaaaccucuucccaggaaggggacauugacacuugaauuuuugucac

SEQ ID NO: 516630 - RNA, 64 nt, Human
uccaaauguguaccauuggugagacacauacaaugcucugaauacacuacgaauuuguauuaaa

SEQ ID NO: 516631 - RNA, 64 nt, Human
acagagagaaaaaaaaaaagagaacccacaugaagcucugaaaccaaacagcauccugccauga

SEQ ID NO: 516632 - RNA, 51 nt, Human
gcugccaguguaagaucugaggcucugaacccagaccuucagguuucaccu

SEQ ID NO: 516633 - RNA, 64 nt, Human
augccugccuaaacaaaaagcaggacauaaccuagcucugaauacaugccacaaggaugaagcu

SEQ ID NO: 516634 - RNA, 57 nt, Human
accccagcccccagcucugaggacccagcucugaaagggcacgaguucucucagccc

SEQ ID NO: 516635 - RNA, 64 nt, Human
ccauuuguauggcaauuuaaaagucuuuggcuuugcucugaauuuaauuaaaacugccuuuuau

SEQ ID NO: 516636 - RNA, 64 nt, Human
cucuacugauuccgcagcucagacccuuucuucagcucugaaagagaaacacguaucccaccug

SEQ ID NO: 516637 - RNA, 64 nt, Human
gcaaaggucaagacugugguauuggggucuuuuggcucugaaggauccuggaaccacugauuuu

SEQ ID NO: 516638 - RNA, 64 nt, Human
uuuauuacagaaaaaaaucugaacugagaaaggagcucugaauuuauuugacagucuaacuuuu

SEQ ID NO: 516639 - RNA, 64 nt, Human
gccugcucuguggauccccugcuggggacucccagcucugaaauuugggaaaaaguagcccaug

SEQ ID NO: 516640 - RNA, 64 nt, Human
ugguggccuucuuaucuaagcacaugaguaguuggcucugaacuuuguguauuugaaaaaggaa

SEQ ID NO: 516641 - RNA, 64 nt, Human
uggaaggauaaaagaucuagucugggcagugucugcucugaaaugucccacaucuccuuuuuuu

SEQ ID NO: 516642 - RNA, 64 nt, Human
guacuaguucuggucuccuuuugacuggacuguggcucugaaccuugagcauaguaccacggac

SEQ ID NO: 516643 - RNA, 64 nt, Human
ggaaccauggcucuaacugggucaaguccuccuagcucugaagcuaaggcugcagagcuguccu

SEQ ID NO: 516644 - RNA, 64 nt, Human
cauuuuaauuuccaggccacaagacaguagugaugcucugaaaugaaaguuugucuucacaaau

SEQ ID NO: 516645 - RNA, 64 nt, Human
guaggauuugggcugccccaggcccacccagggggcucugaauguauuuuguaccguguuucuu

SEQ ID NO: 516646 - RNA, 64 nt, Human
uuggagccuccagugugcgucagggucugugggcaggggacagggcgugggugggggccgaggc

SEQ ID NO: 516647 - RNA, 64 nt, Human
cccugaugccaagagcucuggagguucuugaaagaggggacacgaaggaggagugacugggaag

SEQ ID NO: 516648 - RNA, 64 nt, Human
ugccaguuuaauuccagccuuacccauugacucaaggggacauaaaccacgagagugacaguca

SEQ ID NO: 516649 - RNA, 64 nt, Human
cuccauccagccuggcguccagguugcccuguucaggggacagaugcaagcuguggggaggacu

SEQ ID NO: 516650 - RNA, 64 nt, Human
cagguauguugggcucugccccagccccacacuugcucugaaaaccaagugucagagccccuuc

SEQ ID NO: 516651 - RNA, 64 nt, Human
caaagacucccuccucccugaugcugggaugugggcucugaauacagccccucucucaucccug

SEQ ID NO: 516652 - RNA, 64 nt, Human
acugaaagaauuccagucagccagagccuuggcagcucugaagcuaaccuuagcaucuaagugu

SEQ ID NO: 516653 - RNA, 64 nt, Human
caggaagucuuuggggaaauuaaggaucuuugaagcucugaaauaggugaucagguuaguggug

SEQ ID NO: 516654 - RNA, 54 nt, Human
uguuacagacucaaauaugacugugcucugaaaugcuaaugucaacuacaaauc

SEQ ID NO: 516655 - RNA, 64 nt, Human
aauaacaagagcucuguaauaacaguaauaaauagcucugaaauaacaguccuaagaacuccua

SEQ ID NO: 516656 - RNA, 64 nt, Human
cucuuucuguugguugugcccaagggcuacaguagcucugaaauaacaagagcucuguaauaac

SEQ ID NO: 516657 - RNA, 64 nt, Human
ccuuuuugagacacuaauuuuuaaauacuuacuagcucugaaauauauugauuuuuaucacagu

SEQ ID NO: 516658 - RNA, 64 nt, Human
uagaaggagcuuccugcaauggaaggaaggagaagcucugaagcccauguauggcauggauugu

SEQ ID NO: 516659 - RNA, 64 nt, Human
uuuugaaauaauguaaugugaaguguuucuuaaagcucugaacaucauuaaguaguuaauaaua

SEQ ID NO: 516660 - RNA, 64 nt, Human
cccugcauuuaauuuaagaaggauuaauaauaaugcucugaauuuuucgaaagggauucuccua

SEQ ID NO: 516661 - RNA, 64 nt, Human
ugggugcuggauuggaucuuaaagaucccuuccagcucugaaaugcugauuguacaguauauuc

SEQ ID NO: 516662 - RNA, 64 nt, Human
uuaaccaacccacugaaaacuuguguguugagcagcucugaacugauuuuacuuuuaaagaauu

SEQ ID NO: 516663 - RNA, 64 nt, Human
ugauaauuugacauagacauagauauaaguuccagcucugaaauuaauuaggaaagaauauagg

SEQ ID NO: 516664 - RNA, 64 nt, Human
ugaggaaagacagggccuuggucagagagagaaugcucugaacucugcuaaggacauagaguca

SEQ ID NO: 516665 - RNA, 64 nt, Human
uccacuuugaaccgguuaaagcucauagcugucagcucugaaugaggaggggagaagccccugg

SEQ ID NO: 516666 - RNA, 64 nt, Human
aaggagccugcuuugguacuauggaacuuuucuuaggggacacguccuccuuucacagcuucua

SEQ ID NO: 516667 - RNA, 64 nt, Human
agcuguggacagaaaagccuccuuaagugagcugaggggacaggaaauccaaucagaugaccuu

SEQ ID NO: 516668 - RNA, 64 nt, Human
cgaggugagaacagcauccugaggcacagcucccaggggacagagguguagcuccaaucucccu

SEQ ID NO: 516669 - RNA, 64 nt, Human
ggacacuaaugagccugggaggguggcagggaggaggggacagcuucacccuuggaaguccugg

SEQ ID NO: 516670 - RNA, 64 nt, Human
gagugugcucuagcuggcugccugcuaccccaaagcucugaaagaguaagguugaagugcugga

SEQ ID NO: 516671 - RNA, 64 nt, Human
cauuuucuuuaggacauaaagagagcccuagggugcucugaaucuguacauguucuugucauaa

SEQ ID NO: 516672 - RNA, 64 nt, Human
uuaggaccucuuuuuuuccucucagggaacuaaugcucugaaaagggaucugggcacaacaguu

SEQ ID NO: 516673 - RNA, 64 nt, Human
uuacaguuucguuuuuccucccaugguucacuuggcucugaaccuacagucucaaagauugaga

SEQ ID NO: 516674 - RNA, 64 nt, Human
cagaugaguagugaacacaggugaucgaguguuggcucugaacacuccaaacacuggcucgagu

SEQ ID NO: 516675 - RNA, 64 nt, Human
cuccucuaagcauuuacucauuuacuguauuccugcucugaagauguggauacagaauuaguca

SEQ ID NO: 516676 - RNA, 64 nt, Human
ggccuauauuuagcaccuguucucauguuaaacagcucugaauguuagauauucuuucuuaucc

SEQ ID NO: 516677 - RNA, 64 nt, Human
guaucugagauguacuuacagcaggguucuaagagcucugaaagaagcgcucuguuagaugcag

SEQ ID NO: 516678 - RNA, 64 nt, Human
acaaugaagaagacccuagaugcugcauuuuuuagcucugaagauuccuuagguaucccugaag

SEQ ID NO: 516679 - RNA, 64 nt, Human
ugauaugcaaaauaacuucuauuagaauaauggugcucugaagacucuucuuaacuaaaaagaa

SEQ ID NO: 516680 - RNA, 64 nt, Human
aacuagguaagaguucacucaugaagaaacgagugcucugaagagccaguuacccuguguuggc

SEQ ID NO: 516681 - RNA, 64 nt, Human
ugcagggaccauggccagguuaccaaaaugcccugcucugaagccuugacaccuggguggaaag

SEQ ID NO: 516682 - RNA, 64 nt, Human
ccagaggauugugcuggcaucgugucuuuccugugcucugaagaugccagcuacaucacugggg

SEQ ID NO: 516683 - RNA, 64 nt, Human
gcuucacuaaauuggaccuucacauaucuaaaaagcucugaaguguuuguauauuugaaauacc

SEQ ID NO: 516684 - RNA, 64 nt, Human
gguagacugcagaaagcaaacagucuacccagcagcucugaaugucaccugcccuggggcuuac

SEQ ID NO: 516685 - RNA, 64 nt, Human
ggacacaggaaagacgggcauuacagggaccaaagcucugaaaggugacuuuuauuaccaacac

SEQ ID NO: 516686 - RNA, 64 nt, Human
cuuuacccucuuugcugcagagaaacuuaagcaaaggggacagcugugugacauuuggagaggg

SEQ ID NO: 516687 - RNA, 64 nt, Human
aucuugaggccugucacaugggcagcaugugcacaggggacagaguauuccucuagcacacgca

SEQ ID NO: 516688 - RNA, 64 nt, Human
gcaaucugcccacccucacccagucgcacccuggaggggacaucagccccagcuggacuugggc

SEQ ID NO: 516689 - RNA, 64 nt, Human
ucacugcuuggaagagauucuuggcagagagaagaggggacaaauuugguugugaaguaaacaa

SEQ ID NO: 516690 - RNA, 64 nt, Human
aagccuguagaagagauuuauuuuaaaagagauugcucugaaauuuaucuuaaaagagcuugcu

SEQ ID NO: 516691 - RNA, 64 nt, Human
aaagguuugauuuuggucguucuucagauguuuggcucugaaugacuuaagcugaaguaacugg

SEQ ID NO: 516692 - RNA, 54 nt, Human
cugcccucacugaagacugaccgugcucugaaaucugcuggccuuguucauuuu

SEQ ID NO: 516693 - RNA, 64 nt, Human
auuugcaaauguggggccuaaagaaagcucugcagcucugaaccucucacuggccagagcucag

SEQ ID NO: 516694 - RNA, 64 nt, Human
ccagguggcgcuucugacacgguccacgugccuggcucugaaggcccaacugucagaccagacc

SEQ ID NO: 516695 - RNA, 64 nt, Human
uuguucacuugcagaaaaggagcgcaaggcagaggcucugaagcacuuuccuuguacauuugga

SEQ ID NO: 516696 - RNA, 64 nt, Human
uucuuauuucucaguaggaacuuggaagggaagagcucugaaggagccagaggggcagccaccu

SEQ ID NO: 516697 - RNA, 64 nt, Human
cuuucauuuugccugaguguauuuuacuauuugggcucugaaauaaaaauuaugaaauauggug

SEQ ID NO: 516698 - RNA, 64 nt, Human
cauccucucucuaaggcuccaugguuccuacgaagcucugaaaggugggaacaccacagaggcc

SEQ ID NO: 516699 - RNA, 64 nt, Human
aucuccguaaccauuugcaugugacuuagcaagggcucugaaaugacaaagagaacgagcacca

SEQ ID NO: 516700 - RNA, 64 nt, Human
cccaggaaauguggggucggccaggacccucacagcucugaauuugcuucuguuauuuauggcu

SEQ ID NO: 516701 - RNA, 64 nt, Human
uaaagaaggcugcuucuacuguauagaacccagggcucugaaacagcucuagccgccuaaugca

SEQ ID NO: 516702 - RNA, 64 nt, Human
ggucagccucgcacccaggccaggcagaagcugugcucugaagcuaggacagcuggcugagaag

SEQ ID NO: 516703 - RNA, 64 nt, Human
gaaaggucacauauuucaaacacaacuagauggggcucugaaagauuuguaucucugugcuuga

SEQ ID NO: 516704 - RNA, 64 nt, Human
agugggacuucugucuccccgcuauauucccauugcucugaaugguugauugaagggucaggga

SEQ ID NO: 516705 - RNA, 64 nt, Human
cuguggcuaacaccacuguguauguuucaucauugcucugaaggucaaaagccucauuuuauuu

SEQ ID NO: 516706 - RNA, 64 nt, Human
gucugaagagcucuauacagguacuaagacuagcaggggacaccaagacucugcacaaccagau

SEQ ID NO: 516707 - RNA, 64 nt, Human
ucacucugcacccugaugugggaggcuuuggcgcaggggacacuuucaggaaagggaggagcac

SEQ ID NO: 516708 - RNA, 64 nt, Human
acuauuaaucaaagugcuugcuuucaguccuuugaggggacagauaaucugaaggccagagauu

SEQ ID NO: 516709 - RNA, 64 nt, Human
uggagagaggggccucuucagugucuacugaguaaggggacagcuccaggccggggccugucuc

SEQ ID NO: 516710 - RNA, 64 nt, Human
cauucuccugucuggcuggguugggugcaagcaggcucugaaugccuggcauuucagcugcauc

SEQ ID NO: 516711 - RNA, 64 nt, Human
ugcuaggguuaggagguccuuaggccucugagaagcucugaagaacucucuggaagccccuggg

SEQ ID NO: 516712 - RNA, 64 nt, Human
auaacaauuuuuugguuguuuuguuuaaguuggugcucugaagcuuaaucucaguacccuuuac

SEQ ID NO: 516713 - RNA, 64 nt, Human
gauagcuccagaccugcauccuccuagcuugggggcucugaaugaaagguuucuucccuuccag

SEQ ID NO: 516714 - RNA, 64 nt, Human
agguuuguuacuggcuucagaaagcuaauuaagugcucugaaaaagacaccguuucuugaaaca

SEQ ID NO: 516715 - RNA, 64 nt, Human
aagcccgcccccucacaaaugcugagccguucuugcucugaaacugcgugagucaaggcaaaug

SEQ ID NO: 516716 - RNA, 64 nt, Human
guucugaguaaguguguucauuaauguuuauuuagcucugaagcaagagugauauacuccagga

SEQ ID NO: 516717 - RNA, 64 nt, Human
uccuauugccaaaagaaagaaagggggccaaacagcucugaaauuuccaaaaaauggcuagagg

SEQ ID NO: 516718 - RNA, 64 nt, Human
gugguugaaacaucaggacacucccaaggccccggcucugaacaagaccuuuucguuucuugga

SEQ ID NO: 516719 - RNA, 64 nt, Human
caguggcaggauuuaaucuggggagcaaauuccagcucugaaauggaguucucacaccguaucu

SEQ ID NO: 516720 - RNA, 64 nt, Human
uucuguuuccguuaggccacagacucuucaccuggcucugaagagccacucuuaccucgguccc

SEQ ID NO: 516721 - RNA, 64 nt, Human
accaggucuaauguuuacaaacggugccagcccggcucugaagccaagggccgucccgugccac

SEQ ID NO: 516722 - RNA, 64 nt, Human
acauccuugccgccacaucccggguggcucuggggcucugaacucugaccugugaauagaagca

SEQ ID NO: 516723 - RNA, 64 nt, Human
gcccuuacugguguaccgcucagaaacccgcaaggcucugaaggguucuugaagcccaguuugc

SEQ ID NO: 516724 - RNA, 64 nt, Human
acaaguauugggacguagagcacagccucacucagcucugaaagguaauacagcuugugaggaa

SEQ ID NO: 516725 - RNA, 64 nt, Human
cacagaaugucaaaugaggggccuccugccuccugcucugaauauucuguagcuguagaggcau

SEQ ID NO: 516726 - RNA, 64 nt, Human
ccuaaaagugauucuugucauucaagaaagcaagaggggacaacaaugggaggggucggagcuc

SEQ ID NO: 516727 - RNA, 64 nt, Human
guccucgggagaugaagcauccgugccuaggaaaaggggacagagggcaaggagagaagugaga

SEQ ID NO: 516728 - RNA, 64 nt, Human
ugcucuuuugguauauggcauacagcuccauuggaggggacacaucacuggcuuuaucuggugg

SEQ ID NO: 516729 - RNA, 64 nt, Human
agcauuagcaaggcugaaaguggucuaagaggugaggggacauccuaugacuuuuuaggaaggc

SEQ ID NO: 516730 - RNA, 64 nt, Human
ucuggaccacccugauauugcuucuccucugaaugcucugaaaagugcaggugcccaaggcaug

SEQ ID NO: 516731 - RNA, 64 nt, Human
gggggccgccgguuugagugaggguuucugagcugcucugaauuaguccuugcuuggcugcuug

SEQ ID NO: 516732 - RNA, 64 nt, Human
cuguguucauucuuaccgagaaaaggagaaaggagcucugaaucugauaggaaaagaaggcugc

SEQ ID NO: 516733 - RNA, 64 nt, Human
cgacucugguggugcuuuuguauguuucaauuaggcucugaaaucuugggcaaaaugacaaggg

SEQ ID NO: 516734 - RNA, 64 nt, Human
cuucccccuccauguagaagagggagaaggagaggcucugaaagcugcuucugggggauuucaa

SEQ ID NO: 516735 - RNA, 64 nt, Human
ccuuucuguguccuacuccuugcaggugacauuugcucugaacuggaugauacgaaugauguca

SEQ ID NO: 516736 - RNA, 64 nt, Human
uacauaccugaccgggaguccaaaccaccuuggugcucugaaguccacugacucaucacaccuu

SEQ ID NO: 516737 - RNA, 64 nt, Human
ccugagacauguaggaaacaccuuucagacccaggcucugaagauucccagaagccacaaggau

SEQ ID NO: 516738 - RNA, 64 nt, Human
ggcauggagauccugguugugccgucucagcuccgcucugaaggcacugugugggugcugcgug

SEQ ID NO: 516739 - RNA, 64 nt, Human
cacagugugaggacgcugaccccgggcagccgcugcucugaagagcuuccgcgccuucccccug

SEQ ID NO: 516740 - RNA, 64 nt, Human
gugcacccuuggucuucgcuccaucgccuugaaagcucugaagaggcccuggguugccgcggca

SEQ ID NO: 516741 - RNA, 64 nt, Human
aaacaccuguggcuucuuggcccuccuguugcccgcucugaaucucucugcagucuacaaaauc

SEQ ID NO: 516742 - RNA, 64 nt, Human
ccacuuggagucuggauggacacaugggccaggggcucugaagcagccucacucuuaacuucgu

SEQ ID NO: 516743 - RNA, 64 nt, Human
acuuaaccugaaucucuacucacagcccccaccagcucugaaugucuaaccugcuccccugauu

SEQ ID NO: 516744 - RNA, 64 nt, Human
cugaagacccccugacucccaugcugugcuugccgcucugaaacaaacagaggcuggaacuuug

SEQ ID NO: 516745 - RNA, 64 nt, Human
uuaacuugucccguuuauaaaugggacugcuuaggcucugaaagcuucagugauuuccuuaaaa

SEQ ID NO: 516746 - RNA, 64 nt, Human
agagagcugcccgcuccugcccucuggaugacauaggggacaucaacaagacggcugccaaccu

SEQ ID NO: 516747 - RNA, 64 nt, Human
aggcugagcaccucagccuuuagggcuuauggccaggggacacuguaugacucuccucuccugc

SEQ ID NO: 516748 - RNA, 64 nt, Human
ccuggacgccugaggggcagcuuaucacagugcaaggggacaggguaaacagcagggggugggg

SEQ ID NO: 516749 - RNA, 64 nt, Human
gauucacuagugcuuacaaauugcccccauguguaggggacacagaacccuuugagaaaacuua

SEQ ID NO: 516750 - RNA, 64 nt, Human
cuauagaguuggcauuuuagccccagcuucuguagcucugaaagccuaaagaagguauucucuc

SEQ ID NO: 516751 - RNA, 64 nt, Human
uaccucucuaccaaaugaacauaaguuguaauuugcucugaaaucugucaacuaucuuaauuga

SEQ ID NO: 516752 - RNA, 64 nt, Human
gccuugcagauauguguggcauuuacuagccagagcucugaaaggcagugcugucuguuucuug

SEQ ID NO: 516753 - RNA, 64 nt, Human
gaacauuuucgccugaugcccaucugcugaccccgcucugaaagccgggggugaguguggcuca

SEQ ID NO: 516754 - RNA, 64 nt, Human
aaguggcagaacagggacuugaaccaagcccucugcucugaagaccgcguccugaauuucuuca

SEQ ID NO: 516755 - RNA, 64 nt, Human
ucgaccggcccugcauucuuccgcacccucccuagcucugaaaucaacucucuucggucguauc

SEQ ID NO: 516756 - RNA, 64 nt, Human
agaaaauagcaucccaccucuggguaucugaguggcucugaaguugcaaauaaaauaauuuguu

SEQ ID NO: 516757 - RNA, 64 nt, Human
aguuaagggcuuuugguauuaaagauauucugaagcucugaaaugcuagaaaaaaauuuggaau

SEQ ID NO: 516758 - RNA, 64 nt, Human
aaguugaauggugagcuagcuuauaaauuaaagagcucugaacuguauucagaccgacugggua

SEQ ID NO: 516759 - RNA, 64 nt, Human
uggcugguaagagggagagaugcaaaauucuccagcucugaacuuggagcuacuucacacucua

SEQ ID NO: 516760 - RNA, 64 nt, Human
ugauauucauucguauccagcucuuuauuacauagcucugaaguuaaaaugauuuacauaggcc

SEQ ID NO: 516761 - RNA, 64 nt, Human
ccaaaugauauuuucugaagaugcuuuuuggaaagcucugaaucuauaccuaaugcucuuaauu

SEQ ID NO: 516762 - RNA, 64 nt, Human
uuguucccacuucuuggcuguuaggaauaauguugcucugaacauguaaauaaagaucuuugug

SEQ ID NO: 516763 - RNA, 64 nt, Human
gaauuaaacuggaaaaguauuucauuuacuuagugcucugaauuuacuuuuacaguuuucugca

SEQ ID NO: 516764 - RNA, 64 nt, Human
ucgucauaaagugugguuuauuuuauuuugguaggcucugaaaucaaaaugcuacgccauuaua

SEQ ID NO: 516765 - RNA, 64 nt, Human
guuccggguuggaacagcagaggcucagaaacuggcucugaaauaggcagaccuagcaagagga

SEQ ID NO: 516766 - RNA, 64 nt, Human
guuccucauugccucgggcugcgucaggggaagcaggggacagguguccaguugcugggccgag

SEQ ID NO: 516767 - RNA, 64 nt, Human
aagaauuuauacuuauuuuuuccuuaaaagccacaggggacaguuaaauaucuuaaaauaucua

SEQ ID NO: 516768 - RNA, 64 nt, Human
cuucaccaccacuagugucuguccauggaguuagaggggacaucacuuagaaguucuuauagaa

SEQ ID NO: 516769 - RNA, 64 nt, Human
agguaccuaaguauaugauugcgaguggaaaaauaggggacagaaaucagguauuggcaguuuu

SEQ ID NO: 516770 - RNA, 64 nt, Human
cuccauguaggugcuguguucccggcaccgccuugcucugaacacugguaauuccaggugcugc

SEQ ID NO: 516771 - RNA, 64 nt, Human
cuugucaucuuucucugccugaggggaaacugaagcucugaaaugcgaugugaucuguaccagg

SEQ ID NO: 516772 - RNA, 64 nt, Human
gggggcggguaguauccauacacuaugcacuacugcucugaagcuucuggaaucagaaaugaac

SEQ ID NO: 516773 - RNA, 64 nt, Human
gucuucuugcuucuucuaccuuuauuuauucucagcucugaauguaugaaccugcucaaucacc

SEQ ID NO: 516774 - RNA, 64 nt, Human
ggagauuggggguugggggaggcagcgggugauggcucugaagcugaacccagggccuggcugu

SEQ ID NO: 516775 - RNA, 64 nt, Human
cagcuucagcagacuuaaacauuccugccugccagcucugaagagagcagcaguucuuccagca

SEQ ID NO: 516776 - RNA, 64 nt, Human
aacguauuuccccucucacccuggcuuccaggcagcucugaaauacgucccaccugugcagcua

SEQ ID NO: 516777 - RNA, 64 nt, Human
ccuucacuccuuugccccagggacccaggcucaugcucugaacucuggcugagaggaugcugcu

SEQ ID NO: 516778 - RNA, 64 nt, Human
ccagcuauugaaacucaagcgauuacagacaauugcucugaagaaagaaagacauucaacuuga

SEQ ID NO: 516779 - RNA, 64 nt, Human
aaauauguggguaaaucucuguucaaggcucucagcucugaaggccgugagaccccugauuucc

SEQ ID NO: 516780 - RNA, 64 nt, Human
uaucaaugucagaaaggcuucaacaugaauucaggcucugaauucuuugauguaccaauguaua

SEQ ID NO: 516781 - RNA, 64 nt, Human
ggcggauacagaaacuugugagaaugugaugaacgcucugaacccccuauaaaaaaugugcaug

SEQ ID NO: 516782 - RNA, 64 nt, Human
uuuugauauguagggauguccaguugauauaacagcucugaaggagaucccuuaugaggguggc

SEQ ID NO: 516783 - RNA, 64 nt, Human
uguuguuagaaguguauauaaucugaaucaauaagcucugaaugguggccaagggccucucuua

SEQ ID NO: 516784 - RNA, 64 nt, Human
acuaacugcccucccaaauaucuugguucagacagcucugaaccccacgcucacaguggucgac

SEQ ID NO: 516785 - RNA, 64 nt, Human
cacagaguuacugccacgguccuuugagugucaggcucugaaucucucaaaaugugccgucuuu

SEQ ID NO: 516786 - RNA, 64 nt, Human
ccuggcacaggcuacagggguggggcagaaggaaaggggacaagauagaacccaggaugugagg

SEQ ID NO: 516787 - RNA, 64 nt, Human
gcugaggccucccuugaguaggcccugcuuuaucaggggacaaaccagggguaccaggcacaug

SEQ ID NO: 516788 - RNA, 64 nt, Human
uuccuggaacucaggguguggggacugagccuguaggggacagcaugccgucuugcuguggcca

SEQ ID NO: 516789 - RNA, 64 nt, Human
gagccagccucccuuugaugauuauuggagccccaggggacaagggauuugaggugaggguugg

SEQ ID NO: 516790 - RNA, 64 nt, Human
cgccuuuuauuuguccuuaaacuaccuccuuagagcucugaaggggucuccuaguuccagauuu

SEQ ID NO: 516791 - RNA, 64 nt, Human
ugagcuggcaccagcuccuguggaauguuugguugcucugaagugggcugcggccuguucauua

SEQ ID NO: 516792 - RNA, 64 nt, Human
ccgggaggacaaccagaccaaccgccugcaggaggcucugaaccucuucaagagcaucuggaac

SEQ ID NO: 516793 - RNA, 64 nt, Human
agagucuagcaaaugcuaaggccccucaggcugggcucugaacgaggaccuggacucagagcca

SEQ ID NO: 516794 - RNA, 64 nt, Human
aaagaccaggaucgguccagcucagauauugagggcucugaagccuaguucugucuucucugga

SEQ ID NO: 516795 - RNA, 64 nt, Human
uguuuggauuuugcucaacaucuccaguuucucugcucugaaaaauggggaaaacugcuaaaca

SEQ ID NO: 516796 - RNA, 64 nt, Human
gcccagagucugacucuuaacccuuuugagaauugcucugaauuuuguucucaggcauuauaca

SEQ ID NO: 516797 - RNA, 64 nt, Human
agggcucuaguuaugguuacuuucccuagucaaugcucugaaaaugugucacauuauaaacaau

SEQ ID NO: 516798 - RNA, 64 nt, Human
uuacaaggcucuaauuaugauuucccuagucagugcucugaagaugugucacauuauauuauaa

SEQ ID NO: 516799 - RNA, 64 nt, Human
ugcauauaaucuuugcucuuuuuaagcucugugagcucugaaauauauuuuuggguuacuucag

SEQ ID NO: 516800 - RNA, 64 nt, Human
gcacaggaagguggaaacaaaaugccaggccucugcucugaagagcaaaacugcugucgcugca

SEQ ID NO: 516801 - RNA, 64 nt, Human
ugcccgcuccugaaacccagcaugccccaagugagcucugaagcccccuccucaaucccuugau

SEQ ID NO: 516802 - RNA, 64 nt, Human
agagcagaggggucucuaacuuaaagccagcucagcucugaaauguucagagggcugacauaua

SEQ ID NO: 516803 - RNA, 64 nt, Human
ggaagaugugauugauuuguaaaccgcauuaaaugcucugaaauaaaaugaaaguaaaaauaag

SEQ ID NO: 516804 - RNA, 64 nt, Human
cuuaaagaucucaacauggaaaaauccugucauggcucugaacugcacaaugcauugaaccgcc

SEQ ID NO: 516805 - RNA, 64 nt, Human
cagagccacaggccccuuuuguggguuucucugugcucugaaugggagccagaauucacuagga

SEQ ID NO: 516806 - RNA, 64 nt, Human
guaauucuacaagauaugccaugggccuuuucacaggggacacaggcuucuuaaaacaacccgg

SEQ ID NO: 516807 - RNA, 64 nt, Human
auggguggaauagcgguaaggcuugaguaaaacuaggggacagagguucuuauuugucgauuuu

SEQ ID NO: 516808 - RNA, 64 nt, Human
gaacaagagauggucaagucgcuagagacauaucaggggacauuaggauuggggaagacacuug

SEQ ID NO: 516809 - RNA, 64 nt, Human
guugcagcuaugaugcuaggugguuucuaagcacaggggacaccccacacccccugccugaaug

SEQ ID NO: 516810 - RNA, 64 nt, Human
uuaauacggcuugucuuaagauaucuggaggcaugcucugaaauccuauauaaaagaguuuaaa

SEQ ID NO: 516811 - RNA, 64 nt, Human
aaaugaggaccggccggacgaugcccugcagacugcucugaagagaaggagggaccuucugcag

SEQ ID NO: 516812 - RNA, 64 nt, Human
cucaaucuccagagccauguccauggggaggugggcucugaagggcgaaggugggagagcaggg

SEQ ID NO: 516813 - RNA, 64 nt, Human
uucagaagacaggcuggaugagaucucaggccgagcucugaaauagggagguaauccuccagca

SEQ ID NO: 516814 - RNA, 64 nt, Human
cccaugcaggcgggaguuccagagagaggacauagcucugaauuaccgggacgcugagggggau

SEQ ID NO: 516815 - RNA, 64 nt, Human
caacuucucuucucucuggacuucgguguccucggcucugaaggcgcucucugcacuuagaugc

SEQ ID NO: 516816 - RNA, 64 nt, Human
ugaaacccccacgccuccgcuucagcaucuccacgcucugaagcugucuuucaaaaugugugca

SEQ ID NO: 516817 - RNA, 64 nt, Human
cacugagcccggauaguucucagccuggcaaguggcucugaagcugccuucagacaaggcuagu

SEQ ID NO: 516818 - RNA, 64 nt, Human
caaagcagaagcugcugaagcacggggugaacuugcucugaacugcacccaggaggugacuggg

SEQ ID NO: 516819 - RNA, 64 nt, Human
augaagugauauaaaagcugcauaugccuacaaagcucugaauucaggucccaguugcugucac

SEQ ID NO: 516820 - RNA, 64 nt, Human
uuuuguuuuugaccaaaaaaauaauaauaaguuagcucugaagggcagagggaauacccaagcc

SEQ ID NO: 516821 - RNA, 64 nt, Human
gcagaucugugcuggccacgugcccggugucucagcucugaaccugcugucccugcugagaagc

SEQ ID NO: 516822 - RNA, 64 nt, Human; identical to SEQ ID NO: 516435

SEQ ID NO: 516823 - RNA, 64 nt, Human
uggcccugugugaaguauuucgaaucuccuccuugcucugaaacuucagcgauuccauugugau

SEQ ID NO: 516824 - RNA, 64 nt, Human
ggaugaggacaggucuucuuuccugccagagggagcucugaagacaacuagagaauucugggcc

SEQ ID NO: 516825 - RNA, 64 nt, Human
aguuuccuaauuaauguuguauucauauauguaggcucugaaauguugugaugcuuauugcuuc

SEQ ID NO: 516826 - RNA, 64 nt, Human
uuuugagucugguuucauuguuuuaaauaaauuaaggggacacuaaaguccuaucauucauuuc

SEQ ID NO: 516827 - RNA, 64 nt, Human
aguuggggggaguaucuauaguaaacuugaauaaaggggacaaagcuagaacuuauucauucau

SEQ ID NO: 516828 - RNA, 64 nt, Human
uuaauauauagaaggguaccuugaacacugggggaggggacauugaacaaguuguuucauugac

SEQ ID NO: 516829 - RNA, 64 nt, Human
cacacaaguucacuugauuaauugcaucaguggaaggggacauagcuucucucuuagagagaac

SEQ ID NO: 516830 - RNA, 64 nt, Human
uguggcacccauggcugccuucccaucccccccugcucugaaauaggacauuuuuccuacagua

SEQ ID NO: 516831 - RNA, 64 nt, Human
ggagguucugguccugccuuuggggccaacgcuggcucugaagugucuuuuucagaggaauugg

SEQ ID NO: 516832 - RNA, 64 nt, Human
gaauauuccagaagccauagcuucuuaccgcacggcucugaaacuuaagccugauuuuccugau

SEQ ID NO: 516833 - RNA, 64 nt, Human
aucuguuggcaaaaauaucuuuuucaaggcaucagcucugaaccuagcuuuauuuaaacugaau

SEQ ID NO: 516834 - RNA, 64 nt, Human
gcauccuuacuuagguauuauacuucuuuaaaaagcucugaagcugcuacaauagaaaaaucaa

SEQ ID NO: 516835 - RNA, 64 nt, Human
ccagagucuagcagugauaaaauguacaauuuacgcucugaauagaaacaugacaccaaagaaa

SEQ ID NO: 516836 - RNA, 64 nt, Human
auugccaaguccucuaagguacuaauuuguagcugcucugaaguaaggauuucggauucagcug

SEQ ID NO: 516837 - RNA, 64 nt, Human
uuuguguacagauuaacuaguuaaggcuugagaagcucugaauaauucaaaaguauuagaccca

SEQ ID NO: 516838 - RNA, 64 nt, Human
gaccuguuuggaugugauuacuuaaaaauggaaugcucugaauaggcacucucuacauuaaagg

SEQ ID NO: 516839 - RNA, 64 nt, Human
agguggcaaaaguccuucuguuacucaagaaaaugcucugaaaaauuccuuuucucuuuuuuuu

SEQ ID NO: 516840 - RNA, 64 nt, Human
ucuggugaccugguauuccaucaccauucaccccaggggacagccucgaccgagacaaggaggc

SEQ ID NO: 516841 - RNA, 64 nt, Human
aagccacaggcaggcaucguagcuccacagcccgaggggacacaggauggaaaccccaggauga

SEQ ID NO: 516842 - RNA, 64 nt, Human
gacaacccagccaagcagaggaagaagcugccgaaggggacagacuccacugccagacggccag

SEQ ID NO: 516843 - RNA, 64 nt, Human
ggggaagacaagaugucauccuuggaaacccugcaggggacaguuuuuccaggguggccuauca

SEQ ID NO: 516844 - RNA, 64 nt, Human
aaaagggcagagacuugacacuccagucuuagacaggggacaauuucuuuguaguuguucugau

SEQ ID NO: 516845 - RNA, 64 nt, Human
cauccccuuugagugucagaagcacucugagccaaggggacagggggcacgugcacuggucacg

SEQ ID NO: 516846 - RNA, 64 nt, Human
ccugacuauccccagcccugaaaaaaagagcaggaggggacaccccuccauaugccccccccca

SEQ ID NO: 516847 - RNA, 64 nt, Human
acauuagucauucaaguguucagacagccacaugaggggacagugcagcuacaggauaugccau

SEQ ID NO: 516848 - RNA, 64 nt, Human
aagaggcacccuggcaagcagcagugauugggggaggggacaggaucuaacaaugucacuuggg

SEQ ID NO: 516849 - RNA, 64 nt, Human
uuacauacuguuccccaauggaggccccuggcauaggggacagcccugggcaucuuccuuuggu

SEQ ID NO: 516850 - RNA, 64 nt, Human
gaugcaggcaagacaccuucccagcugcuccuagaggggacaagccaggcccucucugcagucc

SEQ ID NO: 516851 - RNA, 64 nt, Human
accaguuuguuugugugugugugugcucauuuugaggggacaaggaucucuagcauucauaaca

SEQ ID NO: 516852 - RNA, 64 nt, Human
uguuuaauuuauacugguaacuuauuuaggggggaggggacaugaagguagguaaauagguagg

SEQ ID NO: 516853 - RNA, 64 nt, Human
ucauugaauuauaaaagccagcaggcuucaaacuaggggacaaagcaaaaagugaugauagugg

SEQ ID NO: 516854 - RNA, 64 nt, Human
uuuacuuaccuuaugcacaaagguauucccagguaggggacaauaguagcauucgcagugguga

SEQ ID NO: 516855 - RNA, 64 nt, Human
caucucuuuuuaagaagugacugcuguuggggccaggggacaucaugggagguggggcugucca

SEQ ID NO: 516856 - RNA, 64 nt, Human
uaggagggcucugagccaaccuugcucuuggggaaggggacagauuaugaaauuucauggauga

SEQ ID NO: 516857 - RNA, 64 nt, Human
cuuggaacauuugggagacugagcuugauucuaaaggggacagaucuugagcaaggcaagaagu

SEQ ID NO: 516858 - RNA, 64 nt, Human
cccguuccccuaggagcuuugagcauuucucugcaggggacaguaguaauauaauucucucuuc

SEQ ID NO: 516859 - RNA, 64 nt, Human
gcaaccucucucuucuccucuguuucgugaaggcaggggacacagaugggagagauugagccaa

SEQ ID NO: 516860 - RNA, 64 nt, Human
aagaugaugcugaggccugaugacauuuaugcuuaggggacaagaguuugaacucaagggacug

SEQ ID NO: 516861 - RNA, 64 nt, Human
ucuguugaugcuguauucccauaucaaaagacacaggggacacccagaaacgccacauccccca

SEQ ID NO: 516862 - RNA, 64 nt, Human
uauccugcagagggugccucugccucucugugucaggggacagcuugugucaccacgcccggcu

SEQ ID NO: 516863 - RNA, 64 nt, Human
ugacauggacagcugcuuaucaagacacuccaucaaccccuacaguaacagggagagcaggauc

SEQ ID NO: 516864 - RNA, 64 nt, Human
gaaaucuugcaaguuguagcaagagcacacaggaaaccccuaacuuuccuauaccccacccgcc

SEQ ID NO: 516865 - RNA, 64 nt, Human
gcaccgacuaggcugaggugcugguacuugccccaaccccuacuuuuguauuuauaugugugug

SEQ ID NO: 516866 - RNA, 64 nt, Human
uguggagcaucagcagguuuccaacucacucauuaaccccuaccccaucuccaggccuguacua

SEQ ID NO: 516867 - RNA, 62 nt, Human
augcacucuuuuguuguaccaaauagggcuccccaccccaccccugcgacaagugcucuucu

SEQ ID NO: 516868 - RNA, 62 nt, Human
gaaguaaacaguucauccaugaucucacuuaaccaccccaauaaaucugauucuuuauuuuc

SEQ ID NO: 516869 - RNA, 62 nt, Human
cgguucccaggggccaggcugggagcccacagccaccccacuaugccgcaggccgcccuacc

SEQ ID NO: 516870 - RNA, 64 nt, Human
uauuugacuuggaaguguuguguuguauuuuuugaaccccuaggcuucaggaaaacugcucuuu

SEQ ID NO: 516871 - RNA, 64 nt, Human
uucugcaggaacuucucaagggaugaggagacagaaccccuacuuccaagugcucuauuuguau

SEQ ID NO: 516872 - RNA, 64 nt, Human
ggaauauguuaccauuaaucagaaacaucauggcaaccccuaagaauagacuaaguuuguguug

SEQ ID NO: 516873 - RNA, 55 nt, Human
ugcaugccaaaagagcauaaguuacaaccccuaggagcucugcuuucaaaacaaa

SEQ ID NO: 516874 - RNA, 64 nt, Human
auuuucucugcacuuucaaugcccuguucuuccaaaccccuaucccaaguuuuaugacaguuuu

SEQ ID NO: 516875 - RNA, 64 nt, Human
ccaggaucauccugucuggcugcagugagagaccaaccccuaacaagggcugggccacagcagg

SEQ ID NO: 516876 - RNA, 60 nt, Human
aaaacacuaaacaacccugagcccagggccaaccccuacggaacaccacuacuuuaccca

SEQ ID NO: 516877 - RNA, 64 nt, Human
aaauuuuucugaacagcaucuguaaagugacaguaaccccuaccucacaggguuguugugagga

SEQ ID NO: 516878 - RNA, 64 nt, Human
ccuccuccuuucacgaggaaaagaccuuccccugaaccccuaaaaauguuuacagucucugcug

SEQ ID NO: 516879 - RNA, 64 nt, Human
ccgauugguggcgcauaggguguaaccaauaggaaaccccuaaaggguacuuaaaccccagauu

SEQ ID NO: 516880 - RNA, 64 nt, Human
guaacucucuuccuucuuuuucucccuaccccccaaccccuagcccaaccaaugcuagaauuuc

SEQ ID NO: 516881 - RNA, 64 nt, Human
aauauccuacaaacaacaacuguucacaacagcaaaccccuacauuuaugagcuguaagaagaa

SEQ ID NO: 516882 - RNA, 64 nt, Human
gaguggaggagagucucugaccagcugcagagccaaccccuaucauuuuauuaacauggaaccc

SEQ ID NO: 516883 - RNA, 64 nt, Human
gaccuacaagcaaacuaaauagccaacauuucugaaccccuaagucuccugugccaagcugcuc

SEQ ID NO: 516884 - RNA, 64 nt, Human
uuaauucucccuuguugcaacucuguguaccaagaaccccuagcaucagccucauuccuaagcc

SEQ ID NO: 516885 - RNA, 64 nt, Human; identical to SEQ ID NO: 412911

SEQ ID NO: 516886 - RNA, 64 nt, Human; identical to SEQ ID NO: 412912

SEQ ID NO: 516887 - RNA, 64 nt, Human; identical to SEQ ID NO: 412931

SEQ ID NO: 516888 - RNA, 62 nt, Human
acagacagucccccgagguaggcuacauccccccaccccagcuggucugcuuggauuuccua

SEQ ID NO: 516889 - RNA, 64 nt, Human
aaccugagaccgucuggggggcggaagccaaaugaaccccuauugggcaccucugugaugccag

SEQ ID NO: 516890 - RNA, 64 nt, Human
uauuuauaaacaaauacuuuuccugccuccaccaaaccccuacagaacaucaccuggaauugcc

SEQ ID NO: 516891 - RNA, 64 nt, Human
uccaggguacuuucuaagauaagccuuaaacagaaaccccuaagaaagguucucugaaaauuau

SEQ ID NO: 516892 - RNA, 64 nt, Human
ugaaucccucuaucucuaaagaaaaucucugugaaaccccuauguggaggcggaauugcucucc

SEQ ID NO: 516893 - RNA, 64 nt, Human
auggaaugaccaggcucuaugaauguacauggaaaaccccuaaaaauccccaaaacagaaacau

SEQ ID NO: 516894 - RNA, 64 nt, Human
auggacaagcuguuuucuuuucuagguuacugauaaccccuacaauuuucgacuuaacuucaaa

SEQ ID NO: 516895 - RNA, 64 nt, Human
auguuuucuaggauuuuggcuuacaguaaauguuaaccccuaugguaagugauuguuauuguug

SEQ ID NO: 516896 - RNA, 64 nt, Human
ugaagcuggaagccaucauaccuuacugccuugaaaccccuaggacucagcuaaguauuugccu

SEQ ID NO: 516897 - RNA, 64 nt, Human
uuuaaaauauauauauacguaacccaagccccauaaccccuaacuggacaaaugaggucuguuu

SEQ ID NO: 516898 - RNA, 64 nt, Human
gggcagaucucagacuuaaacacaauugaugucuaaccccuagacagucuuuuuagugcccucu

SEQ ID NO: 516899 - RNA, 59 nt, Human
cccaagaugcagccgucugaugaggccacaaccccuaggccccucaggagcuuugcaga

SEQ ID NO: 516900 - RNA, 64 nt, Human
uuuuccuaacaacuuacaaggugacuagcuuugaaaccccuaauuugccucaguugauuuucua

SEQ ID NO: 516901 - RNA, 64 nt, Human
caaguaggaacuuccuuuccuucacuucccuuuuaaccccuagucagagcauuucagccguuug

SEQ ID NO: 516902 - RNA, 64 nt, Human
agucugaauccccggccucugucaccugagacccaaccccuagcugggccaacuccagugaauu

SEQ ID NO: 516903 - RNA, 64 nt, Human
auggcaccuacucagcaaugccuuccuggaccacaaccccuaucccccugccccacccuccuca

SEQ ID NO: 516904 - RNA, 62 nt, Human
cagcuggccacacugagggcccucugggaaccccaccccacuggagccgcuccggcagcucu

SEQ ID NO: 516905 - RNA, 62 nt, Human
agccaggccaugacccaggggagccagcgcugccaccccacccagcgcugccagggagccgc

SEQ ID NO: 516906 - RNA, 62 nt, Human
ggauacggaggggagcccagggccauccauacccaccccaggguaacggggcuggccuggca

SEQ ID NO: 516907 - RNA, 62 nt, Human
acaggugugacauuuguuaccacccauuucucccaccccacccugcuuuuuuguuuguuugu

SEQ ID NO: 516908 - RNA, 64 nt, Human
auguuuguucacauaugcacauacacauacucauaaccccuauaugcguuguugcauaacagau

SEQ ID NO: 516909 - RNA, 64 nt, Human
agcaaaaaccaauucaguuccauuccccgcaaaaaaccccuaacuuuacucugaacuuuuuuug

SEQ ID NO: 516910 - RNA, 64 nt, Human
aagcugcagcuggagcugaaggcucgaucuugugaaccccuaaauccgcucccuccuaacagca

SEQ ID NO: 516911 - RNA, 64 nt, Human
acuaauggucaaguggaacaagcacuacacgacuaaccccuauugggguuuuuaacuuaaggga

SEQ ID NO: 516912 - RNA, 64 nt, Human
gucacaucuacuucuggcggccgcagggcagggaaaccccuacuggacccugugugucugccag

SEQ ID NO: 516913 - RNA, 64 nt, Human
gcuccagagagaagggaaaacuaagagguuuuaaaaccccuacccuccuugguuuaccuccauc

SEQ ID NO: 516914 - RNA, 64 nt, Human
uauaauguuucucuuguaagugauaugauaaauaaaccccuaauuagccuuagaagaaaaacca

SEQ ID NO: 516915 - RNA, 64 nt, Human
agaaaaaguagaaaaaaaaauaacacuuaacuaaaaccccuaggucauuuguagauauauauuu

SEQ ID NO: 516916 - RNA, 64 nt, Human
cuugcucuuaaaccacaccgaggugucuaauuucaaccccuaaugcauuuaagaagcugauaaa

SEQ ID NO: 516917 - RNA, 64 nt, Human
agaggacaagggcguggaucugggccagaagccaaaccccuacuucuacagcuguugucaucac

SEQ ID NO: 516918 - RNA, 64 nt, Human
gccggagugcaguggcaugaucaugguucacuucaaccccuaccuccugggcucaaguguuccu

SEQ ID NO: 516919 - RNA, 64 nt, Human
agggcgggugguacagauguguaugggaaaccccaaccccuauauauuguaaauagaugggcug

SEQ ID NO: 516920 - RNA, 64 nt, Human
cagaaacagggcagcaguggggugaaauuuucuuaaccccuaagacugccuucaguaggaacaa

SEQ ID NO: 516921 - RNA, 64 nt, Human
aaaucagagagaugaguggagucaguccauuuuaaaccccuaaagaugcaacccuuaaagauac

SEQ ID NO: 516922 - RNA, 64 nt, Human
uaucuggccaaccauaugcagaagaaugaaacugaaccccuacuucuccccauauauguaaaau

SEQ ID NO: 516923 - RNA, 64 nt, Human
uugaaaaggacucuugagcccuccuggaauggagcuguauaacugugcagagacuuuauccaug

SEQ ID NO: 516924 - RNA, 64 nt, Human
cuguucgugcuuguaaugcucacuuauguuuucucuguauaacuugugauuccagggcuguuug

SEQ ID NO: 516925 - RNA, 64 nt, Human
gcaauuaauuggauuuuuugguaaagauugccuucuguauaauguuuggauuauauaaaauugc

SEQ ID NO: 516926 - RNA, 64 nt, Human
uaauauuaaucucugccauuaggauaucuacucacuguauaaaccucaguaaaaauagugaaga

SEQ ID NO: 516927 - RNA, 64 nt, Human
agagaagacccuaucaauguagguugcaaaaucuaaccccuaaggaagugcagucuuugauuug

SEQ ID NO: 516928 - RNA, 64 nt, Human
cauuggugacccauaaccccaagucccagcccagaaccccuaacccccaauacuugaagggguu

SEQ ID NO: 516929 - RNA, 64 nt, Human
ugugauucauguaggacuucuuucaucaauucaaaaccccuagaaaacguauacagauuauaua

SEQ ID NO: 516930 - RNA, 64 nt, Human
gccagaccgcaagaagcgcuacaccguggugggcaaccccuacuggauggcaccugagaugauc

SEQ ID NO: 516931 - RNA, 64 nt, Human
acaacaaagcuuaauaagacaugcaaaaauuuagaaccccuacuuuaacugucauugguuuuug

SEQ ID NO: 516932 - RNA, 64 nt, Human
ugguuugauacuuuguuuauacuacccucagcugaaccccuauauaugaauuccguuuucauug

SEQ ID NO: 516933 - RNA, 64 nt, Human
cagccucuccuccuggggccacccaaguggggagaaccccuaguguccugccacaaccugccuu

SEQ ID NO: 516934 - RNA, 64 nt, Human
aucaguuaggauacagggugaacuguaacaaagaaaccccuaaaacagugacuaaaucaagaga

SEQ ID NO: 516935 - RNA, 64 nt, Human
uccccuucugagaaguacagagugagacuuaaagaaccccuagauccccaccaguucaacacuc

SEQ ID NO: 516936 - RNA, 64 nt, Human
acaggguuuugcuguguugcucaggcuggucuggaaccccuaggcucaaaugaugugcccaacu

SEQ ID NO: 516937 - RNA, 64 nt, Human
gcaagcaugaaugcaaugguguagaguugugugaaaccccuagcauagagacagacagcgaaga

SEQ ID NO: 516938 - RNA, 64 nt, Human
cagagaggauacugcucuauguggcauugccuugaaccccuaaaauuaucagacuuccuuuuuc

SEQ ID NO: 516939 - RNA, 64 nt, Human
ucucuugaauuggcugccagaauugaaccaacccaaccccuagcucaccuccuacuguaaagag

SEQ ID NO: 516940 - RNA, 64 nt, Human
cacugugcagggcuguggagcucugagacaccugaaccccuacccauccccugcaccucccuac

SEQ ID NO: 516941 - RNA, 64 nt, Human
aaggaaagggagcugaaauaggaacagaaaaaucaaccccuauaacuagugaacaccaagggaa

SEQ ID NO: 516942 - RNA, 64 nt, Human
uuuuaacauuuuaagcagacugcuaaacuguucucuguauaaguuaugguaugcaugagcugug

SEQ ID NO: 516943 - RNA, 64 nt, Human
cuucuuauugguguugauaguaugucuguaaucucuguauaaacuuugucaacauuuuuaccuc

SEQ ID NO: 516944 - RNA, 64 nt, Human
augcaguauuuuacauacaguucugguuuuaacacuguauaaaacuuuuguguaauaaaaugga

SEQ ID NO: 516945 - RNA, 64 nt, Human
gguuugccaaaaagaaguguuuaagauauguuuucuguauaaaugaacuaauucuuuauauuaa

SEQ ID NO: 516946 - RNA, 64 nt, Human
gggggugaggguggguggcgauugccuuagagggaaccccuaaauugguuuuggauaaguuuga

SEQ ID NO: 516947 - RNA, 64 nt, Human
cugugacuccucuguggacaugguggcagcagggaaccccuagagagaggggccacugggacca

SEQ ID NO: 516948 - RNA, 64 nt, Human
aacuagggccagguggaaggggagcugagaagccaaccccuagcccaggggugcugugggaacu

SEQ ID NO: 516949 - RNA, 64 nt, Human
ucuguuuccaaaaaaaaaaaaaaaaugaaaggucaaccccuaugcaaauuaccacagcaaaggu

SEQ ID NO: 516950 - RNA, 64 nt, Human
cccacccacucacuuguaagcuccuugaugagcaaaccccuaaggcccccagcucagacucagc

SEQ ID NO: 516951 - RNA, 64 nt, Human
gucuuugaaauaggauuccuuacuuuuaguuagaaaccccuaaaacgcuaauauugauuuuccu

SEQ ID NO: 516952 - RNA, 64 nt, Human
ggggguccauaguuggacuucagagggucuaugaaaccccuaaaacugucaguauuuaauguau

SEQ ID NO: 516953 - RNA, 64 nt, Human
ccacaaaaagaaucaggacuuguacugggaaaaaaaccccuaaauuaauuauauuucuuggaca

SEQ ID NO: 516954 - RNA, 64 nt, Human
caagacuaaaccugauccuugggcaaaaguuccuaaccccuacuuuacccucccacccucacuu

SEQ ID NO: 516955 - RNA, 64 nt, Human
cagcaagagaaaaugagaaagaagcaaaaguggaaaccccuaauaaaccuaucagaucuuguga

SEQ ID NO: 516956 - RNA, 64 nt, Human
ccaggcaaauuguuuucuuccuucuacccaccccaaccccuacccaucaccuuuuaagaacaua

SEQ ID NO: 516957 - RNA, 64 nt, Human
guucuuguuuuuaauaaggggaaaaagauaaaauaaccccuauuuuuccuguuauuguauuuaa

SEQ ID NO: 516958 - RNA, 64 nt, Human
gggcucguccugcggugcccgagaaucacucgcuaaccccuaugcccggucccggaccgacauc

SEQ ID NO: 516959 - RNA, 64 nt, Human
auucacucugugguccagagucaacuguucccauaaccccuagucaucguuuguguguauaagu

SEQ ID NO: 516960 - RNA, 64 nt, Human
acacaggccugauaacucuguacgaggcuucucuaaccccuagugucuuuuuuuucuucaccuc

SEQ ID NO: 516961 - RNA, 64 nt, Human
ccuuggcuaaaagaauauugcagagucuaugauacuguauaacaggggcuucuaauuaaauuua

SEQ ID NO: 516962 - RNA, 64 nt, Human
aaugcauuguaguguaauauuuaugcauacuauacuguauaacauguuauucaaaagggauugc

SEQ ID NO: 516963 - RNA, 64 nt, Human
uuugcacuucuguauauagucaaaagagagaaaccuguauaauaguaagaucuuauuuugaaua

SEQ ID NO: 516964 - RNA, 64 nt, Human
guaucaauauccuaaauguagaaauuaaaagauacuguauaauuuuaugccuuugcaaagauuc

SEQ ID NO: 516965 - RNA, 64 nt, Human
acaucuaugcuugcguuugaaacuacaacuugauaaccccuagaaagaagaggacaugaaagga

SEQ ID NO: 516966 - RNA, 64 nt, Human
acggaggccgccccacccccuucccuuuccuccaaaccccuaacucccuccagacacccaggga

SEQ ID NO: 516967 - RNA, 64 nt, Human
ugccuucucucagcucccaggccaacaguagccaaaccccuagagacagugaugccugcccgca

SEQ ID NO: 516968 - RNA, 64 nt, Human
aagagaaaaggcugcuugaugucagcagaaucuaaaccccuacauuaaagcuuugccucccauu

SEQ ID NO: 516969 - RNA, 64 nt, Human
aagaaauaaccuccaucccuaccccucagcacacaaccccuacgguaacagcacacugagcccu

SEQ ID NO: 516970 - RNA, 64 nt, Human
auuuccuuggggucuuucagagggugggggaacaaaccccuaugcacuuuucuuuuuuuuuuuu

SEQ ID NO: 516971 - RNA, 64 nt, Human
ccaguuugacuuucugcgcuucgaccacuaccucaaccccuacuauaaguucauccagaaagcc

SEQ ID NO: 516972 - RNA, 64 nt, Human
gggucagggaggcugcccccaggccuguauauuuaaccccuauguaccaggaguaaugaauagu

SEQ ID NO: 516973 - RNA, 64 nt, Human
aaaaaagauuacuuuccauuccuuuaggggaaaaaaccccuaaauagcuucauguuuccauaau

SEQ ID NO: 516974 - RNA, 64 nt, Human
auugcuuuuuuaaaaguuuacauaaguuuuuuuuaaccccuagaauuuaauauuuguagaugca

SEQ ID NO: 516975 - RNA, 64 nt, Human
uuaaauacaguuuuauuucaugaagagaaaugaaaaccccuacacugauaucuguuuucuaugg

SEQ ID NO: 516976 - RNA, 64 nt, Human
aagcagaaaaagaaaaaaaacacaaaaaauaaaaaaccccuacaaaaaaacuuuaaaaaaaaug

SEQ ID NO: 516977 - RNA, 64 nt, Human
cauuacauuuauuggccccccgaccuuguagaaaaaccccuacccucacaauaccuuauuuaag

SEQ ID NO: 516978 - RNA, 64 nt, Human
gccgcgccuccuggccaggcagggcgccugggagaaccccuacacugcccuggccuuugcagag

SEQ ID NO: 516979 - RNA, 64 nt, Human
aaucccuucaaggagcugaaggcaaaauguguaaaaccccuaaaucagauugaaaagccuauuu

SEQ ID NO: 516980 - RNA, 64 nt, Human
cuguauuucuuauaauuuuaacacuaugagcugccuguauaagaaaucaaguaaccagaaugca

SEQ ID NO: 516981 - RNA, 64 nt, Human
acuacugaaaagaucaauuuccagaagguuuauucuguauaaacuacauguuagucuucaguag

SEQ ID NO: 516982 - RNA, 64 nt, Human
uaauaauauacuuguggacuaaaagauauaagugcuguauaaaaucagccaauuauguuaaacu

SEQ ID NO: 516983 - RNA, 64 nt, Human
uagcugaggauaaugaacuuuuuuccucauucggcuguauaauacauaaccacagcaagacuga

SEQ ID NO: 516984 - RNA, 64 nt, Human
caccauguuucccauuucuguuaauacuucuaugaaccccuaaaguauugaagggaacuagcug

SEQ ID NO: 516985 - RNA, 64 nt, Human
aagcaaauaucacucagaugaaacaaagcagugaaaccccuacaguuuaaaugaugucacuuuu

SEQ ID NO: 516986 - RNA, 64 nt, Human
gagccucaauuuuauuuguaaagugauggaauaaaaccccuaaaaucuuacccaccucuaaaga

SEQ ID NO: 516987 - RNA, 64 nt, Human
uguggcccauggcaccacccccacggcccagcacaaccccuagagcaggaaagagggaagguac

SEQ ID NO: 516988 - RNA, 64 nt, Human
ugccuggggaccugaagagcaccggggaauuuguaaccccuauuuaagccugcaagugccuaag

SEQ ID NO: 516989 - RNA, 64 nt, Human
guauguauuuuuuuauuuauuauuuauuuauugaaaccccuacuuugauugacaaaggaaucaa

SEQ ID NO: 516990 - RNA, 64 nt, Human
agcagaagcggaaggccgcuuccuuucucagcugaaccccuacucccggagcccccagcagggc

SEQ ID NO: 516991 - RNA, 64 nt, Human
agcagaagcggaaggccgcuuccuuucucagcugaaccccuacccggagcccccagcagggccc

SEQ ID NO: 516992 - RNA, 64 nt, Human
ggcaccacccuccaugccuuugcagguaaguaggaaccccuagggcuugagcuaagagcaagcc

SEQ ID NO: 516993 - RNA, 64 nt, Human
acugaauugcgucaaauucauauguuggagcucuaaccccuaaugugacuguaauuggaaauaa

SEQ ID NO: 516994 - RNA, 64 nt, Human
ucuuuaaugcuuuuauauuuuuuuaaaauguuaaaaccccuauagccaccuuuugggaauguuu

SEQ ID NO: 516995 - RNA, 64 nt, Human
aacuugugggcagccugcguacuccaguccugcuaaccccuagcuuuuaauauaaaaguguuug

SEQ ID NO: 516996 - RNA, 64 nt, Human
aaaauuaaggggagagaggaaaacaaaaccaaccaaccccuaaaaucauuuucuuauuguacau

SEQ ID NO: 516997 - RNA, 64 nt, Human
ucaggagccaguuucuccagccccuccuccccacaaccccuaguggggaggggcagcuguccau

SEQ ID NO: 516998 - RNA, 64 nt, Human
gaggugucuacaaaugucuucaugaccuacuucaaaccccuacugaccuggcuggugacagaac

SEQ ID NO: 516999 - RNA, 64 nt, Human
acaugauuaacauucacuuauggauucaugauggcuguauaaagugaauuugaaauuucaaugg

SEQ ID NO: 517000 - RNA, 64 nt, Human
uaaaaaaugcccuauuguaaguuguugguuuauacuguauaaguaacacuaguagcuguuuuga

SEQ ID NO: 517001 - RNA, 64 nt, Human
caggaaugaaguagcugacacauauuuuuagacucuguauaauucagaacaguuauaaauauuu

SEQ ID NO: 517002 - RNA, 64 nt, Human
caguguuaacuggguaucaguuaugagucuacuacuguauaauggcauccaaaagaauuuuaaa

SEQ ID NO: 517003 - RNA, 64 nt, Human
uucuuuugaccaauuuuauuccuaagaauaaacaaaccccuacaguuaaaaugcaaagaugccu

SEQ ID NO: 517004 - RNA, 64 nt, Human
ggagaccgacguccuuuagcccucccaggccccacggcagcacuuaugguagcggcacugucuu

SEQ ID NO: 517005 - RNA, 64 nt, Human
ccagagugugcgcauuucagagcaugggauugaucggcagcaagaguaaagacacagcuccaga

SEQ ID NO: 517006 - RNA, 64 nt, Human
agagucgggggccugcccuggccggggucgcagucggcagcagcgugcaguccggcaucucccg

SEQ ID NO: 517007 - RNA, 64 nt, Human
gcagucccucuacuacaggcaguggaccuuggcccggcagcaccacgcugacuauagcaaccag

SEQ ID NO: 517008 - RNA, 64 nt, Human
aaggguuagggcaccaggaggggccagguggcgucggcagcaucuguccccagaaucaggcaga

SEQ ID NO: 517009 - RNA, 64 nt, Human
agcugcccauuaagggagaaggagaggauccggucggcagcagcccugagcagaaagcuggagg

SEQ ID NO: 517010 - RNA, 64 nt, Human
ucccccaggucauccuauccccaagagugaugcccggcagcauucccagcucagggcuaauggu

SEQ ID NO: 517011 - RNA, 64 nt, Human
ggcagaggagugacagccgcagacacacgacagccggcagcaacuggaauggcagcaauuaagg

SEQ ID NO: 517012 - RNA, 64 nt, Human
ggagacacgaggagggccugcccggaagucacaucggcagcagcugucuaaagggcuugggggc

SEQ ID NO: 517013 - RNA, 64 nt, Human
cuggacccccagugggcagggcaggagguggcagcggcagcagcuguguuucugcaccauuucc

SEQ ID NO: 517014 - RNA, 64 nt, Human
gcccugagccucccccaccaggacugggccuccccggcagcaagaccccggcacuccccgccag

SEQ ID NO: 517015 - RNA, 57 nt, Human; identical to SEQ ID NO: 266260

SEQ ID NO: 517016 - RNA, 64 nt, Human
cauuaugugacucuucauauaacccuuuuuucuacggcagcauuaaaauugucuuuuugcuaua

SEQ ID NO: 517017 - RNA, 62 nt, Human
gacaggugccgagcccugcauguggagcccucccaccccacccccagauagagggaaauaac

SEQ ID NO: 517018 - RNA, 62 nt, Human
gcucccuuugguuugggggucugccugaggucccaccccacuaaagggcuccccaggccugg

SEQ ID NO: 517019 - RNA, 62 nt, Human
gauccaggaaagaugucccacagggaccacauccaccccagccccacugcccuccagggcca

SEQ ID NO: 517020 - RNA, 64 nt, Human
uuuaugaaauacucagcuuaggcauuuuuacuuuaaccccuaaauugauuuuguaaaugccaca

SEQ ID NO: 517021 - RNA, 64 nt, Human
gauaaugauggccucucucaaaagagaaaaacaaaaccccuaagagacugcguucugcaagcau

SEQ ID NO: 517022 - RNA, 64 nt, Human
uaauuuuuaaaaggccugaacuauacuuugaagaaaccccuauagaaaaggaaagcuccagcua

SEQ ID NO: 517023 - RNA, 64 nt, Human
gaauuuggugagcgagauaaaaguccacggugucaaccccuaaaacaugggugaccguacauuu

SEQ ID NO: 517024 - RNA, 64 nt, Human
ccuggcccugccucauccaccaaucucuaagccaaaccccuaaacucaggagucaacguguuua

SEQ ID NO: 517025 - RNA, 54 nt, Human
aacaugaaaugacucacuagagaaaaccccuaugaguguugaacaugugagaaa

SEQ ID NO: 517026 - RNA, 64 nt, Human
cuuucgauaucaugaaaggacucacacuggagagaaccccuaugaguguaagcaauuugggaaa

SEQ ID NO: 517027 - RNA, 64 nt, Human
cucgugcagugggggaguucuggcuccccaaccuaaccccuagccgucaucuccacacucacca

SEQ ID NO: 517028 - RNA, 64 nt, Human
gcuuccucugucuuggcuaacgucugucccccugaaccccuaaccauaccccaagagcucccaa

SEQ ID NO: 517029 - RNA, 64 nt, Human
uggcccucgggggccucucgaggucagccucuccaaccccuaccucagcuccugucugcacuga

SEQ ID NO: 517030 - RNA, 64 nt, Human
cucuuucuuguauaugagagaacuuauauggagaaaccccuaggaauguaaucaguguuaggau

SEQ ID NO: 517031 - RNA, 64 nt, Human
uauggaccacauuagacugggcagagauucgcccaaccccuagcacuccggcucugggcuuucg

SEQ ID NO: 517032 - RNA, 64 nt, Human
cacaagcgcaccuaugggugccucgggacacaccaaccccuauacucacacacaggcauggaug

SEQ ID NO: 517033 - RNA, 64 nt, Human
cccagggccaccaucagacaacucccugcaugcaaaccccuaguacccucucacacccgcaccc

SEQ ID NO: 517034 - RNA, 64 nt, Human
gaugucugaguccucaaggugacuggggacuuggaaccccuaggaccugaacaaccaagacuuu

SEQ ID NO: 517035 - RNA, 64 nt, Human
acauaaacaaagugauuucacagggagaagaaagcuguauaaagcugcagcuuucaacagguuu

SEQ ID NO: 517036 - RNA, 64 nt, Human
caaucaauuuuaaagcuacaucuguauaaaauuucuguauaaagguguauuucuuuuuuaugag

SEQ ID NO: 517037 - RNA, 64 nt, Human
uuccuuugguuuacaaucaauuuuaaagcuacaucuguauaaaauuucuguauaaagguguauu

SEQ ID NO: 517038 - RNA, 64 nt, Human
agaagcaugucaaagcuauuuuuaaagagagaaacuguauaagauguuuacuucauagagauuu

SEQ ID NO: 517039 - RNA, 64 nt, Human
cacauuccuuguggauguggucaagucuguguuuaaccccuaagauguguccauugaggccaca

SEQ ID NO: 517040 - RNA, 64 nt, Human
cuaaagcauuuugaugucucauucuguguuugguaaccccuauaaacuggggcagaggaaaaga

SEQ ID NO: 517041 - RNA, 64 nt, Human
cuguguuccagaugcaugaaauugggugaggaauaaccccuagucuggaaucuuugugaagcau

SEQ ID NO: 517042 - RNA, 64 nt, Human
guugagguucucuacugccuccugaauacacaugaaccccuauaccaauuuuaagaaaaaaaug

SEQ ID NO: 517043 - RNA, 64 nt, Human
uacuucuuuugcucuuagcugucugcucagacagaaccccuacaugaaacagaaacaaaaacac

SEQ ID NO: 517044 - RNA, 64 nt, Human
aggagucugaucugcugggguacagggcugggagaaccccuagcucucccgggguguccucucc

SEQ ID NO: 517045 - RNA, 64 nt, Human
accauuaaccaggccccacccacaagguagaaacaaccccuagagucaacgagaaagucauuuu

SEQ ID NO: 517046 - RNA, 64 nt, Human
agggcaagccaacuagacaggcuggccaggacccaaccccuagaucccaccaacucggggaaca

SEQ ID NO: 517047 - RNA, 64 nt, Human
ucccaaauacauuaacaagcucuuacuucccccuaaccccuaugaacucuugauaacaccaaga

SEQ ID NO: 517048 - RNA, 64 nt, Human
ugcccgaccgacgacacagagacucuucugauccaaccccuagaaccgcguuggguuugugggu

SEQ ID NO: 517049 - RNA, 64 nt, Human
uaauuucuuuguauauuuaaaaauaaauaugaaaaaccccuaaauuacagaauuggaauuugug

SEQ ID NO: 517050 - RNA, 64 nt, Human
cucagccugcucuucucucugguggcuccaccccaaccccuacuucuuuuccuuuauuucucuc

SEQ ID NO: 517051 - RNA, 64 nt, Human
agcgcccagccuggccccaagcauggaaacgcacaaccccuaaucgcccugagcuacugcuucu

SEQ ID NO: 517052 - RNA, 64 nt, Human
aaagugugcuuuauaaaaaaaaguuguuuauaaaaaccccuaaaaacaaaacaaacacacacac

SEQ ID NO: 517053 - RNA, 64 nt, Human
gauucagccagcauggauaauaacccagauaacuaaccccuaccucacaggauaaaaaggauua

SEQ ID NO: 517054 - RNA, 64 nt, Human
auauauuucacuuugacuuuagaccuuuugaagucuguauaaacuuguuuugaaauacagucuc

SEQ ID NO: 517055 - RNA, 64 nt, Human
agacaguggcauaaucagugauaucuuuuauaugcuguauaaauguauaaaauauaaggauuac

SEQ ID NO: 517056 - RNA, 64 nt, Human
aaaucaaauuauuaugcugaagggaaaaauauaccuguauaagaaugguguguuuggcuaaugu

SEQ ID NO: 517057 - RNA, 64 nt, Human
uuacuaggcuuagcuuccaaauuaugcuuuauagcuguauaaacaucgugauuauauucaucua

SEQ ID NO: 517058 - RNA, 64 nt, Human
ccgaggaagggucaaccuauucucucucaaagccaaccccuaggccaauugccuggaucuccuc

SEQ ID NO: 517059 - RNA, 64 nt, Human
uaccugcacaaagcagagaacuucauaaaacauuaaccccuaauucacucuucuuaaauagcuu

SEQ ID NO: 517060 - RNA, 60 nt, Human
acaaggcaaagggcaagugaggcugacguccggcccaagugggcccagcccggcccgcgu

SEQ ID NO: 517061 - RNA, 64 nt, Human
gcugcggugcaggcaccuggccaugcuggcugggcggcccaagcacagcccugacuaggaugac

SEQ ID NO: 517062 - RNA, 64 nt, Human
ccccuaagucucugcucaaaaaaaaaacaauucucggcccaaagaaaacaaucagaagaauuca

SEQ ID NO: 517063 - RNA, 64 nt, Human
aagugcuggaauuacaggcaugagccaccgcgcccggcccaaucauguguuuuuguugaaauga

SEQ ID NO: 517064 - RNA, 64 nt, Human
gcagcagcacggccuagcccaacccagcccaacccggcccaacccagcccagcccagcucagcu

SEQ ID NO: 517065 - RNA, 64 nt, Human
cccccagccuggaccccgccggccgcgggucucccggcccaaccccaccgacccagaccaagac

SEQ ID NO: 517066 - RNA, 64 nt, Human
gugauauuucagcuuggacauuuuacccuucagucggcccaagaaaucaaaauaaaggaaacac

SEQ ID NO: 517067 - RNA, 64 nt, Human
uuuguggcucuuaucuuguggaccauaaauaacacggcccaauaacucuuuguguuuauggagu

SEQ ID NO: 517068 - RNA, 64 nt, Human
uugaagagcaugguccuucagaaaaggcaauaaacggcccaacuagugcuucuggcgaugacau

SEQ ID NO: 517069 - RNA, 64 nt, Human
aaggcuuccuggguuugcaacacuaacggccauccggcccaaggaugccaggaucugcaaagca

SEQ ID NO: 517070 - RNA, 64 nt, Human
uagucgagauuguauuuauauuuuccuguuacuacuguauaaagcuuaaaccuacuuaaacaac

SEQ ID NO: 517071 - RNA, 64 nt, Human
ucugcauuguaaaaaaauuaaaucacauuuagugcuguauaauuugcaugcaauaaaauucaau

SEQ ID NO: 517072 - RNA, 64 nt, Human
agaaaugacauaaaauacgugcuuucucagguuacuguauaacuguuauaauauauuuaauaua

SEQ ID NO: 517073 - RNA, 64 nt, Human
gaacacugguggcugagaugcuauaaaaacagcucggcccaacagacacuuccccuggguugca

SEQ ID NO: 517074 - RNA, 64 nt, Human
ccacaaggggcaggugggggcuugguugcugacccggcccaaguccccacagagcaccuucugu

SEQ ID NO: 517075 - RNA, 64 nt, Human
acacuggaagaagagaguuucuaaucagaugcaacggcccaaauucuugaucugcagcuucucu

SEQ ID NO: 517076 - RNA, 64 nt, Human
auuccuaaaggaaucugaccauuuuacgucucuacggcccaaaaaaagacaaaaauaaaaauuc

SEQ ID NO: 517077 - RNA, 64 nt, Human
gccaggacgguguggcgccagccuugaagcaccacggcccaaggaugcgguguacauacuguau

SEQ ID NO: 517078 - RNA, 54 nt, Human
aggaaggcgacagccccuaggggccggcccaacuuagacgcggcucuccuccgg

SEQ ID NO: 517079 - RNA, 64 nt, Human
ccgagugcugugcacggaagaaacaaagacaucccggcccaaggcgcagcgggagcgcacaggu

SEQ ID NO: 517080 - RNA, 64 nt, Human
ggagggcgggccuuggccccgagugaaggcgcggcggcccaaccggcgugagagcgcggggccg

SEQ ID NO: 517081 - RNA, 64 nt, Human
aaagugcugggauuaaggcgugagccacugcgcccggcccaagagaauaggggagccaaggagg

SEQ ID NO: 517082 - RNA, 64 nt, Human
uuuccuucccaccacagagguggacgagugcucucggcccaaccgcgggggcugugagcagcgg

SEQ ID NO: 517083 - RNA, 64 nt, Human
gggccgcacagcgcggcugggaccgauucggugacggcccaaggaagcugggcucagggcucgc

SEQ ID NO: 517084 - RNA, 59 nt, Human
gggcauccacggcccuguaaacaggucaacggcccaagggccuccugcccuguccugcc

SEQ ID NO: 517085 - RNA, 64 nt, Human
gaggcccgcaugcggcccaggauggcuuugaaugcggcccaacgcaaauucgcaaacuuucuua

SEQ ID NO: 517086 - RNA, 64 nt, Human
ucagaggucucuaucccaucccuuccuguuacugcggcccaaggacaggaaacaacuuuuccaa

SEQ ID NO: 517087 - RNA, 64 nt, Human
cucugauggaccauuuuccauuuaagacauuuuccuguauaagacaguuuuauagcugguuccu

SEQ ID NO: 517088 - RNA, 64 nt, Human
acauaauuucugacggaaaaccuguacccugaugcuguauaauguauguugaauguggucccag

SEQ ID NO: 517089 - RNA, 64 nt, Human
gaaaacugucccuuuccaggugggagcuuaacaccuguauaaaaccuaagguuuugguaaguac

SEQ ID NO: 517090 - RNA, 64 nt, Human
gaaacaugacauuuaaaaaaacuaugaaauaauacuguauaagcauuccauauuucuauaucuu

SEQ ID NO: 517091 - RNA, 64 nt, Human
cuccaucuaaaauuccuagggcaagcuuccaacccggcccaagggccgcauguggcccaggaua

SEQ ID NO: 517092 - RNA, 64 nt, Human
aucaguccauagagacgaacagaaugagaccuuccggcccaagcguggcgcugcgggcacuuug

SEQ ID NO: 517093 - RNA, 64 nt, Human
gcccgcccacuguccugggcgcccuggaagccggcggcccaagcccgacuugcuguuuuguucu

SEQ ID NO: 517094 - RNA, 64 nt, Human
aagugcugggauuacaggcgugagccaccaugcccggcccaaauauuuuuuauucaggauggua

SEQ ID NO: 517095 - RNA, 64 nt, Human
cucagcguugccaggugugcugccaucugcuguucggcccaaccucagagugaaggcagggugg

SEQ ID NO: 517096 - RNA, 64 nt, Human
aagugcugggauuacaggcgugagccaccgugcccggcccaaaggggaaacucuugugggagga

SEQ ID NO: 517097 - RNA, 64 nt, Human
augggaaacguaugugugcaggagccucccugcacggcccaaggggcuucguuuucagucuucu

SEQ ID NO: 517098 - RNA, 64 nt, Human
aagugcugggauuacgggcgugagccaccgugcucggcccaaggcaggagaaucucuugaagcc

SEQ ID NO: 517099 - RNA, 64 nt, Human
cugugcccuugccggcggcagguugcagccaccgcggcccaaugucaccuucacucacagucug

SEQ ID NO: 517100 - RNA, 64 nt, Human
cgcccucuuggguggccagcguuccuacugcagacggcccaacauccagucuuuccccaggaca

SEQ ID NO: 517101 - RNA, 64 nt, Human
augaauaaauugaggcacagaaagauuaaguuaccggcccaaggugacacagugaggagguggc

SEQ ID NO: 517102 - RNA, 64 nt, Human
ccuucugcauuuccucccggagucacugguuucucggcccaaaccaugcuccccagcaguggca

SEQ ID NO: 517103 - RNA, 64 nt, Human
gagggccucacugugcgggaccuggccuucugcacggcccaaggagaaccuggaggccaccacu

SEQ ID NO: 517104 - RNA, 64 nt, Human
aagaacaacccugacggcugcccucccucuuauucggcccaaggacuugaagcccggcaucuuc

SEQ ID NO: 517105 - RNA, 64 nt, Human
ugccaacucuggcgaauguaggaccucugaguggcuguauaauuguuaauucaaaugaaauuca

SEQ ID NO: 517106 - RNA, 64 nt, Human
uuuuccuuuuuauuucuuuauuuuuucuuuuuuacuguauaaugucccucaaguuuauggcagu

SEQ ID NO: 517107 - RNA, 64 nt, Human
uguuuuauaaugaaauaacugcaacuagagaaaacuguauaaaaacauuaaauugucaguauuu

SEQ ID NO: 517108 - RNA, 64 nt, Human
caccuccucccucucccuucaccucaccccugcccggcccaagcucuacuuguguacaguguau

SEQ ID NO: 517109 - RNA, 64 nt, Human
uuuacccggcaugcacucuucagauaagccaugucggcccaaaucugaguaacuuuauauaaau

SEQ ID NO: 517110 - RNA, 64 nt, Human
gucccaaagaguuugaugaggcccuccacaccugcggcccaauccaaggugggguggaagcuug

SEQ ID NO: 517111 - RNA, 64 nt, Human
ccuuccagcccugagcccgcccagaggagcccagcggcccaagagcccgugccacccccagccc

SEQ ID NO: 517112 - RNA, 64 nt, Human
cacaagagccacauccucacaccugacagaugcacggcccaaggggcugcagcccuguugcaau

SEQ ID NO: 517113 - RNA, 64 nt, Human
ugcuggggaguuccccccuccgagcccuccuucccggcccaaccugagggauguggauuuggga

SEQ ID NO: 517114 - RNA, 64 nt, Human
ugggguccccccucccuguaaugcacuccugccccggcccaaccucgcccucucucaccagccu

SEQ ID NO: 517115 - RNA, 64 nt, Human
gggaccccacuccgagggcagcucccggccuugccggcccaauaaaggacuucagaaguguucc

SEQ ID NO: 517116 - RNA, 64 nt, Human
guuccgcaagaggaugaugcuggccuaccgcuuccggcccaacccccugguacgcauguccucc

SEQ ID NO: 517117 - RNA, 64 nt, Human
aagugcugugauuacaggcuuaagccacagcgcccggcccaaaguguucuuuuuuccuugaaaa

SEQ ID NO: 517118 - RNA, 64 nt, Human
uccugcguaaaccgggcgcucaggcgcuuggacccggcccaagauuugacuccgguucucaccc

SEQ ID NO: 517119 - RNA, 64 nt, Human
ggagaccacccccgagcuugccucagggccaagccggcccaacccaaccacucggggcccccau

SEQ ID NO: 517120 - RNA, 64 nt, Human
gagaagagacuagcaaaaagcugcagagaggauucggcccaaacucagaacuguuccccugagg

SEQ ID NO: 517121 - RNA, 64 nt, Human
cccaccccacguacagcaagggacuccccaggugcggcccaaggcuccggaccacacuggcccc

SEQ ID NO: 517122 - RNA, 52 nt, Human; identical to SEQ ID NO: 271937

SEQ ID NO: 517123 - RNA, 62 nt, Human
ggccugaacucggacaagugaucgccacccccccaccccaggcccugccagagcagggggac

SEQ ID NO: 517124 - RNA, 62 nt, Human
agcuuaaggcccaggacuguggaguguguggaccaccccacagaggagggacucagauuuau

SEQ ID NO: 517125 - RNA, 62 nt, Human
ggccucaccucccagggcuacacagacccugcccaccccaucccuggcugaccugcugugga

SEQ ID NO: 517126 - RNA, 64 nt, Human
gccugaaccaagaggccaggagcccccaugggccgcccaguaccaugcacacuccugucccgaa

SEQ ID NO: 517127 - RNA, 64 nt, Human
gcaaaaaacacaaaaccucacaacugccuggcaagcccaguaucacuuguuugggcccuagcgg

SEQ ID NO: 517128 - RNA, 64 nt, Human
ggucagugggacuuagggaucuuucaccugcugugcccaguaguucugaagucugcuuguggag

SEQ ID NO: 517129 - RNA, 64 nt, Human
guccuguccuggcacuggcacaagcucagcacaugcccaguaaugcguguuguuuggcugaugg

SEQ ID NO: 517130 - RNA, 64 nt, Human
ccuuugcugggucccuaccccagcuccgugugaugcccaguaaagccugaaccaugccugccau

SEQ ID NO: 517131 - RNA, 64 nt, Human
uccagccccgcuucagccacaugcuccagcugcugcccaguaaagcccugugccuuuuuuuccc

SEQ ID NO: 517132 - RNA, 64 nt, Human
agaguccacuccagcucagcaggaaaguggaauugcccaguacugccugccagcugggucuccc

SEQ ID NO: 517133 - RNA, 64 nt, Human
gugcagcgcagcuuggacaaaacacauuucaagugcccaguagucagugucuauaguguuggac

SEQ ID NO: 517134 - RNA, 64 nt, Human
ccccaggugggcugaggggcagggagccggcugugcccaguaugccuccuggacccuccaguuc

SEQ ID NO: 517135 - RNA, 64 nt, Human
auaagagguuaaaauaacaguucgcccaauuuaagcccaguagugucaguuuuccuaaucucag

SEQ ID NO: 517136 - RNA, 64 nt, Human
uuuaaaggaacagagaaauauuuguaauuaaucugcccaguaaauaccagcucguagcaguugg

SEQ ID NO: 517137 - RNA, 64 nt, Human
uuuuuuaggcuuagagacagaaacuuuagcauuggcccaguaguggcuucuagcucuaaauguu

SEQ ID NO: 517138 - RNA, 64 nt, Human
cacuccaagcagccucagcagaagaagcagccaugcccaguauucccacucuccaaaaggaacu

SEQ ID NO: 517139 - RNA, 64 nt, Human
cuagaggccucuugugacuggagguaacaacccugcccaguaacugugggagaaggggaucaau

SEQ ID NO: 517140 - RNA, 64 nt, Human
uucucuuuuucauucauauaccauuuuaugaguucuguauaauuuuuugugguuuuuguuuugu

SEQ ID NO: 517141 - RNA, 64 nt, Human
uccuucucauuuaaugcuuauggccuucacauuucuguauaauaaagaucaauuaucagcucuc

SEQ ID NO: 517142 - RNA, 64 nt, Human
agcucagagacuggcagugagagcccagaaggaccuguauaaaaugaaucuggagcuuuacauu

SEQ ID NO: 517143 - RNA, 64 nt, Human
uuuuuuaauagaccaaacccuaaucucuacaggggcccaguacaguuguuuggccuaccugaug

SEQ ID NO: 517144 - RNA, 64 nt, Human
uccaaaguccaaggggcagauggccagaugcacugcccaguaaggcaggaagccaaagaggcag

SEQ ID NO: 517145 - RNA, 64 nt, Human
cggaggccaggcccuccugcuggcugaggcuugggcccaguagccccaauaugguggcccuggg

SEQ ID NO: 517146 - RNA, 64 nt, Human
agauuuucaucaggaaaggagcacugugggaagagcccaguauucacauuuuuuccccauuuuu

SEQ ID NO: 517147 - RNA, 64 nt, Human
uuuugcacauguuuccucuaguucuuuguucauagcccaguagaccuuguuacuucugagguaa

SEQ ID NO: 517148 - RNA, 64 nt, Human
caagaaucuggcucucauucuaagaggcugugcugcccaguauggugguugugauaaaucuaaa

SEQ ID NO: 517149 - RNA, 64 nt, Human
auuuuuuaaaaggugguuaaaauugccuuuaauugcccaguagacuaauuccacagucagaaca

SEQ ID NO: 517150 - RNA, 64 nt, Human
aaaggcauuagagucaacuacacaaagcaggcuugcccaguacauuuaaauuuuuuggcacuug

SEQ ID NO: 517151 - RNA, 64 nt, Human
gucagcaaguuugaugccuagucuaucugacauggcccaguagaacagggcauugauggaucac

SEQ ID NO: 517152 - RNA, 64 nt, Human
aauugcuggguuauaaaaucuuagguuugcuuaugcccaguagcuccugcggaggcuuaauaau

SEQ ID NO: 517153 - RNA, 64 nt, Human
gaaccuccccuuuggcuaaccgagccccugaaaugcccaguacugccauuugacaugaggguac

SEQ ID NO: 517154 - RNA, 64 nt, Human
auguuaauaacaauggaauuggagcauuuaaccagcccaguaugacuuccaaaagaagagacuu

SEQ ID NO: 517155 - RNA, 64 nt, Human
ugaugcucucaaacugcaucuuuuauuucauguugcccaguaaaaguauacaaauucccugcac

SEQ ID NO: 517156 - RNA, 64 nt, Human
aggcugcuggucccaaccucagagccccaccgcagcccaguagggaugcagcacgccccagagg

SEQ ID NO: 517157 - RNA, 64 nt, Human
cuugucuaaaauuucuuuguguucccagugucuugcccaguagauacaagauaaauauugccag

SEQ ID NO: 517158 - RNA, 64 nt, Human
uguguuuuuaguaauguguacugugagcugucuucuguauaauguauuuuguaauguauuuuuc

SEQ ID NO: 517159 - RNA, 64 nt, Human
auccaagugugaucgaaagcuguuaaugugcucucuguauaaacaauuugcuccaaauauuuug

SEQ ID NO: 517160 - RNA, 64 nt, Human
ccauucugcaaaguguauugauguguauagugaucuguauaaagucaguaguucuuagcugaac

SEQ ID NO: 517161 - RNA, 64 nt, Human
ccacagaagcugcaugguuaaaauagcggccugugcccaguacagaaagguguuacuaaccagu

SEQ ID NO: 517162 - RNA, 64 nt, Human
cuagaccaacuggaucagaagcucugggggugaggcccaguauucuguguuuuaacaagcccgu

SEQ ID NO: 517163 - RNA, 64 nt, Human
uccagccccacacccucauuuauaccaauuaccugcccaguaacuguggacuuuugcuuccuca

SEQ ID NO: 517164 - RNA, 64 nt, Human
auauuuuuauaugaaucaucuccucuguggucuugcccaguaccauccaguggagcuuucugca

SEQ ID NO: 517165 - RNA, 64 nt, Human
acucuuccacauucccaaguuggucuagugugcugcccaguagcaaaccauggcagacucacca

SEQ ID NO: 517166 - RNA, 64 nt, Human
uuguguucucauacuuuucugucacuguaagccugcccaguaggcaguguuuugcagacuuugg

SEQ ID NO: 517167 - RNA, 64 nt, Human
caaacauugauaguagggacuccauggaauauuugcccaguaaugguaagaaaucuuucgggua

SEQ ID NO: 517168 - RNA, 64 nt, Human
gaaugaggcauggaccuguuccucagaguuuauggcccaguagacauaauuguauuaggacuuu

SEQ ID NO: 517169 - RNA, 64 nt, Human
cuggcagugacuaaucaguaaaugaugucgguuugcccaguaucacuuaucuucuguauuuuuc

SEQ ID NO: 517170 - RNA, 64 nt, Human
ucuccuaagaguuagggcauuguccuacacauuggcccaguaucacagccaagacgagaaguca

SEQ ID NO: 517171 - RNA, 64 nt, Human
ucacugguccacuggcuugagacucaccccgucugcccaguaaaagccuuucugcagcagcuga

SEQ ID NO: 517172 - RNA, 64 nt, Human
aacugauucuucucaguuuucucauuuuaaaacagcccaguauuccuuuguauccucaaggguc

SEQ ID NO: 517173 - RNA, 64 nt, Human
gacuggccauuaugcauccccuuuucuuuccagugcccaguaugcuguuuugaggugucaaaua

SEQ ID NO: 517174 - RNA, 64 nt, Human
uaaguggaaaucaggauuguuaugaagacuuaaggcccaguauuuuugaauacaauacucaucu

SEQ ID NO: 517175 - RNA, 64 nt, Human
ucauauuuaaugaauuauaguauaaugcuugcaggcccaguacaagcauauauauugugccucu

SEQ ID NO: 517176 - RNA, 64 nt, Human
aaaaaagguuucccaaaacaaucuauuuaaaaaacuguauaaggagauucuguguauuaacaug

SEQ ID NO: 517177 - RNA, 64 nt, Human
aucuuucuaggaaaaaaaaaaaaaagagagagagcuguauaaugauuuuucguuuacaugcuga

SEQ ID NO: 517178 - RNA, 64 nt, Human
aacuuuuucuaaaaauggccauuguuuaugaaaucuguauaaguguguccuuauacaaauuuua

SEQ ID NO: 517179 - RNA, 64 nt, Human
cuguuuggccuggcucuuaauuugcuuuuguuuugcccaguauagacucggaaguaacaguuau

SEQ ID NO: 517180 - RNA, 64 nt, Human
aaccugcuguuuaacaucagggugaccacauuaagcccaguauuccaguuggcaccagaagaua

SEQ ID NO: 517181 - RNA, 64 nt, Human
ggcccuguaggguugagccacagacagcucuucagcccaguagcaguggagcaggcccuguccu

SEQ ID NO: 517182 - RNA, 64 nt, Human
guauguuaccuuuuuacucaaaggaguccccccugcccaguaacaguccuauuaguguuuaauu

SEQ ID NO: 517183 - RNA, 64 nt, Human
gggauacacggugcacccugcaacuuauaccugagcccaguacaacaaaggugacgggugugua

SEQ ID NO: 517184 - RNA, 64 nt, Human
gcucaacauggcuugacauggugggcacacuggcgcccaguaagagagagagagagccaaagcu

SEQ ID NO: 517185 - RNA, 64 nt, Human
ccggcucccaguggggcaggccucgcugcagaaugcccaguaguacugcggccaaggggacagu

SEQ ID NO: 517186 - RNA, 64 nt, Human
uaacgaacucauuugcucacuccuugacagcaaagcccaguacguacaauuguguugggugugg

SEQ ID NO: 517187 - RNA, 64 nt, Human
ucagaaaucuuauuauuuaacccagaaguaaucagcccaguaguaacuuagguuuaauuuuuuu

SEQ ID NO: 517188 - RNA, 64 nt, Human
aagaaggagaaacauugcaguggcuacuguguuggcccaguagaaauugacaguauuuuguaua

SEQ ID NO: 517189 - RNA, 64 nt, Human
aauguuugaaugaucacaaauuaagacauuaucagcccaguaaauuucuugcuuaauguuuuuc

SEQ ID NO: 517190 - RNA, 64 nt, Human
ucuguccaucguguacgcuauucuagugcuuguggcccaguacugucuaugaguugucgugcuc

SEQ ID NO: 517191 - RNA, 64 nt, Human
ugcccaccagcugcuagcccuaggaaggccaggagcccaguagccauguggccagucuaccaug

SEQ ID NO: 517192 - RNA, 64 nt, Human
ucaagcugcugaaggagggucaccgcauggacaagcccaguaacugcaccaacgagcuguaagc

SEQ ID NO: 517193 - RNA, 64 nt, Human
auucaguucuaggccuuuccucugcacgcucaaugcccaguaaaauuucaggauuaacuaaaga

SEQ ID NO: 517194 - RNA, 64 nt, Human
aacccaaauaaauacaaguucaaauuuauguagacuguauaagauuauaauaaaacaugucuga

SEQ ID NO: 517195 - RNA, 64 nt, Human
uuugagguucauuaacaacauagaaagccuugaacuguauaaccagcuagauuccuuaauaauu

SEQ ID NO: 517196 - RNA, 64 nt, Human
cccuuaguaaucccccuugccaaauuccaugucccuguauaauucuacaggauggggacacuaa

SEQ ID NO: 517197 - RNA, 64 nt, Human
aggaaggcaaaagaguaaaaauuaaaaaggccaggcccaguaaguguaccuuguacuuuauaaa

SEQ ID NO: 517198 - RNA, 64 nt, Human
ugaugcaugggccucagucacagaggagcugggugcccaguacccuugggugcagguuugugag

SEQ ID NO: 517199 - RNA, 64 nt, Human
cuggccgcgguucuggaagguggugagcauugaggcccaguaagacacucauguggcuaguguu

SEQ ID NO: 517200 - RNA, 64 nt, Human
aguucuauggauaugagcagaucccuuuacuggagcccaguaugugcugugugaguuagaaguc

SEQ ID NO: 517201 - RNA, 64 nt, Human
guagaggacaagauuuauuuucuuuccucccuuugcccaguagccacaucugguuuacucaggc

SEQ ID NO: 517202 - RNA, 64 nt, Human
auuuguaaaacuguaaauaagagcuuuuguacuagcccaguauuuauuuacauugcuuuguaau

SEQ ID NO: 517203 - RNA, 64 nt, Human
guagaugugagugaaaaacugcaugccuuuagaagcccaguaucagaacuugcuacguuucagg

SEQ ID NO: 517204 - RNA, 64 nt, Human
cuugaagggcaaggagggaaacaguguuaccagagcccaguaagaacugcugucaugaaggagg

SEQ ID NO: 517205 - RNA, 64 nt, Human
agccuuggugaggacaguguugggaggcccaggggcccaguaaagugcauuugacauugaaccu

SEQ ID NO: 517206 - RNA, 64 nt, Human
guguacgcuaguuuucauuuuugcagugugguucgcccaguagucuuguggaugccagagacau

SEQ ID NO: 517207 - RNA, 64 nt, Human
ucaauauauuuuuucuaaaauccaacuucugaccgcccaguaggaagaaaaaugagacauuuuu

SEQ ID NO: 517208 - RNA, 64 nt, Human
ugggcacuagacuuuucuauuggccugugccaucgcccaguauuagcacaaguuagggaggaag

SEQ ID NO: 517209 - RNA, 64 nt, Human
ggcagggagaguagggagagaaaaccuuccagcagcccaguaaacugcgggcgaagagaucuac

SEQ ID NO: 517210 - RNA, 64 nt, Human
agccacugacagguauccccugaaacugagcugagcccaguauccaaggauuccucugucugau

SEQ ID NO: 517211 - RNA, 64 nt, Human
acccuuugacuuuuauaaucaacauaaguuccaggcccaguauggauuuacaaaaucuguguca

SEQ ID NO: 517212 - RNA, 64 nt, Human
auauaaaaucauuguuguucauagaaaauuucaucuguauaagcaguuggauugaagcuuagcu

SEQ ID NO: 517213 - RNA, 64 nt, Human
aaaguauauguaaugaugcuacaguaauguauuucuguauaacaaaugacuccaaacuuacgac

SEQ ID NO: 517214 - RNA, 64 nt, Human
auggcugcuuccaaguuguuugcaauuaaagguucuguauaaaaccaagcccucugugugucgu

SEQ ID NO: 517215 - RNA, 64 nt, Human
cuuccugccaagccagggacuaagcagcccagaagcccaguaacugcccuuucccugcauaugc

SEQ ID NO: 517216 - RNA, 64 nt, Human
ugugcaaagaagcuaaagaaaaggaauaagcccugcccaguauguagacaaccaauucaaauga

SEQ ID NO: 517217 - RNA, 64 nt, Human
aaacaaugcacugaguugacucaacuacuggaaagcccaguaaugaagcucccaaaugggaaac

SEQ ID NO: 517218 - RNA, 64 nt, Human
uuguggaaggcgugccguugagggggaaaacgaagcccaguauuugcuacuguuuuuccuuuuu

SEQ ID NO: 517219 - RNA, 64 nt, Human
ucuaguuccucacucuuccuuuucagaaccugaugcccaguagggguuguccuggugacacccc

SEQ ID NO: 517220 - RNA, 64 nt, Human
cuacugggcucaagccuuccucccgccucagccugcccaguaacugguacuacagaugugcaca

SEQ ID NO: 517221 - RNA, 64 nt, Human
aaauuaauguuaauauggaaaugcauuuagagaagcccaguaguuuuuauuguuggauuuuuga

SEQ ID NO: 517222 - RNA, 64 nt, Human
ucauuugugaaguccacuacgagguacuucaaaagcccaguaaugguggucagauaccauguag

SEQ ID NO: 517223 - RNA, 64 nt, Human
ccaaauuuaaagcuagaugaggaguugccacugggcccaguaagauggaauuucagugagauau

SEQ ID NO: 517224 - RNA, 64 nt, Human
ucaccaucugucaccuucccuugcagcuuaaggagcccaguaaguuuugaaaauguuugcgaau

SEQ ID NO: 517225 - RNA, 64 nt, Human
uuuauuaaacuguccagugaaaaggugccacaaugcccaguauuguaaacaacagguuugcauu

SEQ ID NO: 517226 - RNA, 64 nt, Human
uuguuccugucaaucaaugguuuauuggaagguggcccaguaugagcccuagaagagugugaaa

SEQ ID NO: 517227 - RNA, 64 nt, Human
ugggacaccauagccacugcccccuccccuggaugcccaguaauguaugucuacuggugggaga

SEQ ID NO: 517228 - RNA, 64 nt, Human
agugaugguuggcuugaguaccuuuuuaaaucuagcccaguauaaacauuagccugcuuaauau

SEQ ID NO: 517229 - RNA, 64 nt, Human
aagcauaggagcauugggaaugagagggaacugugcccaguauacuguuuuuuuucuuccucca

SEQ ID NO: 517230 - RNA, 64 nt, Human
uaucauguaaaaacuacauaaggugguugugcuacuguauaauugggggugauaauaccaggaa

SEQ ID NO: 517231 - RNA, 64 nt, Human
aaauaagccuaaaagaagaaaaacaaaaaaaauucuguauaaaacuguaauccuuuguauucau

SEQ ID NO: 517232 - RNA, 64 nt, Human
cauaaauggaggucaauuugauuguccugaccuacuguauaaguaaauuucaaaugucauuacu

SEQ ID NO: 517233 - RNA, 64 nt, Human
uggaaaaacaggauacgaugacugacacucagaugcccaguaucauacguugauaguuuacaaa

SEQ ID NO: 517234 - RNA, 64 nt, Human
gagaagcucugaagaacucucuggaagccccugggcccaguaccuagcuggcucugugagggug

SEQ ID NO: 517235 - RNA, 64 nt, Human
ugggguuuaaaaacaugaggcuuuccaaguucuugcccaguaucuggggcagccuccagaguau

SEQ ID NO: 517236 - RNA, 64 nt, Human
ccugcucuucagcuccugcucccagggcucccuggcccaguacagcugugcggacccccagugg

SEQ ID NO: 517237 - RNA, 64 nt, Human
gaccgcucuuggcuccugacucccaggguacagcgcccaguaacucauccuucauucagagguu

SEQ ID NO: 517238 - RNA, 64 nt, Human
ggagcugaaucggaugccaccaaggcucgguccagcccaguaccgcuggaagugaauaaacucc

SEQ ID NO: 517239 - RNA, 64 nt, Human
ugaaaccaaacaggccucucgcucacuccucccagcccaguaaugcugaggaguucaguuguga

SEQ ID NO: 517240 - RNA, 64 nt, Human
uuccgcaccagagggacacuccacagaagccacagcccaguaagucaggcgcuucugcggcggc

SEQ ID NO: 517241 - RNA, 64 nt, Human
cgaaagcauugccagcugcccguuuccucccauggcccaguaugaggccagcaggggacauuug

SEQ ID NO: 517242 - RNA, 64 nt, Human
auguagguuaccgggcaugacccggcagaugcuugcccaguaguucuggaggaaggcccgggaa

SEQ ID NO: 517243 - RNA, 64 nt, Human
uagucccgagcucaggaaaugagagccuauaagugcccaguacauguuuaaaagaagagcucau

SEQ ID NO: 517244 - RNA, 64 nt, Human
gccacccgcuaugagcacaggccggggguggaaggcccaguagagcugcccuuccccagaugga

SEQ ID NO: 517245 - RNA, 64 nt, Human
uuaacaagggcuuaguacacgcuugcuguucugugcccaguaugugggcggaugacgcaagacu

SEQ ID NO: 517246 - RNA, 64 nt, Human
gcugucacgugaccagugacccacacucucugcugcccaguacugccaaguggggaggguccug

SEQ ID NO: 517247 - RNA, 64 nt, Human
agaaucucuggaaugcaccguggcagaaaccgaggcccaguacagcucccagcuggcccaaauu

SEQ ID NO: 517248 - RNA, 64 nt, Human
aaaucauguuuuuuccuuaaaaagauuguaaauugugcaacaaagaugcauuuaccucuguacc

SEQ ID NO: 517249 - RNA, 64 nt, Human
uguggugacuacagacuagaggaaugcucuacaggugcaacagguucagguguuugcugacguc

SEQ ID NO: 517250 - RNA, 64 nt, Human
cuggacuuggagagaagggcgugccacccuugcugugcaacaugggagagaaguucuuauuguu

SEQ ID NO: 517251 - RNA, 64 nt, Human
acccaugccucccagcugagcacugggaaugucagcccaguaaguauuggccagucaggcgccu

SEQ ID NO: 517252 - RNA, 64 nt, Human
uucacugucuugucuggugucuaguauuaauguugcccaguaagcaccucucucccuuuuuuuu

SEQ ID NO: 517253 - RNA, 64 nt, Human
acauucucaaguuuuucucaucugcauuagaggugcccaguagguucccagguuccagcgugcc

SEQ ID NO: 517254 - RNA, 64 nt, Human
agcauggauuuauugagugccaacugcgugccaggcccaguacggaggacgcuggggaaauggu

SEQ ID NO: 517255 - RNA, 64 nt, Human
guccggccuggccucccccaggaccgagaucaccgcccaguaugggcuagagcaggucuucauc

SEQ ID NO: 517256 - RNA, 64 nt, Human
agucucucuucagcugugacuuauccaccacauagcccaguaagucuucaguuuuggcugggca

SEQ ID NO: 517257 - RNA, 64 nt, Human
uauauuuaauaagaaagaaaguaucauguaaacagcccaguaauaaaauuuuacaaucuuauaa

SEQ ID NO: 517258 - RNA, 64 nt, Human
uauacaggaaucuacaucccucugugacugcuucgcccaguagaauaugguagacguacugcug

SEQ ID NO: 517259 - RNA, 64 nt, Human
cauuuuacaaaacccacuguucuacuguuguauugcccaguaggagcuaucacuauauuuugca

SEQ ID NO: 517260 - RNA, 64 nt, Human
caaacacuagaauagacuggccugaaauccccuugcccaguagaauggacugaucuaugugcac

SEQ ID NO: 517261 - RNA, 52 nt, Human
cacaacgcagggacuccuaggggcccaguaaggacagugcccgccagggacc

SEQ ID NO: 517262 - RNA, 64 nt, Human
uuucaaaguaguaaacuuuucuauuuuucuacuugcccaguagagacucugauucuggaaauuc

SEQ ID NO: 517263 - RNA, 64 nt, Human
cuacauugaguacacgccggccagcccggccuacgcccaguacccaccggccaccuaugaccag

SEQ ID NO: 517264 - RNA, 64 nt, Human
cgaacgcuccaacgaguaccagcugauugacugugcccaguacuuccuggacaagaucgacgug

SEQ ID NO: 517265 - RNA, 64 nt, Human
gaaggaccagguggaggaagucaccuacgacguggcccaguauauaaaguucgagaugccggua

SEQ ID NO: 517266 - RNA, 64 nt, Human
aaaaccucaaguuuuuaaacaugauuuauauguucuguauaauguucaguuuguaacuuuuuaa

SEQ ID NO: 517267 - RNA, 64 nt, Human
agaguccauuguuuaaaaaucuuaauguaucaaacuguauaacuuggccgcuguaugucuuaaa

SEQ ID NO: 517268 - RNA, 64 nt, Human
cacacgaauuuaaaugugaugucuuuguauauaucuguauaauguugagauuacuuacgaaaua

SEQ ID NO: 517269 - RNA, 64 nt, Human
gcacuaguaugccuugcgcuaucaugacugacuggcccaguaugauucuguugucgcugaucuc

SEQ ID NO: 517270 - RNA, 64 nt, Human
ggaagugucugcugaauggaauggcccagcauuagcccaguauuggaaaagacaccagcccagg

SEQ ID NO: 517271 - RNA, 64 nt, Human
gaugaagcuguucaugccaagaccgaaagugcuggcccaguaugaguccauucaguucaugccg

SEQ ID NO: 517272 - RNA, 64 nt, Human
gacagaaauaccccacacauuccccagccucucugcccaguaugcucauccacaggguuuucuc

SEQ ID NO: 517273 - RNA, 64 nt, Human
uguggccgugcaggccuccuuccagcccagaguggcccaguagagcaaggcagacagugaccuc

SEQ ID NO: 517274 - RNA, 64 nt, Human
guacuauuaugugggugaugccuuuuucuuuuaagcccaguacauauauuaugccugccuaagu

SEQ ID NO: 517275 - RNA, 64 nt, Human
gacaaacgacuggacagacuuauuucucacugcggcccaguaacaggcuacaucuuugcuuugu

SEQ ID NO: 517276 - RNA, 64 nt, Human
gccugaugggcaguccaagcuccaggcccugcaugcccaguauugccaaggaccgggcccugcc

SEQ ID NO: 517277 - RNA, 64 nt, Human
uucccugggguacuacucuccagcuugggaggaagcccaguagccauuuuguaacugccuacca

SEQ ID NO: 517278 - RNA, 64 nt, Human
ucuagaugcauuucaaaaggaaaguugguuuugagcccaguauacugaacuagaauauucuaga

SEQ ID NO: 517279 - RNA, 64 nt, Human
ucuuaaccuaucaacuuucugccccuccuucaaggcccaguauaaaugccaccuccuccaugaa

SEQ ID NO: 517280 - RNA, 64 nt, Human
cacuuugggaggccaaggcaggaggaucgcuggagcccaguaggucaagaccagccagggcaac

SEQ ID NO: 517281 - RNA, 64 nt, Human
aaccccgucucuacuaaaaauacaaaaaauuagccgggcguaguggcgggcgccuguaguccca

SEQ ID NO: 517282 - RNA, 64 nt, Human; identical to SEQ ID NO: 517281

SEQ ID NO: 517283 - RNA, 64 nt, Human
aaggguuugugcuauuccccacuuacuggacagccuguauaaccucaaguucugauggugucug

SEQ ID NO: 517284 - RNA, 64 nt, Human
cagagaaucuggaguugaaugauuauuccagauacuguauaaccugcauaacuuuuugucuuua

SEQ ID NO: 517285 - RNA, 64 nt, Human
aacaaauacuuuaaaaauuuggccaaaauuuaaacuguauaauggagcuagauacaagcaagaa

SEQ ID NO: 517286 - RNA, 64 nt, Human
aaucugcacuauuuuggaggacaaguagcacaaacuguauaacgguuuauguccguaguuuuau

SEQ ID NO: 517287 - RNA, 64 nt, Human
cauuaacugagcaccagcugugcuaagccugccacgggcguauccuugcagccucacaacagug

SEQ ID NO: 517288 - RNA, 64 nt, Human
ccagccccaggcggaccagagguggaaggcgcggcgggcguaggagggugggcuggcgguaccc

SEQ ID NO: 517289 - RNA, 64 nt, Human
cgccaccaucuaccaguggggacgcccagggccucgggcguacgcuuaccagcgacucuauagu

SEQ ID NO: 517290 - RNA, 64 nt, Human
aaaccccaucucugccaaaaauacaaaaguuagccgggcguaguggcacaugccuguaauccca

SEQ ID NO: 517291 - RNA, 64 nt, Human
gaaaccccgucucuacuaaaaauacaaaauuagucgggcguaguggugcaugccuguaauccca

SEQ ID NO: 517292 - RNA, 64 nt, Human
aucuuguagugggugcacacgcgugcacugggaccccacacagcaauacgaguccaacuuaaua

SEQ ID NO: 517293 - RNA, 64 nt, Human
ggcggugcagcuccgcccggcuccgccccugcagcccacacagcacaacgucuuaccgugccua

SEQ ID NO: 517294 - RNA, 64 nt, Human
uggggacguugguggcuggcugaggugcaugggccccacacaggacagcuggagaaugggccgu

SEQ ID NO: 517295 - RNA, 64 nt, Human
aaggucagcuggggccaguggugccucaggcaggcccacacaacuggccaccucuucccguuaa

SEQ ID NO: 517296 - RNA, 64 nt, Human
cagcgaugucaggccagggccauggccacacuggcccacacauuccuuucuacagagaauuucu

SEQ ID NO: 517297 - RNA, 64 nt, Human
cuuuucuguucacccccaaaagaaaacuuacacacccacacacauacacauuucaugcuuggag

SEQ ID NO: 517298 - RNA, 64 nt, Human
gcgauuacaauccaauuaccuauugucgacucagcccacacaagcuuuucuccuccucuugcag

SEQ ID NO: 517299 - RNA, 64 nt, Human
cuuuuaaguguaauuuguuuuucuucuguaaagacccacacagaauccugacuguccuuguauu

SEQ ID NO: 517300 - RNA, 64 nt, Human
accgaaaaacucccgugggagauuuuggccccaacccacacaggccaaugcaagaggccaaggc

SEQ ID NO: 517301 - RNA, 64 nt, Human
gagccuggcuguuucacaguauuucaugaauuuacccacacaggugugauccuccuugagcauu

SEQ ID NO: 517302 - RNA, 64 nt, Human; identical to SEQ ID NO: 412440

SEQ ID NO: 517303 - RNA, 64 nt, Human; identical to SEQ ID NO: 409053

SEQ ID NO: 517304 - RNA, 64 nt, Human; identical to SEQ ID NO: 410593

SEQ ID NO: 517305 - RNA, 64 nt, Human
aaggccacaguccccuccugugcuggcagcuuugcccacacauacccagcagcuccccaggcug

SEQ ID NO: 517306 - RNA, 64 nt, Human
agcauuguaaggauuucuucccaucguacccuuccccacacauaccaccuuggcuucuucuaua

SEQ ID NO: 517307 - RNA, 64 nt, Human
gccuuugaaaaugcuuccaaaaguagacccuguccccacacaggucaagacuacagagaaggcu

SEQ ID NO: 517308 - RNA, 64 nt, Human
gggggguauagccccccauccuugaggccugucacccacacaguaggugcugagaguuaggaca

SEQ ID NO: 517309 - RNA, 64 nt, Human
cauaaaccauggcauguuggguuugcaggacuggcccacacaguccccugcagguggcagcccu

SEQ ID NO: 517310 - RNA, 64 nt, Human
ucuugucaagguuugggaaugucaaagcccccuccccacacagggccuuuccugucccuugugg

SEQ ID NO: 517311 - RNA, 64 nt, Human
caguuugguagucccccuuucuggccccuuggagcccacacacguuucaucuuuuuccccucug

SEQ ID NO: 517312 - RNA, 64 nt, Human
cacucagcgggaagggggcuggcaucgccagcgacccacacauuccucacguagcuucugcucc

SEQ ID NO: 517313 - RNA, 64 nt, Human
auugggcagaauccugggcccccagagaccuuugcccacacacacuccuuccccuugucccugg

SEQ ID NO: 517314 - RNA, 64 nt, Human
gaagugcgcaugaaggaugcuucaugcccuguuccccacacagagaagagaugaagagggggag

SEQ ID NO: 517315 - RNA, 64 nt, Human
uaaugucacuguggacccagucucacuccuccaccccacacacugaagcaguagcuucugggcc

SEQ ID NO: 517316 - RNA, 64 nt, Human
cccccacagcagugugacuggugaaaaugcugaccccacacagagugcaaccaguaagugaaaa

SEQ ID NO: 517317 - RNA, 64 nt, Human
uuucaugaaaauuauuggugggccacugaaaguccccacacacaaagccuuuauucuauauaau

SEQ ID NO: 517318 - RNA, 64 nt, Human
auugcccuuuggcaacuaacuuaaccaugugcuucccacacaguacaucaggaaaacuuacagg

SEQ ID NO: 517319 - RNA, 64 nt, Human
cugcacccagaaauuccuucccacucauguuguucccacacacaaaccaagagccaaaaaugag

SEQ ID NO: 517320 - RNA, 64 nt, Human
ccacuccugcugcacaggcccuggggagcuuuugcccacacacuuuccaucucugccugucaau

SEQ ID NO: 517321 - RNA, 64 nt, Human; identical to SEQ ID NO: 412649

SEQ ID NO: 517322 - RNA, 64 nt, Human; identical to SEQ ID NO: 409052

SEQ ID NO: 517323 - RNA, 64 nt, Human; identical to SEQ ID NO: 410577

SEQ ID NO: 517324 - RNA, 64 nt, Human
caaggcccuguugacuagcaauggccuuagcugucccacacaacucaguggccugaacacacac

SEQ ID NO: 517325 - RNA, 52 nt, Human
uuauuccuccaaggcugugaugcccacacagcaucagcaugggcuuagagcu

SEQ ID NO: 517326 - RNA, 64 nt, Human
gggucgaggguccugcauaugcaccuggggaguccccacacacccgcaccaaaggggaaacauu

SEQ ID NO: 517327 - RNA, 64 nt, Human
auuauauucccacauccugagaaaggucauuucucccacacacgacaaagucacagacauccug

SEQ ID NO: 517328 - RNA, 64 nt, Human
guuuuaaauuuuucucaguuccagugauagaaaacccacacaauacauccucugccagucuuaa

SEQ ID NO: 517329 - RNA, 64 nt, Human
uucaugguguccauuuuauuuagcaaggacggcacccacacacaaagaggaugauuucccuuaa

SEQ ID NO: 517330 - RNA, 64 nt, Human
cagagccaaccccuaucauuuuauuaacauggaacccacacagauaggggagggauuaagcuaa

SEQ ID NO: 517331 - RNA, 64 nt, Human
uccugccugaaauugcugcugcccaucgcaugagcccacacaguagcacccccguccuuaggau

SEQ ID NO: 517332 - RNA, 64 nt, Human
uugcguaaaucauauuuuagcugcacggcauuaccccacacaggguggcagaacuugaaggguu

SEQ ID NO: 517333 - RNA, 64 nt, Human
guggcuuccuccgucugcaaugucccuugcacagcccacacaugaaccauccuucccaugaugc

SEQ ID NO: 517334 - RNA, 64 nt, Human
acauauuucuugaguaauuuaaaugcuuuguuuucccacacauauucaaaucagcaagcuugua

SEQ ID NO: 517335 - RNA, 64 nt, Human
cacguagccacgcacagccagacgcauccugccacccacacagcagccuccaggauaccagcaa

SEQ ID NO: 517336 - RNA, 64 nt, Human
ucccuccuuguuugucagccuccuguucauguuccccacacaccugaaggugguagaaucuuuu

SEQ ID NO: 517337 - RNA, 64 nt, Human
uauguauaacuuuaacuucuguuuuaccagcauacccacacaaauaacaagaauacuacuuaug

SEQ ID NO: 517338 - RNA, 64 nt, Human
ucagaugccugggaagcccagccccucaggugcccccacacacagccuucccuugacgccuaca

SEQ ID NO: 517339 - RNA, 64 nt, Human
agcaacgccuuguguuuguuucauuuuuuuaaaacccacacaaagccgcugucucacuuuuucc

SEQ ID NO: 517340 - RNA, 64 nt, Human; identical to SEQ ID NO: 412703

SEQ ID NO: 517341 - RNA, 64 nt, Human; identical to SEQ ID NO: 412704

SEQ ID NO: 517342 - RNA, 64 nt, Human; identical to SEQ ID NO: 412705

SEQ ID NO: 517343 - RNA, 64 nt, Human
ggguacaugcgacuguggccuggccucagugguacccacacaucagcacuaccacaagaaccaa

SEQ ID NO: 517344 - RNA, 64 nt, Human
aagaagccuuacucccugcacauucccucaugcucccacacaaguccagcaauggaaaugcuug

SEQ ID NO: 517345 - RNA, 64 nt, Human
uggaagcugaaauugaugaucccugaagguugaacccacacacaccccugcagccuccccagau

SEQ ID NO: 517346 - RNA, 64 nt, Human
uaguuuuaaauuauuuucagacaauacacuauugcccacacaugggauggacucuccuaccgcc

SEQ ID NO: 517347 - RNA, 64 nt, Human
cacacacacacacacauauacacacacucacagacccacacacauacacacugucaugcacuca

SEQ ID NO: 517348 - RNA, 64 nt, Human
ucgcagggugcucacacacccccacacccacccacccacacacaacacugggacaauucagaca

SEQ ID NO: 517349 - RNA, 64 nt, Human
caucacuaggaauauagacaaaugacugucugggcccacacaguuaaccagcccauuucuccac

SEQ ID NO: 517350 - RNA, 64 nt, Human
gucgggccacaacugucucuguuucaacuuuaagcccacacacucuguagcuuuucuaaaacag

SEQ ID NO: 517351 - RNA, 64 nt, Human
augucugccacacaaacguauguaaauguauauacccacacacauacacacauaugucauauau

SEQ ID NO: 517352 - RNA, 64 nt, Human
ucccaguauuucaucaaggacagggaauaucccucccacacacaggccagcugcucacccugcc

SEQ ID NO: 517353 - RNA, 64 nt, Human
uccuuggacagcagauccacacaccacuuccccacccacacacaguacccugggcugguuggac

SEQ ID NO: 517354 - RNA, 64 nt, Human
aaaauccaaguaacaccuucugaguagcugcugucccacacaauaggguaugaagcugcgcucc

SEQ ID NO: 517355 - RNA, 64 nt, Human
aaucauaugauuuaagugcaugaauaagcauuuucccacacaaugaacauuugaacuguguuua

SEQ ID NO: 517356 - RNA, 64 nt, Human
acagcaaggggcacgguaucacagccuggagacacccacacagauggcuggauccggugcuacg

SEQ ID NO: 517357 - RNA, 64 nt, Human
caaagugcuggaauuacaggcaugagccaccacacccacacaagacuaucauuuuuaaugacca

SEQ ID NO: 517358 - RNA, 64 nt, Human
ugugcuguagccuguaauuacugacaugaagguccccacacagagucuggauggaggcugcccu

SEQ ID NO: 517359 - RNA, 64 nt, Human
gcccuguuggcauuagcacuaccauuguacccugcuguauaauaaacaaucuuagacauuuauc

SEQ ID NO: 517360 - RNA, 64 nt, Human
uuuugaaacauuugccaaacuaaauacuguaacacuguauaacauuuaaaaauguuaaagaacu

SEQ ID NO: 517361 - RNA, 64 nt, Human
gcuguaaauauaaauuuugucccuuccauuucuacuguauaaacaaauuagcaaucauuuuaua

SEQ ID NO: 517362 - RNA, 64 nt, Human
cauuacugaaagaacccugcgaaucaaaacaacccccacacagaccccgcaauccuuuuuuaaa

SEQ ID NO: 517363 - RNA, 64 nt, Human
aaaauucucauuuaauuuucuggucagcaaguuccccacacagaaaucacucugagguuuacag

SEQ ID NO: 517364 - RNA, 64 nt, Human
ggacucgccuugcaaccgacaggccauucccacccccacacacaaccuccccuguuuucacauu

SEQ ID NO: 517365 - RNA, 64 nt, Human
aggcugugccugcucagagcuuuggacuguucaacccacacaagaacaaacgcuaacuaauauu

SEQ ID NO: 517366 - RNA, 64 nt, Human
uaucccacgauaucuaaaugaaaaagaaagaaaacccacacacaaagcaaaaacucaaguauua

SEQ ID NO: 517367 - RNA, 64 nt, Human
agccucucuggcucagcccgggauccugauggcacccacacagaggaccucuuuggggcaagau

SEQ ID NO: 517368 - RNA, 64 nt, Human
aaacagagaaaaccuagugauucugucuggucaucccacacaccucucuacugagugcuccaga

SEQ ID NO: 517369 - RNA, 64 nt, Human
aggacagagacaaaaaugaggaaaacuaggggaccccacacacauguggcuaccauacuccuga

SEQ ID NO: 517370 - RNA, 64 nt, Human
cagcuuuauuccuguugggccucaguuucucuuccccacacaguuuaucuuccgucacauugug

SEQ ID NO: 517371 - RNA, 64 nt, Human
uccuauggaaucuggaaugagugcagagcuccuacccacacaugacugccccgccauuucaucc

SEQ ID NO: 517372 - RNA, 64 nt, Human
aucuccugcuaguacugugccgcuucccccuccccccacacaaaauaaaaacaguaucugccuu

SEQ ID NO: 517373 - RNA, 54 nt, Human
ccagaacacuagcaccaugaacuccccacacaguuuuacagaguucugaaauac

SEQ ID NO: 517374 - RNA, 64 nt, Human
gaugaggaaacagcaacccagagaggagaacuaacccacacaggaucauuucgugaaggagcaa

SEQ ID NO: 517375 - RNA, 64 nt, Human
ugcaugaccaaagugauaaauuccuguugaccuucccacacaaucccuguacucugacccauag

SEQ ID NO: 517376 - RNA, 64 nt, Human
ccuuuucugccuggagagaaacuuucagaccagccccacacaccacagccaggagaggccguuc

SEQ ID NO: 517377 - RNA, 64 nt, Human
caggccugacucaggcagguucugccccccagaccccacacacggccgccccacgugcugucgc

SEQ ID NO: 517378 - RNA, 64 nt, Human; identical to SEQ ID NO: 410594

SEQ ID NO: 517379 - RNA, 64 nt, Human; identical to SEQ ID NO: 412722

SEQ ID NO: 517380 - RNA, 64 nt, Human; identical to SEQ ID NO: 412723

SEQ ID NO: 517381 - RNA, 64 nt, Human
agcuuggaggagcccagagaccguuugcuuuauacccacacagcaacugguccacugcuuuacu

SEQ ID NO: 517382 - RNA, 64 nt, Human
uaggaaacagacuaugauuaauccauuuauucuucccacacacuuaccuuacuaagucuuugcu

SEQ ID NO: 517383 - RNA, 64 nt, Human
aguaggggcagugccacuuucuacaaccugccaacccacacacuggaguaauucugaaaaaaau

SEQ ID NO: 517384 - RNA, 64 nt, Human
ucauucaaauauuuacccgggacacacacccccccccacacacacacacagacacacucacaca

SEQ ID NO: 517385 - RNA, 64 nt, Human
cuuccuguguucucuggcuucagaguuucaccugcccacacaggguccguugcuggcaacugga

SEQ ID NO: 517386 - RNA, 64 nt, Human
caagugcacgagggucucuguguuuccagaaggccccacacacccaagugccccucacaccucg

SEQ ID NO: 517387 - RNA, 64 nt, Human
cccagggaagagaaugaggaccacguggacuccgcccacacagagcuggcugcugugcccaccc

SEQ ID NO: 517388 - RNA, 64 nt, Human
ccaggggccccuggcgagaaccgcacacaccccucccacacaccuugcucuggcuucucugugu

SEQ ID NO: 517389 - RNA, 64 nt, Human
cagaggcuguuuccugcagcauguauuuccauggcccacacagcuauguguuugagcagcgaag

SEQ ID NO: 517390 - RNA, 64 nt, Human
gcugaacaccaucccgccauuagcgcaucggaaccccacacaguugcaacucccaaccccgaau

SEQ ID NO: 517391 - RNA, 64 nt, Human
auauugaaauuuauuauucuaauccaaaaguuaccccacacaaaaguuacugagcuuccuuaug

SEQ ID NO: 517392 - RNA, 64 nt, Human
ccacauauugugcaguaucaagcuaacaaggugacccacacacucaccaugaggcaaaggcaag

SEQ ID NO: 517393 - RNA, 64 nt, Human
aaacucuuucauaaagcacuuuuguggccuaguucccacacacacacaaaaguauuaggucuuu

SEQ ID NO: 517394 - RNA, 64 nt, Human
ccauggagaacacacaaccaguaagugagguugccccacacagccgucucccagggaaucccuu

SEQ ID NO: 517395 - RNA, 64 nt, Human
aagauuaaaguaggcuggguuucauuuccaucuucccacacaucucauugaauuugaugguuga

SEQ ID NO: 517396 - RNA, 64 nt, Human
uaguacugggugcuuuuuauacaacuuuccaucccccacacaguuggagaauaauuuguagacc

SEQ ID NO: 517397 - RNA, 64 nt, Human; identical to SEQ ID NO: 412724

SEQ ID NO: 517398 - RNA, 64 nt, Human; identical to SEQ ID NO: 412857

SEQ ID NO: 517399 - RNA, 64 nt, Human; identical to SEQ ID NO: 409055

SEQ ID NO: 517400 - RNA, 64 nt, Human
acuggugaaggacagucaggugaaggacuguaagcccacacaagcucuucuuaucucuacuaga

SEQ ID NO: 517401 - RNA, 56 nt, Human
uggguaagggcagugccugauaauaccccacacaaguucacuugauuaauugcauc

SEQ ID NO: 517402 - RNA, 64 nt, Human
aaggggaagaagauugaucaaacugaaugaaacccccacacacacacacaugcauacacacaca

SEQ ID NO: 517403 - RNA, 64 nt, Human
gccuacaccccucccuuuuuggggggagccuguccccacacaccuuagcacaaccagaaucuug

SEQ ID NO: 517404 - RNA, 64 nt, Human
acacugguuaaggcuucuguuuaucacacauaggcccacacacagacucaccaacuuugcaaua

SEQ ID NO: 517405 - RNA, 64 nt, Human
agccuccauggccaggggccugucaagccaggggcccacacaccuggugccaggguccaccuug

SEQ ID NO: 517406 - RNA, 64 nt, Human
uucuuauuucuuccagcugugaauguggauucuucccacacagaauauacauuguccucuuuga

SEQ ID NO: 517407 - RNA, 64 nt, Human
gagccaaaagcacauaccuaccccaucccccacccccacacacacacacacacacacaugcaca

SEQ ID NO: 517408 - RNA, 64 nt, Human
ugcgccuugugacauuuauugguguuggccgcgacccacacaccuuuggccucaucgcugaccu

SEQ ID NO: 517409 - RNA, 64 nt, Human
gagcagcagaggcggucuucaacauccugccagccccacacagcuacagcuuucuugcucccuu

SEQ ID NO: 517410 - RNA, 64 nt, Human
uaccugugacccucuuugcugaagaauauuuaaccccacacagcacuucaaagaagcugucuug

SEQ ID NO: 517411 - RNA, 64 nt, Human
gcuuucugauuauagaaggugacuucuugcugugcccacacauggugaaagggacuaccaacuc

SEQ ID NO: 517412 - RNA, 64 nt, Human
ggagcucacugccuaccuggccuggggcugucugcccacacagcaugugcgcucucccugagug

SEQ ID NO: 517413 - RNA, 64 nt, Human
cagcacuccauaucccuuacugucaccuucacuccccacacagcucaugagaugugugaccccu

SEQ ID NO: 517414 - RNA, 64 nt, Human
ggcaggaggccccugcggaggcagcguggaucugcccacacauaggcuacuggaauaguuuaac

SEQ ID NO: 517415 - RNA, 64 nt, Human
aaagcuacaugauaguauuuuuaugcacucuucucccacacauacacacacgugcauguaucug

SEQ ID NO: 517416 - RNA, 64 nt, Human; identical to SEQ ID NO: 412327

SEQ ID NO: 517417 - RNA, 64 nt, Human; identical to SEQ ID NO: 409072

SEQ ID NO: 517418 - RNA, 64 nt, Human; identical to SEQ ID NO: 410611

SEQ ID NO: 517419 - RNA, 64 nt, Human
ucugaccccucacguuccuaccacagggccacagcccacacagcccugggacacugcccuggcc

SEQ ID NO: 517420 - RNA, 64 nt, Human
uauuagcuuacccaaugggaccgugccccaccuccccacacacaggccuucuguggggcugggc

SEQ ID NO: 517421 - RNA, 64 nt, Human
cucucucaguacaguucaagguguagcaaguguacccacacagauagcauucaacaaaagcugc

SEQ ID NO: 517422 - RNA, 64 nt, Human
cucuuuugcacaauugugcauagauauauauaugcccacacacacugggccaugcuugccaagg

SEQ ID NO: 517423 - RNA, 64 nt, Human
aguggcacuggcagagaaggauaggaguggaaugcccacacagugaccaacagaacuggucugc

SEQ ID NO: 517424 - RNA, 64 nt, Human
ucuccuuuucaguauaaccuccccuaugcucaugcccacacagacaaaaaaacaaaacgaaaua

SEQ ID NO: 517425 - RNA, 64 nt, Human
aaguuccuggcuuugaaugaaccagaaguguuugcccacacagcaaaugguccauguuaaaugu

SEQ ID NO: 517426 - RNA, 64 nt, Human
aaggagggguugcuucccucccuaccucauccaucccacacaccuuggccuucugcaagccaag

SEQ ID NO: 517427 - RNA, 64 nt, Human
gacuccuccuuggcaacugcccuuuccugccaggcccacacauacccucuucuggcuguuaggg

SEQ ID NO: 517428 - RNA, 64 nt, Human
cauguggugcuggggauuggcagccauccuggggcccacacaggugugucuugcuccauuuggc

SEQ ID NO: 517429 - RNA, 64 nt, Human
gaccaggccucagcucuuggugggcccagggacacccacacagguggccaucacagccccaugg

SEQ ID NO: 517430 - RNA, 64 nt, Human
uuacuuaacuuaccauaaaugcagugugacuuuucccacacacuggauugugaggcucuuaacu

SEQ ID NO: 517431 - RNA, 64 nt, Human
gcaaaagcacuggcucauccgcccuacuucccaucccacacaaacccaauuguaaauaacauau

SEQ ID NO: 517432 - RNA, 64 nt, Human
uuuguuauauauguuucuauagaauaauaacauacccacacaauuaauauaagggauauguugu

SEQ ID NO: 517433 - RNA, 64 nt, Human
cagcagugaugccagcugggcacgucaggaccuccccacacacccacacgaugccacaggucag

SEQ ID NO: 517434 - RNA, 64 nt, Human
ugcaguaugcuauaaaugauaccccccuaccacacccacacacacaguuuuugucuaaugaaaa

SEQ ID NO: 517435 - RNA, 64 nt, Human; identical to SEQ ID NO: 412329

SEQ ID NO: 517436 - RNA, 64 nt, Human; identical to SEQ ID NO: 412346

SEQ ID NO: 517437 - RNA, 64 nt, Human; identical to SEQ ID NO: 412347

SEQ ID NO: 517438 - RNA, 64 nt, Human
cugucaccccaaaugcagcaauggccuggugauucccacacauccuuccugcaucccccgaccc

SEQ ID NO: 517439 - RNA, 64 nt, Human
gcuaggaacaggggacaaaauggaccgaggggaacccacacagggacccuggccgugugucccc

SEQ ID NO: 517440 - RNA, 64 nt, Human
cugggauuacaggugugggagccaccaugccugacccacacacuuuuuacuuguauagaugauu

SEQ ID NO: 517441 - RNA, 64 nt, Human
uaggccacgugugccccacauaugcagggggugccccacacagcuagagcggccaggagagcgc

SEQ ID NO: 517442 - RNA, 64 nt, Human
acugucccugacaaccccuucguccggacccucccccacacaacuaugucuggucaccagcucc

SEQ ID NO: 517443 - RNA, 64 nt, Human
aauagccauuuccagagggaaguacacacauacccccacacaccagucuuuuuggggguuucag

SEQ ID NO: 517444 - RNA, 64 nt, Human
aaucacugcauggaugucccaggaggcagcucuccccacacagcagcacagccaucacaggauu

SEQ ID NO: 517445 - RNA, 64 nt, Human
cccuuccuuuuuaccucauuuauuugguacuuuccccacacaguccuuuauccaccuggauuuu

SEQ ID NO: 517446 - RNA, 64 nt, Human
gcuccgugaugcuccaccugccagcccccggauucccacacaugcagacauguacacacgugca

SEQ ID NO: 517447 - RNA, 61 nt, Human
uggagcgaaagugccccugauggcacuccuccccacacaccugcucccaagcucagaugga

SEQ ID NO: 517448 - RNA, 64 nt, Human
uuucucacauuugcuucgugagaugggggcuuaacccacacaggucuccgugcgugaaccaggu

SEQ ID NO: 517449 - RNA, 64 nt, Human
gucucuccuucucucucuccccccaccacccacccccacacacgucaucugcauuguuauugga

SEQ ID NO: 517450 - RNA, 64 nt, Human
cuugucgcuuuuaggaccucccacaaccugguuccccacacauccauaguucugccuccccagc

SEQ ID NO: 517451 - RNA, 64 nt, Human
ggguacagaauaauucuucguuguguggcacuaacccacacacugcaggacaucguucucccug

SEQ ID NO: 517452 - RNA, 64 nt, Human
agaagcacaggcucacccgcuccguccagugucacccacacauugguccggggaccccucagug

SEQ ID NO: 517453 - RNA, 64 nt, Human
uggcuaccagcucucaccuacacccacgcacccccccacacacuaugcucucucaagaauguaa

SEQ ID NO: 517454 - RNA, 64 nt, Human; identical to SEQ ID NO: 409073

SEQ ID NO: 517455 - RNA, 64 nt, Human; identical to SEQ ID NO: 412384

SEQ ID NO: 517456 - RNA, 64 nt, Human; identical to SEQ ID NO: 412385

SEQ ID NO: 517457 - RNA, 64 nt, Human
gggccuggagcccugggcggaguccccgggguuccccacacagggcacugacugauagcuuaca

SEQ ID NO: 517458 - RNA, 64 nt, Human
ccaaggugacagaggacacaggggagggggaaaacccacacacacuccuuggaauggguccugu

SEQ ID NO: 517459 - RNA, 64 nt, Human
cucgacuucaggggucaguguuccugucccaaaccccacacagaauacucugccucuguuucau

SEQ ID NO: 517460 - RNA, 64 nt, Human
gccuccaaaguagcuggcacuacaaguguacacccccacacaaggcuaaguuuuguauuuuuug

SEQ ID NO: 517461 - RNA, 64 nt, Human
cccuggcugccuuuuugggggucccugccuuagccccacacaaggcuuucugaacugccaagag

SEQ ID NO: 517462 - RNA, 64 nt, Human
cccuuggccaaucccugucuugguuucugcucuucccacacaaaguuuugggaaucaauucaua

SEQ ID NO: 517463 - RNA, 64 nt, Human
cagcagcagcagcacaaacauugcugccuuuguccccacacagccucuaagcgugcugacauca

SEQ ID NO: 517464 - RNA, 64 nt, Human
ccgcggggccugugagcggagaggggcccugcuucccacacaaauccgccccggugcacccccg

SEQ ID NO: 517465 - RNA, 64 nt, Human
cccaggaucacaccucgacacccaaccccugaaccccacacacucugccaugcacacaggagga

SEQ ID NO: 517466 - RNA, 64 nt, Human
aauccuggaugcuggauggaguauuucucugaggcccacacaaagcuggacacccccaggcucu

SEQ ID NO: 517467 - RNA, 64 nt, Human
cucuggccaugucauagcccaugucuugugcccucccacacagaaaguguuagauagggaaauu

SEQ ID NO: 517468 - RNA, 64 nt, Human
ccucaugaggcuguggccaaccccugccccuugccccacacagaccaggccuuaaaugucgguc

SEQ ID NO: 517469 - RNA, 64 nt, Human
uggaguugaggcuguugucagcaaagccccuggucccacacagcucugcccuagagccaccucu

SEQ ID NO: 517470 - RNA, 64 nt, Human
ugggagagcagccauccccugcuggcaccauagacccacacaaggagccugcacagcaagccag

SEQ ID NO: 517471 - RNA, 64 nt, Human
gcccccagaggaagcccucagccucugcccuccccccacacagggcgggagcccaggccuguuc

SEQ ID NO: 517472 - RNA, 64 nt, Human
uccagcuuucuuaagcccuucuuuaggaagccuucccacacagccaacccugcugcucucugcc

SEQ ID NO: 517473 - RNA, 64 nt, Human; identical to SEQ ID NO: 410613

SEQ ID NO: 517474 - RNA, 64 nt, Human; identical to SEQ ID NO: 409074

SEQ ID NO: 517475 - RNA, 64 nt, Human; identical to SEQ ID NO: 412366

SEQ ID NO: 517476 - RNA, 64 nt, Human
ugcuuccacuugcagagcaccgugccaagcacuucccacacacuuacccguuugauucuccuag

SEQ ID NO: 517477 - RNA, 64 nt, Human
cccggggccacugguggcuccccagagccucagacccacacagcccagaggacgaggccuucaa

SEQ ID NO: 517478 - RNA, 64 nt, Human
aaccaguaaugggggcaaggcuggggcaucccagcccacacacccuggaugcccagcaaggcca

SEQ ID NO: 517479 - RNA, 64 nt, Human
uuaccguuuucgacgacagauuaaccaaaaaugccccacacagguuuuauuacuguuauauacu

SEQ ID NO: 517480 - RNA, 64 nt, Human
gugugaggcugcagugggugggggauggauccuccccacacaucugaggacacacaaccacuug

SEQ ID NO: 517481 - RNA, 64 nt, Human
aggccugaaugaagucauacccuauuagauagcucccacacaucacacaggcugguaaucucuu

SEQ ID NO: 517482 - RNA, 64 nt, Human
aggcagggaagcaauguaguguggugggcagagccccacacagaaucagaagggaugaauggau

SEQ ID NO: 517483 - RNA, 64 nt, Human
ccugccacccugcccgaggauguacagagccgugcccacacauuuccuugcaacuugaucaaau

SEQ ID NO: 517484 - RNA, 64 nt, Human
aaagagggugcagaguccaggccagauagucuuccccacacacuuucaucucguuuccuccacu

SEQ ID NO: 517485 - RNA, 64 nt, Human
agcagcugcucuccaagacagggcccuggaaaggcccacacauacagcccagggcugcccaggg

SEQ ID NO: 517486 - RNA, 64 nt, Human
ccccucgaagacaccucaauucacagacucucagcccacacaaugccccaguguccccagcucc

SEQ ID NO: 517487 - RNA, 64 nt, Human
cccacuucucaucacacacauggaaacccauaggcccacacacagguggugucacugucccucc

SEQ ID NO: 517488 - RNA, 64 nt, Human
auaucgugccauggucugauauaaaucugcuggucccacacacuguucaaaaauagacugccau

SEQ ID NO: 517489 - RNA, 64 nt, Human
gcugcuccuacaagggaagcuucuugcugccaggcccacacauccccaguuguugguuuggcca

SEQ ID NO: 517490 - RNA, 64 nt, Human
aacugggaacaaagaucuacaggcaagcaagaugcccacacaacaggcuuauuuucugugaagg

SEQ ID NO: 517491 - RNA, 64 nt, Human
aucauggaaugaaccaaaucuggcaggaucugcucccacacacaccuuauggagauaaugccuc

SEQ ID NO: 517492 - RNA, 62 nt, Human
agcgucagccuuggagaugccaaagugaccagccaccccaucccuccccuacccaucugucu

SEQ ID NO: 517493 - RNA, 62 nt, Human
ugaaauuuuucuuuuguuccccugucccuccuccaccccacacucccaccucuuucuaggac

SEQ ID NO: 517494 - RNA, 62 nt, Human
ccuggccgcaauggacaagccuccugcucacuccaccccacccaccucugcccuguccuugg

SEQ ID NO: 517495 - RNA, 64 nt, Human
ucuguuuacauccugguggcaccucucacccugacccacacaaagguucuggagauuacuggag

SEQ ID NO: 517496 - RNA, 64 nt, Human
aggcugccaccgcggccugaucaugcccucugugcccacacaggucucugagcggccccugaug

SEQ ID NO: 517497 - RNA, 64 nt, Human
ucuuugcuggcuggcugccucugcugccccauaccccacacacucaucagccugaaguuagccc

SEQ ID NO: 517498 - RNA, 64 nt, Human
cagcugcucuccaagacagggcccuggaaagaggcccacacauacagcccaguugcugcccagg

SEQ ID NO: 517499 - RNA, 64 nt, Human
auaccucuguggggacuguggggacuuuugggaccccacacacuccaggugggaucagaugcug

SEQ ID NO: 517500 - RNA, 64 nt, Human
agagggccacggcugcgugcgauccaggcccaggcccacacacucugcccgugucacacgugug

SEQ ID NO: 517501 - RNA, 64 nt, Human
ugucuucacaccugacgaugagccaggccugagccccacacaggccagggcacauucuuggauu

SEQ ID NO: 517502 - RNA, 64 nt, Human
cccuugguccugccccuagauacagcaguuuauacccacacaccugucuacagugucauucaau

SEQ ID NO: 517503 - RNA, 64 nt, Human
gaagggguaggaggagggcccucagcuggcccuccccacacacaggacggcaggggcacuguga

SEQ ID NO: 517504 - RNA, 64 nt, Human
gagcccuggggcugggggcuggaauccaccuccucccacacaagcucgguggugacucuucggc

SEQ ID NO: 517505 - RNA, 64 nt, Human
ggagcccagccucuugagaugcucccaggguggacccacacauugucuccacuccgaagcaguu

SEQ ID NO: 517506 - RNA, 64 nt, Human
ccagacugggucucagagccgugccacccacccucccacacagccggccacagggagaacuggu

SEQ ID NO: 517507 - RNA, 64 nt, Human
auauuuugcuuugagccagcuuuuuagucucauucccacacauguggaagccacguugccucuc

SEQ ID NO: 517508 - RNA, 64 nt, Human
cuaaagaaggugugggccagacaaggccuuggagcccacacaugggaucaaguccugcaagcag

SEQ ID NO: 517509 - RNA, 64 nt, Human
uacaguugggcaugauuuguaccauccacccauacccacacagucacagucacacacacauaug

SEQ ID NO: 517510 - RNA, 64 nt, Human
gguaccugggggccugaauucuggcccccggcuccccacacagcugggacuggccuggauggcu

SEQ ID NO: 517511 - RNA, 64 nt, Human; identical to SEQ ID NO: 412442

SEQ ID NO: 517512 - RNA, 64 nt, Human; identical to SEQ ID NO: 410629

SEQ ID NO: 517513 - RNA, 64 nt, Human; identical to SEQ ID NO: 412403

SEQ ID NO: 517514 - RNA, 64 nt, Human
guuggggcagucccaugaccccaugucccagcuccccacacagcgcugggccagagaggcauug

SEQ ID NO: 517515 - RNA, 64 nt, Human
ugccugcuuuggcgggcagacacgcgggcgcgaucccacacaggcuggcgggggccggccccga

SEQ ID NO: 517516 - RNA, 64 nt, Human
cagcagaggagugacuuucugacuaaugcugccacccacacagagaauaaggaguagggccugc

SEQ ID NO: 517517 - RNA, 64 nt, Human
guuggggcuggucuuggugaacacacauuauuaccccacacauccccuuuguguagaaagccaa

SEQ ID NO: 517518 - RNA, 64 nt, Human
agaauggcacccaagagccugcggggaugcccaucccacacaccccacccagcuguucuaaccc

SEQ ID NO: 517519 - RNA, 64 nt, Human
uuaauuaagggguaggaaggugcugugggcuggucccacacauccaggaaagaggccaguagag

SEQ ID NO: 517520 - RNA, 63 nt, Human
uugauggaccagacaaauaggaugauggcugcccccacacaauaaaugguaacauaggagaca

SEQ ID NO: 517521 - RNA, 64 nt, Human
cagucuccacagccauccuggcccacacaggcaccccacacaaaccuauuuauugaaucugcug

SEQ ID NO: 517522 - RNA, 64 nt, Human
aguccaccagcuccagucuccacagccauccuggcccacacaggcaccccacacaaaccuauuu

SEQ ID NO: 517523 - RNA, 64 nt, Human
agcccuugagcagcccgugugggggcccgagggacccacacagugggggccagccucgcuggag

SEQ ID NO: 517524 - RNA, 64 nt, Human
aaagcauuucuuaugguucccugagucaguucgucccacacauccucccugaggcaccugcacc

SEQ ID NO: 517525 - RNA, 64 nt, Human
gaggccccuggcccagcggccccucccacacacacccacacacucgcccgcccacuguccuggg

SEQ ID NO: 517526 - RNA, 64 nt, Human
cccagagcaggaggccccuggcccagcggccccucccacacacacccacacacucgcccgccca

SEQ ID NO: 517527 - RNA, 64 nt, Human
gguuuggaggagccccgaguggcccaggaguccccccacacacagaugcauaggccugccuucc

SEQ ID NO: 517528 - RNA, 64 nt, Human
uaaacacaaaugcacugugagauaugugaagaaucccacacauagauucuuacacuuccaaaga

SEQ ID NO: 517529 - RNA, 64 nt, Human
gcuuguucuagcguguauuaaaacuugacacacacccacacacaaaaacaaaaacaccacuguc

SEQ ID NO: 517530 - RNA, 64 nt, Human; identical to SEQ ID NO: 409075

SEQ ID NO: 517531 - RNA, 64 nt, Human; identical to SEQ ID NO: 412403

SEQ ID NO: 517532 - RNA, 62 nt, Human; identical to SEQ ID NO: 174733

SEQ ID NO: 517533 - RNA, 64 nt, Human
aggccucccgcaugcugccugccuccggcccugccccacacaggccuggcccagccagcagguu

SEQ ID NO: 517534 - RNA, 64 nt, Human
uaaagggagggaagguccuacaggucuccggccacccacacaaggaggaggaagaggaaauggu

SEQ ID NO: 517535 - RNA, 64 nt, Human
aagcauuucuuaugguuucucugaaucaguucaucccacacaucauccugaggcaccugcaccu

SEQ ID NO: 517536 - RNA, 64 nt, Human
gaaaacggugcauccacgcacacauggacacagacccacacauguuuacagaacuguuguuuac

SEQ ID NO: 517537 - RNA, 64 nt, Human
ggaagacuaugagaguaggccacaaggacaugggcccacacaucugcuuuggcuuugccggcaa

SEQ ID NO: 517538 - RNA, 64 nt, Human
acaaccugcaucuguuaagauguuugaucuuuaacccacacaauguaaggguacuguugucauu

SEQ ID NO: 517539 - RNA, 64 nt, Human
ucaggugugcgagugccucugggaggcgcagaugcccacacagccagcacugacuuguguucga

SEQ ID NO: 517540 - RNA, 64 nt, Human
uaacauauucauucucucuucuccaucacccauacccacacauacaucuaguauguuuaggguu

SEQ ID NO: 517541 - RNA, 64 nt, Human
uguguguucugcaccccuggcaccuuccucuccucccacacaggaagcugccccacugggcagu

SEQ ID NO: 517542 - RNA, 64 nt, Human
gccccaaggaccccuuugcugaccucugccaggacccacacagcuucgauggaucucaguguuu

SEQ ID NO: 517543 - RNA, 64 nt, Human
uagcccacuccccaguuggcccuucugcccuuaccccacacacaguccaacucuuccaccucug

SEQ ID NO: 517544 - RNA, 64 nt, Human
gugaaaaguucggacucucugucucacuccuugccccacacacacuugucccugcccccacccu

SEQ ID NO: 517545 - RNA, 64 nt, Human
cuggcugggugggccagggagcccgccagcagaccccacacagcauguccgccccagggcaaag

SEQ ID NO: 517546 - RNA, 64 nt, Human
uucguaaggcacaggcugacaguuccacucccaccccacacaacgcagacggugcgccugugca

SEQ ID NO: 517547 - RNA, 64 nt, Human
agcagacugguuccuaacucucucccuccuccugcccacacacaucaaaagaaucuucccuaca

SEQ ID NO: 517548 - RNA, 64 nt, Human
uauccuuacuugaguccauauggguuggacaguccccacacacauuaaauucuguaaaugaaag

SEQ ID NO: 517549 - RNA, 64 nt, Human; identical to SEQ ID NO: 412950

SEQ ID NO: 517550 - RNA, 64 nt, Human; identical to SEQ ID NO: 412967

SEQ ID NO: 517551 - RNA, 64 nt, Human; identical to SEQ ID NO: 412968

SEQ ID NO: 517552 - RNA, 64 nt, Human
aaaccaccagcauauacauggacauacacacacacccacacacacaaacacacacacacacaca

SEQ ID NO: 517553 - RNA, 64 nt, Human
accgugugcaugugcaucaaugucccucuuuucucccacacaucucacaucauggggaggccag

SEQ ID NO: 517554 - RNA, 64 nt, Human
gggccuggucugaucucauuuuagaggcaguugccccacacauagccccuugaccuucccauca

SEQ ID NO: 517555 - RNA, 64 nt, Human
uaucaauagaccacagccaaagccuuaaaucaaacccacacacaacugaaaauugccuccucca

SEQ ID NO: 517556 - RNA, 64 nt, Human
gaggcugcagaagcaauggagugaaccucugcuccccacacagcuggcuacacugcucaggcuu

SEQ ID NO: 517557 - RNA, 64 nt, Human
ccaccccgcacucccucgagacagagaaacggaacccacacauuuaugucuggggccucucucu

SEQ ID NO: 517558 - RNA, 64 nt, Human
caaaagcacacaagcacauacagacauaugcauccccacacacgccuaugcacaaacguggauu

SEQ ID NO: 517559 - RNA, 64 nt, Human
ccucauucucuuuucuuucaaaauguaccuuauucccacacacucuugggcugaccuuuauuuu

SEQ ID NO: 517560 - RNA, 64 nt, Human
uucagccucacuguuuuuaccuuaauuucaacugcccacacacuugaccgugcagucaggagug

SEQ ID NO: 517561 - RNA, 64 nt, Human
gaguuggauuaaauucugggugaaacccuuuucucccacacaaaauaguuuuagugauuuuuuu

SEQ ID NO: 517562 - RNA, 64 nt, Human
gccaguugaccugccuuggagucgucuggcaucucccacacaagacccaaguagcugcuaccuu

SEQ ID NO: 517563 - RNA, 64 nt, Human
ugggagaggaagggaguccagaucccaugaauagcccacacagguaccggcucucagagggucc

SEQ ID NO: 517564 - RNA, 64 nt, Human
gccccagaugccuccucuguccucauucuucucucccacacaagcagucuuuuucuacagccag

SEQ ID NO: 517565 - RNA, 56 nt, Human
uccuccuccuggaucuuuaggaggaacccacacacccuacaaguugaucaugcagg

SEQ ID NO: 517566 - RNA, 64 nt, Human
aucucaccacaccacaccacaccacaccucacugcccacacacggcgcaggcugcccgccuccu

SEQ ID NO: 517567 - RNA, 64 nt, Human
ugagcggccucugaguacccuggcgggaggcuggcccacacagaaagguggcaagaagaucggg

SEQ ID NO: 517568 - RNA, 64 nt, Human; identical to SEQ ID NO: 410630

SEQ ID NO: 517569 - RNA, 64 nt, Human
acauacaccacacacacacguucccauccacucacccacacacuacacagacugcuuccuuaua

SEQ ID NO: 517570 - RNA, 64 nt, Human
gaaagagcgugggaagguggagggugucaccagacccacacagagcaagggagauuaaggcagu

SEQ ID NO: 517571 - RNA, 64 nt, Human
ccccccccgcaaauguuagaccagagcuguugaucccacacauucauuuuucugaaaauucaug

SEQ ID NO: 517572 - RNA, 64 nt, Human
gccugcccguaaacacgccugcaaacgcugccugcccacacagguucacgugcagcucaaggaa

SEQ ID NO: 517573 - RNA, 64 nt, Human
ucaccgaaucggacacucauccuuucucacacuucccacacaugauccuucuucccuucaucac

SEQ ID NO: 517574 - RNA, 64 nt, Human
caagcaauauggaaucuugccugguaucauugagcccacacauggaggaagcagaacucaucag

SEQ ID NO: 517575 - RNA, 64 nt, Human
ccugccucuagcaccucuucugucccugucauuccccacacacguccuguucaccucgagagag

SEQ ID NO: 517576 - RNA, 64 nt, Human
cccagccccugccccuggacaccugcugacagcucccacacagaacagucugaggugaugcugg

SEQ ID NO: 517577 - RNA, 64 nt, Human
uucucucagcccuccacacacacucacccccacucccacacacauacacacacacacacacaua

SEQ ID NO: 517578 - RNA, 64 nt, Human
cuguugauauuaaaaacaaacaaaacaaaaaagccccacacauaacuguuuugcacgugcaaaa

SEQ ID NO: 517579 - RNA, 64 nt, Human
ucuaugggaaacucuucagcaccuaccugcgccccccacacaccucucgaggcaccucccagac

SEQ ID NO: 517580 - RNA, 64 nt, Human
agcaguguguggcgccacgucccgacuggccauacccacacagaagcagugcugcccggggccu

SEQ ID NO: 517581 - RNA, 64 nt, Human
gaagucauuaguugaacuauuuucacauuggccccccacacaggccacucucuucccuuucuug

SEQ ID NO: 517582 - RNA, 64 nt, Human
acuuugggcaaaucauuucacuccucaaagcccccccacacaagcuggauucccacuucuuacc

SEQ ID NO: 517583 - RNA, 64 nt, Human
auuucugcuaauagggagagggacccaccacacacccacacaugccagaggucccuccucacag

SEQ ID NO: 517584 - RNA, 64 nt, Human
gggccucucucccgcccagcauccucccugaguccccacacagggccucacucugcaccccacc

SEQ ID NO: 517585 - RNA, 64 nt, Human; identical to SEQ ID NO: 410540

SEQ ID NO: 517586 - RNA, 64 nt, Human; identical to SEQ ID NO: 413228

SEQ ID NO: 517587 - RNA, 64 nt, Human; identical to SEQ ID NO: 412741

SEQ ID NO: 517588 - RNA, 64 nt, Human
ccugcuguuuaauagacuuggggccaugugccuccccacacaugggcaaggacagguggaaugu

SEQ ID NO: 517589 - RNA, 64 nt, Human
caucaggcgcgcucauaguuguccccauugucuacccacacaaauccucaggaaaccaaccacc

SEQ ID NO: 517590 - RNA, 64 nt, Human
cacauuccucacugaaaaagaaaacacacacccacccacacacacacacacagaagaaaaugaa

SEQ ID NO: 517591 - RNA, 64 nt, Human
aggcagccaggccacaagacccuuguggucccaccccacacacgccagauucuuuccugaggcu

SEQ ID NO: 517592 - RNA, 64 nt, Human
ggguucgcugacaggcgagggucagccugcugugcccacacacacccacuaaggagaaagaagu

SEQ ID NO: 517593 - RNA, 64 nt, Human
cagggaucggcuccuggccccucgggugacccuucccacacaccagccacagauaggccugcca

SEQ ID NO: 517594 - RNA, 64 nt, Human
guagguugugaugcaggcuggagcccccgaaugccccacacacacugcagcauugaccagacca

SEQ ID NO: 517595 - RNA, 64 nt, Human
cugagacggugcugugcaggggaaagcccccgcacccacacaggaauucugcugaggucccccc

SEQ ID NO: 517596 - RNA, 64 nt, Human
auacccggaagcaagaugcacaggcgggcggcuucccacacacccgucacaagacgcggacaug

SEQ ID NO: 517597 - RNA, 64 nt, Human
cuggcagcucugccacgucaccgccugccuggcucccacacagccaugcauugucacucugccu

SEQ ID NO: 517598 - RNA, 64 nt, Human
gacagcauguucaacgagggaaccccaagacggacccacacagguccacccacgcugggggcug

SEQ ID NO: 517599 - RNA, 64 nt, Human
uaggaauugacuccggcgugcacacacguacacacccacacacaucuaucuauacauaauggcu

SEQ ID NO: 517600 - RNA, 64 nt, Human
gcgacagcgagacucuaucucaaaaaaaaaaaaacccacacaaccuuaugagguagaauuccau

SEQ ID NO: 517601 - RNA, 64 nt, Human
aguaucaccagaagacauuagggggcaguaggcccccacacaaaaccuucaggcuugaauuuua

SEQ ID NO: 517602 - RNA, 64 nt, Human
cucggagugccacacaugcccagaccuucucacacccacacaaauaggcucugccgugcacucc

SEQ ID NO: 517603 - RNA, 56 nt, Human
ccccuguuauccuggucuaauaaccccccacacauacaccucuggugaccuauuug

SEQ ID NO: 517604 - RNA, 64 nt, Human; identical to SEQ ID NO: 412742

SEQ ID NO: 517605 - RNA, 64 nt, Human; identical to SEQ ID NO: 410541

SEQ ID NO: 517606 - RNA, 64 nt, Human; identical to SEQ ID NO: 412535

SEQ ID NO: 517607 - RNA, 64 nt, Human
gaggguaguauaaaugagcacagugcacauuguccccacacaccugaauuuucagucacuggag

SEQ ID NO: 517608 - RNA, 64 nt, Human
cuggcuuguugcaagaggaguagaugcccccucacccacacaaaccccacucagucuccaccca

SEQ ID NO: 517609 - RNA, 64 nt, Human
ucucuucaagaagggcccuuugucuuucuccacucccacacaccuuucccaccaagccuugaag

SEQ ID NO: 517610 - RNA, 64 nt, Human
cugagccagggccugcauuuuugguuuuccccaccccacacauucucaaccauaguccuucuaa

SEQ ID NO: 517611 - RNA, 64 nt, Human
gggggcccuuccaggaggaaacccccuugggugccccacacagggcucuccaugaugggaacca

SEQ ID NO: 517612 - RNA, 64 nt, Human
gcccugauguggaguagacagugcgcaccucaggcccacacacggccccgcccuggggccuuga

SEQ ID NO: 517613 - RNA, 64 nt, Human
uccccucacauccuccugcccagcuccucacauacccacacauuccagggcuggggugagccug

SEQ ID NO: 517614 - RNA, 64 nt, Human
ggggguccccugcccagggcacuguccccauuuucccacacacagcucauaugcugcauucgug

SEQ ID NO: 517615 - RNA, 64 nt, Human
cucuccuuccucucguccuuggauagauucagcucccacacacacacccgcacugcccaggucc

SEQ ID NO: 517616 - RNA, 64 nt, Human
gauuucacucuucuucccagguucuucugaagcacccacacaaaaugcacacucugcgauaugu

SEQ ID NO: 517617 - RNA, 64 nt, Human
cacuccggaucgaggccuguauagggcucguuuccccacacaugccuauuucugaagaggcuuc

SEQ ID NO: 517618 - RNA, 64 nt, Human
ugcucgcuuuccuccccugccggcccccuccgcccccacacacacucgggacgucuucauugaa

SEQ ID NO: 517619 - RNA, 64 nt, Human
gcccaggcugcacacccauuucagccaucaagaacccacacagacggcagggaagguggacaca

SEQ ID NO: 517620 - RNA, 64 nt, Human
gugccggaaccuuuucaucauucugaggcuuugccccacacaugguccucacucauaucuguca

SEQ ID NO: 517621 - RNA, 64 nt, Human
cacuacucaccaguguuguucaccaacacccacccccacacacaccaacauuuugcugccuacc

SEQ ID NO: 517622 - RNA, 64 nt, Human
ccugccacccuggcaucggcuuucugugccgccucccacacaaaucagccccagaaggccccgg

SEQ ID NO: 517623 - RNA, 64 nt, Human; identical to SEQ ID NO: 412537

SEQ ID NO: 517624 - RNA, 64 nt, Human; identical to SEQ ID NO: 412743

SEQ ID NO: 517625 - RNA, 64 nt, Human; identical to SEQ ID NO: 410559

SEQ ID NO: 517626 - RNA, 64 nt, Human
cgcuccuuuaucugaugugguuuaguaaaagccucccacacaccuccccguggccugggacgug

SEQ ID NO: 517627 - RNA, 64 nt, Human
acuccuuaaagacagaagucacacuugaacaaaacccacacacaacaaaaccugauuugggaga

SEQ ID NO: 517628 - RNA, 64 nt, Human
gcagcuguuagucuccuuccuuuggcucuugagacccacacauaucacuuuagcccuaacaagg

SEQ ID NO: 517629 - RNA, 64 nt, Human
uccugccagcuucccccgucagccccaaccccagcccacacauuguaccaucucuucugcugug

SEQ ID NO: 517630 - RNA, 64 nt, Human
cugguggggaauggcuggggcugggcaggacccucccacacaccugcacccuagcuucgugcuu

SEQ ID NO: 517631 - RNA, 64 nt, Human
agagaccugugcaaaucugagcuccggcuccgaccccacacacccugagggagcccuacccuag

SEQ ID NO: 517632 - RNA, 64 nt, Human
gcaggcugcuguacccgcucugccucaagcaucccccacacagggcucugguuuucacucgcuu

SEQ ID NO: 517633 - RNA, 64 nt, Human
cccaccgggggccaccugcccucccccauccucucccacacacauuccagaagucagggccccc

SEQ ID NO: 517634 - RNA, 64 nt, Human
cuggacgugccgacauauggccauugagcuccaacccacacauucccauucaccaauaaaggca

SEQ ID NO: 517635 - RNA, 64 nt, Human
ccugagcccgugucauucuuccaaccucccugcccccacacacuuaucccagacacaacaccau

SEQ ID NO: 517636 - RNA, 64 nt, Human
auccacuugugguaaccccuuacgaugaugacaucccacacacuaagagguacaagcaggacca

SEQ ID NO: 517637 - RNA, 64 nt, Human
cggggaucugcaucuagccugcauaucacauugacccacacaaaagauuuuuaaguacgaagua

SEQ ID NO: 517638 - RNA, 64 nt, Human
cccuuugcccgccuccugcaaaccucacaggguccccacacaacagugcccuccagaagcagcc

SEQ ID NO: 517639 - RNA, 64 nt, Human
caaggacccucugaccccaucgaccugggcccugcccacacaacagucugagcaagagaccugc

SEQ ID NO: 517640 - RNA, 64 nt, Human
ucugcuuucgauucguuaagagagcaacauuuuacccacacacagauaaaguuuucccuugagg

SEQ ID NO: 517641 - RNA, 64 nt, Human
gcucuggggacagcuuccucacaccccugucccacccacacagcugcccuagcugaccccgaga

SEQ ID NO: 517642 - RNA, 64 nt, Human; identical to SEQ ID NO: 409034

SEQ ID NO: 517643 - RNA, 64 nt, Human; identical to SEQ ID NO: 412574

SEQ ID NO: 517644 - RNA, 64 nt, Human; identical to SEQ ID NO: 412575

SEQ ID NO: 517645 - RNA, 64 nt, Human
cacccuuggcucuggccaaagcuugcucccugcucccacacaggcucaauaaagcaagucaaag

SEQ ID NO: 517646 - RNA, 64 nt, Human
ccagccuucugggggugcuaugaggugauccguccccacacaugggaugggggaggcagagacu

SEQ ID NO: 517647 - RNA, 64 nt, Human
aggccucuuucuggucugucuggggguucccauucccacacaugugcccagaguagggggcaug

SEQ ID NO: 517648 - RNA, 64 nt, Human
gcaucacuugaguaguccucacccuuauccaggacccacacagaagccuguggccccacuuacc

SEQ ID NO: 517649 - RNA, 64 nt, Human
ccucuccuucgucugggaaggcaccagcaugagucccacacacccagccuucucauuucuagag

SEQ ID NO: 517650 - RNA, 64 nt, Human
uguccuggguguguaccauaccugcugggccagucccacacauuuccacccugccccuggagca

SEQ ID NO: 517651 - RNA, 64 nt, Human
gagacaggccaggcucguggcucggaagacaaaccccacacacacucaaggggucgaaaacaaa

SEQ ID NO: 517652 - RNA, 64 nt, Human
uuugcuucuggggcuggcaaaaaccuucucugaacccacacaccaaguucguaguugguaggug

SEQ ID NO: 517653 - RNA, 64 nt, Human
ggaucaacuguaccauauuuaauaaagcacaaaacccacacagauugucuuauuacagcauuug

SEQ ID NO: 517654 - RNA, 64 nt, Human
acagagagggggccaccuccccaggccguggcugcccacacaccccaauuagcugaauucgcgu

SEQ ID NO: 517655 - RNA, 64 nt, Human
gaggccggggcucccaggaagcggacgcccgguccccacacagcgccgcggccgccccuccacc

SEQ ID NO: 517656 - RNA, 64 nt, Human
cccccuccugcugcuaugccugugacccccgcggcccacacacuggacugaccugcccugagcg

SEQ ID NO: 517657 - RNA, 64 nt, Human
agggcagauguccugggcaaaccgggccccucugcccacacaccucacuugauccuuuugccaa

SEQ ID NO: 517658 - RNA, 64 nt, Human
acggugugggaacuucucacucauuggcuucuuucccacacaccugaagagcacugacugugug

SEQ ID NO: 517659 - RNA, 64 nt, Human
gagcccgagauucgcuccucccccucaugccaaccccacacaggucccggccuuuuaauguucu

SEQ ID NO: 517660 - RNA, 64 nt, Human
caaguccugagugacuuacaaagagacuuacacucccacacaauaauaaugggagacuuaaaca

SEQ ID NO: 517661 - RNA, 64 nt, Human
uugaaagacaaaauucauagaaaauggagcaaaacuguauaaacugauuuguaacuaacacugg

SEQ ID NO: 517662 - RNA, 64 nt, Human
cucggcucaggcucugcugguggaaagcgauucacuguauaaacuuuuuuuuaugaaaaaaaug

SEQ ID NO: 517663 - RNA, 64 nt, Human
aaggacugguaguuuacugauguagaugugaauucuguauaaagauguguaaauucuuuugagg

SEQ ID NO: 517664 - RNA, 64 nt, Human
gcccagcucucgaucucaccuccauccccauccacccacacacuauggauugggcucugggaag

SEQ ID NO: 517665 - RNA, 64 nt, Human
ggaaugggggagaggacgugagggaccacccccacccacacagcugccgcagcaucucacaccc

SEQ ID NO: 517666 - RNA, 64 nt, Human
agauucuuucccauucuguccaugaaucaucuuccccacacacaaucauucauaucuacucacc

SEQ ID NO: 517667 - RNA, 64 nt, Human
gagcugugguuugacagcgcuggcucugcuucuccccacacacuuacauggcaaagguaaaaag

SEQ ID NO: 517668 - RNA, 64 nt, Human
guggcagagaggcccagccucacaggccuguggccccacacaccagucccagcaaggugaccac

SEQ ID NO: 517669 - RNA, 64 nt, Human
ccuucuagggagcacccucccaccccccaccccccccacacacaccaucuuuccaucccaggcu

SEQ ID NO: 517670 - RNA, 64 nt, Human
cugagaaggugucaccuuaucuguccuccucuuccccacacacuggccucugggucccccuucu

SEQ ID NO: 517671 - RNA, 64 nt, Human
ccuccuccuggaccucuuggcccccagccccuuccccacacagccccagaagggucccagagcu

SEQ ID NO: 517672 - RNA, 64 nt, Human
uuaccacccugggguuaugaagaugguugaacaccccacacauagcaccggagauaugagauca

SEQ ID NO: 517673 - RNA, 64 nt, Human
gcugcccugcccgucucagggccaccaagucugacccacacagcgucacucacucccacacaca

SEQ ID NO: 517674 - RNA, 64 nt, Human
gccaccaagucugacccacacagcgucacucacucccacacacacccccuggcucugcugaggu

SEQ ID NO: 517675 - RNA, 64 nt, Human
gggcagggaggggacuggggaagugcgcacacagcccacacagacaacacgcacccacacagac

SEQ ID NO: 517676 - RNA, 64 nt, Human
gaagugcgcacacagcccacacagacaacacgcacccacacagacacagagggaagggguuggg

SEQ ID NO: 517677 - RNA, 64 nt, Human
aauacgucccaccugugcagcuaugugacucccucccacacacgcuuaagacaccucugcaugc

SEQ ID NO: 517678 - RNA, 64 nt, Human
aagucuagauccuggcagcccagucacagaguaucccacacacacuggugcccagagccggcuu

SEQ ID NO: 517679 - RNA, 64 nt, Human
uggauccuggaccucuacgucuuaaccacuggaucccacacaaaucagugaauggaucccaaca

SEQ ID NO: 517680 - RNA, 64 nt, Human; identical to SEQ ID NO: 410539

SEQ ID NO: 517681 - RNA, 64 nt, Human; identical to SEQ ID NO: 413114

SEQ ID NO: 517682 - RNA, 64 nt, Human; identical to SEQ ID NO: 412760

SEQ ID NO: 517683 - RNA, 64 nt, Human
uucccgcuucugaaacucccccuggagucucacucccacacaugcccauagcuagcauucaaca

SEQ ID NO: 517684 - RNA, 64 nt, Human
ccgaguuucuguccacacauugcaugcacagcgccccacacauuggauacuguuguucacgaua

SEQ ID NO: 517685 - RNA, 64 nt, Human
acccccucauggugcuacagacccugcccuggggcccacacacuccugccaggaagcccuacau

SEQ ID NO: 517686 - RNA, 64 nt, Human
agaccaccugccccggccccucuccugcaggggccccacacaggcaugagggauggcccggcca

SEQ ID NO: 517687 - RNA, 64 nt, Human
uggggggggccaggcuccagagagggggcaccuccccacacaccccccccccaccgaggccuag

SEQ ID NO: 517688 - RNA, 64 nt, Human
cggggcucagccucccccugggccgaggccuuggcccacacagcugagggagaggcccagcccu

SEQ ID NO: 517689 - RNA, 64 nt, Human
cagaaaaggaaggcaucagucacauauuagaggccccacacagggagagagguguguggcuacc

SEQ ID NO: 517690 - RNA, 64 nt, Human
gaggugaucccugcccgccccucccaccucccuucccacacagcccauggagguguuuguggac

SEQ ID NO: 517691 - RNA, 64 nt, Human
ucuugaaucgcucauaggcaugggacuccuggaucccacacaagcgcaccuaugggugccucgg

SEQ ID NO: 517692 - RNA, 64 nt, Human
ugggaccgcaguuugguccuggggaccauucauacccacacacccagcuugugccugugguuaa

SEQ ID NO: 517693 - RNA, 64 nt, Human
gagagccucccacagcugucaccaugcuccaacucccacacaaacgcuucuaccccuuccagaa

SEQ ID NO: 517694 - RNA, 64 nt, Human
acaccucaagcccuauucacaggcaccaggaaaccccacacaggaauucccaucccuggaaacu

SEQ ID NO: 517695 - RNA, 64 nt, Human
gugauguauaugugugugauguauacuauauaugcccacacaugcacuacauaacacacuauau

SEQ ID NO: 517696 - RNA, 64 nt, Human
ggagcuggggugcacauggggccugcucaccuugcccacacaucuccagccagccagggcccug

SEQ ID NO: 517697 - RNA, 64 nt, Human
ccagaccucuggaggagacaauggaugcaaacagcccacacaggaaagacaaagcaggagcgug

SEQ ID NO: 517698 - RNA, 64 nt, Human
agagggagagggccaggcuccagacucccacacgcccacacagcaccucugccaggccuaggag

SEQ ID NO: 517699 - RNA, 64 nt, Human; identical to SEQ ID NO: 412593

SEQ ID NO: 517700 - RNA, 64 nt, Human; identical to SEQ ID NO: 409035

SEQ ID NO: 517701 - RNA, 64 nt, Human; identical to SEQ ID NO: 412611

SEQ ID NO: 517702 - RNA, 64 nt, Human
gagagguggacccacuccggauuccuccacaccacccacacaccagucggcagccucccuggug

SEQ ID NO: 517703 - RNA, 64 nt, Human
acuucuccagacccccugccauccucugcugcuacccacacaggcagaauaaaaggcuuaaaug

SEQ ID NO: 517704 - RNA, 64 nt, Human
gaguccugggaucagacaccccuucacguguauccccacacaaaugcaagcucaccaagguccc

SEQ ID NO: 517705 - RNA, 64 nt, Human
gggacuugggcggggccugcccuacagugagcagcccacacaggaacgcuccucucgcgagcgg

SEQ ID NO: 517706 - RNA, 64 nt, Human
uucuugcaaagggucuggcccagggcagggcugccccacacaagggugcacugagugucguggc

SEQ ID NO: 517707 - RNA, 64 nt, Human
agaaucuuuuaaauacauucccugggccaacagacccacacacuuagccauugaaaugucaaau

SEQ ID NO: 517708 - RNA, 64 nt, Human
ccauucacacacacacacacccccacaccccacucccacacacaguuccuacugucuucagucc

SEQ ID NO: 517709 - RNA, 64 nt, Human
ugucugugucacacacuccugucgcccaccugcacccacacaaguggagcucacaggguagcug

SEQ ID NO: 517710 - RNA, 64 nt, Human
aagaccaaccacaucuggucucugccuucgguggcccacacaccuaagcgucaucgucauugcc

SEQ ID NO: 517711 - RNA, 64 nt, Human
uggcgucuuccuacgucccagaagcagcccccaccccacacaugacccacaccgcccucacgug

SEQ ID NO: 517712 - RNA, 64 nt, Human
acaggaagccacccugccugcuggggaggagggacccacacaagcccccucggcaguuuguccc

SEQ ID NO: 517713 - RNA, 64 nt, Human
gaccuaauauagccccacaggacuaugugauuggcccacacaagguuucccaaaaauuugacuu

SEQ ID NO: 517714 - RNA, 64 nt, Human
acuugacccucaggcaggagggcacugaccacaccccacacaaccucaaagggucagugcguca

SEQ ID NO: 517715 - RNA, 64 nt, Human
aguucuaggucguuccccagcaccuccagguuggcccacacagguaccauaagcugccucggcu

SEQ ID NO: 517716 - RNA, 64 nt, Human
caagcuucauuauuacguggcaaaaucccucuggcccacacagaucuguaauucacuaggcucg

SEQ ID NO: 517717 - RNA, 64 nt, Human
aagaagaucuaaguaggaugggagaaugauuuggcccacacaaggaagcaacuuuauucuauau

SEQ ID NO: 517718 - RNA, 64 nt, Human; identical to SEQ ID NO: 412612

SEQ ID NO: 517719 - RNA, 64 nt, Human; identical to SEQ ID NO: 412613

SEQ ID NO: 517720 - RNA, 64 nt, Human; identical to SEQ ID NO: 412686

SEQ ID NO: 517721 - RNA, 64 nt, Human
ccuuccauaauggaucguggucugugugacugaacccacacagagugucaugggugacaguuuc

SEQ ID NO: 517722 - RNA, 64 nt, Human
ccgccuccugcacaugcagagcagacagaaauaccccacacauuccccagccucucugcccagu

SEQ ID NO: 517723 - RNA, 64 nt, Human
ugggcaggaccagaggcccacauggaugccacuccccacacagcccccaggccugcccagccca

SEQ ID NO: 517724 - RNA, 64 nt, Human
gagacuggggaguggcuccaacagccuccugccacccacacaccacucucccuagacucuccua

SEQ ID NO: 517725 - RNA, 64 nt, Human
aaugaaugaaugagccaaagaacaaauaaaugagcccacacacccugaacgcaugcgacacacu

SEQ ID NO: 517726 - RNA, 64 nt, Human
ucugcaagguccaguaugaaauaagaauaagcagcccacacaacugggcauagugguucaugcc

SEQ ID NO: 517727 - RNA, 64 nt, Human
cugagaaugucucucaugggaacacuguuaaugacccacacaggauaagcugaaugcaaaguua

SEQ ID NO: 517728 - RNA, 64 nt, Human
ugcaugaauguuugcgaauguugacugccacugccccacacacugugucuuuauagaauucccc

SEQ ID NO: 517729 - RNA, 64 nt, Human
accuagaggauuguccaccuucugccaaggccagcccacacagcccgagccccuuggggagcag

SEQ ID NO: 517730 - RNA, 64 nt, Human
gcaggcacugggcugugcccacucgagcucacugcccacacacagcaugccuuugggugccauc

SEQ ID NO: 517731 - RNA, 64 nt, Human
cagccugggcuguguaugccugcggaugcagugucccacacaaggacacuuccucuaggaugcc

SEQ ID NO: 517732 - RNA, 59 nt, Human
auucuggggagaagcuauagaaagaggagcccacacaaagcuugaaagccugugccaga

SEQ ID NO: 517733 - RNA, 64 nt, Human
cuccugcacccaggcuggcgacagcccagcagugcccacacaggacugggcccuccgcagggga

SEQ ID NO: 517734 - RNA, 64 nt, Human
ugcccccauucauccuggcuuuccacagcccccucccacacaguuggacccgugauucucaggg

SEQ ID NO: 517735 - RNA, 64 nt, Human
gaaggaggugacagcacuugcauggucacuugagcccacacacacgcucaaccccaaguccuuu

SEQ ID NO: 517736 - RNA, 64 nt, Human
ucugggccacccuuuguuucccucauccucggcucccacacaggugacagacccagcagauagc

SEQ ID NO: 517737 - RNA, 64 nt, Human; identical to SEQ ID NO: 409036

SEQ ID NO: 517738 - RNA, 64 nt, Human; identical to SEQ ID NO: 412631

SEQ ID NO: 517739 - RNA, 64 nt, Human; identical to SEQ ID NO: 412632

SEQ ID NO: 517740 - RNA, 64 nt, Human
ccccaucccuguccucaugaccccucguccaccccccacacacacuauaaggcugagggcugcc

SEQ ID NO: 517741 - RNA, 64 nt, Human
gaaccaucaggaaaccgugaggcaagcccgucaccccacacaggcugcggcaucacccucagac

SEQ ID NO: 517742 - RNA, 64 nt, Human
uccacagccuuugugcaggccaugauggaggggucccacacaaaagcagaccugcgagaucucu

SEQ ID NO: 517743 - RNA, 64 nt, Human
gacagugcccaugaaugggacaccuguaauguaacccacacagcgguuugcagagaauguuagc

SEQ ID NO: 517744 - RNA, 64 nt, Human
guuaugcuaggugcacaauaaaucuaguaauagccccacacagaucucaucauuguugcuacuu

SEQ ID NO: 517745 - RNA, 64 nt, Human
uaaaugauuauuaugauuuuggugguaacgaucccccacacacaaccacuaugaagaaauaaug

SEQ ID NO: 517746 - RNA, 64 nt, Human
ggaagaagaaggccucacuuuugcugcugcggggcccacacagccgcugcuacuuuggggggug

SEQ ID NO: 517747 - RNA, 64 nt, Human
cuacaacugaagacaaugcacuuuacagauaucacccacacacaccucgcuggggcaggggcac

SEQ ID NO: 517748 - RNA, 64 nt, Human
gaaauacaagccuguaccaagcaagcagccuggccccacacagguauuagcaaauaugugguaa

SEQ ID NO: 517749 - RNA, 64 nt, Human
uuacucauuaggccuuaaauuaaaagaaauucugcccacacacacacaaacacauacacacaca

SEQ ID NO: 517750 - RNA, 64 nt, Human
cuugagaagcucugaauaauucaaaaguauuagacccacacagccuuggagagaccuucagaaa

SEQ ID NO: 517751 - RNA, 64 nt, Human
ccugcaagucagcuacucuccgugcccacuuccccccacacacacaccccacccuguugcugac

SEQ ID NO: 517752 - RNA, 64 nt, Human; identical to SEQ ID NO: 412874

SEQ ID NO: 517753 - RNA, 64 nt, Human; identical to SEQ ID NO: 412893

SEQ ID NO: 517754 - RNA, 64 nt, Human; identical to SEQ ID NO: 409092

SEQ ID NO: 517755 - RNA, 64 nt, Human; identical to SEQ ID NO: 412910

SEQ ID NO: 517756 - RNA, 64 nt, Human
uuuuauagcuuacuucacaaugugcccaggucagcuguauaaaauaaauacugcauuguuguuu

SEQ ID NO: 517757 - RNA, 64 nt, Human
ucuggcaguuacuuuugaagcuucacucugcuuucuguauaaagggcagucuguggucacgcaa

SEQ ID NO: 517758 - RNA, 64 nt, Human
uucauccccuucuuaguauuaggucauucuucaucuguauaauuuuuauuaacuuugagauucu

SEQ ID NO: 517759 - RNA, 64 nt, Human
guauacuuuugcuuuucaaauuauaguuuaucuucuguauaacugauuuauaaagguuuuugua

SEQ ID NO: 517760 - RNA, 64 nt, Human
aaaacaacuucaguuaaaacuauaaugugugauucuguauaacaaggugaugucuguuucccag

SEQ ID NO: 517761 - RNA, 64 nt, Human
ugaacugccuuuaucuguaaauuuuaaaguuugacuguauaaauuaucagucccuccugaaggg

SEQ ID NO: 517762 - RNA, 64 nt, Human
aagagcacuuaagagaauauuuuaaguauugcaucuguauaaguaagaaaauauuuugucuaaa

SEQ ID NO: 517763 - RNA, 64 nt, Human
gcuugcuauucauccaaaucauuuucuagagucacuguauaagggucuaugaguagcuguguau

SEQ ID NO: 517764 - RNA, 64 nt, Human
uguugcugccuuaucgaaaugcuucuagaacugucuguauaagucguauuucagacaguacuaa

SEQ ID NO: 517765 - RNA, 64 nt, Human
uuuaaucacacauugaaaaauucauuaacuuauucuguauaaaacugucuuuuaagaauuaucc

SEQ ID NO: 517766 - RNA, 64 nt, Human
auagacuugauguuuauaauuaauaccauuacaacuguauaauaaaagcaauuugaagaaaagc

SEQ ID NO: 517767 - RNA, 64 nt, Human
uuuaaauguugcuaaccuuccuuucccacuggcucuguauaaaaaacuucuggaccaaaagcca

SEQ ID NO: 517768 - RNA, 61 nt, Human
cuuuuaaaagcagagacuaauaaaauucauccuguauaauaauuuuacauaucauuucaua

SEQ ID NO: 517769 - RNA, 64 nt, Human
ugguauuuaucuguauuuuuuacaguuaugcauccuguauaaauacugauauuucauuccuuug

SEQ ID NO: 517770 - RNA, 64 nt, Human
auagcaacuuucaguaguacuucaaagaagauagcuguauaaaugucaucaaacuauacuauau

SEQ ID NO: 517771 - RNA, 64 nt, Human
ggcuaaagcucuuuuuuuccacaaucguuaguaacuguauaaaaacucaugcugcuccaccagu

SEQ ID NO: 517772 - RNA, 64 nt, Human
aaaagccugaugugggucuuacauaaaugaaugucuguauaagaaaauggacucuuuuuuuuag

SEQ ID NO: 517773 - RNA, 64 nt, Human
cucuauucuggacuuuauuacuugauucugucuucuguauaacucugaaguccaccaaaagugg

SEQ ID NO: 517774 - RNA, 64 nt, Human
uuguauacaggugucaaacuccacuugacauuuacuguauaaucugcagcaugcuauagaaagu

SEQ ID NO: 517775 - RNA, 64 nt, Human
auuacauuuguaagguauguaauuauauguauuucuguauaauauguacauauaaauaugcuaa

SEQ ID NO: 517776 - RNA, 64 nt, Human
aggcuuuuucugugcauuuaacuuugugaaaauucuguauaauuaugacuuacuaguauuuuug

SEQ ID NO: 517777 - RNA, 64 nt, Human
ccagugucuaccuuccuccucaacucccagccaucuguauaaacacaauccuuuguucucccaa

SEQ ID NO: 517778 - RNA, 64 nt, Human
aggcuuuuucugugcauugaacuuugugaaaaugcuguauaauuuugacuuacuaguauuuuug

SEQ ID NO: 517779 - RNA, 64 nt, Human
uaaguaauugaaaaugacaacacaauaacacuuucuguauaaaaguauauauuuuaugugauuu

SEQ ID NO: 517780 - RNA, 64 nt, Human
ucaugugaaaauauuuaauuugcuccuuuuaauucuguauaaacaaaucagagguuccugaggu

SEQ ID NO: 517781 - RNA, 64 nt, Human
uuauuguaccuaagggauucuaaagguguugucacuguauaaaacagaaagcacuaggauacaa

SEQ ID NO: 517782 - RNA, 64 nt, Human
uauauaaauauauauaaauaaauauauauauccucuguauaaaaugagguuucaguacaaaagg

SEQ ID NO: 517783 - RNA, 64 nt, Human
uguaaacuaauguauuucuuuauuggcuguuauucuguauaacacucauaucuuugccaaaguu

SEQ ID NO: 517784 - RNA, 64 nt, Human
uuuguuugauaaaguaugcuuauuucugugccuacuguauaaugguuaucaaacaguugucuca

SEQ ID NO: 517785 - RNA, 64 nt, Human
gcaagugaguagcuaacuuccaagcuucccauuucuguauaauuuaagcaugaaaaugagaaca

SEQ ID NO: 517786 - RNA, 64 nt, Human
augcuauugacuuaguagccaauuaucauuucuccuguauaaauuccaguuuuuauugcugcac

SEQ ID NO: 517787 - RNA, 64 nt, Human
uuggcuauugaccaugugguucacguacaaaacucuguauaaguugaaggaaaauguucauguu

SEQ ID NO: 517788 - RNA, 64 nt, Human
uucucaacauuauuguauuuuccacuuauuauuacuguauaacauaugcuaguguuuaguugga

SEQ ID NO: 517789 - RNA, 64 nt, Human
agaucugccuccaagguugaaaaggagacuaagacuguauaaacaucuucauugucaguucuca

SEQ ID NO: 517790 - RNA, 64 nt, Human
aacugaacuugaagaaaauauauugaaauuaaagcuguauaaugggccauuuacugaguguuuc

SEQ ID NO: 517791 - RNA, 64 nt, Human
guaacagagaagaaaccuaaauaauacaacauuccuguauaaugguauuucaaagaaucguguu

SEQ ID NO: 517792 - RNA, 64 nt, Human
uuucaauuaugagaugucauaggcaguaauuucgcuguauaacaagcauagacaaaugaguguc

SEQ ID NO: 517793 - RNA, 64 nt, Human
uagaagcucuaauuuuuguuuucuuuggcuaguacuguauaaaaaacagaauuguguuuuauug

SEQ ID NO: 517794 - RNA, 64 nt, Human
cagucagauccaaccauggauucgagguauuauacuguauaacccuacaaaauacauagaagua

SEQ ID NO: 517795 - RNA, 64 nt, Human
auagcauguuauccugucuaucuuuuaaagauuucuguauaagacuguugagcaguuuuuaaaa

SEQ ID NO: 517796 - RNA, 64 nt, Human
aauuauuuaaccucucaguccuaauuuuccccuucuguauaaugggaguucuggaucacaauau

SEQ ID NO: 517797 - RNA, 64 nt, Human
uguauuugugguuguugagaggcauuuucaaacccuguauaaauaauccaugcuguuggucaua

SEQ ID NO: 517798 - RNA, 64 nt, Human
agcauagccaacuacugaaaugauuuuguuaauucuguauaaugagcucaauucaaagcaauca

SEQ ID NO: 517799 - RNA, 64 nt, Human
gaagaacuaugcuuuuucaaaagcaaaaucaacucuguauaauagcacauucucuacuuuuuaa

SEQ ID NO: 517800 - RNA, 64 nt, Human
uaaacggcuuugccuagccaaggauuuuuuuuaucuguauaaaacuuuuuguauaaaguuugcu

SEQ ID NO: 517801 - RNA, 64 nt, Human
uuguggccauucuuuguagauaauuucugcacaucuguauaaguaccuaagauuuaguuaaaca

SEQ ID NO: 517802 - RNA, 64 nt, Human
uuaacuuaauaaugucuacuuaauauauaauuuacuguauaaaguaauuuuggcaaaauauaag

SEQ ID NO: 517803 - RNA, 64 nt, Human
uaacccagaaaaucugaauuggaaugcacucagacuguauaaggacaguccuauuuagacaugu

SEQ ID NO: 517804 - RNA, 64 nt, Human
augccaaaauacaugaguauuaugggauugcuaccuguauaaacaauggcacugugaaaauacu

SEQ ID NO: 517805 - RNA, 64 nt, Human
uguuacugccuuuugucaaauaaucuugacaaugcuguauaauaaauauuuucuauuuauuaaa

SEQ ID NO: 517806 - RNA, 64 nt, Human
auacaugaaagugccaaaacccuacaauuaaacacuguauaauggaauuacagaugaguuccau

SEQ ID NO: 517807 - RNA, 64 nt, Human
cccuaaauuuaaaagcaguccaguaaaagguuaacuguauaaagaaucuaugacuuuuugaggg

SEQ ID NO: 517808 - RNA, 64 nt, Human
cauuucagcuacaucaugccgcgcuguuguaauacuguauaaagaccucaaucuauccagagua

SEQ ID NO: 517809 - RNA, 64 nt, Human
uuccauuuuucuuuauaauaaaauauuugagccacuguauaaacaugagggugcacaugucaag

SEQ ID NO: 517810 - RNA, 64 nt, Human
gccaaaucaauccaugcagaugauauauuaaaaucuguauaaaggguaaagucuuacauuccaa

SEQ ID NO: 517811 - RNA, 64 nt, Human
ccucagaccaacucucuccuguauaaucucucuccuguauaaccccaccuugccaagcuuucuu

SEQ ID NO: 517812 - RNA, 64 nt, Human
ccuugaacuguucuggccucagaccaacucucuccuguauaaucucucuccuguauaaccccac

SEQ ID NO: 517813 - RNA, 64 nt, Human
auaacgaacugaaucagguugaggauuuugaaaacuguauaaccauaggauuuaggucacuagg

SEQ ID NO: 517814 - RNA, 64 nt, Human
uggccuuauuuguguauuugucuuuuuauuuuaucuguauaauuuuuuuugucagauauucugg

SEQ ID NO: 517815 - RNA, 64 nt, Human
ucaaacuuuagcaucucuguggagcugccauccacuguauaauuucgccuggcaacuggacuga

SEQ ID NO: 517816 - RNA, 64 nt, Human
ggaagaggguuggauuaucauuaccuuuacaauacuguauaaucagaaguucucugaaccucaa

SEQ ID NO: 517817 - RNA, 64 nt, Human
ucguugcaaccacugcaauaucuucguuaguaaucuguauaauacuuuguauacaaguacuggu

SEQ ID NO: 517818 - RNA, 64 nt, Human
uuucacauuuccauggcaugcacuacagaaauaacuguauaaugaaaaaguauuuaaggauaug

SEQ ID NO: 517819 - RNA, 64 nt, Human
cacauggaagauuaaugagggaaaucuuuauauucuguauaaaaacaaaagcaaauuuauauac

SEQ ID NO: 517820 - RNA, 64 nt, Human
guuuuaaauccguaugacccaguguucuagaguucuguauaaaaugauaccaacaacaaauaaa

SEQ ID NO: 517821 - RNA, 64 nt, Human
uuaucauacaacagaaaauggccaauuaaugguccuguauaaguggaaaacuguuaaggagguc

SEQ ID NO: 517822 - RNA, 64 nt, Human
caguuuuauuaccuuugcuauggacuugaacuuacuguauaaaauuaguuggaagccauguaag

SEQ ID NO: 517823 - RNA, 64 nt, Human
uaauaaucugaguagaaaugcguaauuucaauuacuguauaaaguuuauguuuuuuuaagugug

SEQ ID NO: 517824 - RNA, 64 nt, Human
ucguguuggugaguguuccuaggcuaaugauaaucuguauaauucacauccugaaacuaaggaa

SEQ ID NO: 517825 - RNA, 64 nt, Human
gaccaugcaugaauguauggcaguguccacuuuucuguauaaaauguauaaagugggguuucuu

SEQ ID NO: 517826 - RNA, 64 nt, Human
ucuugguauuugggagcuggauucuugucaacugcuguauaaaauauacucacaaaaccauugc

SEQ ID NO: 517827 - RNA, 64 nt, Human
gguccuaaugauggcauuagacuuucauaauguccuguauaaauguuuuuacugcuuuuagaaa

SEQ ID NO: 517828 - RNA, 64 nt, Human
caucugugacuugcguugcagaguguacaugaaacuguauaauugagucauucaguaaaggaga

SEQ ID NO: 517829 - RNA, 64 nt, Human
uagguugguuuauugccauuuuguuuuauuucugcuguauaaaaaccaagagccagacaauuag

SEQ ID NO: 517830 - RNA, 64 nt, Human
guguaaaucuugcaacauagcucucaagauaccacuguauaauauguaauuguuugucugcaaa

SEQ ID NO: 517831 - RNA, 64 nt, Human
acuuugaaaggccuuguagcagaggacuuggugacuguauaaaguuagugguauucagggacag

SEQ ID NO: 517832 - RNA, 64 nt, Human
auacugagcuucuuccuauuugccaugggcuucacuguauaaauaggagaggaugagagcccag

SEQ ID NO: 517833 - RNA, 64 nt, Human
uuaaucaugagccuguuuauugccauuauagcgccuguauaaguagaucugcuuucuguucauc

SEQ ID NO: 517834 - RNA, 64 nt, Human
gcauagaguauagcucuguaguggaauaugucuucuguauaacuaggcuguuaaccuaugauug

SEQ ID NO: 517835 - RNA, 64 nt, Human
gaugcagaaaaagaaaaaaacuauaaauacaaaucuguauaaaugucuauuauuaugaagaauu

SEQ ID NO: 517836 - RNA, 64 nt, Human
ggccaaaugcgcacaguugauuuucgguguguuccuguauaacggcuugaaaggaaaggagaag

SEQ ID NO: 517837 - RNA, 64 nt, Human
gaagagggaggcaaaagaggaggucagagugauccuguauaagaaagacaacuacuuuugaagg

SEQ ID NO: 517838 - RNA, 64 nt, Human
uugagagaaacacaaaaaguuauagauugauagucuguauaauauuagacaaaauaguaagcuu

SEQ ID NO: 517839 - RNA, 64 nt, Human
uacauacaaauaaacaugcaauguuuauguuguacuguauaagagguaagcuaauuaaugcagu

SEQ ID NO: 517840 - RNA, 64 nt, Human
gccaaaccaaacuacauguaaagugaacuguuuccuguauaaaguucucaucuuaaugaaccua

SEQ ID NO: 517841 - RNA, 64 nt, Human
ucagggauuuuuuguauauaagucuguguuaaaucuguauaauucagucgauuucaguucugau

SEQ ID NO: 517842 - RNA, 64 nt, Human
gcuuccagcaaguagcaugaacuucuguguucaccuguauaauuuauuuuaaagauucaaagga

SEQ ID NO: 517843 - RNA, 64 nt, Human
caauauaauuauuggguuuuuuuucuuuuuccugcuguauaacuccuugccaugcaaacucuca

SEQ ID NO: 517844 - RNA, 64 nt, Human
cauauaugaaaacaauacuaaauaaacaucugaucuguauaaaaauguaaauuaguuugacacu

SEQ ID NO: 517845 - RNA, 64 nt, Human
uccuaauagcgucuuuuaauuuauaggaggcaaacuguauaaaugauagguaugaaauagaaua

SEQ ID NO: 517846 - RNA, 64 nt, Human
aauauaauuaauaaaaauguuuuacucuuuuacacuguauaauuguaagaaauagcguauuauu

SEQ ID NO: 517847 - RNA, 64 nt, Human
uacugcacauuuuaaauucuuaacacuaauuuaucuguauaaguguuuuauaugcauauuuuug

SEQ ID NO: 517848 - RNA, 64 nt, Human
guuaauauuucaaaugugugguuuaugaauacgucuguauaaucggcuucuggagugaaacagc

SEQ ID NO: 517849 - RNA, 64 nt, Human
uuuaugccucauucuguuuaucaguucucgcaaucuguauaaaugcauuuuagaacugauagac

SEQ ID NO: 517850 - RNA, 64 nt, Human
ucuaucaacuucaggccaggcccguggcucaugccuguauaaucccagcacuuugggaggccga

SEQ ID NO: 517851 - RNA, 64 nt, Human
uuuuucacuucuaccuacauauuuguauguuuuucuguauaacagccuuuuccuucugguucua

SEQ ID NO: 517852 - RNA, 64 nt, Human
gaacaagaugcacucgcugugauuuuaagacaagcuguauaaacagaacuccacugcaagaggg

SEQ ID NO: 517853 - RNA, 64 nt, Human
uguaaaguauuuaucccacccauuaauauaauuucuguauaauaaacuugaccugaaauuauuu

SEQ ID NO: 517854 - RNA, 64 nt, Human
uguagcugagagcucuaauuuuccugucuugaaacuguauaagaacucaugugauuaaguucac

SEQ ID NO: 517855 - RNA, 64 nt, Human
agucucuucagcauuuguuuaaauuuuagaaaaccuguauaaauuacuggugcauaacuuaaag

SEQ ID NO: 517856 - RNA, 64 nt, Human
gcuuuggucccaucuuuaauugagaaacauuuaucuguauaaaacauauuuuuggauaaauaua

SEQ ID NO: 517857 - RNA, 64 nt, Human
gcagacugaaaagacaaaguuuaucuuggccuuacuguauaaaggugugcuguguccaccguug

SEQ ID NO: 517858 - RNA, 64 nt, Human
auuuugcugcgugugaaaucaugguuccugcaugcuguauaaaaguaaaccaucuuuuauccuc

SEQ ID NO: 517859 - RNA, 64 nt, Human
aguuggccaaaauacugccuguacuguuaauuuccuguauaauucacuuaaauaaaagcagguu

SEQ ID NO: 517860 - RNA, 64 nt, Human
uauuuuucuguguggaguauuuuuauaauuuuaucuguauaagcuguaauaucauuuuauagaa

SEQ ID NO: 517861 - RNA, 64 nt, Human
gaaacucuuucaaaccuaaucuguacuuuugcaucuguauaaaaauaucagugagauggaacug

SEQ ID NO: 517862 - RNA, 64 nt, Human
uuuucuaauccuccaguuauucuuuuauuucccucuguauaacugcaucuucaauacaaguauc

SEQ ID NO: 517863 - RNA, 64 nt, Human
uugaucuugugcuaugaaacaaucuuccaaagaacuguauaagguggucauaagugaauauuuu

SEQ ID NO: 517864 - RNA, 64 nt, Human
augagugugucagaaaucccuugucuauuccugucuguauaaaguguuucauuaugaccagauc

SEQ ID NO: 517865 - RNA, 64 nt, Human
cugauguagcaugcuuguugcaauugccuuuuuucuguauaaaugucuuuaaugcaauauacug

SEQ ID NO: 517866 - RNA, 64 nt, Human
uauaaaaaucuagauuaaaaguguguuuaccauacuguauaauuccauuuacaugaagcaucca

SEQ ID NO: 517867 - RNA, 64 nt, Human
aauauagccuuuaaaucauuuuuauauuauaacucuguauaauagagauaaguccauuuuuuaa

SEQ ID NO: 517868 - RNA, 64 nt, Human
aagugaguuauggcaagagaaacucagccucuuucuguauaaacuuaacagggaagggcugggg

SEQ ID NO: 517869 - RNA, 64 nt, Human
uuuagacuuuucaguguuuucuuuuuccagcccacuguauaaacuuggauuguccauuccuccu

SEQ ID NO: 517870 - RNA, 64 nt, Human
ucuaaaguuuauucagggguaauuucccugaugucuguauaaaaucaagaucuuauuuuacuga

SEQ ID NO: 517871 - RNA, 64 nt, Human
ucguguuuguaagagaagauggucauuuuauucucuguauaaaacuuagcucuaaagcagaaac

SEQ ID NO: 517872 - RNA, 64 nt, Human
ugguuucuacucaccacgugaaauaaacuaucaacuguauaaagagaacaaagugauuuuagaa

SEQ ID NO: 517873 - RNA, 64 nt, Human; identical to SEQ ID NO: 517866

SEQ ID NO: 517874 - RNA, 64 nt, Human
cuguuuauugccuuauguaaaugaguguggccaucuguauaagccucuuugacauuuucaccca

SEQ ID NO: 517875 - RNA, 64 nt, Human
guuuguuuuagaaccagccguauuuuacaugaagcuguauaauuaauugucauuauuuuuguua

SEQ ID NO: 517876 - RNA, 64 nt, Human
ucuucauuuguuggaaaugaaaacguucuagcaacuguauaaaagcguugggcauguuuguuau

SEQ ID NO: 517877 - RNA, 64 nt, Human
guuuggcacaguaugguuucaugaaauuggagcucuguauaaacugaaaaagacaaaauaagua

SEQ ID NO: 517878 - RNA, 64 nt, Human
agugguguuuguauuaaaauacuuuuucaaugaacuguauaaacuauguuuuauuaaacuacaa

SEQ ID NO: 517879 - RNA, 64 nt, Human
auuuucaguuuucugcccaauagaguuuaaauaacuguauaaaugaugacuuuaaaaaaaugua

SEQ ID NO: 517880 - RNA, 64 nt, Human
uacucuuuuuucauggacacuuugaaauguguuucuguauaaagccuguauucucaaacacagu

SEQ ID NO: 517881 - RNA, 64 nt, Human
aauauuuaguaucuagucaguaucuguagcuacacuguauaacuguucuucaauaaaaugguuc

SEQ ID NO: 517882 - RNA, 64 nt, Human
auguaaagcaauaugauuuguuacuauaauuaaccuguauaaaagauacauuuuauggugguuu

SEQ ID NO: 517883 - RNA, 64 nt, Human
cuguuuuacuuauuuaaucuguaugaugaaaauacuguauaauagugugcacugcacaucuguc

SEQ ID NO: 517884 - RNA, 64 nt, Human
uaaaacaucgauaguuuugcuguaaauaauaacacuguauaaauucuaacagaaaaauagaaua

SEQ ID NO: 517885 - RNA, 64 nt, Human
uuuuaucuguaauaagauaacugacucacaacaccuguauaaugugaugcaagucauccucucu

SEQ ID NO: 517886 - RNA, 64 nt, Human
guuuggguaaaaauucuaagcugaaugagaguuucuguauaacauaacugguuucuuucuuuuu

SEQ ID NO: 517887 - RNA, 64 nt, Human
aguaucauaguaucauuaaaguaaagauuuaagucuguauaaaggaggagaguuacugauuggc

SEQ ID NO: 517888 - RNA, 64 nt, Human
auuguuuuaucuguacauuuuuucagauauuuaacuguauaaaaauguucauuuuacacaauau

SEQ ID NO: 517889 - RNA, 64 nt, Human
uaccuccuguguggaagaaggaaacaccgagucucuguauaaucuauuuacauaaaauggguga

SEQ ID NO: 517890 - RNA, 64 nt, Human
gaauauuuuuauuuucugaaggcagagauaucuacuguauaauugcaccaaaguacauuugaaa

SEQ ID NO: 517891 - RNA, 64 nt, Human
aaaacacauguaaaaugcuuuuuaacagcugauacuguauaagacaaagccaagaugcaaaauu

SEQ ID NO: 517892 - RNA, 64 nt, Human
ucucauuaagaucugaaucuugguucuaagcauucuguauaauaugugauugcuuguccuagcu

SEQ ID NO: 517893 - RNA, 64 nt, Human
uuugguuacucagauccauuuuuaaccucuggugcuguauaaagggaauauuaaacuagaugua

SEQ ID NO: 517894 - RNA, 64 nt, Human
acauuuuugccaagacaugaaguuuuauaaagaucuguauaauugccugaaucaccagcacauu

SEQ ID NO: 517895 - RNA, 64 nt, Human
uugcugaugccugguguggguccuaaugauaucucuguauaacaaagcaguuacgaagccuaca

SEQ ID NO: 517896 - RNA, 64 nt, Human
cuuaccuccaucucacacacuugagcuugccacucuguauaauucuaacauccuggagaaaaau

SEQ ID NO: 517897 - RNA, 64 nt, Human
ucagaccagggccaaccaaucagaaggcaacuuacuguauaaauuaugcagaguuauuuuccua

SEQ ID NO: 517898 - RNA, 64 nt, Human
caaagucacccuaaaagaagaucugacaggaaagcuguauaaugagauagaaaaacgucaggua

SEQ ID NO: 517899 - RNA, 64 nt, Human
guacuuaaagguuuguuuguuuguuuuugccauacuguauaauuugggugaggucuacaaaauu

SEQ ID NO: 517900 - RNA, 64 nt, Human
cuauauaauggaauacauuuuucuuugaaagggucuguauaaucauuuucuagaaaguaugggu

SEQ ID NO: 517901 - RNA, 64 nt, Human
ugcaaccaaacguauagcagucaagccgagcaaccuguauaagcagcccaacacaaaacgagug

SEQ ID NO: 517902 - RNA, 64 nt, Human
auaaugauuugcucuuugacaacuaaaauuaggacuguauaaguacuagaugcaucacugggug

SEQ ID NO: 517903 - RNA, 64 nt, Human
caaguacuaccuuccugggccucagcuuucucgucuguauaauggaagcaagacuuccaaccuc

SEQ ID NO: 517904 - RNA, 64 nt, Human
gacauaacaaagaccuaacaguugcagauaugagcuguauaauuguuguuauuauauauuaaua

SEQ ID NO: 517905 - RNA, 64 nt, Human
aaaaucuuacuaggauugacauuuuuucugaauucuguauaaauagcuuauagugagaaguacu

SEQ ID NO: 517906 - RNA, 64 nt, Human
ugauguaaaacagaauauucuguaaaccuaaugucuguauaaauaaugagcguuaacacaguaa

SEQ ID NO: 517907 - RNA, 64 nt, Human
augcacaguuugcuauuugcuuuagagacagggacuguauaaacaagccuaacauuggugcaaa

SEQ ID NO: 517908 - RNA, 64 nt, Human
gugugggugcccuacugaacucugauuagggaaccuguauaaggguauugagugugagguugag

SEQ ID NO: 517909 - RNA, 64 nt, Human
cccauuuauacaaauuguuaauguuucuuuagagcuguauaacuauaguuugaacuagcaagga

SEQ ID NO: 517910 - RNA, 64 nt, Human
aaauacauaucgcugacuucauggaauggacauccuguauaagcacugaaaaacaacaacacaa

SEQ ID NO: 517911 - RNA, 64 nt, Human
cucuauaguuauuguuuuauguucuagugauuuccuguauaauuuaacagugcccuuuucaucu

SEQ ID NO: 517912 - RNA, 64 nt, Human
aucuauguaaauaauauagucuacaacauagagacuguauaauucuguguuauauaugugccua

SEQ ID NO: 517913 - RNA, 64 nt, Human
gcccuauccauucucuccuucccucuccagccugcuguauaaguaacaugugggucauaccuug

SEQ ID NO: 517914 - RNA, 64 nt, Human
uucuacucccucccuggucucugaaugccuucgccuguauaaagaguuggacucucuccccugg

SEQ ID NO: 517915 - RNA, 64 nt, Human
accguugugcauauuguugcuucugaaccacaaacuguauaaauggaugguuuuuugcaucugu

SEQ ID NO: 517916 - RNA, 64 nt, Human
uaaauaaauaaauaaaucccuucguguuacccuccuguauaaauccaaccucuggguccguucu

SEQ ID NO: 517917 - RNA, 64 nt, Human
cacugggagagcugguggugcagccuuccccucccuguauaagacacuuugccaaggcucuccc

SEQ ID NO: 517918 - RNA, 64 nt, Human
aaaagaaguugccugcaugccgguccaaauuguucuguauaaagaugcucuuaaaagacacaag

SEQ ID NO: 517919 - RNA, 64 nt, Human
uguguauaauuggaguagauauuaauuaagucaccuguauaauguuuuguaauuuugcaaaaca

SEQ ID NO: 517920 - RNA, 64 nt, Human
uagagccuuaaacuaugccacuggguggcagaggcuguauaaaacgcacuuguuuucaugcagg

SEQ ID NO: 517921 - RNA, 64 nt, Human
uuacauuuuaauacucuuguaggagaaaaagcaacuguauaaaugaauguagagugacuuucug

SEQ ID NO: 517922 - RNA, 64 nt, Human
acauugcuaauaaccuguggcucaauuuccucaacuguauaaugagguuacuacuaguaucuac

SEQ ID NO: 517923 - RNA, 64 nt, Human
cuccugcccaagcauauaucgucucuuuacuccccuguauaaugaguaagaagcuucuucaagu

SEQ ID NO: 517924 - RNA, 64 nt, Human
uauacuguguucauuucuaguugugcaggugguucuguauaaacuuaaaaggagauuuugaacu

SEQ ID NO: 517925 - RNA, 64 nt, Human
ucuagcugucuggcuguauaacucuuacaguagucuguauaauaagggcaucucuauuagaucu

SEQ ID NO: 517926 - RNA, 64 nt, Human
agaggacugaacagcucuuccucuagcugucuggcuguauaacucuuacaguagucuguauaau

SEQ ID NO: 517927 - RNA, 64 nt, Human
aacugucaagucaugauggagacuucagguuguucuguauaaaaugcaaaauaaauguuuuuau

SEQ ID NO: 517928 - RNA, 64 nt, Human
aaggcuggucgacuuuuuaaaaaacaugaucacacuguauaagcuacuuagaacuuugaagggc

SEQ ID NO: 517929 - RNA, 64 nt, Human
cuuguacgugucuuuaaaacuguuguagaugaaacuguauaagauuuuuacaucuugcuuaauc

SEQ ID NO: 517930 - RNA, 64 nt, Human
aaaaccuucagcugugcuaaacaguauauuaccucuguauaaaauucuucagggagugucaccu

SEQ ID NO: 517931 - RNA, 64 nt, Human
aauaaauaaguaaauacauuauugaaaagcaaaucuguauaaaugugaaauuuuuauuuguauu

SEQ ID NO: 517932 - RNA, 64 nt, Human
auuuuuguauguuuuauuguaaucauaaauacugcuguauaagguaauaaaacucugcaccuaa

SEQ ID NO: 517933 - RNA, 64 nt, Human
aaaaaucuuauuauguacuucugugugaaaaagucuguauaauauuucccuuaaauaugcauua

SEQ ID NO: 517934 - RNA, 64 nt, Human
auuucagugauaauguucauuuugaaaauauguacuguauaacauuaagaaaauauuuaacucc

SEQ ID NO: 517935 - RNA, 64 nt, Human
uucuuacacaguuuugugguagcuccgaucgcuucuguauaauuauaauuucuuacuaagcuaa

SEQ ID NO: 517936 - RNA, 64 nt, Human
uggauugaccacagucuuaucuuccaccauuaagcuguauaacaauaaaauguuaauagucuug

SEQ ID NO: 517937 - RNA, 64 nt, Human
acaccucuggauucauugucucucacagaugugacuguauaacuuucccagguucuguuuaugg

SEQ ID NO: 517938 - RNA, 64 nt, Human
uaauaaaugcugcucccccauauagucuucccuucuguauaauuaacauagguugucucauggc

SEQ ID NO: 517939 - RNA, 64 nt, Human
accaaacauuaacacauauuugugguaaacauuucuguauaaaguuaccugacacacauauaaa

SEQ ID NO: 517940 - RNA, 64 nt, Human
gauuaaagaauugcuaaaugguugucaauacucgcuguauaaaaugaguauucccauuaauagu

SEQ ID NO: 517941 - RNA, 64 nt, Human
ccuagucaaacaaggaagcuguaggugaggagaucuguauaauauucuaauuuaaguaaguuug

SEQ ID NO: 517942 - RNA, 64 nt, Human
auucugggauuugagaggaucuaaaacuauuuuucuguauaaauauuauuugccaaaaguuugu

SEQ ID NO: 517943 - RNA, 64 nt, Human
gcuggcauuauauaugaaacugcuauauacaggacuguauaaagacaguagaagauuuuaguaa

SEQ ID NO: 517944 - RNA, 64 nt, Human
auauuauuuuauaugagagcuauagcaaaauaaucuguauaaacaaggaauguguuagcuuaaa

SEQ ID NO: 517945 - RNA, 64 nt, Human
uuguaguuauaucaguguauauacacgaggggaacuguauaaagacauacuaaagggaacagau

SEQ ID NO: 517946 - RNA, 64 nt, Human
uaucacacuguauauaaacauaucaauguuuguccuguauaagaauuacuaaauuacaaaugca

SEQ ID NO: 517947 - RNA, 64 nt, Human
cacucuuuucuuuuggaauuagauucaugacuuucuguauaaaauucaaaugcagaaugccuca

SEQ ID NO: 517948 - RNA, 64 nt, Human
cacuucacuaacuacucuggcgucaauggauauucuguauaauacuaucaagucccuuuucucu

SEQ ID NO: 517949 - RNA, 64 nt, Human
uuuguucagaaaaguuuauagaauucacauaauucuguauaaacuauggagauccacaguacuu

SEQ ID NO: 517950 - RNA, 64 nt, Human
uaugaauguuucccaaauaaacuaugaauguuuccuguauaauauaugaauguuucugagaaga

SEQ ID NO: 517951 - RNA, 64 nt, Human
cucgaaacguuuucauccaugcuuagcaucuacucuguauaacgcaugagaggggaggcaaaga

SEQ ID NO: 517952 - RNA, 64 nt, Human
aagauauuuugaauaucagucaugauggcaauuucuguauaaaagagccuuaaauggaacauug

SEQ ID NO: 517953 - RNA, 64 nt, Human
caaauuguucaugaaaauggaacauuaaaucaugcuguauaaagcaauaacaauugauugacca

SEQ ID NO: 517954 - RNA, 64 nt, Human
aaugucuauaggcaacuugagauuauaguuuuggcuguauaaauaaaacugugagaagaaaaaa

SEQ ID NO: 517955 - RNA, 64 nt, Human
uuuauugcuuauaauuuauuaagaauguuuacaccuguauaaggauuucauauauacauuguau

SEQ ID NO: 517956 - RNA, 64 nt, Human
gcucuauaauuaggauaggccagaacccuggccacuguauaaaauuggaaagucucuaagacac

SEQ ID NO: 517957 - RNA, 64 nt, Human
uaccaguauuguucaauaauccaugguucaaagacuguauaaaugcauuuuauuuuaaauaaaa

SEQ ID NO: 517958 - RNA, 64 nt, Human
uuccuccauuuuugagcauauuauccaaaauggucuguauaauauaaaugagaaugaugcaguu

SEQ ID NO: 517959 - RNA, 64 nt, Human
aagauaauuacugauaaaugaaggggauauucgacuguauaaccauauggaagugugugugugu

SEQ ID NO: 517960 - RNA, 64 nt, Human
acauguguuuggaacuguugaaaugccaaguuuucuguauaaguguuuuuguaauuaaacuuuc

SEQ ID NO: 517961 - RNA, 64 nt, Human
uguuuaacccugaaaucccucuagguuaucuauacuguauaaaaaagcaauuacccuuaaaacu

SEQ ID NO: 517962 - RNA, 64 nt, Human
cccuagucacauggcagacccacggccuggcccacuguauaaaauaaaccuguuugcuucuuag

SEQ ID NO: 517963 - RNA, 64 nt, Human
ggcagagcugcaucauccuugcagguggggguugcuguauaaguuauuuuuguacauguucggg

SEQ ID NO: 517964 - RNA, 64 nt, Human
acauaaguggaaucaguaugaauagaagaacuugcuguauaaaggaauuucauggcaacaaugc

SEQ ID NO: 517965 - RNA, 64 nt, Human
cuugauuguucgggugugcaaugucugagugaaccuguauaaguggaggcacuuuagggcugua

SEQ ID NO: 517966 - RNA, 64 nt, Human
ccaccgcccucccgcccccaccuggcguguaguacuguauaaaccagucagcugucggguuagu

SEQ ID NO: 517967 - RNA, 64 nt, Human
gacacguauuugaaauuugaaauuuccuucugcacuguauaaaaggaccauuugaggauguuuu

SEQ ID NO: 517968 - RNA, 64 nt, Human
gcuccauggaaaagcgggcuugacugcauugccgcuguauaaagcauguggucuuauaguguuu

SEQ ID NO: 517969 - RNA, 64 nt, Human
gcauucgucugcaguagacacgaguuccucggaccuguauaaucucccaaagccaagguuuggu

SEQ ID NO: 517970 - RNA, 64 nt, Human
cauuuucuaguuuuccacuauuauuguauauuaucuguauaauaaaaaauaauuuuaggguugg

SEQ ID NO: 517971 - RNA, 64 nt, Human
aauuaacuauuaacuacauucaccuuguaaauuacuguauaaaacuuguugacaaugcacugac

SEQ ID NO: 517972 - RNA, 64 nt, Human
uuuugaacuuguguugacuguugauacuuauuuacuguauaaauauaauuuaucauuuguacca

SEQ ID NO: 517973 - RNA, 64 nt, Human
uucuguuuuuuauauguaaacagaucuacuaauccuguauaaaaguuauuuuacgauguuuguc

SEQ ID NO: 517974 - RNA, 64 nt, Human
gugcuguaaagaguaguuguaauuggaauuucuacuguauaaauguuuuacauuaaguguuacg

SEQ ID NO: 517975 - RNA, 64 nt, Human
uaccaaaaugccaacauuuccacgacagacuuaacuguauaauuucguuguaaaaucuguaagu

SEQ ID NO: 517976 - RNA, 64 nt, Human
cuuaaagcacucauaauauggcauccuucaauuucuguauaaaagcagaucuuuuuaaaaagau

SEQ ID NO: 517977 - RNA, 64 nt, Human
uuaacaugaagaccaaguuuauauaacuagguaucuguauaaugcaacaacauuggaacacaau

SEQ ID NO: 517978 - RNA, 64 nt, Human
uaaauaaaauaguguugauguacugaaauaugaacuguauaaaaaguauuaguaauuguauaug

SEQ ID NO: 517979 - RNA, 64 nt, Human
aauuaacuauuaaccacauucaccuuguaaaugacuguauaaaacuuguugacaaugcacugac

SEQ ID NO: 517980 - RNA, 64 nt, Human; identical to SEQ ID NO: 517971

SEQ ID NO: 517981 - RNA, 64 nt, Human
cuguaucucugcaggccauacugguuccauuguucuguauaauacugaauaaauaaauuuacuu

SEQ ID NO: 517982 - RNA, 64 nt, Human
acccccuaugguugauauuguuauaauguauauacuguauaauaugaaagagaaucgauguauc

SEQ ID NO: 517983 - RNA, 64 nt, Human
uugccugaaaacccauuaaaagaaaacgugccuucuguauaaguuuauguuuauuccuacauuu

SEQ ID NO: 517984 - RNA, 64 nt, Human
ugugcagauguaaaucuuguaauuaauggucaaacuguauaaagggauugguagucaaaacaug

SEQ ID NO: 517985 - RNA, 64 nt, Human
uggguuucaguuuuugaaucuuguauuuauuuuucuguauaaugaaauuaauaucuagacuuga

SEQ ID NO: 517986 - RNA, 64 nt, Human
ccgagaggaaagugccgucuuucauagcuggucucuguauaaagaguauguagcaacaacuguu

SEQ ID NO: 517987 - RNA, 64 nt, Human
gagaaaaacuaauauauuugagauguuccauuuucuguauaaaagggaacaguguggagauguu

SEQ ID NO: 517988 - RNA, 64 nt, Human
guuacccccuaagucuccaauauugcagguuucccuguauaacguaaacacacuugcccucaug

SEQ ID NO: 517989 - RNA, 64 nt, Human
uuaucaguuuuuuucacacaucagaaaaaacugacuguauaaacacuuaucacugaccuuuuuc

SEQ ID NO: 517990 - RNA, 64 nt, Human
uagcagcagauguaguuucagacuuggaguaaaacuguauaaacaaaagaaucuuccauauuua

SEQ ID NO: 517991 - RNA, 64 nt, Human
cccuguuuuccaccagaguucugacacugugacucuguauaaaaugguugggaagcugcaccca

SEQ ID NO: 517992 - RNA, 64 nt, Human
ggugcccagauuucauauugcucaaacacacaugcuguauaauuugugcaguuaaugcaauuau

SEQ ID NO: 517993 - RNA, 64 nt, Human
uaacaggcacauuagaucuuacaccagacacaaacuguauaagugucaggaauauggagagaag

SEQ ID NO: 517994 - RNA, 64 nt, Human
gugggccucgggucccccugaacucccuguauaucuguauaaauaacgggauuuucauggcgcc

SEQ ID NO: 517995 - RNA, 64 nt, Human
uuuucucuaugcagacaaccauugauuuacucugcuguauaauacuuuccauuuucuagaauuu

SEQ ID NO: 517996 - RNA, 64 nt, Human
aggcaagaacauccuggaggccaggaguucgacacuguauaacagauauaucugacagcaguaa

SEQ ID NO: 517997 - RNA, 64 nt, Human
ucccauugcaucaccucuguaauuuuucagcucucuguauaaacauuaaaugucuuauauagca

SEQ ID NO: 517998 - RNA, 64 nt, Human
cuauuuauagaaagcuucaauagaacuguuucaacuguauaacuauuuacuauucaaauaaaau

SEQ ID NO: 517999 - RNA, 64 nt, Human
ucugaccacuuguguuaggaaaacuaucggcucccuguauaauaaaucaagccagguccuccaa

SEQ ID NO: 518000 - RNA, 64 nt, Human
guugguuccgcccguggagacgacgauaguguuucuguauaauaaagugucugccggcucgcgg

SEQ ID NO: 518001 - RNA, 64 nt, Human
ccuuacucugcuauaauuucuccuuaauaggacacuguauaacuuauuuucuuauuaucuucuu

SEQ ID NO: 518002 - RNA, 64 nt, Human
acuuugcagcuacuaauuuugacaccuuuuagaucuguauaaaaguguguuguguugaagcagc

SEQ ID NO: 518003 - RNA, 64 nt, Human
auggaagauaaacugcacacuuucccugaacacacuguauaaacucuuuuuaguucuuaacccu

SEQ ID NO: 518004 - RNA, 64 nt, Human
auugacuugguuccagaauuuuguaauucuggaucuguauaaggaauggcaucagaacaauagc

SEQ ID NO: 518005 - RNA, 64 nt, Human
uuaggagacaauuagauaaaaauguaugugaugacuguauaaggaggccuguguguaugaauuu

SEQ ID NO: 518006 - RNA, 64 nt, Human
aagcugacacugcaggguccugaguaaauguguucuguauaaacaaaugcagcuggaaucgcuc

SEQ ID NO: 518007 - RNA, 64 nt, Human
ucugucccuuuaaagucuuuacauguaauuguagcuguauaaucguuauuuuucuuuugcaucu

SEQ ID NO: 518008 - RNA, 64 nt, Human
aucuuuuuaaaacuaaugaguaugaacuugagaucuguauaaauaagagcaugauuugaaaaaa

SEQ ID NO: 518009 - RNA, 64 nt, Human
aaauuauaggauuuuuuucuuuuuuaguaaaaaccuguauaaaaaccaaaauuauaggauuuuu

SEQ ID NO: 518010 - RNA, 64 nt, Human
uaaaaaguaauuagguauaauuccaaauagauuucuguauaaauuguaucuaacuggauuacaa

SEQ ID NO: 518011 - RNA, 64 nt, Human
ccuuuuucaucaguugcauuuuccaggcugagagcuguauaaaacauuuuggacugugaccaug

SEQ ID NO: 518012 - RNA, 64 nt, Human
agcuauagcuuuguuuauuucacccguucacuuacuguauaauuuaaaaucauuuauguagcug

SEQ ID NO: 518013 - RNA, 64 nt, Human
caaaguguugaugagccacuguaccccgauaccacuguauaaaaaauuuaaaaaaaauugugag

SEQ ID NO: 518014 - RNA, 64 nt, Human
cuuucagcccaagauagcuacaugucuuuacuugcuguauaaguuuuccuuuuguccugggggu

SEQ ID NO: 518015 - RNA, 64 nt, Human
gagugaaggacuggguguuacuggagggaacacacuguauaauaccuuuuguuucuguucuaaa

SEQ ID NO: 518016 - RNA, 64 nt, Human
auugcauauaucagauugaguaggaaauuguguacuguauaagacuuauuuaaauagucauuaa

SEQ ID NO: 518017 - RNA, 64 nt, Human
gcaguuuagugcaucuuugccucucgguugaaaccuguauaacccuguuacaaagcuguguugu

SEQ ID NO: 518018 - RNA, 64 nt, Human
uuaaguggaaggaaaagagugcugagaaauggcucuguauaaucuauggcuauccgaauucucu

SEQ ID NO: 518019 - RNA, 64 nt, Human
uuaagacuuguauauaaacugcuuuuuccaaacucuguauaacuuuuaaauggcuggaacuacu

SEQ ID NO: 518020 - RNA, 64 nt, Human
augugcuuauuauauuucuuuuuagauugucuaucuguauaacacacacacacacaccuaagag

SEQ ID NO: 518021 - RNA, 64 nt, Human
aguucucagugucuacauguagacuauuccuuuucuguauaaaguucacucuaggauuucaagu

SEQ ID NO: 518022 - RNA, 64 nt, Human
gccaauagauauuaaaagcaaacccucacugcugcuguauaaaguugccuaauguaaaugucua

SEQ ID NO: 518023 - RNA, 64 nt, Human
uuaaucaaaaugagcuauaaacauggagcaaucacuguauaauuuuaaaauaguuuaccuggcc

SEQ ID NO: 518024 - RNA, 64 nt, Human
ugcagaugccugggccguagcuugucuguagcgucuguauaauuauaauguugcccagugugag

SEQ ID NO: 518025 - RNA, 64 nt, Human
uuuuuuuaggaaucaaugacuuaacagaacucaacuguauaaauaguuugguccccuuaaaugc

SEQ ID NO: 518026 - RNA, 64 nt, Human
cauggcaccuucaauuugccaucgugacgcagaccuguauaaauuagguuaaagaugaauuucc

SEQ ID NO: 518027 - RNA, 64 nt, Human
aaucccuaaguccccugaaauuauauaaggcauucuguauaaaugcaaaugugcauuuuucuga

SEQ ID NO: 518028 - RNA, 64 nt, Human
aauucugaauuuugguaaaucacacugaaacuuucuguauaacuuguauuauuagacucucuag

SEQ ID NO: 518029 - RNA, 64 nt, Human; identical to SEQ ID NO: 518028

SEQ ID NO: 518030 - RNA, 64 nt, Human
cuguuuucauuauuuuucuacuuugugucauguccuguauaaacaggaauauuuagaggguguu

SEQ ID NO: 518031 - RNA, 64 nt, Human
gagacggacguguagcccuggcgaggccagccggcggcagcacagccugucuccaaucagcaag

SEQ ID NO: 518032 - RNA, 64 nt, Human
agugcugaggagaaaggaggggcaguggcuuccccggcagcagccccaugauggcugaauccga

SEQ ID NO: 518033 - RNA, 64 nt, Human
uggggguucaugggaucccgaaggagcaagcagucggcagcacccaggccacaggagacuccgc

SEQ ID NO: 518034 - RNA, 64 nt, Human
aucucaggcagcaagacaaucuuucacucacugacggcagcagccaugucucucaaagugguga

SEQ ID NO: 518035 - RNA, 64 nt, Human
ucugucagcaugcagagggauccaggaauccccccggcagcacggcccgcuuuccuucuccucc

SEQ ID NO: 518036 - RNA, 62 nt, Human
uuguauuuagcuuugaguuucucugcaucuguccaccccauguguauauaacccagccccug

SEQ ID NO: 518037 - RNA, 62 nt, Human
accaaggugugugugucuggaggaaccacugcccaccccaccaccccggggucucuggggaa

SEQ ID NO: 518038 - RNA, 62 nt, Human
gugccuugggagaaccaguccuuccuuuugacccaccccaggaagauggagugcucuuuucu

SEQ ID NO: 518039 - RNA, 64 nt, Human
gccgccaucucacacgccucccuccuguggccgccggcagcauggacaaaggucuccaugcagg

SEQ ID NO: 518040 - RNA, 64 nt, Human
cauggggaaggggguuaguagacuauguggauugcggcagcagaggcugcagccuaacgugugg

SEQ ID NO: 518041 - RNA, 64 nt, Human
ccauuuacucagaaaaaaugucccuuacaggaaccggcagcagcuaggcagucaccggcccgcc

SEQ ID NO: 518042 - RNA, 64 nt, Human
cagcugucugcugaugaacggcccaucugcacagcggcagcaaggauuaccccaagggcaggaa

SEQ ID NO: 518043 - RNA, 64 nt, Human
ggcugucuauauccuuguuacucagagcauggcccggcagcaguguugucacagggcagcuugu

SEQ ID NO: 518044 - RNA, 64 nt, Human
caaccgucuaaacaguguugugcagucgcaguggcggcagcagcggcagccguccgucacucca

SEQ ID NO: 518045 - RNA, 64 nt, Human
gggaggguccccuccuccuucccuacuccugggacggcagcaaggacaugggggcugcuguuag

SEQ ID NO: 518046 - RNA, 64 nt, Human
acaagcaggggacggaaagagagagacacucaggcggcagcauucccucccagccacugagcug

SEQ ID NO: 518047 - RNA, 64 nt, Human
cgccugcccaguguuucugggccucacggugcuccggcagcagagcgcauggugcuagccaugg

SEQ ID NO: 518048 - RNA, 64 nt, Human
gcgcuucucgugguuggcgugcugcagcgacaggcggcagcacagcaccugcacgaacacccgc

SEQ ID NO: 518049 - RNA, 64 nt, Human
gaguccagaccccacaacuucaggagcucuuucccggcagcagagaucugcaggcugccucuuc

SEQ ID NO: 518050 - RNA, 64 nt, Human
acuacuaaaauguaaaaaauuaaugugcucaccucggcagcacauauacuaaaaauuaauaaga

SEQ ID NO: 518051 - RNA, 64 nt, Human
ucucuugcaccauuaaauaguguguuaagugcuacggcagcaaauugcuacaugugcuggauau

SEQ ID NO: 518052 - RNA, 62 nt, Human
caucccuguugugcccuuuaagagacauguuuccaccccacccccaaccuugucccaagugc

SEQ ID NO: 518053 - RNA, 62 nt, Human
uuucuuccccccucacugugaaaaauaacaguccaccccaagucauacacuggacccagugc

SEQ ID NO: 518054 - RNA, 62 nt, Human
agcagcaacacgagacccuccagcuuugggagccaccccacaccuggccaacgcuggcggcc

SEQ ID NO: 518055 - RNA, 62 nt, Human
gcuucccaaagugcuggaauuacaggccugagccaccccacccggccuauuuucuuaaaggg

SEQ ID NO: 518056 - RNA, 64 nt, Human
gauggcccggcuagccgccuggacugcaggggggcggcagcagcggcgguggcagugggugccu

SEQ ID NO: 518057 - RNA, 64 nt, Human
gucaucuugguucugccauccucuugccuuccuacggcagcagcuguucauggcacugaagaug

SEQ ID NO: 518058 - RNA, 64 nt, Human
ucccuggcaugacuccaugaauuugucuccagaacggcagcaggaaagucuuuuuuguuucccc

SEQ ID NO: 518059 - RNA, 64 nt, Human
cugagaaagccagccccgccugcuuagucagccccggcagcagggcagccaugggaacucagga

SEQ ID NO: 518060 - RNA, 64 nt, Human
agcugagaccaaggucugugggcucuaggcagcccggcagcagcccccagaggaacugcuccca

SEQ ID NO: 518061 - RNA, 64 nt, Human
uccaucagcugcauacuuacuaccagcuaggucgcggcagcagugauggauuuauaguuccucc

SEQ ID NO: 518062 - RNA, 64 nt, Human
cugugcccucugggugggguggccuccccgcacucggcagcauggccaggcuggccagggcgug

SEQ ID NO: 518063 - RNA, 64 nt, Human
gcggagcuccguggaacuggagcuagagcggugccggcagcaagcaggccuccuggugaccgga

SEQ ID NO: 518064 - RNA, 64 nt, Human
uagcugaaccagcagaccuaccugcagugggaaccggcagcaucccagccaggguuugcuguuu

SEQ ID NO: 518065 - RNA, 64 nt, Human
gacccgagccgucccagaaaccaaagggcaggcacggcagcaaacgccugagguaauuuucauc

SEQ ID NO: 518066 - RNA, 52 nt, Human; identical to SEQ ID NO: 266788

SEQ ID NO: 518067 - RNA, 64 nt, Human
ggcuccuggauuauagccugcacaaggagaggaccggcagcaaucgauuugccaagguuggauu

SEQ ID NO: 518068 - RNA, 64 nt, Human
gcgugucucugaacugcgccaucaacuccagucucggcagcagcuccgcucccggcgccaccca

SEQ ID NO: 518069 - RNA, 62 nt, Human
ucaagugcuuucucuuuuacacuccccuguccccaccccagugcacucuucuggcccaggca

SEQ ID NO: 518070 - RNA, 62 nt, Human
aacaaagucuucaucucucucuccaguuucacccaccccacccuuugcuuucauuucaggug

SEQ ID NO: 518071 - RNA, 62 nt, Human
gcaagugcugcuuuacuaacugacguguuggaccaccccaccgcuuaauggggcacgcacgg

SEQ ID NO: 518072 - RNA, 62 nt, Human
ugauaaacugagguuuguuuuggcaccuucugccaccccagcagaagccuucauacaaguaa

SEQ ID NO: 518073 - RNA, 64 nt, Human
ccacagugccaaugcuugucagacacaugcccuucggcagcauuccagaacaggagggaagaga

SEQ ID NO: 518074 - RNA, 64 nt, Human
aagacugcuccuggugagccugugcauagggaagcggcagcaucggaugucagcccccugcggc

SEQ ID NO: 518075 - RNA, 64 nt, Human
cagucuguccuauggggagcaguuugggggcggccggcagcaggagccugggaaagaggcccuc

SEQ ID NO: 518076 - RNA, 64 nt, Human
ugaacgacagugccuuggaaaggcaggcuccaugcggcagcaacaggauugucuucgguaccuu

SEQ ID NO: 518077 - RNA, 64 nt, Human
acagcucaguucugucauccaggacauggccgugcggcagcaccugcucacuaaccugguagag

SEQ ID NO: 518078 - RNA, 64 nt, Human
gguuucccaggaggaggaggccccugaaggggugcggcagcaggggggugggaagggaggguaa

SEQ ID NO: 518079 - RNA, 64 nt, Human
ggguccaagucucccucaggaaggccuuuucuaucggcagcaauuccaucaagccaagccuccu

SEQ ID NO: 518080 - RNA, 64 nt, Human
agaggccauagcugcuccagccggggcuccggggcggcagcagagcuggcacaccgauucuggg

SEQ ID NO: 518081 - RNA, 64 nt, Human
agaagaaagaacggagugaagccauuuaugccuacggcagcagaaagagaugaaaucuugagag

SEQ ID NO: 518082 - RNA, 64 nt, Human
uauuauaacaaucauaacuaacauuuacugugcccggcagcaaauuaaguauuugacaaacauu

SEQ ID NO: 518083 - RNA, 64 nt, Human
ugcggcccagacguccagggagccggccccuccccggcagcaggccggggcggagcaggagcgg

SEQ ID NO: 518084 - RNA, 64 nt, Human
gggcacacuuuggugaccccaacgagaacccucucggcagcagccaggagcuguucaccuucca

SEQ ID NO: 518085 - RNA, 64 nt, Human
agcaagugugugcucagagcaucuuuguucuucacggcagcagcuaccuucccucacugucuca

SEQ ID NO: 518086 - RNA, 62 nt, Human
gagggcaucucccugcuccccucaacccccucccaccccauccacgcccccuaccuuuccca

SEQ ID NO: 518087 - RNA, 62 nt, Human
cucaucccucuuuuucuuucuuccaccacuccccaccccagcuguaguuaauuucagugccu

SEQ ID NO: 518088 - RNA, 62 nt, Human
ccccuuccuccuucaugccugggccugcaggcccaccccagccaccacugaguccacucgga

SEQ ID NO: 518089 - RNA, 62 nt, Human
aaccauacacacauacaaguccacacacacucccaccccagccaaaaauauauaaaaaacaa

SEQ ID NO: 518090 - RNA, 64 nt, Human
cugaugaagagcauccucuuuauucaguauaagccggcagcaagcaguucuaccuaacguccca

SEQ ID NO: 518091 - RNA, 64 nt, Human
agcauccaacucugacuucggaggcauucccagccggcagcaguguguccagccugccucuucc

SEQ ID NO: 518092 - RNA, 64 nt, Human
cuggucccugucccucuggugguuggggauggagcggcagcaagggguguaauggggcuggguu

SEQ ID NO: 518093 - RNA, 64 nt, Human
gggucucgugcccagaugaaaccauuuggaaacucggcagcagaguuuguccaaaugacccuuu

SEQ ID NO: 518094 - RNA, 64 nt, Human
ucauggugggaggcaaaaagcacuucuuacauggcggcagcaagagaaaaugagaaagaagcaa

SEQ ID NO: 518095 - RNA, 64 nt, Human
uuguuugagguuuaaaacaauucaauuacaaaagcggcagcagccaaugcacgccccugcaugc

SEQ ID NO: 518096 - RNA, 64 nt, Human
uauaguaaaaaugcauaugcacgugcaauuugcacggcagcauuucaccgauuguggacuguau

SEQ ID NO: 518097 - RNA, 64 nt, Human
uacugagcugcuuugugaugcugaaggauacugccggcagcaggcagaggagggagggggccua

SEQ ID NO: 518098 - RNA, 64 nt, Human
agguuucuagagucuuccagcugcaucuucaugccggcagcauuuuggauuuugugcaaucaug

SEQ ID NO: 518099 - RNA, 64 nt, Human
uggugaccagacacugcccacugcagugccaagacggcagcaggacuggggcugauagcccacc

SEQ ID NO: 518100 - RNA, 64 nt, Human
ggaggaugccuucuacacguuggugcgugagauccggcagcacaagcugcggaagcugaacccu

SEQ ID NO: 518101 - RNA, 64 nt, Human
auuccagcccccuugcuucacucuaccggacagacggcagcagucccagcucugguuuccuucu

SEQ ID NO: 518102 - RNA, 64 nt, Human
gcagagcccucgugcauugacuugacagccucuccggcagcacaggccuagcugguucuggguu

SEQ ID NO: 518103 - RNA, 62 nt, Human
caacaacccccaaccaccaucuaccacuacggccaccccaaaggaccccgacgccaacagac

SEQ ID NO: 518104 - RNA, 62 nt, Human
gaauucaguuuuucaauuguggaaauuuccugccaccccaacaguauuuuuguguguuaauu

SEQ ID NO: 518105 - RNA, 62 nt, Human
aaugcugcacugcagcaaaaacaaaaccaccaccaccccagagaaaaccauguacuaauugg

SEQ ID NO: 518106 - RNA, 62 nt, Human
gcugcaucugcugaagcgagaaccccauucugccaccccaccaggaugcccauucuccagga

SEQ ID NO: 518107 - RNA, 64 nt, Human
uagcugaugcaugcuuuaauauuugccuauagcccggcagcaaggaagucggggcggggggacu

SEQ ID NO: 518108 - RNA, 64 nt, Human
ccccucugcucuguacccuuuuuccuuuuguccccggcagcagggaagaagcuggaggccgugg

SEQ ID NO: 518109 - RNA, 64 nt, Human
auucuuaagaaaaccugaauggauuucaucaaggcggcagcauaauuugaagggcaauugcgug

SEQ ID NO: 518110 - RNA, 64 nt, Human
ugcgggggguaccaugcagccggugucugacuuccggcagcagcugcuggccugugccggggug

SEQ ID NO: 518111 - RNA, 64 nt, Human
caccugacacccacuggggugcacuuuaauguuccggcagcaagacuggggaacuucaggcucc

SEQ ID NO: 518112 - RNA, 64 nt, Human
auuuagcugcaguaucaauguggcauaaauacugcggcagcauucuucgaaaaccgcauuuuca

SEQ ID NO: 518113 - RNA, 64 nt, Human
guugaggaacgcuucagccuuagcugcuaccuuucggcagcagugaaauacaagcugcagccuc

SEQ ID NO: 518114 - RNA, 64 nt, Human
aggcaguucuuuguucaagcguuccucuggggaccggcagcagaggcaccguguucucucagcc

SEQ ID NO: 518115 - RNA, 64 nt, Human
gugugagcaguucagccugcagcagaggagggcacggcagcagagacacgcacaugcacguaag

SEQ ID NO: 518116 - RNA, 64 nt, Human
aucuacaucagaaccaaacuacuucuccaacacccggcagcacuuggcccugcaagcuuaggau

SEQ ID NO: 518117 - RNA, 64 nt, Human
agggagcauguaccccagguacauccaugaacugcggcagcaguuugacuuauugcuguuucag

SEQ ID NO: 518118 - RNA, 64 nt, Human
cggugauguggaugagugaagggagccagguacacggcagcagggcagaggagacuauggggag

SEQ ID NO: 518119 - RNA, 64 nt, Human
gugaguccauguggagagagcacugugugcgcagcggcagcagcacagacguccaugaggaaaa

SEQ ID NO: 518120 - RNA, 64 nt, Human
guuuugcaaaaugaaaaaguucuggagaucaguugugcaacaauaugaauauacauaacaauac

SEQ ID NO: 518121 - RNA, 64 nt, Human
acacucaccucuaaaacaguccuucaaacuuccagugcaacacugaagcucuugaagacacuga

SEQ ID NO: 518122 - RNA, 64 nt, Human
agaaccacuccuccaggagagcuggauguuuugcgugcaacaccuugagcacugacugcuauug

SEQ ID NO: 518123 - RNA, 64 nt, Human
aucauaugguugaaauauugaaacauauuaaauugugcaacaccuagaauagugcuagacauac

SEQ ID NO: 518124 - RNA, 64 nt, Human
gaaccacuacuaucauucacuagcucauaucugccggcagcaauugaagagauccaauauuuga

SEQ ID NO: 518125 - RNA, 64 nt, Human
uggaaucugcuuuuccaagccgccaggguccugacggcagcaggacgaagccuguuguggcguc

SEQ ID NO: 518126 - RNA, 64 nt, Human
caaggaggguguaauggagcaucaagccacucggcggcagcauggagcuauaacuaagcauccu

SEQ ID NO: 518127 - RNA, 64 nt, Human
uucggcagccaacucgaaagcaggcgguugugugcggcagcaguuggcguuugcuuugcacuuc

SEQ ID NO: 518128 - RNA, 64 nt, Human
aaucuuuuuugaagaguuuuucuugugcuugcuucggcagcauauauacugaaauuagaaaaag

SEQ ID NO: 518129 - RNA, 64 nt, Human
gcccucugagugagccccacgggguccaggcgggcggcagcagcccaggggccccaggccuccu

SEQ ID NO: 518130 - RNA, 64 nt, Human
ccacugaagaggucuguacagugacaacccgggccggcagcaaggacacagaugcagccacagu

SEQ ID NO: 518131 - RNA, 64 nt, Human
agucccagggaaugaaugguggucuccccacucccggcagcacuuuaggcagcccauaagcuau

SEQ ID NO: 518132 - RNA, 64 nt, Human
cuccacccugucccccagcucuggugagucuuggcggcagcagccaucauaggaagggaccaag

SEQ ID NO: 518133 - RNA, 64 nt, Human
cccgcuggagggacacucaccccaucugcucccacggcagcaccaucaacucaacaagucagaa

SEQ ID NO: 518134 - RNA, 64 nt, Human
ggaggacgcagcguccagggccagcgagcucccccggcagcagguccccaagccaugucaggca

SEQ ID NO: 518135 - RNA, 64 nt, Human
agcaccuucgcuuugcaucucgguagaggagaaacggcagcacagcccaaggaccaaaggaggg

SEQ ID NO: 518136 - RNA, 64 nt, Human
gggcaucuguuaacagaggagaacgucuggguggcggcagcagcuuugcucugagugccuacaa

SEQ ID NO: 518137 - RNA, 64 nt, Human
ggaugcauugaaauuauauguaauuguauaaauggugcaacaguaauaaaguuaaacaauuaaa

SEQ ID NO: 518138 - RNA, 64 nt, Human
auaaacacuuugagguaccaaacauaaccaaucugugcaacaacauagacugaccucaguaccc

SEQ ID NO: 518139 - RNA, 64 nt, Human
aaaugucuauugaauuagauucggcaacacaccagugcaacaaagacucagcugccuggccaag

SEQ ID NO: 518140 - RNA, 64 nt, Human
gagggcacucuaucagucuauaacuaucaacguagugcaacaggguguuuugauaccuuuguuu

SEQ ID NO: 518141 - RNA, 64 nt, Human
ggggcagaagaggcgucgagggcgccagaaguggcggcagcagcagccgcagcagccaaagaga

SEQ ID NO: 518142 - RNA, 64 nt, Human
gugggcgacacaggcagcuucuucggcagccucacggcagcaaccccagccuucccaaagcagc

SEQ ID NO: 518143 - RNA, 64 nt, Human
cuggcuccuugugccagagaacccagcccacccccggcagcagcccccagcucccaccuccccu

SEQ ID NO: 518144 - RNA, 64 nt, Human
gaaaaggggcacugcacgagcaccugccagccaucggcagcaagcgacacacacucaccuuccu

SEQ ID NO: 518145 - RNA, 64 nt, Human
ccgggguccagcucagaaccacgggggucugugccggcagcaccggugccaucuuggcuuccac

SEQ ID NO: 518146 - RNA, 64 nt, Human
cagccccaagaugccuacagcccccaggccccuucggcagcacugccucugcccaccugccuuu

SEQ ID NO: 518147 - RNA, 64 nt, Human
gagaaaagccaguggagaaagcgcccuuccagggcggcagcagcgggagccacgcagaccccga

SEQ ID NO: 518148 - RNA, 64 nt, Human
uucugucauaaagacauauauacacaaauguucacggcagcacuauacacaaucgcaaagucag

SEQ ID NO: 518149 - RNA, 64 nt, Human
uuaaaaggucuuucccucguggccuuugcacuugcggcagcaacguguacuacacugcagaagg

SEQ ID NO: 518150 - RNA, 64 nt, Human
uuucuggagugccaugcuggcgaggauccggaugcggcagcacccucuuucgggcugcauccac

SEQ ID NO: 518151 - RNA, 64 nt, Human
ucagagguccccaaagauggacacacaaccccagcggcagcaggaaaaacauaugggaauuuuc

SEQ ID NO: 518152 - RNA, 64 nt, Human
gccuugaaagcucugaagaggcccuggguugccgcggcagcaguggucuguuugaugcugccgu

SEQ ID NO: 518153 - RNA, 64 nt, Human
gcauccugagccccugcaugcacccagggccacccggcagcacacucaucccgcgccuccagag

SEQ ID NO: 518154 - RNA, 64 nt, Human
uuaaugagccuugucuuuacaaauaugugccauugugcaacaucgguggauuuucuaaaaauaa

SEQ ID NO: 518155 - RNA, 64 nt, Human
aucauguuuuucuuuuuaaaucacuuauuucagagugcaacacaaggcugcauuuuuaaaaaaa

SEQ ID NO: 518156 - RNA, 64 nt, Human
aauuacuaaugaaacuguguguacgugucugugcgugcaacauaaaaauacaguagcaccuaag

SEQ ID NO: 518157 - RNA, 64 nt, Human
acuuauccaaaaaucucuuuuaaaaaguaaauuugugcaacaacguuuauuugaaagauaaugu

SEQ ID NO: 518158 - RNA, 64 nt, Human
uccucauccuccuccuccuccacuugcagcgagacggcagcacagaccccuggagguccagggg

SEQ ID NO: 518159 - RNA, 64 nt, Human
uuuuuagcauuuaauacaguccauuuuuggcuaguaggguuaguugcaaucauaauaugaguug

SEQ ID NO: 518160 - RNA, 64 nt, Human
gugcaucagugcuuuucaaaggggcugcuuacuauaggguuaacuauguauauucauuguuaag

SEQ ID NO: 518161 - RNA, 64 nt, Human
uuaccugaaggaucuucacaggaggaugaagaccuaggguuaucugaaggaucuucacaagagg

SEQ ID NO: 518162 - RNA, 64 nt, Human
ugucacccccucuacgcucuccuuccucgccagcacgccuuagcuuugcaagccugcaugcauu

SEQ ID NO: 518163 - RNA, 64 nt, Human
ucgccccagaggucguggcucaaaggcacuuaggacgccuuaaauuuguaaauaaaauguuuac

SEQ ID NO: 518164 - RNA, 64 nt, Human
gcugggcccagccgggccgugccugcuggcacagacgccuuaacgcuguguguaugacugugug

SEQ ID NO: 518165 - RNA, 64 nt, Human
ccagcuucugccacauaaaagacacagaacacagacgccuuacuggcaaccugcuuucaagacc

SEQ ID NO: 518166 - RNA, 64 nt, Human
gaaugcgcuuuaucuagcucaugguaacuuugcaacgccuuagauuaaaaugacaguaaauauu

SEQ ID NO: 518167 - RNA, 64 nt, Human
cuuauugcagaugcugugguuggccucacaagcaacgccuuaugcugaugugcagaggugccag

SEQ ID NO: 518168 - RNA, 64 nt, Human
aaacaagcccucccaugccaugucuccgugggccacgccuuauguaagaauauuuccauauuuc

SEQ ID NO: 518169 - RNA, 64 nt, Human
gaggggauagaagucugguggagguggagugggcacgccuuagccuacggaaaggcccauuucu

SEQ ID NO: 518170 - RNA, 64 nt, Human
acugaucuuaagagcagacuuaaaguagcuuuguacgccuuaauguucauuuugauuuauuuua

SEQ ID NO: 518171 - RNA, 64 nt, Human
agaaauuuggcugaucgaugcaccgaugaaguaaacgccuuagugcuucagacccagcaagaaa

SEQ ID NO: 518172 - RNA, 64 nt, Human
cccuguccaagugccuuggagaacucacagcagcacgccuuaaucaaagguuuuaccagcccuu

SEQ ID NO: 518173 - RNA, 64 nt, Human
ucauucuuuuaagaauuauaagccaaaagaauuuacgccuuaaugugucauuauauaacauucc

SEQ ID NO: 518174 - RNA, 64 nt, Human
uagguggaggaaaggaggaaaaagugcuuauuaugugcaacauuaugauuaaucugauuauaca

SEQ ID NO: 518175 - RNA, 64 nt, Human
uguguuuuaaaaaaacugaagguuuuuuuuuuaagugcaacauuucuguauacuguaaaaguua

SEQ ID NO: 518176 - RNA, 64 nt, Human
cucauuucuuauaucauauuguuaaauaaacugugugcaacagacaaaaagggugguccuucuu

SEQ ID NO: 518177 - RNA, 64 nt, Human
agugauuggucuauucaccaucccccugcuguaccggcagcaccaggugagugugacacccuca

SEQ ID NO: 518178 - RNA, 64 nt, Human
ccggcauagccccgguccucuccaucucucuccucggcagcagcgggaggcagaggaaggcggc

SEQ ID NO: 518179 - RNA, 64 nt, Human
uagaauguucugagccgucugagggccuucaugccggcagcagcuagcaaagccagaaagcaag

SEQ ID NO: 518180 - RNA, 64 nt, Human
guguucauccucagugaucugcccuccagcaucucggcagcaucucauccuccaucgucagcug

SEQ ID NO: 518181 - RNA, 64 nt, Human
ggcucagacaccuagacucuaaaacuaucagcagcggcagcagcagcagcagcagcaguuugug

SEQ ID NO: 518182 - RNA, 64 nt, Human
ccugggacggacagggcuggcugucucucagccgcggcagcagggagcgggcagaggccgcagg

SEQ ID NO: 518183 - RNA, 64 nt, Human
ggucuuagucccagcgauucugcagagcggccaucggcagcaugucaaccauuugcauggcugg

SEQ ID NO: 518184 - RNA, 63 nt, Human
ugcggcugaggacacgcugaggccgcggcugcccggcagcaacugggguggccagguggggcg

SEQ ID NO: 518185 - RNA, 64 nt, Human
aucuugaaauggauuucuaggucacuggggacuccggcagcacauucggcuucagaauaaaggg

SEQ ID NO: 518186 - RNA, 64 nt, Human
gaugcccacugugcgcaucuccccaccgaggccccggcagcagucuuguucacagaccuuaggc

SEQ ID NO: 518187 - RNA, 64 nt, Human
gacccccugggggacagcugccagacacagcuggcggcagcaccagaugcuaagcgcuucagag

SEQ ID NO: 518188 - RNA, 64 nt, Human
uugcugggagguccggaucguuccugcagggaagcggcagcacacggagaccacuugguugaau

SEQ ID NO: 518189 - RNA, 64 nt, Human
caggcagguggcacguggcaucgcauggugggcucggcagcaccuugccuguguuucugugagg

SEQ ID NO: 518190 - RNA, 62 nt, Human
acuugucuuucccugcaguaaggcugguuuccccaccccagaaacauguaacgguugguacc

SEQ ID NO: 518191 - RNA, 62 nt, Human
gccuguggcggucagggcaggggucugugucuccaccccaagggcugauggucccuccccug

SEQ ID NO: 518192 - RNA, 62 nt, Human
uggauggaguggaggaggcccaggccacaguaccaccccaccugcccaggcagccccucguc

SEQ ID NO: 518193 - RNA, 62 nt, Human
gauguggaaugcaguccucaucuccagccuccccaccccagugggaacugugcaaagggcug

SEQ ID NO: 518194 - RNA, 64 nt, Human
ccgugcacaggugcccaggcuccaaggacagcuccggcagcagguccucgcugggcagaugcug

SEQ ID NO: 518195 - RNA, 64 nt, Human
guuggaggagaaagacaacacuuggucuaagacacggcagcaagacaucccugcauauuguucc

SEQ ID NO: 518196 - RNA, 64 nt, Human
cgugaaugugaaaaggugaaacuggugcugacuucggcagcagguauacuaaaauuggaaugac

SEQ ID NO: 518197 - RNA, 64 nt, Human
ugugaaugugaaaaggugaaacuguugcugacuucggcagcagguauacuaaaauuggaaugac

SEQ ID NO: 518198 - RNA, 64 nt, Human
ccagguguuacuguaauuccucaacguauuguuucggcagcacuuauuuaaugccgauauacuc

SEQ ID NO: 518199 - RNA, 64 nt, Human
aagaaaagaccuccagcaguuacacauucauaucaaccagcacaacacgggauggcgcccaaac

SEQ ID NO: 518200 - RNA, 64 nt, Human
ugauggacacaauaugcccuuccgguucuauucaaaccagcaggaucugucggugcuuagagau

SEQ ID NO: 518201 - RNA, 64 nt, Human
cuaccccaacucugcccuucucccauccaagagaaaccagcaaaaugauaaagaagcuaaccug

SEQ ID NO: 518202 - RNA, 64 nt, Human
gugaggcuucaagccuuaaagucagugugcccucaaccagcacagccugccccaauucccccag

SEQ ID NO: 518203 - RNA, 64 nt, Human
aaaccaaccucuaaggcauuaggaauuuagcugaaaccagcagaauugaaaacucuggcaauaa

SEQ ID NO: 518204 - RNA, 64 nt, Human
uuuuccaguuacuugacacgauucagugggggaaaaccagcauuuuuuauucuauugauaccaa

SEQ ID NO: 518205 - RNA, 64 nt, Human
aaaccuuaacuaugacuaagaaauuaaagaagaaaaccagcaaacuaaaacuucugggcagcaa

SEQ ID NO: 518206 - RNA, 62 nt, Human
gcucagagcagcuaguguggagcucagcauccccaccccaccccuccucccuguagagcuga

SEQ ID NO: 518207 - RNA, 62 nt, Human
cugaucccaauaccagcuucccccagccccugccaccccagagggcggccacgacagggaga

SEQ ID NO: 518208 - RNA, 62 nt, Human
gcaucagugacugaauucugccuugguucuggccaccccagagugggagaggcugggagguu

SEQ ID NO: 518209 - RNA, 64 nt, Human
uuugauauucagggagguaggaaagguaacagaaaaccagcauauuuaaucaaagcaagaagua

SEQ ID NO: 518210 - RNA, 64 nt, Human
uauaauggcucugggcuauaugccuauauuuauaaaccagcagcaggggaaagauuauauuuua

SEQ ID NO: 518211 - RNA, 64 nt, Human
aaacuggaauuuaugugaagaaccaaacaacuuaaaccagcaucacuuuugucuucaauuugcc

SEQ ID NO: 518212 - RNA, 64 nt, Human
aguguuuaauaaagccggaagugguguugcccugaaccagcagauuuucaccuggguucuggcu

SEQ ID NO: 518213 - RNA, 64 nt, Human
auuuuguuaauaauaagauaaugaugaguaacuuaaccagcacauuucuccuguuuacacucgg

SEQ ID NO: 518214 - RNA, 64 nt, Human
ggagaugguugaauuuaagcuaacaggaaagccaaaccagcacccuccuuugugcucugagagg

SEQ ID NO: 518215 - RNA, 64 nt, Human
agggagaccagccuuccucagcuaugcuugccgaaaccagcaugaugcuucaaagagcccugcu

SEQ ID NO: 518216 - RNA, 64 nt, Human
uaauuagggaguuauuugguaagcaaaucaauauaaccagcaaagauaccugcuucuucuauau

SEQ ID NO: 518217 - RNA, 64 nt, Human
gcccauauaggugagcaucccuuuagaucaugggaaccagcagacugcauuccuaaucuucauu

SEQ ID NO: 518218 - RNA, 64 nt, Human
uacuaauuuauucuucgacuacauacugcagcagaaccagcaauacacuugauuuuuaaaagca

SEQ ID NO: 518219 - RNA, 64 nt, Human
ggagcaggaagagaugcugauaguuugaucuagaaaccagcagcuacuggcucaaauucagguu

SEQ ID NO: 518220 - RNA, 64 nt, Human
ggcuaguuccuuucaauuccauuuaaaaaacaaaaaccagcaggugugguggcucauggcguaa

SEQ ID NO: 518221 - RNA, 64 nt, Human
uucccgcugaccucacuggcccacuggcaaauccaaccagcaaccagaaauguucuaguguaga

SEQ ID NO: 518222 - RNA, 64 nt, Human
uuuuuaaacuuuuucaaaauaggucucuaaggaaaaccagcagaacauuagccugugcaaaacc

SEQ ID NO: 518223 - RNA, 64 nt, Human
agcaggggagggaaagaaaccaggcaucuggucaaaccagcagaucaaaaagcacaaagagcug

SEQ ID NO: 518224 - RNA, 62 nt, Human
cucccccuuccccuacccaacccugcccugccccaccccaccucacagcuacucaguggggc

SEQ ID NO: 518225 - RNA, 61 nt, Human; identical to SEQ ID NO: 271890

SEQ ID NO: 518226 - RNA, 62 nt, Human
aaagugguuugauggugacuuccucgccucucccaccccaugcauuaaauuuuaagguagaa

SEQ ID NO: 518227 - RNA, 64 nt, Human
uguucauugguuccucuccuggaaaguggcuucuaaccagcacuggauggugaucauugguaag

SEQ ID NO: 518228 - RNA, 64 nt, Human
cugccccuagauuucuccucaaggccucuggagcaaccagcacuugcccccuuggaaugcagag

SEQ ID NO: 518229 - RNA, 64 nt, Human
agugagugcuaggcaaggcuacuucaaugcacagaaccagcagagucuccccuuuuccugagcc

SEQ ID NO: 518230 - RNA, 64 nt, Human
aaaggaauuuguuuaaauaacauuaugggauugcaaccagcaaaacauaaacugagaaaaaguu

SEQ ID NO: 518231 - RNA, 64 nt, Human
ucaugauacaccuacugguuaaauaauugacaaaaaccagcagccaaauauuagaggucuccug

SEQ ID NO: 518232 - RNA, 64 nt, Human
guacuguaauccacacaacacauuauaagaagcaaaccagcaucuuaaggaauuauaaaauuac

SEQ ID NO: 518233 - RNA, 64 nt, Human
gcugccagccccuuucagaaagcauggcagugggaaccagcaacuugggcuaccuuaggggaag

SEQ ID NO: 518234 - RNA, 64 nt, Human
gggacguggccaagggugagguggccaaaaccagaaccagcagucuccugccuuguucccuccc

SEQ ID NO: 518235 - RNA, 64 nt, Human
ccugcaugccccaugugggaggugcugagcuccaaaccagcaucacaccaacucugacacaugg

SEQ ID NO: 518236 - RNA, 64 nt, Human
aauaaggcauuuuaauagacuguacugcuucuuaaaccagcauugcugaccagcauuauauuua

SEQ ID NO: 518237 - RNA, 64 nt, Human
gugagcuuagcacagcgggauuaaacaguccuuuaaccagcacagccaguuaaaagaugcagcc

SEQ ID NO: 518238 - RNA, 64 nt, Human
ggagguggcacuagggaucaaagaagaugguuagaaccagcagaagccagagggugggaggggc

SEQ ID NO: 518239 - RNA, 64 nt, Human
ggcuggaagugucuauguuuaacugcaucuuauaaaccagcaacaaguuuucuacugggaauua

SEQ ID NO: 518240 - RNA, 64 nt, Human
auauggguucauuuuaucccuaaacuuaguaccaaaccagcauuuaauaucuaauuauaaaucu

SEQ ID NO: 518241 - RNA, 64 nt, Human
auggcauucucugcauguuaaagaucuuaauggcaaccagcaccucuuaaguaugguuuaaaca

SEQ ID NO: 518242 - RNA, 64 nt, Human
agccagugguuccugggaacgcucuuguugcuuggugcaacagaagcacaaaaaucaauaaaca

SEQ ID NO: 518243 - RNA, 64 nt, Human
acugauuccuuuagaauuaacagcccuccaugcugugcaacaggacaucagaacuuauuccucu

SEQ ID NO: 518244 - RNA, 64 nt, Human
gaauuguacguuucagagaaauuuuuuuuccuaugugcaacacgaagcuuccagaaccauaaaa

SEQ ID NO: 518245 - RNA, 64 nt, Human
agagggcccuguccaguugggugaucaggaaucaaaccagcaucggaaagacuucccagcacca

SEQ ID NO: 518246 - RNA, 64 nt, Human
uuuuauucacagagguaaagugucuuuucaauauaaccagcaauuuagguggcaucuauaaaau

SEQ ID NO: 518247 - RNA, 64 nt, Human
ccuuuaaggcuugaaaaugccuccuguagucccaaaccagcaaagaacugguuaaaugugccag

SEQ ID NO: 518248 - RNA, 64 nt, Human
auucgggguggggugggggacuaggcucagccggaaccagcaccuccaaggaguccgggaggug

SEQ ID NO: 518249 - RNA, 64 nt, Human
ucccuagaagugccuuccaagucaguccuuuggaaaccagcaggucugaaaaagaggcugcauc

SEQ ID NO: 518250 - RNA, 64 nt, Human
gacccugcccagucugugaaagcuacagagcaccaaccagcagaagccuguggacaccaaguac

SEQ ID NO: 518251 - RNA, 64 nt, Human
ucagugaagaauuguauuucaagauucaaacaauaaccagcaauuaaacuuuuuucuacaaugu

SEQ ID NO: 518252 - RNA, 64 nt, Human
ucaguucugaaguuauaaacuuauaaucaauacaaaccagcaacuaauaaaaccucuaauucug

SEQ ID NO: 518253 - RNA, 64 nt, Human
uaucuaauuuauacaaaauaauuuaacuaauuuaaaccagcagaaaagugcuuagaaaguuauu

SEQ ID NO: 518254 - RNA, 64 nt, Human
ggccaauuaaaauauauauaaauauauauuuuucaaccagcauuuuacuacuuguuaccuuucc

SEQ ID NO: 518255 - RNA, 64 nt, Human
aucaucuuaaugacaaagggaauaaugaacuagaaaccagcaagugaaaguguuuauuuccuau

SEQ ID NO: 518256 - RNA, 64 nt, Human
ccauuuuggauuuugaaucaagcaauauggaagcaaccagcaaauuaacuaauuuaaguacauu

SEQ ID NO: 518257 - RNA, 64 nt, Human
aagucuuugcguucacuuguacuguaacaacauaaaccagcacgcgguucccacccggggccaa

SEQ ID NO: 518258 - RNA, 64 nt, Human
uugauuuuaauugaagggugagcauaaccuugugaaccagcacuagcuuguuccaagcuggaau

SEQ ID NO: 518259 - RNA, 62 nt, Human
gauguaguuguuguugcuuuuuucccuauuuuccaccccagucgcuccuuaccgugacuccu

SEQ ID NO: 518260 - RNA, 62 nt, Human
gguuaaagggaucugcaguggggccaaggaugccaccccacccucagcuguaggcaagcuug

SEQ ID NO: 518261 - RNA, 62 nt, Human
cuggccaccagcugggcgacgucacccugcucccaccccacccccaaguucuaaggucucuu

SEQ ID NO: 518262 - RNA, 62 nt, Human
ccccuaccgcauggcagcugggcccacagcccccaccccagcacagcuccuccccugccgcc

SEQ ID NO: 518263 - RNA, 64 nt, Human
aagagaggugugaagaaaccucuccgaacaaaugaaccagcaguaaguuucuaaaaaucagaau

SEQ ID NO: 518264 - RNA, 64 nt, Human
guagcccaauauaaaacuuuugauucuaaaauuaaaccagcagccuauuacaagcacauucuuu

SEQ ID NO: 518265 - RNA, 64 nt, Human
gauuuuuuuucucauuuuucuaguguuaaauuuuaaccagcauuaacaugguagaguggaggag

SEQ ID NO: 518266 - RNA, 64 nt, Human
caucugcccagucccucuccucccagcccaugguaaccagcauuugacucuuuacuuguauaag

SEQ ID NO: 518267 - RNA, 64 nt, Human
ugugucgaagacuuauucgacucauuaaugaggaaaccagcagauaguaaaccugguucaaagu

SEQ ID NO: 518268 - RNA, 64 nt, Human
cucuucuggccugccccauguuacuaugugauggaaccagcacaccucaaccaaaauuuuuuua

SEQ ID NO: 518269 - RNA, 64 nt, Human
ugcgugcugguuccuucagaccccuaacccuacuaaccagcaggcucaucucaccuccaggccu

SEQ ID NO: 518270 - RNA, 64 nt, Human
uaacauagaaguguccagcugcguacagucuaguaaccagcaacuguaaacgaaccugugccuc

SEQ ID NO: 518271 - RNA, 64 nt, Human
agggaaauugagccauauuuuggcuaucggcuggaaccagcaguucagagaucugccuuauaaa

SEQ ID NO: 518272 - RNA, 64 nt, Human
auguguaaccgacguucagucuauucuaggaaugaaccagcaaguuguucauuuaaaacugacc

SEQ ID NO: 518273 - RNA, 64 nt, Human
guaucugcgccacugccgcaagggaagccucaggaaccagcaccuggaggccaggauagccaag

SEQ ID NO: 518274 - RNA, 64 nt, Human
guauuccuucccucuagggcccaaagaggcugcuaaccagcaggaauguccugaaccaaaagga

SEQ ID NO: 518275 - RNA, 64 nt, Human
uccaguuaucauacauuugacuuucaaauguaugaaccagcauguaccccauggauuuaaucuu

SEQ ID NO: 518276 - RNA, 64 nt, Human
gcuggguggccccugccauucugaauggaggcagaaccagcaacaacucugggcgugccugugu

SEQ ID NO: 518277 - RNA, 64 nt, Human
caagcuaugaaauaaccaacaguauucaagaagcaaccagcaccaucaugugauaaugguacua

SEQ ID NO: 518278 - RNA, 62 nt, Human
ugcuucgaaggacucauucuuuccucccacuuccaccccaacauagaguaguauuugcuuuu

SEQ ID NO: 518279 - RNA, 62 nt, Human
cuaccccaacccuucaacuaccagaaucugggccaccccagcaguauuuuuauuuaaaaugu

SEQ ID NO: 518280 - RNA, 62 nt, Human
ugaaaguggacuguucucaggcuugaccugccccaccccauccccgcgguugaggcuguggg

SEQ ID NO: 518281 - RNA, 64 nt, Human
aacuauagcagagaggcuaaaaucuauuuaucgaaaccagcauauuuuuggaaagcuaaauguu

SEQ ID NO: 518282 - RNA, 64 nt, Human
uuggugcuaagcagaaaagaaauuuggaccuugaaaccagcaguucaacauauauacuuuuugc

SEQ ID NO: 518283 - RNA, 64 nt, Human
uauauuuuuaaguaguaugacuaaaauaaagaugaaccagcaaaaggucaguuugcacauuugu

SEQ ID NO: 518284 - RNA, 64 nt, Human
caagaagacugucaggaagggucggagucuguaaaaccagcauacaguuuggcuuuuuucacau

SEQ ID NO: 518285 - RNA, 64 nt, Human
ucaaacuucuccaauacaguaagagauaguguugaaccagcaucaagucuccagaaacauggca

SEQ ID NO: 518286 - RNA, 64 nt, Human
auuugaguaaauacaauuuuuuagguuacucaagaaccagcauuaguaauuucuaguaaaauug

SEQ ID NO: 518287 - RNA, 64 nt, Human
caguuggaaauugguaagggaacugaguacuucaaaccagcacagggaacuuagguuagugugg

SEQ ID NO: 518288 - RNA, 64 nt, Human
acugcaaugauuuugauggaaccaacccugaucuaaccagcacacuaaauaaaguauuugagca

SEQ ID NO: 518289 - RNA, 64 nt, Human
ugaauggucuagaaacauuucuauuuuuuuuuuaaaccagcaggauacaaguugcaaaugaaau

SEQ ID NO: 518290 - RNA, 64 nt, Human
aaaagcuacuuuugugggaguauuucuauuauauaaccagcacuuacuaccuguacucaaaauu

SEQ ID NO: 518291 - RNA, 64 nt, Human
uggaaggaguagggaggagaaugaaggaaaaugcaaccagcaugauuauaguguguucauuuag

SEQ ID NO: 518292 - RNA, 64 nt, Human
ugcuucucagaacccacccguugaguuuguggguaaccagcaggcaggccaaagacuggugcuu

SEQ ID NO: 518293 - RNA, 64 nt, Human
ggagaaaugcuggagaaagcugcacccuacaggcaaccagcacugcagaaaccacuccaggcaa

SEQ ID NO: 518294 - RNA, 64 nt, Human
cgccccuucggcuuggcuccuacaaggcccagaaaaccagcagguccuccagcauccccugcag

SEQ ID NO: 518295 - RNA, 64 nt, Human
cugcauuugccugucaugcgcaacuggagccagcaaccagcacauccaucagcaccccagugga

SEQ ID NO: 518296 - RNA, 64 nt, Human
acauucaauccaagccuuuguauauuuuagagcugugcaacacuuuaagucuuguauuuauuuu

SEQ ID NO: 518297 - RNA, 61 nt, Human; identical to SEQ ID NO: 446092

SEQ ID NO: 518298 - RNA, 61 nt, Human; identical to SEQ ID NO: 446102

SEQ ID NO: 518299 - RNA, 64 nt, Human
aagaagaagaaacagcagaaagcagucucagguaaaccagcaaauuuggcucgauaauaucgcu

SEQ ID NO: 518300 - RNA, 64 nt, Human
agacugcccgccucagaacugcuuagagacuucaaaccagcagaggugaaagucccugucaucc

SEQ ID NO: 518301 - RNA, 64 nt, Human
gaauugauuucguacagcacaguggcuuauaaggaaccagcaguguuuuucccugaguaauuau

SEQ ID NO: 518302 - RNA, 64 nt, Human
ugagacucacagaggggaaagauacugacggugaaaccagcauggaaaacgucuuuaccaugug

SEQ ID NO: 518303 - RNA, 64 nt, Human
aaguauauacuaaccagggguuuaauauaaauacaaccagcauagaaagacccaaaacuauaca

SEQ ID NO: 518304 - RNA, 64 nt, Human
aaacacacacacacacaaaaacagaaacaaaaaaaaccagcauuaaaauaauaagauuguauag

SEQ ID NO: 518305 - RNA, 64 nt, Human
uccaggagcccugaggguggcaggagcuaaccccaaccagcaggcaacuaacacggaauuggcc

SEQ ID NO: 518306 - RNA, 64 nt, Human
gcucugcugcacuugguauuucccugacagagagaaccagcaguuucgcccaaauccuacucug

SEQ ID NO: 518307 - RNA, 64 nt, Human
gugucaguaacacuuuauuaaaaucauguugcagaaccagcagguggauaguauauagguuuau

SEQ ID NO: 518308 - RNA, 64 nt, Human
accaccaccacccccccuuauuuuuuuuauccuaaaccagcaaacgcaggaccuguaccaauuu

SEQ ID NO: 518309 - RNA, 64 nt, Human
uuagaaggaauucagcucugauguuuuuaaagaaaaccagcaucucugauguugcaacauacgu

SEQ ID NO: 518310 - RNA, 64 nt, Human
cugccaguuguuaagagguuuugguuccaaacucaaccagcaauguugagagcugaacuuaaga

SEQ ID NO: 518311 - RNA, 64 nt, Human
guacauaaucccagggggagggggucaggugucgaaccagcaggcaaggcgaggugcccgcuca

SEQ ID NO: 518312 - RNA, 64 nt, Human
cucuugaagucacacccuccgaaagaugaguagaaaccagcaccagcacagcccagaucuucuc

SEQ ID NO: 518313 - RNA, 64 nt, Human
ugugccacgugccuguggcugcagacucccagagaaccagcacuggguuuacagaaugaggccc

SEQ ID NO: 518314 - RNA, 62 nt, Human
ggggcauucuucuaggaaugaggggcaucagcccaccccaggcaccucagugggguuccggg

SEQ ID NO: 518315 - RNA, 62 nt, Human
uccugacccuccccgcugugguuggcagccacccaccccagaggcuggcagagggaaagggg

SEQ ID NO: 518316 - RNA, 62 nt, Human
agugugcccugccccucaugcucagaccucucccaccccaaacccucucccgggacucaguc

SEQ ID NO: 518317 - RNA, 64 nt, Human
gugacuaaggaaaagagcagaagcuccuugguuuaaccagcacagagaaaauaauauaaauccc

SEQ ID NO: 518318 - RNA, 64 nt, Human
auuaaauggauguuuagacuggcuacuugcccuaaaccagcacuuggugaugucuacugggugg

SEQ ID NO: 518319 - RNA, 64 nt, Human
uaacuuuuuuuauauuaguaauaaaugcaguggaaaccagcauuuuauuuaaucccuguguucu

SEQ ID NO: 518320 - RNA, 64 nt, Human
aaaaagccaggaccauguuagaauuaggaaaaguaaccagcauuacugcaccucuuguuagacu

SEQ ID NO: 518321 - RNA, 64 nt, Human
acaagcaguuguuauugggaaaguacagucucaaaaccagcaacagcagcaguaccuacagccc

SEQ ID NO: 518322 - RNA, 64 nt, Human
caaacccccaugacacaccuuuauguauguaacaaaccagcacuuccugcgcauguaccccuga

SEQ ID NO: 518323 - RNA, 64 nt, Human
gagagcugccuuauauuccuacauuccaggccagaaccagcacaggacugaacacaucccuggu

SEQ ID NO: 518324 - RNA, 64 nt, Human
uuaccacacuuuaccugucaucaguuauaguaaaaaccagcaugguguuacucaacuauugaga

SEQ ID NO: 518325 - RNA, 64 nt, Human
uaaagcaguuuuucacaaauucaucuuuacagaaaaccagcaucuagcuuagcaucuuuccccu

SEQ ID NO: 518326 - RNA, 64 nt, Human
auuuagauuucuaucucuuguaagucacucuuuuaaccagcaaaggacuuucaucuuagauuau

SEQ ID NO: 518327 - RNA, 64 nt, Human
auuuaauuacuagcuuucuauuaccauuauauguaaccagcaaauauauuuuuccuuagcccuu

SEQ ID NO: 518328 - RNA, 64 nt, Human
guuaucccgguuccaagccuagaggauccuuccaaaccagcaccaacagagccaaggccuuggg

SEQ ID NO: 518329 - RNA, 64 nt, Human
aaugauaauccuggacaugggugaacaugaggagaaccagcaaaaucugugguguuugacauca

SEQ ID NO: 518330 - RNA, 64 nt, Human
aauaauauagauauaauguuaaaaacaauuugcaaaccagcagaauuuuaagcuuuuaaaauaa

SEQ ID NO: 518331 - RNA, 62 nt, Human
aauaaugucacuguggacccagucucacuccuccaccccacacacugaagcaguagcuucug

SEQ ID NO: 518332 - RNA, 62 nt, Human
gcuggcaggcagcuauuaccccgguucuuuccccaccccaggucugucucuugccuuuucuu

SEQ ID NO: 518333 - RNA, 62 nt, Human
gggcagccugcagcuguguccaggcccaggccccaccccauaacagguggccucagccacac

SEQ ID NO: 518334 - RNA, 62 nt, Human
auuuuuuuaaauggaagcuucuagcaagccccccaccccaaucaaccucuaugcuuucuucu

SEQ ID NO: 518335 - RNA, 64 nt, Human
guguacucacuugccuccucuuuuguccugauuuaaccagcauuuuucaacccugggaaaauuu

SEQ ID NO: 518336 - RNA, 64 nt, Human
aggaaagcacaaucagagaagaaaacagcccccgaaccagcaggaguggccuggcacauggacc

SEQ ID NO: 518337 - RNA, 64 nt, Human
accuauacauuauauauauuuuauaaagauacuaaaccagcauacccuuacucugccagaguag

SEQ ID NO: 518338 - RNA, 64 nt, Human
aaaauuaguugagaaagaagagaagaagaaaaucaaccagcaggaaaguacagaugcagccgug

SEQ ID NO: 518339 - RNA, 64 nt, Human
cuucacagcacauuuuuaaucaagcaguuauuucaaccagcacauucguuuuguucauauucac

SEQ ID NO: 518340 - RNA, 64 nt, Human
caaagcagggacaguggccccucccugcagcuggaaccagcaucucugauuuaugccgucucca

SEQ ID NO: 518341 - RNA, 64 nt, Human
gcuuagccuuucauuagcaauguuaauucuauucaaccagcaccugcuuccacagaaauucugu

SEQ ID NO: 518342 - RNA, 64 nt, Human
aauuuucuaugaauugcuaauucugagggaauuuaaccagcaacauugacccagaaauguaugg

SEQ ID NO: 518343 - RNA, 64 nt, Human
ugggcuauuauagaugaaaacugcacaaggccagaaccagcaggcacucaauaaacguucaugu

SEQ ID NO: 518344 - RNA, 64 nt, Human
acugcguuccagucaccccggucuugccagaagaaaccagcaccucuuucccguggcuccugug

SEQ ID NO: 518345 - RNA, 64 nt, Human
uguauaguuuuuaauagaaagaucuauguuuauaaaccagcacuuggccaaaaacaaaauugua

SEQ ID NO: 518346 - RNA, 64 nt, Human
ggacugggccuuggcuucccugagcccgcacuccaaccagcagcuggauuccugggaacuggag

SEQ ID NO: 518347 - RNA, 64 nt, Human
gccgcugucaucaaauaugaggagaaaccuccaaaaccagcauuucagaaugguuccucaggau

SEQ ID NO: 518348 - RNA, 64 nt, Human
ugcacucauucucaaacauacugauguucauacaaaccagcagagugcugagggacgauaugua

SEQ ID NO: 518349 - RNA, 64 nt, Human
ucugaagguuuccacauucgaugaugucaaccuaaaccagcagccaucccgcuugucccucuua

SEQ ID NO: 518350 - RNA, 62 nt, Human
cacaggcuguugagaauucuuugccacuuuucccaccccaaaacagcauggggccugacauc

SEQ ID NO: 518351 - RNA, 62 nt, Human
cuggguucuuccacagcacaaacacaccucugccaccccagguuuuucaucugaaaagcagu

SEQ ID NO: 518352 - RNA, 62 nt, Human
cacccuucugcccucucuccauugccugcaccccaccccagccacucaacuccugcuuguuu

SEQ ID NO: 518353 - RNA, 64 nt, Human
aaaaggauucagaugcaauuuucaacuauucugaaaccagcaggacacaccugacuuuaauagu

SEQ ID NO: 518354 - RNA, 64 nt, Human
uuaaacaauuuccgaugcccaugaugaguuuaaaaaccagcauugacaccauccccaaaauuaa

SEQ ID NO: 518355 - RNA, 64 nt, Human
aaucugguuauuauuuaaaaacuagaagcccccaaaccagcagaucuuacugaagaugauguuc

SEQ ID NO: 518356 - RNA, 64 nt, Human
uuuuaggaaucucucucagguuuuuucugaccuaaaccagcaggaagucguccugggcuguaag

SEQ ID NO: 518357 - RNA, 64 nt, Human
gaggcuuccagccuguguuccccucacuuggaggaaccagcacucuccauccuuucagaaaguc

SEQ ID NO: 518358 - RNA, 64 nt, Human
uccgggugcgugaccggcccgccaccuuguacagaaccagcacucccagggcccgagcgcgugc

SEQ ID NO: 518359 - RNA, 64 nt, Human
cucugggacuggacaauugcuucaagcauucuucaaccagcagaugcuguuuaagugacugaug

SEQ ID NO: 518360 - RNA, 64 nt, Human
ccagccccccguagcaggggcaugacuguuucccaaccagcacccaaagacgggcgccauugcc

SEQ ID NO: 518361 - RNA, 64 nt, Human
gauuaaauccuguuuuaaaaugucacaaaacaggaaccagcauucuaauuagauuuacuauauc

SEQ ID NO: 518362 - RNA, 64 nt, Human
agaaagccccuucccucccaagcagugaauuaauaaccagcaggugccuaucacugaguaacag

SEQ ID NO: 518363 - RNA, 64 nt, Human
ucugaaccauaaacccagagaagaauuacucauuaaccagcauaaauacugccugaggaucaaa

SEQ ID NO: 518364 - RNA, 64 nt, Human
gaucagaauaaaaacugacuagaaauaccgucaaaaccagcacuuaccaaacucagagcaucug

SEQ ID NO: 518365 - RNA, 64 nt, Human
aaagcucaguggccgcuccuucuuucagcccaucaaccagcauuggucccauagggaagcacag

SEQ ID NO: 518366 - RNA, 64 nt, Human
aaaggcugcaaagcuggacucaggaauguccuccaaccagcagcgcugaccuaagagcucccug

SEQ ID NO: 518367 - RNA, 64 nt, Human
uaaccaggggaacugguuaugaauaugugaaugcaaccagcaaauuuauccuugaaggugugau

SEQ ID NO: 518368 - RNA, 62 nt, Human
caaccaggcagagucccuuucuuuucugcuccccaccccaacccugccccuauguacaggaa

SEQ ID NO: 518369 - RNA, 62 nt, Human
ccacugaucuugggucuggggugauccaaauaccaccccagcuccagcugucuucuaccacu

SEQ ID NO: 518370 - RNA, 62 nt, Human
ugaaacuuugcuuuggguuuguggcacccuggccaccccaucuggcugugacagccucugca

SEQ ID NO: 518371 - RNA, 64 nt, Human
ugaucacuauaauucuaaaacaauuuuuuaaauaaaccagcagguugcuaaaagaaggcauuuu

SEQ ID NO: 518372 - RNA, 64 nt, Human
caguguugcaagagucugggcuuggggucuuuaaaaccagcagggggaaaugauaaaaagagag

SEQ ID NO: 518373 - RNA, 64 nt, Human
guggaggccugagggcuugagggaggcuggggaaaaccagcagggagcacuuggcuccuggcag

SEQ ID NO: 518374 - RNA, 64 nt, Human
acaguaccuaaugaauauuguuggccauuuucaaaaccagcaauaaugaaaagacuaauuggau

SEQ ID NO: 518375 - RNA, 64 nt, Human
gaaaacucugaaguuauauuugcaauaauaaugaaaccagcauuuaguaccagcauaugguuca

SEQ ID NO: 518376 - RNA, 64 nt, Human
gcuaggcuauuuucuugcuaugcuuccugcacccaaccagcagaauucuuccaggguggaggaa

SEQ ID NO: 518377 - RNA, 64 nt, Human
uacagaguugacagucuaguuucagcacauagaaaaccagcagugaauaaaccaaggugaggcc

SEQ ID NO: 518378 - RNA, 64 nt, Human
aacccugcugaacacagugucuguucagcaaacuaaccagcauucccuacagccuagggcagac

SEQ ID NO: 518379 - RNA, 64 nt, Human
uggaggcagaugacaucuaaaauaugugcuuuccaaccagcacagcuggcgcucuuagcuccug

SEQ ID NO: 518380 - RNA, 64 nt, Human
guuccucucggguuaucucccacgccugaccuggaaccagcaagccccuuuccugccuucuuac

SEQ ID NO: 518381 - RNA, 64 nt, Human
acaucccaaccccagaggaaccagugggauugaaaaccagcagaagccaagacaggaugcacag

SEQ ID NO: 518382 - RNA, 64 nt, Human
cuguuguggauaggaaagacuuaaccuaaaauuaaaccagcaagaaagcauuaguaaaaaucua

SEQ ID NO: 518383 - RNA, 64 nt, Human
aaugucaaaccaaacuuaacauucuuguaauagaaaccagcaggguguguacacuuuugugugu

SEQ ID NO: 518384 - RNA, 64 nt, Human
caaggugaaggccucagcauccuagggaacaaggaaccagcaguaagugguuccgaagacaggc

SEQ ID NO: 518385 - RNA, 64 nt, Human
acaaaguguuggaaaaucaaaagaggcucacucaaaccagcacagggaguccucagaguugcag

SEQ ID NO: 518386 - RNA, 62 nt, Human
ggggguuuccgcugccccccacccccagcggcccaccccaugccucagcuucaugucugucc

SEQ ID NO: 518387 - RNA, 62 nt, Human
uuuggggcagcuggucccggagaggccucgacccaccccagugcuuguuccucucaucuccc

SEQ ID NO: 518388 - RNA, 62 nt, Human
guuaacuacaguguuuuccuuugcaccgauccccaccccaauucaaucccggaagggacuua

SEQ ID NO: 518389 - RNA, 64 nt, Human
guaaagauaauaugaagaaccagcuuccaaaagaaaccagcauauggcacuauaaacuauuuca

SEQ ID NO: 518390 - RNA, 64 nt, Human
ccuugucccugguccuguggucccuccaccuucaaaccagcaauggugcauugagcaaauugug

SEQ ID NO: 518391 - RNA, 64 nt, Human
cuucaccuuuugugcugugauucuucaguuucuaaaccagcacugucugggucccuacaaugua

SEQ ID NO: 518392 - RNA, 64 nt, Human
gcuggagaugcagagccagcagcugcgcgaguccaaccagcagcuggaccugagcgccugccgg

SEQ ID NO: 518393 - RNA, 64 nt, Human
ucauuuucccuuuggcugaauauuucaauugacaaaccagcaggacauaugaaaaaugcuucag

SEQ ID NO: 518394 - RNA, 64 nt, Human
aagaaguuacuuccaagacagacuuuuaagauguaaccagcacaaagcaaugucagggaggagu

SEQ ID NO: 518395 - RNA, 64 nt, Human
caggaaccucucagccgaugccccccgguaugggaaccagcaccucccaccaaccaaccacacc

SEQ ID NO: 518396 - RNA, 64 nt, Human
caggaaccucucagccgaugccccccaguaugggaaccagcaccucccaccaaccagccacacc

SEQ ID NO: 518397 - RNA, 64 nt, Human
caggaaccucucagccgaugccccccggugugggaaccagcaccucccaccaaccagccacacc

SEQ ID NO: 518398 - RNA, 64 nt, Human
auaugguagauacuuguaguguuugaauaaaugaaaccagcauuagagcuuuauauacuuucuc

SEQ ID NO: 518399 - RNA, 64 nt, Human
gucaguacacuuuucuagauaaaucuugagugaaaaccagcaauuucuuuuuccuuguggucug

SEQ ID NO: 518400 - RNA, 64 nt, Human
cucccucugucuguuuucacuugaauggguaaauaaccagcagcuagguuuugaauuccuaccu

SEQ ID NO: 518401 - RNA, 64 nt, Human
accuggaggugucagaggcucaacuccuccaucuaaccagcaggcucccagaguccccggaaga

SEQ ID NO: 518402 - RNA, 64 nt, Human
uuguaaaacaugguucacauaacuagcuuguggaaaccagcagguaaaaugaauucuuaaguug

SEQ ID NO: 518403 - RNA, 64 nt, Human
accuuuuuaaaucaaccuuauuuggaugcaucugaaccagcagagcuguguuauauuuucuauc

SEQ ID NO: 518404 - RNA, 62 nt, Human
uuggagaaagaggcuuccuugagccacccuucccaccccagcccuugcuggucccuaggcca

SEQ ID NO: 518405 - RNA, 62 nt, Human
uaagaccuggcccuccccugcugcccugaagaccaccccagucuaccucggugcuggccagg

SEQ ID NO: 518406 - RNA, 62 nt, Human
cucacugugccuucacaccauccauguguaauccaccccaucagcagugguucuccuacuuu

SEQ ID NO: 518407 - RNA, 64 nt, Human
uacccaguuuucaauaaaccuuccaggcugcaauaaccagcaagguuuucaguuaaagcccuau

SEQ ID NO: 518408 - RNA, 64 nt, Human
uggguuuguacaaaaaaaaaaaaaaaaaaaaaaaaaccagcauacauaugcaaaacuauauaua

SEQ ID NO: 518409 - RNA, 64 nt, Human
gcuuucuguuccaaauucaguuucauaaaaggagaaccagcacagcuuagauuucauaguucag

SEQ ID NO: 518410 - RNA, 64 nt, Human
augugugcauugccacucucccaaguuuuucagaaaccagcagagcugucaacucuucucaaaa

SEQ ID NO: 518411 - RNA, 64 nt, Human
cuucuggccaagauuugccagaggcaacaucaaaaaccagcaaauuuuaauuuugucccacagc

SEQ ID NO: 518412 - RNA, 64 nt, Human
uugaggaguuuucacuuuacuacagugauauaaaaaccagcaguuuuuacacuaaauuuuuuaa

SEQ ID NO: 518413 - RNA, 64 nt, Human
uaaauugagaggaaaggccuuggucuuccugaucaaccagcauuuaacgaacaguggcuuaaug

SEQ ID NO: 518414 - RNA, 64 nt, Human
ggcagcugugaugauguggaaaugagguugggggaaccagcagaaaugcccccauucucccagu

SEQ ID NO: 518415 - RNA, 64 nt, Human
ccaguuucaaguaccuauucaaaauuuuauuaaaaaccagcaaauuaauuuuaaucucuagcca

SEQ ID NO: 518416 - RNA, 64 nt, Human
cugucaaaggaaugaguaaagcagaaaaacuuuuaaccagcaacauuucaaguacguaguguga

SEQ ID NO: 518417 - RNA, 64 nt, Human
ccagagguccaaauauugggaggggagaagaucuaaccagcaacagggaaaagagaaauauuau

SEQ ID NO: 518418 - RNA, 64 nt, Human
gaaugauuucugcuagcccugagccuauuuuuggaaccagcacuuggggaaacugaucuuguga

SEQ ID NO: 518419 - RNA, 64 nt, Human
guccuuuguggaugaaucccacauuaggauggugaaccagcagcuacuagggagaagucugcaa

SEQ ID NO: 518420 - RNA, 64 nt, Human
cagccugccggccucccugcagcucacggggcagaaccagcacaucuggagccacacagcuugg

SEQ ID NO: 518421 - RNA, 62 nt, Human
cacgaucugggggggggauccugucuuccuccccaccccaccccacucuuacccaauuucug

SEQ ID NO: 518422 - RNA, 62 nt, Human
ucugggggggggauccugucuuccuccccaccccaccccacucuuacccaauuucugggcuc

SEQ ID NO: 518423 - RNA, 62 nt, Human
auuacugaagugucuaaaaagaacagaaggacccaccccagccauaaugcagacuuucccau

SEQ ID NO: 518424 - RNA, 62 nt, Human
agcccauuucagacugcagaugccgcccacucccaccccacuccuaggcugccuuggagggu

SEQ ID NO: 518425 - RNA, 64 nt, Human
uggggaaaauagaaaauaacauuauuaaguguaaaaccagcaaaguacuuuuuuaauuaaacaa

SEQ ID NO: 518426 - RNA, 64 nt, Human
aaaacaaagaaggggaaaaacugacaacuaacaaaaccagcaccacaucgcuagguggugcuua

SEQ ID NO: 518427 - RNA, 64 nt, Human
cuacuucuucaagggcaaagucuacuggcgccucaaccagcagcuucgaguagagaaaggcuau

SEQ ID NO: 518428 - RNA, 64 nt, Human
ggcaccaugcagagauggcaguugcuuccuccugaaccagcacuaaucccccucugcccuccug

SEQ ID NO: 518429 - RNA, 64 nt, Human
aaaagauguuugauuuuacaguggagccuuacugaaccagcauucagaaguuuaagguccuccu

SEQ ID NO: 518430 - RNA, 64 nt, Human
cauaaucccuuggcagccuggggcuacuuuuuagaaccagcaagcacuguugauacugugaaac

SEQ ID NO: 518431 - RNA, 64 nt, Human
uuguuguuguuguuguuguuuuacagcugaaaccaaccagcaagcccuugaugaccaagaggcg

SEQ ID NO: 518432 - RNA, 64 nt, Human
uacuaaaaguaaccaucuaaagagcuuguggccaaaccagcagaacauucuucucuucaaagga

SEQ ID NO: 518433 - RNA, 64 nt, Human
caucuuccacaguuuuccaaacuggauagcugccaaccagcagacauuacccacuugaaaugga

SEQ ID NO: 518434 - RNA, 64 nt, Human
caaauguuuacauucaauuaaggggaaaaaguagaaccagcacaaaugaguggcaguugcugga

SEQ ID NO: 518435 - RNA, 64 nt, Human
uacaggaacccuggcugguccuggaagugacaaaaaccagcaaauucaauucuuugcaggcuga

SEQ ID NO: 518436 - RNA, 64 nt, Human
guaaccagugcuuuugauaaugugguuggcaacaaaccagcaacuauuuagaagugucauaaga

SEQ ID NO: 518437 - RNA, 64 nt, Human
cacuuuugauagauuacgucuaauccucccaaccaaccagcaggguagcuauuacuguccacau

SEQ ID NO: 518438 - RNA, 64 nt, Human
gguuacccagacuuacagaauuauguccuccagaaaccagcaagaacacuuggaaugaacgaau

SEQ ID NO: 518439 - RNA, 64 nt, Human
uuaaacauuuguuaaguuggagcuugcacauuuaaaccagcagcauacguuccagaagagcauc

SEQ ID NO: 518440 - RNA, 62 nt, Human
cgguaagagauuaaauauaaacacagcaaguuccaccccaguccuauuuguccaaggcugca

SEQ ID NO: 518441 - RNA, 62 nt, Human
aagugacuuugaaaaguuuuguggcaccugacccaccccagacacuagggcuaucagaaggu

SEQ ID NO: 518442 - RNA, 62 nt, Human
uggucucaaacuccugaccucaggugauccacccaccccagccucccaaagugcuaagauua

SEQ ID NO: 518443 - RNA, 64 nt, Human
uguuggccucaagcaaggaagcagagcacuguguaaccagcagucacaggucuuuucuuggcgu

SEQ ID NO: 518444 - RNA, 64 nt, Human
agcauauaaucaagaaauaaccaugaaaauagccaaccagcagcccucagggcugcuuugccua

SEQ ID NO: 518445 - RNA, 64 nt, Human
aaacgaaaccauaucgcaaaccagagcugcuggaaaccagcacacgcaaaagaugacgcccagc

SEQ ID NO: 518446 - RNA, 64 nt, Human
auugcuacagcuugaccuaccaguauuccggaguaaccagcaaaugcaaaguugaccuuguucc

SEQ ID NO: 518447 - RNA, 55 nt, Human
aagaccugcagaguguaugacacauaaccagcacccaagaaaugucuaccgagga

SEQ ID NO: 518448 - RNA, 64 nt, Human
gaaggaaaaacgaagggccuuagaggggccuacaaaccagcaacaugaaauggacaaaccaauc

SEQ ID NO: 518449 - RNA, 64 nt, Human
cggagccucugcccauggcgggguggagacccggaaccagcagcccccuccacuggcgacacaa

SEQ ID NO: 518450 - RNA, 64 nt, Human
ccuuguucuuuuuggaaacucucggcaaagggcaaaccagcaaguauugaggguacccaucuag

SEQ ID NO: 518451 - RNA, 64 nt, Human
uaaaaccacaccagggaggaaaaaugacauucagaaccagcaaacacugaauuucucuuguugu

SEQ ID NO: 518452 - RNA, 64 nt, Human
guaugugucuaugaagcugucuugugccagugagaaccagcaggagaauguacaacagugucac

SEQ ID NO: 518453 - RNA, 64 nt, Human
aagugaaguuuuuuaguuguuuuuugugguauucaaccagcaaguuguuuucuuucagaguuuc

SEQ ID NO: 518454 - RNA, 64 nt, Human
cugguuucucgcagccauugccugccugacccugaaccagcaccuucuuuuccgagucauaccc

SEQ ID NO: 518455 - RNA, 64 nt, Human
accuucacgcugucccaccaugggccaggaaccaaaccagcacuggguucuacugcuguggggu

SEQ ID NO: 518456 - RNA, 64 nt, Human
auuauuuacugagugccaguuguaaauguuuuucaaccagcaccuaaaaagacucuuuucaaaa

SEQ ID NO: 518457 - RNA, 64 nt, Human
ugucaaauucaagguauuauugauaaaccuuuucaaccagcagcaagaaguucaaauuuuuuuc

SEQ ID NO: 518458 - RNA, 62 nt, Human
ccaggacaccucaagucuccagccccacuaccccaccccacuccuguauucuuuuuuuuuuu

SEQ ID NO: 518459 - RNA, 62 nt, Human
ggugccuggccuccagugucccaccuccuucaccaccccacuuggcuccuuugccaucuuga

SEQ ID NO: 518460 - RNA, 62 nt, Human
uauuucuguaaagaugguuauuuaacccuccuccaccccaucacgguggcccugagggcuga

SEQ ID NO: 518461 - RNA, 58 nt, Human
acaaccagcgcuccagauaaccucagggaaccagcacuucccaaaccgcagacuacau

SEQ ID NO: 518462 - RNA, 64 nt, Human
ucaggaccaggcaaugugacuuugcaucagcaacaaccagcaucccuugaccaggccugggcca

SEQ ID NO: 518463 - RNA, 64 nt, Human
uucuggucugaccaucgcaacccucaugaaguacaaccagcauaugcuacaaaguacgcaauaa

SEQ ID NO: 518464 - RNA, 64 nt, Human
aagggagccagggauuccugugauacagauuuugaaccagcagaguacuuugguuuucuucaug

SEQ ID NO: 518465 - RNA, 64 nt, Human
aaauuuaugguuccuugguaagcacgguauucuaaaccagcagagcacuuguuaacguuuggag

SEQ ID NO: 518466 - RNA, 64 nt, Human
ugcucagaccuacuuccuugggagggggugacggaaccagcacuguguggagaccagcuucaag

SEQ ID NO: 518467 - RNA, 64 nt, Human
aucucuaacuucaccauauuaccacagacauacuaaccagcagaaaugccuuacccucauguuc

SEQ ID NO: 518468 - RNA, 64 nt, Human
uuaauguacccugcguuuugucuucaccauugucaaccagcagucaaggaugagcaccagguau

SEQ ID NO: 518469 - RNA, 64 nt, Human
uccccaggacuuacggagagaaauaaggggauguaaccagcaauggccaggguacaacagcccu

SEQ ID NO: 518470 - RNA, 64 nt, Human
caaauagggcuggugaggagugacuguccaggggaaccagcagagggcguugggggugccaagg

SEQ ID NO: 518471 - RNA, 64 nt, Human
cgccucacucagccagguggagagcaccaaucugaaccagcaaugccugcagcccagccccucc

SEQ ID NO: 518472 - RNA, 64 nt, Human
caacaucuggucuuccaggcacucaaaagcugggaaccagcaucucagcgccagcucuaccagu

SEQ ID NO: 518473 - RNA, 64 nt, Human
auggcaaagaauguggucaggcuguagccuccccaaccagcagacagcuuuauggaaacuuggu

SEQ ID NO: 518474 - RNA, 64 nt, Human
cacaggccuucagcccuuuaacgucucugccaaaaaccagcacaaggagacaaagcagagccuu

SEQ ID NO: 518475 - RNA, 64 nt, Human
cagagguggcuuucugaggccuggaaggcaggccaaccagcaaaauccugauaacaagacucug

SEQ ID NO: 518476 - RNA, 62 nt, Human
ucuugacucaucuuuauuuuuauucgcacaucccaccccauccccugaacuacuugggaggu

SEQ ID NO: 518477 - RNA, 62 nt, Human
ccagaaccuacugguacuuuauagcauuugccccaccccacagcuuagguuuuucugucauc

SEQ ID NO: 518478 - RNA, 62 nt, Human
gcucgggguggagggucucagcucugcugcccccaccccaguacuagccuagcuucccaagc

SEQ ID NO: 518479 - RNA, 64 nt, Human
ccccacuccacaucaacauuccagggaugagccaaaccagcagggaguuagcacugaacugcuu

SEQ ID NO: 518480 - RNA, 64 nt, Human
guccuuucucagaggggccagcuaacccgugcagaaccagcacuaagguggacagcagacaaga

SEQ ID NO: 518481 - RNA, 64 nt, Human
aggugugaggcuuuaucugcacacaggacaugaaaaccagcagaaaggcccugagcugcugcau

SEQ ID NO: 518482 - RNA, 64 nt, Human
ucagguuaauccaagcaacacgcauuggguuuaaaaccagcaccgaggcccagugggggaauca

SEQ ID NO: 518483 - RNA, 64 nt, Human
cugcuuaggaaagcggcuguugcuccauaacucuaaccagcacagggcugaggccugcagugca

SEQ ID NO: 518484 - RNA, 64 nt, Human
ggcuuugauggcccuggagauccuacaguaaauaaaccagcauccugccgcccaaagccgccuc

SEQ ID NO: 518485 - RNA, 64 nt, Human
auuaggagccacuugugacuccaugaccuguuaaaaccagcaaugugaguauuauuuggaguaa

SEQ ID NO: 518486 - RNA, 64 nt, Human
ggugagugacuggccuggguucuagaccucugggaaccagcaccugagucacagcugucuaggc

SEQ ID NO: 518487 - RNA, 64 nt, Human
ggcaccagugcggccccgguggccauggggaauaaaccagcauugcugccuccggccuccgccg

SEQ ID NO: 518488 - RNA, 64 nt, Human
gcuguggacauggccaucgcaugggaggagcucaaaccagcacuaaugaacagcauguggaaga

SEQ ID NO: 518489 - RNA, 64 nt, Human
auaucgauaucuauauguauauguauauuuaaucaaccagcaguuuugaaacuagucauccugg

SEQ ID NO: 518490 - RNA, 64 nt, Human
auguacacccacccacauaucuuacagccagaggaaccagcacuccaucacugagagcccgacu

SEQ ID NO: 518491 - RNA, 64 nt, Human
uaauauauuggcaguacuuauuauauaaaagguaaaccagcauucucacugugacgacucuguu

SEQ ID NO: 518492 - RNA, 64 nt, Human
aucaguuuuucccacagcagggacugugagagacaaccagcagcauccucuuuguaaucacagg

SEQ ID NO: 518493 - RNA, 64 nt, Human
cccaagucgaguauauacaggaauacaaaucgguaaccagcagcuguuccucagguugugacuc

SEQ ID NO: 518494 - RNA, 62 nt, Human
agaaacugaaguguuagacacuaugugucccaccaccccauuacagagacauaugacaaugu

SEQ ID NO: 518495 - RNA, 62 nt, Human
acuugugagcgcccccagcuuugcggcgccccccaccccagcgcugucugugggucccuugc

SEQ ID NO: 518496 - RNA, 62 nt, Human
cccaccggaagcgcucuuuacuuggucgcuggccaccccaguguuuggaaaaaaaucucugg

SEQ ID NO: 518497 - RNA, 64 nt, Human
aaccugcuuuuuugaaaggaaaugauuacugucaaaccagcaugguuaauugugagcauccucc

SEQ ID NO: 518498 - RNA, 64 nt, Human
ccagacaguuccagccacuaggaggccgucuuggaaccagcaagucgcauuugccacuugacac

SEQ ID NO: 518499 - RNA, 64 nt, Human
ggagaaggggaaggaaggggcuuugggaucuggaaaccagcaggccaggcagcauccacagugu

SEQ ID NO: 518500 - RNA, 64 nt, Human
augcccuuaaagaggaagccaguccuguuccucuaaccagcaacgugggcagcacagugaaggg

SEQ ID NO: 518501 - RNA, 64 nt, Human
uccaaaccuggccaagcccagcuuccgaagcaggaaccagcacugucucugugccugacucaca

SEQ ID NO: 518502 - RNA, 64 nt, Human
ugaggcugucaucuggacucaccagauucucaucaaccagcauucuugauguagcucaucuaug

SEQ ID NO: 518503 - RNA, 64 nt, Human
cugaugcccucaccuauacucaccugccuuuauuaaccagcauucuugauaugauccaccugug

SEQ ID NO: 518504 - RNA, 64 nt, Human
cuuggccccauuaggagaaggagaaaugacuggaaaccagcacugucagcacuuugagcccucc

SEQ ID NO: 518505 - RNA, 64 nt, Human
gaaucugugcuuccccagucuccuugccccagacaaccagcauguaagacccuucccgcuucac

SEQ ID NO: 518506 - RNA, 64 nt, Human
acacuugauuccauuucauugucauuaguguauuaaccagcaggagaggugaugagccauuuuu

SEQ ID NO: 518507 - RNA, 64 nt, Human
guggcccccgcccccucccuauaugcaccccuggaaccagcaagucccagacaaggagagcgga

SEQ ID NO: 518508 - RNA, 64 nt, Human
ccugcuuuuuccccacagcccguguucccagccgaaccagcacucucccggaagccuggggucc

SEQ ID NO: 518509 - RNA, 64 nt, Human
aggagcaaccuuuguauauuggagacuucagaguaaccagcaaggaagagaaaucuuaaucuuc

SEQ ID NO: 518510 - RNA, 64 nt, Human
uaucucaugcaccucugagugccuucuuccccaaaaccagcagugccauaccugcugucagcaa

SEQ ID NO: 518511 - RNA, 62 nt, Human
gguuucaagucuggguucugguguccacucacccaccccaccccccaaaaucagacaaaugc

SEQ ID NO: 518512 - RNA, 62 nt, Human
ggaccagguccuguuccucuuucuccccgacuccaccccagcucccugugaagagagaguua

SEQ ID NO: 518513 - RNA, 62 nt, Human
gcugcuuuucugcccuuccucacccccacgccccaccccacucccccagaguacuccccacu

SEQ ID NO: 518514 - RNA, 61 nt, Human; identical to SEQ ID NO: 446109

SEQ ID NO: 518515 - RNA, 64 nt, Human
cuucuggggaaggaacaaaguccccaaacaaagcaaccagcacaauucugaaggggccuggccu

SEQ ID NO: 518516 - RNA, 64 nt, Human
agccgggaacagagaaguguggggaagagauaggaaccagcaggauggcaggggcaaagggcuc

SEQ ID NO: 518517 - RNA, 64 nt, Human
gcccugucucaaaaccagguugccagauccaaugaaccagcagcuggaaucugaaggcaucagu

SEQ ID NO: 518518 - RNA, 64 nt, Human
cguuuugacggugguuuucaaaauguuguucuucaaccagcaacagcaacagcuagggacugau

SEQ ID NO: 518519 - RNA, 64 nt, Human
aaggccuugggcugugcguccgacccugcugcagaaccagcaggguguccccucgggcccaucu

SEQ ID NO: 518520 - RNA, 64 nt, Human
gaagaagaagcuccagccaguucugcugcaagucaaccagcaugcagggggccuuccucuaaag

SEQ ID NO: 518521 - RNA, 64 nt, Human
uucucuuuggcaagaaguccccuucucgcccccaaaccagcaagggacucccccaccugggucu

SEQ ID NO: 518522 - RNA, 64 nt, Human
ggugggccagguguuccuugcccucauucggguaaaccagcaaccuccagcaugggugucauag

SEQ ID NO: 518523 - RNA, 64 nt, Human
ucgguagguuccgugaugccccacaagccgcaaaaaccagcaaguuuuuauuagggauuuucaa

SEQ ID NO: 518524 - RNA, 64 nt, Human
ggugggccagguguugcuugcccucauucugguaaaccagcagccuccagcaugggcgucauag

SEQ ID NO: 518525 - RNA, 64 nt, Human
ccuggagcuggccuccuuccagcccagugccagaaaccagcacuccaugaagauaaacucuggg

SEQ ID NO: 518526 - RNA, 64 nt, Human
cugagcccacaaggaccaaagcuguaccuagaggaaccagcacccgggccucagcugucugugc

SEQ ID NO: 518527 - RNA, 64 nt, Human
augugauuaauagggaguaggcgagauuauagcaaaccagcagaaauggaacucugcuaaaugu

SEQ ID NO: 518528 - RNA, 64 nt, Human
acagcugagccccaaccgggccuggcccccucuuaaccagcaguucuugucuggggagcucaga

SEQ ID NO: 518529 - RNA, 64 nt, Human
gccuccacccacucacccccuacagccugaagcaaaccagcagcccagccuugccucucugacc

SEQ ID NO: 518530 - RNA, 62 nt, Human; identical to SEQ ID NO: 271868

SEQ ID NO: 518531 - RNA, 62 nt, Human
cugccuucucuaugcagccugcccuccaucauccaccccagaauugcucucuuuccucucuu

SEQ ID NO: 518532 - RNA, 62 nt, Human
ccacuuaucccucuccauaaccccacccuugcccaccccacccccacccccaccaagggcgc

SEQ ID NO: 518533 - RNA, 64 nt, Human
ugggcuggggucccccccacugccagcugcaaggaaccagcaaagacauuuaccagagucuggg

SEQ ID NO: 518534 - RNA, 64 nt, Human
agcaaauaagcaagaaauaaccauaaaagugggcaaccagcagcucuaggcgcugcucuugucu

SEQ ID NO: 518535 - RNA, 64 nt, Human
ugcccaaauucugugguuuggggccuccuuucaaaaccagcaauggccaaucagucuuacauca

SEQ ID NO: 518536 - RNA, 64 nt, Human
gccugggcaguagagucagucuccaucucaaagaaaccagcaaacaaaaaauauuaaaaaaaaa

SEQ ID NO: 518537 - RNA, 64 nt, Human
aaggcacauaggucacuugaggucagaaguuugaaaccagcauggccaacagaugucagccacu

SEQ ID NO: 518538 - RNA, 64 nt, Human
uccuggagacaagagcuggagacuggagguuucuaaccagcauccagaagguucguuagccagg

SEQ ID NO: 518539 - RNA, 64 nt, Human
auuuuguguucauuuuuguuuucuguuucaccuaaaccagcauaggauugauaggggagacggu

SEQ ID NO: 518540 - RNA, 64 nt, Human
uacaaauugguugaauguuucugucuguggugcgaaccagcauuaacggauggggcacgugccc

SEQ ID NO: 518541 - RNA, 64 nt, Human
uuuugucuuccucacuaguguaaacaaaaauuucaaccagcauucaugccgaaccuauacccau

SEQ ID NO: 518542 - RNA, 64 nt, Human
agcaaaccuucccagcagcccuugagccaaguaaaaccagcacaaccagccaccagugguuggu

SEQ ID NO: 518543 - RNA, 64 nt, Human
accugauacuuucacauguaauuaaauuccaggcaaccagcacaagagccgugagcuuggcaca

SEQ ID NO: 518544 - RNA, 64 nt, Human
gucccccacccacucuuccccccaucaagaaaagaaccagcauuuguaaagcuguggacaccau

SEQ ID NO: 518545 - RNA, 64 nt, Human
ugaaugacuggugugccuucuguggccuggacacaaccagcacagagcugucagugguggagag

SEQ ID NO: 518546 - RNA, 64 nt, Human
cccauucugcaccaguuguuuuaccccugccgauaaccagcagucagagauucuuuuuuaaucc

SEQ ID NO: 518547 - RNA, 62 nt, Human
caacacagguggcagcuucucccccuuccuucccaccccagucccucuucccaccccucucu

SEQ ID NO: 518548 - RNA, 62 nt, Human
ugugaggucaaggugguggccaaggacaccagccaccccacugacccucugaccuccuuccu

SEQ ID NO: 518549 - RNA, 62 nt, Human
gagaacacuugaguugugaagguuuugggcauccaccccagaaagugggaauuugauuuuau

SEQ ID NO: 518550 - RNA, 62 nt, Human
uggccauggccugcaaacugggaaccccuuucccaccccaaccugcucuccucuucuacuca

SEQ ID NO: 518551 - RNA, 64 nt, Human
uuauauuuauuuugaaaccaguuuaaugggauacaaccagcauuuuaaaaaaugaaauagaaua

SEQ ID NO: 518552 - RNA, 64 nt, Human
gcacucucagucaacaugacagauucuggaggauaaccagcaggagcagagauaacuucaggaa

SEQ ID NO: 518553 - RNA, 64 nt, Human
uuuucuggauccuccauugcucgccuuggccaggaaccagcagaccaacugccuuuugugagac

SEQ ID NO: 518554 - RNA, 64 nt, Human
gcgagacccugucuuaaaaaaaaaaacaaaacaaaaccagcaucuguuacuggaacagagaccu

SEQ ID NO: 518555 - RNA, 64 nt, Human
gaagguaaagggacacuggauccagaagcuauggaaccagcaguugauucuuguauuccugauu

SEQ ID NO: 518556 - RNA, 64 nt, Human
acaaaaucaaucuuuuccuuugaucuuguggcuaaaccagcauuucuguguuugagagauuucc

SEQ ID NO: 518557 - RNA, 50 nt, Human
caucuugcucuggacugugaaaccagcagcuucuuuguuccagugaauaa

SEQ ID NO: 518558 - RNA, 64 nt, Human
cauugccaaccauauuggaucugcuugcuguccaaaccagcaaacuuuccugggcaaaucacaa

SEQ ID NO: 518559 - RNA, 64 nt, Human
uaucagagcugucagcacuaccucuccccgcugaaaccagcaguucauggcuuccuguggauuc

SEQ ID NO: 518560 - RNA, 64 nt, Human
uuuugagauuuagagcaaugcauucuggagacagaaccagcagaacagccauuuuucaauuuuu

SEQ ID NO: 518561 - RNA, 64 nt, Human
cuggggguagggaaacuucuaguggcaaugauaaaaccagcagcaaugauaauagaaggcaaac

SEQ ID NO: 518562 - RNA, 64 nt, Human
auauugacggaagaauagagaggaggcuugaaggaaccagcaaugagaaggccaggaaaagaaa

SEQ ID NO: 518563 - RNA, 64 nt, Human
gagacauguacugccccucacauuuucucaccuaaaccagcagcaccuccaucuuaacagccau

SEQ ID NO: 518564 - RNA, 64 nt, Human
uggucccugggggcuggacccaggcuccuaaauaaaccagcaacucccucgagucugucucugu

SEQ ID NO: 518565 - RNA, 64 nt, Human
ugaacugcacccaggaggugacugggaaggagaaaaccagcaaaggaagcucugccuuuuauaa

SEQ ID NO: 518566 - RNA, 62 nt, Human
uucugggcuuccccugguuucuguccuaguucccaccccaaguuuaagaagacuuagauuca

SEQ ID NO: 518567 - RNA, 62 nt, Human
aaagaaaugaugacaauccucuuggcaucaccccaccccacauucuccccgauguuccucuc

SEQ ID NO: 518568 - RNA, 62 nt, Human
cuuugugcucugagagguuggagacaucugguccaccccauugccccugccccuggcaagcc

SEQ ID NO: 518569 - RNA, 64 nt, Human
uauuggggggaggaauagaggggaggugugcaggaaccagcaaugagaaggccaggaaaagaaa

SEQ ID NO: 518570 - RNA, 64 nt, Human
auauugggcgaagaauagagggggagcuugcaggaaccagcaaugagaaggccaggaaaagaaa

SEQ ID NO: 518571 - RNA, 64 nt, Human
ccuucugccaggcaggcccuuccucccuuggcccaaccagcaaagcgccccucagucuucaagg

SEQ ID NO: 518572 - RNA, 64 nt, Human
agcugccuguccgaccccaucuuacagacgagaaaaccagcacacaggcaccaaggaacugucc

SEQ ID NO: 518573 - RNA, 64 nt, Human
uuaccauuuacucuauaaucugcagugaugcaauaaccagcauaauaaaaaggcaaucacauaa

SEQ ID NO: 518574 - RNA, 64 nt, Human
ccaccauuucucauuggaacccauuaauuaagaaaaccagcaugguuugacaccacaugggaac

SEQ ID NO: 518575 - RNA, 64 nt, Human
cugcagagcuagguuguccuauuggcauaaaacaaaccagcaacuuuucucauguguuuggagu

SEQ ID NO: 518576 - RNA, 64 nt, Human
ugauuaaguguguauuuguacccuagaugauaugaaccagcagucuuguuuuggcaucauccuc

SEQ ID NO: 518577 - RNA, 64 nt, Human
uccuuaaaucagacaagcuccuggcuaucuucauaaccagcagugaguagaucuucuuaauaua

SEQ ID NO: 518578 - RNA, 64 nt, Human
ggaagacaaacagcaacucucagcuugcuucaagaaccagcagauaagagaugguuaagcuguu

SEQ ID NO: 518579 - RNA, 64 nt, Human
cuggagucuggacuggcugagauaagagccuggcaaccagcaagagcugggcuguauuuggaga

SEQ ID NO: 518580 - RNA, 64 nt, Human
cggccccuggagucuucccucccugguagccucuaaccagcauucccagacaccugaggcagau

SEQ ID NO: 518581 - RNA, 64 nt, Human
gaugugaacuuaaccuguuucuggcuggcuagccaaccagcauggaaaacagauuagguuagau

SEQ ID NO: 518582 - RNA, 64 nt, Human
gugguuaaucugcuauaucaaacuccuucccugaaaccagcaaacaccgggaaacauuuuggcu

SEQ ID NO: 518583 - RNA, 62 nt, Human
caucuuccuucccuccucugucccugccucggccaccccacgcgggaacccagcgccguccu

SEQ ID NO: 518584 - RNA, 62 nt, Human
uugaguaucuacuuggcuucucgugguuuuucccaccccagcugccccagcacgcgggaccc

SEQ ID NO: 518585 - RNA, 62 nt, Human
gcccccucuggcuuggagagcauuccaagcccccaccccaccccuagaacugccauucccaa

SEQ ID NO: 518586 - RNA, 62 nt, Human
aaacaaaaagaaauguagauucuugggccccaccaccccacgccuacugagccagaaucucu

SEQ ID NO: 518587 - RNA, 62 nt, Human
guuuugacugcuggcagucuaaaacaguccacccaccccauggcacugccgcgugauucccg

SEQ ID NO: 518588 - RNA, 62 nt, Human
cuacccucggcucccgggucuccccucccucgccaccccaaccagcggcuucugcgccgccc

SEQ ID NO: 518589 - RNA, 62 nt, Human
uccugcugagggaucccagagagggcaggugcccaccccacaggcccuuuccuggaccaugg

SEQ ID NO: 518590 - RNA, 62 nt, Human
ccagaggaccuugguguuugcucucccuugacccaccccagugagugccaaagggcagcccc

SEQ ID NO: 518591 - RNA, 62 nt, Human
gcagcccccaucuucaagggcugcuucuacacccaccccaccgaggugcugaagccugucag

SEQ ID NO: 518592 - RNA, 62 nt, Human
cccuccacgccggcucuuccccacccucagccccaccccagguccugcagucuggcugagcc

SEQ ID NO: 518593 - RNA, 62 nt, Human
guaucucccaaugcuaucccuccccccuccccccaccccacaacaguccccagagugugaug

SEQ ID NO: 518594 - RNA, 62 nt, Human
cuugugcugugguggguucgauuuaucccugcccaccccacccccacaacuucccuuuugcu

SEQ ID NO: 518595 - RNA, 62 nt, Human
aggccacucccagggacccagggaggcgauggccaccccagaggccaccuuuugcuccacgg

SEQ ID NO: 518596 - RNA, 62 nt, Human
uauaaacuauaaccucuccuucaugacagccuccaccccacaacccaaaagguuuaagaaau

SEQ ID NO: 518597 - RNA, 62 nt, Human
gcgguaugagccccggccccuccccaccuuucccaccccagcccucuugcaagaggagaggc

SEQ ID NO: 518598 - RNA, 62 nt, Human
cuuugugaucccuucuuacuuaauccuccuugccaccccaccaucaccagaccacugaucug

SEQ ID NO: 518599 - RNA, 62 nt, Human
ugccggcccggacccgucccagccuccccuccccaccccaugcagcccccagggggauagcc

SEQ ID NO: 518600 - RNA, 62 nt, Human
ccuuucacuucucugccuaugggcuacccuccccaccccacuucuaucucaauaaagaacac

SEQ ID NO: 518601 - RNA, 62 nt, Human
aacagcugacuguggcuucaaggacaucagggccaccccaaguccucaguguccuacuccug

SEQ ID NO: 518602 - RNA, 62 nt, Human
caccauauaaccuucgauugugcuucucaacuccaccccauaauuucucccagagaccaucu

SEQ ID NO: 518603 - RNA, 62 nt, Human
uuugggaucaggagcccccaacacaggcaaguccaccccauaauaacccugccagugccagg

SEQ ID NO: 518604 - RNA, 62 nt, Human
caucagcacugccggcccagugacaccgaguuccaccccaucggcuuccauaucuuccaggc

SEQ ID NO: 518605 - RNA, 62 nt, Human
guagaaauuuuacagucugccauuuugggugcccaccccaauuuuuaccuuuuaguaaguug

SEQ ID NO: 518606 - RNA, 62 nt, Human
agugaaggaggauggggcaggacaggacgcggccaccccaggccuuuccagagcaaaccugg

SEQ ID NO: 518607 - RNA, 62 nt, Human
uguuuugcccccauucuacuacccaccacugcccaccccacccccacaucacacacucuucg

SEQ ID NO: 518608 - RNA, 62 nt, Human
uuuggggcugcgaaaacguugaccccuuucccccaccccagaguugggaugcggggcagagc

SEQ ID NO: 518609 - RNA, 62 nt, Human
uguuucacaaagcuuagaccuuuaccuuccagccaccccacagugcuugauauuucagaguc

SEQ ID NO: 518610 - RNA, 62 nt, Human
aguuaggaagaaggacgagagagccucucuccccaccccaaucuaaauauggaauuugguaa

SEQ ID NO: 518611 - RNA, 62 nt, Human
ucccgacuagcuggcauuacaggcgugcagcaccaccccaggcuaauuuaaaaaacuuuuuu

SEQ ID NO: 518612 - RNA, 61 nt, Human; identical to SEQ ID NO: 271993

SEQ ID NO: 518613 - RNA, 62 nt, Human
aacaaaagcgaauuaaaacacaacaaaaaaccccaccccacaaccuucaggacagucuaucu

SEQ ID NO: 518614 - RNA, 62 nt, Human
aguuuguuuccucauacaccuuccucacuaccccaccccacaugguugacucuuucccucag

SEQ ID NO: 518615 - RNA, 62 nt, Human
ugccagcugccacagcugcaugaccugcuuccccaccccacggugucguuuuguuuuuaaag

SEQ ID NO: 518616 - RNA, 62 nt, Human
gggaggguggcuggcccggccuccacagcaccccaccccauaucuucuuuccauuuauuucg

SEQ ID NO: 518617 - RNA, 62 nt, Human
cuugagaaggugcuuuguaauauucuccccacccaccccacgcccgcacccccgcacccuua

SEQ ID NO: 518618 - RNA, 62 nt, Human
ccuuugcugaugacacauuagcuggaucuuagccaccccagaaaggguuugauuugaagcug

SEQ ID NO: 518619 - RNA, 62 nt, Human
cauugaggaccccugcuuccugguucucagucccaccccaaaaccuggcacccagaacaguu

SEQ ID NO: 518620 - RNA, 62 nt, Human
uggggacaucuaacucuggucugggaagccacccaccccagggcaaugcugcugugaugugc

SEQ ID NO: 518621 - RNA, 62 nt, Human
ccucuuuugccugcugcugugaagguauagcaccaccccagguccuccugcagugcggcauc

SEQ ID NO: 518622 - RNA, 62 nt, Human
gagcucaugaagcaggcaaggaccgaacaccuccaccccaacguagaccugcaggugcugcc

SEQ ID NO: 518623 - RNA, 62 nt, Human
ucucucuacacugaaaauaaaaccucuuccacccaccccauucgguucuucugccugaccuu

SEQ ID NO: 518624 - RNA, 62 nt, Human
ucacccaucuguagcucccucaaagucagggcccaccccaucugaggcagagaagacucgag

SEQ ID NO: 518625 - RNA, 62 nt, Human
cuguggcggcuucagaucuccaaucccugccaccaccccaacucaaauuaaauacagauucc

SEQ ID NO: 518626 - RNA, 62 nt, Human
ggaggcccuuuucugaucaugccccuucucucccaccccaucuccccaccaccaccucugug

SEQ ID NO: 518627 - RNA, 62 nt, Human
agcccaacagguccacgauggauccaccagucccaccccagccuuuuccuuucaucugaaca

SEQ ID NO: 518628 - RNA, 62 nt, Human
cccccagccccgacuccagccagcgccucccuccaccccaggacgccacucauuucaucuca

SEQ ID NO: 518629 - RNA, 62 nt, Human
ccuguccccgugggccguggcauggccacaccccaccccacuucucccccaaaaccagagcc

SEQ ID NO: 518630 - RNA, 62 nt, Human
ugcuuucauuaauuacccuacuuucauuccucccaccccaagcaaaucccaacauuucucuu

SEQ ID NO: 518631 - RNA, 62 nt, Human
ggaaugcuacuaggaauuggaaucaaacaaugccaccccaagcguaauuuuagccagcaguu

SEQ ID NO: 518632 - RNA, 62 nt, Human
uauucuaguucagggucgugcguggccagaguccaccccagcaacucagugugcagggcagg

SEQ ID NO: 518633 - RNA, 62 nt, Human
gccagaaggcgacuuauuuuuucucuccuaugccaccccagguggggagggagggagguuuc

SEQ ID NO: 518634 - RNA, 62 nt, Human
cggucuccuuaaacuaccacccucgcugccacccaccccaagcugcugccgccucaccuucc

SEQ ID NO: 518635 - RNA, 62 nt, Human
ggcuccagaaagucagcagugugccugggcacccaccccauccucuaccugccacaccucag

SEQ ID NO: 518636 - RNA, 62 nt, Human
acuccuccacaaaccgugacccauagccgcccccaccccauaccuugaucuaccauccaucc

SEQ ID NO: 518637 - RNA, 62 nt, Human
uuauuaaugccauuaucccugaaucccccuugccaccccacccucccuggaguguggcugag

SEQ ID NO: 518638 - RNA, 62 nt, Human
uccccgaggaagaaggcuucuggucaggacccccaccccaaggcuggggacuccaggcuccu

SEQ ID NO: 518639 - RNA, 62 nt, Human
uggaaaaucgucuaacuggagaagggcgguauccaccccacauucggaucccaggguccuga

SEQ ID NO: 518640 - RNA, 62 nt, Human
aaaggcacaauguggagccuggggugucucccccaccccaggaccgucagguuuaccagugu

SEQ ID NO: 518641 - RNA, 62 nt, Human
cuuugccuuuacccuauaccucucugcacgucccaccccauuuugcugugugcucaccccca

SEQ ID NO: 518642 - RNA, 62 nt, Human
uuuguccuaacaguccacaguccugccccgacccaccccaucccuuuucucuggcacuccag

SEQ ID NO: 518643 - RNA, 62 nt, Human
gauagauacacucauaaaacccccaccccuccccaccccaccccugcucccauugugugugu

SEQ ID NO: 518644 - RNA, 62 nt, Human
ccuucuccccuccccgccuggccagggcagggccaccccacucuaccuccuuagcuuucccu

SEQ ID NO: 518645 - RNA, 62 nt, Human
aagcugagauacugggcacaggguuguggccuccaccccagcucuggucugugcagacucau

SEQ ID NO: 518646 - RNA, 62 nt, Human
ggccuuuccuggcugaucagagcuuaccagccccaccccaccaugguagccuuagggugcug

SEQ ID NO: 518647 - RNA, 62 nt, Human
cacuccaggucugaaaagcaagucccccagccccaccccagggagccagagaggcuugcacu

SEQ ID NO: 518648 - RNA, 62 nt, Human
gaggcugguagcagaaugcacauuggaagcucccaccccauauuguucuucaaaguggaggu

SEQ ID NO: 518649 - RNA, 62 nt, Human
ucagacuucuuuuuucucaaaccucaaaacuuccaccccaaacuucgcucucagcuggugac

SEQ ID NO: 518650 - RNA, 62 nt, Human
auccacagaaauacaugaaaugucuggucuguccaccccaucaacaagucuugaaacaagca

SEQ ID NO: 518651 - RNA, 62 nt, Human
uauauaaggcaguauuauugagcucuauuuccccaccccacuauccucacucccauaagcua

SEQ ID NO: 518652 - RNA, 62 nt, Human
cuuagcacuuuccuucuccagauccccccuacccaccccagucccaaauccaguccucuggc

SEQ ID NO: 518653 - RNA, 62 nt, Human
ugagacuccgagacuaucagaagggaauugacccaccccagucuagcaccacccugccuuca

SEQ ID NO: 518654 - RNA, 62 nt, Human
ucagagccccagacagcacugccucuuccuccccaccccacugcccccaccuuaaugugaau

SEQ ID NO: 518655 - RNA, 62 nt, Human
gugaaaagugugggaguuguaauuaggaucauccaccccagacauggaauccccccucccug

SEQ ID NO: 518656 - RNA, 62 nt, Human
agcagggccccucccccagcuccauuccgcucccaccccagccggcugcguuccucucucca

SEQ ID NO: 518657 - RNA, 62 nt, Human
auuuauucagcuacaucaucccucuauuaaccccaccccaucaggcacgugugcaaaccucu

SEQ ID NO: 518658 - RNA, 62 nt, Human
gaagaucucgugacuauacuggcauuucagauccaccccacccccagacucaucccacucuc

SEQ ID NO: 518659 - RNA, 62 nt, Human
cuccaucaggcauuaaaugaauggucucuuggccaccccagccugggaagaacauuuuccug

SEQ ID NO: 518660 - RNA, 62 nt, Human
gggaacccuucauaggaaauccccacccccguccaccccagagacccugcccuuccacccgg

SEQ ID NO: 518661 - RNA, 62 nt, Human
cuuuccuguuguaggggaggaagcuguucuccccaccccaggugccuuuggagguuaaggcu

SEQ ID NO: 518662 - RNA, 62 nt, Human
uggucgcuuugauucuuccugcacagcucagcccaccccaucuguacuggaagggacccugg

SEQ ID NO: 518663 - RNA, 62 nt, Human
guuuuccuuuguuucaucugcuuccucucucaccaccccaucucccucucuuccccagcaag

SEQ ID NO: 518664 - RNA, 62 nt, Human
ggcugugcuuaccugugacagcagcucuguccccaccccaugggccucaugaauaaauggcu

SEQ ID NO: 518665 - RNA, 62 nt, Human
aagccacacauggcuggcggaacccagagcccccaccccagcccaccuggcucuuuguugac

SEQ ID NO: 518666 - RNA, 62 nt, Human
ggggguggucugugcagacaccuccucacccaccaccccaugcauacucuugggaagcagcu

SEQ ID NO: 518667 - RNA, 62 nt, Human
ccucauccuccuggaggguguggcuacccucgccaccccaaauuccaugucaauaaagaaca

SEQ ID NO: 518668 - RNA, 62 nt, Human
cacaggcgcugaguauggagcagccuggagacccaccccaccugcagggcugcccugagcgc

SEQ ID NO: 518669 - RNA, 62 nt, Human
caaguucccuugccuaagaaggccacucccucccaccccacugaagugggggauagucggug

SEQ ID NO: 518670 - RNA, 62 nt, Human
uccggccauggccgcuguguccgccgcaccagccaccccaaagcccuccuccuccuuaaccc

SEQ ID NO: 518671 - RNA, 60 nt, Human; identical to SEQ ID NO: 272059

SEQ ID NO: 518672 - RNA, 62 nt, Human
gcagcaugcagccacuucacccuggggggccuccaccccaccaucuuccgccaggugugccu

SEQ ID NO: 518673 - RNA, 62 nt, Human
guauccuucauuauccaccccaucccagacucccaccccagggauugcccgugaagacuuug

SEQ ID NO: 518674 - RNA, 62 nt, Human
ccacuucugcaaccccagguauccuucauuauccaccccaucccagacucccaccccaggga

SEQ ID NO: 518675 - RNA, 62 nt, Human
ccaccuccuguggacugaugccccagggauucccaccccacuucugcaaccccagguauccu

SEQ ID NO: 518676 - RNA, 62 nt, Human
uuuguuagaaaaacuuuuuuuuuuuuuucucaccaccccaagccccauuugugcccugccac

SEQ ID NO: 518677 - RNA, 62 nt, Human
ccaaauaaaagagaggcccauugauuccucccccaccccaacacuuuucuuuuaaagcuuuu

SEQ ID NO: 518678 - RNA, 62 nt, Human
uggguaaagcaggaagagagugggaaagagaaccaccccacucugucuucauauuugcauuu

SEQ ID NO: 518679 - RNA, 62 nt, Human
uuccugacuccuucccaaugaacaccucucugccaccccaagcucugcucuccuccucugug

SEQ ID NO: 518680 - RNA, 62 nt, Human
cugaaccccagccuguccgucaccccggauccccaccccauccccauuuuuuuaagcaauaa

SEQ ID NO: 518681 - RNA, 62 nt, Human
ugggccuagccugcccuucucaggugccaauaccaccccagcccugcccuuggccucacuuu

SEQ ID NO: 518682 - RNA, 62 nt, Human
ccuugccccuaguacccccuggcaggagcaacccaccccauggucgagguuccccuaccccu

SEQ ID NO: 518683 - RNA, 62 nt, Human
cuucccccgccgccacugugccccccgucccuccaccccagaagcccugaccucauuugggc

SEQ ID NO: 518684 - RNA, 62 nt, Human
aaagccuuuucucaaagcccuuucaguuacaaccaccccacuauggaaucaguauuuaguua

SEQ ID NO: 518685 - RNA, 62 nt, Human
cuggccucuacccacuaggugccaggaaugcgccaccccauccuccaccccgcccccaaauc

SEQ ID NO: 518686 - RNA, 62 nt, Human
ugugugaucuugagaaagcuccuuccacucacccaccccacuucccagucuguugggaucag

SEQ ID NO: 518687 - RNA, 62 nt, Human
gaccacaccccguccaggccagacaccaccccccaccccacugucgugguggccccagaucu

SEQ ID NO: 518688 - RNA, 62 nt, Human
agagggacacgcgagaggcaggccaggcugcaccaccccaagagccacgccccucgcuggcg

SEQ ID NO: 518689 - RNA, 62 nt, Human
ccccgggcugacccagugugugcucagcagccccaccccacccugccccuuguccucucaga

SEQ ID NO: 518690 - RNA, 62 nt, Human
cugcacuccacggcccuucucagccacacuucccaccccagggggugcccccaggcugaucu

SEQ ID NO: 518691 - RNA, 52 nt, Human; identical to SEQ ID NO: 272082

SEQ ID NO: 518692 - RNA, 62 nt, Human
ggacaccuuugcagggauucuuguccugcuggccaccccacccacaccugucccuggccagc

SEQ ID NO: 518693 - RNA, 62 nt, Human
cugagguaccuuuccacccagacccuccuuccccaccccauaagcccugagacucccgccuu

SEQ ID NO: 518694 - RNA, 62 nt, Human
gccccgcgucuucagcuguuucgcauccaccgccaccccacugagagcugcuccuuuggggg

SEQ ID NO: 518695 - RNA, 62 nt, Human
ucucaaccaggaggugauuuugcccccugacuccaccccagggacauucaaaaaugucuggu

SEQ ID NO: 518696 - RNA, 62 nt, Human
gcacagcacaaccuacaacagcaaagaaucauccaccccaaaauaucaguagugccgagauu

SEQ ID NO: 518697 - RNA, 62 nt, Human
cuucuugggguuuucaguaugaaccuaacuccccaccccaacaucucccucccacauuguca

SEQ ID NO: 518698 - RNA, 62 nt, Human
cuuuuccuucuuucccccuauccuuuuucucuccaccccauccccccccccauuucguuuug

SEQ ID NO: 518699 - RNA, 62 nt, Human
aguauuuuuuaaaauaauuuuauaucuguguaccaccccauauauuucauauuacuguuuca

SEQ ID NO: 518700 - RNA, 62 nt, Human
uuggcuuccacucagcaucagcguggcagucaccaccccagugaggaccucgauguccagcu

SEQ ID NO: 518701 - RNA, 62 nt, Human
uuucucuauuucugugacgcgcccccaugcccccaccccaccacaagaggcaggagggccca

SEQ ID NO: 518702 - RNA, 62 nt, Human
aaaggauuugcuccuuguaugauguaaguggcccaccccaauuuuguaacaugaugcaagug

SEQ ID NO: 518703 - RNA, 62 nt, Human
cacggggaagagcucccugcugugugccugcaccaccccacugccuuccuucagcaccuuua

SEQ ID NO: 518704 - RNA, 62 nt, Human
agauuuucaugagucagcccccccgcccgcccccaccccacacccacauccucucuuuucca

SEQ ID NO: 518705 - RNA, 62 nt, Human
caguuuuaaauguaccuucagaauaagcuuccccaccccaguuuuuguugcuugaaaauauu

SEQ ID NO: 518706 - RNA, 62 nt, Human
gucgauuaaccugcaugcagcaacacccaaguccaccccaauuaacugaagcaaauaccaaa

SEQ ID NO: 518707 - RNA, 62 nt, Human
uccugccauccccccccgccguccugccuuccccaccccacccuuaggucccagguaguugc

SEQ ID NO: 518708 - RNA, 62 nt, Human
gcaauguaagggccucagcuuccuuggagaagccaccccagguuuccagacauagauguuga

SEQ ID NO: 518709 - RNA, 62 nt, Human
agcugcacccacagucccgagacugggaucccccaccccaacagugauuuuggaaaaaaaaa

SEQ ID NO: 518710 - RNA, 62 nt, Human
ggccaggauggucuaucucuugaccucgugauccaccccacucagccucccaaauugcuggg

SEQ ID NO: 518711 - RNA, 62 nt, Human
ucaggcccauccaucccaugccucccuccuccccaccccacuccaacaguuccucuuucccg

SEQ ID NO: 518712 - RNA, 62 nt, Human
uaagcgcuucucuucgcauagucacguagcucccaccccacccucuuccugugucucacgca

SEQ ID NO: 518713 - RNA, 62 nt, Human
gggcugauuucugguuggggucugcuccuaccccaccccauuuaacaaugugaagugacuga

SEQ ID NO: 518714 - RNA, 62 nt, Human
acuuccugaagggcccucccaaggcuacauccccaccccacaguucucccugagagagauca

SEQ ID NO: 518715 - RNA, 62 nt, Human
gugccgagcacuagcuagacuuccacauagucccaccccaagugggcggcaguguuccuggc

SEQ ID NO: 518716 - RNA, 62 nt, Human
ugaaaaauauuuucuccagcguugguuacugaccaccccacccucccaccacacacacacac

SEQ ID NO: 518717 - RNA, 62 nt, Human
acuauugacagucaccccguaagguucacaaaccaccccauugaacagaugaggaacugagg

SEQ ID NO: 518718 - RNA, 62 nt, Human
gugagaggagugguguguaccccuaaauccucccaccccagcacugcccaucuguaaaaucu

SEQ ID NO: 518719 - RNA, 62 nt, Human
ccccagguagggacgccccuuguuccucacccccaccccacuuagguccugggcccccacug

SEQ ID NO: 518720 - RNA, 62 nt, Human
ccuaucagggggacagcuggugggcaaagcagccaccccacagccuuguggcuagaguacag

SEQ ID NO: 518721 - RNA, 62 nt, Human
ggaucuaguaugucugucuugaccccucacccccaccccauucagaccucaguaguccccag

SEQ ID NO: 518722 - RNA, 62 nt, Human
uucuggaaagcucucccaggaggaagcauuccccaccccaccuugccucuguccugcgcugg

SEQ ID NO: 518723 - RNA, 62 nt, Human
uucuccuguggcccucuaguccaccccccgccccaccccagccccuggcaaccacugaucug

SEQ ID NO: 518724 - RNA, 62 nt, Human
acccucagaucuucuuuucuaauagccauuugccaccccaagugguaugucggccauuucuc

SEQ ID NO: 518725 - RNA, 62 nt, Human
uuccagcacucaaccaaggagcaaagcucaucccaccccacaccccucccaggucugcucac

SEQ ID NO: 518726 - RNA, 62 nt, Human
acgacagccaggacugcccuccccaccccaccccaccccaggagcacggcacacaguucagc

SEQ ID NO: 518727 - RNA, 62 nt, Human
agcccacgacagccaggacugcccuccccaccccaccccaccccaggagcacggcacacagu

SEQ ID NO: 518728 - RNA, 62 nt, Human
ccgacagcccacgacagccaggacugcccuccccaccccaccccaccccaggagcacggcac

SEQ ID NO: 518729 - RNA, 62 nt, Human
gucuucacuuccccacaggcuggcgcucggcuccaccccagggccagcuuuuccucaccagg

SEQ ID NO: 518730 - RNA, 62 nt, Human
caucaccaauaccuuugaggucccugaguaauccaccccagcuaaaggcaaacccuucaauc

SEQ ID NO: 518731 - RNA, 62 nt, Human
aaagguccuccuguagggguguggccacuuccccaccccaggacagcgcuucuccguccaau

SEQ ID NO: 518732 - RNA, 62 nt, Human
cuuucuaacuacaugcaucucuccacucaacuccaccccaucccaucccaccuugaaaauca

SEQ ID NO: 518733 - RNA, 62 nt, Human
cauuucgaagcugcucuuucugguccuccccaccaccccacccccaagacuuguguuuguua

SEQ ID NO: 518734 - RNA, 62 nt, Human
gacuuuuuuagacagaucuucaugaccuguucccaccccaguucaucaucaucucuuuuaca

SEQ ID NO: 518735 - RNA, 62 nt, Human
ccagauccuuacugguccaguccucauucccuccaccccaucuccacuucugauucaugcug

SEQ ID NO: 518736 - RNA, 62 nt, Human
gcccaccucuuuccccacccuggcuccaugacccaccccacucuggaugccagggucacugg

SEQ ID NO: 518737 - RNA, 62 nt, Human
caacuucauuucccccucacuguagcccauuuccaccccaccacaaaguugccacagguuuu

SEQ ID NO: 518738 - RNA, 62 nt, Human
uucuauaccuucuucuccuuccccaucucacuccaccccacuuugucccugaugucuugggg

SEQ ID NO: 518739 - RNA, 62 nt, Human
ucuggugaaguccaccuccaacauuaaccugcccaccccacccccgucaucccuggagaauu

SEQ ID NO: 518740 - RNA, 62 nt, Human
cacugcaaggcugaggcugagcuucugauucaccaccccagggccuccuuauaguucucugc

SEQ ID NO: 518741 - RNA, 62 nt, Human
ugaaguggagugaagccucaagcccaugaaugccaccccagucaucucuggugucagcugcu

SEQ ID NO: 518742 - RNA, 62 nt, Human
gugccagcucaaauccagccccucgcccugugccaccccaacugugccugauagaccugccc

SEQ ID NO: 518743 - RNA, 62 nt, Human
ucccugggcccugccccacccaccuuauccucccaccccacucccuccaccaccacagcaca

SEQ ID NO: 518744 - RNA, 62 nt, Human
uucaccucacugaaaacaucuggaaggggaucccaccccauuuucugugggcaggccucgaa

SEQ ID NO: 518745 - RNA, 62 nt, Human
cuuccggcucccucuucuccccccucuacccgccaccccaccccaccccacccccgcccacu

SEQ ID NO: 518746 - RNA, 62 nt, Human
ggcucccucuucuccccccucuacccgccaccccaccccaccccacccccgcccacucguug

SEQ ID NO: 518747 - RNA, 62 nt, Human
ccucuucuccccccucuacccgccaccccaccccaccccacccccgcccacucguugccuga

SEQ ID NO: 518748 - RNA, 58 nt, Human; identical to SEQ ID NO: 272149

SEQ ID NO: 518749 - RNA, 62 nt, Human
ucuuguguuugggagcccaugggggagcucacccaccccacaauuccuccucuggccacauc

SEQ ID NO: 518750 - RNA, 62 nt, Human
ucguguaggcauaaugugaggagguggggagaccaccccacccccauguccaccaugacccu

SEQ ID NO: 518751 - RNA, 62 nt, Human
uuuauuuggccagcagucucacccacugaucuccaccccagaccuucccugauuggugucuc

SEQ ID NO: 518752 - RNA, 62 nt, Human
cugugacucuccuacuggugcuugguucagcuccaccccaaaucuuaccccaccacuggcac

SEQ ID NO: 518753 - RNA, 62 nt, Human
gcagucaucuucagcauuuuccagcccuauagccaccccaaguguggauaugccucuucgau

SEQ ID NO: 518754 - RNA, 62 nt, Human
ccuguuuuauuuuguuuucucguucucccuccccaccccacucccagccuuaucuauccccc

SEQ ID NO: 518755 - RNA, 62 nt, Human
ggccccucaaaucguccagcgaccuuccucauccaccccaucccuccccaguucauugcacu

SEQ ID NO: 518756 - RNA, 62 nt, Human
gaaggugccaaggaggaaggcugagaggggggccaccccauuucugguacccaauuugguuc

SEQ ID NO: 518757 - RNA, 62 nt, Human
ucauggauucggaugaugcaaggagacacaugccaccccagcaguacacaaagcacuuaccu

SEQ ID NO: 518758 - RNA, 62 nt, Human
cagcaguuguauccccucaccuuccucccgucccaccccagauauccuaaaugagagagaaa

SEQ ID NO: 518759 - RNA, 62 nt, Human
ccuucuuuuccguacugugaagaaagaacucuccaccccagcucccacccugcccuggccug

SEQ ID NO: 518760 - RNA, 62 nt, Human
cucucccugcuccuggugccugccucucuccuccaccccaggcuuagaggacagaaaaaugu

SEQ ID NO: 518761 - RNA, 62 nt, Human
ccccagaacuggcugggccccuggggacagagccaccccaugagcucgggguccaccagugu

SEQ ID NO: 518762 - RNA, 62 nt, Human
gggaggacuccuggguggacagccuuugacguccaccccacgcugaugcagaagcucccaga

SEQ ID NO: 518763 - RNA, 62 nt, Human
cacugcauggccucugcccauccugcaccuguccaccccaccccaacacccuggaagccacu

SEQ ID NO: 518764 - RNA, 62 nt, Human
cauggccucugcccauccugcaccuguccaccccaccccaacacccuggaagccacugucaa

SEQ ID NO: 518765 - RNA, 62 nt, Human
ggagggaggggcccuggaggccacauccugccccaccccacccccacucccacggacacuaa

SEQ ID NO: 518766 - RNA, 62 nt, Human
gaucuggggcuguuccccccccuccguuuuuuccaccccacaguuccuccugggaucuggcc

SEQ ID NO: 518767 - RNA, 62 nt, Human
ggggauggggagaggcuuugccuccaccauucccaccccacccuccccuuaaacccucugcc

SEQ ID NO: 518768 - RNA, 62 nt, Human
ucauguuaguaauaccucuaauaguauaaaccccaccccaaaauuagccaguaauccuguag

SEQ ID NO: 518769 - RNA, 62 nt, Human
uucccuucccaccuccaaccuagcccuacugcccaccccaccccaacccaccccaugcccag

SEQ ID NO: 518770 - RNA, 62 nt, Human
uucccaccuccaaccuagcccuacugcccaccccaccccaacccaccccaugcccagugguc

SEQ ID NO: 518771 - RNA, 62 nt, Human
caaccuagcccuacugcccaccccaccccaacccaccccaugcccaguggucucaguagaua

SEQ ID NO: 518772 - RNA, 62 nt, Human
cuaaauuaccaucacaguuaugugccaucuccccaccccauuuuuuuuuuuuuuuuuuugau

SEQ ID NO: 518773 - RNA, 62 nt, Human
gaaaaagaagccccagcccagccugccucaucccaccccaaugcuuccuuucugccaucauc

SEQ ID NO: 518774 - RNA, 62 nt, Human
ugucaggauacccuuccaucaccccaccaccgccaccccaacuugacuuucaagaacacauu

SEQ ID NO: 518775 - RNA, 62 nt, Human
cccaaggcaucuugucauaaaacagcuuucccccaccccauaucaugggaaaagggggagaa

SEQ ID NO: 518776 - RNA, 62 nt, Human
gacauuacugaggucauucugaguuuuaggucccaccccauuggcccgucaccuccaucagc

SEQ ID NO: 518777 - RNA, 62 nt, Human
uggacauuauucuccugauccuccuaccugguccaccccagggcuaccggaagguaaaaucu

SEQ ID NO: 518778 - RNA, 62 nt, Human
cgucuucacacacaaauaagaaaacggcaaacccaccccauuuuuuaauuuuauuauuauua

SEQ ID NO: 518779 - RNA, 62 nt, Human
guccagcaggggucucccaacaagugcucuuuccaccccaaaggggccucuccuuuucucca

SEQ ID NO: 518780 - RNA, 62 nt, Human
ccaccuucccuggcauuuuaaacagaccuaccccaccccaacucagaguuaagcauacaugg

SEQ ID NO: 518781 - RNA, 62 nt, Human
uuuuggacugaccuggggguaucuccccucugccaccccaauugugaauaaagauuguuugc

SEQ ID NO: 518782 - RNA, 62 nt, Human
cggucccaugucagccuucugaugaucccacuccaccccaccucaacuuauuuaacuuccua

SEQ ID NO: 518783 - RNA, 62 nt, Human
ggagacacuacugcccccaccccugacagcccccaccccauggcuuccaucuuuugcaucac

SEQ ID NO: 518784 - RNA, 62 nt, Human
uuucucuccugggcucccccacuuucccuuccccaccccacuuguaugcucuggaaucugug

SEQ ID NO: 518785 - RNA, 62 nt, Human
gccccaagggcacaugaggcagggccggcuccccaccccaccuuugauggccucuucccccc

SEQ ID NO: 518786 - RNA, 62 nt, Human
ggaagagaaaguacaggacacugggucuguccccaccccaauucccuuacaaguaauggagc

SEQ ID NO: 518787 - RNA, 62 nt, Human
cacaagcccuuggccacaacuauacuccugucccaccccaccacgauggccuggucccucca

SEQ ID NO: 518788 - RNA, 62 nt, Human
gaaggcuaaaugaauauuaucccuaauaccugccaccccacucuuaaucagugguggaagaa

SEQ ID NO: 518789 - RNA, 62 nt, Human
ugggcuccagaucucuuauugcccuuauuccuccaccccacuucuuuuagcaaggucugaaa

SEQ ID NO: 518790 - RNA, 62 nt, Human
uauauacucaucuaaaaauaugggaaaacauuccaccccauguaaauauguacaagugcauc

SEQ ID NO: 518791 - RNA, 62 nt, Human
gggcaugcauucauaauuuuucauuuucuuccccaccccaacccccaugagcucuuaaauuu

SEQ ID NO: 518792 - RNA, 62 nt, Human
acaaagugcugagccccucuuccccguguggcccaccccaggcacggcucauuccuccagaa

SEQ ID NO: 518793 - RNA, 62 nt, Human
guaccguccgcaccgccaggcucagccccugcccaccccacuuccacauggcccucgucccu

SEQ ID NO: 518794 - RNA, 62 nt, Human
cccagcccuggguccucccacccucucuccucccaccccacagcucggacugcucugggagg

SEQ ID NO: 518795 - RNA, 62 nt, Human
gcggcagccacuagaccgcgcccggcagccacccaccccacgugccaacuuccccuccccgu

SEQ ID NO: 518796 - RNA, 62 nt, Human
guuugcugugcuucccgccguggagggcagagccaccccacaucaggaucggacgugcuacc

SEQ ID NO: 518797 - RNA, 62 nt, Human
uuuacccccccggccugggcaucugaccucccccaccccagugugauuuaacauccaggaac

SEQ ID NO: 518798 - RNA, 62 nt, Human
ccaugcucuggaggagcaagggggccacauccccaccccagcuguuacccagcccggggcag

SEQ ID NO: 518799 - RNA, 62 nt, Human
uaacccuccaccuccucucuuggacucccuccccaccccaaccacucuuucuuucuccuuua

SEQ ID NO: 518800 - RNA, 62 nt, Human
gcccagccguguguggugucagguuccucuccccaccccagcuucaagcagaggccucgggg

SEQ ID NO: 518801 - RNA, 62 nt, Human
cagcuguguuuuuuaaagccaccucucugucuccaccccaugggcccacacccagguggggg

SEQ ID NO: 518802 - RNA, 62 nt, Human
ucauuccuucuguagcucaggagagcaccccuccaccccauuugcucgcaguauccuagaau

SEQ ID NO: 518803 - RNA, 62 nt, Human
gcuuccacaugagcuaaagcccucccgcgcccccaccccagaccccgagccaccccaggaaa

SEQ ID NO: 518804 - RNA, 62 nt, Human
agcccucccgcgcccccaccccagaccccgagccaccccaggaaaagcacaaggacugccgc

SEQ ID NO: 518805 - RNA, 62 nt, Human
cccgcccccagaucuucccucugugcucccugccaccccagcagcuguugauuucagaaccc

SEQ ID NO: 518806 - RNA, 62 nt, Human
uaaacaguguuuuaaacucuccuagucaauauccaccccauccaauuuaucaaggaagaaau

SEQ ID NO: 518807 - RNA, 62 nt, Human
cacggaacaugaugggggauuuaccugaccagccaccccauagccccuggcugaagaagaaa

SEQ ID NO: 518808 - RNA, 62 nt, Human
gacguguggagcuaggggccugccugccccacccaccccacagacuccggccuguaaucagc

SEQ ID NO: 518809 - RNA, 62 nt, Human
ucuauccucuaaacuuaucuggugcauucuccccaccccacccccauuauauaagggcuauu

SEQ ID NO: 518810 - RNA, 62 nt, Human
ugaccuuguuucagcaaaguaaacagcacuccccaccccacccuccuuuuuuuacucaucuu

SEQ ID NO: 518811 - RNA, 62 nt, Human
uugcucaaacuguagaaugcccuacauuccccccaccccaauuugcuauuuccuuauuaaaa

SEQ ID NO: 518812 - RNA, 62 nt, Human
uccggaccugagcuccgugcucaacccccagcccaccccacccucccugggcagggucuuga

SEQ ID NO: 518813 - RNA, 62 nt, Human
ugccuugggggugaagugaaggcccagccuccccaccccaccgcgccccagggguuggagga

SEQ ID NO: 518814 - RNA, 62 nt, Human
gggugcagugguggcguggaagcccugucaccccaccccaggccacccucucccagaggacg

SEQ ID NO: 518815 - RNA, 62 nt, Human
uuguuacaggaagucccuugccauccuaaaagccaccccacuucucucuaaggagaauggcc

SEQ ID NO: 518816 - RNA, 62 nt, Human
ccuugagaaguuaagagacuguuuccugcuucccaccccaccccguuuuuugucccuccguu

SEQ ID NO: 518817 - RNA, 62 nt, Human
gguuuguuaucacaauguauaauuguguuuuuccaccccacauuuuuaaggcaauuaaauau

SEQ ID NO: 518818 - RNA, 62 nt, Human
aguagaaaugauuuuuacuaaucaaguuaaucccaccccaucaaaagguauuccuagaaaug

SEQ ID NO: 518819 - RNA, 62 nt, Human
ugggaagaauuggccacguuggagaccccaugccaccccaccauggugagugcucugugccu

SEQ ID NO: 518820 - RNA, 62 nt, Human
uuuuuugcaccccaaguuggcuggagcaucggccaccccaagauucaucugugaccuccagg

SEQ ID NO: 518821 - RNA, 62 nt, Human
caagcgggaggaugggggcuacaccuucacagccaccccagaggacuucccuaaaaagcaca

SEQ ID NO: 518822 - RNA, 62 nt, Human
cuggaaggggcuggcuggugcccuauuuccagccaccccagcagcuagggaggcaaagcagg

SEQ ID NO: 518823 - RNA, 62 nt, Human
gucugugccccgcaaguguuugaguuuggccuccaccccauugaugcggugacggggcggaa

SEQ ID NO: 518824 - RNA, 62 nt, Human
gaugggaaaaucauccaggaaacccccuacccccaccccagagggaccacagucagcgugaa

SEQ ID NO: 518825 - RNA, 62 nt, Human
guuucuacgaugguuuguuugguccuuuugaaccaccccaaagaacucaacauggcaaagca

SEQ ID NO: 518826 - RNA, 62 nt, Human
auaccacugaagaggacacacucugcacccccccaccccacgaccuuggcccgagccccucc

SEQ ID NO: 518827 - RNA, 62 nt, Human
acccaaaaaaucaucucaccuugagcccacccccaccccauugucuaaucuguagaagcuaa

SEQ ID NO: 518828 - RNA, 62 nt, Human
ccggccccgcaguacugaccugcaggaacuccccaccccagggacaccgccuccccauuuuc

SEQ ID NO: 518829 - RNA, 62 nt, Human
uaacacagacgagccccagacucugcccauccccaccccaccccgacgucccccggggcucc

SEQ ID NO: 518830 - RNA, 62 nt, Human
gagggagaacggggccccaggagacccggccgccaccccacccgcuacccuugggugccaca

SEQ ID NO: 518831 - RNA, 62 nt, Human
cuuucuugcugcagccugcuccagccuggcccccaccccaggggcaggcggccccuccuggc

SEQ ID NO: 518832 - RNA, 62 nt, Human
gaugagccuuagguuccagccgccugcagaccccaccccagcaggcucacucagcaaggagc

SEQ ID NO: 518833 - RNA, 62 nt, Human
gccuccagcagcaccacagagcuccagaccaaccaccccaagugccguuuggauggggaagg

SEQ ID NO: 518834 - RNA, 62 nt, Human
aaaacaggccagccugcuugggcgcucggucuccaccccagggucauaaguggggagagagc

SEQ ID NO: 518835 - RNA, 62 nt, Human
gaugcaaguggacuugggcagaggaggucacaccaccccaccaagguagacuuagauuagag

SEQ ID NO: 518836 - RNA, 62 nt, Human
auacguaauuuaaacaaauuuagaagaaaaaaccaccccauuaaaaagugggcaaaggacau

SEQ ID NO: 518837 - RNA, 62 nt, Human
gagcggcagccucaggggccucaggggagcccccaccccacggauguugucaggaaucauga

SEQ ID NO: 518838 - RNA, 62 nt, Human
aaaguaaaagcggacugcgauuuaagauguuuccaccccaauaccuggucuuccuucccggc

SEQ ID NO: 518839 - RNA, 62 nt, Human
guucucccugcaugcccuccguggcugggcugccaccccacccggcccgaaucugucuugac

SEQ ID NO: 518840 - RNA, 62 nt, Human
ggcauuccucccacagcccuuucauuuccuccccaccccacuccccaaauacagaggucugc

SEQ ID NO: 518841 - RNA, 62 nt, Human
gggggaagcuuugauauccaugccacguccauccaccccaccccuuuucgucacgagcacaa

SEQ ID NO: 518842 - RNA, 62 nt, Human
ccucaguagagucaaguccugcugcagcugccccaccccaaguuucuaucauuuccucuuua

SEQ ID NO: 518843 - RNA, 62 nt, Human
accuccuugugccuccacugaugcaggagcugccaccccaaggggagugaccccugccagca

SEQ ID NO: 518844 - RNA, 62 nt, Human
auaucuccuaaagcuaucccuccccccuccccccaccccacaacaguccccagagugugaug

SEQ ID NO: 518845 - RNA, 62 nt, Human
ucccuacguuagccgggaggacuugucacccuccaccccacauugcugagcugccucuugug

SEQ ID NO: 518846 - RNA, 62 nt, Human
aggcaccucuucccccaggaagccuucccugcccaccccaucuaugacuugagccaggucug

SEQ ID NO: 518847 - RNA, 62 nt, Human
uacucauuguugcaugagcccugucugccagcccaccccagggacugggggcagcaccaggu

SEQ ID NO: 518848 - RNA, 62 nt, Human
augguggugccaccuccgcgggagcacugguaccaccccauccuccggcugcaggaggccaa

SEQ ID NO: 518849 - RNA, 62 nt, Human
aagaguucccuuccagcucccacugcugcuuuccaccccaucuccuuuauguccaagcuuug

SEQ ID NO: 518850 - RNA, 62 nt, Human
cuagugggauggaaguuuuugcuacauguuauccaccccaggccagguggaaguaacugaau

SEQ ID NO: 518851 - RNA, 62 nt, Human
gaugcagaggaaaggggaauaaucuuagguacccaccccacuuccuucucggaaggccagcu

SEQ ID NO: 518852 - RNA, 62 nt, Human
ucugcaguggugccgucagcccuuuaaauggcccaccccaggcagacucagacacagggaag

SEQ ID NO: 518853 - RNA, 62 nt, Human
caagcggaccuaggagacaucuacagaacgcuccaccccaaaucaacagaauauacauucuu

SEQ ID NO: 518854 - RNA, 62 nt, Human
cccauccgagaccucuguccuuacaccacuagccaccccacgugggacuuccauggcuucug

SEQ ID NO: 518855 - RNA, 62 nt, Human
agcaggccccacagaccccacagaggaugaagccaccccacagaggaugcagcccccagcug

SEQ ID NO: 518856 - RNA, 62 nt, Human
uggucuuccucccccaagccaggccccuguccccaccccaccaccuuccagggugccaggca

SEQ ID NO: 518857 - RNA, 62 nt, Human
caggaguucuggccugugacuaacuaacugccccaccccagccgagaccucggcgagacugu

SEQ ID NO: 518858 - RNA, 62 nt, Human
auauauuguguguguugcuguuggaaauagccccaccccauccucccaauccaaaacguaac

SEQ ID NO: 518859 - RNA, 62 nt, Human
ggaauuuccagcccuuuuaugccugugugaucccaccccacccccauaguuguauaaagguc

SEQ ID NO: 518860 - RNA, 62 nt, Human
uaugcuuguccugaagagagguuuggcuauccccaccccaccccaccccacccuguuccuuu

SEQ ID NO: 518861 - RNA, 62 nt, Human
uuguccugaagagagguuuggcuauccccaccccaccccaccccacccuguuccuuuuuuau

SEQ ID NO: 518862 - RNA, 62 nt, Human
cugaagagagguuuggcuauccccaccccaccccaccccacccuguuccuuuuuuaucagga

SEQ ID NO: 518863 - RNA, 62 nt, Human
ggucugggaggaagagagaacucgcuccucaaccaccccagacacuggagugucaggaaagc

SEQ ID NO: 518864 - RNA, 62 nt, Human
cccagggcuccaucuccgccucaggggcuucuccaccccaagucuggcuccauuccuggccu

SEQ ID NO: 518865 - RNA, 62 nt, Human
agauaucaaggaauugggaaauccuggccaaaccaccccaagaugauuacacugaaauguag

SEQ ID NO: 518866 - RNA, 62 nt, Human
accuuccccuuggcggcucuccuccccaacccccaccccacaauuuuaugacuuccauuugg

SEQ ID NO: 518867 - RNA, 62 nt, Human
cucuugucuuuggccagcccccucagcccagcccaccccacccgcuguccggccacauucca

SEQ ID NO: 518868 - RNA, 62 nt, Human
cccuugcaaauguauaauuaaggccuuucuucccaccccaaguccaagaacaaaugccagcc

SEQ ID NO: 518869 - RNA, 62 nt, Human
cacccaggccacaguuccugugccugccuuccccaccccagcaguggccccuccccaucccc

SEQ ID NO: 518870 - RNA, 62 nt, Human
ccugaggaccccgccuggacuccccagccuucccaccccauaccucccucccgaucuugcug

SEQ ID NO: 518871 - RNA, 62 nt, Human
cuggcuauaacaggcagagucggagcugccucccaccccagucagaagccuggcacccccuc

SEQ ID NO: 518872 - RNA, 51 nt, Human; identical to SEQ ID NO: 272288

SEQ ID NO: 518873 - RNA, 62 nt, Human
gagcauuugauaagcaagaaagauuucaucucccaccccagccucaaguaggaguuuuauau

SEQ ID NO: 518874 - RNA, 62 nt, Human
uccuguuccaccucagguuuucacaggugcucccaccccaguugaggcucccacccacaggg

SEQ ID NO: 518875 - RNA, 62 nt, Human
gccccuucuccacuguagcaaaauaagcacccccaccccaucugccuucaggucuucuucac

SEQ ID NO: 518876 - RNA, 62 nt, Human
guugaaagcuccgaguuugggccaguuuaccaccaccccaaguacacagcagaauaguacaa

SEQ ID NO: 518877 - RNA, 62 nt, Human
cucaccaaugcaucuaucugucugccaccagcccaccccacccugcccccacccucacccac

SEQ ID NO: 518878 - RNA, 62 nt, Human
aguggggggaucacaaagccaggggcuuggccccaccccagcgaagccaugaacucccaagc

SEQ ID NO: 518879 - RNA, 62 nt, Human
cuggccuugccacacucuuucuccugcuuuaaccaccccaucugcauucccagcucuacccu

SEQ ID NO: 518880 - RNA, 62 nt, Human
gaaggaggcuaugcucaggggcccuggagcagccaccccaugcuggccuugccacacucuuu

SEQ ID NO: 518881 - RNA, 62 nt, Human
gcugccuuggugcagcagggucaucuguagggccaccccacagcucuuuccuuccccuccuc

SEQ ID NO: 518882 - RNA, 62 nt, Human
ccuccagcugucugacuauccauccaucauaaccaccccagccugggaaggagagcuugcuu

SEQ ID NO: 518883 - RNA, 62 nt, Human
ucucugugucuuuccaccuaauuaaagaggauccaccccaggguuauuuugaggauucaaaa

SEQ ID NO: 518884 - RNA, 62 nt, Human
agcacaaggccuaaugaggucacccugacuccccaccccagcauuucauucauaccagauaa

SEQ ID NO: 518885 - RNA, 62 nt, Human
uagccccagucuucucuuuucuauaaugagacccaccccagcuugccucccucccuggcuuc

SEQ ID NO: 518886 - RNA, 62 nt, Human
agcugcguaacauccauccugcuacaacucuuccaccccaaacaaaagggcucaggcuacac

SEQ ID NO: 518887 - RNA, 62 nt, Human
cuugucuguggagcugcucucucucccucaucccaccccaaauacuuaaaaugacacuacac

SEQ ID NO: 518888 - RNA, 62 nt, Human
ucaagccaggaugggcccaggccugggaucccccaccccaggacccccaggcccccuccccu

SEQ ID NO: 518889 - RNA, 62 nt, Human
ccuccuuggucgggcaccauaccuccuccccuccaccccacacccuguguccauaucaagcc

SEQ ID NO: 518890 - RNA, 62 nt, Human
cagccacuggcuuggaacaccuuggggucccuccaccccacagaaccuucaacccagugggu

SEQ ID NO: 518891 - RNA, 62 nt, Human
uggguggcucaggcccaagcagaccccgggcuccaccccagccccgcccaggcugcugccag

SEQ ID NO: 518892 - RNA, 62 nt, Human
ccacugccaagcaggacuuggcacaugagcacccaccccacagcaccaucaggcagcaccca

SEQ ID NO: 518893 - RNA, 62 nt, Human
ccccaaggugcugucugucuagacaggcugucccaccccaggguggcuaguggccauaugca

SEQ ID NO: 518894 - RNA, 62 nt, Human
gcagucucugucaucccgucgccccuuaccccccaccccaggccacugggccccucccacac

SEQ ID NO: 518895 - RNA, 62 nt, Human
cuguggucacugacuggaaggcagucucuaauccaccccaauccucccagaaagcaaaccug

SEQ ID NO: 518896 - RNA, 62 nt, Human
uucucuaagccccucagggucuccuccucaccccaccccaggcccuugguguccaggcugca

SEQ ID NO: 518897 - RNA, 62 nt, Human
cuguguccuccuggcagccccucaaacacacaccaccccaugucacacggguauccagagca

SEQ ID NO: 518898 - RNA, 62 nt, Human
cgcuccaccccaccacugucuucuccauccuuccaccccacccucagcgucucugccccuaa

SEQ ID NO: 518899 - RNA, 62 nt, Human
auuccuccacccacccucuaucccccaccgcuccaccccaccacugucuucuccauccuucc

SEQ ID NO: 518900 - RNA, 62 nt, Human
aacuuuuggcgucuacugauuccuccaacucuccaccccacaaaauaacggggaccaauauu

SEQ ID NO: 518901 - RNA, 62 nt, Human
ccccagggaauucucuagcagagggaggggacccaccccagugaggaaguagauugcugccu

SEQ ID NO: 518902 - RNA, 62 nt, Human
gagccugucaccacuccccucccuauauacccccaccccacaaagauuuucuucagguuaaa

SEQ ID NO: 518903 - RNA, 62 nt, Human
uuuuacugcccuucacccaaccucucccaccuccaccccacaaugaauguauuuauugugag

SEQ ID NO: 518904 - RNA, 62 nt, Human
gccucccugcgacugcccaggcacacugcccaccaccccacccccgaaacaaugccagcccg

SEQ ID NO: 518905 - RNA, 62 nt, Human
uugcuaccacucaggcugccacucaguggacuccaccccagggacacggcagggucugcaga

SEQ ID NO: 518906 - RNA, 62 nt, Human
agauaagccacaaaugaagagaaaagccaugcccaccccagccccagagaaaccaauaagaa

SEQ ID NO: 518907 - RNA, 62 nt, Human
aagugcgcucauuuuaggccuccucucugccaccaccccauaaucucauucaaagaauacua

SEQ ID NO: 518908 - RNA, 62 nt, Human
caucuuccuggaccugaaguucaugcucccagccaccccaccccugagcugaauaaagauga

SEQ ID NO: 518909 - RNA, 62 nt, Human
ugauuccaggcaaauuguuuucuuccuucuacccaccccaaccccuacccaucaccuuuuaa

SEQ ID NO: 518910 - RNA, 62 nt, Human
agaaucuucaaucaaccugggcucuccccaccccaccccagauaaccuccucaguucccuag

SEQ ID NO: 518911 - RNA, 62 nt, Human
ucacuagaaucuucaaucaaccugggcucuccccaccccaccccagauaaccuccucaguuc

SEQ ID NO: 518912 - RNA, 62 nt, Human
uucaccggcacccucaccugugacaccaagacccaccccaaucccagacuucacacaguauu

SEQ ID NO: 518913 - RNA, 62 nt, Human
ugcuuggcccaguuuugauugcuggcaucuugccaccccagguaucccugguauuguccuaa

SEQ ID NO: 518914 - RNA, 62 nt, Human
ugaaucuuaauacuuucuuuucacaggugucaccaccccaauaaacuuagacaaugauaaau

SEQ ID NO: 518915 - RNA, 62 nt, Human
gacuggagggaguagacccuaucuauaaggugccaccccaucauccaagcugccacacugcc

SEQ ID NO: 518916 - RNA, 62 nt, Human
aaacaagaaacacgauaccauucuggccuuccccaccccacauccucucuuggccuuacuga

SEQ ID NO: 518917 - RNA, 62 nt, Human
guagcuucugacaugugugccucagaucuguuccaccccacucacagugguucuguuugcuc

SEQ ID NO: 518918 - RNA, 62 nt, Human
acccgagagguauuuugccuguuccaaucaaaccaccccauucagguccaucagccucugau

SEQ ID NO: 518919 - RNA, 62 nt, Human
cugauggagcaaggguccagacuaggagccuuccaccccagcugugucuggcgccccuagau

SEQ ID NO: 518920 - RNA, 62 nt, Human
cuucggccggguccccagcccccgcuccugccccaccccaccuccuccgggcuuccucccgg

SEQ ID NO: 518921 - RNA, 62 nt, Human
caccacccaaaggguggugggcacugcugugaccaccccagcugcagagucagugcccuggg

SEQ ID NO: 518922 - RNA, 62 nt, Human
ggguccugggaccucuaaugugggcaugucguccaccccaggacgagccaucagggacagac

SEQ ID NO: 518923 - RNA, 62 nt, Human
ugaaggaugggccugcugcacgucucccuccuccaccccauaccacacuggggggucugagc

SEQ ID NO: 518924 - RNA, 62 nt, Human
ccagcccaaaccuugggcccuggaagaguccuccaccccaucacuagagugcucugacccug

SEQ ID NO: 518925 - RNA, 62 nt, Human
auccccaagggacuguccuuuccucuccuaccccaccccacucccagacagagcagaaguau

SEQ ID NO: 518926 - RNA, 62 nt, Human
agucagccggccaaacuaacacucccccuccuccaccccagccugcugcugcuacugcugcc

SEQ ID NO: 518927 - RNA, 62 nt, Human
ccaagccucgccuccuaccacaccacaccaggccaccccagcugcaagugccuuccuuggag

SEQ ID NO: 518928 - RNA, 62 nt, Human
cggucacccuccugguucugcccugucccauuccaccccaccccagggggaacaguagcuuc

SEQ ID NO: 518929 - RNA, 62 nt, Human
acccuccugguucugcccugucccauuccaccccaccccagggggaacaguagcuucaccuu

SEQ ID NO: 518930 - RNA, 62 nt, Human
agcacucgugcuuguucacauaauuagguuucccaccccagccuacccgacuuacuugcuag

SEQ ID NO: 518931 - RNA, 62 nt, Human
gcccgugugcauguccuuugcgccugugaccaccaccccaacaaaccauccagugacaaacc

SEQ ID NO: 518932 - RNA, 62 nt, Human
uggaauagugaugaagagcaucaguggaaaacccaccccacacgccauggaccucagggcac

SEQ ID NO: 518933 - RNA, 62 nt, Human
ggcccuuaaaaaccuucccaucacuccaaaucccaccccagugcaagucuggggaagguagg

SEQ ID NO: 518934 - RNA, 62 nt, Human
guuugcuaaucugcucccagcccaaccuauuaccaccccaccucgcugggaccuacugcucg

SEQ ID NO: 518935 - RNA, 62 nt, Human
uauuuugaugacagauaaacagagucuaauucccaccccaaauuuugcugagguuuucuuaa

SEQ ID NO: 518936 - RNA, 62 nt, Human
caacugguccaagaucuagaccagguacucaaccaccccacuccacaugcaacuguccccaa

SEQ ID NO: 518937 - RNA, 62 nt, Human
cugguccuuggauccccuucgucccaccugguccaccccagaugcugaggaugggggagcuc

SEQ ID NO: 518938 - RNA, 62 nt, Human
gcauccaaguguggcauggccugcuguauaccccaccccaguacuccacagcaccuuguaca

SEQ ID NO: 518939 - RNA, 62 nt, Human
ugccccuggcucugaccgaaacagcgcuggguccaccccaugucaccggauccugggugguc

SEQ ID NO: 518940 - RNA, 62 nt, Human
agucuaguaugguccccauuugcccuuccacuccaccccacccuaaaccaugcgcucccaau

SEQ ID NO: 518941 - RNA, 62 nt, Human
ugcucccuuuuccacuuuucuauguccuccuuccaccccaagucccggaucacucgcuguuu

SEQ ID NO: 518942 - RNA, 62 nt, Human
caaauguguacaccugcggggccacccaucguccaccccagugugcacgccugcaggcugga

SEQ ID NO: 518943 - RNA, 62 nt, Human
cagcaucuuuccagguguggcucugcgcuaggccaccccagguggccccgcuuucuccauuc

SEQ ID NO: 518944 - RNA, 53 nt, Human; identical to SEQ ID NO: 272367

SEQ ID NO: 518945 - RNA, 62 nt, Human
ggugggcggacccccaggcuccgccagccccuccaccccagccugccugcugccucggaacu

SEQ ID NO: 518946 - RNA, 62 nt, Human
acugugggacuuucuggugggcuccucagcucccaccccaggcuggggcccagauugugagg

SEQ ID NO: 518947 - RNA, 62 nt, Human
caggacccccaggccugagcccagcacccgcuccaccccagccagcugggcagggccggugu

SEQ ID NO: 518948 - RNA, 62 nt, Human
ggaugggagccccacagaggcagguccuggaaccaccccacccccacaccuggacgcucgcu

SEQ ID NO: 518949 - RNA, 62 nt, Human
cagugcagcagggggacacagaccugcccaagccaccccacugccguucccucucugagcac

SEQ ID NO: 518950 - RNA, 62 nt, Human
ccuacugacucauaauucacuugucccaaaagccaccccacaagccugagccaaccugcugc

SEQ ID NO: 518951 - RNA, 62 nt, Human
cccgcuucugugugcuuguccuccuccuccucccaccccauaacuguuccuaagccuucacc

SEQ ID NO: 518952 - RNA, 62 nt, Human
uagaagguuuuaggaauagugacagagucaggccaccccaagggccaugggagccagcugac

SEQ ID NO: 518953 - RNA, 62 nt, Human
gcauccuacuccuggcaacaucaggccaacguccaccccagccucacauugccagauguugg

SEQ ID NO: 518954 - RNA, 62 nt, Human
uguucuggguggcuggaucuccaggguacccuccaccccagcugccaagcccugggccagca

SEQ ID NO: 518955 - RNA, 62 nt, Human
ccugaaggggagcucugagacagagcaaacacccaccccagaacaagccgacacacagggag

SEQ ID NO: 518956 - RNA, 58 nt, Human; identical to SEQ ID NO: 272382

SEQ ID NO: 518957 - RNA, 62 nt, Human
ccaaugcugauaguccccucuccugcaucccuccaccccaguccccgggaaaggccgguggg

SEQ ID NO: 518958 - RNA, 62 nt, Human
agagcagcgggccuguccaggggcuccccgccccaccccacgccuuagcugcaggcccuuuu

SEQ ID NO: 518959 - RNA, 62 nt, Human
gagccccgccccuuucuuuccccggagucccuccaccccauaacaauaccucgaauuuccaa

SEQ ID NO: 518960 - RNA, 62 nt, Human
accuccguccucugcuuuccgggcagcucucaccaccccaggccccggcaugaggccuuucc

SEQ ID NO: 518961 - RNA, 62 nt, Human
ggaaaacaaagaauguguuaagggaugcucccccaccccacaucuuaagucagugugccaag

SEQ ID NO: 518962 - RNA, 62 nt, Human
caccacgccaacaggaccacagcgcacuggcuccaccccaucucugccaucuccacuccccu

SEQ ID NO: 518963 - RNA, 62 nt, Human
uaaugugcgagaaagugaaaaugccacucucuccaccccauuuuacagaggagaacaccaag

SEQ ID NO: 518964 - RNA, 62 nt, Human
cacaaagaauuugacaguacaagucaaaucccccaccccacaaaauauguguggagauauau

SEQ ID NO: 518965 - RNA, 62 nt, Human
uauauauacaaauaucaaacaucucaccacacccaccccaaaaguuacacugugugugugug

SEQ ID NO: 518966 - RNA, 62 nt, Human
gaagagguguuuauuuuuuaacuaacagccucccaccccauuaagacucaccaggagagguc

SEQ ID NO: 518967 - RNA, 62 nt, Human
gaagccucacaccucgucaccaccaccaccccccaccccauccugaggcacugccuggcaga

SEQ ID NO: 518968 - RNA, 62 nt, Human
ccgcucucugcuggcacgcgaggcuuccccuuccaccccauguggguauucccacaacaggu

SEQ ID NO: 518969 - RNA, 62 nt, Human
gucuggagcauaacccacaggcguuuuuucugccaccccaucccugcaugccugauccccag

SEQ ID NO: 518970 - RNA, 62 nt, Human
cccgguugcaaucucacucagacaucacaguaccaccccagggguggcaguagacaacaacc

SEQ ID NO: 518971 - RNA, 62 nt, Human
ccuaauagcuaggauuacagguguguggccucccaccccaccccacccuucacaccuggcug

SEQ ID NO: 518972 - RNA, 62 nt, Human
uagcuaggauuacagguguguggccucccaccccaccccacccuucacaccuggcugauuuu

SEQ ID NO: 518973 - RNA, 62 nt, Human
ucacucuccccaguccucaggcagcagcuuuuccaccccaggaaucucuguuccuucucugu

SEQ ID NO: 518974 - RNA, 62 nt, Human
cccagcauggaugugucucaggcaccucauccccaccccaccucaccccaacaaacuccucu

SEQ ID NO: 518975 - RNA, 62 nt, Human
ggaagccuccucccaggugcuugccccagcucccaccccacagcccacucucaggcaggaac

SEQ ID NO: 518976 - RNA, 62 nt, Human
uaggcuacauccugauaccuauaaguucacccccaccccacagcugcuggagagaaauccca

SEQ ID NO: 518977 - RNA, 62 nt, Human
cucuguauauacuuucccagcccugucugucuccaccccauccccucuugucucugagaacc

SEQ ID NO: 518978 - RNA, 62 nt, Human
cccauccccucuugucucugagaaccauucucccaccccaaguuccaccuucuauguuucua

SEQ ID NO: 518979 - RNA, 62 nt, Human
agugguacucugugucuggcaggcuacucugcccaccccagcaucagcacagcucuccuccu

SEQ ID NO: 518980 - RNA, 62 nt, Human
cagguuauaaaacauaacucacaccccugcccccaccccaugcccccacccuccccucacac

SEQ ID NO: 518981 - RNA, 62 nt, Human
aagcaauacauuuuggggguucccucagccccccaccccagaucuuagcuggcaggucuggg

SEQ ID NO: 518982 - RNA, 62 nt, Human
accgccagcagagcggggggaucucccugcccccaccccaguuccccaacccacucccuucc

SEQ ID NO: 518983 - RNA, 62 nt, Human
cuccauggcccagcaaggccaagauaaaucuaccaccccaggcaccugugagccaacagguu

SEQ ID NO: 518984 - RNA, 62 nt, Human
aaaggauggaguguuuuaguucuugggggaggccaccccaaaccccagccccaacuccaggg

SEQ ID NO: 518985 - RNA, 62 nt, Human
gccagaagaaaggggcuguagaccccuauuccccaccccauggccacagggcaucuggcaau

SEQ ID NO: 518986 - RNA, 62 nt, Human
cgcgguguguaacacuguguacaccucaaauaccaccccaacccacucccuguagugaaucc

SEQ ID NO: 518987 - RNA, 62 nt, Human
aaacgaguuggugucuuucgucucaguagcccccaccccaauaagcuguagacauugguuua

SEQ ID NO: 518988 - RNA, 62 nt, Human
ugugaauacugaaauuaugccuugucuccuccccaccccagggggaugccguuuugcagugu

SEQ ID NO: 518989 - RNA, 62 nt, Human
acuucccucacccacuuuggccuccguucaccccaccccaccccaccucuccccaccuuacc

SEQ ID NO: 518990 - RNA, 62 nt, Human
ccucacccacuuuggccuccguucaccccaccccaccccaccucuccccaccuuacccccgc

SEQ ID NO: 518991 - RNA, 62 nt, Human
uguuuagggacacagggcuuuugagagcagcaccaccccacuggggcauccccagacuuggg

SEQ ID NO: 518992 - RNA, 62 nt, Human
gggaagcaagggccaaacauucuuuaucccucccaccccagggaaaacauuuggaaaauagu

SEQ ID NO: 518993 - RNA, 62 nt, Human
ggacugcgggaaggcgcgggagccaggggccuccaccccaaccccggcucagagacugggcg

SEQ ID NO: 518994 - RNA, 62 nt, Human
gagccagcagcugccaugcccuccugcuccccccaccccagcccuagcccuuuagccuuuca

SEQ ID NO: 518995 - RNA, 62 nt, Human
uguucguaaggcacaggcugacaguuccacucccaccccacacaacgcagacggugcgccug

SEQ ID NO: 518996 - RNA, 62 nt, Human
ggcucugcucccggucuugggcccugggaaccccaccccaccccaccccacaggcguuguaa

SEQ ID NO: 518997 - RNA, 62 nt, Human
ugcucccggucuugggcccugggaaccccaccccaccccaccccacaggcguuguaaccuug

SEQ ID NO: 518998 - RNA, 62 nt, Human
ccggucuugggcccugggaaccccaccccaccccaccccacaggcguuguaaccuugaaucu

SEQ ID NO: 518999 - RNA, 62 nt, Human
ugcugacugcuguccuuguccaucacccaauaccaccccaaacacaacucaacuucccacac

SEQ ID NO: 519000 - RNA, 62 nt, Human
uuuugagggauuggaaccccacuggggucucuccaccccagagucucaggcaccgcgagcau

SEQ ID NO: 519001 - RNA, 62 nt, Human
cucuuuuccucuacagcuccaucuuguuucacccaccccacaucucacacauccagaauucc

SEQ ID NO: 519002 - RNA, 62 nt, Human
acauucggaguuccuguuuugcucaucccgcaccaccccacccuccacacacuaacaucccu

SEQ ID NO: 519003 - RNA, 62 nt, Human
uucuggggccucccccaccauagcucugauucccaccccacauaggaguagccugacugagg

SEQ ID NO: 519004 - RNA, 62 nt, Human
ccuacucacgauaaauaaucggcccacagcucccaccccacccccuucagugcccaccaaca

SEQ ID NO: 519005 - RNA, 62 nt, Human
ugugaguccuugugcuccugcuccucagcucuccaccccagguugccucucuccugugggcc

SEQ ID NO: 519006 - RNA, 62 nt, Human
cugcauccccagcacugguccugggcacuuccccaccccagccaggugucccuccuaugcac

SEQ ID NO: 519007 - RNA, 62 nt, Human
agcuuucugcuuccugaggacucccgcuccccccaccccaaaguuugucugugguguuauag

SEQ ID NO: 519008 - RNA, 62 nt, Human
cuagagcccgccgggcccaucuuuguacucauccaccccagccggcuugggacucagacacc

SEQ ID NO: 519009 - RNA, 62 nt, Human
ccuucucucacacuuuuaucuacuggcaucacccaccccacauggcauauaccacccaucuc

SEQ ID NO: 519010 - RNA, 62 nt, Human
uucucugugugaucccccacuucugggcucugccaccccacagugggaaaggccacccuaga

SEQ ID NO: 519011 - RNA, 62 nt, Human
uuucccaaaucuaaaucaucaaaacagaauccccaccccaaucccaaauuuuguuuugguuc

SEQ ID NO: 519012 - RNA, 62 nt, Human
cccacgcccccauauuggcaacacccccagcgccaccccaugcuccccaagaacgcggcucu

SEQ ID NO: 519013 - RNA, 62 nt, Human
uugcuggagaucugagccggguggaaggucucccaccccagggcugcccugacagucucucu

SEQ ID NO: 519014 - RNA, 62 nt, Human
gagcuguggcuaagggcaagccccuuccugccccaccccauuccuuauauucagcaagcaac

SEQ ID NO: 519015 - RNA, 62 nt, Human
uugacuuuaguguagugguggggucuuucccaccaccccacuaagccuuggcaaccucauuu

SEQ ID NO: 519016 - RNA, 62 nt, Human
ugaugacauauuacccgcugacccagccccagccaccccauggacucaggacucaggucucc

SEQ ID NO: 519017 - RNA, 62 nt, Human
gccucccaaguagcugagauuacaggcgccugccaccccaccuggcugauuuuuguaauuuu

SEQ ID NO: 519018 - RNA, 62 nt, Human
ggauaugucucaagacacucaugugaaucaugccaccccaaauccuggcuuaucaaguccca

SEQ ID NO: 519019 - RNA, 62 nt, Human
guguaaauuuauuuauauuuauuguggcccauccaccccacuucugcaaacccaucccgagg

SEQ ID NO: 519020 - RNA, 62 nt, Human
gcuguguccucuaggcugccagcucacagcccccaccccagggcccuguaagcugugcagug

SEQ ID NO: 519021 - RNA, 62 nt, Human
acagggagcuagaaccccugcucccccuguccccaccccaggagaguaaggggacgagggcc

SEQ ID NO: 519022 - RNA, 62 nt, Human
agguuugauuggcacagcagcaaaaguugaggccaccccacuuguguccacuguuuuuagaa

SEQ ID NO: 519023 - RNA, 62 nt, Human
uccauccuccccagggguagaggcugggggcuccaccccagcccauguacguccccacgaac

SEQ ID NO: 519024 - RNA, 62 nt, Human
uuagcuucccucucccucauucccggacccuuccaccccacugggcccaaccaugggcucag

SEQ ID NO: 519025 - RNA, 62 nt, Human
cugcuuuuauuuauuuuggauuagccgguugcccaccccagcccucugguccaucccucccu

SEQ ID NO: 519026 - RNA, 62 nt, Human
aggcugcagccuggcacccaccccucccaucuccaccccacauggaagacuugucuucaacu

SEQ ID NO: 519027 - RNA, 57 nt, Human; identical to SEQ ID NO: 272465

SEQ ID NO: 519028 - RNA, 62 nt, Human
gugccaucuccaauauuucuauaguauaccaaccaccccaggaaugcacuuuaacaauauca

SEQ ID NO: 519029 - RNA, 62 nt, Human
aagcccaagucauucuugauccaccccuucucccaccccagaucccagggacucauccugug

SEQ ID NO: 519030 - RNA, 62 nt, Human
uuuguuuaaaagagugcuuuugaaauaagcauccaccccaaauguugguuguauuuaugcug

SEQ ID NO: 519031 - RNA, 62 nt, Human
agugagaugggugcuguucuugagcagcuugaccaccccaacagggaucugggcagagaguc

SEQ ID NO: 519032 - RNA, 62 nt, Human
acugcaauaucacugagccugcgaucuauacaccaccccacauuuuguugguuucacagucu

SEQ ID NO: 519033 - RNA, 62 nt, Human
acgggucggggccucucucccucucccuguccccaccccagcgcagcagcccuccccgcagc

SEQ ID NO: 519034 - RNA, 62 nt, Human
guaccacaaaacaguguguccccagcagcuccccaccccagagccaaaugacaguagugcac

SEQ ID NO: 519035 - RNA, 62 nt, Human
accuccugaaccgagagaacccagaggaacccccaccccacccccaccuaccacuccaugcu

SEQ ID NO: 519036 - RNA, 62 nt, Human
gucugcguguuuaauuuuucccucucucaccuccaccccauccauauccucuuuauuuccuc

SEQ ID NO: 519037 - RNA, 62 nt, Human
cugacuccaccgaagaggugcgccacugggagccaccccagcgccaggcgcccguccaggga

SEQ ID NO: 519038 - RNA, 62 nt, Human
acguacacacacugucuuagaguacugugagcccaccccacauuggucaucuucccuaucac

SEQ ID NO: 519039 - RNA, 62 nt, Human
ccugccugcuccuguccagccaggucuaccacccaccccaccccucuucuccggcucccugc

SEQ ID NO: 519040 - RNA, 62 nt, Human
uugggauucacuagcccccagcccgccaaaccccaccccagcccuacacagcagucuggccu

SEQ ID NO: 519041 - RNA, 62 nt, Human
cagguuggaagaagaaaaauagccucaaucucccaccccauguaggcacuaccuccccaauu

SEQ ID NO: 519042 - RNA, 62 nt, Human
ucuuuugcccagagcguucccuguagccacccccaccccacuugcccuugguucuuuagaag

SEQ ID NO: 519043 - RNA, 62 nt, Human
uucaauuaucugagguugucugggaccugccuccaccccauccagggaugagaauggcagcc

SEQ ID NO: 519044 - RNA, 62 nt, Human
aggccaggcucccgaccccauccaccuauccaccaccccacccaccuuugcagggaauaccu

SEQ ID NO: 519045 - RNA, 62 nt, Human
uccucaggccauuccccaugagucccccacacccaccccauccucggucuuugcaaagaagg

SEQ ID NO: 519046 - RNA, 62 nt, Human
ggguugacgacgguguccucgcagugucgccgccaccccagcguaguccaagucagacuauu

SEQ ID NO: 519047 - RNA, 62 nt, Human
gcccagacucuggaggccuucacugaucccagccaccccagaaaagcugcagccugcaggca

SEQ ID NO: 519048 - RNA, 62 nt, Human
auggugucucccagcuuccccgcccagcuugcccaccccauaguuggugagaugccaaguuu

SEQ ID NO: 519049 - RNA, 62 nt, Human
cucuuuccugccccuccccaucauaccugcacccaccccagccagggcucccuguccagaau

SEQ ID NO: 519050 - RNA, 62 nt, Human
aauacaaacaagcaacagcaacaaauccaccuccaccccaucucccccucauaucccugacc

SEQ ID NO: 519051 - RNA, 62 nt, Human
cucugcauagccagauuugaagugacugauacccaccccaaaccuugcuguucacagucucc

SEQ ID NO: 519052 - RNA, 62 nt, Human
cauucagaagacugguggcccacgugccaggaccaccccaccucucuugcugccuuuucucc

SEQ ID NO: 519053 - RNA, 62 nt, Human
aaagaccuccagcucagucccccaccuucaucccaccccacagaugauaaaauucagaccuc

SEQ ID NO: 519054 - RNA, 62 nt, Human
gcugagcccggcgcagcaccugggcaguguccccaccccaggcccuccacauccuccucccu

SEQ ID NO: 519055 - RNA, 62 nt, Human
ggcacugaguggcccagcaccgccuagcccugccaccccacugcccuccugggccuucugcu

SEQ ID NO: 519056 - RNA, 51 nt, Human; identical to SEQ ID NO: 272500

SEQ ID NO: 519057 - RNA, 62 nt, Human
uaguguguguguuuuguauacacuguaugaccccaccccaaaucuuuguauuguccacauuc

SEQ ID NO: 519058 - RNA, 52 nt, Human; identical to SEQ ID NO: 272502

SEQ ID NO: 519059 - RNA, 62 nt, Human
cagggacccuguggcucugaucccccauuuauccaccccaugugccucaggacuagagugag

SEQ ID NO: 519060 - RNA, 62 nt, Human
cuacagagugaaaugaaaacgggcugaaaauaccaccccaggagaggaccucgccccaagca

SEQ ID NO: 519061 - RNA, 62 nt, Human
caggaggguuugguuagcucacaggacuucccccaccccagaagauuagcaucccauacuag

SEQ ID NO: 519062 - RNA, 62 nt, Human
ugggaggggacaaauaagggaauaaaaucuggccaccccagccagcagcagcaaccuguuca

SEQ ID NO: 519063 - RNA, 62 nt, Human
uguauucaguuaaugacaccaaaaggcucagcccaccccaacccuaucucauguucagucug

SEQ ID NO: 519064 - RNA, 62 nt, Human
gguggccuugccuggggagccccauguguggcccaccccaccaggccauccccauaccuucu

SEQ ID NO: 519065 - RNA, 62 nt, Human
ggacugauucccaggcccugcugcucccauccccaccccagaucgaaugaacuuggcagaaa

SEQ ID NO: 519066 - RNA, 62 nt, Human
uggagacccccugccggcagccccuuucccugccaccccaggagccaggcuuccccucagcu

SEQ ID NO: 519067 - RNA, 62 nt, Human
gcugaucuugggugucugaacagcuauuggguccaccccagucccuuucagcugcugcuuaa

SEQ ID NO: 519068 - RNA, 62 nt, Human
ugucacuuuccuacccugauggucacacuagcccaccccaagcuccgacauugagguuuuca

SEQ ID NO: 519069 - RNA, 62 nt, Human
guuuucaucucugcagggagagguuccaauguccaccccacccccagguacccgccucuucc

SEQ ID NO: 519070 - RNA, 62 nt, Human
ugagaacaagaacugagggaaagcaccuucccccaccccagacguuuuuaucugaaugcaua

SEQ ID NO: 519071 - RNA, 62 nt, Human
cugcugggugccuccuugccuugggaccauggccaccccagagccauccgaucgauggaugg

SEQ ID NO: 519072 - RNA, 62 nt, Human
uuccucagcucagcugggccacuccucuucacccaccccauggagacaauaaacagcugaac

SEQ ID NO: 519073 - RNA, 62 nt, Human
caguggagagagccaggggcuggagguggggcccaccccagccucuggucccagcucugcug

SEQ ID NO: 519074 - RNA, 62 nt, Human
ugagcugaagugauccucucgucucuguuuccccaccccauuuguauuaauccuucauacaa

SEQ ID NO: 519075 - RNA, 62 nt, Human
agaaccaggguguccccgggacaggccgucccccaccccauccuguagaaguccauuccccu

SEQ ID NO: 519076 - RNA, 62 nt, Human
auccacccagccugaggcucaagcugcccuuaccaccccaucccccacgcaggaccaacuac

SEQ ID NO: 519077 - RNA, 62 nt, Human
ccaaaccacuuacuucccuguucaccucugccccaccccagcccagaggaguuugagccacc

SEQ ID NO: 519078 - RNA, 62 nt, Human
ucaccccgggguggcccuggaggccccugaccccaccccacccacagagcacgagggccccg

SEQ ID NO: 519079 - RNA, 62 nt, Human
ucaucagaggacgccccgugcgcugucaccuuccaccccacaaggccaaccuuuuucugugg

SEQ ID NO: 519080 - RNA, 62 nt, Human
cuggccaggagcaggcacgggugguccccguuccaccccaagagaacucgcgcucaguaaac

SEQ ID NO: 519081 - RNA, 62 nt, Human
aguccaucagcugccagccccggcccuggcccccaccccaaguucccugaagcauccuccag

SEQ ID NO: 519082 - RNA, 62 nt, Human
uccccgucgucaagccucuauccugucuguccccaccccagcuguccccugcccagggagcu

SEQ ID NO: 519083 - RNA, 62 nt, Human
ggcagucaccgagugaccaccaagaggaagacccaccccacggcggggacagaugcggggua

SEQ ID NO: 519084 - RNA, 62 nt, Human
gcggcuggcaggcacagaccagggcuccaaggccaccccaccaacgcaggccccagggucuc

SEQ ID NO: 519085 - RNA, 62 nt, Human
agugacacucaggauccaaaagcuagcccugcccaccccagccccuggaccugcuuaccugg

SEQ ID NO: 519086 - RNA, 62 nt, Human
ucguggcauuucuguggcucugcaguguuccuccaccccaggaccaauauguucaggccaca

SEQ ID NO: 519087 - RNA, 62 nt, Human
gugauccuugucaggauguacaguccuugcucccaccccauccgggauggccgccugucccu

SEQ ID NO: 519088 - RNA, 62 nt, Human
cucggaccgagcaucucccacgcaccucuaccccaccccaagcaccucucuccccccaugca

SEQ ID NO: 519089 - RNA, 62 nt, Human
cccacugcucugguuaucuaauauguaacaagccaccccaaaucauaguggcuuaaaacaac

SEQ ID NO: 519090 - RNA, 62 nt, Human
caggccacuucccucccagugccagucuccauccaccccagagaggaacaggcgggugggcc

SEQ ID NO: 519091 - RNA, 51 nt, Human; identical to SEQ ID NO: 272541

SEQ ID NO: 519092 - RNA, 62 nt, Human
ucaccacuagggggugauggagaggaagggggccaccccagggccauuaacaaccaguacuc

SEQ ID NO: 519093 - RNA, 62 nt, Human
uaccugcacaucugccacagcuggcccugggcccaccccacgaagggccugggccuaacccc

SEQ ID NO: 519094 - RNA, 62 nt, Human
gaauccccugccggggucccuggaaacagugcccaccccacaucacuacauucccucggccc

SEQ ID NO: 519095 - RNA, 62 nt, Human
uggacccugggggcugugcccccaucuccuccccaccccaggucuaguggccccacccucca

SEQ ID NO: 519096 - RNA, 62 nt, Human
agagccagggagcccuuagccucaacucugccccaccccagccucuuccaggagagcacccu

SEQ ID NO: 519097 - RNA, 62 nt, Human
ugucccgccgaguacuauguauuaccagccccccaccccacagaucaguuuuccuagucuuu

SEQ ID NO: 519098 - RNA, 62 nt, Human
caaccucgaccuccuggguucaagcgauucucccaccccagccucccaaguagcugggauua

SEQ ID NO: 519099 - RNA, 62 nt, Human
gcaggcagccaggccacaagacccuuguggucccaccccacacacgccagauucuuuccuga

SEQ ID NO: 519100 - RNA, 62 nt, Human
gagcgagcugggccgguuaguguaugucacccccaccccaccccuaaguagucaucaaugca

SEQ ID NO: 519101 - RNA, 62 nt, Human
cgcuccccucugccggucccccaugccaccacccaccccaaacuuccagguuccauccacca

SEQ ID NO: 519102 - RNA, 62 nt, Human
augugucgccuccgccaguccgacugcccuccccaccccacccccgccaccccccacaugug

SEQ ID NO: 519103 - RNA, 62 nt, Human
aaguaugggcaggaggcauggggcaggguggcccaccccagugggcaguagccuggccuuuu

SEQ ID NO: 519104 - RNA, 62 nt, Human
acacuccgucugcuccaaugacugagcagcauccaccccaccccaucuuugcugccagcucu

SEQ ID NO: 519105 - RNA, 62 nt, Human
ccgucugcuccaaugacugagcagcauccaccccaccccaucuuugcugccagcucucagga

SEQ ID NO: 519106 - RNA, 62 nt, Human
augaggcugcagagauggggaccagaagccccccaccccagcuuuccugggucugcauccca

SEQ ID NO: 519107 - RNA, 62 nt, Human
gcuggggugcgcaggugggcgcucgcgucuccccaccccagggcuccccccgugcugaggcu

SEQ ID NO: 519108 - RNA, 62 nt, Human
ccuccagggcccaggugggcgggcuucuggccccaccccacagcgcuuggagcaucccuuug

SEQ ID NO: 519109 - RNA, 62 nt, Human
ccucccagggucacuaggcgggcagcccacacccaccccagacggccaccacacugaggcca

SEQ ID NO: 519110 - RNA, 62 nt, Human
cccccucuccaggggcugugcaggcagcccauccaccccaguggaguucccacggacgcuuc

SEQ ID NO: 519111 - RNA, 62 nt, Human
cucgaggccaagaugccuaaaaaagcuaaaggccaccccaccccccacccaccaccuccugc

SEQ ID NO: 519112 - RNA, 62 nt, Human
guuuuggccaccuggggccgcccccaaccuccccaccccaagaggggucugagugggaccuc

SEQ ID NO: 519113 - RNA, 62 nt, Human
cagcccccaccucugccuccaggucucaucuuccaccccaaaaaugucugucucucucuuuu

SEQ ID NO: 519114 - RNA, 62 nt, Human
ucacauccagaaauucuguuggacacucacuuccaccccaaacuccucaaaucaaaagccuu

SEQ ID NO: 519115 - RNA, 62 nt, Human
aagaacuuacuucugaaaugaagggaaaaaaaccaccccaucguucccuacuccuccccacc

SEQ ID NO: 519116 - RNA, 62 nt, Human
ugugggcagagggacaggucagacacccaggcccaccccagagacccuccaugaacugugcu

SEQ ID NO: 519117 - RNA, 62 nt, Human
cccaauguuuacauucucuucugucucugcccccaccccaugcagcgcuuugaggaauugga

SEQ ID NO: 519118 - RNA, 62 nt, Human
ccccaaggguuccucauguguuuucaccaaaaccaccccagugccugagauugaaaauauug

SEQ ID NO: 519119 - RNA, 62 nt, Human
cagcacaaagaucugaaugaugcaccccacccccaccccaauaaagaaauaacagaaaaccc

SEQ ID NO: 519120 - RNA, 62 nt, Human
gcaagaagagacagcgugaugccucccacaguccaccccagacccuggggcagccccucugg

SEQ ID NO: 519121 - RNA, 62 nt, Human
auagacugggucgugugugagacgcaugugcuccaccccacuccuuuugggggaagccaggc

SEQ ID NO: 519122 - RNA, 62 nt, Human
gaucaucugugucugugcggaagacuacugccccaccccagaggccacaccccaggccgggc

SEQ ID NO: 519123 - RNA, 62 nt, Human
cucucccugugucccacagggaguagcaagacccaccccacacugccuucaccaucuacacc

SEQ ID NO: 519124 - RNA, 62 nt, Human
uaccucuguguaucuguacagccucgcuccugccaccccacccuugcguucugcauuaggua

SEQ ID NO: 519125 - RNA, 62 nt, Human
ccgggcacugcacagccugucugggggccagaccaccccauuguccauccuuguuguccgug

SEQ ID NO: 519126 - RNA, 62 nt, Human
ccccuguugccuauagcccuuuacccugagcaccaccccaacagacuggggaccagcccccu

SEQ ID NO: 519127 - RNA, 62 nt, Human; identical to SEQ ID NO: 272586

SEQ ID NO: 519128 - RNA, 62 nt, Human
augucccugacccugccugaucccucccucacccaccccaaagguauuuuugauaacagagc

SEQ ID NO: 519129 - RNA, 62 nt, Human
aaugggggccuuauggggaaggcucugacacuccaccccagcucaggccaugggcagcaggg

SEQ ID NO: 519130 - RNA, 62 nt, Human
gacugagccagggccugcauuuuugguuuuccccaccccacacauucucaaccauaguccuu

SEQ ID NO: 519131 - RNA, 62 nt, Human
uggacuuaauaccagccggauaccucuggcccccaccccauuacuguaccucuggagucacu

SEQ ID NO: 519132 - RNA, 62 nt, Human
ccugggaaaaaacccaaagaaccaaaaacaaaccaccccaaggauaauaauagcuacacugc

SEQ ID NO: 519133 - RNA, 54 nt, Human; identical to SEQ ID NO: 272592

SEQ ID NO: 519134 - RNA, 62 nt, Human
ucccggaaccggacggcacagggcguucuugcccaccccaggggccaggcuugcggaggggg

SEQ ID NO: 519135 - RNA, 62 nt, Human
gacguggcacacauuccacgugggugcugccgccaccccagucggucguggcgugcagcugg

SEQ ID NO: 519136 - RNA, 62 nt, Human
cuuuggccucuguuuguccccuuuccaguccuccaccccaccccuggagcccagccugggag

SEQ ID NO: 519137 - RNA, 62 nt, Human
cugcacuacaugcaggaaucuccagggaccagccaccccaugcucagguuugacuauguccc

SEQ ID NO: 519138 - RNA, 62 nt, Human
augcucaguccccucccaucccccacgcagcuccaccccagucccaagccaccagcugucug

SEQ ID NO: 519139 - RNA, 62 nt, Human
uaucucccauccuguggaacccgccccauuggccaccccaugcugcugcugccugggucucu

SEQ ID NO: 519140 - RNA, 62 nt, Human
cuggggcacagccuggccaugcccaggaagacccaccccauucccacuccucugagcccgga

SEQ ID NO: 519141 - RNA, 62 nt, Human
ccucccaucugcuccccaauucuugaucucucccaccccaucccucuccccagucuuggaua

SEQ ID NO: 519142 - RNA, 62 nt, Human
ucugagaagugaggagccccuccgcccggcagccaccccaucugggaagugaggagcgucua

SEQ ID NO: 519143 - RNA, 62 nt, Human
acugggaagugaggagccccucugccuggccaccaccccaucugggaggugugcccagcagc

SEQ ID NO: 519144 - RNA, 62 nt, Human
cuagcauuguuugcacaaaaaguuggugauucccaccccaaauaguaauaaaauuacuucug

SEQ ID NO: 519145 - RNA, 62 nt, Human
cuuugccuggugucuuccuuucccguguccgcccaccccagcgucuguugguacuuaccugu

SEQ ID NO: 519146 - RNA, 62 nt, Human
caacaccagucagcccuauacccuaacucacuccaccccauuuucuccggcugccuggccgg

SEQ ID NO: 519147 - RNA, 62 nt, Human
guauuuuguuuuuguucucaccugcugcccccccaccccaccaccccagggauaaauuggau

SEQ ID NO: 519148 - RNA, 62 nt, Human
uuuuuguucucaccugcugcccccccaccccaccaccccagggauaaauuggauauaaacac

SEQ ID NO: 519149 - RNA, 62 nt, Human
ccuagaaccaagcuucagagccuagccaccucccaccccacuccagcccuguccccugaaaa

SEQ ID NO: 519150 - RNA, 62 nt, Human
gcccucggucuucggcauugguucccuuugcuccaccccacucacagagacacagggcaucc

SEQ ID NO: 519151 - RNA, 62 nt, Human
gcuuuuuccagauucuuccacuggcuccacauccaccccacuggaucuucagaaggcuagag

SEQ ID NO: 519152 - RNA, 62 nt, Human
cuucacagggacgcuuccuucccuccccgcaaccaccccaggcuccccugggaggcugcagu

SEQ ID NO: 519153 - RNA, 62 nt, Human
ccugcaggccaggccagcuuccccucacuuaaccaccccauaccagucaccuccugcuccuu

SEQ ID NO: 519154 - RNA, 62 nt, Human
ugagguggggagccuucuacggcgaaagccugccaccccacaaugaauccacccugcuccac

SEQ ID NO: 519155 - RNA, 62 nt, Human
ggccucaacccucccucagccccucuugccccccaccccagccuaagaugaagaggaucgga

SEQ ID NO: 519156 - RNA, 62 nt, Human
cacagcccauccgcgugcugugugucccucuuccaccccaaccccugcuggcuccucuggga

SEQ ID NO: 519157 - RNA, 62 nt, Human
acuugaauguagaauaggcagggggcccugccccaccccauccagccagaccccacgcugac

SEQ ID NO: 519158 - RNA, 62 nt, Human
cccugcccccucccuggccuucuuccaccuauccaccccaaugccucucagcaaacugggcg

SEQ ID NO: 519159 - RNA, 62 nt, Human
cuguuacucucagccuggaauccccaccuugcccaccccaguggaaaguaagcagugcccug

SEQ ID NO: 519160 - RNA, 62 nt, Human
guaacaugagcacugugauuggcuggcuauaaccaccccaguuaaaccauuuucauaauuag

SEQ ID NO: 519161 - RNA, 62 nt, Human
uccgcacucugccacccuccugccccuuccacccaccccagcucuaugucugugucugaauu

SEQ ID NO: 519162 - RNA, 62 nt, Human
cacccagugacuggcagggccgagccagcauuccaccccaccuuuuuccuucuccccaauua

SEQ ID NO: 519163 - RNA, 62 nt, Human
accagcccugguaacugcaucuucuccccuugccaccccauggccccggcugaaagcuucgg

SEQ ID NO: 519164 - RNA, 62 nt, Human
acaggcaagcccugcuccugggagggcuccugccaccccacccuuccucuguguguuaucuc

SEQ ID NO: 519165 - RNA, 62 nt, Human
uauguaaggccuucuaguuuguucugagacccccaccccacgaaccaaauccaaauaaagug

SEQ ID NO: 519166 - RNA, 62 nt, Human
aguugcccuguccacuuacccuagguagccccccaccccaucagugccgaguccuugucccu

SEQ ID NO: 519167 - RNA, 62 nt, Human
aagucauuuccguccccccccaggcccucccaccaccccauuuuauuuuauaugauuuucuc

SEQ ID NO: 519168 - RNA, 62 nt, Human
acauccauguguggcucugcuccaccccugugccaccccagagcccugggggguggucucca

SEQ ID NO: 519169 - RNA, 62 nt, Human
gugucuccacggugcucucgcccugcccauggccaccccagacucugaucuccaggaacccc

SEQ ID NO: 519170 - RNA, 62 nt, Human
ccgcacacggacauuccaaagaccuccagagaccaccccacccccacauuccuuugaccagc

SEQ ID NO: 519171 - RNA, 62 nt, Human
ugaagcugacccucaccuccgagcccccacucccaccccagccgcacaguucccaccuccug

SEQ ID NO: 519172 - RNA, 62 nt, Human
gagaggcagaugagguuccugccuacugugugccaccccaagaagguagccccccaacagcc

SEQ ID NO: 519173 - RNA, 62 nt, Human
cagcagcccugggcccccaccucuucuaccauccaccccagacuuaccacacacccuuccug

SEQ ID NO: 519174 - RNA, 62 nt, Human
aggucaccauccucagaggcugagcccuguacccaccccagcacagccaccuccgccagacc

SEQ ID NO: 519175 - RNA, 62 nt, Human
guuguaguucugggcccucgauuccuuucccaccaccccacaggcuuuacccuuugagaaaa

SEQ ID NO: 519176 - RNA, 62 nt, Human
ccaaaccuaccuugcuuugggagcugccugcaccaccccagagaaggccccaccuucuucau

SEQ ID NO: 519177 - RNA, 62 nt, Human
cccagaagaacuaccugaagcaccaaagcuccccaccccagccugguggcagaggaagcagg

SEQ ID NO: 519178 - RNA, 62 nt, Human
uucuagguuuucuuggcccagcacugcccaucccaccccaugaggcucacucauugcagauc

SEQ ID NO: 519179 - RNA, 62 nt, Human
gccccugagccugggcagguggggacccaacuccaccccaccugucuucaucgugaggcugc

SEQ ID NO: 519180 - RNA, 62 nt, Human
cucuuaccuccuccugguugcuuuucuugcccccaccccaaguuuauuuuuguuuucccccg

SEQ ID NO: 519181 - RNA, 62 nt, Human
accaucagauuauaucuucaacaccacaccccccaccccaucgugggugaggguauccccug

SEQ ID NO: 519182 - RNA, 62 nt, Human
auuaucccaguguccccugccccccucuucccccaccccaugcccccaauucuguggcgcau

SEQ ID NO: 519183 - RNA, 62 nt, Human
acacacgcgcgcgcacacacacacacacacauccaccccagggccaagagaaaggccugcac

SEQ ID NO: 519184 - RNA, 62 nt, Human
guguguguguggaccauccgcaccuccagcccccaccccacccucuuugucucagcguguua

SEQ ID NO: 519185 - RNA, 62 nt, Human
cauaggagcugggccacuccagacauuaauccccaccccaacagagccacuggcacaagugc

SEQ ID NO: 519186 - RNA, 62 nt, Human
cucagggaggcucugcucagaguucggcggacccaccccaacccaacucccagccgccagcc

SEQ ID NO: 519187 - RNA, 62 nt, Human
guuucaccccuccuccuguacccaacccauccccaccccauaugggagaugcuugcccaugu

SEQ ID NO: 519188 - RNA, 62 nt, Human
uaaccuccaccucccaggcucaagugauccucccaccccagccuccugaguagcugggacua

SEQ ID NO: 519189 - RNA, 62 nt, Human
uugaugaagugaugggcugcuucucugacuccccaccccagagucccacauucccugaggca

SEQ ID NO: 519190 - RNA, 62 nt, Human
ccauuucuccccucucuuccuucaucuccaccccaccccacccuacucuccagacgcccuga

SEQ ID NO: 519191 - RNA, 62 nt, Human
uccugccauuucuccccucucuuccuucaucuccaccccaccccacccuacucuccagacgc

SEQ ID NO: 519192 - RNA, 62 nt, Human
cucauguggcagccacauguggcguugugaggccaccccauguggggucuguggugagaguc

SEQ ID NO: 519193 - RNA, 62 nt, Human
uggaggagcugggcucuaucccacacccacccccaccccacccccacccagccuccagaagc

SEQ ID NO: 519194 - RNA, 62 nt, Human
uggcaaaccaccugcuacaggaccaccugcugccaccccagcuauugcauuuccagcugcug

SEQ ID NO: 519195 - RNA, 62 nt, Human
agacuugauacacuuucagguugggaguggacccaccccagggccugcugaggacagagcag

SEQ ID NO: 519196 - RNA, 62 nt, Human
agcgacagcgacugagccgcccccgcugccacccaccccauuccucgcuccuuccgaacuuc

SEQ ID NO: 519197 - RNA, 62 nt, Human
gugaagugcgauuucugcuuuuguguaccccaccaccccauuaccacagcugccuuugugug

SEQ ID NO: 519198 - RNA, 62 nt, Human
aaucauucacauguaaaaauaaccccaccuccccaccccaaaaagggcaagagcuguggaaa

SEQ ID NO: 519199 - RNA, 62 nt, Human
gacuaaggacugagcccccuacccaacuacccccaccccaaucccaccuucacccucuuccu

SEQ ID NO: 519200 - RNA, 62 nt, Human
cagucaccaguucuccucuggacuggccacacccaccccauuccuggacuccucccaccucu

SEQ ID NO: 519201 - RNA, 62 nt, Human
ucagacagucccucccacagucuacucugucuccaccccaaggucugguucugaaucauuca

SEQ ID NO: 519202 - RNA, 62 nt, Human
aucagacuaagccagcaccggaccagccuggcccaccccacccacuucugcacuugcgguuc

SEQ ID NO: 519203 - RNA, 59 nt, Human; identical to SEQ ID NO: 272674

SEQ ID NO: 519204 - RNA, 62 nt, Human
gccuggaggccgggugcucagggcugacacguccaccccagugcacccacucugcuuugacu

SEQ ID NO: 519205 - RNA, 62 nt, Human
ccaguaagccacugccacacgucugacccucuccaccccauagugaccggcugcuuuucccu

SEQ ID NO: 519206 - RNA, 62 nt, Human
gcuggcacauuuccccagaccugagcuccccaccaccccagcugcuccccucccuccucugu

SEQ ID NO: 519207 - RNA, 62 nt, Human
ggacuguuuacugcccaccuccgccugccagcccaccccagccuggggagaggucgcggcgg

SEQ ID NO: 519208 - RNA, 62 nt, Human
cuuguggucugaugggugaggcugacccaagcccaccccauugccaacagggccagggcaag

SEQ ID NO: 519209 - RNA, 62 nt, Human
cgaccccgguuccucuguguccucuuuacuccccaccccagugcgucucgccugcugagccc

SEQ ID NO: 519210 - RNA, 62 nt, Human
ugaucaucaaaaguucccacucccuacuucugccaccccaccaacgccuuggacuccucucu

SEQ ID NO: 519211 - RNA, 62 nt, Human
cgaugauucuuaacacagccuuccuucugcucccaccccagaaaucacugugaaauuucaug

SEQ ID NO: 519212 - RNA, 62 nt, Human
cacugggguaccccuccagauguggggacauuccaccccaguggggacagccauuccccuac

SEQ ID NO: 519213 - RNA, 62 nt, Human
acaggaacaucauuccucucccgcaaccacucccaccccagggaggcccuggccuccagugc

SEQ ID NO: 519214 - RNA, 62 nt, Human
gagacggucuugccucucagccccucccugccccaccccagcuccugcccuggaaaucugga

SEQ ID NO: 519215 - RNA, 62 nt, Human
cgggagcucuuggcugcaucuucucccugcccccaccccacuaugaccuuugacccuacggc

SEQ ID NO: 519216 - RNA, 62 nt, Human
ggaagaguuugggcugccuccccuccucccguccaccccagaggggaaguuccucagccaga

SEQ ID NO: 519217 - RNA, 62 nt, Human
guagaccucagguagaacgacacugggcggagccaccccagggccugcucccagggagugcu

SEQ ID NO: 519218 - RNA, 62 nt, Human
ucacccucagcuccgagggccgagggcuuuccccaccccacccuccuccuggccggcagucg

SEQ ID NO: 519219 - RNA, 62 nt, Human
gggcuggcgaaggaaauggucacaccccccgcccaccccaggcgaggauccuggugacaugc

SEQ ID NO: 519220 - RNA, 62 nt, Human
ccuuuuggcuggucccgucccugaugucacccccaccccaccagccccuuucaucccuccuu

SEQ ID NO: 519221 - RNA, 62 nt, Human
cccccccaagagcccucgauggacagccucacccaccccaccugggcccagccaggagcccc

SEQ ID NO: 519222 - RNA, 62 nt, Human
accggaggucacuccaccauccccaccccaccccaccccacccccgccaugcaacgggauug

SEQ ID NO: 519223 - RNA, 62 nt, Human
cugccaccggaggucacuccaccauccccaccccaccccaccccacccccgccaugcaacgg

SEQ ID NO: 519224 - RNA, 62 nt, Human
cccgccugccaccggaggucacuccaccauccccaccccaccccaccccacccccgccaugc

SEQ ID NO: 519225 - RNA, 62 nt, Human
caucaaacccacagacccggacucccuuucugccaccccaggcugguccggccccaggugug

SEQ ID NO: 519226 - RNA, 62 nt, Human
aaucaggaucucuuucucauucaaggggggaaccaccccaggucagcgcugcgccugcugug

SEQ ID NO: 519227 - RNA, 62 nt, Human
uccuuuccuuugaaugauagcugugauucaccccaccccauuuucuuguuucugguccaucc

SEQ ID NO: 519228 - RNA, 62 nt, Human
gggcugcucaguucacaggaggcucccagcagccaccccacauccagccuacacagaacuuc

SEQ ID NO: 519229 - RNA, 62 nt, Human
agcaauaaauauggagugucaguagucuccuuccaccccagaaauguguugguguaacauuc

SEQ ID NO: 519230 - RNA, 62 nt, Human
uuuucuucauuucuuuccagaacaacucuuucccaccccaacaccacugccaccaccccucu

SEQ ID NO: 519231 - RNA, 62 nt, Human
gcaggugcaacaaaaacaagaaacaaaugugcccaccccacuuuccgcuuaacugaaaagcu

SEQ ID NO: 519232 - RNA, 62 nt, Human
gaaauuaauaucuagacuugaccacuaucugcccaccccauuggcacucccaucuuagggca

SEQ ID NO: 519233 - RNA, 62 nt, Human
uuccucacaccagauuguucccaggggccugcccaccccagugccauccaguggcacggccg

SEQ ID NO: 519234 - RNA, 62 nt, Human
cgucugcaaggagcaagcaacgguggcccuguccaccccagcaaauaagaagcauaucugua

SEQ ID NO: 519235 - RNA, 62 nt, Human
uuguauuuacuuguuucuguacucaccuacucccaccccaagggaaaauuuuagacaugaac

SEQ ID NO: 519236 - RNA, 62 nt, Human
uggugggucuacaggagccucagccaggcagcccaccccacccuggggcccugccucaccaa

SEQ ID NO: 519237 - RNA, 62 nt, Human
aucaugugagccggcccccgagaccccggcccccaccccacaccacagacacccaccagccc

SEQ ID NO: 519238 - RNA, 62 nt, Human
cagaugaggggaggggccgcagugcgcagaacccaccccaccccccagugcagacuucgggg

SEQ ID NO: 519239 - RNA, 62 nt, Human
caccccaccccccagugcagacuucggggucuccaccccaggccagcagcgcccacugggcu

SEQ ID NO: 519240 - RNA, 62 nt, Human
cgcgcgccuggucugucugauuccccuagccgccaccccacguuucuguaccgggucucugc

SEQ ID NO: 519241 - RNA, 62 nt, Human
cagcuucaacuuccugggcucaaguaauccucccaccccagccucccagguagcuaguacua

SEQ ID NO: 519242 - RNA, 62 nt, Human
gcuucccauggucacccuggacaaggaggcaaccaccccaccuccccguaggagcagagagc

SEQ ID NO: 519243 - RNA, 62 nt, Human
cccaguuccucccuagccuuccaucccucuguccaccccagggggagguaaccccgcacuca

SEQ ID NO: 519244 - RNA, 62 nt, Human
caaaggguucaccucacacuugaauguacaacccaccccacugucgggaaggccuccguccu

SEQ ID NO: 519245 - RNA, 62 nt, Human
caaagcccccagagcccaggcucggccugcccccaccccauucccgcagugggagcaaacug

SEQ ID NO: 519246 - RNA, 62 nt, Human
gggcuaacaucagcucauugucaaggccacccccaccccagaacagaaccgugucucugaua

SEQ ID NO: 519247 - RNA, 62 nt, Human
gaccaggagggggagagcagccuccacuuaccccaccccacccuugggcuaaaagcccccag

SEQ ID NO: 519248 - RNA, 62 nt, Human
gaggggcaccccagccccgccucugcucccccccaccccacccacccucggggcgccccccu

SEQ ID NO: 519249 - RNA, 62 nt, Human
gggcuguugccccucccuccaucuccccacacccaccccaccccacagcagggcuccuggcc

SEQ ID NO: 519250 - RNA, 62 nt, Human
guugccccucccuccaucuccccacacccaccccaccccacagcagggcuccuggcccccac

SEQ ID NO: 519251 - RNA, 62 nt, Human
ucaccccuccucuccccccgccuccuggccugccaccccaccccagcguuuaccccaaagca

SEQ ID NO: 519252 - RNA, 62 nt, Human
ccuccucuccccccgccuccuggccugccaccccaccccagcguuuaccccaaagcacaaug

SEQ ID NO: 519253 - RNA, 62 nt, Human
gaguuugacagaugcauacaugcauguaaccaccaccccauuccagauauagaauguuucua

SEQ ID NO: 519254 - RNA, 62 nt, Human
ggucucccucgaugacgacgacgacgacgccaccaccccagcccccgucugugacugaaggc

SEQ ID NO: 519255 - RNA, 62 nt, Human
cccccugcccuccugccggacccuggggccucccaccccagccucccugaggcccauacucc

SEQ ID NO: 519256 - RNA, 62 nt, Human
ugucucucuccauguuggggguccuaacucccccaccccauaucuacguguccuccgggcau

SEQ ID NO: 519257 - RNA, 62 nt, Human
augcaucccaugaagcccagauacacaaaauuccaccccaugaucaagaauccugcuccacu

SEQ ID NO: 519258 - RNA, 62 nt, Human
guagugccccugcccugggucccacuccugccccaccccacccuugucccuggccauugccu

SEQ ID NO: 519259 - RNA, 62 nt, Human
caagcggaccuaauagacaucuacagaacucuccaccccaaauuaacagaauauacauuuuu

SEQ ID NO: 519260 - RNA, 50 nt, Human; identical to SEQ ID NO: 272743

SEQ ID NO: 519261 - RNA, 62 nt, Human
cugcccgcccagagcuguggggaugaguguccccaccccagggccacuuagcugacaccagc

SEQ ID NO: 519262 - RNA, 62 nt, Human
ccgggagcgcuccccggaaugagccgccccacccaccccaaggcuggagccgcugcacccug

SEQ ID NO: 519263 - RNA, 62 nt, Human
cggggccuggaccuaugcagggaggccacgucccaccccaccucuuguuucugggucccugc

SEQ ID NO: 519264 - RNA, 62 nt, Human
auggugaagggggaccugguacccagugauccccaccccaggauccuaaaucaugacuuacc

SEQ ID NO: 519265 - RNA, 62 nt, Human
ucacagcagccgcagccaaacccggcugccucccaccccagccucaaaaccucuuccugacg

SEQ ID NO: 519266 - RNA, 62 nt, Human
gccauaucucggccccuucccacucaccacccccaccccaggugcugggggucccuuauuuu

SEQ ID NO: 519267 - RNA, 62 nt, Human
gccacuggggaaaacuccaccuucccacuuucccaccccacgccuuauccccacuugcagcc

SEQ ID NO: 519268 - RNA, 62 nt, Human
uacugagucccucugggcagcagcucccuucuccaccccaccccagcacccgucccaaaugu

SEQ ID NO: 519269 - RNA, 62 nt, Human
agucccucugggcagcagcucccuucuccaccccaccccagcacccgucccaaauguggccu

SEQ ID NO: 519270 - RNA, 62 nt, Human
cucaacccauaaccucaaccacaucuuauccuccaccccacaucccaccacauccaccucca

SEQ ID NO: 519271 - RNA, 62 nt, Human
gucgggggggacauuggaaaggagggaccccgccaccccagcagcugaggaggggauucugg

SEQ ID NO: 519272 - RNA, 62 nt, Human
augucucaccgggcugggggugagauauccccccaccccagggacuccccuucccucuggcu

SEQ ID NO: 519273 - RNA, 62 nt, Human
ugaugaccccuauggccaacaucaacccggcaccaccccaaggcuggcuggggaacccuuca

SEQ ID NO: 519274 - RNA, 62 nt, Human
guucauuucaucuggcuccccccaccaccuccccaccccaccccccacccccugcuuccccu

SEQ ID NO: 519275 - RNA, 62 nt, Human
gcuccagugcccucccucuguucccuggaccaccaccccacguagcugcucacaccagccuc

SEQ ID NO: 519276 - RNA, 62 nt, Human
ccuggccucuuuggcagcuccacccuguccccccaccccacaaaggggggcuacgcagucac

SEQ ID NO: 519277 - RNA, 62 nt, Human
cucgcugggauucccacgcccaccacugucccccaccccauggcugggaggggccucugaac

SEQ ID NO: 519278 - RNA, 62 nt, Human
ucuguguguaugugucuuccccggaauccacaccaccccacccuccuccugucccgugguuu

SEQ ID NO: 519279 - RNA, 62 nt, Human
gggggcacggccuggcauuucacgcauugcugccaccccagguccaccugucuccacuuuca

SEQ ID NO: 519280 - RNA, 62 nt, Human
aggggccagggaaguggaugucuccuccccucccaccccacccuguuguagccccuccuacc

SEQ ID NO: 519281 - RNA, 62 nt, Human
ccugccgugcauggcuccugucuggcucggacccaccccaacucuccccagugccugccacu

SEQ ID NO: 519282 - RNA, 62 nt, Human
uccccagggagcaaagccauaaggggcaggggccaccccacggcaucuccccagaaguacag

SEQ ID NO: 519283 - RNA, 62 nt, Human
ggggcccacucacacuacacccucuuccuuucccaccccaccuccccggagagaaacuggac

SEQ ID NO: 519284 - RNA, 62 nt, Human
cgcugggagacccacagagugugcaucagucaccaccccaacaugcucagggaggcagaguu

SEQ ID NO: 519285 - RNA, 62 nt, Human
cgaaagaagcuaaaccuugcacaucccaacacccaccccagggagaguucccgugugugccu

SEQ ID NO: 519286 - RNA, 62 nt, Human
cacugaguuuauccaccgccauccaccucuauccaccccauaaggucccuacagcaaguggg

SEQ ID NO: 519287 - RNA, 62 nt, Human
aggcuaugugugacacccuccugaggaccuccccaccccaguguaauggcccuucauggcag

SEQ ID NO: 519288 - RNA, 62 nt, Human
ugcucaggagccagcacaggacaccccccaccccaccccaccauguccccauuacaccagag

SEQ ID NO: 519289 - RNA, 62 nt, Human
gaugcugcucaggagccagcacaggacaccccccaccccaccccaccauguccccauuacac

SEQ ID NO: 519290 - RNA, 62 nt, Human
ucaggcaggcagguggcaggcagcucacccacccaccccaugggaucccccagcccuucacc

SEQ ID NO: 519291 - RNA, 62 nt, Human
gaacgagccaacaugugaccggcgagcgcgggccaccccacccuguucauuuccauaaacgu

SEQ ID NO: 519292 - RNA, 62 nt, Human
cacuucgccgcugccccggagacuuuucaaucccaccccacuccucaucucaccauuugguc

SEQ ID NO: 519293 - RNA, 62 nt, Human
gcaggggcuucuggggccaucuuggagucuguccaccccaacuccugacagcaucauccucu

SEQ ID NO: 519294 - RNA, 62 nt, Human
caccaugguacugucuccacagcccucaguccccaccccaggagaggcgccugccaccuccu

SEQ ID NO: 519295 - RNA, 62 nt, Human
ccuccagggccuuagaaccaccgccccucuccccaccccaggcaccccucuuuuuacucaaa

SEQ ID NO: 519296 - RNA, 62 nt, Human
cuccaacccugccugcggccuccccccgucgcccaccccacgucuccuggccacugagacac

SEQ ID NO: 519297 - RNA, 62 nt, Human
gccccggcccucccuggcuccccuuccccccaccaccccaucgcuggguuucggggcuuggu

SEQ ID NO: 519298 - RNA, 62 nt, Human
uggcacaagcugccaccaccagccacccacacccaccccagcacaccucacacgggaccaca

SEQ ID NO: 519299 - RNA, 62 nt, Human
ucugucucaugcucucccuguuccucuccccgccaccccagggccuccaagccaccucugga

SEQ ID NO: 519300 - RNA, 62 nt, Human
cuggccucugagguugggggacuacuuguuucccaccccagguuccuccaggccaagucaug

SEQ ID NO: 519301 - RNA, 62 nt, Human
cuuuguccgucuauccacccgcccacccgcccccaccccaccggcagcguccaggugcgggg

SEQ ID NO: 519302 - RNA, 62 nt, Human
gucugaggccagggacacaugaagggauguccccaccccagcacuaucagggccuccccagg

SEQ ID NO: 519303 - RNA, 62 nt, Human
uucagcugacaggaggccucuauccugucccuccaccccacccuccaccucaauccccuccc

SEQ ID NO: 519304 - RNA, 62 nt, Human
acacccuccccugaccugacuagggggaggauccaccccaaccucugcccugcccgccccag

SEQ ID NO: 519305 - RNA, 62 nt, Human
acauccacuccaaggggacuauucccccgaccccaccccagucuccccacacggaccuuugc

SEQ ID NO: 519306 - RNA, 62 nt, Human
ccgucuccucccuguucccguuccucccuggcccaccccacucacacuccccaaggcccacg

SEQ ID NO: 519307 - RNA, 62 nt, Human
gccggagccccugggagcccucgcaccgcuccccaccccacucagcggccccaucggaacug

SEQ ID NO: 519308 - RNA, 62 nt, Human
ccauagcaucccacaggcccaggcaggaggucccaccccagacccugccccagacgcucccu

SEQ ID NO: 519309 - RNA, 62 nt, Human
gcccggggaucccccgccccauccuccugcccccaccccaggcugggcuguucacucucucg

SEQ ID NO: 519310 - RNA, 62 nt, Human
auuccauaaauuagcugggugucccugcacgcccaccccaugaaacucgagcaggucucugg

SEQ ID NO: 519311 - RNA, 62 nt, Human
agaccacgcuucuccuccgugccgugcgacccccaccccaugacuauugugcgauucgugag

SEQ ID NO: 519312 - RNA, 62 nt, Human
cccagcgucuucuccccagccccguccucccaccaccccagggggcaggcaggcaggccccc

SEQ ID NO: 519313 - RNA, 62 nt, Human
ucguaauagaaaaguggggagccgcuggggagccaccccauucauccccguauuucccccuc

SEQ ID NO: 519314 - RNA, 62 nt, Human
ggccccagaguuccuugcaucuaauuucacccccaccccacccuccaggguuagggggagca

SEQ ID NO: 519315 - RNA, 62 nt, Human
ccaaccuaaccagaccuggugccuugacgcccccaccccagcugggacgguacagagaaggg

SEQ ID NO: 519316 - RNA, 62 nt, Human
caggggucgggggaguguugggagccuccuccccaccccaccucccucacuucacugcauuc

SEQ ID NO: 519317 - RNA, 62 nt, Human
caccucuguaaguugaguccuccgccuccgggccaccccacucccuuccgcuugcagcuucc

SEQ ID NO: 519318 - RNA, 62 nt, Human
gaggagugggguuuguugaugaaccuccacccccaccccacccccgcacgccuguaauccca

SEQ ID NO: 519319 - RNA, 62 nt, Human
uggauaccacacauuucucaucucauuggcccccaccccagagaccuccaccucaacuucug

SEQ ID NO: 519320 - RNA, 62 nt, Human
ccacgccucucccaccucccuccgcacacaccccaccccagccugcuauaggcugggcuucc

SEQ ID NO: 519321 - RNA, 62 nt, Human
agaacacccaacaccaaacuguacagacucucccaccccaaccuccccagacucugcacgga

SEQ ID NO: 519322 - RNA, 62 nt, Human
ccucaagaaacccccagugccuuguaugaagcccaccccacauggcccacagcuccugugcu

SEQ ID NO: 519323 - RNA, 62 nt, Human
uagcagugccucccucaagggccuggguucuaccaccccacuccuagggaucucuugaaccu

SEQ ID NO: 519324 - RNA, 62 nt, Human
ccccaaacucuuccccgggaagggggacagacccaccccagcccagggcccucacccaccuc

SEQ ID NO: 519325 - RNA, 62 nt, Human
cuuaggggcucuccugggccccacaccagugcccaccccaaaucuggucgucuccucccccc

SEQ ID NO: 519326 - RNA, 62 nt, Human
ucuacaagugccugcuaucccucucccacuccccaccccagcaccgguccaaccccuucauc

SEQ ID NO: 519327 - RNA, 58 nt, Human; identical to SEQ ID NO: 272822

SEQ ID NO: 519328 - RNA, 62 nt, Human
cccuggcaggguccucuucuuuucccagagcuccaccccaaccaggagcucuaguuaaugga

SEQ ID NO: 519329 - RNA, 62 nt, Human
ccaaucugcguccacuuaggaggcccaacugcccaccccaaguccccaggggauggcccucc

SEQ ID NO: 519330 - RNA, 62 nt, Human
guuggugaccgucuauaucccuggggaaauuuccaccccaguccccuccccagggaaccacc

SEQ ID NO: 519331 - RNA, 62 nt, Human
gacccugggcccuggagcuuaggggauucuccccaccccagccccacaccugcuccuucccu

SEQ ID NO: 519332 - RNA, 62 nt, Human
uuucuacuuggggcccccuuccuaggacucucccaccccaaacuccaaccuguaucagaugc

SEQ ID NO: 519333 - RNA, 62 nt, Human
acccugacaugugacaucuaccucccgaccuaccaccccacuggcugguuccagaacgucuc

SEQ ID NO: 519334 - RNA, 62 nt, Human
auuuauuugugucagaaaauacuccagaacaaccaccccauauuaugauuagcucuuuuccu

SEQ ID NO: 519335 - RNA, 62 nt, Human
aacuuugagacuguagagucaggucccuaaguccaccccaggggcuggaaaccuggaguuca

SEQ ID NO: 519336 - RNA, 62 nt, Human
cacguuguauacauguacugcaauauugcuguccaccccauaaauauguacaauucuguaua

SEQ ID NO: 519337 - RNA, 62 nt, Human
gcuuccucugacgguuacccuccccccaccuuccaccccaaccaucugaaccauuccugucu

SEQ ID NO: 519338 - RNA, 53 nt, Human; identical to SEQ ID NO: 272836

SEQ ID NO: 519339 - RNA, 62 nt, Human
cccacugggguagggaucaaagccagccacccccaccccaacacacucggugucccuuucau

SEQ ID NO: 519340 - RNA, 62 nt, Human
cccucgaagcgcgccacucgcuucccccauagccaccccagaaauggugaaaauaaaauaaa

SEQ ID NO: 519341 - RNA, 62 nt, Human
aaggucagcuuaugaaggaccccacuugcaccccaccccagccauggaagagcagcuggagg

SEQ ID NO: 519342 - RNA, 62 nt, Human
cauacucacuucuuuagccagccccauccccuccaccccacaccugaguucuugccuccucc

SEQ ID NO: 519343 - RNA, 62 nt, Human
ucuucccucaucuccccccuccuuccucugccccaccccagcggggagcagacugcuccucc

SEQ ID NO: 519344 - RNA, 62 nt, Human
ccaacaccugcuggucagaugucccccuacccccaccccacuguccuccaaggcuacaggac

SEQ ID NO: 519345 - RNA, 62 nt, Human
ucucggcucccuccucccccuucccccuucccccaccccacacccuucacccucuguguccu

SEQ ID NO: 519346 - RNA, 51 nt, Human; identical to SEQ ID NO: 272844

SEQ ID NO: 519347 - RNA, 62 nt, Human
gaaggggagagguucucagcaucaggccaccuccaccccaaugccaggauagauguauucua

SEQ ID NO: 519348 - RNA, 62 nt, Human
ggagagcggggaagucucugcauccaugccacccaccccagucgggucucacuuuccugugc

SEQ ID NO: 519349 - RNA, 56 nt, Human; identical to SEQ ID NO: 272850

SEQ ID NO: 519350 - RNA, 62 nt, Human
ggacaaaggcugacagacucacugggaagcucccaccccacucaggggaccccacuccccuc

SEQ ID NO: 519351 - RNA, 62 nt, Human
cauggauuguguugagugugcagacagggaggccaccccaauaggaauucgucuccaggauu

SEQ ID NO: 519352 - RNA, 62 nt, Human
aaggagagggaagcagcggccucggccaaggcccaccccauacucuuggcucuguagcauuu

SEQ ID NO: 519353 - RNA, 62 nt, Human
acagagggccgagggucacccgucggccgccgccaccccaggcgaggccggaggaaggauca

SEQ ID NO: 519354 - RNA, 62 nt, Human
ugccuguuccgacuccaccugugcagccggggccaccccaggagaaaguguccagguggggg

SEQ ID NO: 519355 - RNA, 62 nt, Human
ccuagcugugcccccaaccuagauuggcagcaccaccccagggcagaggacucucugggcac

SEQ ID NO: 519356 - RNA, 53 nt, Human; identical to SEQ ID NO: 272857

SEQ ID NO: 519357 - RNA, 62 nt, Human
ugucuacguggauuuuugguuuucagcuucccccaccccacuggcucuucuuaauuagaagu

SEQ ID NO: 519358 - RNA, 62 nt, Human
gagacgcaagggagaagaaauccauaacacccccaccccaacacccccaagacagcagucuu

SEQ ID NO: 519359 - RNA, 62 nt, Human
gggagcugguuagaaaugcagaauccuaggcuccaccccauccaguucaugagaaucuauau

SEQ ID NO: 519360 - RNA, 62 nt, Human
guuggcgucuuccuacgucccagaagcagcccccaccccacacaugacccacaccgcccuca

SEQ ID NO: 519361 - RNA, 62 nt, Human
cuccugaggggcaucugccccucccccaacccccaccccacacuuguuccagcucuuugaaa

SEQ ID NO: 519362 - RNA, 62 nt, Human
uggcugcuggcugaggguucugcuguccugugccaccccauuaaagugcaguucccuccggg

SEQ ID NO: 519363 - RNA, 62 nt, Human
cccuggcagaacacccagagugcccguggcucccaccccagggucuggccggugugcuggau

SEQ ID NO: 519364 - RNA, 62 nt, Human
caacaccaccacccccagggggucuccccaccccaccccauuuacagggugagcucagccug

SEQ ID NO: 519365 - RNA, 62 nt, Human
ggagccaacaccaccacccccagggggucuccccaccccaccccauuuacagggugagcuca

SEQ ID NO: 519366 - RNA, 62 nt, Human
aaugcuggagggagcacgccgcugagaugcccccaccccagguuucccccaucagaguuaag

SEQ ID NO: 519367 - RNA, 62 nt, Human
ugggacuagcagugaaucgggacacaaaccacccaccccauugggagaaaaacccagacgcc

SEQ ID NO: 519368 - RNA, 62 nt, Human
uaacauugugagccagcuagacccccagugcaccaccccauauugaaaaacaguugucuggc

SEQ ID NO: 519369 - RNA, 62 nt, Human
caagaaggcuggugagggaagggcucagcuucccaccccacguacagcaagggacuccccag

SEQ ID NO: 519370 - RNA, 62 nt, Human
aaagccaggggcccaccccgccccaccccaccccaccccacccucugaaaugugaaaagccu

SEQ ID NO: 519371 - RNA, 62 nt, Human
agcccaaagccaggggcccaccccgccccaccccaccccaccccacccucugaaaugugaaa

SEQ ID NO: 519372 - RNA, 62 nt, Human
agggcagcccaaagccaggggcccaccccgccccaccccaccccaccccacccucugaaaug

SEQ ID NO: 519373 - RNA, 62 nt, Human
ucugguagcagccugucacuccagacuguccuccaccccagacuuccgcaaacugaugggcu

SEQ ID NO: 519374 - RNA, 62 nt, Human
uguguggaaauggccaccaccauucuccuuccccaccccaccacaaaaagagaagcuguguc

SEQ ID NO: 519375 - RNA, 54 nt, Human; identical to SEQ ID NO: 272879

SEQ ID NO: 519376 - RNA, 62 nt, Human
uuuauaagaacccuggucauugaauuuaaggcccaccccaaguccagaaugaccucgcaaga

SEQ ID NO: 519377 - RNA, 62 nt, Human
ggcucagcuaucuguucaaacgucaccuguucccaccccagacccaaagagguugauucagu

SEQ ID NO: 519378 - RNA, 62 nt, Human
cacagcaauaacugggcuuccuguccccacccccaccccagcagugcucucuggcacuggga

SEQ ID NO: 519379 - RNA, 62 nt, Human
cgcuaugccagccaguggacccucaaccgaccccaccccaccaucucagcacacacccucac

SEQ ID NO: 519380 - RNA, 62 nt, Human
aaggguauuacugguggaauaauauccgccccccaccccaguuucuaauuugcuguaggcug

SEQ ID NO: 519381 - RNA, 62 nt, Human
guggggguucucgccaauucccuaaugagauuccaccccaauaucaucaggcaccuuucccc

SEQ ID NO: 519382 - RNA, 62 nt, Human
ggcucccccggcccccaccacccucagcagccccaccccacucaacccugaggguccccagg

SEQ ID NO: 519383 - RNA, 62 nt, Human
gaggcccaggacccaccccccugccaccccucccaccccacucccugcucaguaccuggcgu

SEQ ID NO: 519384 - RNA, 62 nt, Human
ggguggccauuuagggaucguggggacgggguccaccccaagaagaaagaaaggcccgucca

SEQ ID NO: 519385 - RNA, 62 nt, Human
ccccgccuccuccgcugcccaaucucucagacccaccccaccugcaggcccagaccacgugg

SEQ ID NO: 519386 - RNA, 62 nt, Human
cccaccaacuucucugccccagggacccgaggccaccccagccugguguggacccaucggcg

SEQ ID NO: 519387 - RNA, 62 nt, Human
cccucaggcccucccugccaaacuggagaaccccaccccaaggcaugccacguccgcagccc

SEQ ID NO: 519388 - RNA, 62 nt, Human
ggucccagggcggggcagggaauucuaaguguccaccccagggaggcaaggggcugcuuucc

SEQ ID NO: 519389 - RNA, 62 nt, Human
uuauggaucccuugggcugugggccuucccauccaccccaccacaacugcccagguagcugg

SEQ ID NO: 519390 - RNA, 62 nt, Human
ugguggguccccacuccuggggcccccuaaccccaccccaggcagcggaaggggcugacugg

SEQ ID NO: 519391 - RNA, 62 nt, Human
acauuccauuuguugagccccaguccugccccccaccccacccucccuaccccuccccaguc

SEQ ID NO: 519392 - RNA, 62 nt, Human
ggaacccgccgcacgcuguguucuaggcccgcccaccccaaccuucugguggggagaaauaa

SEQ ID NO: 519393 - RNA, 62 nt, Human
ccuucuuugaagagcucuagcaggugacccagccaccccaggaccugccacuucuccugcua

SEQ ID NO: 519394 - RNA, 62 nt, Human
cagaggcccagcuaccaaggccacauuguccaccaccccagccuagagccuagaacuguagu

SEQ ID NO: 519395 - RNA, 62 nt, Human
gccagccuggcccugcaggucucccaugaaggccaccccauggucugaugggcaugaagcau

SEQ ID NO: 519396 - RNA, 62 nt, Human
ugcagugggaucuggcugcucugccuccuuucccaccccagcugaccaugagacuuugcuga

SEQ ID NO: 519397 - RNA, 62 nt, Human
uccuugagccuuaguccagggggucacuccucccaccccaccuaccucacaggguuguugug

SEQ ID NO: 519398 - RNA, 62 nt, Human
cccaucgccugcagcaccuggagacccaccucccaccccagugcacucuuuugggccacaga

SEQ ID NO: 519399 - RNA, 62 nt, Human
aagggucccaccacagccagcgggcuggccucccaccccagcauccauacacguaggccugu

SEQ ID NO: 519400 - RNA, 62 nt, Human
uuuugucugaugcucugggauucuggccagacccaccccagggcacauguccugcgggggcg

SEQ ID NO: 519401 - RNA, 62 nt, Human
agccuuucgcgucaccuggaggccacaucuucccaccccaccugccagccccugucucuccu

SEQ ID NO: 519402 - RNA, 62 nt, Human
aggcuguaggggggugagaaggagagaagggaccaccccauucuucucaagcaaggauugcc

SEQ ID NO: 519403 - RNA, 62 nt, Human
cugugcuuguggcuaugagcgugugccuccacccaccccacgacccgugacuacugugcaag

SEQ ID NO: 519404 - RNA, 62 nt, Human
gcuucugguccaagcuguguugacugucauccccaccccaccccuaccucacgccugcccca

SEQ ID NO: 519405 - RNA, 62 nt, Human
ggccucugcccacccuuugagcugcaccugccccaccccagcucauccaugugcuuguaccc

SEQ ID NO: 519406 - RNA, 62 nt, Human
cggagcggagagggcggccgugguggaggccuccaccccaggagcaccccgcgcacccucgg

SEQ ID NO: 519407 - RNA, 62 nt, Human
cugugggagccccggccggcacccggcuggucccaccccaaauaccucagccauggagacca

SEQ ID NO: 519408 - RNA, 62 nt, Human
aggccagggaggggaacucagcaguucaggagccaccccaaaccauucugggacagggacac

SEQ ID NO: 519409 - RNA, 62 nt, Human
acagggacaagaggggcccccucgccccagccccaccccacauggagcucagggggaagcag

SEQ ID NO: 519410 - RNA, 62 nt, Human
cugcuagcgcaccccugcaguccagcgugcauccaccccacgcacgccccgugcuguguucc

SEQ ID NO: 519411 - RNA, 62 nt, Human
ugcagcccagcucuguggcaggaggccugaccccaccccaucagucccucucccagcauugc

SEQ ID NO: 519412 - RNA, 62 nt, Human
aagccugacuuuggggacacccuccugcccccccaccccacuccccccauccuaccuaacuc

SEQ ID NO: 519413 - RNA, 62 nt, Human
ugauggacgccugccgcccgccacccccaucuccaccccaucauguuuacaggguucggcgg

SEQ ID NO: 519414 - RNA, 62 nt, Human
gcgcagcucccucagcuucgcagcgccgcccgccaccccacaccucccacgcuaccgggcac

SEQ ID NO: 519415 - RNA, 62 nt, Human
gccuggugcgccuaggcccucggaccccauccccaccccagccgggcccgcucaggaugccc

SEQ ID NO: 519416 - RNA, 62 nt, Human
agaucucacagcugaacgugacugaacauuuuccaccccaagcagggccacucuaagaauug

SEQ ID NO: 519417 - RNA, 62 nt, Human
cgccacuggccauguggaauccauggccuggaccaccccagaucccacauccccugacgaag

SEQ ID NO: 519418 - RNA, 62 nt, Human
ccauccucaagaacugagaccccggccagcgcccaccccagccuucugcccgccccaucgag

SEQ ID NO: 519419 - RNA, 62 nt, Human
ugcuaggacaagcucagcuguugaggacacccccaccccaaauuucaguucuuacgugauuu

SEQ ID NO: 519420 - RNA, 62 nt, Human
cccagcagggugaagaguccaagaagccagcaccaccccauccgcaucucaaguaagugcuu

SEQ ID NO: 519421 - RNA, 62 nt, Human
ccucugcccugccucuccuucagcuccgaaccccaccccacucaguacauggccccccaaca

SEQ ID NO: 519422 - RNA, 62 nt, Human
gcagaucacguugcaauggcucaaacaacauuccaccccagcaggacagugaccccaguccc

SEQ ID NO: 519423 - RNA, 62 nt, Human
cauguggaagcaucuacccguucacuccagucccaccccacgccugacuccccucuggaaac

SEQ ID NO: 519424 - RNA, 62 nt, Human
cugggggcugggacuaaagaaaugggugucccccaccccaucagcugggaaagcccaggccg

SEQ ID NO: 519425 - RNA, 62 nt, Human
uacucucuucaccccuuuauuccagcugccugccaccccagacccccaccucccacccugac

SEQ ID NO: 519426 - RNA, 62 nt, Human
ccuuuaugcaacacccaaacaucuuggcauccccaccccaggaagugcggggaggagguuau

SEQ ID NO: 519427 - RNA, 62 nt, Human
aaaaauaauaauaaucuuaaagaugagaaaagccaccccaucuggcaccacagcugcaucuu

SEQ ID NO: 519428 - RNA, 62 nt, Human
gggcccuccugcccgaagucauacucuugcucccaccccacccuugcccccagcccucucuc

SEQ ID NO: 519429 - RNA, 62 nt, Human
auuggaaggcccaaacccucucccuugaguggccaccccagccugguuggcugguuuucccc

SEQ ID NO: 519430 - RNA, 62 nt, Human
agugaaacuccuuucaucucuguccuauggccccaccccaccauucccucuaggcccagacc

SEQ ID NO: 519431 - RNA, 62 nt, Human
agcaccucagccugcucuucucucugguggcuccaccccaaccccuacuucuuuuccuuuau

SEQ ID NO: 519432 - RNA, 62 nt, Human
ugcucauuuguaaaaugggcaggucaaucuucccaccccaccgugugggcugccccaacccc

SEQ ID NO: 519433 - RNA, 62 nt, Human
cuuucccuuuuccuugaguugugcugaaugccccaccccagcucucuuucccuucugggugu

SEQ ID NO: 519434 - RNA, 62 nt, Human
caugggcagcccaaagcugcaggugccagggcccaccccagccucgccugucacccccacuc

SEQ ID NO: 519435 - RNA, 62 nt, Human
cuggggagccguuugggggcagccccuucugcccaccccauccuucuuccucuccagagaug

SEQ ID NO: 519436 - RNA, 62 nt, Human
cuguuacacuguauaguaguccuauggcacccccaccccaucccuuucgugccacucccguc

SEQ ID NO: 519437 - RNA, 62 nt, Human
ccaucccuuucgugccacucccguccccacccccaccccaguguguauaagcuggcauuucg

SEQ ID NO: 519438 - RNA, 62 nt, Human
caaaaucacaccauuuucaugccugucaauccccaccccaccacaaggcaggaagggggugg

SEQ ID NO: 519439 - RNA, 62 nt, Human
cccugccaccuguaccaccaaugggccugcccccaccccaggaguuuggccgggggaaccca

SEQ ID NO: 519440 - RNA, 62 nt, Human
gcaaauaacuccuccauugaaauaacuccuccccaccccaacaacaacauucccagcagacc

SEQ ID NO: 519441 - RNA, 62 nt, Human
acacccagugaagcauuggaaacccuauuuccccaccccagcucaugcccccuuucagaugu

SEQ ID NO: 519442 - RNA, 62 nt, Human
uauucccugacuuggguuucacacuuuaucgaccaccccaugggguccuguguagccuuugg

SEQ ID NO: 519443 - RNA, 62 nt, Human
auccaccuccacacugccuccuggccagcugcccaccccagugccaggugggagagggagca

SEQ ID NO: 519444 - RNA, 62 nt, Human
ugggggaaugacacaucccccccaaccuacccccaccccaaaagcagcuccaacagaauggc

SEQ ID NO: 519445 - RNA, 62 nt, Human
acuccaccucaaagucauuugacugcccccauccaccccaccacccuaaucuuccaccaccu

SEQ ID NO: 519446 - RNA, 62 nt, Human
accugccagggaggccaucuggggcuccuucuccaccccagcccccaaagcagcccuucccc

SEQ ID NO: 519447 - RNA, 62 nt, Human
uuuucuuccucauuuccuucuuuuauuccuccccaccccaaccccuuaaaaaaaaggucaga

SEQ ID NO: 519448 - RNA, 62 nt, Human
aagccauuuuggaaauucacgaaaguacugcuccaccccaguugaguuauuuagaauuuuau

SEQ ID NO: 519449 - RNA, 62 nt, Human
gaguaacuucugaggcuuuuugagaauaaaauccaccccacccuuguuuccccuugguauuu

SEQ ID NO: 519450 - RNA, 62 nt, Human
uaaagaaguaugggaaaugagaggcauuucccccaccccauuucucuccucacacacagacu

SEQ ID NO: 519451 - RNA, 62 nt, Human
auuucaauuucaaugguguuggcuuccccuccccaccccacgcgugcauaaaaacugguucu

SEQ ID NO: 519452 - RNA, 62 nt, Human
cccugcagggggaggggugacagggcgagcccccaccccagcagcagcaauacccccacccu

SEQ ID NO: 519453 - RNA, 62 nt, Human
gcuuauccccucucaucuuccuccccuaaaccccaccccaguuuaggagauuaucaagcugg

SEQ ID NO: 519454 - RNA, 62 nt, Human
cacccaucagccaacacuccccaacccaucggccaccccaagcccucugcaaccacgaaucg

SEQ ID NO: 519455 - RNA, 62 nt, Human
gcguccauaaggguccugcacguugccucccaccaccccagcucugccagaauaaaauuguu

SEQ ID NO: 519456 - RNA, 62 nt, Human
ggggaaguagccaggaaaugagaaacuuccucccaccccagacauuuuuccuggugggagcu

SEQ ID NO: 519457 - RNA, 62 nt, Human
uuuuuuauugcuccgcauacugagaaucuaggccaccccaaccucuguuccccacccaguuc

SEQ ID NO: 519458 - RNA, 62 nt, Human
cccugggaucuguacccaggaccuggagaauaccaccccacccccagcccauaauugggacc

SEQ ID NO: 519459 - RNA, 62 nt, Human
cccagucaccauugucaccacacucacccaucccaccccaccccuccuauccaccccucccc

SEQ ID NO: 519460 - RNA, 62 nt, Human
aaggaccgggcccugccccgccacccuaccucccaccccagcagcccucucuucccccaccu

SEQ ID NO: 519461 - RNA, 62 nt, Human
cuucucuccccuuuccaugccguccaugauccccaccccauguguuuuaaaaaggcaguagc

SEQ ID NO: 519462 - RNA, 62 nt, Human
gaccuagaggguuugggacaaacugggagcccccaccccacacucuaguugcccaugucuga

SEQ ID NO: 519463 - RNA, 62 nt, Human
uaaauuucccuuuggcucaugucccccccgccccaccccaccuucuccuuuuuggcaugucu

SEQ ID NO: 519464 - RNA, 62 nt, Human
augccaccuccuccaugaagccuucccuaauuccaccccaaacccccaccuucaacaauauu

SEQ ID NO: 519465 - RNA, 62 nt, Human
cuccuguaucccagucacuaguccucccugguccaccccacccucauccucaggagccacag

SEQ ID NO: 519466 - RNA, 62 nt, Human
cagucaccuugcagucaggcuggaaucuugggccaccccaaagugcuuugcugaaggauuua

SEQ ID NO: 519467 - RNA, 62 nt, Human
aaaaugccagacaugucccagcccgaacucccccaccccauggccuggagguuucuagaugg

SEQ ID NO: 519468 - RNA, 62 nt, Human
uugagcagucaccucucauuuucucccagugcccaccccauccccgagccccuggcaaccac

SEQ ID NO: 519469 - RNA, 62 nt, Human
uaaacuuggccaauuuggaaagggggaaggagccaccccaaaacggugguucagcuuguaga

SEQ ID NO: 519470 - RNA, 62 nt, Human
ucuggcagcaccgccucuucccgccgcccagcccaccccauggccggcuuucaggagcucca

SEQ ID NO: 519471 - RNA, 62 nt, Human
ggcugggggaucugcuuggaguuuucugccccccaccccaaacuucugucgaggagcaaggc

SEQ ID NO: 519472 - RNA, 62 nt, Human
cagcaaugcggagugggauagggauaaaauacccaccccaaaaugaccuuggccaccugucu

SEQ ID NO: 519473 - RNA, 62 nt, Human
uuggauuaaacucuuccccuccugcuuuagugccaccccaaacugcauuuauaauuuuguga

SEQ ID NO: 519474 - RNA, 64 nt, Human
uuaaauguaagcugaaacuggucuacugugucucuaggguuaagccaaaagacaaaaaaaauuu

SEQ ID NO: 519475 - RNA, 64 nt, Human
guagauaaauaaaugaugcuagaggcaacaggucuaggguuaaggauuaaggccugggaauugg

SEQ ID NO: 519476 - RNA, 64 nt, Human
ucugcuuaggggacugcaugggaagcacggaauauaggguuagauguguguuaucuguaaccau

SEQ ID NO: 519477 - RNA, 64 nt, Human
uccuugcagccaaccuguauucgugggauugguguaggguuaaaucaucaacauuauuucauaa

SEQ ID NO: 519478 - RNA, 61 nt, Human; identical to SEQ ID NO: 446121

SEQ ID NO: 519479 - RNA, 61 nt, Human; identical to SEQ ID NO: 446129

SEQ ID NO: 519480 - RNA, 61 nt, Human; identical to SEQ ID NO: 446140

SEQ ID NO: 519481 - RNA, 61 nt, Human; identical to SEQ ID NO: 446145

SEQ ID NO: 519482 - RNA, 64 nt, Human
uugcccaaggcccuuaacauuuggacacuuaaaauaggguuaauuuucagggaaaaagaauguu

SEQ ID NO: 519483 - RNA, 64 nt, Human
uuuuuauaauaugauaagccugggauucuacuuuuaggguuauuuguacuuuugaguaauauau

SEQ ID NO: 519484 - RNA, 64 nt, Human
uuuauuauauuugaauugacaggggaacuugguuuaggguuaagacguuggaaggaaaucuaag

SEQ ID NO: 519485 - RNA, 64 nt, Human
gacaaggcugaagguucuauuuauuuacaauacauaggguuacucaccaaacuuuuugacaagg

SEQ ID NO: 519486 - RNA, 64 nt, Human
aacuuuucugaagguucuauuuauuuaccauacauaggguuacuuaccaaacuuuuugacaagg

SEQ ID NO: 519487 - RNA, 64 nt, Human
aaauaugugaacauaguaugaaguagcaucauuuuaggguuauucuguuacuuaggguuuuugu

SEQ ID NO: 519488 - RNA, 64 nt, Human
auuccuacaccuauuuucugcugcaggaugaggcuaggguuagcauucuagacacccaguugag

SEQ ID NO: 519489 - RNA, 64 nt, Human
ugcuuuaagaaaaauguuuauugcacucaugucauaggguuaauuggagguuauuuuauuuuug

SEQ ID NO: 519490 - RNA, 64 nt, Human
ucuagcuuuggcucuuauuagguauuguaaauaguaggguuauaucgauaucagcuuuugugau

SEQ ID NO: 519491 - RNA, 64 nt, Human
auuugauuuuuauaaaguaaaaauacggcugcauuaggguuacaaacagaaaagugucuuaaug

SEQ ID NO: 519492 - RNA, 64 nt, Human
uugcuguggaccauuguuaaagugacaggaguuguaggguuaccccuuugacaagcuuccauag

SEQ ID NO: 519493 - RNA, 64 nt, Human
uugccaagucugccucccgcugacugagggaggguaggguuaccuugaacgaaacagaacuuga

SEQ ID NO: 519494 - RNA, 64 nt, Human
ucaugguagguagaguuuuagguaaaaguggaucuaggguuacuuucuuuauuaacauuuccua

SEQ ID NO: 519495 - RNA, 64 nt, Human
gaauuauaucucguuucuacuuaaauguagugcuuaggguuaauuuuuuguacugaagucuuua

SEQ ID NO: 519496 - RNA, 64 nt, Human
gccacauugaguugcuuuuucugggaugaggaaguaggguuaaacuccccaguuuccugaggga

SEQ ID NO: 519497 - RNA, 64 nt, Human
gcuguaugcuaguaauuguuuuuauuccuaaugugugcaacaucacaucuccccaagaagcaac

SEQ ID NO: 519498 - RNA, 64 nt, Human
guaucuauaugaucacucccaacgggagguuuaagugcaacaccagguaaggugccuggagggg

SEQ ID NO: 519499 - RNA, 64 nt, Human
aauauguauauauuaaaaaccaagacuggaaucagugcaacagugggaacuaccuuuuacaagu

SEQ ID NO: 519500 - RNA, 61 nt, Human; identical to SEQ ID NO: 446157

SEQ ID NO: 519501 - RNA, 60 nt, Human
acaacauaaccuuaggcugacaacuguacauaggguuaacuucuauuuauugaugagacu

SEQ ID NO: 519502 - RNA, 64 nt, Human
guccucaucuugccauggcucuucuaggccucuuuaggguuaaggcauauuuccuucugagaau

SEQ ID NO: 519503 - RNA, 64 nt, Human
ucguugugggggucucuugccuggcucccagggcuaggguuagggcucuggaggugcuuucacu

SEQ ID NO: 519504 - RNA, 64 nt, Human
cuaguaauucuccuaucucagccucccaaagugcuaggguuacagacaugagccacugugccug

SEQ ID NO: 519505 - RNA, 64 nt, Human
aaaaaugacuuauccaauuucuguauuucaccuuuaggguuaaaaaaaacucuucuacugaauc

SEQ ID NO: 519506 - RNA, 64 nt, Human
uauauuuaguaacccaguaauaucucacuuaguuuaggguuagaucuuuaguuaauucaaccuu

SEQ ID NO: 519507 - RNA, 64 nt, Human
gguauccuuuuccugugugguugccccucuggccuaggguuaagugugcaagauaacuacucgu

SEQ ID NO: 519508 - RNA, 64 nt, Human
cccaaguccaugcuuuaaaggguuugcaagaaguuaggguuaaggagaggugaugccaacaaga

SEQ ID NO: 519509 - RNA, 64 nt, Human
gaccacaagggggaaauuuugugcauuauuauuguaggguuaaaugccugaaaaaaauaagcau

SEQ ID NO: 519510 - RNA, 64 nt, Human
cagccucguagagcuucacagcuacuccagaaaauaggguuaugugugucauucaugaaucucu

SEQ ID NO: 519511 - RNA, 64 nt, Human
uaaauaccuaaaaugguauaagauuuaucaauuguaggguuauggaaucuaguaauaaaauuuc

SEQ ID NO: 519512 - RNA, 64 nt, Human
uuaaaugaccauaaguggucauuuaagaacauguuaggguuagcccugaucugaauauaaaagu

SEQ ID NO: 519513 - RNA, 64 nt, Human
caagauugaaucuuuucaauguagcacaugucuguaggguuauacagaugucagagagcuaacu

SEQ ID NO: 519514 - RNA, 64 nt, Human
auugucaccggugaaaagaaacagguaguuaaguuaggguuaacauucauuucaaccacgaggu

SEQ ID NO: 519515 - RNA, 64 nt, Human
uaauaaguuagccauucucuauugcauuccagauuaggguuaggguagggaggacuggguguuc

SEQ ID NO: 519516 - RNA, 61 nt, Human; identical to SEQ ID NO: 446163

SEQ ID NO: 519517 - RNA, 61 nt, Human; identical to SEQ ID NO: 446172

SEQ ID NO: 519518 - RNA, 61 nt, Human; identical to SEQ ID NO: 446177

SEQ ID NO: 519519 - RNA, 61 nt, Human; identical to SEQ ID NO: 446185

SEQ ID NO: 519520 - RNA, 64 nt, Human
ccagccaauacaaauuggaaaaucuggcccauuuuaggguuaccauuuuuuccuuauuugugcc

SEQ ID NO: 519521 - RNA, 64 nt, Human
auaucccauaugggagaaguccagugcccaggcauaggguuagcucaguuucccuccuucccaa

SEQ ID NO: 519522 - RNA, 64 nt, Human
uugaggccucuccaguucucaugcacccugaucuuaggguuagaauacuugacccugauaccug

SEQ ID NO: 519523 - RNA, 64 nt, Human
augcucuagugccuucuaaagguguugucccuucuaggguuauugcauuuggauuggggucccu

SEQ ID NO: 519524 - RNA, 64 nt, Human
auuuagaugaaauuuucucuuuuaaaguucuuuauaggguuagggugugggaaaaugcuauauu

SEQ ID NO: 519525 - RNA, 64 nt, Human
ugucacacagcaaaggggacuuugcagguggaauuaggguuagggaucuaaggaugggagggga

SEQ ID NO: 519526 - RNA, 64 nt, Human
aauuaaaaggagacuuucuuaagcaccauauagauaggguuauguauaaaagcauaugugcuac

SEQ ID NO: 519527 - RNA, 64 nt, Human
uguaguguuggagaagaacugaaaucauacuucuuaggguuaugauuaaguaaugauaacugga

SEQ ID NO: 519528 - RNA, 64 nt, Human
caauuucguaaauucucucaauucaugaagaucguaggguuaaacuuuuuugugugugauuuaa

SEQ ID NO: 519529 - RNA, 64 nt, Human
caacaguuagaucaugcaacaguuagauuauguuuaggguuaggauuuucaaagaauggagguu

SEQ ID NO: 519530 - RNA, 64 nt, Human
agggauuuccaaaguaaccugcuuuuugccuggauaggguuaaaauagaccuuucuugccuauc

SEQ ID NO: 519531 - RNA, 64 nt, Human
ucucccuggaguuauguugaaggcagaguuuucauaggguuagauuuuuuuuauccuuuucuag

SEQ ID NO: 519532 - RNA, 64 nt, Human
ggacacuccucagcuuuaauggguguggccccuuuaggguuaguccucagacuaaugauagugu

SEQ ID NO: 519533 - RNA, 64 nt, Human
uaugaaaacauuccuagugaucauguaguaaauguaggguuaagcauggacagccagagcuuuc

SEQ ID NO: 519534 - RNA, 64 nt, Human
acuuaagaacagugauuuuuauugggaauuuucuuaggguuauuacacuuaaagcaacaaccaa

SEQ ID NO: 519535 - RNA, 61 nt, Human; identical to SEQ ID NO: 446193

SEQ ID NO: 519536 - RNA, 61 nt, Human; identical to SEQ ID NO: 446204

SEQ ID NO: 519537 - RNA, 61 nt, Human; identical to SEQ ID NO: 446208

SEQ ID NO: 519538 - RNA, 61 nt, Human; identical to SEQ ID NO: 446215

SEQ ID NO: 519539 - RNA, 64 nt, Human
cccucucaucucagguagaagguugacacaguuguaggguuacagagaccuauguaagaauuca

SEQ ID NO: 519540 - RNA, 64 nt, Human
cuugggcuucggcuucagaguaacgucaguggcuuaggguuaaacggccauuuuauucaaaugc

SEQ ID NO: 519541 - RNA, 64 nt, Human
ucaguaauaaauuaugacuguuuucauauugccuuaggguuauuucccuguguaaaccauuguc

SEQ ID NO: 519542 - RNA, 64 nt, Human
acugacuggguauauauaggaaugaaucuggcuuuaggguuaaaucauuuaagguccuuuuaua

SEQ ID NO: 519543 - RNA, 64 nt, Human
aagaugaccuacagugcuguguacccuggggcaauaggguuaaaugguaguuagcaacuagggc

SEQ ID NO: 519544 - RNA, 64 nt, Human
uguacaguuuuguuuucucguaaggggagcaucauaggguuacuuuauaccaguuguaacauuu

SEQ ID NO: 519545 - RNA, 64 nt, Human
ugauaguugcagguuaucgcaagaugucuuagaguaggguuaagguucucagugacacaagaau

SEQ ID NO: 519546 - RNA, 64 nt, Human
ugaagauuuuaaauaaacaggaaauuagaaguguuaggguuagauaaaggaaaagugaaaaagc

SEQ ID NO: 519547 - RNA, 64 nt, Human
ggcaccacagggagggagggagaaaagagguggguaggguuacagauccagguuauaacuacuc

SEQ ID NO: 519548 - RNA, 64 nt, Human
aaaaaaaaaaagacagguaaauguuauauaauuguaggguuaguuaaggaaauuaguccauaaa

SEQ ID NO: 519549 - RNA, 64 nt, Human
ugguugugcagguguaauuuuuucccuuuuugauuaggguuacaaaauuuagagaccaguauga

SEQ ID NO: 519550 - RNA, 64 nt, Human
aaacuaagugccguuucaacguuacaaucauuuuuaggguuauuguaaucaaugugaauaucau

SEQ ID NO: 519551 - RNA, 64 nt, Human
ugauuauucaggaauauuaucucucagauaaguuuaggguuagauuucugauuuguaacuuuuu

SEQ ID NO: 519552 - RNA, 64 nt, Human
ggauccaaggggcagucuugcaacagugccauguuaggguuauguuuuuaggauuccccucaau

SEQ ID NO: 519553 - RNA, 64 nt, Human
uuguucccugacucauagcugccgcuuguuagguuaggguuagauggggagagacagggcacag

SEQ ID NO: 519554 - RNA, 61 nt, Human; identical to SEQ ID NO: 446220

SEQ ID NO: 519555 - RNA, 61 nt, Human; identical to SEQ ID NO: 446230

SEQ ID NO: 519556 - RNA, 61 nt, Human; identical to SEQ ID NO: 446238

SEQ ID NO: 519557 - RNA, 61 nt, Human; identical to SEQ ID NO: 446246

SEQ ID NO: 519558 - RNA, 64 nt, Human
aauuuugucuuuaugggguggggugauuuucuccuaggguuauguccaguugggguuuuuaagg

SEQ ID NO: 519559 - RNA, 64 nt, Human
gagcaucuaaguacagguguucuuuggcuuaggauaggguuacauccugauaaaauaaucauaa

SEQ ID NO: 519560 - RNA, 64 nt, Human
aagaaccaaaguauuuuuucagcugguuguugaauaggguuaaguccgcuuggauuagcugugc

SEQ ID NO: 519561 - RNA, 64 nt, Human
aguacuuguuuggcguucccuaccuucauucucuuaggguuaaggagccuuucuuucugcagcu

SEQ ID NO: 519562 - RNA, 64 nt, Human
ugaagaaucuccuuguuauuuguauuauuugcuauaggguuagauguugagaaauucugcugac

SEQ ID NO: 519563 - RNA, 64 nt, Human
uauuucacugaagugccugucauuuguuuguuuuuaggguuaaauguggguaaccuguaguauu

SEQ ID NO: 519564 - RNA, 64 nt, Human
uuucacaaagugcacagugggaaucgagaaucgauaggguuaauuuuggagcaguggcuuauac

SEQ ID NO: 519565 - RNA, 64 nt, Human
gcagugaucagcaguagccaccuuagcacgaacauaggguuaacccuuucaggccuucaugucu

SEQ ID NO: 519566 - RNA, 64 nt, Human
auuuaauauucugggggaaaaaaggccuugauuuuaggguuaaaaaccugacuuauagaagagu

SEQ ID NO: 519567 - RNA, 64 nt, Human
agaaugugaguaacuguuguuuugcaaggauuuguaggguuaugggcaguuguuguuugaagca

SEQ ID NO: 519568 - RNA, 64 nt, Human
uaugcuuauacacuuacacuuuaugcacaaaauguaggguuauaauaauguuaacauggacaug

SEQ ID NO: 519569 - RNA, 64 nt, Human
uacuuuauuuuauuauauuagguaguaaaaaauguaggguuauuuaccauaaccuguucauuaa

SEQ ID NO: 519570 - RNA, 64 nt, Human
caggggaggcauagcagaaagacuggccccuuccuaggguuaugagcuggaacuguuucuacuu

SEQ ID NO: 519571 - RNA, 64 nt, Human
uuuuauucaugacagguagacuacaauucgaacuuaggguuaccucagucuuuagccauuacug

SEQ ID NO: 519572 - RNA, 64 nt, Human
aguuaagguuaaggcuagaguugucuuuaaggguuaggguuaggaccagguuaggucaggguug

SEQ ID NO: 519573 - RNA, 61 nt, Human; identical to SEQ ID NO: 446251

SEQ ID NO: 519574 - RNA, 61 nt, Human; identical to SEQ ID NO: 446256

SEQ ID NO: 519575 - RNA, 61 nt, Human; identical to SEQ ID NO: 446268

SEQ ID NO: 519576 - RNA, 61 nt, Human; identical to SEQ ID NO: 446280

SEQ ID NO: 519577 - RNA, 64 nt, Human
ccuucccaaguugugcuugagccaggaggccugcuaggguuaggagguccuuaggccucugaga

SEQ ID NO: 519578 - RNA, 64 nt, Human
cacgaagucuucauugacucacuggcuuggauuuuaggguuagaaaaucugaauguucuuaugu

SEQ ID NO: 519579 - RNA, 64 nt, Human
uugugucugauuccauauggaggccugaaaauuguaggguuauuaguccaaaugugaucaacug

SEQ ID NO: 519580 - RNA, 64 nt, Human
uuuauuuucauugugauuuauauauaagguaauguaggguuauauuugggagugacugcaagca

SEQ ID NO: 519581 - RNA, 64 nt, Human
aagcgcgguaggguucguagguagggcuaguagguaggguuaguagguagggcuaguagguagg

SEQ ID NO: 519582 - RNA, 64 nt, Human
uucguagguaggguucguagguagggcugguagguaggguuaguagguagggcuaguagguagg

SEQ ID NO: 519583 - RNA, 64 nt, Human
cugguagguaggguuaguagguagggcuaguagguaggguuaguagguaggguucguagguagg

SEQ ID NO: 519584 - RNA, 64 nt, Human
uucguagguaggguucguagguagggcuaguagguaggguuaguagguaggguucguagguagg

SEQ ID NO: 519585 - RNA, 64 nt, Human
uucguagguaggguucguagguagggcuaguagguaggguuaguagguagggcuaguagguagg

SEQ ID NO: 519586 - RNA, 64 nt, Human
uuaguagguagggcuaguagguagggcuaguagguaggguuaguagguagggcuaguagguagg

SEQ ID NO: 519587 - RNA, 64 nt, Human
uuaguagguagggcuaguagguaggguucguagguaggguuaguagguagggcuaguagguagg

SEQ ID NO: 519588 - RNA, 64 nt, Human; identical to SEQ ID NO: 519585

SEQ ID NO: 519589 - RNA, 64 nt, Human
uucguagguaggguucguagguaggguucguagguaggguuaguagguaggguucguagguagg

SEQ ID NO: 519590 - RNA, 64 nt, Human
cuaguagguagggcuaguagguagggcuaguagguaggguuaguagguagggcuaguagguagg

SEQ ID NO: 519591 - RNA, 64 nt, Human
uucguagguaggguucguagguaggguucguagguaggguuaguagcgcgucugugcugcuucc

SEQ ID NO: 519592 - RNA, 61 nt, Human; identical to SEQ ID NO: 446287

SEQ ID NO: 519593 - RNA, 61 nt, Human; identical to SEQ ID NO: 446298

SEQ ID NO: 519594 - RNA, 61 nt, Human; identical to SEQ ID NO: 446303

SEQ ID NO: 519595 - RNA, 61 nt, Human; identical to SEQ ID NO: 446314

SEQ ID NO: 519596 - RNA, 64 nt, Human
auaaaagucaaguuaguauuacaugaauuugggguaggguuagugcuuugaaaaaauguugaac

SEQ ID NO: 519597 - RNA, 64 nt, Human
aguugccacugccugggugaagaaaaagcacugcuaggguuagcaaccugucuggcaagggaca

SEQ ID NO: 519598 - RNA, 64 nt, Human
gaauauuuuuaccaccuauccugaucuuugaagguaggguuaggacuacuuaaccucuauuccc

SEQ ID NO: 519599 - RNA, 64 nt, Human
cuggguccuucccccugcuccaucugagccuugguaggguuaaagggaggugacagggugaaga

SEQ ID NO: 519600 - RNA, 64 nt, Human
caagugaucugcccgccuuggccacccaaagugcuaggguuacaggcaugagccacugugccca

SEQ ID NO: 519601 - RNA, 64 nt, Human
ugcugugcugguuucuugacucagacuuuacugguaggguuacuucaucucaugaaaugacaga

SEQ ID NO: 519602 - RNA, 64 nt, Human
uuuuguguccuccaggagcuucuuguuuccuuguuaggguuaacccuucaucuuccuguguccu

SEQ ID NO: 519603 - RNA, 64 nt, Human
ggaauaaccccuagucuggaaucuuugugaagcauaggguuauugcaaggcaaaugggaacuaa

SEQ ID NO: 519604 - RNA, 64 nt, Human
cuccuccuccgcccccuuccuucccuuguccccguaggguuauagcuggagcugccuguuauac

SEQ ID NO: 519605 - RNA, 64 nt, Human
uauugcaaauauuauuaggauguggacaugcuauuaggguuaucuacaauauaaaugggaauua

SEQ ID NO: 519606 - RNA, 64 nt, Human
gcuguuauaaggaaguguuugucccacauuuuccuaggguuaacaccucaccaaguucuuccag

SEQ ID NO: 519607 - RNA, 64 nt, Human
ccccucuuuugucacagauuaggaaauugagaacuaggguuaaccuugacuauauuuagagguc

SEQ ID NO: 519608 - RNA, 64 nt, Human
cagugugagacuuccacuagaaaaaagugaaaguuaggguuaggacauccuuuuuuaaaaauua

SEQ ID NO: 519609 - RNA, 64 nt, Human
gauacagagcucuuuguaaaccgcagucacacauuaggguuaguauuaaacuuuguuuagaugu

SEQ ID NO: 519610 - RNA, 64 nt, Human
cagaaccaccugggccccuuucugucaguauuauuaggguuacgaauugcagcuguuuaacuug

SEQ ID NO: 519611 - RNA, 61 nt, Human; identical to SEQ ID NO: 446321

SEQ ID NO: 519612 - RNA, 61 nt, Human; identical to SEQ ID NO: 446332

SEQ ID NO: 519613 - RNA, 61 nt, Human; identical to SEQ ID NO: 446337

SEQ ID NO: 519614 - RNA, 61 nt, Human; identical to SEQ ID NO: 446349

SEQ ID NO: 519615 - RNA, 64 nt, Human
ggcuucaaacuuccugguuucaugauaucuugagacgccuuacaaaugauggaggauuccaaag

SEQ ID NO: 519616 - RNA, 61 nt, Human; identical to SEQ ID NO: 446353

SEQ ID NO: 519617 - RNA, 61 nt, Human; identical to SEQ ID NO: 446364

SEQ ID NO: 519618 - RNA, 61 nt, Human; identical to SEQ ID NO: 446369

SEQ ID NO: 519619 - RNA, 61 nt, Human; identical to SEQ ID NO: 446380

SEQ ID NO: 519620 - RNA, 61 nt, Human; identical to SEQ ID NO: 446385

SEQ ID NO: 519621 - RNA, 61 nt, Human; identical to SEQ ID NO: 446396

SEQ ID NO: 519622 - RNA, 61 nt, Human; identical to SEQ ID NO: 446403

SEQ ID NO: 519623 - RNA, 61 nt, Human; identical to SEQ ID NO: 446412

SEQ ID NO: 519624 - RNA, 61 nt, Human; identical to SEQ ID NO: 446418

SEQ ID NO: 519625 - RNA, 61 nt, Human; identical to SEQ ID NO: 446429

SEQ ID NO: 519626 - RNA, 61 nt, Human; identical to SEQ ID NO: 446434

SEQ ID NO: 519627 - RNA, 61 nt, Human; identical to SEQ ID NO: 446446

SEQ ID NO: 519628 - RNA, 61 nt, Human; identical to SEQ ID NO: 446454

SEQ ID NO: 519629 - RNA, 61 nt, Human; identical to SEQ ID NO: 446462

SEQ ID NO: 519630 - RNA, 64 nt, Human; identical to SEQ ID NO: 222666

SEQ ID NO: 519631 - RNA, 64 nt, Human; identical to SEQ ID NO: 222667

SEQ ID NO: 519632 - RNA, 64 nt, Human; identical to SEQ ID NO: 222684

SEQ ID NO: 519633 - RNA, 64 nt, Human; identical to SEQ ID NO: 222685

SEQ ID NO: 519634 - RNA, 64 nt, Human
cuucuugccaccuuccccuccgggcagucagcucuccauccaucccccucuuuaaucuaugaau

SEQ ID NO: 519635 - RNA, 64 nt, Human
cuguguuaguuugcuuaugauaauggcuuccagcuccauccauauugcuacagaggacaugauc

SEQ ID NO: 519636 - RNA, 64 nt, Human
guauuuugaaugaguuugacacugccggcuuccuuccauccagcgagguggugcugacagugug

SEQ ID NO: 519637 - RNA, 64 nt, Human
ugugaacauaguuugauuugaucacaggucaaaaacgccuuauauuuucgaaagacuccuggcc

SEQ ID NO: 519638 - RNA, 64 nt, Human
ccucuuuucccuagggcauugcucuccuauucccacgccuuaacacagcucuauaccuagaagc

SEQ ID NO: 519639 - RNA, 64 nt, Human
cagacugaaccuuucgccagaagcuguccuuauaacgccuuauacgcauacacagccaggaaac

SEQ ID NO: 519640 - RNA, 64 nt, Human
aguggaaaggaagacccuccauccucugguauuaacgccuuaaugccccugucuuuuacuguaa

SEQ ID NO: 519641 - RNA, 64 nt, Human
uagaauucuuugcauuuuuguguuuguaacagaaacgccuuaagacacuauguuugggaauaua

SEQ ID NO: 519642 - RNA, 64 nt, Human
cccuaaucuguggccaccaccccccccccccgccacgccuuagagcagagcagccccuccucuc

SEQ ID NO: 519643 - RNA, 64 nt, Human
agcuuuucagcaggcccggaaagguacgcaggugacgccuuagcagccccgcagcuggugcucu

SEQ ID NO: 519644 - RNA, 64 nt, Human
ccgagcgggagagguggagaugcuuauagcaguuacgccuuaggaaggggacaaccaggccccg

SEQ ID NO: 519645 - RNA, 64 nt, Human
ggaccaggccuccagcugucuggccucgcccuucacgccuuaacacuaagcccaccuccccugc

SEQ ID NO: 519646 - RNA, 64 nt, Human
agcgggccuguccaggggcuccccgccccaccccacgccuuagcugcaggcccuuuugggcaaa

SEQ ID NO: 519647 - RNA, 64 nt, Human
cagcauucuuauuugcugaugcugcuaugauaccacgccuuaaaaauugacaguugaaaaaaaa

SEQ ID NO: 519648 - RNA, 64 nt, Human
gauggccacauaauaacuacugcauaauauggauacgccuuauuugauuuaacuaguucccuaa

SEQ ID NO: 519649 - RNA, 64 nt, Human
cugcuccgacacccggcaagcagccggagacaaaacgccuuaaagcccccggcccagcccugca

SEQ ID NO: 519650 - RNA, 64 nt, Human
uggggaaaacuccaccuucccacuuucccaccccacgccuuauccccacuugcagcccugucuu

SEQ ID NO: 519651 - RNA, 64 nt, Human
gugaagcaugugacaaaguuuucagucacagaucacgccuuaaaagacauaggagaauucauac

SEQ ID NO: 519652 - RNA, 64 nt, Human
ucugaugucuuagugacuuaguucuuagaagcucacgccuuaguuugaaacagauucuccacgg

SEQ ID NO: 519653 - RNA, 61 nt, Human; identical to SEQ ID NO: 446463

SEQ ID NO: 519654 - RNA, 61 nt, Human; identical to SEQ ID NO: 446464

SEQ ID NO: 519655 - RNA, 61 nt, Human; identical to SEQ ID NO: 446465

SEQ ID NO: 519656 - RNA, 64 nt, Human
ccaaugccaaucugaggaccuucagagacagucuacgccuuaacaagcacaugaaggaaacuau

SEQ ID NO: 519657 - RNA, 64 nt, Human
agaauauuccgucaaaaauaguuugccuuaggucacgccuuaggauuuuaaaaaaauuacauug

SEQ ID NO: 519658 - RNA, 64 nt, Human; identical to SEQ ID NO: 388109

SEQ ID NO: 519659 - RNA, 64 nt, Human; identical to SEQ ID NO: 388113

SEQ ID NO: 519660 - RNA, 64 nt, Human; identical to SEQ ID NO: 388114

SEQ ID NO: 519661 - RNA, 64 nt, Human; identical to SEQ ID NO: 388115

SEQ ID NO: 519662 - RNA, 64 nt, Human; identical to SEQ ID NO: 388116

SEQ ID NO: 519663 - RNA, 64 nt, Human; identical to SEQ ID NO: 388117

SEQ ID NO: 519664 - RNA, 64 nt, Human; identical to SEQ ID NO: 388118

SEQ ID NO: 519665 - RNA, 64 nt, Human; identical to SEQ ID NO: 388119

SEQ ID NO: 519666 - RNA, 64 nt, Human; identical to SEQ ID NO: 388120

SEQ ID NO: 519667 - RNA, 64 nt, Human; identical to SEQ ID NO: 388121

SEQ ID NO: 519668 - RNA, 64 nt, Human; identical to SEQ ID NO: 388122

SEQ ID NO: 519669 - RNA, 64 nt, Human; identical to SEQ ID NO: 388123

SEQ ID NO: 519670 - RNA, 64 nt, Human
ugggucuuaacuuauuggaacuguagagcauccauccauccauccauccagcaaugugacuuuu

SEQ ID NO: 519671 - RNA, 64 nt, Human
aggggugucuugggcagagcuggcucugagcgccuccauccaaggccagguucuccguuagcuc

SEQ ID NO: 519672 - RNA, 64 nt, Human
uaggauugaaacagucuauaaacuguauuuuugguccauccaggaagcuagucccuuguuucuc

SEQ ID NO: 519673 - RNA, 64 nt, Human; identical to SEQ ID NO: 388124

SEQ ID NO: 519674 - RNA, 64 nt, Human; identical to SEQ ID NO: 388125

SEQ ID NO: 519675 - RNA, 64 nt, Human; identical to SEQ ID NO: 388126

SEQ ID NO: 519676 - RNA, 57 nt, Human; identical to SEQ ID NO: 388127

SEQ ID NO: 519677 - RNA, 64 nt, Human; identical to SEQ ID NO: 388131

SEQ ID NO: 519678 - RNA, 64 nt, Human; identical to SEQ ID NO: 388132

SEQ ID NO: 519679 - RNA, 64 nt, Human; identical to SEQ ID NO: 388133

SEQ ID NO: 519680 - RNA, 64 nt, Human; identical to SEQ ID NO: 388134

SEQ ID NO: 519681 - RNA, 64 nt, Human; identical to SEQ ID NO: 388135

SEQ ID NO: 519682 - RNA, 64 nt, Human; identical to SEQ ID NO: 388136

SEQ ID NO: 519683 - RNA, 64 nt, Human; identical to SEQ ID NO: 388137

SEQ ID NO: 519684 - RNA, 64 nt, Human; identical to SEQ ID NO: 388138

SEQ ID NO: 519685 - RNA, 64 nt, Human; identical to SEQ ID NO: 388139

SEQ ID NO: 519686 - RNA, 64 nt, Human; identical to SEQ ID NO: 388140

SEQ ID NO: 519687 - RNA, 64 nt, Human; identical to SEQ ID NO: 388141

SEQ ID NO: 519688 - RNA, 64 nt, Human; identical to SEQ ID NO: 388142

SEQ ID NO: 519689 - RNA, 64 nt, Human
uccuaugaauguauguaaauaaacuguacauagguccauccacauaaaauaucuuuuaauaaca

SEQ ID NO: 519690 - RNA, 64 nt, Human
gcugugugugugugugugugugcgcgugcccguguccauccaugucucuguugugugucugugu

SEQ ID NO: 519691 - RNA, 64 nt, Human
uugcuaggacaccaaaagaccuagcugggcuaacuccauccaaaugauuuuacaguuuuauuuu

SEQ ID NO: 519692 - RNA, 64 nt, Human; identical to SEQ ID NO: 388143

SEQ ID NO: 519693 - RNA, 64 nt, Human; identical to SEQ ID NO: 388144

SEQ ID NO: 519694 - RNA, 64 nt, Human; identical to SEQ ID NO: 388145

SEQ ID NO: 519695 - RNA, 64 nt, Human; identical to SEQ ID NO: 388149

SEQ ID NO: 519696 - RNA, 64 nt, Human; identical to SEQ ID NO: 388150

SEQ ID NO: 519697 - RNA, 64 nt, Human; identical to SEQ ID NO: 388151

SEQ ID NO: 519698 - RNA, 64 nt, Human; identical to SEQ ID NO: 388152

SEQ ID NO: 519699 - RNA, 58 nt, Human; identical to SEQ ID NO: 388153

SEQ ID NO: 519700 - RNA, 64 nt, Human; identical to SEQ ID NO: 388154

SEQ ID NO: 519701 - RNA, 64 nt, Human; identical to SEQ ID NO: 388155

SEQ ID NO: 519702 - RNA, 64 nt, Human; identical to SEQ ID NO: 388156

SEQ ID NO: 519703 - RNA, 59 nt, Human; identical to SEQ ID NO: 388157

SEQ ID NO: 519704 - RNA, 64 nt, Human; identical to SEQ ID NO: 388158

SEQ ID NO: 519705 - RNA, 64 nt, Human; identical to SEQ ID NO: 388159

SEQ ID NO: 519706 - RNA, 64 nt, Human; identical to SEQ ID NO: 388160

SEQ ID NO: 519707 - RNA, 64 nt, Human; identical to SEQ ID NO: 388161

SEQ ID NO: 519708 - RNA, 64 nt, Human
agaaauuccuauaaaguaagaucuccuugccucuuccauccauuguuggcacccccuugcaaaa

SEQ ID NO: 519709 - RNA, 64 nt, Human
accauuuacuguuuuuuucuguagcaccagagaauccauccaaaguucccuaugaaaaaugugu

SEQ ID NO: 519710 - RNA, 64 nt, Human
uuuuccaugcauuugcaaauacguauauucuuuuuccauccacuugcacaauaucauuaccauc

SEQ ID NO: 519711 - RNA, 64 nt, Human; identical to SEQ ID NO: 388162

SEQ ID NO: 519712 - RNA, 64 nt, Human; identical to SEQ ID NO: 388163

SEQ ID NO: 519713 - RNA, 64 nt, Human; identical to SEQ ID NO: 388167

SEQ ID NO: 519714 - RNA, 64 nt, Human; identical to SEQ ID NO: 388168

SEQ ID NO: 519715 - RNA, 64 nt, Human; identical to SEQ ID NO: 388169

SEQ ID NO: 519716 - RNA, 64 nt, Human; identical to SEQ ID NO: 388170

SEQ ID NO: 519717 - RNA, 64 nt, Human; identical to SEQ ID NO: 388171

SEQ ID NO: 519718 - RNA, 64 nt, Human; identical to SEQ ID NO: 388172

SEQ ID NO: 519719 - RNA, 64 nt, Human; identical to SEQ ID NO: 388173

SEQ ID NO: 519720 - RNA, 64 nt, Human; identical to SEQ ID NO: 388174

SEQ ID NO: 519721 - RNA, 64 nt, Human; identical to SEQ ID NO: 388175

SEQ ID NO: 519722 - RNA, 64 nt, Human; identical to SEQ ID NO: 388176

SEQ ID NO: 519723 - RNA, 64 nt, Human; identical to SEQ ID NO: 388177

SEQ ID NO: 519724 - RNA, 64 nt, Human; identical to SEQ ID NO: 388178

SEQ ID NO: 519725 - RNA, 64 nt, Human; identical to SEQ ID NO: 388179

SEQ ID NO: 519726 - RNA, 64 nt, Human; identical to SEQ ID NO: 388180

SEQ ID NO: 519727 - RNA, 64 nt, Human
gagcugugauggcuaacugauguuuauaaugcccuccauccagguagcaagauguguguauguc

SEQ ID NO: 519728 - RNA, 64 nt, Human
agaugaggaaucugaggauuaucagaacucagcauccauccaucaguggcgcgaguccaggaag

SEQ ID NO: 519729 - RNA, 64 nt, Human
caggugcaaaaaagugguggaacaaauaccaacauccauccaaaaugaaaaagaacaggaaauu

SEQ ID NO: 519730 - RNA, 64 nt, Human; identical to SEQ ID NO: 388181

SEQ ID NO: 519731 - RNA, 64 nt, Human; identical to SEQ ID NO: 388184

SEQ ID NO: 519732 - RNA, 64 nt, Human; identical to SEQ ID NO: 388185

SEQ ID NO: 519733 - RNA, 64 nt, Human; identical to SEQ ID NO: 388186

SEQ ID NO: 519734 - RNA, 64 nt, Human; identical to SEQ ID NO: 388187

SEQ ID NO: 519735 - RNA, 64 nt, Human; identical to SEQ ID NO: 388188

SEQ ID NO: 519736 - RNA, 64 nt, Human; identical to SEQ ID NO: 388189

SEQ ID NO: 519737 - RNA, 64 nt, Human; identical to SEQ ID NO: 388190

SEQ ID NO: 519738 - RNA, 64 nt, Human; identical to SEQ ID NO: 388191

SEQ ID NO: 519739 - RNA, 64 nt, Human; identical to SEQ ID NO: 388192

SEQ ID NO: 519740 - RNA, 64 nt, Human; identical to SEQ ID NO: 388193

SEQ ID NO: 519741 - RNA, 64 nt, Human; identical to SEQ ID NO: 388194

SEQ ID NO: 519742 - RNA, 64 nt, Human; identical to SEQ ID NO: 388195

SEQ ID NO: 519743 - RNA, 64 nt, Human; identical to SEQ ID NO: 388196

SEQ ID NO: 519744 - RNA, 64 nt, Human; identical to SEQ ID NO: 388197

SEQ ID NO: 519745 - RNA, 64 nt, Human; identical to SEQ ID NO: 388198

SEQ ID NO: 519746 - RNA, 61 nt, Human; identical to SEQ ID NO: 446461

SEQ ID NO: 519747 - RNA, 61 nt, Human; identical to SEQ ID NO: 446466

SEQ ID NO: 519748 - RNA, 61 nt, Human; identical to SEQ ID NO: 446467

SEQ ID NO: 519749 - RNA, 64 nt, Human; identical to SEQ ID NO: 388202

SEQ ID NO: 519750 - RNA, 64 nt, Human; identical to SEQ ID NO: 388203

SEQ ID NO: 519751 - RNA, 64 nt, Human; identical to SEQ ID NO: 388204

SEQ ID NO: 519752 - RNA, 64 nt, Human; identical to SEQ ID NO: 388205

SEQ ID NO: 519753 - RNA, 64 nt, Human; identical to SEQ ID NO: 388206

SEQ ID NO: 519754 - RNA, 64 nt, Human; identical to SEQ ID NO: 388207

SEQ ID NO: 519755 - RNA, 64 nt, Human; identical to SEQ ID NO: 388208

SEQ ID NO: 519756 - RNA, 64 nt, Human; identical to SEQ ID NO: 388209

SEQ ID NO: 519757 - RNA, 64 nt, Human; identical to SEQ ID NO: 388210

SEQ ID NO: 519758 - RNA, 64 nt, Human; identical to SEQ ID NO: 388211

SEQ ID NO: 519759 - RNA, 64 nt, Human; identical to SEQ ID NO: 388212

SEQ ID NO: 519760 - RNA, 64 nt, Human; identical to SEQ ID NO: 388213

SEQ ID NO: 519761 - RNA, 64 nt, Human; identical to SEQ ID NO: 388214

SEQ ID NO: 519762 - RNA, 64 nt, Human; identical to SEQ ID NO: 388215

SEQ ID NO: 519763 - RNA, 64 nt, Human; identical to SEQ ID NO: 388216

SEQ ID NO: 519764 - RNA, 64 nt, Human; identical to SEQ ID NO: 388220

SEQ ID NO: 519765 - RNA, 61 nt, Human; identical to SEQ ID NO: 446468

SEQ ID NO: 519766 - RNA, 61 nt, Human; identical to SEQ ID NO: 446469

SEQ ID NO: 519767 - RNA, 61 nt, Human; identical to SEQ ID NO: 446470

SEQ ID NO: 519768 - RNA, 64 nt, Human; identical to SEQ ID NO: 388221

SEQ ID NO: 519769 - RNA, 64 nt, Human; identical to SEQ ID NO: 388222

SEQ ID NO: 519770 - RNA, 64 nt, Human; identical to SEQ ID NO: 388223

SEQ ID NO: 519771 - RNA, 64 nt, Human; identical to SEQ ID NO: 388224

SEQ ID NO: 519772 - RNA, 64 nt, Human; identical to SEQ ID NO: 388225

SEQ ID NO: 519773 - RNA, 64 nt, Human; identical to SEQ ID NO: 388226

SEQ ID NO: 519774 - RNA, 64 nt, Human; identical to SEQ ID NO: 388227

SEQ ID NO: 519775 - RNA, 59 nt, Human; identical to SEQ ID NO: 388228

SEQ ID NO: 519776 - RNA, 64 nt, Human; identical to SEQ ID NO: 388229

SEQ ID NO: 519777 - RNA, 64 nt, Human; identical to SEQ ID NO: 388230

SEQ ID NO: 519778 - RNA, 64 nt, Human; identical to SEQ ID NO: 388231

SEQ ID NO: 519779 - RNA, 64 nt, Human; identical to SEQ ID NO: 388232

SEQ ID NO: 519780 - RNA, 64 nt, Human; identical to SEQ ID NO: 388233

SEQ ID NO: 519781 - RNA, 64 nt, Human; identical to SEQ ID NO: 388234

SEQ ID NO: 519782 - RNA, 64 nt, Human; identical to SEQ ID NO: 388238

SEQ ID NO: 519783 - RNA, 64 nt, Human; identical to SEQ ID NO: 388239

SEQ ID NO: 519784 - RNA, 61 nt, Human; identical to SEQ ID NO: 446471

SEQ ID NO: 519785 - RNA, 61 nt, Human; identical to SEQ ID NO: 446476

SEQ ID NO: 519786 - RNA, 61 nt, Human; identical to SEQ ID NO: 446477

SEQ ID NO: 519787 - RNA, 64 nt, Human; identical to SEQ ID NO: 388240

SEQ ID NO: 519788 - RNA, 64 nt, Human; identical to SEQ ID NO: 388241

SEQ ID NO: 519789 - RNA, 64 nt, Human; identical to SEQ ID NO: 388242

SEQ ID NO: 519790 - RNA, 64 nt, Human; identical to SEQ ID NO: 388243

SEQ ID NO: 519791 - RNA, 64 nt, Human; identical to SEQ ID NO: 388244

SEQ ID NO: 519792 - RNA, 64 nt, Human; identical to SEQ ID NO: 388245

SEQ ID NO: 519793 - RNA, 64 nt, Human; identical to SEQ ID NO: 388246

SEQ ID NO: 519794 - RNA, 64 nt, Human; identical to SEQ ID NO: 388247

SEQ ID NO: 519795 - RNA, 64 nt, Human; identical to SEQ ID NO: 388248

SEQ ID NO: 519796 - RNA, 64 nt, Human; identical to SEQ ID NO: 388249

SEQ ID NO: 519797 - RNA, 64 nt, Human; identical to SEQ ID NO: 388250

SEQ ID NO: 519798 - RNA, 64 nt, Human; identical to SEQ ID NO: 388251

SEQ ID NO: 519799 - RNA, 64 nt, Human; identical to SEQ ID NO: 388252

SEQ ID NO: 519800 - RNA, 64 nt, Human; identical to SEQ ID NO: 388256

SEQ ID NO: 519801 - RNA, 64 nt, Human; identical to SEQ ID NO: 388257

SEQ ID NO: 519802 - RNA, 64 nt, Human; identical to SEQ ID NO: 388258

SEQ ID NO: 519803 - RNA, 61 nt, Human; identical to SEQ ID NO: 446478

SEQ ID NO: 519804 - RNA, 61 nt, Human; identical to SEQ ID NO: 446479

SEQ ID NO: 519805 - RNA, 61 nt, Human; identical to SEQ ID NO: 446480

SEQ ID NO: 519806 - RNA, 64 nt, Human; identical to SEQ ID NO: 388259

SEQ ID NO: 519807 - RNA, 64 nt, Human; identical to SEQ ID NO: 388260

SEQ ID NO: 519808 - RNA, 64 nt, Human; identical to SEQ ID NO: 388261

SEQ ID NO: 519809 - RNA, 64 nt, Human; identical to SEQ ID NO: 388262

SEQ ID NO: 519810 - RNA, 64 nt, Human; identical to SEQ ID NO: 388263

SEQ ID NO: 519811 - RNA, 64 nt, Human; identical to SEQ ID NO: 388264

SEQ ID NO: 519812 - RNA, 64 nt, Human; identical to SEQ ID NO: 388265

SEQ ID NO: 519813 - RNA, 64 nt, Human; identical to SEQ ID NO: 388266

SEQ ID NO: 519814 - RNA, 64 nt, Human; identical to SEQ ID NO: 388267

SEQ ID NO: 519815 - RNA, 64 nt, Human; identical to SEQ ID NO: 388268

SEQ ID NO: 519816 - RNA, 64 nt, Human; identical to SEQ ID NO: 388269

SEQ ID NO: 519817 - RNA, 64 nt, Human; identical to SEQ ID NO: 388270

SEQ ID NO: 519818 - RNA, 64 nt, Human; identical to SEQ ID NO: 388274

SEQ ID NO: 519819 - RNA, 64 nt, Human; identical to SEQ ID NO: 388275

SEQ ID NO: 519820 - RNA, 64 nt, Human; identical to SEQ ID NO: 388276

SEQ ID NO: 519821 - RNA, 64 nt, Human; identical to SEQ ID NO: 388277

SEQ ID NO: 519822 - RNA, 61 nt, Human; identical to SEQ ID NO: 446431

SEQ ID NO: 519823 - RNA, 61 nt, Human; identical to SEQ ID NO: 446432

SEQ ID NO: 519824 - RNA, 61 nt, Human; identical to SEQ ID NO: 446433

SEQ ID NO: 519825 - RNA, 64 nt, Human; identical to SEQ ID NO: 388278

SEQ ID NO: 519826 - RNA, 64 nt, Human; identical to SEQ ID NO: 388279

SEQ ID NO: 519827 - RNA, 64 nt, Human; identical to SEQ ID NO: 388280

SEQ ID NO: 519828 - RNA, 64 nt, Human; identical to SEQ ID NO: 388281

SEQ ID NO: 519829 - RNA, 64 nt, Human; identical to SEQ ID NO: 388282

SEQ ID NO: 519830 - RNA, 64 nt, Human; identical to SEQ ID NO: 388283

SEQ ID NO: 519831 - RNA, 64 nt, Human; identical to SEQ ID NO: 388284

SEQ ID NO: 519832 - RNA, 64 nt, Human; identical to SEQ ID NO: 388285

SEQ ID NO: 519833 - RNA, 64 nt, Human; identical to SEQ ID NO: 388286

SEQ ID NO: 519834 - RNA, 64 nt, Human; identical to SEQ ID NO: 388287

SEQ ID NO: 519835 - RNA, 64 nt, Human; identical to SEQ ID NO: 388288

SEQ ID NO: 519836 - RNA, 64 nt, Human; identical to SEQ ID NO: 388292

SEQ ID NO: 519837 - RNA, 64 nt, Human; identical to SEQ ID NO: 388293

SEQ ID NO: 519838 - RNA, 64 nt, Human; identical to SEQ ID NO: 388294

SEQ ID NO: 519839 - RNA, 64 nt, Human; identical to SEQ ID NO: 388295

SEQ ID NO: 519840 - RNA, 64 nt, Human; identical to SEQ ID NO: 388296

SEQ ID NO: 519841 - RNA, 61 nt, Human; identical to SEQ ID NO: 446481

SEQ ID NO: 519842 - RNA, 61 nt, Human; identical to SEQ ID NO: 446482

SEQ ID NO: 519843 - RNA, 61 nt, Human; identical to SEQ ID NO: 446483

SEQ ID NO: 519844 - RNA, 64 nt, Human; identical to SEQ ID NO: 388297

SEQ ID NO: 519845 - RNA, 64 nt, Human; identical to SEQ ID NO: 388298

SEQ ID NO: 519846 - RNA, 64 nt, Human; identical to SEQ ID NO: 388299

SEQ ID NO: 519847 - RNA, 64 nt, Human; identical to SEQ ID NO: 388300

SEQ ID NO: 519848 - RNA, 64 nt, Human; identical to SEQ ID NO: 388301

SEQ ID NO: 519849 - RNA, 64 nt, Human; identical to SEQ ID NO: 388302

SEQ ID NO: 519850 - RNA, 64 nt, Human; identical to SEQ ID NO: 388303

SEQ ID NO: 519851 - RNA, 64 nt, Human; identical to SEQ ID NO: 388304

SEQ ID NO: 519852 - RNA, 64 nt, Human; identical to SEQ ID NO: 388305

SEQ ID NO: 519853 - RNA, 64 nt, Human; identical to SEQ ID NO: 388306

SEQ ID NO: 519854 - RNA, 64 nt, Human; identical to SEQ ID NO: 388310

SEQ ID NO: 519855 - RNA, 64 nt, Human; identical to SEQ ID NO: 388311

SEQ ID NO: 519856 - RNA, 64 nt, Human; identical to SEQ ID NO: 388312

SEQ ID NO: 519857 - RNA, 64 nt, Human; identical to SEQ ID NO: 388313

SEQ ID NO: 519858 - RNA, 64 nt, Human; identical to SEQ ID NO: 388314

SEQ ID NO: 519859 - RNA, 64 nt, Human; identical to SEQ ID NO: 388315

SEQ ID NO: 519860 - RNA, 61 nt, Human; identical to SEQ ID NO: 446484

SEQ ID NO: 519861 - RNA, 61 nt, Human; identical to SEQ ID NO: 446485

SEQ ID NO: 519862 - RNA, 61 nt, Human; identical to SEQ ID NO: 446486

SEQ ID NO: 519863 - RNA, 64 nt, Human; identical to SEQ ID NO: 388316

SEQ ID NO: 519864 - RNA, 64 nt, Human; identical to SEQ ID NO: 388317

SEQ ID NO: 519865 - RNA, 64 nt, Human; identical to SEQ ID NO: 388318

SEQ ID NO: 519866 - RNA, 64 nt, Human; identical to SEQ ID NO: 388319

SEQ ID NO: 519867 - RNA, 64 nt, Human; identical to SEQ ID NO: 388320

SEQ ID NO: 519868 - RNA, 64 nt, Human; identical to SEQ ID NO: 388321

SEQ ID NO: 519869 - RNA, 64 nt, Human; identical to SEQ ID NO: 388322

SEQ ID NO: 519870 - RNA, 64 nt, Human; identical to SEQ ID NO: 388323

SEQ ID NO: 519871 - RNA, 64 nt, Human; identical to SEQ ID NO: 388324

SEQ ID NO: 519872 - RNA, 64 nt, Human; identical to SEQ ID NO: 388328

SEQ ID NO: 519873 - RNA, 64 nt, Human; identical to SEQ ID NO: 388329

SEQ ID NO: 519874 - RNA, 64 nt, Human; identical to SEQ ID NO: 388330

SEQ ID NO: 519875 - RNA, 64 nt, Human; identical to SEQ ID NO: 388331

SEQ ID NO: 519876 - RNA, 64 nt, Human; identical to SEQ ID NO: 388332

SEQ ID NO: 519877 - RNA, 64 nt, Human; identical to SEQ ID NO: 388333

SEQ ID NO: 519878 - RNA, 64 nt, Human; identical to SEQ ID NO: 388334

SEQ ID NO: 519879 - RNA, 61 nt, Human; identical to SEQ ID NO: 446417

SEQ ID NO: 519880 - RNA, 64 nt, Human
caggggcugaggccucugcuacuggcugccccuuuccauccaguggcugcuguuucccaagaca

SEQ ID NO: 519881 - RNA, 64 nt, Human
acuagaaauccaucaucucuaucguugauauccuuccauccaggaauagauuuuucuuacucua

SEQ ID NO: 519882 - RNA, 64 nt, Human; identical to SEQ ID NO: 388335

SEQ ID NO: 519883 - RNA, 64 nt, Human; identical to SEQ ID NO: 388336

SEQ ID NO: 519884 - RNA, 64 nt, Human; identical to SEQ ID NO: 388337

SEQ ID NO: 519885 - RNA, 64 nt, Human; identical to SEQ ID NO: 388338

SEQ ID NO: 519886 - RNA, 64 nt, Human; identical to SEQ ID NO: 388339

SEQ ID NO: 519887 - RNA, 64 nt, Human; identical to SEQ ID NO: 388340

SEQ ID NO: 519888 - RNA, 64 nt, Human; identical to SEQ ID NO: 388341

SEQ ID NO: 519889 - RNA, 64 nt, Human; identical to SEQ ID NO: 388342

SEQ ID NO: 519890 - RNA, 64 nt, Human; identical to SEQ ID NO: 388345

SEQ ID NO: 519891 - RNA, 64 nt, Human; identical to SEQ ID NO: 388346

SEQ ID NO: 519892 - RNA, 64 nt, Human; identical to SEQ ID NO: 388347

SEQ ID NO: 519893 - RNA, 64 nt, Human; identical to SEQ ID NO: 388348

SEQ ID NO: 519894 - RNA, 64 nt, Human; identical to SEQ ID NO: 388349

SEQ ID NO: 519895 - RNA, 64 nt, Human; identical to SEQ ID NO: 388350

SEQ ID NO: 519896 - RNA, 64 nt, Human; identical to SEQ ID NO: 388351

SEQ ID NO: 519897 - RNA, 64 nt, Human; identical to SEQ ID NO: 388352

SEQ ID NO: 519898 - RNA, 64 nt, Human
agcccagccugccuguccuccagcugucugacuauccauccaucauaaccaccccagccuggga

SEQ ID NO: 519899 - RNA, 64 nt, Human
accccaggcccccacagugagcaugccgggccccuccauccacccgggggagcccagugaagcc

SEQ ID NO: 519900 - RNA, 64 nt, Human
aaaauuucugccuccuaaguuuauguaccuuguuuccauccauuuaccacauauuuccaucuga

SEQ ID NO: 519901 - RNA, 64 nt, Human; identical to SEQ ID NO: 388353

SEQ ID NO: 519902 - RNA, 64 nt, Human; identical to SEQ ID NO: 388354

SEQ ID NO: 519903 - RNA, 64 nt, Human; identical to SEQ ID NO: 388355

SEQ ID NO: 519904 - RNA, 64 nt, Human; identical to SEQ ID NO: 388356

SEQ ID NO: 519905 - RNA, 64 nt, Human; identical to SEQ ID NO: 388357

SEQ ID NO: 519906 - RNA, 64 nt, Human; identical to SEQ ID NO: 388358

SEQ ID NO: 519907 - RNA, 64 nt, Human; identical to SEQ ID NO: 388359

SEQ ID NO: 519908 - RNA, 64 nt, Human; identical to SEQ ID NO: 388363

SEQ ID NO: 519909 - RNA, 64 nt, Human; identical to SEQ ID NO: 388364

SEQ ID NO: 519910 - RNA, 64 nt, Human; identical to SEQ ID NO: 388365

SEQ ID NO: 519911 - RNA, 64 nt, Human; identical to SEQ ID NO: 388366

SEQ ID NO: 519912 - RNA, 64 nt, Human; identical to SEQ ID NO: 388367

SEQ ID NO: 519913 - RNA, 64 nt, Human; identical to SEQ ID NO: 388368

SEQ ID NO: 519914 - RNA, 64 nt, Human; identical to SEQ ID NO: 388369

SEQ ID NO: 519915 - RNA, 64 nt, Human; identical to SEQ ID NO: 388370

SEQ ID NO: 519916 - RNA, 64 nt, Human; identical to SEQ ID NO: 388371

SEQ ID NO: 519917 - RNA, 64 nt, Human
uuggccugcuaaggucuuggaacuugccugccuuuccauccauggccagcagcaccugcccuac

SEQ ID NO: 519918 - RNA, 64 nt, Human
uggaaggaaacguuauaccuuguaccccucggucuccauccaucaagccaaaccugcugccaca

SEQ ID NO: 519919 - RNA, 64 nt, Human
uccuccuuccuuccacacagcaagccuaccuuucuccauccaugcucaccauagcccccuuccu

SEQ ID NO: 519920 - RNA, 64 nt, Human; identical to SEQ ID NO: 388372

SEQ ID NO: 519921 - RNA, 64 nt, Human; identical to SEQ ID NO: 388373

SEQ ID NO: 519922 - RNA, 64 nt, Human; identical to SEQ ID NO: 388374

SEQ ID NO: 519923 - RNA, 64 nt, Human; identical to SEQ ID NO: 388375

SEQ ID NO: 519924 - RNA, 63 nt, Human; identical to SEQ ID NO: 388376

SEQ ID NO: 519925 - RNA, 64 nt, Human; identical to SEQ ID NO: 388377

SEQ ID NO: 519926 - RNA, 64 nt, Human; identical to SEQ ID NO: 388381

SEQ ID NO: 519927 - RNA, 64 nt, Human; identical to SEQ ID NO: 388382

SEQ ID NO: 519928 - RNA, 64 nt, Human; identical to SEQ ID NO: 388383

SEQ ID NO: 519929 - RNA, 64 nt, Human; identical to SEQ ID NO: 388384

SEQ ID NO: 519930 - RNA, 64 nt, Human; identical to SEQ ID NO: 388385

SEQ ID NO: 519931 - RNA, 64 nt, Human; identical to SEQ ID NO: 388386

SEQ ID NO: 519932 - RNA, 64 nt, Human; identical to SEQ ID NO: 388387

SEQ ID NO: 519933 - RNA, 64 nt, Human; identical to SEQ ID NO: 388388

SEQ ID NO: 519934 - RNA, 64 nt, Human; identical to SEQ ID NO: 388389

SEQ ID NO: 519935 - RNA, 64 nt, Human; identical to SEQ ID NO: 388390

SEQ ID NO: 519936 - RNA, 61 nt, Human; identical to SEQ ID NO: 446386

SEQ ID NO: 519937 - RNA, 61 nt, Human; identical to SEQ ID NO: 446387

SEQ ID NO: 519938 - RNA, 61 nt, Human; identical to SEQ ID NO: 446388

SEQ ID NO: 519939 - RNA, 64 nt, Human; identical to SEQ ID NO: 388391

SEQ ID NO: 519940 - RNA, 64 nt, Human; identical to SEQ ID NO: 388392

SEQ ID NO: 519941 - RNA, 64 nt, Human; identical to SEQ ID NO: 388393

SEQ ID NO: 519942 - RNA, 64 nt, Human; identical to SEQ ID NO: 388394

SEQ ID NO: 519943 - RNA, 64 nt, Human; identical to SEQ ID NO: 388395

SEQ ID NO: 519944 - RNA, 64 nt, Human; identical to SEQ ID NO: 388399

SEQ ID NO: 519945 - RNA, 64 nt, Human; identical to SEQ ID NO: 388400

SEQ ID NO: 519946 - RNA, 64 nt, Human; identical to SEQ ID NO: 388401

SEQ ID NO: 519947 - RNA, 64 nt, Human; identical to SEQ ID NO: 388402

SEQ ID NO: 519948 - RNA, 64 nt, Human; identical to SEQ ID NO: 388403

SEQ ID NO: 519949 - RNA, 64 nt, Human; identical to SEQ ID NO: 388404

SEQ ID NO: 519950 - RNA, 64 nt, Human; identical to SEQ ID NO: 388405

SEQ ID NO: 519951 - RNA, 64 nt, Human; identical to SEQ ID NO: 388406

SEQ ID NO: 519952 - RNA, 57 nt, Human; identical to SEQ ID NO: 388407

SEQ ID NO: 519953 - RNA, 64 nt, Human; identical to SEQ ID NO: 388408

SEQ ID NO: 519954 - RNA, 64 nt, Human; identical to SEQ ID NO: 388409

SEQ ID NO: 519955 - RNA, 61 nt, Human; identical to SEQ ID NO: 446393

SEQ ID NO: 519956 - RNA, 61 nt, Human; identical to SEQ ID NO: 446394

SEQ ID NO: 519957 - RNA, 61 nt, Human; identical to SEQ ID NO: 446395

SEQ ID NO: 519958 - RNA, 64 nt, Human; identical to SEQ ID NO: 388410

SEQ ID NO: 519959 - RNA, 64 nt, Human; identical to SEQ ID NO: 388411

SEQ ID NO: 519960 - RNA, 64 nt, Human; identical to SEQ ID NO: 388412

SEQ ID NO: 519961 - RNA, 64 nt, Human; identical to SEQ ID NO: 388413

SEQ ID NO: 519962 - RNA, 64 nt, Human; identical to SEQ ID NO: 388417

SEQ ID NO: 519963 - RNA, 64 nt, Human; identical to SEQ ID NO: 388418

SEQ ID NO: 519964 - RNA, 64 nt, Human; identical to SEQ ID NO: 388419

SEQ ID NO: 519965 - RNA, 64 nt, Human; identical to SEQ ID NO: 388420

SEQ ID NO: 519966 - RNA, 64 nt, Human; identical to SEQ ID NO: 388421

SEQ ID NO: 519967 - RNA, 55 nt, Human; identical to SEQ ID NO: 388422

SEQ ID NO: 519968 - RNA, 64 nt, Human; identical to SEQ ID NO: 388423

SEQ ID NO: 519969 - RNA, 64 nt, Human; identical to SEQ ID NO: 388424

SEQ ID NO: 519970 - RNA, 64 nt, Human; identical to SEQ ID NO: 388425

SEQ ID NO: 519971 - RNA, 64 nt, Human; identical to SEQ ID NO: 388426

SEQ ID NO: 519972 - RNA, 64 nt, Human; identical to SEQ ID NO: 388427

SEQ ID NO: 519973 - RNA, 64 nt, Human; identical to SEQ ID NO: 388428

SEQ ID NO: 519974 - RNA, 61 nt, Human; identical to SEQ ID NO: 446397

SEQ ID NO: 519975 - RNA, 61 nt, Human; identical to SEQ ID NO: 446398

SEQ ID NO: 519976 - RNA, 61 nt, Human; identical to SEQ ID NO: 446399

SEQ ID NO: 519977 - RNA, 64 nt, Human; identical to SEQ ID NO: 388429

SEQ ID NO: 519978 - RNA, 64 nt, Human; identical to SEQ ID NO: 388430

SEQ ID NO: 519979 - RNA, 64 nt, Human; identical to SEQ ID NO: 388431

SEQ ID NO: 519980 - RNA, 64 nt, Human; identical to SEQ ID NO: 388435

SEQ ID NO: 519981 - RNA, 64 nt, Human; identical to SEQ ID NO: 388436

SEQ ID NO: 519982 - RNA, 64 nt, Human; identical to SEQ ID NO: 388437

SEQ ID NO: 519983 - RNA, 64 nt, Human; identical to SEQ ID NO: 388438

SEQ ID NO: 519984 - RNA, 64 nt, Human; identical to SEQ ID NO: 388439

SEQ ID NO: 519985 - RNA, 64 nt, Human; identical to SEQ ID NO: 388440

SEQ ID NO: 519986 - RNA, 64 nt, Human; identical to SEQ ID NO: 388441

SEQ ID NO: 519987 - RNA, 64 nt, Human; identical to SEQ ID NO: 388442

SEQ ID NO: 519988 - RNA, 64 nt, Human; identical to SEQ ID NO: 388443

SEQ ID NO: 519989 - RNA, 64 nt, Human; identical to SEQ ID NO: 388444

SEQ ID NO: 519990 - RNA, 64 nt, Human; identical to SEQ ID NO: 388445

SEQ ID NO: 519991 - RNA, 64 nt, Human; identical to SEQ ID NO: 388446

SEQ ID NO: 519992 - RNA, 64 nt, Human; identical to SEQ ID NO: 388447

SEQ ID NO: 519993 - RNA, 61 nt, Human
ccaacaggucugaucccugaggugaaccccagugcaacaccaaacuucaggggcacaagcg

SEQ ID NO: 519994 - RNA, 64 nt, Human
caagggcuuccugagaguucaggaaaguucucuugugcaacagcaaguagcuaagccuauagca

SEQ ID NO: 519995 - RNA, 64 nt, Human
auagagauccugcccaaugugugcuacacagcaugugcaacacucaaaguaagagucaugcacu

SEQ ID NO: 519996 - RNA, 64 nt, Human; identical to SEQ ID NO: 388448

SEQ ID NO: 519997 - RNA, 64 nt, Human; identical to SEQ ID NO: 388449

SEQ ID NO: 519998 - RNA, 64 nt, Human; identical to SEQ ID NO: 388453

SEQ ID NO: 519999 - RNA, 64 nt, Human; identical to SEQ ID NO: 388454

SEQ ID NO: 520000 - RNA, 64 nt, Human; identical to SEQ ID NO: 388455

SEQ ID NO: 520001 - RNA, 64 nt, Human; identical to SEQ ID NO: 388456

SEQ ID NO: 520002 - RNA, 64 nt, Human; identical to SEQ ID NO: 388457

SEQ ID NO: 520003 - RNA, 64 nt, Human; identical to SEQ ID NO: 388458

SEQ ID NO: 520004 - RNA, 64 nt, Human; identical to SEQ ID NO: 388459

SEQ ID NO: 520005 - RNA, 64 nt, Human; identical to SEQ ID NO: 388460

SEQ ID NO: 520006 - RNA, 64 nt, Human; identical to SEQ ID NO: 388461

SEQ ID NO: 520007 - RNA, 64 nt, Human; identical to SEQ ID NO: 388462

SEQ ID NO: 520008 - RNA, 64 nt, Human; identical to SEQ ID NO: 388463

SEQ ID NO: 520009 - RNA, 64 nt, Human; identical to SEQ ID NO: 388464

SEQ ID NO: 520010 - RNA, 57 nt, Human; identical to SEQ ID NO: 388465

SEQ ID NO: 520011 - RNA, 64 nt, Human; identical to SEQ ID NO: 388466

SEQ ID NO: 520012 - RNA, 64 nt, Human
ccgcgacccaucgcacaccugcacuccaguccuggugcaacagauggagauccuuucagggaga

SEQ ID NO: 520013 - RNA, 64 nt, Human
accuugccaagcuguacacaguugcugauacccugugcaacagcucucauuuccuggcaagcuc

SEQ ID NO: 520014 - RNA, 64 nt, Human
aaagcagucgaggagauuuguaauccacuuuuuagugcaacaagagcuccauguuaugcuugua

SEQ ID NO: 520015 - RNA, 64 nt, Human; identical to SEQ ID NO: 388467

SEQ ID NO: 520016 - RNA, 64 nt, Human; identical to SEQ ID NO: 388471

SEQ ID NO: 520017 - RNA, 64 nt, Human; identical to SEQ ID NO: 388472

SEQ ID NO: 520018 - RNA, 64 nt, Human; identical to SEQ ID NO: 388473

SEQ ID NO: 520019 - RNA, 64 nt, Human; identical to SEQ ID NO: 388474

SEQ ID NO: 520020 - RNA, 64 nt, Human; identical to SEQ ID NO: 388475

SEQ ID NO: 520021 - RNA, 64 nt, Human; identical to SEQ ID NO: 388476

SEQ ID NO: 520022 - RNA, 64 nt, Human; identical to SEQ ID NO: 388477

SEQ ID NO: 520023 - RNA, 64 nt, Human; identical to SEQ ID NO: 388478

SEQ ID NO: 520024 - RNA, 64 nt, Human; identical to SEQ ID NO: 388479

SEQ ID NO: 520025 - RNA, 64 nt, Human; identical to SEQ ID NO: 388480

SEQ ID NO: 520026 - RNA, 64 nt, Human; identical to SEQ ID NO: 388481

SEQ ID NO: 520027 - RNA, 64 nt, Human; identical to SEQ ID NO: 388482

SEQ ID NO: 520028 - RNA, 64 nt, Human; identical to SEQ ID NO: 388483

SEQ ID NO: 520029 - RNA, 64 nt, Human; identical to SEQ ID NO: 388484

SEQ ID NO: 520030 - RNA, 64 nt, Human; identical to SEQ ID NO: 388485

SEQ ID NO: 520031 - RNA, 64 nt, Human
aacuucagucuucugaguauacuucaguauacuagugcaacaagggacacaaagaaauucuguc

SEQ ID NO: 520032 - RNA, 64 nt, Human
acacuccacuguugaaacacugugccagugagaagugcaacauccagugggcagaugaaaauga

SEQ ID NO: 520033 - RNA, 64 nt, Human
ccguuuucaaauccaggaaaugcagaagaggaaugugcaacauucucugcccacucuggguccu

SEQ ID NO: 520034 - RNA, 64 nt, Human; identical to SEQ ID NO: 388489

SEQ ID NO: 520035 - RNA, 64 nt, Human; identical to SEQ ID NO: 388490

SEQ ID NO: 520036 - RNA, 64 nt, Human; identical to SEQ ID NO: 388491

SEQ ID NO: 520037 - RNA, 64 nt, Human; identical to SEQ ID NO: 388492

SEQ ID NO: 520038 - RNA, 64 nt, Human; identical to SEQ ID NO: 388493

SEQ ID NO: 520039 - RNA, 64 nt, Human; identical to SEQ ID NO: 388494

SEQ ID NO: 520040 - RNA, 64 nt, Human; identical to SEQ ID NO: 388495

SEQ ID NO: 520041 - RNA, 64 nt, Human; identical to SEQ ID NO: 388496

SEQ ID NO: 520042 - RNA, 64 nt, Human; identical to SEQ ID NO: 388497

SEQ ID NO: 520043 - RNA, 64 nt, Human; identical to SEQ ID NO: 388498

SEQ ID NO: 520044 - RNA, 64 nt, Human; identical to SEQ ID NO: 388499

SEQ ID NO: 520045 - RNA, 64 nt, Human; identical to SEQ ID NO: 388500

SEQ ID NO: 520046 - RNA, 64 nt, Human; identical to SEQ ID NO: 388501

SEQ ID NO: 520047 - RNA, 64 nt, Human; identical to SEQ ID NO: 388502

SEQ ID NO: 520048 - RNA, 64 nt, Human; identical to SEQ ID NO: 388503

SEQ ID NO: 520049 - RNA, 64 nt, Human; identical to SEQ ID NO: 388505

SEQ ID NO: 520050 - RNA, 64 nt, Human
uucauuuuuuucugccucuuacuauacgacuguagugcaacaaauauuuuaaagcccccuuuuc

SEQ ID NO: 520051 - RNA, 64 nt, Human
gaccccgggaccagaugucccuccccucaugagcgugcaacagggagcagccccagccagcccc

SEQ ID NO: 520052 - RNA, 64 nt, Human
uagguuuacuuucacuuguuauuugacuuagcaggugcaacaaaaacaagaaacaaaugugccc

SEQ ID NO: 520053 - RNA, 64 nt, Human; identical to SEQ ID NO: 388506

SEQ ID NO: 520054 - RNA, 64 nt, Human; identical to SEQ ID NO: 388507

SEQ ID NO: 520055 - RNA, 64 nt, Human; identical to SEQ ID NO: 388508

SEQ ID NO: 520056 - RNA, 64 nt, Human; identical to SEQ ID NO: 388509

SEQ ID NO: 520057 - RNA, 59 nt, Human; identical to SEQ ID NO: 388510

SEQ ID NO: 520058 - RNA, 64 nt, Human; identical to SEQ ID NO: 388511

SEQ ID NO: 520059 - RNA, 64 nt, Human; identical to SEQ ID NO: 388512

SEQ ID NO: 520060 - RNA, 64 nt, Human; identical to SEQ ID NO: 388513

SEQ ID NO: 520061 - RNA, 64 nt, Human; identical to SEQ ID NO: 388514

SEQ ID NO: 520062 - RNA, 64 nt, Human; identical to SEQ ID NO: 388515

SEQ ID NO: 520063 - RNA, 64 nt, Human; identical to SEQ ID NO: 388516

SEQ ID NO: 520064 - RNA, 64 nt, Human; identical to SEQ ID NO: 388517

SEQ ID NO: 520065 - RNA, 64 nt, Human; identical to SEQ ID NO: 388518

SEQ ID NO: 520066 - RNA, 64 nt, Human; identical to SEQ ID NO: 388519

SEQ ID NO: 520067 - RNA, 64 nt, Human; identical to SEQ ID NO: 388523

SEQ ID NO: 520068 - RNA, 64 nt, Human; identical to SEQ ID NO: 388524

SEQ ID NO: 520069 - RNA, 61 nt, Human; identical to SEQ ID NO: 446400

SEQ ID NO: 520070 - RNA, 61 nt, Human; identical to SEQ ID NO: 446401

SEQ ID NO: 520071 - RNA, 61 nt, Human; identical to SEQ ID NO: 446402

SEQ ID NO: 520072 - RNA, 64 nt, Human; identical to SEQ ID NO: 388525

SEQ ID NO: 520073 - RNA, 64 nt, Human; identical to SEQ ID NO: 388526

SEQ ID NO: 520074 - RNA, 64 nt, Human; identical to SEQ ID NO: 388527

SEQ ID NO: 520075 - RNA, 64 nt, Human; identical to SEQ ID NO: 388528

SEQ ID NO: 520076 - RNA, 58 nt, Human; identical to SEQ ID NO: 388529

SEQ ID NO: 520077 - RNA, 64 nt, Human; identical to SEQ ID NO: 388530

SEQ ID NO: 520078 - RNA, 64 nt, Human; identical to SEQ ID NO: 388531

SEQ ID NO: 520079 - RNA, 64 nt, Human; identical to SEQ ID NO: 388532

SEQ ID NO: 520080 - RNA, 64 nt, Human; identical to SEQ ID NO: 388533

SEQ ID NO: 520081 - RNA, 64 nt, Human; identical to SEQ ID NO: 388534

SEQ ID NO: 520082 - RNA, 64 nt, Human
cuaaauaccugauuuaaaaauagaagacauccccaguccucaugacauaccgcaaauaucugug

SEQ ID NO: 520083 - RNA, 64 nt, Human
gagauguuguguuuacguuacacuaaaaccacaugugcaacaaauaccuccauuaaauggucua

SEQ ID NO: 520084 - RNA, 64 nt, Human
uaaaucuuuuauguauucuaacuuuaaaagacaagugcaacaaaguuagacugacuucuauaug

SEQ ID NO: 520085 - RNA, 64 nt, Human
ugugagccaagaucgcaccauugcacuccagccugugcaacaagcgaaacuccgucucaaaaaa

SEQ ID NO: 520086 - RNA, 64 nt, Human
gcugauuccaguagaauuagcagcccucaaugcugugcaacaagacaucagaacuuauuccucu

SEQ ID NO: 520087 - RNA, 64 nt, Human
cucucuuccuucuccucuucagcuuuuuaaaaacaguccucagaggauccaugauccccagcac

SEQ ID NO: 520088 - RNA, 64 nt, Human
agagaggauucagacgcucugggagccaguuccuaguccucaacuccagccaccugccccagcu

SEQ ID NO: 520089 - RNA, 64 nt, Human
aucaugugcuauguucuaagaauuugagaacuagaguccucauccccaggcuugaaggcacaug

SEQ ID NO: 520090 - RNA, 64 nt, Human
gcguguugauuuggaggcacugcaguccaggccgaguccucagugcggggagcaggcugcugcu

SEQ ID NO: 520091 - RNA, 64 nt, Human
uaaugaaagugacaaauuuuaaauuuucucuaauaguccucaucauaaacuuuuuaaaggaaaa

SEQ ID NO: 520092 - RNA, 64 nt, Human
aagacgcccucucguccaacuaugcccaggcugaaguccucacccucucuuaaagcggcaccaa

SEQ ID NO: 520093 - RNA, 64 nt, Human
gacccuccagcuuuuucuuagcugaugaaauaugaguccucagcuugguucccagccugcugau

SEQ ID NO: 520094 - RNA, 64 nt, Human
agccagaggcucuguaaaaucagaccauaguggaaguccucagcccccuggccccuuccgcaau

SEQ ID NO: 520095 - RNA, 64 nt, Human
uguacuuaauaacacuucaccuucuguaauacuaaguccucagagcuccaugcuguucugaaag

SEQ ID NO: 520096 - RNA, 64 nt, Human
ccuacugcuggccucuucaguggccacaauccucaguccucaccugcugguuuggagacucaug

SEQ ID NO: 520097 - RNA, 64 nt, Human
ucccaccagcccacauccaguggggucucaguccaguccucacaugcccgcugucccagggguc

SEQ ID NO: 520098 - RNA, 64 nt, Human
ucuuccucucaaaggcugaaggcagggccuuuccaguccucacaaccuguccuucaccuagucc

SEQ ID NO: 520099 - RNA, 64 nt, Human
gagcuaagcagucgugguaugggggcgacuggggaguccucauugaauccucauuuuauaccca

SEQ ID NO: 520100 - RNA, 64 nt, Human
uauccagaaauaaaacaacucugauguggaaugcaguccucaucuccagccuccccaccccagu

SEQ ID NO: 520101 - RNA, 64 nt, Human
gugggaucuggggagagcggcuggagaaagaugcaguccucaggaagggggccgccacccuccc

SEQ ID NO: 520102 - RNA, 64 nt, Human
uguucuccugucuuccuaucuuuaucauuuggcaaguccucagcuucugucagugucuuagggc

SEQ ID NO: 520103 - RNA, 64 nt, Human
caugcagaaaaguuucuaaucucagaucggggaugugcaacaaauuccauuucaaaggaaugac

SEQ ID NO: 520104 - RNA, 64 nt, Human
auuuucuaaaaugaguaggaaguuggauuuuuaugugcaacaguuucuuuuaaugcuuuguuga

SEQ ID NO: 520105 - RNA, 64 nt, Human
uuuuuauugucuuccagaacuuuccauuugcagugugcaacagaaaaaaaaaaaugaaguaaug

SEQ ID NO: 520106 - RNA, 64 nt, Human
uaaccagcccuuuuuuuucugaaggcuuguuuuuaguccucauuguacaaaauauaaaauaauc

SEQ ID NO: 520107 - RNA, 64 nt, Human
uaaacagaacagcuuucaccaaaguggguaguauaguccucaaauaucggauaaauauaugcgu

SEQ ID NO: 520108 - RNA, 64 nt, Human
ucugucugagcugccuucucuaucauucagcuugaguccucaagacuacuggucacaaugaguc

SEQ ID NO: 520109 - RNA, 60 nt, Human
agaaaauugucauuaaaugaagagaugucuaguccucagaaacuucuuuccugcccugau

SEQ ID NO: 520110 - RNA, 64 nt, Human
uacugccacuguccagguggagcuaagaaaaggaaguccucagcugugccagcucccagagcuu

SEQ ID NO: 520111 - RNA, 64 nt, Human
ucuccucuucaggcuacaggguugucaccugcugaguccucagguuguuuggccucucuggucc

SEQ ID NO: 520112 - RNA, 64 nt, Human
auccaucugaaaaacucagcuaccuuuaguuuuuaguccucauuuuuggucuugucucugcgga

SEQ ID NO: 520113 - RNA, 64 nt, Human
gggcugcuauuuucuuguuuucucuaguuucucaaguccucagaacaguuucaaaucaagaaaa

SEQ ID NO: 520114 - RNA, 60 nt, Human
agacccugaccgcccugugagggcucagccaguccucaugcugccuacagagugccuggc

SEQ ID NO: 520115 - RNA, 64 nt, Human
aucaagaauuagagugcccuggaggucacucacaaguccucauggagacucugccgugaccucg

SEQ ID NO: 520116 - RNA, 64 nt, Human
gccucccuucccuuugaaaaucuaagaagcucccaguccucagagacccugcugguacccagac

SEQ ID NO: 520117 - RNA, 64 nt, Human
uuguacaugugacaauugccuuaaaaccuagcacaguccucagaaaugaauaccguguuuccac

SEQ ID NO: 520118 - RNA, 64 nt, Human
agacacaggggcagaaaaugacauucaucuuuugaguccucauccauggagugcuguguuuggg

SEQ ID NO: 520119 - RNA, 64 nt, Human
aaucaugugcuuauuaacauauuggaaaugcuucaguccucacaugauaauacacuaacauuuu

SEQ ID NO: 520120 - RNA, 64 nt, Human
gcacaacacacuuuggucauuucucaaaaaccacaguccucaccacaguuuauugauuucaaau

SEQ ID NO: 520121 - RNA, 64 nt, Human
aauuaauuuucagcauugggcacugaauuaggacaguccucaucucauugcuuggcccuucaag

SEQ ID NO: 520122 - RNA, 64 nt, Human
cgcuucccuucacauuagaaaacaagaucagccugugcaacauggugaaaccucaucucuacca

SEQ ID NO: 520123 - RNA, 64 nt, Human
accauugguuaaucuggacuuauuuuuggacuuagugcaacagguugaggcuaaaacaaaucuc

SEQ ID NO: 520124 - RNA, 64 nt, Human
ucugagcaacuugcucugaccuauaaugucuuaggugcaacacggaccccaccagagcucuugg

SEQ ID NO: 520125 - RNA, 64 nt, Human
agcugaggccuggggaugugaacaaccugcucacaguccucauuuacuggauuugacuucagcc

SEQ ID NO: 520126 - RNA, 64 nt, Human
gcaugggcuucagaaguaucugcacaauuagaaaaguccucagaagcuuuuucuuggaggguac

SEQ ID NO: 520127 - RNA, 64 nt, Human
ggagggggcacuccucuccagccccugguaccacaguccucacgauggugcagugauuucuagc

SEQ ID NO: 520128 - RNA, 64 nt, Human
ugacuguggcuucaaggacaucagggccaccccaaguccucaguguccuacuccuggcaaggag

SEQ ID NO: 520129 - RNA, 64 nt, Human
gaugguugcaauugauccuuaaccaauaauggucaguccucaucucugucgugcuucauaggug

SEQ ID NO: 520130 - RNA, 64 nt, Human
cccaucccaggaagaagggccaucucaggacaugaguccucaggggcccugcacauucaaucug

SEQ ID NO: 520131 - RNA, 56 nt, Human
ccuggucugugagggucuaaagagagaguccucagcagagucuucuugugcugccu

SEQ ID NO: 520132 - RNA, 64 nt, Human
accgugggauaccagauucgguuagaaagugucaaguccucagccaccagacuguuauacugca

SEQ ID NO: 520133 - RNA, 64 nt, Human
aguaugcacaaagaauuaauuagcauuauuaaagaguccucacuaaacauuucauaugaucaca

SEQ ID NO: 520134 - RNA, 64 nt, Human
aucuuccuacagagucuaggcuggccgucguugaaguccucaccaguacuacaccacuuuuccu

SEQ ID NO: 520135 - RNA, 60 nt, Human
caccaugcuauuaugcauagaaagaugacuaguccucacuucaggcucuuuucaucaaaa

SEQ ID NO: 520136 - RNA, 64 nt, Human
ucccaagcuggagccacccagggcugggucugggaguccucaguguccacuugucccagguuag

SEQ ID NO: 520137 - RNA, 64 nt, Human
uaagauauuuucuucuugaagagacuuuucgauuaguccucauauauuuaucuacuaaaauaga

SEQ ID NO: 520138 - RNA, 64 nt, Human
uaagaugcagagaauucuuuauuugucauaagccaguccucaaaagaguuccuaacaguaguga

SEQ ID NO: 520139 - RNA, 64 nt, Human
caaagcugauguucaggccccacccacucccuacaguccucagaccaaggagggguuuggguag

SEQ ID NO: 520140 - RNA, 64 nt, Human
aaagaagcgaccgguuucucccucgcccucugaaaguccucaugccuggcagucggaggagagc

SEQ ID NO: 520141 - RNA, 64 nt, Human
uacaauaaagaguuuauuauuauuuguaaguugugugcaacaaacauacccuuuaucucuguaa

SEQ ID NO: 520142 - RNA, 64 nt, Human
gauccguggcggccuuuaucuucaaggagugugggugcaacagcuacagucucauugaugggag

SEQ ID NO: 520143 - RNA, 64 nt, Human
aucaaggagggagaaaggcaaaccaauuuguucugugcaacaaacucaaaauguggaccaguuc

SEQ ID NO: 520144 - RNA, 64 nt, Human
uacuuccauaacuaacucaccaaaucaaaucaucaguccucauauucuuguuuuauuuaauaca

SEQ ID NO: 520145 - RNA, 59 nt, Human
ucgaugcccucggggccugagaagaucugaguccucaaucccaagccaccugcacaccu

SEQ ID NO: 520146 - RNA, 64 nt, Human
acauuucaggucagcaaaauuagaagucauuucuaguccucaaagcagaaauaauuagaaaugu

SEQ ID NO: 520147 - RNA, 64 nt, Human
ccuuucaacaacaguuaagccaaaagguacagugaguccucacuuaaggucuucgauagguucu

SEQ ID NO: 520148 - RNA, 64 nt, Human
cuuauuaaaggaggggucccuccucccccagagcaguccucaacacuaugucagugcuggaaau

SEQ ID NO: 520149 - RNA, 64 nt, Human
ucuagaggaagcucaagaucaaggacugcgucaaaguccucaucacauucucgaaguagaucaa

SEQ ID NO: 520150 - RNA, 64 nt, Human
uggugugggggugcaguguggaggaaggcacgugaguccucacuccuggccuuggauaccaugg

SEQ ID NO: 520151 - RNA, 64 nt, Human
cccuugcaugggcaguggcuuuuauaggagcauuaguccucauucgcugaacccuguuguuuag

SEQ ID NO: 520152 - RNA, 64 nt, Human
ggaacuuggccauuagguuauuauuugagaggaaaguccucacaucaauaguacauaugaaagu

SEQ ID NO: 520153 - RNA, 64 nt, Human
uaaaaaaaggaaaagaaaaugugaaacacaauuuaguccucauuauuuauuuguagauccugca

SEQ ID NO: 520154 - RNA, 64 nt, Human
ggcugaacccccacucacacaagcacacacacacaguccucacacacggaggccagacacaggc

SEQ ID NO: 520155 - RNA, 64 nt, Human
cacucagcugcuucggaaagcgugacgaagcaguaguccucaguguguguguaagugaagagga

SEQ ID NO: 520156 - RNA, 64 nt, Human
cucucaccacaaggacaaaguauggauguggcagaguccucaugaaagauguauccaaacaaga

SEQ ID NO: 520157 - RNA, 64 nt, Human
agccacucuugaaaucacaaguccaaccacagagaguccucacucuuacacgaguacugcagug

SEQ ID NO: 520158 - RNA, 64 nt, Human
gguugaaaauuccaaguaacugggagagugggcaaguccucagcugaacaaucuuggauguagu

SEQ ID NO: 520159 - RNA, 64 nt, Human
gccugaugacccuacaggucgugcuaugauauggaguccucauggguaaagcaggaagagagug

SEQ ID NO: 520160 - RNA, 64 nt, Human
cacagcgagaaaacuucguaagaacauguuacgugugcaacagguaaacagaaauccuuucaua

SEQ ID NO: 520161 - RNA, 64 nt, Human
ugauagagaagagucccccaugacaggaguuugugugcaacagaguccuguagcuagcucguga

SEQ ID NO: 520162 - RNA, 64 nt, Human
aggccgcccugcgggugaacaaagcagccacgaggugcaacaagguccucugucagucacagcc

SEQ ID NO: 520163 - RNA, 64 nt, Human
aggcuacccagucgaguccucuuguggagcccacaguccucauggagcuaacuucucaaauguu

SEQ ID NO: 520164 - RNA, 64 nt, Human
ccuuuuuguauuuuuaaacaagaaagaaaaccccaguccucauuugccuucccuaccucuuccu

SEQ ID NO: 520165 - RNA, 64 nt, Human
ccucagaaacaaacuaacagcacacguuaggaggaguccucaucagcuguucucauugccagug

SEQ ID NO: 520166 - RNA, 64 nt, Human
auaaaauccaucccguguuugccacacgcccuccaguccucaguucccacugccuaacgucugc

SEQ ID NO: 520167 - RNA, 64 nt, Human
uuuaagaagacuauccuuaccuuuuaguuucagcaguccucaccaccaccauauccccagugcu

SEQ ID NO: 520168 - RNA, 64 nt, Human
gaacgugccaguaccucaccgcacgaccucacugaguccucacaacaaauccaggcugcagauu

SEQ ID NO: 520169 - RNA, 64 nt, Human
auauuugaacaauuugaauauaaauucaucauuuaguccucaaaauauauauagcauugcuaag

SEQ ID NO: 520170 - RNA, 64 nt, Human
acagcuagccagggccacgggggcccagcacgagaguccucaugggcacucacagacugcgugc

SEQ ID NO: 520171 - RNA, 64 nt, Human
acauguuaaaaaaaaaaauuauaagacauggacuaguccucauuagcauguuugcauagcaacc

SEQ ID NO: 520172 - RNA, 64 nt, Human
cuccaucauuguuauuuuaacgauaguaauucacaguccucagaagccuauuuuuaaagcagaa

SEQ ID NO: 520173 - RNA, 64 nt, Human
ccucuauaaggcguuauuacauuuaugagaauggaguccucaugaccuaaucgugaccuuaaag

SEQ ID NO: 520174 - RNA, 64 nt, Human
ugucuccuuggcagcaggaugcuggcaucuguguaguccucauacuguuuacugauaacccaca

SEQ ID NO: 520175 - RNA, 64 nt, Human
ccacauggcaagaaaaacaaagugacaauuguagaguccucaauuguguuuacauuaauagugg

SEQ ID NO: 520176 - RNA, 64 nt, Human
cuuucuaguuugguaggaaucacccugaagaccuaguccucaauuuaauuguguggguuuuuaa

SEQ ID NO: 520177 - RNA, 64 nt, Human
cauuguuauuaauacuaauuguucuuucugguuuaguccucauugccacuuuuguccuuauguu

SEQ ID NO: 520178 - RNA, 64 nt, Human
uugaaaccuagacacaaggucaaauugcuggaagaguccucagagguccaccucuuacccuaca

SEQ ID NO: 520179 - RNA, 64 nt, Human
ggaaauuauaguucaauuauuuuaaugugauagagugcaacaagucauuguagaacuuuucacc

SEQ ID NO: 520180 - RNA, 64 nt, Human
aaaauaaauaaggaaaagcuuagcuuuagaaacagugcaacacuggucugcuguuccaguggua

SEQ ID NO: 520181 - RNA, 64 nt, Human
ugguuucugagggguucugaaaguaugauucaaugugcaacauacagguaggucuucagcauaa

SEQ ID NO: 520182 - RNA, 64 nt, Human
ugccagcagcacgucgccauccgucaccagaauuaguccucacagccuaggaccaguuuuguau

SEQ ID NO: 520183 - RNA, 64 nt, Human
acaguaauuuuaagcucaguguuuccaaacgucaaguccucaucuguuauauaaaauccuuucu

SEQ ID NO: 520184 - RNA, 64 nt, Human
cuuuggacaaguccuugaccucuauaaacuucagaguccucauuauaaaaugggaagacugagc

SEQ ID NO: 520185 - RNA, 64 nt, Human
ggaaagcaaucggaaaauugcaguuuuggucuguaguccucaugauaucugcuaucagugggga

SEQ ID NO: 520186 - RNA, 64 nt, Human
agaccugcuaacgcauuagcauuagcagcaccuaaguccucauugaauguucugguucaaggcu

SEQ ID NO: 520187 - RNA, 64 nt, Human
uuuugguagcaauuauaugguuacuauccacugcaguccucaguuguugggguaaaucccacau

SEQ ID NO: 520188 - RNA, 64 nt, Human
augagucuuuucaucaugccacauuaucugauccaguccucacauuuuuaaauauaaaacuaaa

SEQ ID NO: 520189 - RNA, 64 nt, Human
gcuccaagugucacacaccagaacauuaagccuaaguccucaauucauaaguuaucauucuaga

SEQ ID NO: 520190 - RNA, 64 nt, Human
uauuuaaaauguuuaauuaccguuuagaaauucuaguccucaauaaguggguggcucaugcuau

SEQ ID NO: 520191 - RNA, 64 nt, Human
cuaaggguuaugaccuccagauccuuacugguccaguccucauucccuccaccccaucuccacu

SEQ ID NO: 520192 - RNA, 64 nt, Human
auugaaauuaaaauucagcuuuagcuuccauggcaguccucacccccaccucucuaaaagacac

SEQ ID NO: 520193 - RNA, 64 nt, Human
uuacuaauuacaaauguugaggccuaauucugaaaguccucauauuuaaaggcuagacaacgua

SEQ ID NO: 520194 - RNA, 64 nt, Human
ccugauugaugaucacagucuucaguggugagucaguccucaccaaguuuuccagaucauuccu

SEQ ID NO: 520195 - RNA, 64 nt, Human
ugcuauuccagaacccagccuccuggguuuccccaguccucauuuuuccucccaauacccaccc

SEQ ID NO: 520196 - RNA, 64 nt, Human
gcuguagucccaaucaaucaaaggcuaccaacugaguccucagguucauuucuuuuuuuuuuuu

SEQ ID NO: 520197 - RNA, 64 nt, Human
auccccugcagaugccaaaauacauggaugcccaaguccucagcuaaaaauagcguaguauuug

SEQ ID NO: 520198 - RNA, 61 nt, Human; identical to SEQ ID NO: 446404

SEQ ID NO: 520199 - RNA, 61 nt, Human; identical to SEQ ID NO: 446405

SEQ ID NO: 520200 - RNA, 61 nt, Human; identical to SEQ ID NO: 446409

SEQ ID NO: 520201 - RNA, 64 nt, Human
acuuggaauccugaccauguccaucccaaaauucaguccucaguuaacggaucauguuugcaaa

SEQ ID NO: 520202 - RNA, 64 nt, Human
gaccaguauaaaauuacaguggauugcucaucucaguccucaaagcuuuuugaaaaccaacacc

SEQ ID NO: 520203 - RNA, 64 nt, Human
cagggcgguaccuugugcccaggguuuugccccaaguccucauuuaaaagcauaaggccggacg

SEQ ID NO: 520204 - RNA, 64 nt, Human
auauaucgaaccacuuaggcauguuacgggguaaaguccucaccccugcauuugagaaauauuu

SEQ ID NO: 520205 - RNA, 64 nt, Human
cacaucaccuucccugggaacuggacagggugaaaguccucaaacucugggaacaggcgagaug

SEQ ID NO: 520206 - RNA, 64 nt, Human
aguaagcaguuuauucugagccccggggguagacaguccucagugagggguuuuggggaguuug

SEQ ID NO: 520207 - RNA, 64 nt, Human
auggugcugacugguuuucuguauauugcacaacaguccucaaauacacugauguaugaaacua

SEQ ID NO: 520208 - RNA, 64 nt, Human
uuauccagugguuaaaaaaggauucugccucuuuaguccucacuguuaaauaaaacccaaucau

SEQ ID NO: 520209 - RNA, 64 nt, Human
cgaagaaucaagugauuucuugccauccuugcguaguccucaagucuucuaaucaucuaugugu

SEQ ID NO: 520210 - RNA, 64 nt, Human
uacaaaugagaagaauguggcaaugccuuuaaucaguccucacaccuuucuacacauaagauaa

SEQ ID NO: 520211 - RNA, 64 nt, Human
uacaaaugugaagaauguggcaaagcuuuuaaccaguccucacaccuuaugagacauaagaaaa

SEQ ID NO: 520212 - RNA, 64 nt, Human
uacaaaugugaacaguguggcaaggucuuuaagaaguccucaacucuuacugcacauaagauca

SEQ ID NO: 520213 - RNA, 64 nt, Human
ucagucauagcucagaucuuauccugcaacaagaaguccucaccagacagaaagccuuugauug

SEQ ID NO: 520214 - RNA, 64 nt, Human
uccuggccuucggacucugaaucugggcaggaagaguccucagucccaagaccaggagggggca

SEQ ID NO: 520215 - RNA, 64 nt, Human
uuuggagguuugugggcuuuuuuuaaaaaaaaaaaguccucaaaucaggaagaaacaucaaaga

SEQ ID NO: 520216 - RNA, 64 nt, Human
ggacugaccagcuagcuaggagagcugagacgccaguccucaaauggcguucuuaccaauaguc

SEQ ID NO: 520217 - RNA, 64 nt, Human
gcaucaacugggccacgucggccuucagagaacagugcaacaaaugccagcauugccauucggg

SEQ ID NO: 520218 - RNA, 64 nt, Human
uguauuauuauauauguauaucuguguaagacacgugcaacagacugccuuauauuauuuucug

SEQ ID NO: 520219 - RNA, 61 nt, Human; identical to SEQ ID NO: 446410

SEQ ID NO: 520220 - RNA, 64 nt, Human
cuccuaaaagaaauacucaggaauugucucauaaaguccucaccuacuggcaaaaacaagaugu

SEQ ID NO: 520221 - RNA, 64 nt, Human
uucuugaugcgggucaacauuuccaaaaguggcuaguccucacuucuagaucucagccauucua

SEQ ID NO: 520222 - RNA, 64 nt, Human
ccgaaagcuauauuguacuguguauuuuuacuuuaguccucauaaucauguugaauuuauguga

SEQ ID NO: 520223 - RNA, 64 nt, Human
aaaugccgagugguagaaacuccucuuucuucauaguccucaggcuuugguuacauuugcauau

SEQ ID NO: 520224 - RNA, 64 nt, Human
ugguguagaacucucaaugacaugaauggaggguaguccucaguaaauuacucauuccuuaguc

SEQ ID NO: 520225 - RNA, 64 nt, Human
caauacugaucaacugaaaguaaaguauccauggaguccucauugacaccucuuuucugcacaa

SEQ ID NO: 520226 - RNA, 64 nt, Human
uuacaaaaauaucccacucaaugccaaaucuuucaguccucaaaggcauuuaaguccaauaguc

SEQ ID NO: 520227 - RNA, 64 nt, Human
ccucagcuuuaauggguguggccccuuuaggguuaguccucagacuaaugauagugucugcuuu

SEQ ID NO: 520228 - RNA, 64 nt, Human
cagucaaaaauacauuuauaaauuauuuaaugccaguccucauguaaccucagguaucuucagc

SEQ ID NO: 520229 - RNA, 64 nt, Human
gauacccaccacacaccugggggcccccacacccaguccucacccuuaacuucugccaugggaa

SEQ ID NO: 520230 - RNA, 64 nt, Human
gucauuucaaaauguauugauaucuauaaggaauaguccucaauguugggaaaacagaugagca

SEQ ID NO: 520231 - RNA, 64 nt, Human
cgcccagccaggugagagcaugagcacuucccugaguccucaccagcccuccccauuuguccuc

SEQ ID NO: 520232 - RNA, 64 nt, Human
auuugucuuccucaccagccagguccucaggcaaaguccucagccagugcuuuagagcaacuuc

SEQ ID NO: 520233 - RNA, 64 nt, Human
gaagcaucugauaauaggaaaagaaaaggacaaaaguccucaacuugugagcaauaugcuuucc

SEQ ID NO: 520234 - RNA, 64 nt, Human
cacccauggcaggcggagggucccagaggggcugaguccucaaauccggcugaggcagcagcug

SEQ ID NO: 520235 - RNA, 64 nt, Human
gcugcuggcuuaacagcaggcaucugggcaggccaguccucaaagcagcuccugaaggucugug

SEQ ID NO: 520236 - RNA, 64 nt, Human
uucagagcuccaggccuggaagcagugccucuuggugcaacaagaaacuucucccucacccccu

SEQ ID NO: 520237 - RNA, 64 nt, Human
aagagcaaaacugcacaaacuugcacauuggaaagugcaacaaguucccgugauugcaguaaaa

SEQ ID NO: 520238 - RNA, 64 nt, Human
aaucagcaaggguauuuuagcuaauagaauaaaagugcaacagaagaauuugauuagucuauga

SEQ ID NO: 520239 - RNA, 64 nt, Human
guccgcaugguggcaccgugaggcagucucagcaaguccucaugcuguucuuggucuuccacaa

SEQ ID NO: 520240 - RNA, 64 nt, Human
cggcccagcacagcaagcagcaggaccgcugcccaguccucaggcccggaggggcaggccuagc

SEQ ID NO: 520241 - RNA, 64 nt, Human
gaggcuggagcggggaggcgaggagggggcugugaguccucagaggcccugggccaccacauuu

SEQ ID NO: 520242 - RNA, 64 nt, Human
aaguucacugucacgggggaaggagccaccagccaguccucagauuucagagacugcggagggg

SEQ ID NO: 520243 - RNA, 64 nt, Human
guaauaggaagggucuaaagaaaauuauuugcugaguccucauaaucaauuggcuauaaucaca

SEQ ID NO: 520244 - RNA, 64 nt, Human
cagcaugccaguguggagagcgccucuucccaccaguccucagccaccuucuccacggcagcga

SEQ ID NO: 520245 - RNA, 64 nt, Human
cuugggaccucaagcccccaacaucccaguccucaguccucagucaucuugguagguauacauu

SEQ ID NO: 520246 - RNA, 64 nt, Human
acuacuucuugggaccucaagcccccaacaucccaguccucaguccucagucaucuugguaggu

SEQ ID NO: 520247 - RNA, 64 nt, Human
cuucucacuccucaaagcccccucaggagcacccaguccucagcugcucucuuagguggggguc

SEQ ID NO: 520248 - RNA, 64 nt, Human
gcuucuuagcaguuccuggucugaacccucucccaguccucaucuuccacccuaaaacuagagu

SEQ ID NO: 520249 - RNA, 64 nt, Human
gcacuggccugggagucagacagaccuggguucaaguccucaguccccugcccacucccuacgu

SEQ ID NO: 520250 - RNA, 64 nt, Human
aaaaauuuuuuuugcuauaaggcuuugaucauauaguccucauagcaacauaacuaccaucuag

SEQ ID NO: 520251 - RNA, 64 nt, Human
gaagccuuuucccuaguggaacauucagugcagaaguccucacacacuaacagaucuccaccau

SEQ ID NO: 520252 - RNA, 64 nt, Human
gcggggaagcgaggguccaauccugcccugcgcuaguccucaucugagucucagccuggguccc

SEQ ID NO: 520253 - RNA, 64 nt, Human
ucaucuuggccuuggggaguugccuuuaggcuugaguccucaagccucuccuuuucguccauaa

SEQ ID NO: 520254 - RNA, 64 nt, Human
guagaaaacacuuccuccucuccugagucugugaaguccucagugguccuuuuuggauucuagg

SEQ ID NO: 520255 - RNA, 64 nt, Human
cuuggaucugaacaauacacaccaggacaauugugugcaacaguucuacaaacugauauuucua

SEQ ID NO: 520256 - RNA, 64 nt, Human
uuuaucugugcaugaaagggucacuucuguaauagugcaacagauuugguauuaaaaauuaaau

SEQ ID NO: 520257 - RNA, 64 nt, Human
gaguguguuuauucuucucuacuugauuuccaaagugcaacauuuuccgaugcuuuagaaauca

SEQ ID NO: 520258 - RNA, 64 nt, Human
agucucgccagcgcccacccccauggcucgggucaguccucaucgcucccccuccccaccccgc

SEQ ID NO: 520259 - RNA, 64 nt, Human
gagccaggcggaggacucguuccuugcagaggucaguccucaccugcaggugucgggguguggg

SEQ ID NO: 520260 - RNA, 64 nt, Human
uuuaaucuaaauuagagaauugugauacaauggcaguccucaaaggcguaacgaguucaucuuu

SEQ ID NO: 520261 - RNA, 64 nt, Human
uaaacacugcaaaggagagccacuuggugucugcaguccucauauuaacagucugucacagaau

SEQ ID NO: 520262 - RNA, 64 nt, Human
ggucucccuggaauggaaguccccuggcauggucaguccucaggcccaagacucaagugugcac

SEQ ID NO: 520263 - RNA, 64 nt, Human
ugauggggaaggcuggcacccaccaagaaguggaaguccucagaaauucucggcacacccuaga

SEQ ID NO: 520264 - RNA, 64 nt, Human
cauuuucauuguugucuccuuccuuuucugugaaaguccucauacugagaaauuuguauauuuu

SEQ ID NO: 520265 - RNA, 64 nt, Human
auuaauaagcaauuauagcaggguuguagaauguaguccucagguauaugauaaaaaagaauua

SEQ ID NO: 520266 - RNA, 64 nt, Human
ucuuaagaaaaauaggauuaagcuauucuguuccaguccucagagaaauaaucacuuucuuaaa

SEQ ID NO: 520267 - RNA, 64 nt, Human
ucuugcacaguuguucaaaaaagagacaaguuucaguccucaaugcuguccuuuguuuuacagg

SEQ ID NO: 520268 - RNA, 64 nt, Human
cacaugguugaagagugacguggggcuaggugagaguccucagcccaagggaaaugaccucaac

SEQ ID NO: 520269 - RNA, 64 nt, Human
aggaccacaccggccacuggaggagggcaggagcaguccucacucugaauggcugcagaguuaa

SEQ ID NO: 520270 - RNA, 64 nt, Human
aaaucaaaagaggcucacucaaaccagcacagggaguccucagaguugcaguucaauucauuuu

SEQ ID NO: 520271 - RNA, 64 nt, Human
aagauuuaauuauuuuucuacuuggggggaaaaaaguccucauguagaagcacccacuuuugca

SEQ ID NO: 520272 - RNA, 64 nt, Human
acuauuagaauugcauaaugugagauauuuuguuaguccucaaaaggaauaucuugcaguguuu

SEQ ID NO: 520273 - RNA, 64 nt, Human
augccaccgcgagaugguccccgagcuccccgagaguccucagugaaaggauuccgcggcacug

SEQ ID NO: 520274 - RNA, 64 nt, Human
uguacaguucaucaguguuaacuguauucaccuugugcaacagaucucaaggacuuuuucaccu

SEQ ID NO: 520275 - RNA, 64 nt, Human
agugagcugagauugcaccauugcacuccagccugugcaacaagagugaaacuccauuucaaga

SEQ ID NO: 520276 - RNA, 64 nt, Human
aguuaggaaacgacgcugagaggaugacgacaacgugcaacagcagaaagaugcuugcaagcag

SEQ ID NO: 520277 - RNA, 64 nt, Human
gggggagggcagccuucaaacguguggggucuacaguccucaggucuaggcagggcugccgguu

SEQ ID NO: 520278 - RNA, 64 nt, Human
agcuggagccgugaacacugggguccccuggcagaguccucaugacccauccuggucucucugu

SEQ ID NO: 520279 - RNA, 64 nt, Human
agagauaguaaacugcagcaaguaacuauguguaaguccucaucaaaugaaaagcagaaagaca

SEQ ID NO: 520280 - RNA, 64 nt, Human
ucucacaguuuuuccccaggaagucuggagaaaaaguccucaugucaccaauuucucuguugca

SEQ ID NO: 520281 - RNA, 64 nt, Human
uaucagaaaaauccuguuauccuguguauuuacuaguccucaugaucuagacuuaaccccuuuu

SEQ ID NO: 520282 - RNA, 64 nt, Human
cauaggccacucuuuccuuucccucugcccaccaaguccucauaucugcagagaacccauugau

SEQ ID NO: 520283 - RNA, 64 nt, Human
ugccuccuccaugcccaaggaacacccauggugcaguccucaggcaaggccaggacggggcuga

SEQ ID NO: 520284 - RNA, 64 nt, Human
cugugucaucuuuucaccccaccuucaaucaacaaguccucaaucaacaaguccuacugacugc

SEQ ID NO: 520285 - RNA, 64 nt, Human
uccuuaacuugaaaacaucuuucugagauuucagaguccucaaauuucuuagauuaagagacaa

SEQ ID NO: 520286 - RNA, 64 nt, Human
ccggcacccugcagcuuuaguuuacuaaacuagaaguccucauaguuuaaaauggccucagcag

SEQ ID NO: 520287 - RNA, 64 nt, Human
caaacaccagugaggcucuauugagccaagaccaaguccucaaagcaccugaaccacuguggcc

SEQ ID NO: 520288 - RNA, 64 nt, Human
agacagggaccagacugaacugccacccucugcuaguccucaugcaacucaguccccagaaugg

SEQ ID NO: 520289 - RNA, 64 nt, Human
aguuucuguaacagaacaagugagucugggaugaaguccucaaaguacuucaaaugguaauugu

SEQ ID NO: 520290 - RNA, 64 nt, Human
aaauuccuaauuaugcauuaucuuucuuuucuccaguccucacaaauacagaaacaauaacuga

SEQ ID NO: 520291 - RNA, 64 nt, Human
cuuuucuaucuuuaaaccagaaaaccucauacucaguccucagugaaagaaaguaaaguauuaa

SEQ ID NO: 520292 - RNA, 64 nt, Human
gaaccagggguaugucaucacuuuuuucauaucaaguccucacccuccuuccacauaaugcucu

SEQ ID NO: 520293 - RNA, 61 nt, Human; identical to SEQ ID NO: 446089

SEQ ID NO: 520294 - RNA, 61 nt, Human; identical to SEQ ID NO: 446090

SEQ ID NO: 520295 - RNA, 61 nt, Human; identical to SEQ ID NO: 446091

SEQ ID NO: 520296 - RNA, 64 nt, Human
ugaaaagcugcucccguuggcuuuaugagcaucaaguccucacccagacccccugcuggugccg

SEQ ID NO: 520297 - RNA, 64 nt, Human
uccuucucuggggcucccagggagggggaagagaaguccucagcuggggcucaugggacccuac

SEQ ID NO: 520298 - RNA, 64 nt, Human
auguggggucccagcugccugccugccucuuaggaguccucagagagccuucugugccccuggc

SEQ ID NO: 520299 - RNA, 64 nt, Human
ugccccaucuccucccauggccuucccuccccacaguccucacagccucucccuuaaugagcaa

SEQ ID NO: 520300 - RNA, 64 nt, Human
gcaauacccauccaucacccaucucacucuccccaguccucaggcagcagcuuuuccaccccag

SEQ ID NO: 520301 - RNA, 64 nt, Human
cuuaguacuaagagacuucaagcuucuugcuuuaaguccucacccuuuacauuaucuaauucuu

SEQ ID NO: 520302 - RNA, 64 nt, Human
gagaaaaauuacuuagccucucccaagaugagaaaguccucaagugaggggaggaggaagcaga

SEQ ID NO: 520303 - RNA, 64 nt, Human
ggauuguaauguccucuccaucauccucagugugaguccucagagccuccaucugccaagaaca

SEQ ID NO: 520304 - RNA, 64 nt, Human
cugccaguuccacugcccccuugaucuuugaaggaguccucaggccccucgcagcauaaggaug

SEQ ID NO: 520305 - RNA, 64 nt, Human
gugagcaauccugcaagaacaagguacauaaacaaguccucagugguuggcaauuguuucaacc

SEQ ID NO: 520306 - RNA, 64 nt, Human
gucaacucucagacauuguauuuugguuucccucaguccucauaacuuccuucuugcugaacau

SEQ ID NO: 520307 - RNA, 64 nt, Human
aguuaaguaaauguaguauuggcuaguuacuguaaguccucaucuucugguagguccuguaacu

SEQ ID NO: 520308 - RNA, 64 nt, Human
gcguuacagauggacguagcugcuuugguuuuccaguccucaagggaauacugaagaugcugac

SEQ ID NO: 520309 - RNA, 64 nt, Human
gcacuaaagugcugccuccagcucucggucccacaguccucaggcccuucucuggcugcagagc

SEQ ID NO: 520310 - RNA, 64 nt, Human
gcacuaaagugcgucugcuagcucucggucccacaguccucaggccccucucuggcugcagagc

SEQ ID NO: 520311 - RNA, 64 nt, Human
gucaucagaaagguuuaucccuuugagaguaucaaguccucaguuaaugauucuugcuuucauc

SEQ ID NO: 520312 - RNA, 64 nt, Human
aaauucagaaacauauauuugugugcauuugcaugugcaacaguacacacaaacauacauaaag

SEQ ID NO: 520313 - RNA, 64 nt, Human
uacuggaaaacaugcagaugaggauaucuuuuaugugcaacaguauccuuugcaugggaggaga

SEQ ID NO: 520314 - RNA, 64 nt, Human
ucggccauggcgcgccucccccaagggcucaucugugcaacaaccacaugccaacaauagcucc

SEQ ID NO: 520315 - RNA, 64 nt, Human
ccccccacugugguaggacaggacuggcccacuuaguccucaagcucccaaccugcugucccuc

SEQ ID NO: 520316 - RNA, 64 nt, Human
uggccauggcccgggcucuggugcggaaccccccaguccucauccuggaugaagccaccagcgc

SEQ ID NO: 520317 - RNA, 64 nt, Human
acuuguuuuuauuaaaaauuuccucacaaaagagaguccucaaguuguggcuguucuugggaaa

SEQ ID NO: 520318 - RNA, 64 nt, Human
ggauucuuuguacaggaaauauugcccaaugacuaguccucauccauguagcaccacuaauucu

SEQ ID NO: 520319 - RNA, 64 nt, Human
cuaugagucauaauugugccaaguuguuucaugcaguccucaaaaauuagauguaauugagcuu

SEQ ID NO: 520320 - RNA, 64 nt, Human
ggugauugugaagaugguaauuugcugcuaauagaguccucaaaggguuaaggccaauuugcaa

SEQ ID NO: 520321 - RNA, 64 nt, Human
accuggauaccaccaucuaagcuccuguaucagcaguccucaucaucacucaucugccaagcuc

SEQ ID NO: 520322 - RNA, 64 nt, Human
acauucagaagaguucacugcagaugcugcagguaguccucaaaaauggguuccagaaauguuu

SEQ ID NO: 520323 - RNA, 64 nt, Human
uacauuucucagaguggauaaaaauguuugacaaaguccucacuuuuaaggaaaugcaaagcuu

SEQ ID NO: 520324 - RNA, 64 nt, Human
gaguuugaaccuuuugcauuuuguuagcucagucaguccucaucgugguccugaggcauaggua

SEQ ID NO: 520325 - RNA, 64 nt, Human
ccgggaccccggucuuguguggucccugauguggaguccucaguccuuaagauacauccagaaa

SEQ ID NO: 520326 - RNA, 64 nt, Human
agcacaaagcaugagguggaguuacugugcccaaaguccucacucagaccagugccccuccagu

SEQ ID NO: 520327 - RNA, 64 nt, Human
gggguacgggucccucaaacacaagucuugaaucaguccucagggccccagaucccccuucuaa

SEQ ID NO: 520328 - RNA, 64 nt, Human
ugaaggguugagaagaaagagaaauuguccaaagaguccucagaaccugccuggagaaaugcgc

SEQ ID NO: 520329 - RNA, 64 nt, Human
ugcucagcgccacaagugaccagugccucccaggaguccucaggcccuggggacucugacucaa

SEQ ID NO: 520330 - RNA, 64 nt, Human
ugugcacugcauggucuagggacguucucucuccaguccucagggaagaggaccccaggacuuc

SEQ ID NO: 520331 - RNA, 64 nt, Human
ccugcggaggagguguggucaccaggaggcggcagugcaacaaccccagguaccgcagggaggg

SEQ ID NO: 520332 - RNA, 64 nt, Human
gugcauguguuggugcugaccuccaggccgagaugugcaacacucagguaggccugcuuccugg

SEQ ID NO: 520333 - RNA, 64 nt, Human
aucaauaauauaauuguugauccacuuauaauucgugcaacacuguauguauguagagauugag

SEQ ID NO: 520334 - RNA, 64 nt, Human
cccacucauccuuaugugcuagggauaaaucaagaguccucagcacuccacauucccaaaaaau

SEQ ID NO: 520335 - RNA, 64 nt, Human
ugccccagccccuaagccccguccccuaacccccaguccucacuguccuguuuucuuaggcacu

SEQ ID NO: 520336 - RNA, 64 nt, Human
uucccgggcagcuccuggccagcuuccagcccagaguccucaaguccagggcaccuugggccca

SEQ ID NO: 520337 - RNA, 64 nt, Human
uguccacacaguuagcggagcgcgggacuucugcaguccucaggugaccccgggccuccagcac

SEQ ID NO: 520338 - RNA, 64 nt, Human
ggcugucccugaguaguuuugcugccauagguuaaguccucauguguacagugcaggcccugug

SEQ ID NO: 520339 - RNA, 64 nt, Human
gccaaagugcccccucccguucaccuaccacccaaguccucaugcccuccgagggcugggggag

SEQ ID NO: 520340 - RNA, 64 nt, Human
acccacuggagagccccgccccuaagguacuaugaguccucaggggucaaguucagaaacggcc

SEQ ID NO: 520341 - RNA, 64 nt, Human
caaguucaauccuaccuguuuuguggucagcuguaguccucauaaaaagcaaaacaaaaauuag

SEQ ID NO: 520342 - RNA, 64 nt, Human
uugccccaagacugugggauaaaccaccauugcuaguccucaggaauuagaccauauuuaguau

SEQ ID NO: 520343 - RNA, 64 nt, Human
cugggcaggcccaagcccaccacgagcaucauccaguccucagcccuaaucugcccuuaggagu

SEQ ID NO: 520344 - RNA, 64 nt, Human
gaaggucccugacuccuaagagaaccacacccaaaguccucacucuugcagggguagacauuuc

SEQ ID NO: 520345 - RNA, 64 nt, Human
uuccucccaggcuacccugagccuuuccuggcccaguccucaccacaguccacagaagccgcaa

SEQ ID NO: 520346 - RNA, 64 nt, Human
uuucuagccucugagaugcuaauuuauuuccccgaguccucagguacagcgggcugugcccggc

SEQ ID NO: 520347 - RNA, 64 nt, Human
cccagugguccaagaacacuuucugggcuaacauaguccucacacagggcugagaaagaaagug

SEQ ID NO: 520348 - RNA, 64 nt, Human
aguauuuggauuugcauuccaucccuugggagggaguccucagggccacuagugaugagccaag

SEQ ID NO: 520349 - RNA, 64 nt, Human
agacuuugagguaacauggucuggugguggcaugaguccucagaagguauuuguaauaagguuc

SEQ ID NO: 520350 - RNA, 64 nt, Human
caaagaagauucauggauagucagacugaacugugugcaacaggaaaagucaaaagggaaaagg

SEQ ID NO: 520351 - RNA, 64 nt, Human
gcaguggaacacugagucacucuuuucuuaacacgugcaacaucuuaauuuuuguuuuucagca

SEQ ID NO: 520352 - RNA, 64 nt, Human
aggaucacuugaagccagaguuugagaccagccugugcaacacagcaagaccccgucucuacaa

SEQ ID NO: 520353 - RNA, 64 nt, Human
ugugcaagucugguuuugguuagguaguaauaaaaguccucacuguagaucucuaaauuucaac

SEQ ID NO: 520354 - RNA, 64 nt, Human
ggaagggcuuaagggacacaguggacgaggggagaguccucaucugcuggcauuuuguggggug

SEQ ID NO: 520355 - RNA, 64 nt, Human
cacugccauccuggacagaaaggcaggagcucugaguccucagguccacccauuucccucaugg

SEQ ID NO: 520356 - RNA, 64 nt, Human
ccgaggagggaaggauggcuaagcugggaccggcaguccucacagggugccugugagaaaggac

SEQ ID NO: 520357 - RNA, 64 nt, Human
gagagccuuugccuuuagggguguguauucacauaguccucagggcucagucuuuugagguaag

SEQ ID NO: 520358 - RNA, 64 nt, Human
aaaggugauuaaauauuuaaugaugugucauaugaguccucaagcuucucagacuucucuuauu

SEQ ID NO: 520359 - RNA, 64 nt, Human
ugcugacagcugccaagaaaaugcuucacucaacaguccucaugugcccagagauguuuauaga

SEQ ID NO: 520360 - RNA, 64 nt, Human
cucauucucucgucuugcugcguccugucuguggaguccucagucacucugcuguuggagagug

SEQ ID NO: 520361 - RNA, 64 nt, Human
agauggaaguuuuggccggugcucauuagacaugaguccucacucuguguccugagcccguguc

SEQ ID NO: 520362 - RNA, 64 nt, Human
guccugcaggcaucagugcccuggcuguccugugaguccucaugcagagcagggccaucauggu

SEQ ID NO: 520363 - RNA, 64 nt, Human
ccaucagccucucacccacucccagacacacacaaguccucaaaaguuucagcuccguguguga

SEQ ID NO: 520364 - RNA, 64 nt, Human
gcucaggguuaccgaagaggggccaagaaauuagaguccucagaagagaacuuaucuagugagg

SEQ ID NO: 520365 - RNA, 64 nt, Human
cagcccaggcuuccuccacagugguccaaggagcaguccucagugggggcaggugugggcccua

SEQ ID NO: 520366 - RNA, 64 nt, Human
gccaccgagcugggacuucuggcaucacuugaguaguccucacccuuauccaggacccacacag

SEQ ID NO: 520367 - RNA, 64 nt, Human
uaguaaaaugcuaugcgcauuuauaccuugcauaaguccucauucuaccacauguuaacccucu

SEQ ID NO: 520368 - RNA, 64 nt, Human
aaacuuguagucauaauaguacuauauucuucuuaguccucaccucuuccuugucuuuuagauc

SEQ ID NO: 520369 - RNA, 64 nt, Human
guguggcugcuuuuggcuggauucccugcacccagugcaacacacccuuuccccuucacucucc

SEQ ID NO: 520370 - RNA, 64 nt, Human
ccacccuggguggaucgaggagucuggguccagggugcaacagagaaaaacuucaugcaugaau

SEQ ID NO: 520371 - RNA, 64 nt, Human
ugggcauaauuauaucuuaaucauauauggaaaugugcaacauaugguauuuguuaaauacguu

SEQ ID NO: 520372 - RNA, 64 nt, Human
gccguucugacacuggguguugaggucauguggcaguccucacgauugaaauuauugcccuuug

SEQ ID NO: 520373 - RNA, 64 nt, Human
aguaaguuucauuuuuuuuaucugggcuauauacaguccucaaauaaauaaugucuugauuuua

SEQ ID NO: 520374 - RNA, 64 nt, Human
caucugugacaacuccacgagcccuuaauuucuuaguccucaccagaagaacaggucucacaag

SEQ ID NO: 520375 - RNA, 64 nt, Human
ccauuccucaagauaauuuuagaguuauaaaaccaguccucaauuuugggucuucacagagaau

SEQ ID NO: 520376 - RNA, 64 nt, Human
ccagggaugcaggguuaggcagacagguccccagaguccucacccugcuccccagacaguagac

SEQ ID NO: 520377 - RNA, 64 nt, Human
uaugagugugaagaauauggcaaagccuucaacaaguccucaauucuuaccagacauaagauaa

SEQ ID NO: 520378 - RNA, 52 nt, Human
gaaugugggaaagccuuuaagcaguccucaacucuuacuaagcauuaaauau

SEQ ID NO: 520379 - RNA, 64 nt, Human
uacaaaugugaagaauguggcaaagccuuuauccaguccucaacuccuaguaaacauaauuaau

SEQ ID NO: 520380 - RNA, 64 nt, Human
uacaacugugaagaauguggcaaagcuuuuaaccaguccucaaacuuuauugaacaaaauaauu

SEQ ID NO: 520381 - RNA, 64 nt, Human
uacaaaugugaagaaugugacaaagccuuuaaccaguccucaauuuuuacuaaacauaagaaaa

SEQ ID NO: 520382 - RNA, 64 nt, Human
uaugauugugaaaaauauggcaaaggcuuuaacuaguccucaguucuuaacacacauacgauaa

SEQ ID NO: 520383 - RNA, 64 nt, Human
cuaaagugugaagaaugucacaaagcccuuaauaaguccucaauucuuaacagauauaagaugu

SEQ ID NO: 520384 - RNA, 64 nt, Human
cuuuucuggaagccaaagucacccuccccaauaaaguccucacugccaacaucuugcuuauucu

SEQ ID NO: 520385 - RNA, 64 nt, Human
uagaccacagucacacacugcuguagucuuccccaguccucauucccagcugccucuuccuacu

SEQ ID NO: 520386 - RNA, 64 nt, Human
ggacgaguauggaguacuugaauaauugaccugaaguccucagaccugagguucccuagaguuc

SEQ ID NO: 520387 - RNA, 64 nt, Human
aacuaucccagcaucacagugccugugcccaagcaguccucacuuugcuuaacaguggccccag

SEQ ID NO: 520388 - RNA, 64 nt, Human
uucuggguaaaaaaaaccuagaaucauuucugaugugcaacauugucaagugaagaagcuaaca

SEQ ID NO: 520389 - RNA, 64 nt, Human
aauuaacacccaaaagaauuaaauugauuauuuugugcaacauaacaauucggcaguuggccaa

SEQ ID NO: 520390 - RNA, 64 nt, Human
aaacgagaucgggaagcagaaauauagugcaauagugcaacaucucugaauccuuuuaaucuag

SEQ ID NO: 520391 - RNA, 64 nt, Human
gggagggagauggucucagccccacagaguuuggaguccucagugugcugagcaaacguggaga

SEQ ID NO: 520392 - RNA, 64 nt, Human
gucugcggguucuuuuaccugcucucccucagugaguccucaaccacccugggcccagaaacag

SEQ ID NO: 520393 - RNA, 64 nt, Human
guuuuagugauacaccaccuccgauaagcaaaaaaguccucacauucaauggguugcauaccca

SEQ ID NO: 520394 - RNA, 64 nt, Human
cugcccagucuaccaaauaauuuauauacaucucaguccucacacaaccaucccuguuuuauag

SEQ ID NO: 520395 - RNA, 64 nt, Human
ggagggagacguggguccaccaggcuucuggaaaaguccucaaugcaauaaaaacaauuucuuu

SEQ ID NO: 520396 - RNA, 64 nt, Human
cgggccccgucucuauaaugcagcugugcucuggaguccucaacccggggcucauuucaaacuu

SEQ ID NO: 520397 - RNA, 64 nt, Human
ggagaaaucauuuaggcaaauagcaaggguaggaaguccucaguaagguuuuccauuuaaugaa

SEQ ID NO: 520398 - RNA, 64 nt, Human
uucaucuguccugggaauguccucccaagacuggaguccucagcucagaacaaagggaaagggg

SEQ ID NO: 520399 - RNA, 64 nt, Human
uacaaaugugaaaaauguggcaaagccuuuuaccaguccucaacucuuacuaaacauaaaaaaa

SEQ ID NO: 520400 - RNA, 64 nt, Human
uacaaaggugaagaauguggcaaagcuuuuaaacaguccucaaucuuuauuacacauaagaaaa

SEQ ID NO: 520401 - RNA, 64 nt, Human
aucucugggcuggggacugaauuccugaugucugaguccucaaggugacuggggacuuggaacc

SEQ ID NO: 520402 - RNA, 64 nt, Human
agccucccguggaaggcgagaugguccuggaggcaguccucaccucugccucccucgcuccucc

SEQ ID NO: 520403 - RNA, 50 nt, Human
aagauucuguuuuguuuugaaguccucaaaugggagcugaaauuuuccag

SEQ ID NO: 520404 - RNA, 64 nt, Human
agaagguuccuggaaauuccaauguccacccaugaguccucagcugagacucccugcuccgcug

SEQ ID NO: 520405 - RNA, 64 nt, Human
uccagccugccgcuccuggacugcccuguaucuaaguccucaauaaacccuaugucucauuuuc

SEQ ID NO: 520406 - RNA, 64 nt, Human
guaaaaauagauuuuagaauuaaaacaaaauccaaguccucacaccccugucaucccaggagau

SEQ ID NO: 520407 - RNA, 64 nt, Human
aagacaaaacaaaaaaccaacucugacuuuucuggugcaacaguggagaaucuuaccauuggau

SEQ ID NO: 520408 - RNA, 64 nt, Human
agugaucuuucccaagagaaggggaagcacucgugugcaacagacaagugacuguaucugugua

SEQ ID NO: 520409 - RNA, 64 nt, Human
gaguuccucuucuauuacuuaaaacguuuuuauugugcaacauuuaaggcauacaaaaacauau

SEQ ID NO: 520410 - RNA, 64 nt, Human
ucuaggacucccgaguggcuuccagggggccgucaguccucagccgcgccuguguccggugccc

SEQ ID NO: 520411 - RNA, 64 nt, Human
guucugccagggcuccccucccugccuguccccaaguccucaccucaaacucccuccaaguccc

SEQ ID NO: 520412 - RNA, 64 nt, Human
gguccguguucccgcagggcgcacaugcuuggagaguccucagcaggguagccgaggccaggcc

SEQ ID NO: 520413 - RNA, 64 nt, Human
ucuaguggguuuaauguuuagucaguguacucugaguccucauuguucagaaaagcaccucuug

SEQ ID NO: 520414 - RNA, 64 nt, Human
auguguggggagaauggacaaggacuuaggaaaaaguccucaucaaagaacagcuuuuuuggga

SEQ ID NO: 520415 - RNA, 64 nt, Human
accaggacucccuccucaccucuggacuggcuagaguccucacucccaguccaaauguccucca

SEQ ID NO: 520416 - RNA, 64 nt, Human
cccccaggccuagguucccuuggaggcuguggcaaguccucaauccugugucccagaggucccu

SEQ ID NO: 520417 - RNA, 64 nt, Human
gauuugcuuuguuauaggguaaagcuuugucuaaaguccucauuuucuuuuaaaauugaauaaa

SEQ ID NO: 520418 - RNA, 64 nt, Human
ugugcauggugucagcccaaagccaggcugagacaguccucauauccucuugagccaaacuguu

SEQ ID NO: 520419 - RNA, 64 nt, Human
aucauauguuguccaucccccccucaggcuugaaaguccucaaagagacccacuaucccauauc

SEQ ID NO: 520420 - RNA, 64 nt, Human
cacaucuccagguuccccccguauccacuccuucaguccucauuugcucaucaaccucagagac

SEQ ID NO: 520421 - RNA, 64 nt, Human
gcagaugaggccacaccuguacacucccuggaugaguccucaguuggucuucugcacauggugc

SEQ ID NO: 520422 - RNA, 64 nt, Human; identical to SEQ ID NO: 520421

SEQ ID NO: 520423 - RNA, 64 nt, Human
gucgugugacccucagucagguuggugggggcugaguccucacugagcagccacuuuccacauc

SEQ ID NO: 520424 - RNA, 64 nt, Human
ccaggagagaggcagaggggcugugccgugcuagaguccucagggagggagugaccucgacccu

SEQ ID NO: 520425 - RNA, 64 nt, Human
gugucuuucacuggcagcaugaaguuagccaccaaguccucacaagccgugcugcuuaguugcu

SEQ ID NO: 520426 - RNA, 64 nt, Human
aaugaaguucuaugaaaguacuaaauaugggacagugcaacaaguaacgagacuauuuuguauu

SEQ ID NO: 520427 - RNA, 64 nt, Human
ccuuuccucccaccacccaugugcaugagcaaaugugcaacaaaacccugggacuuugcaguca

SEQ ID NO: 520428 - RNA, 52 nt, Human
ccaaaaaaaccaugagauaaaagugcaacacagcccauuucccaguagucug

SEQ ID NO: 520429 - RNA, 64 nt, Human
acuuugucauuuuacaaggaagaaccucuuaagaaguccucagaaccagaagcaaugugaacuc

SEQ ID NO: 520430 - RNA, 64 nt, Human
cauuuucucaacuuuuaauagcaaaaagugccaaaguccucagagaccuaacagccuuggucua

SEQ ID NO: 520431 - RNA, 64 nt, Human
gcagccuggguuugcaggccugcacaggcuggggaguccucaggaccuuaggaccuucauccag

SEQ ID NO: 520432 - RNA, 64 nt, Human
ugguccaggacaggaggaugaaaugagaucccagaguccucacaccugaaugaauuauacaugu

SEQ ID NO: 520433 - RNA, 64 nt, Human
auuguuuguaugaagaugcuguacccacuugaacaguccucagguguuuacauaaauacuaugu

SEQ ID NO: 520434 - RNA, 64 nt, Human
uuuauuauuacuguuugucuucuccccaggguucaguccucaaggggccauccugucccaccau

SEQ ID NO: 520435 - RNA, 64 nt, Human
accaacugacuuuccuauugacucaucaggaaccaguccucagucuggucaaguuguuucuuau

SEQ ID NO: 520436 - RNA, 64 nt, Human
guagcaggguauugccuuugauucaacuguuuuaaguccucauuuucucaaacuaagugcuugc

SEQ ID NO: 520437 - RNA, 64 nt, Human
guuguuuguaugaagaugcuguacccacuugaacaguccucagguguuuacauaaauacuaugu

SEQ ID NO: 520438 - RNA, 64 nt, Human
uauuguuacagcugaaagacaguaaagaccauuuaguccucaccuucuguuuuagaguugagca

SEQ ID NO: 520439 - RNA, 64 nt, Human
cuggcuuccuggggugaagaggcaggcaccccagaguccucaacuggaccuaggggaagaagga

SEQ ID NO: 520440 - RNA, 64 nt, Human
aauauucauggauggcucaagucugcacagagcaaguccucacucuucaaggaggcccacugug

SEQ ID NO: 520441 - RNA, 64 nt, Human
uucaauaaugagguaaucauguuacauacacauuaguccucaguuauaaagugaaucucagaua

SEQ ID NO: 520442 - RNA, 64 nt, Human
aaguucucauggucagaaguucucauggugcacgaguccucagcacucugccggcagugggggu

SEQ ID NO: 520443 - RNA, 64 nt, Human
uguuugauuuucagugauugucugguauauuuacaguccucaaacaugguuauuucugucagug

SEQ ID NO: 520444 - RNA, 64 nt, Human; identical to SEQ ID NO: 470492

SEQ ID NO: 520445 - RNA, 64 nt, Human
auucagauuuuuuuuacccuggguugcuguaagggugcaacaucagggcgcuugaguugcugag

SEQ ID NO: 520446 - RNA, 64 nt, Human
gguauuauaauaauauauugguguaauuuaauuggugcaacaugcuuuauggcuccugucaaaa

SEQ ID NO: 520447 - RNA, 64 nt, Human
uuuaaucuacauuauaauaaaauuucuugcugcagugcaacaggaggcuuuuucagugaucuuc

SEQ ID NO: 520448 - RNA, 64 nt, Human; identical to SEQ ID NO: 470493

SEQ ID NO: 520449 - RNA, 64 nt, Human; identical to SEQ ID NO: 470494

SEQ ID NO: 520450 - RNA, 64 nt, Human; identical to SEQ ID NO: 470495

SEQ ID NO: 520451 - RNA, 64 nt, Human; identical to SEQ ID NO: 470496

SEQ ID NO: 520452 - RNA, 64 nt, Human; identical to SEQ ID NO: 470497

SEQ ID NO: 520453 - RNA, 64 nt, Human; identical to SEQ ID NO: 470498

SEQ ID NO: 520454 - RNA, 64 nt, Human; identical to SEQ ID NO: 470499

SEQ ID NO: 520455 - RNA, 64 nt, Human; identical to SEQ ID NO: 470500

SEQ ID NO: 520456 - RNA, 64 nt, Human; identical to SEQ ID NO: 470501

SEQ ID NO: 520457 - RNA, 64 nt, Human; identical to SEQ ID NO: 470502

SEQ ID NO: 520458 - RNA, 64 nt, Human; identical to SEQ ID NO: 470503

SEQ ID NO: 520459 - RNA, 64 nt, Human; identical to SEQ ID NO: 470504

SEQ ID NO: 520460 - RNA, 64 nt, Human; identical to SEQ ID NO: 470505

SEQ ID NO: 520461 - RNA, 64 nt, Human; identical to SEQ ID NO: 470506

SEQ ID NO: 520462 - RNA, 64 nt, Human; identical to SEQ ID NO: 470510

SEQ ID NO: 520463 - RNA, 61 nt, Human; identical to SEQ ID NO: 446382

SEQ ID NO: 520464 - RNA, 61 nt, Human; identical to SEQ ID NO: 446383

SEQ ID NO: 520465 - RNA, 61 nt, Human; identical to SEQ ID NO: 446384

SEQ ID NO: 520466 - RNA, 64 nt, Human; identical to SEQ ID NO: 470511

SEQ ID NO: 520467 - RNA, 64 nt, Human; identical to SEQ ID NO: 470512

SEQ ID NO: 520468 - RNA, 64 nt, Human; identical to SEQ ID NO: 470513

SEQ ID NO: 520469 - RNA, 64 nt, Human; identical to SEQ ID NO: 470514

SEQ ID NO: 520470 - RNA, 64 nt, Human; identical to SEQ ID NO: 470515

SEQ ID NO: 520471 - RNA, 64 nt, Human; identical to SEQ ID NO: 470516

SEQ ID NO: 520472 - RNA, 64 nt, Human; identical to SEQ ID NO: 470517

SEQ ID NO: 520473 - RNA, 64 nt, Human; identical to SEQ ID NO: 470518

SEQ ID NO: 520474 - RNA, 64 nt, Human; identical to SEQ ID NO: 470519

SEQ ID NO: 520475 - RNA, 64 nt, Human; identical to SEQ ID NO: 470520

SEQ ID NO: 520476 - RNA, 64 nt, Human; identical to SEQ ID NO: 470521

SEQ ID NO: 520477 - RNA, 64 nt, Human; identical to SEQ ID NO: 470522

SEQ ID NO: 520478 - RNA, 64 nt, Human; identical to SEQ ID NO: 470523

SEQ ID NO: 520479 - RNA, 64 nt, Human; identical to SEQ ID NO: 470524

SEQ ID NO: 520480 - RNA, 64 nt, Human; identical to SEQ ID NO: 470528

SEQ ID NO: 520481 - RNA, 64 nt, Human
cagaggaccgggaggcaccccacccuccccaccagugcaacagaaaccaccugcguccacaccc

SEQ ID NO: 520482 - RNA, 64 nt, Human
caaucccuccuacagggccuggcucacaaaaagagugcaacaaaugcuucuauuccauagcuac

SEQ ID NO: 520483 - RNA, 64 nt, Human
uggaagucuuugguauaugcaaaugaaaggagaggugcaacaacuuaguuuaauuauaaaaguu

SEQ ID NO: 520484 - RNA, 64 nt, Human; identical to SEQ ID NO: 470529

SEQ ID NO: 520485 - RNA, 64 nt, Human; identical to SEQ ID NO: 470530

SEQ ID NO: 520486 - RNA, 64 nt, Human; identical to SEQ ID NO: 470531

SEQ ID NO: 520487 - RNA, 64 nt, Human; identical to SEQ ID NO: 470532

SEQ ID NO: 520488 - RNA, 64 nt, Human; identical to SEQ ID NO: 470533

SEQ ID NO: 520489 - RNA, 64 nt, Human; identical to SEQ ID NO: 470534

SEQ ID NO: 520490 - RNA, 64 nt, Human; identical to SEQ ID NO: 470535

SEQ ID NO: 520491 - RNA, 64 nt, Human
uauugucuauuauaaagcucauuauaauauaaaagugaaguacaaaaguuguaaguuuccuaau

SEQ ID NO: 520492 - RNA, 64 nt, Human
ccguacccccacagagccuuaagcaacuacuucugugaaguauuuuuugacuguuucauggaaa

SEQ ID NO: 520493 - RNA, 64 nt, Human
ggaucacuugagcacaggaguuugagaccagccugugcaacaucaugaaacaucaucucuacau

SEQ ID NO: 520494 - RNA, 64 nt, Human
uuugucuagcuucuaaugugguaaauugcacauugugcaacagaaccauuaauaaaagaaagga

SEQ ID NO: 520495 - RNA, 64 nt, Human
uacaauaacucuuugaguaaguugaaguuuaauugugcaacaaauuuguauuagaguacaauuu

SEQ ID NO: 520496 - RNA, 64 nt, Human
uggggcucucuuggagcacccagggacacccagcgugcaacagccacgggaagccuuucugccg

SEQ ID NO: 520497 - RNA, 64 nt, Human
guguguguaugacuaaagagagaauguagauauugugaaguacauauuaggaaaauauggguug

SEQ ID NO: 520498 - RNA, 64 nt, Human
cuccugccuuuaggccauggguggaaagugcucagugaaguacaccuguguggcccaguucuga

SEQ ID NO: 520499 - RNA, 64 nt, Human
gcaauacucaguaacaguguaguacucaguaacagugaaguacucaguaauacaguacaguauu

SEQ ID NO: 520500 - RNA, 64 nt, Human
uacucaguaauacaguacaguauucaguaaggcagugaaguacucaguaauacaauacaguacu

SEQ ID NO: 520501 - RNA, 64 nt, Human
auucccuuuuucuaaggcacagagcugguaaaaugugaaguaauagugaaccuaacagucagag

SEQ ID NO: 520502 - RNA, 64 nt, Human
uuuguuuuuaaguguugauagugaacgaaaagaugugaaguaaugauauuuuucugcuuacaac

SEQ ID NO: 520503 - RNA, 64 nt, Human
auguagcuugcuaauaagauagaaugauacaaaagugaaguaguagccacaguacaacacugac

SEQ ID NO: 520504 - RNA, 64 nt, Human
cuagccuugaauucauuuuaucuucauuaucccugugaaguaggugggacaaguauaaggggaa

SEQ ID NO: 520505 - RNA, 64 nt, Human
ugaccuaguggacaagcugaauuugaaauagacugugaaguaagcuguaacuugucauuuuaau

SEQ ID NO: 520506 - RNA, 64 nt, Human
aaacuacuuauuguugguaggcacaucgugucaagugaaguaguuuuauagguauggguuuuuu

SEQ ID NO: 520507 - RNA, 64 nt, Human
gcuuccauuuauaagucuuagcauuauuuccuuugugaaguacuauguaacagaugauuguuug

SEQ ID NO: 520508 - RNA, 64 nt, Human
aacuaccuuucaguccugucuggguuuuaaauaagugaaguagaagaaauugaguauuuucuga

SEQ ID NO: 520509 - RNA, 64 nt, Human
cuucuggcuugggcaaagggcaucauagguguaagugaaguaauuccuuuuuccuucccccucc

SEQ ID NO: 520510 - RNA, 64 nt, Human
gucccugugcugauccugcugaccucacuguccugugaaguaaccccuccuggcugugacaccu

SEQ ID NO: 520511 - RNA, 64 nt, Human
aaaaagucuacgcucuccuuucuuucuaacuccagugaaguaaugggguccugcucaaguugaa

SEQ ID NO: 520512 - RNA, 64 nt, Human
uaaccuagucugggagaugcguaauauaauucuggugaaguaauaguuucaguggaugauugaa

SEQ ID NO: 520513 - RNA, 64 nt, Human
aagucuugcuguccauggugguguaggaauuucugugcaacaccucaccacgucugguuaaucc

SEQ ID NO: 520514 - RNA, 64 nt, Human
auuuuuguuuauuuaagcaacacuuaauguaaaagugcaacaggcaauugaauccaaauuucaa

SEQ ID NO: 520515 - RNA, 64 nt, Human
ugccagaagauccccucaggacugcaacaggcuugugcaacaauaaauguuggcuuggauuggc

SEQ ID NO: 520516 - RNA, 64 nt, Human
uggaucugugucucuuccuuuuuaacaaguucaagugaaguaaaaccuuuucuuuuuuuccuuc

SEQ ID NO: 520517 - RNA, 64 nt, Human
ccuuacuguaaaaauaacugucgcguacacaugugugaaguagcuagaacauacugaauuuuuu

SEQ ID NO: 520518 - RNA, 64 nt, Human
caugcccuuucgguugugucccacuuaacaaauugugaaguaacaauuuucuguaaucucucuu

SEQ ID NO: 520519 - RNA, 64 nt, Human
uggcgugcauauguaaagcacaucagauccgugcgugaaguaggcauauaucacuaagcugugg

SEQ ID NO: 520520 - RNA, 64 nt, Human
aaggucauaugauacuguauagacaagcuuuguagugaaguauaguagcaauaauuucuguacc

SEQ ID NO: 520521 - RNA, 64 nt, Human
agcuguucuucuguguucucucauuauggacuuugugaaguagaaacauaauuuuuuuuccucc

SEQ ID NO: 520522 - RNA, 64 nt, Human
aucuguuccuaugcccaggaugauuuugugaaccgugaaguacgugagacuagaagacgcccaa

SEQ ID NO: 520523 - RNA, 64 nt, Human
gcuugccaguacugccaaagcacugcugugaaaugugaaguacuuuguuuuuuuauuuuuaaug

SEQ ID NO: 520524 - RNA, 64 nt, Human
aaauuggccuaaguauucaugagcccauguuucugugaaguaauuauuaaaccaacuuaaugau

SEQ ID NO: 520525 - RNA, 64 nt, Human
uacuaauaaaauacauacuauagauucuuuauuagugaaguaugcacuaaucaauacuuugaac

SEQ ID NO: 520526 - RNA, 64 nt, Human
ucuaaaaauuuagcaauauuagaauaggauacuagugaaguaagaaauuuugcuuguuguuuug

SEQ ID NO: 520527 - RNA, 64 nt, Human
uuuuuuauuaccgccgaagaaacaggccagauaagugaaguaauuugccuaaggucacagcuaa

SEQ ID NO: 520528 - RNA, 64 nt, Human
auaguacauguuagcauauaauguauuuugaagagugaaguaaaugcuauugauaacaguaaaa

SEQ ID NO: 520529 - RNA, 64 nt, Human
uacuggguauuaaaauuaaaagcaaguuauaucagugaaguaagauccuuuugaauguacaaag

SEQ ID NO: 520530 - RNA, 64 nt, Human
uuuuccagacacuuuuuugaguggaugauguuucgugaaguauacuguauuuuuaccuuuuucc

SEQ ID NO: 520531 - RNA, 64 nt, Human
uacagcuuuggacagaggcauuuucaccuuaauggugaaguaauuuaaaauauaaauccauuca

SEQ ID NO: 520532 - RNA, 64 nt, Human
aaaugucuuuccuuuugcucuuaaguuguggagagugcaacaguagcauaggacccuacccucu

SEQ ID NO: 520533 - RNA, 64 nt, Human
gcuaaaucauggauaaacugugaaccaaaauauggugcaacauacgagacaugaauauagucca

SEQ ID NO: 520534 - RNA, 64 nt, Human
guggaauauauuuuuggguaauaagaaugguugagugcaacaucauguauuaauaucaaaugaa

SEQ ID NO: 520535 - RNA, 64 nt, Human
cuuguucucugaagagugggaaggagaggagugagugaaguagccuguccccugcagguccucu

SEQ ID NO: 520536 - RNA, 64 nt, Human
aacuuguggaugacuuuugucccauguggcuuuugugaaguauggcaaagguuuuucaugagug

SEQ ID NO: 520537 - RNA, 64 nt, Human
gaugaggauccuuuacaacuauucagaggacugugugaaguaguuacuggaaaaagaacuugaa

SEQ ID NO: 520538 - RNA, 64 nt, Human
gauuuacuccaacacaaauaggacugaauuuauugugaaguaacauuggcaaucuuaacuuauu

SEQ ID NO: 520539 - RNA, 64 nt, Human
uaggaguauaaguauuacuuccuuguggucuauugugaaguaaaaaguagacccuugcauauac

SEQ ID NO: 520540 - RNA, 64 nt, Human
auacuaucauuuaaccaccaggaagcugaagugugugaaguacaaagcugacagcacuuuauuu

SEQ ID NO: 520541 - RNA, 64 nt, Human
uccaugauacuguguaaaauauuuuugcacuguugugaaguauuuuugacuuuuuucuguacau

SEQ ID NO: 520542 - RNA, 64 nt, Human
cccuuaacagagagaagaggggacaaauuugguugugaaguaaacaagaaacacaagacggcua

SEQ ID NO: 520543 - RNA, 64 nt, Human
gaaauuccagggucacacuuuuccaaguuuaucagugaaguagugauuaacaauggggaguguc

SEQ ID NO: 520544 - RNA, 64 nt, Human
guuuguauuuggaauauuugaauaaugacagauggugaaguaacaugcauacuuuauugugggc

SEQ ID NO: 520545 - RNA, 64 nt, Human
caaaucagauuuuauucaagcuuucuaaauaucugugaaguagacccuagaaaauugucucguu

SEQ ID NO: 520546 - RNA, 64 nt, Human
uucuuuagugaaaugauguuuuauguuauuaugugugaaguaauauauuguacaaguaauaaau

SEQ ID NO: 520547 - RNA, 64 nt, Human
caaugccuagacaucagggucagggccuggucuggugaaguaugcagaaguuggggggcccucg

SEQ ID NO: 520548 - RNA, 64 nt, Human
ucuugccuuaaccagucucucaagugaugagacagugaaguaaaauugagugcacuaaacaaau

SEQ ID NO: 520549 - RNA, 64 nt, Human
aucugugauuaaaugucugaauauguaaugccucgugaaguauuuaauaauggccuuuauuugu

SEQ ID NO: 520550 - RNA, 64 nt, Human
gugagguggccugaaugacaccucuuagaggacugugaaguacaggcacagcccgacugcaggg

SEQ ID NO: 520551 - RNA, 64 nt, Human
gagagaggugcccaaggaagauggaguuggugaugugcaacauuucggugagaacuuuauuguc

SEQ ID NO: 520552 - RNA, 64 nt, Human
ucuuccacuguuagugccagugagcaauacuguugugcaacaaaaaugucacuuuaucucagug

SEQ ID NO: 520553 - RNA, 64 nt, Human
uuaagaguuggaggugcaaauauauuccaaaagggugcaacagacacaguguaucccccugcuu

SEQ ID NO: 520554 - RNA, 64 nt, Human
uaccuuuaaauaucauucuuuguaucuuaaaucugugaaguagaacaauuuggucuuagcuuua

SEQ ID NO: 520555 - RNA, 64 nt, Human
aaauggaagguuuggaaaggaaugccucugucuugugaaguaggacauggcagacuuggcgacg

SEQ ID NO: 520556 - RNA, 64 nt, Human
cauuugcucuccuaggacaguguaauacauuuaugugaaguaaagacaugcgagacugguggcc

SEQ ID NO: 520557 - RNA, 64 nt, Human
aguucuccuucauccuauuuaugugguacagguugugaaguaucucuauauaaagggaaauuuu

SEQ ID NO: 520558 - RNA, 64 nt, Human
auuaccacaccaucucccaugaagaaagggaacggugaaguacuaagcgcuagaggaagcagcc

SEQ ID NO: 520559 - RNA, 64 nt, Human
gcaucuuacuggauuuaggacuucugagaugcuugugaaguauagaugugguuguggucuuaga

SEQ ID NO: 520560 - RNA, 64 nt, Human
auuauucuacuauacuguacaugaaaguagcagugugaaguacaauaauucauauucuucauau

SEQ ID NO: 520561 - RNA, 64 nt, Human
agucacaucagaguucaugaccuagugauugcuggugaaguaauauuggaauuuugguaccaug

SEQ ID NO: 520562 - RNA, 64 nt, Human
auggggccccuccugugccaaggguacguauauugugaaguaaagccucacaaagcuaaauaaa

SEQ ID NO: 520563 - RNA, 64 nt, Human
gaagaauaaugccuuguaugguguugauacgugugugaaguauucuuauuuuauuugucugaca

SEQ ID NO: 520564 - RNA, 64 nt, Human
guauaguuuuauuuacuucuguauguguauuuuugugaaguauucacaaagguuaaguuaaaau

SEQ ID NO: 520565 - RNA, 64 nt, Human
ggauaaccacuauuuuugugcaaauaauaugaaagugaaguaaaagcaauagaagaaauuucua

SEQ ID NO: 520566 - RNA, 64 nt, Human
uuaucacccuguauguuagggcaagaucucagcagugaaguauaaucagcacuuugccaugcuc

SEQ ID NO: 520567 - RNA, 64 nt, Human
guaaauaugugcuccgcuuuuguugcaucacuaugugaaguacuguguugcagaaguggcaaaa

SEQ ID NO: 520568 - RNA, 64 nt, Human
agguucugcaggucagcaucauuguguaaugagagugaaguaggggacccugugguucaaccuu

SEQ ID NO: 520569 - RNA, 64 nt, Human
uguaacauagaaaaugaaaaaacaguuaaaaaaagugaaguaguugcaaaguguuuugcacugu

SEQ ID NO: 520570 - RNA, 64 nt, Human
ggcccagccuucuuagccccaacuugggaacaaagugcaacaugggaucauggguuggggugcu

SEQ ID NO: 520571 - RNA, 64 nt, Human
cuaugcccuugguccguauuuuuaacagaagacagugcaacaacuggucuccaccaguauuugu

SEQ ID NO: 520572 - RNA, 64 nt, Human
aaggaaguuugcagucuugcagcuuuuauucccugugcaacaaaagauuagaacauguuaaagg

SEQ ID NO: 520573 - RNA, 64 nt, Human
cagauauggccaguugcgcagguuucugccaacugugaaguauccuccuggagcagugacacaa

SEQ ID NO: 520574 - RNA, 64 nt, Human
aaaauuucaaggugagccuggagcauuguguguggugaaguaaaauaaaggcucaaaacgugac

SEQ ID NO: 520575 - RNA, 64 nt, Human
cuacaucagcacugggcauucuuggagggauccugugaaguauuguuaggaggugaacuucacu

SEQ ID NO: 520576 - RNA, 64 nt, Human
auugagugccuaaugagaccucugugugaagcaagugaaguauagcugcuucuuuuaaccugcc

SEQ ID NO: 520577 - RNA, 64 nt, Human
uagcauuccccaaaugaacagcagccagaauuaggugaaguagcaugauagcaguguuuaaaaa

SEQ ID NO: 520578 - RNA, 64 nt, Human
aauguugccauauuaaaggagagaacuugguaacgugaaguauuucucauugaaaugcuuuccc

SEQ ID NO: 520579 - RNA, 64 nt, Human
acuauuauccccauuucuuuuuuaaaugaagaaagugaaguaggccgggcacgguggcucacgc

SEQ ID NO: 520580 - RNA, 64 nt, Human
caauuuccuguguuugcaauguugaaauuuuuuggugaaguacugaacuugcuuuuuuuccggu

SEQ ID NO: 520581 - RNA, 64 nt, Human
uguuaaaaagcuuuagaggaggaaugaaaacaaagugaaguacacuuagaaaagggccaagugg

SEQ ID NO: 520582 - RNA, 64 nt, Human
uuaaguuuggcauuauugucagacuggauggagggugaaguaaaauaguaugaacaauuaagag

SEQ ID NO: 520583 - RNA, 64 nt, Human
gcaccucccucccacccuucaggcugcacugugugugaaguagccaccugcccugccucccucc

SEQ ID NO: 520584 - RNA, 64 nt, Human
ucugaaaaucauuaaugccaacuugcucugauaugugaaguaauggacaagagugggaaaaaag

SEQ ID NO: 520585 - RNA, 64 nt, Human
cuccuacaaggccccaagguuuacauagucugaagugaaguacagagcuggcaucuaucuggug

SEQ ID NO: 520586 - RNA, 64 nt, Human
cauuuuguuauuuucuuaccaagugcauugauaugugaaguagaaugaauugcagaggaaaguu

SEQ ID NO: 520587 - RNA, 64 nt, Human
gucuaauaaucccugcacacguuuugaacuugcagugaaguacacugcuguuccuugcuuccug

SEQ ID NO: 520588 - RNA, 64 nt, Human
aaagugagaagaaacugaagauggacucuauuaugugaaguaguaauguucagaaacugauuau

SEQ ID NO: 520589 - RNA, 64 nt, Human
uuuuuguuguguaagacaaugauaacuauuauuugugcaacauuacucuuugaaauaaaaauug

SEQ ID NO: 520590 - RNA, 64 nt, Human
ucaaagagagagaaccaacguuccuaaaaguacagugcaacauauacaaauugacugagugcag

SEQ ID NO: 520591 - RNA, 64 nt, Human
cuaaaaaacuuuggaaauggaaaauaauguauuagugcaacaguugaugugcuucuuugggcaa

SEQ ID NO: 520592 - RNA, 64 nt, Human
accagaggccucauacuaaaauauauuuuugcaagugaaguaaauauaaaaauaauuuaaucca

SEQ ID NO: 520593 - RNA, 64 nt, Human
gcuuuguaacauuccucagugccuguccauaacugugaaguauuaagcacuuagggccagaugc

SEQ ID NO: 520594 - RNA, 64 nt, Human
agauuuacucuggugacugccuuuugaguuaugggugaaguaagguauggcuuuaccauaaccu

SEQ ID NO: 520595 - RNA, 64 nt, Human
gaaggaacagccucuauugauacuugguuguaaagugaaguaagauuggaggguggauggcugu

SEQ ID NO: 520596 - RNA, 64 nt, Human
auguaaaaugugacagccugcaauuuuguagacagugaaguaauggcugcuauuuauaaaugga

SEQ ID NO: 520597 - RNA, 64 nt, Human
auaaaaauuuucuaacuuggguucaauauuuguagugaaguaucuguuuucauuuuuuucacgu

SEQ ID NO: 520598 - RNA, 64 nt, Human
aguggaaaaguguuucuuuaguuuggaaagaccugugaaguauccuagucagggaaagaaccug

SEQ ID NO: 520599 - RNA, 64 nt, Human
ccaaagcucaggcuauuguuaaaucaauaauguugugaaguaaaacaaucaguacugagaaacc

SEQ ID NO: 520600 - RNA, 64 nt, Human
uucuguuuuagccucaucccaaauauaaagcuuugugaaguacaauuaacuuaauguacuugaa

SEQ ID NO: 520601 - RNA, 64 nt, Human
uauuuguguuugcauaguuugagcaggauguuuugugaaguauguuuguauuuauuugccuacu

SEQ ID NO: 520602 - RNA, 64 nt, Human
cauauuaaaucaaaguauauucuuaaaaguacuugugaaguaaaaucuuucuugugcauuuuca

SEQ ID NO: 520603 - RNA, 64 nt, Human
aauguuuucaaggagaaaagcagcauauccuuaagugaaguauuauauuuuucaauaacccugu

SEQ ID NO: 520604 - RNA, 64 nt, Human
ucuuauuccagaagacuguuuuuaguagcuuauugugaaguaagacaacuauaaugaaugucug

SEQ ID NO: 520605 - RNA, 64 nt, Human
gagcaggaguaacaauugaugagcaauauucagagugaaguaaaucuggaaaugguagacugug

SEQ ID NO: 520606 - RNA, 64 nt, Human
auugaguuuaagcaaggcauucuuacacgaggaagugaaguaaauuuuaguucagacauaaaau

SEQ ID NO: 520607 - RNA, 64 nt, Human
aacugacgaaaccuauaagccuauguguuugacagugaaguauguuuuauggacuuaaaugcca

SEQ ID NO: 520608 - RNA, 64 nt, Human
aaauacuuuuuuuuucuuuuccacuguuuguaaggugcaacaauuuaauauuuuuaagggacuu

SEQ ID NO: 520609 - RNA, 64 nt, Human
ccagggcucaugaaucucauucucuuagcugggcgugcaacagaccaacagauaacucauccua

SEQ ID NO: 520610 - RNA, 64 nt, Human
caacugccagccuggagaaggugacaguccaagugugcaacagcuguucugaauugucuuccgc

SEQ ID NO: 520611 - RNA, 64 nt, Human
ugaagaguucaaguucuguacagguuuuuaaaacgugaaguaauguuugaacuggaagaugagc

SEQ ID NO: 520612 - RNA, 64 nt, Human
agauacagcuccaggguuaaaaagagaguuuuuagugaaguaucuuucagauagcaggcaggga

SEQ ID NO: 520613 - RNA, 64 nt, Human
uuugcgaaacuaugcaacaguuuacaucagucaugugaaguauuugucuaaaacagagcaaacu

SEQ ID NO: 520614 - RNA, 64 nt, Human
uuuauuucauccuuucgacuguacuugauuaccagugaaguaagaugggucagguuacgacuua

SEQ ID NO: 520615 - RNA, 64 nt, Human
agggguuguuugcaggauccucagccauguucaagugaaguaagccugagccagugcguggacu

SEQ ID NO: 520616 - RNA, 64 nt, Human
uuguacuguuuugugcaguuugucuacuuucuuagugaaguauuuuuuguauaaaauguuacaa

SEQ ID NO: 520617 - RNA, 64 nt, Human
ggcuucgguguaggaaaaaugaaaaccaaacucagugaaguacucaucuugcaggaagcaaacc

SEQ ID NO: 520618 - RNA, 64 nt, Human
uaugacauuucuuaaaacuuuauuaaaagaaugagugaaguauugcugaaaaguggaaauucgg

SEQ ID NO: 520619 - RNA, 64 nt, Human
uauaugcuuauugggcacuuggguaucuucuuuugugaaguacccguucacauuuuuguauuuu

SEQ ID NO: 520620 - RNA, 64 nt, Human
gcuugggacugauuugggggacauuguacagugagugaaguauagccuuuaugccacacucugu

SEQ ID NO: 520621 - RNA, 64 nt, Human
uuuuucacugccagguacugaaugcagaggcucagugaaguauauaugugggaagugcaugcau

SEQ ID NO: 520622 - RNA, 64 nt, Human
guaggugguaggugucacuuguguguauguguaagugaaguaugaugcaugcucauucacuugg

SEQ ID NO: 520623 - RNA, 64 nt, Human
uuugucaagacauuaaaccaucuuagaucggagugugaaguaaauuaugguauauuuuauguaa

SEQ ID NO: 520624 - RNA, 64 nt, Human
guuuuuguuuaugucgaugcccuguaguuugaaagugaaguaaagauuuagaauucaccuaagu

SEQ ID NO: 520625 - RNA, 64 nt, Human
caccacacugaaucgagcauuuguguguguaugugugaaguauauacugggacuucagaagugc

SEQ ID NO: 520626 - RNA, 64 nt, Human
aucuguggccaucgcuggguccauuuuucugacugugaaguaaggagagacgucucaguaccca

SEQ ID NO: 520627 - RNA, 64 nt, Human
uuuuuaaaagagauguagcagaauaauucuuccagugcaacaaaaucaauuuuuugcuaaacga

SEQ ID NO: 520628 - RNA, 64 nt, Human
guaaaaacaaaaagacagugugugugucuguugagugcaacaagagcaaaaugaugcuuuccgc

SEQ ID NO: 520629 - RNA, 64 nt, Human
gauguccuuguaaaagaauaaaaaaggaauugcagugcaacaaaguacgugaaaaucagguuuc

SEQ ID NO: 520630 - RNA, 64 nt, Human
gccuauuuguguaggcccauggaaaucacuacuugugaaguagagaugccuuuuugucuaaugg

SEQ ID NO: 520631 - RNA, 64 nt, Human
ucuaaauuuuauaaaauuugagacugagcucuuagugaaguauauucugguuuuaagugcuuuu

SEQ ID NO: 520632 - RNA, 64 nt, Human
uucaaucaaaauuucagcauuauugaaauuguaagugaaguaaaacuuaagauauuugaguuaa

SEQ ID NO: 520633 - RNA, 64 nt, Human
gaaaccaaguguccucugugccuuuuuucuuucugugaaguaauuuaagaauauccaaaaaaau

SEQ ID NO: 520634 - RNA, 64 nt, Human
agaggauauauuuaagauacauagaaauuaugaugugaaguauucaugagaaucuguagauucc

SEQ ID NO: 520635 - RNA, 64 nt, Human
gagugugugcguguguguguauaugugugugugugugaaguaaauugucaauguuaguaauugu

SEQ ID NO: 520636 - RNA, 64 nt, Human
cagggaagccccacuugaaggaagaagucuaagagugaaguaggugugacuugaacuagauugc

SEQ ID NO: 520637 - RNA, 64 nt, Human
caauuuacuaucaaauuauaguaacugagccugugugaaguaucucaucauuuucgaaaggaac

SEQ ID NO: 520638 - RNA, 64 nt, Human
uagauugccaguuccugggaccaggccucagacugugaaguauauauccuccagcauucagucc

SEQ ID NO: 520639 - RNA, 64 nt, Human
ggggacauugggaccucagcaaugaagaacccuugugaaguaaccaggaggaauggggaaagaa

SEQ ID NO: 520640 - RNA, 64 nt, Human
auaugugaaaacauucuguaagcuucguacaaaugugaaguauuaauauuaucgcaguauuauu

SEQ ID NO: 520641 - RNA, 64 nt, Human
cugugaauuuguauucccuuucaccuccuggaaggugaaguaccccuucaucccuuuguuacua

SEQ ID NO: 520642 - RNA, 64 nt, Human
ugaguuuagaacuguagcagugcagguggcuuaagugaaguaacuccauauguaauuacaugau

SEQ ID NO: 520643 - RNA, 64 nt, Human
caacaggcccuugggugaaaggugcuauauaauugugaaguauuaagccuaccguauuucagcc

SEQ ID NO: 520644 - RNA, 64 nt, Human
uauauguauuuaaaaugugccauuuuauugcuaagugaaguauguccuguuuucugcuauaauu

SEQ ID NO: 520645 - RNA, 64 nt, Human
agcuuuaacuuaguuguguguguuuuaaauccuagugaaguauguacauacagagaaaccugaa

SEQ ID NO: 520646 - RNA, 64 nt, Human
uuuugauccauauguuaagugauagaagauuuuggugcaacaguaguaggauauauuucuccua

SEQ ID NO: 520647 - RNA, 64 nt, Human
ugggccugauuaccagcugggacuuagaguuucugugcaacaguuuuucacugagcaugucaag

SEQ ID NO: 520648 - RNA, 64 nt, Human
cugaaagaggagacaucaaacagaauuaggaguugugcaacagcucuuuugagaggaggccuaa

SEQ ID NO: 520649 - RNA, 64 nt, Human
ugagccacuggccuggccuucagcaguucuuuuugugaaguaaaacuuguauguuggaaagagu

SEQ ID NO: 520650 - RNA, 64 nt, Human
cugaguggccacuguccuuccuaaaugucaagaagugaaguaugucacccuuucagggaaauuc

SEQ ID NO: 520651 - RNA, 64 nt, Human
agucacaagcccagcucagauucaagaaaagggugugaaguagaggugcaguuaaguggggggc

SEQ ID NO: 520652 - RNA, 64 nt, Human
uguuuugguuuuccagcgaagggaagcuccuccagugaaguagccucuuguguaacuaauuugu

SEQ ID NO: 520653 - RNA, 64 nt, Human
ucuuggaaagaagccuuaugugaaagugaugacugugaaguaauauggcccacacuuuauucac

SEQ ID NO: 520654 - RNA, 64 nt, Human
ccauagugaagugugaggcggcccugaccaaugugugaaguaugcacuuggccugacucaggaa

SEQ ID NO: 520655 - RNA, 64 nt, Human
auauauugaucuaguugaucgguagaggaagcuugugaaguagguaggacagguuaugaugucu

SEQ ID NO: 520656 - RNA, 64 nt, Human
cugggagaguggaguucccguagggcauaggccugugaaguaacacuggggcagauauguaugu

SEQ ID NO: 520657 - RNA, 64 nt, Human
ugcuuuuuguucuaaggugcaucuagugcagauagugaaguagauuagcaucuacugcccuaag

SEQ ID NO: 520658 - RNA, 64 nt, Human
cuugacaauauaaaugcugcagcaaagaugagaggugaaguaaaaccgauaccuguccugcagg

SEQ ID NO: 520659 - RNA, 64 nt, Human
ugcucaagcucugacauuuuugguuuucauagucgugaaguauuuaucauuugcaugacuaaug

SEQ ID NO: 520660 - RNA, 64 nt, Human
gggcagaguaaucuagcaaaggagacugaggccagugaaguaggaagaaaguauuucaaggaga

SEQ ID NO: 520661 - RNA, 64 nt, Human
cauuuccccagguguuguuuggaacacugaucuugugaaguauuuuugcucccuuucuauucua

SEQ ID NO: 520662 - RNA, 64 nt, Human
ugacacaugcucuccuucaaaaugcuaauucagagugaaguaauugggaaacuguucauuugag

SEQ ID NO: 520663 - RNA, 64 nt, Human
gguuuuccuguugaggggcaccacauacaauagugugaaguagguaugaggggcagucauugua

SEQ ID NO: 520664 - RNA, 64 nt, Human
gugucaggaaggcaggggugccaggucccaccuagugaaguaauaaaccguggguggugauagu

SEQ ID NO: 520665 - RNA, 64 nt, Human
aaugcugcaaauuuuccuccauuaucagccagaagugcaacauguaugugcaaaagcuaaaaug

SEQ ID NO: 520666 - RNA, 64 nt, Human
aaauaccauacagauaccuuaaauguaugcauuugugcaacaauuuuugagaaggugaguggca

SEQ ID NO: 520667 - RNA, 64 nt, Human
uccucuacguuuuagagaggaaucuuguuuuugugugcaacauaagaaaauuaugaaaacuaau

SEQ ID NO: 520668 - RNA, 64 nt, Human
uguccuguaagucuuacuuccugcuuagggcacagugaaguaggaaacaauauuuugaaaauaa

SEQ ID NO: 520669 - RNA, 64 nt, Human
ggagcuucauuuugguaagagacagaauguaucugugaaguaguucuguuuggugugucccauu

SEQ ID NO: 520670 - RNA, 64 nt, Human
uagguuagguguuaguggacuuuuaauguaucuugugaaguaugguuacuaggguagguucaag

SEQ ID NO: 520671 - RNA, 64 nt, Human
aauuguacuaguuguaguuacgaguuuucccucagugaaguagcaauaggcuguaaucaagaaa

SEQ ID NO: 520672 - RNA, 64 nt, Human
ugaaaugcagaucccagagucaguaaaucugccugugaaguaugauagucugcauuuguaauga

SEQ ID NO: 520673 - RNA, 64 nt, Human
ccagaguauuggucuccucucagccccugauccugugaaguaaggaugugggggaagaccuggc

SEQ ID NO: 520674 - RNA, 64 nt, Human
aaguugaaagaugggguuggguaaaguagauuaggugaaguagaacauaaaauugaauaguacc

SEQ ID NO: 520675 - RNA, 64 nt, Human
aggcauuggaggugguuucuggccgugauuggaugugaaguagaagagguccucgaucauggug

SEQ ID NO: 520676 - RNA, 64 nt, Human
gcauaugugagaaaagacaacauuggugcuaacagugaaguaaggcccaaaggaaagacggcuu

SEQ ID NO: 520677 - RNA, 64 nt, Human
gccccccacacaggccacucucuucccuuucuuggugaaguaaggaaggagaaagugguuacua

SEQ ID NO: 520678 - RNA, 64 nt, Human
cugggcggccaggggaugacaguauggacuuccagugaaguagugacggaagccugaucauaga

SEQ ID NO: 520679 - RNA, 64 nt, Human
cugaaagaauuugauacugccuucuccuuugauugugaaguagccccaaaugaugucgucucug

SEQ ID NO: 520680 - RNA, 64 nt, Human
cucaacucauagaagaugaacccuucaagaaaacgugaaguagaacgggugggccagaaaugaa

SEQ ID NO: 520681 - RNA, 64 nt, Human
gucccacagggcgcccgccgaccugcaccugucugugaaguauguagggugggcagaagccaca

SEQ ID NO: 520682 - RNA, 64 nt, Human
caaauaguaaacccuucaauuauaguuagucuuggugaaguaagauguuuguagacuuuagagu

SEQ ID NO: 520683 - RNA, 64 nt, Human
gcagugccagcugacuuaagggagugaacuaccugugaaguagaaaaucagagggaaguuuuca

SEQ ID NO: 520684 - RNA, 64 nt, Human
uugugcuuacacaugaagccugacuuaacuguaugugcaacagcaaugaaauuaacuccagaag

SEQ ID NO: 520685 - RNA, 64 nt, Human
aaaaauuacaaaaugagucccggaaggucaguaagugcaacaugaaaaaaaucuaugaaaagau

SEQ ID NO: 520686 - RNA, 64 nt, Human
acccggccuggauaugaauuuauaauacccuacagugcaacacaagaagaugcacucaaagcac

SEQ ID NO: 520687 - RNA, 64 nt, Human
gcagcaagcuuugguuuaugguuuucauucauuggugaaguaaauuaggcagugcuaaagccug

SEQ ID NO: 520688 - RNA, 64 nt, Human
ccuggacuucauccugggugcugcagauacugcagugaaguaaaacaggaaucaaucuugccug

SEQ ID NO: 520689 - RNA, 64 nt, Human
acauggaacagagcuugugggaugcuaauaguuagugaaguauacaugauuuaauuucuaauaa

SEQ ID NO: 520690 - RNA, 64 nt, Human
ggcugaugggccuuuccauuaggguuuugcuuaugugaaguaauggaauuauguugguuauuuu

SEQ ID NO: 520691 - RNA, 64 nt, Human
gcuucuuuuucauguuucaucuagguuuuuagaagugaaguauaguaaauuugguucguuaaau

SEQ ID NO: 520692 - RNA, 64 nt, Human
cagccuuuuccuccucaguuuucucuuuaaaacugugaaguacuaacuuuccaaggccugccuu

SEQ ID NO: 520693 - RNA, 64 nt, Human
uugcaacuuaauagcagcagcugcccaaugccaugugaaguaacaaacugguuuuugguuuuuu

SEQ ID NO: 520694 - RNA, 64 nt, Human
caacaaugucacaagcacugugcuaaacacuguggugaaguagaacaauugcuaaucauuuccu

SEQ ID NO: 520695 - RNA, 64 nt, Human
uuuuaucuucucuaaaauuauuucccccaagguagugaaguaauuggaaugaaggaggcugaaa

SEQ ID NO: 520696 - RNA, 64 nt, Human
gauuuguagcucuagguuucuugaugaucaaggagugaaguaauugacagggaaaauauagacc

SEQ ID NO: 520697 - RNA, 64 nt, Human
aucaaauggcgacagacuguuccguuccacccccgugaaguaaucaugcaccgugugaauagua

SEQ ID NO: 520698 - RNA, 64 nt, Human
ccguuaggcugaauguuacugcuugccauaugaugugaaguacagcaauaucccaaguucuugu

SEQ ID NO: 520699 - RNA, 64 nt, Human
gucuacggcugccugagaugggugugcacagugugugaaguaccuaccuccuugccuugcugga

SEQ ID NO: 520700 - RNA, 64 nt, Human
uuuggggaagguguuuuuaguacaagacaucaaagugaaguaaagcccaaguguucuuuagcuu

SEQ ID NO: 520701 - RNA, 64 nt, Human
auccccauuugacagacgaaaaaauagaggcacagugaaguaacuugccuaagaccacacagga

SEQ ID NO: 520702 - RNA, 64 nt, Human
uauggugcugaggaagagcagcagcagcaggauggugaaguaguaaacugggggaggcagggca

SEQ ID NO: 520703 - RNA, 64 nt, Human
ccaguuuauauugacuccguaugcaugaguauuugugcaacacaagcacaacuaaguauguaua

SEQ ID NO: 520704 - RNA, 64 nt, Human
cuuucuuuuuuauucuugguauuuuccauaucgggugcaacacuucaguuaccaaauuucauug

SEQ ID NO: 520705 - RNA, 64 nt, Human
uggucauucaagguaguaggucucuuucaacugagugcaacauugagaauaaugauuugguuca

SEQ ID NO: 520706 - RNA, 64 nt, Human
aaggaaauuggauuuuagaacuggauguggugcagugaaguauuuuaggcccaggucuguguac

SEQ ID NO: 520707 - RNA, 64 nt, Human
agaguuagaacacuauguacucugcacagggggagugaaguaauauuggcuuagaagacuucac

SEQ ID NO: 520708 - RNA, 64 nt, Human
ggucucacucugucacccaggcuggaaugacgaagugaaguagugcaaacauagcucacugcag

SEQ ID NO: 520709 - RNA, 64 nt, Human
acaguucuguaaugcaaggaugcaguuuaaaaaugugaaguagugaugguuuuugaaauaagcu

SEQ ID NO: 520710 - RNA, 64 nt, Human
uauuaaauggaaaaggccugaauuaugcucuuaugugaaguaaauugauauaaccuauugacug

SEQ ID NO: 520711 - RNA, 64 nt, Human
auuuugaaaggacuuauuaauuuugcugacaaaagugaaguaacaaauauaaugauaauuggcu

SEQ ID NO: 520712 - RNA, 64 nt, Human
aaucacgcgccccugauggaacuuuucugcuguugugaaguacuuuuauccauuugcuucucug

SEQ ID NO: 520713 - RNA, 64 nt, Human
cucaugacggaaaucacacuaaagagagaaaucagugaaguaaggaacguggaaggucaugaau

SEQ ID NO: 520714 - RNA, 64 nt, Human
gauguaccuuuucccugccucacuccagguuuuagugaaguaaacaguauuuggaaaguuguug

SEQ ID NO: 520715 - RNA, 64 nt, Human
cuccuuaaccuuccaugucuccauuuucuucucugugaaguagguauaagaaguccuaucucau

SEQ ID NO: 520716 - RNA, 64 nt, Human
agaacuaguauuauaugguuuuuaaaaaacaauggugaaguacaugccacauaaaauuugccau

SEQ ID NO: 520717 - RNA, 64 nt, Human
gagggucacugcugcccacugcagggucccugaggugaaguaaacgccggcgcugggcuuggcc

SEQ ID NO: 520718 - RNA, 64 nt, Human
auuauucugaugcugggacaggugagaagaaacugugaaguauaugagccuuugaaaguucccu

SEQ ID NO: 520719 - RNA, 64 nt, Human
ugaagaauuauucaacaccuuuaacaauguauaugugaaguacuuuauucuuucauauuuuaaa

SEQ ID NO: 520720 - RNA, 64 nt, Human
aauguuauaugcugcaaacauuuacuauguaaacgugaaguagccaauaauaucucaauaguag

SEQ ID NO: 520721 - RNA, 64 nt, Human
uuccggauccagagccacagaaagaaauguaggugugaaguauuaggcugcugucagggagagg

SEQ ID NO: 520722 - RNA, 64 nt, Human
cccuguccuccugggcccugaggccccugcccuagugcaacaggcauugcugaggucugagcag

SEQ ID NO: 520723 - RNA, 64 nt, Human
ccugaccaggauagggcgggugggaaggagaggggugcaacaggaccgccugcacugaaaacuc

SEQ ID NO: 520724 - RNA, 64 nt, Human
cacuuaaggaauccuuacagcaugccgugaaugugugcaacauccuuauucucaucuuuaaggu

SEQ ID NO: 520725 - RNA, 64 nt, Human
uauuaucccagugguauucaauaaaucaaaaugugugaaguaaugggcaauaucaaacuuccug

SEQ ID NO: 520726 - RNA, 64 nt, Human
gcaggaauuugcugauuaauuuauuuuuaauggagugaaguauaccaugcaccaaaauaaacuu

SEQ ID NO: 520727 - RNA, 64 nt, Human
ugucuucuagccuugagccucugagggucaguaagugaaguacagauagcaaaauuuuacuacc

SEQ ID NO: 520728 - RNA, 64 nt, Human
uaguaugaauguggucagaggauuauaguugagagugaaguacuaugugugaguuauagaucuc

SEQ ID NO: 520729 - RNA, 64 nt, Human
guguccuccuuauuuaaaaagguauacuuacaaugugaaguaacuuaugaauaaaaggaaaagu

SEQ ID NO: 520730 - RNA, 64 nt, Human
guuuauaauccuauaagucuagauguauccaaaggugaaguauguaaaaagcagcaaaauauuu

SEQ ID NO: 520731 - RNA, 64 nt, Human
ugccuccacuugccuugugauauucuauuaccuugugaaguaggugaucuuugugacccacacc

SEQ ID NO: 520732 - RNA, 64 nt, Human
acuuugcuuauuugaagaaucagugguaggagcagugaaguaaauucuauggaguacauuucua

SEQ ID NO: 520733 - RNA, 64 nt, Human
uccaacugaauugcuaucauuuggcuggaugggggugaaguaugucuucaaaauauauugaagu

SEQ ID NO: 520734 - RNA, 64 nt, Human
uuugcacuauuucuuuuuguaacauuggcccugugugaaguauuucgaaucuccuccuugcucu

SEQ ID NO: 520735 - RNA, 64 nt, Human
caugugcagauaaaagagguuuaugaaguuuagggugaaguaggcaagggaaucuguuuacucc

SEQ ID NO: 520736 - RNA, 64 nt, Human
ucacaauuugugucucguuguucagaacaacccugugaaguaguuuuggcaaugucuguguuac

SEQ ID NO: 520737 - RNA, 64 nt, Human
auguuuuguaagaaaccaaucaagauaaaggacagugaaguaauccguaccuuguguuuuguuu

SEQ ID NO: 520738 - RNA, 64 nt, Human
auuuuaaguaauuuuuguuuuggcauuuuuuugugugaaguaaauuaaucaacuagagaggugc

SEQ ID NO: 520739 - RNA, 64 nt, Human
guuaaauauuugaacaauaaaaaagguacaaaaagugaaguacaaauuacccaaaucucuccac

SEQ ID NO: 520740 - RNA, 64 nt, Human
agaaaugacuuggccucauuuuggauuucauaaugugaaguauucaugauuuugaacugguaau

SEQ ID NO: 520741 - RNA, 64 nt, Human
guuuuuucuuaaaaaaaaaaaaagacuguaaauugugcaacaaagaugcauuuaccucuguauc

SEQ ID NO: 520742 - RNA, 64 nt, Human
gcuacuuccucaaaauguauccuuagucaccucagugcaacagcugggagggggccguguuaag

SEQ ID NO: 520743 - RNA, 64 nt, Human
aaggacaucauugacuuaauaauaguaucagucggugcaacaguuggcaacaugugccuucaca

SEQ ID NO: 520744 - RNA, 64 nt, Human
gguggauggcuacuuuaaucucuaaaaaagccaagugaaguaaaaguauucaguaugccuuuuc

SEQ ID NO: 520745 - RNA, 64 nt, Human
auguuacacaaagcaguaaaguuuuugagaacuagugaaguacuaauuaucaaggacauuuuga

SEQ ID NO: 520746 - RNA, 64 nt, Human
ggccuccgcuggaaaugcaaagugauucuagagagugaaguaauugcagaagcaguugggguga

SEQ ID NO: 520747 - RNA, 64 nt, Human
ugggucccaucugauaguggcuuugggaaccucugugaaguagagagcccucccuugucagggu

SEQ ID NO: 520748 - RNA, 64 nt, Human
agacccuguuucaaaaagaaaaacccugggaaaagugaaguauggcuguaagucucaugguuca

SEQ ID NO: 520749 - RNA, 64 nt, Human
ggaagggaccccuggagcaggcuggcccgggguggugaaguagcuggagcccgaucacaguccc

SEQ ID NO: 520750 - RNA, 64 nt, Human
auuguauuuuauaacaguagaaaacauauagucagugaaguaaauauuuuaaaggaaacauuau

SEQ ID NO: 520751 - RNA, 64 nt, Human
uuuacucaguuacucccuguaacuauguuaugcugugaaguaggcaauacaguuguuaaagaag

SEQ ID NO: 520752 - RNA, 64 nt, Human; identical to SEQ ID NO: 186552

SEQ ID NO: 520753 - RNA, 64 nt, Human; identical to SEQ ID NO: 186553

SEQ ID NO: 520754 - RNA, 57 nt, Human; identical to SEQ ID NO: 186554

SEQ ID NO: 520755 - RNA, 64 nt, Human; identical to SEQ ID NO: 186555

SEQ ID NO: 520756 - RNA, 64 nt, Human; identical to SEQ ID NO: 186556

SEQ ID NO: 520757 - RNA, 64 nt, Human; identical to SEQ ID NO: 186557

SEQ ID NO: 520758 - RNA, 64 nt, Human; identical to SEQ ID NO: 186558

SEQ ID NO: 520759 - RNA, 64 nt, Human; identical to SEQ ID NO: 186559

SEQ ID NO: 520760 - RNA, 64 nt, Human
aaacuuaaccaccuacaaggagauaagaaagcaggugcaacacucaagucuauugaauaaugua

SEQ ID NO: 520761 - RNA, 60 nt, Human
cagugggaucugaugaguaaauguuccuuugugcaacaauucggucuuuacuuaaccugc

SEQ ID NO: 520762 - RNA, 64 nt, Human
gauuuccauguuaaugaucuaauauaaucacucagugcaacauugagaauuuuuuuuuaauggc

SEQ ID NO: 520763 - RNA, 64 nt, Human; identical to SEQ ID NO: 186560

SEQ ID NO: 520764 - RNA, 64 nt, Human; identical to SEQ ID NO: 186561

SEQ ID NO: 520765 - RNA, 64 nt, Human; identical to SEQ ID NO: 186562

SEQ ID NO: 520766 - RNA, 64 nt, Human; identical to SEQ ID NO: 186563

SEQ ID NO: 520767 - RNA, 64 nt, Human; identical to SEQ ID NO: 186564

SEQ ID NO: 520768 - RNA, 64 nt, Human; identical to SEQ ID NO: 186565

SEQ ID NO: 520769 - RNA, 64 nt, Human; identical to SEQ ID NO: 186566

SEQ ID NO: 520770 - RNA, 64 nt, Human; identical to SEQ ID NO: 186567

SEQ ID NO: 520771 - RNA, 64 nt, Human; identical to SEQ ID NO: 186568

SEQ ID NO: 520772 - RNA, 64 nt, Human; identical to SEQ ID NO: 186569

SEQ ID NO: 520773 - RNA, 64 nt, Human; identical to SEQ ID NO: 186570

SEQ ID NO: 520774 - RNA, 64 nt, Human; identical to SEQ ID NO: 186571

SEQ ID NO: 520775 - RNA, 64 nt, Human; identical to SEQ ID NO: 186572

SEQ ID NO: 520776 - RNA, 64 nt, Human; identical to SEQ ID NO: 186573

SEQ ID NO: 520777 - RNA, 64 nt, Human; identical to SEQ ID NO: 186574

SEQ ID NO: 520778 - RNA, 52 nt, Human; identical to SEQ ID NO: 186575

SEQ ID NO: 520779 - RNA, 64 nt, Human
caauucauugguuuuuaguauaguucacugaguugugcaacaucauugcuauuuaauuucaggc

SEQ ID NO: 520780 - RNA, 64 nt, Human
cuuuauggugggggcagacuuugcacuuacugcagugcaacacuugcacuuuaauuuuccucca

SEQ ID NO: 520781 - RNA, 64 nt, Human
ugguaacaagaguuccaucccaggaggccaaacggugcaacagaaggguagguuagaugcuauu

SEQ ID NO: 520782 - RNA, 64 nt, Human; identical to SEQ ID NO: 186576

SEQ ID NO: 520783 - RNA, 64 nt, Human; identical to SEQ ID NO: 186577

SEQ ID NO: 520784 - RNA, 52 nt, Human; identical to SEQ ID NO: 186578

SEQ ID NO: 520785 - RNA, 64 nt, Human; identical to SEQ ID NO: 186579

SEQ ID NO: 520786 - RNA, 64 nt, Human; identical to SEQ ID NO: 186580

SEQ ID NO: 520787 - RNA, 64 nt, Human; identical to SEQ ID NO: 186581

SEQ ID NO: 520788 - RNA, 64 nt, Human; identical to SEQ ID NO: 186582

SEQ ID NO: 520789 - RNA, 64 nt, Human; identical to SEQ ID NO: 186583

SEQ ID NO: 520790 - RNA, 64 nt, Human; identical to SEQ ID NO: 186584

SEQ ID NO: 520791 - RNA, 64 nt, Human; identical to SEQ ID NO: 186585

SEQ ID NO: 520792 - RNA, 64 nt, Human; identical to SEQ ID NO: 186586

SEQ ID NO: 520793 - RNA, 64 nt, Human; identical to SEQ ID NO: 186587

SEQ ID NO: 520794 - RNA, 64 nt, Human; identical to SEQ ID NO: 186588

SEQ ID NO: 520795 - RNA, 64 nt, Human; identical to SEQ ID NO: 186589

SEQ ID NO: 520796 - RNA, 64 nt, Human; identical to SEQ ID NO: 186590

SEQ ID NO: 520797 - RNA, 64 nt, Human; identical to SEQ ID NO: 186591

SEQ ID NO: 520798 - RNA, 64 nt, Human
auaauagauccagaagaagugaccugaaguuucugugcaacacucacacuaggcaaugccauuu

SEQ ID NO: 520799 - RNA, 64 nt, Human
caguuaaagguuuaauuuuuguuuaaaccuagacgugcaacaaaaguuuuaccacagucugcac

SEQ ID NO: 520800 - RNA, 64 nt, Human
cugauaggggacacuucacuaccagaugugugcagugcaacagauggucauauacacugugagg

SEQ ID NO: 520801 - RNA, 64 nt, Human; identical to SEQ ID NO: 186592

SEQ ID NO: 520802 - RNA, 64 nt, Human; identical to SEQ ID NO: 186593

SEQ ID NO: 520803 - RNA, 64 nt, Human; identical to SEQ ID NO: 186594

SEQ ID NO: 520804 - RNA, 56 nt, Human; identical to SEQ ID NO: 186595

SEQ ID NO: 520805 - RNA, 64 nt, Human; identical to SEQ ID NO: 186596

SEQ ID NO: 520806 - RNA, 64 nt, Human; identical to SEQ ID NO: 186597

SEQ ID NO: 520807 - RNA, 64 nt, Human; identical to SEQ ID NO: 186598

SEQ ID NO: 520808 - RNA, 64 nt, Human; identical to SEQ ID NO: 186599

SEQ ID NO: 520809 - RNA, 64 nt, Human; identical to SEQ ID NO: 186600

SEQ ID NO: 520810 - RNA, 64 nt, Human; identical to SEQ ID NO: 186601

SEQ ID NO: 520811 - RNA, 64 nt, Human; identical to SEQ ID NO: 186602

SEQ ID NO: 520812 - RNA, 64 nt, Human; identical to SEQ ID NO: 186603

SEQ ID NO: 520813 - RNA, 64 nt, Human; identical to SEQ ID NO: 186604

SEQ ID NO: 520814 - RNA, 64 nt, Human; identical to SEQ ID NO: 186605

SEQ ID NO: 520815 - RNA, 64 nt, Human; identical to SEQ ID NO: 186606

SEQ ID NO: 520816 - RNA, 64 nt, Human; identical to SEQ ID NO: 186607

SEQ ID NO: 520817 - RNA, 64 nt, Human
caaguuucauucucccuuucacuaaaacacacaggugcaacagacuugaaugcuaguuauacuu

SEQ ID NO: 520818 - RNA, 64 nt, Human
uuuguguguugucucuugaguuugucgcucaugugugcaacaggguauggacuaucugucuggu

SEQ ID NO: 520819 - RNA, 64 nt, Human
cucugggacccccuguguuguuacaggcugugcagugcaacaauuccagcaaaaauacccuauc

SEQ ID NO: 520820 - RNA, 64 nt, Human; identical to SEQ ID NO: 186608

SEQ ID NO: 520821 - RNA, 64 nt, Human; identical to SEQ ID NO: 186608

SEQ ID NO: 520822 - RNA, 64 nt, Human; identical to SEQ ID NO: 186610

SEQ ID NO: 520823 - RNA, 64 nt, Human; identical to SEQ ID NO: 186611

SEQ ID NO: 520824 - RNA, 64 nt, Human; identical to SEQ ID NO: 186612

SEQ ID NO: 520825 - RNA, 64 nt, Human; identical to SEQ ID NO: 186613

SEQ ID NO: 520826 - RNA, 64 nt, Human; identical to SEQ ID NO: 186614

SEQ ID NO: 520827 - RNA, 64 nt, Human; identical to SEQ ID NO: 186615

SEQ ID NO: 520828 - RNA, 64 nt, Human; identical to SEQ ID NO: 186616

SEQ ID NO: 520829 - RNA, 64 nt, Human; identical to SEQ ID NO: 186617

SEQ ID NO: 520830 - RNA, 64 nt, Human; identical to SEQ ID NO: 186618

SEQ ID NO: 520831 - RNA, 64 nt, Human; identical to SEQ ID NO: 186619

SEQ ID NO: 520832 - RNA, 64 nt, Human; identical to SEQ ID NO: 186620

SEQ ID NO: 520833 - RNA, 64 nt, Human; identical to SEQ ID NO: 186621

SEQ ID NO: 520834 - RNA, 64 nt, Human; identical to SEQ ID NO: 186622

SEQ ID NO: 520835 - RNA, 64 nt, Human; identical to SEQ ID NO: 186623

SEQ ID NO: 520836 - RNA, 64 nt, Human
gaugaauagcuaacuguucccaaguguuugcuaugugcaacacaccgcgugagcaguguuaccu

SEQ ID NO: 520837 - RNA, 54 nt, Human
uuucggcgagauacgucuaacccugugcaacagccacuacauuacuucaaacug

SEQ ID NO: 520838 - RNA, 64 nt, Human
gauauuagaugcccgaucauauagauauuuuuaagugcaacauuuacaugauaacaguacauuu

SEQ ID NO: 520839 - RNA, 64 nt, Human; identical to SEQ ID NO: 186624

SEQ ID NO: 520840 - RNA, 64 nt, Human; identical to SEQ ID NO: 186625

SEQ ID NO: 520841 - RNA, 64 nt, Human; identical to SEQ ID NO: 186626

SEQ ID NO: 520842 - RNA, 64 nt, Human; identical to SEQ ID NO: 186627

SEQ ID NO: 520843 - RNA, 64 nt, Human; identical to SEQ ID NO: 186628

SEQ ID NO: 520844 - RNA, 64 nt, Human; identical to SEQ ID NO: 186629

SEQ ID NO: 520845 - RNA, 64 nt, Human; identical to SEQ ID NO: 186630

SEQ ID NO: 520846 - RNA, 64 nt, Human; identical to SEQ ID NO: 186631

SEQ ID NO: 520847 - RNA, 64 nt, Human; identical to SEQ ID NO: 186632

SEQ ID NO: 520848 - RNA, 64 nt, Human; identical to SEQ ID NO: 186633

SEQ ID NO: 520849 - RNA, 64 nt, Human; identical to SEQ ID NO: 186634

SEQ ID NO: 520850 - RNA, 64 nt, Human; identical to SEQ ID NO: 186635

SEQ ID NO: 520851 - RNA, 64 nt, Human; identical to SEQ ID NO: 186636

SEQ ID NO: 520852 - RNA, 64 nt, Human; identical to SEQ ID NO: 186637

SEQ ID NO: 520853 - RNA, 64 nt, Human; identical to SEQ ID NO: 186638

SEQ ID NO: 520854 - RNA, 64 nt, Human; identical to SEQ ID NO: 186639

SEQ ID NO: 520855 - RNA, 64 nt, Human
uguuguuccuuuuuugaaguugucauuaaaguaggugcaacaaccaagaaagugucucuucccu

SEQ ID NO: 520856 - RNA, 64 nt, Human
ggaucgcuugaggucaggaguucgagaccagcuugugcaacaaagugagagccugucucuacaa

SEQ ID NO: 520857 - RNA, 64 nt, Human
caccagcccgcugagugugcacgaaauguucgcagugcaacaaaaagaaaaauccaucaggaac

SEQ ID NO: 520858 - RNA, 64 nt, Human
gaggaagggcgaguaggggcaccuggacgcugaugguggccaggaugcucagcuggccaggagg

SEQ ID NO: 520859 - RNA, 64 nt, Human
caaccaccucugacgggcugggcagccgggggccgguggccagagcgagggcaccagccacgaa

SEQ ID NO: 520860 - RNA, 64 nt, Human
gugggcagguggacgcucugcugagacagaagcugguggccacugccgggugcccgcguggggu

SEQ ID NO: 520861 - RNA, 64 nt, Human
gaugcgacggggcagcuggcuguguccauggccagguggccagggucagggcugcaagccaggg

SEQ ID NO: 520862 - RNA, 64 nt, Human
gaggaaaugaguugguagccucugugcacuguuugguggccacaucacaggugauguccuguuc

SEQ ID NO: 520863 - RNA, 64 nt, Human
caagaccaccagggucccaggaagccggugccuggguggccauccuacccagcguggcccaggc

SEQ ID NO: 520864 - RNA, 64 nt, Human
uuaucaggggucaggcgccugggaaggggccuuugguggccacccuggugaggacaccuguccc

SEQ ID NO: 520865 - RNA, 64 nt, Human
cuaggcugccuuggaggguacaagauccacugaggguggccaccacagccuuggcuccauggug

SEQ ID NO: 520866 - RNA, 64 nt, Human
aaaauuccucugcgcugggguccgacugcccucugguggccauuuggggaaaacugcagcccgg

SEQ ID NO: 520867 - RNA, 64 nt, Human
cugcccaguuuucacugccuugugaggucaaggugguggccaaggacaccagccaccccacuga

SEQ ID NO: 520868 - RNA, 64 nt, Human
uuuuuuuuuucuguuccaaagauucauccuaugggguggccauaaagucuagaauuagauacua

SEQ ID NO: 520869 - RNA, 64 nt, Human
aggcccugccaaccaacugccucucugaggaggagguggccaagaagcggaaaaaccuggccac

SEQ ID NO: 520870 - RNA, 64 nt, Human
cugcccacuuguccaggccuggccucuuucuugagguggccaccaggcccaggccaggcccuuu

SEQ ID NO: 520871 - RNA, 61 nt, Human; identical to SEQ ID NO: 446352

SEQ ID NO: 520872 - RNA, 61 nt, Human; identical to SEQ ID NO: 446413

SEQ ID NO: 520873 - RNA, 61 nt, Human; identical to SEQ ID NO: 446414

SEQ ID NO: 520874 - RNA, 61 nt, Human; identical to SEQ ID NO: 446415

SEQ ID NO: 520875 - RNA, 64 nt, Human
ugaggaugucacagcuugaggcuguggugugaaagguggccagccugguucucuucccugcuca

SEQ ID NO: 520876 - RNA, 63 nt, Human
agccccagggggccacguagcagcggcucaguggguggccaucgaucuggaccguccccugcc

SEQ ID NO: 520877 - RNA, 64 nt, Human
agaucacaguggccacggccacggccacagucaugguggccacggccacagccacuaaucagga

SEQ ID NO: 520878 - RNA, 64 nt, Human
agaugccacaagcauucagaaaggagucugaaaggguggccacagccccacguggugugcccug

SEQ ID NO: 520879 - RNA, 64 nt, Human
acgguucucaaauaucaguuaaaaacuaauuuuagguggccauaaacauaaaauagaaacccug

SEQ ID NO: 520880 - RNA, 64 nt, Human
gccuccaggugggaggagagcaugccuaaacccugguggccauuguucuguacuaaggaacaac

SEQ ID NO: 520881 - RNA, 64 nt, Human
ccaaucagaauauaagacucaaggaguuugacuugguggccaauaccugccuuccaaagagauc

SEQ ID NO: 520882 - RNA, 64 nt, Human
gcuuggucugacugagccuaaaguugagaaaauggguggccaaggccagugccagugucuuggg

SEQ ID NO: 520883 - RNA, 64 nt, Human
ggcugucaccacgugcaguaucucaagauauucagguggccagaagagcuugucagcaagagga

SEQ ID NO: 520884 - RNA, 64 nt, Human
gucuagagucaugugagccucgugucaucuccgggguggccacaggcuagauccccggugguuu

SEQ ID NO: 520885 - RNA, 64 nt, Human
acccuauucucccacgaggauccucagugaccaugguggccacacgccuggccagccugcuggc

SEQ ID NO: 520886 - RNA, 64 nt, Human
gacuucugaccucucacaagaaggcugcaggugagguggccaaguccagggaaaggcccugcua

SEQ ID NO: 520887 - RNA, 64 nt, Human
gacauagccuguccgggcaucaacccucucuggcgguggccaccaguccuugccaauccccaga

SEQ ID NO: 520888 - RNA, 61 nt, Human; identical to SEQ ID NO: 446377

SEQ ID NO: 520889 - RNA, 61 nt, Human; identical to SEQ ID NO: 446378

SEQ ID NO: 520890 - RNA, 61 nt, Human; identical to SEQ ID NO: 446379

SEQ ID NO: 520891 - RNA, 61 nt, Human; identical to SEQ ID NO: 446416

SEQ ID NO: 520892 - RNA, 64 nt, Human
uucagaugaccauugcuagcaagaaacaggaggcgguggccauauuccaaaaaccacuucuguc

SEQ ID NO: 520893 - RNA, 64 nt, Human
gccagugaagccuccaacccuaagccacugggacgguggccagagaugccagcagccucugucg

SEQ ID NO: 520894 - RNA, 64 nt, Human
ucacgccuguaaucccagcacuuugggaggccgagguggccagaucaccugaggucaggaguuc

SEQ ID NO: 520895 - RNA, 64 nt, Human
aauaaauuauagaauguaguuggguggauuuugggguggccauauaguaauggaaagcugcaau

SEQ ID NO: 520896 - RNA, 64 nt, Human
uaccuucuacaggcccggcccagccuaggcccgggguggccacaccacagcaagccggcccccc

SEQ ID NO: 520897 - RNA, 64 nt, Human
ccuggcuuccuggaguugauggaauaaagguugggguggccauaaugguuuguugggggugagg

SEQ ID NO: 520898 - RNA, 64 nt, Human
cuaucccccaggacugauucuuucccggagaugggguggccacuuaucuguccucuggaucagg

SEQ ID NO: 520899 - RNA, 64 nt, Human
guggcuuagccggaggggacguggccaagggugagguggccaaaaccagaaccagcagucuccu

SEQ ID NO: 520900 - RNA, 64 nt, Human
gucugugucacugaggugaccugcgugucacugagguggccaccaugcuggccugcggcaugug

SEQ ID NO: 520901 - RNA, 64 nt, Human
ggagguuggucacaaugagaaccucgggguuugagguggccaugggcagacagccgaaagggag

SEQ ID NO: 520902 - RNA, 64 nt, Human
gacaaccauggcugcuguacugccgcccaggguggguggccagugaggacuggccuuagcccag

SEQ ID NO: 520903 - RNA, 64 nt, Human
cucccccuacguugcgcugcucaucacagcccgggguggccacaucggcuuccuggaagggcug

SEQ ID NO: 520904 - RNA, 64 nt, Human
caauggaaagcucuaggaaacaccagucuugagagguggccagccagacugccuguccacaugc

SEQ ID NO: 520905 - RNA, 61 nt, Human; identical to SEQ ID NO: 446419

SEQ ID NO: 520906 - RNA, 61 nt, Human; identical to SEQ ID NO: 446420

SEQ ID NO: 520907 - RNA, 61 nt, Human; identical to SEQ ID NO: 446421

SEQ ID NO: 520908 - RNA, 61 nt, Human; identical to SEQ ID NO: 446425

SEQ ID NO: 520909 - RNA, 64 nt, Human
ccuagagggcccagcauguggcugggaaacuguugguggccaguggguaauaaagaccuuucag

SEQ ID NO: 520910 - RNA, 64 nt, Human
ucccugaagcuguagggccuugugggagugaucugguggccagaacaggauuuugcacggcccc

SEQ ID NO: 520911 - RNA, 64 nt, Human
gggacacaaucagcuuuaaccaauggaugagggggguggccacaggagauggggagaggagucu

SEQ ID NO: 520912 - RNA, 64 nt, Human
cgcuguccugcugugugaauucccagguuggccugguggccaugucgccugcccccagcacucc

SEQ ID NO: 520913 - RNA, 64 nt, Human
gauucugagcauuugauucugacuucuguacucugguggccacuggaucuuugggauuaaagcu

SEQ ID NO: 520914 - RNA, 64 nt, Human
agggauuagauagugacuaagccgccagaauugagguggccauuccuuuuuguauaggcuaaga

SEQ ID NO: 520915 - RNA, 64 nt, Human
ggcuggcaccucauaucucagcagagaagccagugguggccacgcagccuuauaaagcagguuu

SEQ ID NO: 520916 - RNA, 64 nt, Human
aggguggggggucuuccuucuuaaucccauggcugguggccacgcccccaccaucaucagcugg

SEQ ID NO: 520917 - RNA, 64 nt, Human
auuccugaaggaagacagugguagccacaggaacgguggccauuuccaagcucccugcccucug

SEQ ID NO: 520918 - RNA, 64 nt, Human
caggaagaaaacuucaugaccgaaucagagccuugguggccacugacucucgugcuuauugcag

SEQ ID NO: 520919 - RNA, 64 nt, Human
cacgugagucccgucgcauccccucccucuuccugguggccaccucccucccgcccacccacuc

SEQ ID NO: 520920 - RNA, 64 nt, Human
acuaagcaucuccugcgaucccacagaggacugugguggccacaggagcugaaagcagaagagu

SEQ ID NO: 520921 - RNA, 64 nt, Human
gccaccucucugccuguuccucccaagaggccaggguggccagggguggugagggcaguucugc

SEQ ID NO: 520922 - RNA, 61 nt, Human; identical to SEQ ID NO: 446426

SEQ ID NO: 520923 - RNA, 61 nt, Human; identical to SEQ ID NO: 446427

SEQ ID NO: 520924 - RNA, 61 nt, Human; identical to SEQ ID NO: 446428

SEQ ID NO: 520925 - RNA, 61 nt, Human; identical to SEQ ID NO: 446430

SEQ ID NO: 520926 - RNA, 64 nt, Human
gcuuaagagcagauggugacaaguucucugggcagguggccauggggaggggccauggcuuggc

SEQ ID NO: 520927 - RNA, 64 nt, Human
auggggcugggaggucucaggggccuucccuggggguggccagccugguagggggcagagaagg

SEQ ID NO: 520928 - RNA, 64 nt, Human
gcgagccagauuaggccuggaguugggcugguuugguggccaggcugguaaauuuaggauauua

SEQ ID NO: 520929 - RNA, 64 nt, Human
cuguccauauucaggaaucugagaguguaaaaaagguggccauaagacagagagagaauaaucg

SEQ ID NO: 520930 - RNA, 64 nt, Human
gcuccugugcuuucccugaacugggaccuuuagugguggccauuuagccaccaucuuugcaggu

SEQ ID NO: 520931 - RNA, 64 nt, Human
ucggcuuccuuacccagcaccccuccgguagguggguggccacguggaugccucgcuggggcgg

SEQ ID NO: 520932 - RNA, 57 nt, Human
acaucauugagaagugguaguggcggugguggccacggggaggccucuuggggggug

SEQ ID NO: 520933 - RNA, 64 nt, Human
aaauaaaaaaaaaaaaagacgaacuauuggaggugguggccaaugaugcauuuacuguuugcag

SEQ ID NO: 520934 - RNA, 55 nt, Human
ucagugugaugggaaccuaagcguggguggccaacaucauauaccucuugaagaa

SEQ ID NO: 520935 - RNA, 64 nt, Human
acggucuugggacuuguuugacuuuccccucccugguggccacucuuugcucugaagcccagau

SEQ ID NO: 520936 - RNA, 64 nt, Human
augucaucuccuagacaaucagucaaauagagcugguggccagugguuagcuauucgcacguua

SEQ ID NO: 520937 - RNA, 64 nt, Human
gugugagaugccaaaucugugaaaaccagacacagguggccaggugggugucgaacuccugacc

SEQ ID NO: 520938 - RNA, 64 nt, Human
gcuccuucucuccaagugcacuacccuggagagugguggccacucaauaccuuuuccucuagcu

SEQ ID NO: 520939 - RNA, 61 nt, Human; identical to SEQ ID NO: 446366

SEQ ID NO: 520940 - RNA, 61 nt, Human; identical to SEQ ID NO: 446367

SEQ ID NO: 520941 - RNA, 61 nt, Human; identical to SEQ ID NO: 446368

SEQ ID NO: 520942 - RNA, 61 nt, Human; identical to SEQ ID NO: 446460

SEQ ID NO: 520943 - RNA, 64 nt, Human
gaggcuggcugccucuccuccugcugucucugcugguggccacaugggugcugguggcagggau

SEQ ID NO: 520944 - RNA, 64 nt, Human
ggcucagaaucuuagguaggugcuuaacucuugugguggccagccuccaagaugagccccagug

SEQ ID NO: 520945 - RNA, 64 nt, Human
gugagcgcccagcuucuguuucauagucuuaacagguggccauugucgugaaacgagugaugcc

SEQ ID NO: 520946 - RNA, 64 nt, Human
aucaggugcaagugguagggacaagcagugaggugguggccaugacacuggagaccaagccuca

SEQ ID NO: 520947 - RNA, 64 nt, Human
acuugagacuugcuaggccucugcugugugcugggguggccagugggacucaggagagagcaag

SEQ ID NO: 520948 - RNA, 64 nt, Human
ccaaggcucugaccaugcuuaguacuggaauagagguggccaggcccccagcgacucuucuugg

SEQ ID NO: 520949 - RNA, 64 nt, Human
uguacccggcuacuuagguaugcuuaggggagcugguggccaggggugccccuucaggccugcu

SEQ ID NO: 520950 - RNA, 64 nt, Human
uaaaccucaagccccugacccccaagggcacaacgguggccaaacucagggcucacaggccagc

SEQ ID NO: 520951 - RNA, 64 nt, Human
caacaguuuucucgggggaguucagugaccuuuugguggccacccucuguucucaccugugagu

SEQ ID NO: 520952 - RNA, 64 nt, Human
gagugccacuucgggagaagaaggcaacccaaaugguggccauugugcuugguaaguuuggguu

SEQ ID NO: 520953 - RNA, 64 nt, Human
gccuucgugccuucgugccuucgugccuucccgcgguggccaggccucugcugcagccgcuggu

SEQ ID NO: 520954 - RNA, 64 nt, Human
aaaaaucauguuaucaaaaacugucaguuauuuugguggccacaugcaaccaugugauuacuuu

SEQ ID NO: 520955 - RNA, 53 nt, Human
gaagagcagagaaaucuuaagacgguggccaaauuaaagugcuggccuucaga

SEQ ID NO: 520956 - RNA, 61 nt, Human; identical to SEQ ID NO: 446435

SEQ ID NO: 520957 - RNA, 61 nt, Human; identical to SEQ ID NO: 446436

SEQ ID NO: 520958 - RNA, 61 nt, Human; identical to SEQ ID NO: 446437

SEQ ID NO: 520959 - RNA, 61 nt, Human; identical to SEQ ID NO: 446442

SEQ ID NO: 520960 - RNA, 64 nt, Human
agucugucuuccccugcggauggccucagcccuggguggccagacucugugcucacaauccaga

SEQ ID NO: 520961 - RNA, 64 nt, Human
gcucaggguggucucuucuuggggcccagugcaugguggccagaggugucacccaaaccggcag

SEQ ID NO: 520962 - RNA, 64 nt, Human
ucauuugaaauuacagcaugaugaauuuugcauggguggccagccagcuagcccauaacugaua

SEQ ID NO: 520963 - RNA, 64 nt, Human
aggugacugggauguagagaggcguuagugggcagguggccacagcaggacugaggacaggccc

SEQ ID NO: 520964 - RNA, 64 nt, Human
agugccccucacaccucgugccucccccucacaggguggccaccugcaccagcgucagggccca

SEQ ID NO: 520965 - RNA, 64 nt, Human
ucaaauggaguauugcggcugcacgucacacuaggguggccacccccgccauugcgagccacau

SEQ ID NO: 520966 - RNA, 64 nt, Human
uguacuacggugccgaccgcaaugcgaggaaugugguggccacgcgauggagcuggccggagga

SEQ ID NO: 520967 - RNA, 64 nt, Human
ucccucuuucuuacgguucaaaggugacccuggugguggccagagcaguaaugcuuguuugaug

SEQ ID NO: 520968 - RNA, 64 nt, Human
cagcauuuaugguagaauauauaauuauauauaagguggccacgcuggggcaaguucccucccc

SEQ ID NO: 520969 - RNA, 64 nt, Human
gaaaggggcuucuucggucccgagcucgcguccagguggccaggccucugccggcggcuccagu

SEQ ID NO: 520970 - RNA, 64 nt, Human
aaaauaguccuccaaaacacaagggaggauuuuggguggccaaaguguacaauuuucaucccac

SEQ ID NO: 520971 - RNA, 64 nt, Human
cucaaucagucucagaaugucauuuugguacuuugguggccacauaagccauuauucacuagua

SEQ ID NO: 520972 - RNA, 64 nt, Human
uuuuuguauuuucaguagagacggguuucaucaugguggccaggauggucuaucucuugaccuc

SEQ ID NO: 520973 - RNA, 61 nt, Human; identical to SEQ ID NO: 446315

SEQ ID NO: 520974 - RNA, 61 nt, Human; identical to SEQ ID NO: 446316

SEQ ID NO: 520975 - RNA, 61 nt, Human; identical to SEQ ID NO: 446317

SEQ ID NO: 520976 - RNA, 61 nt, Human; identical to SEQ ID NO: 446318

SEQ ID NO: 520977 - RNA, 64 nt, Human
gcagugugaugugucccaaacggacuggcucauggguggccacgucacaaccucugaucucaga

SEQ ID NO: 520978 - RNA, 64 nt, Human
cucugucauugagggaugcugggcacugcugccggguggccaggguauggggcaugugcccagc

SEQ ID NO: 520979 - RNA, 64 nt, Human
auguauuuggggccuucucaggugaggaagccaagguggccaaggcccucgguccccugcccug

SEQ ID NO: 520980 - RNA, 64 nt, Human
aaaauguauagaugcuuggacagacccgguaauggguggccauugguaaauguuaggaacacac

SEQ ID NO: 520981 - RNA, 64 nt, Human
ccacuguggcacugccuaacuccguguauccucggguggccaacuugcuaucuggugggugacu

SEQ ID NO: 520982 - RNA, 64 nt, Human
cgugguagaugaagccucuuacugccccacuuaggguggccacggcugcuugugaaugcagcuu

SEQ ID NO: 520983 - RNA, 64 nt, Human
ccaucuccacuucugauucaugcugccccuccuugguggccacaauuuagccaugucaucuggu

SEQ ID NO: 520984 - RNA, 64 nt, Human
agagccugugucaggccccaucccagcaggccuggguggccacuuucugacccccaaagguggg

SEQ ID NO: 520985 - RNA, 64 nt, Human
augugccuaaaggcucaaggggauauuccucugggguggccacucccaccacccugacccuguc

SEQ ID NO: 520986 - RNA, 64 nt, Human
uuacuaagccacaagaaauuugauuucuauucaagguggccaaauuauuuguguaauagaaaac

SEQ ID NO: 520987 - RNA, 64 nt, Human
ggccagagccucagcuggaugagaggcugagauggguggccagcuuguacaccagucccugaac

SEQ ID NO: 520988 - RNA, 64 nt, Human
uuuauugaacuaauguccaggaguagacaugauugguggccaaguuauuuggggacaccuaaac

SEQ ID NO: 520989 - RNA, 64 nt, Human
ccccuugugaccggcccugaacgcccagcagagugguggccagaggggagaggugcucccccug

SEQ ID NO: 520990 - RNA, 61 nt, Human; identical to SEQ ID NO: 446311

SEQ ID NO: 520991 - RNA, 61 nt, Human; identical to SEQ ID NO: 446312

SEQ ID NO: 520992 - RNA, 61 nt, Human; identical to SEQ ID NO: 446313

SEQ ID NO: 520993 - RNA, 61 nt, Human; identical to SEQ ID NO: 446319

SEQ ID NO: 520994 - RNA, 64 nt, Human
ucugggccugaccaaacagccaacuagccccugggguggccaccaguaugacaguauuauacgc

SEQ ID NO: 520995 - RNA, 64 nt, Human
ccccaagggcccaggcuguggcugacacauagaagguggccacauaggucucuggggugagaag

SEQ ID NO: 520996 - RNA, 64 nt, Human
gagagaacaagcaagccggggcuaccugcccccagguggccaccaaguuguggaagcacauuuc

SEQ ID NO: 520997 - RNA, 64 nt, Human
ugaguuaggaagcccucagucacuugccuuccacgguggccagcccugcugccaucauuggcug

SEQ ID NO: 520998 - RNA, 64 nt, Human
cgccugcccucccugggguccuugcugcaggccggguggccaauccaggugggagagacacucc

SEQ ID NO: 520999 - RNA, 64 nt, Human
ggcagaagccacagcagccucuguccagccugcagguggccacuuggaaccauguguccacugg

SEQ ID NO: 521000 - RNA, 64 nt, Human
uuauuguuuuaaaccaaaguuuacagugucuguugguggccaagaccuucucucuccaccccuc

SEQ ID NO: 521001 - RNA, 64 nt, Human
gacugaucuccugaguacacugaagccacaggcugguggccauguucucugaauugggugcaga

SEQ ID NO: 521002 - RNA, 64 nt, Human
uggaccagccguaauaaagagccaagguagugaugguggccacgugccucguugcuauuuuuaa

SEQ ID NO: 521003 - RNA, 64 nt, Human
cuccaggugucagguccccucauugcucuucucagguggccacacuaugucaagaagccucucc

SEQ ID NO: 521004 - RNA, 64 nt, Human
agcuucuucauugaacacuguaucucuugagagagguggccauaagacauggcacacaauuccc

SEQ ID NO: 521005 - RNA, 64 nt, Human
uugucugauguggcaaaaggcccucuggagggcugguggccacgagguuaaagaagcugcaugu

SEQ ID NO: 521006 - RNA, 64 nt, Human
cuuuauggagaguucaggagaaaaaggauuuugugguggccaucacuuucauucaauuugcgac

SEQ ID NO: 521007 - RNA, 61 nt, Human; identical to SEQ ID NO: 446411

SEQ ID NO: 521008 - RNA, 61 nt, Human; identical to SEQ ID NO: 446443

SEQ ID NO: 521009 - RNA, 61 nt, Human; identical to SEQ ID NO: 446444

SEQ ID NO: 521010 - RNA, 61 nt, Human; identical to SEQ ID NO: 446445

SEQ ID NO: 521011 - RNA, 64 nt, Human
uuacuagaucccuuaccagucacauuuguggacugguggccagucguauaccaucccuggaagg

SEQ ID NO: 521012 - RNA, 64 nt, Human
auuuaguuuguguuaacuaugaaccaagcagugugguggccacuggugacuugaaaauauagag

SEQ ID NO: 521013 - RNA, 64 nt, Human
ucacacugacuuagaacggggggaggggguaccagguggccaggugggacuguuucaaauuucc

SEQ ID NO: 521014 - RNA, 64 nt, Human
augcaugauaaagagaggcccaaggcuuggauaagguggccacuucccucaguggagucaguca

SEQ ID NO: 521015 - RNA, 64 nt, Human
gggacacaggauccuggccugagaauugaggggagguggccagcccgcagagguggggugcugg

SEQ ID NO: 521016 - RNA, 64 nt, Human
agagaaccucaccaaacagcugguguggccugaggguggccauggugggaaaugggcaugagaa

SEQ ID NO: 521017 - RNA, 64 nt, Human
uucugccccaugacaggccugggugccacacagagguggccacccucccaccacagugucugca

SEQ ID NO: 521018 - RNA, 64 nt, Human
gcccccagcugggucucagaggagcugggggagcgguggccagcccauuuucuggggugaggcu

SEQ ID NO: 521019 - RNA, 64 nt, Human
gcauggguuacuggaagccgggacugcuagggcugguggccagggagcugcaagagugaggcuc

SEQ ID NO: 521020 - RNA, 64 nt, Human
agggucuaagacccagaaugaguuucuccagccagguggccacuuuauggaaaggaugcagggu

SEQ ID NO: 521021 - RNA, 64 nt, Human
cucagcucuuggugggcccagggacacccacacagguggccaucacagccccauggacaacacu

SEQ ID NO: 521022 - RNA, 64 nt, Human
ccuauauuccagguuuaaguagauuucaugccuggguggccaaacaacagucuucauuuuuuuu

SEQ ID NO: 521023 - RNA, 64 nt, Human
gaauauauaaaaagggaauuuaggauccaccaucgguggccaggaaaauagcagugacaauaaa

SEQ ID NO: 521024 - RNA, 61 nt, Human; identical to SEQ ID NO: 446322

SEQ ID NO: 521025 - RNA, 61 nt, Human; identical to SEQ ID NO: 446326

SEQ ID NO: 521026 - RNA, 61 nt, Human; identical to SEQ ID NO: 446327

SEQ ID NO: 521027 - RNA, 61 nt, Human; identical to SEQ ID NO: 446328

SEQ ID NO: 521028 - RNA, 64 nt, Human
acauuuugcucuuuggccugguguggacggaaaggguggccaaauggauugagugaugagcaga

SEQ ID NO: 521029 - RNA, 64 nt, Human
caaauuaucauccaaccuauacuuaaaaacauaugguggccaggcaugguggcucacgccugua

SEQ ID NO: 521030 - RNA, 64 nt, Human
uuauguuccugcuuuguaauucauguuugagauggguggccacuguacagauauuuauuacgcu

SEQ ID NO: 521031 - RNA, 64 nt, Human
gucuauauauaugaggaacuuguguuuuuuaaaugguggccagguagaggaacuagaaaagaga

SEQ ID NO: 521032 - RNA, 64 nt, Human
ugccuuuuuucuuuuucucuugcuucuaaggggugguggccaccacuguuuagaaugacccuug

SEQ ID NO: 521033 - RNA, 64 nt, Human
aggagcugcccagaccugcgugucagcccuuggugguggccagggagaggcgcccggugcagau

SEQ ID NO: 521034 - RNA, 62 nt, Human
ucgugaagacccugaagugagccgcugugacggguggccaguuuccuuaauuuaugaaggca

SEQ ID NO: 521035 - RNA, 64 nt, Human
agcagugaccucgcaccccagcacgcccgccucugguggccaccccgcugccccauggcuggcu

SEQ ID NO: 521036 - RNA, 64 nt, Human
ucugguggccaccccgcugccccauggcuggcuggguggccaggcaggaagugcccagcccgag

SEQ ID NO: 521037 - RNA, 64 nt, Human
auuuguguuguucugauucaauaauugguuucuggguggccaauucagaagaagaguguacaug

SEQ ID NO: 521038 - RNA, 64 nt, Human
ggaggcagaggugacaguucccagagugggcuuugguggccagggaggcagccuagccuauguc

SEQ ID NO: 521039 - RNA, 64 nt, Human
ugggugggcccugcuagcgagagaggucaaccccgguggccagggaacccacuuccaagcgcag

SEQ ID NO: 521040 - RNA, 64 nt, Human
ucuggcaaagaguccuguggguuguuuauaccuggguggccagggccucccucucuguuaccaa

SEQ ID NO: 521041 - RNA, 61 nt, Human; identical to SEQ ID NO: 446329

SEQ ID NO: 521042 - RNA, 61 nt, Human; identical to SEQ ID NO: 446330

SEQ ID NO: 521043 - RNA, 61 nt, Human; identical to SEQ ID NO: 446331

SEQ ID NO: 521044 - RNA, 61 nt, Human; identical to SEQ ID NO: 446333

SEQ ID NO: 521045 - RNA, 64 nt, Human
aaccucugugcaggaccuuggccagaguggggaggguggccagccacucugagggacagaacgu

SEQ ID NO: 521046 - RNA, 64 nt, Human
agaacccuuaguguccuguagggggacagaaugggguggccagguggugauuucucuuugacca

SEQ ID NO: 521047 - RNA, 64 nt, Human
ugaggggcacgcccuccucagcgagaggcagcaagguggccacagugucacuggucaggugcuu

SEQ ID NO: 521048 - RNA, 64 nt, Human
cugcgcccucccugaccucccaggcugcggcucagguggccaaccaggcccugauccgggguga

SEQ ID NO: 521049 - RNA, 64 nt, Human
uccggggugacuggaaccggggcgguggggugaggguggccagcguacaacagguaagcccggc

SEQ ID NO: 521050 - RNA, 64 nt, Human
cgaaauagauauccucucccccuccuccagggaagguggccacagcaaguacagcggcuccccu

SEQ ID NO: 521051 - RNA, 64 nt, Human
gccuagggggugccgaggccucuggucuccucaggguggccacuggaggaugggugggggccuc

SEQ ID NO: 521052 - RNA, 64 nt, Human
cugcgcucccagcacugggguuuggggggagggggguggccaaggggcguuuccucugcuuuug

SEQ ID NO: 521053 - RNA, 64 nt, Human
cauagcugggcugcaguacccuacgcugccagcagguggccaugacuacccgugguaccaaucu

SEQ ID NO: 521054 - RNA, 64 nt, Human
uagccuucugucuugucaccaaccauucuuacuugguggccauguacuuggaaaaaggccgcau

SEQ ID NO: 521055 - RNA, 64 nt, Human
uuaacauuuagggaguuaucuguuuucaucuugagguggccaauauggggauguggaauuuuua

SEQ ID NO: 521056 - RNA, 64 nt, Human
ggcguggcucacccaaguuccucgacugagggccgguggccaugcagaggcguccgcaggugcc

SEQ ID NO: 521057 - RNA, 64 nt, Human
ucaacacaucaucuuaaaguggugcuggaugggugguggccaggugacauuuucugugcguuuu

SEQ ID NO: 521058 - RNA, 61 nt, Human; identical to SEQ ID NO: 446338

SEQ ID NO: 521059 - RNA, 61 nt, Human; identical to SEQ ID NO: 446343

SEQ ID NO: 521060 - RNA, 61 nt, Human; identical to SEQ ID NO: 446344

SEQ ID NO: 521061 - RNA, 61 nt, Human; identical to SEQ ID NO: 446345

SEQ ID NO: 521062 - RNA, 63 nt, Human
cuguugugaaacuuguuugagagagacuggggagguggccauaaaggggcagagucuucuuuc

SEQ ID NO: 521063 - RNA, 64 nt, Human
cacugcagccucacaccgaguccaccuuggacaugguggccacauuacucagcugggagaagcc

SEQ ID NO: 521064 - RNA, 64 nt, Human
gccaaggauauuaggcaaaagaggcuacuugauugguggccaaccucgugcccacauggaaggu

SEQ ID NO: 521065 - RNA, 64 nt, Human
guccccacccaugcgccuucgugccugagaccaggguggccacacaggcagggccuggcuccag

SEQ ID NO: 521066 - RNA, 64 nt, Human
acagagugggcagggacagugguagcauccaucugguggccaaagagaaucguagccccagagc

SEQ ID NO: 521067 - RNA, 64 nt, Human
ugcaggggcgggucaguuucccaggccaugccgggguggccaucuaugguagggcuggaagcug

SEQ ID NO: 521068 - RNA, 64 nt, Human
gccuccacccagugcugggaggugucccgccggugguggccaucacuauuccugguggggcuuu

SEQ ID NO: 521069 - RNA, 55 nt, Human
augaugaccuguauggcuaaguggugguggccagcgugcagugagcuggccugcc

SEQ ID NO: 521070 - RNA, 64 nt, Human
uaugaaaauguccauuucuggugugugcagacaugguggccauugcccacccagguaccagcag

SEQ ID NO: 521071 - RNA, 64 nt, Human
aaacccaccucucuggaaggccccuucccuggcagguggccaggcaggcgggggcugcucagcc

SEQ ID NO: 521072 - RNA, 64 nt, Human
uggccacuggcucuggucuuaagugccugggcuugguggccaucaagagggagccagucaggcc

SEQ ID NO: 521073 - RNA, 64 nt, Human
aaucaacgcuuucucugauucugugucacagagugguggccaguggcuacacaauagcgauuuu

SEQ ID NO: 521074 - RNA, 64 nt, Human
gcuucgucaaguggaugaucaagaacaagggcuugguggccaucccugucuccaucuucuauag

SEQ ID NO: 521075 - RNA, 61 nt, Human; identical to SEQ ID NO: 446346

SEQ ID NO: 521076 - RNA, 61 nt, Human; identical to SEQ ID NO: 446347

SEQ ID NO: 521077 - RNA, 61 nt, Human; identical to SEQ ID NO: 446348

SEQ ID NO: 521078 - RNA, 61 nt, Human; identical to SEQ ID NO: 446350

SEQ ID NO: 521079 - RNA, 64 nt, Human
gacacugggguuucugcagucagggaggagggaggguggccaggcugacagcuuuuugcaagag

SEQ ID NO: 521080 - RNA, 64 nt, Human
aaaccugcucacgcagcugugaugcuuggcacgggguggccagugcagauggagcccaaggccc

SEQ ID NO: 521081 - RNA, 64 nt, Human
ggaggaggagccuuccccaggaggaacgaggagagguggccacguggcaggccacagugcccua

SEQ ID NO: 521082 - RNA, 64 nt, Human
cuggcuugggggcaggacaagggcuaggcuugaugguggccaggcuugccugcuccccaccugg

SEQ ID NO: 521083 - RNA, 59 nt, Human
uucuugugccuggcagcuaacacgcccgggguggccacagcgccagccucagacuggag

SEQ ID NO: 521084 - RNA, 64 nt, Human
acacucacccucccucaaggcccugugccauagggguggccacccgaccugcccccagaacuuu

SEQ ID NO: 521085 - RNA, 64 nt, Human
ucaaauaggucaucaugaaagguuaaaaaagcgagguggccauguuaugcuggugguuaaggcc

SEQ ID NO: 521086 - RNA, 64 nt, Human
agagcucucagagcagggcagauugcugggcucugguggccagugucugucugugagggcagga

SEQ ID NO: 521087 - RNA, 64 nt, Human
ggggcgcugggcucuguucccagcguuugccagagguggccacuucagccaagcccagagaagu

SEQ ID NO: 521088 - RNA, 64 nt, Human
uguuagagugauuuggucuccucuggcaggcugugguggccacauaaaggaucuuccauuagag

SEQ ID NO: 521089 - RNA, 64 nt, Human
gauuccuucccauggagggagggagugguuugcagguggccaaguuccucuaacuuggcucaca

SEQ ID NO: 521090 - RNA, 64 nt, Human
gggagcugggccuggucucacccuggaggcaccugguggccaugcuccucuuccccagacgccu

SEQ ID NO: 521091 - RNA, 64 nt, Human
uuuuaggauacaguaaagaugagcuucagaagaagguggccacaugguugaagagugacguggg

SEQ ID NO: 521092 - RNA, 61 nt, Human; identical to SEQ ID NO: 446447

SEQ ID NO: 521093 - RNA, 61 nt, Human; identical to SEQ ID NO: 446448

SEQ ID NO: 521094 - RNA, 61 nt, Human; identical to SEQ ID NO: 446449

SEQ ID NO: 521095 - RNA, 61 nt, Human; identical to SEQ ID NO: 446450

SEQ ID NO: 521096 - RNA, 64 nt, Human
cauuuccagugcuuccuuaccugucaauaacaaugguggccaccugggucccagcacuuggcug

SEQ ID NO: 521097 - RNA, 64 nt, Human
aucuacuaacauguuuagcaaauggcucugacaggguggccaugagcagaugagaccagcucuu

SEQ ID NO: 521098 - RNA, 64 nt, Human
caacauagcucacugaagagcuguuagauccugggguggccacgucacuuguguuuauuuguuc

SEQ ID NO: 521099 - RNA, 64 nt, Human
guggcuucagggccuccggacccccccugggagggguggccacgugcuggcugcggaacccagg

SEQ ID NO: 521100 - RNA, 53 nt, Human
ccagcugguucgggcugugacgggguggccagcagggacgcgccccagguggg

SEQ ID NO: 521101 - RNA, 64 nt, Human
guguaccccugggccagucucuuugaacccugaggguggccaggaucuggagcugcaucucuaa

SEQ ID NO: 521102 - RNA, 64 nt, Human
gaaggccacaucaacuuuauguagcaaagggcuugguggccaagccuggcccuuaaacaacugc

SEQ ID NO: 521103 - RNA, 50 nt, Human
gucugaugaagaaaacgugagguggccaugaugcuuacagguuuugugag

SEQ ID NO: 521104 - RNA, 64 nt, Human
cuguguugagaaagaugucaugcaaaaggacgacgguggccaacuaaagcaagucuuccuucca

SEQ ID NO: 521105 - RNA, 64 nt, Human
cccaacgccucugcgccuacaccaaagggccccagguggccaccuuccuucccucaaggggcuc

SEQ ID NO: 521106 - RNA, 64 nt, Human
agauguacagaaaugauuuccuggcuggccaacugguggccagugggaggugaugguggaccua

SEQ ID NO: 521107 - RNA, 64 nt, Human
gugccuccuagccccuucuuccaaggagcagagagguggccaccggggguggcucuguccuacc

SEQ ID NO: 521108 - RNA, 64 nt, Human
aacuccaagcagacuccagccccuggaccccugggguggccagggcuuccccaucagcucccaa

SEQ ID NO: 521109 - RNA, 61 nt, Human; identical to SEQ ID NO: 446320

SEQ ID NO: 521110 - RNA, 61 nt, Human; identical to SEQ ID NO: 446334

SEQ ID NO: 521111 - RNA, 61 nt, Human; identical to SEQ ID NO: 446335

SEQ ID NO: 521112 - RNA, 61 nt, Human; identical to SEQ ID NO: 446336

SEQ ID NO: 521113 - RNA, 64 nt, Human
gccagucagugguuacccuccagggcagugccgugguggccaaccggacccaggccuuccagga

SEQ ID NO: 521114 - RNA, 64 nt, Human
ugccagugcucucugggccuggcucccagucagugguggccacgaugcgguacagggcaucccu

SEQ ID NO: 521115 - RNA, 64 nt, Human
ucugugacauucuuuaucccuucuuccccggguugguggccauggagggucuugucugcuguga

SEQ ID NO: 521116 - RNA, 64 nt, Human
aggggggcuccccggagccccagggguggggauugguggccacuguuuguauguucuugagugc

SEQ ID NO: 521117 - RNA, 64 nt, Human
ggcuucagaucacccacgccuguuuucagcuguggguggccaugcagacacgcgcccuggcaug

SEQ ID NO: 521118 - RNA, 64 nt, Human
gacgcagaaucagggcuauacccacuucugccgggguggccacuuccgcuacacacuacccguc

SEQ ID NO: 521119 - RNA, 64 nt, Human
ccugccaagccucacggagcacgggggagucugugguggccaguuuaccugggcaucuggcuga

SEQ ID NO: 521120 - RNA, 58 nt, Human
uggaggccagugcgcacuagcugggccugguggccaccgccagagcuccuggcgacau

SEQ ID NO: 521121 - RNA, 64 nt, Human
cuuuauuucugcaaaucuguuagcauaauuccaagguggccaagcagaugucacauggaguuag

SEQ ID NO: 521122 - RNA, 64 nt, Human
cauuggcucugucccuguggcgauggcagggcaggguggccaaacaggucaggugcuuguucug

SEQ ID NO: 521123 - RNA, 64 nt, Human
ccuggaguuuggcucuagucacuucuggcugccugguggccacugcuacagcugguccacagag

SEQ ID NO: 521124 - RNA, 64 nt, Human
uugcccuuagaggggcucugaguaucuacuuguggguggccauuuccugacaucugcauguacc

SEQ ID NO: 521125 - RNA, 64 nt, Human
uucccucaagaggaagugagcggugcuguccucagguggccaugguacagcucuucugccuggg

SEQ ID NO: 521126 - RNA, 61 nt, Human; identical to SEQ ID NO: 446302

SEQ ID NO: 521127 - RNA, 61 nt, Human; identical to SEQ ID NO: 446354

SEQ ID NO: 521128 - RNA, 61 nt, Human; identical to SEQ ID NO: 446355

SEQ ID NO: 521129 - RNA, 61 nt, Human; identical to SEQ ID NO: 446360

SEQ ID NO: 521130 - RNA, 64 nt, Human
aaagguauggagcuaacucaucucuuuuacaagggguggccaugacuuacuguugcaaaguacu

SEQ ID NO: 521131 - RNA, 64 nt, Human
auaaguuauucaccugaguaugcaauaaagaugugguggccacucuuucauggugguggcagca

SEQ ID NO: 521132 - RNA, 64 nt, Human
cccuagacauggccucuggaaaaaggaaaucuuugguggccaaagauuuccuuucuguggugag

SEQ ID NO: 521133 - RNA, 64 nt, Human
uuuuuccuaauuuuuuauauuuccuuacaauuuugguggccauuaauuuaacuuuaggcuuuug

SEQ ID NO: 521134 - RNA, 64 nt, Human
ugaaaugccacacuaaugcuuguuggauucaugagguggccagaccaauguguuguuuuguugu

SEQ ID NO: 521135 - RNA, 64 nt, Human
uaaauugaccaaccuaauguuacaacuacuuugagguggccaaauguaaacuaaaagccuuaau

SEQ ID NO: 521136 - RNA, 64 nt, Human
gggcucagcugggcuguucuucugccagccugcagguggccacucauguggucagcaggucggc

SEQ ID NO: 521137 - RNA, 64 nt, Human
cuacaccccaacccuggggggaauguagggaagagguggccaagccaaccgugggguuagcucu

SEQ ID NO: 521138 - RNA, 64 nt, Human
uuucuagacgagaaggaggcuagcuucuagccuggguggccauuauuccaaaaggucauuguuu

SEQ ID NO: 521139 - RNA, 64 nt, Human
uuuucauccuggcuggagaauguggagaacuaaagguggccacaaauucuuugacacucaaguc

SEQ ID NO: 521140 - RNA, 64 nt, Human
acuuugucuccucuuucugagcuuagggggcuaggguggccauuuagucugaccugggcuaugg

SEQ ID NO: 521141 - RNA, 64 nt, Human
accaaauagugcuccugggugcauugucaccguggguggccacucaaggguccaagccucuagg

SEQ ID NO: 521142 - RNA, 64 nt, Human
ccacgccuguugccauguggaaaagugggccuaggguggccacagcuuugauuuuucaagagac

SEQ ID NO: 521143 - RNA, 61 nt, Human; identical to SEQ ID NO: 446361

SEQ ID NO: 521144 - RNA, 61 nt, Human; identical to SEQ ID NO: 446362

SEQ ID NO: 521145 - RNA, 61 nt, Human; identical to SEQ ID NO: 446363

SEQ ID NO: 521146 - RNA, 61 nt, Human; identical to SEQ ID NO: 446365

SEQ ID NO: 521147 - RNA, 64 nt, Human
uuuuuaauguaauaaaucuuuauugagcacugcugguggccaggagugcggucuacuuggggaa

SEQ ID NO: 521148 - RNA, 64 nt, Human
agggcgcccagcugucagguggccagaagcagcggguggccauggcccgggcucuggugcggaa

SEQ ID NO: 521149 - RNA, 64 nt, Human
uacagagacaggggagaagggcgcccagcugucagguggccagaagcagcggguggccauggcc

SEQ ID NO: 521150 - RNA, 64 nt, Human
agugcagcgcggggucuccauggugcuaggccaggguggccagccccgccaggaggccuggccu

SEQ ID NO: 521151 - RNA, 64 nt, Human
ucucugcaacuaucauuccagaaauggucuuggagguggccagaaucauugaccauauuuuuau

SEQ ID NO: 521152 - RNA, 64 nt, Human
guuagauggcagagaccaagaauucaagaugguugguggccagauuuuuguagacagagauggu

SEQ ID NO: 521153 - RNA, 64 nt, Human
uguccuuuccagcaccauuauuugggucuuucaggguggccaucucuguuagaagacaguagca

SEQ ID NO: 521154 - RNA, 64 nt, Human
cuugaggugggcacagccuggcaguguggccagggguggccauguaagucccaucaggacguag

SEQ ID NO: 521155 - RNA, 64 nt, Human
ccacccauugaagucuccuugggccaccaaaggugguggccaugguaccggggacuugggagag

SEQ ID NO: 521156 - RNA, 64 nt, Human
uaacuccuaaguacuguagucucugggugucggggguggccagggcgggggcggggugcauuuc

SEQ ID NO: 521157 - RNA, 64 nt, Human
acuuagugcuuugucuauucuuuauuucucucaggguggccaguauuuugacuuauuuauccug

SEQ ID NO: 521158 - RNA, 64 nt, Human
gggacuuccucuuugagagucuggggagagaaaagguggccaggauccuaggacugaaugacuc

SEQ ID NO: 521159 - RNA, 64 nt, Human
cagccauccuuugccggggggggcauccagccuggguggccaccccuccuuaucucuggguggu

SEQ ID NO: 521160 - RNA, 61 nt, Human; identical to SEQ ID NO: 446370

SEQ ID NO: 521161 - RNA, 61 nt, Human; identical to SEQ ID NO: 446371

SEQ ID NO: 521162 - RNA, 61 nt, Human; identical to SEQ ID NO: 446372

SEQ ID NO: 521163 - RNA, 61 nt, Human; identical to SEQ ID NO: 446376

SEQ ID NO: 521164 - RNA, 64 nt, Human
aucucacgugaaagacauugccucagcuacugaagguggccaccuccacucuaaaugacauuuu

SEQ ID NO: 521165 - RNA, 64 nt, Human
aaagauggucugugagcccgggcugccuccuggugguggccauugucccccaucggccccucag

SEQ ID NO: 521166 - RNA, 64 nt, Human
ccagggcagcggcuccacuuucucauccgaagaugguggccacagacugacccccaucugagcu

SEQ ID NO: 521167 - RNA, 64 nt, Human
cugucgccccaggcccucccugacucccuguggggguggccaucccugggccccuccacgccuc

SEQ ID NO: 521168 - RNA, 64 nt, Human
ugagcuggagggccucuagggaaccguggggcaggguggccagcugcuggcucccagagcgcag

SEQ ID NO: 521169 - RNA, 64 nt, Human
aggcagagggcaucggggccauuuggccggcucugguggccacugagcuggcugacuaagcccc

SEQ ID NO: 521170 - RNA, 64 nt, Human
cuucucugauuucccaccucccaaccuuguuccagguggccauagucagucaccaugugugggc

SEQ ID NO: 521171 - RNA, 64 nt, Human
acacugugaaccacuuaggaugugaucacuuucagguggccaggaauguugaaugucuuuggcu

SEQ ID NO: 521172 - RNA, 64 nt, Human
uguggcucugggaauuccugcagagaagagcagggguggccaggagauagugagcagcucccag

SEQ ID NO: 521173 - RNA, 64 nt, Human
caagcaacaggcacugccaaauucagggaacagugguggccagcuuggaggauggacauuucug

SEQ ID NO: 521174 - RNA, 64 nt, Human
ugcucagagccccacugcccccucucucugugcagguggccagugccccucccugcucugggag

SEQ ID NO: 521175 - RNA, 64 nt, Human
ucgggggcaaguuugcaguggggccggaaaauaugguggccacccuaccaugagagucagccgu

SEQ ID NO: 521176 - RNA, 64 nt, Human
ggcagguguccagcgcagccccgcagagcuccaggguggccaaguggaucucaccggggccacc

SEQ ID NO: 521177 - RNA, 61 nt, Human; identical to SEQ ID NO: 446273

SEQ ID NO: 521178 - RNA, 61 nt, Human; identical to SEQ ID NO: 446278

SEQ ID NO: 521179 - RNA, 61 nt, Human; identical to SEQ ID NO: 446279

SEQ ID NO: 521180 - RNA, 61 nt, Human; identical to SEQ ID NO: 446381

SEQ ID NO: 521181 - RNA, 64 nt, Human
cuuaaagaugucuuucagagaaauuaauuugguugguggccacuuuuagguggaucaaaagacc

SEQ ID NO: 521182 - RNA, 61 nt, Human
ugaccuccaaauaccguuaagcuggagccucgguggccaugcuucuugccccuugggccuc

SEQ ID NO: 521183 - RNA, 64 nt, Human
ggcuuggaggucauugggagugagcagauguggggguggccagccaggcuggccgcacuccauc

SEQ ID NO: 521184 - RNA, 64 nt, Human
auucucagggcucuaccccccuuuccugguccuagguggccaguggguaugaggagggcuggaa

SEQ ID NO: 521185 - RNA, 64 nt, Human
gugcugugaaccccugcacccaaccccacaucuggguggccaacuuggcaggacuuggccagca

SEQ ID NO: 521186 - RNA, 64 nt, Human
ccuucgugguggucucccuccuugcgcccucuuggguggccagcguuccuacugcagacggccc

SEQ ID NO: 521187 - RNA, 64 nt, Human
ggggucccggcugacaagccagcauagggcauucgguggccagagccgaggguccucccacacg

SEQ ID NO: 521188 - RNA, 64 nt, Human
uccuuggaagaggacuuuacuaaaagucacaggugguggccaggggggauuuccgaaucuccau

SEQ ID NO: 521189 - RNA, 56 nt, Human
gcaccuggagcaccaggugauccucagguggccagccuggaucuccucaagucccc

SEQ ID NO: 521190 - RNA, 64 nt, Human
aacccuguucuccaaaacccugccccaggcuaaggguggccagagaaggucaccauguaccaca

SEQ ID NO: 521191 - RNA, 64 nt, Human
caguagcggcuccuucccgacagagcugccucucgguggccagcaggacucugcccagaccaca

SEQ ID NO: 521192 - RNA, 64 nt, Human
gccuggcacagggcagugggacagggcauggccagguggccacuccagaccccuggcuuuucac

SEQ ID NO: 521193 - RNA, 64 nt, Human
agaacuucguggugacugccuuugggagcccgcagguggccagaggcagggguagcugaguucc

SEQ ID NO: 521194 - RNA, 61 nt, Human; identical to SEQ ID NO: 446231

SEQ ID NO: 521195 - RNA, 61 nt, Human; identical to SEQ ID NO: 446232

SEQ ID NO: 521196 - RNA, 61 nt, Human; identical to SEQ ID NO: 446233

SEQ ID NO: 521197 - RNA, 61 nt, Human; identical to SEQ ID NO: 446234

SEQ ID NO: 521198 - RNA, 64 nt, Human
uagcuagagcugcuggcuucccuguggcuuagcugguggccagccugacuggcuuccugggcga

SEQ ID NO: 521199 - RNA, 58 nt, Human
ggacucuugacuucaagugacagccccagguggccaggccuccaggaggcaccaggca

SEQ ID NO: 521200 - RNA, 64 nt, Human
cccagccaccugggaguccgaagcuuagccuggagguggccaagccagucccuacucuugggcu

SEQ ID NO: 521201 - RNA, 64 nt, Human
gaguccaacagcagaacuugggggaagcggucgggguggccaggaacauaaacuauguauaggg

SEQ ID NO: 521202 - RNA, 64 nt, Human
gagcacacuuuucccuuccccgaugaccugggaugguggccaggccgugcccuugcuguugcug

SEQ ID NO: 521203 - RNA, 64 nt, Human
agcaucuccuagaagcagccggcacaggagggaagguggccaggcucgaagcagucucuguuuc

SEQ ID NO: 521204 - RNA, 64 nt, Human
cagcauuuacgaugcaauauguaauuauauauaggguggccacacuagggcgggguccuucccc

SEQ ID NO: 521205 - RNA, 64 nt, Human
cucaaguguccccuuagaucuagaacugcuccuugguggccauuagaucgagucaguuuugauc

SEQ ID NO: 521206 - RNA, 64 nt, Human
uggacaucaguaucuagagggacaagaagaagaagguggccaagacccagggauaacuguggug

SEQ ID NO: 521207 - RNA, 64 nt, Human
aaaaccuagcccuguacagcugcccuuuuaaagagguggccauugcagggucucugccucccca

SEQ ID NO: 521208 - RNA, 64 nt, Human
cugggccugcagcucccuucuccugggacuuagagguggccagauuuaaggccccucuacucau

SEQ ID NO: 521209 - RNA, 64 nt, Human
cuccugaccccugguaggagggucacauccacuugguggccagguggcccuuggugacccacuu

SEQ ID NO: 521210 - RNA, 64 nt, Human
uacaauugaaagaguucuguccaaaaagccaaaagguggccaggcuugguggcucaggccugua

SEQ ID NO: 521211 - RNA, 61 nt, Human; identical to SEQ ID NO: 446235

SEQ ID NO: 521212 - RNA, 61 nt, Human; identical to SEQ ID NO: 446236

SEQ ID NO: 521213 - RNA, 61 nt, Human; identical to SEQ ID NO: 446237

SEQ ID NO: 521214 - RNA, 61 nt, Human; identical to SEQ ID NO: 446239

SEQ ID NO: 521215 - RNA, 64 nt, Human
ggagcuguaagggucacauaaucaugggacugccgguggccaucuuuuccuacuaccuagagaa

SEQ ID NO: 521216 - RNA, 64 nt, Human
gaaugguggcaggagugggcaccagugcggccccgguggccauggggaauaaaccagcauugcu

SEQ ID NO: 521217 - RNA, 64 nt, Human
ccaauuucccggagccaucacccucacccacucugguggccacuucauuccagcagcugcaccc

SEQ ID NO: 521218 - RNA, 64 nt, Human
acgcacacuccacaugcccagcagaguggcacuugguggccagaaagugugagccucaugaucu

SEQ ID NO: 521219 - RNA, 64 nt, Human
uuaaacccagggcaucaggaugugcuugggcuaugguggccauaaacccugagcccagagagcu

SEQ ID NO: 521220 - RNA, 64 nt, Human
cucgacugaauggacuuugcacacuuuggcccaggguggccacaccucuaucccggcuuuggug

SEQ ID NO: 521221 - RNA, 64 nt, Human
auccccuuggcugugaggccccuggacaagcagagguggccagagcugggaggcauggcccugg

SEQ ID NO: 521222 - RNA, 64 nt, Human
ucucucagaagcaucuguuccuuccuggucacgagguggccagagcacaauguauaggcagacc

SEQ ID NO: 521223 - RNA, 64 nt, Human
uuuuaacaaauccccuccuuaaacggagcuauaagguggccaaaucugagaacaauuaaauuca

SEQ ID NO: 521224 - RNA, 64 nt, Human
gaaguggauuguauugugagauccugugauuccugguggccaguauccuggauuccucuaagau

SEQ ID NO: 521225 - RNA, 64 nt, Human
ggcugccugggggaggcagacaugggagugccaagguggccagaugguuccaggacuacaaugu

SEQ ID NO: 521226 - RNA, 64 nt, Human
ggaauuuuuuuucaacuguauguagggcugcagugguggccagaauuagauaucuuuaaagaau

SEQ ID NO: 521227 - RNA, 64 nt, Human
ucacaccuguaaucccagcauuuugggaggcugagguggccagaucccaaggucagaagaucga

SEQ ID NO: 521228 - RNA, 61 nt, Human; identical to SEQ ID NO: 446240

SEQ ID NO: 521229 - RNA, 61 nt, Human; identical to SEQ ID NO: 446244

SEQ ID NO: 521230 - RNA, 61 nt, Human; identical to SEQ ID NO: 446245

SEQ ID NO: 521231 - RNA, 61 nt, Human; identical to SEQ ID NO: 446247

SEQ ID NO: 521232 - RNA, 64 nt, Human
cauucaaauggcucugcauuaucuucccuuggaagguggccacuccucgguggcagggccuuuc

SEQ ID NO: 521233 - RNA, 64 nt, Human
gugggugcgggggaggguauccggugcgcagggagguggccagcgcccccgggcacugcugcuc

SEQ ID NO: 521234 - RNA, 64 nt, Human
cuccaggaccugggaagcaaaggcacaggcccacgguggccagccauuguggugccgccccagc

SEQ ID NO: 521235 - RNA, 64 nt, Human
agagaagaacaaaugaggcucacccacgaggcuggguggccagcagucugggcacacacgagca

SEQ ID NO: 521236 - RNA, 64 nt, Human
gcaagaccccugcagaccucauagagccucaucugguggccacagcagccaagccuagagcccu

SEQ ID NO: 521237 - RNA, 64 nt, Human
ggacaauugggagggcagcaggcagcccgcagaugguggccauguggcacgcugcugagacgac

SEQ ID NO: 521238 - RNA, 64 nt, Human
gucagccgcugcccaucggccugaggggcagccugguggccagagcugggggcacacagaauag

SEQ ID NO: 521239 - RNA, 64 nt, Human
uccuggguuggggcccagccccucuagaguagcugguggccagggaugaaccuugcccagccgu

SEQ ID NO: 521240 - RNA, 64 nt, Human
ugguuuccuguaucacagcccaaagagguucucugguggccacagcugugugcucagucagugc

SEQ ID NO: 521241 - RNA, 64 nt, Human
agggagcuccgucagcacucgcaugugucgcucagguggccacucaugccugcauuccauuuaa

SEQ ID NO: 521242 - RNA, 61 nt, Human
aggaugaaauccgugugugaggcggacaguggguggccaccgggagcucuuggcugcaucu

SEQ ID NO: 521243 - RNA, 64 nt, Human
aaagaugaggcuccagcugcccuggggggagggugguggccauuacuagagggggccugggucc

SEQ ID NO: 521244 - RNA, 64 nt, Human
ugaggccagggauuuuuaauuaaauggggugauggguggccaauaccacaauuccugcugaaaa

SEQ ID NO: 521245 - RNA, 61 nt, Human; identical to SEQ ID NO: 446451

SEQ ID NO: 521246 - RNA, 61 nt, Human; identical to SEQ ID NO: 446452

SEQ ID NO: 521247 - RNA, 61 nt, Human; identical to SEQ ID NO: 446453

SEQ ID NO: 521248 - RNA, 61 nt, Human; identical to SEQ ID NO: 446459

SEQ ID NO: 521249 - RNA, 64 nt, Human
gccccugguuggggcuaucaggagagugggggaugguggccacaugucccccagguggucuccc

SEQ ID NO: 521250 - RNA, 64 nt, Human
gucuccucugguccugagaugagcugugagccuagguggccaaggcuuccugcauugcuucccu

SEQ ID NO: 521251 - RNA, 64 nt, Human
ggcagaaccacgacccuugacucccggguggggagguggccaaggaugcuggagcugaaucaga

SEQ ID NO: 521252 - RNA, 64 nt, Human
uccuugugcagcccccacuuuuguccuggcuguggguggccauccauuuugagcaccucugcca

SEQ ID NO: 521253 - RNA, 64 nt, Human
gugguggcauuacagggaugagggagucacuguggguggccacagggcuauggccaagcguucc

SEQ ID NO: 521254 - RNA, 64 nt, Human
ccacuuagcugaauaccaguuugaaggaaaacaggguggccacuuacaaacuuacggagcucag

SEQ ID NO: 521255 - RNA, 64 nt, Human
uccucugugaacccauaccucucuagauggagcagguggccacuggugccucauacucaguauu

SEQ ID NO: 521256 - RNA, 64 nt, Human
uucauugggcaugaaugagucaagucucugaagcgguggccacuucuuggacaucuugacccag

SEQ ID NO: 521257 - RNA, 64 nt, Human
ccccauccccccagcugggaugguggaagccggugguggccacggaccgccccccuccugccag

SEQ ID NO: 521258 - RNA, 64 nt, Human
ggagccagaacacucacagagacaccccugagaggguggccacagcccaagaugaagucaucaa

SEQ ID NO: 521259 - RNA, 64 nt, Human
ggacccaggccaggugccccccggagccugcugggguggccagagcaggaggggguguguuucc

SEQ ID NO: 521260 - RNA, 64 nt, Human
gucugaggcucagacccugcugugguuggcuugggguggccaaugggcugggacccuccaugag

SEQ ID NO: 521261 - RNA, 64 nt, Human
ggacucuccaggcaccgccugcccccagcguggggguggccacuccugggccccagaaagccuc

SEQ ID NO: 521262 - RNA, 61 nt, Human; identical to SEQ ID NO: 446248

SEQ ID NO: 521263 - RNA, 61 nt, Human; identical to SEQ ID NO: 446249

SEQ ID NO: 521264 - RNA, 61 nt, Human; identical to SEQ ID NO: 446250

SEQ ID NO: 521265 - RNA, 61 nt, Human; identical to SEQ ID NO: 446252

SEQ ID NO: 521266 - RNA, 64 nt, Human
aaaaaauuagccaggagugguggcgggcgccugugguggccagcuacucaggaggcugaggcag

SEQ ID NO: 521267 - RNA, 64 nt, Human
gcuuugggggcgccggcuagaaaaaguagggugcgguggccaggagggccccugccgcgcgggg

SEQ ID NO: 521268 - RNA, 64 nt, Human
aggaggaggaggauacgccagucagccccaaggagguggccacccugagcaaggaacuccugca

SEQ ID NO: 521269 - RNA, 64 nt, Human
ugagcggggcagggaugaggcccgaggugggggcgguggccaggacaacgggcuggagggucug

SEQ ID NO: 521270 - RNA, 64 nt, Human
acacagcccagcuuagugggccucuguuccugcggguggccagccugucuguguggcugggcug

SEQ ID NO: 521271 - RNA, 64 nt, Human
aauuucccugccagaccuuguuuacuagaaaucagguggccaaaacaugacucucagagugggg

SEQ ID NO: 521272 - RNA, 64 nt, Human
agacaagauggagcugcucacuuuugccggguuugguggccacuucacccccaacccugucuca

SEQ ID NO: 521273 - RNA, 64 nt, Human
acgaguguggcugcuggaucagggcagccggggagguggccaggccaguggccaggcccugugg

SEQ ID NO: 521274 - RNA, 64 nt, Human
uccugcaaggcccgucugucuguccaggacuccugguggccagauucggccuccgaccuugacc

SEQ ID NO: 521275 - RNA, 64 nt, Human
uguccagaccccaccaucucccggaccccagggagguggccauugccagaagccuguggguuuc

SEQ ID NO: 521276 - RNA, 64 nt, Human
acaaagguuccagugagcgcaugucccagccccugguggccaggcuccccuugcugagccgcug

SEQ ID NO: 521277 - RNA, 64 nt, Human
ucacuuuccuggggccucaccugcuggagucuucgguggccagguaugucccuuaccugggauu

SEQ ID NO: 521278 - RNA, 64 nt, Human
ucaccugccuggggccucaccugcuggagucuuugguggccaggcaugugacuuaccugggauu

SEQ ID NO: 521279 - RNA, 61 nt, Human; identical to SEQ ID NO: 446261

SEQ ID NO: 521280 - RNA, 61 nt, Human; identical to SEQ ID NO: 446262

SEQ ID NO: 521281 - RNA, 61 nt, Human; identical to SEQ ID NO: 446263

SEQ ID NO: 521282 - RNA, 61 nt, Human; identical to SEQ ID NO: 446264

SEQ ID NO: 521283 - RNA, 64 nt, Human
ugcaugagcuugcugcuuuccaggguguguugaggguggccaugggugacacgucccacucuuu

SEQ ID NO: 521284 - RNA, 64 nt, Human
agcagcagcagcagcagcagcagcagcagcaggcgguggccaggccgggccgggcggccaccag

SEQ ID NO: 521285 - RNA, 64 nt, Human
agcacaacuccccgcagggcccccagcccacagggguggccauauuugggcaguucccaguccu

SEQ ID NO: 521286 - RNA, 64 nt, Human
aucagcaguucaaggauuuccagcggcggauccugguggccaccaaucuguuuggccgggggau

SEQ ID NO: 521287 - RNA, 64 nt, Human
gccaaagcucauuugcauaauaagauuagggugggguggccagcucacauagggguaggcccua

SEQ ID NO: 521288 - RNA, 64 nt, Human
aguguaaguaggcgcccaugccgggagccgcgccgguggccagcggugccggcugugggaccuu

SEQ ID NO: 521289 - RNA, 64 nt, Human
ugacacccuaaagcaggcugaucgggcaaugggagguggccaggccugccagccccucggcucu

SEQ ID NO: 521290 - RNA, 64 nt, Human
ccuggguugccaccaucaagcuguccggcucucugguggccaagcuggagcacuacgacuugca

SEQ ID NO: 521291 - RNA, 64 nt, Human
ccuuccaugaaucugcuugcugcugcuucagugugguggccaucaugcugugugacaaaccagg

SEQ ID NO: 521292 - RNA, 64 nt, Human
gguggugggcaugccugccucaccuucaucaggggguggccaggaggggcccagacugugaauc

SEQ ID NO: 521293 - RNA, 64 nt, Human
cgcaguggcucaccccuguaaucucagcacuuuggguggccaaggcgggcagaugacuugaggu

SEQ ID NO: 521294 - RNA, 64 nt, Human
auguuuuuaguagagaugggguuucaccuuguuggguggccaggcuggucuccaacuccugagc

SEQ ID NO: 521295 - RNA, 64 nt, Human
aaguguauauaaucugaaucaauaagcucugaaugguggccaagggccucucuuauggcacaaa

SEQ ID NO: 521296 - RNA, 61 nt, Human; identical to SEQ ID NO: 446269

SEQ ID NO: 521297 - RNA, 61 nt, Human; identical to SEQ ID NO: 446270

SEQ ID NO: 521298 - RNA, 61 nt, Human; identical to SEQ ID NO: 446271

SEQ ID NO: 521299 - RNA, 61 nt, Human; identical to SEQ ID NO: 446272

SEQ ID NO: 521300 - RNA, 64 nt, Human
ugugacccugugggaaugcaguccacaguggccagguggccagauuuuucaagaaaagcuggau

SEQ ID NO: 521301 - RNA, 64 nt, Human
cagcaacacagagcacuagguucaauucccugaagguggccacuuuaagagagaaaucugaaaa

SEQ ID NO: 521302 - RNA, 64 nt, Human
cagccucaggcugagaaacacugauagaccaagagguggccaggguucccagaaggaaggaacu

SEQ ID NO: 521303 - RNA, 64 nt, Human
gagucagcaaaucuuaaucuguuuaguuuacucagguggccacauacagucucuguuguauauu

SEQ ID NO: 521304 - RNA, 64 nt, Human
gguggacaaagucaacuuccacauguuugacguggguggccagcgcgaugaacgccgcaagugg

SEQ ID NO: 521305 - RNA, 64 nt, Human
ucuuugguuaagaugugacugccaucaucuucgugguggccagcagcagcuacaacauggucau

SEQ ID NO: 521306 - RNA, 64 nt, Human
uagcaaggcaucucgacaagcauggucuaggucugguggccagcuugccaguaccugagccggu

SEQ ID NO: 521307 - RNA, 64 nt, Human
aaaucucaguaugaacagaccaggcggaaagcuugguggccaagcagucugugugcuuccccgc

SEQ ID NO: 521308 - RNA, 64 nt, Human
guguugcgggggaagcuguguggaaggagaagcugguggccacagcagaguccugcucugggga

SEQ ID NO: 521309 - RNA, 64 nt, Human
gagguagcuccuaaaaugaacagauuuaaagacagguggccacugacagccacuccaggaacuu

SEQ ID NO: 521310 - RNA, 64 nt, Human
cugaccagcuaguguggccagggccugguggccugguggccaggaaguuucagguugaagggaa

SEQ ID NO: 521311 - RNA, 64 nt, Human
agcacacaccugaaggggagauauugggggacacgguggccacucgcggucugugucaugacac

SEQ ID NO: 521312 - RNA, 64 nt, Human
ccagccaaggacagacuguagaggauccacaucagguggccacgaggacuugcaggcuauaguu

SEQ ID NO: 521313 - RNA, 61 nt, Human; identical to SEQ ID NO: 446281

SEQ ID NO: 521314 - RNA, 61 nt, Human; identical to SEQ ID NO: 446282

SEQ ID NO: 521315 - RNA, 61 nt, Human; identical to SEQ ID NO: 446283

SEQ ID NO: 521316 - RNA, 61 nt, Human; identical to SEQ ID NO: 446284

SEQ ID NO: 521317 - RNA, 64 nt, Human
cccauggauccucuggcugggaagccacugaccagguggccagggggcagggugggaagagggg

SEQ ID NO: 521318 - RNA, 64 nt, Human
acaugaggacccgucuuuuugcagugccaggcaggguggccaaagaggacuggacucuggaccu

SEQ ID NO: 521319 - RNA, 64 nt, Human
ugucuuuugcuuguacagaaucuguagugauuuugguggccaguaaaugccagccauuucucaa

SEQ ID NO: 521320 - RNA, 64 nt, Human
cucucuuugagugacuggcuacaagggccugagagguggccagccaggguuggagcuggagggg

SEQ ID NO: 521321 - RNA, 64 nt, Human
acgucugagucacuuggucuaaaaaguagccucagguggccagaaggccgaguuguguaaugag

SEQ ID NO: 521322 - RNA, 64 nt, Human
cugcccaccccgccucugggcucacaccagcccugguggccaagccugccccggccacucuguu

SEQ ID NO: 521323 - RNA, 64 nt, Human
ucugccuuccaggcguagggccagggcucuggcagguggccagggcuccacgggggccuagugg

SEQ ID NO: 521324 - RNA, 64 nt, Human
cuccugggcaucuggggacaggaacaccucucaggguggccaagaggggcuuccuugggaccag

SEQ ID NO: 521325 - RNA, 64 nt, Human
cucaugccuugagaucugugguggucuucaaaaugguggccagccagaucaaggauguaguauc

SEQ ID NO: 521326 - RNA, 64 nt, Human
ucacaccuguaaucccagcacuuugggaggccgagguggccagaucaccugaggucaggaguuu

SEQ ID NO: 521327 - RNA, 64 nt, Human
ucuuccugcuggcugugugggugguguccuucgggguggccaagcaggccauccucauccacaa

SEQ ID NO: 521328 - RNA, 64 nt, Human
ggcucuggggcagcucccagccucuucccaugcugguggccaccgugucccuugcugcggcugc

SEQ ID NO: 521329 - RNA, 64 nt, Human
cugauggguucuuagagccuuagcagcccuggaugguggccagaaauaaagggaccagcccuuc

SEQ ID NO: 521330 - RNA, 61 nt, Human; identical to SEQ ID NO: 446253

SEQ ID NO: 521331 - RNA, 61 nt, Human; identical to SEQ ID NO: 446254

SEQ ID NO: 521332 - RNA, 61 nt, Human; identical to SEQ ID NO: 446255

SEQ ID NO: 521333 - RNA, 61 nt, Human; identical to SEQ ID NO: 446351

SEQ ID NO: 521334 - RNA, 64 nt, Human
agcagcaguuaggugcauggagaggguaucaccugguggccacagucccccuucucaccucagc

SEQ ID NO: 521335 - RNA, 64 nt, Human
cacgcugaggccgcggcugcccggcagcaacugggguggccagguggggcgggaccccagcacc

SEQ ID NO: 521336 - RNA, 64 nt, Human
ccuauuguccuucccugaggcuccauugcugcuugguggccauucucugccuuuuuacagucac

SEQ ID NO: 521337 - RNA, 64 nt, Human
gcaggccucucgcugccuguugggcugucugggggguggccauuuagggaucguggggacgggg

SEQ ID NO: 521338 - RNA, 64 nt, Human
cuaggauucccccugcccugugccgcacucuggcgguggccacagcgugcuggcgacacucagg

SEQ ID NO: 521339 - RNA, 59 nt, Human
uccagucaacagaacucuagucccaaagggguggccagagccaaagccagcuacugucc

SEQ ID NO: 521340 - RNA, 64 nt, Human
aaaccacccaagacugaggggcucgugccagagcgguggccacagguaagaaccccggcccagg

SEQ ID NO: 521341 - RNA, 64 nt, Human
aacuuggagacagagagacuggccaggccuccccgguggccagagccagccagcauggccaccc

SEQ ID NO: 521342 - RNA, 64 nt, Human
gggugcccgcagggauggaggcagcuccugaacugguggccagcccacgggguacuggaagaca

SEQ ID NO: 521343 - RNA, 64 nt, Human
gagccugcaggaucucaccaggcagccucugggggguggccaggccgggaaaaagcccaccauu

SEQ ID NO: 521344 - RNA, 64 nt, Human
gucagcuggaaaauccagucacuaguugggguuugguggccauguuuucuacccagacaggccc

SEQ ID NO: 521345 - RNA, 64 nt, Human
ccagacuccagcacaccugucuccuccugccugggguggccauggggauggaaggggguggaau

SEQ ID NO: 521346 - RNA, 64 nt, Human
uggcugggguggggaaagguggcccaguggagccgguggccaggaaggcugaagcccgcuuccc

SEQ ID NO: 521347 - RNA, 61 nt, Human; identical to SEQ ID NO: 446203

SEQ ID NO: 521348 - RNA, 61 nt, Human; identical to SEQ ID NO: 446217

SEQ ID NO: 521349 - RNA, 61 nt, Human; identical to SEQ ID NO: 446218

SEQ ID NO: 521350 - RNA, 61 nt, Human; identical to SEQ ID NO: 446219

SEQ ID NO: 521351 - RNA, 64 nt, Human
gggaagaggaagguggggccagucccaccagugggguggccacgcccauggggucacaugcuca

SEQ ID NO: 521352 - RNA, 64 nt, Human
uggcuccagcugccaacccuggagcccagaccgagguggccauggagacuccaccuggaucccc

SEQ ID NO: 521353 - RNA, 64 nt, Human
uccagagcagcaggcaugugcauuaugggugccagguggccagugagggcccgaggaccacgca

SEQ ID NO: 521354 - RNA, 64 nt, Human
aguuagacagcccaggggaccagguggaccaggugguggccagagaggcuccaggggcuagacu

SEQ ID NO: 521355 - RNA, 64 nt, Human
ucgggcccagcuucacccugcgguggggcugagggguggccaucuccugcccuggggccacugg

SEQ ID NO: 521356 - RNA, 64 nt, Human
uguuggcaccccgggagccacugcccagggugaugguggccagcucagggcuuccugcggguga

SEQ ID NO: 521357 - RNA, 64 nt, Human
uauuuuggcgucacagcugagcaccgugccgggagguggccaagguacagcccgcaaugggccu

SEQ ID NO: 521358 - RNA, 64 nt, Human
ggcagugccaggcggucaucgagaguuccuaccagguggccaaggcguuggcagacgacgugga

SEQ ID NO: 521359 - RNA, 64 nt, Human
uggaccccccagccaaguggcagacgcugguuuugguggccacaggggguggcccgugcgacag

SEQ ID NO: 521360 - RNA, 64 nt, Human
aggggugcuguggacauguggguggagaagggaggguggccagcacuaguaaaggaggaauagu

SEQ ID NO: 521361 - RNA, 64 nt, Human
cuacaaaaugcuaaaauauuuaaugaaaauugaugguggccacagugugcagguuauaaaagca

SEQ ID NO: 521362 - RNA, 64 nt, Human
ggguguggcaaaauggagccuuucacauccuagugguggccauuugguaauacagauauaagcc

SEQ ID NO: 521363 - RNA, 64 nt, Human
auagaaauccaaggcugaagccaaaaguaaggaggguggccaaaugguaaacuauugguacuug

SEQ ID NO: 521364 - RNA, 61 nt, Human; identical to SEQ ID NO: 446288

SEQ ID NO: 521365 - RNA, 61 nt, Human; identical to SEQ ID NO: 446289

SEQ ID NO: 521366 - RNA, 61 nt, Human; identical to SEQ ID NO: 446290

SEQ ID NO: 521367 - RNA, 61 nt, Human; identical to SEQ ID NO: 446294

SEQ ID NO: 521368 - RNA, 64 nt, Human
agcugcagaagcguguggagggccuacagcgggagguggccacgcgcgccgucucauccucauc

SEQ ID NO: 521369 - RNA, 64 nt, Human
cugaggggagcguauccuggcagugugggcaccugguggccaagccucaguuucccccaaauga

SEQ ID NO: 521370 - RNA, 64 nt, Human
cuugacgggaucacuggggcucuuugugagugaggguggccaaacuaccgccggaggagauggg

SEQ ID NO: 521371 - RNA, 64 nt, Human
cucucccgccugccuagcccaggaugaagggcuggguggccacaacugggaugccaccuggagc

SEQ ID NO: 521372 - RNA, 64 nt, Human
ccccccgcccuccagcccaggggggaccgugggugguggccacuggcacacuuaguguucuucu

SEQ ID NO: 521373 - RNA, 64 nt, Human
caagccugcuucuuggggggugggcggguagggggguggccaucccugcuacccgcccaccccu

SEQ ID NO: 521374 - RNA, 51 nt, Human
aggcacaggaccucuacugaggguggccacugcagcaccugccacugccgu

SEQ ID NO: 521375 - RNA, 61 nt, Human; identical to SEQ ID NO: 446295

SEQ ID NO: 521376 - RNA, 61 nt, Human; identical to SEQ ID NO: 446296

SEQ ID NO: 521377 - RNA, 61 nt, Human; identical to SEQ ID NO: 446297

SEQ ID NO: 521378 - RNA, 64 nt, Human
cauuagauuugaagauguuuacauuguuguuauuguuauguaucacuugcuaaaaauauuguuu

SEQ ID NO: 521379 - RNA, 64 nt, Human
guauaugguguuccuagaaugcagcugaagaccuguuauguagaggaaauacgagggguggugc

SEQ ID NO: 521380 - RNA, 64 nt, Human
gccgugagaggccccacggggugugggcgacgcuguuauguaaauagagcugcugaguuggacc

SEQ ID NO: 521381 - RNA, 61 nt, Human; identical to SEQ ID NO: 446286

SEQ ID NO: 521382 - RNA, 61 nt, Human; identical to SEQ ID NO: 446299

SEQ ID NO: 521383 - RNA, 61 nt, Human; identical to SEQ ID NO: 446300

SEQ ID NO: 521384 - RNA, 64 nt, Human
aaaauguuaacucuauaaauaugauguucaugugguuauguauuaguuuuaauugucagccucu

SEQ ID NO: 521385 - RNA, 64 nt, Human
guuuuuacagagauuauuaauaugguagaacccuguuauguaauuccaaaacuuaagaaccaua

SEQ ID NO: 521386 - RNA, 64 nt, Human
cucuggggagcaagcccuuacuugcucagcacugguuauguagcacaaauagcuccuaggaaaa

SEQ ID NO: 521387 - RNA, 64 nt, Human
uuugcauauaugagaggguaccucaaauacuucuguuauguaucugugauuuuauuucuucuuu

SEQ ID NO: 521388 - RNA, 64 nt, Human
uuuguguacuuuguuacuugcauguaugaauuuuguuauguaaaauauaguuauagaccuaaau

SEQ ID NO: 521389 - RNA, 64 nt, Human
aaauucaaaguugaaagaaucaaaagcagccacaguuauguaggucugauuugaaugucauaau

SEQ ID NO: 521390 - RNA, 64 nt, Human
gagucuuuuguauauaguuguaaauauugucuugguuauguaaaaaugaaauuuuuuagacaca

SEQ ID NO: 521391 - RNA, 64 nt, Human
auguuuuauacuaaauaaaacccaucagcaugggguuauguagaaaagcaauuuauuccauuuu

SEQ ID NO: 521392 - RNA, 64 nt, Human
aggaagcacgcuggugcuaaguauuuuuuaaaugguuauguaagcaaagcugaacuguaaaucu

SEQ ID NO: 521393 - RNA, 64 nt, Human
uuugcauuugauauaucauugaugagauuuuguuguuauguaauauucuuuggcuacgcaucug

SEQ ID NO: 521394 - RNA, 64 nt, Human
gaacugggauauaagucauaauauuaauuaugcuguuauguaaaugauugguuuguaacauucc

SEQ ID NO: 521395 - RNA, 64 nt, Human
aggccacauuccaaguauuuguaaucuagaaaguguuauguaagugauguuauuagcaucgaga

SEQ ID NO: 521396 - RNA, 64 nt, Human
uuauacuuuauauguaggaagcuaauauaaaauaguuauguaacugugauuuugguuuucaguu

SEQ ID NO: 521397 - RNA, 61 nt, Human; identical to SEQ ID NO: 446164

SEQ ID NO: 521398 - RNA, 61 nt, Human; identical to SEQ ID NO: 446166

SEQ ID NO: 521399 - RNA, 61 nt, Human; identical to SEQ ID NO: 446167

SEQ ID NO: 521400 - RNA, 61 nt, Human; identical to SEQ ID NO: 446168

SEQ ID NO: 521401 - RNA, 64 nt, Human
augcaaaauugagcuuugguggggcugggaggggguuauguauucaugggaccuuuaauuugua

SEQ ID NO: 521402 - RNA, 64 nt, Human
gcauguuuuguauacaaauauauuguuaaucucuguuauguacuguacuaauucuuacacugcc

SEQ ID NO: 521403 - RNA, 64 nt, Human
uccccuaccccuaguuaagugccacaaagacuguguuauguagucaguacuuuuuucucaugua

SEQ ID NO: 521404 - RNA, 64 nt, Human
guugauagaguacuuaaaugcauuacuuuauuagguuauguaaguggucagugcauuccaguau

SEQ ID NO: 521405 - RNA, 64 nt, Human
ugguuuuaaugaagacaauuuguaaaguaauacuguuauguauaugcuaaauguugguaaauac

SEQ ID NO: 521406 - RNA, 64 nt, Human
gucaguuguacguaauguauuuauauguuaauuuguuauguauauagaugugcaagucuuguca

SEQ ID NO: 521407 - RNA, 64 nt, Human
ugcuucccauauuugucccaguugcagcccuguuguuauguauuuacucuucaauuucuuauuu

SEQ ID NO: 521408 - RNA, 64 nt, Human
uguuccacuuauugcuuuguuagucaaaaugcauguuauguagaaaauggucaauggcaaauuu

SEQ ID NO: 521409 - RNA, 64 nt, Human
ggacaaagccuuaguauauuuuugccacauacauguuauguauaaauuuuacuguugaauaaua

SEQ ID NO: 521410 - RNA, 64 nt, Human
cuagcccuguuucggaccugcacuucaccucuaaguuauguacaacucaaccugcaucccucua

SEQ ID NO: 521411 - RNA, 64 nt, Human
uugacacuuaaaaaugguuuaaauggucaauuuuguuauguauauuuuauaucaauuuaaaaaa

SEQ ID NO: 521412 - RNA, 64 nt, Human
uggaccacguugcccaagucacacaggcuucuguguuauguauuuagauaagaugugugaaaau

SEQ ID NO: 521413 - RNA, 64 nt, Human
aaauguggaggcagggcaaacguuuauaagggcuguuauguaugaaaugugccucugacccaaa

SEQ ID NO: 521414 - RNA, 61 nt, Human; identical to SEQ ID NO: 446169

SEQ ID NO: 521415 - RNA, 61 nt, Human; identical to SEQ ID NO: 446170

SEQ ID NO: 521416 - RNA, 61 nt, Human; identical to SEQ ID NO: 446171

SEQ ID NO: 521417 - RNA, 61 nt, Human; identical to SEQ ID NO: 446173

SEQ ID NO: 521418 - RNA, 64 nt, Human
uagcauauugaaccacacaagugcuuaauucauuguuauguaaucuuuguacauauaggcagua

SEQ ID NO: 521419 - RNA, 64 nt, Human
ugugcuuuaacucauuucuuuucuuugguauuggguuauguaugcgugugcauuuuuuuaacuu

SEQ ID NO: 521420 - RNA, 64 nt, Human
uguaugcaguacugcaagcuaauaacguugguuuguuauguagugugcuuuuugucccuuuccu

SEQ ID NO: 521421 - RNA, 64 nt, Human
gacucauuuuaaaaaauggaacauaaaauacaauguuauguauuauuauucccauucuacauac

SEQ ID NO: 521422 - RNA, 64 nt, Human
aaagcugauagucuaugucaauuaaauacccuauguuauguaaauaguuauuuuauccuguggu

SEQ ID NO: 521423 - RNA, 64 nt, Human
cuuuaauauugauaaaguuaauauauuuuaggauguuauguaaauauuuuugcauguaucugua

SEQ ID NO: 521424 - RNA, 64 nt, Human
auuuuuuauauuuagugcuuaaucuuugccucauguuauguaaaauuagccugcagauauuuuc

SEQ ID NO: 521425 - RNA, 64 nt, Human
ugucuauaaauggugucauaacuagagcacgggcguuauguaaguuucuaagaauuuagaggau

SEQ ID NO: 521426 - RNA, 64 nt, Human
ucaaugacaacuguuaauauuuaauaaauuccauguuauguauaaggaguuaauugcaaacaug

SEQ ID NO: 521427 - RNA, 64 nt, Human
uucaguaaacauaaagccacaacuccuacaugauguuauguaccauaugaucuguuuuguaucu

SEQ ID NO: 521428 - RNA, 64 nt, Human
auucuguuguagucauuaggugcccuucucugaaguuauguaaaauaaaagcaucugauccuuc

SEQ ID NO: 521429 - RNA, 64 nt, Human
cucagcuaaguaauucuauuuuauuauuuuuacuguuauguauguuuuuaaucauauuucuuag

SEQ ID NO: 521430 - RNA, 64 nt, Human
uugugcaaaaaaauuuaaaaauggaugucaagauguuauguaaaagaugaguguaauugugaaa

SEQ ID NO: 521431 - RNA, 61 nt, Human; identical to SEQ ID NO: 446174

SEQ ID NO: 521432 - RNA, 61 nt, Human; identical to SEQ ID NO: 446175

SEQ ID NO: 521433 - RNA, 61 nt, Human; identical to SEQ ID NO: 446176

SEQ ID NO: 521434 - RNA, 61 nt, Human; identical to SEQ ID NO: 446178

SEQ ID NO: 521435 - RNA, 64 nt, Human
uuacugaagaaugaacagaugaguaaguggagguguuauguaaaggcauauuguacucgaaauc

SEQ ID NO: 521436 - RNA, 64 nt, Human
gccauucuuuaaaauauuuauagcauaaauauauguuauguaaaguguguauauagaauuaguu

SEQ ID NO: 521437 - RNA, 64 nt, Human
caacacuuuuuuuuaacguuuuaauuacuauaguguuauguagagauuugauugagcagcuaau

SEQ ID NO: 521438 - RNA, 64 nt, Human
aacaaagaaacuccaacauuucacauuaugcauaguuauguagccauuucacaguuucuuuaag

SEQ ID NO: 521439 - RNA, 64 nt, Human
uuguguuacucaaaaaaacuacuggaugcaaacuguuauguaaaucugagauuucacugacaac

SEQ ID NO: 521440 - RNA, 64 nt, Human
uaaguucaaggggaacuugggaccagaaaccacuguuauguacaaaaaaauggcaaauucaaua

SEQ ID NO: 521441 - RNA, 64 nt, Human
gacaaaucauuagaaacugggcaucauauccacaguuauguaaggcagugauauacuauaagga

SEQ ID NO: 521442 - RNA, 64 nt, Human
uacaaaaaaaguuuauguuuaguuugguagagguguuauguauaaugcuuuguuaaagaacccc

SEQ ID NO: 521443 - RNA, 64 nt, Human
aaguggaaaucauuaguaugugagggccuugauuguuauguaauauugccaaugaugaauucag

SEQ ID NO: 521444 - RNA, 64 nt, Human
aaauguuuaaaaauaaaugguuaaaagguuuuauguuauguauauuuuaccacaauaaaugcaa

SEQ ID NO: 521445 - RNA, 64 nt, Human
uguacccauaaaaaugguuaaaaugguaaauuuuguuauguauauuuuaucauaauuuaaaaaa

SEQ ID NO: 521446 - RNA, 64 nt, Human
acacugccaguuguauaaaaguacagcacauucaguuauguacaguauguaauacugauaauga

SEQ ID NO: 521447 - RNA, 64 nt, Human
ugguuagauuugacugguuuugcagaagauuacaguuauguacugcauaaugacauauacaaua

SEQ ID NO: 521448 - RNA, 61 nt, Human; identical to SEQ ID NO: 446186

SEQ ID NO: 521449 - RNA, 61 nt, Human; identical to SEQ ID NO: 446187

SEQ ID NO: 521450 - RNA, 61 nt, Human; identical to SEQ ID NO: 446188

SEQ ID NO: 521451 - RNA, 61 nt, Human; identical to SEQ ID NO: 446189

SEQ ID NO: 521452 - RNA, 64 nt, Human
ccaaggccccggaccaaggggauacuguaaucagguuauguacaccaaccucugcaucaguugc

SEQ ID NO: 521453 - RNA, 64 nt, Human
acagcucaguaaauggcuucuucuagaauguaaaguuauguauuuaaaguuguaucuugacaca

SEQ ID NO: 521454 - RNA, 64 nt, Human
cuucugugguuuauugauccaaaaguacauauuuguuauguaaacuuauacuauguaaacuuga

SEQ ID NO: 521455 - RNA, 64 nt, Human
gaaauaccgcaagauuauguuuucuguuuccaggguuauguacuuguguccagaugaauaaagc

SEQ ID NO: 521456 - RNA, 64 nt, Human
ccucacaggucuuguguuaguuguaucugaaacuguuauguaucucucuaccuucuggaaaaca

SEQ ID NO: 521457 - RNA, 64 nt, Human
gauguuuaauacuuaaguuauugugcucuuuucuguuauguauucugauuuucaaggauuacuu

SEQ ID NO: 521458 - RNA, 64 nt, Human
cuauauugcagaaaccaauaucuguuucuuggugguuauguaaaagaccugaagaauuacuauc

SEQ ID NO: 521459 - RNA, 64 nt, Human
aaaaggcuugguggugggauuuuuuuaaauguguguuauguacauauauauauauauauaauau

SEQ ID NO: 521460 - RNA, 64 nt, Human
auguagcaaauuauguaaagcauguguauccagcguuauguacuuugcgccuugugacgucuuu

SEQ ID NO: 521461 - RNA, 64 nt, Human
aaccucguagggagcaaccccaggauagcuaaguguuauguaauaugccuagaaggugauguga

SEQ ID NO: 521462 - RNA, 64 nt, Human
uuuaaaacaaucagauucaaguugguuaauuuuaguuauguaacaaccugacaugauggaggaa

SEQ ID NO: 521463 - RNA, 64 nt, Human
uguaccugagacauauuagucuuugaaaaauaaaguuauguaagguuuuuuuuaucuuuaaaua

SEQ ID NO: 521464 - RNA, 64 nt, Human
uuuuccuuaaaguuuucagcuauagcaaaagguaguuauguaugccagaccuaauaugagcugc

SEQ ID NO: 521465 - RNA, 61 nt, Human; identical to SEQ ID NO: 446182

SEQ ID NO: 521466 - RNA, 61 nt, Human; identical to SEQ ID NO: 446183

SEQ ID NO: 521467 - RNA, 61 nt, Human; identical to SEQ ID NO: 446184

SEQ ID NO: 521468 - RNA, 61 nt, Human; identical to SEQ ID NO: 446285

SEQ ID NO: 521469 - RNA, 64 nt, Human
aggaaguggaauggguaacucuucuugauuaaaaguuauguaauaaccaaaugcaaugugaaau

SEQ ID NO: 521470 - RNA, 64 nt, Human; identical to SEQ ID NO: 521469

SEQ ID NO: 521471 - RNA, 64 nt, Human
aauaagcucaucuaaaggcagaaauauauccaaaguuauguacuuaauguucauuuauaccguu

SEQ ID NO: 521472 - RNA, 64 nt, Human
gagauugacacuuauauuacucauuacuucagcaguuauguaagucuggucuuuaaugaccauu

SEQ ID NO: 521473 - RNA, 64 nt, Human
aaaguggggggcauauuguaguccugucauuuaaguuauguaaaaaauuuaaucauuauuuuga

SEQ ID NO: 521474 - RNA, 64 nt, Human
ccaaguccaaauaaagcauuucacuagguuacacguuauguauauguguuacauaacaguaaca

SEQ ID NO: 521475 - RNA, 64 nt, Human
acguacaguuuuuaugcuugagauauuucaacauguuauguauauuggaacuucuacagcuuga

SEQ ID NO: 521476 - RNA, 64 nt, Human
gaucugcuuuauguuugagagaacuguucuggcuguuauguaaaggagugcagggaggggcagg

SEQ ID NO: 521477 - RNA, 64 nt, Human
cuuugggcuuacuuagaguuuuggcaaaugcagaguuauguaacgaacccaacaaugaagauac

SEQ ID NO: 521478 - RNA, 64 nt, Human
aaauauuuuaaagauauaaauauaugcuguauauguuauguaauuuauuuuaggcuauaauaca

SEQ ID NO: 521479 - RNA, 64 nt, Human
cuuuaacagcacuucaguccugccuuaaguuauaguuauguauagauacccauuauacuuuaaa

SEQ ID NO: 521480 - RNA, 64 nt, Human
ugggauaucuggggauaauuuuaaaggauuacauguuauguaaauuuuuaugugacugacaugg

SEQ ID NO: 521481 - RNA, 64 nt, Human
auguauuuauucuuuguauaauuauagcauacauguuauguaauauaacuuaugaaaaguacag

SEQ ID NO: 521482 - RNA, 58 nt, Human; identical to SEQ ID NO: 446194

SEQ ID NO: 521483 - RNA, 61 nt, Human; identical to SEQ ID NO: 446199

SEQ ID NO: 521484 - RNA, 61 nt, Human; identical to SEQ ID NO: 446200

SEQ ID NO: 521485 - RNA, 61 nt, Human; identical to SEQ ID NO: 446201

SEQ ID NO: 521486 - RNA, 64 nt, Human
uuuuccuuuuccuuuaaaauuguaaauaaauaauguuauguaucagugugccugaaccuugcau

SEQ ID NO: 521487 - RNA, 64 nt, Human
ucuggcaguggauuucuaaugcuuuuggcuguauguuauguaagauuuaauauguuguuacugu

SEQ ID NO: 521488 - RNA, 64 nt, Human
auugauaucugauguguguauaguacaucuguugguuauguacauuuuaauuuacauguugugu

SEQ ID NO: 521489 - RNA, 64 nt, Human
uuuuaaaccauuuucuuuuuuugugguuagaaaaguuauguagaaaaaaguaaaugugauuuac

SEQ ID NO: 521490 - RNA, 64 nt, Human
uuugaaagaugcgcauucuaaccuggaggucaauguuauguauuuauuuauuuauuuauuuggu

SEQ ID NO: 521491 - RNA, 64 nt, Human
uauaauuauuuuuuucacuuguuaggaagcuuuuguuauguauuuucuguuaauaguaccuaaa

SEQ ID NO: 521492 - RNA, 64 nt, Human
uugacuaaaagcagugaaggggauuugcuuccuuguuauguaaaguuucucgguguguucuguu

SEQ ID NO: 521493 - RNA, 64 nt, Human
auggugugagcuuccuuggggaaguacuucuugaguuauguaacuaacaggauguuuuacuaca

SEQ ID NO: 521494 - RNA, 64 nt, Human
auuccagauguuguauaacuauuauguuguguaaguuauguauguacauauuccacauauguau

SEQ ID NO: 521495 - RNA, 64 nt, Human
ucuuuucccuucaggcauaugucucuaaaccaauguuauguaucaaagacuguugaaagagaca

SEQ ID NO: 521496 - RNA, 64 nt, Human
auuggcuuugucauauuaguuuuuuuugcaaguaguuauguaaaagagauagauaauaaaauau

SEQ ID NO: 521497 - RNA, 64 nt, Human
uuaguaaaggcaggaaaaaaauagcaauauuugaguuauguaaggauaaaaaauccacugacuu

SEQ ID NO: 521498 - RNA, 64 nt, Human
auuucucagacuuuggaaaaugcauuguaucgauguuauguaaaaggccaaaccucuguucagu

SEQ ID NO: 521499 - RNA, 61 nt, Human; identical to SEQ ID NO: 446142

SEQ ID NO: 521500 - RNA, 61 nt, Human; identical to SEQ ID NO: 446143

SEQ ID NO: 521501 - RNA, 61 nt, Human; identical to SEQ ID NO: 446144

SEQ ID NO: 521502 - RNA, 61 nt, Human; identical to SEQ ID NO: 446205

SEQ ID NO: 521503 - RNA, 64 nt, Human
ugucugucauuuacccugucaggugucaugccagguuauguauacauuuauguggaggugauua

SEQ ID NO: 521504 - RNA, 64 nt, Human
uaguugugagcguuagccaaguuauuuucauguuguuauguaaucaauauuuuucaauagaagu

SEQ ID NO: 521505 - RNA, 64 nt, Human
auaagucagugauuauaugugugcucaaauaaguguuauguaucagcuagauacugagcuuuga

SEQ ID NO: 521506 - RNA, 64 nt, Human
aaaaggagacuuucuuaagcaccauauagauaggguuauguauaaaagcauaugugcuacucau

SEQ ID NO: 521507 - RNA, 64 nt, Human
uuuaaccuaugauauuuucugugccugaauauuuguuauguagauaacaagaccucagugccuu

SEQ ID NO: 521508 - RNA, 64 nt, Human
guauauucugcugcauguacuguacuccagagcuguuauguaacacuguauauaaaugguugca

SEQ ID NO: 521509 - RNA, 64 nt, Human
cacuuaaaauacugcaggaugcuuagugcucaguguuauguaugaacuuguggacuuuacaaug

SEQ ID NO: 521510 - RNA, 64 nt, Human
aguagcuugaaauugauuaacuuauacuguagguguuauguauuccuaugacaaaaaaaauuaa

SEQ ID NO: 521511 - RNA, 64 nt, Human
gggaucgaaaagaagguauuuuuccaaucacaguguuauguaguauuguucuauuuuuguuuac

SEQ ID NO: 521512 - RNA, 64 nt, Human
uguaauaaauauuuuuaaaaucuccuuucuacugguuauguaaauaaaucaaauaaauauauca

SEQ ID NO: 521513 - RNA, 64 nt, Human
uuuuacuucuacuuuauuucuuugcagggauaauguuauguaguuuauaauucuaguugaugaa

SEQ ID NO: 521514 - RNA, 64 nt, Human
cuuuuguuauauaaacugcuagccacaaauuuuaguuauguaaaaggcuacccuugacaagaaa

SEQ ID NO: 521515 - RNA, 64 nt, Human
aacauugugucauuuauuagcaucauaauucuuuguuauguaaguuaaauauaucaagaaagaa

SEQ ID NO: 521516 - RNA, 61 nt, Human; identical to SEQ ID NO: 446190

SEQ ID NO: 521517 - RNA, 61 nt, Human; identical to SEQ ID NO: 446191

SEQ ID NO: 521518 - RNA, 61 nt, Human; identical to SEQ ID NO: 446192

SEQ ID NO: 521519 - RNA, 61 nt, Human; identical to SEQ ID NO: 446206

SEQ ID NO: 521520 - RNA, 64 nt, Human
uaagaucugagaaguggaauuuguagggucauagguuauguacacuuaaguuuuugacacucac

SEQ ID NO: 521521 - RNA, 64 nt, Human
uuuacagucgauuuugaagagcuucuacauaucgguuauguaaauucauauauguauauuuugg

SEQ ID NO: 521522 - RNA, 64 nt, Human
cccuagcugaaggacauccaguuccccagcuguaguuauguaucugccuucaagucucugacaa

SEQ ID NO: 521523 - RNA, 64 nt, Human
cuuuaacuauauacuauguaacaggguaaacaguguuauguagaauagaauuguguaaacuaga

SEQ ID NO: 521524 - RNA, 64 nt, Human
uauuugagugauugcugggaagugugaaaauauuguuauguaucauaucaaagagaaacauguu

SEQ ID NO: 521525 - RNA, 64 nt, Human
guaaauaauggaaaugaguagugauaugaaaaugguuauguaacuacauauuacuuguuucugg

SEQ ID NO: 521526 - RNA, 64 nt, Human
guaaucuaagauuaaaauguaaacauuuauuuuuguuauguaaguuuauaagauguuuuauguu

SEQ ID NO: 521527 - RNA, 64 nt, Human
aguucuaacuagacauuuguacuaagguauuucaguuauguaaacucagccugggcacuuucug

SEQ ID NO: 521528 - RNA, 64 nt, Human
guuuaauauuguucuugaaaauaguugaugcuauguuauguauaacuuuucuaauaaaaguugu

SEQ ID NO: 521529 - RNA, 64 nt, Human
acaucugaaaucuacaacauaaugauacugaauuguuauguaaacaucauaaauaguaaauaau

SEQ ID NO: 521530 - RNA, 64 nt, Human
aaucaaccagguuacucccacaguuugcccguguguuauguaucaguuauacagguaucccacc

SEQ ID NO: 521531 - RNA, 64 nt, Human
guguuuuauuucuccaagugcgguguuccugaauguuauguaugcuuuuuuuucuguaccacag

SEQ ID NO: 521532 - RNA, 64 nt, Human
auuuaggaauaucuggagagaaagagagccugcaguuauguacauuuuguccuuuccguaagag

SEQ ID NO: 521533 - RNA, 61 nt, Human; identical to SEQ ID NO: 446207

SEQ ID NO: 521534 - RNA, 61 nt, Human; identical to SEQ ID NO: 446209

SEQ ID NO: 521535 - RNA, 61 nt, Human; identical to SEQ ID NO: 446210

SEQ ID NO: 521536 - RNA, 61 nt, Human; identical to SEQ ID NO: 446211

SEQ ID NO: 521537 - RNA, 64 nt, Human
uguuccuacaaaacucccacucucaggugcaagaguuauguagaaggaaagggagcugaaauag

SEQ ID NO: 521538 - RNA, 64 nt, Human
auguuaauuuccugguuuugaaaaucauauuaugguuauguacauuguuaacauuaaggaaagc

SEQ ID NO: 521539 - RNA, 64 nt, Human
ugugauaaacgcucccaacccuguggugaucaggguuauguaauguucaaagauucagacacac

SEQ ID NO: 521540 - RNA, 64 nt, Human
auucagugggcacgauggacuccaaaugccucaaguuauguauaccugucccagauguaaacuu

SEQ ID NO: 521541 - RNA, 64 nt, Human
gaaagucaaacuuacaaaaacuguugugacaaauguuauguacauauauugauauguaacugca

SEQ ID NO: 521542 - RNA, 64 nt, Human
uucuaaaggugcugcacugccuauuuuuccucuuguuauguaaauuuuuguacacauugauugu

SEQ ID NO: 521543 - RNA, 64 nt, Human
ugagccuugagaggaauguggcuguguggccugaguuauguagcaugcaacugcaacuucugcu

SEQ ID NO: 521544 - RNA, 64 nt, Human
augugguagucuauauaagugauguaugaguugaguuauguaaauuuugucauuguaguguaca

SEQ ID NO: 521545 - RNA, 64 nt, Human
guagcguuuaaaaaauauauauauauacauaacuguuauguaguucggauagcuuaguuuuaaa

SEQ ID NO: 521546 - RNA, 64 nt, Human
uguuauugaggauuuguuuggaauucaaauuacaguuauguacuggaugcuacagacuuauaac

SEQ ID NO: 521547 - RNA, 64 nt, Human
gucccuguuuagaaaacauuuaaaaugacuuuuaguuauguacaguacguuggcaaugaauaca

SEQ ID NO: 521548 - RNA, 64 nt, Human
guuuacaauagugugacaacgaugaaaaugcuugguuauguaaagugauuggaaauguaaugga

SEQ ID NO: 521549 - RNA, 64 nt, Human
ggggugaacacuguugaagacugguuaauuauaaguuauguaagaaucaucgccuuguggaaca

SEQ ID NO: 521550 - RNA, 61 nt, Human; identical to SEQ ID NO: 446212

SEQ ID NO: 521551 - RNA, 61 nt, Human; identical to SEQ ID NO: 446213

SEQ ID NO: 521552 - RNA, 61 nt, Human; identical to SEQ ID NO: 446214

SEQ ID NO: 521553 - RNA, 61 nt, Human; identical to SEQ ID NO: 446216

SEQ ID NO: 521554 - RNA, 64 nt, Human
ucauuauugguuguuacauaucaaggcuguuuugguuauguaucaauauugugguuuauuugag

SEQ ID NO: 521555 - RNA, 64 nt, Human
caacucaguguucaaugugaaauugcugccaaauguuauguaguuuaauagagaacuugaaaaa

SEQ ID NO: 521556 - RNA, 64 nt, Human
cacggagugacugagcuugcuggcagucacgucaguuauguagauacugcauggcaggagagcu

SEQ ID NO: 521557 - RNA, 64 nt, Human
gagacagguaguuaccugaauauagguugaaaagguuauguaaaaagaaauuauaauaaaaggg

SEQ ID NO: 521558 - RNA, 64 nt, Human
cuuuauuuagauuucuacuacuccaauuauuaauguuauguauuucucauuguuuuacuucuuc

SEQ ID NO: 521559 - RNA, 64 nt, Human
uggaauuuguucaaguuuuggguauguuuaaucuguuauguacuaguguucuguuuguuauugu

SEQ ID NO: 521560 - RNA, 64 nt, Human
uaaaaacaacacagaaaucuccugcucugauauaguuauguaacugaucucuuaaucuguagca

SEQ ID NO: 521561 - RNA, 64 nt, Human
guaaauguacaguuuucuuuuuuuuuuuuuuuugguuauguauacaaaaguuuuaacuacuuuu

SEQ ID NO: 521562 - RNA, 64 nt, Human
ccagucccgggcccuggagagcagaugcugucuuguuauguacaggaggaccuuuuaaaaaaau

SEQ ID NO: 521563 - RNA, 64 nt, Human
guuugucuuuuugugccucucaucuuucuuuuguguuauguaagauugauuauucauuucuccc

SEQ ID NO: 521564 - RNA, 64 nt, Human
guauaauauaucuugacaaauuuuacuaccauauguuauguaauaaauguguauuuuuguacuu

SEQ ID NO: 521565 - RNA, 64 nt, Human
acaaggaauaugcccaaacugucaaaugucaccuguuauguauucgucccuauuccuuaacuau

SEQ ID NO: 521566 - RNA, 64 nt, Human
guguaaauaacuaaguuguuaacugucaaguccaguuauguauucuguaaguuguguucuaguc

SEQ ID NO: 521567 - RNA, 61 nt, Human; identical to SEQ ID NO: 446265

SEQ ID NO: 521568 - RNA, 61 nt, Human; identical to SEQ ID NO: 446266

SEQ ID NO: 521569 - RNA, 61 nt, Human; identical to SEQ ID NO: 446267

SEQ ID NO: 521570 - RNA, 61 nt, Human; identical to SEQ ID NO: 446301

SEQ ID NO: 521571 - RNA, 64 nt, Human
cacaaauggacuaaaaaaucuggcacaaaacauuguuauguaaugucuuaugaugugugccucu

SEQ ID NO: 521572 - RNA, 64 nt, Human
aagcagauuuauccaucgagacuaucugguaugcguuauguauguagucuguugcugcugaaag

SEQ ID NO: 521573 - RNA, 64 nt, Human
aaauguuauauuauuucacauauauaaaacagauguuauguaagaauguuguauauuuuaacau

SEQ ID NO: 521574 - RNA, 64 nt, Human
gccaagguagcacugugagaaaucucacuuggauguuauguaaggggugagacacaacagucug

SEQ ID NO: 521575 - RNA, 64 nt, Human
cgucuuuggaguugacauggaacagcagguaguuguuauguagagcuaguucucaaagcugccc

SEQ ID NO: 521576 - RNA, 64 nt, Human
ucuccagguaucacaaagaaacccagaaugcauuguuauguaguagccauccaucuuggagucu

SEQ ID NO: 521577 - RNA, 64 nt, Human
uauuuucagaaguaaagcaaagaagcuauaacauguuauguacaguacacucugaaaagaaauc

SEQ ID NO: 521578 - RNA, 64 nt, Human
aaugcaauguaauguuacugagacuuaaauagauguuauguauaugauugucuguuuaaguguu

SEQ ID NO: 521579 - RNA, 64 nt, Human
uuucaaagggauugcuuuuuccucucauugucuuguuauguacaaacuaguuuuuauagcuauc

SEQ ID NO: 521580 - RNA, 64 nt, Human
caguuauuuucaucucuugaaacaugaaagaaauguuauguagauguucuuuagaagaucuggc

SEQ ID NO: 521581 - RNA, 64 nt, Human
ugguuuuacauuuuaguuacugaagccuuacaagguuauguagagagauaccaucuucuguacc

SEQ ID NO: 521582 - RNA, 64 nt, Human
cuauuuacuauuuguugaauuuauuuuuccgucaguuauguaaaauaaacauacucuucuuccu

SEQ ID NO: 521583 - RNA, 64 nt, Human
gaauuauugcuucaucugacuuuauucaaaucuaguuauguauuggccuaaauuauuugugcaa

SEQ ID NO: 521584 - RNA, 61 nt, Human; identical to SEQ ID NO: 446103

SEQ ID NO: 521585 - RNA, 61 nt, Human; identical to SEQ ID NO: 446104

SEQ ID NO: 521586 - RNA, 61 nt, Human; identical to SEQ ID NO: 446105

SEQ ID NO: 521587 - RNA, 61 nt, Human; identical to SEQ ID NO: 446106

SEQ ID NO: 521588 - RNA, 64 nt, Human
cuggaaguaguaauugcaagaguucgaauagaaaguuauguaccaaguaaccauuucucagcug

SEQ ID NO: 521589 - RNA, 64 nt, Human
uucgagauauagauugagccccaguuuuuggaguguuauguauuuccuggauguuuggaaacau

SEQ ID NO: 521590 - RNA, 64 nt, Human
ccuuuguuaauauggagaauuaugguucauaucaguuauguaggaccuuuggacccaggguccu

SEQ ID NO: 521591 - RNA, 64 nt, Human
ucuacugcccuaagugcuccuucuggcauaagaaguuauguauucauccaauaauucaagccaa

SEQ ID NO: 521592 - RNA, 64 nt, Human
gcuucaauccuugauagagcaaaacucagaacagguuauguaaaaauauagucuggcuuuagaa

SEQ ID NO: 521593 - RNA, 64 nt, Human
caaugaaguguuuguuuuauauuaaaaaaaaccuguuauguacaguugaaauaaauuuugcauu

SEQ ID NO: 521594 - RNA, 64 nt, Human
gacaugaugaugguccccaaaccauugauguucuguuauguacuguaaugggaagcgauucuga

SEQ ID NO: 521595 - RNA, 64 nt, Human
uggcucacucacuuuucuauuuuggaauuacauaguuauguaaguaaaauuuuuaaaaaucaua

SEQ ID NO: 521596 - RNA, 64 nt, Human
auagauaacauaguacucuaacuaaagucuccaaguuauguauuauaauauuacauaguaguau

SEQ ID NO: 521597 - RNA, 64 nt, Human
cuaugcugaaaaguacaaaguaguacaguauauuguuauguacauaucauuguuaauacagucc

SEQ ID NO: 521598 - RNA, 64 nt, Human
auuugcuucuagcugcucuuggcaaugaugaauuguuauguaugcauuaauguuuugcagccca

SEQ ID NO: 521599 - RNA, 64 nt, Human
caugaacauuaaagagccagaaauauuuuccuuuguuauguacggauauauauauauauagucu

SEQ ID NO: 521600 - RNA, 64 nt, Human
cucauucuuuuaaaaaauaagggacuauaaaucaguuauguaguaucuuuuguuuuuguagcug

SEQ ID NO: 521601 - RNA, 61 nt, Human; identical to SEQ ID NO: 446096

SEQ ID NO: 521602 - RNA, 61 nt, Human; identical to SEQ ID NO: 446097

SEQ ID NO: 521603 - RNA, 61 nt, Human; identical to SEQ ID NO: 446101

SEQ ID NO: 521604 - RNA, 61 nt, Human; identical to SEQ ID NO: 446107

SEQ ID NO: 521605 - RNA, 64 nt, Human
cgugcuugauuuguuuuuguccuugaauaagcauguuauguauauugucucguguuuuuauuuu

SEQ ID NO: 521606 - RNA, 64 nt, Human
augcaggaccucuguacuuucuaaagaacaaaauguuauguagacauuauacaugguugguugu

SEQ ID NO: 521607 - RNA, 64 nt, Human
auguugucuuuuuguccuguagauugucauaucuguuauguaguuauccuuuuggcaaguccuu

SEQ ID NO: 521608 - RNA, 64 nt, Human
agaauuauauauauaaaaauauauauguauaagaguuauguauuugaaaaaaauauauaaaaga

SEQ ID NO: 521609 - RNA, 64 nt, Human
cguuuucuguuacuccugauggugccaugaaaagguuauguaauaaaauauuuuaaaaucaggu

SEQ ID NO: 521610 - RNA, 64 nt, Human
ucugucucaggagagcauaggcacauuuuaaaagguuauguacuagguuuuuguggauucuauc

SEQ ID NO: 521611 - RNA, 64 nt, Human
cuguggcaacagcaggcucuaggggaauccugugguuauguagagacuccauguccugguguga

SEQ ID NO: 521612 - RNA, 64 nt, Human
auuaauuuuuuucauaauugagacagaacuguuuguuauguaccauaaugcuaaauaaaacugu

SEQ ID NO: 521613 - RNA, 64 nt, Human
ucagaaacagaaccagagagaaguuaaacaaaagguuauguaacuguuccuuuaauguuguaau

SEQ ID NO: 521614 - RNA, 64 nt, Human
aaaaagaaaaauaauugaaauguugagagagaugguuauguaaguuaguccucugcuguuuacu

SEQ ID NO: 521615 - RNA, 64 nt, Human
auaauuugguuuuuuaucaagaacaacacuuaucguuauguauuguguuaguuauauugccagu

SEQ ID NO: 521616 - RNA, 64 nt, Human
uagagaaggauauuuuguaguaguauaguaauguguuauguaguacaguuuuaaagcuauaaau

SEQ ID NO: 521617 - RNA, 64 nt, Human
uaguugacagcuuauacuucucaaaauucauauuguuauguacacaaacuaaguuucuauaugu

SEQ ID NO: 521618 - RNA, 61 nt, Human; identical to SEQ ID NO: 446304

SEQ ID NO: 521619 - RNA, 61 nt, Human; identical to SEQ ID NO: 446305

SEQ ID NO: 521620 - RNA, 61 nt, Human; identical to SEQ ID NO: 446306

SEQ ID NO: 521621 - RNA, 61 nt, Human; identical to SEQ ID NO: 446310

SEQ ID NO: 521622 - RNA, 64 nt, Human
gggucucuuccuucggucuuuuguauuuuugauuguuauguaaaacucgcuuuuauuuuaauau

SEQ ID NO: 521623 - RNA, 64 nt, Human
guaauaacacuacguuaaagguuuuaacugcuuuguuauguaagcuuacccagcccggcgcaca

SEQ ID NO: 521624 - RNA, 64 nt, Human
ugaugacagaacacaucuuggaaagacugacucuguuauguaacucuucauuuauguuaaguau

SEQ ID NO: 521625 - RNA, 64 nt, Human
cuaagaaaacgaucauuuucaggaggggccgggaguuauguaucugaagcagcuuuccaagcaa

SEQ ID NO: 521626 - RNA, 64 nt, Human
uggggagggagauauuuauuugugcccagaagcaguuauguaugcuucuugucuugguuacugu

SEQ ID NO: 521627 - RNA, 64 nt, Human
agcccagggacuggcuucucuuucucugaguguaguuauguaucuggguucuaaccaguaaggu

SEQ ID NO: 521628 - RNA, 64 nt, Human
cuuuacaauuguuaguaaaguucgauuauaguugguuauguaguaaacacugucauuuuauaaa

SEQ ID NO: 521629 - RNA, 64 nt, Human
uuaggagaaacacauucuuauuaauucuucaccuguuauguaugaaggaaucauuccagugcua

SEQ ID NO: 521630 - RNA, 64 nt, Human
uuuugcucucuaaaucuaaugcucgcucuaugugguuauguacauauugacaaauauucauuua

SEQ ID NO: 521631 - RNA, 64 nt, Human
uuguauguuuaccauauacuuugauauuugaaauguuauguacuggaaaggccacuuauauuuc

SEQ ID NO: 521632 - RNA, 64 nt, Human
aauucuuaaggauuucaaaugaaaccagaaggugguuauguaagaggcuuaaaaugaucuuaug

SEQ ID NO: 521633 - RNA, 64 nt, Human
ugugacagguagcaucacuauauaugcaauaguuguuauguagacugucaaagaauuuuuuuuu

SEQ ID NO: 521634 - RNA, 64 nt, Human
aagggugucucuguguacuuugaauuauuuugcaguuauguagguauccuaaugagugaauggu

SEQ ID NO: 521635 - RNA, 61 nt, Human; identical to SEQ ID NO: 446110

SEQ ID NO: 521636 - RNA, 61 nt, Human; identical to SEQ ID NO: 446111

SEQ ID NO: 521637 - RNA, 61 nt, Human; identical to SEQ ID NO: 446112

SEQ ID NO: 521638 - RNA, 61 nt, Human; identical to SEQ ID NO: 446113

SEQ ID NO: 521639 - RNA, 64 nt, Human
aguuuaguauuugcuaauuuuacuacacucuuuuguuauguauauguagggaagucauagggau

SEQ ID NO: 521640 - RNA, 64 nt, Human
aaagcguccacucacagauuguucuguaaggaauguuauguaugggugagcgggugacacaucc

SEQ ID NO: 521641 - RNA, 64 nt, Human
aaguuuacacuggagaaaggccuuagggugacagguuauguacugucucugaaucaauaugacc

SEQ ID NO: 521642 - RNA, 64 nt, Human
ggggucacccucuccagcaagagaaccccgugggguuauguaucagaagagaggggaagaaaca

SEQ ID NO: 521643 - RNA, 64 nt, Human
ugauuacaguguuauuuuuauggucauaauaaaaguuauguagaaguauaauaaaaucccuaca

SEQ ID NO: 521644 - RNA, 64 nt, Human
aagaaacuuuguuaugugugauaauagcauugugguuauguaaaaguguauuuguuagagauaa

SEQ ID NO: 521645 - RNA, 64 nt, Human
ugcggaugcgggucacacugaaugcuggagagauguuauguaauaugcugagguggcgaccuca

SEQ ID NO: 521646 - RNA, 64 nt, Human
agcuuguaggagguuuguacggaugugcuuugaaguuauguauauuacauauaacaggaaaaaa

SEQ ID NO: 521647 - RNA, 64 nt, Human
auuuucaauuauguuggcuuuuuauaaagcuugaguuauguaagauuuaaauaaaaguuugcua

SEQ ID NO: 521648 - RNA, 64 nt, Human
cguggacuccuuuuuauaaggaguuuuaaaaauuguuauguauuggaugaaugacuuauuaaug

SEQ ID NO: 521649 - RNA, 64 nt, Human
aaagaaaaaaaugucaaaaguagaacuuuguauaguuauguaaauaauucuuuuuuauuaauca

SEQ ID NO: 521650 - RNA, 64 nt, Human
gagacuacaggcaccugccaccauacccagcuaaguuauguauuuuuaguagagauggaguuuc

SEQ ID NO: 521651 - RNA, 64 nt, Human
acacccagagguggagcagguggcuuagggggugguuauguacuucacaagccaauucccuuca

SEQ ID NO: 521652 - RNA, 61 nt, Human; identical to SEQ ID NO: 446118

SEQ ID NO: 521653 - RNA, 61 nt, Human; identical to SEQ ID NO: 446119

SEQ ID NO: 521654 - RNA, 61 nt, Human; identical to SEQ ID NO: 446120

SEQ ID NO: 521655 - RNA, 61 nt, Human; identical to SEQ ID NO: 446202

SEQ ID NO: 521656 - RNA, 57 nt, Human
gugaaaucaguaguacuuaaaguauauguuauguaagauaaaauauuugcucaauuc

SEQ ID NO: 521657 - RNA, 64 nt, Human
aaaugccacugaauuuguauacuucagaauguuuguuauguaaauuuuaccucaacuaaaaaaa

SEQ ID NO: 521658 - RNA, 64 nt, Human
agaaacagcuuaaaauaauuuuauuuacaagcaaguuauguaagagaauguuuuauacuauagc

SEQ ID NO: 521659 - RNA, 64 nt, Human
auacacuguauuucuguuauaguaacaaaauagaguuauguagaauuguauggaacucaaauuu

SEQ ID NO: 521660 - RNA, 64 nt, Human
aauagguaggccucuaauugaaccaccucucuaaguuauguacguauauauaagcugaaauugu

SEQ ID NO: 521661 - RNA, 64 nt, Human
agaagguuacaguguauuauguagcaugcaauguguuauguagugcuuaauaaaaauaaaauga

SEQ ID NO: 521662 - RNA, 64 nt, Human
aguucaaauacuauagcugucaguugaugaauuuguuauguaguaaaauguaugacuuuguaug

SEQ ID NO: 521663 - RNA, 64 nt, Human
gcauuaugggucaaaaaucaaacauuccucucauguuauguauauuuuguuccuguuauauugg

SEQ ID NO: 521664 - RNA, 64 nt, Human
uucguggcagcuuugacuguuggcauagccauuuguuauguagugguagcgacuuuccugcuau

SEQ ID NO: 521665 - RNA, 64 nt, Human
cuagacacuucugugagaaggcagggauugcacaguuauguacauggucaauuaaauuuuaaca

SEQ ID NO: 521666 - RNA, 64 nt, Human
cuagacacuucugugagaaagcagggauugcauaguuauguacacggucaauuaaauuuuaaca

SEQ ID NO: 521667 - RNA, 53 nt, Human
aacuagugaacaaauucugauugguuauguaccgucaaaagacuugaagaaau

SEQ ID NO: 521668 - RNA, 64 nt, Human
ugcucuaaaauauuuaugaagaaaauacuuaaauguuauguauauggugguaauaagggaaaaa

SEQ ID NO: 521669 - RNA, 61 nt, Human; identical to SEQ ID NO: 446122

SEQ ID NO: 521670 - RNA, 61 nt, Human; identical to SEQ ID NO: 446123

SEQ ID NO: 521671 - RNA, 61 nt, Human; identical to SEQ ID NO: 446124

SEQ ID NO: 521672 - RNA, 61 nt, Human; identical to SEQ ID NO: 446125

SEQ ID NO: 521673 - RNA, 64 nt, Human
uguuucuuuaagaagaugcagucauggucuuucaguuauguauauuuguuuuccuuguuuuucc

SEQ ID NO: 521674 - RNA, 64 nt, Human
caaggcaacaucuccacacagaaaaucugcaccaguuauguaagcuaaaaagcugugugaaccc

SEQ ID NO: 521675 - RNA, 64 nt, Human
ugccagacuguaaucccagguauucacugcaucagacaccgagacacugaacuuccugagccac

SEQ ID NO: 521676 - RNA, 64 nt, Human
guucaugggcccucaaagguaaauugcaguuguagacaccgaggaugguugacaacccaugguu

SEQ ID NO: 521677 - RNA, 64 nt, Human
ggagcaacuuuugaguaucuuuaguuuccugaaggacaccgaauucuccauuagauaaaccacc

SEQ ID NO: 521678 - RNA, 64 nt, Human
guuucagugguccuacaaagguagauggugggcggacaccgaagucaacuugacuguaaaagua

SEQ ID NO: 521679 - RNA, 64 nt, Human
ggcugggucuguaccaaaggugugaaggaaagaagacaccgaccacggcgaagcaauagagggg

SEQ ID NO: 521680 - RNA, 64 nt, Human
agcugcagaaauucguugccaaagauuggacagagacaccgaaggaaaugggguggugaaaccc

SEQ ID NO: 521681 - RNA, 64 nt, Human
uucucuuguggagggggcaggugacguuucagaagacaccgagcuggaugggacuaccuuucug

SEQ ID NO: 521682 - RNA, 64 nt, Human
uccagugagggagaaagugaucugcagggagguggacaccgagcccugagugcugugcugcugc

SEQ ID NO: 521683 - RNA, 64 nt, Human
ccgcaucacucugcaucagcacugccggcccagugacaccgaguuccaccccaucggcuuccau

SEQ ID NO: 521684 - RNA, 64 nt, Human
aucaugcuacagagagugaauacacuggaauucagacaccgacucugagcugcuaggaaccuca

SEQ ID NO: 521685 - RNA, 64 nt, Human
agccauucaucaucugaucucugcuggaucuacagacaccgaugcagaccacucgauuucauga

SEQ ID NO: 521686 - RNA, 64 nt, Human
cagaucugcugcuucuaacagauggccaggaggugacaccgauuucagccauugccaagguuag

SEQ ID NO: 521687 - RNA, 64 nt, Human
uuguauuacaacaugaaauauaguugcauauauggacaccgacuugggaggacagguccugaau

SEQ ID NO: 521688 - RNA, 61 nt, Human; identical to SEQ ID NO: 446130

SEQ ID NO: 521689 - RNA, 61 nt, Human; identical to SEQ ID NO: 446135

SEQ ID NO: 521690 - RNA, 61 nt, Human; identical to SEQ ID NO: 446136

SEQ ID NO: 521691 - RNA, 64 nt, Human
cuccccuguauucccccaucuagccauuucggaagacaccgaggaagaggaggaagaugaagac

SEQ ID NO: 521692 - RNA, 64 nt, Human
accccuccccggcaucugccagcucagcacagaagacaccgaaugugcaucuggagguguugcg

SEQ ID NO: 521693 - RNA, 64 nt, Human
gcagaagccccugcccacgggauccggccccccagacaccgaccccacaggccgucccggaucu

SEQ ID NO: 521694 - RNA, 64 nt, Human
uggcucccucaugaagguagaaccagcugcuguugacaccgagguuacaucuguaugucuauuu

SEQ ID NO: 521695 - RNA, 64 nt, Human
agccauggcccgccuuguggccaccccucacccugacaccgacguguccuguacauagauuagg

SEQ ID NO: 521696 - RNA, 64 nt, Human
cuccacauugcaauguucaaugccacgugcugcugacaccgaccggaguacuagccagcacaaa

SEQ ID NO: 521697 - RNA, 64 nt, Human
ccagaaaucuucuaaccuaccagagccuagaugagacaccgaauuaacauuaaaauuucaguaa

SEQ ID NO: 521698 - RNA, 64 nt, Human
ggaagcuuccccuccugccuuaugcucaccuguggacaccgaggaugcccucacauuggugcuu

SEQ ID NO: 521699 - RNA, 64 nt, Human
cugcugcccggccugccuggggcugggagccccagacaccgacacccugaggacguguggagcu

SEQ ID NO: 521700 - RNA, 64 nt, Human
uuguacucauccaccccagccggcuugggacucagacaccgaagucuuuuuuuuuuucucuccg

SEQ ID NO: 521701 - RNA, 64 nt, Human
ggaggagcaggcugagaagucuugcagucugcaggacaccgaggaaucguaugugggaacgucc

SEQ ID NO: 521702 - RNA, 64 nt, Human
aggccucggccuugcaccgggacgccgaguuugggacaccgaacacugggcaaaagagaauccc

SEQ ID NO: 521703 - RNA, 64 nt, Human
gccacuuccugagggcaaguccuaauagcccugagacaccgagacggcauguucuucauuagac

SEQ ID NO: 521704 - RNA, 64 nt, Human
gaguagcucuguguuuagaguuggggacaaggaugacaccgaagguccaggaguccaggacagc

SEQ ID NO: 521705 - RNA, 64 nt, Human
uccguguucugaaguuguucuuuucauggugucugacaccgagggcguuguucguccaucaggc

SEQ ID NO: 521706 - RNA, 61 nt, Human; identical to SEQ ID NO: 446137

SEQ ID NO: 521707 - RNA, 61 nt, Human; identical to SEQ ID NO: 446138

SEQ ID NO: 521708 - RNA, 61 nt, Human; identical to SEQ ID NO: 446139

SEQ ID NO: 521709 - RNA, 61 nt, Human; identical to SEQ ID NO: 446141

SEQ ID NO: 521710 - RNA, 64 nt, Human
ccaccuccccacugccuuuucucacucagauggggacaccgagguccagaggaaaagacaccug

SEQ ID NO: 521711 - RNA, 64 nt, Human
cuugcccuuucaggaacuucacccugaugaaauugacaccgacucugccuacauucuuuucuau

SEQ ID NO: 521712 - RNA, 64 nt, Human
ugaaaggaacagaaacaguguuauuagguuggaggacaccgacuaauuugggaaacggaugaag

SEQ ID NO: 521713 - RNA, 64 nt, Human
aacauuuaaucugucuccaauauuuuaaccaagugacaccgagguuuuuaucgaagcauuucac

SEQ ID NO: 521714 - RNA, 64 nt, Human
ggccuggggccucugggaccggcuuucucuccuggacaccgaggauuggaaauaagggccugga

SEQ ID NO: 521715 - RNA, 64 nt, Human
uugggagggcuuuagcaaugagacugcagccugugacaccgaaagagacuuuagcugaagagga

SEQ ID NO: 521716 - RNA, 64 nt, Human
cagccaagccacaccacccgacagguucuucugugacaccgagagaucuaacccaaggccuggg

SEQ ID NO: 521717 - RNA, 64 nt, Human
guccaaguucuuuggccagauagugcaauguugugacaccgaccgaagccuuuguucuggaucu

SEQ ID NO: 521718 - RNA, 64 nt, Human
guuucaagcacaaaacugggcggccauucgggcagacaccgagcuagcuguaggaguuuuuuug

SEQ ID NO: 521719 - RNA, 57 nt, Human
aggucaucuucuacaccuaggcugcccgacaccgacaccgcccucccuccgugggga

SEQ ID NO: 521720 - RNA, 64 nt, Human
uauagagagagggaggagagcgagagagagugaggacaccgaacugggcuggcggcuccaaagc

SEQ ID NO: 521721 - RNA, 64 nt, Human
gaucccugucgggcuccuccgacuccucgggcuggacaccgaaaccucccuucuuaaagcgugu

SEQ ID NO: 521722 - RNA, 64 nt, Human
uuaaauaaauaaaccuagcaugcugaaugcacgugacaccgacugacuucagggaucugggcca

SEQ ID NO: 521723 - RNA, 64 nt, Human
aggaacgcugagccuuccucccuggguuugucuggacaccgagagcgaccacauccuggagaag

SEQ ID NO: 521724 - RNA, 64 nt, Human
ccuugggcaggucacacaaccugucccagcgagggacaccgaguggcccuucauguacauccau

SEQ ID NO: 521725 - RNA, 61 nt, Human; identical to SEQ ID NO: 446146

SEQ ID NO: 521726 - RNA, 61 nt, Human; identical to SEQ ID NO: 446147

SEQ ID NO: 521727 - RNA, 61 nt, Human; identical to SEQ ID NO: 446152

SEQ ID NO: 521728 - RNA, 61 nt, Human; identical to SEQ ID NO: 446153

SEQ ID NO: 521729 - RNA, 64 nt, Human
gccuggacaucagggacuuuugcccacagcacaugacaccgacagcugcccagccuguucacau

SEQ ID NO: 521730 - RNA, 64 nt, Human
cgggaaaggggucgggacaggagcacguggcucagacaccgacgccgggaggccgcagaccccg

SEQ ID NO: 521731 - RNA, 64 nt, Human
augcggguaguauuguucccguugcgcaguugaggacaccgagguucacggucugaguaacacc

SEQ ID NO: 521732 - RNA, 64 nt, Human
uggcagagcuggguggcagcucuuccucccaccggacaccgacccgcccgcugcugugcccugg

SEQ ID NO: 521733 - RNA, 64 nt, Human
cuuauuuccugggcuggugcgccccaaaacacggccccgacacuuaguguggccccaggcccca

SEQ ID NO: 521734 - RNA, 64 nt, Human
gggugacccucuagcucucucugcaucucccaccccccgacacccugggacccucgaccccacc

SEQ ID NO: 521735 - RNA, 64 nt, Human
aaauauauauaauacugacuuaaaaaaucaaaucccccgacauacguuuuuuuuaaucugugcc

SEQ ID NO: 521736 - RNA, 64 nt, Human
agagaucauucugcacuaaguuucgggaacuuauccccgacagugacugaacucacugacuaau

SEQ ID NO: 521737 - RNA, 64 nt, Human
cuuuucaugcccaucccgaugaaccugcaucauuccccgacacugccaagccaacccuggaaaa

SEQ ID NO: 521738 - RNA, 64 nt, Human
ccacucuuuccaucagcccuacccuacccucauuccccgacacccucuggcuugaaccauggcu

SEQ ID NO: 521739 - RNA, 64 nt, Human
gaaucaaauuuugccagagaaacuaacuugguggccccgacaggucuuccggggccaugggcau

SEQ ID NO: 521740 - RNA, 64 nt, Human
cucccccgcaguccccagcccuucugccuuucucccccgacacugcugcaccagagugaaaggg

SEQ ID NO: 521741 - RNA, 64 nt, Human
cucguuuucugcucccuucccucgucccuucccuccccgacaggucacauaacagcugcaucau

SEQ ID NO: 521742 - RNA, 61 nt, Human; identical to SEQ ID NO: 446126

SEQ ID NO: 521743 - RNA, 61 nt, Human; identical to SEQ ID NO: 446127

SEQ ID NO: 521744 - RNA, 61 nt, Human; identical to SEQ ID NO: 446128

SEQ ID NO: 521745 - RNA, 64 nt, Human
gacauuggggcauuacauggccaggugagcugucccccgacaucccaccgaaucugaugcugcu

SEQ ID NO: 521746 - RNA, 64 nt, Human
gaaccacccccucaguccccugcacugacucacuccccgacauauccggaccuccccaagucca

SEQ ID NO: 521747 - RNA, 64 nt, Human
aaacacggaaguucauacuugaaugcugaauuggccccgacagauuaaaugcguguuggggauu

SEQ ID NO: 521748 - RNA, 64 nt, Human
ccagggggccagcgggagcagggccugcaugagaccccgacagaaggugggggggggggggcuc

SEQ ID NO: 521749 - RNA, 64 nt, Human
uguuauacucuuugcaccuuaaacccccaccacuccccgacacuauugccuucccagcauggcu

SEQ ID NO: 521750 - RNA, 64 nt, Human
cuucaggaaaauaccuauacccaaauguucccucccccgacauauaucauggcaugauuuaagg

SEQ ID NO: 521751 - RNA, 64 nt, Human
gauuuuuaauuuaucuucacucagcaccaagggcccccgacacuccacuccugcugccccugag

SEQ ID NO: 521752 - RNA, 64 nt, Human
gggcaaggaacugucuuucugguucaauagacugccccgacagucuacaagccucagcccacug

SEQ ID NO: 521753 - RNA, 64 nt, Human
cagagaccuugcgaccauguguagauugcguggaccccgacaaagggaaggcugcuguguagcu

SEQ ID NO: 521754 - RNA, 64 nt, Human
ggggagugaccuaacuggccuaauuaaugggauaccccgacauuuccacuguuagcaaauauac

SEQ ID NO: 521755 - RNA, 64 nt, Human
cccggccccugccacccagccucaugcaagucauccccgacaugaccuucacgaccgcaaugca

SEQ ID NO: 521756 - RNA, 64 nt, Human
ccuuuuccaauacuuaugcaaaagcaaaagaaaaccccgacaccucaccuuucgcuguuuguug

SEQ ID NO: 521757 - RNA, 64 nt, Human
ggccauucacauucugacccguugccuggugcugccccgacacucuccucuccugggcuugggc

SEQ ID NO: 521758 - RNA, 64 nt, Human
agacaguaaguccggcugguugcagggcuauuugccccgacagcaucagccuguaacauuucuu

SEQ ID NO: 521759 - RNA, 64 nt, Human
aggggcacacgcgcgcagagugaacagugaguucccccgacagcccacgacagccaggacugcc

SEQ ID NO: 521760 - RNA, 61 nt, Human; identical to SEQ ID NO: 446221

SEQ ID NO: 521761 - RNA, 61 nt, Human; identical to SEQ ID NO: 446222

SEQ ID NO: 521762 - RNA, 61 nt, Human; identical to SEQ ID NO: 446223

SEQ ID NO: 521763 - RNA, 64 nt, Human
cuggacauuggaaccuuggagaaugucuucacagccccgacaucaacuccuucuagcauccagc

SEQ ID NO: 521764 - RNA, 64 nt, Human
uaaacgaagauccgagcgacggcuccuccccgauccccgacaguggcucuccaagcggcccccg

SEQ ID NO: 521765 - RNA, 53 nt, Human
uuucccgcucucaccuuugaggcccccgacaaagacagaaagaaggagcuauc

SEQ ID NO: 521766 - RNA, 64 nt, Human
ggaggaugcuguuucucugucaccuccacuugcuccccgacagguggggcacagaccucuguuc

SEQ ID NO: 521767 - RNA, 64 nt, Human
ccagggcggagagccauacccuggccccagcgcgccccgacacacaugcuuuucuccaugacac

SEQ ID NO: 521768 - RNA, 64 nt, Human
gcccgagcaacagguucugugucaccagccuggaccccgacacgcugccugcuguugccacacu

SEQ ID NO: 521769 - RNA, 64 nt, Human
ccguugcucgcacuggggucucuggugugaacacccccgacagcagcccuccgcccacucugcc

SEQ ID NO: 521770 - RNA, 63 nt, Human
acuugcuggaauucaagugaaaaugggcuccucccccgacaauccuguccuuguguuugugug

SEQ ID NO: 521771 - RNA, 64 nt, Human
ccaggccuuggcuggccccacaucgccuuuuccuccccgacaccuccgugcacuuguguccgag

SEQ ID NO: 521772 - RNA, 64 nt, Human
ucaccaccgagcuggccgagcaccgcucauauccccccgacaagaaggucaaagccaaggacgu

SEQ ID NO: 521773 - RNA, 64 nt, Human
cucucaugagccgcugcccgaggagcccugccugccccgacacccagcccagcuugccaauggc

SEQ ID NO: 521774 - RNA, 64 nt, Human
uggcuccuggggcgcuuccaggcauucugcccugccccgacaccagaacccuggugcugguggg

SEQ ID NO: 521775 - RNA, 64 nt, Human
gagucuuguggcccaacuaccagagaacgcugucccccgacaucccacuccaaagugugccacc

SEQ ID NO: 521776 - RNA, 64 nt, Human
cgcccuuucccagcugcacucgcccuguggacagccccgacacaccacuuuccugaggcugucg

SEQ ID NO: 521777 - RNA, 64 nt, Human
ggggugcuccuugcaacgucuuaagcaagcgaccccccgacauagcaaaagguggcaacccaug

SEQ ID NO: 521778 - RNA, 61 nt, Human; identical to SEQ ID NO: 446154

SEQ ID NO: 521779 - RNA, 61 nt, Human; identical to SEQ ID NO: 446155

SEQ ID NO: 521780 - RNA, 61 nt, Human; identical to SEQ ID NO: 446156

SEQ ID NO: 521781 - RNA, 64 nt, Human
gaagguacagcucgccugccugccccaaucccagccccgacaaucacaugcagcugacucggac

SEQ ID NO: 521782 - RNA, 64 nt, Human
gggucuuccuccagcaguuacuugaugcccccucccccgacacagacucucaaucugccggugg

SEQ ID NO: 521783 - RNA, 64 nt, Human
cugcucucccaggggccagguggagagcagugccccccgacacauguauucucaucuguggucc

SEQ ID NO: 521784 - RNA, 64 nt, Human
ccagaacuccucuugauguggccacccaccugcuccccgacauaucuaaggcuguuucucuccu

SEQ ID NO: 521785 - RNA, 64 nt, Human
ggaaggaggcggcucucgaucacggggugggugcccccgacaccgggucuccuagcuugaguuc

SEQ ID NO: 521786 - RNA, 64 nt, Human
ucuuucagaaggccucaucuccacuugccaggagccccgacaccacccuuggagacacggcuug

SEQ ID NO: 521787 - RNA, 64 nt, Human
cccuuggaaaguucagccagaaucuucguccugcccccgacagcccagccuagcccacuuguca

SEQ ID NO: 521788 - RNA, 64 nt, Human
uuaagauguaugugguggccggcgggaagaccagccccgacagcaccuccugagaaagucagcc

SEQ ID NO: 521789 - RNA, 64 nt, Human
uccuggccucacugaucuacaacuucguccuguuccccgacaccaagacccuggcgcagcggcu

SEQ ID NO: 521790 - RNA, 64 nt, Human
cuugggccucuaggcugucucuguccccucagcuccccgacaugcauuuacucucugccguggg

SEQ ID NO: 521791 - RNA, 64 nt, Human
cuccaguggaagagccgggaccuucccccugcacccccgacauccagggacggggugugaggaa

SEQ ID NO: 521792 - RNA, 64 nt, Human
acacagcuccagggacccaggccagcugccacacccccgacacuccugcuguccacuggccuua

SEQ ID NO: 521793 - RNA, 64 nt, Human
ccgucaugagcuaugccgacagucagcagcugauccccgacagaaacgcagcagaugcagacgg

SEQ ID NO: 521794 - RNA, 64 nt, Human
ugacccccuggacacgugacagggcccgcgcggcccccgacacgccccuggggcgcagagacac

SEQ ID NO: 521795 - RNA, 64 nt, Human
cgguggcggcugcacaacagcccugccugagaagccccgacacacggggcucgggccuuuaaaa

SEQ ID NO: 521796 - RNA, 61 nt, Human; identical to SEQ ID NO: 446158

SEQ ID NO: 521797 - RNA, 61 nt, Human; identical to SEQ ID NO: 446159

SEQ ID NO: 521798 - RNA, 61 nt, Human; identical to SEQ ID NO: 446160

SEQ ID NO: 521799 - RNA, 64 nt, Human
acugggucaccaucgagaucaauccuccucccugccccgacaccucgggcacaucgcaugcacu

SEQ ID NO: 521800 - RNA, 64 nt, Human
accccccacccccacacgcacuuuaugagggagaccccgacagaggacgcuugagccagaaucu

SEQ ID NO: 521801 - RNA, 64 nt, Human
cccaggcugcuggacacgucggacagcgaaguauccccgacaggacgggcuugggcuuccauuu

SEQ ID NO: 521802 - RNA, 64 nt, Human
ccagggccccacccugccauaugaaggaccccacccccgacaccacaaggcauuauuauucuau

SEQ ID NO: 521803 - RNA, 64 nt, Human
cuguauuuuucacgcucuuccagggaucccugucccccgacauugaagagaucucauucaggcc

SEQ ID NO: 521804 - RNA, 64 nt, Human
ccugcacaggagacaagugcguucagggcacaggccccgacaucaccccaaggacaacggcaca

SEQ ID NO: 521805 - RNA, 64 nt, Human
ccugcacaggagacaagugcauuuagggcacaggccccgacaucaccccaaggacaacggcaga

SEQ ID NO: 521806 - RNA, 64 nt, Human
gccagagccagccagcuuugaagacgcggcccugccccgacacaggcagccuggagaagcuggg

SEQ ID NO: 521807 - RNA, 64 nt, Human
cuguuagcacagugccugccacaaaaacaagugcccccgacaagauaguugcuauguuaugaca

SEQ ID NO: 521808 - RNA, 64 nt, Human
ugugggcugggcuggucagaaucaggguguaccuccccgacaccuucuuuuucagugauguuuu

SEQ ID NO: 521809 - RNA, 64 nt, Human
uuggggccccaaagcuuugcugcuauugauuuguccccgacagcaggcaaagccucacauugcc

SEQ ID NO: 521810 - RNA, 64 nt, Human
caucugacccuggagcuugggguuggcaccucugccccgacagaauggggcugaaucagcucca

SEQ ID NO: 521811 - RNA, 64 nt, Human
ccccaugggcuuuacccuucccugcgggcucucuccccgacacauuuguuaaaaucaaaccuga

SEQ ID NO: 521812 - RNA, 64 nt, Human
cucagaccauauggcaaaguuuuccaagaaaaugccccgacaggggugcccagcacacugccug

SEQ ID NO: 521813 - RNA, 64 nt, Human
uccauguaaucagagcauuagcugcagaaaaaccccccgacagagcccuggcggagaggcaggc

SEQ ID NO: 521814 - RNA, 61 nt, Human; identical to SEQ ID NO: 446108

SEQ ID NO: 521815 - RNA, 61 nt, Human; identical to SEQ ID NO: 446161

SEQ ID NO: 521816 - RNA, 61 nt, Human; identical to SEQ ID NO: 446162

SEQ ID NO: 521817 - RNA, 64 nt, Human
ccaggcgggccgcgguuccuccuuagggccuucuccccgacaaggaguccgacggggcggaugc

SEQ ID NO: 521818 - RNA, 64 nt, Human
ucagcucagcggcucucuccgagagcaccacccuccccgacacacagguucaugcggccccagg

SEQ ID NO: 521819 - RNA, 64 nt, Human
ugacuuuagugggucuugauguagggugggcaagccccgacacuggagcuuagccugagagggu

SEQ ID NO: 521820 - RNA, 57 nt, Human
gcuucggcuuccgcagauaggucgggcccccgacaccggacagggguugaggggacc

SEQ ID NO: 521821 - RNA, 64 nt, Human
cuucccaccccggggucagccggccgugugcgucccccgacagacacugugaacggaagacagc

SEQ ID NO: 521822 - RNA, 64 nt, Human
guguugcuggagaacccugagggcagggcccgagccccgacacaucccuucccccaaaaagcaa

SEQ ID NO: 521823 - RNA, 51 nt, Human
guggcagcgaagaagacugagccccgacauuccagucucgaccccgagccc

SEQ ID NO: 521824 - RNA, 64 nt, Human
ggguaaccugacugaguccugggcagaugauaacccccgacaccauggccuggcugcccacucc

SEQ ID NO: 521825 - RNA, 64 nt, Human
cucccccugcacggaugccgacggccgggccccuccccgacaagccucccagggccccggcacc

SEQ ID NO: 521826 - RNA, 64 nt, Human
gccccagccaucuccucuagaccaaggcaggcagccccgacaucugcuuccucuaucgcccaau

SEQ ID NO: 521827 - RNA, 64 nt, Human
caccccaaccucugcccugcccgccccaggggcaccccgacauccaggccacccccucauggug

SEQ ID NO: 521828 - RNA, 64 nt, Human
gccugucccgggaagcagcccagccuguggcugcccccgacaccaggaggagggccaggagagu

SEQ ID NO: 521829 - RNA, 64 nt, Human
ucaacacccucucaacaccccccucccucaaccaccccgacaaccacuacagaaccaacauugu

SEQ ID NO: 521830 - RNA, 64 nt, Human
aacaaccccaauccacguuuuggaugcacugagaccccgacauuccucgguauuuauugucugu

SEQ ID NO: 521831 - RNA, 64 nt, Human
gacacaccccaaggcagcccaacccccaccccuuccccgacacccaagccccuccccacgucgc

SEQ ID NO: 521832 - RNA, 61 nt, Human; identical to SEQ ID NO: 446224

SEQ ID NO: 521833 - RNA, 61 nt, Human; identical to SEQ ID NO: 446228

SEQ ID NO: 521834 - RNA, 61 nt, Human; identical to SEQ ID NO: 446229

SEQ ID NO: 521835 - RNA, 64 nt, Human
ucccacuuuccauccugcccauacgccccucuucccccgacaucugggggcgcugguggcacuu

SEQ ID NO: 521836 - RNA, 64 nt, Human
uaaagcgugugagguugggugauagccguuccuuccccgacacccucaauuuccccaucucuga

SEQ ID NO: 521837 - RNA, 64 nt, Human
uugcgggcaggguucucuguccuuccaaguggggccccgacacuuugguuccagucaucgaggg

SEQ ID NO: 521838 - RNA, 64 nt, Human
cguguccaggaggagccuggccauggguccuugcccccgacagacagagcagcccccacccggg

SEQ ID NO: 521839 - RNA, 64 nt, Human
gccaggagagcuuagggucucagggugucccagaccccgacaccggccaguggcggaagugacc

SEQ ID NO: 521840 - RNA, 64 nt, Human
ggcccucccugccacacuagcuucccagggcugcccccgacaggcuggcucucaguggaggcca

SEQ ID NO: 521841 - RNA, 64 nt, Human
caccuccaccuccuuccccuucucccucaggcaaccccgacagacaguggcacuccugguccug

SEQ ID NO: 521842 - RNA, 64 nt, Human
ucccgagacggcugagugaccccaagaaaggcuuccccgacacccagacagaggcugcagggcu

SEQ ID NO: 521843 - RNA, 64 nt, Human
ccggaaaguguaguccugcccuaacccaagucacccccgacaguaaauuuuaccuucauguuga

SEQ ID NO: 521844 - RNA, 61 nt, Human; identical to SEQ ID NO: 446093

SEQ ID NO: 521845 - RNA, 61 nt, Human; identical to SEQ ID NO: 446094

SEQ ID NO: 521846 - RNA, 61 nt, Human; identical to SEQ ID NO: 446095

SEQ ID NO: 521847 - RNA, 61 nt, Human; identical to SEQ ID NO: 446060

SEQ ID NO: 521848 - RNA, 61 nt, Human; identical to SEQ ID NO: 446061

SEQ ID NO: 521849 - RNA, 61 nt, Human; identical to SEQ ID NO: 446062

SEQ ID NO: 521850 - RNA, 61 nt, Human; identical to SEQ ID NO: 446063

SEQ ID NO: 521851 - RNA, 61 nt, Human; identical to SEQ ID NO: 446064

SEQ ID NO: 521852 - RNA, 61 nt, Human; identical to SEQ ID NO: 446068

SEQ ID NO: 521853 - RNA, 61 nt, Human; identical to SEQ ID NO: 446069

SEQ ID NO: 521854 - RNA, 61 nt, Human; identical to SEQ ID NO: 446070

SEQ ID NO: 521855 - RNA, 61 nt, Human; identical to SEQ ID NO: 446071

SEQ ID NO: 521856 - RNA, 61 nt, Human; identical to SEQ ID NO: 446072

SEQ ID NO: 521857 - RNA, 61 nt, Human; identical to SEQ ID NO: 446073

SEQ ID NO: 521858 - RNA, 61 nt, Human; identical to SEQ ID NO: 446074

SEQ ID NO: 521859 - RNA, 61 nt, Human; identical to SEQ ID NO: 446075

SEQ ID NO: 521860 - RNA, 61 nt, Human; identical to SEQ ID NO: 446076

SEQ ID NO: 521861 - RNA, 61 nt, Human; identical to SEQ ID NO: 446077

SEQ ID NO: 521862 - RNA, 61 nt, Human; identical to SEQ ID NO: 446078

SEQ ID NO: 521863 - RNA, 61 nt, Human; identical to SEQ ID NO: 446079

SEQ ID NO: 521864 - RNA, 61 nt, Human; identical to SEQ ID NO: 446080

SEQ ID NO: 521865 - RNA, 61 nt, Human; identical to SEQ ID NO: 446085

SEQ ID NO: 521866 - RNA, 61 nt, Human; identical to SEQ ID NO: 446086

SEQ ID NO: 521867 - RNA, 61 nt, Human; identical to SEQ ID NO: 446087

SEQ ID NO: 521868 - RNA, 61 nt, Human; identical to SEQ ID NO: 446088

SEQ ID NO: 521869 - RNA, 61 nt, Human; identical to SEQ ID NO: 446487

SEQ ID NO: 521870 - RNA, 61 nt, Human; identical to SEQ ID NO: 446488

SEQ ID NO: 521871 - RNA, 61 nt, Human; identical to SEQ ID NO: 446493

SEQ ID NO: 521872 - RNA, 61 nt, Human; identical to SEQ ID NO: 446494

SEQ ID NO: 521873 - RNA, 61 nt, Human; identical to SEQ ID NO: 446495

SEQ ID NO: 521874 - RNA, 61 nt, Human; identical to SEQ ID NO: 446496

SEQ ID NO: 521875 - RNA, 61 nt, Human; identical to SEQ ID NO: 446497

SEQ ID NO: 521876 - RNA, 61 nt, Human; identical to SEQ ID NO: 446498

SEQ ID NO: 521877 - RNA, 61 nt, Human; identical to SEQ ID NO: 446499

SEQ ID NO: 521878 - RNA, 61 nt, Human; identical to SEQ ID NO: 446500

SEQ ID NO: 521879 - RNA, 61 nt, Human; identical to SEQ ID NO: 446501

SEQ ID NO: 521880 - RNA, 61 nt, Human; identical to SEQ ID NO: 446502

SEQ ID NO: 521881 - RNA, 61 nt, Human; identical to SEQ ID NO: 446503

SEQ ID NO: 521882 - RNA, 61 nt, Human; identical to SEQ ID NO: 446504

SEQ ID NO: 521883 - RNA, 61 nt, Human; identical to SEQ ID NO: 446505

SEQ ID NO: 521884 - RNA, 61 nt, Human; identical to SEQ ID NO: 446510

SEQ ID NO: 521885 - RNA, 50 nt, Human; identical to SEQ ID NO: 446511

SEQ ID NO: 521886 - RNA, 61 nt, Human; identical to SEQ ID NO: 446512

SEQ ID NO: 521887 - RNA, 61 nt, Human; identical to SEQ ID NO: 446513

SEQ ID NO: 521888 - RNA, 61 nt, Human; identical to SEQ ID NO: 446514

SEQ ID NO: 521889 - RNA, 61 nt, Human; identical to SEQ ID NO: 446515

SEQ ID NO: 521890 - RNA, 61 nt, Human; identical to SEQ ID NO: 446516

SEQ ID NO: 521891 - RNA, 61 nt, Human; identical to SEQ ID NO: 446517

SEQ ID NO: 521892 - RNA, 61 nt, Human; identical to SEQ ID NO: 446518

SEQ ID NO: 521893 - RNA, 61 nt, Human; identical to SEQ ID NO: 446519

SEQ ID NO: 521894 - RNA, 61 nt, Human; identical to SEQ ID NO: 446520

SEQ ID NO: 521895 - RNA, 61 nt, Human; identical to SEQ ID NO: 446521

SEQ ID NO: 521896 - RNA, 61 nt, Human; identical to SEQ ID NO: 446522

SEQ ID NO: 521897 - RNA, 61 nt, Human; identical to SEQ ID NO: 446527

SEQ ID NO: 521898 - RNA, 61 nt, Human; identical to SEQ ID NO: 446528

SEQ ID NO: 521899 - RNA, 61 nt, Human; identical to SEQ ID NO: 446529

SEQ ID NO: 521900 - RNA, 61 nt, Human; identical to SEQ ID NO: 446530

SEQ ID NO: 521901 - RNA, 61 nt, Human; identical to SEQ ID NO: 446531

SEQ ID NO: 521902 - RNA, 61 nt, Human; identical to SEQ ID NO: 446532

SEQ ID NO: 521903 - RNA, 61 nt, Human; identical to SEQ ID NO: 446533

SEQ ID NO: 521904 - RNA, 61 nt, Human; identical to SEQ ID NO: 446534

SEQ ID NO: 521905 - RNA, 61 nt, Human; identical to SEQ ID NO: 446535

SEQ ID NO: 521906 - RNA, 61 nt, Human; identical to SEQ ID NO: 446536

SEQ ID NO: 521907 - RNA, 61 nt, Human; identical to SEQ ID NO: 446537

SEQ ID NO: 521908 - RNA, 61 nt, Human; identical to SEQ ID NO: 446538

SEQ ID NO: 521909 - RNA, 61 nt, Human; identical to SEQ ID NO: 446539

SEQ ID NO: 521910 - RNA, 61 nt, Human; identical to SEQ ID NO: 446544

SEQ ID NO: 521911 - RNA, 61 nt, Human; identical to SEQ ID NO: 446545

SEQ ID NO: 521912 - RNA, 61 nt, Human; identical to SEQ ID NO: 446546

SEQ ID NO: 521913 - RNA, 61 nt, Human; identical to SEQ ID NO: 446547

SEQ ID NO: 521914 - RNA, 61 nt, Human; identical to SEQ ID NO: 446548

SEQ ID NO: 521915 - RNA, 61 nt, Human; identical to SEQ ID NO: 446549

SEQ ID NO: 521916 - RNA, 61 nt, Human; identical to SEQ ID NO: 446550

SEQ ID NO: 521917 - RNA, 61 nt, Human; identical to SEQ ID NO: 446551

SEQ ID NO: 521918 - RNA, 61 nt, Human; identical to SEQ ID NO: 446552

SEQ ID NO: 521919 - RNA, 61 nt, Human; identical to SEQ ID NO: 446553

SEQ ID NO: 521920 - RNA, 61 nt, Human; identical to SEQ ID NO: 446554

SEQ ID NO: 521921 - RNA, 61 nt, Human; identical to SEQ ID NO: 446555

SEQ ID NO: 521922 - RNA, 61 nt, Human; identical to SEQ ID NO: 446556

SEQ ID NO: 521923 - RNA, 61 nt, Human; identical to SEQ ID NO: 446561

SEQ ID NO: 521924 - RNA, 61 nt, Human; identical to SEQ ID NO: 446562

SEQ ID NO: 521925 - RNA, 61 nt, Human; identical to SEQ ID NO: 446563

SEQ ID NO: 521926 - RNA, 61 nt, Human; identical to SEQ ID NO: 446564

SEQ ID NO: 521927 - RNA, 61 nt, Human; identical to SEQ ID NO: 446565

SEQ ID NO: 521928 - RNA, 61 nt, Human; identical to SEQ ID NO: 446566

SEQ ID NO: 521929 - RNA, 61 nt, Human; identical to SEQ ID NO: 446567

SEQ ID NO: 521930 - RNA, 61 nt, Human; identical to SEQ ID NO: 446568

SEQ ID NO: 521931 - RNA, 61 nt, Human; identical to SEQ ID NO: 446569

SEQ ID NO: 521932 - RNA, 61 nt, Human; identical to SEQ ID NO: 446570

SEQ ID NO: 521933 - RNA, 61 nt, Human; identical to SEQ ID NO: 446571

SEQ ID NO: 521934 - RNA, 61 nt, Human; identical to SEQ ID NO: 446572

SEQ ID NO: 521935 - RNA, 61 nt, Human; identical to SEQ ID NO: 446573

SEQ ID NO: 521936 - RNA, 61 nt, Human; identical to SEQ ID NO: 446578

SEQ ID NO: 521937 - RNA, 61 nt, Human; identical to SEQ ID NO: 446579

SEQ ID NO: 521938 - RNA, 61 nt, Human; identical to SEQ ID NO: 446580

SEQ ID NO: 521939 - RNA, 61 nt, Human; identical to SEQ ID NO: 446581

SEQ ID NO: 521940 - RNA, 61 nt, Human; identical to SEQ ID NO: 446582

SEQ ID NO: 521941 - RNA, 61 nt, Human; identical to SEQ ID NO: 446583

SEQ ID NO: 521942 - RNA, 61 nt, Human; identical to SEQ ID NO: 446584

SEQ ID NO: 521943 - RNA, 61 nt, Human; identical to SEQ ID NO: 446585

SEQ ID NO: 521944 - RNA, 61 nt, Human; identical to SEQ ID NO: 446586

SEQ ID NO: 521945 - RNA, 61 nt, Human; identical to SEQ ID NO: 446587

SEQ ID NO: 521946 - RNA, 61 nt, Human; identical to SEQ ID NO: 446588

SEQ ID NO: 521947 - RNA, 61 nt, Human; identical to SEQ ID NO: 446589

SEQ ID NO: 521948 - RNA, 52 nt, Human; identical to SEQ ID NO: 446590

SEQ ID NO: 521949 - RNA, 61 nt, Human; identical to SEQ ID NO: 446595

SEQ ID NO: 521950 - RNA, 61 nt, Human; identical to SEQ ID NO: 446596

SEQ ID NO: 521951 - RNA, 61 nt, Human; identical to SEQ ID NO: 446597

SEQ ID NO: 521952 - RNA, 61 nt, Human; identical to SEQ ID NO: 446598

SEQ ID NO: 521953 - RNA, 61 nt, Human; identical to SEQ ID NO: 446599

SEQ ID NO: 521954 - RNA, 61 nt, Human; identical to SEQ ID NO: 446600

SEQ ID NO: 521955 - RNA, 61 nt, Human; identical to SEQ ID NO: 446601

SEQ ID NO: 521956 - RNA, 61 nt, Human; identical to SEQ ID NO: 446602

SEQ ID NO: 521957 - RNA, 50 nt, Human; identical to SEQ ID NO: 446603

SEQ ID NO: 521958 - RNA, 61 nt, Human; identical to SEQ ID NO: 446604

SEQ ID NO: 521959 - RNA, 61 nt, Human; identical to SEQ ID NO: 446605

SEQ ID NO: 521960 - RNA, 61 nt, Human; identical to SEQ ID NO: 446606

SEQ ID NO: 521961 - RNA, 61 nt, Human; identical to SEQ ID NO: 446607

SEQ ID NO: 521962 - RNA, 61 nt, Human; identical to SEQ ID NO: 446612

SEQ ID NO: 521963 - RNA, 61 nt, Human; identical to SEQ ID NO: 446613

SEQ ID NO: 521964 - RNA, 61 nt, Human; identical to SEQ ID NO: 446614

SEQ ID NO: 521965 - RNA, 61 nt, Human; identical to SEQ ID NO: 446615

SEQ ID NO: 521966 - RNA, 61 nt, Human; identical to SEQ ID NO: 446616

SEQ ID NO: 521967 - RNA, 61 nt, Human; identical to SEQ ID NO: 446617

SEQ ID NO: 521968 - RNA, 61 nt, Human; identical to SEQ ID NO: 446618

SEQ ID NO: 521969 - RNA, 61 nt, Human; identical to SEQ ID NO: 446619

SEQ ID NO: 521970 - RNA, 61 nt, Human; identical to SEQ ID NO: 446620

SEQ ID NO: 521971 - RNA, 61 nt, Human; identical to SEQ ID NO: 446621

SEQ ID NO: 521972 - RNA, 61 nt, Human; identical to SEQ ID NO: 446622

SEQ ID NO: 521973 - RNA, 61 nt, Human; identical to SEQ ID NO: 446623

SEQ ID NO: 521974 - RNA, 61 nt, Human; identical to SEQ ID NO: 446624

SEQ ID NO: 521975 - RNA, 64 nt, Human; identical to SEQ ID NO: 223298

SEQ ID NO: 521976 - RNA, 64 nt, Human; identical to SEQ ID NO: 223299

SEQ ID NO: 521977 - RNA, 64 nt, Human; identical to SEQ ID NO: 223300

SEQ ID NO: 521978 - RNA, 64 nt, Human; identical to SEQ ID NO: 223301

SEQ ID NO: 521979 - RNA, 64 nt, Human; identical to SEQ ID NO: 223302

SEQ ID NO: 521980 - RNA, 64 nt, Human; identical to SEQ ID NO: 223303

SEQ ID NO: 521981 - RNA, 64 nt, Human
ccauuuuuuuguacugggccuuuaaaaaaauaaauccauccaacuuuaacacaacauuucucag

SEQ ID NO: 521982 - RNA, 64 nt, Human
ggacaggcuagauugauuacggauguaauugcuguccauccauacagagcauacucuacagugu

SEQ ID NO: 521983 - RNA, 64 nt, Human
ucaggauuugagagcuggagcccaucuuucugccuccauccaaagaggccuuuuaacucagccu

SEQ ID NO: 521984 - RNA, 64 nt, Human; identical to SEQ ID NO: 223304

SEQ ID NO: 521985 - RNA, 64 nt, Human; identical to SEQ ID NO: 223305

SEQ ID NO: 521986 - RNA, 64 nt, Human; identical to SEQ ID NO: 223306

SEQ ID NO: 521987 - RNA, 64 nt, Human; identical to SEQ ID NO: 223307

SEQ ID NO: 521988 - RNA, 64 nt, Human; identical to SEQ ID NO: 223308

SEQ ID NO: 521989 - RNA, 64 nt, Human; identical to SEQ ID NO: 223309

SEQ ID NO: 521990 - RNA, 64 nt, Human; identical to SEQ ID NO: 223310

SEQ ID NO: 521991 - RNA, 64 nt, Human; identical to SEQ ID NO: 223311

SEQ ID NO: 521992 - RNA, 64 nt, Human; identical to SEQ ID NO: 223312

SEQ ID NO: 521993 - RNA, 64 nt, Human; identical to SEQ ID NO: 223313

SEQ ID NO: 521994 - RNA, 64 nt, Human; identical to SEQ ID NO: 223314

SEQ ID NO: 521995 - RNA, 64 nt, Human; identical to SEQ ID NO: 222683

SEQ ID NO: 521996 - RNA, 64 nt, Human; identical to SEQ ID NO: 215633

SEQ ID NO: 521997 - RNA, 64 nt, Human; identical to SEQ ID NO: 223058

SEQ ID NO: 521998 - RNA, 64 nt, Human; identical to SEQ ID NO: 223059

SEQ ID NO: 521999 - RNA, 64 nt, Human
ccagcugggggcccucagguggagagagcugcgauccauccaggccaagaccacagcucuguga

SEQ ID NO: 522000 - RNA, 64 nt, Human
gaaaggaguaaaggcaucuccaccugacuucacuuccauccagggccacuggcagcaucuggaa

SEQ ID NO: 522001 - RNA, 64 nt, Human
ggacagagaccacacugggucggcggacacaaaguccauccaggacccaggccgcagagggagc

SEQ ID NO: 522002 - RNA, 64 nt, Human; identical to SEQ ID NO: 223060

SEQ ID NO: 522003 - RNA, 64 nt, Human; identical to SEQ ID NO: 223184

SEQ ID NO: 522004 - RNA, 64 nt, Human; identical to SEQ ID NO: 215634

SEQ ID NO: 522005 - RNA, 64 nt, Human; identical to SEQ ID NO: 223094

SEQ ID NO: 522006 - RNA, 64 nt, Human; identical to SEQ ID NO: 223095

SEQ ID NO: 522007 - RNA, 64 nt, Human; identical to SEQ ID NO: 223096

SEQ ID NO: 522008 - RNA, 64 nt, Human; identical to SEQ ID NO: 223238

SEQ ID NO: 522009 - RNA, 64 nt, Human; identical to SEQ ID NO: 215651

SEQ ID NO: 522010 - RNA, 64 nt, Human; identical to SEQ ID NO: 223130

SEQ ID NO: 522011 - RNA, 64 nt, Human; identical to SEQ ID NO: 223131

SEQ ID NO: 522012 - RNA, 64 nt, Human; identical to SEQ ID NO: 223132

SEQ ID NO: 522013 - RNA, 64 nt, Human; identical to SEQ ID NO: 223022

SEQ ID NO: 522014 - RNA, 64 nt, Human; identical to SEQ ID NO: 215652

SEQ ID NO: 522015 - RNA, 64 nt, Human; identical to SEQ ID NO: 223148

SEQ ID NO: 522016 - RNA, 64 nt, Human; identical to SEQ ID NO: 223149

SEQ ID NO: 522017 - RNA, 64 nt, Human
acacccggcucccuccagacaaugccagcauaaauccauccauccaaaggcagagaaccaaagg

SEQ ID NO: 522018 - RNA, 64 nt, Human
auauauacuaucugugccuguuaugaaugaaaaauccauccacucugcugccauucacagccua

SEQ ID NO: 522019 - RNA, 64 nt, Human
guuaauuaucuagauuuuuguccacaguauaugauccauccagacauuugcaaacgucaggaga

SEQ ID NO: 522020 - RNA, 64 nt, Human; identical to SEQ ID NO: 223150

SEQ ID NO: 522021 - RNA, 64 nt, Human; identical to SEQ ID NO: 223185

SEQ ID NO: 522022 - RNA, 64 nt, Human; identical to SEQ ID NO: 215653

SEQ ID NO: 522023 - RNA, 64 nt, Human; identical to SEQ ID NO: 223166

SEQ ID NO: 522024 - RNA, 64 nt, Human; identical to SEQ ID NO: 223167

SEQ ID NO: 522025 - RNA, 64 nt, Human; identical to SEQ ID NO: 223168

SEQ ID NO: 522026 - RNA, 64 nt, Human; identical to SEQ ID NO: 222968

SEQ ID NO: 522027 - RNA, 64 nt, Human; identical to SEQ ID NO: 221857

SEQ ID NO: 522028 - RNA, 64 nt, Human; identical to SEQ ID NO: 223202

SEQ ID NO: 522029 - RNA, 57 nt, Human; identical to SEQ ID NO: 223203

SEQ ID NO: 522030 - RNA, 64 nt, Human; identical to SEQ ID NO: 223204

SEQ ID NO: 522031 - RNA, 64 nt, Human; identical to SEQ ID NO: 223220

SEQ ID NO: 522032 - RNA, 64 nt, Human; identical to SEQ ID NO: 221858

SEQ ID NO: 522033 - RNA, 64 nt, Human; identical to SEQ ID NO: 223221

SEQ ID NO: 522034 - RNA, 64 nt, Human; identical to SEQ ID NO: 223222

SEQ ID NO: 522035 - RNA, 64 nt, Human
uguaaaucauuaccucauuuccagccucccaggcuccauccaucccagcaucuuuuauucugcc

SEQ ID NO: 522036 - RNA, 64 nt, Human
ccuucauucacuucgccauucauucauacuuccguccauccauucagaaagcauuuauuaagaa

SEQ ID NO: 522037 - RNA, 64 nt, Human
uaggguuccuucugcggcuauugcugaaccccuguccauccacgggacccugaaacuccacuug

SEQ ID NO: 522038 - RNA, 64 nt, Human; identical to SEQ ID NO: 223023

SEQ ID NO: 522039 - RNA, 64 nt, Human; identical to SEQ ID NO: 221875

SEQ ID NO: 522040 - RNA, 64 nt, Human; identical to SEQ ID NO: 223256

SEQ ID NO: 522041 - RNA, 57 nt, Human; identical to SEQ ID NO: 223257

SEQ ID NO: 522042 - RNA, 64 nt, Human; identical to SEQ ID NO: 223258

SEQ ID NO: 522043 - RNA, 64 nt, Human; identical to SEQ ID NO: 222969

SEQ ID NO: 522044 - RNA, 64 nt, Human; identical to SEQ ID NO: 221876

SEQ ID NO: 522045 - RNA, 64 nt, Human; identical to SEQ ID NO: 223274

SEQ ID NO: 522046 - RNA, 64 nt, Human; identical to SEQ ID NO: 223275

SEQ ID NO: 522047 - RNA, 64 nt, Human; identical to SEQ ID NO: 223276

SEQ ID NO: 522048 - RNA, 64 nt, Human; identical to SEQ ID NO: 222932

SEQ ID NO: 522049 - RNA, 64 nt, Human; identical to SEQ ID NO: 221877

SEQ ID NO: 522050 - RNA, 64 nt, Human; identical to SEQ ID NO: 223292

SEQ ID NO: 522051 - RNA, 64 nt, Human; identical to SEQ ID NO: 223293

SEQ ID NO: 522052 - RNA, 64 nt, Human; identical to SEQ ID NO: 223294

SEQ ID NO: 522053 - RNA, 64 nt, Human
uucuccuccuguguuuaaguggauggccccucuauccauccaggucccaugccaagaaccagug

SEQ ID NO: 522054 - RNA, 64 nt, Human
gcaauaggggauugcuuaaguaaauuauuguaucuccauccagaugguggaguaccgcgcagac

SEQ ID NO: 522055 - RNA, 64 nt, Human
caucauggugucaggaaggcugagauguauugguuccauccaacaccugaaaagcaaauuuggc

SEQ ID NO: 522056 - RNA, 64 nt, Human; identical to SEQ ID NO: 222914

SEQ ID NO: 522057 - RNA, 64 nt, Human; identical to SEQ ID NO: 221894

SEQ ID NO: 522058 - RNA, 64 nt, Human; identical to SEQ ID NO: 222878

SEQ ID NO: 522059 - RNA, 64 nt, Human; identical to SEQ ID NO: 222879

SEQ ID NO: 522060 - RNA, 64 nt, Human; identical to SEQ ID NO: 222880

SEQ ID NO: 522061 - RNA, 64 nt, Human; identical to SEQ ID NO: 222933

SEQ ID NO: 522062 - RNA, 64 nt, Human; identical to SEQ ID NO: 221895

SEQ ID NO: 522063 - RNA, 64 nt, Human; identical to SEQ ID NO: 222896

SEQ ID NO: 522064 - RNA, 64 nt, Human; identical to SEQ ID NO: 222897

SEQ ID NO: 522065 - RNA, 64 nt, Human; identical to SEQ ID NO: 222898

SEQ ID NO: 522066 - RNA, 64 nt, Human; identical to SEQ ID NO: 222970

SEQ ID NO: 522067 - RNA, 64 nt, Human; identical to SEQ ID NO: 221896

SEQ ID NO: 522068 - RNA, 64 nt, Human; identical to SEQ ID NO: 222915

SEQ ID NO: 522069 - RNA, 64 nt, Human; identical to SEQ ID NO: 222916

SEQ ID NO: 522070 - RNA, 64 nt, Human; identical to SEQ ID NO: 222934

SEQ ID NO: 522071 - RNA, 64 nt, Human
ucuagguccucaagugcucgugacacauaaucauuccauccaaugaucgccuuugcuuuaccac

SEQ ID NO: 522072 - RNA, 64 nt, Human
gccccuaacuacccuccccagccuccaggaacuauccauccacucuuaucuccaugaguucaau

SEQ ID NO: 522073 - RNA, 64 nt, Human
gagcagggaccaucucuguccccuccacccucacuccauccaccucggagaccacccuccccca

SEQ ID NO: 522074 - RNA, 64 nt, Human; identical to SEQ ID NO: 221913

SEQ ID NO: 522075 - RNA, 64 nt, Human; identical to SEQ ID NO: 222986

SEQ ID NO: 522076 - RNA, 64 nt, Human; identical to SEQ ID NO: 222987

SEQ ID NO: 522077 - RNA, 64 nt, Human; identical to SEQ ID NO: 222988

SEQ ID NO: 522078 - RNA, 64 nt, Human; identical to SEQ ID NO: 223004

SEQ ID NO: 522079 - RNA, 64 nt, Human; identical to SEQ ID NO: 221914

SEQ ID NO: 522080 - RNA, 64 nt, Human; identical to SEQ ID NO: 223005

SEQ ID NO: 522081 - RNA, 64 nt, Human; identical to SEQ ID NO: 223006

SEQ ID NO: 522082 - RNA, 64 nt, Human; identical to SEQ ID NO: 222755

SEQ ID NO: 522083 - RNA, 64 nt, Human; identical to SEQ ID NO: 221915

SEQ ID NO: 522084 - RNA, 64 nt, Human; identical to SEQ ID NO: 223024

SEQ ID NO: 522085 - RNA, 64 nt, Human; identical to SEQ ID NO: 223076

SEQ ID NO: 522086 - RNA, 64 nt, Human; identical to SEQ ID NO: 221931

SEQ ID NO: 522087 - RNA, 64 nt, Human; identical to SEQ ID NO: 223077

SEQ ID NO: 522088 - RNA, 64 nt, Human; identical to SEQ ID NO: 223078

SEQ ID NO: 522089 - RNA, 64 nt, Human
aggacgcaggcauuccuagguccccagcucuaauuccauccaucuacccaacugucaccaucuu

SEQ ID NO: 522090 - RNA, 64 nt, Human
gcguggcaacuugaccuugggggaauauuucacauccauccagagcucggaaucuacagcgucc

SEQ ID NO: 522091 - RNA, 64 nt, Human
gggcucugcuuccuguagacacgcacacguugucuccauccaauggccuuuucugaaguuacag

SEQ ID NO: 522092 - RNA, 64 nt, Human; identical to SEQ ID NO: 222842

SEQ ID NO: 522093 - RNA, 64 nt, Human; identical to SEQ ID NO: 221932

SEQ ID NO: 522094 - RNA, 64 nt, Human; identical to SEQ ID NO: 223112

SEQ ID NO: 522095 - RNA, 64 nt, Human; identical to SEQ ID NO: 223113

SEQ ID NO: 522096 - RNA, 64 nt, Human; identical to SEQ ID NO: 223114

SEQ ID NO: 522097 - RNA, 64 nt, Human; identical to SEQ ID NO: 222773

SEQ ID NO: 522098 - RNA, 64 nt, Human; identical to SEQ ID NO: 221933

SEQ ID NO: 522099 - RNA, 64 nt, Human; identical to SEQ ID NO: 223186

SEQ ID NO: 522100 - RNA, 58 nt, Human; identical to SEQ ID NO: 222737

SEQ ID NO: 522101 - RNA, 64 nt, Human; identical to SEQ ID NO: 222006

SEQ ID NO: 522102 - RNA, 64 nt, Human; identical to SEQ ID NO: 222007

SEQ ID NO: 522103 - RNA, 64 nt, Human; identical to SEQ ID NO: 222008

SEQ ID NO: 522104 - RNA, 64 nt, Human; identical to SEQ ID NO: 222738

SEQ ID NO: 522105 - RNA, 64 nt, Human; identical to SEQ ID NO: 222739

SEQ ID NO: 522106 - RNA, 64 nt, Human; identical to SEQ ID NO: 222665

SEQ ID NO: 522107 - RNA, 64 nt, Human
cccggauggcccccacccaguccugcacacuugguccauccauuuccaaaccuccacugcugcu

SEQ ID NO: 522108 - RNA, 64 nt, Human
auuagcacaaaagucuugauagcacaacacaaauuccauccaagaggagaaucuuccccagggu

SEQ ID NO: 522109 - RNA, 64 nt, Human; identical to SEQ ID NO: 521999

SEQ ID NO: 522110 - RNA, 64 nt, Human; identical to SEQ ID NO: 222701

SEQ ID NO: 522111 - RNA, 64 nt, Human
gcgagcaugugacagucccuggacaaccuccugcuccauccacuacaagaaggaaggauguccc

SEQ ID NO: 522112 - RNA, 64 nt, Human
guuuggggguuuuauaaaagcaacuacugucaccuccauccagauucuuuuaaauuauugaucc

SEQ ID NO: 522113 - RNA, 64 nt, Human
uuucuuucuuucuuuuuuuuuaaauuuuguauuuuccauccaacagcaguguguagagagaaua

SEQ ID NO: 522114 - RNA, 64 nt, Human
aacuuauuggaacuguagagcauccauccauccauccauccagcaaugugacuuuuucaugucu

SEQ ID NO: 522115 - RNA, 64 nt, Human
cuauguggcugugcuaugguuucuaugagucugcuccauccaugugucuguuugggggucuauc

SEQ ID NO: 522116 - RNA, 64 nt, Human; identical to SEQ ID NO: 519672

SEQ ID NO: 522117 - RNA, 64 nt, Human
cuucccaggucuaugcccaagagaauugaaaacauccauccacacaauaccugugcucccgcgu

SEQ ID NO: 522118 - RNA, 64 nt, Human
uacacuaaagaaaaugaacuccgccauccgaccuuccauccaguugcugaugcuuugucuucag

SEQ ID NO: 522119 - RNA, 64 nt, Human
ucugccuuuguuacagaugagacugaucgugggguugaccaacaagauggaaagaaccacgcag

SEQ ID NO: 522120 - RNA, 64 nt, Human
uguuuguaaagcuugucucuuaaucaaauuugucuugaccaaauaaguuuccugagggcuggaa

SEQ ID NO: 522121 - RNA, 64 nt, Human
ucagaacuguuaaaggucauaugcacguuaaaaguugaccaaugaaaugaauuuacagaacagu

SEQ ID NO: 522122 - RNA, 64 nt, Human
aggccccacuuggcuauuucauaucuaccuacaauugaccaaaaaaaauuuuuuaggccagcaa

SEQ ID NO: 522123 - RNA, 64 nt, Human
guggauguguguguguggguuuuguaaagaauucuugaccaauaaaagcaaaaacugucugcug

SEQ ID NO: 522124 - RNA, 64 nt, Human
cauugaaaaugaaugcuugacuucaacuuuuuaguugaccaaauacaaacauccuaaaguagag

SEQ ID NO: 522125 - RNA, 64 nt, Human; identical to SEQ ID NO: 255911

SEQ ID NO: 522126 - RNA, 64 nt, Human; identical to SEQ ID NO: 255918

SEQ ID NO: 522127 - RNA, 64 nt, Human; identical to SEQ ID NO: 255928

SEQ ID NO: 522128 - RNA, 64 nt, Human; identical to SEQ ID NO: 255935

SEQ ID NO: 522129 - RNA, 64 nt, Human; identical to SEQ ID NO: 222702

SEQ ID NO: 522130 - RNA, 64 nt, Human; identical to SEQ ID NO: 222703

SEQ ID NO: 522131 - RNA, 64 nt, Human; identical to SEQ ID NO: 222719

SEQ ID NO: 522132 - RNA, 64 nt, Human; identical to SEQ ID NO: 222720

SEQ ID NO: 522133 - RNA, 64 nt, Human; identical to SEQ ID NO: 222721

SEQ ID NO: 522134 - RNA, 64 nt, Human; identical to SEQ ID NO: 222756

SEQ ID NO: 522135 - RNA, 64 nt, Human; identical to SEQ ID NO: 222757

SEQ ID NO: 522136 - RNA, 64 nt, Human; identical to SEQ ID NO: 222774

SEQ ID NO: 522137 - RNA, 64 nt, Human; identical to SEQ ID NO: 222775

SEQ ID NO: 522138 - RNA, 64 nt, Human; identical to SEQ ID NO: 223315

SEQ ID NO: 522139 - RNA, 64 nt, Human; identical to SEQ ID NO: 223316

SEQ ID NO: 522140 - RNA, 64 nt, Human; identical to SEQ ID NO: 223317

SEQ ID NO: 522141 - RNA, 64 nt, Human; identical to SEQ ID NO: 223318

SEQ ID NO: 522142 - RNA, 64 nt, Human; identical to SEQ ID NO: 223319

SEQ ID NO: 522143 - RNA, 64 nt, Human; identical to SEQ ID NO: 223320

SEQ ID NO: 522144 - RNA, 64 nt, Human
auccuggucagucuagagucugugcaccaggcaguccauccacugaaggcuguguuuauucuuu

SEQ ID NO: 522145 - RNA, 64 nt, Human
ggccacacuaaacuacucagugggauuuauauauuccauccacuugaaacaauaaacaguaaug

SEQ ID NO: 522146 - RNA, 64 nt, Human
ggcuccugccugaucuuuguaguuuguucauucauccauccaccuguucauuuguucauccaug

SEQ ID NO: 522147 - RNA, 64 nt, Human; identical to SEQ ID NO: 223321

SEQ ID NO: 522148 - RNA, 64 nt, Human; identical to SEQ ID NO: 223322

SEQ ID NO: 522149 - RNA, 64 nt, Human; identical to SEQ ID NO: 223323

SEQ ID NO: 522150 - RNA, 64 nt, Human; identical to SEQ ID NO: 223324

SEQ ID NO: 522151 - RNA, 64 nt, Human; identical to SEQ ID NO: 223325

SEQ ID NO: 522152 - RNA, 64 nt, Human; identical to SEQ ID NO: 223326

SEQ ID NO: 522153 - RNA, 64 nt, Human; identical to SEQ ID NO: 223327

SEQ ID NO: 522154 - RNA, 64 nt, Human; identical to SEQ ID NO: 223328

SEQ ID NO: 522155 - RNA, 64 nt, Human; identical to SEQ ID NO: 223329

SEQ ID NO: 522156 - RNA, 64 nt, Human; identical to SEQ ID NO: 223330

SEQ ID NO: 522157 - RNA, 64 nt, Human; identical to SEQ ID NO: 223331

SEQ ID NO: 522158 - RNA, 64 nt, Human; identical to SEQ ID NO: 223332

SEQ ID NO: 522159 - RNA, 64 nt, Human; identical to SEQ ID NO: 223333

SEQ ID NO: 522160 - RNA, 64 nt, Human; identical to SEQ ID NO: 223334

SEQ ID NO: 522161 - RNA, 64 nt, Human; identical to SEQ ID NO: 223335

SEQ ID NO: 522162 - RNA, 64 nt, Human
aaggaagcuggggcagugaaaaacacuucguugauccauccagcccuaaaguucauugacuaau

SEQ ID NO: 522163 - RNA, 64 nt, Human; identical to SEQ ID NO: 519691

SEQ ID NO: 522164 - RNA, 64 nt, Human
gcacaggucugcaaaaacaaaaauuauaaacuaguccauccaagaaccaaaguuuguauaaaca

SEQ ID NO: 522165 - RNA, 64 nt, Human; identical to SEQ ID NO: 223336

SEQ ID NO: 522166 - RNA, 64 nt, Human; identical to SEQ ID NO: 223337

SEQ ID NO: 522167 - RNA, 64 nt, Human; identical to SEQ ID NO: 223338

SEQ ID NO: 522168 - RNA, 64 nt, Human; identical to SEQ ID NO: 223339

SEQ ID NO: 522169 - RNA, 64 nt, Human; identical to SEQ ID NO: 223340

SEQ ID NO: 522170 - RNA, 64 nt, Human; identical to SEQ ID NO: 223341

SEQ ID NO: 522171 - RNA, 64 nt, Human; identical to SEQ ID NO: 223342

SEQ ID NO: 522172 - RNA, 64 nt, Human; identical to SEQ ID NO: 223343

SEQ ID NO: 522173 - RNA, 64 nt, Human; identical to SEQ ID NO: 223344

SEQ ID NO: 522174 - RNA, 64 nt, Human; identical to SEQ ID NO: 223345

SEQ ID NO: 522175 - RNA, 64 nt, Human; identical to SEQ ID NO: 223346

SEQ ID NO: 522176 - RNA, 64 nt, Human; identical to SEQ ID NO: 223347

SEQ ID NO: 522177 - RNA, 64 nt, Human; identical to SEQ ID NO: 223348

SEQ ID NO: 522178 - RNA, 64 nt, Human; identical to SEQ ID NO: 223349

SEQ ID NO: 522179 - RNA, 64 nt, Human; identical to SEQ ID NO: 223350

SEQ ID NO: 522180 - RNA, 64 nt, Human; identical to SEQ ID NO: 255912

SEQ ID NO: 522181 - RNA, 64 nt, Human; identical to SEQ ID NO: 255913

SEQ ID NO: 522182 - RNA, 64 nt, Human; identical to SEQ ID NO: 255914

SEQ ID NO: 522183 - RNA, 64 nt, Human; identical to SEQ ID NO: 223351

SEQ ID NO: 522184 - RNA, 64 nt, Human; identical to SEQ ID NO: 223352

SEQ ID NO: 522185 - RNA, 64 nt, Human; identical to SEQ ID NO: 223353

SEQ ID NO: 522186 - RNA, 64 nt, Human; identical to SEQ ID NO: 223354

SEQ ID NO: 522187 - RNA, 64 nt, Human; identical to SEQ ID NO: 223355

SEQ ID NO: 522188 - RNA, 64 nt, Human; identical to SEQ ID NO: 223356

SEQ ID NO: 522189 - RNA, 64 nt, Human; identical to SEQ ID NO: 223357

SEQ ID NO: 522190 - RNA, 64 nt, Human; identical to SEQ ID NO: 223358

SEQ ID NO: 522191 - RNA, 64 nt, Human; identical to SEQ ID NO: 223359

SEQ ID NO: 522192 - RNA, 64 nt, Human; identical to SEQ ID NO: 223360

SEQ ID NO: 522193 - RNA, 64 nt, Human; identical to SEQ ID NO: 223361

SEQ ID NO: 522194 - RNA, 64 nt, Human; identical to SEQ ID NO: 223362

SEQ ID NO: 522195 - RNA, 64 nt, Human; identical to SEQ ID NO: 223363

SEQ ID NO: 522196 - RNA, 64 nt, Human; identical to SEQ ID NO: 223364

SEQ ID NO: 522197 - RNA, 64 nt, Human; identical to SEQ ID NO: 223365

SEQ ID NO: 522198 - RNA, 64 nt, Human; identical to SEQ ID NO: 255945

SEQ ID NO: 522199 - RNA, 64 nt, Human; identical to SEQ ID NO: 255946

SEQ ID NO: 522200 - RNA, 64 nt, Human; identical to SEQ ID NO: 255947

SEQ ID NO: 522201 - RNA, 64 nt, Human; identical to SEQ ID NO: 223366

SEQ ID NO: 522202 - RNA, 64 nt, Human; identical to SEQ ID NO: 223367

SEQ ID NO: 522203 - RNA, 64 nt, Human; identical to SEQ ID NO: 223368

SEQ ID NO: 522204 - RNA, 64 nt, Human; identical to SEQ ID NO: 223369

SEQ ID NO: 522205 - RNA, 64 nt, Human; identical to SEQ ID NO: 223370

SEQ ID NO: 522206 - RNA, 64 nt, Human; identical to SEQ ID NO: 223371

SEQ ID NO: 522207 - RNA, 64 nt, Human; identical to SEQ ID NO: 223372

SEQ ID NO: 522208 - RNA, 64 nt, Human; identical to SEQ ID NO: 223373

SEQ ID NO: 522209 - RNA, 64 nt, Human; identical to SEQ ID NO: 223374

SEQ ID NO: 522210 - RNA, 64 nt, Human; identical to SEQ ID NO: 223375

SEQ ID NO: 522211 - RNA, 53 nt, Human; identical to SEQ ID NO: 223376

SEQ ID NO: 522212 - RNA, 64 nt, Human; identical to SEQ ID NO: 223377

SEQ ID NO: 522213 - RNA, 64 nt, Human; identical to SEQ ID NO: 223378

SEQ ID NO: 522214 - RNA, 64 nt, Human; identical to SEQ ID NO: 223379

SEQ ID NO: 522215 - RNA, 64 nt, Human; identical to SEQ ID NO: 223380

SEQ ID NO: 522216 - RNA, 64 nt, Human
cuccugugguuugcuccagaauuaagguuuguuuuccauccauucucccuuuugacacaguugu

SEQ ID NO: 522217 - RNA, 64 nt, Human
ugaucucaaacuaugacagaaaaguaauguaaaauccauccaaucuauuauuucucuaauuaug

SEQ ID NO: 522218 - RNA, 64 nt, Human
uuuuuaaccaaacuuuguagcauggaaaaaauuuuccauccacaaauacaaacaugaauaaaua

SEQ ID NO: 522219 - RNA, 64 nt, Human; identical to SEQ ID NO: 223381

SEQ ID NO: 522220 - RNA, 64 nt, Human; identical to SEQ ID NO: 223382

SEQ ID NO: 522221 - RNA, 64 nt, Human; identical to SEQ ID NO: 223383

SEQ ID NO: 522222 - RNA, 61 nt, Human; identical to SEQ ID NO: 223384

SEQ ID NO: 522223 - RNA, 64 nt, Human; identical to SEQ ID NO: 223385

SEQ ID NO: 522224 - RNA, 64 nt, Human; identical to SEQ ID NO: 223386

SEQ ID NO: 522225 - RNA, 64 nt, Human; identical to SEQ ID NO: 223387

SEQ ID NO: 522226 - RNA, 64 nt, Human; identical to SEQ ID NO: 223388

SEQ ID NO: 522227 - RNA, 64 nt, Human; identical to SEQ ID NO: 223389

SEQ ID NO: 522228 - RNA, 64 nt, Human; identical to SEQ ID NO: 223390

SEQ ID NO: 522229 - RNA, 64 nt, Human; identical to SEQ ID NO: 223391

SEQ ID NO: 522230 - RNA, 64 nt, Human; identical to SEQ ID NO: 223392

SEQ ID NO: 522231 - RNA, 64 nt, Human; identical to SEQ ID NO: 223393

SEQ ID NO: 522232 - RNA, 64 nt, Human; identical to SEQ ID NO: 223394

SEQ ID NO: 522233 - RNA, 64 nt, Human; identical to SEQ ID NO: 223395

SEQ ID NO: 522234 - RNA, 64 nt, Human
ugaagcagcgcugcaugucacuagguaacacagauccauccagaugguguuuacauuugauuua

SEQ ID NO: 522235 - RNA, 64 nt, Human
ucuggagauuucuguuuuuuaagcacauucuccuuccauccacauauuuacauccuuguaaugg

SEQ ID NO: 522236 - RNA, 64 nt, Human; identical to SEQ ID NO: 519708

SEQ ID NO: 522237 - RNA, 64 nt, Human; identical to SEQ ID NO: 223396

SEQ ID NO: 522238 - RNA, 64 nt, Human; identical to SEQ ID NO: 223397

SEQ ID NO: 522239 - RNA, 64 nt, Human; identical to SEQ ID NO: 223398

SEQ ID NO: 522240 - RNA, 64 nt, Human; identical to SEQ ID NO: 223399

SEQ ID NO: 522241 - RNA, 64 nt, Human; identical to SEQ ID NO: 223400

SEQ ID NO: 522242 - RNA, 64 nt, Human; identical to SEQ ID NO: 223401

SEQ ID NO: 522243 - RNA, 64 nt, Human; identical to SEQ ID NO: 223402

SEQ ID NO: 522244 - RNA, 64 nt, Human; identical to SEQ ID NO: 223403

SEQ ID NO: 522245 - RNA, 64 nt, Human; identical to SEQ ID NO: 223404

SEQ ID NO: 522246 - RNA, 64 nt, Human; identical to SEQ ID NO: 223405

SEQ ID NO: 522247 - RNA, 64 nt, Human; identical to SEQ ID NO: 223406

SEQ ID NO: 522248 - RNA, 64 nt, Human; identical to SEQ ID NO: 223407

SEQ ID NO: 522249 - RNA, 64 nt, Human; identical to SEQ ID NO: 223408

SEQ ID NO: 522250 - RNA, 64 nt, Human; identical to SEQ ID NO: 223409

SEQ ID NO: 522251 - RNA, 64 nt, Human; identical to SEQ ID NO: 223410

SEQ ID NO: 522252 - RNA, 64 nt, Human
aaaauuauguguugaaauaaguggaaaagugcaauccauccacccuuaugauuaacguagauga

SEQ ID NO: 522253 - RNA, 64 nt, Human
aauguugauggcgccguguagaagccgcucuguauccauccacgcgugcagagcugccagcagg

SEQ ID NO: 522254 - RNA, 64 nt, Human
uggugagaagccaauucccacuugacagaaggcguccauccauucaucucauuggccaaggaca

SEQ ID NO: 522255 - RNA, 64 nt, Human; identical to SEQ ID NO: 223411

SEQ ID NO: 522256 - RNA, 64 nt, Human; identical to SEQ ID NO: 223412

SEQ ID NO: 522257 - RNA, 50 nt, Human; identical to SEQ ID NO: 223413

SEQ ID NO: 522258 - RNA, 64 nt, Human; identical to SEQ ID NO: 223414

SEQ ID NO: 522259 - RNA, 64 nt, Human; identical to SEQ ID NO: 223415

SEQ ID NO: 522260 - RNA, 64 nt, Human; identical to SEQ ID NO: 223416

SEQ ID NO: 522261 - RNA, 64 nt, Human; identical to SEQ ID NO: 223417

SEQ ID NO: 522262 - RNA, 64 nt, Human; identical to SEQ ID NO: 223418

SEQ ID NO: 522263 - RNA, 64 nt, Human; identical to SEQ ID NO: 223419

SEQ ID NO: 522264 - RNA, 64 nt, Human; identical to SEQ ID NO: 223420

SEQ ID NO: 522265 - RNA, 64 nt, Human; identical to SEQ ID NO: 223421

SEQ ID NO: 522266 - RNA, 64 nt, Human; identical to SEQ ID NO: 223422

SEQ ID NO: 522267 - RNA, 64 nt, Human; identical to SEQ ID NO: 223423

SEQ ID NO: 522268 - RNA, 64 nt, Human; identical to SEQ ID NO: 223424

SEQ ID NO: 522269 - RNA, 64 nt, Human; identical to SEQ ID NO: 223425

SEQ ID NO: 522270 - RNA, 64 nt, Human
uuuuuaggacuugugaggaacacagcaacggaaauccauccacaaaggaugcagugccccaacu

SEQ ID NO: 522271 - RNA, 64 nt, Human
gaauagacucacauuagguuuaguuugugaaaacuccauccagcuaagcgaucuugaacaaguc

SEQ ID NO: 522272 - RNA, 64 nt, Human
gccaugccgggcuguguuugcagcuguccgagucuccauccaccuuuagaaaaccagccacuuc

SEQ ID NO: 522273 - RNA, 64 nt, Human; identical to SEQ ID NO: 223426

SEQ ID NO: 522274 - RNA, 64 nt, Human; identical to SEQ ID NO: 223427

SEQ ID NO: 522275 - RNA, 64 nt, Human; identical to SEQ ID NO: 223428

SEQ ID NO: 522276 - RNA, 64 nt, Human; identical to SEQ ID NO: 223429

SEQ ID NO: 522277 - RNA, 64 nt, Human; identical to SEQ ID NO: 223430

SEQ ID NO: 522278 - RNA, 64 nt, Human; identical to SEQ ID NO: 223431

SEQ ID NO: 522279 - RNA, 64 nt, Human; identical to SEQ ID NO: 223432

SEQ ID NO: 522280 - RNA, 64 nt, Human; identical to SEQ ID NO: 223433

SEQ ID NO: 522281 - RNA, 64 nt, Human; identical to SEQ ID NO: 223434

SEQ ID NO: 522282 - RNA, 64 nt, Human; identical to SEQ ID NO: 223435

SEQ ID NO: 522283 - RNA, 64 nt, Human; identical to SEQ ID NO: 223436

SEQ ID NO: 522284 - RNA, 64 nt, Human; identical to SEQ ID NO: 223437

SEQ ID NO: 522285 - RNA, 64 nt, Human; identical to SEQ ID NO: 223438

SEQ ID NO: 522286 - RNA, 64 nt, Human; identical to SEQ ID NO: 223439

SEQ ID NO: 522287 - RNA, 64 nt, Human; identical to SEQ ID NO: 223440

SEQ ID NO: 522288 - RNA, 64 nt, Human; identical to SEQ ID NO: 519709

SEQ ID NO: 522289 - RNA, 64 nt, Human
uccacuugcaacacccgccucacugugccaacacuccauccacacaggaaaggacugagaacgu

SEQ ID NO: 522290 - RNA, 64 nt, Human
ccuggggcuuuuucuuuaucacccucagucuuaauccauccaccagagucuagaaggccagacg

SEQ ID NO: 522291 - RNA, 64 nt, Human; identical to SEQ ID NO: 223441

SEQ ID NO: 522292 - RNA, 64 nt, Human; identical to SEQ ID NO: 223442

SEQ ID NO: 522293 - RNA, 64 nt, Human; identical to SEQ ID NO: 223443

SEQ ID NO: 522294 - RNA, 64 nt, Human; identical to SEQ ID NO: 223444

SEQ ID NO: 522295 - RNA, 64 nt, Human; identical to SEQ ID NO: 223445

SEQ ID NO: 522296 - RNA, 64 nt, Human; identical to SEQ ID NO: 223446

SEQ ID NO: 522297 - RNA, 64 nt, Human; identical to SEQ ID NO: 223447

SEQ ID NO: 522298 - RNA, 64 nt, Human; identical to SEQ ID NO: 223448

SEQ ID NO: 522299 - RNA, 64 nt, Human; identical to SEQ ID NO: 223449

SEQ ID NO: 522300 - RNA, 64 nt, Human; identical to SEQ ID NO: 223450

SEQ ID NO: 522301 - RNA, 64 nt, Human; identical to SEQ ID NO: 223451

SEQ ID NO: 522302 - RNA, 64 nt, Human; identical to SEQ ID NO: 223452

SEQ ID NO: 522303 - RNA, 64 nt, Human; identical to SEQ ID NO: 223453

SEQ ID NO: 522304 - RNA, 64 nt, Human; identical to SEQ ID NO: 223454

SEQ ID NO: 522305 - RNA, 64 nt, Human; identical to SEQ ID NO: 223455

SEQ ID NO: 522306 - RNA, 55 nt, Human
uccuggcggcccagaaguagagccauccauccaugccauaccacuugucagggca

SEQ ID NO: 522307 - RNA, 64 nt, Human
aaacaaacaagaggugaccaccuuauugugagguuccauccagccaaguuuauguggccuauug

SEQ ID NO: 522308 - RNA, 64 nt, Human
ucuuguuccccuggccccccacucucccuccauguccauccaaaaaccauaaaaucacuggguu

SEQ ID NO: 522309 - RNA, 64 nt, Human; identical to SEQ ID NO: 223456

SEQ ID NO: 522310 - RNA, 64 nt, Human; identical to SEQ ID NO: 223457

SEQ ID NO: 522311 - RNA, 64 nt, Human; identical to SEQ ID NO: 223458

SEQ ID NO: 522312 - RNA, 64 nt, Human; identical to SEQ ID NO: 223459

SEQ ID NO: 522313 - RNA, 64 nt, Human; identical to SEQ ID NO: 223460

SEQ ID NO: 522314 - RNA, 64 nt, Human; identical to SEQ ID NO: 223461

SEQ ID NO: 522315 - RNA, 59 nt, Human; identical to SEQ ID NO: 223462

SEQ ID NO: 522316 - RNA, 64 nt, Human; identical to SEQ ID NO: 223463

SEQ ID NO: 522317 - RNA, 64 nt, Human; identical to SEQ ID NO: 223464

SEQ ID NO: 522318 - RNA, 64 nt, Human; identical to SEQ ID NO: 223465

SEQ ID NO: 522319 - RNA, 64 nt, Human; identical to SEQ ID NO: 223466

SEQ ID NO: 522320 - RNA, 64 nt, Human; identical to SEQ ID NO: 223467

SEQ ID NO: 522321 - RNA, 64 nt, Human; identical to SEQ ID NO: 223468

SEQ ID NO: 522322 - RNA, 64 nt, Human; identical to SEQ ID NO: 223469

SEQ ID NO: 522323 - RNA, 64 nt, Human; identical to SEQ ID NO: 223470

SEQ ID NO: 522324 - RNA, 64 nt, Human; identical to SEQ ID NO: 255948

SEQ ID NO: 522325 - RNA, 64 nt, Human; identical to SEQ ID NO: 255949

SEQ ID NO: 522326 - RNA, 64 nt, Human; identical to SEQ ID NO: 255950

SEQ ID NO: 522327 - RNA, 64 nt, Human; identical to SEQ ID NO: 223471

SEQ ID NO: 522328 - RNA, 64 nt, Human; identical to SEQ ID NO: 223472

SEQ ID NO: 522329 - RNA, 64 nt, Human; identical to SEQ ID NO: 223473

SEQ ID NO: 522330 - RNA, 64 nt, Human; identical to SEQ ID NO: 223474

SEQ ID NO: 522331 - RNA, 64 nt, Human; identical to SEQ ID NO: 223475

SEQ ID NO: 522332 - RNA, 64 nt, Human; identical to SEQ ID NO: 223476

SEQ ID NO: 522333 - RNA, 64 nt, Human; identical to SEQ ID NO: 223477

SEQ ID NO: 522334 - RNA, 64 nt, Human; identical to SEQ ID NO: 223478

SEQ ID NO: 522335 - RNA, 64 nt, Human; identical to SEQ ID NO: 223479

SEQ ID NO: 522336 - RNA, 64 nt, Human; identical to SEQ ID NO: 223480

SEQ ID NO: 522337 - RNA, 64 nt, Human; identical to SEQ ID NO: 223481

SEQ ID NO: 522338 - RNA, 64 nt, Human; identical to SEQ ID NO: 223482

SEQ ID NO: 522339 - RNA, 64 nt, Human; identical to SEQ ID NO: 223483

SEQ ID NO: 522340 - RNA, 64 nt, Human; identical to SEQ ID NO: 223484

SEQ ID NO: 522341 - RNA, 64 nt, Human; identical to SEQ ID NO: 223485

SEQ ID NO: 522342 - RNA, 64 nt, Human
cuaaaaauacaaaaauuagccgggcaugguggcaggcgccuauaaucccagcuacuggggaggc

SEQ ID NO: 522343 - RNA, 64 nt, Human
uagaagaagcuuugccgcuuuugugccucucacaggcgccuaaagucauugccaugggaggaag

SEQ ID NO: 522344 - RNA, 64 nt, Human
acaaaaauacaaaaauuagcugggugugguggcgggcgccuauaauccuagcuacuagggaggc

SEQ ID NO: 522345 - RNA, 64 nt, Human; identical to SEQ ID NO: 223486

SEQ ID NO: 522346 - RNA, 64 nt, Human; identical to SEQ ID NO: 223487

SEQ ID NO: 522347 - RNA, 64 nt, Human; identical to SEQ ID NO: 223488

SEQ ID NO: 522348 - RNA, 64 nt, Human; identical to SEQ ID NO: 223489

SEQ ID NO: 522349 - RNA, 64 nt, Human; identical to SEQ ID NO: 223490

SEQ ID NO: 522350 - RNA, 64 nt, Human; identical to SEQ ID NO: 223491

SEQ ID NO: 522351 - RNA, 64 nt, Human; identical to SEQ ID NO: 223492

SEQ ID NO: 522352 - RNA, 64 nt, Human; identical to SEQ ID NO: 223493

SEQ ID NO: 522353 - RNA, 64 nt, Human; identical to SEQ ID NO: 223494

SEQ ID NO: 522354 - RNA, 64 nt, Human; identical to SEQ ID NO: 223495

SEQ ID NO: 522355 - RNA, 64 nt, Human; identical to SEQ ID NO: 223496

SEQ ID NO: 522356 - RNA, 64 nt, Human; identical to SEQ ID NO: 223497

SEQ ID NO: 522357 - RNA, 64 nt, Human; identical to SEQ ID NO: 223498

SEQ ID NO: 522358 - RNA, 64 nt, Human; identical to SEQ ID NO: 223499

SEQ ID NO: 522359 - RNA, 64 nt, Human; identical to SEQ ID NO: 223500

SEQ ID NO: 522360 - RNA, 61 nt, Human
agcuagcuggccagguggggaggggcuggggaccggccaggaaggaggggugacuucaucc

SEQ ID NO: 522361 - RNA, 61 nt, Human
aaguguugggauuauaggagugagccaccacaccggccaagaugcuuuucaaacugauaca

SEQ ID NO: 522362 - RNA, 61 nt, Human
uaguuuccccaggacuggccuaggaaggagcaccggccacagcugcuccccgugccacuca

SEQ ID NO: 522363 - RNA, 64 nt, Human; identical to SEQ ID NO: 223501

SEQ ID NO: 522364 - RNA, 64 nt, Human; identical to SEQ ID NO: 223502

SEQ ID NO: 522365 - RNA, 64 nt, Human; identical to SEQ ID NO: 223503

SEQ ID NO: 522366 - RNA, 64 nt, Human; identical to SEQ ID NO: 223504

SEQ ID NO: 522367 - RNA, 64 nt, Human; identical to SEQ ID NO: 223505

SEQ ID NO: 522368 - RNA, 64 nt, Human; identical to SEQ ID NO: 223506

SEQ ID NO: 522369 - RNA, 64 nt, Human; identical to SEQ ID NO: 223507

SEQ ID NO: 522370 - RNA, 64 nt, Human; identical to SEQ ID NO: 223508

SEQ ID NO: 522371 - RNA, 64 nt, Human; identical to SEQ ID NO: 223509

SEQ ID NO: 522372 - RNA, 64 nt, Human; identical to SEQ ID NO: 223510

SEQ ID NO: 522373 - RNA, 64 nt, Human; identical to SEQ ID NO: 223511

SEQ ID NO: 522374 - RNA, 64 nt, Human; identical to SEQ ID NO: 223512

SEQ ID NO: 522375 - RNA, 64 nt, Human; identical to SEQ ID NO: 223513

SEQ ID NO: 522376 - RNA, 64 nt, Human; identical to SEQ ID NO: 223514

SEQ ID NO: 522377 - RNA, 64 nt, Human; identical to SEQ ID NO: 223515

SEQ ID NO: 522378 - RNA, 64 nt, Human; identical to SEQ ID NO: 255951

SEQ ID NO: 522379 - RNA, 64 nt, Human; identical to SEQ ID NO: 255952

SEQ ID NO: 522380 - RNA, 64 nt, Human; identical to SEQ ID NO: 255953

SEQ ID NO: 522381 - RNA, 64 nt, Human; identical to SEQ ID NO: 223516

SEQ ID NO: 522382 - RNA, 64 nt, Human; identical to SEQ ID NO: 223517

SEQ ID NO: 522383 - RNA, 64 nt, Human; identical to SEQ ID NO: 223518

SEQ ID NO: 522384 - RNA, 64 nt, Human; identical to SEQ ID NO: 223519

SEQ ID NO: 522385 - RNA, 64 nt, Human; identical to SEQ ID NO: 223520

SEQ ID NO: 522386 - RNA, 64 nt, Human; identical to SEQ ID NO: 223521

SEQ ID NO: 522387 - RNA, 64 nt, Human; identical to SEQ ID NO: 223522

SEQ ID NO: 522388 - RNA, 64 nt, Human; identical to SEQ ID NO: 223523

SEQ ID NO: 522389 - RNA, 64 nt, Human; identical to SEQ ID NO: 223524

SEQ ID NO: 522390 - RNA, 64 nt, Human; identical to SEQ ID NO: 223525

SEQ ID NO: 522391 - RNA, 64 nt, Human; identical to SEQ ID NO: 223526

SEQ ID NO: 522392 - RNA, 64 nt, Human; identical to SEQ ID NO: 223527

SEQ ID NO: 522393 - RNA, 64 nt, Human; identical to SEQ ID NO: 223528

SEQ ID NO: 522394 - RNA, 64 nt, Human; identical to SEQ ID NO: 223529

SEQ ID NO: 522395 - RNA, 64 nt, Human; identical to SEQ ID NO: 223530

SEQ ID NO: 522396 - RNA, 64 nt, Human; identical to SEQ ID NO: 255954

SEQ ID NO: 522397 - RNA, 64 nt, Human; identical to SEQ ID NO: 255955

SEQ ID NO: 522398 - RNA, 64 nt, Human; identical to SEQ ID NO: 255956

SEQ ID NO: 522399 - RNA, 64 nt, Human; identical to SEQ ID NO: 223531

SEQ ID NO: 522400 - RNA, 64 nt, Human; identical to SEQ ID NO: 223532

SEQ ID NO: 522401 - RNA, 64 nt, Human; identical to SEQ ID NO: 223533

SEQ ID NO: 522402 - RNA, 64 nt, Human; identical to SEQ ID NO: 223534

SEQ ID NO: 522403 - RNA, 64 nt, Human; identical to SEQ ID NO: 223535

SEQ ID NO: 522404 - RNA, 52 nt, Human; identical to SEQ ID NO: 223536

SEQ ID NO: 522405 - RNA, 64 nt, Human; identical to SEQ ID NO: 223537

SEQ ID NO: 522406 - RNA, 64 nt, Human; identical to SEQ ID NO: 223538

SEQ ID NO: 522407 - RNA, 64 nt, Human; identical to SEQ ID NO: 223539

SEQ ID NO: 522408 - RNA, 64 nt, Human; identical to SEQ ID NO: 223540

SEQ ID NO: 522409 - RNA, 64 nt, Human; identical to SEQ ID NO: 223541

SEQ ID NO: 522410 - RNA, 64 nt, Human; identical to SEQ ID NO: 223542

SEQ ID NO: 522411 - RNA, 64 nt, Human; identical to SEQ ID NO: 223543

SEQ ID NO: 522412 - RNA, 64 nt, Human; identical to SEQ ID NO: 223544

SEQ ID NO: 522413 - RNA, 64 nt, Human; identical to SEQ ID NO: 223545

SEQ ID NO: 522414 - RNA, 64 nt, Human; identical to SEQ ID NO: 522001

SEQ ID NO: 522415 - RNA, 64 nt, Human; identical to SEQ ID NO: 519634

SEQ ID NO: 522416 - RNA, 64 nt, Human
gaaccggcagcagcuaggcagucaccggcccgccuccauccaaaaucacgcucgcgugcuucgg

SEQ ID NO: 522417 - RNA, 64 nt, Human; identical to SEQ ID NO: 223546

SEQ ID NO: 522418 - RNA, 64 nt, Human; identical to SEQ ID NO: 223547

SEQ ID NO: 522419 - RNA, 64 nt, Human; identical to SEQ ID NO: 223548

SEQ ID NO: 522420 - RNA, 64 nt, Human; identical to SEQ ID NO: 223549

SEQ ID NO: 522421 - RNA, 64 nt, Human; identical to SEQ ID NO: 223550

SEQ ID NO: 522422 - RNA, 64 nt, Human; identical to SEQ ID NO: 223551

SEQ ID NO: 522423 - RNA, 64 nt, Human; identical to SEQ ID NO: 223552

SEQ ID NO: 522424 - RNA, 64 nt, Human; identical to SEQ ID NO: 223553

SEQ ID NO: 522425 - RNA, 64 nt, Human; identical to SEQ ID NO: 223554

SEQ ID NO: 522426 - RNA, 64 nt, Human; identical to SEQ ID NO: 223555

SEQ ID NO: 522427 - RNA, 64 nt, Human; identical to SEQ ID NO: 223556

SEQ ID NO: 522428 - RNA, 64 nt, Human; identical to SEQ ID NO: 223557

SEQ ID NO: 522429 - RNA, 64 nt, Human; identical to SEQ ID NO: 223558

SEQ ID NO: 522430 - RNA, 64 nt, Human; identical to SEQ ID NO: 223559

SEQ ID NO: 522431 - RNA, 64 nt, Human; identical to SEQ ID NO: 223560

SEQ ID NO: 522432 - RNA, 64 nt, Human
caccacugagucaucugcugucucuucagucugcuccauccaucacccauuuacccaucucuca

SEQ ID NO: 522433 - RNA, 64 nt, Human
aggcgaucugcauacuuuaaggaccagaucaugcuccauccagccccacccaauggccuuuugu

SEQ ID NO: 522434 - RNA, 64 nt, Human
aacgucgggggcaaagcauacacacacacuccaauccauccaugcauacauagacacaagacac

SEQ ID NO: 522435 - RNA, 64 nt, Human; identical to SEQ ID NO: 223561

SEQ ID NO: 522436 - RNA, 64 nt, Human; identical to SEQ ID NO: 223562

SEQ ID NO: 522437 - RNA, 64 nt, Human; identical to SEQ ID NO: 223563

SEQ ID NO: 522438 - RNA, 64 nt, Human; identical to SEQ ID NO: 223564

SEQ ID NO: 522439 - RNA, 64 nt, Human; identical to SEQ ID NO: 223565

SEQ ID NO: 522440 - RNA, 64 nt, Human; identical to SEQ ID NO: 223566

SEQ ID NO: 522441 - RNA, 64 nt, Human; identical to SEQ ID NO: 223567

SEQ ID NO: 522442 - RNA, 64 nt, Human; identical to SEQ ID NO: 223568

SEQ ID NO: 522443 - RNA, 64 nt, Human; identical to SEQ ID NO: 223569

SEQ ID NO: 522444 - RNA, 64 nt, Human; identical to SEQ ID NO: 223570

SEQ ID NO: 522445 - RNA, 64 nt, Human; identical to SEQ ID NO: 223571

SEQ ID NO: 522446 - RNA, 64 nt, Human; identical to SEQ ID NO: 223572

SEQ ID NO: 522447 - RNA, 64 nt, Human; identical to SEQ ID NO: 223573

SEQ ID NO: 522448 - RNA, 64 nt, Human; identical to SEQ ID NO: 223574

SEQ ID NO: 522449 - RNA, 64 nt, Human; identical to SEQ ID NO: 223575

SEQ ID NO: 522450 - RNA, 64 nt, Human
ucgugagccccaucuucacccaggccuauguugauccauccagcuugccagaugcugcagaguc

SEQ ID NO: 522451 - RNA, 64 nt, Human; identical to SEQ ID NO: 519635

SEQ ID NO: 522452 - RNA, 64 nt, Human
ugucaccuccauccagauucuuuuaaauuauugauccauccauaguauauauugcuacucauuc

SEQ ID NO: 522453 - RNA, 64 nt, Human; identical to SEQ ID NO: 223576

SEQ ID NO: 522454 - RNA, 64 nt, Human; identical to SEQ ID NO: 223577

SEQ ID NO: 522455 - RNA, 64 nt, Human; identical to SEQ ID NO: 223578

SEQ ID NO: 522456 - RNA, 64 nt, Human; identical to SEQ ID NO: 223579

SEQ ID NO: 522457 - RNA, 64 nt, Human; identical to SEQ ID NO: 223580

SEQ ID NO: 522458 - RNA, 64 nt, Human; identical to SEQ ID NO: 223581

SEQ ID NO: 522459 - RNA, 64 nt, Human; identical to SEQ ID NO: 223582

SEQ ID NO: 522460 - RNA, 64 nt, Human; identical to SEQ ID NO: 223583

SEQ ID NO: 522461 - RNA, 64 nt, Human; identical to SEQ ID NO: 223584

SEQ ID NO: 522462 - RNA, 64 nt, Human; identical to SEQ ID NO: 223585

SEQ ID NO: 522463 - RNA, 64 nt, Human; identical to SEQ ID NO: 223586

SEQ ID NO: 522464 - RNA, 64 nt, Human; identical to SEQ ID NO: 223587

SEQ ID NO: 522465 - RNA, 64 nt, Human; identical to SEQ ID NO: 223588

SEQ ID NO: 522466 - RNA, 64 nt, Human; identical to SEQ ID NO: 223589

SEQ ID NO: 522467 - RNA, 64 nt, Human; identical to SEQ ID NO: 223590

SEQ ID NO: 522468 - RNA, 64 nt, Human
uauauauucauaaaaaauauggugcucauucucauccauccaggauguacuaaaacaguguguu

SEQ ID NO: 522469 - RNA, 64 nt, Human
aucacuucaaccccugccuuguacauaauacuauuccauccacacaguuuccacccucaccugc

SEQ ID NO: 522470 - RNA, 64 nt, Human
acuggaaucucugugccaacccaggauacaaacuuccauccagaugcauggauacaaauuucca

SEQ ID NO: 522471 - RNA, 64 nt, Human; identical to SEQ ID NO: 223591

SEQ ID NO: 522472 - RNA, 64 nt, Human; identical to SEQ ID NO: 223592

SEQ ID NO: 522473 - RNA, 64 nt, Human; identical to SEQ ID NO: 223593

SEQ ID NO: 522474 - RNA, 64 nt, Human; identical to SEQ ID NO: 223594

SEQ ID NO: 522475 - RNA, 64 nt, Human; identical to SEQ ID NO: 223595

SEQ ID NO: 522476 - RNA, 64 nt, Human; identical to SEQ ID NO: 223596

SEQ ID NO: 522477 - RNA, 64 nt, Human; identical to SEQ ID NO: 223597

SEQ ID NO: 522478 - RNA, 64 nt, Human; identical to SEQ ID NO: 223598

SEQ ID NO: 522479 - RNA, 64 nt, Human; identical to SEQ ID NO: 223599

SEQ ID NO: 522480 - RNA, 64 nt, Human; identical to SEQ ID NO: 223600

SEQ ID NO: 522481 - RNA, 64 nt, Human; identical to SEQ ID NO: 223601

SEQ ID NO: 522482 - RNA, 64 nt, Human; identical to SEQ ID NO: 223602

SEQ ID NO: 522483 - RNA, 64 nt, Human; identical to SEQ ID NO: 223603

SEQ ID NO: 522484 - RNA, 64 nt, Human; identical to SEQ ID NO: 223604

SEQ ID NO: 522485 - RNA, 64 nt, Human; identical to SEQ ID NO: 223605

SEQ ID NO: 522486 - RNA, 64 nt, Human
gucuuuuuauucaugucgguggcaguguggaaauuccauccagaaaauuacaacuccacuugau

SEQ ID NO: 522487 - RNA, 64 nt, Human; identical to SEQ ID NO: 519636

SEQ ID NO: 522488 - RNA, 64 nt, Human
gagacuaccauugcggcugcaucgccuucuccccuccauccagccuggcguccagguugcccug

SEQ ID NO: 522489 - RNA, 64 nt, Human; identical to SEQ ID NO: 223606

SEQ ID NO: 522490 - RNA, 64 nt, Human; identical to SEQ ID NO: 223607

SEQ ID NO: 522491 - RNA, 64 nt, Human; identical to SEQ ID NO: 223608

SEQ ID NO: 522492 - RNA, 64 nt, Human; identical to SEQ ID NO: 223609

SEQ ID NO: 522493 - RNA, 64 nt, Human; identical to SEQ ID NO: 223610

SEQ ID NO: 522494 - RNA, 64 nt, Human; identical to SEQ ID NO: 223611

SEQ ID NO: 522495 - RNA, 64 nt, Human; identical to SEQ ID NO: 223612

SEQ ID NO: 522496 - RNA, 64 nt, Human; identical to SEQ ID NO: 223613

SEQ ID NO: 522497 - RNA, 64 nt, Human; identical to SEQ ID NO: 223614

SEQ ID NO: 522498 - RNA, 64 nt, Human; identical to SEQ ID NO: 223615

SEQ ID NO: 522499 - RNA, 56 nt, Human; identical to SEQ ID NO: 223616

SEQ ID NO: 522500 - RNA, 64 nt, Human; identical to SEQ ID NO: 223617

SEQ ID NO: 522501 - RNA, 64 nt, Human; identical to SEQ ID NO: 223618

SEQ ID NO: 522502 - RNA, 64 nt, Human; identical to SEQ ID NO: 223619

SEQ ID NO: 522503 - RNA, 64 nt, Human; identical to SEQ ID NO: 223620

SEQ ID NO: 522504 - RNA, 64 nt, Human
uauuguuauuuucucucaucuuuuucaagucuuuuccauccacaguugguugaauuuguggaug

SEQ ID NO: 522505 - RNA, 64 nt, Human
ugucuccccggcccaggucccucccgccuccagguccauccaucccguccggaaaagaaggacc

SEQ ID NO: 522506 - RNA, 64 nt, Human
augaaugccagggacagugugcucaguaaagucuuccauccaaaaggggcagggcacgguggcu

SEQ ID NO: 522507 - RNA, 64 nt, Human; identical to SEQ ID NO: 223621

SEQ ID NO: 522508 - RNA, 64 nt, Human; identical to SEQ ID NO: 223622

SEQ ID NO: 522509 - RNA, 64 nt, Human; identical to SEQ ID NO: 223623

SEQ ID NO: 522510 - RNA, 64 nt, Human; identical to SEQ ID NO: 223624

SEQ ID NO: 522511 - RNA, 64 nt, Human; identical to SEQ ID NO: 223625

SEQ ID NO: 522512 - RNA, 64 nt, Human; identical to SEQ ID NO: 223626

SEQ ID NO: 522513 - RNA, 56 nt, Human; identical to SEQ ID NO: 223627

SEQ ID NO: 522514 - RNA, 64 nt, Human; identical to SEQ ID NO: 223628

SEQ ID NO: 522515 - RNA, 64 nt, Human; identical to SEQ ID NO: 223629

SEQ ID NO: 522516 - RNA, 64 nt, Human; identical to SEQ ID NO: 223630

SEQ ID NO: 522517 - RNA, 64 nt, Human; identical to SEQ ID NO: 223631

SEQ ID NO: 522518 - RNA, 64 nt, Human; identical to SEQ ID NO: 223632

SEQ ID NO: 522519 - RNA, 64 nt, Human; identical to SEQ ID NO: 223633

SEQ ID NO: 522520 - RNA, 64 nt, Human; identical to SEQ ID NO: 223634

SEQ ID NO: 522521 - RNA, 64 nt, Human; identical to SEQ ID NO: 223635

SEQ ID NO: 522522 - RNA, 64 nt, Human
cauuugggucuuaacuuauuggaacuguagagcauccauccauccauccauccagcaaugugac

SEQ ID NO: 522523 - RNA, 64 nt, Human; identical to SEQ ID NO: 519670

SEQ ID NO: 522524 - RNA, 64 nt, Human
ucuuaacuuauuggaacuguagagcauccauccauccauccauccagcaaugugacuuuuucau

SEQ ID NO: 522525 - RNA, 64 nt, Human; identical to SEQ ID NO: 223636

SEQ ID NO: 522526 - RNA, 64 nt, Human; identical to SEQ ID NO: 223637

SEQ ID NO: 522527 - RNA, 64 nt, Human; identical to SEQ ID NO: 223638

SEQ ID NO: 522528 - RNA, 64 nt, Human; identical to SEQ ID NO: 223639

SEQ ID NO: 522529 - RNA, 64 nt, Human; identical to SEQ ID NO: 223640

SEQ ID NO: 522530 - RNA, 64 nt, Human; identical to SEQ ID NO: 223641

SEQ ID NO: 522531 - RNA, 64 nt, Human; identical to SEQ ID NO: 223642

SEQ ID NO: 522532 - RNA, 64 nt, Human; identical to SEQ ID NO: 223643

SEQ ID NO: 522533 - RNA, 64 nt, Human; identical to SEQ ID NO: 223644

SEQ ID NO: 522534 - RNA, 64 nt, Human; identical to SEQ ID NO: 223645

SEQ ID NO: 522535 - RNA, 64 nt, Human; identical to SEQ ID NO: 223646

SEQ ID NO: 522536 - RNA, 64 nt, Human; identical to SEQ ID NO: 223647

SEQ ID NO: 522537 - RNA, 64 nt, Human; identical to SEQ ID NO: 223648

SEQ ID NO: 522538 - RNA, 64 nt, Human; identical to SEQ ID NO: 223649

SEQ ID NO: 522539 - RNA, 64 nt, Human; identical to SEQ ID NO: 223650

SEQ ID NO: 522540 - RNA, 64 nt, Human
uagggugauauccgucauuacucugucucuucaauccauccagcuaaauggaauaggugaugac

SEQ ID NO: 522541 - RNA, 64 nt, Human
gagguucccaucccucauuggaaucaccacccauuccauccaggacuucucuuacacuuggggg

SEQ ID NO: 522542 - RNA, 64 nt, Human
ucacugcugucgguccccucccugagccagcaucuccauccaccaccccgugccagcucccgug

SEQ ID NO: 522543 - RNA, 61 nt, Human; identical to SEQ ID NO: 223651

SEQ ID NO: 522544 - RNA, 64 nt, Human; identical to SEQ ID NO: 223652

SEQ ID NO: 522545 - RNA, 64 nt, Human
uuucuggugaccugguauuccaucaccauucaccccaggggacagccucgaccgagacaaggag

SEQ ID NO: 522546 - RNA, 64 nt, Human
agcaugauugguagacagaagggugcagaggcgcccaggggaguacauugccccgugcaaagca

SEQ ID NO: 522547 - RNA, 64 nt, Human
aagauacgacaccacugggaggguuguguaggugccaggggaccaucgugguucucuagggcgc

SEQ ID NO: 522548 - RNA, 64 nt, Human
agugccaggagagaccagagccucuggaggcuacccaggggaccacaccaaguccuugccugug

SEQ ID NO: 522549 - RNA, 64 nt, Human
cugaauagccaguggggcacacugacuguccuccccaggggaacugcagcgcccuccuccccac

SEQ ID NO: 522550 - RNA, 64 nt, Human
ggcacugaagcccugguguuccuggucacgucccccaggggacccugcccacuuccuggacuuc

SEQ ID NO: 522551 - RNA, 64 nt, Human
ucuguguugguuucuuagauugcuagcuuuuccuccaggggaccacagcaggugaagcucaaga

SEQ ID NO: 522552 - RNA, 64 nt, Human
caggucucagcuugcgggguggggggagucaugcccaggggaggagacuuuuuaucuggagggg

SEQ ID NO: 522553 - RNA, 64 nt, Human
uuuuaugaaaauuguguaaaauuacauuuuuuuuccaggggagaaaaaaacaucaaacaaaaac

SEQ ID NO: 522554 - RNA, 64 nt, Human
accgaguaggggccacccuugacgggauuccugcccaggggagagaggcgcugggaagauggcu

SEQ ID NO: 522555 - RNA, 64 nt, Human
cagaccaagucccuauaaacaaggaccuuccaguccaggggaaugacugugcaagguaguaucu

SEQ ID NO: 522556 - RNA, 64 nt, Human
guaccuuuaugacagaauuguccuggauuuugacuccauccacgcccaucaccuuucuacauuu

SEQ ID NO: 522557 - RNA, 64 nt, Human; identical to SEQ ID NO: 519671

SEQ ID NO: 522558 - RNA, 64 nt, Human
aggucccaggaaccuugccuucgucaucuguggauccauccagaacagcgguaucugaagccca

SEQ ID NO: 522559 - RNA, 64 nt, Human
cuugagcccaggaguucaagaccagccugagcaaccaggggagaccuuguuucuacaaaagaau

SEQ ID NO: 522560 - RNA, 64 nt, Human
ggggaauucucagcucuugggaacccccuugcucccaggggaggggaaaccuuuuucauucaac

SEQ ID NO: 522561 - RNA, 64 nt, Human
guacaguugaagaagaguguggaggaagcuauuaccaggggagggccagggcucugaggagugg

SEQ ID NO: 522562 - RNA, 64 nt, Human
ggcuggucagagcccugggucaaaaccacucagcccaggggaggggaugaggcauugucacccu

SEQ ID NO: 522563 - RNA, 64 nt, Human
gagcccuagcagugaagaagauuccauuucuuguccaggggauuuaaaagaguuuucugcuuug

SEQ ID NO: 522564 - RNA, 64 nt, Human
ccccguugcuucuggucagcccacuuguagacuuccaggggacacaucuuuauucuguuucagg

SEQ ID NO: 522565 - RNA, 64 nt, Human
ggcuucacggaagagccuugcggaagguucuacgccaggggaaaaucagccugcuccagcuguu

SEQ ID NO: 522566 - RNA, 64 nt, Human
ugggccuuuucccuggggcagcaccuugcccuccccaggggaucacucacuugucuucuaugaa

SEQ ID NO: 522567 - RNA, 64 nt, Human
gcaggcugagcaccucagccuuuagggcuuauggccaggggacacuguaugacucuccucuccu

SEQ ID NO: 522568 - RNA, 64 nt, Human
ugaggacagggcgggaggagggggcacacaugccccaggggagcgaggagaacucuugaaaucu

SEQ ID NO: 522569 - RNA, 64 nt, Human
acugagccuggggcaaacgaggcuucccacacugccaggggagccucacugugaagucuaggcu

SEQ ID NO: 522570 - RNA, 64 nt, Human
cugcucuguuuagacagcggacagacgcucacgcccaggggauguccucacgcugucgccgcgc

SEQ ID NO: 522571 - RNA, 64 nt, Human
acgcgcaucucuuguucuguguucaaucaguaguccaggggagaagcuucugcuacuucagagc

SEQ ID NO: 522572 - RNA, 64 nt, Human
aaagcagccccacaaguaacuggaaaucugaagaccaggggacaaaugcuggugaaugcuuagg

SEQ ID NO: 522573 - RNA, 64 nt, Human
cuccgccuucaccuagcaaugggaacccugcuucccaggggaggaaccaacugcuccaccuucu

SEQ ID NO: 522574 - RNA, 64 nt, Human
cacucaugaaaauaugguauucuguaacuugaauuccauccauuuuccagaccucuacucaugu

SEQ ID NO: 522575 - RNA, 64 nt, Human
cucucauuuauuugggguucgcucuuggaucucauccauccauuguguucucuuuaaugcugcc

SEQ ID NO: 522576 - RNA, 64 nt, Human
guuaauuguccuacaucaaacuuaguuaaauaauuccauccacuuauggaggaggaggagaaug

SEQ ID NO: 522577 - RNA, 64 nt, Human
gugaaacuuaggccagagucagauuugagcugagccaggggaggccuuggcaaccuacuucuac

SEQ ID NO: 522578 - RNA, 64 nt, Human
agcccccuggcacuucuguugcccugagagugucccaggggauucagagucuccagaaagauau

SEQ ID NO: 522579 - RNA, 64 nt, Human
gcagaaucuauauacugaagggcuaguggcacugccaggggaagggagugcguaggcuuccagu

SEQ ID NO: 522580 - RNA, 64 nt, Human
ggugcgcuccucagggcgggugccaccggguuccccaggggaauacauguccccagcucuggga

SEQ ID NO: 522581 - RNA, 64 nt, Human
gggagccagccucccuuugaugauuauuggagccccaggggacaagggauuugaggugaggguu

SEQ ID NO: 522582 - RNA, 64 nt, Human
ucccuggccagggcccuggggaggcagaggguacccaggggacugagggcuuagaaaugacuuu

SEQ ID NO: 522583 - RNA, 64 nt, Human
ugccaggccacagccggaacagccaggccaugacccaggggagccagcgcugccaccccaccca

SEQ ID NO: 522584 - RNA, 64 nt, Human
agguggagagaguggucuccgcucugaauuggauccaggggaccugggcucauucuucuuggcu

SEQ ID NO: 522585 - RNA, 64 nt, Human
uaugucuauccuugcuacuugguugugaguuucuccaggggaggaacuguguuuuauucaucuc

SEQ ID NO: 522586 - RNA, 64 nt, Human
gcguagagccugagacugccauucuaacauguucccaggggaugcugaugcugcuggcccuggg

SEQ ID NO: 522587 - RNA, 64 nt, Human
gcacccagagaauccuuccucagcucucuucuuuccaggggaaggaggugcucaggggugggua

SEQ ID NO: 522588 - RNA, 64 nt, Human
aggaaaucaugagggugacguagaauugagucuuccaggggacucuaucagaacuggaccaucu

SEQ ID NO: 522589 - RNA, 64 nt, Human
agcuuugcucagugauacccacaugggaaaaaucccaggggauguugcuuacucuuuuugccca

SEQ ID NO: 522590 - RNA, 53 nt, Human
aggcccugcccccucgcuaacagccaggggauuucaccacucaaaggccagac

SEQ ID NO: 522591 - RNA, 64 nt, Human
uuagcauacccaguaaggaaaaugagugcaggggccaggggaacccgugaggaucacucucaaa

SEQ ID NO: 522592 - RNA, 64 nt, Human
gagaugauucagaacaaaucaugcuaacuuugaauccauccagccacuugcaaaugauaaucag

SEQ ID NO: 522593 - RNA, 64 nt, Human
ucggcugcuggaauuggaaucaggcuguacucuuuccauccauuugggcuucucuguguuuucc

SEQ ID NO: 522594 - RNA, 64 nt, Human
caaagcccuccuccuccuuaacccugccaguuucuccauccagcucacgccugguggugggccc

SEQ ID NO: 522595 - RNA, 64 nt, Human
ggugcucuccacacauaggaugguaaugccagucccaggggagggugugauaguaaggaaggcc

SEQ ID NO: 522596 - RNA, 64 nt, Human
ggggccugcucccagccacugaggcccgcucuggccaggggagaaggagcugccgugcgucuuc

SEQ ID NO: 522597 - RNA, 64 nt, Human
gcaccccucauccaucucagcaucaacacaauuuccaggggaccucaggucuaccucaggacug

SEQ ID NO: 522598 - RNA, 64 nt, Human
uuuggcuuuggcuuauuauuuagcacugggaggcccaggggaauuggugauuacaguagcacuu

SEQ ID NO: 522599 - RNA, 64 nt, Human
cuacccccuccucucugccgcaauacaggaacccccaggggaaagaugagcuuuucuaggcuac

SEQ ID NO: 522600 - RNA, 64 nt, Human
gcacacucugccaugcugagcuccaagggugcuaccaggggaagaugggaucuauagagucucu

SEQ ID NO: 522601 - RNA, 64 nt, Human
acauuaacauugaugaugacuacgucccgugucuccaggggaucacacgagcuagcuucugcaa

SEQ ID NO: 522602 - RNA, 64 nt, Human
aggacaugcuucaaugccuggugccauaggaagcccaggggacagucacaacuucuuggggccu

SEQ ID NO: 522603 - RNA, 64 nt, Human
uucuuuugaauuucuuacagggcugcaaaguaugccaggggaguauguagcccgggguggucca

SEQ ID NO: 522604 - RNA, 64 nt, Human
agccagagggugggaggggccaugcugugugagaccaggggaccagagggaugggagagucaag

SEQ ID NO: 522605 - RNA, 64 nt, Human
guuacagggugugcaggggcagagaaggaagggaccaggggacugggccaguauguggaggaug

SEQ ID NO: 522606 - RNA, 61 nt, Human
cugaggcugccugugccugagcucccgcugcccaggggagcccuccacgccggcucuuccc

SEQ ID NO: 522607 - RNA, 64 nt, Human
agcuuggggcagcagaggccccugggcagcccagccaggggagccacagccccaaggauggucu

SEQ ID NO: 522608 - RNA, 64 nt, Human
cagugcugugcuccaguaucuaaaaauuuuaucaccaggggaauaaacucaauacacauucauu

SEQ ID NO: 522609 - RNA, 64 nt, Human
uuugaagggauggagaggcaguacgcauccuuacccaggggaggacccgcagauccuguagacu

SEQ ID NO: 522610 - RNA, 64 nt, Human
uucuguaucauuacuucacuuaauggccuccagguccauccauguuguugcaaaagauaagauu

SEQ ID NO: 522611 - RNA, 64 nt, Human; identical to SEQ ID NO: 519689

SEQ ID NO: 522612 - RNA, 64 nt, Human
uauucuauagaaucgaucuaugcccuuguuaaucuccauccauauaggagucacguucuuuaag

SEQ ID NO: 522613 - RNA, 64 nt, Human
uaaguaggauguuguugccuuuaacuuuucuuauccaggggaaaauugccauuuuagggucagc

SEQ ID NO: 522614 - RNA, 64 nt, Human
agaaagaaagacgcugggcccaauuuugacuuggccaggggacaccuugguguguuuguuaucu

SEQ ID NO: 522615 - RNA, 64 nt, Human
ugccucugcccugggccaaaagggccccuccuugccaggggagagacagccacgguccucuuug

SEQ ID NO: 522616 - RNA, 64 nt, Human
ccuggcuguccccagcaccuuccugaaggacgcgccaggggaguuccugcuccgagucuucucu

SEQ ID NO: 522617 - RNA, 64 nt, Human
gccaggucucgggggcuccgggaggugcugccugccaggggaagcuggaaccaguagcaaggag

SEQ ID NO: 522618 - RNA, 64 nt, Human
gacugggcccugcagggucagaaccuccccacccccaggggaggccaggcagaagccuggguca

SEQ ID NO: 522619 - RNA, 64 nt, Human
agcccaaccccaugggcgggggggcccauauggaccaggggaccuugccuugacugaggcacuu

SEQ ID NO: 522620 - RNA, 64 nt, Human
auaucagaugggauaucuccuuccauuccccgguccaggggagagucacuaguuguacccuacu

SEQ ID NO: 522621 - RNA, 64 nt, Human
ggggcaucuggcuaaacaaccugacaaacuguggccaggggaaccgacacaacccucaagcauu

SEQ ID NO: 522622 - RNA, 64 nt, Human
cccucagagugggcacaagugcccucuagggcagccaggggaauacuauuguucgauaccuggg

SEQ ID NO: 522623 - RNA, 64 nt, Human
guuccuguucagguucuggcaggggcccagggauccaggggaccugguuccaaucucagcccug

SEQ ID NO: 522624 - RNA, 64 nt, Human
uaauucccucaacagcagaaccuaccugcagccaccaggggaccagcucuguguagguaaccag

SEQ ID NO: 522625 - RNA, 64 nt, Human
cuccugccagacagcccacgaccgggucgaccccccaggggacgcccaugccaggcccggggac

SEQ ID NO: 522626 - RNA, 64 nt, Human
ugagccuucagucaggguuugucagaggaacaaaccaggggacacuuuguuagaaagugcuuag

SEQ ID NO: 522627 - RNA, 64 nt, Human
gauacuucacuuuuggaaaacuguuaccugagacccaggggagaauuuacuggccauuuuaguu

SEQ ID NO: 522628 - RNA, 64 nt, Human
agaggggacggcuggggucccgagcaacucugccuccauccacgugggaagcggacccuccugc

SEQ ID NO: 522629 - RNA, 64 nt, Human
cggggcuguccauagcggcugggaccccguuucauccauccaugcuuccuagaacacacgaugg

SEQ ID NO: 522630 - RNA, 64 nt, Human
auguggacacagaccacagaugugggcacacgaauccauccaccuguccacgugcacacgugaa

SEQ ID NO: 522631 - RNA, 64 nt, Human
cagucaagacaaaaguaaaaugguuuaccugagcccaggggagggaaaauugauuaagauauca

SEQ ID NO: 522632 - RNA, 64 nt, Human
ccagguucucuuagagccauaugcccucaucaucccaggggagaacuacauugggauaaaugug

SEQ ID NO: 522633 - RNA, 64 nt, Human
cacugcggucuugcccacucucugccuuaggcucccaggggaauccaagacagaaaaugaagac

SEQ ID NO: 522634 - RNA, 64 nt, Human
ccaggccugggaugagggggcgaugucugcuggcccaggggaagggaaaagacaaaugucuuga

SEQ ID NO: 522635 - RNA, 64 nt, Human
caagaaccaggcagcccugccaugucacaauaggccaggggaguuuccaaagauguggguggca

SEQ ID NO: 522636 - RNA, 64 nt, Human
ggugaagcaucugcuggacaagucggaccacuggccaggggaccuuugauugucuuuccagaga

SEQ ID NO: 522637 - RNA, 64 nt, Human
uggagaccaaggcaauaguccuuuccacuacaggccaggggaugggacaagaaguagggaacag

SEQ ID NO: 522638 - RNA, 64 nt, Human
gacuggcucuggccucagguggggcgcaggagagccaggggaaaagugccucauaguuaggaaa

SEQ ID NO: 522639 - RNA, 64 nt, Human
uggggcuucucuucccuccaugagccuggagaccccaggggaggauccauuugggaugagcccc

SEQ ID NO: 522640 - RNA, 64 nt, Human
gucacggugggugggugggggcugaccccagcuuccaggggacugucacuguggacgccaaaau

SEQ ID NO: 522641 - RNA, 64 nt, Human
auuuuugcaucccugucugcuuuguuacaagcucccaggggaggugggguuugugucuuccaac

SEQ ID NO: 522642 - RNA, 64 nt, Human
ucuucuaguugacuuugcaccugucuucaggcugccaggggaggaggagaagccagcaggcacc

SEQ ID NO: 522643 - RNA, 64 nt, Human
aaaaggagguacacagccaucaugcgagucggugccaggggaccccccggagauccugaccagc

SEQ ID NO: 522644 - RNA, 64 nt, Human
uuagagugccagaauuagcacuggggaaaacuggccaggggaacacaaagcaggagacagccug

SEQ ID NO: 522645 - RNA, 64 nt, Human
ucugccagaggagcaagggugccuuagaccgaagccaggggaagaagcaucuucauaaaaaacu

SEQ ID NO: 522646 - RNA, 64 nt, Human
uuagcggcuccacaaagucaucagucaccugagcuccauccaucuucacaugcugugcuaccau

SEQ ID NO: 522647 - RNA, 64 nt, Human
gcauccugcuguguguccuguuccauguuccgguuccauccaaauacacuuucuggaacaaaug

SEQ ID NO: 522648 - RNA, 64 nt, Human
cuaagucuauaccuuuuaaaaccuuauuccucacuccauccagccucuugacaagcaccgcucu

SEQ ID NO: 522649 - RNA, 64 nt, Human
caggccagagaggaggccagcaggcccagaguccccaggggaggaggaccaggucaagggacgu

SEQ ID NO: 522650 - RNA, 64 nt, Human
gaccaucuggucccaggagcucaggaggaggaccccaggggagaggagagcugugagagcaccg

SEQ ID NO: 522651 - RNA, 64 nt, Human
uuuugaaccguaaauaucagaaugaauccucuucccaggggauugaacagaagcuuaauguuua

SEQ ID NO: 522652 - RNA, 64 nt, Human
guuugaaggaacucagcaguaugaugaucugguuccaggggaaaaaaauagcugguuggugucu

SEQ ID NO: 522653 - RNA, 64 nt, Human
gugagacgaaguauagagaacagguggcccagauccaggggacccaacuucuggccccuugguc

SEQ ID NO: 522654 - RNA, 64 nt, Human
gaagggcugagccacaugaaggcagcacucagggccaggggagagagaagaggaucagcagugc

SEQ ID NO: 522655 - RNA, 64 nt, Human
acuuuuuuuuuuuuaaugggauuuuuaggucagcccaggggagaaagauaacugcuaaaauucc

SEQ ID NO: 522656 - RNA, 64 nt, Human
uuucauuauucucauagaccagaguuggagccacccaggggaaugaucucugaugaccuaaccu

SEQ ID NO: 522657 - RNA, 64 nt, Human
ccaguuagccucugcaggauguggaaaccuccuuccaggggagguucagugaauuguguaggag

SEQ ID NO: 522658 - RNA, 64 nt, Human
gucugaggcacaaguuggcuguucaucuuugaaaccaggggaugcacagucuaaaugaauaucu

SEQ ID NO: 522659 - RNA, 64 nt, Human
uuuuuccuuuaaguuuguuuuuaaauguauuaguccaggggauuuugccuuaugcugaggucaa

SEQ ID NO: 522660 - RNA, 64 nt, Human
ggugugaccucuccuuugccugcauaccucaaggccaggggaauaugccucagugaugcauuua

SEQ ID NO: 522661 - RNA, 64 nt, Human
aaagcacugagggggugcagagggcccgcuaguuccaggggaacugaaagcuguuccugaucag

SEQ ID NO: 522662 - RNA, 64 nt, Human
aggucugggucucaggacagugauguuggcuagcccaggggaauguauuuuucaaaacauacaa

SEQ ID NO: 522663 - RNA, 64 nt, Human
ggcuccaaccacugccaagugaucacucuuaggcccaggggaacacaaugacuaucauuacuga

SEQ ID NO: 522664 - RNA, 64 nt, Human
ccugcuccauccaucccuccugggcgccagacccuccauccaagcccugugucuuuccauaguc

SEQ ID NO: 522665 - RNA, 64 nt, Human
gagucugacuggagucucgcauccuggggccugcuccauccaucccuccugggcgccagacccu

SEQ ID NO: 522666 - RNA, 64 nt, Human
uauauuaccagaugaaaggauaaacaaaaugugguccauccauacaauggaguauuacacagcc

SEQ ID NO: 522667 - RNA, 64 nt, Human
cccccaguuucugcuguuacuugcugccuccaggccaggggagcaggagaugcucagcucuggu

SEQ ID NO: 522668 - RNA, 64 nt, Human
uaaugacuguccuugaaauuauuauaacuggcucccaggggaauagaggaaaccaggaauucau

SEQ ID NO: 522669 - RNA, 64 nt, Human
uaauaaaagauuaucauguaucacauaucucacaccaggggaacaauuagcuacauaauuguca

SEQ ID NO: 522670 - RNA, 64 nt, Human
cucauuguccccagcccagugggcauuggaggugccaggggagucaggguuguagccaagacgc

SEQ ID NO: 522671 - RNA, 64 nt, Human
gccaugggaacgccaacuggaaagguccccuuccccaggggagccugcgaaggagagguucugu

SEQ ID NO: 522672 - RNA, 64 nt, Human
cccagccuuuuuuuuuuuuuuuuuuuuuuugucuccaggggaggggcuguuugcuggcucaggc

SEQ ID NO: 522673 - RNA, 64 nt, Human
cacacauccagcugccccucccucagggagcgauccaggggaagccagugacacuaaaacaaga

SEQ ID NO: 522674 - RNA, 64 nt, Human
caccggagcuuucaaagaaggaauucuaggcaucccaggggaccacaccucccugaaccauccc

SEQ ID NO: 522675 - RNA, 64 nt, Human
gaccaacugucacucauugcugagccucugcuccccaggggaguugugucuguaaucgcccuac

SEQ ID NO: 522676 - RNA, 55 nt, Human
ccaccaaggauccaaagugaccccaccaggggacagccagaggaaggggaccaug

SEQ ID NO: 522677 - RNA, 64 nt, Human
ugccugcugcguggaggcagccaugggaaggagcccaggggagcuggccugggggagcgaagcc

SEQ ID NO: 522678 - RNA, 64 nt, Human
cccugaggccagaggcggggccugggccgggagcccaggggaaggccaggcuggaccccggcuc

SEQ ID NO: 522679 - RNA, 64 nt, Human
uuagagaacacuucuaaggcgagccacuccacacccaggggaguuaaagcacaugaaaaagaca

SEQ ID NO: 522680 - RNA, 64 nt, Human
ggaaguuaugaagacuucaacaauuaaacugaaaccaggggaagcuugcuuaguuuuggguuuc

SEQ ID NO: 522681 - RNA, 64 nt, Human
cuccuccuaauaggaaggcgaggagaggagaaggccaggggaaugaauucaagagagaugucca

SEQ ID NO: 522682 - RNA, 64 nt, Human
acucaaaagucaaacgguagcaacaacccaaauguccauccacagaugaauuaagacaugaagu

SEQ ID NO: 522683 - RNA, 64 nt, Human
cuaucuucuuuggacuucugaagagaccacucaauccauccauguacuucccucuugaaaccug

SEQ ID NO: 522684 - RNA, 64 nt, Human
cggcaucaucccaucucuaauuuccccucuguccuccauccagcggcuucuuccgcuucauucu

SEQ ID NO: 522685 - RNA, 58 nt, Human
acaacaaugaggauuuuugaaagacaauccaggggacauaauagcagugugcaugcag

SEQ ID NO: 522686 - RNA, 64 nt, Human
ccaccgacacccccagaacccucugggggccugcccaggggacccccugagccccccgaccggc

SEQ ID NO: 522687 - RNA, 64 nt, Human
aagaaucuggagcugggaaaaggguucuuggaggccaggggaauacggggucccagagaaagau

SEQ ID NO: 522688 - RNA, 64 nt, Human
ggccagggcguggagagcccucagucggggcaggccaggggaggggugaagugguugccuggac

SEQ ID NO: 522689 - RNA, 64 nt, Human
uguguguugauggguggcccaugagugacccccgccaggggagaccaggcuggcuggauccagc

SEQ ID NO: 522690 - RNA, 64 nt, Human
agauggccucagcguggccagccugccaaacugaccaggggacggccacgguccccgcgugcac

SEQ ID NO: 522691 - RNA, 64 nt, Human
uggggcuugagucuuaauagggcugauaguccaaccaggggacaggguaucauaaagagauaau

SEQ ID NO: 522692 - RNA, 64 nt, Human
caaccugcccagucuuuccucugggcuugacccgccaggggaguucuccaggccuagggccagg

SEQ ID NO: 522693 - RNA, 64 nt, Human
ucucuuuuaugcccccucuauucuccucucucccccaggggauuuucaucucaacaacagagug

SEQ ID NO: 522694 - RNA, 64 nt, Human
auuguccuugccccagccugcaaucuguggaugcccaggggaaggcauacaggccucauccacc

SEQ ID NO: 522695 - RNA, 64 nt, Human
cugaggucaucggccugagagaagaacaccggacccaggggagauguggauuuucagcaggaac

SEQ ID NO: 522696 - RNA, 64 nt, Human
gccgaggugagaacagcauccugaggcacagcucccaggggacagagguguagcuccaaucucc

SEQ ID NO: 522697 - RNA, 64 nt, Human
ugacuucaagggcuggcagccagggagaaugggcccaggggaagcaaagaccucuucccucugc

SEQ ID NO: 522698 - RNA, 64 nt, Human
uguggcccguggcccugcccuugggacguggagcccaggggagguuugaaggggauccugggcu

SEQ ID NO: 522699 - RNA, 64 nt, Human
uggcucccagcuggggccuguccucacuggugcuccaggggaagaaacgacagccucacuucug

SEQ ID NO: 522700 - RNA, 64 nt, Human
acugucccugccucuggcacccccuuucauugguuccauccauccccacaacagccugccaauc

SEQ ID NO: 522701 - RNA, 64 nt, Human
aaaaugcgugccugaugaccaaacucucccuuucuccauccaaucgguccacacuccccgcccc

SEQ ID NO: 522702 - RNA, 64 nt, Human
uuggcuauuucaacuaaagcagauuaaccugaaauccauccaaguuguucugcauaucauuguu

SEQ ID NO: 522703 - RNA, 64 nt, Human
ccugggaugagaauauagauagucguacaacaacccaggggauccagauacaugagaccagggc

SEQ ID NO: 522704 - RNA, 64 nt, Human
gcccucucccagccuugccuggcugagcuguguuccaggggagcccuggacaagcccucauagg

SEQ ID NO: 522705 - RNA, 64 nt, Human
ccugguaacccagugccuagaauauuauaugauuccaggggauggcuagaggcauuucuguugu

SEQ ID NO: 522706 - RNA, 64 nt, Human
ccugacccuuggccuucccucacaccaucuccuuccaggggaugaaucuuuggggguugguuug

SEQ ID NO: 522707 - RNA, 64 nt, Human
ugcucccagugaccuggaagcaagcccacccuccccaggggaaaaucuaggagaaugcauuccu

SEQ ID NO: 522708 - RNA, 54 nt, Human
gcggcgaaggcaacaauuaaggccccaggggaacuggcagcgcacgcggaugcu

SEQ ID NO: 522709 - RNA, 64 nt, Human
aucuuguucccuugaggugccuccucuccucugcccaggggagggaguguggacaguaucugga

SEQ ID NO: 522710 - RNA, 64 nt, Human
ccucggucucccuugcaccaggcacccuugggcuccaggggagggugcgugggggcgguguggc

SEQ ID NO: 522711 - RNA, 64 nt, Human
guuuccaaauuuggcugcacauucauaccaaucaccaggggauuuuuuuaaaauccugaugccc

SEQ ID NO: 522712 - RNA, 64 nt, Human
aaaccaaacacccagaggucucaucucccaggccccaggggagaaagaggaguagcaugaacgc

SEQ ID NO: 522713 - RNA, 64 nt, Human
agccaagccuccugugguccugagcaugaaggggccaggggaccuccugggagaugcagcuuuu

SEQ ID NO: 522714 - RNA, 64 nt, Human
uuugguaauagacacaaaugcagugggaagaagaccaggggacaagaggcaaguuggagugaug

SEQ ID NO: 522715 - RNA, 64 nt, Human
agcagguccacagcaccugggcagaggucagagaccaggggaggccgggccuugcccucccuuc

SEQ ID NO: 522716 - RNA, 64 nt, Human
cugugugugucuagguagagauauuggaaggcugccaggggauuucgaaguuugcaaccuuuau

SEQ ID NO: 522717 - RNA, 64 nt, Human
ucagacguugccugagaagaaguggcugccacacccaggggaaggcccugaggcggaggcugug

SEQ ID NO: 522718 - RNA, 64 nt, Human
caaagucccucaugcuaccuuuuuaugcuuacacuccauccaaaccuaacucugccaaccacuu

SEQ ID NO: 522719 - RNA, 64 nt, Human
gcauucucccccaguccacccagaacacacagccuccauccagguacuggcucugagcaggaca

SEQ ID NO: 522720 - RNA, 64 nt, Human
ugaacaucuuugauccuuccauuucauuuauucauccauccauucaacaaguauuugcuaaaca

SEQ ID NO: 522721 - RNA, 64 nt, Human
uggcuggcugucuugcaucagucccaggccucggccaggggagccagccuuugguuucguuuac

SEQ ID NO: 522722 - RNA, 64 nt, Human
gcaaguccauuauguaauagugacagcaaagggaccaggggagaggcauugccuucucugccca

SEQ ID NO: 522723 - RNA, 64 nt, Human
ccuagguuacaaguaaaucauugucaagggccagccaggggaagguuucaauuaagguucuguu

SEQ ID NO: 522724 - RNA, 64 nt, Human
gcuggccagccucgggcagcgcggcccccuccucccaggggagaguagaagucgcacacgcagc

SEQ ID NO: 522725 - RNA, 64 nt, Human
ccgugggacccaggccugacccggagccccagccccaggggaccaugccggggugcugccuggg

SEQ ID NO: 522726 - RNA, 64 nt, Human
aaauccauggagauggaacauagauuagugguugccaggggauagaggaguaauuguuaguggg

SEQ ID NO: 522727 - RNA, 64 nt, Human
gugggacuccagcucguguguccucauggagaacccaggggacagcuggugcaaauucagaacu

SEQ ID NO: 522728 - RNA, 64 nt, Human
uauggcgccucaucuuuaaacuguccuuaguagcccaggggagccacacccucacucccugccu

SEQ ID NO: 522729 - RNA, 64 nt, Human
gcccccaggccucaggaccccaccccucugaggcccaggggagcccuguucacgcugguuucuc

SEQ ID NO: 522730 - RNA, 64 nt, Human
uccucccccauguccugccuaggcccucagaggaccaggggaucaugucuccagguaacccgac

SEQ ID NO: 522731 - RNA, 64 nt, Human
cugacagaagccuguccuuguaaggcccagccuuccaggggaacacucagacauguucauucuc

SEQ ID NO: 522732 - RNA, 64 nt, Human
ggggcugcagaagacauggugugaguaguuggguccaggggaggcaucaggccuucuucugguu

SEQ ID NO: 522733 - RNA, 64 nt, Human
caagcugggcccaagcccagagccccugccugccccaggggagccagaauccagccccuuggag

SEQ ID NO: 522734 - RNA, 64 nt, Human
caguggagggccacuacucauccccauugguuucccaggggagggguguugucuggaagggcag

SEQ ID NO: 522735 - RNA, 64 nt, Human
uguacccugccacgcuagguuaugacgaccugacccaggggacagcagcaggagacuacuccaa

SEQ ID NO: 522736 - RNA, 64 nt, Human
uguucugggccugcugaggauggcagagcugguguccauccagcacugaccagcccugauuccc

SEQ ID NO: 522737 - RNA, 64 nt, Human
aacaggagaccacaaagguuucacuucuuuuagauccauccaauaugcgaaaaaaggguacauu

SEQ ID NO: 522738 - RNA, 64 nt, Human
ucuaauauggagugauauaguuuggcucugugucuccauccaaaucucaucuuaaauuguaauc

SEQ ID NO: 522739 - RNA, 64 nt, Human
uguuaguggcaccuguaugaggccaagugugcguccaggggaacagcacagguuaaugcgucuc

SEQ ID NO: 522740 - RNA, 64 nt, Human
gguguggggaguaggucagaggguuagugaaaguccaggggauuucuccuccaaguccuaccac

SEQ ID NO: 522741 - RNA, 64 nt, Human
cuggcaaaagggggcagcccuugggagcugggggccaggggauugacuugguucccugacaagg

SEQ ID NO: 522742 - RNA, 64 nt, Human
aucuccaccauugggugagccggagccugugguuccaggggagauccagaaugcaugugucucu

SEQ ID NO: 522743 - RNA, 64 nt, Human
aaaggcucccaugugagucccugugauggccaggccaggggaccccugccaguucucuguggaa

SEQ ID NO: 522744 - RNA, 64 nt, Human
cccacccacacccacugcuuccucucggcgcaccccaggggaguguuagcagcgaggccuuccu

SEQ ID NO: 522745 - RNA, 64 nt, Human
auauacgugauuuaaucugcaauagguggaauaaccaggggaacugguuaugaauaugugaaug

SEQ ID NO: 522746 - RNA, 64 nt, Human
augaugcuuuuucucugaaguggugugggaaguaccaggggacuggcagaagcccaggcccucu

SEQ ID NO: 522747 - RNA, 64 nt, Human
cacucgcuuccucugugcugugacaacauuggugccaggggagaugguguuuuucaaagggacc

SEQ ID NO: 522748 - RNA, 64 nt, Human
uauuagaacucuuuucuucuaaggacugagacuuccaggggauugccaucuuaccugucucuuc

SEQ ID NO: 522749 - RNA, 64 nt, Human
caccuugaggggucgcugcuugagggcucuuaucccaggggacuuuuuaauucggauguuacuu

SEQ ID NO: 522750 - RNA, 64 nt, Human
aguugccaccaaccaauuuacugaugaaugaagcccaggggacugccauuuuauaaaugucagc

SEQ ID NO: 522751 - RNA, 64 nt, Human
aacccuguucacaggcgcuuccagcccacuccagccaggggagcagggaagaagaaggggcucc

SEQ ID NO: 522752 - RNA, 64 nt, Human
uggcacaaagaaaagcugcuaaaucuauagccaaccaggggaccacaguagugggcaagaguga

SEQ ID NO: 522753 - RNA, 64 nt, Human
acuuuuuuuuucuuuuugucuguuaguuauuucuccaggggaaaaggcaauaauuuucuaagac

SEQ ID NO: 522754 - RNA, 64 nt, Human
gcuggagaucagcaugccuguccuuucagucugauccauccaucucucucuugccugaggggaa

SEQ ID NO: 522755 - RNA, 64 nt, Human
agagaguugaacaguggugagcugggcucacagcuccauccaugggccccauuuuguaccuugu

SEQ ID NO: 522756 - RNA, 64 nt, Human
ccucacccucuggcugaggagcugucggcugcuuuccauccagcugggagucuggcaggcccuu

SEQ ID NO: 522757 - RNA, 64 nt, Human
gccucauggccaacaauggacaccuccagagccuccaggggaccacacaguagacuaucccuac

SEQ ID NO: 522758 - RNA, 64 nt, Human
cccggcgcggggcgcggacuccgggcacggcuucccaggggaacgaggagaucuguguuuacuu

SEQ ID NO: 522759 - RNA, 64 nt, Human
uggaaguaguggagccccugcucugguggggcugccaggggagaccccgggagccggggaagga

SEQ ID NO: 522760 - RNA, 64 nt, Human
gacgcugcuccaugcugaagaaaagugacagucuccaggggacauuucagccaugcugaaaggg

SEQ ID NO: 522761 - RNA, 64 nt, Human
gauucguauggcuaacgucagugaaucaaggaucccaggggaugccaauggcagggcaccucag

SEQ ID NO: 522762 - RNA, 64 nt, Human
ggggucgucgagaggcugcgggcuggcggcagucccaggggagagacaccacagaaggagaccc

SEQ ID NO: 522763 - RNA, 64 nt, Human
cuuuccgcacucugagaccaugaucuuccuccugccaggggagagccacccacaggccaugucc

SEQ ID NO: 522764 - RNA, 64 nt, Human
uucaucuagaugacucuaaggucucuuucaggucccaggggacgugaucuaaguuaggaguggg

SEQ ID NO: 522765 - RNA, 64 nt, Human
ggaccacaggcucaggcaggggccuccaugggccccaggggaacacuggggacuuggccucucu

SEQ ID NO: 522766 - RNA, 64 nt, Human
ggaccucaagauuccuggaaagaagccccagcccccaggggaaaccuccagaggaacaagguca

SEQ ID NO: 522767 - RNA, 64 nt, Human
gagccccuagcccauccuguggaacacaugcuguccaggggaucaaggcccuuuguuuuggguu

SEQ ID NO: 522768 - RNA, 64 nt, Human
aauuuaccaaguugccuuuugccacuguagcugaccaggggacuagguuguagaggugggaagg

SEQ ID NO: 522769 - RNA, 64 nt, Human
cugcagguccagccggcuggcacccuccauguacccaggggagauuccagccagacacccgccc

SEQ ID NO: 522770 - RNA, 64 nt, Human
uagcagauuguguaacaauuuuaaugcuauuuccccaggggaaaaugaagguuaggauuuaaca

SEQ ID NO: 522771 - RNA, 64 nt, Human
uccucccgugccccuccccgcuguccucuuggccccaggggagaagaugaggccaucagagaug

SEQ ID NO: 522772 - RNA, 64 nt, Human
ggggccaucugcggcccugguucgggcagggacauccauccaccucugaguccuucugagccac

SEQ ID NO: 522773 - RNA, 64 nt, Human
uuccugcagaggcuccuuucugccuccauggcuauccauccacccccacagaccccguuccucc

SEQ ID NO: 522774 - RNA, 64 nt, Human
uuccugcagaggccucuuucugccuccauggcuauccauccacccaccaagacccuguucccug

SEQ ID NO: 522775 - RNA, 64 nt, Human
aagaugaggccaucagagauggccaggagaagggccaggggaauagagcuauuuuuuuaacaaa

SEQ ID NO: 522776 - RNA, 64 nt, Human
gggccgcccacgggcagcaggagggacaaugcggccaggggacgagcgccuuccuugcccaccu

SEQ ID NO: 522777 - RNA, 64 nt, Human
acaaaaaggagauauguacacuagagacaucaaaccaggggacaugaaauguauagggcaaacc

SEQ ID NO: 522778 - RNA, 64 nt, Human
cuuuagauguaucuaauucuccugacuguucuucccaggggagugugaaggucuuggcccuguu

SEQ ID NO: 522779 - RNA, 64 nt, Human
agccaggcuacugucuguacccccacuccaucccccaggggaacaccccugcccagcuacuuuc

SEQ ID NO: 522780 - RNA, 64 nt, Human
ugggcagugccagccaaucccuggccauuuggccccaggggacgugggcccugcaggcugcagg

SEQ ID NO: 522781 - RNA, 64 nt, Human
gcccucguggcuucggagagcagaggggucaggcccaggggaacgagcuggccuugccaacccu

SEQ ID NO: 522782 - RNA, 64 nt, Human
uggcugcagucagugcccagggcgaggaauguggccaggggauccaggaccugggauccagggc

SEQ ID NO: 522783 - RNA, 64 nt, Human
gugauauggggggaggaggggcuagaacaagggcccaggggacuggaggcaggaugguggcuuu

SEQ ID NO: 522784 - RNA, 64 nt, Human
gaaacggaaucccagccagcggauuggggguggcccaggggaugcugcugaugugcaggugggu

SEQ ID NO: 522785 - RNA, 64 nt, Human
ggcugcauaaaggacucugaugucaaaauggaaaccaggggacuuaccuuuucacaugacuuac

SEQ ID NO: 522786 - RNA, 64 nt, Human
ucgagcggugaagccgcgcuccccuggaagcgacccaggggaggccaaguugucagcuuuuuga

SEQ ID NO: 522787 - RNA, 64 nt, Human
aggaugacucaauguuaaagcauuuaaauggaaaccaggggaguuuuaaagcccgagaaaccac

SEQ ID NO: 522788 - RNA, 64 nt, Human
ugcccaccugucaaacaaagccagaagcugagcaccaggggaugaguggagguuaaggcugagg

SEQ ID NO: 522789 - RNA, 64 nt, Human
ggggugggguggagaacuccuaggguggcuggguccaggggaugggagguugugggcauugaug

SEQ ID NO: 522790 - RNA, 64 nt, Human
auccaguggccccguggcacccuccuuuaugacauccauccaucuguggugaaccaagugaagg

SEQ ID NO: 522791 - RNA, 64 nt, Human
ucccuggccuuucccauagcuggugaaggacaccuccauccauuccacgcaguugcucaaagca

SEQ ID NO: 522792 - RNA, 64 nt, Human
cagccaggggaacucgccaccugcccacgcuaguuccauccacgcucaagacccgcccuuagac

SEQ ID NO: 522793 - RNA, 64 nt, Human
ugcugcccaagggucgccuuccccagcuugugcuccaggggagccccgacgccggcggggaggc

SEQ ID NO: 522794 - RNA, 64 nt, Human
ucucccaagaugcagaaauguggaugcucuuuucccaggggacaugaguaaagcagugugguac

SEQ ID NO: 522795 - RNA, 64 nt, Human
ggucaguccagauagguggguucuagcaauuuccccaggggauuaaggggcucuagggccaccu

SEQ ID NO: 522796 - RNA, 64 nt, Human
ucuccuugcacuuagccuuggcagacccuugacuccaggggagaugaccugggggaggaagugu

SEQ ID NO: 522797 - RNA, 64 nt, Human
uuggcaguccucccaaucccacaccuccuguuugccaggggaaagaaccuaaagacuucgugug

SEQ ID NO: 522798 - RNA, 64 nt, Human
uucuggcuaggcucucauguccagacagcggggaccaggggaaaacccagccccuucuguaauc

SEQ ID NO: 522799 - RNA, 64 nt, Human
agacuacaaguggugggucaggugguccuaggacccaggggagguuuagggguccuaucuccug

SEQ ID NO: 522800 - RNA, 64 nt, Human
agugugaggaccucccugucucccggcuccccucccaggggagccagcugcuugaccuagcucu

SEQ ID NO: 522801 - RNA, 64 nt, Human
gccucgcaaaucagaggcaagggagagguuguuaccaggggacacugagaauguacauuugauc

SEQ ID NO: 522802 - RNA, 64 nt, Human
aagagcagugcuguccaugauguaauggaagcuaccaggggaggcagugucuggaugaugcugu

SEQ ID NO: 522803 - RNA, 64 nt, Human
gccuugacagcuggcaucaaucagcccaagacccccaggggauucaugggaaaugucguauuuu

SEQ ID NO: 522804 - RNA, 64 nt, Human
uucccagucagggcuccccagggacaagggauggccaggggagggggucuguggaagauucagg

SEQ ID NO: 522805 - RNA, 64 nt, Human
ccaugagccaagagcccucuucacgcugcuaacuccaggggacagacgaagggacaucuuugga

SEQ ID NO: 522806 - RNA, 64 nt, Human
cucucugacccucuccccacugcucauuuggaucccaggggaguguucagggccagcccuggcu

SEQ ID NO: 522807 - RNA, 64 nt, Human
gccuccugagaguuggcccucccuugugccacugccaggggaggaaaggccuugauguuccaga

SEQ ID NO: 522808 - RNA, 64 nt, Human
aguuguauuuucagucuucgccaggucauugagauccauccacucacaucuuaagcauucuucc

SEQ ID NO: 522809 - RNA, 64 nt, Human; identical to SEQ ID NO: 519690

SEQ ID NO: 522810 - RNA, 64 nt, Human
ccccccagugcucaucaaaguaggacaauaaaaauccauccaucucaguccaggcagauuuaca

SEQ ID NO: 522811 - RNA, 64 nt, Human
accaucacagaccagguccuaauggguguggaccccaggggagaaucagaggucaaagcucagg

SEQ ID NO: 522812 - RNA, 64 nt, Human
ccagggaagggguugcuguagagauagcccccacccaggggauggaggucuacccuggacacua

SEQ ID NO: 522813 - RNA, 64 nt, Human
ucauaguaucugccuuggucuugcuuggggcguuccaggggaugcuguugguucaaggacaaca

SEQ ID NO: 522814 - RNA, 64 nt, Human
aucacugcauucauucugagcccccuuccuguccccaggggagguguauuguguauguagccuu

SEQ ID NO: 522815 - RNA, 64 nt, Human
caggcagccccaccugcaggagaacgucagcccuccaggggaucagccccugccaguuccaccc

SEQ ID NO: 522816 - RNA, 64 nt, Human
gaggcacuaagccuaagaaguucccugguuuuucccaggggacaggacccacugggagacaagc

SEQ ID NO: 522817 - RNA, 64 nt, Human
aauauugcuuuaucagcaucuuuucucuguagcuccaggggaaucuuuucucuaaaacauuuau

SEQ ID NO: 522818 - RNA, 64 nt, Human
acugggcugacaguaaaagcacagaauacaaaacccaggggauggggcugggaggggcugugag

SEQ ID NO: 522819 - RNA, 64 nt, Human
cuccccuaaagguagaagauacucgagcaugcugccaggggagcuggauggugaaacaccugaa

SEQ ID NO: 522820 - RNA, 64 nt, Human
ccuguggagagucggggcuccagccaggagcgcuccaggggagucucucaggaaaaagaagccc

SEQ ID NO: 522821 - RNA, 64 nt, Human
ucuugucauaugcaacuaaaacaggguagacaggccaggggaaaaaggcacucagggcacacag

SEQ ID NO: 522822 - RNA, 64 nt, Human
gugcuguuuuaauuucuaaagguaggaccaacacccaggggaucagugaaggaagagaaggcca

SEQ ID NO: 522823 - RNA, 64 nt, Human
agaguagccgagagccugcucccccacccccuccccaggggagagggucuggagaagcagugag

SEQ ID NO: 522824 - RNA, 64 nt, Human
caaggggugcuguaugcucuaggcauccccucccccaggggauuuucuaaguagauggggggac

SEQ ID NO: 522825 - RNA, 64 nt, Human
gaagcccugagcugggggaaggggucaugcagcaccaggggauaugcccaacucacugccugcu

SEQ ID NO: 522826 - RNA, 64 nt, Human
caguuuaacuggggaccaucugugaaauuaauuuuccauccagacagcugcugugagcaaauga

SEQ ID NO: 522827 - RNA, 64 nt, Human
gcacuguuuguucccacuuaugugagugaccccauccauccaugaccagaggauuauuuuccug

SEQ ID NO: 522828 - RNA, 64 nt, Human
augaaugcucccugauauuuccucuugguaaucuuccauccacugccccugacccuguucccug

SEQ ID NO: 522829 - RNA, 64 nt, Human
ggccaggggaggcauuaaguggcccaaaagagagccaggggagccccuucugccugccagacgu

SEQ ID NO: 522830 - RNA, 64 nt, Human
guccuuuccagucacuucucaggagcaggaacagccaggggaccucagacccaggguauuuuca

SEQ ID NO: 522831 - RNA, 64 nt, Human
auuggggcagggacccuccuacacuacagaggggccaggggaucccucucucccuagugccuuc

SEQ ID NO: 522832 - RNA, 64 nt, Human
uuguucauauuuguauguacaugacuauuuaaagccaggggauuaucuuucuauaaauguauaa

SEQ ID NO: 522833 - RNA, 64 nt, Human
auguucucccucccucccauuguagccuugcugcccaggggagggauaugucuuccuuuaugca

SEQ ID NO: 522834 - RNA, 64 nt, Human
ccuaugguccccgugugauccacccugcuucucuccaggggaccauaggucccgucauguacuc

SEQ ID NO: 522835 - RNA, 64 nt, Human
uuugcuuuauggcaccuccuagaggaccagcuguccaggggaggugguauugaccggcacucag

SEQ ID NO: 522836 - RNA, 64 nt, Human
ugggcaccaggggacgcucuggcgagggcagaccccaggggaaagcaaagggcgucucagggaa

SEQ ID NO: 522837 - RNA, 64 nt, Human
ccccuucccccucgacccccgcaaugagugggcaccaggggacgcucuggcgagggcagacccc

SEQ ID NO: 522838 - RNA, 64 nt, Human
ccgugcccggcccaggacuuuuaaaacaagcaucccaggggauuccggugccuaccagaagucg

SEQ ID NO: 522839 - RNA, 64 nt, Human
cuggcaguuggggaggccacagcagcuagaauuuccaggggaaaguacuggagagaugggaucc

SEQ ID NO: 522840 - RNA, 64 nt, Human
agagguggacauugucagggguucuggaaugggaccaggggaccuuuuggugcagugggugccu

SEQ ID NO: 522841 - RNA, 64 nt, Human
agaaaaucuuauuuuucugaacauuuucaugaauccaggggacuugaaaauauggaagacccac

SEQ ID NO: 522842 - RNA, 64 nt, Human
ugggggaggaggagggaugugggcauuuuggacaccaggggaaauggaaaugcugcuuucaaaa

SEQ ID NO: 522843 - RNA, 64 nt, Human
uuaacacauauugguuuuugaaugcagucaaucuccaggggaaaaguuaacaaguuaucuuucg

SEQ ID NO: 522844 - RNA, 64 nt, Human
guuaaaaugaucaaucaagauaaaaggugaucuauccauccaauggaauauuauuuggccuuaa

SEQ ID NO: 522845 - RNA, 64 nt, Human
gggauaugaauauuauuagacaguaauuuugcuuuccauccaguaugcuaguucuuauucgaga

SEQ ID NO: 522846 - RNA, 64 nt, Human
uaacggcucuaucgccuuuuaugaugcuuugaacuccauccaccucuacaccuucgacgucgca

SEQ ID NO: 522847 - RNA, 64 nt, Human
ucucuuccugccccuaguauuugauuacaaggaaccaggggaaaaaaacuuucuuagacacacu

SEQ ID NO: 522848 - RNA, 64 nt, Human
cuaucugauauacgguagcagggguuuacggcugccaggggaaaauaacucaucaaguguugga

SEQ ID NO: 522849 - RNA, 64 nt, Human
accggcaaaugcccugcaacgguggcuccugacaccaggggauagggagaugugccagaguccu

SEQ ID NO: 522850 - RNA, 64 nt, Human
aucauccugaagaacuucgagaagcucaagaagcccaggggagaaacaaagggaaugaucuauu

SEQ ID NO: 522851 - RNA, 64 nt, Human
gggucaggauuccugccagguccccgauguguauccaggggaagaauugguggccugagccgau

SEQ ID NO: 522852 - RNA, 54 nt, Human
ccaccacccccaucuacugaauagccaggggagggcaccaaugaacagcacagu

SEQ ID NO: 522853 - RNA, 64 nt, Human
agaugccucuucuaccucuuccaggaagcacaggccaggggaucugggugugugagugggagga

SEQ ID NO: 522854 - RNA, 64 nt, Human
cagaggccagaguagaauggaggaugauugccgcccaggggacgagcucagcccugcgccuugg

SEQ ID NO: 522855 - RNA, 64 nt, Human
uguauagauuaagcccuauaaugcuauuuauauuccaggggaacgaaaaucugaauuuguuuua

SEQ ID NO: 522856 - RNA, 64 nt, Human
uuugugaauaucaucaucuuugccagacaagucuccaggggaucccuguuucccaacugaaagg

SEQ ID NO: 522857 - RNA, 64 nt, Human
cccugccccucgcccugcagagaagagaaccaugccaggggagaaggcacccagccauccugac

SEQ ID NO: 522858 - RNA, 64 nt, Human
cacuugugauuacauuagggcucaccccuuuaauccaggggagccucuccacuucaugauuuuc

SEQ ID NO: 522859 - RNA, 64 nt, Human
caggaagcccuaggaagaggggacugcaggguccccaggggaucuuuccucccuccccugcaug

SEQ ID NO: 522860 - RNA, 64 nt, Human
uauaaaauuggaaagucucuaagacacaggcaaaccaggggacuuaaugauuugguucguuuau

SEQ ID NO: 522861 - RNA, 64 nt, Human
augagaaacagcucagccaguggggaugaggucaccaggggaggagccugugcgucccagcuga

SEQ ID NO: 522862 - RNA, 64 nt, Human
cccccaugccaccacccaccccaaacuuccagguuccauccaccaccuugccaaugguguagcu

SEQ ID NO: 522863 - RNA, 64 nt, Human
ugguuugccauaggcccugccaagauacugcagguccauccaggccucugcuaucugcaucugc

SEQ ID NO: 522864 - RNA, 64 nt, Human
ggaaccucgugggcuccagggacccaggcccacauccauccagcguucccgcuggcugugggac

SEQ ID NO: 522865 - RNA, 64 nt, Human
caccgccaccccgcaccccgcguguccccggggcccaggggaggcggcacuccaaccuaaccug

SEQ ID NO: 522866 - RNA, 64 nt, Human
aaugacucuugccuaugaccaaggccauuugaugccaggggaguuugccaaugaaguaaaggga

SEQ ID NO: 522867 - RNA, 64 nt, Human
gggggagggcaggggccccuguggguucugggcuccaggggagggagcuggggaggccagggua

SEQ ID NO: 522868 - RNA, 64 nt, Human
cuuuugacaaaagaucgccuaugaguuacaagcaccaggggaugcucuacaucaagggaugcac

SEQ ID NO: 522869 - RNA, 64 nt, Human
ugagggcuaaaggugcgagcccagauggcgagccccaggggauggcccuggcugaacuggacag

SEQ ID NO: 522870 - RNA, 64 nt, Human
agguccccacccucagcugucaccaccacccuccccaggggacuccaucugagaugaggccucg

SEQ ID NO: 522871 - RNA, 64 nt, Human
gaugguuccauggaguucugaucuuugggcauggccaggggaagcagaagggagacucuaggag

SEQ ID NO: 522872 - RNA, 64 nt, Human
cccucugacccuggcccagggaccccucacggggccaggggaggcauagcagaaagacuggccc

SEQ ID NO: 522873 - RNA, 64 nt, Human
cugggggugcagagcccaccuggguaccugacccccaggggaugaaaaugcaaggaugagucug

SEQ ID NO: 522874 - RNA, 64 nt, Human
ugcaggacaugcugcccaugccaggagauccaacccaggggacuggcaacuauaacaucgaaga

SEQ ID NO: 522875 - RNA, 64 nt, Human
aacucaguuuacugagguuugagagaacaucccuccaggggagccugggagcugcucucccagu

SEQ ID NO: 522876 - RNA, 64 nt, Human
uuuucccucucuauuuucagguuugcagagcaugccaggggacuacguuucucagggugguccu

SEQ ID NO: 522877 - RNA, 64 nt, Human
aaaaagaucaccucccagugaccucccucagcccccaggggaguaggucuguguccaaagcuau

SEQ ID NO: 522878 - RNA, 64 nt, Human
uucagauccuaccagcaaccguagcaccuuccacccaggggacucccagaagccaguagagaga

SEQ ID NO: 522879 - RNA, 64 nt, Human
cggaaaauguuuucuuggcuuggaaacugggcggccaggggaugacaguauggacuuccaguga

SEQ ID NO: 522880 - RNA, 64 nt, Human
ggaggaaggcugacagagaaggucuccucugugcuccauccacacaggaugccggagagacagc

SEQ ID NO: 522881 - RNA, 64 nt, Human
uucuuacuacuugcaguagccuguccccaacuuuuccauccagugcuuaaccuaaaaaacuccu

SEQ ID NO: 522882 - RNA, 64 nt, Human
gccucaaaucagggaggauacgcgggaggcccccuccauccaggcggugcuccuggggugccgg

SEQ ID NO: 522883 - RNA, 64 nt, Human
cugacacauggggcagaggagcuccaggcacagaccaggggaggggauauuuaggggcuccccu

SEQ ID NO: 522884 - RNA, 64 nt, Human
ggcagagcaaauagggcuggugaggagugacuguccaggggaaccagcagagggcguugggggu

SEQ ID NO: 522885 - RNA, 64 nt, Human
augguaguggagccaggcuuccacugcauccuggccaggggacggagccccuugccuucgugcc

SEQ ID NO: 522886 - RNA, 64 nt, Human
ggcuggcccgggagcuccuugccugccacuucuuccaggggacagaauaacccaguggaggaug

SEQ ID NO: 522887 - RNA, 64 nt, Human
uaaccauccuugugguugcuucugugaaccucuuccaggggaacccaccaagaccaaccugguc

SEQ ID NO: 522888 - RNA, 64 nt, Human
uacugagguucccugcccuaccuggcguccugguccaggggagcccugggcagaagcccccggc

SEQ ID NO: 522889 - RNA, 64 nt, Human
uuccccugacaggaaguucuuggcggguuuggagccaggggauggcauggagugauguggcuuu

SEQ ID NO: 522890 - RNA, 64 nt, Human
aucauugccccauccaguguccucugcagcagggccaggggacgcacaccugccugacucuuuc

SEQ ID NO: 522891 - RNA, 64 nt, Human
ccuccacugggcacuugccgaccugagucuggggccaggggagcccaggcugcccugcacuccu

SEQ ID NO: 522892 - RNA, 64 nt, Human
gacuaacggcuaaccuggaccuggaacuguagggccaggggauugucucagggccgacguucca

SEQ ID NO: 522893 - RNA, 64 nt, Human
ucggaccacucccagccccccauccccccguuccccaggggagcuggggaauuccugccaagca

SEQ ID NO: 522894 - RNA, 64 nt, Human
gggggccgcgggcagccgcucuucagcucgcggcccaggggaguggcgaggggcgccccaaccc

SEQ ID NO: 522895 - RNA, 64 nt, Human
ugguguucaccgcccccacccugagcgccuggguccaggggaggccuuccagggacgaagaaga

SEQ ID NO: 522896 - RNA, 64 nt, Human
ccuggaagcaccugcuuggcccugccaccuuccuccaggggagggccagauggcauccuggcuu

SEQ ID NO: 522897 - RNA, 64 nt, Human
auuaggcccccaucauccucuggcuuggccacagccaggggagcagaggggcagaggcccacau

SEQ ID NO: 522898 - RNA, 64 nt, Human
aagagugcaggcaaguagagugauggggucaguguccauccaguuuacgcugagucaguccaua

SEQ ID NO: 522899 - RNA, 64 nt, Human
acuuugccucuugacugucccuucucuuccuaccuccauccauggaaaauuaguuauuuucuga

SEQ ID NO: 522900 - RNA, 64 nt, Human
guaucucagagaaucagcuaaguuuccuaacuuguccauccaaaugugaucaccacgauucaac

SEQ ID NO: 522901 - RNA, 64 nt, Human
ggcagagaccugggaugggagaaguccuggggcgccaggggauccagccuagagcagaccuuag

SEQ ID NO: 522902 - RNA, 64 nt, Human
uccaagagcacccaccaagacacagcaggacaggccaggggagggcaucuggaccagggcaucc

SEQ ID NO: 522903 - RNA, 64 nt, Human
ccggcagccugcuggacucccagaccccauccagccaggggaccgcaggccauuguugaacucc

SEQ ID NO: 522904 - RNA, 60 nt, Human
ucuuugcugucaggcagugaauuuccagcaccaggggagaaggggcgucuucaggagggc

SEQ ID NO: 522905 - RNA, 64 nt, Human
guggauggaguucacaggcgaauagaggagaggaccaggggacguggcuugucccuuuugucca

SEQ ID NO: 522906 - RNA, 64 nt, Human
uuauaacaaaaaagaaaauuugaaaaaaaaaaucccaggggaguagcaggagcccuuugcugug

SEQ ID NO: 522907 - RNA, 64 nt, Human
ugggauggggcuucacugcugugacuuccuccugccaggggauuuggggcuuucuugaaagaca

SEQ ID NO: 522908 - RNA, 64 nt, Human
gucucgguuugcauucuugugcuuuugggaggugccaggggagggaagggcugggaugcuggga

SEQ ID NO: 522909 - RNA, 64 nt, Human
gcuugggcccuggaggagaaagccauucuggacaccaggggaccuggacggaggguccccacag

SEQ ID NO: 522910 - RNA, 64 nt, Human
ggaaggauaaagccacuucuggcuucagcccccaccaggggaaggaaggagggcacauuaacuc

SEQ ID NO: 522911 - RNA, 64 nt, Human
ugggggcguggggaagagggcaggagcugaaguuccaggggagcccaggaccccuggggaccug

SEQ ID NO: 522912 - RNA, 64 nt, Human
ccaguuaaacccccuacauuaguaucccacuagcccaggggagcaguaaacuuucucugcaaag

SEQ ID NO: 522913 - RNA, 64 nt, Human
ccacucagucuccacccaacuccuggcacugcucccaggggaucgggucuccacuccagcuuuc

SEQ ID NO: 522914 - RNA, 53 nt, Human
agaacagcgucuccaucuaaaucccaggggaacacaggcccagaugacauccc

SEQ ID NO: 522915 - RNA, 64 nt, Human
uccagaagagacugugcuggguguggcuuggcacccaggggaugagagcccugagcuuuggguc

SEQ ID NO: 522916 - RNA, 64 nt, Human
caguguccugaaagauuccuuuccuauccauccuuccauccaguucucugaaucuuuaaugaaa

SEQ ID NO: 522917 - RNA, 64 nt, Human
auacucacugggcaccagccuugcccucuuagccuccauccauccagacagcccuucccaccuc

SEQ ID NO: 522918 - RNA, 64 nt, Human
ucacugggcaccagccuugcccucuuagccuccauccauccagacagcccuucccaccuccugg

SEQ ID NO: 522919 - RNA, 64 nt, Human
acagcgccaauaacaauacagugucugaguaucuccaggggaugauuucuggcucuuugucucc

SEQ ID NO: 522920 - RNA, 64 nt, Human
cugaagcugauuuguaaugauuggcacucuucagccaggggaguggguaggccauagccaagga

SEQ ID NO: 522921 - RNA, 64 nt, Human
agcguuuagaaacacaccuguauuugauucucagccaggggagcacucgcugcacuggugggag

SEQ ID NO: 522922 - RNA, 64 nt, Human
guuuagacaucugcagagaggcaggcagcccagcccaggggacccguuccucuugaaccaguca

SEQ ID NO: 522923 - RNA, 64 nt, Human
agccagcuugccuccugcaccccacccccaccaaccaggggagccacuaagcugacuaacaacu

SEQ ID NO: 522924 - RNA, 64 nt, Human
ggcaucaagaggugggagggcccuccgaccacuuccaggggaaccugccaugccaggaaccugu

SEQ ID NO: 522925 - RNA, 64 nt, Human
augcagagacucuguacugaggccagggccagggccaggggacucugugagucuggcucaagac

SEQ ID NO: 522926 - RNA, 64 nt, Human
agccuucugauggccuggcccaccuuccccagaaccaggggaggccugaggcuucaguuuuacu

SEQ ID NO: 522927 - RNA, 64 nt, Human
cugagggccagggcccuacagcaugccccuacggccaggggacugucugccagccucccaggcc

SEQ ID NO: 522928 - RNA, 64 nt, Human
agagcugggcucuagcaggacaguucuuuuguagccaggggacccuagaagugggguggggcgg

SEQ ID NO: 522929 - RNA, 64 nt, Human
ugcuccuugugguuauugcucagcccuggcauccccaggggaauggcagcagugagguagaugg

SEQ ID NO: 522930 - RNA, 64 nt, Human
acuguggucggcaaggugagggagauagggauauccaggggaagaggguguugcuguggcccac

SEQ ID NO: 522931 - RNA, 64 nt, Human
ucaacggagggaguggcacuucugccuugaguccccaggggaaaaaaaaaaaagauauuuauga

SEQ ID NO: 522932 - RNA, 64 nt, Human
agcauaacaaaggugguguugcuccagcucagccccaggggacacagaugcacuuuggggguga

SEQ ID NO: 522933 - RNA, 64 nt, Human
gggucucgcugagcagucauggaaugcgguagagccaggggacccugucugccccgaauaacuu

SEQ ID NO: 522934 - RNA, 64 nt, Human
cuaccaccaccaccaccaccccuucuggggucacuccauccaugcucucuccagccagccaucu

SEQ ID NO: 522935 - RNA, 64 nt, Human
cugccuuuugggacuuaaaccccagccucccccguccauccagcccuggggcuggggggcuuca

SEQ ID NO: 522936 - RNA, 64 nt, Human; identical to SEQ ID NO: 522000

SEQ ID NO: 522937 - RNA, 64 nt, Human
cccaucggcccuguccccuggagugugucagagcccaggggagaaugcagcccaccaggagcac

SEQ ID NO: 522938 - RNA, 64 nt, Human
ucccaaggaaaacccaaaguggaggugcucagguccaggggaguccagugggcaggacccuugg

SEQ ID NO: 522939 - RNA, 64 nt, Human
cgccggcguucccgcuccgcuaaagauuucaaauccaggggauuccaugcucaauggaugaaug

SEQ ID NO: 522940 - RNA, 64 nt, Human
cagggcugggccauggggagggaaggacuuucucccaggggaagcccccagcccugugggucau

SEQ ID NO: 522941 - RNA, 64 nt, Human
ggcuaccagaggcugauuucuccccucuccugggccaggggagggguauuaucccugccuccug

SEQ ID NO: 522942 - RNA, 64 nt, Human
ccgaccaaaguaggcuggugaggaaguccaggcuccaggggaacagacgcugcccaguguucau

SEQ ID NO: 522943 - RNA, 64 nt, Human
ucccuuccuguucccuccugguccuggacaccucccaggggacuguuccuuauuucucucuccu

SEQ ID NO: 522944 - RNA, 64 nt, Human
aggccagggugggcaccaaagaccaggcccagagccaggggacagguuggggcugugggcuugg

SEQ ID NO: 522945 - RNA, 51 nt, Human
ugacggagacuaacgcauagcccaggggagugguuggcagcccucucaccc

SEQ ID NO: 522946 - RNA, 64 nt, Human
guguuccuggguuauuuacauagcugagcaguguccaggggaggugcgcagugaacugucaagg

SEQ ID NO: 522947 - RNA, 64 nt, Human
caucaucaagagaguucugcuggucagcccugcuccaggggaugccucugccuucgcauagcac

SEQ ID NO: 522948 - RNA, 64 nt, Human
caaaaaacugcuccuucacccucacccugaggccccaggggagaggacccgugggauggugccc

SEQ ID NO: 522949 - RNA, 64 nt, Human
caggggccacacggcgggaggaagggcucugagcccaggggaggggagggagcgaggggcucac

SEQ ID NO: 522950 - RNA, 64 nt, Human
cugucaggacccccggucacacaggaaccacccgccaggggagccugugacugucaguuccugu

SEQ ID NO: 522951 - RNA, 64 nt, Human
cuguggguggccugucccaggggccucgcuucccccaggggacucgccuucucucuccccaagg

SEQ ID NO: 522952 - RNA, 64 nt, Human
ccacauaccuggcccugugccuuggugugcuguauccauccauggggcugauuguauuuaccuu

SEQ ID NO: 522953 - RNA, 64 nt, Human
cuucccaagcgugagagagugacugacacuugguuccauccauuuaggggccuugccauccggg

SEQ ID NO: 522954 - RNA, 64 nt, Human
cauauuuccaguacauucuuucagagucuguuuuuccauccaaauauaagccccaggccauucc

SEQ ID NO: 522955 - RNA, 64 nt, Human
ggcugaacauggaccacgcaguugcgacaggaggccaggggaaaaaccccugcucacuuguuug

SEQ ID NO: 522956 - RNA, 64 nt, Human
ggaccguggaucaccugcaacaagcucugauacuccaggggauacuuaagcccucaucacuuca

SEQ ID NO: 522957 - RNA, 64 nt, Human
auccaaaacuucucuugaaaaguucagggaccguccaggggagauggggaggagauauggagug

SEQ ID NO: 522958 - RNA, 64 nt, Human
ucggaggaacaggccuugggcuguuuccgugugaccaggggaauguguggcccgcuggcagcca

SEQ ID NO: 522959 - RNA, 64 nt, Human
uuauccuaugggggccugagcaggauugagggagccaggggaggggcaggagucccagcaccau

SEQ ID NO: 522960 - RNA, 64 nt, Human
gagcccugccaggggcugugggccuacaaggcuuccaggggaugccauccagccuguaggaaac

SEQ ID NO: 522961 - RNA, 64 nt, Human
gcacgugaguugggggaugggauccuagguagggccaggggaggagacccauaaauguucccuu

SEQ ID NO: 522962 - RNA, 64 nt, Human
ccccuuccccauugccccagcuuagccucuucucccaggggagcuacucaggacucacguagca

SEQ ID NO: 522963 - RNA, 64 nt, Human
cuaccuugagcucacagagggacugucaucuaaaccaggggaaccacugaacuaaagcccaauu

SEQ ID NO: 522964 - RNA, 64 nt, Human
ccaccucccuucuucuaacuaaauauaaaaagauccaggggacauaaauguggagauuaaauaa

SEQ ID NO: 522965 - RNA, 64 nt, Human
ccaguucuguuccuucugacuagccccucuuccuccaggggagaacuuccaaauguuaauuuuu

SEQ ID NO: 522966 - RNA, 64 nt, Human
cccacccuccuggcagcagaugccuggggcaaggccaggggaaacugggggggccucagggaca

SEQ ID NO: 522967 - RNA, 64 nt, Human
gggggccgcggaggagccgaaagggcguugggauccaggggaagggucuguccugcgcuucgaa

SEQ ID NO: 522968 - RNA, 64 nt, Human
cagcugcgagcaugugcacuaaacgcagcccuuuccaggggaagagaacaggauggagaaugga

SEQ ID NO: 522969 - RNA, 64 nt, Human
gauaaaagugaguguguuuugucgggagggaacuccaggggaagugaggggagaagguucccca

SEQ ID NO: 522970 - RNA, 64 nt, Human
cauauguucauuuuaaucucugggagauuauuuuuccauccagggugccaucaguaaucaugcc

SEQ ID NO: 522971 - RNA, 64 nt, Human
ugccuucuuccguccgcagugcgccuucuagugcuccauccaccccucucuccacagacgcacc

SEQ ID NO: 522972 - RNA, 64 nt, Human
guaaaagcagccaccccuucaagagucacaggcauccauccagucguaucuuucagagaaaaaa

SEQ ID NO: 522973 - RNA, 64 nt, Human
ucaccugugucccagcccucugaugguggugagaccaggggaaaggccagcucagagggugguc

SEQ ID NO: 522974 - RNA, 64 nt, Human
gguacugucugggccugggaggcgagagcagugcccaggggacuucugggcuuacaggacagcg

SEQ ID NO: 522975 - RNA, 64 nt, Human
cucgcgggcugggaaggauucacucucuuuagccccaggggagcagcucagcuuagcccagcau

SEQ ID NO: 522976 - RNA, 64 nt, Human
caccugacauuaaagaagcaagccaagugaggagccaggggagauaagcauuccuggcaaagag

SEQ ID NO: 522977 - RNA, 64 nt, Human
aaagaaaacuuacuguaucauauaacagaaugauccaggggagauuaagcuuugggcaagggcu

SEQ ID NO: 522978 - RNA, 64 nt, Human
augccccgccaaguacugcacagggaccccccacccaggggaccugcuccgugagauaauguga

SEQ ID NO: 522979 - RNA, 64 nt, Human
ugucgcgggggugcguggcgcuugcgagcccuggccaggggaggaagugaggcccaggcaccug

SEQ ID NO: 522980 - RNA, 64 nt, Human
uggcccaggacagcugagaggagguggaggggccccaggggaguguacgucaggcuuugcgggg

SEQ ID NO: 522981 - RNA, 64 nt, Human
ucagggagcagggccaggcgggcucgggggccggccaggggagcaccccacucaacuacucaga

SEQ ID NO: 522982 - RNA, 64 nt, Human
ccaggcucucugguggccgccccugugcaccuggccaggggaagcccgggggucuggggccucc

SEQ ID NO: 522983 - RNA, 64 nt, Human
ggccccccuccccacuuggccacccagcugccugccaggggagaccugggaccuggacggccac

SEQ ID NO: 522984 - RNA, 64 nt, Human
gucccaggauccuggagagggagaacuccuggccccaggggaaagaggggggggucucccguuu

SEQ ID NO: 522985 - RNA, 64 nt, Human
agcgugauucucccaucugaggcaaucuugccucccaggggaaauuuugcaauguuuggaggau

SEQ ID NO: 522986 - RNA, 64 nt, Human
ccccuagccgucaucuccacacucaccaggcccaccaggggagggggcuggccugggggucuug

SEQ ID NO: 522987 - RNA, 64 nt, Human
aagauacaagaggcaguaggaccuggguuggaacccaggggagcagacuggggggcuguugccc

SEQ ID NO: 522988 - RNA, 64 nt, Human
aguccugcuucuccgcaauggcacaugcuuccacuccauccauacuggcauccucaaauaaaca

SEQ ID NO: 522989 - RNA, 64 nt, Human
ucagcuuguuuuuuggcuccaguaggaaaaaaaauccauccaucugagaugggguccuguuguu

SEQ ID NO: 522990 - RNA, 64 nt, Human
ggggggccuugcucugggcauguggggcucuuccuccauccagagcuggcccaagacccuuaga

SEQ ID NO: 522991 - RNA, 64 nt, Human
caacaccccggccucggggcuccugguggcagcaccaggggacacaccugccaaacccaccaga

SEQ ID NO: 522992 - RNA, 64 nt, Human
gaugcugucacucagccagaucaguauugacccaccaggggaggugggguuuggugagagacgc

SEQ ID NO: 522993 - RNA, 64 nt, Human
cugacuuuacguuggccccuccucugccaagcccccaggggagcccucccuggcguccgagggu

SEQ ID NO: 522994 - RNA, 64 nt, Human
caccugcaauaaaacagucuugucggccagcugcccaggggacggcagcuacagcagccucugc

SEQ ID NO: 522995 - RNA, 64 nt, Human
cgaggcgggugacgcgcccccugaugaugggccuccaggggagcucgggccugacggcccugac

SEQ ID NO: 522996 - RNA, 64 nt, Human
uuccugccuuuauucucugccccuguaucacucuccaggggacucuugauauuacuuagaucug

SEQ ID NO: 522997 - RNA, 64 nt, Human
ugggcuggggggagaggcuggagcaccccaaaagccaggggaaaguggagggagagaaacguga

SEQ ID NO: 522998 - RNA, 64 nt, Human
cuagccuuggggggacaagccucucucagcuacgccaggggaaaagagaguuaaggacacucac

SEQ ID NO: 522999 - RNA, 64 nt, Human
augaccccccuuccuguacccgaaguccagacucccaggggaaucagcagccaggacagacauc

SEQ ID NO: 523000 - RNA, 64 nt, Human
ucaugagccugcagaacugcuuuccuauguuuacccaggggaccuccuuucagaugaacuggga

SEQ ID NO: 523001 - RNA, 64 nt, Human
aaaaagaauggaacauugaagagcaguacaaaaaccaggggagaaaucucaggugagucacacu

SEQ ID NO: 523002 - RNA, 64 nt, Human
gggggaaguguagugaggaggagcccagaggaccccaggggagugaggagggagaacuuggaag

SEQ ID NO: 523003 - RNA, 64 nt, Human
guguuaggggcggugguggaggugggaucagcggccaggggaugccucagggccuggcccuccu

SEQ ID NO: 523004 - RNA, 64 nt, Human
agaugcuggacacugacagccaaauguccucacuccaggggagccccagacgcuccgcucccug

SEQ ID NO: 523005 - RNA, 64 nt, Human
ccuucgccugccaugggcuucacccacccccacgccaggggagaggauccuucagcagagagga

SEQ ID NO: 523006 - RNA, 64 nt, Human
ucauuuauguggcauuugcuuaggauuccagaucuccauccacuuuucuccugggggcugggcu

SEQ ID NO: 523007 - RNA, 64 nt, Human
acaucgagcccaugcuuuguuugauuuguucuauuccauccauugucccuuuuguuacugacag

SEQ ID NO: 523008 - RNA, 64 nt, Human
cucaccuggaaccugauauaacucaggcugcaauuccauccaguucccacaucaacggagccac

SEQ ID NO: 523009 - RNA, 64 nt, Human
aaggucuacucccuccucaccccacccuggagggccaggggaguggagagagcuccugaugucu

SEQ ID NO: 523010 - RNA, 64 nt, Human
cuacuagccccaacgccggggcuuugcauggggcccaggggaggccugagcuuggauuuacacu

SEQ ID NO: 523011 - RNA, 64 nt, Human
ccacuuaggaggcccaacugcccaccccaaguccccaggggauggcccucccccucuaccaagc

SEQ ID NO: 523012 - RNA, 64 nt, Human
gcugucagacaggcugggggccucacucuguuuuccaggggagaaaccugagucucagagcagg

SEQ ID NO: 523013 - RNA, 64 nt, Human
ugcccuccacccagccuccuggacucggccuggaccaggggaccucgggacugcgcgugaggcc

SEQ ID NO: 523014 - RNA, 64 nt, Human
aguuaagggaugaaggcaaggcugcaggucuggcccaggggaauuaaaagccagccacuccagu

SEQ ID NO: 523015 - RNA, 64 nt, Human
accacaggacccuucggcucaccaagaacagggcccaggggagucaggccuauucgcugcacuu

SEQ ID NO: 523016 - RNA, 64 nt, Human
gcuggcacuaggggccacuggggggcuggggucuccaggggaugacuguuuucaaucucugggc

SEQ ID NO: 523017 - RNA, 64 nt, Human
ugggcacuggcuuggacuuuagcggggagggaagccaggggauuuugaaggguggacauuaggg

SEQ ID NO: 523018 - RNA, 64 nt, Human
gccucuuugcuguuucucugggcuccugagcauaccaggggaaguucuagaaaccgcagcugac

SEQ ID NO: 523019 - RNA, 64 nt, Human
ccacuuucauacucacguccucauccuuggauacccaggggagggcgaaccguuuucgcucgug

SEQ ID NO: 523020 - RNA, 64 nt, Human
accacuucccugcuuuucucccagaaggcuggguccaggggagggaaaagcuaagagggugaac

SEQ ID NO: 523021 - RNA, 64 nt, Human
uggguagaugggaguggggcucggucccccaggcccaggggacucucuccacucuuuccugggc

SEQ ID NO: 523022 - RNA, 64 nt, Human
gggguucagaaaauaaaaugccgcgcagcccuugccaggggaagugucgcuucagguguguccu

SEQ ID NO: 523023 - RNA, 64 nt, Human
aggacagagugcccuggggcauccaccuuccugcccaggggacguggcgcugucgguguuugga

SEQ ID NO: 523024 - RNA, 64 nt, Human
caucauggugucuggaaggcuuagaugcauuggcuccauccaacaccugaaaaacaaacuuggc

SEQ ID NO: 523025 - RNA, 64 nt, Human
gccucugcacuugggcuccccuccugcccugcauuccauccauccucacucagcugcugccuac

SEQ ID NO: 523026 - RNA, 64 nt, Human
cagacaaacuauuuucuuuugaccuuucuuccccuccauccaguauuucgguugauuucauuuu

SEQ ID NO: 523027 - RNA, 64 nt, Human
cgagcacugggcccugccugggggcucccgggagccaggggagaugcuaccucggaagcugaag

SEQ ID NO: 523028 - RNA, 64 nt, Human
gagagagaccugggaaaaguccaggguagcuugcccaggggaagacagcagccacauaccuggg

SEQ ID NO: 523029 - RNA, 64 nt, Human
cucagagacacugcuuuccaacuuaccucgagucccaggggaggaaaaugaaaaagcagacgcu

SEQ ID NO: 523030 - RNA, 64 nt, Human
gggagcagggaaaggugcccccacuccccgagagccaggggaaggaguggcucugggcagagag

SEQ ID NO: 523031 - RNA, 64 nt, Human
gacgcaccucgaggguguccgccggccccagcacccaggggacgcgcuggaaagcaaacaggaa

SEQ ID NO: 523032 - RNA, 64 nt, Human
cucuguggucccuuccaaugcuguggguuuccaaccaggggaagggucccuuuugcauugccaa

SEQ ID NO: 523033 - RNA, 64 nt, Human
cccagcuuuuccuaucagaggcgauuuuccuucaccaggggaugggcaggaaagaggcaggggc

SEQ ID NO: 523034 - RNA, 64 nt, Human
cuggaguguugaggggguuguaccugccagacuuccaggggacgauggaauacccagaacgcuc

SEQ ID NO: 523035 - RNA, 64 nt, Human
uuucuuugugcagcggucugguuaucgucuauccccaggggaauccacacagcccgcucccagg

SEQ ID NO: 523036 - RNA, 64 nt, Human
ggaagggcugugaaggccuccaggcuggccccuuccaggggaauccuggaggccuggggugggc

SEQ ID NO: 523037 - RNA, 64 nt, Human
auuugaggggccacugcagccccaccgccacgccccaggggaccagccaggccuggaaugcccc

SEQ ID NO: 523038 - RNA, 64 nt, Human
guaacagagcagugccagagcaugggcccaggucccaggggagagguuggggcuggcaggccac

SEQ ID NO: 523039 - RNA, 64 nt, Human
uucuuucugguuuuggcagucacuggaucaggauccaggggagggagauggaggcacccaaacu

SEQ ID NO: 523040 - RNA, 64 nt, Human
uaacaggaaacacuucucacccccucacacaggcccaggggagccccuggagggaaauuccuug

SEQ ID NO: 523041 - RNA, 64 nt, Human
ccaccugggggugucgcaguugaggggcuaauucccaggggacugacguuaguucccuacucca

SEQ ID NO: 523042 - RNA, 64 nt, Human
agcacuuuuagaaaucuucucugaccuagaagaauccauccaaaucccugccuuccucucugaa

SEQ ID NO: 523043 - RNA, 64 nt, Human
aguucccuucucugacaggggccauccucuaucuuccauccagcggcucuucuuuuuaggaagg

SEQ ID NO: 523044 - RNA, 64 nt, Human
ucaaaaggucuugcugcugucagguguuaugcacuccauccaucauaacuguaugaaacacauu

SEQ ID NO: 523045 - RNA, 64 nt, Human
uaacagacguuaagaccaagccguggaccucaccccaggggaaugccacggcccuuuggggacc

SEQ ID NO: 523046 - RNA, 64 nt, Human
ugcucauuguuuuucccuuuauuacacaggacagccaggggaggaggggggcccagcccuggga

SEQ ID NO: 523047 - RNA, 64 nt, Human
guggcucgggagcagacgcaggccucuccauuguccaggggagccuggcggcgcaucccuccuc

SEQ ID NO: 523048 - RNA, 64 nt, Human
gcugcuaaaaggccuugugagguggccccacccuccaggggagcuggugaagaugggccacaga

SEQ ID NO: 523049 - RNA, 64 nt, Human
ggacagccuuuguuuucugagauaccaaagagagccaggggagggccccggguucggcggccag

SEQ ID NO: 523050 - RNA, 64 nt, Human
ugcagcccagcccgccugagacacgacgccugccccaggggacugucaggcacagaagcggccu

SEQ ID NO: 523051 - RNA, 64 nt, Human
gaccccacccaaaggggccuggagcugcaggaucccaggggaagggucucucucugcaucccaa

SEQ ID NO: 523052 - RNA, 64 nt, Human
caagagcccugaccacagggugagacagcagggcccaggggaguggaccagcccccagcaaauu

SEQ ID NO: 523053 - RNA, 64 nt, Human
gaagauaaauuuucugcccugugagugacacuggccaggggauagguugaggcagauggugccc

SEQ ID NO: 523054 - RNA, 64 nt, Human
guuuugcaaacaaacaaaaagagaaaaaucccagccaggggaacucgccaccugcccacgcuag

SEQ ID NO: 523055 - RNA, 64 nt, Human
gcaccccaggccccugggaggugaguuagacagcccaggggaccagguggaccaggugguggcc

SEQ ID NO: 523056 - RNA, 64 nt, Human
ggcagcuuccagcagaagucacgcuccccaucccccaggggacauaggaccuuuuuccugcuuc

SEQ ID NO: 523057 - RNA, 64 nt, Human
ggcccagcccugcucuguuguggggaguuggcccccaggggaaagggcugugagcugcuccgcc

SEQ ID NO: 523058 - RNA, 64 nt, Human
cuuguuucuggaccacugggagcagcacugcagcccaggggagcuggaguccagcuuggagcag

SEQ ID NO: 523059 - RNA, 64 nt, Human
cuaguggggaucuguccuaagcugaguacagcagccaggggaccagaacuguguggggaggucc

SEQ ID NO: 523060 - RNA, 64 nt, Human
caccagccaccucauccccaacccccuguaagguuccauccaccccugcgucgagcugggaagg

SEQ ID NO: 523061 - RNA, 64 nt, Human
ccuccucccugcccucgggucuccccaccugcacuccauccagcuacaggagagauagaagccu

SEQ ID NO: 523062 - RNA, 64 nt, Human
ugaguuaggacaugcuaucaguaauagucccaguuccauccaacuuucugaaauuucauuuuuu

SEQ ID NO: 523063 - RNA, 64 nt, Human
guuuguagcagggccacaaaacaaagugaaacguccaggggaacccaacaguccuaugucaucu

SEQ ID NO: 523064 - RNA, 64 nt, Human
ggggggagggggcaggccaaugaggucugcauggccaggggaccuucaaggugcguaaaguccc

SEQ ID NO: 523065 - RNA, 64 nt, Human
accaagggcuugggccucucggggcuggggccucccaggggauggggacccagagugcaguggc

SEQ ID NO: 523066 - RNA, 64 nt, Human
cccaggggccugaaaaggaaggaccaggcuggggccaggggaccuuccugucuccgccuuucua

SEQ ID NO: 523067 - RNA, 64 nt, Human
gagggggcuucucaguccugugccguccucccauccaggggaguggcuggcucaagccuggguc

SEQ ID NO: 523068 - RNA, 64 nt, Human
cccaucucuuuuuaagaagugacugcuguuggggccaggggacaucaugggagguggggcuguc

SEQ ID NO: 523069 - RNA, 64 nt, Human
ugcugaguccagaggcagucacagagaccucuggccaggggauccuaacuggguucuugggguc

SEQ ID NO: 523070 - RNA, 64 nt, Human
uccuguagcccgccucaugcacugaccacagcccccaggggaggaugguacuggaucuggcccc

SEQ ID NO: 523071 - RNA, 64 nt, Human
gagaggcgcugaguggaaccacgaugggcugaggccaggggagacaucacaaccuccaacaaca

SEQ ID NO: 523072 - RNA, 64 nt, Human
aagggccgcggccuccuccacacacacacacacaccaggggaaccaagagaaccacguagaauc

SEQ ID NO: 523073 - RNA, 64 nt, Human
acccuggagcuccucccgggaccuugcaagccucuccauccagcaucuucucuaucuuaguuga

SEQ ID NO: 523074 - RNA, 64 nt, Human
aucaaaggugcugggacaucccaggguggugagauccauccacgauccagcuccgguggagaaa

SEQ ID NO: 523075 - RNA, 64 nt, Human
uccacacaggucuccagaagcccugcauugaauauccauccacacuuugguuuuccuucagaca

SEQ ID NO: 523076 - RNA, 64 nt, Human; identical to SEQ ID NO: 223298

SEQ ID NO: 523077 - RNA, 64 nt, Human; identical to SEQ ID NO: 223299

SEQ ID NO: 523078 - RNA, 64 nt, Human; identical to SEQ ID NO: 223300

SEQ ID NO: 523079 - RNA, 64 nt, Human; identical to SEQ ID NO: 223301

SEQ ID NO: 523080 - RNA, 64 nt, Human; identical to SEQ ID NO: 223302

SEQ ID NO: 523081 - RNA, 64 nt, Human; identical to SEQ ID NO: 223303

SEQ ID NO: 523082 - RNA, 64 nt, Human; identical to SEQ ID NO: 223304

SEQ ID NO: 523083 - RNA, 64 nt, Human; identical to SEQ ID NO: 223305

SEQ ID NO: 523084 - RNA, 64 nt, Human; identical to SEQ ID NO: 223306

SEQ ID NO: 523085 - RNA, 64 nt, Human; identical to SEQ ID NO: 223307

SEQ ID NO: 523086 - RNA, 64 nt, Human; identical to SEQ ID NO: 223308

SEQ ID NO: 523087 - RNA, 64 nt, Human; identical to SEQ ID NO: 223309

SEQ ID NO: 523088 - RNA, 64 nt, Human; identical to SEQ ID NO: 223310

SEQ ID NO: 523089 - RNA, 64 nt, Human; identical to SEQ ID NO: 223311

SEQ ID NO: 523090 - RNA, 64 nt, Human
gaugguaugauucuauuauauauuuuauauaaaauccauccaaauuaaguuuuggguaagugug

SEQ ID NO: 523091 - RNA, 64 nt, Human
uucuuccuuugcuaaauucaggcugcaggcuccuuccauccagauaacuccauccugucgagua

SEQ ID NO: 523092 - RNA, 64 nt, Human
accgucacuuaaaaccuaagacauguggcgaaauuccauccaguucuaagugaaagaguuucag

SEQ ID NO: 523093 - RNA, 64 nt, Human; identical to SEQ ID NO: 223312

SEQ ID NO: 523094 - RNA, 64 nt, Human; identical to SEQ ID NO: 223313

SEQ ID NO: 523095 - RNA, 64 nt, Human; identical to SEQ ID NO: 223314

SEQ ID NO: 523096 - RNA, 64 nt, Human; identical to SEQ ID NO: 222683

SEQ ID NO: 523097 - RNA, 64 nt, Human; identical to SEQ ID NO: 215633

SEQ ID NO: 523098 - RNA, 64 nt, Human; identical to SEQ ID NO: 223058

SEQ ID NO: 523099 - RNA, 64 nt, Human; identical to SEQ ID NO: 223059

SEQ ID NO: 523100 - RNA, 64 nt, Human; identical to SEQ ID NO: 223060

SEQ ID NO: 523101 - RNA, 64 nt, Human; identical to SEQ ID NO: 223184

SEQ ID NO: 523102 - RNA, 64 nt, Human; identical to SEQ ID NO: 215634

SEQ ID NO: 523103 - RNA, 64 nt, Human; identical to SEQ ID NO: 223094

SEQ ID NO: 523104 - RNA, 64 nt, Human; identical to SEQ ID NO: 223095

SEQ ID NO: 523105 - RNA, 64 nt, Human; identical to SEQ ID NO: 223096

SEQ ID NO: 523106 - RNA, 64 nt, Human; identical to SEQ ID NO: 223238

SEQ ID NO: 523107 - RNA, 64 nt, Human; identical to SEQ ID NO: 215651

SEQ ID NO: 523108 - RNA, 64 nt, Human
ccucuucccuuccuccauugcacaugaacauauguccauccauauauauucaucagaauguuaa

SEQ ID NO: 523109 - RNA, 64 nt, Human
aaauagcccagaucccaagagauuauguaacuccuccauccauguguuccaaauuugcuuuaca

SEQ ID NO: 523110 - RNA, 64 nt, Human
accccuugccugacccucagggagucagccugcuuccauccaugggugggaagacuucagcaca

SEQ ID NO: 523111 - RNA, 64 nt, Human; identical to SEQ ID NO: 223130

SEQ ID NO: 523112 - RNA, 64 nt, Human; identical to SEQ ID NO: 223131

SEQ ID NO: 523113 - RNA, 64 nt, Human; identical to SEQ ID NO: 223132

SEQ ID NO: 523114 - RNA, 64 nt, Human; identical to SEQ ID NO: 223022

SEQ ID NO: 523115 - RNA, 64 nt, Human; identical to SEQ ID NO: 215652

SEQ ID NO: 523116 - RNA, 64 nt, Human; identical to SEQ ID NO: 223148

SEQ ID NO: 523117 - RNA, 64 nt, Human; identical to SEQ ID NO: 223149

SEQ ID NO: 523118 - RNA, 64 nt, Human; identical to SEQ ID NO: 223150

SEQ ID NO: 523119 - RNA, 64 nt, Human; identical to SEQ ID NO: 223185

SEQ ID NO: 523120 - RNA, 64 nt, Human; identical to SEQ ID NO: 215653

SEQ ID NO: 523121 - RNA, 64 nt, Human; identical to SEQ ID NO: 223166

SEQ ID NO: 523122 - RNA, 64 nt, Human; identical to SEQ ID NO: 223167

SEQ ID NO: 523123 - RNA, 64 nt, Human; identical to SEQ ID NO: 223168

SEQ ID NO: 523124 - RNA, 64 nt, Human; identical to SEQ ID NO: 222968

SEQ ID NO: 523125 - RNA, 64 nt, Human; identical to SEQ ID NO: 221857

SEQ ID NO: 523126 - RNA, 64 nt, Human
uuucucucugcccucuagagcaaggcccaccagguccauccaggaggcucuccugaccucaagu

SEQ ID NO: 523127 - RNA, 64 nt, Human
guuaaaagcauggacugugccacacacccagugauccauccaaaaacaaggacugcagccuaaa

SEQ ID NO: 523128 - RNA, 64 nt, Human
aagcuccgccggcgaccagacuccugccacgccuuccauccagaggugcggguugaggcggauc

SEQ ID NO: 523129 - RNA, 64 nt, Human; identical to SEQ ID NO: 223202

SEQ ID NO: 523130 - RNA, 57 nt, Human; identical to SEQ ID NO: 223203

SEQ ID NO: 523131 - RNA, 64 nt, Human; identical to SEQ ID NO: 223204

SEQ ID NO: 523132 - RNA, 64 nt, Human; identical to SEQ ID NO: 223220

SEQ ID NO: 523133 - RNA, 64 nt, Human; identical to SEQ ID NO: 221858

SEQ ID NO: 523134 - RNA, 64 nt, Human; identical to SEQ ID NO: 223221

SEQ ID NO: 523135 - RNA, 64 nt, Human; identical to SEQ ID NO: 223222

SEQ ID NO: 523136 - RNA, 64 nt, Human; identical to SEQ ID NO: 223023

SEQ ID NO: 523137 - RNA, 64 nt, Human; identical to SEQ ID NO: 221875

SEQ ID NO: 523138 - RNA, 64 nt, Human; identical to SEQ ID NO: 223256

SEQ ID NO: 523139 - RNA, 57 nt, Human; identical to SEQ ID NO: 223257

SEQ ID NO: 523140 - RNA, 64 nt, Human; identical to SEQ ID NO: 223258

SEQ ID NO: 523141 - RNA, 64 nt, Human; identical to SEQ ID NO: 222969

SEQ ID NO: 523142 - RNA, 64 nt, Human; identical to SEQ ID NO: 221876

SEQ ID NO: 523143 - RNA, 64 nt, Human; identical to SEQ ID NO: 223274

SEQ ID NO: 523144 - RNA, 64 nt, Human
ccccauugggugggcaugugaagcccagcucuguuccauccaggugccucgggccugaggaguc

SEQ ID NO: 523145 - RNA, 64 nt, Human
ccccuuggagacacccccccucccaaaagccauguccauccagcccuuccccccaaaccuagca

SEQ ID NO: 523146 - RNA, 64 nt, Human
auaaauuaucagucugggugggaaagcccccaccuccauccauuuuccugcuuagggucccugg

SEQ ID NO: 523147 - RNA, 64 nt, Human; identical to SEQ ID NO: 223275

SEQ ID NO: 523148 - RNA, 64 nt, Human; identical to SEQ ID NO: 223276

SEQ ID NO: 523149 - RNA, 64 nt, Human; identical to SEQ ID NO: 222932

SEQ ID NO: 523150 - RNA, 64 nt, Human; identical to SEQ ID NO: 221877

SEQ ID NO: 523151 - RNA, 64 nt, Human; identical to SEQ ID NO: 223292

SEQ ID NO: 523152 - RNA, 64 nt, Human; identical to SEQ ID NO: 223293

SEQ ID NO: 523153 - RNA, 64 nt, Human; identical to SEQ ID NO: 223294

SEQ ID NO: 523154 - RNA, 64 nt, Human; identical to SEQ ID NO: 222914

SEQ ID NO: 523155 - RNA, 64 nt, Human; identical to SEQ ID NO: 221894

SEQ ID NO: 523156 - RNA, 64 nt, Human; identical to SEQ ID NO: 222878

SEQ ID NO: 523157 - RNA, 64 nt, Human; identical to SEQ ID NO: 222879

SEQ ID NO: 523158 - RNA, 64 nt, Human; identical to SEQ ID NO: 222880

SEQ ID NO: 523159 - RNA, 64 nt, Human; identical to SEQ ID NO: 222933

SEQ ID NO: 523160 - RNA, 64 nt, Human; identical to SEQ ID NO: 221895

SEQ ID NO: 523161 - RNA, 64 nt, Human; identical to SEQ ID NO: 222896

SEQ ID NO: 523162 - RNA, 64 nt, Human
auaauacauuucuuccuggacaguugauaaaaguuccauccauagcauauuuccagaauauccc

SEQ ID NO: 523163 - RNA, 64 nt, Human
gguacuucguggccgcacauccuacaguuggaaauccauccagaggccauguuccaauaaacag

SEQ ID NO: 523164 - RNA, 64 nt, Human
ccggcucccuccagacaaugccagcauaaauccauccauccaaaggcagagaaccaaaggggcc

SEQ ID NO: 523165 - RNA, 64 nt, Human; identical to SEQ ID NO: 222897

SEQ ID NO: 523166 - RNA, 64 nt, Human; identical to SEQ ID NO: 222898

SEQ ID NO: 523167 - RNA, 64 nt, Human; identical to SEQ ID NO: 222970

SEQ ID NO: 523168 - RNA, 64 nt, Human; identical to SEQ ID NO: 221896

SEQ ID NO: 523169 - RNA, 64 nt, Human; identical to SEQ ID NO: 222915

SEQ ID NO: 523170 - RNA, 64 nt, Human; identical to SEQ ID NO: 222916

SEQ ID NO: 523171 - RNA, 64 nt, Human; identical to SEQ ID NO: 222934

SEQ ID NO: 523172 - RNA, 64 nt, Human; identical to SEQ ID NO: 221913

SEQ ID NO: 523173 - RNA, 64 nt, Human; identical to SEQ ID NO: 222986

SEQ ID NO: 523174 - RNA, 64 nt, Human; identical to SEQ ID NO: 222987

SEQ ID NO: 523175 - RNA, 64 nt, Human; identical to SEQ ID NO: 222988

SEQ ID NO: 523176 - RNA, 64 nt, Human; identical to SEQ ID NO: 223004

SEQ ID NO: 523177 - RNA, 64 nt, Human; identical to SEQ ID NO: 221914

SEQ ID NO: 523178 - RNA, 64 nt, Human; identical to SEQ ID NO: 223005

SEQ ID NO: 523179 - RNA, 64 nt, Human; identical to SEQ ID NO: 223006

SEQ ID NO: 523180 - RNA, 64 nt, Human
uauauuaccagaugaaaggauaaacaaaauaugguccauccauacaauggaguauuacacagcc

SEQ ID NO: 523181 - RNA, 64 nt, Human
gagagaccagggaccaucacauggguagggauuuuccauccagagccaauaaaaggacuggugg

SEQ ID NO: 523182 - RNA, 64 nt, Human
uuaugcaugagacuguacugguaagacuuguaucuccauccaccugaaggagaauugcuggcuc

SEQ ID NO: 523183 - RNA, 64 nt, Human; identical to SEQ ID NO: 222755

SEQ ID NO: 523184 - RNA, 64 nt, Human; identical to SEQ ID NO: 221915

SEQ ID NO: 523185 - RNA, 64 nt, Human; identical to SEQ ID NO: 223024

SEQ ID NO: 523186 - RNA, 64 nt, Human; identical to SEQ ID NO: 223076

SEQ ID NO: 523187 - RNA, 64 nt, Human; identical to SEQ ID NO: 221931

SEQ ID NO: 523188 - RNA, 64 nt, Human; identical to SEQ ID NO: 223077

SEQ ID NO: 523189 - RNA, 64 nt, Human; identical to SEQ ID NO: 223078

SEQ ID NO: 523190 - RNA, 64 nt, Human; identical to SEQ ID NO: 222842

SEQ ID NO: 523191 - RNA, 64 nt, Human; identical to SEQ ID NO: 221932

SEQ ID NO: 523192 - RNA, 64 nt, Human; identical to SEQ ID NO: 223112

SEQ ID NO: 523193 - RNA, 64 nt, Human; identical to SEQ ID NO: 223113

SEQ ID NO: 523194 - RNA, 64 nt, Human; identical to SEQ ID NO: 223114

SEQ ID NO: 523195 - RNA, 64 nt, Human; identical to SEQ ID NO: 222773

SEQ ID NO: 523196 - RNA, 64 nt, Human; identical to SEQ ID NO: 221933

SEQ ID NO: 523197 - RNA, 64 nt, Human; identical to SEQ ID NO: 223186

SEQ ID NO: 523198 - RNA, 64 nt, Human
ccugcacuuguggccucgaaggaagcacaaacccuccauccacuucccauuuccucugcccuuu

SEQ ID NO: 523199 - RNA, 64 nt, Human
aaccaaggaaggagccccugaguccgccugcgccuccauccaucuguccguccagagccggcau

SEQ ID NO: 523200 - RNA, 64 nt, Human
aguuggaaaaacuauuauuaauaauauuauccuauccauccauaucuauugaaauuguacaggu

SEQ ID NO: 523201 - RNA, 58 nt, Human; identical to SEQ ID NO: 222737

SEQ ID NO: 523202 - RNA, 64 nt, Human; identical to SEQ ID NO: 222006

SEQ ID NO: 523203 - RNA, 64 nt, Human; identical to SEQ ID NO: 222007

SEQ ID NO: 523204 - RNA, 64 nt, Human; identical to SEQ ID NO: 222008

SEQ ID NO: 523205 - RNA, 64 nt, Human; identical to SEQ ID NO: 222738

SEQ ID NO: 523206 - RNA, 64 nt, Human; identical to SEQ ID NO: 222739

SEQ ID NO: 523207 - RNA, 64 nt, Human; identical to SEQ ID NO: 222665

SEQ ID NO: 523208 - RNA, 64 nt, Human; identical to SEQ ID NO: 222666

SEQ ID NO: 523209 - RNA, 64 nt, Human; identical to SEQ ID NO: 222667

SEQ ID NO: 523210 - RNA, 64 nt, Human; identical to SEQ ID NO: 222684

SEQ ID NO: 523211 - RNA, 64 nt, Human; identical to SEQ ID NO: 222685

SEQ ID NO: 523212 - RNA, 64 nt, Human; identical to SEQ ID NO: 222701

SEQ ID NO: 523213 - RNA, 64 nt, Human; identical to SEQ ID NO: 222702

SEQ ID NO: 523214 - RNA, 64 nt, Human; identical to SEQ ID NO: 222703

SEQ ID NO: 523215 - RNA, 64 nt, Human; identical to SEQ ID NO: 222719

SEQ ID NO: 523216 - RNA, 64 nt, Human
agccucccuaccacgacauccaacagcuggaacuuccauccaguccuucacaugaugggcaccu

SEQ ID NO: 523217 - RNA, 64 nt, Human
cuccaucccccacuucaccccaucccauaccaguuccauccagggucugcuuaacugccaagag

SEQ ID NO: 523218 - RNA, 64 nt, Human
uugggaauugaagauugacuuugugcuuccacccuccauccagaaaggcacccuucauuccacc

SEQ ID NO: 523219 - RNA, 64 nt, Human; identical to SEQ ID NO: 222720

SEQ ID NO: 523220 - RNA, 64 nt, Human; identical to SEQ ID NO: 222721

SEQ ID NO: 523221 - RNA, 64 nt, Human; identical to SEQ ID NO: 222756

SEQ ID NO: 523222 - RNA, 64 nt, Human; identical to SEQ ID NO: 222757

SEQ ID NO: 523223 - RNA, 64 nt, Human; identical to SEQ ID NO: 222774

SEQ ID NO: 523224 - RNA, 64 nt, Human; identical to SEQ ID NO: 222775

SEQ ID NO: 523225 - RNA, 64 nt, Human; identical to SEQ ID NO: 223315

SEQ ID NO: 523226 - RNA, 64 nt, Human; identical to SEQ ID NO: 223316

SEQ ID NO: 523227 - RNA, 64 nt, Human; identical to SEQ ID NO: 223317

SEQ ID NO: 523228 - RNA, 64 nt, Human; identical to SEQ ID NO: 223318

SEQ ID NO: 523229 - RNA, 64 nt, Human; identical to SEQ ID NO: 223319

SEQ ID NO: 523230 - RNA, 64 nt, Human; identical to SEQ ID NO: 223320

SEQ ID NO: 523231 - RNA, 64 nt, Human; identical to SEQ ID NO: 223321

SEQ ID NO: 523232 - RNA, 64 nt, Human; identical to SEQ ID NO: 223322

SEQ ID NO: 523233 - RNA, 64 nt, Human; identical to SEQ ID NO: 223323

SEQ ID NO: 523234 - RNA, 64 nt, Human
uagaugugaacugcucaacacacagaucuccuacuccauccaguccugaggagccuuaggaugc

SEQ ID NO: 523235 - RNA, 64 nt, Human
cucgucaccaccucugcaccugcugucuugagacuccauccagccccaggcacgccaccugcuc

SEQ ID NO: 523236 - RNA, 64 nt, Human
auuugugcuccucuggccaggaaagggaacagaguccauccaagcugccccccacucaucugcc

SEQ ID NO: 523237 - RNA, 64 nt, Human; identical to SEQ ID NO: 223324

SEQ ID NO: 523238 - RNA, 64 nt, Human; identical to SEQ ID NO: 223325

SEQ ID NO: 523239 - RNA, 64 nt, Human; identical to SEQ ID NO: 223326

SEQ ID NO: 523240 - RNA, 64 nt, Human; identical to SEQ ID NO: 223327

SEQ ID NO: 523241 - RNA, 64 nt, Human; identical to SEQ ID NO: 223328

SEQ ID NO: 523242 - RNA, 64 nt, Human; identical to SEQ ID NO: 223329

SEQ ID NO: 523243 - RNA, 64 nt, Human; identical to SEQ ID NO: 223330

SEQ ID NO: 523244 - RNA, 64 nt, Human; identical to SEQ ID NO: 223331

SEQ ID NO: 523245 - RNA, 64 nt, Human; identical to SEQ ID NO: 223332

SEQ ID NO: 523246 - RNA, 64 nt, Human; identical to SEQ ID NO: 223333

SEQ ID NO: 523247 - RNA, 64 nt, Human; identical to SEQ ID NO: 223334

SEQ ID NO: 523248 - RNA, 64 nt, Human; identical to SEQ ID NO: 223335

SEQ ID NO: 523249 - RNA, 64 nt, Human; identical to SEQ ID NO: 223336

SEQ ID NO: 523250 - RNA, 64 nt, Human; identical to SEQ ID NO: 223337

SEQ ID NO: 523251 - RNA, 64 nt, Human; identical to SEQ ID NO: 223338

SEQ ID NO: 523252 - RNA, 64 nt, Human
ugaucuuuuuucauucagcauaauucccuugaaauccauccaaguuguugcauguaugaauagu

SEQ ID NO: 523253 - RNA, 64 nt, Human
gguacaaagagaaaucucuaaaagaauaugaucuuccauccaaguggagggaaacuuuaaaaca

SEQ ID NO: 523254 - RNA, 64 nt, Human
ucaucuuccccauucugcugcugaaugccacacauccauccagucugagaaagugagagaggca

SEQ ID NO: 523255 - RNA, 64 nt, Human; identical to SEQ ID NO: 223339

SEQ ID NO: 523256 - RNA, 64 nt, Human; identical to SEQ ID NO: 223340

SEQ ID NO: 523257 - RNA, 64 nt, Human; identical to SEQ ID NO: 223341

SEQ ID NO: 523258 - RNA, 64 nt, Human; identical to SEQ ID NO: 223342

SEQ ID NO: 523259 - RNA, 64 nt, Human; identical to SEQ ID NO: 223343

SEQ ID NO: 523260 - RNA, 64 nt, Human; identical to SEQ ID NO: 223344

SEQ ID NO: 523261 - RNA, 64 nt, Human; identical to SEQ ID NO: 223345

SEQ ID NO: 523262 - RNA, 64 nt, Human; identical to SEQ ID NO: 223346

SEQ ID NO: 523263 - RNA, 64 nt, Human; identical to SEQ ID NO: 223347

SEQ ID NO: 523264 - RNA, 64 nt, Human; identical to SEQ ID NO: 223348

SEQ ID NO: 523265 - RNA, 64 nt, Human; identical to SEQ ID NO: 223349

SEQ ID NO: 523266 - RNA, 64 nt, Human; identical to SEQ ID NO: 223350

SEQ ID NO: 523267 - RNA, 64 nt, Human; identical to SEQ ID NO: 223351

SEQ ID NO: 523268 - RNA, 64 nt, Human; identical to SEQ ID NO: 223352

SEQ ID NO: 523269 - RNA, 64 nt, Human; identical to SEQ ID NO: 223353

SEQ ID NO: 523270 - RNA, 64 nt, Human
ggcugguuacagcuucagucccuuugucugucuguccauccauuccuccauccacccaucuguc

SEQ ID NO: 523271 - RNA, 64 nt, Human
cuucagucccuuugucugucuguccauccauuccuccauccacccaucuguccauccgcccauc

SEQ ID NO: 523272 - RNA, 64 nt, Human
cauccacccaucuguccauccgcccaucugcccguccauccauccauccacucuuccacccucu

SEQ ID NO: 523273 - RNA, 64 nt, Human; identical to SEQ ID NO: 223354

SEQ ID NO: 523274 - RNA, 64 nt, Human; identical to SEQ ID NO: 223355

SEQ ID NO: 523275 - RNA, 64 nt, Human; identical to SEQ ID NO: 223356

SEQ ID NO: 523276 - RNA, 64 nt, Human; identical to SEQ ID NO: 223357

SEQ ID NO: 523277 - RNA, 64 nt, Human; identical to SEQ ID NO: 223358

SEQ ID NO: 523278 - RNA, 64 nt, Human; identical to SEQ ID NO: 223359

SEQ ID NO: 523279 - RNA, 64 nt, Human; identical to SEQ ID NO: 223360

SEQ ID NO: 523280 - RNA, 64 nt, Human; identical to SEQ ID NO: 223361

SEQ ID NO: 523281 - RNA, 64 nt, Human; identical to SEQ ID NO: 223362

SEQ ID NO: 523282 - RNA, 64 nt, Human; identical to SEQ ID NO: 223363

SEQ ID NO: 523283 - RNA, 64 nt, Human; identical to SEQ ID NO: 223364

SEQ ID NO: 523284 - RNA, 64 nt, Human; identical to SEQ ID NO: 223365

SEQ ID NO: 523285 - RNA, 64 nt, Human; identical to SEQ ID NO: 223366

SEQ ID NO: 523286 - RNA, 64 nt, Human; identical to SEQ ID NO: 223367

SEQ ID NO: 523287 - RNA, 64 nt, Human; identical to SEQ ID NO: 223368

SEQ ID NO: 523288 - RNA, 64 nt, Human
cacccaucuguccauccgcccaucugcccguccauccauccauccacucuuccacccucuaccc

SEQ ID NO: 523289 - RNA, 64 nt, Human
caucuguccauccgcccaucugcccguccauccauccauccacucuuccacccucuaccccuua

SEQ ID NO: 523290 - RNA, 64 nt, Human
aaaacaguaguaggagcacuaggcuuucugggaguccauccagcuggaguggcuuugagugagu

SEQ ID NO: 523291 - RNA, 64 nt, Human; identical to SEQ ID NO: 223369

SEQ ID NO: 523292 - RNA, 64 nt, Human; identical to SEQ ID NO: 223370

SEQ ID NO: 523293 - RNA, 64 nt, Human; identical to SEQ ID NO: 223371

SEQ ID NO: 523294 - RNA, 64 nt, Human; identical to SEQ ID NO: 223372

SEQ ID NO: 523295 - RNA, 64 nt, Human; identical to SEQ ID NO: 223373

SEQ ID NO: 523296 - RNA, 64 nt, Human; identical to SEQ ID NO: 223374

SEQ ID NO: 523297 - RNA, 64 nt, Human; identical to SEQ ID NO: 223375

SEQ ID NO: 523298 - RNA, 53 nt, Human; identical to SEQ ID NO: 223376

SEQ ID NO: 523299 - RNA, 64 nt, Human; identical to SEQ ID NO: 223377

SEQ ID NO: 523300 - RNA, 64 nt, Human; identical to SEQ ID NO: 223378

SEQ ID NO: 523301 - RNA, 64 nt, Human; identical to SEQ ID NO: 223379

SEQ ID NO: 523302 - RNA, 64 nt, Human; identical to SEQ ID NO: 223380

SEQ ID NO: 523303 - RNA, 64 nt, Human; identical to SEQ ID NO: 223381

SEQ ID NO: 523304 - RNA, 64 nt, Human; identical to SEQ ID NO: 223382

SEQ ID NO: 523305 - RNA, 64 nt, Human; identical to SEQ ID NO: 223383

SEQ ID NO: 523306 - RNA, 64 nt, Human
gggggugacagaaccgagaagggggugacaguccuccauccacguggccucucucucucuccuc

SEQ ID NO: 523307 - RNA, 64 nt, Human
augccccucaucucuuccuuuugcccucgccucuuccauccaugucuuccaaggccugaugcau

SEQ ID NO: 523308 - RNA, 64 nt, Human
aggcacaucacacacacacuggcacacgcaggcauccauccauccgucauucauucaaauauuu

SEQ ID NO: 523309 - RNA, 61 nt, Human; identical to SEQ ID NO: 223384

SEQ ID NO: 523310 - RNA, 64 nt, Human; identical to SEQ ID NO: 223385

SEQ ID NO: 523311 - RNA, 64 nt, Human; identical to SEQ ID NO: 223386

SEQ ID NO: 523312 - RNA, 64 nt, Human; identical to SEQ ID NO: 223387

SEQ ID NO: 523313 - RNA, 64 nt, Human; identical to SEQ ID NO: 223388

SEQ ID NO: 523314 - RNA, 64 nt, Human; identical to SEQ ID NO: 223389

SEQ ID NO: 523315 - RNA, 64 nt, Human; identical to SEQ ID NO: 223390

SEQ ID NO: 523316 - RNA, 64 nt, Human; identical to SEQ ID NO: 223391

SEQ ID NO: 523317 - RNA, 64 nt, Human; identical to SEQ ID NO: 223392

SEQ ID NO: 523318 - RNA, 64 nt, Human; identical to SEQ ID NO: 223393

SEQ ID NO: 523319 - RNA, 64 nt, Human; identical to SEQ ID NO: 223394

SEQ ID NO: 523320 - RNA, 64 nt, Human; identical to SEQ ID NO: 223395

SEQ ID NO: 523321 - RNA, 64 nt, Human; identical to SEQ ID NO: 223396

SEQ ID NO: 523322 - RNA, 64 nt, Human; identical to SEQ ID NO: 223397

SEQ ID NO: 523323 - RNA, 64 nt, Human; identical to SEQ ID NO: 223398

SEQ ID NO: 523324 - RNA, 64 nt, Human
ccaugacuucccuucuauccccaugagccccuccuccauccagcgacaagccaugggcaugcau

SEQ ID NO: 523325 - RNA, 64 nt, Human
aagguagcuguaggguucucccauuuccagaggcuccauccacaccugccuucccacauucuga

SEQ ID NO: 523326 - RNA, 64 nt, Human
aagacugacuggaaucaagcugccgacagcuuucuccauccagauugugacgguugcuaccugg

SEQ ID NO: 523327 - RNA, 64 nt, Human; identical to SEQ ID NO: 223399

SEQ ID NO: 523328 - RNA, 64 nt, Human; identical to SEQ ID NO: 223400

SEQ ID NO: 523329 - RNA, 64 nt, Human; identical to SEQ ID NO: 223401

SEQ ID NO: 523330 - RNA, 64 nt, Human; identical to SEQ ID NO: 223402

SEQ ID NO: 523331 - RNA, 64 nt, Human; identical to SEQ ID NO: 223403

SEQ ID NO: 523332 - RNA, 64 nt, Human; identical to SEQ ID NO: 223404

SEQ ID NO: 523333 - RNA, 64 nt, Human; identical to SEQ ID NO: 223405

SEQ ID NO: 523334 - RNA, 64 nt, Human; identical to SEQ ID NO: 223406

SEQ ID NO: 523335 - RNA, 64 nt, Human; identical to SEQ ID NO: 223407

SEQ ID NO: 523336 - RNA, 64 nt, Human; identical to SEQ ID NO: 223408

SEQ ID NO: 523337 - RNA, 64 nt, Human; identical to SEQ ID NO: 223409

SEQ ID NO: 523338 - RNA, 64 nt, Human; identical to SEQ ID NO: 223410

SEQ ID NO: 523339 - RNA, 64 nt, Human; identical to SEQ ID NO: 223411

SEQ ID NO: 523340 - RNA, 64 nt, Human; identical to SEQ ID NO: 223412

SEQ ID NO: 523341 - RNA, 50 nt, Human; identical to SEQ ID NO: 223413

SEQ ID NO: 523342 - RNA, 64 nt, Human
cugagggcuucccuuggcuuccagaaggcagccuuccauccagacaagccagugagcucucccc

SEQ ID NO: 523343 - RNA, 64 nt, Human
cacagcagacaauacacacccacucgcacaagcuuccauccacauguguuguacuuucagcucu

SEQ ID NO: 523344 - RNA, 64 nt, Human
agccuuuauagcucucuuuagcucaaccacucuguccauccagccaauggaugucccuuccccu

SEQ ID NO: 523345 - RNA, 64 nt, Human; identical to SEQ ID NO: 223414

SEQ ID NO: 523346 - RNA, 64 nt, Human; identical to SEQ ID NO: 223415

SEQ ID NO: 523347 - RNA, 64 nt, Human; identical to SEQ ID NO: 223416

SEQ ID NO: 523348 - RNA, 64 nt, Human; identical to SEQ ID NO: 223417

SEQ ID NO: 523349 - RNA, 64 nt, Human; identical to SEQ ID NO: 223418

SEQ ID NO: 523350 - RNA, 64 nt, Human; identical to SEQ ID NO: 223419

SEQ ID NO: 523351 - RNA, 64 nt, Human; identical to SEQ ID NO: 223420

SEQ ID NO: 523352 - RNA, 64 nt, Human; identical to SEQ ID NO: 223421

SEQ ID NO: 523353 - RNA, 64 nt, Human; identical to SEQ ID NO: 223422

SEQ ID NO: 523354 - RNA, 64 nt, Human; identical to SEQ ID NO: 223423

SEQ ID NO: 523355 - RNA, 64 nt, Human; identical to SEQ ID NO: 223424

SEQ ID NO: 523356 - RNA, 64 nt, Human; identical to SEQ ID NO: 223425

SEQ ID NO: 523357 - RNA, 64 nt, Human; identical to SEQ ID NO: 223426

SEQ ID NO: 523358 - RNA, 64 nt, Human; identical to SEQ ID NO: 223427

SEQ ID NO: 523359 - RNA, 64 nt, Human; identical to SEQ ID NO: 223428

SEQ ID NO: 523360 - RNA, 64 nt, Human
gcuugguauucauaaauauugggauuggauggccuccauccagaaaucacuaugggugagcaua

SEQ ID NO: 523361 - RNA, 64 nt, Human
ugagggcucagaccacaugccccaucccaugcuguccauccauucucacaggucccaaauggcc

SEQ ID NO: 523362 - RNA, 64 nt, Human
guggaaaugauaaucagaaaagacuguaaauagauccauccaaaugauuucucuguacaaauga

SEQ ID NO: 523363 - RNA, 64 nt, Human; identical to SEQ ID NO: 223429

SEQ ID NO: 523364 - RNA, 64 nt, Human; identical to SEQ ID NO: 223430

SEQ ID NO: 523365 - RNA, 64 nt, Human; identical to SEQ ID NO: 223431

SEQ ID NO: 523366 - RNA, 64 nt, Human; identical to SEQ ID NO: 223432

SEQ ID NO: 523367 - RNA, 64 nt, Human; identical to SEQ ID NO: 223433

SEQ ID NO: 523368 - RNA, 64 nt, Human; identical to SEQ ID NO: 223434

SEQ ID NO: 523369 - RNA, 64 nt, Human; identical to SEQ ID NO: 223435

SEQ ID NO: 523370 - RNA, 64 nt, Human; identical to SEQ ID NO: 223436

SEQ ID NO: 523371 - RNA, 64 nt, Human; identical to SEQ ID NO: 223437

SEQ ID NO: 523372 - RNA, 64 nt, Human; identical to SEQ ID NO: 223438

SEQ ID NO: 523373 - RNA, 64 nt, Human; identical to SEQ ID NO: 223439

SEQ ID NO: 523374 - RNA, 64 nt, Human; identical to SEQ ID NO: 223440

SEQ ID NO: 523375 - RNA, 64 nt, Human; identical to SEQ ID NO: 223441

SEQ ID NO: 523376 - RNA, 64 nt, Human; identical to SEQ ID NO: 223442

SEQ ID NO: 523377 - RNA, 64 nt, Human; identical to SEQ ID NO: 223443

SEQ ID NO: 523378 - RNA, 64 nt, Human
cggaggggcugggacuggggagggggcagccaccuccauccaaggcucuuccuaggggcccugc

SEQ ID NO: 523379 - RNA, 64 nt, Human
gagcagauaucuccuuggccgccauggagccucauccauccacacgugccuguagcauuccaga

SEQ ID NO: 523380 - RNA, 64 nt, Human
ccucacucucuccagcuggauucuggagcuguucuccauccaugagaguggcuggcaauggcug

SEQ ID NO: 523381 - RNA, 64 nt, Human; identical to SEQ ID NO: 223444

SEQ ID NO: 523382 - RNA, 64 nt, Human; identical to SEQ ID NO: 223445

SEQ ID NO: 523383 - RNA, 64 nt, Human; identical to SEQ ID NO: 223446

SEQ ID NO: 523384 - RNA, 64 nt, Human; identical to SEQ ID NO: 223447

SEQ ID NO: 523385 - RNA, 64 nt, Human; identical to SEQ ID NO: 223448

SEQ ID NO: 523386 - RNA, 64 nt, Human; identical to SEQ ID NO: 223449

SEQ ID NO: 523387 - RNA, 64 nt, Human; identical to SEQ ID NO: 223450

SEQ ID NO: 523388 - RNA, 64 nt, Human; identical to SEQ ID NO: 223451

SEQ ID NO: 523389 - RNA, 64 nt, Human; identical to SEQ ID NO: 223452

SEQ ID NO: 523390 - RNA, 64 nt, Human; identical to SEQ ID NO: 223453

SEQ ID NO: 523391 - RNA, 64 nt, Human; identical to SEQ ID NO: 223454

SEQ ID NO: 523392 - RNA, 64 nt, Human; identical to SEQ ID NO: 223455

SEQ ID NO: 523393 - RNA, 64 nt, Human; identical to SEQ ID NO: 223456

SEQ ID NO: 523394 - RNA, 64 nt, Human; identical to SEQ ID NO: 223457

SEQ ID NO: 523395 - RNA, 64 nt, Human; identical to SEQ ID NO: 223458

SEQ ID NO: 523396 - RNA, 64 nt, Human
acacagggguaccucaaaaauagaacaagagcacuccauccaugugcggaugacugucaagguc

SEQ ID NO: 523397 - RNA, 62 nt, Human
uguaacuuacaaacaugauaaauaaauuaaaaauuccauccaggccuuuguguucucugcau

SEQ ID NO: 523398 - RNA, 64 nt, Human
augaauacaauaauaaugcauauguaauaaugacuccauccagcucuaucuuuguguuuacauc

SEQ ID NO: 523399 - RNA, 64 nt, Human; identical to SEQ ID NO: 223459

SEQ ID NO: 523400 - RNA, 64 nt, Human; identical to SEQ ID NO: 223460

SEQ ID NO: 523401 - RNA, 64 nt, Human; identical to SEQ ID NO: 223461

SEQ ID NO: 523402 - RNA, 59 nt, Human; identical to SEQ ID NO: 223462

SEQ ID NO: 523403 - RNA, 64 nt, Human; identical to SEQ ID NO: 223463

SEQ ID NO: 523404 - RNA, 64 nt, Human; identical to SEQ ID NO: 223464

SEQ ID NO: 523405 - RNA, 64 nt, Human; identical to SEQ ID NO: 223465

SEQ ID NO: 523406 - RNA, 64 nt, Human; identical to SEQ ID NO: 223466

SEQ ID NO: 523407 - RNA, 64 nt, Human; identical to SEQ ID NO: 223467

SEQ ID NO: 523408 - RNA, 64 nt, Human; identical to SEQ ID NO: 223468

SEQ ID NO: 523409 - RNA, 64 nt, Human; identical to SEQ ID NO: 223469

SEQ ID NO: 523410 - RNA, 64 nt, Human; identical to SEQ ID NO: 223470

SEQ ID NO: 523411 - RNA, 64 nt, Human; identical to SEQ ID NO: 223471

SEQ ID NO: 523412 - RNA, 64 nt, Human; identical to SEQ ID NO: 223472

SEQ ID NO: 523413 - RNA, 64 nt, Human; identical to SEQ ID NO: 223473

SEQ ID NO: 523414 - RNA, 64 nt, Human
auaguaucauuucacccuugccaguaaaaaccuuuccauccacccauucucagcagacuccagu

SEQ ID NO: 523415 - RNA, 64 nt, Human
auguaacuugcggauguucagcgugcauguggaauccauccauaaugguacauagcgaaauaau

SEQ ID NO: 523416 - RNA, 64 nt, Human
ugguggagggccacaugggaggcucacccccuucuccauccacaugggagccgggucugccucu

SEQ ID NO: 523417 - RNA, 64 nt, Human; identical to SEQ ID NO: 223474

SEQ ID NO: 523418 - RNA, 64 nt, Human; identical to SEQ ID NO: 223475

SEQ ID NO: 523419 - RNA, 64 nt, Human; identical to SEQ ID NO: 223476

SEQ ID NO: 523420 - RNA, 64 nt, Human; identical to SEQ ID NO: 223477

SEQ ID NO: 523421 - RNA, 64 nt, Human; identical to SEQ ID NO: 223478

SEQ ID NO: 523422 - RNA, 64 nt, Human; identical to SEQ ID NO: 223479

SEQ ID NO: 523423 - RNA, 64 nt, Human; identical to SEQ ID NO: 223480

SEQ ID NO: 523424 - RNA, 64 nt, Human; identical to SEQ ID NO: 223481

SEQ ID NO: 523425 - RNA, 64 nt, Human; identical to SEQ ID NO: 223482

SEQ ID NO: 523426 - RNA, 64 nt, Human; identical to SEQ ID NO: 223483

SEQ ID NO: 523427 - RNA, 64 nt, Human; identical to SEQ ID NO: 223484

SEQ ID NO: 523428 - RNA, 64 nt, Human; identical to SEQ ID NO: 223485

SEQ ID NO: 523429 - RNA, 64 nt, Human; identical to SEQ ID NO: 223486

SEQ ID NO: 523430 - RNA, 64 nt, Human; identical to SEQ ID NO: 223487

SEQ ID NO: 523431 - RNA, 64 nt, Human; identical to SEQ ID NO: 223488

SEQ ID NO: 523432 - RNA, 64 nt, Human
uuccuccucacaaccccaagagcccccagcccgguccauccacgucuggagucuggggagagga

SEQ ID NO: 523433 - RNA, 64 nt, Human
gugccuagcugcccacagagggcaggcacucccauccauccauccguccaccuuccuccagacu

SEQ ID NO: 523434 - RNA, 64 nt, Human
ucauccucaggaguuccaggcacaugagucaccguccauccacauccaguguggccuggagcug

SEQ ID NO: 523435 - RNA, 64 nt, Human; identical to SEQ ID NO: 223489

SEQ ID NO: 523436 - RNA, 64 nt, Human; identical to SEQ ID NO: 223490

SEQ ID NO: 523437 - RNA, 64 nt, Human; identical to SEQ ID NO: 223491

SEQ ID NO: 523438 - RNA, 64 nt, Human; identical to SEQ ID NO: 223492

SEQ ID NO: 523439 - RNA, 64 nt, Human; identical to SEQ ID NO: 223493

SEQ ID NO: 523440 - RNA, 64 nt, Human; identical to SEQ ID NO: 223494

SEQ ID NO: 523441 - RNA, 64 nt, Human; identical to SEQ ID NO: 223495

SEQ ID NO: 523442 - RNA, 64 nt, Human; identical to SEQ ID NO: 223496

SEQ ID NO: 523443 - RNA, 64 nt, Human; identical to SEQ ID NO: 223497

SEQ ID NO: 523444 - RNA, 64 nt, Human; identical to SEQ ID NO: 223498

SEQ ID NO: 523445 - RNA, 64 nt, Human; identical to SEQ ID NO: 223499

SEQ ID NO: 523446 - RNA, 64 nt, Human; identical to SEQ ID NO: 223500

SEQ ID NO: 523447 - RNA, 64 nt, Human; identical to SEQ ID NO: 223501

SEQ ID NO: 523448 - RNA, 64 nt, Human; identical to SEQ ID NO: 223502

SEQ ID NO: 523449 - RNA, 64 nt, Human; identical to SEQ ID NO: 223503

SEQ ID NO: 523450 - RNA, 64 nt, Human
uauuuaucuuaaaacuauacaguuacaucuuaauuccauccaaagaagauacaguuugaagaca

SEQ ID NO: 523451 - RNA, 64 nt, Human
gaaugaagagacugagcaucuaaaaugggcagccuccauccacccgcuucagggaggaacugga

SEQ ID NO: 523452 - RNA, 64 nt, Human
cuuuggggcuucugugaaaaaccugaugcagugcuccauccaaacucagaaggcuuugggauau

SEQ ID NO: 523453 - RNA, 64 nt, Human; identical to SEQ ID NO: 223504

SEQ ID NO: 523454 - RNA, 64 nt, Human; identical to SEQ ID NO: 223505

SEQ ID NO: 523455 - RNA, 64 nt, Human; identical to SEQ ID NO: 223506

SEQ ID NO: 523456 - RNA, 64 nt, Human; identical to SEQ ID NO: 223507

SEQ ID NO: 523457 - RNA, 64 nt, Human; identical to SEQ ID NO: 223508

SEQ ID NO: 523458 - RNA, 64 nt, Human; identical to SEQ ID NO: 223509

SEQ ID NO: 523459 - RNA, 64 nt, Human; identical to SEQ ID NO: 223510

SEQ ID NO: 523460 - RNA, 64 nt, Human; identical to SEQ ID NO: 223511

SEQ ID NO: 523461 - RNA, 64 nt, Human; identical to SEQ ID NO: 223512

SEQ ID NO: 523462 - RNA, 64 nt, Human; identical to SEQ ID NO: 223513

SEQ ID NO: 523463 - RNA, 64 nt, Human; identical to SEQ ID NO: 223514

SEQ ID NO: 523464 - RNA, 64 nt, Human; identical to SEQ ID NO: 223515

SEQ ID NO: 523465 - RNA, 64 nt, Human; identical to SEQ ID NO: 223516

SEQ ID NO: 523466 - RNA, 64 nt, Human; identical to SEQ ID NO: 223517

SEQ ID NO: 523467 - RNA, 64 nt, Human; identical to SEQ ID NO: 223518

SEQ ID NO: 523468 - RNA, 64 nt, Human
cugugaugcucccccauccccacccacuucuacauccauccacaccccagggugagcuggagcu

SEQ ID NO: 523469 - RNA, 64 nt, Human
gacaaccaucucacaaagaucuuaaguaacuuuuuccauccagcaacauccagacgauuucagu

SEQ ID NO: 523470 - RNA, 64 nt, Human
gaacauguaaguugagggguaugcuucauguucuuccauccauuuaccuaauaguaugaaacag

SEQ ID NO: 523471 - RNA, 64 nt, Human; identical to SEQ ID NO: 223519

SEQ ID NO: 523472 - RNA, 64 nt, Human; identical to SEQ ID NO: 223520

SEQ ID NO: 523473 - RNA, 64 nt, Human; identical to SEQ ID NO: 223521

SEQ ID NO: 523474 - RNA, 64 nt, Human; identical to SEQ ID NO: 223522

SEQ ID NO: 523475 - RNA, 64 nt, Human; identical to SEQ ID NO: 223523

SEQ ID NO: 523476 - RNA, 64 nt, Human; identical to SEQ ID NO: 223524

SEQ ID NO: 523477 - RNA, 64 nt, Human; identical to SEQ ID NO: 223525

SEQ ID NO: 523478 - RNA, 64 nt, Human; identical to SEQ ID NO: 223526

SEQ ID NO: 523479 - RNA, 64 nt, Human; identical to SEQ ID NO: 223527

SEQ ID NO: 523480 - RNA, 64 nt, Human; identical to SEQ ID NO: 223528

SEQ ID NO: 523481 - RNA, 64 nt, Human; identical to SEQ ID NO: 223529

SEQ ID NO: 523482 - RNA, 64 nt, Human; identical to SEQ ID NO: 223530

SEQ ID NO: 523483 - RNA, 64 nt, Human; identical to SEQ ID NO: 223531

SEQ ID NO: 523484 - RNA, 64 nt, Human; identical to SEQ ID NO: 223532

SEQ ID NO: 523485 - RNA, 64 nt, Human; identical to SEQ ID NO: 223533

SEQ ID NO: 523486 - RNA, 64 nt, Human
ccgccuccucccuggccccggcccuucccucacuuccauccaucucuagacccccccaaggcuu

SEQ ID NO: 523487 - RNA, 64 nt, Human
auccccugccgcuacuucucuggggaauguggguuccauccaggauugggggccucucugcuca

SEQ ID NO: 523488 - RNA, 64 nt, Human
cagggccucugccuucaaggcccccauggggcuguccauccauggcucugccuacggaaggggc

SEQ ID NO: 523489 - RNA, 64 nt, Human; identical to SEQ ID NO: 223534

SEQ ID NO: 523490 - RNA, 64 nt, Human; identical to SEQ ID NO: 223535

SEQ ID NO: 523491 - RNA, 52 nt, Human; identical to SEQ ID NO: 223536

SEQ ID NO: 523492 - RNA, 64 nt, Human; identical to SEQ ID NO: 223537

SEQ ID NO: 523493 - RNA, 64 nt, Human; identical to SEQ ID NO: 223538

SEQ ID NO: 523494 - RNA, 64 nt, Human; identical to SEQ ID NO: 223539

SEQ ID NO: 523495 - RNA, 64 nt, Human; identical to SEQ ID NO: 223540

SEQ ID NO: 523496 - RNA, 64 nt, Human; identical to SEQ ID NO: 223541

SEQ ID NO: 523497 - RNA, 64 nt, Human; identical to SEQ ID NO: 223542

SEQ ID NO: 523498 - RNA, 64 nt, Human; identical to SEQ ID NO: 223543

SEQ ID NO: 523499 - RNA, 64 nt, Human; identical to SEQ ID NO: 223544

SEQ ID NO: 523500 - RNA, 64 nt, Human; identical to SEQ ID NO: 223545

SEQ ID NO: 523501 - RNA, 64 nt, Human; identical to SEQ ID NO: 223546

SEQ ID NO: 523502 - RNA, 64 nt, Human; identical to SEQ ID NO: 223547

SEQ ID NO: 523503 - RNA, 64 nt, Human; identical to SEQ ID NO: 223548

SEQ ID NO: 523504 - RNA, 64 nt, Human
cagugaggcaucucucugggaugcagaacuucccuccauccaccccucuggcaccuggguuggu

SEQ ID NO: 523505 - RNA, 64 nt, Human
ucauugcaacuuaaaagcguaaaaaccccaaauguccauccacagacgaauguauaaacugugg

SEQ ID NO: 523506 - RNA, 64 nt, Human
ugggaugagcucacagagcccucaugaguuaagauccauccauaucacauaggcaauuccuuuu

SEQ ID NO: 523507 - RNA, 64 nt, Human; identical to SEQ ID NO: 223549

SEQ ID NO: 523508 - RNA, 64 nt, Human; identical to SEQ ID NO: 223550

SEQ ID NO: 523509 - RNA, 64 nt, Human; identical to SEQ ID NO: 223551

SEQ ID NO: 523510 - RNA, 64 nt, Human; identical to SEQ ID NO: 223552

SEQ ID NO: 523511 - RNA, 64 nt, Human; identical to SEQ ID NO: 223553

SEQ ID NO: 523512 - RNA, 64 nt, Human; identical to SEQ ID NO: 223554

SEQ ID NO: 523513 - RNA, 64 nt, Human; identical to SEQ ID NO: 223555

SEQ ID NO: 523514 - RNA, 64 nt, Human; identical to SEQ ID NO: 223556

SEQ ID NO: 523515 - RNA, 64 nt, Human; identical to SEQ ID NO: 223557

SEQ ID NO: 523516 - RNA, 64 nt, Human; identical to SEQ ID NO: 223558

SEQ ID NO: 523517 - RNA, 64 nt, Human; identical to SEQ ID NO: 223559

SEQ ID NO: 523518 - RNA, 64 nt, Human; identical to SEQ ID NO: 223560

SEQ ID NO: 523519 - RNA, 64 nt, Human; identical to SEQ ID NO: 223561

SEQ ID NO: 523520 - RNA, 64 nt, Human; identical to SEQ ID NO: 223562

SEQ ID NO: 523521 - RNA, 64 nt, Human; identical to SEQ ID NO: 223563

SEQ ID NO: 523522 - RNA, 64 nt, Human
acacuuuguguccugcugcaauguguucugucuguccauccaucucugcccucuguaccggaca

SEQ ID NO: 523523 - RNA, 64 nt, Human
gucagggaagccaggcagagcccacagagcaugguccauccagaguguucccugagcccccucc

SEQ ID NO: 523524 - RNA, 64 nt, Human
ccacuuuagggcgacuuugcccgaggcccacgcauccauccacuccuuuagugccuugaaucuc

SEQ ID NO: 523525 - RNA, 64 nt, Human; identical to SEQ ID NO: 223564

SEQ ID NO: 523526 - RNA, 64 nt, Human; identical to SEQ ID NO: 223565

SEQ ID NO: 523527 - RNA, 64 nt, Human; identical to SEQ ID NO: 223566

SEQ ID NO: 523528 - RNA, 64 nt, Human; identical to SEQ ID NO: 223567

SEQ ID NO: 523529 - RNA, 64 nt, Human; identical to SEQ ID NO: 223568

SEQ ID NO: 523530 - RNA, 64 nt, Human; identical to SEQ ID NO: 223569

SEQ ID NO: 523531 - RNA, 64 nt, Human; identical to SEQ ID NO: 223570

SEQ ID NO: 523532 - RNA, 64 nt, Human; identical to SEQ ID NO: 223571

SEQ ID NO: 523533 - RNA, 64 nt, Human; identical to SEQ ID NO: 223572

SEQ ID NO: 523534 - RNA, 64 nt, Human; identical to SEQ ID NO: 223573

SEQ ID NO: 523535 - RNA, 64 nt, Human; identical to SEQ ID NO: 223574

SEQ ID NO: 523536 - RNA, 64 nt, Human; identical to SEQ ID NO: 223575

SEQ ID NO: 523537 - RNA, 64 nt, Human; identical to SEQ ID NO: 223576

SEQ ID NO: 523538 - RNA, 64 nt, Human; identical to SEQ ID NO: 223577

SEQ ID NO: 523539 - RNA, 64 nt, Human; identical to SEQ ID NO: 223578

SEQ ID NO: 523540 - RNA, 64 nt, Human
cuguguuaguuugcgaaggauaguagccuccaauuccauccaugucaaauaaucaaaauuauuu

SEQ ID NO: 523541 - RNA, 64 nt, Human
aacccccugacauuaucuuggauccuaugguuucuccauccaauucuuugaauuucccagucuc

SEQ ID NO: 523542 - RNA, 64 nt, Human
uugcacauguccacccaaacuaaagacuacauuuuccauccacccuagaggcugggugcagcua

SEQ ID NO: 523543 - RNA, 64 nt, Human; identical to SEQ ID NO: 223579

SEQ ID NO: 523544 - RNA, 64 nt, Human; identical to SEQ ID NO: 223580

SEQ ID NO: 523545 - RNA, 64 nt, Human; identical to SEQ ID NO: 223581

SEQ ID NO: 523546 - RNA, 64 nt, Human; identical to SEQ ID NO: 223582

SEQ ID NO: 523547 - RNA, 64 nt, Human; identical to SEQ ID NO: 223583

SEQ ID NO: 523548 - RNA, 64 nt, Human; identical to SEQ ID NO: 223584

SEQ ID NO: 523549 - RNA, 64 nt, Human; identical to SEQ ID NO: 223585

SEQ ID NO: 523550 - RNA, 64 nt, Human; identical to SEQ ID NO: 223586

SEQ ID NO: 523551 - RNA, 64 nt, Human; identical to SEQ ID NO: 223587

SEQ ID NO: 523552 - RNA, 64 nt, Human; identical to SEQ ID NO: 223588

SEQ ID NO: 523553 - RNA, 64 nt, Human; identical to SEQ ID NO: 223589

SEQ ID NO: 523554 - RNA, 64 nt, Human; identical to SEQ ID NO: 223590

SEQ ID NO: 523555 - RNA, 64 nt, Human; identical to SEQ ID NO: 223591

SEQ ID NO: 523556 - RNA, 64 nt, Human; identical to SEQ ID NO: 223592

SEQ ID NO: 523557 - RNA, 64 nt, Human; identical to SEQ ID NO: 223593

SEQ ID NO: 523558 - RNA, 64 nt, Human
cagguuugggaagcaauugaauuuccaggaaauauccauccaugaauuaugccagcaagaauga

SEQ ID NO: 523559 - RNA, 64 nt, Human
uguccaugugcucugcacaaaaacagaccuguuguccauccaguccacugacaagaggguuucc

SEQ ID NO: 523560 - RNA, 64 nt, Human
acaacucaugugcaacugguagucuugaccacauuccauccauuuccucagguuucugugguuc

SEQ ID NO: 523561 - RNA, 64 nt, Human; identical to SEQ ID NO: 223594

SEQ ID NO: 523562 - RNA, 64 nt, Human; identical to SEQ ID NO: 223595

SEQ ID NO: 523563 - RNA, 64 nt, Human; identical to SEQ ID NO: 223596

SEQ ID NO: 523564 - RNA, 64 nt, Human; identical to SEQ ID NO: 223597

SEQ ID NO: 523565 - RNA, 64 nt, Human; identical to SEQ ID NO: 223598

SEQ ID NO: 523566 - RNA, 64 nt, Human; identical to SEQ ID NO: 223599

SEQ ID NO: 523567 - RNA, 64 nt, Human; identical to SEQ ID NO: 223600

SEQ ID NO: 523568 - RNA, 64 nt, Human; identical to SEQ ID NO: 223601

SEQ ID NO: 523569 - RNA, 64 nt, Human; identical to SEQ ID NO: 223602

SEQ ID NO: 523570 - RNA, 64 nt, Human; identical to SEQ ID NO: 223603

SEQ ID NO: 523571 - RNA, 64 nt, Human; identical to SEQ ID NO: 223604

SEQ ID NO: 523572 - RNA, 64 nt, Human; identical to SEQ ID NO: 223605

SEQ ID NO: 523573 - RNA, 64 nt, Human; identical to SEQ ID NO: 223606

SEQ ID NO: 523574 - RNA, 64 nt, Human; identical to SEQ ID NO: 223607

SEQ ID NO: 523575 - RNA, 64 nt, Human; identical to SEQ ID NO: 223608

SEQ ID NO: 523576 - RNA, 64 nt, Human
guucacaccgcacccugcacucacccacagcagcuccauccacugggaaaacugggguuugcau

SEQ ID NO: 523577 - RNA, 63 nt, Human
agaggaagcuuggggugugacuguggggaggacuccauccaccucaucacuggacugcauggg

SEQ ID NO: 523578 - RNA, 64 nt, Human
gugaaaacaugccuccuuuuuaaaaaauaaccccuccauccaggauauggaauccagcaccaca

SEQ ID NO: 523579 - RNA, 64 nt, Human; identical to SEQ ID NO: 223609

SEQ ID NO: 523580 - RNA, 64 nt, Human; identical to SEQ ID NO: 223610

SEQ ID NO: 523581 - RNA, 64 nt, Human; identical to SEQ ID NO: 223611

SEQ ID NO: 523582 - RNA, 64 nt, Human; identical to SEQ ID NO: 223612

SEQ ID NO: 523583 - RNA, 64 nt, Human; identical to SEQ ID NO: 223613

SEQ ID NO: 523584 - RNA, 64 nt, Human; identical to SEQ ID NO: 223614

SEQ ID NO: 523585 - RNA, 64 nt, Human; identical to SEQ ID NO: 223615

SEQ ID NO: 523586 - RNA, 56 nt, Human; identical to SEQ ID NO: 223616

SEQ ID NO: 523587 - RNA, 64 nt, Human; identical to SEQ ID NO: 223617

SEQ ID NO: 523588 - RNA, 64 nt, Human; identical to SEQ ID NO: 223618

SEQ ID NO: 523589 - RNA, 64 nt, Human; identical to SEQ ID NO: 223619

SEQ ID NO: 523590 - RNA, 64 nt, Human; identical to SEQ ID NO: 223620

SEQ ID NO: 523591 - RNA, 64 nt, Human; identical to SEQ ID NO: 223621

SEQ ID NO: 523592 - RNA, 64 nt, Human; identical to SEQ ID NO: 223622

SEQ ID NO: 523593 - RNA, 64 nt, Human; identical to SEQ ID NO: 223623

SEQ ID NO: 523594 - RNA, 64 nt, Human
uuacaauugucauuuauaaaaccaucaaaaauauuccauccauauacuuuggggacuuguaggg

SEQ ID NO: 523595 - RNA, 64 nt, Human
gggcugcgugcauugaggccgccucuuugacggguccauccagggggacccucuccuuucugug

SEQ ID NO: 523596 - RNA, 64 nt, Human
uggcaccccccuucccucccuucuugguuccauuuccauccaugacagguacagcaucccagga

SEQ ID NO: 523597 - RNA, 64 nt, Human; identical to SEQ ID NO: 223624

SEQ ID NO: 523598 - RNA, 64 nt, Human; identical to SEQ ID NO: 223625

SEQ ID NO: 523599 - RNA, 64 nt, Human; identical to SEQ ID NO: 223626

SEQ ID NO: 523600 - RNA, 56 nt, Human; identical to SEQ ID NO: 223627

SEQ ID NO: 523601 - RNA, 64 nt, Human; identical to SEQ ID NO: 223628

SEQ ID NO: 523602 - RNA, 64 nt, Human; identical to SEQ ID NO: 223629

SEQ ID NO: 523603 - RNA, 64 nt, Human; identical to SEQ ID NO: 223630

SEQ ID NO: 523604 - RNA, 64 nt, Human; identical to SEQ ID NO: 223631

SEQ ID NO: 523605 - RNA, 64 nt, Human; identical to SEQ ID NO: 223632

SEQ ID NO: 523606 - RNA, 64 nt, Human; identical to SEQ ID NO: 223633

SEQ ID NO: 523607 - RNA, 64 nt, Human; identical to SEQ ID NO: 223634

SEQ ID NO: 523608 - RNA, 64 nt, Human; identical to SEQ ID NO: 223635

SEQ ID NO: 523609 - RNA, 64 nt, Human; identical to SEQ ID NO: 223636

SEQ ID NO: 523610 - RNA, 64 nt, Human; identical to SEQ ID NO: 223637

SEQ ID NO: 523611 - RNA, 64 nt, Human; identical to SEQ ID NO: 223638

SEQ ID NO: 523612 - RNA, 64 nt, Human
uuuccucuccaucuacuuuucccugugcauaauauccauccaaaggacaacaguggcaaagcug

SEQ ID NO: 523613 - RNA, 64 nt, Human
gguggccuaggaugcgggugucuccccaggugaguccauccacacacguuugaaaaacacuauu

SEQ ID NO: 523614 - RNA, 64 nt, Human
cccagaggcugccaccggggagaagcagcgguccuccauccagaaccuaagggcugaagcaaag

SEQ ID NO: 523615 - RNA, 64 nt, Human; identical to SEQ ID NO: 223639

SEQ ID NO: 523616 - RNA, 64 nt, Human; identical to SEQ ID NO: 223640

SEQ ID NO: 523617 - RNA, 64 nt, Human; identical to SEQ ID NO: 223641

SEQ ID NO: 523618 - RNA, 64 nt, Human; identical to SEQ ID NO: 223642

SEQ ID NO: 523619 - RNA, 64 nt, Human; identical to SEQ ID NO: 223643

SEQ ID NO: 523620 - RNA, 64 nt, Human; identical to SEQ ID NO: 223644

SEQ ID NO: 523621 - RNA, 64 nt, Human; identical to SEQ ID NO: 223645

SEQ ID NO: 523622 - RNA, 64 nt, Human; identical to SEQ ID NO: 223646

SEQ ID NO: 523623 - RNA, 64 nt, Human; identical to SEQ ID NO: 223647

SEQ ID NO: 523624 - RNA, 64 nt, Human; identical to SEQ ID NO: 223648

SEQ ID NO: 523625 - RNA, 64 nt, Human; identical to SEQ ID NO: 223649

SEQ ID NO: 523626 - RNA, 64 nt, Human; identical to SEQ ID NO: 223650

SEQ ID NO: 523627 - RNA, 61 nt, Human; identical to SEQ ID NO: 223651

SEQ ID NO: 523628 - RNA, 64 nt, Human; identical to SEQ ID NO: 223652

SEQ ID NO: 523629 - RNA, 64 nt, Human
accucaaauuguagauauaggguaaucaauaaaauccauccaugccuuucacacacuaagucau

SEQ ID NO: 523630 - RNA, 64 nt, Human
cuauagaggauacaugaaaaguaugagaucugguuccauccaguaagacauuuuaauagagaag

SEQ ID NO: 523631 - RNA, 64 nt, Human
uuugugucugggucuugucaacaucuaauuuuuuuccauccauucuguuacacuuuguauuuuc

SEQ ID NO: 523632 - RNA, 64 nt, Human; identical to SEQ ID NO: 522545

SEQ ID NO: 523633 - RNA, 64 nt, Human; identical to SEQ ID NO: 522546

SEQ ID NO: 523634 - RNA, 64 nt, Human; identical to SEQ ID NO: 522547

SEQ ID NO: 523635 - RNA, 64 nt, Human; identical to SEQ ID NO: 522548

SEQ ID NO: 523636 - RNA, 64 nt, Human; identical to SEQ ID NO: 522549

SEQ ID NO: 523637 - RNA, 64 nt, Human; identical to SEQ ID NO: 522550

SEQ ID NO: 523638 - RNA, 64 nt, Human; identical to SEQ ID NO: 522551

SEQ ID NO: 523639 - RNA, 64 nt, Human; identical to SEQ ID NO: 522552

SEQ ID NO: 523640 - RNA, 64 nt, Human; identical to SEQ ID NO: 522553

SEQ ID NO: 523641 - RNA, 64 nt, Human; identical to SEQ ID NO: 522554

SEQ ID NO: 523642 - RNA, 64 nt, Human; identical to SEQ ID NO: 522555

SEQ ID NO: 523643 - RNA, 64 nt, Human; identical to SEQ ID NO: 522559

SEQ ID NO: 523644 - RNA, 64 nt, Human; identical to SEQ ID NO: 522560

SEQ ID NO: 523645 - RNA, 64 nt, Human; identical to SEQ ID NO: 522561

SEQ ID NO: 523646 - RNA, 64 nt, Human
agcaaaaaauaggguacauaaagcaggguggcuguccauccacugauucuggggugagaagcga

SEQ ID NO: 523647 - RNA, 64 nt, Human
gaauguacaggcggaacuguacgaacagcucccuuccauccauuuuuaacucuuucggaaauaa

SEQ ID NO: 523648 - RNA, 64 nt, Human
aaacauuggcuuugacaucugccaagaugaugauuccauccaccuggaguccaucuauaguaau

SEQ ID NO: 523649 - RNA, 64 nt, Human; identical to SEQ ID NO: 522562

SEQ ID NO: 523650 - RNA, 64 nt, Human; identical to SEQ ID NO: 522563

SEQ ID NO: 523651 - RNA, 64 nt, Human; identical to SEQ ID NO: 522564

SEQ ID NO: 523652 - RNA, 64 nt, Human; identical to SEQ ID NO: 522565

SEQ ID NO: 523653 - RNA, 64 nt, Human; identical to SEQ ID NO: 522566

SEQ ID NO: 523654 - RNA, 64 nt, Human; identical to SEQ ID NO: 522567

SEQ ID NO: 523655 - RNA, 64 nt, Human; identical to SEQ ID NO: 522568

SEQ ID NO: 523656 - RNA, 64 nt, Human; identical to SEQ ID NO: 522569

SEQ ID NO: 523657 - RNA, 64 nt, Human; identical to SEQ ID NO: 522570

SEQ ID NO: 523658 - RNA, 64 nt, Human; identical to SEQ ID NO: 522571

SEQ ID NO: 523659 - RNA, 64 nt, Human; identical to SEQ ID NO: 522572

SEQ ID NO: 523660 - RNA, 64 nt, Human; identical to SEQ ID NO: 522573

SEQ ID NO: 523661 - RNA, 64 nt, Human; identical to SEQ ID NO: 522577

SEQ ID NO: 523662 - RNA, 64 nt, Human; identical to SEQ ID NO: 522578

SEQ ID NO: 523663 - RNA, 64 nt, Human; identical to SEQ ID NO: 522579

SEQ ID NO: 523664 - RNA, 54 nt, Human
auguccacacuugcaaguaaccacuccauccagccuugggcaagaugccucagc

SEQ ID NO: 523665 - RNA, 64 nt, Human
aaagagccuggagaagcugaugcuuugcuucaaauccauccagaauaaaacgcaaagggcugaa

SEQ ID NO: 523666 - RNA, 64 nt, Human
ugccauauuuuaaaucaacuacuccacguguuuuuccauccaaucacacugcugugauucaggg

SEQ ID NO: 523667 - RNA, 64 nt, Human; identical to SEQ ID NO: 522580

SEQ ID NO: 523668 - RNA, 64 nt, Human; identical to SEQ ID NO: 522581

SEQ ID NO: 523669 - RNA, 64 nt, Human; identical to SEQ ID NO: 522582

SEQ ID NO: 523670 - RNA, 64 nt, Human; identical to SEQ ID NO: 522583

SEQ ID NO: 523671 - RNA, 64 nt, Human; identical to SEQ ID NO: 522584

SEQ ID NO: 523672 - RNA, 64 nt, Human; identical to SEQ ID NO: 522585

SEQ ID NO: 523673 - RNA, 64 nt, Human; identical to SEQ ID NO: 522586

SEQ ID NO: 523674 - RNA, 64 nt, Human; identical to SEQ ID NO: 522587

SEQ ID NO: 523675 - RNA, 64 nt, Human; identical to SEQ ID NO: 522588

SEQ ID NO: 523676 - RNA, 64 nt, Human; identical to SEQ ID NO: 522589

SEQ ID NO: 523677 - RNA, 53 nt, Human; identical to SEQ ID NO: 522590

SEQ ID NO: 523678 - RNA, 64 nt, Human; identical to SEQ ID NO: 522591

SEQ ID NO: 523679 - RNA, 64 nt, Human; identical to SEQ ID NO: 522595

SEQ ID NO: 523680 - RNA, 64 nt, Human; identical to SEQ ID NO: 522596

SEQ ID NO: 523681 - RNA, 64 nt, Human; identical to SEQ ID NO: 522597

SEQ ID NO: 523682 - RNA, 64 nt, Human
uacauguuuuaaccucuuuuuuuuuucuaauuauuccauccaaaauuucuggugaauuacacag

SEQ ID NO: 523683 - RNA, 64 nt, Human
auguguugguuugcuuaggguaauggccuccagcuccauccauguugcugcaaagacaugaucu

SEQ ID NO: 523684 - RNA, 64 nt, Human
uauaucaguuaugacgcccauugcccagcuucaguccauccauguuagauggacagaaauuaug

SEQ ID NO: 523685 - RNA, 64 nt, Human; identical to SEQ ID NO: 522598

SEQ ID NO: 523686 - RNA, 64 nt, Human; identical to SEQ ID NO: 522599

SEQ ID NO: 523687 - RNA, 64 nt, Human; identical to SEQ ID NO: 522600

SEQ ID NO: 523688 - RNA, 64 nt, Human; identical to SEQ ID NO: 522601

SEQ ID NO: 523689 - RNA, 64 nt, Human; identical to SEQ ID NO: 522602

SEQ ID NO: 523690 - RNA, 64 nt, Human; identical to SEQ ID NO: 522603

SEQ ID NO: 523691 - RNA, 64 nt, Human; identical to SEQ ID NO: 522604

SEQ ID NO: 523692 - RNA, 64 nt, Human; identical to SEQ ID NO: 522605

SEQ ID NO: 523693 - RNA, 61 nt, Human; identical to SEQ ID NO: 522606

SEQ ID NO: 523694 - RNA, 64 nt, Human; identical to SEQ ID NO: 522607

SEQ ID NO: 523695 - RNA, 64 nt, Human; identical to SEQ ID NO: 522608

SEQ ID NO: 523696 - RNA, 64 nt, Human; identical to SEQ ID NO: 522609

SEQ ID NO: 523697 - RNA, 64 nt, Human; identical to SEQ ID NO: 522613

SEQ ID NO: 523698 - RNA, 64 nt, Human; identical to SEQ ID NO: 522614

SEQ ID NO: 523699 - RNA, 64 nt, Human; identical to SEQ ID NO: 522615

SEQ ID NO: 523700 - RNA, 64 nt, Human
cugguggcaggccacuucccucccagugccagucuccauccaccccagagaggaacaggcgggu

SEQ ID NO: 523701 - RNA, 64 nt, Human
auucaggaagcagcuuuccccaugucucgacucauccauccaggccauuccccgucucugguuc

SEQ ID NO: 523702 - RNA, 64 nt, Human
uguccccugaagcccaggacugcguuguaugcuuuccauccacucaccuuaccccauagcaucu

SEQ ID NO: 523703 - RNA, 64 nt, Human; identical to SEQ ID NO: 522616

SEQ ID NO: 523704 - RNA, 64 nt, Human; identical to SEQ ID NO: 522617

SEQ ID NO: 523705 - RNA, 64 nt, Human; identical to SEQ ID NO: 522618

SEQ ID NO: 523706 - RNA, 64 nt, Human; identical to SEQ ID NO: 522619

SEQ ID NO: 523707 - RNA, 64 nt, Human; identical to SEQ ID NO: 522620

SEQ ID NO: 523708 - RNA, 64 nt, Human; identical to SEQ ID NO: 522621

SEQ ID NO: 523709 - RNA, 64 nt, Human; identical to SEQ ID NO: 522622

SEQ ID NO: 523710 - RNA, 64 nt, Human; identical to SEQ ID NO: 522623

SEQ ID NO: 523711 - RNA, 64 nt, Human; identical to SEQ ID NO: 522624

SEQ ID NO: 523712 - RNA, 64 nt, Human; identical to SEQ ID NO: 522625

SEQ ID NO: 523713 - RNA, 64 nt, Human; identical to SEQ ID NO: 522626

SEQ ID NO: 523714 - RNA, 64 nt, Human; identical to SEQ ID NO: 522627

SEQ ID NO: 523715 - RNA, 64 nt, Human; identical to SEQ ID NO: 522631

SEQ ID NO: 523716 - RNA, 64 nt, Human; identical to SEQ ID NO: 522632

SEQ ID NO: 523717 - RNA, 64 nt, Human; identical to SEQ ID NO: 522633

SEQ ID NO: 523718 - RNA, 64 nt, Human
uuucuuuaucgcuacauuuauuuaggggacaaacuccauccagguugacucucucuggaaugcg

SEQ ID NO: 523719 - RNA, 64 nt, Human
caccacgcagcugaccaugaacauccccuuccaguccauccacuucaucaccuaugaguuccug

SEQ ID NO: 523720 - RNA, 64 nt, Human
guuuguggggggaagcuuugauauccaugccacguccauccaccccaccccuuuucgucacgag

SEQ ID NO: 523721 - RNA, 64 nt, Human; identical to SEQ ID NO: 522634

SEQ ID NO: 523722 - RNA, 64 nt, Human; identical to SEQ ID NO: 522635

SEQ ID NO: 523723 - RNA, 64 nt, Human; identical to SEQ ID NO: 522636

SEQ ID NO: 523724 - RNA, 64 nt, Human; identical to SEQ ID NO: 522637

SEQ ID NO: 523725 - RNA, 64 nt, Human; identical to SEQ ID NO: 522638

SEQ ID NO: 523726 - RNA, 64 nt, Human; identical to SEQ ID NO: 522639

SEQ ID NO: 523727 - RNA, 64 nt, Human; identical to SEQ ID NO: 522640

SEQ ID NO: 523728 - RNA, 64 nt, Human; identical to SEQ ID NO: 522641

SEQ ID NO: 523729 - RNA, 64 nt, Human; identical to SEQ ID NO: 522642

SEQ ID NO: 523730 - RNA, 64 nt, Human; identical to SEQ ID NO: 522643

SEQ ID NO: 523731 - RNA, 64 nt, Human; identical to SEQ ID NO: 522644

SEQ ID NO: 523732 - RNA, 64 nt, Human; identical to SEQ ID NO: 522645

SEQ ID NO: 523733 - RNA, 64 nt, Human; identical to SEQ ID NO: 522649

SEQ ID NO: 523734 - RNA, 64 nt, Human; identical to SEQ ID NO: 522650

SEQ ID NO: 523735 - RNA, 64 nt, Human; identical to SEQ ID NO: 522651

SEQ ID NO: 523736 - RNA, 64 nt, Human
cuguuuaacagcuguaaccaaugguacugaucuauccauccaauguugucauuauauuugacug

SEQ ID NO: 523737 - RNA, 64 nt, Human
uucucccacccuaagucuuacauaaugccaccaguccauccaaaaccuauauaucaccuauacu

SEQ ID NO: 523738 - RNA, 64 nt, Human
cugcugccccagcugacuguggcccccuccgugauccauccaucuccagggagcaagacagaga

SEQ ID NO: 523739 - RNA, 64 nt, Human; identical to SEQ ID NO: 522652

SEQ ID NO: 523740 - RNA, 64 nt, Human; identical to SEQ ID NO: 522653

SEQ ID NO: 523741 - RNA, 64 nt, Human; identical to SEQ ID NO: 522654

SEQ ID NO: 523742 - RNA, 64 nt, Human; identical to SEQ ID NO: 522655

SEQ ID NO: 523743 - RNA, 64 nt, Human; identical to SEQ ID NO: 522656

SEQ ID NO: 523744 - RNA, 64 nt, Human; identical to SEQ ID NO: 522657

SEQ ID NO: 523745 - RNA, 64 nt, Human; identical to SEQ ID NO: 522658

SEQ ID NO: 523746 - RNA, 64 nt, Human; identical to SEQ ID NO: 522659

SEQ ID NO: 523747 - RNA, 64 nt, Human; identical to SEQ ID NO: 522660

SEQ ID NO: 523748 - RNA, 64 nt, Human; identical to SEQ ID NO: 522661

SEQ ID NO: 523749 - RNA, 64 nt, Human; identical to SEQ ID NO: 522662

SEQ ID NO: 523750 - RNA, 64 nt, Human; identical to SEQ ID NO: 522663

SEQ ID NO: 523751 - RNA, 64 nt, Human; identical to SEQ ID NO: 522667

SEQ ID NO: 523752 - RNA, 64 nt, Human; identical to SEQ ID NO: 522668

SEQ ID NO: 523753 - RNA, 64 nt, Human; identical to SEQ ID NO: 522669

SEQ ID NO: 523754 - RNA, 64 nt, Human
gggauggaugguuggauacagguggcugggcuauuccauccaucuggaagcacauuugagccuc

SEQ ID NO: 523755 - RNA, 64 nt, Human
caacauauguaaucugcuuauauauuuuuaaaaauccauccacacacaugguaaauuaaguaua

SEQ ID NO: 523756 - RNA, 64 nt, Human
agaagaaacuuuaugcuuguuuaaugcuuaaauuuccauccauugugagaauauuuucacugac

SEQ ID NO: 523757 - RNA, 64 nt, Human; identical to SEQ ID NO: 522670

SEQ ID NO: 523758 - RNA, 64 nt, Human; identical to SEQ ID NO: 522671

SEQ ID NO: 523759 - RNA, 64 nt, Human; identical to SEQ ID NO: 522672

SEQ ID NO: 523760 - RNA, 64 nt, Human; identical to SEQ ID NO: 522673

SEQ ID NO: 523761 - RNA, 64 nt, Human; identical to SEQ ID NO: 522674

SEQ ID NO: 523762 - RNA, 64 nt, Human; identical to SEQ ID NO: 522675

SEQ ID NO: 523763 - RNA, 55 nt, Human; identical to SEQ ID NO: 522676

SEQ ID NO: 523764 - RNA, 64 nt, Human; identical to SEQ ID NO: 522677

SEQ ID NO: 523765 - RNA, 64 nt, Human; identical to SEQ ID NO: 522678

SEQ ID NO: 523766 - RNA, 64 nt, Human; identical to SEQ ID NO: 522679

SEQ ID NO: 523767 - RNA, 64 nt, Human; identical to SEQ ID NO: 522680

SEQ ID NO: 523768 - RNA, 64 nt, Human; identical to SEQ ID NO: 522681

SEQ ID NO: 523769 - RNA, 58 nt, Human; identical to SEQ ID NO: 522685

SEQ ID NO: 523770 - RNA, 64 nt, Human; identical to SEQ ID NO: 522686

SEQ ID NO: 523771 - RNA, 64 nt, Human; identical to SEQ ID NO: 522687

SEQ ID NO: 523772 - RNA, 64 nt, Human; identical to SEQ ID NO: 522558

SEQ ID NO: 523773 - RNA, 64 nt, Human; identical to SEQ ID NO: 522115

SEQ ID NO: 523774 - RNA, 64 nt, Human; identical to SEQ ID NO: 522574

SEQ ID NO: 523775 - RNA, 64 nt, Human; identical to SEQ ID NO: 522688

SEQ ID NO: 523776 - RNA, 64 nt, Human; identical to SEQ ID NO: 522689

SEQ ID NO: 523777 - RNA, 64 nt, Human; identical to SEQ ID NO: 522690

SEQ ID NO: 523778 - RNA, 64 nt, Human; identical to SEQ ID NO: 522691

SEQ ID NO: 523779 - RNA, 64 nt, Human; identical to SEQ ID NO: 522692

SEQ ID NO: 523780 - RNA, 64 nt, Human; identical to SEQ ID NO: 522693

SEQ ID NO: 523781 - RNA, 64 nt, Human; identical to SEQ ID NO: 522694

SEQ ID NO: 523782 - RNA, 64 nt, Human; identical to SEQ ID NO: 522695

SEQ ID NO: 523783 - RNA, 64 nt, Human; identical to SEQ ID NO: 522696

SEQ ID NO: 523784 - RNA, 64 nt, Human; identical to SEQ ID NO: 522697

SEQ ID NO: 523785 - RNA, 64 nt, Human; identical to SEQ ID NO: 522698

SEQ ID NO: 523786 - RNA, 64 nt, Human; identical to SEQ ID NO: 522699

SEQ ID NO: 523787 - RNA, 64 nt, Human; identical to SEQ ID NO: 522703

SEQ ID NO: 523788 - RNA, 64 nt, Human; identical to SEQ ID NO: 522704

SEQ ID NO: 523789 - RNA, 64 nt, Human; identical to SEQ ID NO: 522705

SEQ ID NO: 523790 - RNA, 64 nt, Human; identical to SEQ ID NO: 522592

SEQ ID NO: 523791 - RNA, 64 nt, Human; identical to SEQ ID NO: 522593

SEQ ID NO: 523792 - RNA, 64 nt, Human; identical to SEQ ID NO: 522594

SEQ ID NO: 523793 - RNA, 64 nt, Human; identical to SEQ ID NO: 522706

SEQ ID NO: 523794 - RNA, 64 nt, Human; identical to SEQ ID NO: 522707

SEQ ID NO: 523795 - RNA, 54 nt, Human; identical to SEQ ID NO: 522708

SEQ ID NO: 523796 - RNA, 64 nt, Human; identical to SEQ ID NO: 522709

SEQ ID NO: 523797 - RNA, 64 nt, Human; identical to SEQ ID NO: 522710

SEQ ID NO: 523798 - RNA, 64 nt, Human; identical to SEQ ID NO: 522711

SEQ ID NO: 523799 - RNA, 64 nt, Human; identical to SEQ ID NO: 522712

SEQ ID NO: 523800 - RNA, 64 nt, Human; identical to SEQ ID NO: 522713

SEQ ID NO: 523801 - RNA, 64 nt, Human; identical to SEQ ID NO: 522714

SEQ ID NO: 523802 - RNA, 64 nt, Human; identical to SEQ ID NO: 522715

SEQ ID NO: 523803 - RNA, 64 nt, Human; identical to SEQ ID NO: 522716

SEQ ID NO: 523804 - RNA, 64 nt, Human; identical to SEQ ID NO: 522717

SEQ ID NO: 523805 - RNA, 64 nt, Human; identical to SEQ ID NO: 522721

SEQ ID NO: 523806 - RNA, 64 nt, Human; identical to SEQ ID NO: 522722

SEQ ID NO: 523807 - RNA, 64 nt, Human; identical to SEQ ID NO: 522723

SEQ ID NO: 523808 - RNA, 64 nt, Human; identical to SEQ ID NO: 522575

SEQ ID NO: 523809 - RNA, 64 nt, Human; identical to SEQ ID NO: 522576

SEQ ID NO: 523810 - RNA, 64 nt, Human; identical to SEQ ID NO: 522610

SEQ ID NO: 523811 - RNA, 64 nt, Human; identical to SEQ ID NO: 522724

SEQ ID NO: 523812 - RNA, 64 nt, Human; identical to SEQ ID NO: 522725

SEQ ID NO: 523813 - RNA, 64 nt, Human; identical to SEQ ID NO: 522726

SEQ ID NO: 523814 - RNA, 64 nt, Human; identical to SEQ ID NO: 522727

SEQ ID NO: 523815 - RNA, 64 nt, Human; identical to SEQ ID NO: 522728

SEQ ID NO: 523816 - RNA, 64 nt, Human; identical to SEQ ID NO: 522729

SEQ ID NO: 523817 - RNA, 64 nt, Human; identical to SEQ ID NO: 522730

SEQ ID NO: 523818 - RNA, 64 nt, Human; identical to SEQ ID NO: 522731

SEQ ID NO: 523819 - RNA, 64 nt, Human; identical to SEQ ID NO: 522732

SEQ ID NO: 523820 - RNA, 64 nt, Human; identical to SEQ ID NO: 522733

SEQ ID NO: 523821 - RNA, 64 nt, Human; identical to SEQ ID NO: 522734

SEQ ID NO: 523822 - RNA, 64 nt, Human; identical to SEQ ID NO: 522735

SEQ ID NO: 523823 - RNA, 64 nt, Human; identical to SEQ ID NO: 522739

SEQ ID NO: 523824 - RNA, 64 nt, Human; identical to SEQ ID NO: 522740

SEQ ID NO: 523825 - RNA, 64 nt, Human; identical to SEQ ID NO: 522741

SEQ ID NO: 523826 - RNA, 64 nt, Human
auuuauguugaauggaacuccaagaucucaccucuccauccaggaauggaguccauguaaucaa

SEQ ID NO: 523827 - RNA, 64 nt, Human
agggccuggcaccuccauccugaggugcugccccuccauccaaaacugccaagugacucauugc

SEQ ID NO: 523828 - RNA, 64 nt, Human
gagccagcucagagaaggaacugaacccaggagauccauccaccuauuagcccugggccuggac

SEQ ID NO: 523829 - RNA, 64 nt, Human; identical to SEQ ID NO: 522742

SEQ ID NO: 523830 - RNA, 64 nt, Human; identical to SEQ ID NO: 522743

SEQ ID NO: 523831 - RNA, 64 nt, Human; identical to SEQ ID NO: 522744

SEQ ID NO: 523832 - RNA, 64 nt, Human; identical to SEQ ID NO: 522745

SEQ ID NO: 523833 - RNA, 64 nt, Human; identical to SEQ ID NO: 522746

SEQ ID NO: 523834 - RNA, 64 nt, Human; identical to SEQ ID NO: 522747

SEQ ID NO: 523835 - RNA, 64 nt, Human; identical to SEQ ID NO: 522748

SEQ ID NO: 523836 - RNA, 64 nt, Human; identical to SEQ ID NO: 522749

SEQ ID NO: 523837 - RNA, 64 nt, Human; identical to SEQ ID NO: 522750

SEQ ID NO: 523838 - RNA, 64 nt, Human; identical to SEQ ID NO: 522751

SEQ ID NO: 523839 - RNA, 64 nt, Human; identical to SEQ ID NO: 522752

SEQ ID NO: 523840 - RNA, 64 nt, Human; identical to SEQ ID NO: 522753

SEQ ID NO: 523841 - RNA, 64 nt, Human; identical to SEQ ID NO: 522757

SEQ ID NO: 523842 - RNA, 64 nt, Human; identical to SEQ ID NO: 522758

SEQ ID NO: 523843 - RNA, 64 nt, Human; identical to SEQ ID NO: 522759

SEQ ID NO: 523844 - RNA, 64 nt, Human; identical to SEQ ID NO: 522612

SEQ ID NO: 523845 - RNA, 64 nt, Human; identical to SEQ ID NO: 522117

SEQ ID NO: 523846 - RNA, 64 nt, Human; identical to SEQ ID NO: 522682

SEQ ID NO: 523847 - RNA, 64 nt, Human; identical to SEQ ID NO: 522760

SEQ ID NO: 523848 - RNA, 64 nt, Human; identical to SEQ ID NO: 522761

SEQ ID NO: 523849 - RNA, 64 nt, Human; identical to SEQ ID NO: 522762

SEQ ID NO: 523850 - RNA, 64 nt, Human; identical to SEQ ID NO: 522763

SEQ ID NO: 523851 - RNA, 64 nt, Human; identical to SEQ ID NO: 522764

SEQ ID NO: 523852 - RNA, 64 nt, Human; identical to SEQ ID NO: 522765

SEQ ID NO: 523853 - RNA, 64 nt, Human; identical to SEQ ID NO: 522766

SEQ ID NO: 523854 - RNA, 64 nt, Human; identical to SEQ ID NO: 522767

SEQ ID NO: 523855 - RNA, 64 nt, Human; identical to SEQ ID NO: 522768

SEQ ID NO: 523856 - RNA, 64 nt, Human; identical to SEQ ID NO: 522769

SEQ ID NO: 523857 - RNA, 64 nt, Human; identical to SEQ ID NO: 522770

SEQ ID NO: 523858 - RNA, 64 nt, Human; identical to SEQ ID NO: 522771

SEQ ID NO: 523859 - RNA, 64 nt, Human; identical to SEQ ID NO: 522775

SEQ ID NO: 523860 - RNA, 64 nt, Human; identical to SEQ ID NO: 522776

SEQ ID NO: 523861 - RNA, 64 nt, Human; identical to SEQ ID NO: 522777

SEQ ID NO: 523862 - RNA, 64 nt, Human; identical to SEQ ID NO: 522683

SEQ ID NO: 523863 - RNA, 64 nt, Human; identical to SEQ ID NO: 522684

SEQ ID NO: 523864 - RNA, 64 nt, Human; identical to SEQ ID NO: 522808

SEQ ID NO: 523865 - RNA, 64 nt, Human; identical to SEQ ID NO: 522778

SEQ ID NO: 523866 - RNA, 64 nt, Human; identical to SEQ ID NO: 522779

SEQ ID NO: 523867 - RNA, 64 nt, Human; identical to SEQ ID NO: 522780

SEQ ID NO: 523868 - RNA, 64 nt, Human; identical to SEQ ID NO: 522781

SEQ ID NO: 523869 - RNA, 64 nt, Human; identical to SEQ ID NO: 522782

SEQ ID NO: 523870 - RNA, 64 nt, Human; identical to SEQ ID NO: 522783

SEQ ID NO: 523871 - RNA, 64 nt, Human; identical to SEQ ID NO: 522784

SEQ ID NO: 523872 - RNA, 64 nt, Human; identical to SEQ ID NO: 522785

SEQ ID NO: 523873 - RNA, 64 nt, Human; identical to SEQ ID NO: 522786

SEQ ID NO: 523874 - RNA, 64 nt, Human; identical to SEQ ID NO: 522787

SEQ ID NO: 523875 - RNA, 64 nt, Human; identical to SEQ ID NO: 522788

SEQ ID NO: 523876 - RNA, 64 nt, Human; identical to SEQ ID NO: 522789

SEQ ID NO: 523877 - RNA, 64 nt, Human; identical to SEQ ID NO: 522793

SEQ ID NO: 523878 - RNA, 64 nt, Human; identical to SEQ ID NO: 522794

SEQ ID NO: 523879 - RNA, 64 nt, Human; identical to SEQ ID NO: 522795

SEQ ID NO: 523880 - RNA, 64 nt, Human; identical to SEQ ID NO: 522810

SEQ ID NO: 523881 - RNA, 64 nt, Human; identical to SEQ ID NO: 522118

SEQ ID NO: 523882 - RNA, 64 nt, Human; identical to SEQ ID NO: 522144

SEQ ID NO: 523883 - RNA, 64 nt, Human; identical to SEQ ID NO: 522796

SEQ ID NO: 523884 - RNA, 64 nt, Human; identical to SEQ ID NO: 522797

SEQ ID NO: 523885 - RNA, 64 nt, Human; identical to SEQ ID NO: 522798

SEQ ID NO: 523886 - RNA, 64 nt, Human; identical to SEQ ID NO: 522799

SEQ ID NO: 523887 - RNA, 64 nt, Human; identical to SEQ ID NO: 522800

SEQ ID NO: 523888 - RNA, 64 nt, Human; identical to SEQ ID NO: 522801

SEQ ID NO: 523889 - RNA, 64 nt, Human; identical to SEQ ID NO: 522802

SEQ ID NO: 523890 - RNA, 64 nt, Human; identical to SEQ ID NO: 522803

SEQ ID NO: 523891 - RNA, 64 nt, Human; identical to SEQ ID NO: 522804

SEQ ID NO: 523892 - RNA, 64 nt, Human; identical to SEQ ID NO: 522805

SEQ ID NO: 523893 - RNA, 64 nt, Human; identical to SEQ ID NO: 522806

SEQ ID NO: 523894 - RNA, 64 nt, Human; identical to SEQ ID NO: 522807

SEQ ID NO: 523895 - RNA, 64 nt, Human; identical to SEQ ID NO: 522811

SEQ ID NO: 523896 - RNA, 64 nt, Human; identical to SEQ ID NO: 522812

SEQ ID NO: 523897 - RNA, 64 nt, Human; identical to SEQ ID NO: 522813

SEQ ID NO: 523898 - RNA, 64 nt, Human; identical to SEQ ID NO: 522145

SEQ ID NO: 523899 - RNA, 64 nt, Human; identical to SEQ ID NO: 522146

SEQ ID NO: 523900 - RNA, 64 nt, Human; identical to SEQ ID NO: 522162

SEQ ID NO: 523901 - RNA, 64 nt, Human; identical to SEQ ID NO: 522814

SEQ ID NO: 523902 - RNA, 64 nt, Human; identical to SEQ ID NO: 522815

SEQ ID NO: 523903 - RNA, 64 nt, Human; identical to SEQ ID NO: 522816

SEQ ID NO: 523904 - RNA, 64 nt, Human; identical to SEQ ID NO: 522817

SEQ ID NO: 523905 - RNA, 64 nt, Human; identical to SEQ ID NO: 522818

SEQ ID NO: 523906 - RNA, 64 nt, Human; identical to SEQ ID NO: 522819

SEQ ID NO: 523907 - RNA, 64 nt, Human; identical to SEQ ID NO: 522820

SEQ ID NO: 523908 - RNA, 64 nt, Human; identical to SEQ ID NO: 522821

SEQ ID NO: 523909 - RNA, 64 nt, Human; identical to SEQ ID NO: 522822

SEQ ID NO: 523910 - RNA, 64 nt, Human; identical to SEQ ID NO: 522823

SEQ ID NO: 523911 - RNA, 64 nt, Human; identical to SEQ ID NO: 522824

SEQ ID NO: 523912 - RNA, 64 nt, Human; identical to SEQ ID NO: 522825

SEQ ID NO: 523913 - RNA, 64 nt, Human; identical to SEQ ID NO: 522829

SEQ ID NO: 523914 - RNA, 64 nt, Human; identical to SEQ ID NO: 522830

SEQ ID NO: 523915 - RNA, 64 nt, Human; identical to SEQ ID NO: 522831

SEQ ID NO: 523916 - RNA, 64 nt, Human; identical to SEQ ID NO: 522164

SEQ ID NO: 523917 - RNA, 64 nt, Human; identical to SEQ ID NO: 522216

SEQ ID NO: 523918 - RNA, 64 nt, Human; identical to SEQ ID NO: 522217

SEQ ID NO: 523919 - RNA, 64 nt, Human; identical to SEQ ID NO: 522832

SEQ ID NO: 523920 - RNA, 64 nt, Human; identical to SEQ ID NO: 522833

SEQ ID NO: 523921 - RNA, 64 nt, Human; identical to SEQ ID NO: 522834

SEQ ID NO: 523922 - RNA, 64 nt, Human; identical to SEQ ID NO: 522835

SEQ ID NO: 523923 - RNA, 64 nt, Human; identical to SEQ ID NO: 522836

SEQ ID NO: 523924 - RNA, 64 nt, Human; identical to SEQ ID NO: 522837

SEQ ID NO: 523925 - RNA, 64 nt, Human; identical to SEQ ID NO: 522838

SEQ ID NO: 523926 - RNA, 64 nt, Human; identical to SEQ ID NO: 522839

SEQ ID NO: 523927 - RNA, 64 nt, Human; identical to SEQ ID NO: 522840

SEQ ID NO: 523928 - RNA, 64 nt, Human; identical to SEQ ID NO: 522841

SEQ ID NO: 523929 - RNA, 64 nt, Human; identical to SEQ ID NO: 522842

SEQ ID NO: 523930 - RNA, 64 nt, Human; identical to SEQ ID NO: 522843

SEQ ID NO: 523931 - RNA, 64 nt, Human; identical to SEQ ID NO: 522847

SEQ ID NO: 523932 - RNA, 64 nt, Human; identical to SEQ ID NO: 522848

SEQ ID NO: 523933 - RNA, 64 nt, Human; identical to SEQ ID NO: 522849

SEQ ID NO: 523934 - RNA, 64 nt, Human; identical to SEQ ID NO: 522218

SEQ ID NO: 523935 - RNA, 64 nt, Human; identical to SEQ ID NO: 522234

SEQ ID NO: 523936 - RNA, 64 nt, Human; identical to SEQ ID NO: 522235

SEQ ID NO: 523937 - RNA, 64 nt, Human; identical to SEQ ID NO: 522850

SEQ ID NO: 523938 - RNA, 64 nt, Human; identical to SEQ ID NO: 522851

SEQ ID NO: 523939 - RNA, 54 nt, Human; identical to SEQ ID NO: 522852

SEQ ID NO: 523940 - RNA, 64 nt, Human; identical to SEQ ID NO: 522853

SEQ ID NO: 523941 - RNA, 64 nt, Human; identical to SEQ ID NO: 522854

SEQ ID NO: 523942 - RNA, 64 nt, Human; identical to SEQ ID NO: 522855

SEQ ID NO: 523943 - RNA, 64 nt, Human; identical to SEQ ID NO: 522856

SEQ ID NO: 523944 - RNA, 64 nt, Human; identical to SEQ ID NO: 522857

SEQ ID NO: 523945 - RNA, 64 nt, Human; identical to SEQ ID NO: 522858

SEQ ID NO: 523946 - RNA, 64 nt, Human; identical to SEQ ID NO: 522859

SEQ ID NO: 523947 - RNA, 64 nt, Human; identical to SEQ ID NO: 522860

SEQ ID NO: 523948 - RNA, 64 nt, Human; identical to SEQ ID NO: 522861

SEQ ID NO: 523949 - RNA, 64 nt, Human; identical to SEQ ID NO: 522865

SEQ ID NO: 523950 - RNA, 64 nt, Human; identical to SEQ ID NO: 522866

SEQ ID NO: 523951 - RNA, 64 nt, Human; identical to SEQ ID NO: 522867

SEQ ID NO: 523952 - RNA, 64 nt, Human
aacuguuucccuuugauucuccaguauuccuguuuccauccaguuccuuacucuccucuuuccu

SEQ ID NO: 523953 - RNA, 64 nt, Human
caguucugcucugguuguuucuguuccaaaugauuccauccaccuuucccaaucggccuuacuu

SEQ ID NO: 523954 - RNA, 64 nt, Human
auuuaagcacagaaaucccagaccuguuguucucuccauccagcgugaccagggcccgagagac

SEQ ID NO: 523955 - RNA, 64 nt, Human; identical to SEQ ID NO: 522868

SEQ ID NO: 523956 - RNA, 64 nt, Human; identical to SEQ ID NO: 522869

SEQ ID NO: 523957 - RNA, 64 nt, Human; identical to SEQ ID NO: 522870

SEQ ID NO: 523958 - RNA, 64 nt, Human; identical to SEQ ID NO: 522871

SEQ ID NO: 523959 - RNA, 64 nt, Human; identical to SEQ ID NO: 522872

SEQ ID NO: 523960 - RNA, 64 nt, Human; identical to SEQ ID NO: 522873

SEQ ID NO: 523961 - RNA, 64 nt, Human; identical to SEQ ID NO: 522874

SEQ ID NO: 523962 - RNA, 64 nt, Human; identical to SEQ ID NO: 522875

SEQ ID NO: 523963 - RNA, 64 nt, Human; identical to SEQ ID NO: 522876

SEQ ID NO: 523964 - RNA, 64 nt, Human; identical to SEQ ID NO: 522877

SEQ ID NO: 523965 - RNA, 64 nt, Human; identical to SEQ ID NO: 522878

SEQ ID NO: 523966 - RNA, 64 nt, Human; identical to SEQ ID NO: 522879

SEQ ID NO: 523967 - RNA, 64 nt, Human; identical to SEQ ID NO: 522883

SEQ ID NO: 523968 - RNA, 64 nt, Human; identical to SEQ ID NO: 522884

SEQ ID NO: 523969 - RNA, 64 nt, Human; identical to SEQ ID NO: 522885

SEQ ID NO: 523970 - RNA, 64 nt, Human; identical to SEQ ID NO: 522252

SEQ ID NO: 523971 - RNA, 64 nt, Human; identical to SEQ ID NO: 522253

SEQ ID NO: 523972 - RNA, 64 nt, Human; identical to SEQ ID NO: 522254

SEQ ID NO: 523973 - RNA, 64 nt, Human; identical to SEQ ID NO: 522886

SEQ ID NO: 523974 - RNA, 64 nt, Human; identical to SEQ ID NO: 522887

SEQ ID NO: 523975 - RNA, 64 nt, Human; identical to SEQ ID NO: 522888

SEQ ID NO: 523976 - RNA, 64 nt, Human; identical to SEQ ID NO: 522889

SEQ ID NO: 523977 - RNA, 64 nt, Human; identical to SEQ ID NO: 522890

SEQ ID NO: 523978 - RNA, 64 nt, Human; identical to SEQ ID NO: 522891

SEQ ID NO: 523979 - RNA, 64 nt, Human; identical to SEQ ID NO: 522892

SEQ ID NO: 523980 - RNA, 64 nt, Human; identical to SEQ ID NO: 522893

SEQ ID NO: 523981 - RNA, 64 nt, Human; identical to SEQ ID NO: 522894

SEQ ID NO: 523982 - RNA, 64 nt, Human; identical to SEQ ID NO: 522895

SEQ ID NO: 523983 - RNA, 64 nt, Human; identical to SEQ ID NO: 522896

SEQ ID NO: 523984 - RNA, 64 nt, Human; identical to SEQ ID NO: 522897

SEQ ID NO: 523985 - RNA, 64 nt, Human; identical to SEQ ID NO: 522901

SEQ ID NO: 523986 - RNA, 64 nt, Human; identical to SEQ ID NO: 522902

SEQ ID NO: 523987 - RNA, 64 nt, Human; identical to SEQ ID NO: 522903

SEQ ID NO: 523988 - RNA, 64 nt, Human; identical to SEQ ID NO: 522416

SEQ ID NO: 523989 - RNA, 64 nt, Human; identical to SEQ ID NO: 522111

SEQ ID NO: 523990 - RNA, 64 nt, Human; identical to SEQ ID NO: 522432

SEQ ID NO: 523991 - RNA, 60 nt, Human; identical to SEQ ID NO: 522904

SEQ ID NO: 523992 - RNA, 64 nt, Human; identical to SEQ ID NO: 522905

SEQ ID NO: 523993 - RNA, 64 nt, Human; identical to SEQ ID NO: 522906

SEQ ID NO: 523994 - RNA, 64 nt, Human; identical to SEQ ID NO: 522907

SEQ ID NO: 523995 - RNA, 64 nt, Human; identical to SEQ ID NO: 522908

SEQ ID NO: 523996 - RNA, 64 nt, Human; identical to SEQ ID NO: 522909

SEQ ID NO: 523997 - RNA, 64 nt, Human; identical to SEQ ID NO: 522910

SEQ ID NO: 523998 - RNA, 64 nt, Human; identical to SEQ ID NO: 522911

SEQ ID NO: 523999 - RNA, 64 nt, Human; identical to SEQ ID NO: 522912

SEQ ID NO: 524000 - RNA, 64 nt, Human; identical to SEQ ID NO: 522913

SEQ ID NO: 524001 - RNA, 53 nt, Human; identical to SEQ ID NO: 522914

SEQ ID NO: 524002 - RNA, 64 nt, Human; identical to SEQ ID NO: 522915

SEQ ID NO: 524003 - RNA, 64 nt, Human; identical to SEQ ID NO: 522919

SEQ ID NO: 524004 - RNA, 64 nt, Human; identical to SEQ ID NO: 522920

SEQ ID NO: 524005 - RNA, 64 nt, Human; identical to SEQ ID NO: 522921

SEQ ID NO: 524006 - RNA, 64 nt, Human; identical to SEQ ID NO: 522433

SEQ ID NO: 524007 - RNA, 64 nt, Human; identical to SEQ ID NO: 522434

SEQ ID NO: 524008 - RNA, 64 nt, Human; identical to SEQ ID NO: 522450

SEQ ID NO: 524009 - RNA, 64 nt, Human; identical to SEQ ID NO: 522922

SEQ ID NO: 524010 - RNA, 64 nt, Human; identical to SEQ ID NO: 522923

SEQ ID NO: 524011 - RNA, 64 nt, Human; identical to SEQ ID NO: 522924

SEQ ID NO: 524012 - RNA, 64 nt, Human; identical to SEQ ID NO: 522925

SEQ ID NO: 524013 - RNA, 64 nt, Human; identical to SEQ ID NO: 522926

SEQ ID NO: 524014 - RNA, 64 nt, Human; identical to SEQ ID NO: 522927

SEQ ID NO: 524015 - RNA, 64 nt, Human; identical to SEQ ID NO: 522928

SEQ ID NO: 524016 - RNA, 64 nt, Human; identical to SEQ ID NO: 522929

SEQ ID NO: 524017 - RNA, 64 nt, Human; identical to SEQ ID NO: 522930

SEQ ID NO: 524018 - RNA, 64 nt, Human; identical to SEQ ID NO: 522931

SEQ ID NO: 524019 - RNA, 64 nt, Human; identical to SEQ ID NO: 522932

SEQ ID NO: 524020 - RNA, 64 nt, Human; identical to SEQ ID NO: 522933

SEQ ID NO: 524021 - RNA, 64 nt, Human; identical to SEQ ID NO: 522937

SEQ ID NO: 524022 - RNA, 64 nt, Human; identical to SEQ ID NO: 522938

SEQ ID NO: 524023 - RNA, 64 nt, Human; identical to SEQ ID NO: 522939

SEQ ID NO: 524024 - RNA, 64 nt, Human; identical to SEQ ID NO: 522270

SEQ ID NO: 524025 - RNA, 64 nt, Human; identical to SEQ ID NO: 522271

SEQ ID NO: 524026 - RNA, 64 nt, Human; identical to SEQ ID NO: 522272

SEQ ID NO: 524027 - RNA, 64 nt, Human; identical to SEQ ID NO: 522940

SEQ ID NO: 524028 - RNA, 64 nt, Human; identical to SEQ ID NO: 522941

SEQ ID NO: 524029 - RNA, 64 nt, Human; identical to SEQ ID NO: 522942

SEQ ID NO: 524030 - RNA, 64 nt, Human; identical to SEQ ID NO: 522943

SEQ ID NO: 524031 - RNA, 64 nt, Human; identical to SEQ ID NO: 522944

SEQ ID NO: 524032 - RNA, 51 nt, Human; identical to SEQ ID NO: 522945

SEQ ID NO: 524033 - RNA, 64 nt, Human; identical to SEQ ID NO: 522946

SEQ ID NO: 524034 - RNA, 64 nt, Human; identical to SEQ ID NO: 522947

SEQ ID NO: 524035 - RNA, 64 nt, Human; identical to SEQ ID NO: 522948

SEQ ID NO: 524036 - RNA, 64 nt, Human; identical to SEQ ID NO: 522949

SEQ ID NO: 524037 - RNA, 64 nt, Human; identical to SEQ ID NO: 522950

SEQ ID NO: 524038 - RNA, 64 nt, Human; identical to SEQ ID NO: 522951

SEQ ID NO: 524039 - RNA, 64 nt, Human; identical to SEQ ID NO: 522955

SEQ ID NO: 524040 - RNA, 64 nt, Human; identical to SEQ ID NO: 522956

SEQ ID NO: 524041 - RNA, 64 nt, Human; identical to SEQ ID NO: 522957

SEQ ID NO: 524042 - RNA, 64 nt, Human; identical to SEQ ID NO: 522289

SEQ ID NO: 524043 - RNA, 64 nt, Human; identical to SEQ ID NO: 522290

SEQ ID NO: 524044 - RNA, 55 nt, Human; identical to SEQ ID NO: 522306

SEQ ID NO: 524045 - RNA, 64 nt, Human; identical to SEQ ID NO: 522958

SEQ ID NO: 524046 - RNA, 64 nt, Human; identical to SEQ ID NO: 522959

SEQ ID NO: 524047 - RNA, 64 nt, Human; identical to SEQ ID NO: 522960

SEQ ID NO: 524048 - RNA, 64 nt, Human; identical to SEQ ID NO: 522961

SEQ ID NO: 524049 - RNA, 64 nt, Human; identical to SEQ ID NO: 522962

SEQ ID NO: 524050 - RNA, 64 nt, Human; identical to SEQ ID NO: 522963

SEQ ID NO: 524051 - RNA, 64 nt, Human; identical to SEQ ID NO: 522964

SEQ ID NO: 524052 - RNA, 64 nt, Human; identical to SEQ ID NO: 522965

SEQ ID NO: 524053 - RNA, 64 nt, Human; identical to SEQ ID NO: 522966

SEQ ID NO: 524054 - RNA, 64 nt, Human; identical to SEQ ID NO: 522967

SEQ ID NO: 524055 - RNA, 64 nt, Human; identical to SEQ ID NO: 522968

SEQ ID NO: 524056 - RNA, 64 nt, Human; identical to SEQ ID NO: 522969

SEQ ID NO: 524057 - RNA, 64 nt, Human; identical to SEQ ID NO: 522973

SEQ ID NO: 524058 - RNA, 64 nt, Human; identical to SEQ ID NO: 522974

SEQ ID NO: 524059 - RNA, 64 nt, Human; identical to SEQ ID NO: 522975

SEQ ID NO: 524060 - RNA, 64 nt, Human; identical to SEQ ID NO: 522452

SEQ ID NO: 524061 - RNA, 64 nt, Human; identical to SEQ ID NO: 522112

SEQ ID NO: 524062 - RNA, 64 nt, Human; identical to SEQ ID NO: 522468

SEQ ID NO: 524063 - RNA, 64 nt, Human; identical to SEQ ID NO: 522976

SEQ ID NO: 524064 - RNA, 64 nt, Human; identical to SEQ ID NO: 522977

SEQ ID NO: 524065 - RNA, 64 nt, Human; identical to SEQ ID NO: 522978

SEQ ID NO: 524066 - RNA, 64 nt, Human; identical to SEQ ID NO: 522979

SEQ ID NO: 524067 - RNA, 64 nt, Human; identical to SEQ ID NO: 522980

SEQ ID NO: 524068 - RNA, 64 nt, Human; identical to SEQ ID NO: 522981

SEQ ID NO: 524069 - RNA, 64 nt, Human; identical to SEQ ID NO: 522982

SEQ ID NO: 524070 - RNA, 64 nt, Human; identical to SEQ ID NO: 522983

SEQ ID NO: 524071 - RNA, 64 nt, Human; identical to SEQ ID NO: 522984

SEQ ID NO: 524072 - RNA, 64 nt, Human; identical to SEQ ID NO: 522985

SEQ ID NO: 524073 - RNA, 64 nt, Human; identical to SEQ ID NO: 522986

SEQ ID NO: 524074 - RNA, 64 nt, Human; identical to SEQ ID NO: 522987

SEQ ID NO: 524075 - RNA, 64 nt, Human; identical to SEQ ID NO: 522991

SEQ ID NO: 524076 - RNA, 64 nt, Human; identical to SEQ ID NO: 522992

SEQ ID NO: 524077 - RNA, 64 nt, Human; identical to SEQ ID NO: 522993

SEQ ID NO: 524078 - RNA, 64 nt, Human; identical to SEQ ID NO: 522469

SEQ ID NO: 524079 - RNA, 64 nt, Human; identical to SEQ ID NO: 522470

SEQ ID NO: 524080 - RNA, 64 nt, Human; identical to SEQ ID NO: 522486

SEQ ID NO: 524081 - RNA, 64 nt, Human; identical to SEQ ID NO: 522994

SEQ ID NO: 524082 - RNA, 64 nt, Human; identical to SEQ ID NO: 522995

SEQ ID NO: 524083 - RNA, 64 nt, Human; identical to SEQ ID NO: 522996

SEQ ID NO: 524084 - RNA, 64 nt, Human; identical to SEQ ID NO: 522997

SEQ ID NO: 524085 - RNA, 64 nt, Human; identical to SEQ ID NO: 522998

SEQ ID NO: 524086 - RNA, 64 nt, Human; identical to SEQ ID NO: 522999

SEQ ID NO: 524087 - RNA, 64 nt, Human; identical to SEQ ID NO: 523000

SEQ ID NO: 524088 - RNA, 64 nt, Human; identical to SEQ ID NO: 523001

SEQ ID NO: 524089 - RNA, 64 nt, Human; identical to SEQ ID NO: 523002

SEQ ID NO: 524090 - RNA, 64 nt, Human; identical to SEQ ID NO: 523003

SEQ ID NO: 524091 - RNA, 64 nt, Human; identical to SEQ ID NO: 523004

SEQ ID NO: 524092 - RNA, 64 nt, Human; identical to SEQ ID NO: 523005

SEQ ID NO: 524093 - RNA, 64 nt, Human; identical to SEQ ID NO: 523009

SEQ ID NO: 524094 - RNA, 64 nt, Human; identical to SEQ ID NO: 523010

SEQ ID NO: 524095 - RNA, 64 nt, Human; identical to SEQ ID NO: 523011

SEQ ID NO: 524096 - RNA, 64 nt, Human; identical to SEQ ID NO: 522488

SEQ ID NO: 524097 - RNA, 64 nt, Human; identical to SEQ ID NO: 522113

SEQ ID NO: 524098 - RNA, 64 nt, Human; identical to SEQ ID NO: 522504

SEQ ID NO: 524099 - RNA, 64 nt, Human; identical to SEQ ID NO: 523012

SEQ ID NO: 524100 - RNA, 64 nt, Human; identical to SEQ ID NO: 523013

SEQ ID NO: 524101 - RNA, 64 nt, Human; identical to SEQ ID NO: 523014

SEQ ID NO: 524102 - RNA, 64 nt, Human; identical to SEQ ID NO: 523015

SEQ ID NO: 524103 - RNA, 64 nt, Human; identical to SEQ ID NO: 523016

SEQ ID NO: 524104 - RNA, 64 nt, Human; identical to SEQ ID NO: 523017

SEQ ID NO: 524105 - RNA, 64 nt, Human; identical to SEQ ID NO: 523018

SEQ ID NO: 524106 - RNA, 64 nt, Human; identical to SEQ ID NO: 523019

SEQ ID NO: 524107 - RNA, 64 nt, Human; identical to SEQ ID NO: 523020

SEQ ID NO: 524108 - RNA, 64 nt, Human; identical to SEQ ID NO: 523021

SEQ ID NO: 524109 - RNA, 64 nt, Human; identical to SEQ ID NO: 523022

SEQ ID NO: 524110 - RNA, 64 nt, Human; identical to SEQ ID NO: 523023

SEQ ID NO: 524111 - RNA, 64 nt, Human; identical to SEQ ID NO: 523027

SEQ ID NO: 524112 - RNA, 64 nt, Human; identical to SEQ ID NO: 523028

SEQ ID NO: 524113 - RNA, 64 nt, Human; identical to SEQ ID NO: 523029

SEQ ID NO: 524114 - RNA, 64 nt, Human; identical to SEQ ID NO: 522505

SEQ ID NO: 524115 - RNA, 64 nt, Human; identical to SEQ ID NO: 522506

SEQ ID NO: 524116 - RNA, 64 nt, Human; identical to SEQ ID NO: 522522

SEQ ID NO: 524117 - RNA, 64 nt, Human; identical to SEQ ID NO: 523030

SEQ ID NO: 524118 - RNA, 64 nt, Human; identical to SEQ ID NO: 523031

SEQ ID NO: 524119 - RNA, 64 nt, Human; identical to SEQ ID NO: 523032

SEQ ID NO: 524120 - RNA, 64 nt, Human; identical to SEQ ID NO: 523033

SEQ ID NO: 524121 - RNA, 64 nt, Human; identical to SEQ ID NO: 523034

SEQ ID NO: 524122 - RNA, 64 nt, Human; identical to SEQ ID NO: 523035

SEQ ID NO: 524123 - RNA, 64 nt, Human; identical to SEQ ID NO: 523036

SEQ ID NO: 524124 - RNA, 64 nt, Human; identical to SEQ ID NO: 523037

SEQ ID NO: 524125 - RNA, 64 nt, Human; identical to SEQ ID NO: 523038

SEQ ID NO: 524126 - RNA, 64 nt, Human; identical to SEQ ID NO: 523039

SEQ ID NO: 524127 - RNA, 64 nt, Human; identical to SEQ ID NO: 523040

SEQ ID NO: 524128 - RNA, 64 nt, Human; identical to SEQ ID NO: 523041

SEQ ID NO: 524129 - RNA, 64 nt, Human; identical to SEQ ID NO: 523045

SEQ ID NO: 524130 - RNA, 64 nt, Human; identical to SEQ ID NO: 523046

SEQ ID NO: 524131 - RNA, 64 nt, Human; identical to SEQ ID NO: 523047

SEQ ID NO: 524132 - RNA, 64 nt, Human; identical to SEQ ID NO: 522307

SEQ ID NO: 524133 - RNA, 64 nt, Human; identical to SEQ ID NO: 522308

SEQ ID NO: 524134 - RNA, 64 nt, Human
guugguggccaagaccuucucucuccaccccuccuccauccacccugaggacccuggggcucag

SEQ ID NO: 524135 - RNA, 64 nt, Human; identical to SEQ ID NO: 523048

SEQ ID NO: 524136 - RNA, 64 nt, Human; identical to SEQ ID NO: 523049

SEQ ID NO: 524137 - RNA, 64 nt, Human; identical to SEQ ID NO: 523050

SEQ ID NO: 524138 - RNA, 64 nt, Human; identical to SEQ ID NO: 523051

SEQ ID NO: 524139 - RNA, 64 nt, Human; identical to SEQ ID NO: 523052

SEQ ID NO: 524140 - RNA, 64 nt, Human; identical to SEQ ID NO: 523053

SEQ ID NO: 524141 - RNA, 64 nt, Human; identical to SEQ ID NO: 523054

SEQ ID NO: 524142 - RNA, 64 nt, Human; identical to SEQ ID NO: 523055

SEQ ID NO: 524143 - RNA, 64 nt, Human; identical to SEQ ID NO: 523056

SEQ ID NO: 524144 - RNA, 64 nt, Human; identical to SEQ ID NO: 523057

SEQ ID NO: 524145 - RNA, 64 nt, Human; identical to SEQ ID NO: 523058

SEQ ID NO: 524146 - RNA, 64 nt, Human; identical to SEQ ID NO: 523059

SEQ ID NO: 524147 - RNA, 64 nt, Human; identical to SEQ ID NO: 523063

SEQ ID NO: 524148 - RNA, 64 nt, Human; identical to SEQ ID NO: 523064

SEQ ID NO: 524149 - RNA, 64 nt, Human; identical to SEQ ID NO: 523065

SEQ ID NO: 524150 - RNA, 64 nt, Human; identical to SEQ ID NO: 522524

SEQ ID NO: 524151 - RNA, 64 nt, Human; identical to SEQ ID NO: 522114

SEQ ID NO: 524152 - RNA, 64 nt, Human; identical to SEQ ID NO: 522540

SEQ ID NO: 524153 - RNA, 64 nt, Human; identical to SEQ ID NO: 523066

SEQ ID NO: 524154 - RNA, 64 nt, Human; identical to SEQ ID NO: 523067

SEQ ID NO: 524155 - RNA, 64 nt, Human; identical to SEQ ID NO: 523068

SEQ ID NO: 524156 - RNA, 64 nt, Human; identical to SEQ ID NO: 523069

SEQ ID NO: 524157 - RNA, 64 nt, Human; identical to SEQ ID NO: 523070

SEQ ID NO: 524158 - RNA, 64 nt, Human; identical to SEQ ID NO: 523071

SEQ ID NO: 524159 - RNA, 64 nt, Human; identical to SEQ ID NO: 523072

SEQ ID NO: 524160 - RNA, 64 nt, Human
acccuccgcacucaccugccgggacccucccuauuccauccaagggaagcagaacugccaaaga

SEQ ID NO: 524161 - RNA, 64 nt, Human
cuggaagacaagguguuucugccaaacggggaccuccauccagagaaaaggaagaaggugcagg

SEQ ID NO: 524162 - RNA, 64 nt, Human; identical to SEQ ID NO: 522541

SEQ ID NO: 524163 - RNA, 64 nt, Human; identical to SEQ ID NO: 522542

SEQ ID NO: 524164 - RNA, 64 nt, Human; identical to SEQ ID NO: 522556

SEQ ID NO: 524165 - RNA, 64 nt, Human
gggccccaggcaaggugcagccuuugcucacagcuccauccaugucuagaccuucaggccaguc

SEQ ID NO: 524166 - RNA, 64 nt, Human
cugaaaagagaagcuccguuguguacugaggauauccauccauauucagcuagcuuucaaaugg

SEQ ID NO: 524167 - RNA, 64 nt, Human
aauucaguaauuguugauaguauuacuuaccuaguccauccauacucauauuauucaaauauau

SEQ ID NO: 524168 - RNA, 64 nt, Human
guuuucaccucuaguucuggauguacauuccauuuccauccacaguguacuuuaagauugucuu

SEQ ID NO: 524169 - RNA, 64 nt, Human
acacuguaccugccugcugaacagccugcccccguccauccaugagccagcauccguccguccu

SEQ ID NO: 524170 - RNA, 64 nt, Human
uaaaauauauuuguauuauuuguccuucauacuauccauccauaccacacuaucuucuguauca

SEQ ID NO: 524171 - RNA, 64 nt, Human
uuugcuucaucuggagucccuccucccccacgccuccauccacacacagcagcuccaaccugga

SEQ ID NO: 524172 - RNA, 64 nt, Human
cucuucucugggcaagaugagccaagcagaacauuccauccaggacacuggaaguucuccagga

SEQ ID NO: 524173 - RNA, 64 nt, Human
cucugaugcuucuuuagauuuaagaguucauaauuccauccacugcugagaaaucuccucaaac

SEQ ID NO: 524174 - RNA, 64 nt, Human
ggcuauauaugauuuggcuauuauuucuagacacuccauccacaugauuccacuaacaaggauu

SEQ ID NO: 524175 - RNA, 64 nt, Human
uaaagcauuccacaaauaugagaugaugguauuauccauccauaaauagguagauauaucucua

SEQ ID NO: 524176 - RNA, 64 nt, Human
ucagcugggucacauccaucccuccauucauccuuccauccaucuuuccauccauuaccuccau

SEQ ID NO: 524177 - RNA, 64 nt, Human
cauccaucccuccauucauccuuccauccaucuuuccauccauuaccuccauccauccuuccaa

SEQ ID NO: 524178 - RNA, 64 nt, Human
auucauccuuccauccaucuuuccauccauuaccuccauccauccuuccaacauauauuuauug

SEQ ID NO: 524179 - RNA, 64 nt, Human
ccacgaaagcauucagaaacccuacaaccaaaaguccauccacagcuucaugacccacccugaa

SEQ ID NO: 524180 - RNA, 64 nt, Human
gcugugacuggaggggcaggagaugguccaaguguccauccagagaugagacucuuagaaucaa

SEQ ID NO: 524181 - RNA, 64 nt, Human
augguguuuguagcauuuuuaucauacaguagauuccauccauucacuauacuuuucuaacuga

SEQ ID NO: 524182 - RNA, 64 nt, Human; identical to SEQ ID NO: 523060

SEQ ID NO: 524183 - RNA, 64 nt, Human; identical to SEQ ID NO: 523061

SEQ ID NO: 524184 - RNA, 64 nt, Human; identical to SEQ ID NO: 523062

SEQ ID NO: 524185 - RNA, 64 nt, Human
uuuaguuaaguauagcaauucaaacugaccugcauccauccaaaacaaauuccuccuucaaccu

SEQ ID NO: 524186 - RNA, 64 nt, Human
cacuggagugccgagcccugccuuccacccagcguccauccagccccuguccucaccucuccgg

SEQ ID NO: 524187 - RNA, 64 nt, Human
cuauacuuaggaaaaagccuuuguuguccucccauccauccauuaagcugcuaucucagccugu

SEQ ID NO: 524188 - RNA, 64 nt, Human
guuuucugguugugcccaucuguaccagcuccuuuccauccaccuucguaugcacccagauuuu

SEQ ID NO: 524189 - RNA, 64 nt, Human
uaucacuacaguuauaggaaguuucagucuacaguccauccaaaggaccaaccugccuuacaca

SEQ ID NO: 524190 - RNA, 64 nt, Human
gauaugcauuuauuuaaaaugcauuagacucucuuccauccaucaaauacuuuacaggauggca

SEQ ID NO: 524191 - RNA, 64 nt, Human
ucguccuugccucuacucggucauucuccccauuuccauccauuaccccuuagccauugagacu

SEQ ID NO: 524192 - RNA, 64 nt, Human
gugagauguuuggcaagaaauccccuaacugauuuccauccaaaccuaccuuauagagcacaau

SEQ ID NO: 524193 - RNA, 64 nt, Human
uuuuguaguuuggaugaauauguccugagaaauuuccauccacuuugguucagcggacaucaag

SEQ ID NO: 524194 - RNA, 64 nt, Human
uggucugcuccgccuggggcagaaagccacaaacuccauccagauccggaacgucagccagcuc

SEQ ID NO: 524195 - RNA, 64 nt, Human
gcuuccucccuggugugaacucuuucuuugguauuccauccacuauccuggcaacucaaggcug

SEQ ID NO: 524196 - RNA, 64 nt, Human
auggaacuguuuucugguccacaugaacacaggcuccauccaggcccagcuccuacccaccgcc

SEQ ID NO: 524197 - RNA, 64 nt, Human
gguaaccuugucugcucugccauuccacugcuccuccauccacucgccaaucccaagagucugg

SEQ ID NO: 524198 - RNA, 64 nt, Human
cguuuugcacaaaugccugcccaccugccccucuuccauccaggagugugcuacugaggggcug

SEQ ID NO: 524199 - RNA, 64 nt, Human
uucuuugcauauaucuagcuacucccuaaaugguuccauccaaggcuuagaguacccaaaggcu

SEQ ID NO: 524200 - RNA, 64 nt, Human
uuacugaagagcaaggcauaaauuuagacuaaaauccauccagauuacacucauucuuuaggcu

SEQ ID NO: 524201 - RNA, 64 nt, Human
gauuauuuaugugauaaaugaaaucuccuaccaauccauccagccuuuaccagggaagaaaagc

SEQ ID NO: 524202 - RNA, 64 nt, Human
ggaguugucacaucagauaagacauaucucuaauuccauccauaaauccaguucuacuauggcu

SEQ ID NO: 524203 - RNA, 64 nt, Human
aaaggcagcagucuucaacauuugguugcaaaucuccauccacaucagggagcuuuccccaggc

SEQ ID NO: 524204 - RNA, 64 nt, Human
uggaccccgcugccacccgcuuuccgggcacccauccauccaggcacccaacucacccaagcag

SEQ ID NO: 524205 - RNA, 64 nt, Human; identical to SEQ ID NO: 524160

SEQ ID NO: 524206 - RNA, 64 nt, Human; identical to SEQ ID NO: 524161

SEQ ID NO: 524207 - RNA, 64 nt, Human; identical to SEQ ID NO: 524165

SEQ ID NO: 524208 - RNA, 64 nt, Human; identical to SEQ ID NO: 524166

SEQ ID NO: 524209 - RNA, 64 nt, Human; identical to SEQ ID NO: 524167

SEQ ID NO: 524210 - RNA, 64 nt, Human; identical to SEQ ID NO: 524168

SEQ ID NO: 524211 - RNA, 64 nt, Human; identical to SEQ ID NO: 524169

SEQ ID NO: 524212 - RNA, 64 nt, Human; identical to SEQ ID NO: 524170

SEQ ID NO: 524213 - RNA, 64 nt, Human; identical to SEQ ID NO: 524171

SEQ ID NO: 524214 - RNA, 64 nt, Human; identical to SEQ ID NO: 524172

SEQ ID NO: 524215 - RNA, 64 nt, Human; identical to SEQ ID NO: 524173

SEQ ID NO: 524216 - RNA, 64 nt, Human; identical to SEQ ID NO: 524174

SEQ ID NO: 524217 - RNA, 64 nt, Human; identical to SEQ ID NO: 524175

SEQ ID NO: 524218 - RNA, 64 nt, Human; identical to SEQ ID NO: 524176

SEQ ID NO: 524219 - RNA, 64 nt, Human; identical to SEQ ID NO: 524177

SEQ ID NO: 524220 - RNA, 64 nt, Human; identical to SEQ ID NO: 524178

SEQ ID NO: 524221 - RNA, 64 nt, Human; identical to SEQ ID NO: 524179

SEQ ID NO: 524222 - RNA, 64 nt, Human; identical to SEQ ID NO: 524180

SEQ ID NO: 524223 - RNA, 64 nt, Human; identical to SEQ ID NO: 524181

SEQ ID NO: 524224 - RNA, 64 nt, Human; identical to SEQ ID NO: 524185

SEQ ID NO: 524225 - RNA, 64 nt, Human; identical to SEQ ID NO: 524186

SEQ ID NO: 524226 - RNA, 64 nt, Human; identical to SEQ ID NO: 524187

SEQ ID NO: 524227 - RNA, 64 nt, Human; identical to SEQ ID NO: 524188

SEQ ID NO: 524228 - RNA, 64 nt, Human; identical to SEQ ID NO: 524189

SEQ ID NO: 524229 - RNA, 64 nt, Human; identical to SEQ ID NO: 524190

SEQ ID NO: 524230 - RNA, 64 nt, Human; identical to SEQ ID NO: 524191

SEQ ID NO: 524231 - RNA, 64 nt, Human; identical to SEQ ID NO: 524192

SEQ ID NO: 524232 - RNA, 64 nt, Human; identical to SEQ ID NO: 524193

SEQ ID NO: 524233 - RNA, 64 nt, Human; identical to SEQ ID NO: 524194

SEQ ID NO: 524234 - RNA, 64 nt, Human; identical to SEQ ID NO: 524195

SEQ ID NO: 524235 - RNA, 64 nt, Human; identical to SEQ ID NO: 524196

SEQ ID NO: 524236 - RNA, 64 nt, Human; identical to SEQ ID NO: 524197

SEQ ID NO: 524237 - RNA, 64 nt, Human; identical to SEQ ID NO: 524198

SEQ ID NO: 524238 - RNA, 64 nt, Human; identical to SEQ ID NO: 524199

SEQ ID NO: 524239 - RNA, 64 nt, Human; identical to SEQ ID NO: 524200

SEQ ID NO: 524240 - RNA, 64 nt, Human; identical to SEQ ID NO: 524201

SEQ ID NO: 524241 - RNA, 64 nt, Human; identical to SEQ ID NO: 524202

SEQ ID NO: 524242 - RNA, 64 nt, Human; identical to SEQ ID NO: 524203

SEQ ID NO: 524243 - RNA, 64 nt, Human; identical to SEQ ID NO: 524204

SEQ ID NO: 524244 - RNA, 64 nt, Human; identical to SEQ ID NO: 524134

SEQ ID NO: 524245 - RNA, 64 nt, Human; identical to SEQ ID NO: 519710

SEQ ID NO: 524246 - RNA, 64 nt, Human; identical to SEQ ID NO: 523540

SEQ ID NO: 524247 - RNA, 64 nt, Human; identical to SEQ ID NO: 523541

SEQ ID NO: 524248 - RNA, 64 nt, Human; identical to SEQ ID NO: 523542

SEQ ID NO: 524249 - RNA, 64 nt, Human; identical to SEQ ID NO: 523558

SEQ ID NO: 524250 - RNA, 64 nt, Human; identical to SEQ ID NO: 523559

SEQ ID NO: 524251 - RNA, 64 nt, Human; identical to SEQ ID NO: 523560

SEQ ID NO: 524252 - RNA, 64 nt, Human; identical to SEQ ID NO: 519727

SEQ ID NO: 524253 - RNA, 64 nt, Human; identical to SEQ ID NO: 523594

SEQ ID NO: 524254 - RNA, 64 nt, Human; identical to SEQ ID NO: 523595

SEQ ID NO: 524255 - RNA, 64 nt, Human; identical to SEQ ID NO: 523596

SEQ ID NO: 524256 - RNA, 64 nt, Human; identical to SEQ ID NO: 523612

SEQ ID NO: 524257 - RNA, 64 nt, Human; identical to SEQ ID NO: 523613

SEQ ID NO: 524258 - RNA, 64 nt, Human; identical to SEQ ID NO: 523614

SEQ ID NO: 524259 - RNA, 64 nt, Human; identical to SEQ ID NO: 519728

SEQ ID NO: 524260 - RNA, 64 nt, Human; identical to SEQ ID NO: 523629

SEQ ID NO: 524261 - RNA, 64 nt, Human; identical to SEQ ID NO: 523630

SEQ ID NO: 524262 - RNA, 64 nt, Human; identical to SEQ ID NO: 523631

SEQ ID NO: 524263 - RNA, 64 nt, Human; identical to SEQ ID NO: 523646

SEQ ID NO: 524264 - RNA, 64 nt, Human; identical to SEQ ID NO: 523647

SEQ ID NO: 524265 - RNA, 64 nt, Human; identical to SEQ ID NO: 523648

SEQ ID NO: 524266 - RNA, 64 nt, Human; identical to SEQ ID NO: 519729

SEQ ID NO: 524267 - RNA, 54 nt, Human; identical to SEQ ID NO: 523664

SEQ ID NO: 524268 - RNA, 64 nt, Human; identical to SEQ ID NO: 523665

SEQ ID NO: 524269 - RNA, 64 nt, Human; identical to SEQ ID NO: 523666

SEQ ID NO: 524270 - RNA, 64 nt, Human; identical to SEQ ID NO: 523682

SEQ ID NO: 524271 - RNA, 64 nt, Human; identical to SEQ ID NO: 523683

SEQ ID NO: 524272 - RNA, 64 nt, Human; identical to SEQ ID NO: 523684

SEQ ID NO: 524273 - RNA, 64 nt, Human; identical to SEQ ID NO: 519880

SEQ ID NO: 524274 - RNA, 64 nt, Human; identical to SEQ ID NO: 523718

SEQ ID NO: 524275 - RNA, 64 nt, Human; identical to SEQ ID NO: 523719

SEQ ID NO: 524276 - RNA, 64 nt, Human; identical to SEQ ID NO: 523720

SEQ ID NO: 524277 - RNA, 64 nt, Human; identical to SEQ ID NO: 523736

SEQ ID NO: 524278 - RNA, 64 nt, Human; identical to SEQ ID NO: 523737

SEQ ID NO: 524279 - RNA, 64 nt, Human; identical to SEQ ID NO: 523738

SEQ ID NO: 524280 - RNA, 64 nt, Human; identical to SEQ ID NO: 519881

SEQ ID NO: 524281 - RNA, 64 nt, Human; identical to SEQ ID NO: 523754

SEQ ID NO: 524282 - RNA, 64 nt, Human; identical to SEQ ID NO: 523755

SEQ ID NO: 524283 - RNA, 64 nt, Human; identical to SEQ ID NO: 523756

SEQ ID NO: 524284 - RNA, 64 nt, Human; identical to SEQ ID NO: 523826

SEQ ID NO: 524285 - RNA, 64 nt, Human; identical to SEQ ID NO: 523827

SEQ ID NO: 524286 - RNA, 64 nt, Human; identical to SEQ ID NO: 523828

SEQ ID NO: 524287 - RNA, 64 nt, Human; identical to SEQ ID NO: 519898

SEQ ID NO: 524288 - RNA, 64 nt, Human; identical to SEQ ID NO: 523324

SEQ ID NO: 524289 - RNA, 64 nt, Human; identical to SEQ ID NO: 523325

SEQ ID NO: 524290 - RNA, 64 nt, Human; identical to SEQ ID NO: 523326

SEQ ID NO: 524291 - RNA, 64 nt, Human; identical to SEQ ID NO: 523342

SEQ ID NO: 524292 - RNA, 64 nt, Human; identical to SEQ ID NO: 523343

SEQ ID NO: 524293 - RNA, 64 nt, Human; identical to SEQ ID NO: 523344

SEQ ID NO: 524294 - RNA, 64 nt, Human; identical to SEQ ID NO: 519899

SEQ ID NO: 524295 - RNA, 64 nt, Human; identical to SEQ ID NO: 523360

SEQ ID NO: 524296 - RNA, 64 nt, Human; identical to SEQ ID NO: 523361

SEQ ID NO: 524297 - RNA, 64 nt, Human; identical to SEQ ID NO: 523362

SEQ ID NO: 524298 - RNA, 64 nt, Human; identical to SEQ ID NO: 523378

SEQ ID NO: 524299 - RNA, 64 nt, Human; identical to SEQ ID NO: 523379

SEQ ID NO: 524300 - RNA, 64 nt, Human; identical to SEQ ID NO: 523380

SEQ ID NO: 524301 - RNA, 64 nt, Human; identical to SEQ ID NO: 519900

SEQ ID NO: 524302 - RNA, 64 nt, Human; identical to SEQ ID NO: 523396

SEQ ID NO: 524303 - RNA, 62 nt, Human; identical to SEQ ID NO: 523397

SEQ ID NO: 524304 - RNA, 64 nt, Human; identical to SEQ ID NO: 523398

SEQ ID NO: 524305 - RNA, 64 nt, Human; identical to SEQ ID NO: 523414

SEQ ID NO: 524306 - RNA, 64 nt, Human; identical to SEQ ID NO: 523415

SEQ ID NO: 524307 - RNA, 64 nt, Human; identical to SEQ ID NO: 523416

SEQ ID NO: 524308 - RNA, 64 nt, Human; identical to SEQ ID NO: 519917

SEQ ID NO: 524309 - RNA, 64 nt, Human; identical to SEQ ID NO: 523450

SEQ ID NO: 524310 - RNA, 64 nt, Human; identical to SEQ ID NO: 523451

SEQ ID NO: 524311 - RNA, 64 nt, Human; identical to SEQ ID NO: 523452

SEQ ID NO: 524312 - RNA, 64 nt, Human; identical to SEQ ID NO: 523468

SEQ ID NO: 524313 - RNA, 64 nt, Human; identical to SEQ ID NO: 523469

SEQ ID NO: 524314 - RNA, 64 nt, Human; identical to SEQ ID NO: 523470

SEQ ID NO: 524315 - RNA, 64 nt, Human; identical to SEQ ID NO: 519918

SEQ ID NO: 524316 - RNA, 64 nt, Human; identical to SEQ ID NO: 523486

SEQ ID NO: 524317 - RNA, 64 nt, Human; identical to SEQ ID NO: 523487

SEQ ID NO: 524318 - RNA, 64 nt, Human; identical to SEQ ID NO: 523488

SEQ ID NO: 524319 - RNA, 64 nt, Human; identical to SEQ ID NO: 523504

SEQ ID NO: 524320 - RNA, 64 nt, Human; identical to SEQ ID NO: 523505

SEQ ID NO: 524321 - RNA, 64 nt, Human; identical to SEQ ID NO: 523506

SEQ ID NO: 524322 - RNA, 64 nt, Human; identical to SEQ ID NO: 519919

SEQ ID NO: 524323 - RNA, 64 nt, Human; identical to SEQ ID NO: 523522

SEQ ID NO: 524324 - RNA, 64 nt, Human; identical to SEQ ID NO: 523523

SEQ ID NO: 524325 - RNA, 64 nt, Human; identical to SEQ ID NO: 523524

SEQ ID NO: 524326 - RNA, 64 nt, Human; identical to SEQ ID NO: 523576

SEQ ID NO: 524327 - RNA, 63 nt, Human; identical to SEQ ID NO: 523577

SEQ ID NO: 524328 - RNA, 64 nt, Human; identical to SEQ ID NO: 523578

SEQ ID NO: 524329 - RNA, 64 nt, Human; identical to SEQ ID NO: 521981

SEQ ID NO: 524330 - RNA, 64 nt, Human; identical to SEQ ID NO: 523952

SEQ ID NO: 524331 - RNA, 64 nt, Human; identical to SEQ ID NO: 523953

SEQ ID NO: 524332 - RNA, 64 nt, Human; identical to SEQ ID NO: 523954

SEQ ID NO: 524333 - RNA, 64 nt, Human; identical to SEQ ID NO: 523108

SEQ ID NO: 524334 - RNA, 64 nt, Human; identical to SEQ ID NO: 523109

SEQ ID NO: 524335 - RNA, 64 nt, Human; identical to SEQ ID NO: 523110

SEQ ID NO: 524336 - RNA, 64 nt, Human; identical to SEQ ID NO: 521982

SEQ ID NO: 524337 - RNA, 64 nt, Human; identical to SEQ ID NO: 523090

SEQ ID NO: 524338 - RNA, 64 nt, Human; identical to SEQ ID NO: 523091

SEQ ID NO: 524339 - RNA, 64 nt, Human; identical to SEQ ID NO: 523092

SEQ ID NO: 524340 - RNA, 64 nt, Human; identical to SEQ ID NO: 523126

SEQ ID NO: 524341 - RNA, 64 nt, Human; identical to SEQ ID NO: 523127

SEQ ID NO: 524342 - RNA, 64 nt, Human; identical to SEQ ID NO: 523128

SEQ ID NO: 524343 - RNA, 64 nt, Human; identical to SEQ ID NO: 521983

SEQ ID NO: 524344 - RNA, 64 nt, Human; identical to SEQ ID NO: 523144

SEQ ID NO: 524345 - RNA, 64 nt, Human; identical to SEQ ID NO: 523145

SEQ ID NO: 524346 - RNA, 64 nt, Human; identical to SEQ ID NO: 523146

SEQ ID NO: 524347 - RNA, 64 nt, Human; identical to SEQ ID NO: 523162

SEQ ID NO: 524348 - RNA, 64 nt, Human; identical to SEQ ID NO: 523163

SEQ ID NO: 524349 - RNA, 64 nt, Human; identical to SEQ ID NO: 523164

SEQ ID NO: 524350 - RNA, 64 nt, Human; identical to SEQ ID NO: 522017

SEQ ID NO: 524351 - RNA, 64 nt, Human; identical to SEQ ID NO: 523198

SEQ ID NO: 524352 - RNA, 64 nt, Human; identical to SEQ ID NO: 523199

SEQ ID NO: 524353 - RNA, 64 nt, Human; identical to SEQ ID NO: 523200

SEQ ID NO: 524354 - RNA, 64 nt, Human; identical to SEQ ID NO: 523216

SEQ ID NO: 524355 - RNA, 64 nt, Human; identical to SEQ ID NO: 523217

SEQ ID NO: 524356 - RNA, 64 nt, Human; identical to SEQ ID NO: 523218

SEQ ID NO: 524357 - RNA, 64 nt, Human; identical to SEQ ID NO: 522018

SEQ ID NO: 524358 - RNA, 64 nt, Human; identical to SEQ ID NO: 523234

SEQ ID NO: 524359 - RNA, 64 nt, Human; identical to SEQ ID NO: 523235

SEQ ID NO: 524360 - RNA, 64 nt, Human; identical to SEQ ID NO: 523236

SEQ ID NO: 524361 - RNA, 64 nt, Human; identical to SEQ ID NO: 523252

SEQ ID NO: 524362 - RNA, 64 nt, Human; identical to SEQ ID NO: 523253

SEQ ID NO: 524363 - RNA, 64 nt, Human; identical to SEQ ID NO: 523254

SEQ ID NO: 524364 - RNA, 64 nt, Human; identical to SEQ ID NO: 522019

SEQ ID NO: 524365 - RNA, 64 nt, Human; identical to SEQ ID NO: 523270

SEQ ID NO: 524366 - RNA, 64 nt, Human; identical to SEQ ID NO: 523271

SEQ ID NO: 524367 - RNA, 64 nt, Human; identical to SEQ ID NO: 523272

SEQ ID NO: 524368 - RNA, 64 nt, Human; identical to SEQ ID NO: 523288

SEQ ID NO: 524369 - RNA, 64 nt, Human; identical to SEQ ID NO: 523289

SEQ ID NO: 524370 - RNA, 64 nt, Human; identical to SEQ ID NO: 523290

SEQ ID NO: 524371 - RNA, 64 nt, Human; identical to SEQ ID NO: 522035

SEQ ID NO: 524372 - RNA, 64 nt, Human; identical to SEQ ID NO: 523432

SEQ ID NO: 524373 - RNA, 64 nt, Human; identical to SEQ ID NO: 523433

SEQ ID NO: 524374 - RNA, 64 nt, Human; identical to SEQ ID NO: 523434

SEQ ID NO: 524375 - RNA, 64 nt, Human; identical to SEQ ID NO: 523700

SEQ ID NO: 524376 - RNA, 64 nt, Human; identical to SEQ ID NO: 523701

SEQ ID NO: 524377 - RNA, 64 nt, Human; identical to SEQ ID NO: 523702

SEQ ID NO: 524378 - RNA, 64 nt, Human; identical to SEQ ID NO: 522036

SEQ ID NO: 524379 - RNA, 64 nt, Human; identical to SEQ ID NO: 522862

SEQ ID NO: 524380 - RNA, 64 nt, Human; identical to SEQ ID NO: 522863

SEQ ID NO: 524381 - RNA, 64 nt, Human; identical to SEQ ID NO: 522864

SEQ ID NO: 524382 - RNA, 64 nt, Human; identical to SEQ ID NO: 522880

SEQ ID NO: 524383 - RNA, 64 nt, Human; identical to SEQ ID NO: 522881

SEQ ID NO: 524384 - RNA, 64 nt, Human; identical to SEQ ID NO: 522882

SEQ ID NO: 524385 - RNA, 64 nt, Human; identical to SEQ ID NO: 522037

SEQ ID NO: 524386 - RNA, 64 nt, Human; identical to SEQ ID NO: 522898

SEQ ID NO: 524387 - RNA, 64 nt, Human; identical to SEQ ID NO: 522899

SEQ ID NO: 524388 - RNA, 64 nt, Human; identical to SEQ ID NO: 522900

SEQ ID NO: 524389 - RNA, 64 nt, Human; identical to SEQ ID NO: 522916

SEQ ID NO: 524390 - RNA, 64 nt, Human; identical to SEQ ID NO: 522917

SEQ ID NO: 524391 - RNA, 64 nt, Human; identical to SEQ ID NO: 522918

SEQ ID NO: 524392 - RNA, 64 nt, Human; identical to SEQ ID NO: 522053

SEQ ID NO: 524393 - RNA, 64 nt, Human; identical to SEQ ID NO: 522952

SEQ ID NO: 524394 - RNA, 64 nt, Human; identical to SEQ ID NO: 522953

SEQ ID NO: 524395 - RNA, 64 nt, Human; identical to SEQ ID NO: 522954

SEQ ID NO: 524396 - RNA, 64 nt, Human; identical to SEQ ID NO: 522970

SEQ ID NO: 524397 - RNA, 64 nt, Human; identical to SEQ ID NO: 522971

SEQ ID NO: 524398 - RNA, 64 nt, Human; identical to SEQ ID NO: 522972

SEQ ID NO: 524399 - RNA, 64 nt, Human; identical to SEQ ID NO: 522054

SEQ ID NO: 524400 - RNA, 64 nt, Human; identical to SEQ ID NO: 522988

SEQ ID NO: 524401 - RNA, 64 nt, Human; identical to SEQ ID NO: 522989

SEQ ID NO: 524402 - RNA, 64 nt, Human; identical to SEQ ID NO: 522990

SEQ ID NO: 524403 - RNA, 64 nt, Human; identical to SEQ ID NO: 523006

SEQ ID NO: 524404 - RNA, 64 nt, Human; identical to SEQ ID NO: 523007

SEQ ID NO: 524405 - RNA, 64 nt, Human; identical to SEQ ID NO: 523008

SEQ ID NO: 524406 - RNA, 64 nt, Human; identical to SEQ ID NO: 522055

SEQ ID NO: 524407 - RNA, 64 nt, Human; identical to SEQ ID NO: 523024

SEQ ID NO: 524408 - RNA, 64 nt, Human; identical to SEQ ID NO: 523025

SEQ ID NO: 524409 - RNA, 64 nt, Human; identical to SEQ ID NO: 523026

SEQ ID NO: 524410 - RNA, 64 nt, Human; identical to SEQ ID NO: 523042

SEQ ID NO: 524411 - RNA, 64 nt, Human; identical to SEQ ID NO: 523043

SEQ ID NO: 524412 - RNA, 64 nt, Human; identical to SEQ ID NO: 523044

SEQ ID NO: 524413 - RNA, 64 nt, Human; identical to SEQ ID NO: 522071

SEQ ID NO: 524414 - RNA, 64 nt, Human; identical to SEQ ID NO: 523073

SEQ ID NO: 524415 - RNA, 64 nt, Human; identical to SEQ ID NO: 523074

SEQ ID NO: 524416 - RNA, 64 nt, Human; identical to SEQ ID NO: 523075

SEQ ID NO: 524417 - RNA, 64 nt, Human; identical to SEQ ID NO: 523180

SEQ ID NO: 524418 - RNA, 64 nt, Human; identical to SEQ ID NO: 523181

SEQ ID NO: 524419 - RNA, 64 nt, Human; identical to SEQ ID NO: 523182

SEQ ID NO: 524420 - RNA, 64 nt, Human; identical to SEQ ID NO: 522072

SEQ ID NO: 524421 - RNA, 64 nt, Human; identical to SEQ ID NO: 523306

SEQ ID NO: 524422 - RNA, 64 nt, Human; identical to SEQ ID NO: 523307

SEQ ID NO: 524423 - RNA, 64 nt, Human; identical to SEQ ID NO: 523308

SEQ ID NO: 524424 - RNA, 64 nt, Human; identical to SEQ ID NO: 522646

SEQ ID NO: 524425 - RNA, 64 nt, Human; identical to SEQ ID NO: 522647

SEQ ID NO: 524426 - RNA, 64 nt, Human; identical to SEQ ID NO: 522648

SEQ ID NO: 524427 - RNA, 64 nt, Human; identical to SEQ ID NO: 522073

SEQ ID NO: 524428 - RNA, 64 nt, Human; identical to SEQ ID NO: 522628

SEQ ID NO: 524429 - RNA, 64 nt, Human; identical to SEQ ID NO: 522629

SEQ ID NO: 524430 - RNA, 64 nt, Human; identical to SEQ ID NO: 522630

SEQ ID NO: 524431 - RNA, 64 nt, Human; identical to SEQ ID NO: 522664

SEQ ID NO: 524432 - RNA, 64 nt, Human; identical to SEQ ID NO: 522665

SEQ ID NO: 524433 - RNA, 64 nt, Human; identical to SEQ ID NO: 522666

SEQ ID NO: 524434 - RNA, 64 nt, Human; identical to SEQ ID NO: 522089

SEQ ID NO: 524435 - RNA, 64 nt, Human; identical to SEQ ID NO: 522700

SEQ ID NO: 524436 - RNA, 64 nt, Human; identical to SEQ ID NO: 522701

SEQ ID NO: 524437 - RNA, 64 nt, Human; identical to SEQ ID NO: 522702

SEQ ID NO: 524438 - RNA, 64 nt, Human; identical to SEQ ID NO: 522718

SEQ ID NO: 524439 - RNA, 64 nt, Human; identical to SEQ ID NO: 522719

SEQ ID NO: 524440 - RNA, 64 nt, Human; identical to SEQ ID NO: 522720

SEQ ID NO: 524441 - RNA, 64 nt, Human; identical to SEQ ID NO: 522090

SEQ ID NO: 524442 - RNA, 64 nt, Human; identical to SEQ ID NO: 522736

SEQ ID NO: 524443 - RNA, 64 nt, Human; identical to SEQ ID NO: 522737

SEQ ID NO: 524444 - RNA, 64 nt, Human; identical to SEQ ID NO: 522738

SEQ ID NO: 524445 - RNA, 64 nt, Human; identical to SEQ ID NO: 522754

SEQ ID NO: 524446 - RNA, 64 nt, Human; identical to SEQ ID NO: 522755

SEQ ID NO: 524447 - RNA, 64 nt, Human; identical to SEQ ID NO: 522756

SEQ ID NO: 524448 - RNA, 64 nt, Human; identical to SEQ ID NO: 522091

SEQ ID NO: 524449 - RNA, 64 nt, Human; identical to SEQ ID NO: 522772

SEQ ID NO: 524450 - RNA, 64 nt, Human; identical to SEQ ID NO: 522773

SEQ ID NO: 524451 - RNA, 64 nt, Human; identical to SEQ ID NO: 522774

SEQ ID NO: 524452 - RNA, 64 nt, Human; identical to SEQ ID NO: 522790

SEQ ID NO: 524453 - RNA, 64 nt, Human; identical to SEQ ID NO: 522791

SEQ ID NO: 524454 - RNA, 64 nt, Human; identical to SEQ ID NO: 522792

SEQ ID NO: 524455 - RNA, 64 nt, Human; identical to SEQ ID NO: 522107

SEQ ID NO: 524456 - RNA, 64 nt, Human; identical to SEQ ID NO: 522826

SEQ ID NO: 524457 - RNA, 64 nt, Human; identical to SEQ ID NO: 522827

SEQ ID NO: 524458 - RNA, 64 nt, Human; identical to SEQ ID NO: 522828

SEQ ID NO: 524459 - RNA, 64 nt, Human; identical to SEQ ID NO: 522844

SEQ ID NO: 524460 - RNA, 64 nt, Human; identical to SEQ ID NO: 522845

SEQ ID NO: 524461 - RNA, 64 nt, Human; identical to SEQ ID NO: 522846

SEQ ID NO: 524462 - RNA, 64 nt, Human; identical to SEQ ID NO: 522108

SEQ ID NO: 524463 - RNA, 64 nt, Human; identical to SEQ ID NO: 522934

SEQ ID NO: 524464 - RNA, 64 nt, Human; identical to SEQ ID NO: 522935

SEQ ID NO: 524465 - RNA, 64 nt, Human
agacaccuguguguccuaucuggguucugcugucuccgcguaggcagcuucggggcaaggauuc

SEQ ID NO: 524466 - RNA, 64 nt, Human
gaccggcucuccauggcuccugcgccucgugcuuuccgcguacagaagugcuugcccggggagu

SEQ ID NO: 524467 - RNA, 64 nt, Human
cgggacagaauucgauggauuccuuuaguuggaguccgcguagucagcacagacagcaguggaa

SEQ ID NO: 524468 - RNA, 64 nt, Human
cuuggccaccaguucaggcuucuuggccuucuucuccgcguacugcugcagccgcuccuccugc

SEQ ID NO: 524469 - RNA, 64 nt, Human
aacaucaggauggauuauuguacauugaauucauuccgcguauaaugugguauuucuuacucug

SEQ ID NO: 524470 - RNA, 64 nt, Human
uccccccagccuucaccuggccaugaaggaccuuuugaccaacucccugucauuccuaaccuaa

SEQ ID NO: 524471 - RNA, 64 nt, Human
gguguccaugggacaaaaaagaacgauccuccacuugaccaagaaaaaagugauucucccagaa

SEQ ID NO: 524472 - RNA, 64 nt, Human
aacucaagucauuuucuaaaguaaguuacccacauugaccaaaaugcagcuucaacguugagua

SEQ ID NO: 524473 - RNA, 64 nt, Human
gcagaugagguucccuaccuuuuucuucucuucauugaccaaaucaaccaaucacuacagcugc

SEQ ID NO: 524474 - RNA, 64 nt, Human
agaaacacccucacaggaacacucagaauaauguuugaccaaauagcugggcaucuugugaccc

SEQ ID NO: 524475 - RNA, 64 nt, Human; identical to SEQ ID NO: 255915

SEQ ID NO: 524476 - RNA, 64 nt, Human; identical to SEQ ID NO: 255916

SEQ ID NO: 524477 - RNA, 64 nt, Human; identical to SEQ ID NO: 255917

SEQ ID NO: 524478 - RNA, 64 nt, Human
uagaagggaggguuggcuucccaaaagcauaaccuugaccaaaccaaacaauaggcaccagcaa

SEQ ID NO: 524479 - RNA, 64 nt, Human
uugauauucaaggucuuuggcaagaaucccaggcuugaccaacugguaccaggucaaagauuuu

SEQ ID NO: 524480 - RNA, 64 nt, Human
ggaacugggauuuggguaaguucuccuccacuguuugaccaaauucucagugauaaauaugugu

SEQ ID NO: 524481 - RNA, 64 nt, Human
cugguguuccauggagagggagaaaggaacaagcuugaccaauucauucaacuccuuauaaaaa

SEQ ID NO: 524482 - RNA, 64 nt, Human
caauugccaucaagacuccugaagccagcugugcuugaccaaggaugggccauaaacaaugagu

SEQ ID NO: 524483 - RNA, 64 nt, Human
ucuuauuaguuuguuaauugccuguuacuaguacuugaccaauacauugugcuauauguaaaug

SEQ ID NO: 524484 - RNA, 64 nt, Human
ucccagccaugcuuuuguaacuugccagguggacuugaccaacuacauuaccaugcugugccuc

SEQ ID NO: 524485 - RNA, 64 nt, Human
uuuauauuuucagaucucucaaaaaucacaucauuugaccaaagaauaauuuaagacacauaga

SEQ ID NO: 524486 - RNA, 64 nt, Human
cuauuaccagugaauuucuuuuauucaccuucccuugaccaagaaauuggguuucuuuucccuc

SEQ ID NO: 524487 - RNA, 64 nt, Human
ggacucauuucacauaauagaaugccuagucucauugaccaaucguuaaaaaaucauauuugug

SEQ ID NO: 524488 - RNA, 64 nt, Human
aggucugagcagagggaggcccccaagagugccauugaccaagagacagcagacagccugccuc

SEQ ID NO: 524489 - RNA, 64 nt, Human
ggcugcaggaagaaacuuuuuuauuuuuuaaaucuugaccaacagaaaccuuuuauuuuuauuu

SEQ ID NO: 524490 - RNA, 64 nt, Human
ccgcgcgaacggaacguuggacuuuucguuaacauugaccaagaacugcauggaccuaacauuc

SEQ ID NO: 524491 - RNA, 64 nt, Human
cuucugggaccaccauuguauaugcgguacaucauugaccaaaacaucguuauccagcauauga

SEQ ID NO: 524492 - RNA, 64 nt, Human; identical to SEQ ID NO: 255905

SEQ ID NO: 524493 - RNA, 64 nt, Human; identical to SEQ ID NO: 255909

SEQ ID NO: 524494 - RNA, 64 nt, Human; identical to SEQ ID NO: 255910

SEQ ID NO: 524495 - RNA, 64 nt, Human
auaacuagggagugagugguaguuacuuaaguaauugaccaaauggaaaaggggaaguaauuaa

SEQ ID NO: 524496 - RNA, 64 nt, Human
ucaauuuguucucaagguggcugucuacagacauuugaccaagacauacaucugauuuaccuug

SEQ ID NO: 524497 - RNA, 64 nt, Human
uuuauucuaugcucucuguacuuuugaccaaaaauugaccaaaguaagaaaaugcaaguucuaa

SEQ ID NO: 524498 - RNA, 64 nt, Human
acaucuuugcuuuuauucuaugcucucuguacuuuugaccaaaaauugaccaaaguaagaaaau

SEQ ID NO: 524499 - RNA, 64 nt, Human
gauagcuagauagcuagauagucuugugucuuguuugaccaagguaaccguaauaaaagagucc

SEQ ID NO: 524500 - RNA, 64 nt, Human
uuauuugcaauauucaguaucaaauuagagcauuuugaccaacugaaacauauaacguuuucau

SEQ ID NO: 524501 - RNA, 64 nt, Human
gccuuucuguucauuuuguuugaaggaaauuguuuugaccaaacagaaaauuacuuggaauggu

SEQ ID NO: 524502 - RNA, 64 nt, Human
cuuccuuuuucaauaguaauauuuaaacccacuuuugaccaauuguuugcccaaauauucuugu

SEQ ID NO: 524503 - RNA, 64 nt, Human
caacucccuugcacguaaacuucagugucccaccuugaccaaaaucagcuuuguaacuguuuuc

SEQ ID NO: 524504 - RNA, 64 nt, Human
ggacucaacauucacuucgauuaaaaauagcaauuugaccaaguuggacuuccacuacaaagca

SEQ ID NO: 524505 - RNA, 64 nt, Human
ugucuuuuaugaauucugaucauauuuagucauuuugaccaaaugagggauuuggucaaaugag

SEQ ID NO: 524506 - RNA, 64 nt, Human
uuaaaaaugugguuuguuuugaacuggaagcaaguugaccaaggacuuaugacuaaugugaugc

SEQ ID NO: 524507 - RNA, 64 nt, Human
uauuugccuuaggcugauaggaauguggguuuucuugaccaaauauaucagcaucuaauugaaa

SEQ ID NO: 524508 - RNA, 64 nt, Human
ugcugggagcugcagugguaaugugugggacaccuugaccaaaggggagcuuugucucgugugu

SEQ ID NO: 524509 - RNA, 64 nt, Human; identical to SEQ ID NO: 255957

SEQ ID NO: 524510 - RNA, 64 nt, Human; identical to SEQ ID NO: 255958

SEQ ID NO: 524511 - RNA, 64 nt, Human; identical to SEQ ID NO: 255959

SEQ ID NO: 524512 - RNA, 64 nt, Human
aauucgugagacugaaguugcuuagaguacuucuuugaccaaggaauaccacagacacccuacc

SEQ ID NO: 524513 - RNA, 64 nt, Human
uccgaacuggaacugaacugccuucucugcacgcuugaccaaagcagugaugagggcggccagu

SEQ ID NO: 524514 - RNA, 64 nt, Human
uaaaaguuaguucaaacuaaugauguagaaugcuuugaccaaaugagcuggucuauuaugccuu

SEQ ID NO: 524515 - RNA, 64 nt, Human
cagggcucagcagcaagucacauuuuucuacuauuugaccaaaaggaaaagaaaauaaagaaga

SEQ ID NO: 524516 - RNA, 64 nt, Human
uuuacaggguagcuucugaaauuaacucaaacuuuugaccaaaugagugcagauucuuggauuc

SEQ ID NO: 524517 - RNA, 64 nt, Human
uuccaaaauaaaccugugcuuaaaaaagaaauaauugaccaaguaaguuugcauaaaaugugaa

SEQ ID NO: 524518 - RNA, 64 nt, Human
uacugucugcugugguucuguauuuuuuuauuuuuugaccaacuguauggaaaguugucaguaa

SEQ ID NO: 524519 - RNA, 64 nt, Human
aaugaauugaaugccuaguagaguauaggagaaguugaccaaggaaggauuuaaccuggugcca

SEQ ID NO: 524520 - RNA, 64 nt, Human
uaaaauuauaugguuuauuuuaaaugcguacauauugaccaauggccucugaaaaagcacauuu

SEQ ID NO: 524521 - RNA, 64 nt, Human
aagucuucagauaauugcaacuucaguugaucuuuugaccaagaccucaagagagccagaacua

SEQ ID NO: 524522 - RNA, 64 nt, Human
uguuuguuugcuuguugaauuuuugaacagccaguugaccaaucauagaaaguauuacuuucuu

SEQ ID NO: 524523 - RNA, 64 nt, Human
uugugauagcaaugaaugguaugaugaagaaaguuugaccaaauuuguuuuuuuguuguuguug

SEQ ID NO: 524524 - RNA, 64 nt, Human
uuuaaauccuauuguguaguuaaagugucaugccuugaccaaucuaaugaauugauuaauuaac

SEQ ID NO: 524525 - RNA, 64 nt, Human
ccuaauuuaaauguggcuugggccugguagaaguuugaccaaauggaauggaggcugugagcaa

SEQ ID NO: 524526 - RNA, 64 nt, Human; identical to SEQ ID NO: 255963

SEQ ID NO: 524527 - RNA, 64 nt, Human; identical to SEQ ID NO: 255964

SEQ ID NO: 524528 - RNA, 64 nt, Human; identical to SEQ ID NO: 255965

SEQ ID NO: 524529 - RNA, 64 nt, Human
ggggauucuaauguuuguaagugcuuugagaucuuugaccaacaggugcuauuggagugcaaag

SEQ ID NO: 524530 - RNA, 64 nt, Human
accaauuaaaaaaacauagagaacaaaagcauauuugaccaagcaacaagcuuauaauuaauuu

SEQ ID NO: 524531 - RNA, 64 nt, Human
uuagaauacaagauuccuuuacugucccucaaccuugaccaaaugggaagcauucccccuuguc

SEQ ID NO: 524532 - RNA, 64 nt, Human
acuggcgaaccuuggagagggaaugcugauugucuugaccaaacccacagccugucucuucucu

SEQ ID NO: 524533 - RNA, 64 nt, Human
caggccugcugcugaguuaugcacagacuuuuuguugaccaaaauaaaauauaaaggguuuucu

SEQ ID NO: 524534 - RNA, 64 nt, Human
ggugcuucuggggaagugcugggcauucacucuauugaccaaacauugugcauugaucguuugu

SEQ ID NO: 524535 - RNA, 64 nt, Human
gugcacaguaugaguuaaucugagcaggucugaauugaccaaaugcuuaucuacgagguuccua

SEQ ID NO: 524536 - RNA, 64 nt, Human
caguagacauagugcacuaaacccauaaggauacuugaccaauauuugagcacagcaagcugac

SEQ ID NO: 524537 - RNA, 64 nt, Human
ucguauuucaaauaaggucagaccuuuuauacuuuugaccaaauaguuauuuucuauguuggac

SEQ ID NO: 524538 - RNA, 64 nt, Human
uuguaguuuuuauuagcauguaccuugaaauuauuugaccaagaagcucaaagaaaagaaguac

SEQ ID NO: 524539 - RNA, 64 nt, Human
aacauauuccuccaauguaacugaaauguaucccuugaccaacaucacugcccggccccagccc

SEQ ID NO: 524540 - RNA, 64 nt, Human
gugucugccggucgaccaaucugccugccacacauugaccaagccagacccgguucacccagcu

SEQ ID NO: 524541 - RNA, 64 nt, Human
uucccaaaaaaccuaaguuuugcugaaaucugauuugaccaauuuaucaaauaugucauuuuaa

SEQ ID NO: 524542 - RNA, 64 nt, Human
aaagcugaauaaacuuugagaaauuauuucugaguugaccaauaaauaaaaauaccacuuucuu

SEQ ID NO: 524543 - RNA, 64 nt, Human; identical to SEQ ID NO: 255966

SEQ ID NO: 524544 - RNA, 64 nt, Human; identical to SEQ ID NO: 255967

SEQ ID NO: 524545 - RNA, 64 nt, Human; identical to SEQ ID NO: 255968

SEQ ID NO: 524546 - RNA, 64 nt, Human
auuuuguaacaaaaagaccuucauauuaucuguuuugaccaaaauauguagcuauuucccuuac

SEQ ID NO: 524547 - RNA, 64 nt, Human
uuaaaauuccauuugcuuuuaugguuagacaugcuugaccaaaaauguucagaagaaaauaugu

SEQ ID NO: 524548 - RNA, 64 nt, Human
uuguuaaagcugaaacacugaaacagccauugccuugaccaacauauuccuuugucacauuaug

SEQ ID NO: 524549 - RNA, 64 nt, Human
cagaauaucgauggacuuaaaaaggcucagguuuuugaccaaaauacaaugugaauuuauucug

SEQ ID NO: 524550 - RNA, 64 nt, Human
cagcauugcucccuuacuuaguaugccaaaugucuugaccaauaucaaaaacaagugcuuguuu

SEQ ID NO: 524551 - RNA, 64 nt, Human
gugauuuuuacaugauuccagaauaacacuuguauugaccaauuuagacagauaccagaccaau

SEQ ID NO: 524552 - RNA, 64 nt, Human
gcgauuuccuguuaagaugaguuuguacucagaauugaccaauucaggagguguaaaaauaaac

SEQ ID NO: 524553 - RNA, 64 nt, Human
ugcaggaaagccaguuucccuuuuguugaucuacuugaccaagcaaaggggcugaaaaacugaa

SEQ ID NO: 524554 - RNA, 64 nt, Human
aagcuucugugauuguaauuauaaaagagcaacauugaccaaaccugggaaacaagagcacagu

SEQ ID NO: 524555 - RNA, 64 nt, Human
uuuuuuuuugguagagaccagggguuucacuauguugaccaagcuggucuuggaacuccugggc

SEQ ID NO: 524556 - RNA, 64 nt, Human
acaaacaaacaaaaaacuguuuucauuugcucucuugaccaaaggauaggacuuuaguucuuua

SEQ ID NO: 524557 - RNA, 64 nt, Human
cuccguguagcaacccagguguuguccgugucuguugaccaaucucuauucagcaucguguggg

SEQ ID NO: 524558 - RNA, 64 nt, Human
aucuuucaaauaagaaaaaaauaaagacguauguuugaccaaguaguuucacaagaauauuugg

SEQ ID NO: 524559 - RNA, 64 nt, Human
acucuuaaagauagcuuaaugacuguuuauucucuugaccaaauagacucauaauaacauauaa

SEQ ID NO: 524560 - RNA, 64 nt, Human; identical to SEQ ID NO: 255969

SEQ ID NO: 524561 - RNA, 64 nt, Human; identical to SEQ ID NO: 255970

SEQ ID NO: 524562 - RNA, 64 nt, Human; identical to SEQ ID NO: 255971

SEQ ID NO: 524563 - RNA, 64 nt, Human
aaaguaauuaaaaaauuuuuaauguauaacagaauugaccaauaggccaguuuucugguaacuu

SEQ ID NO: 524564 - RNA, 64 nt, Human
gacaggaagaaacuuuggaauaaggaagagaagauugaccaaaccauccaaaugccaaaaagaa

SEQ ID NO: 524565 - RNA, 64 nt, Human
guacuuuuuuuaaaaugaaaguugcuaguucugcuugaccaaguagugcaaucauuauuuuuuu

SEQ ID NO: 524566 - RNA, 64 nt, Human
uguagacugccaucauugaugaucacugugaaaauugaccaagugauguguuuacauuuacuga

SEQ ID NO: 524567 - RNA, 64 nt, Human
aacucaugacuaaucuuugugcaaucaugaacuuuugaccaauaauuguuguuuugugucagcu

SEQ ID NO: 524568 - RNA, 64 nt, Human
uuuuuaaaaagcuaaaauugccaacuuuagaaucuugaccaaaaaaaauuaauuuuaggagcau

SEQ ID NO: 524569 - RNA, 64 nt, Human
uaugaugaagucaucagcuuugugccaccaccccuugaccaagaagagauggaguccugagcac

SEQ ID NO: 524570 - RNA, 64 nt, Human
gggcuuucuccccacuaagggcaaggccccaguuuugaccaaucgcaugguucuccuggcaggc

SEQ ID NO: 524571 - RNA, 64 nt, Human
aucagauuaugcuaaucauuuaguugagcaguuuuugaccaagaaucagaagcccaagggguac

SEQ ID NO: 524572 - RNA, 64 nt, Human
uugucuaucauguuuuguaaauacuggagaagcuuugaccaauuugacuuagagauggaaugua

SEQ ID NO: 524573 - RNA, 64 nt, Human
aaauacuguaaaagacuuuaaggaacaaguuuuauugaccaauaaguugauauuuguccauagg

SEQ ID NO: 524574 - RNA, 64 nt, Human
guccuuguucucauuaauucagcuaaagguggauuugaccaaaauaaugcugguuaaauuugua

SEQ ID NO: 524575 - RNA, 64 nt, Human
ucuuaugggaccacauaguauaagugguccguuguugaccaaaauguuguuaugcaggcaugac

SEQ ID NO: 524576 - RNA, 64 nt, Human
uuuaugcuuuggagaauuugacucaaauauauacuugaccaagcaccaugaucccuaggggcau

SEQ ID NO: 524577 - RNA, 61 nt, Human
gagaaagaacagaccagcgcccuucccgacuacauccgaaacuucacacaggguguuucug

SEQ ID NO: 524578 - RNA, 61 nt, Human
uguucuagccacagugguagauuuaugauucacauccgaaagugugccuuaguuaucaauu

SEQ ID NO: 524579 - RNA, 61 nt, Human
gaggggauaaagaggaagcaauaaaaaaaaaacauccgacagagcagcucuggcuuugcag

SEQ ID NO: 524580 - RNA, 64 nt, Human
guuuuuaaaaucaguacuuuuuaauggaaacaacuugaccaaaaauuugucacagaauuuugag

SEQ ID NO: 524581 - RNA, 64 nt, Human
aauccucagaucuagauaacucaugacauuuuauuugaccaacauagcacaugaugagauauca

SEQ ID NO: 524582 - RNA, 64 nt, Human
cucacaucuacccuuucccaguuagguuugcuuuuugaccaaaaagauaacaaauaccagguau

SEQ ID NO: 524583 - RNA, 64 nt, Human
caucacugucuugccagauuaccgacacugucacuugaccaauacugacccucuuuaccucgcc

SEQ ID NO: 524584 - RNA, 64 nt, Human
ugccagcuuggacaucaguguuuguuggauccguuugaccaauuugcaccaguuuuauccauaa

SEQ ID NO: 524585 - RNA, 64 nt, Human
uaacaaugaaauaugaaugcaaguuaagcuacacuugaccaaaugguaauaaauguuuacuucc

SEQ ID NO: 524586 - RNA, 64 nt, Human
ggauggucuccagacaccuucuugcagagugauuuugaccaaugccuuuccagcaccuuccccu

SEQ ID NO: 524587 - RNA, 64 nt, Human
acagaauguaauauaaggcaaaugcaucugggacuugaccaaaguuguucuguuuuguuuuuuu

SEQ ID NO: 524588 - RNA, 64 nt, Human
gcucuuuuggaccuacauacauuuuccuuuguuuuugaccaaucaaugaagccaaauuuauaug

SEQ ID NO: 524589 - RNA, 64 nt, Human
uuuuuguuuguuuuuuugcgauuucauuccauucuugaccaaagcuucucuuuaaguaguuuau

SEQ ID NO: 524590 - RNA, 64 nt, Human
cccaaagacaaguuaccagcauauccugagucauuugaccaagacacagaagaugaugaauggg

SEQ ID NO: 524591 - RNA, 64 nt, Human
cauggaacagcaaacgccuguuuaauaaagaacuuugaccaaggcuauaaaugccacguacauu

SEQ ID NO: 524592 - RNA, 64 nt, Human
uuuggaauguacauacugaaaaauacagguuuuuuugaccaaaaguuuuuauaucuuuucuuuu

SEQ ID NO: 524593 - RNA, 64 nt, Human
augcugaucacaggcuauauucaugaaguuacuuuugaccaaccugaaaacugauaggauuuug

SEQ ID NO: 524594 - RNA, 61 nt, Human
aaucccugaccccugcccugggccuuaacacacauccgacgaaugaaugaaggguugccuc

SEQ ID NO: 524595 - RNA, 64 nt, Human; identical to SEQ ID NO: 384030

SEQ ID NO: 524596 - RNA, 64 nt, Human; identical to SEQ ID NO: 384037

SEQ ID NO: 524597 - RNA, 64 nt, Human
uacuagcauacguuuuucuuaauuguuaucagcauugaccaagugguuuggaaggaggcaugcu

SEQ ID NO: 524598 - RNA, 64 nt, Human
uccugcuaugaaauauaucaccaccagcuugauucaaccuuaaaaauaaggucaucaguauuau

SEQ ID NO: 524599 - RNA, 64 nt, Human
caacugugucauuuggagagcuaggaaaaauaaacaaccuuaugccaccggggaaaaaaucaca

SEQ ID NO: 524600 - RNA, 64 nt, Human
cuguuacugucauuaucuguguuaaccugccagacaaccuuauauggguugcuuuugcuuucac

SEQ ID NO: 524601 - RNA, 64 nt, Human
aauacaugagggaaccagaguucaaaguccuaugcaaccuuaggaggggguuagagagucuguu

SEQ ID NO: 524602 - RNA, 64 nt, Human
ugagcccagacugacgcugaaaucccucaugagccaaccuuagcuacaagguagggaguucuga

SEQ ID NO: 524603 - RNA, 64 nt, Human
auuccuggguuuccuguuaaaaaaucuuaaagcccaaccuuaggaauauagugccccaaaaggc

SEQ ID NO: 524604 - RNA, 64 nt, Human
uguggucagaggaggagccggcgccuggccacgccaaccuuagaaucaugaacuguagucacag

SEQ ID NO: 524605 - RNA, 64 nt, Human
cccuuccucucccccugucuguuuccuucccccucaaccuuaccccaccccucuguuaauuuga

SEQ ID NO: 524606 - RNA, 64 nt, Human
uuuuauccuuucauauauacacaugcaaaguuuacaaccuuauuccaugcugucuuucagauuu

SEQ ID NO: 524607 - RNA, 64 nt, Human
cgauggcgauggacuacugaagcccuaacucagccaaccuuacuuacagcauaagggagcguag

SEQ ID NO: 524608 - RNA, 64 nt, Human
cagcaucacucuguaaguuccuugaaaggaagaacaaccuuagaguauuucugauacaaaauga

SEQ ID NO: 524609 - RNA, 64 nt, Human
uguguaaguuuucuauuuccccaguacuuuuagccaaccuuaccaagugguguguaaacuagua

SEQ ID NO: 524610 - RNA, 64 nt, Human
ucuuaaagcauuaaagcauaguuuuuuguauggccaaccuuacuaaauuaaguucugacuugcu

SEQ ID NO: 524611 - RNA, 64 nt, Human; identical to SEQ ID NO: 384044

SEQ ID NO: 524612 - RNA, 62 nt, Human
cauucccacacuccagucuggauccaggucugcaaggccagcccgacccugacacugcacgu

SEQ ID NO: 524613 - RNA, 62 nt, Human
cugggcagaaccagaacaaccugcacuucugccaaggccagggccagcaggacggcaggacu

SEQ ID NO: 524614 - RNA, 64 nt, Human
gcuuaaguaaugucauaauagaaaacacaagcauuugaccaaaugagauccauucagcgacuaa

SEQ ID NO: 524615 - RNA, 64 nt, Human
acccccuaccccagaaauaggacaauucacuucauugaccaagaugaucacauggaaggcggca

SEQ ID NO: 524616 - RNA, 64 nt, Human
gcgguguauuuugauugcuggugcuuuaacuauauugaccaagguguauaguaaccuauuuauc

SEQ ID NO: 524617 - RNA, 64 nt, Human
ggacagaaugggguggccagguggugauuucucuuugaccaaugcauaguuuggcagaaaaauc

SEQ ID NO: 524618 - RNA, 64 nt, Human
aggauuuagaacaaaguggaagccuguuacuaacuugaccaaagaacacuugauuugguuaauu

SEQ ID NO: 524619 - RNA, 64 nt, Human
cugauuuaucaauacauggacaaaaaguaaaucauugaccaaagcuaugaaauguuucacaaag

SEQ ID NO: 524620 - RNA, 64 nt, Human
acaccgaaguaauuccagcauagcggggaagauguugaccaagguggagaagaaucacgaaaag

SEQ ID NO: 524621 - RNA, 64 nt, Human
ucauuugaaaguuccaugcagcuuuagcacagaguugaccaaacacuggcguaaguucaauuua

SEQ ID NO: 524622 - RNA, 64 nt, Human
uaccaaaacaaagagaaugcaaaguuaagcagacuugaccaaugcaagucucuaaguuguuuuu

SEQ ID NO: 524623 - RNA, 64 nt, Human
uguauuuccggaugagguuucugaucuaggccauuugaccaaacuuugcugugucuaagauauu

SEQ ID NO: 524624 - RNA, 64 nt, Human
caacugaguuaucuagugauaugaccucacugucuugaccaaagccagaauagaaggcaggauu

SEQ ID NO: 524625 - RNA, 57 nt, Human
aguaugagucuucacucuaagagcaucuugaccaaguugagaaggggaccuuaaguu

SEQ ID NO: 524626 - RNA, 64 nt, Human
uggugcuugacucucacuaggcuaaacucaagauuugaccaaaucgagugauagggauccuggu

SEQ ID NO: 524627 - RNA, 64 nt, Human
ccagaugugcuuuuauuuagcuuuacauauuccuuugaccaaauaguuuguggguuaaacaaaa

SEQ ID NO: 524628 - RNA, 62 nt, Human
cccaaguggagggucggggcagaggccuccaccaaggccaucaauaaccaggugugagcuac

SEQ ID NO: 524629 - RNA, 62 nt, Human
gaacugacuuucuaguucuagaaguuccgcugcaaggccaggaaagcuugagaaagguauug

SEQ ID NO: 524630 - RNA, 62 nt, Human
gacugaaaaacacucugagagcauacacuguccaaggccauuaguguaaggaccgcuaccca

SEQ ID NO: 524631 - RNA, 64 nt, Human
cucaagguaaauuaaggauuuacugaauaagguguugaccaaauccagaccauuuuauuuuauu

SEQ ID NO: 524632 - RNA, 64 nt, Human
cucuauucuuugagaugugauuaagcuuagaacuuugaccaaaaauuuuacaguaaaaauuguu

SEQ ID NO: 524633 - RNA, 64 nt, Human
gauuccagaucuagccuccaucaugaagaagcucuugaccaaguaugacaaccucuuugagacg

SEQ ID NO: 524634 - RNA, 64 nt, Human
ggccacagauaacauugcaagguccaagacuuuuuugaccaaacaguagauauuuucuauuuuu

SEQ ID NO: 524635 - RNA, 64 nt, Human
cucaagagcugugacucgggagagcuaccuuacuuugaccaacagccugcccaguguggauguc

SEQ ID NO: 524636 - RNA, 64 nt, Human
ugcucccugcugcggagaccgcggaggcuucgcguugaccaaguuccuuaaagaacuggcugau

SEQ ID NO: 524637 - RNA, 64 nt, Human
guuucaaaacgaccaaaagacccaccacuguauuuugaccaaauaaugacaacuucuuuagaaa

SEQ ID NO: 524638 - RNA, 64 nt, Human
ugacaucagaacuuuuuuuauuauuguuuuauauuugaccaaaauauucugguuuagauacaga

SEQ ID NO: 524639 - RNA, 64 nt, Human
cuaggucauuaguuuuguuaauauuuguguugucuugaccaagcuccuacuaaguauaggacac

SEQ ID NO: 524640 - RNA, 64 nt, Human
ugcuauuuuauuuggaagaagcuggcaacuggucuugaccaaaauagaaaaaaaaaaaaaaagu

SEQ ID NO: 524641 - RNA, 64 nt, Human
gauuucuucuagagcucauguagaggaccacguuuugaccaaaacuucuccuaaggcauuugac

SEQ ID NO: 524642 - RNA, 64 nt, Human
ccagccuuuuuuguaagcaaauuucuccccuuuauugaccaauuaacugagcacuugcugcuau

SEQ ID NO: 524643 - RNA, 64 nt, Human
gugauggguugccauccaagugaaagucuuuuccuugaccaagggggacagucaguuuugcaaa

SEQ ID NO: 524644 - RNA, 64 nt, Human
aaaugcuuguuuugcacuaucacuuaguaccuguuugaccaagguguuaaggggauaguaccuc

SEQ ID NO: 524645 - RNA, 62 nt, Human
caacuggaauuuaggcuuuaaaaauaauguuucaaggccagguguggugauucaugccugaa

SEQ ID NO: 524646 - RNA, 62 nt, Human
agcugggcaagaaagcagcaguggaccugccccaaggccacacgugccuggucaggcuggcu

SEQ ID NO: 524647 - RNA, 62 nt, Human
auuacagucucuucauuggaagcucuguaggccaaggccagagcugauacugacacggagcc

SEQ ID NO: 524648 - RNA, 64 nt, Human
gcggaucacuugagguugggaguucaugaccagcuugaccaacaugaagaaacccugucucuau

SEQ ID NO: 524649 - RNA, 64 nt, Human
ucacccucacaccguguuaggagacuacuguuauuugaccaaugaauugacuucuaauaaaauc

SEQ ID NO: 524650 - RNA, 64 nt, Human
aaagaguauuuugagaugagccccaaaauuugguuugaccaaagcuuccccacucauuuugcaa

SEQ ID NO: 524651 - RNA, 64 nt, Human
ucagaacuacauuauuacaaaacaaaaugaacacuugaccaaaaaaccacauuaauuuaaaugg

SEQ ID NO: 524652 - RNA, 64 nt, Human
gaucgguccuuccucagcuccuugauuugugaccuugaccaaggggccugccacccagccccuc

SEQ ID NO: 524653 - RNA, 64 nt, Human
ccaauagccuccuggcaccagccagaccucacccuugaccaaccucucggggcuggggguucau

SEQ ID NO: 524654 - RNA, 64 nt, Human
ugccuugguaaaguugauaacuauuuaugaauauuugaccaaauuauuccagcaucagaauaau

SEQ ID NO: 524655 - RNA, 64 nt, Human
ucuuggaaaaguuuuuaaaucaaccacucauaauuugaccaaaauuuuaaaaaacugguauuuu

SEQ ID NO: 524656 - RNA, 64 nt, Human
uucguuucugcucuccccggcaugccuggcuuguuugaccaaagagcccucuuuccacgagacu

SEQ ID NO: 524657 - RNA, 64 nt, Human
uguauucugccaaaagcauuguuuuccagggcccuugaccaacaucggcuuccccaguccaggg

SEQ ID NO: 524658 - RNA, 64 nt, Human
gacauucugccaggcccccaagccugcagucaucuugaccaagcaggaagcucagacugguuga

SEQ ID NO: 524659 - RNA, 64 nt, Human
aaguagcagcaacuagauuaagacugggaggauuuugaccaaacuaaaggccuuuucuccuuac

SEQ ID NO: 524660 - RNA, 64 nt, Human
cucuuaccaagugcuuuccucaaguuugucucucuugaccaaucauuuuuuccaaaucaaucac

SEQ ID NO: 524661 - RNA, 64 nt, Human
cacaucccuaugaaguugaaaaauaaaguuaauuuugaccaaaagacuucauuuguaacccaug

SEQ ID NO: 524662 - RNA, 64 nt, Human; identical to SEQ ID NO: 255929

SEQ ID NO: 524663 - RNA, 64 nt, Human; identical to SEQ ID NO: 255930

SEQ ID NO: 524664 - RNA, 64 nt, Human; identical to SEQ ID NO: 255931

SEQ ID NO: 524665 - RNA, 64 nt, Human
uaguuucuguucuguaaagugauaucuuucauacuugaccaaaguucccaauaacuucccaacc

SEQ ID NO: 524666 - RNA, 64 nt, Human
gaagaggggccggccucagcugucaccagcacuuuugaccaaguccugcuacugcggccccugc

SEQ ID NO: 524667 - RNA, 64 nt, Human
cuugaaaugcucgccaaauguccccaugggauuuuugaccaaaaguaaggugauaacugaagaa

SEQ ID NO: 524668 - RNA, 64 nt, Human
cuuccuuguuaaaucauuauuuaagccguucuuauugaccaauuccugacacuugauugucucc

SEQ ID NO: 524669 - RNA, 64 nt, Human
ggggugggagagggaauuuaaaaggugucaacuuuugaccaaaaaaauugugcccuuguaccga

SEQ ID NO: 524670 - RNA, 64 nt, Human
ucacucugccuacagacucagucuuauuacagcuuugaccaaugguuggaacccaacaccagag

SEQ ID NO: 524671 - RNA, 64 nt, Human
uuuuugccuuagaucauccagccccucuuagaacuugaccaaaauagaaguaaauuaaaguugu

SEQ ID NO: 524672 - RNA, 64 nt, Human
uuuauugccucauguucuuguaagucauucuuaauugaccaaugauuguagaccuugcuugagu

SEQ ID NO: 524673 - RNA, 64 nt, Human
acaggugccugacagguucccuucuaacaacuauuugaccaagagaggcaaucaggggguugua

SEQ ID NO: 524674 - RNA, 64 nt, Human
uguccccucucaucuaugcucuuuccugucuuccuugaccaaagcucucuuugagguccaaaaa

SEQ ID NO: 524675 - RNA, 64 nt, Human
guuacuucaaguaauacguuuugacauaagaugguugaccaaggugcuuuucuucggcuugagu

SEQ ID NO: 524676 - RNA, 64 nt, Human
ugugucuauccaacagggagccacaguauuuaaauugaccaaccuaauguuacaacuacuuuga

SEQ ID NO: 524677 - RNA, 64 nt, Human
cagcgcacaauugcuaucuauccauagaccauucuugaccaagcaagcaugcacauuaugggca

SEQ ID NO: 524678 - RNA, 64 nt, Human
gcuguauccaaccacaaacaacaaaggcuacccuuugaccaaaugucuuucucugcaacauggc

SEQ ID NO: 524679 - RNA, 64 nt, Human; identical to SEQ ID NO: 255919

SEQ ID NO: 524680 - RNA, 64 nt, Human; identical to SEQ ID NO: 255920

SEQ ID NO: 524681 - RNA, 64 nt, Human; identical to SEQ ID NO: 255921

SEQ ID NO: 524682 - RNA, 64 nt, Human
gguguggcuuuuuuuuuuuucuuuuuuccagccguugaccaauuauaguucggcuguugacuga

SEQ ID NO: 524683 - RNA, 64 nt, Human
gggcaaaacaggcuagcaauugcaaagucaggcuuugaccaacauauuucuuugcacugaggcc

SEQ ID NO: 524684 - RNA, 64 nt, Human
aauuccuacagaaguaauuggccugagagcauucuugaccaagucuuaaaugcuagaaucugag

SEQ ID NO: 524685 - RNA, 64 nt, Human
ggcuuuuauugccaugagcuagaagcaucacagguugaccaauaaccaugcccaagaaugagaa

SEQ ID NO: 524686 - RNA, 64 nt, Human
uugguguuuuuuguagagacuggguuuugccauguugaccaagcuggucucuaacuccugggcu

SEQ ID NO: 524687 - RNA, 64 nt, Human
aucuuugagcaagugccaaauuuguacugaaguguugaccaaguucauuuuuucucuuuacuuu

SEQ ID NO: 524688 - RNA, 64 nt, Human
gacaguuuguguuaaauguuggcauuuacuuguauugaccaaaguuuugcagcucuacuauauu

SEQ ID NO: 524689 - RNA, 64 nt, Human
ugauuucuuuuucagagauaacaaugguuucguuuugaccaaacuuguauuaggacagaauuaa

SEQ ID NO: 524690 - RNA, 64 nt, Human
aaacaccuguucccaaccuacuucuuggugcaaguugaccaaaucguuuuaagugguaacucuu

SEQ ID NO: 524691 - RNA, 64 nt, Human
ucuuacgggaucaucaucguauauuuggccauuguugaccaaaaguuaugcagcacaucauuau

SEQ ID NO: 524692 - RNA, 64 nt, Human
agaugacaagcuguguugaaauacauuuuuucuuuugaccaauugacagaaucuaauaagcuuu

SEQ ID NO: 524693 - RNA, 64 nt, Human
auucuccugucuagaaugacccccccaccaguacuugaccaauuucauguaucaaucuggauuu

SEQ ID NO: 524694 - RNA, 64 nt, Human
uaaacugugaugaacuugugauuuuguguuuuacuugaccaaaaccaaguguauauguuuacau

SEQ ID NO: 524695 - RNA, 64 nt, Human
auaaauauuuuaggaaacucuccaugauuauuaguugaccaacuauauugcgagaaacagagau

SEQ ID NO: 524696 - RNA, 64 nt, Human; identical to SEQ ID NO: 255922

SEQ ID NO: 524697 - RNA, 64 nt, Human; identical to SEQ ID NO: 255923

SEQ ID NO: 524698 - RNA, 64 nt, Human; identical to SEQ ID NO: 255927

SEQ ID NO: 524699 - RNA, 64 nt, Human
ccagaaauuauuuuucuacaccaaauugagcaauuugaccaagauuucuaguagcagagccggu

SEQ ID NO: 524700 - RNA, 64 nt, Human
cauggcuauaucuauagaccuuggauaaacuggauugaccaauuauacacucacggugacuuuu

SEQ ID NO: 524701 - RNA, 64 nt, Human
guuugaugagcauuugccuuucuccccagagagcuugaccaaguuacauauucuagagaucguc

SEQ ID NO: 524702 - RNA, 64 nt, Human
aucuccugcagguagaauauuccgugguugcuucuugaccaagggaaauacagucuggcuguga

SEQ ID NO: 524703 - RNA, 64 nt, Human
ccaugggagguccuggcuagaguucugcccaaccuugaccaaccccagcaauuuuuccaaaagc

SEQ ID NO: 524704 - RNA, 64 nt, Human
uacaauaacucucuguuaaccagaacaccgucauuugaccaagcccuacaagaguuuaccacac

SEQ ID NO: 524705 - RNA, 64 nt, Human
uucgaggccacucauguucuuuguaacuuaaacuuugaccaagaaauucuucacuucucacuuc

SEQ ID NO: 524706 - RNA, 64 nt, Human
uuaaggaagccugugggggaccugguggauggaguugaccaacaucgcuggguggcuacggccc

SEQ ID NO: 524707 - RNA, 64 nt, Human
gaacucgaucuucucuuccuuaaaugaaaaguuauugaccaaauggacuuuuuaaaagacacag

SEQ ID NO: 524708 - RNA, 64 nt, Human
ggggcuggggcgcacggagaagcaggucccuauauugaccaaggaguuugugguacgaccccuc

SEQ ID NO: 524709 - RNA, 64 nt, Human
auugacuagcccauaggccaaaggccuguucuaguugaccaaguuucaaguaggauuaagaggu

SEQ ID NO: 524710 - RNA, 64 nt, Human
guggcaacgugccccccgcagaggccacgcauguuugaccaaagcccucauugugguccgagga

SEQ ID NO: 524711 - RNA, 64 nt, Human
gguuuuuuagugcaauuucuucuguagcuauucuuugaccaaacuguggguauuguuaauauua

SEQ ID NO: 524712 - RNA, 64 nt, Human
uuuuagaaguuuuuuuccuuaaugugaaaguaauuugaccaaguuauaaugcauuuuuguuuuu

SEQ ID NO: 524713 - RNA, 64 nt, Human; identical to SEQ ID NO: 255932

SEQ ID NO: 524714 - RNA, 64 nt, Human; identical to SEQ ID NO: 255933

SEQ ID NO: 524715 - RNA, 64 nt, Human; identical to SEQ ID NO: 255934

SEQ ID NO: 524716 - RNA, 64 nt, Human
ucuuaagcucuaaauuagaggcccugacccaucauugaccaaacugaugacuucgaguaagcca

SEQ ID NO: 524717 - RNA, 64 nt, Human
cggcccuugcccaggguggggccuggcccucaucuugaccaaagcugcuguguggcagcucggc

SEQ ID NO: 524718 - RNA, 64 nt, Human
aaaaccaaaaaaaccucuguagcauuccagcggcuugaccaaugaccuaugucacaagaggugg

SEQ ID NO: 524719 - RNA, 64 nt, Human
uuguguaaaguagaagcagaacaaaaugaauuuauugaccaauuuauuuuucagaaaugaacug

SEQ ID NO: 524720 - RNA, 64 nt, Human
ugcaguggaccaauuuuuguauuuuuuuaaaugcuugaccaagugucuaaaauaggcaaguagu

SEQ ID NO: 524721 - RNA, 64 nt, Human
ccuuuuagccugcucucuagaacccuacuuacaguugaccaagcugcuuaaaguagaaggauca

SEQ ID NO: 524722 - RNA, 64 nt, Human
agcugaccaaagcagcccuaacgggccauaacacuugaccaauucagcugcuggcagagggagg

SEQ ID NO: 524723 - RNA, 64 nt, Human
cuuugcauucaucucucaaacuuaguuuuuaucuuugaccaaccgaacaugaccaaaaaccaaa

SEQ ID NO: 524724 - RNA, 64 nt, Human
uugagggugcugguagcaggugagcaggacaaaguugaccaaggacacuuauuucuagauuaug

SEQ ID NO: 524725 - RNA, 64 nt, Human
ggaggggaaacugagcccacagugaguauguaacuugaccaaggucacugagccaggacuggac

SEQ ID NO: 524726 - RNA, 64 nt, Human
agauacacagacuaauauuuguguggagguucuuuugaccaauuuuauuccuaagaauaaacaa

SEQ ID NO: 524727 - RNA, 64 nt, Human
caugaaccauucauauuacagcucuuacuuaaauuugaccaagccaggauauaucuguuaggcc

SEQ ID NO: 524728 - RNA, 64 nt, Human
guacuucagauagacgcagaaaauuggugagugguugaccaagaacacugcacaaauauaaaaa

SEQ ID NO: 524729 - RNA, 64 nt, Human
aaaauugucuauuucagugucuuuuuuagcaagauugaccaaaacaggugguagguguguaauu

SEQ ID NO: 524730 - RNA, 64 nt, Human; identical to SEQ ID NO: 255936

SEQ ID NO: 524731 - RNA, 64 nt, Human; identical to SEQ ID NO: 255937

SEQ ID NO: 524732 - RNA, 64 nt, Human; identical to SEQ ID NO: 255938

SEQ ID NO: 524733 - RNA, 64 nt, Human
uuaauaugugggcuauuagcugcuuauuuaaauguugaccaaauugucugauauaucugauuaa

SEQ ID NO: 524734 - RNA, 64 nt, Human
aguugcagacgucugugccuagcaauauuuccaguugaccaaauauucuaaucuuuuuucauuu

SEQ ID NO: 524735 - RNA, 64 nt, Human
ugauaacguccuaauuuccuucuggacaaccuccuugaccaauggcauauugagaucuauguga

SEQ ID NO: 524736 - RNA, 64 nt, Human
gcugggcaacagcuggcuugugaaaugagacaccuugaccaauaugcuuuggguggacggucuc

SEQ ID NO: 524737 - RNA, 64 nt, Human
uauggaaugccccaaguauucaagaucaucuugauugaccaaagaccaaaaaaaaaaaaaagac

SEQ ID NO: 524738 - RNA, 64 nt, Human
gcugaacuguucgaggcaaagacaaaacccaacuuugaccaagaagagcaaucuggauucuugu

SEQ ID NO: 524739 - RNA, 64 nt, Human
caagcagaggccaccuucuccugagaaguugcuguugaccaaggagaggucacauucuuuucag

SEQ ID NO: 524740 - RNA, 64 nt, Human
uguaauguggaugcugggcacagagcugccaucuuugaccaauuccguggaguacagaacauug

SEQ ID NO: 524741 - RNA, 64 nt, Human
aggucgaucacgaggucaggcguuuaagaccagcuugaccaacauggugaaaccccaucucuac

SEQ ID NO: 524742 - RNA, 64 nt, Human
gagaacagccuggcuaacauggcgaauccucguuuugaccaaaauauagaaauuagccuggugu

SEQ ID NO: 524743 - RNA, 64 nt, Human
caugcccugccuaccuucugaaauguuuaccccauugaccaaacuuggcuccagccauugcggu

SEQ ID NO: 524744 - RNA, 64 nt, Human
uuaaaaaguugcccuguaaaguuauuuggugucauugaccaauugcaucccagcuaaaaagcaa

SEQ ID NO: 524745 - RNA, 64 nt, Human
acucagcagaagugaugacucuuaaaaauuggcuuugaccaaaguucucuuguuuucagggaaa

SEQ ID NO: 524746 - RNA, 64 nt, Human
cugucagccuaaucuguaggagcagaaccucugauugaccaaaaggcauauggguuuagguugg

SEQ ID NO: 524747 - RNA, 64 nt, Human; identical to SEQ ID NO: 255939

SEQ ID NO: 524748 - RNA, 64 nt, Human; identical to SEQ ID NO: 255940

SEQ ID NO: 524749 - RNA, 64 nt, Human; identical to SEQ ID NO: 255941

SEQ ID NO: 524750 - RNA, 64 nt, Human
gacauuuaagaugguguaugacagagcauuggccuugaccaaauguuaaauccucuguguguau

SEQ ID NO: 524751 - RNA, 64 nt, Human
cagaugcuuggaccugggugccuggcuauggagauugaccaagcaagaucaggagcuccugaua

SEQ ID NO: 524752 - RNA, 64 nt, Human
aauaauguuguuaaagaggcuguuuagcacuaauuugaccaaaucuauagucaaaguuugauuc

SEQ ID NO: 524753 - RNA, 64 nt, Human
ugcuggaacaagcggcugguguugaaagaguggguugaccaauuugguauugaauguugcccag

SEQ ID NO: 524754 - RNA, 64 nt, Human
ucuauuuugucccugaauaauauuuuucuuagaauugaccaaauaagaaguggaauuuuugcau

SEQ ID NO: 524755 - RNA, 64 nt, Human
uauucaugagaaguaaagcugagaaaggaccagauugaccaagcgccagagacaaaauguggca

SEQ ID NO: 524756 - RNA, 64 nt, Human
cuggcaguugcuaaauuuguguucccauuuuaaauugaccaauuuuggggugugacacuuuuga

SEQ ID NO: 524757 - RNA, 64 nt, Human
uugcuauuaauauuucaauuuggaauguucugaauugaccaaauuuaaugaaccugcccaaagu

SEQ ID NO: 524758 - RNA, 64 nt, Human
uucagucacaucuuccugcuuuguccagaacacauugaccaagcuccugaaagauguaaguuua

SEQ ID NO: 524759 - RNA, 64 nt, Human
aaaauauccauauauauuucuauaaaaaaaguguuugaccaaaguaggucugcagcuauuucaa

SEQ ID NO: 524760 - RNA, 64 nt, Human
uuaccuuaugucugcuagaaaguguuguaguugauugaccaaaccaguucauaaggggaauuuu

SEQ ID NO: 524761 - RNA, 64 nt, Human
acagccuccccgcaucuaaaggccccuucaguucuugaccaaaggugcuacgagaaccugccgu

SEQ ID NO: 524762 - RNA, 64 nt, Human
ucucuggcuuugcggugggcuguggaggcugguuuugaccaaaagugaguggggcgggaggaag

SEQ ID NO: 524763 - RNA, 64 nt, Human
uuugcagacuguggaaggaucugcaguuuuguuuuugaccaaaaaaauaauaauaaguuagcuc

SEQ ID NO: 524764 - RNA, 62 nt, Human
cccacagggaucuagccacccuucaguggccccaaggccagacugaggcucauccaguggag

SEQ ID NO: 524765 - RNA, 62 nt, Human
ccacagcaggacaggccgggacaggccucacccaaggccaaggcuggcaucagccaaucauu

SEQ ID NO: 524766 - RNA, 62 nt, Human
acaaauuuuaagaccaagguaagauaacuaaucaaggccauuuaauccgucacauucaucuc

SEQ ID NO: 524767 - RNA, 64 nt, Human
acuugggaguugggggccagaguugagccuggacuugaccaauuaauucccuuaccuuucagcc

SEQ ID NO: 524768 - RNA, 64 nt, Human
gccuaaaagugauucuuugaaaguuuaaagaaacuugaccaaaagacaguacaaaaacacuggc

SEQ ID NO: 524769 - RNA, 64 nt, Human
uugucggccagcccacuccccagccagagagggcuugaccaaaucaaauugagguggugacuuu

SEQ ID NO: 524770 - RNA, 64 nt, Human
ugcugaacugcugcuaaagugauuuuuuuuuuauuugaccaaaaaaaaaaaggcccaagaagaa

SEQ ID NO: 524771 - RNA, 64 nt, Human
uuuucauaauuuuuccuacguauacacaaacauuuugaccaaaaauccacacuauauguacugu

SEQ ID NO: 524772 - RNA, 64 nt, Human
auaaccuaaccaaccuccaccuccuccuuccauuuugaccaaccuucuucuaacaaggugcuca

SEQ ID NO: 524773 - RNA, 64 nt, Human
caguuauuaauuuauaauaauacaugucugaaauuugaccaaaaacaucuucuuuaugucaagg

SEQ ID NO: 524774 - RNA, 64 nt, Human
cuucucaggcucaagguaacaguguucuugugguuugaccaauuguuuuucuuucuuuuuuuuu

SEQ ID NO: 524775 - RNA, 64 nt, Human
gccuaaaaaugauucuuugaaaguuuaaagaaacuugaccaaaagacaguacaaaaaacacugg

SEQ ID NO: 524776 - RNA, 64 nt, Human; identical to SEQ ID NO: 255899

SEQ ID NO: 524777 - RNA, 64 nt, Human; identical to SEQ ID NO: 255900

SEQ ID NO: 524778 - RNA, 64 nt, Human; identical to SEQ ID NO: 255901

SEQ ID NO: 524779 - RNA, 64 nt, Human; identical to SEQ ID NO: 255902

SEQ ID NO: 524780 - RNA, 64 nt, Human; identical to SEQ ID NO: 255903

SEQ ID NO: 524781 - RNA, 64 nt, Human; identical to SEQ ID NO: 255904

SEQ ID NO: 524782 - RNA, 64 nt, Human; identical to SEQ ID NO: 255972

SEQ ID NO: 524783 - RNA, 64 nt, Human; identical to SEQ ID NO: 255973

SEQ ID NO: 524784 - RNA, 64 nt, Human; identical to SEQ ID NO: 255974

SEQ ID NO: 524785 - RNA, 64 nt, Human; identical to SEQ ID NO: 255975

SEQ ID NO: 524786 - RNA, 64 nt, Human; identical to SEQ ID NO: 255976

SEQ ID NO: 524787 - RNA, 64 nt, Human; identical to SEQ ID NO: 255977

SEQ ID NO: 524788 - RNA, 64 nt, Human; identical to SEQ ID NO: 255981

SEQ ID NO: 524789 - RNA, 64 nt, Human; identical to SEQ ID NO: 255982

SEQ ID NO: 524790 - RNA, 64 nt, Human; identical to SEQ ID NO: 255983

SEQ ID NO: 524791 - RNA, 64 nt, Human; identical to SEQ ID NO: 255984

SEQ ID NO: 524792 - RNA, 64 nt, Human; identical to SEQ ID NO: 255985

SEQ ID NO: 524793 - RNA, 64 nt, Human; identical to SEQ ID NO: 255986

SEQ ID NO: 524794 - RNA, 64 nt, Human; identical to SEQ ID NO: 255987

SEQ ID NO: 524795 - RNA, 64 nt, Human; identical to SEQ ID NO: 255988

SEQ ID NO: 524796 - RNA, 64 nt, Human; identical to SEQ ID NO: 255989

SEQ ID NO: 524797 - RNA, 64 nt, Human; identical to SEQ ID NO: 255990

SEQ ID NO: 524798 - RNA, 64 nt, Human; identical to SEQ ID NO: 255991

SEQ ID NO: 524799 - RNA, 64 nt, Human; identical to SEQ ID NO: 255992

SEQ ID NO: 524800 - RNA, 64 nt, Human; identical to SEQ ID NO: 255993

SEQ ID NO: 524801 - RNA, 64 nt, Human; identical to SEQ ID NO: 255994

SEQ ID NO: 524802 - RNA, 64 nt, Human; identical to SEQ ID NO: 255995

SEQ ID NO: 524803 - RNA, 64 nt, Human; identical to SEQ ID NO: 255999

SEQ ID NO: 524804 - RNA, 64 nt, Human; identical to SEQ ID NO: 256000

SEQ ID NO: 524805 - RNA, 64 nt, Human; identical to SEQ ID NO: 256001

SEQ ID NO: 524806 - RNA, 64 nt, Human; identical to SEQ ID NO: 256002

SEQ ID NO: 524807 - RNA, 64 nt, Human; identical to SEQ ID NO: 256003

SEQ ID NO: 524808 - RNA, 64 nt, Human; identical to SEQ ID NO: 256004

SEQ ID NO: 524809 - RNA, 64 nt, Human; identical to SEQ ID NO: 256005

SEQ ID NO: 524810 - RNA, 64 nt, Human; identical to SEQ ID NO: 256006

SEQ ID NO: 524811 - RNA, 64 nt, Human; identical to SEQ ID NO: 256007

SEQ ID NO: 524812 - RNA, 64 nt, Human; identical to SEQ ID NO: 256008

SEQ ID NO: 524813 - RNA, 64 nt, Human; identical to SEQ ID NO: 256009

SEQ ID NO: 524814 - RNA, 64 nt, Human; identical to SEQ ID NO: 256010

SEQ ID NO: 524815 - RNA, 64 nt, Human; identical to SEQ ID NO: 256011

SEQ ID NO: 524816 - RNA, 64 nt, Human; identical to SEQ ID NO: 256012

SEQ ID NO: 524817 - RNA, 64 nt, Human; identical to SEQ ID NO: 256013

SEQ ID NO: 524818 - RNA, 64 nt, Human; identical to SEQ ID NO: 256017

SEQ ID NO: 524819 - RNA, 64 nt, Human; identical to SEQ ID NO: 256018

SEQ ID NO: 524820 - RNA, 64 nt, Human; identical to SEQ ID NO: 256019

SEQ ID NO: 524821 - RNA, 64 nt, Human; identical to SEQ ID NO: 256020

SEQ ID NO: 524822 - RNA, 64 nt, Human; identical to SEQ ID NO: 256021

SEQ ID NO: 524823 - RNA, 64 nt, Human; identical to SEQ ID NO: 256022

SEQ ID NO: 524824 - RNA, 64 nt, Human; identical to SEQ ID NO: 256023

SEQ ID NO: 524825 - RNA, 64 nt, Human; identical to SEQ ID NO: 256024

SEQ ID NO: 524826 - RNA, 64 nt, Human; identical to SEQ ID NO: 256025

SEQ ID NO: 524827 - RNA, 64 nt, Human; identical to SEQ ID NO: 256026

SEQ ID NO: 524828 - RNA, 64 nt, Human; identical to SEQ ID NO: 256027

SEQ ID NO: 524829 - RNA, 64 nt, Human; identical to SEQ ID NO: 256028

SEQ ID NO: 524830 - RNA, 64 nt, Human; identical to SEQ ID NO: 256029

SEQ ID NO: 524831 - RNA, 64 nt, Human; identical to SEQ ID NO: 256030

SEQ ID NO: 524832 - RNA, 64 nt, Human; identical to SEQ ID NO: 256031

SEQ ID NO: 524833 - RNA, 64 nt, Human; identical to SEQ ID NO: 256035

SEQ ID NO: 524834 - RNA, 64 nt, Human; identical to SEQ ID NO: 256036

SEQ ID NO: 524835 - RNA, 64 nt, Human; identical to SEQ ID NO: 256037

SEQ ID NO: 524836 - RNA, 64 nt, Human; identical to SEQ ID NO: 256038

SEQ ID NO: 524837 - RNA, 64 nt, Human; identical to SEQ ID NO: 256039

SEQ ID NO: 524838 - RNA, 64 nt, Human; identical to SEQ ID NO: 256040

SEQ ID NO: 524839 - RNA, 64 nt, Human; identical to SEQ ID NO: 256041

SEQ ID NO: 524840 - RNA, 64 nt, Human; identical to SEQ ID NO: 256042

SEQ ID NO: 524841 - RNA, 64 nt, Human; identical to SEQ ID NO: 256043

SEQ ID NO: 524842 - RNA, 64 nt, Human; identical to SEQ ID NO: 256044

SEQ ID NO: 524843 - RNA, 64 nt, Human; identical to SEQ ID NO: 256045

SEQ ID NO: 524844 - RNA, 64 nt, Human; identical to SEQ ID NO: 256046

SEQ ID NO: 524845 - RNA, 64 nt, Human; identical to SEQ ID NO: 256047

SEQ ID NO: 524846 - RNA, 64 nt, Human; identical to SEQ ID NO: 256048

SEQ ID NO: 524847 - RNA, 64 nt, Human; identical to SEQ ID NO: 256049

SEQ ID NO: 524848 - RNA, 64 nt, Human; identical to SEQ ID NO: 256053

SEQ ID NO: 524849 - RNA, 64 nt, Human; identical to SEQ ID NO: 256054

SEQ ID NO: 524850 - RNA, 64 nt, Human; identical to SEQ ID NO: 256055

SEQ ID NO: 524851 - RNA, 64 nt, Human; identical to SEQ ID NO: 256056

SEQ ID NO: 524852 - RNA, 64 nt, Human; identical to SEQ ID NO: 256057

SEQ ID NO: 524853 - RNA, 64 nt, Human; identical to SEQ ID NO: 256058

SEQ ID NO: 524854 - RNA, 64 nt, Human; identical to SEQ ID NO: 256059

SEQ ID NO: 524855 - RNA, 64 nt, Human; identical to SEQ ID NO: 256060

SEQ ID NO: 524856 - RNA, 64 nt, Human; identical to SEQ ID NO: 256061

SEQ ID NO: 524857 - RNA, 64 nt, Human; identical to SEQ ID NO: 256062

SEQ ID NO: 524858 - RNA, 64 nt, Human; identical to SEQ ID NO: 256063

SEQ ID NO: 524859 - RNA, 64 nt, Human; identical to SEQ ID NO: 256064

SEQ ID NO: 524860 - RNA, 64 nt, Human; identical to SEQ ID NO: 256065

SEQ ID NO: 524861 - RNA, 64 nt, Human; identical to SEQ ID NO: 256066

SEQ ID NO: 524862 - RNA, 64 nt, Human; identical to SEQ ID NO: 256067

SEQ ID NO: 524863 - RNA, 64 nt, Human; identical to SEQ ID NO: 256071

SEQ ID NO: 524864 - RNA, 64 nt, Human; identical to SEQ ID NO: 256072

SEQ ID NO: 524865 - RNA, 64 nt, Human; identical to SEQ ID NO: 256073

SEQ ID NO: 524866 - RNA, 64 nt, Human; identical to SEQ ID NO: 256074

SEQ ID NO: 524867 - RNA, 64 nt, Human; identical to SEQ ID NO: 256075

SEQ ID NO: 524868 - RNA, 64 nt, Human; identical to SEQ ID NO: 256076

SEQ ID NO: 524869 - RNA, 64 nt, Human; identical to SEQ ID NO: 256077

SEQ ID NO: 524870 - RNA, 64 nt, Human; identical to SEQ ID NO: 256078

SEQ ID NO: 524871 - RNA, 64 nt, Human; identical to SEQ ID NO: 256079

SEQ ID NO: 524872 - RNA, 64 nt, Human; identical to SEQ ID NO: 256080

SEQ ID NO: 524873 - RNA, 64 nt, Human; identical to SEQ ID NO: 256081

SEQ ID NO: 524874 - RNA, 64 nt, Human; identical to SEQ ID NO: 256082

SEQ ID NO: 524875 - RNA, 64 nt, Human; identical to SEQ ID NO: 256083

SEQ ID NO: 524876 - RNA, 64 nt, Human; identical to SEQ ID NO: 256084

SEQ ID NO: 524877 - RNA, 64 nt, Human; identical to SEQ ID NO: 256085

SEQ ID NO: 524878 - RNA, 64 nt, Human; identical to SEQ ID NO: 256089

SEQ ID NO: 524879 - RNA, 64 nt, Human; identical to SEQ ID NO: 256090

SEQ ID NO: 524880 - RNA, 64 nt, Human; identical to SEQ ID NO: 256091

SEQ ID NO: 524881 - RNA, 64 nt, Human; identical to SEQ ID NO: 256092

SEQ ID NO: 524882 - RNA, 64 nt, Human; identical to SEQ ID NO: 256093

SEQ ID NO: 524883 - RNA, 64 nt, Human; identical to SEQ ID NO: 256094

SEQ ID NO: 524884 - RNA, 64 nt, Human; identical to SEQ ID NO: 256095

SEQ ID NO: 524885 - RNA, 64 nt, Human; identical to SEQ ID NO: 256096

SEQ ID NO: 524886 - RNA, 64 nt, Human; identical to SEQ ID NO: 256097

SEQ ID NO: 524887 - RNA, 64 nt, Human; identical to SEQ ID NO: 256098

SEQ ID NO: 524888 - RNA, 64 nt, Human; identical to SEQ ID NO: 256099

SEQ ID NO: 524889 - RNA, 64 nt, Human; identical to SEQ ID NO: 256100

SEQ ID NO: 524890 - RNA, 64 nt, Human; identical to SEQ ID NO: 256101

SEQ ID NO: 524891 - RNA, 64 nt, Human; identical to SEQ ID NO: 256102

SEQ ID NO: 524892 - RNA, 64 nt, Human; identical to SEQ ID NO: 256103

SEQ ID NO: 524893 - RNA, 64 nt, Human; identical to SEQ ID NO: 256107

SEQ ID NO: 524894 - RNA, 64 nt, Human; identical to SEQ ID NO: 256108

SEQ ID NO: 524895 - RNA, 64 nt, Human; identical to SEQ ID NO: 256109

SEQ ID NO: 524896 - RNA, 64 nt, Human; identical to SEQ ID NO: 256110

SEQ ID NO: 524897 - RNA, 64 nt, Human; identical to SEQ ID NO: 256111

SEQ ID NO: 524898 - RNA, 64 nt, Human; identical to SEQ ID NO: 256112

SEQ ID NO: 524899 - RNA, 64 nt, Human; identical to SEQ ID NO: 256113

SEQ ID NO: 524900 - RNA, 64 nt, Human; identical to SEQ ID NO: 256114

SEQ ID NO: 524901 - RNA, 64 nt, Human; identical to SEQ ID NO: 256115

SEQ ID NO: 524902 - RNA, 64 nt, Human; identical to SEQ ID NO: 256116

SEQ ID NO: 524903 - RNA, 64 nt, Human; identical to SEQ ID NO: 256117

SEQ ID NO: 524904 - RNA, 64 nt, Human; identical to SEQ ID NO: 256118

SEQ ID NO: 524905 - RNA, 64 nt, Human; identical to SEQ ID NO: 256119

SEQ ID NO: 524906 - RNA, 64 nt, Human; identical to SEQ ID NO: 256120

SEQ ID NO: 524907 - RNA, 64 nt, Human; identical to SEQ ID NO: 256121

SEQ ID NO: 524908 - RNA, 64 nt, Human; identical to SEQ ID NO: 256125

SEQ ID NO: 524909 - RNA, 64 nt, Human; identical to SEQ ID NO: 256126

SEQ ID NO: 524910 - RNA, 64 nt, Human; identical to SEQ ID NO: 256127

SEQ ID NO: 524911 - RNA, 64 nt, Human; identical to SEQ ID NO: 256128

SEQ ID NO: 524912 - RNA, 64 nt, Human; identical to SEQ ID NO: 256129

SEQ ID NO: 524913 - RNA, 64 nt, Human; identical to SEQ ID NO: 256130

SEQ ID NO: 524914 - RNA, 64 nt, Human; identical to SEQ ID NO: 256131

SEQ ID NO: 524915 - RNA, 64 nt, Human; identical to SEQ ID NO: 256132

SEQ ID NO: 524916 - RNA, 64 nt, Human; identical to SEQ ID NO: 256133

SEQ ID NO: 524917 - RNA, 64 nt, Human; identical to SEQ ID NO: 256134

SEQ ID NO: 524918 - RNA, 64 nt, Human; identical to SEQ ID NO: 256135

SEQ ID NO: 524919 - RNA, 64 nt, Human; identical to SEQ ID NO: 256136

SEQ ID NO: 524920 - RNA, 64 nt, Human; identical to SEQ ID NO: 256137

SEQ ID NO: 524921 - RNA, 64 nt, Human; identical to SEQ ID NO: 256138

SEQ ID NO: 524922 - RNA, 56 nt, Human; identical to SEQ ID NO: 256139

SEQ ID NO: 524923 - RNA, 64 nt, Human; identical to SEQ ID NO: 256143

SEQ ID NO: 524924 - RNA, 64 nt, Human; identical to SEQ ID NO: 256144

SEQ ID NO: 524925 - RNA, 64 nt, Human; identical to SEQ ID NO: 256145

SEQ ID NO: 524926 - RNA, 64 nt, Human; identical to SEQ ID NO: 256146

SEQ ID NO: 524927 - RNA, 64 nt, Human; identical to SEQ ID NO: 256147

SEQ ID NO: 524928 - RNA, 64 nt, Human; identical to SEQ ID NO: 256148

SEQ ID NO: 524929 - RNA, 64 nt, Human; identical to SEQ ID NO: 256149

SEQ ID NO: 524930 - RNA, 64 nt, Human; identical to SEQ ID NO: 256150

SEQ ID NO: 524931 - RNA, 64 nt, Human; identical to SEQ ID NO: 256151

SEQ ID NO: 524932 - RNA, 64 nt, Human; identical to SEQ ID NO: 256152

SEQ ID NO: 524933 - RNA, 64 nt, Human; identical to SEQ ID NO: 256153

SEQ ID NO: 524934 - RNA, 62 nt, Human
auauauaauacugacuuaaaaaaucaaaucccccgacauacguuuuuuuuaaucugugccaa

SEQ ID NO: 524935 - RNA, 62 nt, Human
aaaaaggaaagacaacgguuugugugcacuucccgacauaccugugucuucgugugccugcc

SEQ ID NO: 524936 - RNA, 62 nt, Human
aaaaucguguaacacuaugcucaugcuaagaaccgacauaacagaauuacugaaauaaaugu

SEQ ID NO: 524937 - RNA, 62 nt, Human
cacccccucaguccccugcacugacucacuccccgacauauccggaccuccccaaguccaga

SEQ ID NO: 524938 - RNA, 62 nt, Human
acucugccuaucccugacauuuaguagcaugcccgacauacaauguuagcuauugguauuau

SEQ ID NO: 524939 - RNA, 62 nt, Human
aggaaaauaccuauacccaaauguucccucccccgacauauaucauggcaugauuuaaggcu

SEQ ID NO: 524940 - RNA, 62 nt, Human
ccauauuuuccuacuuguggcagcgacugcauccgacauaaaggaacaguugugcucugccc

SEQ ID NO: 524941 - RNA, 62 nt, Human
cccucuggcugcugcugcugcuuuuuggugucccgacauaccuacgcccccguuuuaugggu

SEQ ID NO: 524942 - RNA, 62 nt, Human
cagugggagauugggcuuuggaacagacacauccgacauaaaauuccugcucugccacagcu

SEQ ID NO: 524943 - RNA, 62 nt, Human
ugaacucaccagugaguuagcagcacguguucccgacauaacauuguacuguaauggaguga

SEQ ID NO: 524944 - RNA, 62 nt, Human
aacagcccauucauuuauuucuguuuuguuuaccgacauauucaguauuauucuuguuuucu

SEQ ID NO: 524945 - RNA, 62 nt, Human
ugcuccuugcaacgucuuaagcaagcgaccccccgacauagcaaaagguggcaacccaugga

SEQ ID NO: 524946 - RNA, 62 nt, Human
aacuccucuugauguggccacccaccugcuccccgacauaucuaaggcuguuucucuccucc

SEQ ID NO: 524947 - RNA, 62 nt, Human
uugauaaaaccuccagccuucucuguguuguuccgacauaccgaggaccaacuggucuacau

SEQ ID NO: 524948 - RNA, 62 nt, Human
uggaaccugcugccuuggggacccuggacgugccgacauauggccauugagcuccaacccac

SEQ ID NO: 524949 - RNA, 62 nt, Human
auuuuuuuccuuuuuuuuuuuuugucauuuuaccgacauaauacauggagccaaagaaaaca

SEQ ID NO: 524950 - RNA, 62 nt, Human
gacuucaguugugcccauguuauaauguguuuccgacauaggagagucgugcugcugucuag

SEQ ID NO: 524951 - RNA, 62 nt, Human
aauguguuucuccugagcuaggaagagucuacccgacauaagucgagggacuuuauguuuuu

SEQ ID NO: 524952 - RNA, 62 nt, Human
uuauccauaguuuuuuuagugcuuuuaacauuccgacauacaucauucugugauuaaaucuc

SEQ ID NO: 524953 - RNA, 62 nt, Human; identical to SEQ ID NO: 524952

SEQ ID NO: 524954 - RNA, 64 nt, Human
cuccucuaagcccaaagauuaacuagagucccuccaaccuuauagauuguuggcuuucacaauc

SEQ ID NO: 524955 - RNA, 64 nt, Human
cauggauuaaugugggaacuuggcuucaagaacacaaccuuaggaccuugggccccaaaagcug

SEQ ID NO: 524956 - RNA, 64 nt, Human
ggcaaacuuaaaaaugcagcagaaacuuacauuccaaccuuagagacucauagugagcacaagg

SEQ ID NO: 524957 - RNA, 64 nt, Human
ccgcuuccucuuuuucuugcaaguuuuaaauuuccaaccuuaagugaauuuguggaccaaauuu

SEQ ID NO: 524958 - RNA, 64 nt, Human
aggaaucuaaauauuuauagugagauugugaaagcaaccuuaaaguuuugaagaagacugauga

SEQ ID NO: 524959 - RNA, 64 nt, Human
uuuaugggauaugguccucuuaggcucuguuguacaaccuuagguacauuccauaucuuaagac

SEQ ID NO: 524960 - RNA, 64 nt, Human
gaauauaguccauuuccaaaggagcaggaacucccaaccuuaaguuaauuucacugaagagaau

SEQ ID NO: 524961 - RNA, 64 nt, Human
aaggaacagauguggaauacacuggcccauauuucaaccuuaacagcugaagcuaugccuuauu

SEQ ID NO: 524962 - RNA, 64 nt, Human
aauaugccauuucauaaagucugaggauuuucgucaaccuuacugaaacacacuggugcuuuca

SEQ ID NO: 524963 - RNA, 64 nt, Human
agcccuuuacagucauauccuauaauccccauaucaaccuuauaaggaagguguuuguagauga

SEQ ID NO: 524964 - RNA, 64 nt, Human
cguaagccggcguccccgcccagccgagagggccggcgccuaccugagggccccugugucccga

SEQ ID NO: 524965 - RNA, 64 nt, Human
ucugcuauuaccgaccccccuucaugcugccccuggcgccuagaacccuugccccuccucauag

SEQ ID NO: 524966 - RNA, 64 nt, Human
uaaaaauacaaaaaauuagccuggcguaauggcaggcgccuauaaucccagcuacucaggaggc

SEQ ID NO: 524967 - RNA, 64 nt, Human
aggucaugaaauagguacacuaauaauuuucuaucaaccuuaaaaagugucaaagcaucuuugu

SEQ ID NO: 524968 - RNA, 64 nt, Human
gacaagauccagagcuaucaauaccucaguuaugcaaccuuagagguuuucuuuuuucuuucau

SEQ ID NO: 524969 - RNA, 64 nt, Human
uuaaauguucacuuuaagguaauaaucaggaaagcaaccuuacuacugaaauguaucuuggcug

SEQ ID NO: 524970 - RNA, 64 nt, Human
aaguagcagugacuagacccacagacaugaaaagcaaccuuaggaguaaagugacccaaacauu

SEQ ID NO: 524971 - RNA, 64 nt, Human
gaacaggcaaaagguaaauuuuuuuuuuuuuuuacaaccuuaaguaaucucaauaauaaaauuu

SEQ ID NO: 524972 - RNA, 64 nt, Human
gaacugaaacacugccccucuccccauugccccacaaccuuacucuaaauuugaguagagaaaa

SEQ ID NO: 524973 - RNA, 64 nt, Human
augcauaaacaacaguaccugaaggauuauuaagcaaccuuaaagcaauaaguucauuaaacag

SEQ ID NO: 524974 - RNA, 64 nt, Human
ccccgggaccccugccgguggcuccaucagccagcaaccuuagagagaggaaagacaguuuuca

SEQ ID NO: 524975 - RNA, 64 nt, Human
ugguugucccuggggagggcccucuggccccaggcaaccuuagccccucagaacagggaguccc

SEQ ID NO: 524976 - RNA, 64 nt, Human
uuaaauucuuggugcaaaugugugcuuuguaguucaaccuuauuaaaaauucuucagccaguua

SEQ ID NO: 524977 - RNA, 64 nt, Human
cugaccugcauccauccaaaacaaauuccuccuucaaccuuauuuuuacuugaaauuugcuaga

SEQ ID NO: 524978 - RNA, 64 nt, Human
caccagaauaaugagucugcauaaacuucaucuucaaccuuaaggacuuagcuggccacaguga

SEQ ID NO: 524979 - RNA, 64 nt, Human
cguccagggucauaacccccuaaaauccaucaugcaaccuuauuaaucugucuugggauuccag

SEQ ID NO: 524980 - RNA, 64 nt, Human
ggaggcaauguucuucucauuugaauccuuauggcaaccuuauucaauagguuuucccauauuu

SEQ ID NO: 524981 - RNA, 64 nt, Human
agccaaauagaacuguaaugggguuguauuuaugggcgccuagaaagaaaacacaaggacuugg

SEQ ID NO: 524982 - RNA, 64 nt, Human
ggucacgcugcgcagcucucuguaccgggcggggggcgccuacgggccgggcacucccgagcug

SEQ ID NO: 524983 - RNA, 64 nt, Human
cuucaacaaugguuccugcuugggugucccagcgggcgccuauggcaaaaacacagcgguugca

SEQ ID NO: 524984 - RNA, 64 nt, Human
aguucuucaggccuguagaaagaggaguauggaacaaccuuacauuuguugaaauaacuugaaa

SEQ ID NO: 524985 - RNA, 64 nt, Human
uucuaccauugcagauuucuucugaccccaaaugcaaccuuacagagaaugcugaaugaggaag

SEQ ID NO: 524986 - RNA, 64 nt, Human
aguugaaacuugauugaaggacuuaaaacauucacaaccuuaagccgagguggggggauauggg

SEQ ID NO: 524987 - RNA, 64 nt, Human
uuucuucuagauauaucucucacuauccguuauucaaccuuagcucugcuuucuauuacuuuuu

SEQ ID NO: 524988 - RNA, 64 nt, Human
cucacuuaguuuaggguuagaucuuuaguuaauucaaccuuauagaucauacuuaugaagguga

SEQ ID NO: 524989 - RNA, 59 nt, Human
uuacucagauaaaaagaugaaagaucaaccaaccuuaaauauauguauguauauaugua

SEQ ID NO: 524990 - RNA, 64 nt, Human
aggucuuggaauucacuuuuuaaauguuacguuccaaccuuauauguuccaaggugcagugcac

SEQ ID NO: 524991 - RNA, 64 nt, Human
guguaaugagagugaaguaggggacccugugguucaaccuuagaaucuguuuccuguaggcucu

SEQ ID NO: 524992 - RNA, 64 nt, Human
uugagaacaugguucuuuacauauaaaucugcuucaaccuuaggauguuuucagaccagaggca

SEQ ID NO: 524993 - RNA, 64 nt, Human
uaggaaaguugcaggauuagcggaauguaugguucaaccuuaauuauagcuucauugcaggacu

SEQ ID NO: 524994 - RNA, 64 nt, Human
ccugaaucuggagugggguugagcccucugccuucaaccuuaagauuuaggaaguucuuucccc

SEQ ID NO: 524995 - RNA, 64 nt, Human
uucagugauaucaccacuugcucagucaccaucucaaccuuaugucaccucagcccucaucuca

SEQ ID NO: 524996 - RNA, 64 nt, Human
uuaaauaaauuaaaucuuacuuucuuuuaaugaccaaccuuagguaaaacaaaaauauuguaau

SEQ ID NO: 524997 - RNA, 64 nt, Human
gugaugaguuugggaaagccuucagucaucauugcaaccuuauuaggcauuuuagaauccauac

SEQ ID NO: 524998 - RNA, 64 nt, Human
ggaccuuggucugaucgacguggugacgccccggggcgccuagagcgcggcuggcucuguggag

SEQ ID NO: 524999 - RNA, 64 nt, Human
uggccaguuucuucauuuuacauauggucacauuggcgccuagaacaguuaggucgcucgucac

SEQ ID NO: 525000 - RNA, 64 nt, Human
cuugcuuugguguuugccgcagcauggaaaacagggcgccuaaggcugggagcuggaagaaggg

SEQ ID NO: 525001 - RNA, 64 nt, Human
uuaaauaguuuguccuaagguguuuaaaacaugucaaccuuauguaaggaaaaauuuccugguc

SEQ ID NO: 525002 - RNA, 64 nt, Human
ugugaauggaauauaacaauucagcuuaauuccccaaccuuauucuguguguagacauuguauu

SEQ ID NO: 525003 - RNA, 64 nt, Human
gaagaaacuugauucaucgcugcaaaggaaagaacaaccuuaaaacuuuuaacagauaaaacuu

SEQ ID NO: 525004 - RNA, 64 nt, Human
ucuguuugcaaaguagaaaaagauucucaucacucaaccuuaugagcaggaagagggaaggcug

SEQ ID NO: 525005 - RNA, 64 nt, Human
uuaauacucuguaaacaaacaaacaaacaaaaaacaaccuuagcauuaagaaauaaaaacaaaa

SEQ ID NO: 525006 - RNA, 64 nt, Human
aagcuuucuguguucaguauaauuuuauuuuucucaaccuuaaauaugaacuuaggaaauaagg

SEQ ID NO: 525007 - RNA, 64 nt, Human
uucguguuucacucuuucaagaggugaacagauacaaccuuaaucuuaaaagauuauugcuuuu

SEQ ID NO: 525008 - RNA, 64 nt, Human
guuaaaggccuuuuauggaaaccaacuuggaaaacaaccuuaaauguggauguaucagauuugg

SEQ ID NO: 525009 - RNA, 64 nt, Human
augucacccucuacaucaucuuaccuagcccacccaaccuuauaaacaugauaauugacuacuu

SEQ ID NO: 525010 - RNA, 64 nt, Human
auucuguuuguaaaaccagccaguaauuucugugcaaccuuacuaugugcaauauuuuuaaauc

SEQ ID NO: 525011 - RNA, 64 nt, Human
auguuuguugaauaaaagagggaagaaggcaagccaaccuuagcuacaauccuaccuuuugaua

SEQ ID NO: 525012 - RNA, 64 nt, Human
uggcccccaacauucucuuccuuuugcuucuagucaaccuuaaugggcuguuacagaaacuagu

SEQ ID NO: 525013 - RNA, 64 nt, Human
uuaaauuuuauacaaagcacuuuaaugauagaugcaaccuuauuuuucaguuccuauuuuuuua

SEQ ID NO: 525014 - RNA, 64 nt, Human
gcuuaggcuggggauucuggaugcaacgucuuuacaaccuuaccuagauaucugcuacucacau

SEQ ID NO: 525015 - RNA, 64 nt, Human
aggucuaggaaugaacuucuuuggaacuugcauaggcgccuagaauggggcugaugagaacauc

SEQ ID NO: 525016 - RNA, 64 nt, Human
gcccuagagccugcuacuccaucuggcuccuccuggcgccuacacccccucucagccacugucu

SEQ ID NO: 525017 - RNA, 64 nt, Human
gcacuuagaugaauuauugaucuuccuaauaucaggcgccuacuuaaccuaugguguguacuuu

SEQ ID NO: 525018 - RNA, 64 nt, Human
aaaauuauuguaguaaacuuuuaauauggcaaagcaaccuuaagcucuauuuuagccaaaugaa

SEQ ID NO: 525019 - RNA, 64 nt, Human
gcaacuucuacaggggccagucuuuugaacuggacaaccuuacaaguauaugaguauuauuuau

SEQ ID NO: 525020 - RNA, 64 nt, Human
auucaagguuaucauauaauuuaacaaaauuguacaaccuuaaggcucuucacaguauaaauua

SEQ ID NO: 525021 - RNA, 64 nt, Human
uucugagggucucgggauugcagguugaaaaacacaaccuuaaucagcaguaaauucuucucua

SEQ ID NO: 525022 - RNA, 64 nt, Human
auacuggaguuagaacuuuuuccuuauugaaugccaaccuuaugauggaugugaaaaucuacgg

SEQ ID NO: 525023 - RNA, 64 nt, Human
auaauugguuugagguaugugaaacacuagaggucaaccuuacauaguauauagaacugauggg

SEQ ID NO: 525024 - RNA, 64 nt, Human
uaaagccagaaagagcugagggaguuaagagggccaaccuuagggcacgugggcauuauuaaag

SEQ ID NO: 525025 - RNA, 64 nt, Human
agcuggccuugaaccccuugccucaagugagcuucaaccuuagccuccugaguagccaggacua

SEQ ID NO: 525026 - RNA, 64 nt, Human
caccauacauuauuucuucccagaaucucugagccaaccuuaaaccucuucuauugcuaguucu

SEQ ID NO: 525027 - RNA, 64 nt, Human
uccuccaggucauuucccagugugagcacaaugccaaccuuaguguuucuccagccagacagau

SEQ ID NO: 525028 - RNA, 64 nt, Human
cucagaccacuucucaucguucagggauggacugcaaccuuaauuuacuugccggaguguacau

SEQ ID NO: 525029 - RNA, 64 nt, Human
ugcuauaauuaguauuauguugauaauucauuugcaaccuuauucuauuuaggaggaugaaguu

SEQ ID NO: 525030 - RNA, 64 nt, Human
ccaguuuauguucuguguccuuccucaugauuuccaaccuuaauacuauuaguaaccacaaguu

SEQ ID NO: 525031 - RNA, 64 nt, Human
aaggaacuuuauguucccucuccugcuguguccacaaccuuagaaaucuguagcuagauuuuug

SEQ ID NO: 525032 - RNA, 64 nt, Human
gggcaccagugccacccagggcccggcacaaaggggcgccuaguaaaccuuaaccaacuugguu

SEQ ID NO: 525033 - RNA, 64 nt, Human
gcaccaacaacucagaaugggggcuuucggggagggcgccuaguccccccagcucuaagcagcc

SEQ ID NO: 525034 - RNA, 64 nt, Human
uccugccucagccucccgaguagcugggacuacaggcgccuaucaccaugccuggcuaauuuuu

SEQ ID NO: 525035 - RNA, 64 nt, Human
agaggggcugaauagcagaagguugcaccucccccaaccuuagauguucuaagucuuuccauug

SEQ ID NO: 525036 - RNA, 64 nt, Human
gucaugauguguguuguauuuuaaaaauuaucugcaaccuuaauucagcugaaguacuuuauau

SEQ ID NO: 525037 - RNA, 64 nt, Human
gccaugaccacauuggagaaaugguuuuuauugucaaccuuaacacccaucaccaaaucgguaa

SEQ ID NO: 525038 - RNA, 64 nt, Human
cgggugcuggggucuucuccaauaaauggggugucaaccuuacccaaggcuucugacccccacu

SEQ ID NO: 525039 - RNA, 64 nt, Human
guggaauaauuauaaaaguaugaccuuuuuaaaucaaccuuauuuggaugcaucugaaccagca

SEQ ID NO: 525040 - RNA, 64 nt, Human
aguauggaucaaauugcaaaauaaagaaaaaugccaaccuuagaaaagacaauaaaugcacaaa

SEQ ID NO: 525041 - RNA, 64 nt, Human
gacaccacaaaauuguugaacaguuuaagaauuucaaccuuaaucuuggaucccuuuaccucau

SEQ ID NO: 525042 - RNA, 64 nt, Human
augaccauucagaaauaaagcaaaaagcaggccacaaccuuaaccaacaccaaagaaacaucca

SEQ ID NO: 525043 - RNA, 64 nt, Human
ggcccuguuggaagguaucuauacugaauuaccccaaccuuacuuuuaagaugugugguauaga

SEQ ID NO: 525044 - RNA, 64 nt, Human
cuuuucuaagaucaagccagaguugcuucucuuacaaccuuacggcgcuaaugcauuaaguuga

SEQ ID NO: 525045 - RNA, 64 nt, Human
ucuuaaaucuaauugacacuucuguaaugagaggcaaccuuauaacucuggaguuguaguuuga

SEQ ID NO: 525046 - RNA, 64 nt, Human
agcagaauucaacuuuuuaaacaauaaacaccaucaaccuuauugacuuuauugucccuuaaau

SEQ ID NO: 525047 - RNA, 64 nt, Human
cacuagccaguccaagcuaccuaugcauuugacccaaccuuauuuauuauuguacagaugaagc

SEQ ID NO: 525048 - RNA, 64 nt, Human
acauugcuagauguacaaacuuuauacagaagcacaaccuuaucauuuuuaaauaaaaacaggg

SEQ ID NO: 525049 - RNA, 64 nt, Human
ccuaccagaagucgcaagcugcuuggcucuggagggcgccuaggagucggugucgccuaagaug

SEQ ID NO: 525050 - RNA, 64 nt, Human
agcaugaugggaauagggagacaggguaggaaagggcgccuacucuucagggucuaaagaucaa

SEQ ID NO: 525051 - RNA, 64 nt, Human
gccccaacgcguucucuggagcuuugggccucagggcgccuagaaggcgaggacgcagaccuga

SEQ ID NO: 525052 - RNA, 64 nt, Human
aaucacaaacugaaugacuugacuucaaaagcaacaaccuuaaaggccgucauuucauuaguau

SEQ ID NO: 525053 - RNA, 64 nt, Human
uaacaccccauuaccaaaagaaaagguaagguggcaaccuuauuuuuaauaguuugaaaugaug

SEQ ID NO: 525054 - RNA, 64 nt, Human
aaaguacuguacugaaaauucagaaaaaaaaucucaaccuuaugccaaaauggaguaaugcuuu

SEQ ID NO: 525055 - RNA, 64 nt, Human
agaaacaagacaaggugcaccgguuucauagacgcaaccuuaacuuacuauuuagaugagaucu

SEQ ID NO: 525056 - RNA, 64 nt, Human
gauuaucauuaugugauacuggcagauugcagugcaaccuuaugccaauaaaauguaauuuaac

SEQ ID NO: 525057 - RNA, 64 nt, Human
agcucuagugcaguagugcaaucacagcucacugcaaccuuacuccuaggcucaaguuaacuau

SEQ ID NO: 525058 - RNA, 64 nt, Human
aggagaaauauuucagagccaaaagugccuuauacaaccuuagccuauuauaguaaaucauuca

SEQ ID NO: 525059 - RNA, 64 nt, Human
uaccucucccugacauuuugcuccggggcagauccaaccuuaccuggggcagcaaacuuugucc

SEQ ID NO: 525060 - RNA, 64 nt, Human
acugugauaacuggagguacuacggucuauuucucaaccuuaggcaguaauagacaucacaaac

SEQ ID NO: 525061 - RNA, 64 nt, Human
cagaagaauuuaguuacacauagacauaacucuucaaccuuaacuauggcaauacauuugugcu

SEQ ID NO: 525062 - RNA, 64 nt, Human
gcgagacucuaucucaaaaaaaaaaaaacccacacaaccuuaugagguagaauuccauuuuaga

SEQ ID NO: 525063 - RNA, 64 nt, Human
uagucggccucgugucuguccucccaucuuggaacaaccuuaucaacaggccgcacugcagaaa

SEQ ID NO: 525064 - RNA, 64 nt, Human
ggggcugaauuccagcucacacacaccucaaguccaaccuuacuuucuucagccagaauacauu

SEQ ID NO: 525065 - RNA, 64 nt, Human
auuuaccagcaacagagaagcaaagaauggaguucaaccuuacacuauaaacaucuaauagaua

SEQ ID NO: 525066 - RNA, 64 nt, Human
ugguagccaauguuuuuuuugucuugucaucacaggcgccuauacagcuucugucucaauaggg

SEQ ID NO: 525067 - RNA, 64 nt, Human
acccccaggggcuuauccuggacaggcaccuccaggcgccuacccuggagcaccuggagcuuau

SEQ ID NO: 525068 - RNA, 64 nt, Human
cugaaaauagaaaaauuagcugggcaugguggugggcgccuauaaucccagcuauucuggaggc

SEQ ID NO: 525069 - RNA, 64 nt, Human
acugauuuaaaagggcucuuuagccaguuguugccaaccuuauagggaugaguccccugugaga

SEQ ID NO: 525070 - RNA, 64 nt, Human
cacaucaauuaauugauuccucgcgacaucuucucaaccuuaucaaggauuuucauguugauga

SEQ ID NO: 525071 - RNA, 64 nt, Human
aaggcuuuagcauugugaagcgcugcacccccaccaaccuuacccucaccggggaacccucacu

SEQ ID NO: 525072 - RNA, 64 nt, Human
ccaaccgaacaugaccaaaaaccaaaagugcauucaaccuuaccaaaaaaaaaaaaaaaaaaag

SEQ ID NO: 525073 - RNA, 64 nt, Human
uggcaacugaagauggaagucuggggggcacagacaaccuuaucaaacaauauaaaagccaaua

SEQ ID NO: 525074 - RNA, 64 nt, Human
uacuuuucaugcuucuguacuuacauuuuuaucucaaccuuaauuuuucuuucuuuuuuuuuuu

SEQ ID NO: 525075 - RNA, 64 nt, Human
uuucuuuauaaaaaucuguuguucugaaaaucaacaaccuuagaaggauuuugucuuagaaaau

SEQ ID NO: 525076 - RNA, 64 nt, Human
cccaggcagauagggguggguaccuggugaaacccaaccuuaaagcugaagacagucccggcua

SEQ ID NO: 525077 - RNA, 64 nt, Human
aagugcugagauuacaggcaugagccacugcacucaaccuuaagaccuacuguucuaaagcucu

SEQ ID NO: 525078 - RNA, 64 nt, Human
auauaauauuuuuggacauuguuuugcuacccugcaaccuuauugaguucacuuauuauuuuua

SEQ ID NO: 525079 - RNA, 64 nt, Human
uuccccaaugacaccucaccaggaucacccuuaccaaccuuacuuccagcuugcacaucagaau

SEQ ID NO: 525080 - RNA, 64 nt, Human
uuccccaaugacaccucaccagaauaacccuuaccaaccuuauuuccagcuugcacaucagaau

SEQ ID NO: 525081 - RNA, 64 nt, Human
cccagagggagcuggucuccagccaggugagcaacaaccuuauggagugagcagccaccuuugg

SEQ ID NO: 525082 - RNA, 64 nt, Human
ccuguacacagugcccccuuguggcacguugacccaaccuuaccaguugguuuuucauuuuuug

SEQ ID NO: 525083 - RNA, 64 nt, Human
ugugcugugacgugugugucguggcuggccccgcggcgccuaccgcccuggccgugucugucug

SEQ ID NO: 525084 - RNA, 64 nt, Human
uuaaagaagaagaaaaguaaaagagcuuaccacuggcgccuaugcgaucacuucauuuuuaguu

SEQ ID NO: 525085 - RNA, 64 nt, Human
aggaaaaagaagcaaaacuaaaggcagguagccuggcgccuaggaaccagaccugaaaccaagg

SEQ ID NO: 525086 - RNA, 64 nt, Human
uuggagcuuaagauuuguuagagcuguuaacauucaaccuuauugauuauauugagagcgcucu

SEQ ID NO: 525087 - RNA, 64 nt, Human; identical to SEQ ID NO: 206509
